United States Patent 7,888,497 (BIOINFORMATICALLY DETECTABLE GROUP OF NOVEL REGULATORY OLIGONUCLEOTIDES AND USES THEREOF) - sequence listing, part 10

SEQ ID NO: 375930 - DNA, 19 bp, Homo sapiens
agcctgcaatttcatatgc

SEQ ID NO: 375931 - DNA, 20 bp, Homo sapiens
agcctgcacacacctgcctg

SEQ ID NO: 375932 - DNA, 21 bp, Homo sapiens
agcctgcagggtggtgctggg

SEQ ID NO: 375933 - DNA, 22 bp, Homo sapiens
agcctgcagggtggtgctggga

SEQ ID NO: 375934 - DNA, 15 bp, Homo sapiens
agcctgccccagctg

SEQ ID NO: 375935 - DNA, 17 bp, Homo sapiens
agcctgcgtggcctggg

SEQ ID NO: 375936 - DNA, 23 bp, Homo sapiens
agcctgcttcccacctccctgcc

SEQ ID NO: 375937 - DNA, 17 bp, Homo sapiens
agcctggagcccctgtg

SEQ ID NO: 375938 - DNA, 23 bp, Homo sapiens
agcctggaggccgggtgctcagg

SEQ ID NO: 375939 - DNA, 20 bp, Homo sapiens
agcctggatgccaaggagcc

SEQ ID NO: 375940 - DNA, 18 bp, Homo sapiens
agcctggcacagggcagt

SEQ ID NO: 375941 - DNA, 23 bp, Homo sapiens
agcctggccacgcagccaggaca

SEQ ID NO: 375942 - DNA, 15 bp, Homo sapiens
agcctggcttgggtt

SEQ ID NO: 375943 - DNA, 22 bp, Homo sapiens
agcctggcttttctggctgggg

SEQ ID NO: 375944 - DNA, 18 bp, Homo sapiens
agcctgggcaacagagca

SEQ ID NO: 375945 - DNA, 17 bp, Homo sapiens
agcctgggcagaaatgt

SEQ ID NO: 375946 - DNA, 17 bp, Homo sapiens
agcctgggcagccaggc

SEQ ID NO: 375947 - DNA, 20 bp, Homo sapiens
agcctgggcagccaggctgc

SEQ ID NO: 375948 - DNA, 17 bp, Homo sapiens
agcctgggccactggca

SEQ ID NO: 375949 - DNA, 23 bp, Homo sapiens
agcctgggccactggcatctctg

SEQ ID NO: 375950 - DNA, 13 bp, Homo sapiens
agcctgggccaga

SEQ ID NO: 375951 - DNA, 13 bp, Homo sapiens
agcctggggcctg

SEQ ID NO: 375952 - DNA, 21 bp, Homo sapiens
agcctggggcctggggatgta

SEQ ID NO: 375953 - DNA, 11 bp, Homo sapiens
agcctgggtga

SEQ ID NO: 375954 - DNA, 18 bp, Homo sapiens
agcctgggtgacagagcg

SEQ ID NO: 375955 - DNA, 13 bp, Homo sapiens
agcctgggtgaga

SEQ ID NO: 375956 - DNA, 15 bp, Homo sapiens
agcctggtgacaggc

SEQ ID NO: 375957 - DNA, 15 bp, Homo sapiens
agcctggtgctgctg

SEQ ID NO: 375958 - DNA, 17 bp, Homo sapiens
acacatcgttcgattta

SEQ ID NO: 375959 - DNA, 13 bp, Homo sapiens
acacatcttccct

SEQ ID NO: 375960 - DNA, 18 bp, Homo sapiens
acacattcttaaggcaat

SEQ ID NO: 375961 - DNA, 22 bp, Homo sapiens
acacattgaatgcgctttattg

SEQ ID NO: 375962 - DNA, 21 bp, Homo sapiens
acacattgtgtcacatcatga

SEQ ID NO: 375963 - DNA, 12 bp, Homo sapiens
acacatttaaaa

SEQ ID NO: 375964 - DNA, 17 bp, Homo sapiens
acacatttaaaacattt

SEQ ID NO: 375965 - DNA, 14 bp, Homo sapiens
acacatttctaatt

SEQ ID NO: 375966 - DNA, 16 bp, Homo sapiens
acaccaaattgctgag

SEQ ID NO: 375967 - DNA, 20 bp, Homo sapiens
acaccaaattgctgagatgt

SEQ ID NO: 375968 - DNA, 15 bp, Homo sapiens
acaccaagagtacag

SEQ ID NO: 375969 - DNA, 15 bp, Homo sapiens
acaccacactgacca

SEQ ID NO: 375970 - DNA, 14 bp, Homo sapiens
acaccacagacaca

SEQ ID NO: 375971 - DNA, 16 bp, Homo sapiens
acaccacagacacaca

SEQ ID NO: 375972 - DNA, 22 bp, Homo sapiens
acaccacagacacacacacgca

SEQ ID NO: 375973 - DNA, 15 bp, Homo sapiens
acaccacaggatctg

SEQ ID NO: 375974 - DNA, 23 bp, Homo sapiens
acaccaccaaatgacaagtcaca

SEQ ID NO: 375975 - DNA, 14 bp, Homo sapiens
acaccaccttatta

SEQ ID NO: 375976 - DNA, 19 bp, Homo sapiens
acaccactaaccatcccca

SEQ ID NO: 375977 - DNA, 11 bp, Homo sapiens
acaccactgcc

SEQ ID NO: 375978 - DNA, 14 bp, Homo sapiens
acaccactgccctg

SEQ ID NO: 375979 - DNA, 15 bp, Homo sapiens
acaccactgccctgc

SEQ ID NO: 375980 - DNA, 21 bp, Homo sapiens
acaccactgccctgcctgccc

SEQ ID NO: 375981 - DNA, 22 bp, Homo sapiens
acaccacttggagatctttgct

SEQ ID NO: 375982 - DNA, 15 bp, Homo sapiens
acaccagaagtgcca

SEQ ID NO: 375983 - DNA, 22 bp, Homo sapiens
acaccagccctgctgcttccta

SEQ ID NO: 375984 - DNA, 23 bp, Homo sapiens
acaccagccctgctgcttcctaa

SEQ ID NO: 375985 - DNA, 13 bp, Homo sapiens
acaccaggactta

SEQ ID NO: 375986 - DNA, 18 bp, Homo sapiens
acaccaggctgtgggcct

SEQ ID NO: 375987 - DNA, 19 bp, Homo sapiens
acaccatcacagcttgttt

SEQ ID NO: 375988 - DNA, 21 bp, Homo sapiens
acaccatcacagcttgttttg

SEQ ID NO: 375989 - DNA, 14 bp, Homo sapiens
acaccattattcca

SEQ ID NO: 375990 - DNA, 21 bp, Homo sapiens
acacccaattttaaaaaataa

SEQ ID NO: 375991 - DNA, 14 bp, Homo sapiens
acacccagccccag

SEQ ID NO: 375992 - DNA, 15 bp, Homo sapiens
acacccaggaaggga

SEQ ID NO: 375993 - DNA, 17 bp, Homo sapiens
acacccatgactgcccc

SEQ ID NO: 375994 - DNA, 18 bp, Homo sapiens
acaccccacaccccagcc

SEQ ID NO: 375995 - DNA, 11 bp, Homo sapiens
acaccccagcc

SEQ ID NO: 375996 - DNA, 13 bp, Homo sapiens
acaccccagccca

SEQ ID NO: 375997 - DNA, 13 bp, Homo sapiens
acaccccagcgcc

SEQ ID NO: 375998 - DNA, 20 bp, Homo sapiens
acaccccccgccccccacct

SEQ ID NO: 375999 - DNA, 15 bp, Homo sapiens
acaccccgtctgccc

SEQ ID NO: 376000 - DNA, 13 bp, Homo sapiens
acacccctgccgg

SEQ ID NO: 376001 - DNA, 21 bp, Homo sapiens
aagggggctattccctggaga

SEQ ID NO: 376002 - DNA, 23 bp, Homo sapiens
aagggggctattccctggagacc

SEQ ID NO: 376003 - DNA, 16 bp, Homo sapiens
aaggggggagggggag

SEQ ID NO: 376004 - DNA, 21 bp, Homo sapiens
aaggggggttgcagtggagag

SEQ ID NO: 376005 - DNA, 18 bp, Homo sapiens
aagggtatgggaagccat

SEQ ID NO: 376006 - DNA, 21 bp, Homo sapiens
aagggtcctacggagggacca

SEQ ID NO: 376007 - DNA, 15 bp, Homo sapiens
aagggtctgataaac

SEQ ID NO: 376008 - DNA, 16 bp, Homo sapiens
aagggtgacatcccag

SEQ ID NO: 376009 - DNA, 16 bp, Homo sapiens
aagggtgctgcttccc

SEQ ID NO: 376010 - DNA, 19 bp, Homo sapiens
aagggtgctgcttccctct

SEQ ID NO: 376011 - DNA, 20 bp, Homo sapiens
aagggtgtgggtcagggagg

SEQ ID NO: 376012 - DNA, 17 bp, Homo sapiens
aagggttgaaggcagtc

SEQ ID NO: 376013 - DNA, 14 bp, Homo sapiens
aaggtaatactata

SEQ ID NO: 376014 - DNA, 22 bp, Homo sapiens
aaggtaatactataaatatatt

SEQ ID NO: 376015 - DNA, 18 bp, Homo sapiens
aaggtaggtgcatgcctt

SEQ ID NO: 376016 - DNA, 19 bp, Homo sapiens
aaggtattttgaataccat

SEQ ID NO: 376017 - DNA, 19 bp, Homo sapiens
aaggtcacatagctgggat

SEQ ID NO: 376018 - DNA, 20 bp, Homo sapiens
aaggtccactccctgctcca

SEQ ID NO: 376019 - DNA, 13 bp, Homo sapiens
aaggtcctgccct

SEQ ID NO: 376020 - DNA, 24 bp, Homo sapiens
aaggtcctgctcaactctacccct

SEQ ID NO: 376021 - DNA, 18 bp, Homo sapiens
aaggtcggaggcttggga

SEQ ID NO: 376022 - DNA, 20 bp, Homo sapiens
aaggtcggaggcttgggacc

SEQ ID NO: 376023 - DNA, 22 bp, Homo sapiens
aaggtcggaggcttgggaccgc

SEQ ID NO: 376024 - DNA, 20 bp, Homo sapiens
aaggtcgtttttttcattcc

SEQ ID NO: 376025 - DNA, 15 bp, Homo sapiens
aaggtgaaacacaca

SEQ ID NO: 376026 - DNA, 11 bp, Homo sapiens
aaggtgcacat

SEQ ID NO: 376027 - DNA, 21 bp, Homo sapiens
aagtgaggaagcctaaataaa

SEQ ID NO: 376028 - DNA, 16 bp, Homo sapiens
aagtgaggatgaaaaa

SEQ ID NO: 376029 - DNA, 11 bp, Homo sapiens
aagtgaggcct

SEQ ID NO: 376030 - DNA, 22 bp, Homo sapiens
aagtgatcaataaaatgtgatt

SEQ ID NO: 376031 - DNA, 15 bp, Homo sapiens
aagtgatgtgattta

SEQ ID NO: 376032 - DNA, 17 bp, Homo sapiens
aagtgatgtgatttatg

SEQ ID NO: 376033 - DNA, 14 bp, Homo sapiens
aagtgattgacatt

SEQ ID NO: 376034 - DNA, 17 bp, Homo sapiens
aagtgcaggctggcacc

SEQ ID NO: 376035 - DNA, 14 bp, Homo sapiens
aagtgcatttctga

SEQ ID NO: 376036 - DNA, 22 bp, Homo sapiens
aagtgccactgcccgagctggt

SEQ ID NO: 376037 - DNA, 11 bp, Homo sapiens
aagtgcccaaa

SEQ ID NO: 376038 - DNA, 12 bp, Homo sapiens
aagtgcccaaag

SEQ ID NO: 376039 - DNA, 14 bp, Homo sapiens
aagtgcccaaagtg

SEQ ID NO: 376040 - DNA, 17 bp, Homo sapiens
aagtgcccaaagtgggg

SEQ ID NO: 376041 - DNA, 12 bp, Homo sapiens
aagtgcccctgc

SEQ ID NO: 376042 - DNA, 13 bp, Homo sapiens
aagtgcccctgct

SEQ ID NO: 376043 - DNA, 16 bp, Homo sapiens
aagtgccttgagctgc

SEQ ID NO: 376044 - DNA, 17 bp, Homo sapiens
aagtgccttgagctgcc

SEQ ID NO: 376045 - DNA, 20 bp, Homo sapiens
aagtgcttggttgaaaagat

SEQ ID NO: 376046 - DNA, 10 bp, Homo sapiens
aagtggaaaa

SEQ ID NO: 376047 - DNA, 17 bp, Homo sapiens
aagtggaaaaaagagaa

SEQ ID NO: 376048 - DNA, 16 bp, Homo sapiens
aagtggaaaaagaaat

SEQ ID NO: 376049 - DNA, 17 bp, Homo sapiens
aagtggaaaaagaaatt

SEQ ID NO: 376050 - DNA, 21 bp, Homo sapiens
aagtggaaaaagaaattctgt

SEQ ID NO: 376051 - DNA, 22 bp, Homo sapiens
aagtggaaaaagaaattctgtt

SEQ ID NO: 376052 - DNA, 12 bp, Homo sapiens
aagtggacccag

SEQ ID NO: 376053 - DNA, 21 bp, Homo sapiens
aagtggaggaaatgttggaac

SEQ ID NO: 376054 - DNA, 18 bp, Homo sapiens
aagtggaggttgagtgag

SEQ ID NO: 376055 - DNA, 11 bp, Homo sapiens
aagtgggagaa

SEQ ID NO: 376056 - DNA, 15 bp, Homo sapiens
aagtgggagaagtgg

SEQ ID NO: 376057 - DNA, 17 bp, Homo sapiens
aagtgggagtgggagag

SEQ ID NO: 376058 - DNA, 23 bp, Homo sapiens
aagtgggagtgggagaggaagcc

SEQ ID NO: 376059 - DNA, 17 bp, Homo sapiens
aagtgggtttcaattta

SEQ ID NO: 376060 - DNA, 11 bp, Homo sapiens
aagtgtaaaaa

SEQ ID NO: 376061 - DNA, 15 bp, Homo sapiens
aagtgtaacagctga

SEQ ID NO: 376062 - DNA, 16 bp, Homo sapiens
aagtgtaacagctgag

SEQ ID NO: 376063 - DNA, 17 bp, Homo sapiens
aagtgtaacagctgagg

SEQ ID NO: 376064 - DNA, 21 bp, Homo sapiens
aagtgtaacagctgaggtctc

SEQ ID NO: 376065 - DNA, 13 bp, Homo sapiens
aagtgtacaattt

SEQ ID NO: 376066 - DNA, 15 bp, Homo sapiens
aagtgtacaattttc

SEQ ID NO: 376067 - DNA, 15 bp, Homo sapiens
aagtgtcatttcttt

SEQ ID NO: 376068 - DNA, 20 bp, Homo sapiens
aagtgtgagtaagagctggt

SEQ ID NO: 376069 - DNA, 21 bp, Homo sapiens
aagtgtgagtaagagctggtg

SEQ ID NO: 376070 - DNA, 21 bp, Homo sapiens
aagtgtgcctgctatccagcc

SEQ ID NO: 376071 - DNA, 12 bp, Homo sapiens
aagtgtggctgg

SEQ ID NO: 376072 - DNA, 19 bp, Homo sapiens
aagtgtggctggtgtcccc

SEQ ID NO: 376073 - DNA, 22 bp, Homo sapiens
aagtgtggggcgggggtctata

SEQ ID NO: 376074 - DNA, 18 bp, Homo sapiens
aagtgttcaagaaataaa

SEQ ID NO: 376075 - DNA, 19 bp, Homo sapiens
aagtgttcaagaaataaaa

SEQ ID NO: 376076 - DNA, 16 bp, Homo sapiens
aagtgttggtctttct

SEQ ID NO: 376077 - DNA, 22 bp, Homo sapiens
aagtgttttctcagaacagctg

SEQ ID NO: 376078 - DNA, 17 bp, Homo sapiens
aagttaaaaaaaataat

SEQ ID NO: 376079 - DNA, 17 bp, Homo sapiens
aagttaaagagacaaat

SEQ ID NO: 376080 - DNA, 14 bp, Homo sapiens
aagttaaaggcagt

SEQ ID NO: 376081 - DNA, 22 bp, Homo sapiens
aagttaaaggcagtccagagct

SEQ ID NO: 376082 - DNA, 20 bp, Homo sapiens
aagttaatattggaagtgaa

SEQ ID NO: 376083 - DNA, 13 bp, Homo sapiens
aagttacagaaat

SEQ ID NO: 376084 - DNA, 16 bp, Homo sapiens
aagttactatcctggc

SEQ ID NO: 376085 - DNA, 17 bp, Homo sapiens
aagttactgggcattct

SEQ ID NO: 376086 - DNA, 18 bp, Homo sapiens
aagttataaatcaatgtc

SEQ ID NO: 376087 - DNA, 17 bp, Homo sapiens
aagttataccagcaaaa

SEQ ID NO: 376088 - DNA, 17 bp, Homo sapiens
aagttattaatttcttc

SEQ ID NO: 376089 - DNA, 23 bp, Homo sapiens
aagttatttacttttaccactat

SEQ ID NO: 376090 - DNA, 15 bp, Homo sapiens
aagttcaagactgaa

SEQ ID NO: 376091 - DNA, 22 bp, Homo sapiens
aagttcaagactgaaatggctt

SEQ ID NO: 376092 - DNA, 18 bp, Homo sapiens
aagttcaattgtgtctgt

SEQ ID NO: 376093 - DNA, 21 bp, Homo sapiens
aagttcaccagactctataaa

SEQ ID NO: 376094 - DNA, 22 bp, Homo sapiens
aagttcaccgtagtaacacata

SEQ ID NO: 376095 - DNA, 21 bp, Homo sapiens
aagttcacgtaagatacaagt

SEQ ID NO: 376096 - DNA, 16 bp, Homo sapiens
aagttcatagtttctg

SEQ ID NO: 376097 - DNA, 21 bp, Homo sapiens
aagttcatagtttctgtaatt

SEQ ID NO: 376098 - DNA, 12 bp, Homo sapiens
aagttctattta

SEQ ID NO: 376099 - DNA, 16 bp, Homo sapiens
aagttctcaatgtgaa

SEQ ID NO: 376100 - DNA, 22 bp, Homo sapiens
aagttctgggcagctaaaagca

SEQ ID NO: 376101 - DNA, 15 bp, Homo sapiens
aagttcttcacctct

SEQ ID NO: 376102 - DNA, 17 bp, Homo sapiens
aagttgaagctaagatt

SEQ ID NO: 376103 - DNA, 16 bp, Homo sapiens
aagttgaggggagagg

SEQ ID NO: 376104 - DNA, 19 bp, Homo sapiens
aagttgataggagacttgt

SEQ ID NO: 376105 - DNA, 20 bp, Homo sapiens
aagttgataggagacttgta

SEQ ID NO: 376106 - DNA, 16 bp, Homo sapiens
aagttgcagtgagctg

SEQ ID NO: 376107 - DNA, 21 bp, Homo sapiens
aagttgctgtaagcacctggg

SEQ ID NO: 376108 - DNA, 13 bp, Homo sapiens
aagttggactggg

SEQ ID NO: 376109 - DNA, 16 bp, Homo sapiens
aagttgggagcctgaa

SEQ ID NO: 376110 - DNA, 19 bp, Homo sapiens
aagttgtgccttttatagc

SEQ ID NO: 376111 - DNA, 20 bp, Homo sapiens
aagttgtgccttttatagct

SEQ ID NO: 376112 - DNA, 19 bp, Homo sapiens
aagttgtttcaaacagcat

SEQ ID NO: 376113 - DNA, 11 bp, Homo sapiens
aagtttaaata

SEQ ID NO: 376114 - DNA, 12 bp, Homo sapiens
aagtttaaatac

SEQ ID NO: 376115 - DNA, 23 bp, Homo sapiens
aagtttacaagtgtatatcagaa

SEQ ID NO: 376116 - DNA, 18 bp, Homo sapiens
aagtttacaatcaaagga

SEQ ID NO: 376117 - DNA, 18 bp, Homo sapiens
aagtttacagtaaataaa

SEQ ID NO: 376118 - DNA, 21 bp, Homo sapiens
aagtttacagtaaataaattg

SEQ ID NO: 376119 - DNA, 11 bp, Homo sapiens
aagtttagaga

SEQ ID NO: 376120 - DNA, 18 bp, Homo sapiens
aagtttatacagtacagt

SEQ ID NO: 376121 - DNA, 20 bp, Homo sapiens
aagtttatgtggcacacaat

SEQ ID NO: 376122 - DNA, 21 bp, Homo sapiens
aagtttattgtaaaagtgaca

SEQ ID NO: 376123 - DNA, 22 bp, Homo sapiens
aagtttattgtaaaagtgacat

SEQ ID NO: 376124 - DNA, 16 bp, Homo sapiens
aagtttcaatgtgatt

SEQ ID NO: 376125 - DNA, 19 bp, Homo sapiens
aagtttcaggatacatgtg

SEQ ID NO: 376126 - DNA, 16 bp, Homo sapiens
aagtttcagtaatagc

SEQ ID NO: 376127 - DNA, 21 bp, Homo sapiens
aagtttcagtaatagctgaac

SEQ ID NO: 376128 - DNA, 12 bp, Homo sapiens
aagtttcattta

SEQ ID NO: 376129 - DNA, 17 bp, Homo sapiens
aagtttccccaccagtg

SEQ ID NO: 376130 - DNA, 19 bp, Homo sapiens
aagtttctagctagaaata

SEQ ID NO: 376131 - DNA, 15 bp, Homo sapiens
aagtttgatttcatt

SEQ ID NO: 376132 - DNA, 19 bp, Homo sapiens
aagtttggcaatagtttgc

SEQ ID NO: 376133 - DNA, 21 bp, Homo sapiens
aagtttgtgttctgtttgtta

SEQ ID NO: 376134 - DNA, 22 bp, Homo sapiens
aagtttgtgttctgtttgttaa

SEQ ID NO: 376135 - DNA, 21 bp, Homo sapiens
aagtttgttctgcagagactt

SEQ ID NO: 376136 - DNA, 13 bp, Homo sapiens
aagttttcagatt

SEQ ID NO: 376137 - DNA, 22 bp, Homo sapiens
aagttttcagattgtaaaggta

SEQ ID NO: 376138 - DNA, 13 bp, Homo sapiens
aagttttccagta

SEQ ID NO: 376139 - DNA, 20 bp, Homo sapiens
aataaaactttatgtactgc

SEQ ID NO: 376140 - DNA, 18 bp, Homo sapiens
aataaaagcagcatctgc

SEQ ID NO: 376141 - DNA, 12 bp, Homo sapiens
aataaaagtgac

SEQ ID NO: 376142 - DNA, 14 bp, Homo sapiens
aataaaagtgcaca

SEQ ID NO: 376143 - DNA, 19 bp, Homo sapiens
aataaaagtgcacacctta

SEQ ID NO: 376144 - DNA, 15 bp, Homo sapiens
aataaaatatcattc

SEQ ID NO: 376145 - DNA, 16 bp, Homo sapiens
aataaaatatcattca

SEQ ID NO: 376146 - DNA, 18 bp, Homo sapiens
aataaaatatcattcagc

SEQ ID NO: 376147 - DNA, 16 bp, Homo sapiens
aataaaattcatttct

SEQ ID NO: 376148 - DNA, 21 bp, Homo sapiens
aataaacagcttcatgccttt

SEQ ID NO: 376149 - DNA, 22 bp, Homo sapiens
aataaacagcttcatgcctttg

SEQ ID NO: 376150 - DNA, 20 bp, Homo sapiens
aataaaccacacttagtcct

SEQ ID NO: 376151 - DNA, 14 bp, Homo sapiens
aataaaccttgttt

SEQ ID NO: 376152 - DNA, 17 bp, Homo sapiens
aataaaccttgtttctt

SEQ ID NO: 376153 - DNA, 22 bp, Homo sapiens
aataaaccttgtttctttctga

SEQ ID NO: 376154 - DNA, 17 bp, Homo sapiens
aataaacgaaacacaga

SEQ ID NO: 376155 - DNA, 14 bp, Homo sapiens
aataaactagggtt

SEQ ID NO: 376156 - DNA, 15 bp, Homo sapiens
aataaactctaaaca

SEQ ID NO: 376157 - DNA, 17 bp, Homo sapiens
aataaactcttcaaggc

SEQ ID NO: 376158 - DNA, 20 bp, Homo sapiens
aataaactcttcaaggccaa

SEQ ID NO: 376159 - DNA, 13 bp, Homo sapiens
aataaactgtttt

SEQ ID NO: 376160 - DNA, 22 bp, Homo sapiens
aataaacttagaataaaattgt

SEQ ID NO: 376161 - DNA, 20 bp, Homo sapiens
aataaagaaaaaaatagttt

SEQ ID NO: 376162 - DNA, 21 bp, Homo sapiens
aataaagaaaaaaatagtttt

SEQ ID NO: 376163 - DNA, 23 bp, Homo sapiens
aataaagaactccttattttgta

SEQ ID NO: 376164 - DNA, 12 bp, Homo sapiens
aataaagaagaa

SEQ ID NO: 376165 - DNA, 21 bp, Homo sapiens
aataaagcactattgtttaga

SEQ ID NO: 376166 - DNA, 21 bp, Homo sapiens
aataaagctggacaagaagct

SEQ ID NO: 376167 - DNA, 20 bp, Homo sapiens
aataaaggtttcgttgcatg

SEQ ID NO: 376168 - DNA, 9 bp, Homo sapiens
aataaagta

SEQ ID NO: 376169 - DNA, 15 bp, Homo sapiens
aataaagtatatata

SEQ ID NO: 376170 - DNA, 11 bp, Homo sapiens
aataaagtatc

SEQ ID NO: 376171 - DNA, 16 bp, Homo sapiens
aataaagtatcatgca

SEQ ID NO: 376172 - DNA, 17 bp, Homo sapiens
aataaagtatcatgcat

SEQ ID NO: 376173 - DNA, 19 bp, Homo sapiens
aataaagtatcatgcattc

SEQ ID NO: 376174 - DNA, 11 bp, Homo sapiens
aataaagtatt

SEQ ID NO: 376175 - DNA, 15 bp, Homo sapiens
aataaagtattccac

SEQ ID NO: 376176 - DNA, 15 bp, Homo sapiens
aataaagttaaaagt

SEQ ID NO: 376177 - DNA, 14 bp, Homo sapiens
aataaataaagaag

SEQ ID NO: 376178 - DNA, 14 bp, Homo sapiens
aataaatatactaa

SEQ ID NO: 376179 - DNA, 16 bp, Homo sapiens
aataaatatactaata

SEQ ID NO: 376180 - DNA, 14 bp, Homo sapiens
aataaatatttatg

SEQ ID NO: 376181 - DNA, 22 bp, Homo sapiens
aataaatctcttctttgctgca

SEQ ID NO: 376182 - DNA, 22 bp, Homo sapiens
aataaatctgttgccaagctgg

SEQ ID NO: 376183 - DNA, 15 bp, Homo sapiens
aataaatctttggaa

SEQ ID NO: 376184 - DNA, 16 bp, Homo sapiens
aataaatctttggaaa

SEQ ID NO: 376185 - DNA, 12 bp, Homo sapiens
aataaatgacca

SEQ ID NO: 376186 - DNA, 20 bp, Homo sapiens
aataaatgtcccaaataaat

SEQ ID NO: 376187 - DNA, 21 bp, Homo sapiens
aataaattaaataaaataacc

SEQ ID NO: 376188 - DNA, 21 bp, Homo sapiens
aataaattggtgataagtgga

SEQ ID NO: 376189 - DNA, 22 bp, Homo sapiens
aataaattggtgataagtggaa

SEQ ID NO: 376190 - DNA, 12 bp, Homo sapiens
aataaatttctg

SEQ ID NO: 376191 - DNA, 21 bp, Homo sapiens
aataaatttctgggatattta

SEQ ID NO: 376192 - DNA, 22 bp, Homo sapiens
aataaatttctgggatatttaa

SEQ ID NO: 376193 - DNA, 18 bp, Homo sapiens
aataaatttggttctaat

SEQ ID NO: 376194 - DNA, 12 bp, Homo sapiens
aataaattttat

SEQ ID NO: 376195 - DNA, 16 bp, Homo sapiens
aataacacagagagac

SEQ ID NO: 376196 - DNA, 11 bp, Homo sapiens
aataacactgc

SEQ ID NO: 376197 - DNA, 15 bp, Homo sapiens
aataacatattcttg

SEQ ID NO: 376198 - DNA, 15 bp, Homo sapiens
aataacatctgaaaa

SEQ ID NO: 376199 - DNA, 17 bp, Homo sapiens
aataacatctgaaaaga

SEQ ID NO: 376200 - DNA, 13 bp, Homo sapiens
aataacattgcac

SEQ ID NO: 376201 - DNA, 14 bp, Homo sapiens
aataacattgcact

SEQ ID NO: 376202 - DNA, 15 bp, Homo sapiens
aataacattgcactt

SEQ ID NO: 376203 - DNA, 20 bp, Homo sapiens
aataactactgcaaaaagta

SEQ ID NO: 376204 - DNA, 15 bp, Homo sapiens
aataactactgtgtt

SEQ ID NO: 376205 - DNA, 19 bp, Homo sapiens
aataactactgtgttcctg

SEQ ID NO: 376206 - DNA, 19 bp, Homo sapiens
aataactcctcattgtaaa

SEQ ID NO: 376207 - DNA, 19 bp, Homo sapiens
aataactctgtggcattat

SEQ ID NO: 376208 - DNA, 14 bp, Homo sapiens
aataactgtgaagt

SEQ ID NO: 376209 - DNA, 20 bp, Homo sapiens
aataactgtgaagtttacat

SEQ ID NO: 376210 - DNA, 15 bp, Homo sapiens
aataacttcagagaa

SEQ ID NO: 376211 - DNA, 18 bp, Homo sapiens
aataacttcagagaagtc

SEQ ID NO: 376212 - DNA, 14 bp, Homo sapiens
aataagaatttagg

SEQ ID NO: 376213 - DNA, 14 bp, Homo sapiens
aataagagaaagaa

SEQ ID NO: 376214 - DNA, 14 bp, Homo sapiens
aataagctctagtt

SEQ ID NO: 376215 - DNA, 14 bp, Homo sapiens
aataagtaacatat

SEQ ID NO: 376216 - DNA, 15 bp, Homo sapiens
aataagtaacatata

SEQ ID NO: 376217 - DNA, 17 bp, Homo sapiens
aataagtgaatctaata

SEQ ID NO: 376218 - DNA, 17 bp, Homo sapiens
aataagtggttatttct

SEQ ID NO: 376219 - DNA, 13 bp, Homo sapiens
aataataaataca

SEQ ID NO: 376220 - DNA, 12 bp, Homo sapiens
aataataaatta

SEQ ID NO: 376221 - DNA, 14 bp, Homo sapiens
aataataaattaac

SEQ ID NO: 376222 - DNA, 15 bp, Homo sapiens
aataataaattaaca

SEQ ID NO: 376223 - DNA, 18 bp, Homo sapiens
aataataaattaacatta

SEQ ID NO: 376224 - DNA, 22 bp, Homo sapiens
aataataaattaacattatatt

SEQ ID NO: 376225 - DNA, 20 bp, Homo sapiens
aataataatttttatattta

SEQ ID NO: 376226 - DNA, 15 bp, Homo sapiens
aataatacatcttta

SEQ ID NO: 376227 - DNA, 16 bp, Homo sapiens
aataatattatattgt

SEQ ID NO: 376228 - DNA, 15 bp, Homo sapiens
aataatcacattgac

SEQ ID NO: 376229 - DNA, 17 bp, Homo sapiens
aataatcacattgactt

SEQ ID NO: 376230 - DNA, 13 bp, Homo sapiens
aataatgaataat

SEQ ID NO: 376231 - DNA, 22 bp, Homo sapiens
aataatgacgtattgtgaaatt

SEQ ID NO: 376232 - DNA, 12 bp, Homo sapiens
aataatgattta

SEQ ID NO: 376233 - DNA, 19 bp, Homo sapiens
aataatgtacatctggcct

SEQ ID NO: 376234 - DNA, 19 bp, Homo sapiens
aataatgtcctttccctgg

SEQ ID NO: 376235 - DNA, 21 bp, Homo sapiens
aataatgtgggaagaaacaaa

SEQ ID NO: 376236 - DNA, 19 bp, Homo sapiens
aataatgttaacatggaca

SEQ ID NO: 376237 - DNA, 16 bp, Homo sapiens
aataatgttctattgt

SEQ ID NO: 376238 - DNA, 13 bp, Homo sapiens
aataattagaaac

SEQ ID NO: 376239 - DNA, 14 bp, Homo sapiens
aataattggttctt

SEQ ID NO: 376240 - DNA, 14 bp, Homo sapiens
aataattgtgtaca

SEQ ID NO: 376241 - DNA, 20 bp, Homo sapiens
aataattgtgtacaaagtag

SEQ ID NO: 376242 - DNA, 21 bp, Homo sapiens
aataattttaagaaatcaaag

SEQ ID NO: 376243 - DNA, 23 bp, Homo sapiens
aataattttatgaactgcatgta

SEQ ID NO: 376244 - DNA, 22 bp, Homo sapiens
aataatttttatatttaattat

SEQ ID NO: 376245 - DNA, 21 bp, Homo sapiens
aatacaaaaaattagccgagc

SEQ ID NO: 376246 - DNA, 17 bp, Homo sapiens
aatacaaaataaaatta

SEQ ID NO: 376247 - DNA, 18 bp, Homo sapiens
aatacaacttaaataata

SEQ ID NO: 376248 - DNA, 19 bp, Homo sapiens
aatacaagccaagctagaa

SEQ ID NO: 376249 - DNA, 16 bp, Homo sapiens
aatacaagttctattt

SEQ ID NO: 376250 - DNA, 23 bp, Homo sapiens
aatacaagttctatttaagtgta

SEQ ID NO: 376251 - DNA, 13 bp, Homo sapiens
aatacaataaact

SEQ ID NO: 376252 - DNA, 19 bp, Homo sapiens
aatacaatagtatgcagct

SEQ ID NO: 376253 - DNA, 17 bp, Homo sapiens
aatacaattcagtttta

SEQ ID NO: 376254 - DNA, 15 bp, Homo sapiens
aatacagacactaag

SEQ ID NO: 376255 - DNA, 21 bp, Homo sapiens
aatacagacactaagttatag

SEQ ID NO: 376256 - DNA, 18 bp, Homo sapiens
aagcctgttcccctcact

SEQ ID NO: 376257 - DNA, 24 bp, Homo sapiens
aagccttacggtcatgatgtctgc

SEQ ID NO: 376258 - DNA, 23 bp, Homo sapiens
aagccttatcaagtgtcttccat

SEQ ID NO: 376259 - DNA, 21 bp, Homo sapiens
aagccttttccataaagtgta

SEQ ID NO: 376260 - DNA, 22 bp, Homo sapiens
aagccttttccataaagtgtaa

SEQ ID NO: 376261 - DNA, 15 bp, Homo sapiens
aagcgaacatcttca

SEQ ID NO: 376262 - DNA, 16 bp, Homo sapiens
aagcgaacatcttcat

SEQ ID NO: 376263 - DNA, 15 bp, Homo sapiens
aagcgggcagccccg

SEQ ID NO: 376264 - DNA, 13 bp, Homo sapiens
aagcgtctccctt

SEQ ID NO: 376265 - DNA, 18 bp, Homo sapiens
aagcgtctcccttggcca

SEQ ID NO: 376266 - DNA, 19 bp, Homo sapiens
aagcgttcctggccttctg

SEQ ID NO: 376267 - DNA, 20 bp, Homo sapiens
aagctaataaaatatcattc

SEQ ID NO: 376268 - DNA, 19 bp, Homo sapiens
aagctaatgtttaaaagca

SEQ ID NO: 376269 - DNA, 19 bp, Homo sapiens
aagctacctcaaacttcca

SEQ ID NO: 376270 - DNA, 15 bp, Homo sapiens
aagctagaaggaagc

SEQ ID NO: 376271 - DNA, 19 bp, Homo sapiens
aagctagacaaaggcccag

SEQ ID NO: 376272 - DNA, 20 bp, Homo sapiens
aagctagacaaaggcccaga

SEQ ID NO: 376273 - DNA, 17 bp, Homo sapiens
aagctaggaaaggcaga

SEQ ID NO: 376274 - DNA, 19 bp, Homo sapiens
aagctagggtggcccttgc

SEQ ID NO: 376275 - DNA, 22 bp, Homo sapiens
aagctagggtggcccttgcagt

SEQ ID NO: 376276 - DNA, 18 bp, Homo sapiens
aagctcaaataaaaataa

SEQ ID NO: 376277 - DNA, 14 bp, Homo sapiens
aagctcaaatgtat

SEQ ID NO: 376278 - DNA, 14 bp, Homo sapiens
aagctcagaataga

SEQ ID NO: 376279 - DNA, 16 bp, Homo sapiens
aagctcagtttggctg

SEQ ID NO: 376280 - DNA, 21 bp, Homo sapiens
aagctcatattttgtatatat

SEQ ID NO: 376281 - DNA, 22 bp, Homo sapiens
aagctcatattttgtatatatc

SEQ ID NO: 376282 - DNA, 21 bp, Homo sapiens
aagctccacggtgcgtggctg

SEQ ID NO: 376283 - DNA, 13 bp, Homo sapiens
aagctccagcttt

SEQ ID NO: 376284 - DNA, 14 bp, Homo sapiens
aagctccaggtgcc

SEQ ID NO: 376285 - DNA, 18 bp, Homo sapiens
aagctccagtcctgctct

SEQ ID NO: 376286 - DNA, 19 bp, Homo sapiens
aagctccagtcctgctctc

SEQ ID NO: 376287 - DNA, 21 bp, Homo sapiens
aagctccagtcctgctctcta

SEQ ID NO: 376288 - DNA, 11 bp, Homo sapiens
aagctctgttg

SEQ ID NO: 376289 - DNA, 15 bp, Homo sapiens
aagctctttgagaac

SEQ ID NO: 376290 - DNA, 16 bp, Homo sapiens
aagctctttgagaact

SEQ ID NO: 376291 - DNA, 14 bp, Homo sapiens
aagctgaagaaaat

SEQ ID NO: 376292 - DNA, 14 bp, Homo sapiens
aagctgaatatttt

SEQ ID NO: 376293 - DNA, 23 bp, Homo sapiens
aagctgaatattttttatttcta

SEQ ID NO: 376294 - DNA, 20 bp, Homo sapiens
aagctgagcgggtctagtgg

SEQ ID NO: 376295 - DNA, 23 bp, Homo sapiens
aagctgagttacttgtctgaggc

SEQ ID NO: 376296 - DNA, 21 bp, Homo sapiens
aagctgatgatgtctcttgta

SEQ ID NO: 376297 - DNA, 15 bp, Homo sapiens
aagctgattcccaga

SEQ ID NO: 376298 - DNA, 16 bp, Homo sapiens
aagctgattcccagag

SEQ ID NO: 376299 - DNA, 22 bp, Homo sapiens
aagctgattcccagagcagacc

SEQ ID NO: 376300 - DNA, 17 bp, Homo sapiens
aagctgcctccctgtcc

SEQ ID NO: 376301 - DNA, 19 bp, Homo sapiens
aagctgcctccctgtccac

SEQ ID NO: 376302 - DNA, 20 bp, Homo sapiens
aagctgcctccctgtccacc

SEQ ID NO: 376303 - DNA, 22 bp, Homo sapiens
aagctgcctccctgtccacccc

SEQ ID NO: 376304 - DNA, 11 bp, Homo sapiens
aagctgcctct

SEQ ID NO: 376305 - DNA, 13 bp, Homo sapiens
aagctgcctctga

SEQ ID NO: 376306 - DNA, 15 bp, Homo sapiens
aagctgcctgtagtt

SEQ ID NO: 376307 - DNA, 19 bp, Homo sapiens
aagctgcctgtagttagga

SEQ ID NO: 376308 - DNA, 21 bp, Homo sapiens
aagctgctgagaatctagcct

SEQ ID NO: 376309 - DNA, 18 bp, Homo sapiens
aagctggacaagaagctg

SEQ ID NO: 376310 - DNA, 23 bp, Homo sapiens
aagctggagccaatggtgagggc

SEQ ID NO: 376311 - DNA, 16 bp, Homo sapiens
aagctggcaacatgaa

SEQ ID NO: 376312 - DNA, 15 bp, Homo sapiens
aagctggcaggagac

SEQ ID NO: 376313 - DNA, 16 bp, Homo sapiens
aagctggcaggagaca

SEQ ID NO: 376314 - DNA, 21 bp, Homo sapiens
aagctggccgagggtcctggc

SEQ ID NO: 376315 - DNA, 23 bp, Homo sapiens
aagctggggacagctttcctggg

SEQ ID NO: 376316 - DNA, 17 bp, Homo sapiens
aagctggtaaactattt

SEQ ID NO: 376317 - DNA, 20 bp, Homo sapiens
aagctgtactcagagcagag

SEQ ID NO: 376318 - DNA, 16 bp, Homo sapiens
aagctgtgaaatgtgc

SEQ ID NO: 376319 - DNA, 13 bp, Homo sapiens
aagctgtgaaatt

SEQ ID NO: 376320 - DNA, 16 bp, Homo sapiens
aagctgtgtctctgta

SEQ ID NO: 376321 - DNA, 23 bp, Homo sapiens
aagctgtttagtttgttaattga

SEQ ID NO: 376322 - DNA, 12 bp, Homo sapiens
aagctgtttcta

SEQ ID NO: 376323 - DNA, 22 bp, Homo sapiens
aagcttaaattgcttttgttgt

SEQ ID NO: 376324 - DNA, 14 bp, Homo sapiens
aagcttaaggagag

SEQ ID NO: 376325 - DNA, 18 bp, Homo sapiens
aagcttagattttctgta

SEQ ID NO: 376326 - DNA, 14 bp, Homo sapiens
aagcttcattctca

SEQ ID NO: 376327 - DNA, 21 bp, Homo sapiens
aagcttggcagccgagctcgt

SEQ ID NO: 376328 - DNA, 23 bp, Homo sapiens
aagcttgtattatcagtgaatat

SEQ ID NO: 376329 - DNA, 23 bp, Homo sapiens
aagcttgtggccccttttacttt

SEQ ID NO: 376330 - DNA, 15 bp, Homo sapiens
aagcttgtttccctg

SEQ ID NO: 376331 - DNA, 21 bp, Homo sapiens
aagcttgtttccctgctggcc

SEQ ID NO: 376332 - DNA, 16 bp, Homo sapiens
aagctttaaaaaataa

SEQ ID NO: 376333 - DNA, 16 bp, Homo sapiens
aagctttcctgcccca

SEQ ID NO: 376334 - DNA, 21 bp, Homo sapiens
aagctttcctgccccaggcct

SEQ ID NO: 376335 - DNA, 14 bp, Homo sapiens
aagctttctccttt

SEQ ID NO: 376336 - DNA, 19 bp, Homo sapiens
aagctttctctgcttcagc

SEQ ID NO: 376337 - DNA, 23 bp, Homo sapiens
aagctttctctgcttcagcttgc

SEQ ID NO: 376338 - DNA, 20 bp, Homo sapiens
aagctttcttacaatgtgga

SEQ ID NO: 376339 - DNA, 23 bp, Homo sapiens
aagctttcttctacaaccagagc

SEQ ID NO: 376340 - DNA, 14 bp, Homo sapiens
aagcttttcctttc

SEQ ID NO: 376341 - DNA, 13 bp, Homo sapiens
aagctttttgaaa

SEQ ID NO: 376342 - DNA, 16 bp, Homo sapiens
aaggaaaaacagaaca

SEQ ID NO: 376343 - DNA, 23 bp, Homo sapiens
aaggaaaaacagaacatttctca

SEQ ID NO: 376344 - DNA, 14 bp, Homo sapiens
aaggaaaaggctgg

SEQ ID NO: 376345 - DNA, 16 bp, Homo sapiens
aaggaaagcaataaat

SEQ ID NO: 376346 - DNA, 16 bp, Homo sapiens
aagatttaatgttaca

SEQ ID NO: 376347 - DNA, 12 bp, Homo sapiens
aagatttattat

SEQ ID NO: 376348 - DNA, 23 bp, Homo sapiens
aagattttctgggcctaaaggat

SEQ ID NO: 376349 - DNA, 20 bp, Homo sapiens
aagcaaaaaatgaatgtcta

SEQ ID NO: 376350 - DNA, 14 bp, Homo sapiens
aagcaaacatcaaa

SEQ ID NO: 376351 - DNA, 18 bp, Homo sapiens
aagcaaacatcaaataaa

SEQ ID NO: 376352 - DNA, 14 bp, Homo sapiens
aagcaaaccttctc

SEQ ID NO: 376353 - DNA, 16 bp, Homo sapiens
aagcaaataccaaagc

SEQ ID NO: 376354 - DNA, 18 bp, Homo sapiens
aagcaaataccaaagcag

SEQ ID NO: 376355 - DNA, 17 bp, Homo sapiens
aagcaaatcagaaactt

SEQ ID NO: 376356 - DNA, 14 bp, Homo sapiens
aagcaaatcagaca

SEQ ID NO: 376357 - DNA, 20 bp, Homo sapiens
aagcaaatcccaacatttct

SEQ ID NO: 376358 - DNA, 20 bp, Homo sapiens
aagcaaatttctagatatga

SEQ ID NO: 376359 - DNA, 19 bp, Homo sapiens
aagcaacaaagagcgagtc

SEQ ID NO: 376360 - DNA, 15 bp, Homo sapiens
aagcaacaactttgt

SEQ ID NO: 376361 - DNA, 14 bp, Homo sapiens
aagcaacaggtttt

SEQ ID NO: 376362 - DNA, 16 bp, Homo sapiens
aagcaacgactacttt

SEQ ID NO: 376363 - DNA, 19 bp, Homo sapiens
aagcaagacgtcctggaat

SEQ ID NO: 376364 - DNA, 23 bp, Homo sapiens
aagcaagacgtcctggaatgaag

SEQ ID NO: 376365 - DNA, 16 bp, Homo sapiens
aagcaagtagctttcc

SEQ ID NO: 376366 - DNA, 14 bp, Homo sapiens
aagcaataaatgaa

SEQ ID NO: 376367 - DNA, 15 bp, Homo sapiens
aagcaataagttcat

SEQ ID NO: 376368 - DNA, 21 bp, Homo sapiens
aagcaataagttcattaaaca

SEQ ID NO: 376369 - DNA, 20 bp, Homo sapiens
aagcaattatttaaagaaag

SEQ ID NO: 376370 - DNA, 15 bp, Homo sapiens
aagcaattgccctgt

SEQ ID NO: 376371 - DNA, 16 bp, Homo sapiens
aagcacaaaccctggg

SEQ ID NO: 376372 - DNA, 11 bp, Homo sapiens
aagcacaggcc

SEQ ID NO: 376373 - DNA, 13 bp, Homo sapiens
aagcacagtgtta

SEQ ID NO: 376374 - DNA, 20 bp, Homo sapiens
aagcacagtgttaaatgaaa

SEQ ID NO: 376375 - DNA, 14 bp, Homo sapiens
aagcactattgttt

SEQ ID NO: 376376 - DNA, 19 bp, Homo sapiens
aagcagatggaatgctgtg

SEQ ID NO: 376377 - DNA, 10 bp, Homo sapiens
aagcagccag

SEQ ID NO: 376378 - DNA, 12 bp, Homo sapiens
aagcagccagcc

SEQ ID NO: 376379 - DNA, 17 bp, Homo sapiens
aagcagccagccagtct

SEQ ID NO: 376380 - DNA, 19 bp, Homo sapiens
aagcagcctttctgtggag

SEQ ID NO: 376381 - DNA, 21 bp, Homo sapiens
aagcaggaaagatcccaagtc

SEQ ID NO: 376382 - DNA, 15 bp, Homo sapiens
aagcaggagcagctg

SEQ ID NO: 376383 - DNA, 15 bp, Homo sapiens
aagcaggatggctgg

SEQ ID NO: 376384 - DNA, 16 bp, Homo sapiens
aagcaggcttgtgctt

SEQ ID NO: 376385 - DNA, 20 bp, Homo sapiens
aagcagggaaagctccacgg

SEQ ID NO: 376386 - DNA, 16 bp, Homo sapiens
aagcagggaatttcta

SEQ ID NO: 376387 - DNA, 18 bp, Homo sapiens
aagcaggtcagaagaggg

SEQ ID NO: 376388 - DNA, 19 bp, Homo sapiens
aagcagtctacccacctca

SEQ ID NO: 376389 - DNA, 20 bp, Homo sapiens
aagcagttaagccccctcct

SEQ ID NO: 376390 - DNA, 13 bp, Homo sapiens
aagcagttgggag

SEQ ID NO: 376391 - DNA, 21 bp, Homo sapiens
aagcagttgggagtacatatg

SEQ ID NO: 376392 - DNA, 15 bp, Homo sapiens
aagcagttgtgtcag

SEQ ID NO: 376393 - DNA, 17 bp, Homo sapiens
aagcatcagcaagacaa

SEQ ID NO: 376394 - DNA, 16 bp, Homo sapiens
aagcatgccaatttct

SEQ ID NO: 376395 - DNA, 19 bp, Homo sapiens
aagcatgccaatttctctt

SEQ ID NO: 376396 - DNA, 20 bp, Homo sapiens
aagcatgctcagtattgaga

SEQ ID NO: 376397 - DNA, 16 bp, Homo sapiens
aagcatgctttgctgc

SEQ ID NO: 376398 - DNA, 19 bp, Homo sapiens
aagcatgctttgctgctat

SEQ ID NO: 376399 - DNA, 20 bp, Homo sapiens
aagcatgctttgctgctatg

SEQ ID NO: 376400 - DNA, 15 bp, Homo sapiens
aagcatgtctctgct

SEQ ID NO: 376401 - DNA, 13 bp, Homo sapiens
aagcatgtggcat

SEQ ID NO: 376402 - DNA, 15 bp, Homo sapiens
aagcatgtttcatgt

SEQ ID NO: 376403 - DNA, 20 bp, Homo sapiens
aagcatgtttcatgttttgt

SEQ ID NO: 376404 - DNA, 17 bp, Homo sapiens
aagcattaacttctctg

SEQ ID NO: 376405 - DNA, 20 bp, Homo sapiens
aagcattccttagcagctca

SEQ ID NO: 376406 - DNA, 23 bp, Homo sapiens
aagcattccttagcagctcaggc

SEQ ID NO: 376407 - DNA, 16 bp, Homo sapiens
aagcattctgagctgg

SEQ ID NO: 376408 - DNA, 18 bp, Homo sapiens
aagcattgcagaacatga

SEQ ID NO: 376409 - DNA, 11 bp, Homo sapiens
aagcattgttt

SEQ ID NO: 376410 - DNA, 17 bp, Homo sapiens
aagcattttcagcatca

SEQ ID NO: 376411 - DNA, 21 bp, Homo sapiens
aagccaaaaaccttagctccc

SEQ ID NO: 376412 - DNA, 22 bp, Homo sapiens
aagccaagaagtgaggcctggg

SEQ ID NO: 376413 - DNA, 14 bp, Homo sapiens
aagccaagacagtg

SEQ ID NO: 376414 - DNA, 16 bp, Homo sapiens
aagccaagggcctctt

SEQ ID NO: 376415 - DNA, 15 bp, Homo sapiens
aagccacaaggctgg

SEQ ID NO: 376416 - DNA, 18 bp, Homo sapiens
aagccacaaggctggcca

SEQ ID NO: 376417 - DNA, 15 bp, Homo sapiens
aagccacataaccag

SEQ ID NO: 376418 - DNA, 17 bp, Homo sapiens
aagccacctctccctca

SEQ ID NO: 376419 - DNA, 20 bp, Homo sapiens
aagccacctctccctcaaca

SEQ ID NO: 376420 - DNA, 14 bp, Homo sapiens
aagccacgtgctgg

SEQ ID NO: 376421 - DNA, 19 bp, Homo sapiens
aagccacgtgctggagagt

SEQ ID NO: 376422 - DNA, 17 bp, Homo sapiens
aagccactagactcttc

SEQ ID NO: 376423 - DNA, 21 bp, Homo sapiens
aagccactcccgccacacgct

SEQ ID NO: 376424 - DNA, 17 bp, Homo sapiens
aagccactgttacattt

SEQ ID NO: 376425 - DNA, 21 bp, Homo sapiens
aagccagctgcagctgggctg

SEQ ID NO: 376426 - DNA, 12 bp, Homo sapiens
aagccaggagac

SEQ ID NO: 376427 - DNA, 20 bp, Homo sapiens
aagccaggagaccctgtctt

SEQ ID NO: 376428 - DNA, 12 bp, Homo sapiens
aagaatgtacat

SEQ ID NO: 376429 - DNA, 19 bp, Homo sapiens
aagaattctccaaaacaat

SEQ ID NO: 376430 - DNA, 12 bp, Homo sapiens
aagaattcttat

SEQ ID NO: 376431 - DNA, 22 bp, Homo sapiens
aagaattgctaaatataaaaac

SEQ ID NO: 376432 - DNA, 15 bp, Homo sapiens
aagaatttagggaga

SEQ ID NO: 376433 - DNA, 15 bp, Homo sapiens
aagaatttcaatttg

SEQ ID NO: 376434 - DNA, 14 bp, Homo sapiens
aagacaaagaagga

SEQ ID NO: 376435 - DNA, 19 bp, Homo sapiens
aagacaaatatttctttct

SEQ ID NO: 376436 - DNA, 13 bp, Homo sapiens
aagacaaatggga

SEQ ID NO: 376437 - DNA, 14 bp, Homo sapiens
aagacaacaggcat

SEQ ID NO: 376438 - DNA, 15 bp, Homo sapiens
aagacacacagcctt

SEQ ID NO: 376439 - DNA, 18 bp, Homo sapiens
aagacacacagcctttct

SEQ ID NO: 376440 - DNA, 23 bp, Homo sapiens
aagacacacaggagtcctttctt

SEQ ID NO: 376441 - DNA, 12 bp, Homo sapiens
aagacacccagt

SEQ ID NO: 376442 - DNA, 13 bp, Homo sapiens
aagacacgtgttt

SEQ ID NO: 376443 - DNA, 19 bp, Homo sapiens
aagacacgtgtttttgtat

SEQ ID NO: 376444 - DNA, 22 bp, Homo sapiens
aagacagaaggccttgaagaat

SEQ ID NO: 376445 - DNA, 20 bp, Homo sapiens
aagacagatgccccagagct

SEQ ID NO: 376446 - DNA, 19 bp, Homo sapiens
aagacagggaatagtggga

SEQ ID NO: 376447 - DNA, 16 bp, Homo sapiens
aagacatatctctaat

SEQ ID NO: 376448 - DNA, 21 bp, Homo sapiens
aagacatcaagatacacttgt

SEQ ID NO: 376449 - DNA, 18 bp, Homo sapiens
aagacatggagactcctg

SEQ ID NO: 376450 - DNA, 13 bp, Homo sapiens
aagacattgtcaa

SEQ ID NO: 376451 - DNA, 13 bp, Homo sapiens
aagacatttttat

SEQ ID NO: 376452 - DNA, 19 bp, Homo sapiens
aagaccaaaatgacaatga

SEQ ID NO: 376453 - DNA, 20 bp, Homo sapiens
aagaccagcctggccatcat

SEQ ID NO: 376454 - DNA, 20 bp, Homo sapiens
aagaccagtcacagccattt

SEQ ID NO: 376455 - DNA, 22 bp, Homo sapiens
aagaccccacccaagcttggca

SEQ ID NO: 376456 - DNA, 14 bp, Homo sapiens
aagacccctgctcc

SEQ ID NO: 376457 - DNA, 15 bp, Homo sapiens
aagaccctgagactc

SEQ ID NO: 376458 - DNA, 22 bp, Homo sapiens
aagaccgtgtcccaaggagctg

SEQ ID NO: 376459 - DNA, 15 bp, Homo sapiens
aagacctgcctgtgt

SEQ ID NO: 376460 - DNA, 21 bp, Homo sapiens
aagaccttctccaaatgagat

SEQ ID NO: 376461 - DNA, 14 bp, Homo sapiens
aagaccttctgaag

SEQ ID NO: 376462 - DNA, 17 bp, Homo sapiens
aagacgtggctctgggt

SEQ ID NO: 376463 - DNA, 15 bp, Homo sapiens
aagactaacctttgt

SEQ ID NO: 376464 - DNA, 23 bp, Homo sapiens
aagactagactactcaatattaa

SEQ ID NO: 376465 - DNA, 20 bp, Homo sapiens
aagactagaggcttgcataa

SEQ ID NO: 376466 - DNA, 19 bp, Homo sapiens
aagactcttacctacaaaa

SEQ ID NO: 376467 - DNA, 13 bp, Homo sapiens
aagactgaaagaa

SEQ ID NO: 376468 - DNA, 23 bp, Homo sapiens
aagactggagactgtccacttct

SEQ ID NO: 376469 - DNA, 13 bp, Homo sapiens
aagactgtactgg

SEQ ID NO: 376470 - DNA, 20 bp, Homo sapiens
aagactgtactggccagtgt

SEQ ID NO: 376471 - DNA, 13 bp, Homo sapiens
aagacttaagatt

SEQ ID NO: 376472 - DNA, 14 bp, Homo sapiens
aagacttaagatta

SEQ ID NO: 376473 - DNA, 20 bp, Homo sapiens
aagacttagatctgagccct

SEQ ID NO: 376474 - DNA, 15 bp, Homo sapiens
aagacttctagcaga

SEQ ID NO: 376475 - DNA, 14 bp, Homo sapiens
aagacttgatgaat

SEQ ID NO: 376476 - DNA, 20 bp, Homo sapiens
aagacttggcccaggaaaaa

SEQ ID NO: 376477 - DNA, 17 bp, Homo sapiens
aagacttgtttctttct

SEQ ID NO: 376478 - DNA, 12 bp, Homo sapiens
aagacttgtttt

SEQ ID NO: 376479 - DNA, 23 bp, Homo sapiens
aagactttccccatactctgtct

SEQ ID NO: 376480 - DNA, 23 bp, Homo sapiens
aagactttgatgtgtttttgtat

SEQ ID NO: 376481 - DNA, 12 bp, Homo sapiens
aagacttttctt

SEQ ID NO: 376482 - DNA, 20 bp, Homo sapiens
aagagaaaaaccaatgattc

SEQ ID NO: 376483 - DNA, 12 bp, Homo sapiens
aagagaaaagat

SEQ ID NO: 376484 - DNA, 11 bp, Homo sapiens
aagagaaatga

SEQ ID NO: 376485 - DNA, 20 bp, Homo sapiens
aagagaaatgaaatattttt

SEQ ID NO: 376486 - DNA, 18 bp, Homo sapiens
aagagaaatgaggaagaa

SEQ ID NO: 376487 - DNA, 13 bp, Homo sapiens
aagagaaggagat

SEQ ID NO: 376488 - DNA, 10 bp, Homo sapiens
aagagaatgt

SEQ ID NO: 376489 - DNA, 21 bp, Homo sapiens
aagagaattattacatcttta

SEQ ID NO: 376490 - DNA, 11 bp, Homo sapiens
aagagaattct

SEQ ID NO: 376491 - DNA, 15 bp, Homo sapiens
aagagacaaatagta

SEQ ID NO: 376492 - DNA, 19 bp, Homo sapiens
aagagacttaaaggacagg

SEQ ID NO: 376493 - DNA, 20 bp, Homo sapiens
aagagacttaaaggacagga

SEQ ID NO: 376494 - DNA, 20 bp, Homo sapiens
aagagacttctgcttttcaa

SEQ ID NO: 376495 - DNA, 14 bp, Homo sapiens
aagagagaaaataa

SEQ ID NO: 376496 - DNA, 13 bp, Homo sapiens
aagagagaatgta

SEQ ID NO: 376497 - DNA, 13 bp, Homo sapiens
aagagagcctgcc

SEQ ID NO: 376498 - DNA, 12 bp, Homo sapiens
aagagaggcacc

SEQ ID NO: 376499 - DNA, 17 bp, Homo sapiens
aagagaggcacctgctg

SEQ ID NO: 376500 - DNA, 11 bp, Homo sapiens
aagagaggtta

SEQ ID NO: 376501 - DNA, 13 bp, Homo sapiens
aagagatgctcta

SEQ ID NO: 376502 - DNA, 19 bp, Homo sapiens
aagagattaagaatattgc

SEQ ID NO: 376503 - DNA, 19 bp, Homo sapiens
aagagattctattaaaagc

SEQ ID NO: 376504 - DNA, 13 bp, Homo sapiens
aagagcagagtct

SEQ ID NO: 376505 - DNA, 19 bp, Homo sapiens
aagagcagagtctgggcct

SEQ ID NO: 376506 - DNA, 17 bp, Homo sapiens
aagagcagcctgtggca

SEQ ID NO: 376507 - DNA, 14 bp, Homo sapiens
aagagccaatggag

SEQ ID NO: 376508 - DNA, 9 bp, Homo sapiens
aagagccat

SEQ ID NO: 376509 - DNA, 17 bp, Homo sapiens
aagagcgctcctctgcc

SEQ ID NO: 376510 - DNA, 20 bp, Homo sapiens
aagagcgctcctctgccttg

SEQ ID NO: 376511 - DNA, 19 bp, Homo sapiens
aagagctcaggagaaggcc

SEQ ID NO: 376512 - DNA, 21 bp, Homo sapiens
aagagctgggtaccaggccac

SEQ ID NO: 376513 - DNA, 22 bp, Homo sapiens
aagagctgttttggatgaatgc

SEQ ID NO: 376514 - DNA, 23 bp, Homo sapiens
aagagctgttttggatgaatgca

SEQ ID NO: 376515 - DNA, 19 bp, Homo sapiens
aagaggaaaatattgacaa

SEQ ID NO: 376516 - DNA, 16 bp, Homo sapiens
aagaggaagccttgcc

SEQ ID NO: 376517 - DNA, 15 bp, Homo sapiens
aagaggccaatgccc

SEQ ID NO: 376518 - DNA, 21 bp, Homo sapiens
aagaggccagcgtgaaggacc

SEQ ID NO: 376519 - DNA, 13 bp, Homo sapiens
aagaggccttggg

SEQ ID NO: 376520 - DNA, 17 bp, Homo sapiens
aagaggctagccccagg

SEQ ID NO: 376521 - DNA, 18 bp, Homo sapiens
aagaggctagccccaggg

SEQ ID NO: 376522 - DNA, 15 bp, Homo sapiens
aagaggctgaggcct

SEQ ID NO: 376523 - DNA, 12 bp, Homo sapiens
aagagggagaag

SEQ ID NO: 376524 - DNA, 17 bp, Homo sapiens
aagagggagaagcatga

SEQ ID NO: 376525 - DNA, 21 bp, Homo sapiens
aagagggagccggtttgggag

SEQ ID NO: 376526 - DNA, 12 bp, Homo sapiens
aagagggcctgt

SEQ ID NO: 376527 - DNA, 17 bp, Homo sapiens
aagaggtgctgctttgc

SEQ ID NO: 376528 - DNA, 15 bp, Homo sapiens
aagaggttctcagca

SEQ ID NO: 376529 - DNA, 22 bp, Homo sapiens
aagaggttctcagcaagtgtac

SEQ ID NO: 376530 - DNA, 19 bp, Homo sapiens
aagaggttctcgactggag

SEQ ID NO: 376531 - DNA, 21 bp, Homo sapiens
aagagtaacactgaggcgctc

SEQ ID NO: 376532 - DNA, 21 bp, Homo sapiens
aagagtacaggtcttctttaa

SEQ ID NO: 376533 - DNA, 19 bp, Homo sapiens
aagagtagttgatgttgca

SEQ ID NO: 376534 - DNA, 22 bp, Homo sapiens
aagagtagttgatgttgcattt

SEQ ID NO: 376535 - DNA, 14 bp, Homo sapiens
aagagtatactttg

SEQ ID NO: 376536 - DNA, 16 bp, Homo sapiens
aagagtatgagaaata

SEQ ID NO: 376537 - DNA, 22 bp, Homo sapiens
aagagtatgagaaatacagtgc

SEQ ID NO: 376538 - DNA, 23 bp, Homo sapiens
aagagtatgagaaatacagtgct

SEQ ID NO: 376539 - DNA, 14 bp, Homo sapiens
aagagtatgtagtg

SEQ ID NO: 376540 - DNA, 20 bp, Homo sapiens
aagagtcctgaggcagaacc

SEQ ID NO: 376541 - DNA, 21 bp, Homo sapiens
aagagtcctgaggcagaacct

SEQ ID NO: 376542 - DNA, 23 bp, Homo sapiens
aagagtcctgaggcagaacctgg

SEQ ID NO: 376543 - DNA, 22 bp, Homo sapiens
aagagtgacagtggattgcatt

SEQ ID NO: 376544 - DNA, 18 bp, Homo sapiens
aagagtgactagtacaaa

SEQ ID NO: 376545 - DNA, 19 bp, Homo sapiens
aagagtggcatataatttt

SEQ ID NO: 376546 - DNA, 22 bp, Homo sapiens
aagagttatatgacttcttgtt

SEQ ID NO: 376547 - DNA, 20 bp, Homo sapiens
aagagttctatccccaagct

SEQ ID NO: 376548 - DNA, 21 bp, Homo sapiens
aagagttctatccccaagctg

SEQ ID NO: 376549 - DNA, 16 bp, Homo sapiens
aagagttgagcacagg

SEQ ID NO: 376550 - DNA, 20 bp, Homo sapiens
aagataaaaggataggaaaa

SEQ ID NO: 376551 - DNA, 12 bp, Homo sapiens
aagataaagatg

SEQ ID NO: 376552 - DNA, 14 bp, Homo sapiens
aagataaagatgat

SEQ ID NO: 376553 - DNA, 20 bp, Homo sapiens
aagataaatccaactctgac

SEQ ID NO: 376554 - DNA, 18 bp, Homo sapiens
aagataacgcaggagaga

SEQ ID NO: 376555 - DNA, 21 bp, Homo sapiens
aagataacgcaggagagagag

SEQ ID NO: 376556 - DNA, 20 bp, Homo sapiens
aagataatggataatcttcg

SEQ ID NO: 376557 - DNA, 16 bp, Homo sapiens
aagataatgttcttta

SEQ ID NO: 376558 - DNA, 19 bp, Homo sapiens
aagataattaaatgaaata

SEQ ID NO: 376559 - DNA, 18 bp, Homo sapiens
aagatacacaagagggac

SEQ ID NO: 376560 - DNA, 16 bp, Homo sapiens
aagatacactcctgct

SEQ ID NO: 376561 - DNA, 14 bp, Homo sapiens
aagatacatttgta

SEQ ID NO: 376562 - DNA, 16 bp, Homo sapiens
aacttaaataatttaa

SEQ ID NO: 376563 - DNA, 16 bp, Homo sapiens
aacttaacattgcatc

SEQ ID NO: 376564 - DNA, 18 bp, Homo sapiens
aacttaaccgcatcagaa

SEQ ID NO: 376565 - DNA, 22 bp, Homo sapiens
aacttaaccgcatcagaagcct

SEQ ID NO: 376566 - DNA, 21 bp, Homo sapiens
aacttaagtttagaaattaca

SEQ ID NO: 376567 - DNA, 20 bp, Homo sapiens
aacttaatgttctgaataat

SEQ ID NO: 376568 - DNA, 20 bp, Homo sapiens
aacttaattcaatgctttct

SEQ ID NO: 376569 - DNA, 23 bp, Homo sapiens
aacttacctaagtgacatttgta

SEQ ID NO: 376570 - DNA, 20 bp, Homo sapiens
aacttactatggtatatatt

SEQ ID NO: 376571 - DNA, 16 bp, Homo sapiens
aacttagtgtttagca

SEQ ID NO: 376572 - DNA, 23 bp, Homo sapiens
aacttagtttgtgaattgatttt

SEQ ID NO: 376573 - DNA, 13 bp, Homo sapiens
aacttagttttgt

SEQ ID NO: 376574 - DNA, 15 bp, Homo sapiens
aacttataaatcata

SEQ ID NO: 376575 - DNA, 21 bp, Homo sapiens
aacttatctagaaagaaaaga

SEQ ID NO: 376576 - DNA, 19 bp, Homo sapiens
aacttatttgagtgattat

SEQ ID NO: 376577 - DNA, 13 bp, Homo sapiens
aacttcaaagctg

SEQ ID NO: 376578 - DNA, 19 bp, Homo sapiens
aacttcaaagctgaatatt

SEQ ID NO: 376579 - DNA, 15 bp, Homo sapiens
aacttcaccaccccc

SEQ ID NO: 376580 - DNA, 12 bp, Homo sapiens
aacttcacctta

SEQ ID NO: 376581 - DNA, 14 bp, Homo sapiens
aacttcagagaagt

SEQ ID NO: 376582 - DNA, 11 bp, Homo sapiens
aacttcagcaa

SEQ ID NO: 376583 - DNA, 12 bp, Homo sapiens
aacttcagcaac

SEQ ID NO: 376584 - DNA, 15 bp, Homo sapiens
aacttcagtcctggg

SEQ ID NO: 376585 - DNA, 21 bp, Homo sapiens
aacttcattctaaaccaaaac

SEQ ID NO: 376586 - DNA, 14 bp, Homo sapiens
aacttcatttgatg

SEQ ID NO: 376587 - DNA, 21 bp, Homo sapiens
aacttccattctttcttcctc

SEQ ID NO: 376588 - DNA, 14 bp, Homo sapiens
aacttctaatatat

SEQ ID NO: 376589 - DNA, 16 bp, Homo sapiens
aacttctaatatattt

SEQ ID NO: 376590 - DNA, 16 bp, Homo sapiens
aacttctaattgccat

SEQ ID NO: 376591 - DNA, 21 bp, Homo sapiens
aacttctagttgctcttgctt

SEQ ID NO: 376592 - DNA, 19 bp, Homo sapiens
aacttctcgtagatgctgc

SEQ ID NO: 376593 - DNA, 23 bp, Homo sapiens
aacttctgtcccttgtttttgat

SEQ ID NO: 376594 - DNA, 20 bp, Homo sapiens
aacttgagatgtatgaaggc

SEQ ID NO: 376595 - DNA, 14 bp, Homo sapiens
aacttgaggacaca

SEQ ID NO: 376596 - DNA, 16 bp, Homo sapiens
aacttgaggacacatg

SEQ ID NO: 376597 - DNA, 15 bp, Homo sapiens
aacttgatttgcatg

SEQ ID NO: 376598 - DNA, 20 bp, Homo sapiens
aacttgatttgcatggattt

SEQ ID NO: 376599 - DNA, 14 bp, Homo sapiens
aacttgctgtgaaa

SEQ ID NO: 376600 - DNA, 14 bp, Homo sapiens
aacttgtaaataca

SEQ ID NO: 376601 - DNA, 19 bp, Homo sapiens
aacttgtgcttttgcaaaa

SEQ ID NO: 376602 - DNA, 21 bp, Homo sapiens
aacttgtgtactgataaaata

SEQ ID NO: 376603 - DNA, 21 bp, Homo sapiens
aactttaattctctttcaaag

SEQ ID NO: 376604 - DNA, 21 bp, Homo sapiens
aactttagaagtgcatttctg

SEQ ID NO: 376605 - DNA, 19 bp, Homo sapiens
aactttagggggtgggagg

SEQ ID NO: 376606 - DNA, 15 bp, Homo sapiens
aactttcacctcaga

SEQ ID NO: 376607 - DNA, 14 bp, Homo sapiens
aactttcagaactg

SEQ ID NO: 376608 - DNA, 20 bp, Homo sapiens
aactttccatgacagtagca

SEQ ID NO: 376609 - DNA, 14 bp, Homo sapiens
aactttcctcgcct

SEQ ID NO: 376610 - DNA, 14 bp, Homo sapiens
aactttctcttgta

SEQ ID NO: 376611 - DNA, 11 bp, Homo sapiens
aactttctgta

SEQ ID NO: 376612 - DNA, 21 bp, Homo sapiens
aactttgaggaggaagcagaa

SEQ ID NO: 376613 - DNA, 16 bp, Homo sapiens
aactttgctggaaaat

SEQ ID NO: 376614 - DNA, 11 bp, Homo sapiens
aactttgtcac

SEQ ID NO: 376615 - DNA, 20 bp, Homo sapiens
aactttgtcacttctgctgt

SEQ ID NO: 376616 - DNA, 16 bp, Homo sapiens
aactttgtgcctttga

SEQ ID NO: 376617 - DNA, 20 bp, Homo sapiens
aactttgtggatgtcttcct

SEQ ID NO: 376618 - DNA, 17 bp, Homo sapiens
aacttttataaattaaa

SEQ ID NO: 376619 - DNA, 21 bp, Homo sapiens
aacttttcttaaaaagttata

SEQ ID NO: 376620 - DNA, 18 bp, Homo sapiens
aagaaaaaaaaggcagta

SEQ ID NO: 376621 - DNA, 16 bp, Homo sapiens
aagaaaaaaaataaca

SEQ ID NO: 376622 - DNA, 18 bp, Homo sapiens
aagaaaaaaaataacaca

SEQ ID NO: 376623 - DNA, 12 bp, Homo sapiens
aagaaaaaaata

SEQ ID NO: 376624 - DNA, 24 bp, Homo sapiens
aagaaaaaaataattttatgaact

SEQ ID NO: 376625 - DNA, 19 bp, Homo sapiens
aagaaaaacatgtcatgta

SEQ ID NO: 376626 - DNA, 12 bp, Homo sapiens
aagaaaaaggaa

SEQ ID NO: 376627 - DNA, 13 bp, Homo sapiens
aagaaaaaggaaa

SEQ ID NO: 376628 - DNA, 9 bp, Homo sapiens
aagaaaaat

SEQ ID NO: 376629 - DNA, 14 bp, Homo sapiens
aagaaaacaacttc

SEQ ID NO: 376630 - DNA, 12 bp, Homo sapiens
aagaaaacatat

SEQ ID NO: 376631 - DNA, 13 bp, Homo sapiens
aagaaaacatata

SEQ ID NO: 376632 - DNA, 15 bp, Homo sapiens
aagaaaacatatatt

SEQ ID NO: 376633 - DNA, 22 bp, Homo sapiens
aaaggaaaaacagaacatttct

SEQ ID NO: 376634 - DNA, 21 bp, Homo sapiens
aaaggaaaactcaccatttca

SEQ ID NO: 376635 - DNA, 17 bp, Homo sapiens
aaaggaacacccggaaa

SEQ ID NO: 376636 - DNA, 12 bp, Homo sapiens
aaaggaagacta

SEQ ID NO: 376637 - DNA, 22 bp, Homo sapiens
aaaggaagacttggcccaggaa

SEQ ID NO: 376638 - DNA, 19 bp, Homo sapiens
aaaggaagagctaataaat

SEQ ID NO: 376639 - DNA, 19 bp, Homo sapiens
aaaggaataggtaggagac

SEQ ID NO: 376640 - DNA, 22 bp, Homo sapiens
aaaggaatataccacaccgagg

SEQ ID NO: 376641 - DNA, 12 bp, Homo sapiens
aaaggaatgcaa

SEQ ID NO: 376642 - DNA, 16 bp, Homo sapiens
aaaggacaaacagtga

SEQ ID NO: 376643 - DNA, 13 bp, Homo sapiens
aaaggactgacct

SEQ ID NO: 376644 - DNA, 16 bp, Homo sapiens
aaaggactgacctgcc

SEQ ID NO: 376645 - DNA, 16 bp, Homo sapiens
aaaggagcgggcaggg

SEQ ID NO: 376646 - DNA, 19 bp, Homo sapiens
aaaggatatttaagaaaat

SEQ ID NO: 376647 - DNA, 13 bp, Homo sapiens
aaaggatgaagaa

SEQ ID NO: 376648 - DNA, 16 bp, Homo sapiens
aaaggatgatttaaca

SEQ ID NO: 376649 - DNA, 22 bp, Homo sapiens
aaaggatggcagcctcagggct

SEQ ID NO: 376650 - DNA, 13 bp, Homo sapiens
aaaggattaagat

SEQ ID NO: 376651 - DNA, 19 bp, Homo sapiens
aaaggattaagatacactc

SEQ ID NO: 376652 - DNA, 18 bp, Homo sapiens
aaaggattttggaaaaga

SEQ ID NO: 376653 - DNA, 16 bp, Homo sapiens
aaaggcagagattggg

SEQ ID NO: 376654 - DNA, 20 bp, Homo sapiens
aaaggcctttgggatttgcc

SEQ ID NO: 376655 - DNA, 14 bp, Homo sapiens
aaaggctgaacata

SEQ ID NO: 376656 - DNA, 19 bp, Homo sapiens
aaaggctttggcaacagaa

SEQ ID NO: 376657 - DNA, 16 bp, Homo sapiens
aaagggaaaagggaga

SEQ ID NO: 376658 - DNA, 22 bp, Homo sapiens
aaagggacagcatgccccttgg

SEQ ID NO: 376659 - DNA, 18 bp, Homo sapiens
aaagggagccatgctctt

SEQ ID NO: 376660 - DNA, 17 bp, Homo sapiens
aaagggcagcccctccc

SEQ ID NO: 376661 - DNA, 19 bp, Homo sapiens
aaagggcagcccctcccca

SEQ ID NO: 376662 - DNA, 22 bp, Homo sapiens
aaagggcagcccctccccatgg

SEQ ID NO: 376663 - DNA, 23 bp, Homo sapiens
aaaggggagaaactgaaagtgtt

SEQ ID NO: 376664 - DNA, 15 bp, Homo sapiens
aaaggggctgctggg

SEQ ID NO: 376665 - DNA, 22 bp, Homo sapiens
aaagggggctattccctggaga

SEQ ID NO: 376666 - DNA, 14 bp, Homo sapiens
aaaggtaggtgcat

SEQ ID NO: 376667 - DNA, 16 bp, Homo sapiens
aaaggtcatattggaa

SEQ ID NO: 376668 - DNA, 18 bp, Homo sapiens
aaaggtcattgtggctat

SEQ ID NO: 376669 - DNA, 14 bp, Homo sapiens
aaaggtcctgccct

SEQ ID NO: 376670 - DNA, 15 bp, Homo sapiens
aaaggtcctgccctc

SEQ ID NO: 376671 - DNA, 16 bp, Homo sapiens
aaaggtgacccttctg

SEQ ID NO: 376672 - DNA, 15 bp, Homo sapiens
aaaggtgattaaata

SEQ ID NO: 376673 - DNA, 14 bp, Homo sapiens
aaaggtgattttcc

SEQ ID NO: 376674 - DNA, 11 bp, Homo sapiens
aaaggtgctca

SEQ ID NO: 376675 - DNA, 21 bp, Homo sapiens
aaaggtgctcaaagatgtact

SEQ ID NO: 376676 - DNA, 15 bp, Homo sapiens
aaaggttaacagtaa

SEQ ID NO: 376677 - DNA, 21 bp, Homo sapiens
aaaggttaacagtaaaaattt

SEQ ID NO: 376678 - DNA, 16 bp, Homo sapiens
aaaggttgaattaatt

SEQ ID NO: 376679 - DNA, 19 bp, Homo sapiens
aaaggtttcactgttcatg

SEQ ID NO: 376680 - DNA, 22 bp, Homo sapiens
aaaggtttcactgttcatgaat

SEQ ID NO: 376681 - DNA, 12 bp, Homo sapiens
aaagtaaaagag

SEQ ID NO: 376682 - DNA, 23 bp, Homo sapiens
aaagtaaagctaaaatgatttta

SEQ ID NO: 376683 - DNA, 18 bp, Homo sapiens
aaagtacaaagcatattt

SEQ ID NO: 376684 - DNA, 13 bp, Homo sapiens
aaagtacatagtg

SEQ ID NO: 376685 - DNA, 14 bp, Homo sapiens
aaagtactaaaact

SEQ ID NO: 376686 - DNA, 19 bp, Homo sapiens
aaagtactaaaactagata

SEQ ID NO: 376687 - DNA, 22 bp, Homo sapiens
aaagtatacttttgtttcaggg

SEQ ID NO: 376688 - DNA, 12 bp, Homo sapiens
aaagtatcatgc

SEQ ID NO: 376689 - DNA, 16 bp, Homo sapiens
aaagtatcatgcattc

SEQ ID NO: 376690 - DNA, 14 bp, Homo sapiens
aaagtattcttctt

SEQ ID NO: 376691 - DNA, 15 bp, Homo sapiens
aaagtcaattcatct

SEQ ID NO: 376692 - DNA, 23 bp, Homo sapiens
aaagtcacagccgtttgaatata

SEQ ID NO: 376693 - DNA, 21 bp, Homo sapiens
aaagtcatctttgagataatt

SEQ ID NO: 376694 - DNA, 23 bp, Homo sapiens
aaagtcatgaagctcagtttggc

SEQ ID NO: 376695 - DNA, 14 bp, Homo sapiens
aaagtcctcttccc

SEQ ID NO: 376696 - DNA, 15 bp, Homo sapiens
aaagtcgaattaata

SEQ ID NO: 376697 - DNA, 16 bp, Homo sapiens
aaagtctaaagtttac

SEQ ID NO: 376698 - DNA, 13 bp, Homo sapiens
aaagtctatgctt

SEQ ID NO: 376699 - DNA, 12 bp, Homo sapiens
aaagtctatttt

SEQ ID NO: 376700 - DNA, 21 bp, Homo sapiens
aaagtctatttttttaactga

SEQ ID NO: 376701 - DNA, 19 bp, Homo sapiens
aaagtctcaatgttccatt

SEQ ID NO: 376702 - DNA, 17 bp, Homo sapiens
aaagtctcctgtatcat

SEQ ID NO: 376703 - DNA, 19 bp, Homo sapiens
aaagtctgcattacattcc

SEQ ID NO: 376704 - DNA, 19 bp, Homo sapiens
aaagtcttaacaacagctt

SEQ ID NO: 376705 - DNA, 18 bp, Homo sapiens
aaagtcttgtgactagtg

SEQ ID NO: 376706 - DNA, 13 bp, Homo sapiens
aaagtgaagcaaa

SEQ ID NO: 376707 - DNA, 15 bp, Homo sapiens
aaagtgaataaaaat

SEQ ID NO: 376708 - DNA, 22 bp, Homo sapiens
aaagtgaatttgaatgaaaaat

SEQ ID NO: 376709 - DNA, 14 bp, Homo sapiens
aaagtgacacagca

SEQ ID NO: 376710 - DNA, 16 bp, Homo sapiens
aaagtgagatgggaag

SEQ ID NO: 376711 - DNA, 21 bp, Homo sapiens
aaagtgagatgggaagggctt

SEQ ID NO: 376712 - DNA, 21 bp, Homo sapiens
aaagtgcaattgcacaaatac

SEQ ID NO: 376713 - DNA, 21 bp, Homo sapiens
aaagtgcagcccttcctcctg

SEQ ID NO: 376714 - DNA, 12 bp, Homo sapiens
aaagtgctggga

SEQ ID NO: 376715 - DNA, 21 bp, Homo sapiens
aaagtgctttgctggagtcct

SEQ ID NO: 376716 - DNA, 23 bp, Homo sapiens
aaagtgctttgctggagtcctgt

SEQ ID NO: 376717 - DNA, 19 bp, Homo sapiens
aaagtggcaagaccaaaat

SEQ ID NO: 376718 - DNA, 17 bp, Homo sapiens
aaagtgtgttgttgctt

SEQ ID NO: 376719 - DNA, 19 bp, Homo sapiens
aaagtgttattttgtataa

SEQ ID NO: 376720 - DNA, 18 bp, Homo sapiens
aaagtgttggtctttcta

SEQ ID NO: 376721 - DNA, 17 bp, Homo sapiens
aaagtgtttatttttca

SEQ ID NO: 376722 - DNA, 22 bp, Homo sapiens
aaagttaaaaaaaataataaat

SEQ ID NO: 376723 - DNA, 12 bp, Homo sapiens
aaagttaaaagt

SEQ ID NO: 376724 - DNA, 14 bp, Homo sapiens
aaagttacagaaat

SEQ ID NO: 376725 - DNA, 15 bp, Homo sapiens
aaagttattttcaga

SEQ ID NO: 376726 - DNA, 22 bp, Homo sapiens
aaagttcatagggtctcttcag

SEQ ID NO: 376727 - DNA, 21 bp, Homo sapiens
aaagttccctacttcctgtga

SEQ ID NO: 376728 - DNA, 18 bp, Homo sapiens
aaagttgtgattccagat

SEQ ID NO: 376729 - DNA, 15 bp, Homo sapiens
aaagttgttttgatt

SEQ ID NO: 376730 - DNA, 13 bp, Homo sapiens
aaagtttaaatac

SEQ ID NO: 376731 - DNA, 18 bp, Homo sapiens
aaagtttacagtaaataa

SEQ ID NO: 376732 - DNA, 12 bp, Homo sapiens
aaagtttcaatg

SEQ ID NO: 376733 - DNA, 13 bp, Homo sapiens
aaagtttccatat

SEQ ID NO: 376734 - DNA, 22 bp, Homo sapiens
aaagtttccccaccagtgaatg

SEQ ID NO: 376735 - DNA, 12 bp, Homo sapiens
aaagttttcaga

SEQ ID NO: 376736 - DNA, 14 bp, Homo sapiens
aaagttttccagta

SEQ ID NO: 376737 - DNA, 16 bp, Homo sapiens
aaagttttccagtatt

SEQ ID NO: 376738 - DNA, 21 bp, Homo sapiens
aaagttttccatttttgtcag

SEQ ID NO: 376739 - DNA, 14 bp, Homo sapiens
aaataaaaagtgac

SEQ ID NO: 376740 - DNA, 19 bp, Homo sapiens
aaataaaaagtgacacagc

SEQ ID NO: 376741 - DNA, 13 bp, Homo sapiens
aaataaaaatatt

SEQ ID NO: 376742 - DNA, 16 bp, Homo sapiens
aaataaaaatattctc

SEQ ID NO: 376743 - DNA, 18 bp, Homo sapiens
aaataaaacgttatctca

SEQ ID NO: 376744 - DNA, 19 bp, Homo sapiens
aaataaaactaaggaaccc

SEQ ID NO: 376745 - DNA, 21 bp, Homo sapiens
aaataaaactaaggaaccctg

SEQ ID NO: 376746 - DNA, 15 bp, Homo sapiens
aaataaaactattta

SEQ ID NO: 376747 - DNA, 16 bp, Homo sapiens
aaataaaactatttaa

SEQ ID NO: 376748 - DNA, 11 bp, Homo sapiens
aaataaaagca

SEQ ID NO: 376749 - DNA, 13 bp, Homo sapiens
aaataaaataaac

SEQ ID NO: 376750 - DNA, 13 bp, Homo sapiens
aaataaaataacc

SEQ ID NO: 376751 - DNA, 12 bp, Homo sapiens
aaataaaataag

SEQ ID NO: 376752 - DNA, 13 bp, Homo sapiens
aaataaaataagt

SEQ ID NO: 376753 - DNA, 13 bp, Homo sapiens
aaataaaatactg

SEQ ID NO: 376754 - DNA, 11 bp, Homo sapiens
aaataaaatga

SEQ ID NO: 376755 - DNA, 17 bp, Homo sapiens
aaataaacgaaacattt

SEQ ID NO: 376756 - DNA, 21 bp, Homo sapiens
aaataaactagggttttggcc

SEQ ID NO: 376757 - DNA, 11 bp, Homo sapiens
aaataaactct

SEQ ID NO: 376758 - DNA, 12 bp, Homo sapiens
aaataaactctt

SEQ ID NO: 376759 - DNA, 14 bp, Homo sapiens
aaataaactcttca

SEQ ID NO: 376760 - DNA, 16 bp, Homo sapiens
aaataaactcttcaag

SEQ ID NO: 376761 - DNA, 16 bp, Homo sapiens
aaataaacttgacaaa

SEQ ID NO: 376762 - DNA, 23 bp, Homo sapiens
aactattaggaggaatgtgcttt

SEQ ID NO: 376763 - DNA, 20 bp, Homo sapiens
aactattagtattattaaca

SEQ ID NO: 376764 - DNA, 15 bp, Homo sapiens
aactattcagaggaa

SEQ ID NO: 376765 - DNA, 23 bp, Homo sapiens
aactattcaggagagtagaacag

SEQ ID NO: 376766 - DNA, 18 bp, Homo sapiens
aactatttaaaattggca

SEQ ID NO: 376767 - DNA, 20 bp, Homo sapiens
aactatttaaaattggcacc

SEQ ID NO: 376768 - DNA, 15 bp, Homo sapiens
aactcaaaaggagaa

SEQ ID NO: 376769 - DNA, 16 bp, Homo sapiens
aactcaaacacagaga

SEQ ID NO: 376770 - DNA, 14 bp, Homo sapiens
aactcaccatttca

SEQ ID NO: 376771 - DNA, 19 bp, Homo sapiens
aactcaccatttcatccat

SEQ ID NO: 376772 - DNA, 22 bp, Homo sapiens
aactcacccccaaggggcagtc

SEQ ID NO: 376773 - DNA, 17 bp, Homo sapiens
aactcaccgctcaccct

SEQ ID NO: 376774 - DNA, 21 bp, Homo sapiens
aactcacctaatgtttatgag

SEQ ID NO: 376775 - DNA, 22 bp, Homo sapiens
aactcacctgctggcccctcac

SEQ ID NO: 376776 - DNA, 14 bp, Homo sapiens
aactcagatcacta

SEQ ID NO: 376777 - DNA, 20 bp, Homo sapiens
aactcagatcactactgcag

SEQ ID NO: 376778 - DNA, 14 bp, Homo sapiens
aactcagcagttga

SEQ ID NO: 376779 - DNA, 20 bp, Homo sapiens
aactcagctattaagaaaat

SEQ ID NO: 376780 - DNA, 14 bp, Homo sapiens
aactcatcataaaa

SEQ ID NO: 376781 - DNA, 17 bp, Homo sapiens
aactcatctgttatcct

SEQ ID NO: 376782 - DNA, 19 bp, Homo sapiens
aactcatgactgagtctgg

SEQ ID NO: 376783 - DNA, 18 bp, Homo sapiens
aactccaaggcaaatgtc

SEQ ID NO: 376784 - DNA, 21 bp, Homo sapiens
aactccagccacccagccagg

SEQ ID NO: 376785 - DNA, 15 bp, Homo sapiens
aactccaggggcacc

SEQ ID NO: 376786 - DNA, 21 bp, Homo sapiens
aactccagtgttcccttctgg

SEQ ID NO: 376787 - DNA, 16 bp, Homo sapiens
aactccatacagcctc

SEQ ID NO: 376788 - DNA, 18 bp, Homo sapiens
aactccatgaccaggcca

SEQ ID NO: 376789 - DNA, 19 bp, Homo sapiens
aactccatgaccaggccac

SEQ ID NO: 376790 - DNA, 14 bp, Homo sapiens
aactcccagccacc

SEQ ID NO: 376791 - DNA, 16 bp, Homo sapiens
aactcccagccaccac

SEQ ID NO: 376792 - DNA, 21 bp, Homo sapiens
aactcccagccaccaccactg

SEQ ID NO: 376793 - DNA, 14 bp, Homo sapiens
aactcccaggacct

SEQ ID NO: 376794 - DNA, 21 bp, Homo sapiens
aactccctagttacccaccct

SEQ ID NO: 376795 - DNA, 16 bp, Homo sapiens
aactccgcccagcctc

SEQ ID NO: 376796 - DNA, 17 bp, Homo sapiens
aactccgcccagcctct

SEQ ID NO: 376797 - DNA, 17 bp, Homo sapiens
aactcctactgcttcct

SEQ ID NO: 376798 - DNA, 16 bp, Homo sapiens
aactcctgacagtctt

SEQ ID NO: 376799 - DNA, 17 bp, Homo sapiens
aactcctgattttgtag

SEQ ID NO: 376800 - DNA, 10 bp, Homo sapiens
aactcctgcc

SEQ ID NO: 376801 - DNA, 12 bp, Homo sapiens
aactcctgcctg

SEQ ID NO: 376802 - DNA, 18 bp, Homo sapiens
aactccttccatccttga

SEQ ID NO: 376803 - DNA, 12 bp, Homo sapiens
aactccttcctc

SEQ ID NO: 376804 - DNA, 13 bp, Homo sapiens
aactccttggcct

SEQ ID NO: 376805 - DNA, 16 bp, Homo sapiens
aactcgatgcactgac

SEQ ID NO: 376806 - DNA, 14 bp, Homo sapiens
aactcgtctgatgt

SEQ ID NO: 376807 - DNA, 15 bp, Homo sapiens
aactctacccctgct

SEQ ID NO: 376808 - DNA, 18 bp, Homo sapiens
aactctacccctgctccc

SEQ ID NO: 376809 - DNA, 19 bp, Homo sapiens
aactctaccctggtaggaa

SEQ ID NO: 376810 - DNA, 23 bp, Homo sapiens
aactctaccctggtaggaaagca

SEQ ID NO: 376811 - DNA, 14 bp, Homo sapiens
aactctatctgggc

SEQ ID NO: 376812 - DNA, 18 bp, Homo sapiens
aactctatctgggcctgg

SEQ ID NO: 376813 - DNA, 19 bp, Homo sapiens
aactctatctgggcctggg

SEQ ID NO: 376814 - DNA, 15 bp, Homo sapiens
aactctattttttac

SEQ ID NO: 376815 - DNA, 15 bp, Homo sapiens
aactctcaaaagtct

SEQ ID NO: 376816 - DNA, 13 bp, Homo sapiens
aactctcaggact

SEQ ID NO: 376817 - DNA, 15 bp, Homo sapiens
aactctccagtgcct

SEQ ID NO: 376818 - DNA, 19 bp, Homo sapiens
aactctccccagtgcctgc

SEQ ID NO: 376819 - DNA, 23 bp, Homo sapiens
aactctccccagtgcctgccact

SEQ ID NO: 376820 - DNA, 13 bp, Homo sapiens
aactctcctcttt

SEQ ID NO: 376821 - DNA, 19 bp, Homo sapiens
aactctgcatagacaaagg

SEQ ID NO: 376822 - DNA, 23 bp, Homo sapiens
aactctggccttggttcctccag

SEQ ID NO: 376823 - DNA, 19 bp, Homo sapiens
aactctggctccttctcca

SEQ ID NO: 376824 - DNA, 21 bp, Homo sapiens
aactctgtgcaggtgctgcct

SEQ ID NO: 376825 - DNA, 15 bp, Homo sapiens
aactctgttccccca

SEQ ID NO: 376826 - DNA, 19 bp, Homo sapiens
aactctgttcccccaccct

SEQ ID NO: 376827 - DNA, 21 bp, Homo sapiens
aactcttcaatctcttgcact

SEQ ID NO: 376828 - DNA, 21 bp, Homo sapiens
aactcttcagcctcattcact

SEQ ID NO: 376829 - DNA, 21 bp, Homo sapiens
aactcttcatcttaaactaca

SEQ ID NO: 376830 - DNA, 16 bp, Homo sapiens
aactcttgctcactcc

SEQ ID NO: 376831 - DNA, 14 bp, Homo sapiens
aactcttgtattgc

SEQ ID NO: 376832 - DNA, 21 bp, Homo sapiens
aactcttgtattgctccattt

SEQ ID NO: 376833 - DNA, 17 bp, Homo sapiens
aactgaaaactgtaaat

SEQ ID NO: 376834 - DNA, 13 bp, Homo sapiens
aactgaaaatgta

SEQ ID NO: 376835 - DNA, 17 bp, Homo sapiens
aactgaaaatgtaaatt

SEQ ID NO: 376836 - DNA, 17 bp, Homo sapiens
aactgaaagtgttttac

SEQ ID NO: 376837 - DNA, 20 bp, Homo sapiens
aactgaagacctccacatta

SEQ ID NO: 376838 - DNA, 17 bp, Homo sapiens
aactgaagcaaatacca

SEQ ID NO: 376839 - DNA, 15 bp, Homo sapiens
aactgaccctccctt

SEQ ID NO: 376840 - DNA, 15 bp, Homo sapiens
aactgactaaccatt

SEQ ID NO: 376841 - DNA, 20 bp, Homo sapiens
aactgactattcttgatgta

SEQ ID NO: 376842 - DNA, 13 bp, Homo sapiens
aactgacttctgc

SEQ ID NO: 376843 - DNA, 13 bp, Homo sapiens
aactgactttctc

SEQ ID NO: 376844 - DNA, 18 bp, Homo sapiens
aactgactttttcccccc

SEQ ID NO: 376845 - DNA, 19 bp, Homo sapiens
aactgactttttcccccca

SEQ ID NO: 376846 - DNA, 12 bp, Homo sapiens
aactgagagaag

SEQ ID NO: 376847 - DNA, 19 bp, Homo sapiens
aactgagccgtgcagctgg

SEQ ID NO: 376848 - DNA, 22 bp, Homo sapiens
aactgagccgtgcagctgggat

SEQ ID NO: 376849 - DNA, 14 bp, Homo sapiens
aactgagctcctct

SEQ ID NO: 376850 - DNA, 17 bp, Homo sapiens
aactgagctgccagtgg

SEQ ID NO: 376851 - DNA, 13 bp, Homo sapiens
aactgaggcccag

SEQ ID NO: 376852 - DNA, 16 bp, Homo sapiens
aactgatgatagactt

SEQ ID NO: 376853 - DNA, 17 bp, Homo sapiens
aactgatggaccgggtg

SEQ ID NO: 376854 - DNA, 23 bp, Homo sapiens
aactgcaaattgtagcccagttg

SEQ ID NO: 376855 - DNA, 22 bp, Homo sapiens
aactgcaatagagactgtagat

SEQ ID NO: 376856 - DNA, 17 bp, Homo sapiens
aactgcacacacagctc

SEQ ID NO: 376857 - DNA, 14 bp, Homo sapiens
aactgcacagtgct

SEQ ID NO: 376858 - DNA, 16 bp, Homo sapiens
aactgcacagtgctgt

SEQ ID NO: 376859 - DNA, 18 bp, Homo sapiens
aactgcacagtgctgttg

SEQ ID NO: 376860 - DNA, 21 bp, Homo sapiens
aactgcatggacctaacattc

SEQ ID NO: 376861 - DNA, 18 bp, Homo sapiens
aactgcatgtataaatga

SEQ ID NO: 376862 - DNA, 16 bp, Homo sapiens
aactgcccccaacttt

SEQ ID NO: 376863 - DNA, 14 bp, Homo sapiens
aactgcccccactg

SEQ ID NO: 376864 - DNA, 21 bp, Homo sapiens
aactgcccttttaaatggcat

SEQ ID NO: 376865 - DNA, 10 bp, Homo sapiens
aactgctgag

SEQ ID NO: 376866 - DNA, 12 bp, Homo sapiens
aactgctgagcc

SEQ ID NO: 376867 - DNA, 13 bp, Homo sapiens
aactgctgagcca

SEQ ID NO: 376868 - DNA, 21 bp, Homo sapiens
aactgctgttttatgtcatac

SEQ ID NO: 376869 - DNA, 19 bp, Homo sapiens
aactggaacggtgaaggtg

SEQ ID NO: 376870 - DNA, 13 bp, Homo sapiens
aactggccccagg

SEQ ID NO: 376871 - DNA, 16 bp, Homo sapiens
aactgggaagatgctg

SEQ ID NO: 376872 - DNA, 23 bp, Homo sapiens
aactggggtgatgttttactttt

SEQ ID NO: 376873 - DNA, 15 bp, Homo sapiens
aactgtaaaatactt

SEQ ID NO: 376874 - DNA, 13 bp, Homo sapiens
aactgtaaataca

SEQ ID NO: 376875 - DNA, 16 bp, Homo sapiens
aactgtagaaatgatg

SEQ ID NO: 376876 - DNA, 17 bp, Homo sapiens
aactgtatcaaatctgt

SEQ ID NO: 376877 - DNA, 14 bp, Homo sapiens
aactgtatgtctta

SEQ ID NO: 376878 - DNA, 23 bp, Homo sapiens
aactgtatgtcttataagaaaac

SEQ ID NO: 376879 - DNA, 17 bp, Homo sapiens
aactgtcccacaaaata

SEQ ID NO: 376880 - DNA, 21 bp, Homo sapiens
aactgtcctctttcagaaaac

SEQ ID NO: 376881 - DNA, 19 bp, Homo sapiens
aactgtgaagtttacattg

SEQ ID NO: 376882 - DNA, 15 bp, Homo sapiens
aactgtgacaggaag

SEQ ID NO: 376883 - DNA, 17 bp, Homo sapiens
aactgtgacattccaca

SEQ ID NO: 376884 - DNA, 22 bp, Homo sapiens
aactgtgtaactgcccaaagca

SEQ ID NO: 376885 - DNA, 15 bp, Homo sapiens
aactgttagatgctg

SEQ ID NO: 376886 - DNA, 21 bp, Homo sapiens
aactgttctctattagacttt

SEQ ID NO: 376887 - DNA, 21 bp, Homo sapiens
aactgttctggcctcagacca

SEQ ID NO: 376888 - DNA, 17 bp, Homo sapiens
aactgttggataataac

SEQ ID NO: 376889 - DNA, 15 bp, Homo sapiens
aactgttggctgctc

SEQ ID NO: 376890 - DNA, 18 bp, Homo sapiens
aactgttgtttgatgtgt

SEQ ID NO: 376891 - DNA, 19 bp, Homo sapiens
aactgttgtttgatgtgta

SEQ ID NO: 376892 - DNA, 14 bp, Homo sapiens
aactgtttttgaag

SEQ ID NO: 376893 - DNA, 13 bp, Homo sapiens
aacttaaaaatgt

SEQ ID NO: 376894 - DNA, 21 bp, Homo sapiens
aacttaaaaatgtaaatattc

SEQ ID NO: 376895 - DNA, 14 bp, Homo sapiens
aacttaaataattt

SEQ ID NO: 376896 - DNA, 14 bp, Homo sapiens
aacccccctcccca

SEQ ID NO: 376897 - DNA, 20 bp, Homo sapiens
aaccccgcggtgctctggcg

SEQ ID NO: 376898 - DNA, 21 bp, Homo sapiens
aaccccgcggtgctctggcgg

SEQ ID NO: 376899 - DNA, 12 bp, Homo sapiens
aacccctgcctg

SEQ ID NO: 376900 - DNA, 17 bp, Homo sapiens
aacccctgtacccagct

SEQ ID NO: 376901 - DNA, 15 bp, Homo sapiens
aaccctataaaagtg

SEQ ID NO: 376902 - DNA, 21 bp, Homo sapiens
aaccctccacctcctctcttg

SEQ ID NO: 376903 - DNA, 13 bp, Homo sapiens
aaccctccctcag

SEQ ID NO: 376904 - DNA, 15 bp, Homo sapiens
aaccctccctcagcc

SEQ ID NO: 376905 - DNA, 16 bp, Homo sapiens
aaccctccctcagccc

SEQ ID NO: 376906 - DNA, 17 bp, Homo sapiens
aaccctccctcagcccc

SEQ ID NO: 376907 - DNA, 18 bp, Homo sapiens
aaccctccctcagcccct

SEQ ID NO: 376908 - DNA, 15 bp, Homo sapiens
aaccctgccctgcac

SEQ ID NO: 376909 - DNA, 15 bp, Homo sapiens
aaccctgcttctgct

SEQ ID NO: 376910 - DNA, 22 bp, Homo sapiens
aaccctgcttctgctgccctga

SEQ ID NO: 376911 - DNA, 16 bp, Homo sapiens
aacccttttggccccc

SEQ ID NO: 376912 - DNA, 23 bp, Homo sapiens
aaccgagccagcagctgaagtct

SEQ ID NO: 376913 - DNA, 13 bp, Homo sapiens
aaccgatgctcca

SEQ ID NO: 376914 - DNA, 17 bp, Homo sapiens
aaccgatgctccagcca

SEQ ID NO: 376915 - DNA, 22 bp, Homo sapiens
aaccgcatctgctcatctgata

SEQ ID NO: 376916 - DNA, 15 bp, Homo sapiens
aaccggcaacctgta

SEQ ID NO: 376917 - DNA, 16 bp, Homo sapiens
aaccggcaacctgtaa

SEQ ID NO: 376918 - DNA, 18 bp, Homo sapiens
aaccggcaacctgtaact

SEQ ID NO: 376919 - DNA, 15 bp, Homo sapiens
aaccgggaaaggcat

SEQ ID NO: 376920 - DNA, 23 bp, Homo sapiens
aaccgtgagcaggaaggcctggg

SEQ ID NO: 376921 - DNA, 19 bp, Homo sapiens
aaccgtgcaacgtgtaact

SEQ ID NO: 376922 - DNA, 22 bp, Homo sapiens
aacctaaataaacacatagatt

SEQ ID NO: 376923 - DNA, 22 bp, Homo sapiens
aacctaaatttggttctaggcc

SEQ ID NO: 376924 - DNA, 15 bp, Homo sapiens
aacctacctgtgaat

SEQ ID NO: 376925 - DNA, 15 bp, Homo sapiens
aacctagatgtttaa

SEQ ID NO: 376926 - DNA, 22 bp, Homo sapiens
aacctaggatggatagaaggaa

SEQ ID NO: 376927 - DNA, 21 bp, Homo sapiens
aacctagtactctctgctcta

SEQ ID NO: 376928 - DNA, 14 bp, Homo sapiens
aacctatttgactg

SEQ ID NO: 376929 - DNA, 15 bp, Homo sapiens
aacctcaatgccctg

SEQ ID NO: 376930 - DNA, 23 bp, Homo sapiens
aacctcactgccctccctcggcc

SEQ ID NO: 376931 - DNA, 22 bp, Homo sapiens
aacctcagacttaccaggaagc

SEQ ID NO: 376932 - DNA, 21 bp, Homo sapiens
aacctcagctctgggagagga

SEQ ID NO: 376933 - DNA, 16 bp, Homo sapiens
aacctcaggttccaaa

SEQ ID NO: 376934 - DNA, 13 bp, Homo sapiens
aacctcagtgtca

SEQ ID NO: 376935 - DNA, 18 bp, Homo sapiens
aacctcagtgtcatttat

SEQ ID NO: 376936 - DNA, 19 bp, Homo sapiens
aacctcagtgtcatttatg

SEQ ID NO: 376937 - DNA, 11 bp, Homo sapiens
aacctcattaa

SEQ ID NO: 376938 - DNA, 19 bp, Homo sapiens
aacctcggcttgtgggctg

SEQ ID NO: 376939 - DNA, 23 bp, Homo sapiens
aacctctatatctttaaataaat

SEQ ID NO: 376940 - DNA, 15 bp, Homo sapiens
aacctctcagatccc

SEQ ID NO: 376941 - DNA, 19 bp, Homo sapiens
aacctctcagatccctcgg

SEQ ID NO: 376942 - DNA, 18 bp, Homo sapiens
aacctctttcctctctgg

SEQ ID NO: 376943 - DNA, 11 bp, Homo sapiens
aacctgaaaaa

SEQ ID NO: 376944 - DNA, 21 bp, Homo sapiens
aacctgaaaaaaagtttacaa

SEQ ID NO: 376945 - DNA, 17 bp, Homo sapiens
aacctgcacttcatatc

SEQ ID NO: 376946 - DNA, 17 bp, Homo sapiens
aacctgcagttcctgag

SEQ ID NO: 376947 - DNA, 15 bp, Homo sapiens
aacctgccacaatgt

SEQ ID NO: 376948 - DNA, 17 bp, Homo sapiens
aacctgccacaatgtga

SEQ ID NO: 376949 - DNA, 22 bp, Homo sapiens
aacctgcccctccccagccctt

SEQ ID NO: 376950 - DNA, 15 bp, Homo sapiens
aacctgccctgcctg

SEQ ID NO: 376951 - DNA, 15 bp, Homo sapiens
aacctgctctcctct

SEQ ID NO: 376952 - DNA, 20 bp, Homo sapiens
aacctgctctcctcttgcca

SEQ ID NO: 376953 - DNA, 22 bp, Homo sapiens
aacctggctgcgaactgtgcag

SEQ ID NO: 376954 - DNA, 23 bp, Homo sapiens
aacctggtcacaggactctgcct

SEQ ID NO: 376955 - DNA, 16 bp, Homo sapiens
aacctgtaaattattt

SEQ ID NO: 376956 - DNA, 17 bp, Homo sapiens
aacctgtaaattatttt

SEQ ID NO: 376957 - DNA, 14 bp, Homo sapiens
aacctgtaactgcc

SEQ ID NO: 376958 - DNA, 12 bp, Homo sapiens
aacctgtgtctc

SEQ ID NO: 376959 - DNA, 18 bp, Homo sapiens
aacctgttcaaaatgtta

SEQ ID NO: 376960 - DNA, 19 bp, Homo sapiens
aaccttaaagcaataagtt

SEQ ID NO: 376961 - DNA, 13 bp, Homo sapiens
aaccttcctgtct

SEQ ID NO: 376962 - DNA, 23 bp, Homo sapiens
aaccttctgcccatcctgtctgt

SEQ ID NO: 376963 - DNA, 16 bp, Homo sapiens
aaccttgagacagctt

SEQ ID NO: 376964 - DNA, 17 bp, Homo sapiens
aaccttgtttctttctg

SEQ ID NO: 376965 - DNA, 14 bp, Homo sapiens
aacctttattcttt

SEQ ID NO: 376966 - DNA, 18 bp, Homo sapiens
aacctttcaaatttcaca

SEQ ID NO: 376967 - DNA, 15 bp, Homo sapiens
aacctttgtgtaata

SEQ ID NO: 376968 - DNA, 22 bp, Homo sapiens
aaccttttaaaaaaataatata

SEQ ID NO: 376969 - DNA, 23 bp, Homo sapiens
aaccttttatcaataaagcacta

SEQ ID NO: 376970 - DNA, 16 bp, Homo sapiens
aaccttttgagtgcct

SEQ ID NO: 376971 - DNA, 18 bp, Homo sapiens
aacctttttttttgaaac

SEQ ID NO: 376972 - DNA, 15 bp, Homo sapiens
aacgaaactgctcta

SEQ ID NO: 376973 - DNA, 13 bp, Homo sapiens
aacgaagaaaaaa

SEQ ID NO: 376974 - DNA, 14 bp, Homo sapiens
aacgagcactggcc

SEQ ID NO: 376975 - DNA, 16 bp, Homo sapiens
aacgagcactggccag

SEQ ID NO: 376976 - DNA, 17 bp, Homo sapiens
aacgatcatatctgtat

SEQ ID NO: 376977 - DNA, 22 bp, Homo sapiens
aacgatgatgcttgtaacaaga

SEQ ID NO: 376978 - DNA, 12 bp, Homo sapiens
aacgatttagaa

SEQ ID NO: 376979 - DNA, 12 bp, Homo sapiens
aacgcagccctg

SEQ ID NO: 376980 - DNA, 14 bp, Homo sapiens
aacgcaggagagag

SEQ ID NO: 376981 - DNA, 16 bp, Homo sapiens
aacgcaggagagagag

SEQ ID NO: 376982 - DNA, 21 bp, Homo sapiens
aacgcatggagtgtgtattgt

SEQ ID NO: 376983 - DNA, 23 bp, Homo sapiens
aacgcatggagtgtgtattgttc

SEQ ID NO: 376984 - DNA, 15 bp, Homo sapiens
aacgccagtctccca

SEQ ID NO: 376985 - DNA, 20 bp, Homo sapiens
aacgccagtctcccaggccc

SEQ ID NO: 376986 - DNA, 20 bp, Homo sapiens
aacgcctgccttctgggcaa

SEQ ID NO: 376987 - DNA, 12 bp, Homo sapiens
aacgggttgtgt

SEQ ID NO: 376988 - DNA, 23 bp, Homo sapiens
aacggtgaaatctctagcctctt

SEQ ID NO: 376989 - DNA, 18 bp, Homo sapiens
aacgtcattcagtactta

SEQ ID NO: 376990 - DNA, 15 bp, Homo sapiens
aacgtccatctctct

SEQ ID NO: 376991 - DNA, 15 bp, Homo sapiens
aacgtgatgatcagc

SEQ ID NO: 376992 - DNA, 23 bp, Homo sapiens
aacgtgatgtgctcatcagaaac

SEQ ID NO: 376993 - DNA, 13 bp, Homo sapiens
aacgtgccctctg

SEQ ID NO: 376994 - DNA, 23 bp, Homo sapiens
aacgtgggagttcagctgcttct

SEQ ID NO: 376995 - DNA, 18 bp, Homo sapiens
aacgtggggcagcacaga

SEQ ID NO: 376996 - DNA, 23 bp, Homo sapiens
aacgtggttcagagactggcagc

SEQ ID NO: 376997 - DNA, 17 bp, Homo sapiens
aacgtgtatagtgccta

SEQ ID NO: 376998 - DNA, 16 bp, Homo sapiens
aacgttaaaagacagt

SEQ ID NO: 376999 - DNA, 18 bp, Homo sapiens
aacgttttgtttgaaaaa

SEQ ID NO: 377000 - DNA, 16 bp, Homo sapiens
aactaaaattcaacaa

SEQ ID NO: 377001 - DNA, 12 bp, Homo sapiens
aactaaagaata

SEQ ID NO: 377002 - DNA, 18 bp, Homo sapiens
aactaaagtatttaaaga

SEQ ID NO: 377003 - DNA, 19 bp, Homo sapiens
aactaaataacacagatat

SEQ ID NO: 377004 - DNA, 20 bp, Homo sapiens
aactaaatagatttttagat

SEQ ID NO: 377005 - DNA, 16 bp, Homo sapiens
aactaacaatgccttg

SEQ ID NO: 377006 - DNA, 15 bp, Homo sapiens
aactaagcaagtata

SEQ ID NO: 377007 - DNA, 21 bp, Homo sapiens
aactaagttttgtgtgtatat

SEQ ID NO: 377008 - DNA, 20 bp, Homo sapiens
aactaatgtgatatgaaaat

SEQ ID NO: 377009 - DNA, 23 bp, Homo sapiens
aactaatttgaatgtggttactt

SEQ ID NO: 377010 - DNA, 20 bp, Homo sapiens
aactaatttggtttttactc

SEQ ID NO: 377011 - DNA, 15 bp, Homo sapiens
aactacatttatgag

SEQ ID NO: 377012 - DNA, 18 bp, Homo sapiens
aactactaagaataaata

SEQ ID NO: 377013 - DNA, 13 bp, Homo sapiens
aactactgtacat

SEQ ID NO: 377014 - DNA, 14 bp, Homo sapiens
aactactgtacatt

SEQ ID NO: 377015 - DNA, 16 bp, Homo sapiens
aactactgtacatttt

SEQ ID NO: 377016 - DNA, 15 bp, Homo sapiens
aactactgtgttcct

SEQ ID NO: 377017 - DNA, 19 bp, Homo sapiens
aactagaatttattcaatt

SEQ ID NO: 377018 - DNA, 22 bp, Homo sapiens
aactagataacttaaataattt

SEQ ID NO: 377019 - DNA, 17 bp, Homo sapiens
aactagatctcctattt

SEQ ID NO: 377020 - DNA, 20 bp, Homo sapiens
aactagatctcctatttttc

SEQ ID NO: 377021 - DNA, 23 bp, Homo sapiens
aactagatctcctatttttcaga

SEQ ID NO: 377022 - DNA, 14 bp, Homo sapiens
aactagcctcatct

SEQ ID NO: 377023 - DNA, 17 bp, Homo sapiens
aactagggttttggcct

SEQ ID NO: 377024 - DNA, 19 bp, Homo sapiens
aactagggttttggcctgc

SEQ ID NO: 377025 - DNA, 21 bp, Homo sapiens
aactagtgtttctgcagaggc

SEQ ID NO: 377026 - DNA, 16 bp, Homo sapiens
aactagttaaaagcct

SEQ ID NO: 377027 - DNA, 21 bp, Homo sapiens
aactatatttggagaaaacag

SEQ ID NO: 377028 - DNA, 20 bp, Homo sapiens
aactatggttcccaataaaa

SEQ ID NO: 377029 - DNA, 19 bp, Homo sapiens
aacagttgtaccactgcta

SEQ ID NO: 377030 - DNA, 22 bp, Homo sapiens
aacagttgtgaaccaagatcta

SEQ ID NO: 377031 - DNA, 22 bp, Homo sapiens
aacagtttatgcagtgctgctt

SEQ ID NO: 377032 - DNA, 11 bp, Homo sapiens
aacagttttcc

SEQ ID NO: 377033 - DNA, 14 bp, Homo sapiens
aacagttttccatg

SEQ ID NO: 377034 - DNA, 16 bp, Homo sapiens
aacagttttccatgaa

SEQ ID NO: 377035 - DNA, 21 bp, Homo sapiens
aacagttttttatgctaatca

SEQ ID NO: 377036 - DNA, 15 bp, Homo sapiens
aacataaaagtgcta

SEQ ID NO: 377037 - DNA, 14 bp, Homo sapiens
aacataaaatgagg

SEQ ID NO: 377038 - DNA, 18 bp, Homo sapiens
aacataaagaaacacttt

SEQ ID NO: 377039 - DNA, 15 bp, Homo sapiens
aacataacaaccttt

SEQ ID NO: 377040 - DNA, 15 bp, Homo sapiens
aacataatagaattt

SEQ ID NO: 377041 - DNA, 23 bp, Homo sapiens
aacataatagaatttcctaatga

SEQ ID NO: 377042 - DNA, 12 bp, Homo sapiens
aacataattaaa

SEQ ID NO: 377043 - DNA, 18 bp, Homo sapiens
aacatagagtagacctga

SEQ ID NO: 377044 - DNA, 17 bp, Homo sapiens
aacatagcccctgcccc

SEQ ID NO: 377045 - DNA, 19 bp, Homo sapiens
aacatataaattaatacat

SEQ ID NO: 377046 - DNA, 22 bp, Homo sapiens
aacatataaattaatacataag

SEQ ID NO: 377047 - DNA, 14 bp, Homo sapiens
aacatataatatat

SEQ ID NO: 377048 - DNA, 21 bp, Homo sapiens
aacatataatatatgttttaa

SEQ ID NO: 377049 - DNA, 21 bp, Homo sapiens
aacatataatgttgttattta

SEQ ID NO: 377050 - DNA, 13 bp, Homo sapiens
aacatatatgaaa

SEQ ID NO: 377051 - DNA, 17 bp, Homo sapiens
aacatatgaaaatacaa

SEQ ID NO: 377052 - DNA, 16 bp, Homo sapiens
aacatatgtacataaa

SEQ ID NO: 377053 - DNA, 20 bp, Homo sapiens
aacatatttcttgagtaatt

SEQ ID NO: 377054 - DNA, 22 bp, Homo sapiens
aacatatttcttgagtaattta

SEQ ID NO: 377055 - DNA, 13 bp, Homo sapiens
aacatcaaataaa

SEQ ID NO: 377056 - DNA, 15 bp, Homo sapiens
aacatcaaataaatt

SEQ ID NO: 377057 - DNA, 17 bp, Homo sapiens
aacatcaaataaatttc

SEQ ID NO: 377058 - DNA, 17 bp, Homo sapiens
aacatcaagataccttt

SEQ ID NO: 377059 - DNA, 13 bp, Homo sapiens
aacatcaatgttc

SEQ ID NO: 377060 - DNA, 19 bp, Homo sapiens
aacatcatcaggcttggaa

SEQ ID NO: 377061 - DNA, 17 bp, Homo sapiens
aacatccatataggatt

SEQ ID NO: 377062 - DNA, 17 bp, Homo sapiens
aacatcccaataaagtc

SEQ ID NO: 377063 - DNA, 22 bp, Homo sapiens
aacatcctatcaacaacaaggt

SEQ ID NO: 377064 - DNA, 12 bp, Homo sapiens
aacatctgaaaa

SEQ ID NO: 377065 - DNA, 13 bp, Homo sapiens
aacatctgaaaag

SEQ ID NO: 377066 - DNA, 14 bp, Homo sapiens
aacatctgaaaaga

SEQ ID NO: 377067 - DNA, 13 bp, Homo sapiens
aacatcttcatat

SEQ ID NO: 377068 - DNA, 17 bp, Homo sapiens
aacatcttcatataaac

SEQ ID NO: 377069 - DNA, 18 bp, Homo sapiens
aacatctttttcctccct

SEQ ID NO: 377070 - DNA, 21 bp, Homo sapiens
aacatgaaaaacacggcagct

SEQ ID NO: 377071 - DNA, 12 bp, Homo sapiens
aacatgaaaaca

SEQ ID NO: 377072 - DNA, 20 bp, Homo sapiens
aacatgaaaacattgatgaa

SEQ ID NO: 377073 - DNA, 21 bp, Homo sapiens
aacatgaaaacattgatgaat

SEQ ID NO: 377074 - DNA, 14 bp, Homo sapiens
aacatgaagaatgc

SEQ ID NO: 377075 - DNA, 22 bp, Homo sapiens
aacatgaattaagaactgacac

SEQ ID NO: 377076 - DNA, 15 bp, Homo sapiens
aacatgaatttaatg

SEQ ID NO: 377077 - DNA, 12 bp, Homo sapiens
aacatgagtgtc

SEQ ID NO: 377078 - DNA, 14 bp, Homo sapiens
aacatgctgtgtaa

SEQ ID NO: 377079 - DNA, 19 bp, Homo sapiens
aacatgctgtgtaagctgt

SEQ ID NO: 377080 - DNA, 15 bp, Homo sapiens
aacatggattccaaa

SEQ ID NO: 377081 - DNA, 22 bp, Homo sapiens
aacatggccaatagtcatatgt

SEQ ID NO: 377082 - DNA, 23 bp, Homo sapiens
aacatggcctttgcttgaaagaa

SEQ ID NO: 377083 - DNA, 22 bp, Homo sapiens
aacatgggcattgggttctaaa

SEQ ID NO: 377084 - DNA, 23 bp, Homo sapiens
aacatggggttggctgggcccag

SEQ ID NO: 377085 - DNA, 21 bp, Homo sapiens
aacatggtgtgtgtctctgac

SEQ ID NO: 377086 - DNA, 12 bp, Homo sapiens
aacatgtatgtg

SEQ ID NO: 377087 - DNA, 14 bp, Homo sapiens
aacattaaaagaag

SEQ ID NO: 377088 - DNA, 11 bp, Homo sapiens
aacattaaaca

SEQ ID NO: 377089 - DNA, 13 bp, Homo sapiens
aacattaaacact

SEQ ID NO: 377090 - DNA, 16 bp, Homo sapiens
aacattagaagaaaac

SEQ ID NO: 377091 - DNA, 15 bp, Homo sapiens
aacattcaaaagcac

SEQ ID NO: 377092 - DNA, 20 bp, Homo sapiens
aacattcacacagggctctt

SEQ ID NO: 377093 - DNA, 22 bp, Homo sapiens
aacattcatatttgcaataaaa

SEQ ID NO: 377094 - DNA, 20 bp, Homo sapiens
aacattcctcatgaatgtaa

SEQ ID NO: 377095 - DNA, 22 bp, Homo sapiens
aacattcctcatgaatgtaaat

SEQ ID NO: 377096 - DNA, 19 bp, Homo sapiens
aacattgaagtaatgaatt

SEQ ID NO: 377097 - DNA, 23 bp, Homo sapiens
aacattgcactttataaacactg

SEQ ID NO: 377098 - DNA, 15 bp, Homo sapiens
aacatttacagtcct

SEQ ID NO: 377099 - DNA, 16 bp, Homo sapiens
aacatttgacacataa

SEQ ID NO: 377100 - DNA, 22 bp, Homo sapiens
aacatttggaaaccatgcacta

SEQ ID NO: 377101 - DNA, 21 bp, Homo sapiens
aacatttgggacctggataat

SEQ ID NO: 377102 - DNA, 23 bp, Homo sapiens
aacatttgtaatttttttctagt

SEQ ID NO: 377103 - DNA, 20 bp, Homo sapiens
aacattttaaataaaagaaa

SEQ ID NO: 377104 - DNA, 11 bp, Homo sapiens
aaccaaaacag

SEQ ID NO: 377105 - DNA, 16 bp, Homo sapiens
aaccaaaacccatcgt

SEQ ID NO: 377106 - DNA, 19 bp, Homo sapiens
aaccaaattaaaaattttt

SEQ ID NO: 377107 - DNA, 14 bp, Homo sapiens
aaccaactgcctta

SEQ ID NO: 377108 - DNA, 21 bp, Homo sapiens
aaccaacttggttctgcttca

SEQ ID NO: 377109 - DNA, 13 bp, Homo sapiens
aaccaagcagctt

SEQ ID NO: 377110 - DNA, 16 bp, Homo sapiens
aaccaagccgtggctt

SEQ ID NO: 377111 - DNA, 13 bp, Homo sapiens
aaccaagccttgg

SEQ ID NO: 377112 - DNA, 11 bp, Homo sapiens
aaccaagctgt

SEQ ID NO: 377113 - DNA, 14 bp, Homo sapiens
aaccaaggcagcct

SEQ ID NO: 377114 - DNA, 22 bp, Homo sapiens
aaccaaggcagcctccagagcc

SEQ ID NO: 377115 - DNA, 18 bp, Homo sapiens
aaccaatcccgtgaaaga

SEQ ID NO: 377116 - DNA, 19 bp, Homo sapiens
aaccaatgattcataacaa

SEQ ID NO: 377117 - DNA, 23 bp, Homo sapiens
aaccaatgattcataacaatgta

SEQ ID NO: 377118 - DNA, 15 bp, Homo sapiens
aaccacacttcttga

SEQ ID NO: 377119 - DNA, 13 bp, Homo sapiens
aaccacagccctg

SEQ ID NO: 377120 - DNA, 13 bp, Homo sapiens
aaccaccctgagg

SEQ ID NO: 377121 - DNA, 19 bp, Homo sapiens
aaccaccgcatatgcatgc

SEQ ID NO: 377122 - DNA, 20 bp, Homo sapiens
aaccaccgcatatgcatgcc

SEQ ID NO: 377123 - DNA, 23 bp, Homo sapiens
aaccaccgcatatgcatgccagg

SEQ ID NO: 377124 - DNA, 18 bp, Homo sapiens
aaccaccgctccccagcc

SEQ ID NO: 377125 - DNA, 22 bp, Homo sapiens
aaccactaatgcttgccaagaa

SEQ ID NO: 377126 - DNA, 14 bp, Homo sapiens
aaccactgcaacgg

SEQ ID NO: 377127 - DNA, 15 bp, Homo sapiens
aaccactgtaaaatg

SEQ ID NO: 377128 - DNA, 17 bp, Homo sapiens
aaccactttttgcagct

SEQ ID NO: 377129 - DNA, 18 bp, Homo sapiens
aaccagagccatggactc

SEQ ID NO: 377130 - DNA, 11 bp, Homo sapiens
aaccagcaggt

SEQ ID NO: 377131 - DNA, 15 bp, Homo sapiens
aaccagccctccaga

SEQ ID NO: 377132 - DNA, 18 bp, Homo sapiens
aaccagctattggaacag

SEQ ID NO: 377133 - DNA, 15 bp, Homo sapiens
aaccagctctttggt

SEQ ID NO: 377134 - DNA, 15 bp, Homo sapiens
aaccaggactctgcc

SEQ ID NO: 377135 - DNA, 22 bp, Homo sapiens
aaccaggagcattttgtgtctt

SEQ ID NO: 377136 - DNA, 17 bp, Homo sapiens
aaccaggccccagcctc

SEQ ID NO: 377137 - DNA, 20 bp, Homo sapiens
aaccagtaagtatgggagtc

SEQ ID NO: 377138 - DNA, 17 bp, Homo sapiens
aaccagtcttctccctg

SEQ ID NO: 377139 - DNA, 18 bp, Homo sapiens
aaccagtttcaggtgttt

SEQ ID NO: 377140 - DNA, 17 bp, Homo sapiens
aaccataaaataaataa

SEQ ID NO: 377141 - DNA, 23 bp, Homo sapiens
aaccatatgattgaaaagaagaa

SEQ ID NO: 377142 - DNA, 13 bp, Homo sapiens
aaccatctggcct

SEQ ID NO: 377143 - DNA, 15 bp, Homo sapiens
aaccatctggcctgg

SEQ ID NO: 377144 - DNA, 17 bp, Homo sapiens
aaccatctggcctggcc

SEQ ID NO: 377145 - DNA, 12 bp, Homo sapiens
aaccatgactgt

SEQ ID NO: 377146 - DNA, 13 bp, Homo sapiens
aaccattactgta

SEQ ID NO: 377147 - DNA, 12 bp, Homo sapiens
aaccattgcttc

SEQ ID NO: 377148 - DNA, 23 bp, Homo sapiens
aaccattgcttcactacccatcg

SEQ ID NO: 377149 - DNA, 17 bp, Homo sapiens
aaccattgttcagaaga

SEQ ID NO: 377150 - DNA, 17 bp, Homo sapiens
aacccaagtggaatcat

SEQ ID NO: 377151 - DNA, 17 bp, Homo sapiens
aacccaggacgcttctg

SEQ ID NO: 377152 - DNA, 15 bp, Homo sapiens
aacccatgccctgcc

SEQ ID NO: 377153 - DNA, 17 bp, Homo sapiens
aacccattaatcttttg

SEQ ID NO: 377154 - DNA, 20 bp, Homo sapiens
aacccatttgccatgctgct

SEQ ID NO: 377155 - DNA, 22 bp, Homo sapiens
aaccccaaaatgaagattattt

SEQ ID NO: 377156 - DNA, 15 bp, Homo sapiens
aaccccaactcccag

SEQ ID NO: 377157 - DNA, 19 bp, Homo sapiens
aaccccaactcccagccta

SEQ ID NO: 377158 - DNA, 14 bp, Homo sapiens
aaccccacttccat

SEQ ID NO: 377159 - DNA, 19 bp, Homo sapiens
aaccccacttccattgtat

SEQ ID NO: 377160 - DNA, 15 bp, Homo sapiens
aaccccagcctgacc

SEQ ID NO: 377161 - DNA, 21 bp, Homo sapiens
aaccccagcctgacctgagac

SEQ ID NO: 377162 - DNA, 13 bp, Homo sapiens
aacccccctccca

SEQ ID NO: 377163 - DNA, 16 bp, Homo sapiens
aacaagaaagtttccc

SEQ ID NO: 377164 - DNA, 14 bp, Homo sapiens
aacaagaatactga

SEQ ID NO: 377165 - DNA, 18 bp, Homo sapiens
aacaagaatattgtatgt

SEQ ID NO: 377166 - DNA, 14 bp, Homo sapiens
aacaagatttccct

SEQ ID NO: 377167 - DNA, 21 bp, Homo sapiens
aacaagccaaacattcttatt

SEQ ID NO: 377168 - DNA, 20 bp, Homo sapiens
aacaaggaatgcctgtgcca

SEQ ID NO: 377169 - DNA, 21 bp, Homo sapiens
aacaaggcaaggctgtcaatt

SEQ ID NO: 377170 - DNA, 23 bp, Homo sapiens
aacaaggcaaggctgtcaattac

SEQ ID NO: 377171 - DNA, 20 bp, Homo sapiens
aacaagggagagacctcatc

SEQ ID NO: 377172 - DNA, 19 bp, Homo sapiens
aacaagggtggcatcccag

SEQ ID NO: 377173 - DNA, 17 bp, Homo sapiens
aacaagtcacagctgca

SEQ ID NO: 377174 - DNA, 20 bp, Homo sapiens
aacaagtcacagctgcagct

SEQ ID NO: 377175 - DNA, 21 bp, Homo sapiens
aacaagtcacagctgcagctg

SEQ ID NO: 377176 - DNA, 17 bp, Homo sapiens
aacaagtgcctcctgga

SEQ ID NO: 377177 - DNA, 13 bp, Homo sapiens
aacaagtgtacag

SEQ ID NO: 377178 - DNA, 14 bp, Homo sapiens
aacaagtgtacaga

SEQ ID NO: 377179 - DNA, 18 bp, Homo sapiens
aacaagtgtacagaagaa

SEQ ID NO: 377180 - DNA, 20 bp, Homo sapiens
aacaagtgtacagaagaatt

SEQ ID NO: 377181 - DNA, 17 bp, Homo sapiens
aacaagtttagaaagct

SEQ ID NO: 377182 - DNA, 14 bp, Homo sapiens
aacaataataaatg

SEQ ID NO: 377183 - DNA, 14 bp, Homo sapiens
aacaatatgcttta

SEQ ID NO: 377184 - DNA, 15 bp, Homo sapiens
aacaatatgctttac

SEQ ID NO: 377185 - DNA, 23 bp, Homo sapiens
aacaatcaaagcacttggactct

SEQ ID NO: 377186 - DNA, 18 bp, Homo sapiens
aacaatcaaggcaactag

SEQ ID NO: 377187 - DNA, 20 bp, Homo sapiens
aacaatcacaaaagctgtgt

SEQ ID NO: 377188 - DNA, 23 bp, Homo sapiens
aacaatccaaatgcattcatgtt

SEQ ID NO: 377189 - DNA, 18 bp, Homo sapiens
aacaatcccaatctttct

SEQ ID NO: 377190 - DNA, 19 bp, Homo sapiens
aacaatcccaatctttcta

SEQ ID NO: 377191 - DNA, 19 bp, Homo sapiens
aacaatgcatgctttggaa

SEQ ID NO: 377192 - DNA, 16 bp, Homo sapiens
aacaatgccttgttgt

SEQ ID NO: 377193 - DNA, 23 bp, Homo sapiens
aacaatgccttgttgtattcctg

SEQ ID NO: 377194 - DNA, 11 bp, Homo sapiens
aacaatgtgtg

SEQ ID NO: 377195 - DNA, 15 bp, Homo sapiens
aacaatgtttgtcat

SEQ ID NO: 377196 - DNA, 15 bp, Homo sapiens
aacaattgtgttttc

SEQ ID NO: 377197 - DNA, 20 bp, Homo sapiens
aacaatttaggaatgctcaa

SEQ ID NO: 377198 - DNA, 22 bp, Homo sapiens
aacaatttattttattttagca

SEQ ID NO: 377199 - DNA, 19 bp, Homo sapiens
aacaatttgcataatacta

SEQ ID NO: 377200 - DNA, 14 bp, Homo sapiens
aacaattttctgca

SEQ ID NO: 377201 - DNA, 19 bp, Homo sapiens
aacacaaagcggggggagg

SEQ ID NO: 377202 - DNA, 15 bp, Homo sapiens
aacacaaatgtgtac

SEQ ID NO: 377203 - DNA, 17 bp, Homo sapiens
aacacaaatgtgtactt

SEQ ID NO: 377204 - DNA, 17 bp, Homo sapiens
aacacaagcaaaccttc

SEQ ID NO: 377205 - DNA, 19 bp, Homo sapiens
aacacaagcaaaccttctc

SEQ ID NO: 377206 - DNA, 13 bp, Homo sapiens
aacacaatgttat

SEQ ID NO: 377207 - DNA, 20 bp, Homo sapiens
aacacacaaaagattatgta

SEQ ID NO: 377208 - DNA, 23 bp, Homo sapiens
aacacacacacacgcagacacac

SEQ ID NO: 377209 - DNA, 12 bp, Homo sapiens
aacacacagaca

SEQ ID NO: 377210 - DNA, 15 bp, Homo sapiens
aacacaccaggctgt

SEQ ID NO: 377211 - DNA, 17 bp, Homo sapiens
aacacagcatgtgccaa

SEQ ID NO: 377212 - DNA, 19 bp, Homo sapiens
aacacagctgagagacttt

SEQ ID NO: 377213 - DNA, 17 bp, Homo sapiens
aacacagggttttgtat

SEQ ID NO: 377214 - DNA, 20 bp, Homo sapiens
aacacagttttgaaagaaaa

SEQ ID NO: 377215 - DNA, 23 bp, Homo sapiens
aacacataaagtaaatgctacct

SEQ ID NO: 377216 - DNA, 13 bp, Homo sapiens
aacacatggcaga

SEQ ID NO: 377217 - DNA, 18 bp, Homo sapiens
aacacattgaatgcgctt

SEQ ID NO: 377218 - DNA, 19 bp, Homo sapiens
aacacattgaatgcgcttt

SEQ ID NO: 377219 - DNA, 18 bp, Homo sapiens
aacacatttgattctgtg

SEQ ID NO: 377220 - DNA, 12 bp, Homo sapiens
aacaccacactg

SEQ ID NO: 377221 - DNA, 14 bp, Homo sapiens
aacaccacactgac

SEQ ID NO: 377222 - DNA, 16 bp, Homo sapiens
aacaccacactgacca

SEQ ID NO: 377223 - DNA, 12 bp, Homo sapiens
aacaccaggact

SEQ ID NO: 377224 - DNA, 13 bp, Homo sapiens
aacacccaagtcc

SEQ ID NO: 377225 - DNA, 15 bp, Homo sapiens
aacacccaagtccac

SEQ ID NO: 377226 - DNA, 19 bp, Homo sapiens
aacacccgccccccccatg

SEQ ID NO: 377227 - DNA, 16 bp, Homo sapiens
aacacccggaaagact

SEQ ID NO: 377228 - DNA, 20 bp, Homo sapiens
aacacctgtggataaaacat

SEQ ID NO: 377229 - DNA, 16 bp, Homo sapiens
aacactatgtttattt

SEQ ID NO: 377230 - DNA, 13 bp, Homo sapiens
aacactcagctgt

SEQ ID NO: 377231 - DNA, 14 bp, Homo sapiens
aacactcagctgtt

SEQ ID NO: 377232 - DNA, 16 bp, Homo sapiens
aacactcgtgtgcatg

SEQ ID NO: 377233 - DNA, 23 bp, Homo sapiens
aacactcgtgtgcatgagaatgt

SEQ ID NO: 377234 - DNA, 21 bp, Homo sapiens
aacactctctgagatgcccct

SEQ ID NO: 377235 - DNA, 13 bp, Homo sapiens
aacactggcccct

SEQ ID NO: 377236 - DNA, 15 bp, Homo sapiens
aacactggcccctag

SEQ ID NO: 377237 - DNA, 23 bp, Homo sapiens
aacactggtggaggatggaaagg

SEQ ID NO: 377238 - DNA, 19 bp, Homo sapiens
aacactgtaatatctttaa

SEQ ID NO: 377239 - DNA, 13 bp, Homo sapiens
aacactgtactga

SEQ ID NO: 377240 - DNA, 14 bp, Homo sapiens
aacactgtattgta

SEQ ID NO: 377241 - DNA, 22 bp, Homo sapiens
aacacttaagggttttagaaaa

SEQ ID NO: 377242 - DNA, 19 bp, Homo sapiens
aacacttattgctttgaaa

SEQ ID NO: 377243 - DNA, 11 bp, Homo sapiens
aacacttccat

SEQ ID NO: 377244 - DNA, 20 bp, Homo sapiens
aacacttgtgttgctttctg

SEQ ID NO: 377245 - DNA, 16 bp, Homo sapiens
aacagaaaaaaaacac

SEQ ID NO: 377246 - DNA, 13 bp, Homo sapiens
aacagaaaacaac

SEQ ID NO: 377247 - DNA, 20 bp, Homo sapiens
aacagaaaagagaagaaaga

SEQ ID NO: 377248 - DNA, 15 bp, Homo sapiens
aacagaacatttctc

SEQ ID NO: 377249 - DNA, 16 bp, Homo sapiens
aacagaactcgatgca

SEQ ID NO: 377250 - DNA, 22 bp, Homo sapiens
aacagaatattgacaagctagg

SEQ ID NO: 377251 - DNA, 15 bp, Homo sapiens
aacagacactacatt

SEQ ID NO: 377252 - DNA, 22 bp, Homo sapiens
aacagacctcactgctttgtag

SEQ ID NO: 377253 - DNA, 18 bp, Homo sapiens
aacagacctcggctgtgt

SEQ ID NO: 377254 - DNA, 22 bp, Homo sapiens
aacagactcgatgcaagtgttt

SEQ ID NO: 377255 - DNA, 13 bp, Homo sapiens
aacagaggcagga

SEQ ID NO: 377256 - DNA, 20 bp, Homo sapiens
aacagaggcaggagtggcag

SEQ ID NO: 377257 - DNA, 20 bp, Homo sapiens
aacagagtagttttggtttt

SEQ ID NO: 377258 - DNA, 18 bp, Homo sapiens
aacagagtatatatgtac

SEQ ID NO: 377259 - DNA, 21 bp, Homo sapiens
aacagagtatatatgtacagt

SEQ ID NO: 377260 - DNA, 16 bp, Homo sapiens
aacagatggctgtgaa

SEQ ID NO: 377261 - DNA, 15 bp, Homo sapiens
aacagatgtccctga

SEQ ID NO: 377262 - DNA, 18 bp, Homo sapiens
aacagcactggctctctc

SEQ ID NO: 377263 - DNA, 20 bp, Homo sapiens
aacagcactggctctctcca

SEQ ID NO: 377264 - DNA, 18 bp, Homo sapiens
aacagcatcaaaatacaa

SEQ ID NO: 377265 - DNA, 15 bp, Homo sapiens
aacagcatgtctact

SEQ ID NO: 377266 - DNA, 22 bp, Homo sapiens
aacagccgtcagccaaatgtaa

SEQ ID NO: 377267 - DNA, 23 bp, Homo sapiens
aacagcctgtttgggaggctgga

SEQ ID NO: 377268 - DNA, 12 bp, Homo sapiens
aacagccttagc

SEQ ID NO: 377269 - DNA, 21 bp, Homo sapiens
aacagcgggagacctgtgcta

SEQ ID NO: 377270 - DNA, 22 bp, Homo sapiens
aacagcgtgtcaactttcattt

SEQ ID NO: 377271 - DNA, 18 bp, Homo sapiens
aacagctatgggagcccc

SEQ ID NO: 377272 - DNA, 22 bp, Homo sapiens
aacagctatgggagccccaggg

SEQ ID NO: 377273 - DNA, 19 bp, Homo sapiens
aacagcttcttgcttgtaa

SEQ ID NO: 377274 - DNA, 16 bp, Homo sapiens
aacagctttcaagtgc

SEQ ID NO: 377275 - DNA, 16 bp, Homo sapiens
aacaggaaaaaaactt

SEQ ID NO: 377276 - DNA, 22 bp, Homo sapiens
aacaggaaaaaaacttttataa

SEQ ID NO: 377277 - DNA, 14 bp, Homo sapiens
aacaggaaaagaaa

SEQ ID NO: 377278 - DNA, 22 bp, Homo sapiens
aacaggaagatcttaaattttg

SEQ ID NO: 377279 - DNA, 16 bp, Homo sapiens
aacaggaccaggagcc

SEQ ID NO: 377280 - DNA, 16 bp, Homo sapiens
aacaggattagacagt

SEQ ID NO: 377281 - DNA, 19 bp, Homo sapiens
aacaggcattgcactaaaa

SEQ ID NO: 377282 - DNA, 22 bp, Homo sapiens
aacaggcattgcactaaaagtg

SEQ ID NO: 377283 - DNA, 21 bp, Homo sapiens
aacaggctcaatattcctgaa

SEQ ID NO: 377284 - DNA, 17 bp, Homo sapiens
aacagggcccaggcctg

SEQ ID NO: 377285 - DNA, 13 bp, Homo sapiens
aacaggggctggt

SEQ ID NO: 377286 - DNA, 15 bp, Homo sapiens
aacagggtaaattat

SEQ ID NO: 377287 - DNA, 16 bp, Homo sapiens
aacagggtaaattatt

SEQ ID NO: 377288 - DNA, 16 bp, Homo sapiens
aacaggttttataatt

SEQ ID NO: 377289 - DNA, 14 bp, Homo sapiens
aacagtaaaggcca

SEQ ID NO: 377290 - DNA, 13 bp, Homo sapiens
aacagtacatttt

SEQ ID NO: 377291 - DNA, 12 bp, Homo sapiens
aacagtgaattt

SEQ ID NO: 377292 - DNA, 20 bp, Homo sapiens
aacagtgaatttaagcatga

SEQ ID NO: 377293 - DNA, 23 bp, Homo sapiens
aacagtgattaaagcaagagaat

SEQ ID NO: 377294 - DNA, 19 bp, Homo sapiens
aacagtgggagccctgacc

SEQ ID NO: 377295 - DNA, 17 bp, Homo sapiens
aacagtgtggatgtaaa

SEQ ID NO: 377296 - DNA, 22 bp, Homo sapiens
aaatcctagagattcttagctc

SEQ ID NO: 377297 - DNA, 14 bp, Homo sapiens
aaatcgattggctt

SEQ ID NO: 377298 - DNA, 15 bp, Homo sapiens
aaatcgattggcttt

SEQ ID NO: 377299 - DNA, 21 bp, Homo sapiens
aaatcgctgctcaaaaatgat

SEQ ID NO: 377300 - DNA, 15 bp, Homo sapiens
aaatctaaattaact

SEQ ID NO: 377301 - DNA, 17 bp, Homo sapiens
aaatctaatattaaaaa

SEQ ID NO: 377302 - DNA, 19 bp, Homo sapiens
aaatctaatctcttattct

SEQ ID NO: 377303 - DNA, 19 bp, Homo sapiens
aaatctagacatagatcct

SEQ ID NO: 377304 - DNA, 19 bp, Homo sapiens
aaatctattcagacaagca

SEQ ID NO: 377305 - DNA, 17 bp, Homo sapiens
aaatctcctcttttgta

SEQ ID NO: 377306 - DNA, 15 bp, Homo sapiens
aaatctctaatatgg

SEQ ID NO: 377307 - DNA, 15 bp, Homo sapiens
aaatctctagcctct

SEQ ID NO: 377308 - DNA, 17 bp, Homo sapiens
aaatctctctctgttgt

SEQ ID NO: 377309 - DNA, 20 bp, Homo sapiens
aaatctgaactctcaaaagt

SEQ ID NO: 377310 - DNA, 21 bp, Homo sapiens
aaatctgtccaaaggaggctg

SEQ ID NO: 377311 - DNA, 19 bp, Homo sapiens
aaatctgtctgattctatg

SEQ ID NO: 377312 - DNA, 20 bp, Homo sapiens
aaatctgtctgattctatgc

SEQ ID NO: 377313 - DNA, 23 bp, Homo sapiens
aaatctgtctgattctatgcctg

SEQ ID NO: 377314 - DNA, 19 bp, Homo sapiens
aaatctgtgatgatcctca

SEQ ID NO: 377315 - DNA, 18 bp, Homo sapiens
aaatctgtttgatccctg

SEQ ID NO: 377316 - DNA, 21 bp, Homo sapiens
aaatcttaagattacaagata

SEQ ID NO: 377317 - DNA, 16 bp, Homo sapiens
aaatcttcagctggtg

SEQ ID NO: 377318 - DNA, 17 bp, Homo sapiens
aaatcttcctctggagc

SEQ ID NO: 377319 - DNA, 17 bp, Homo sapiens
aaatcttgaatttctgc

SEQ ID NO: 377320 - DNA, 16 bp, Homo sapiens
aaatcttgtcatgtgt

SEQ ID NO: 377321 - DNA, 13 bp, Homo sapiens
aaatctttaagaa

SEQ ID NO: 377322 - DNA, 12 bp, Homo sapiens
aaatctttcaga

SEQ ID NO: 377323 - DNA, 19 bp, Homo sapiens
aaatctttcagaatacaat

SEQ ID NO: 377324 - DNA, 16 bp, Homo sapiens
aaatctttcagcctgc

SEQ ID NO: 377325 - DNA, 18 bp, Homo sapiens
aaatctttccatctcatt

SEQ ID NO: 377326 - DNA, 22 bp, Homo sapiens
aaatgaaaggtagtgagtaatt

SEQ ID NO: 377327 - DNA, 17 bp, Homo sapiens
aaatgaaatacttgaca

SEQ ID NO: 377328 - DNA, 14 bp, Homo sapiens
aaatgaacacatgg

SEQ ID NO: 377329 - DNA, 17 bp, Homo sapiens
aaatgaacacatggcag

SEQ ID NO: 377330 - DNA, 21 bp, Homo sapiens
aaatgaactgaagtttcacat

SEQ ID NO: 377331 - DNA, 15 bp, Homo sapiens
aaatgaataatttcc

SEQ ID NO: 377332 - DNA, 14 bp, Homo sapiens
aaatgaatagtaca

SEQ ID NO: 377333 - DNA, 19 bp, Homo sapiens
aaatgaatgcattggccct

SEQ ID NO: 377334 - DNA, 19 bp, Homo sapiens
aaatgaatgtctaaaattg

SEQ ID NO: 377335 - DNA, 15 bp, Homo sapiens
aaatgaccaatatta

SEQ ID NO: 377336 - DNA, 11 bp, Homo sapiens
aaatgaccagt

SEQ ID NO: 377337 - DNA, 12 bp, Homo sapiens
aaatgaccagtt

SEQ ID NO: 377338 - DNA, 14 bp, Homo sapiens
aaatgaccagttta

SEQ ID NO: 377339 - DNA, 15 bp, Homo sapiens
aaatgaccagtttac

SEQ ID NO: 377340 - DNA, 14 bp, Homo sapiens
aaatgacttattga

SEQ ID NO: 377341 - DNA, 12 bp, Homo sapiens
aaatgaggaaga

SEQ ID NO: 377342 - DNA, 14 bp, Homo sapiens
aaatgaggacatgt

SEQ ID NO: 377343 - DNA, 20 bp, Homo sapiens
aaatgagtttaaaaaaataa

SEQ ID NO: 377344 - DNA, 18 bp, Homo sapiens
aaatgataaagatgtcaa

SEQ ID NO: 377345 - DNA, 12 bp, Homo sapiens
aaatgatctatt

SEQ ID NO: 377346 - DNA, 15 bp, Homo sapiens
aaatgatctattgca

SEQ ID NO: 377347 - DNA, 19 bp, Homo sapiens
aaatgatgatgtggaagaa

SEQ ID NO: 377348 - DNA, 13 bp, Homo sapiens
aaatgattatctt

SEQ ID NO: 377349 - DNA, 21 bp, Homo sapiens
aaatgattcacttttattgta

SEQ ID NO: 377350 - DNA, 13 bp, Homo sapiens
aaatgattccaaa

SEQ ID NO: 377351 - DNA, 20 bp, Homo sapiens
aaatgattttcatcaattta

SEQ ID NO: 377352 - DNA, 21 bp, Homo sapiens
aaatgattttcatcaatttaa

SEQ ID NO: 377353 - DNA, 19 bp, Homo sapiens
aaatgcacatagctatcaa

SEQ ID NO: 377354 - DNA, 20 bp, Homo sapiens
aaatgcatatcctgagccat

SEQ ID NO: 377355 - DNA, 14 bp, Homo sapiens
aaatgcatgatatt

SEQ ID NO: 377356 - DNA, 14 bp, Homo sapiens
aaatgcattcatgt

SEQ ID NO: 377357 - DNA, 21 bp, Homo sapiens
aaatgctgatttaaacttctt

SEQ ID NO: 377358 - DNA, 13 bp, Homo sapiens
aaatgctgcctgc

SEQ ID NO: 377359 - DNA, 16 bp, Homo sapiens
aaatgctgcctgcctg

SEQ ID NO: 377360 - DNA, 19 bp, Homo sapiens
aaatgctgttggtgagaat

SEQ ID NO: 377361 - DNA, 20 bp, Homo sapiens
aaatgctgttggtgagaatc

SEQ ID NO: 377362 - DNA, 19 bp, Homo sapiens
aaatgctttgtgtgattga

SEQ ID NO: 377363 - DNA, 18 bp, Homo sapiens
aaatgctttgttttccca

SEQ ID NO: 377364 - DNA, 14 bp, Homo sapiens
aaatggaaagaaaa

SEQ ID NO: 377365 - DNA, 20 bp, Homo sapiens
aaatggaaaggtcctgctgt

SEQ ID NO: 377366 - DNA, 22 bp, Homo sapiens
aaatggaatgtgcccctggccc

SEQ ID NO: 377367 - DNA, 14 bp, Homo sapiens
aaatggacgtgtta

SEQ ID NO: 377368 - DNA, 20 bp, Homo sapiens
aaatggacgtgttatgactc

SEQ ID NO: 377369 - DNA, 22 bp, Homo sapiens
aaatggacgtgttatgactcca

SEQ ID NO: 377370 - DNA, 14 bp, Homo sapiens
aaatggacttgctt

SEQ ID NO: 377371 - DNA, 19 bp, Homo sapiens
aaatggacttgcttcttgt

SEQ ID NO: 377372 - DNA, 19 bp, Homo sapiens
aaatggacttttgttcatg

SEQ ID NO: 377373 - DNA, 17 bp, Homo sapiens
aaatggatgacaaagaa

SEQ ID NO: 377374 - DNA, 18 bp, Homo sapiens
aaatggatgacaaagaaa

SEQ ID NO: 377375 - DNA, 19 bp, Homo sapiens
aaatggatgacaaagaaaa

SEQ ID NO: 377376 - DNA, 23 bp, Homo sapiens
aaatggatgacaaagaaaatgag

SEQ ID NO: 377377 - DNA, 13 bp, Homo sapiens
aaatggcacctgt

SEQ ID NO: 377378 - DNA, 17 bp, Homo sapiens
aaatggcacctgtatac

SEQ ID NO: 377379 - DNA, 18 bp, Homo sapiens
aaatgggactgatgtcat

SEQ ID NO: 377380 - DNA, 20 bp, Homo sapiens
aaatgggactgatgtcatct

SEQ ID NO: 377381 - DNA, 22 bp, Homo sapiens
aaatgggttggtgcttctaacc

SEQ ID NO: 377382 - DNA, 20 bp, Homo sapiens
aaatggtagaagatgaatca

SEQ ID NO: 377383 - DNA, 20 bp, Homo sapiens
aaatggtcagtgtgcaaaga

SEQ ID NO: 377384 - DNA, 19 bp, Homo sapiens
aaatggtgttttcatgtaa

SEQ ID NO: 377385 - DNA, 14 bp, Homo sapiens
aaatggtgtttttt

SEQ ID NO: 377386 - DNA, 17 bp, Homo sapiens
aaatgtaaaagtactct

SEQ ID NO: 377387 - DNA, 18 bp, Homo sapiens
aaatgtaaatttataaat

SEQ ID NO: 377388 - DNA, 21 bp, Homo sapiens
aaatgtactacatttgcatgc

SEQ ID NO: 377389 - DNA, 14 bp, Homo sapiens
aaatgtagaagaaa

SEQ ID NO: 377390 - DNA, 17 bp, Homo sapiens
aaatgtatatttaactt

SEQ ID NO: 377391 - DNA, 14 bp, Homo sapiens
aaatgtatcttatt

SEQ ID NO: 377392 - DNA, 15 bp, Homo sapiens
aaatgtattcaagca

SEQ ID NO: 377393 - DNA, 14 bp, Homo sapiens
aaatgtattttgaa

SEQ ID NO: 377394 - DNA, 16 bp, Homo sapiens
aaatgtcccaaataaa

SEQ ID NO: 377395 - DNA, 22 bp, Homo sapiens
aaatgtcctgtggtgacaggcc

SEQ ID NO: 377396 - DNA, 21 bp, Homo sapiens
aaatgtctgttttagttggaa

SEQ ID NO: 377397 - DNA, 15 bp, Homo sapiens
aaatgtgatcaactg

SEQ ID NO: 377398 - DNA, 13 bp, Homo sapiens
aaatgtgcaagag

SEQ ID NO: 377399 - DNA, 19 bp, Homo sapiens
aaatgtgcaagagtatact

SEQ ID NO: 377400 - DNA, 18 bp, Homo sapiens
aaatgtgtgcttggaaaa

SEQ ID NO: 377401 - DNA, 14 bp, Homo sapiens
aaatgttaataaag

SEQ ID NO: 377402 - DNA, 22 bp, Homo sapiens
aaatgttaataaaggtttcgtt

SEQ ID NO: 377403 - DNA, 16 bp, Homo sapiens
aaatgttagcaagatg

SEQ ID NO: 377404 - DNA, 20 bp, Homo sapiens
aaatgttagcaagatgattt

SEQ ID NO: 377405 - DNA, 17 bp, Homo sapiens
aaatgttcattctatga

SEQ ID NO: 377406 - DNA, 12 bp, Homo sapiens
aaatgttttatg

SEQ ID NO: 377407 - DNA, 21 bp, Homo sapiens
aaattaaaacgaaaataaagt

SEQ ID NO: 377408 - DNA, 13 bp, Homo sapiens
aaattaaaagaag

SEQ ID NO: 377409 - DNA, 22 bp, Homo sapiens
aaattaaaatccagcatcccaa

SEQ ID NO: 377410 - DNA, 13 bp, Homo sapiens
aaattaaacaatt

SEQ ID NO: 377411 - DNA, 17 bp, Homo sapiens
aaattaaacgagcgaag

SEQ ID NO: 377412 - DNA, 17 bp, Homo sapiens
aaattaaataattttac

SEQ ID NO: 377413 - DNA, 12 bp, Homo sapiens
aaattaaatata

SEQ ID NO: 377414 - DNA, 23 bp, Homo sapiens
aaattaaatatatgtatgtaaaa

SEQ ID NO: 377415 - DNA, 17 bp, Homo sapiens
aaattaaattctctcta

SEQ ID NO: 377416 - DNA, 21 bp, Homo sapiens
aaattaaattctctctaacat

SEQ ID NO: 377417 - DNA, 12 bp, Homo sapiens
aaattaacatta

SEQ ID NO: 377418 - DNA, 13 bp, Homo sapiens
aaattaacattat

SEQ ID NO: 377419 - DNA, 16 bp, Homo sapiens
aaattaacattatatt

SEQ ID NO: 377420 - DNA, 17 bp, Homo sapiens
aaattaagaagtacaat

SEQ ID NO: 377421 - DNA, 15 bp, Homo sapiens
aaattaagactttaa

SEQ ID NO: 377422 - DNA, 22 bp, Homo sapiens
aaattaataaatcatgttttga

SEQ ID NO: 377423 - DNA, 16 bp, Homo sapiens
aaattacacccatgca

SEQ ID NO: 377424 - DNA, 20 bp, Homo sapiens
aaattagaaaaaaacaaact

SEQ ID NO: 377425 - DNA, 14 bp, Homo sapiens
aaattagatgaact

SEQ ID NO: 377426 - DNA, 18 bp, Homo sapiens
aaattaggaataaataaa

SEQ ID NO: 377427 - DNA, 18 bp, Homo sapiens
aaattaggatttcatgat

SEQ ID NO: 377428 - DNA, 18 bp, Homo sapiens
aaattagggctctaattt

SEQ ID NO: 377429 - DNA, 16 bp, Homo sapiens
aaattagtaatgtact

SEQ ID NO: 377430 - DNA, 15 bp, Homo sapiens
aaattataaggactg

SEQ ID NO: 377431 - DNA, 17 bp, Homo sapiens
aaattataaggactgca

SEQ ID NO: 377432 - DNA, 20 bp, Homo sapiens
aaattataagtagatttgta

SEQ ID NO: 377433 - DNA, 16 bp, Homo sapiens
aaattatactgtagct

SEQ ID NO: 377434 - DNA, 18 bp, Homo sapiens
aaattatatgatatgcat

SEQ ID NO: 377435 - DNA, 16 bp, Homo sapiens
aaattatcaagctaat

SEQ ID NO: 377436 - DNA, 15 bp, Homo sapiens
aaattatctttaaaa

SEQ ID NO: 377437 - DNA, 13 bp, Homo sapiens
aaattatgtaatg

SEQ ID NO: 377438 - DNA, 17 bp, Homo sapiens
aaattattactttaaat

SEQ ID NO: 377439 - DNA, 18 bp, Homo sapiens
aaattattactttaaatt

SEQ ID NO: 377440 - DNA, 17 bp, Homo sapiens
aaattattgtaaacttt

SEQ ID NO: 377441 - DNA, 13 bp, Homo sapiens
aaattatttaata

SEQ ID NO: 377442 - DNA, 15 bp, Homo sapiens
aaattatttaataaa

SEQ ID NO: 377443 - DNA, 21 bp, Homo sapiens
aaattatttctaaaacattaa

SEQ ID NO: 377444 - DNA, 19 bp, Homo sapiens
aaattatttgccttttaaa

SEQ ID NO: 377445 - DNA, 21 bp, Homo sapiens
aaattatttgtgtaatagaaa

SEQ ID NO: 377446 - DNA, 14 bp, Homo sapiens
aaattcaaaaagtg

SEQ ID NO: 377447 - DNA, 14 bp, Homo sapiens
aaattcaacaaatg

SEQ ID NO: 377448 - DNA, 16 bp, Homo sapiens
aaattcaacaaatgat

SEQ ID NO: 377449 - DNA, 17 bp, Homo sapiens
aaattcaacacttattt

SEQ ID NO: 377450 - DNA, 16 bp, Homo sapiens
aaattcaagaaaataa

SEQ ID NO: 377451 - DNA, 13 bp, Homo sapiens
aaattcacactgt

SEQ ID NO: 377452 - DNA, 14 bp, Homo sapiens
aaattcatataaag

SEQ ID NO: 377453 - DNA, 22 bp, Homo sapiens
aaattccccatatttgtgttca

SEQ ID NO: 377454 - DNA, 12 bp, Homo sapiens
aaattccctgga

SEQ ID NO: 377455 - DNA, 14 bp, Homo sapiens
aaattcctctgtag

SEQ ID NO: 377456 - DNA, 12 bp, Homo sapiens
aaattcctgttg

SEQ ID NO: 377457 - DNA, 13 bp, Homo sapiens
aaattcctgttgt

SEQ ID NO: 377458 - DNA, 15 bp, Homo sapiens
aaattcgtagcaaat

SEQ ID NO: 377459 - DNA, 16 bp, Homo sapiens
aaattctagtctctga

SEQ ID NO: 377460 - DNA, 17 bp, Homo sapiens
aaattctcaagtgatag

SEQ ID NO: 377461 - DNA, 15 bp, Homo sapiens
aaattctgctgcttg

SEQ ID NO: 377462 - DNA, 17 bp, Homo sapiens
aaattctgtggcagttt

SEQ ID NO: 377463 - DNA, 23 bp, Homo sapiens
aaattcttattggccaaatgcct

SEQ ID NO: 377464 - DNA, 18 bp, Homo sapiens
aaattcttgaagttcatg

SEQ ID NO: 377465 - DNA, 15 bp, Homo sapiens
aaattcttgaataaa

SEQ ID NO: 377466 - DNA, 21 bp, Homo sapiens
aaattcttgcactgtatccaa

SEQ ID NO: 377467 - DNA, 23 bp, Homo sapiens
aaattgaaagcttccatgtttaa

SEQ ID NO: 377468 - DNA, 13 bp, Homo sapiens
aaattgaaattgt

SEQ ID NO: 377469 - DNA, 14 bp, Homo sapiens
aaattgatcattca

SEQ ID NO: 377470 - DNA, 14 bp, Homo sapiens
aaattgatgggtgg

SEQ ID NO: 377471 - DNA, 14 bp, Homo sapiens
aaattgatgtgttt

SEQ ID NO: 377472 - DNA, 21 bp, Homo sapiens
aaattgatgtgtttatttata

SEQ ID NO: 377473 - DNA, 21 bp, Homo sapiens
aaattgcaaagaaaattctca

SEQ ID NO: 377474 - DNA, 16 bp, Homo sapiens
aaattgcataaagcat

SEQ ID NO: 377475 - DNA, 17 bp, Homo sapiens
aaattgcatgctgcttt

SEQ ID NO: 377476 - DNA, 19 bp, Homo sapiens
aaattgcatgctgctttaa

SEQ ID NO: 377477 - DNA, 18 bp, Homo sapiens
aaattgcatttcctgaca

SEQ ID NO: 377478 - DNA, 13 bp, Homo sapiens
aaattgctcataa

SEQ ID NO: 377479 - DNA, 13 bp, Homo sapiens
aaattgctccttg

SEQ ID NO: 377480 - DNA, 14 bp, Homo sapiens
aaattgctccttga

SEQ ID NO: 377481 - DNA, 20 bp, Homo sapiens
aaattgctgagatgtttagt

SEQ ID NO: 377482 - DNA, 18 bp, Homo sapiens
aaattgcttttgttgtga

SEQ ID NO: 377483 - DNA, 18 bp, Homo sapiens
aaattggattagcctgga

SEQ ID NO: 377484 - DNA, 18 bp, Homo sapiens
aaattggctcctttccca

SEQ ID NO: 377485 - DNA, 22 bp, Homo sapiens
aaattggctcctttcccacagt

SEQ ID NO: 377486 - DNA, 22 bp, Homo sapiens
aaattgggtgtgccctggctcc

SEQ ID NO: 377487 - DNA, 18 bp, Homo sapiens
aaattggtgataagtgga

SEQ ID NO: 377488 - DNA, 22 bp, Homo sapiens
aaattggtgataagtggaaaaa

SEQ ID NO: 377489 - DNA, 19 bp, Homo sapiens
aaattgtgaactcattgct

SEQ ID NO: 377490 - DNA, 17 bp, Homo sapiens
aaattgtgtccacataa

SEQ ID NO: 377491 - DNA, 18 bp, Homo sapiens
aaattgtgtccacataat

SEQ ID NO: 377492 - DNA, 13 bp, Homo sapiens
aaattgttcctga

SEQ ID NO: 377493 - DNA, 12 bp, Homo sapiens
aaatttaaaaaa

SEQ ID NO: 377494 - DNA, 18 bp, Homo sapiens
aaatttaaaacaaacaac

SEQ ID NO: 377495 - DNA, 12 bp, Homo sapiens
aaatttaagcat

SEQ ID NO: 377496 - DNA, 13 bp, Homo sapiens
aaatttaagcatt

SEQ ID NO: 377497 - DNA, 14 bp, Homo sapiens
aaatttaagcattg

SEQ ID NO: 377498 - DNA, 23 bp, Homo sapiens
aaatttaagtatcttttttcaaa

SEQ ID NO: 377499 - DNA, 16 bp, Homo sapiens
aaatttaatgtagaca

SEQ ID NO: 377500 - DNA, 17 bp, Homo sapiens
aaatttacatcatttct

SEQ ID NO: 377501 - DNA, 15 bp, Homo sapiens
aaatttacgtatatt

SEQ ID NO: 377502 - DNA, 22 bp, Homo sapiens
aaatttataaactaattttgta

SEQ ID NO: 377503 - DNA, 19 bp, Homo sapiens
aaatttctgggatatttaa

SEQ ID NO: 377504 - DNA, 18 bp, Homo sapiens
aaatttgaaccaaaacat

SEQ ID NO: 377505 - DNA, 14 bp, Homo sapiens
aaatttgagactat

SEQ ID NO: 377506 - DNA, 20 bp, Homo sapiens
aaatttgatggtgaatatta

SEQ ID NO: 377507 - DNA, 13 bp, Homo sapiens
aaatttgtactat

SEQ ID NO: 377508 - DNA, 19 bp, Homo sapiens
aaatttgtactatttaact

SEQ ID NO: 377509 - DNA, 20 bp, Homo sapiens
aaatttgtactatttaactg

SEQ ID NO: 377510 - DNA, 12 bp, Homo sapiens
aaatttgtgtaa

SEQ ID NO: 377511 - DNA, 20 bp, Homo sapiens
aaatttgttatacttcaaaa

SEQ ID NO: 377512 - DNA, 22 bp, Homo sapiens
aaatttgttgtcatgtgtatga

SEQ ID NO: 377513 - DNA, 15 bp, Homo sapiens
aaatttgtttaaagt

SEQ ID NO: 377514 - DNA, 22 bp, Homo sapiens
aaatttgttttgacggatgatt

SEQ ID NO: 377515 - DNA, 14 bp, Homo sapiens
aaattttaatgtaa

SEQ ID NO: 377516 - DNA, 21 bp, Homo sapiens
aaattttataaaattaagcaa

SEQ ID NO: 377517 - DNA, 12 bp, Homo sapiens
aaattttattga

SEQ ID NO: 377518 - DNA, 19 bp, Homo sapiens
aaattttattgaatataat

SEQ ID NO: 377519 - DNA, 17 bp, Homo sapiens
aaattttgaggtctttt

SEQ ID NO: 377520 - DNA, 21 bp, Homo sapiens
aaattttgtgatatggagccc

SEQ ID NO: 377521 - DNA, 14 bp, Homo sapiens
aaatttttaaatca

SEQ ID NO: 377522 - DNA, 20 bp, Homo sapiens
aaatttttaaatcatttcat

SEQ ID NO: 377523 - DNA, 13 bp, Homo sapiens
aaatttttgaaaa

SEQ ID NO: 377524 - DNA, 19 bp, Homo sapiens
aaattttttgatgtcagcc

SEQ ID NO: 377525 - DNA, 20 bp, Homo sapiens
aaattttttgatgtcagcct

SEQ ID NO: 377526 - DNA, 15 bp, Homo sapiens
aaatttttttccaga

SEQ ID NO: 377527 - DNA, 20 bp, Homo sapiens
aaatttttttgtatttttag

SEQ ID NO: 377528 - DNA, 17 bp, Homo sapiens
aaattttttttttaata

SEQ ID NO: 377529 - DNA, 16 bp, Homo sapiens
aacaaaaaccagcagg

SEQ ID NO: 377530 - DNA, 11 bp, Homo sapiens
aacaaaaattt

SEQ ID NO: 377531 - DNA, 16 bp, Homo sapiens
aacaaaacaagaaaga

SEQ ID NO: 377532 - DNA, 20 bp, Homo sapiens
aacaaaatgaagttaactta

SEQ ID NO: 377533 - DNA, 15 bp, Homo sapiens
aacaaacaaaactta

SEQ ID NO: 377534 - DNA, 21 bp, Homo sapiens
aacaaacagaaacgagatttg

SEQ ID NO: 377535 - DNA, 18 bp, Homo sapiens
aacaaacgtaatttgtta

SEQ ID NO: 377536 - DNA, 19 bp, Homo sapiens
aacaaacgtaatttgttat

SEQ ID NO: 377537 - DNA, 15 bp, Homo sapiens
aacaaactgaaaaat

SEQ ID NO: 377538 - DNA, 16 bp, Homo sapiens
aacaaactgaaaaatc

SEQ ID NO: 377539 - DNA, 20 bp, Homo sapiens
aacaaactgtgtaactgccc

SEQ ID NO: 377540 - DNA, 11 bp, Homo sapiens
aacaaagaaga

SEQ ID NO: 377541 - DNA, 20 bp, Homo sapiens
aacaaagaccaatgtgaaga

SEQ ID NO: 377542 - DNA, 14 bp, Homo sapiens
aacaaagcatgctc

SEQ ID NO: 377543 - DNA, 22 bp, Homo sapiens
aacaaagcatgctcagtattga

SEQ ID NO: 377544 - DNA, 15 bp, Homo sapiens
aacaaagctgatttc

SEQ ID NO: 377545 - DNA, 18 bp, Homo sapiens
aacaaagtcaagattccc

SEQ ID NO: 377546 - DNA, 20 bp, Homo sapiens
aacaaagtgactgtttggct

SEQ ID NO: 377547 - DNA, 21 bp, Homo sapiens
aacaaagtgactgtttggctt

SEQ ID NO: 377548 - DNA, 13 bp, Homo sapiens
aacaaatatgcaa

SEQ ID NO: 377549 - DNA, 13 bp, Homo sapiens
aacaacaaaaaat

SEQ ID NO: 377550 - DNA, 17 bp, Homo sapiens
aacaacaaagcatgctc

SEQ ID NO: 377551 - DNA, 18 bp, Homo sapiens
aacaacaaagcatgctca

SEQ ID NO: 377552 - DNA, 14 bp, Homo sapiens
aacaacaacaaagc

SEQ ID NO: 377553 - DNA, 19 bp, Homo sapiens
aacaacagtcagccagctt

SEQ ID NO: 377554 - DNA, 15 bp, Homo sapiens
aacaaccctgttgag

SEQ ID NO: 377555 - DNA, 24 bp, Homo sapiens
aacaacctgccacaatgtgatatg

SEQ ID NO: 377556 - DNA, 19 bp, Homo sapiens
aacaactaattataatgca

SEQ ID NO: 377557 - DNA, 18 bp, Homo sapiens
aacaactatttataaact

SEQ ID NO: 377558 - DNA, 13 bp, Homo sapiens
aacaactctattt

SEQ ID NO: 377559 - DNA, 14 bp, Homo sapiens
aacaacttactaaa

SEQ ID NO: 377560 - DNA, 17 bp, Homo sapiens
aacaactttgtttctca

SEQ ID NO: 377561 - DNA, 13 bp, Homo sapiens
aacaagaaaacat

SEQ ID NO: 377562 - DNA, 23 bp, Homo sapiens
aacaagaaaccaagtgggctggt

SEQ ID NO: 377563 - DNA, 13 bp, Homo sapiens
aacaagaaagaaa

SEQ ID NO: 377564 - DNA, 17 bp, Homo sapiens
aacaagaaagaaacgta

SEQ ID NO: 377565 - DNA, 16 bp, Homo sapiens
aaataaatagctatat

SEQ ID NO: 377566 - DNA, 12 bp, Homo sapiens
aaataaatgaaa

SEQ ID NO: 377567 - DNA, 23 bp, Homo sapiens
aaataaattggtgataagtggaa

SEQ ID NO: 377568 - DNA, 21 bp, Homo sapiens
aaataaatttaactttaacca

SEQ ID NO: 377569 - DNA, 19 bp, Homo sapiens
aaataaatttggttctaat

SEQ ID NO: 377570 - DNA, 18 bp, Homo sapiens
aaataacacagatattgt

SEQ ID NO: 377571 - DNA, 12 bp, Homo sapiens
aaataacattgc

SEQ ID NO: 377572 - DNA, 12 bp, Homo sapiens
aaataaccacaa

SEQ ID NO: 377573 - DNA, 20 bp, Homo sapiens
aaataaccacaaggtccact

SEQ ID NO: 377574 - DNA, 19 bp, Homo sapiens
aaataactactgcaaaaag

SEQ ID NO: 377575 - DNA, 21 bp, Homo sapiens
aaataactactgcaaaaagta

SEQ ID NO: 377576 - DNA, 15 bp, Homo sapiens
aaataagaaattagc

SEQ ID NO: 377577 - DNA, 14 bp, Homo sapiens
aaataagagatttg

SEQ ID NO: 377578 - DNA, 15 bp, Homo sapiens
aaataagtaacatat

SEQ ID NO: 377579 - DNA, 18 bp, Homo sapiens
aaataagtcctaaagtga

SEQ ID NO: 377580 - DNA, 22 bp, Homo sapiens
aaataagtgaatctaataaaat

SEQ ID NO: 377581 - DNA, 12 bp, Homo sapiens
aaataagttaaa

SEQ ID NO: 377582 - DNA, 13 bp, Homo sapiens
aaataataaatta

SEQ ID NO: 377583 - DNA, 17 bp, Homo sapiens
aaataataaattaacat

SEQ ID NO: 377584 - DNA, 18 bp, Homo sapiens
aaataataaattaacatt

SEQ ID NO: 377585 - DNA, 19 bp, Homo sapiens
aaataataaattaacatta

SEQ ID NO: 377586 - DNA, 15 bp, Homo sapiens
aaataataataatgt

SEQ ID NO: 377587 - DNA, 19 bp, Homo sapiens
aaataatattatattgtat

SEQ ID NO: 377588 - DNA, 13 bp, Homo sapiens
aaataatgattta

SEQ ID NO: 377589 - DNA, 15 bp, Homo sapiens
aaataattaaaacaa

SEQ ID NO: 377590 - DNA, 14 bp, Homo sapiens
aaataattatcaca

SEQ ID NO: 377591 - DNA, 13 bp, Homo sapiens
aaatacaaaataa

SEQ ID NO: 377592 - DNA, 19 bp, Homo sapiens
aaatacaacttaaataata

SEQ ID NO: 377593 - DNA, 12 bp, Homo sapiens
aaatacaataaa

SEQ ID NO: 377594 - DNA, 14 bp, Homo sapiens
aaatacaataaact

SEQ ID NO: 377595 - DNA, 15 bp, Homo sapiens
aaatacaataaacta

SEQ ID NO: 377596 - DNA, 18 bp, Homo sapiens
aaatacaattactcacca

SEQ ID NO: 377597 - DNA, 16 bp, Homo sapiens
aaatacactacaaatg

SEQ ID NO: 377598 - DNA, 18 bp, Homo sapiens
aaatacactacaaatgtt

SEQ ID NO: 377599 - DNA, 17 bp, Homo sapiens
aaataccatgtctctaa

SEQ ID NO: 377600 - DNA, 19 bp, Homo sapiens
aaataccatgtctctaagc

SEQ ID NO: 377601 - DNA, 17 bp, Homo sapiens
aaatactattggacaga

SEQ ID NO: 377602 - DNA, 23 bp, Homo sapiens
aaatactgcttttgcaaacagaa

SEQ ID NO: 377603 - DNA, 19 bp, Homo sapiens
aaatacttctttttcatta

SEQ ID NO: 377604 - DNA, 16 bp, Homo sapiens
aaatacttgtgatttt

SEQ ID NO: 377605 - DNA, 16 bp, Homo sapiens
aaatagaaccactatg

SEQ ID NO: 377606 - DNA, 15 bp, Homo sapiens
aaatagagcttttaa

SEQ ID NO: 377607 - DNA, 20 bp, Homo sapiens
aaatagagcttttaaaaatg

SEQ ID NO: 377608 - DNA, 19 bp, Homo sapiens
aaatagagtatatgcactt

SEQ ID NO: 377609 - DNA, 20 bp, Homo sapiens
aaatagagtttttatatttg

SEQ ID NO: 377610 - DNA, 15 bp, Homo sapiens
aaatagctaaatggc

SEQ ID NO: 377611 - DNA, 16 bp, Homo sapiens
aaatagctaaatggca

SEQ ID NO: 377612 - DNA, 18 bp, Homo sapiens
aaatagctataaatagtg

SEQ ID NO: 377613 - DNA, 16 bp, Homo sapiens
aaatagcttgtatagt

SEQ ID NO: 377614 - DNA, 18 bp, Homo sapiens
aaatagggcaaagaatca

SEQ ID NO: 377615 - DNA, 20 bp, Homo sapiens
aaatagtaggaccaatgttg

SEQ ID NO: 377616 - DNA, 20 bp, Homo sapiens
aaatagtgcagaatctcata

SEQ ID NO: 377617 - DNA, 15 bp, Homo sapiens
aaatagtgttctttt

SEQ ID NO: 377618 - DNA, 21 bp, Homo sapiens
aaatagttattttaatacctt

SEQ ID NO: 377619 - DNA, 19 bp, Homo sapiens
aaatagtttatttttcaca

SEQ ID NO: 377620 - DNA, 12 bp, Homo sapiens
aaatataaatta

SEQ ID NO: 377621 - DNA, 23 bp, Homo sapiens
aaatataacaggtgcttctttgt

SEQ ID NO: 377622 - DNA, 14 bp, Homo sapiens
aaatatacaacttt

SEQ ID NO: 377623 - DNA, 16 bp, Homo sapiens
aaatatactaataaaa

SEQ ID NO: 377624 - DNA, 18 bp, Homo sapiens
aaatatactaataaaaag

SEQ ID NO: 377625 - DNA, 19 bp, Homo sapiens
aaatatactaataaaaagg

SEQ ID NO: 377626 - DNA, 20 bp, Homo sapiens
aaatatactaataaaaaggt

SEQ ID NO: 377627 - DNA, 21 bp, Homo sapiens
aaatatactaataaaaaggtt

SEQ ID NO: 377628 - DNA, 16 bp, Homo sapiens
aaatatagaattttta

SEQ ID NO: 377629 - DNA, 22 bp, Homo sapiens
aaatatagttgtctttctttgc

SEQ ID NO: 377630 - DNA, 22 bp, Homo sapiens
aaatatagtttgattcttcatt

SEQ ID NO: 377631 - DNA, 13 bp, Homo sapiens
aaatatatataac

SEQ ID NO: 377632 - DNA, 15 bp, Homo sapiens
aaatatatgtatgta

SEQ ID NO: 377633 - DNA, 19 bp, Homo sapiens
aaatatatgtatgtaaaaa

SEQ ID NO: 377634 - DNA, 20 bp, Homo sapiens
aaatatatgtatgtaaaaat

SEQ ID NO: 377635 - DNA, 17 bp, Homo sapiens
aaatatatgtttggctg

SEQ ID NO: 377636 - DNA, 19 bp, Homo sapiens
aaatatatgtttggctgaa

SEQ ID NO: 377637 - DNA, 14 bp, Homo sapiens
aaatatattaaaaa

SEQ ID NO: 377638 - DNA, 15 bp, Homo sapiens
aaatatattaaaaat

SEQ ID NO: 377639 - DNA, 23 bp, Homo sapiens
aaatatattcaggagttggaatg

SEQ ID NO: 377640 - DNA, 14 bp, Homo sapiens
aaatatattgtata

SEQ ID NO: 377641 - DNA, 23 bp, Homo sapiens
aaatatatttttccctgtttgcc

SEQ ID NO: 377642 - DNA, 16 bp, Homo sapiens
aaatatcactttgtat

SEQ ID NO: 377643 - DNA, 19 bp, Homo sapiens
aaatatcattatagcatgt

SEQ ID NO: 377644 - DNA, 22 bp, Homo sapiens
aaatatcattatagcatgtaat

SEQ ID NO: 377645 - DNA, 15 bp, Homo sapiens
aaatatcattcagca

SEQ ID NO: 377646 - DNA, 18 bp, Homo sapiens
aaatatcatttatttttt

SEQ ID NO: 377647 - DNA, 17 bp, Homo sapiens
aaatatgagattggaaa

SEQ ID NO: 377648 - DNA, 15 bp, Homo sapiens
aaatatgatatatat

SEQ ID NO: 377649 - DNA, 21 bp, Homo sapiens
aaatatgattctcctctccca

SEQ ID NO: 377650 - DNA, 19 bp, Homo sapiens
aaatatgattttatttgac

SEQ ID NO: 377651 - DNA, 20 bp, Homo sapiens
aaatatgattttatttgaca

SEQ ID NO: 377652 - DNA, 10 bp, Homo sapiens
aaatatgcaa

SEQ ID NO: 377653 - DNA, 19 bp, Homo sapiens
aaatatgcactttccctag

SEQ ID NO: 377654 - DNA, 13 bp, Homo sapiens
aaatatgcatgta

SEQ ID NO: 377655 - DNA, 22 bp, Homo sapiens
aaatatgcccctccccagtagc

SEQ ID NO: 377656 - DNA, 17 bp, Homo sapiens
aaatatggaacttctaa

SEQ ID NO: 377657 - DNA, 18 bp, Homo sapiens
aaatatggaacttctaat

SEQ ID NO: 377658 - DNA, 20 bp, Homo sapiens
aaatatggaacttctaatat

SEQ ID NO: 377659 - DNA, 19 bp, Homo sapiens
aaatatggctataaatata

SEQ ID NO: 377660 - DNA, 16 bp, Homo sapiens
aaatatgtcctggggt

SEQ ID NO: 377661 - DNA, 20 bp, Homo sapiens
aaatatgtgagcatgaaact

SEQ ID NO: 377662 - DNA, 21 bp, Homo sapiens
aaatatgtgagcatgaaacta

SEQ ID NO: 377663 - DNA, 18 bp, Homo sapiens
aaatattaaaagaaaggg

SEQ ID NO: 377664 - DNA, 22 bp, Homo sapiens
aaatattatctttgtaattatt

SEQ ID NO: 377665 - DNA, 15 bp, Homo sapiens
aaatattatgatttt

SEQ ID NO: 377666 - DNA, 23 bp, Homo sapiens
aaatattattgtggaaatgaata

SEQ ID NO: 377667 - DNA, 20 bp, Homo sapiens
aaatattattttatgaaagg

SEQ ID NO: 377668 - DNA, 23 bp, Homo sapiens
aaatattccatccatatactttg

SEQ ID NO: 377669 - DNA, 17 bp, Homo sapiens
aaatattcttgtccaca

SEQ ID NO: 377670 - DNA, 20 bp, Homo sapiens
aaatattcttgtccacattc

SEQ ID NO: 377671 - DNA, 17 bp, Homo sapiens
aaatatttatgacctca

SEQ ID NO: 377672 - DNA, 22 bp, Homo sapiens
aaatatttatgacctcaacaaa

SEQ ID NO: 377673 - DNA, 20 bp, Homo sapiens
aaatatttctaagcttattt

SEQ ID NO: 377674 - DNA, 17 bp, Homo sapiens
aaatatttctatgtaaa

SEQ ID NO: 377675 - DNA, 18 bp, Homo sapiens
aaatatttctatgtaaat

SEQ ID NO: 377676 - DNA, 14 bp, Homo sapiens
aaatatttttgtac

SEQ ID NO: 377677 - DNA, 16 bp, Homo sapiens
aaatatttttttctag

SEQ ID NO: 377678 - DNA, 19 bp, Homo sapiens
aaatatttttttctagcta

SEQ ID NO: 377679 - DNA, 21 bp, Homo sapiens
aaatatttttttctagctata

SEQ ID NO: 377680 - DNA, 22 bp, Homo sapiens
aaatatttttttctagctataa

SEQ ID NO: 377681 - DNA, 15 bp, Homo sapiens
aaatcaaatttttct

SEQ ID NO: 377682 - DNA, 17 bp, Homo sapiens
aaatcaccttttctaaa

SEQ ID NO: 377683 - DNA, 21 bp, Homo sapiens
aaatcaccttttctaaaaagt

SEQ ID NO: 377684 - DNA, 12 bp, Homo sapiens
aaatcagacaca

SEQ ID NO: 377685 - DNA, 14 bp, Homo sapiens
aaatcagacacaat

SEQ ID NO: 377686 - DNA, 17 bp, Homo sapiens
aaatcaggattttagtg

SEQ ID NO: 377687 - DNA, 18 bp, Homo sapiens
aaatcagtgtttaaataa

SEQ ID NO: 377688 - DNA, 19 bp, Homo sapiens
aaatcagttttgtgtacag

SEQ ID NO: 377689 - DNA, 22 bp, Homo sapiens
aaatcataggaaagtatttttt

SEQ ID NO: 377690 - DNA, 13 bp, Homo sapiens
aaatcatattgat

SEQ ID NO: 377691 - DNA, 19 bp, Homo sapiens
aaatcattcaaaactttca

SEQ ID NO: 377692 - DNA, 17 bp, Homo sapiens
aaatccagaagttttaa

SEQ ID NO: 377693 - DNA, 12 bp, Homo sapiens
aaatccagcccc

SEQ ID NO: 377694 - DNA, 20 bp, Homo sapiens
aaatccagccccatagaaaa

SEQ ID NO: 377695 - DNA, 22 bp, Homo sapiens
aaatccataccccctgccccag

SEQ ID NO: 377696 - DNA, 20 bp, Homo sapiens
aaatccatatcttaaagaaa

SEQ ID NO: 377697 - DNA, 16 bp, Homo sapiens
aaatcccagttcatgt

SEQ ID NO: 377698 - DNA, 14 bp, Homo sapiens
cacaggggcaggcc

SEQ ID NO: 377699 - DNA, 18 bp, Homo sapiens
cacaggggcaggcctggg

SEQ ID NO: 377700 - DNA, 13 bp, Homo sapiens
cacaggggcccca

SEQ ID NO: 377701 - DNA, 18 bp, Homo sapiens
cacaggggccccagatct

SEQ ID NO: 377702 - DNA, 19 bp, Homo sapiens
cacaggggccccagatctg

SEQ ID NO: 377703 - DNA, 16 bp, Homo sapiens
cacaggggcggggcag

SEQ ID NO: 377704 - DNA, 18 bp, Homo sapiens
cacaggggcggggcagga

SEQ ID NO: 377705 - DNA, 22 bp, Homo sapiens
cacaggggctatcccttctcag

SEQ ID NO: 377706 - DNA, 23 bp, Homo sapiens
cacaggggctatcccttctcaga

SEQ ID NO: 377707 - DNA, 14 bp, Homo sapiens
cacagggttgggcc

SEQ ID NO: 377708 - DNA, 19 bp, Homo sapiens
cacaggttcatgccaccat

SEQ ID NO: 377709 - DNA, 18 bp, Homo sapiens
cacagtacaatgtttcag

SEQ ID NO: 377710 - DNA, 15 bp, Homo sapiens
cacagtccctcctgt

SEQ ID NO: 377711 - DNA, 14 bp, Homo sapiens
cacagtcctcacag

SEQ ID NO: 377712 - DNA, 17 bp, Homo sapiens
cacagtcctcacagcct

SEQ ID NO: 377713 - DNA, 17 bp, Homo sapiens
cacagtctctccctggg

SEQ ID NO: 377714 - DNA, 21 bp, Homo sapiens
cacagtgagagtactcacttt

SEQ ID NO: 377715 - DNA, 14 bp, Homo sapiens
cacagtgcatctca

SEQ ID NO: 377716 - DNA, 13 bp, Homo sapiens
cacagtgctcagt

SEQ ID NO: 377717 - DNA, 17 bp, Homo sapiens
cacagtgctgcttctct

SEQ ID NO: 377718 - DNA, 21 bp, Homo sapiens
cacagtgggccggccccaggc

SEQ ID NO: 377719 - DNA, 22 bp, Homo sapiens
cacagtgggccggccccaggct

SEQ ID NO: 377720 - DNA, 14 bp, Homo sapiens
cacagtggggccca

SEQ ID NO: 377721 - DNA, 18 bp, Homo sapiens
cacagtgggtggcacctc

SEQ ID NO: 377722 - DNA, 20 bp, Homo sapiens
cacagtgtaatccaggggtg

SEQ ID NO: 377723 - DNA, 19 bp, Homo sapiens
cacagtgttgcccaggctg

SEQ ID NO: 377724 - DNA, 14 bp, Homo sapiens
cacagttctctcct

SEQ ID NO: 377725 - DNA, 15 bp, Homo sapiens
cacagttctctcctt

SEQ ID NO: 377726 - DNA, 22 bp, Homo sapiens
cacagttggctggatgaaattt

SEQ ID NO: 377727 - DNA, 24 bp, Homo sapiens
cacagttgtctattctgagccttg

SEQ ID NO: 377728 - DNA, 14 bp, Homo sapiens
cacagtttgcaatc

SEQ ID NO: 377729 - DNA, 22 bp, Homo sapiens
cacagtttgctatttgctttag

SEQ ID NO: 377730 - DNA, 15 bp, Homo sapiens
cacagttttgaaaga

SEQ ID NO: 377731 - DNA, 18 bp, Homo sapiens
cacataaatctgtctgat

SEQ ID NO: 377732 - DNA, 22 bp, Homo sapiens
cacataatccacgctcatcttg

SEQ ID NO: 377733 - DNA, 13 bp, Homo sapiens
cacatacacacac

SEQ ID NO: 377734 - DNA, 15 bp, Homo sapiens
cacataccctccccc

SEQ ID NO: 377735 - DNA, 22 bp, Homo sapiens
cacatagattcacctgtaaaac

SEQ ID NO: 377736 - DNA, 21 bp, Homo sapiens
cacatagtgggccttcattaa

SEQ ID NO: 377737 - DNA, 14 bp, Homo sapiens
cacatcattggaat

SEQ ID NO: 377738 - DNA, 15 bp, Homo sapiens
cacatcccagcagcc

SEQ ID NO: 377739 - DNA, 16 bp, Homo sapiens
cacatcccagcagccc

SEQ ID NO: 377740 - DNA, 22 bp, Homo sapiens
cacatcccagcagcccaagctt

SEQ ID NO: 377741 - DNA, 22 bp, Homo sapiens
cacatcccaggcttcaccctga

SEQ ID NO: 377742 - DNA, 17 bp, Homo sapiens
cacatcccggcctcttc

SEQ ID NO: 377743 - DNA, 19 bp, Homo sapiens
cacatcccggcctcttcca

SEQ ID NO: 377744 - DNA, 21 bp, Homo sapiens
cacatcccggcctcttccacc

SEQ ID NO: 377745 - DNA, 14 bp, Homo sapiens
cacatcctccgtcc

SEQ ID NO: 377746 - DNA, 22 bp, Homo sapiens
cacatctcctccatactcagga

SEQ ID NO: 377747 - DNA, 11 bp, Homo sapiens
cacatctctgc

SEQ ID NO: 377748 - DNA, 13 bp, Homo sapiens
cacatctgcattt

SEQ ID NO: 377749 - DNA, 12 bp, Homo sapiens
cacatcttccct

SEQ ID NO: 377750 - DNA, 22 bp, Homo sapiens
cacatcttccctagagggttcc

SEQ ID NO: 377751 - DNA, 14 bp, Homo sapiens
cacatcttgtcttt

SEQ ID NO: 377752 - DNA, 16 bp, Homo sapiens
cacatgaatttctgcc

SEQ ID NO: 377753 - DNA, 14 bp, Homo sapiens
cacatgagtcccag

SEQ ID NO: 377754 - DNA, 16 bp, Homo sapiens
cacatgcactcagtgt

SEQ ID NO: 377755 - DNA, 20 bp, Homo sapiens
cacatgctctcaatatataa

SEQ ID NO: 377756 - DNA, 13 bp, Homo sapiens
cacatgctggcca

SEQ ID NO: 377757 - DNA, 14 bp, Homo sapiens
cacatgctggccag

SEQ ID NO: 377758 - DNA, 17 bp, Homo sapiens
cacatgctggccagcct

SEQ ID NO: 377759 - DNA, 21 bp, Homo sapiens
cacatgcttgatggtttatgt

SEQ ID NO: 377760 - DNA, 21 bp, Homo sapiens
cacatggtccatttcatgtga

SEQ ID NO: 377761 - DNA, 16 bp, Homo sapiens
cacattatagaaatta

SEQ ID NO: 377762 - DNA, 20 bp, Homo sapiens
cacattatcgggagcagtgt

SEQ ID NO: 377763 - DNA, 23 bp, Homo sapiens
cacattatcgggagcagtgtctt

SEQ ID NO: 377764 - DNA, 18 bp, Homo sapiens
cacattatgttagagagg

SEQ ID NO: 377765 - DNA, 14 bp, Homo sapiens
cacattatttgcat

SEQ ID NO: 377766 - DNA, 15 bp, Homo sapiens
cacattatttgcatg

SEQ ID NO: 377767 - DNA, 13 bp, Homo sapiens
cacattccctctc

SEQ ID NO: 377768 - DNA, 16 bp, Homo sapiens
cacattccctctcatc

SEQ ID NO: 377769 - DNA, 15 bp, Homo sapiens
cacattcctggcccc

SEQ ID NO: 377770 - DNA, 13 bp, Homo sapiens
cacattctacttc

SEQ ID NO: 377771 - DNA, 12 bp, Homo sapiens
cacattctccct

SEQ ID NO: 377772 - DNA, 18 bp, Homo sapiens
cacattctgctgccccca

SEQ ID NO: 377773 - DNA, 22 bp, Homo sapiens
cacattctgctgcccccagacc

SEQ ID NO: 377774 - DNA, 13 bp, Homo sapiens
cacattcttaagg

SEQ ID NO: 377775 - DNA, 21 bp, Homo sapiens
cacattcttaaggcaataaaa

SEQ ID NO: 377776 - DNA, 21 bp, Homo sapiens
cacattgccagtgacatgaga

SEQ ID NO: 377777 - DNA, 20 bp, Homo sapiens
cacattgtgtcacatcatga

SEQ ID NO: 377778 - DNA, 13 bp, Homo sapiens
cacatttaaaaca

SEQ ID NO: 377779 - DNA, 14 bp, Homo sapiens
cacatttaaaacat

SEQ ID NO: 377780 - DNA, 15 bp, Homo sapiens
cacatttaaaacatt

SEQ ID NO: 377781 - DNA, 17 bp, Homo sapiens
cacatttaaaacatttg

SEQ ID NO: 377782 - DNA, 19 bp, Homo sapiens
cacatttctggccatttaa

SEQ ID NO: 377783 - DNA, 19 bp, Homo sapiens
cacatttgtaaatgtcttt

SEQ ID NO: 377784 - DNA, 20 bp, Homo sapiens
cacatttgtcactgaataat

SEQ ID NO: 377785 - DNA, 21 bp, Homo sapiens
cacattttaacagtacctgtg

SEQ ID NO: 377786 - DNA, 21 bp, Homo sapiens
cacattttccacggaaacaga

SEQ ID NO: 377787 - DNA, 17 bp, Homo sapiens
caccaaagatgcagccg

SEQ ID NO: 377788 - DNA, 18 bp, Homo sapiens
caccaaagatgcagccgc

SEQ ID NO: 377789 - DNA, 15 bp, Homo sapiens
caccaaatctgtcta

SEQ ID NO: 377790 - DNA, 19 bp, Homo sapiens
caccaaatgcctctgcctt

SEQ ID NO: 377791 - DNA, 18 bp, Homo sapiens
caccaaattgctgagatg

SEQ ID NO: 377792 - DNA, 19 bp, Homo sapiens
caccaacaacagtcagcca

SEQ ID NO: 377793 - DNA, 20 bp, Homo sapiens
caccaacaacagtcagccag

SEQ ID NO: 377794 - DNA, 16 bp, Homo sapiens
caccaacctcactgcc

SEQ ID NO: 377795 - DNA, 17 bp, Homo sapiens
caccaacctcactgccc

SEQ ID NO: 377796 - DNA, 18 bp, Homo sapiens
caccaacctcactgccct

SEQ ID NO: 377797 - DNA, 15 bp, Homo sapiens
caccaactctgcact

SEQ ID NO: 377798 - DNA, 22 bp, Homo sapiens
caccaactctgcactccatggc

SEQ ID NO: 377799 - DNA, 13 bp, Homo sapiens
caccaagaagggg

SEQ ID NO: 377800 - DNA, 19 bp, Homo sapiens
caccaagacttgaaggtgc

SEQ ID NO: 377801 - DNA, 15 bp, Homo sapiens
caccaagcccacagg

SEQ ID NO: 377802 - DNA, 17 bp, Homo sapiens
caccaagccctgcaaat

SEQ ID NO: 377803 - DNA, 22 bp, Homo sapiens
caccaagctgctctccttcact

SEQ ID NO: 377804 - DNA, 17 bp, Homo sapiens
caccaagggtatctgct

SEQ ID NO: 377805 - DNA, 16 bp, Homo sapiens
caccaataaaaatcct

SEQ ID NO: 377806 - DNA, 23 bp, Homo sapiens
caccacaactaacaatgccttgt

SEQ ID NO: 377807 - DNA, 16 bp, Homo sapiens
caccacaagagctcct

SEQ ID NO: 377808 - DNA, 14 bp, Homo sapiens
caccacactgacca

SEQ ID NO: 377809 - DNA, 21 bp, Homo sapiens
caccacagaagcttgtattat

SEQ ID NO: 377810 - DNA, 18 bp, Homo sapiens
caccacagacgccacctg

SEQ ID NO: 377811 - DNA, 13 bp, Homo sapiens
caccacagcaggt

SEQ ID NO: 377812 - DNA, 22 bp, Homo sapiens
caccaccagatgagaagttaag

SEQ ID NO: 377813 - DNA, 15 bp, Homo sapiens
caccaccagccagcg

SEQ ID NO: 377814 - DNA, 12 bp, Homo sapiens
caccacccaccc

SEQ ID NO: 377815 - DNA, 16 bp, Homo sapiens
caccaccccagctgct

SEQ ID NO: 377816 - DNA, 17 bp, Homo sapiens
caccaccccctgtccca

SEQ ID NO: 377817 - DNA, 20 bp, Homo sapiens
caccacccctccctctgctc

SEQ ID NO: 377818 - DNA, 21 bp, Homo sapiens
caccacccctccctctgctct

SEQ ID NO: 377819 - DNA, 22 bp, Homo sapiens
caccaccctagtcccttcccct

SEQ ID NO: 377820 - DNA, 16 bp, Homo sapiens
caccacctcactcctg

SEQ ID NO: 377821 - DNA, 20 bp, Homo sapiens
caccacctggatggatctgc

SEQ ID NO: 377822 - DNA, 21 bp, Homo sapiens
caccacctggatggatctgct

SEQ ID NO: 377823 - DNA, 15 bp, Homo sapiens
caccacgtccagctg

SEQ ID NO: 377824 - DNA, 15 bp, Homo sapiens
caccacgtctgccag

SEQ ID NO: 377825 - DNA, 16 bp, Homo sapiens
caccacgtctgccagg

SEQ ID NO: 377826 - DNA, 21 bp, Homo sapiens
caccacgtctgccaggcccat

SEQ ID NO: 377827 - DNA, 18 bp, Homo sapiens
caccactaaccatcccca

SEQ ID NO: 377828 - DNA, 19 bp, Homo sapiens
cacccctccctctgctctc

SEQ ID NO: 377829 - DNA, 17 bp, Homo sapiens
cacccctcctgggccca

SEQ ID NO: 377830 - DNA, 20 bp, Homo sapiens
cacccctcctgggcccaggc

SEQ ID NO: 377831 - DNA, 13 bp, Homo sapiens
cacccctccttcc

SEQ ID NO: 377832 - DNA, 14 bp, Homo sapiens
cacccctccttccc

SEQ ID NO: 377833 - DNA, 17 bp, Homo sapiens
cacccctccttccctgg

SEQ ID NO: 377834 - DNA, 11 bp, Homo sapiens
cacccctgcac

SEQ ID NO: 377835 - DNA, 12 bp, Homo sapiens
cacccctgcact

SEQ ID NO: 377836 - DNA, 14 bp, Homo sapiens
cacccctgcccagg

SEQ ID NO: 377837 - DNA, 20 bp, Homo sapiens
cacccctgccggccttggcc

SEQ ID NO: 377838 - DNA, 15 bp, Homo sapiens
cacccctggaaccag

SEQ ID NO: 377839 - DNA, 14 bp, Homo sapiens
cacccctgggcagg

SEQ ID NO: 377840 - DNA, 19 bp, Homo sapiens
cacccctgtacccagccac

SEQ ID NO: 377841 - DNA, 15 bp, Homo sapiens
caccccttccccact

SEQ ID NO: 377842 - DNA, 13 bp, Homo sapiens
caccccttgccca

SEQ ID NO: 377843 - DNA, 15 bp, Homo sapiens
cacccctttctagtt

SEQ ID NO: 377844 - DNA, 22 bp, Homo sapiens
cacccctttctagttcaatgcc

SEQ ID NO: 377845 - DNA, 20 bp, Homo sapiens
cacccgacaccagccctgct

SEQ ID NO: 377846 - DNA, 22 bp, Homo sapiens
cacccgacaccagccctgctgc

SEQ ID NO: 377847 - DNA, 23 bp, Homo sapiens
cacccgccccagagactgcccac

SEQ ID NO: 377848 - DNA, 14 bp, Homo sapiens
cacccgcccgcccc

SEQ ID NO: 377849 - DNA, 14 bp, Homo sapiens
cacccgccctttcc

SEQ ID NO: 377850 - DNA, 16 bp, Homo sapiens
cacccgctgcccagcc

SEQ ID NO: 377851 - DNA, 17 bp, Homo sapiens
cacccgctgcccagccc

SEQ ID NO: 377852 - DNA, 18 bp, Homo sapiens
cacccgctgcccagccct

SEQ ID NO: 377853 - DNA, 15 bp, Homo sapiens
cacccgcttcctgtt

SEQ ID NO: 377854 - DNA, 17 bp, Homo sapiens
cacccggaaagactgaa

SEQ ID NO: 377855 - DNA, 15 bp, Homo sapiens
cacccggatctccag

SEQ ID NO: 377856 - DNA, 21 bp, Homo sapiens
cacccggatctccaggcccag

SEQ ID NO: 377857 - DNA, 13 bp, Homo sapiens
cacccggcagccc

SEQ ID NO: 377858 - DNA, 21 bp, Homo sapiens
cacccggcagccccccagtgt

SEQ ID NO: 377859 - DNA, 18 bp, Homo sapiens
cacccggccacagctgct

SEQ ID NO: 377860 - DNA, 17 bp, Homo sapiens
cacccgtaggcagcctc

SEQ ID NO: 377861 - DNA, 21 bp, Homo sapiens
cacccgtaggcagcctctctg

SEQ ID NO: 377862 - DNA, 17 bp, Homo sapiens
cacccgtcctggggtgg

SEQ ID NO: 377863 - DNA, 21 bp, Homo sapiens
cacccgtcttcaatctctgtt

SEQ ID NO: 377864 - DNA, 16 bp, Homo sapiens
cacccgtggagatggg

SEQ ID NO: 377865 - DNA, 21 bp, Homo sapiens
cacccgttctgctggcctgga

SEQ ID NO: 377866 - DNA, 16 bp, Homo sapiens
caccctaactcttgct

SEQ ID NO: 377867 - DNA, 20 bp, Homo sapiens
caccctaactcttgctcact

SEQ ID NO: 377868 - DNA, 21 bp, Homo sapiens
caccctaactgagctgccagt

SEQ ID NO: 377869 - DNA, 22 bp, Homo sapiens
caccctaatttgcccttcagga

SEQ ID NO: 377870 - DNA, 22 bp, Homo sapiens
caccctacaagttgatcatgca

SEQ ID NO: 377871 - DNA, 12 bp, Homo sapiens
caccctacctgt

SEQ ID NO: 377872 - DNA, 14 bp, Homo sapiens
caccctacctgttc

SEQ ID NO: 377873 - DNA, 17 bp, Homo sapiens
caccctagtcccttccc

SEQ ID NO: 377874 - DNA, 16 bp, Homo sapiens
caccctagtttccctg

SEQ ID NO: 377875 - DNA, 14 bp, Homo sapiens
caccctcacacaca

SEQ ID NO: 377876 - DNA, 16 bp, Homo sapiens
aggacccacccatctt

SEQ ID NO: 377877 - DNA, 14 bp, Homo sapiens
aggacccaggccct

SEQ ID NO: 377878 - DNA, 16 bp, Homo sapiens
aggacccaggccctcc

SEQ ID NO: 377879 - DNA, 21 bp, Homo sapiens
aggaccccagagggaccagct

SEQ ID NO: 377880 - DNA, 17 bp, Homo sapiens
aggaccccatctgctga

SEQ ID NO: 377881 - DNA, 18 bp, Homo sapiens
aggaccccatctgctgag

SEQ ID NO: 377882 - DNA, 22 bp, Homo sapiens
aggaccccatctgctgagctct

SEQ ID NO: 377883 - DNA, 13 bp, Homo sapiens
aggacccctcacc

SEQ ID NO: 377884 - DNA, 11 bp, Homo sapiens
agctgtgaaat

SEQ ID NO: 377885 - DNA, 15 bp, Homo sapiens
agctgtgaaattgaa

SEQ ID NO: 377886 - DNA, 18 bp, Homo sapiens
agctgtgaaattgaagtc

SEQ ID NO: 377887 - DNA, 18 bp, Homo sapiens
agctgtgactgagggcct

SEQ ID NO: 377888 - DNA, 16 bp, Homo sapiens
agctgtggggagctgg

SEQ ID NO: 377889 - DNA, 17 bp, Homo sapiens
agctgtggggagctggt

SEQ ID NO: 377890 - DNA, 21 bp, Homo sapiens
agctgtgggtacagagaggtc

SEQ ID NO: 377891 - DNA, 20 bp, Homo sapiens
agctgtgtttgagtttctgg

SEQ ID NO: 377892 - DNA, 15 bp, Homo sapiens
agctgttactttctt

SEQ ID NO: 377893 - DNA, 17 bp, Homo sapiens
agctgttactttctttc

SEQ ID NO: 377894 - DNA, 21 bp, Homo sapiens
agctgttcaacaagagtaaat

SEQ ID NO: 377895 - DNA, 16 bp, Homo sapiens
agctgttgagctgttt

SEQ ID NO: 377896 - DNA, 19 bp, Homo sapiens
agctgtttatggcctcagc

SEQ ID NO: 377897 - DNA, 20 bp, Homo sapiens
agctgtttatggcctcagct

SEQ ID NO: 377898 - DNA, 18 bp, Homo sapiens
agctgttttagttaaatt

SEQ ID NO: 377899 - DNA, 14 bp, Homo sapiens
agctgttttggatg

SEQ ID NO: 377900 - DNA, 12 bp, Homo sapiens
agcttaaaaaaa

SEQ ID NO: 377901 - DNA, 20 bp, Homo sapiens
agcttaaaataaacagttgt

SEQ ID NO: 377902 - DNA, 14 bp, Homo sapiens
agcttaaaataagt

SEQ ID NO: 377903 - DNA, 24 bp, Homo sapiens
agcttaaattgcttttgttgtgac

SEQ ID NO: 377904 - DNA, 21 bp, Homo sapiens
agcttaatagccctccccctc

SEQ ID NO: 377905 - DNA, 15 bp, Homo sapiens
agcttacaagccagc

SEQ ID NO: 377906 - DNA, 22 bp, Homo sapiens
agcttagattttctgtaaatga

SEQ ID NO: 377907 - DNA, 17 bp, Homo sapiens
agcttagccaatgtggg

SEQ ID NO: 377908 - DNA, 13 bp, Homo sapiens
agcttagccttgt

SEQ ID NO: 377909 - DNA, 16 bp, Homo sapiens
agcttatctccctgct

SEQ ID NO: 377910 - DNA, 19 bp, Homo sapiens
agcttatctccctgcttca

SEQ ID NO: 377911 - DNA, 20 bp, Homo sapiens
agcttatctccctgcttcat

SEQ ID NO: 377912 - DNA, 21 bp, Homo sapiens
agcttattaatgctaagggca

SEQ ID NO: 377913 - DNA, 15 bp, Homo sapiens
agcttattggccact

SEQ ID NO: 377914 - DNA, 17 bp, Homo sapiens
agcttattggccactgg

SEQ ID NO: 377915 - DNA, 21 bp, Homo sapiens
agcttatttagcacattttga

SEQ ID NO: 377916 - DNA, 12 bp, Homo sapiens
agcttcaaaaca

SEQ ID NO: 377917 - DNA, 15 bp, Homo sapiens
agcttcaaaacagaa

SEQ ID NO: 377918 - DNA, 15 bp, Homo sapiens
agcttcaaagttggc

SEQ ID NO: 377919 - DNA, 19 bp, Homo sapiens
agcttcaagtctgtgcctg

SEQ ID NO: 377920 - DNA, 17 bp, Homo sapiens
agcttcatgcctttgta

SEQ ID NO: 377921 - DNA, 18 bp, Homo sapiens
agcttcatgcctttgtaa

SEQ ID NO: 377922 - DNA, 19 bp, Homo sapiens
agcttcatttgtgtcaatg

SEQ ID NO: 377923 - DNA, 18 bp, Homo sapiens
agcttccaaatttgaatg

SEQ ID NO: 377924 - DNA, 13 bp, Homo sapiens
agcttccagatgg

SEQ ID NO: 377925 - DNA, 18 bp, Homo sapiens
agcttcccaacaatactt

SEQ ID NO: 377926 - DNA, 18 bp, Homo sapiens
agcttcctccagaggagg

SEQ ID NO: 377927 - DNA, 13 bp, Homo sapiens
agcttcctgtttc

SEQ ID NO: 377928 - DNA, 14 bp, Homo sapiens
agcttcctgtttct

SEQ ID NO: 377929 - DNA, 14 bp, Homo sapiens
agcttccttccaag

SEQ ID NO: 377930 - DNA, 19 bp, Homo sapiens
agcttccttctgtgaaagt

SEQ ID NO: 377931 - DNA, 21 bp, Homo sapiens
agcttcggagggcccctgcgt

SEQ ID NO: 377932 - DNA, 17 bp, Homo sapiens
agcttcgtgctggagga

SEQ ID NO: 377933 - DNA, 17 bp, Homo sapiens
agcttctatcccaggag

SEQ ID NO: 377934 - DNA, 18 bp, Homo sapiens
agcttctctgccaagccc

SEQ ID NO: 377935 - DNA, 23 bp, Homo sapiens
agcttcttaatataactgcctta

SEQ ID NO: 377936 - DNA, 14 bp, Homo sapiens
agcttcttgctcct

SEQ ID NO: 377937 - DNA, 12 bp, Homo sapiens
agcttgaatgtc

SEQ ID NO: 377938 - DNA, 13 bp, Homo sapiens
agcttgaatgtcc

SEQ ID NO: 377939 - DNA, 23 bp, Homo sapiens
agcttgaatgtccccattctata

SEQ ID NO: 377940 - DNA, 20 bp, Homo sapiens
agcttgagctcccctggagc

SEQ ID NO: 377941 - DNA, 23 bp, Homo sapiens
agcttgcgttagaatgaggagga

SEQ ID NO: 377942 - DNA, 17 bp, Homo sapiens
agcttggcagccgagct

SEQ ID NO: 377943 - DNA, 20 bp, Homo sapiens
agcttggcagccgagctcgt

SEQ ID NO: 377944 - DNA, 15 bp, Homo sapiens
agcttggctgagccc

SEQ ID NO: 377945 - DNA, 21 bp, Homo sapiens
agcttggctgagccccctctc

SEQ ID NO: 377946 - DNA, 18 bp, Homo sapiens
agcttgggagagcccctg

SEQ ID NO: 377947 - DNA, 24 bp, Homo sapiens
agcttgggagagcccctggggcct

SEQ ID NO: 377948 - DNA, 18 bp, Homo sapiens
agcttgggcccagctggg

SEQ ID NO: 377949 - DNA, 21 bp, Homo sapiens
agcttgggcccagctgggctc

SEQ ID NO: 377950 - DNA, 18 bp, Homo sapiens
agcttggggaacccatga

SEQ ID NO: 377951 - DNA, 17 bp, Homo sapiens
agcttggttcctgcccc

SEQ ID NO: 377952 - DNA, 16 bp, Homo sapiens
agcttgtctttaaagt

SEQ ID NO: 377953 - DNA, 19 bp, Homo sapiens
agcttgtttccctgctggc

SEQ ID NO: 377954 - DNA, 22 bp, Homo sapiens
agcttgtttccctgctggccaa

SEQ ID NO: 377955 - DNA, 19 bp, Homo sapiens
agcttgttttggactttgt

SEQ ID NO: 377956 - DNA, 20 bp, Homo sapiens
agcttgttttggactttgtt

SEQ ID NO: 377957 - DNA, 19 bp, Homo sapiens
agctttattttttaagtat

SEQ ID NO: 377958 - DNA, 12 bp, Homo sapiens
agctttcagagc

SEQ ID NO: 377959 - DNA, 19 bp, Homo sapiens
agctttcagagccagtgaa

SEQ ID NO: 377960 - DNA, 21 bp, Homo sapiens
agctttcccaaataaactcta

SEQ ID NO: 377961 - DNA, 15 bp, Homo sapiens
agctttccctggctc

SEQ ID NO: 377962 - DNA, 16 bp, Homo sapiens
agctttccctggctca

SEQ ID NO: 377963 - DNA, 17 bp, Homo sapiens
agctttccctggctcag

SEQ ID NO: 377964 - DNA, 20 bp, Homo sapiens
agctttccctggctcaggga

SEQ ID NO: 377965 - DNA, 18 bp, Homo sapiens
agctttccggggaggagc

SEQ ID NO: 377966 - DNA, 22 bp, Homo sapiens
agctttccggggaggagccttg

SEQ ID NO: 377967 - DNA, 12 bp, Homo sapiens
agctttcctggg

SEQ ID NO: 377968 - DNA, 14 bp, Homo sapiens
agctttcctgggtg

SEQ ID NO: 377969 - DNA, 23 bp, Homo sapiens
agctttctaagctttcttacaat

SEQ ID NO: 377970 - DNA, 13 bp, Homo sapiens
agctttctccaga

SEQ ID NO: 377971 - DNA, 13 bp, Homo sapiens
agctttctctgct

SEQ ID NO: 377972 - DNA, 18 bp, Homo sapiens
agctttctctgcttcagc

SEQ ID NO: 377973 - DNA, 11 bp, Homo sapiens
agctttcttct

SEQ ID NO: 377974 - DNA, 17 bp, Homo sapiens
agctttcttctacaacc

SEQ ID NO: 377975 - DNA, 23 bp, Homo sapiens
agctttcttctacaaccagagcc

SEQ ID NO: 377976 - DNA, 19 bp, Homo sapiens
agctttggacgcacacagc

SEQ ID NO: 377977 - DNA, 16 bp, Homo sapiens
agcttttaataaaatt

SEQ ID NO: 377978 - DNA, 19 bp, Homo sapiens
agcttttagtacccacctg

SEQ ID NO: 377979 - DNA, 17 bp, Homo sapiens
agcttttcatggaagtg

SEQ ID NO: 377980 - DNA, 14 bp, Homo sapiens
agcttttcctccct

SEQ ID NO: 377981 - DNA, 12 bp, Homo sapiens
agcttttccttt

SEQ ID NO: 377982 - DNA, 16 bp, Homo sapiens
agcttttcctttcttt

SEQ ID NO: 377983 - DNA, 15 bp, Homo sapiens
agcttttcttgccag

SEQ ID NO: 377984 - DNA, 17 bp, Homo sapiens
agcttttcttgccagct

SEQ ID NO: 377985 - DNA, 20 bp, Homo sapiens
agcttttcttgccagctcag

SEQ ID NO: 377986 - DNA, 18 bp, Homo sapiens
agcttttgaataaaaact

SEQ ID NO: 377987 - DNA, 21 bp, Homo sapiens
agctttttaccgttcacttcc

SEQ ID NO: 377988 - DNA, 15 bp, Homo sapiens
agctttttgaaaacc

SEQ ID NO: 377989 - DNA, 14 bp, Homo sapiens
agcttttttacaca

SEQ ID NO: 377990 - DNA, 15 bp, Homo sapiens
aggaaaaaaactttt

SEQ ID NO: 377991 - DNA, 16 bp, Homo sapiens
aggaaaaaaactttta

SEQ ID NO: 377992 - DNA, 17 bp, Homo sapiens
aggaaaaaaacttttat

SEQ ID NO: 377993 - DNA, 19 bp, Homo sapiens
aggaaaaacagaacatttc

SEQ ID NO: 377994 - DNA, 18 bp, Homo sapiens
aggaaaacaaatcactgt

SEQ ID NO: 377995 - DNA, 19 bp, Homo sapiens
aggaaaaccaagccgtggc

SEQ ID NO: 377996 - DNA, 20 bp, Homo sapiens
aggaaaaccaagccgtggct

SEQ ID NO: 377997 - DNA, 16 bp, Homo sapiens
aggaaaactgaatcca

SEQ ID NO: 377998 - DNA, 23 bp, Homo sapiens
aggaaaagaacaaacaaaactta

SEQ ID NO: 377999 - DNA, 11 bp, Homo sapiens
aggaaaagagt

SEQ ID NO: 378000 - DNA, 15 bp, Homo sapiens
aggaaaaggctggca

SEQ ID NO: 378001 - DNA, 16 bp, Homo sapiens
aggaaaaggctggcaa

SEQ ID NO: 378002 - DNA, 18 bp, Homo sapiens
aggaaaaggtgatatcca

SEQ ID NO: 378003 - DNA, 21 bp, Homo sapiens
aggaaaaggtgatatccattc

SEQ ID NO: 378004 - DNA, 16 bp, Homo sapiens
aggaaaagtacattta

SEQ ID NO: 378005 - DNA, 19 bp, Homo sapiens
aggaaaagtacatttaata

SEQ ID NO: 378006 - DNA, 16 bp, Homo sapiens
aggaaaatagtaatgt

SEQ ID NO: 378007 - DNA, 21 bp, Homo sapiens
aggaaactctgcattctagta

SEQ ID NO: 378008 - DNA, 19 bp, Homo sapiens
aggaaactgaggcccagag

SEQ ID NO: 378009 - DNA, 20 bp, Homo sapiens
aggaaactgaggcccagaga

SEQ ID NO: 378010 - DNA, 14 bp, Homo sapiens
caatctttgccttt

SEQ ID NO: 378011 - DNA, 15 bp, Homo sapiens
caatgaaaagaaaat

SEQ ID NO: 378012 - DNA, 17 bp, Homo sapiens
caatgaaaccttcctct

SEQ ID NO: 378013 - DNA, 23 bp, Homo sapiens
caatgaaatatttgcttatttat

SEQ ID NO: 378014 - DNA, 15 bp, Homo sapiens
atttatataaatgta

SEQ ID NO: 378015 - DNA, 18 bp, Homo sapiens
atttatataaatgtaaaa

SEQ ID NO: 378016 - DNA, 22 bp, Homo sapiens
atttatataattatgttattga

SEQ ID NO: 378017 - DNA, 15 bp, Homo sapiens
atttatatatttata

SEQ ID NO: 378018 - DNA, 13 bp, Homo sapiens
atttatattagag

SEQ ID NO: 378019 - DNA, 13 bp, Homo sapiens
atttatatttcac

SEQ ID NO: 378020 - DNA, 14 bp, Homo sapiens
atttatatttgtct

SEQ ID NO: 378021 - DNA, 17 bp, Homo sapiens
atttatcagtgacagag

SEQ ID NO: 378022 - DNA, 16 bp, Homo sapiens
atttatccaaagcatt

SEQ ID NO: 378023 - DNA, 23 bp, Homo sapiens
atttatcttatctagcaagaaga

SEQ ID NO: 378024 - DNA, 14 bp, Homo sapiens
atttatcttctgtt

SEQ ID NO: 378025 - DNA, 24 bp, Homo sapiens
atttatcttctgtttttctcaaat

SEQ ID NO: 378026 - DNA, 19 bp, Homo sapiens
atttatcttgtctctgggc

SEQ ID NO: 378027 - DNA, 13 bp, Homo sapiens
atttatgaaaaga

SEQ ID NO: 378028 - DNA, 20 bp, Homo sapiens
atttatgacctcaacaaaga

SEQ ID NO: 378029 - DNA, 21 bp, Homo sapiens
atttatgacctcaacaaagaa

SEQ ID NO: 378030 - DNA, 18 bp, Homo sapiens
atttatgagtttttgata

SEQ ID NO: 378031 - DNA, 19 bp, Homo sapiens
atttatgagtttttgatag

SEQ ID NO: 378032 - DNA, 13 bp, Homo sapiens
atttatgcatgag

SEQ ID NO: 378033 - DNA, 22 bp, Homo sapiens
atttatgcatgagaactaaata

SEQ ID NO: 378034 - DNA, 12 bp, Homo sapiens
atttatgcattt

SEQ ID NO: 378035 - DNA, 13 bp, Homo sapiens
atttatgcattta

SEQ ID NO: 378036 - DNA, 18 bp, Homo sapiens
atttatggtcaacactta

SEQ ID NO: 378037 - DNA, 14 bp, Homo sapiens
atttatgtagatgt

SEQ ID NO: 378038 - DNA, 20 bp, Homo sapiens
atttatgtagatgtgcattt

SEQ ID NO: 378039 - DNA, 21 bp, Homo sapiens
atttatgtagatgtgcatttt

SEQ ID NO: 378040 - DNA, 19 bp, Homo sapiens
atttatgtgtgaggagctg

SEQ ID NO: 378041 - DNA, 18 bp, Homo sapiens
atttatgtttaagtgctt

SEQ ID NO: 378042 - DNA, 13 bp, Homo sapiens
atttattaaactt

SEQ ID NO: 378043 - DNA, 15 bp, Homo sapiens
atttattacctctga

SEQ ID NO: 378044 - DNA, 16 bp, Homo sapiens
atttattagctgtaaa

SEQ ID NO: 378045 - DNA, 18 bp, Homo sapiens
atttattagctgtaaata

SEQ ID NO: 378046 - DNA, 13 bp, Homo sapiens
atttattattgta

SEQ ID NO: 378047 - DNA, 18 bp, Homo sapiens
atttattcaattcctctg

SEQ ID NO: 378048 - DNA, 15 bp, Homo sapiens
atttattcatctgca

SEQ ID NO: 378049 - DNA, 15 bp, Homo sapiens
atttattcttatctt

SEQ ID NO: 378050 - DNA, 20 bp, Homo sapiens
atttatttaataacaattgt

SEQ ID NO: 378051 - DNA, 16 bp, Homo sapiens
atttatttatgtgcaa

SEQ ID NO: 378052 - DNA, 17 bp, Homo sapiens
atttatttatgtgcaag

SEQ ID NO: 378053 - DNA, 13 bp, Homo sapiens
atttatttattgt

SEQ ID NO: 378054 - DNA, 14 bp, Homo sapiens
atttatttatttaa

SEQ ID NO: 378055 - DNA, 12 bp, Homo sapiens
atttatttggag

SEQ ID NO: 378056 - DNA, 20 bp, Homo sapiens
atttattttcctccccagca

SEQ ID NO: 378057 - DNA, 20 bp, Homo sapiens
atttatttttgtactgtgct

SEQ ID NO: 378058 - DNA, 19 bp, Homo sapiens
atttattttttacattatt

SEQ ID NO: 378059 - DNA, 18 bp, Homo sapiens
atttcaaaaatataactt

SEQ ID NO: 378060 - DNA, 14 bp, Homo sapiens
atttcaaaatgcat

SEQ ID NO: 378061 - DNA, 17 bp, Homo sapiens
accttcagactttgctt

SEQ ID NO: 378062 - DNA, 21 bp, Homo sapiens
accttcatttcaggagggatt

SEQ ID NO: 378063 - DNA, 16 bp, Homo sapiens
accttcatttcatcct

SEQ ID NO: 378064 - DNA, 17 bp, Homo sapiens
accttcatttcatcctg

SEQ ID NO: 378065 - DNA, 14 bp, Homo sapiens
accttccaggaccc

SEQ ID NO: 378066 - DNA, 15 bp, Homo sapiens
accttccaggacccc

SEQ ID NO: 378067 - DNA, 20 bp, Homo sapiens
accttccctccacctgcttg

SEQ ID NO: 378068 - DNA, 22 bp, Homo sapiens
accttcctgggcagcccagaga

SEQ ID NO: 378069 - DNA, 13 bp, Homo sapiens
accttcctgtctt

SEQ ID NO: 378070 - DNA, 23 bp, Homo sapiens
accttctaatccatgtgctgctg

SEQ ID NO: 378071 - DNA, 15 bp, Homo sapiens
accttctagaattat

SEQ ID NO: 378072 - DNA, 16 bp, Homo sapiens
accttctagaattata

SEQ ID NO: 378073 - DNA, 19 bp, Homo sapiens
accttctgaacatgagtgt

SEQ ID NO: 378074 - DNA, 21 bp, Homo sapiens
accttctgacctccccacccc

SEQ ID NO: 378075 - DNA, 14 bp, Homo sapiens
accttctgtcccca

SEQ ID NO: 378076 - DNA, 15 bp, Homo sapiens
accttctgtccccag

SEQ ID NO: 378077 - DNA, 21 bp, Homo sapiens
accttctgtccccagccctgt

SEQ ID NO: 378078 - DNA, 22 bp, Homo sapiens
accttctgtccccagccctgtc

SEQ ID NO: 378079 - DNA, 12 bp, Homo sapiens
accttctgtggc

SEQ ID NO: 378080 - DNA, 16 bp, Homo sapiens
accttctgtggctcac

SEQ ID NO: 378081 - DNA, 13 bp, Homo sapiens
accttcttccaca

SEQ ID NO: 378082 - DNA, 23 bp, Homo sapiens
accttcttggcttctgggacctg

SEQ ID NO: 378083 - DNA, 15 bp, Homo sapiens
accttgaatgatgcc

SEQ ID NO: 378084 - DNA, 17 bp, Homo sapiens
accttgacttgattagt

SEQ ID NO: 378085 - DNA, 17 bp, Homo sapiens
accttgagaccctcttc

SEQ ID NO: 378086 - DNA, 11 bp, Homo sapiens
accttgaggtc

SEQ ID NO: 378087 - DNA, 19 bp, Homo sapiens
accttgcaacacacagaca

SEQ ID NO: 378088 - DNA, 21 bp, Homo sapiens
accttgccaagctttcttcta

SEQ ID NO: 378089 - DNA, 16 bp, Homo sapiens
accttgccgagagagg

SEQ ID NO: 378090 - DNA, 18 bp, Homo sapiens
accttgccgagagaggcg

SEQ ID NO: 378091 - DNA, 14 bp, Homo sapiens
accttgcctcccct

SEQ ID NO: 378092 - DNA, 20 bp, Homo sapiens
accttgcctcccctcctctc

SEQ ID NO: 378093 - DNA, 13 bp, Homo sapiens
accttgctaattt

SEQ ID NO: 378094 - DNA, 18 bp, Homo sapiens
accttgctgcagtgtcca

SEQ ID NO: 378095 - DNA, 18 bp, Homo sapiens
accttggagagctcagga

SEQ ID NO: 378096 - DNA, 18 bp, Homo sapiens
accttgggcaagtccctt

SEQ ID NO: 378097 - DNA, 21 bp, Homo sapiens
accttgtgactcagtgtattt

SEQ ID NO: 378098 - DNA, 18 bp, Homo sapiens
accttgttgatgccagct

SEQ ID NO: 378099 - DNA, 16 bp, Homo sapiens
accttgttggagcctg

SEQ ID NO: 378100 - DNA, 18 bp, Homo sapiens
accttgttggagcctgca

SEQ ID NO: 378101 - DNA, 16 bp, Homo sapiens
accttgtttctttctg

SEQ ID NO: 378102 - DNA, 13 bp, Homo sapiens
accttgtttgttt

SEQ ID NO: 378103 - DNA, 17 bp, Homo sapiens
accttgtttgttttatt

SEQ ID NO: 378104 - DNA, 15 bp, Homo sapiens
acctttaaaataata

SEQ ID NO: 378105 - DNA, 16 bp, Homo sapiens
acctttaaatatcatt

SEQ ID NO: 378106 - DNA, 13 bp, Homo sapiens
acctttatgaggt

SEQ ID NO: 378107 - DNA, 14 bp, Homo sapiens
acctttattcttta

SEQ ID NO: 378108 - DNA, 17 bp, Homo sapiens
acctttcaaatttcaca

SEQ ID NO: 378109 - DNA, 21 bp, Homo sapiens
acctttccactcccactgcca

SEQ ID NO: 378110 - DNA, 14 bp, Homo sapiens
acctttctgaggag

SEQ ID NO: 378111 - DNA, 22 bp, Homo sapiens
acctttgcgtggatcaagcttg

SEQ ID NO: 378112 - DNA, 18 bp, Homo sapiens
acctttggagcaaagctg

SEQ ID NO: 378113 - DNA, 15 bp, Homo sapiens
acctttggcttaatt

SEQ ID NO: 378114 - DNA, 19 bp, Homo sapiens
acctttgggatcagcctcc

SEQ ID NO: 378115 - DNA, 13 bp, Homo sapiens
acctttgtgtaat

SEQ ID NO: 378116 - DNA, 16 bp, Homo sapiens
acctttgtgtaataaa

SEQ ID NO: 378117 - DNA, 12 bp, Homo sapiens
accttttctaaa

SEQ ID NO: 378118 - DNA, 23 bp, Homo sapiens
accttttctaaaaagtcaattca

SEQ ID NO: 378119 - DNA, 14 bp, Homo sapiens
accttttgagtgcc

SEQ ID NO: 378120 - DNA, 20 bp, Homo sapiens
accttttgagtgccttacac

SEQ ID NO: 378121 - DNA, 18 bp, Homo sapiens
accttttgataaaatgtt

SEQ ID NO: 378122 - DNA, 21 bp, Homo sapiens
acctttttataggttgttctt

SEQ ID NO: 378123 - DNA, 20 bp, Homo sapiens
acctttttatattttatact

SEQ ID NO: 378124 - DNA, 19 bp, Homo sapiens
acctttttttttgaaacag

SEQ ID NO: 378125 - DNA, 13 bp, Homo sapiens
acgaaacacagaa

SEQ ID NO: 378126 - DNA, 23 bp, Homo sapiens
acgaaatgttattttttaattat

SEQ ID NO: 378127 - DNA, 17 bp, Homo sapiens
acgaacatggcatgtga

SEQ ID NO: 378128 - DNA, 12 bp, Homo sapiens
acgaagaaaaaa

SEQ ID NO: 378129 - DNA, 20 bp, Homo sapiens
acgacaaaaacaagactgcc

SEQ ID NO: 378130 - DNA, 20 bp, Homo sapiens
acgacaacgatgatgcttgt

SEQ ID NO: 378131 - DNA, 20 bp, Homo sapiens
acgacaatagctttaccctc

SEQ ID NO: 378132 - DNA, 14 bp, Homo sapiens
acgactactttgct

SEQ ID NO: 378133 - DNA, 22 bp, Homo sapiens
acgacttcagggcagggctctg

SEQ ID NO: 378134 - DNA, 13 bp, Homo sapiens
acgagatcttcct

SEQ ID NO: 378135 - DNA, 14 bp, Homo sapiens
acgagcactggcca

SEQ ID NO: 378136 - DNA, 16 bp, Homo sapiens
acgagcactggccaga

SEQ ID NO: 378137 - DNA, 18 bp, Homo sapiens
acgagcactggccagaga

SEQ ID NO: 378138 - DNA, 18 bp, Homo sapiens
acgaggcaatgactgtga

SEQ ID NO: 378139 - DNA, 14 bp, Homo sapiens
acgaggcaggggct

SEQ ID NO: 378140 - DNA, 17 bp, Homo sapiens
acgaggcaggggctctg

SEQ ID NO: 378141 - DNA, 20 bp, Homo sapiens
acgaggtggtagctctgagc

SEQ ID NO: 378142 - DNA, 14 bp, Homo sapiens
acgagtcacctgca

SEQ ID NO: 378143 - DNA, 18 bp, Homo sapiens
acgagtcacctgcaagcc

SEQ ID NO: 378144 - DNA, 20 bp, Homo sapiens
acgagtcacctgcaagcccc

SEQ ID NO: 378145 - DNA, 13 bp, Homo sapiens
acgatctcagctc

SEQ ID NO: 378146 - DNA, 22 bp, Homo sapiens
acgattcttaccctttcttttg

SEQ ID NO: 378147 - DNA, 15 bp, Homo sapiens
acgattttaaaatga

SEQ ID NO: 378148 - DNA, 18 bp, Homo sapiens
acgattttaaaatgactt

SEQ ID NO: 378149 - DNA, 18 bp, Homo sapiens
acgcaagggcatcaggca

SEQ ID NO: 378150 - DNA, 15 bp, Homo sapiens
acgcacatgcgaccc

SEQ ID NO: 378151 - DNA, 18 bp, Homo sapiens
acgcaccccactgggaga

SEQ ID NO: 378152 - DNA, 14 bp, Homo sapiens
acgcacctgtagtc

SEQ ID NO: 378153 - DNA, 18 bp, Homo sapiens
acgcacctgtagtcccag

SEQ ID NO: 378154 - DNA, 13 bp, Homo sapiens
acgcacgcacaca

SEQ ID NO: 378155 - DNA, 19 bp, Homo sapiens
acgcacgtgggtcttcagg

SEQ ID NO: 378156 - DNA, 20 bp, Homo sapiens
acgcacgtgggtcttcaggg

SEQ ID NO: 378157 - DNA, 11 bp, Homo sapiens
acgcagacaca

SEQ ID NO: 378158 - DNA, 15 bp, Homo sapiens
acgcagacacacaca

SEQ ID NO: 378159 - DNA, 17 bp, Homo sapiens
acgcagagccccggagc

SEQ ID NO: 378160 - DNA, 15 bp, Homo sapiens
acgcagaggaatttt

SEQ ID NO: 378161 - DNA, 19 bp, Homo sapiens
acgcagatgatccatgagt

SEQ ID NO: 378162 - DNA, 11 bp, Homo sapiens
acgcagcagct

SEQ ID NO: 378163 - DNA, 14 bp, Homo sapiens
acgcagccaggaca

SEQ ID NO: 378164 - DNA, 12 bp, Homo sapiens
acgcaggaatgg

SEQ ID NO: 378165 - DNA, 17 bp, Homo sapiens
attatcgggagcagtgt

SEQ ID NO: 378166 - DNA, 13 bp, Homo sapiens
attatctctttct

SEQ ID NO: 378167 - DNA, 17 bp, Homo sapiens
attatcttctggtgcat

SEQ ID NO: 378168 - DNA, 12 bp, Homo sapiens
attatcttgaaa

SEQ ID NO: 378169 - DNA, 18 bp, Homo sapiens
attatctttgtaattatt

SEQ ID NO: 378170 - DNA, 17 bp, Homo sapiens
attatcttttggctctg

SEQ ID NO: 378171 - DNA, 12 bp, Homo sapiens
attatgacagtt

SEQ ID NO: 378172 - DNA, 15 bp, Homo sapiens
attatgacagttata

SEQ ID NO: 378173 - DNA, 12 bp, Homo sapiens
attatgataaag

SEQ ID NO: 378174 - DNA, 21 bp, Homo sapiens
attatggctttgtgcttgttc

SEQ ID NO: 378175 - DNA, 16 bp, Homo sapiens
attatgggaacaagtg

SEQ ID NO: 378176 - DNA, 19 bp, Homo sapiens
attatgggaacaagtgtac

SEQ ID NO: 378177 - DNA, 18 bp, Homo sapiens
attatgggtatgtgttgc

SEQ ID NO: 378178 - DNA, 23 bp, Homo sapiens
attatgggtatgtgttgccaaag

SEQ ID NO: 378179 - DNA, 17 bp, Homo sapiens
attatgggtcacaggaa

SEQ ID NO: 378180 - DNA, 14 bp, Homo sapiens
attatgtataacaa

SEQ ID NO: 378181 - DNA, 17 bp, Homo sapiens
attatgtattggcattt

SEQ ID NO: 378182 - DNA, 23 bp, Homo sapiens
attatgtcaaatggatgtaatat

SEQ ID NO: 378183 - DNA, 15 bp, Homo sapiens
attatgtccattatt

SEQ ID NO: 378184 - DNA, 20 bp, Homo sapiens
attatgtgacaacctttgtg

SEQ ID NO: 378185 - DNA, 22 bp, Homo sapiens
attattaaatcagttttgtgta

SEQ ID NO: 378186 - DNA, 14 bp, Homo sapiens
attattaacactaa

SEQ ID NO: 378187 - DNA, 19 bp, Homo sapiens
attattaacactaataata

SEQ ID NO: 378188 - DNA, 18 bp, Homo sapiens
attattaactacatttat

SEQ ID NO: 378189 - DNA, 19 bp, Homo sapiens
attattaactacatttatg

SEQ ID NO: 378190 - DNA, 14 bp, Homo sapiens
attattattactgt

SEQ ID NO: 378191 - DNA, 14 bp, Homo sapiens
attattatttgctt

SEQ ID NO: 378192 - DNA, 15 bp, Homo sapiens
attattatttgtact

SEQ ID NO: 378193 - DNA, 21 bp, Homo sapiens
attattcaccatgtaaaacaa

SEQ ID NO: 378194 - DNA, 16 bp, Homo sapiens
attattcatagctgta

SEQ ID NO: 378195 - DNA, 22 bp, Homo sapiens
attattcatagctgtatatttg

SEQ ID NO: 378196 - DNA, 18 bp, Homo sapiens
attattcatcaaactctt

SEQ ID NO: 378197 - DNA, 14 bp, Homo sapiens
attattcatttaaa

SEQ ID NO: 378198 - DNA, 16 bp, Homo sapiens
attattcatttaaaat

SEQ ID NO: 378199 - DNA, 18 bp, Homo sapiens
attattcatttaaaatga

SEQ ID NO: 378200 - DNA, 19 bp, Homo sapiens
attattcatttaaaatgat

SEQ ID NO: 378201 - DNA, 21 bp, Homo sapiens
attattcatttaaaatgatta

SEQ ID NO: 378202 - DNA, 13 bp, Homo sapiens
attattgaatgtt

SEQ ID NO: 378203 - DNA, 12 bp, Homo sapiens
attattgcatta

SEQ ID NO: 378204 - DNA, 17 bp, Homo sapiens
attattggcttgcactt

SEQ ID NO: 378205 - DNA, 17 bp, Homo sapiens
attattgtaaacttttt

SEQ ID NO: 378206 - DNA, 11 bp, Homo sapiens
attatttaaag

SEQ ID NO: 378207 - DNA, 13 bp, Homo sapiens
attatttaaagca

SEQ ID NO: 378208 - DNA, 16 bp, Homo sapiens
attatttatatatgta

SEQ ID NO: 378209 - DNA, 19 bp, Homo sapiens
attatttatcgaaagtaaa

SEQ ID NO: 378210 - DNA, 13 bp, Homo sapiens
attatttcatcat

SEQ ID NO: 378211 - DNA, 22 bp, Homo sapiens
attatttctccatcccctccct

SEQ ID NO: 378212 - DNA, 13 bp, Homo sapiens
attatttgccttt

SEQ ID NO: 378213 - DNA, 17 bp, Homo sapiens
attatttgtactttgtt

SEQ ID NO: 378214 - DNA, 15 bp, Homo sapiens
attatttgtgtaata

SEQ ID NO: 378215 - DNA, 14 bp, Homo sapiens
attattttaaatta

SEQ ID NO: 378216 - DNA, 20 bp, Homo sapiens
attattttaaattataagga

SEQ ID NO: 378217 - DNA, 23 bp, Homo sapiens
attattttaaattataaggactg

SEQ ID NO: 378218 - DNA, 21 bp, Homo sapiens
attattttgaatgtcacaaat

SEQ ID NO: 378219 - DNA, 14 bp, Homo sapiens
attattttgttact

SEQ ID NO: 378220 - DNA, 20 bp, Homo sapiens
attattttgttactgtctgt

SEQ ID NO: 378221 - DNA, 12 bp, Homo sapiens
attatttttaat

SEQ ID NO: 378222 - DNA, 18 bp, Homo sapiens
attatttttgtgtttcta

SEQ ID NO: 378223 - DNA, 20 bp, Homo sapiens
attatttttgtgtttctaaa

SEQ ID NO: 378224 - DNA, 13 bp, Homo sapiens
attcaaaaaaaaa

SEQ ID NO: 378225 - DNA, 22 bp, Homo sapiens
attcaaaaaaatcctagagatt

SEQ ID NO: 378226 - DNA, 17 bp, Homo sapiens
attcaaaaagtgtttat

SEQ ID NO: 378227 - DNA, 14 bp, Homo sapiens
attcaaaagcacaa

SEQ ID NO: 378228 - DNA, 19 bp, Homo sapiens
attcaaaatataacaggtg

SEQ ID NO: 378229 - DNA, 13 bp, Homo sapiens
attcaaaatcttc

SEQ ID NO: 378230 - DNA, 17 bp, Homo sapiens
attcaaacacacagtat

SEQ ID NO: 378231 - DNA, 14 bp, Homo sapiens
attcaaataccaat

SEQ ID NO: 378232 - DNA, 13 bp, Homo sapiens
attcaaatgcatg

SEQ ID NO: 378233 - DNA, 11 bp, Homo sapiens
attcaacaaat

SEQ ID NO: 378234 - DNA, 14 bp, Homo sapiens
attcaacacttatt

SEQ ID NO: 378235 - DNA, 20 bp, Homo sapiens
attcaaggagaatatgataa

SEQ ID NO: 378236 - DNA, 17 bp, Homo sapiens
attcaaggagatataaa

SEQ ID NO: 378237 - DNA, 19 bp, Homo sapiens
attcaaggagatataaaat

SEQ ID NO: 378238 - DNA, 21 bp, Homo sapiens
attcaaggcatttctatcaca

SEQ ID NO: 378239 - DNA, 12 bp, Homo sapiens
attcaagtatta

SEQ ID NO: 378240 - DNA, 16 bp, Homo sapiens
attcaagttattgtac

SEQ ID NO: 378241 - DNA, 22 bp, Homo sapiens
attcaataactattgctgcttt

SEQ ID NO: 378242 - DNA, 15 bp, Homo sapiens
attcaatgctttcta

SEQ ID NO: 378243 - DNA, 23 bp, Homo sapiens
attcaattaagttattaacattt

SEQ ID NO: 378244 - DNA, 17 bp, Homo sapiens
attcaattcctctggga

SEQ ID NO: 378245 - DNA, 13 bp, Homo sapiens
attcaatttctca

SEQ ID NO: 378246 - DNA, 14 bp, Homo sapiens
attcaatttctcac

SEQ ID NO: 378247 - DNA, 15 bp, Homo sapiens
attcaatttctcaca

SEQ ID NO: 378248 - DNA, 22 bp, Homo sapiens
attcaattttctttaaccagtc

SEQ ID NO: 378249 - DNA, 16 bp, Homo sapiens
attcacaagctgcctc

SEQ ID NO: 378250 - DNA, 23 bp, Homo sapiens
attcacaagttaagattcttggt

SEQ ID NO: 378251 - DNA, 11 bp, Homo sapiens
attcacacaca

SEQ ID NO: 378252 - DNA, 14 bp, Homo sapiens
attcacacacagcc

SEQ ID NO: 378253 - DNA, 15 bp, Homo sapiens
attcacacacagcct

SEQ ID NO: 378254 - DNA, 17 bp, Homo sapiens
attcacacacagcctgg

SEQ ID NO: 378255 - DNA, 18 bp, Homo sapiens
attcacactgtgcgtttt

SEQ ID NO: 378256 - DNA, 23 bp, Homo sapiens
attcacactgtgcgttttagagt

SEQ ID NO: 378257 - DNA, 16 bp, Homo sapiens
attcacatatgtctta

SEQ ID NO: 378258 - DNA, 12 bp, Homo sapiens
attcaccaccct

SEQ ID NO: 378259 - DNA, 15 bp, Homo sapiens
attcacctgtaaaac

SEQ ID NO: 378260 - DNA, 17 bp, Homo sapiens
attcacctgtaaaactt

SEQ ID NO: 378261 - DNA, 13 bp, Homo sapiens
attcactaaaata

SEQ ID NO: 378262 - DNA, 14 bp, Homo sapiens
attcactattagag

SEQ ID NO: 378263 - DNA, 19 bp, Homo sapiens
attcactattagagaaaca

SEQ ID NO: 378264 - DNA, 18 bp, Homo sapiens
attcactctcccagaggc

SEQ ID NO: 378265 - DNA, 19 bp, Homo sapiens
attcagaacaccaagactt

SEQ ID NO: 378266 - DNA, 20 bp, Homo sapiens
attcagaacttgtaactaaa

SEQ ID NO: 378267 - DNA, 13 bp, Homo sapiens
attcagacaagca

SEQ ID NO: 378268 - DNA, 19 bp, Homo sapiens
attcagattaggacacagt

SEQ ID NO: 378269 - DNA, 17 bp, Homo sapiens
attcagattgttatcta

SEQ ID NO: 378270 - DNA, 14 bp, Homo sapiens
attcagattttaaa

SEQ ID NO: 378271 - DNA, 19 bp, Homo sapiens
attcagattttaaaaagtc

SEQ ID NO: 378272 - DNA, 19 bp, Homo sapiens
attcagcactgatttcaca

SEQ ID NO: 378273 - DNA, 12 bp, Homo sapiens
attcagctgccc

SEQ ID NO: 378274 - DNA, 22 bp, Homo sapiens
attcaggacttaacggctccag

SEQ ID NO: 378275 - DNA, 20 bp, Homo sapiens
attcagtaccctatggagta

SEQ ID NO: 378276 - DNA, 15 bp, Homo sapiens
attcagttaagaaaa

SEQ ID NO: 378277 - DNA, 16 bp, Homo sapiens
attcagttaagaaaaa

SEQ ID NO: 378278 - DNA, 21 bp, Homo sapiens
attcagttttagtttcaaaat

SEQ ID NO: 378279 - DNA, 23 bp, Homo sapiens
attcagttttagtttcaaaatgt

SEQ ID NO: 378280 - DNA, 18 bp, Homo sapiens
attcataacaatgtatgt

SEQ ID NO: 378281 - DNA, 14 bp, Homo sapiens
attcataatgactt

SEQ ID NO: 378282 - DNA, 13 bp, Homo sapiens
attcatacctgtt

SEQ ID NO: 378283 - DNA, 19 bp, Homo sapiens
attcatagctgtatatttg

SEQ ID NO: 378284 - DNA, 20 bp, Homo sapiens
attcatatttacttcttata

SEQ ID NO: 378285 - DNA, 19 bp, Homo sapiens
attcatcaaataaaccttg

SEQ ID NO: 378286 - DNA, 20 bp, Homo sapiens
attcatctagttaagtcgct

SEQ ID NO: 378287 - DNA, 13 bp, Homo sapiens
attcatctgcaat

SEQ ID NO: 378288 - DNA, 18 bp, Homo sapiens
attcatctgggctggcag

SEQ ID NO: 378289 - DNA, 19 bp, Homo sapiens
attcatctgggctggcaga

SEQ ID NO: 378290 - DNA, 18 bp, Homo sapiens
attcatgctttctccttt

SEQ ID NO: 378291 - DNA, 19 bp, Homo sapiens
attcatgctttctcctttt

SEQ ID NO: 378292 - DNA, 16 bp, Homo sapiens
attcattaataggaaa

SEQ ID NO: 378293 - DNA, 19 bp, Homo sapiens
attcattatttttccactt

SEQ ID NO: 378294 - DNA, 20 bp, Homo sapiens
attcattatttttccacttt

SEQ ID NO: 378295 - DNA, 13 bp, Homo sapiens
attcattctttat

SEQ ID NO: 378296 - DNA, 14 bp, Homo sapiens
attcatttaaaatg

SEQ ID NO: 378297 - DNA, 15 bp, Homo sapiens
attcatttaaaatga

SEQ ID NO: 378298 - DNA, 15 bp, Homo sapiens
attccaacagtgagt

SEQ ID NO: 378299 - DNA, 15 bp, Homo sapiens
attccaagggcccag

SEQ ID NO: 378300 - DNA, 22 bp, Homo sapiens
attccaagggtatgggaagcca

SEQ ID NO: 378301 - DNA, 17 bp, Homo sapiens
attccaatatgatgact

SEQ ID NO: 378302 - DNA, 22 bp, Homo sapiens
attccacagggataccttaatt

SEQ ID NO: 378303 - DNA, 20 bp, Homo sapiens
attccaccaggattaatctc

SEQ ID NO: 378304 - DNA, 21 bp, Homo sapiens
attccacccctccttccctgg

SEQ ID NO: 378305 - DNA, 16 bp, Homo sapiens
attccacctgcaatca

SEQ ID NO: 378306 - DNA, 20 bp, Homo sapiens
attccaccttaaattaaaca

SEQ ID NO: 378307 - DNA, 16 bp, Homo sapiens
attccagaatatctgg

SEQ ID NO: 378308 - DNA, 18 bp, Homo sapiens
attccagaatatctggga

SEQ ID NO: 378309 - DNA, 19 bp, Homo sapiens
attccagagagtggctcct

SEQ ID NO: 378310 - DNA, 19 bp, Homo sapiens
attccagcgtcttctagag

SEQ ID NO: 378311 - DNA, 15 bp, Homo sapiens
attccagctctgccc

SEQ ID NO: 378312 - DNA, 17 bp, Homo sapiens
attccagctctgccccc

SEQ ID NO: 378313 - DNA, 18 bp, Homo sapiens
attccagtgtattttctg

SEQ ID NO: 378314 - DNA, 12 bp, Homo sapiens
attccagttgcg

SEQ ID NO: 378315 - DNA, 15 bp, Homo sapiens
attccatcacagcca

SEQ ID NO: 378316 - DNA, 18 bp, Homo sapiens
attccatcacagccagcc

SEQ ID NO: 378317 - DNA, 23 bp, Homo sapiens
attccatcacagccagcccagct

SEQ ID NO: 378318 - DNA, 11 bp, Homo sapiens
attccatctcc

SEQ ID NO: 378319 - DNA, 13 bp, Homo sapiens
attccatgaatgt

SEQ ID NO: 378320 - DNA, 11 bp, Homo sapiens
attcccactgc

SEQ ID NO: 378321 - DNA, 17 bp, Homo sapiens
attcccactttcattca

SEQ ID NO: 378322 - DNA, 19 bp, Homo sapiens
attcccagatagtcccagc

SEQ ID NO: 378323 - DNA, 17 bp, Homo sapiens
attcccaggcagggagg

SEQ ID NO: 378324 - DNA, 16 bp, Homo sapiens
attcccatcactgctg

SEQ ID NO: 378325 - DNA, 21 bp, Homo sapiens
attcccccatgtggctgaaga

SEQ ID NO: 378326 - DNA, 22 bp, Homo sapiens
attcccctcccacctctccttt

SEQ ID NO: 378327 - DNA, 18 bp, Homo sapiens
attccccttcccttattt

SEQ ID NO: 378328 - DNA, 20 bp, Homo sapiens
attcccgggcccttcagtcc

SEQ ID NO: 378329 - DNA, 20 bp, Homo sapiens
attccctctcatccaggtcc

SEQ ID NO: 378330 - DNA, 17 bp, Homo sapiens
attccctctcctgccca

SEQ ID NO: 378331 - DNA, 15 bp, Homo sapiens
attccctggaattca

SEQ ID NO: 378332 - DNA, 16 bp, Homo sapiens
attccctggaattcac

SEQ ID NO: 378333 - DNA, 14 bp, Homo sapiens
attccctggaccag

SEQ ID NO: 378334 - DNA, 17 bp, Homo sapiens
attccctttttaaatga

SEQ ID NO: 378335 - DNA, 23 bp, Homo sapiens
attccgaaaaaaaaatgttcatt

SEQ ID NO: 378336 - DNA, 22 bp, Homo sapiens
attccgaagagggaatggatgg

SEQ ID NO: 378337 - DNA, 15 bp, Homo sapiens
attccggccctggct

SEQ ID NO: 378338 - DNA, 16 bp, Homo sapiens
attccggccctggctg

SEQ ID NO: 378339 - DNA, 21 bp, Homo sapiens
attccgtattggttgggggct

SEQ ID NO: 378340 - DNA, 19 bp, Homo sapiens
attccgtttacattttaga

SEQ ID NO: 378341 - DNA, 19 bp, Homo sapiens
attcctaagcagtgcttgt

SEQ ID NO: 378342 - DNA, 17 bp, Homo sapiens
attcctacaatatatat

SEQ ID NO: 378343 - DNA, 22 bp, Homo sapiens
attcctacttaaacaaaaactt

SEQ ID NO: 378344 - DNA, 23 bp, Homo sapiens
attcctaggcaactattaataat

SEQ ID NO: 378345 - DNA, 16 bp, Homo sapiens
attcctcagctgccaa

SEQ ID NO: 378346 - DNA, 15 bp, Homo sapiens
attcctccagcctcc

SEQ ID NO: 378347 - DNA, 11 bp, Homo sapiens
attcctccctc

SEQ ID NO: 378348 - DNA, 12 bp, Homo sapiens
attcctctggga

SEQ ID NO: 378349 - DNA, 18 bp, Homo sapiens
attcctcttgcctctctc

SEQ ID NO: 378350 - DNA, 20 bp, Homo sapiens
attcctcttgcctctctcag

SEQ ID NO: 378351 - DNA, 13 bp, Homo sapiens
attcctgaaagaa

SEQ ID NO: 378352 - DNA, 14 bp, Homo sapiens
attcctgcagcctg

SEQ ID NO: 378353 - DNA, 19 bp, Homo sapiens
attcctgcagcctggaggc

SEQ ID NO: 378354 - DNA, 15 bp, Homo sapiens
attcctgcatttgtg

SEQ ID NO: 378355 - DNA, 18 bp, Homo sapiens
attcctgcatttgtgaaa

SEQ ID NO: 378356 - DNA, 12 bp, Homo sapiens
attcctgccttt

SEQ ID NO: 378357 - DNA, 18 bp, Homo sapiens
attcctgcctttcttcca

SEQ ID NO: 378358 - DNA, 19 bp, Homo sapiens
attcctgcctttcttccat

SEQ ID NO: 378359 - DNA, 15 bp, Homo sapiens
attcctgcctttgat

SEQ ID NO: 378360 - DNA, 16 bp, Homo sapiens
attcctggcatgacac

SEQ ID NO: 378361 - DNA, 21 bp, Homo sapiens
attcctggcatgacactctag

SEQ ID NO: 378362 - DNA, 12 bp, Homo sapiens
attcctggcccc

SEQ ID NO: 378363 - DNA, 15 bp, Homo sapiens
attcctgggcctgtc

SEQ ID NO: 378364 - DNA, 16 bp, Homo sapiens
attcctgggcctgtcc

SEQ ID NO: 378365 - DNA, 17 bp, Homo sapiens
attcctgggcctgtccc

SEQ ID NO: 378366 - DNA, 13 bp, Homo sapiens
attcctgttctct

SEQ ID NO: 378367 - DNA, 16 bp, Homo sapiens
attccttagcagctca

SEQ ID NO: 378368 - DNA, 20 bp, Homo sapiens
attccttaggcttaagagag

SEQ ID NO: 378369 - DNA, 12 bp, Homo sapiens
attccttcctgt

SEQ ID NO: 378370 - DNA, 14 bp, Homo sapiens
attccttcctgttc

SEQ ID NO: 378371 - DNA, 17 bp, Homo sapiens
attccttcctgttctga

SEQ ID NO: 378372 - DNA, 16 bp, Homo sapiens
attccttctggccttt

SEQ ID NO: 378373 - DNA, 20 bp, Homo sapiens
attccttgataatgttgtgg

SEQ ID NO: 378374 - DNA, 18 bp, Homo sapiens
attccttggagccactgg

SEQ ID NO: 378375 - DNA, 14 bp, Homo sapiens
attccttggcccag

SEQ ID NO: 378376 - DNA, 16 bp, Homo sapiens
attccttgtcaccagc

SEQ ID NO: 378377 - DNA, 20 bp, Homo sapiens
attcctttaaattctccaac

SEQ ID NO: 378378 - DNA, 21 bp, Homo sapiens
attcctttacaactaaataac

SEQ ID NO: 378379 - DNA, 23 bp, Homo sapiens
attcctttacaactaaataacac

SEQ ID NO: 378380 - DNA, 22 bp, Homo sapiens
attcgaggtgtcaccctgcaga

SEQ ID NO: 378381 - DNA, 22 bp, Homo sapiens
attcgcagcagctccgcctggc

SEQ ID NO: 378382 - DNA, 19 bp, Homo sapiens
attcgcccaaagccagaca

SEQ ID NO: 378383 - DNA, 20 bp, Homo sapiens
attcgcccaaagccagacag

SEQ ID NO: 378384 - DNA, 13 bp, Homo sapiens
attctaaaagaga

SEQ ID NO: 378385 - DNA, 12 bp, Homo sapiens
attctaaacaga

SEQ ID NO: 378386 - DNA, 18 bp, Homo sapiens
attctaagattgtacata

SEQ ID NO: 378387 - DNA, 20 bp, Homo sapiens
attctaagttatttactttt

SEQ ID NO: 378388 - DNA, 17 bp, Homo sapiens
attctactcttgtcatt

SEQ ID NO: 378389 - DNA, 16 bp, Homo sapiens
attctactttgagtgc

SEQ ID NO: 378390 - DNA, 16 bp, Homo sapiens
attctagtctctgatt

SEQ ID NO: 378391 - DNA, 23 bp, Homo sapiens
attctagtctctgatttgcaaat

SEQ ID NO: 378392 - DNA, 14 bp, Homo sapiens
attctataaattca

SEQ ID NO: 378393 - DNA, 15 bp, Homo sapiens
attctatactgttga

SEQ ID NO: 378394 - DNA, 15 bp, Homo sapiens
attctatatgaattt

SEQ ID NO: 378395 - DNA, 21 bp, Homo sapiens
attctatttcaacttcaggaa

SEQ ID NO: 378396 - DNA, 15 bp, Homo sapiens
attctatttgctggg

SEQ ID NO: 378397 - DNA, 18 bp, Homo sapiens
attctatttgctgggctt

SEQ ID NO: 378398 - DNA, 13 bp, Homo sapiens
attctcaaagcag

SEQ ID NO: 378399 - DNA, 14 bp, Homo sapiens
attctcaaagcagg

SEQ ID NO: 378400 - DNA, 16 bp, Homo sapiens
attctcactctgcttt

SEQ ID NO: 378401 - DNA, 12 bp, Homo sapiens
attctcattatt

SEQ ID NO: 378402 - DNA, 16 bp, Homo sapiens
attctcattgcagaat

SEQ ID NO: 378403 - DNA, 16 bp, Homo sapiens
attctccaaatgattt

SEQ ID NO: 378404 - DNA, 18 bp, Homo sapiens
attctccaacccaaagta

SEQ ID NO: 378405 - DNA, 15 bp, Homo sapiens
attctccctgacctt

SEQ ID NO: 378406 - DNA, 20 bp, Homo sapiens
attctcccttttgacacagt

SEQ ID NO: 378407 - DNA, 15 bp, Homo sapiens
attctcctgcctcag

SEQ ID NO: 378408 - DNA, 20 bp, Homo sapiens
attctcctgcctcagcctcc

SEQ ID NO: 378409 - DNA, 14 bp, Homo sapiens
attctcctgtgcta

SEQ ID NO: 378410 - DNA, 13 bp, Homo sapiens
attctctgcaatt

SEQ ID NO: 378411 - DNA, 23 bp, Homo sapiens
attctctgcaatttgtttaaaga

SEQ ID NO: 378412 - DNA, 17 bp, Homo sapiens
attctctgtccagggct

SEQ ID NO: 378413 - DNA, 19 bp, Homo sapiens
attctcttcgctgtgatgc

SEQ ID NO: 378414 - DNA, 12 bp, Homo sapiens
attctcttctca

SEQ ID NO: 378415 - DNA, 17 bp, Homo sapiens
attctcttggctggctt

SEQ ID NO: 378416 - DNA, 13 bp, Homo sapiens
attctgaatgtac

SEQ ID NO: 378417 - DNA, 17 bp, Homo sapiens
attctgcaacagcctgt

SEQ ID NO: 378418 - DNA, 20 bp, Homo sapiens
attctgcaacagcctgtttg

SEQ ID NO: 378419 - DNA, 19 bp, Homo sapiens
attctgcaagcacatctgc

SEQ ID NO: 378420 - DNA, 22 bp, Homo sapiens
attctgcaagcacatctgcatt

SEQ ID NO: 378421 - DNA, 19 bp, Homo sapiens
attctgctcctgaaaaatg

SEQ ID NO: 378422 - DNA, 20 bp, Homo sapiens
attctgctcctgaaaaatga

SEQ ID NO: 378423 - DNA, 10 bp, Homo sapiens
attctgggaa

SEQ ID NO: 378424 - DNA, 15 bp, Homo sapiens
attctgggaaaggtg

SEQ ID NO: 378425 - DNA, 17 bp, Homo sapiens
attctgggaaaggtgct

SEQ ID NO: 378426 - DNA, 20 bp, Homo sapiens
attctgggaaaggtgctcaa

SEQ ID NO: 378427 - DNA, 21 bp, Homo sapiens
attctgggaagcttgagcctc

SEQ ID NO: 378428 - DNA, 23 bp, Homo sapiens
attctgggctcctggaaccaatc

SEQ ID NO: 378429 - DNA, 17 bp, Homo sapiens
attctgtcccccacgtg

SEQ ID NO: 378430 - DNA, 18 bp, Homo sapiens
attctgtccctgtccctg

SEQ ID NO: 378431 - DNA, 14 bp, Homo sapiens
attctgtgaagaat

SEQ ID NO: 378432 - DNA, 15 bp, Homo sapiens
attctgtgaagaatg

SEQ ID NO: 378433 - DNA, 16 bp, Homo sapiens
attctgtgaagaatga

SEQ ID NO: 378434 - DNA, 21 bp, Homo sapiens
aggttctggttagctcagccc

SEQ ID NO: 378435 - DNA, 14 bp, Homo sapiens
aggttcttactgct

SEQ ID NO: 378436 - DNA, 14 bp, Homo sapiens
aggttgaggctaaa

SEQ ID NO: 378437 - DNA, 16 bp, Homo sapiens
aggttgagtgagccgg

SEQ ID NO: 378438 - DNA, 15 bp, Homo sapiens
aggttgatcagtgag

SEQ ID NO: 378439 - DNA, 14 bp, Homo sapiens
aggttgcagctgct

SEQ ID NO: 378440 - DNA, 15 bp, Homo sapiens
aggttgcagctgctc

SEQ ID NO: 378441 - DNA, 17 bp, Homo sapiens
aggttgcagctgctctt

SEQ ID NO: 378442 - DNA, 14 bp, Homo sapiens
aggttgctgttgtg

SEQ ID NO: 378443 - DNA, 14 bp, Homo sapiens
aggttgcttcaaga

SEQ ID NO: 378444 - DNA, 18 bp, Homo sapiens
aggttggaaaagaaatca

SEQ ID NO: 378445 - DNA, 23 bp, Homo sapiens
aggttggaaaagaaatcaatttt

SEQ ID NO: 378446 - DNA, 17 bp, Homo sapiens
aggttggaccccagaga

SEQ ID NO: 378447 - DNA, 12 bp, Homo sapiens
aggttggatggg

SEQ ID NO: 378448 - DNA, 20 bp, Homo sapiens
aggttggatgggagtgggca

SEQ ID NO: 378449 - DNA, 15 bp, Homo sapiens
aggtttaactcagat

SEQ ID NO: 378450 - DNA, 17 bp, Homo sapiens
aggtttaactcagatca

SEQ ID NO: 378451 - DNA, 19 bp, Homo sapiens
aggtttaactcagatcact

SEQ ID NO: 378452 - DNA, 23 bp, Homo sapiens
aggtttaactcagatcactactg

SEQ ID NO: 378453 - DNA, 16 bp, Homo sapiens
aggtttcactgttcat

SEQ ID NO: 378454 - DNA, 17 bp, Homo sapiens
aggtttcactgttcatg

SEQ ID NO: 378455 - DNA, 14 bp, Homo sapiens
aggtttgagtagag

SEQ ID NO: 378456 - DNA, 21 bp, Homo sapiens
aggtttggatgggagtgagac

SEQ ID NO: 378457 - DNA, 17 bp, Homo sapiens
aggtttgtcatcagatg

SEQ ID NO: 378458 - DNA, 14 bp, Homo sapiens
aggttttctgctct

SEQ ID NO: 378459 - DNA, 17 bp, Homo sapiens
aggtttttatgtgcctt

SEQ ID NO: 378460 - DNA, 16 bp, Homo sapiens
agtaaaaataaactgt

SEQ ID NO: 378461 - DNA, 20 bp, Homo sapiens
agtaaaacagatttgttcat

SEQ ID NO: 378462 - DNA, 14 bp, Homo sapiens
agtaaagataaaag

SEQ ID NO: 378463 - DNA, 21 bp, Homo sapiens
agtaaagataaaaggatagga

SEQ ID NO: 378464 - DNA, 23 bp, Homo sapiens
agtaaagttccacttagagaaca

SEQ ID NO: 378465 - DNA, 17 bp, Homo sapiens
agtaaataaactcttca

SEQ ID NO: 378466 - DNA, 22 bp, Homo sapiens
agtaaataaactcttcaaggcc

SEQ ID NO: 378467 - DNA, 15 bp, Homo sapiens
agtaaataaattgtt

SEQ ID NO: 378468 - DNA, 16 bp, Homo sapiens
agtaaataaattgttt

SEQ ID NO: 378469 - DNA, 11 bp, Homo sapiens
agtaaatgcta

SEQ ID NO: 378470 - DNA, 13 bp, Homo sapiens
agtaacacataaa

SEQ ID NO: 378471 - DNA, 14 bp, Homo sapiens
agtaacacataaag

SEQ ID NO: 378472 - DNA, 17 bp, Homo sapiens
agtaacagggccttgct

SEQ ID NO: 378473 - DNA, 18 bp, Homo sapiens
agtaacatataaattaat

SEQ ID NO: 378474 - DNA, 19 bp, Homo sapiens
agtaacatataaattaata

SEQ ID NO: 378475 - DNA, 20 bp, Homo sapiens
agtaacctctacaggcattt

SEQ ID NO: 378476 - DNA, 16 bp, Homo sapiens
agtaacgcgtcttcct

SEQ ID NO: 378477 - DNA, 18 bp, Homo sapiens
agtaacgcgtcttcctga

SEQ ID NO: 378478 - DNA, 22 bp, Homo sapiens
agtaacgcgtcttcctgagtgg

SEQ ID NO: 378479 - DNA, 15 bp, Homo sapiens
agtaactattattat

SEQ ID NO: 378480 - DNA, 14 bp, Homo sapiens
agtaagaagacatg

SEQ ID NO: 378481 - DNA, 22 bp, Homo sapiens
agtaagaccggaagctcctggt

SEQ ID NO: 378482 - DNA, 18 bp, Homo sapiens
agtaagcagagttctttg

SEQ ID NO: 378483 - DNA, 20 bp, Homo sapiens
agtaagcagagttctttgca

SEQ ID NO: 378484 - DNA, 22 bp, Homo sapiens
agtaagcagagttctttgcaag

SEQ ID NO: 378485 - DNA, 18 bp, Homo sapiens
agtaagcctccctcctcg

SEQ ID NO: 378486 - DNA, 19 bp, Homo sapiens
agtaagcctccctcctcgt

SEQ ID NO: 378487 - DNA, 14 bp, Homo sapiens
agtaagctgctttt

SEQ ID NO: 378488 - DNA, 18 bp, Homo sapiens
agtaaggcagctctgtcg

SEQ ID NO: 378489 - DNA, 23 bp, Homo sapiens
agtaagtggggttgcaaccactg

SEQ ID NO: 378490 - DNA, 12 bp, Homo sapiens
agtaatagctga

SEQ ID NO: 378491 - DNA, 15 bp, Homo sapiens
agtaatagctgaacc

SEQ ID NO: 378492 - DNA, 16 bp, Homo sapiens
agtaatagctgaacct

SEQ ID NO: 378493 - DNA, 17 bp, Homo sapiens
agtaatatctttcagtt

SEQ ID NO: 378494 - DNA, 14 bp, Homo sapiens
agtaatccacctgc

SEQ ID NO: 378495 - DNA, 21 bp, Homo sapiens
agtaatgaatttttatgatat

SEQ ID NO: 378496 - DNA, 22 bp, Homo sapiens
agtaatgaatttttatgatatt

SEQ ID NO: 378497 - DNA, 19 bp, Homo sapiens
agtaatgtttaagatctgt

SEQ ID NO: 378498 - DNA, 13 bp, Homo sapiens
agtaattatcggg

SEQ ID NO: 378499 - DNA, 22 bp, Homo sapiens
agtaattatcgggaacagtgtt

SEQ ID NO: 378500 - DNA, 12 bp, Homo sapiens
agtaattatctg

SEQ ID NO: 378501 - DNA, 22 bp, Homo sapiens
agtaattctaccctgaaagtga

SEQ ID NO: 378502 - DNA, 22 bp, Homo sapiens
agtaattggtccgatctttgac

SEQ ID NO: 378503 - DNA, 17 bp, Homo sapiens
agtaattgttacaattt

SEQ ID NO: 378504 - DNA, 11 bp, Homo sapiens
agtacaaagac

SEQ ID NO: 378505 - DNA, 15 bp, Homo sapiens
agtacaaagacaggg

SEQ ID NO: 378506 - DNA, 19 bp, Homo sapiens
agtacaaagacagggaata

SEQ ID NO: 378507 - DNA, 15 bp, Homo sapiens
agtacaataagcaga

SEQ ID NO: 378508 - DNA, 20 bp, Homo sapiens
agtacaataataaatcctca

SEQ ID NO: 378509 - DNA, 14 bp, Homo sapiens
agtacaattctttg

SEQ ID NO: 378510 - DNA, 22 bp, Homo sapiens
agtacaattctttgttgcttaa

SEQ ID NO: 378511 - DNA, 23 bp, Homo sapiens
agtacaattctttgttgcttaat

SEQ ID NO: 378512 - DNA, 14 bp, Homo sapiens
agtacagatcctct

SEQ ID NO: 378513 - DNA, 13 bp, Homo sapiens
agtacagccttca

SEQ ID NO: 378514 - DNA, 22 bp, Homo sapiens
agtacagtggttctacaatcta

SEQ ID NO: 378515 - DNA, 14 bp, Homo sapiens
agtacattccaact

SEQ ID NO: 378516 - DNA, 12 bp, Homo sapiens
agtacatttttg

SEQ ID NO: 378517 - DNA, 11 bp, Homo sapiens
agtaccaaaga

SEQ ID NO: 378518 - DNA, 15 bp, Homo sapiens
agtaccaaagtttta

SEQ ID NO: 378519 - DNA, 19 bp, Homo sapiens
agtaccaaagttttatcaa

SEQ ID NO: 378520 - DNA, 16 bp, Homo sapiens
agtaccaactgagcca

SEQ ID NO: 378521 - DNA, 16 bp, Homo sapiens
agtaccaatcatttta

SEQ ID NO: 378522 - DNA, 15 bp, Homo sapiens
agtaccaatgctgtt

SEQ ID NO: 378523 - DNA, 21 bp, Homo sapiens
agtaccagcgctctaaaagca

SEQ ID NO: 378524 - DNA, 16 bp, Homo sapiens
agtaccatcccactga

SEQ ID NO: 378525 - DNA, 22 bp, Homo sapiens
agtaccccagccactcctcaac

SEQ ID NO: 378526 - DNA, 15 bp, Homo sapiens
agtacccccctgaga

SEQ ID NO: 378527 - DNA, 15 bp, Homo sapiens
agtacctataaagta

SEQ ID NO: 378528 - DNA, 17 bp, Homo sapiens
agtacctgctgccccag

SEQ ID NO: 378529 - DNA, 17 bp, Homo sapiens
agtacctgtagtgagaa

SEQ ID NO: 378530 - DNA, 16 bp, Homo sapiens
agtaccttcagatcct

SEQ ID NO: 378531 - DNA, 20 bp, Homo sapiens
agtaccttcagatcctaccc

SEQ ID NO: 378532 - DNA, 16 bp, Homo sapiens
agtacctttgctcttg

SEQ ID NO: 378533 - DNA, 18 bp, Homo sapiens
agtacctttgctcttgca

SEQ ID NO: 378534 - DNA, 21 bp, Homo sapiens
agtacctttgctcttgcagag

SEQ ID NO: 378535 - DNA, 13 bp, Homo sapiens
agtacctttgtca

SEQ ID NO: 378536 - DNA, 15 bp, Homo sapiens
agtacctttgtcaca

SEQ ID NO: 378537 - DNA, 21 bp, Homo sapiens
agtacgtcccgctgctgtgct

SEQ ID NO: 378538 - DNA, 22 bp, Homo sapiens
agtacgtgtttacttggtgagg

SEQ ID NO: 378539 - DNA, 15 bp, Homo sapiens
agtacgttattgttg

SEQ ID NO: 378540 - DNA, 21 bp, Homo sapiens
cagagcccttcactgccatga

SEQ ID NO: 378541 - DNA, 15 bp, Homo sapiens
cagagccgttcctgg

SEQ ID NO: 378542 - DNA, 19 bp, Homo sapiens
cagagcctggtagagacta

SEQ ID NO: 378543 - DNA, 17 bp, Homo sapiens
cagagcgagactctgtc

SEQ ID NO: 378544 - DNA, 19 bp, Homo sapiens
cagagcgagactctgtctc

SEQ ID NO: 378545 - DNA, 19 bp, Homo sapiens
cagagcgcccctccctagt

SEQ ID NO: 378546 - DNA, 13 bp, Homo sapiens
cagagctcagagg

SEQ ID NO: 378547 - DNA, 22 bp, Homo sapiens
cagagctcatttcggggtcagg

SEQ ID NO: 378548 - DNA, 13 bp, Homo sapiens
cagagctcccagg

SEQ ID NO: 378549 - DNA, 15 bp, Homo sapiens
cagagctcccaggac

SEQ ID NO: 378550 - DNA, 20 bp, Homo sapiens
cagagctcccaggacgcagg

SEQ ID NO: 378551 - DNA, 13 bp, Homo sapiens
cagagctccgatg

SEQ ID NO: 378552 - DNA, 16 bp, Homo sapiens
cagagctccgatgccc

SEQ ID NO: 378553 - DNA, 20 bp, Homo sapiens
cagagctccgatgcccgccc

SEQ ID NO: 378554 - DNA, 21 bp, Homo sapiens
cagagctctggagccacctgt

SEQ ID NO: 378555 - DNA, 18 bp, Homo sapiens
cagagctcttcaagctgt

SEQ ID NO: 378556 - DNA, 21 bp, Homo sapiens
cagagctcttcaagctgtccc

SEQ ID NO: 378557 - DNA, 13 bp, Homo sapiens
cagagctggaaca

SEQ ID NO: 378558 - DNA, 14 bp, Homo sapiens
cagagctggaaggc

SEQ ID NO: 378559 - DNA, 21 bp, Homo sapiens
cagagctggaaggcagggcag

SEQ ID NO: 378560 - DNA, 12 bp, Homo sapiens
cagagctggggg

SEQ ID NO: 378561 - DNA, 13 bp, Homo sapiens
cagagctgggtgg

SEQ ID NO: 378562 - DNA, 19 bp, Homo sapiens
cagagctgtttatggcctc

SEQ ID NO: 378563 - DNA, 18 bp, Homo sapiens
cagagcttattggccact

SEQ ID NO: 378564 - DNA, 20 bp, Homo sapiens
cagagcttattggccactgg

SEQ ID NO: 378565 - DNA, 15 bp, Homo sapiens
cagatgctaataaac

SEQ ID NO: 378566 - DNA, 18 bp, Homo sapiens
cagatggatgtagataca

SEQ ID NO: 378567 - DNA, 22 bp, Homo sapiens
cagatggatttgcctgtgccac

SEQ ID NO: 378568 - DNA, 15 bp, Homo sapiens
cagatggcacctgtg

SEQ ID NO: 378569 - DNA, 20 bp, Homo sapiens
cagatggcacctgtggccag

SEQ ID NO: 378570 - DNA, 17 bp, Homo sapiens
cagatgggtattaaact

SEQ ID NO: 378571 - DNA, 13 bp, Homo sapiens
cagatgtatcatg

SEQ ID NO: 378572 - DNA, 22 bp, Homo sapiens
cagatgtctaaaagattcttta

SEQ ID NO: 378573 - DNA, 17 bp, Homo sapiens
cagatgtcttctgcctg

SEQ ID NO: 378574 - DNA, 18 bp, Homo sapiens
cagatgtcttctgcctgt

SEQ ID NO: 378575 - DNA, 18 bp, Homo sapiens
cagattaggacacagtgt

SEQ ID NO: 378576 - DNA, 13 bp, Homo sapiens
cagattcaatttt

SEQ ID NO: 378577 - DNA, 20 bp, Homo sapiens
cagattcctgggcctgtccc

SEQ ID NO: 378578 - DNA, 19 bp, Homo sapiens
cagattctagcacatcatg

SEQ ID NO: 378579 - DNA, 24 bp, Homo sapiens
cagattctagcacatcatggcagt

SEQ ID NO: 378580 - DNA, 14 bp, Homo sapiens
cagattgcctcctt

SEQ ID NO: 378581 - DNA, 15 bp, Homo sapiens
cagattgctacacac

SEQ ID NO: 378582 - DNA, 16 bp, Homo sapiens
cagattgctacacaca

SEQ ID NO: 378583 - DNA, 17 bp, Homo sapiens
cagattgctacacacac

SEQ ID NO: 378584 - DNA, 12 bp, Homo sapiens
cagattgctttt

SEQ ID NO: 378585 - DNA, 20 bp, Homo sapiens
cagattggcacccctttcta

SEQ ID NO: 378586 - DNA, 13 bp, Homo sapiens
cagattgggggcc

SEQ ID NO: 378587 - DNA, 16 bp, Homo sapiens
cagattgggggccctg

SEQ ID NO: 378588 - DNA, 18 bp, Homo sapiens
cagattgtaaaggtaggt

SEQ ID NO: 378589 - DNA, 14 bp, Homo sapiens
cagattgttatcta

SEQ ID NO: 378590 - DNA, 16 bp, Homo sapiens
cagatttccagtctcc

SEQ ID NO: 378591 - DNA, 24 bp, Homo sapiens
cagatttccagtctccaccaggaa

SEQ ID NO: 378592 - DNA, 14 bp, Homo sapiens
cagatttctcacct

SEQ ID NO: 378593 - DNA, 22 bp, Homo sapiens
cagattttaaaaagtcttcact

SEQ ID NO: 378594 - DNA, 22 bp, Homo sapiens
cagattttttacagctgcctgc

SEQ ID NO: 378595 - DNA, 18 bp, Homo sapiens
cagcaaaagttctttctc

SEQ ID NO: 378596 - DNA, 13 bp, Homo sapiens
cagcaaaatatat

SEQ ID NO: 378597 - DNA, 18 bp, Homo sapiens
cagcaaaatatatgtttg

SEQ ID NO: 378598 - DNA, 16 bp, Homo sapiens
cagcaaaccggggcct

SEQ ID NO: 378599 - DNA, 20 bp, Homo sapiens
cagcaaagcttggtgtcttg

SEQ ID NO: 378600 - DNA, 13 bp, Homo sapiens
cagcaacaacaac

SEQ ID NO: 378601 - DNA, 13 bp, Homo sapiens
cagcaacctgtaa

SEQ ID NO: 378602 - DNA, 22 bp, Homo sapiens
cagcaacttgtctttttctgga

SEQ ID NO: 378603 - DNA, 16 bp, Homo sapiens
cagcaagaataaaaaa

SEQ ID NO: 378604 - DNA, 16 bp, Homo sapiens
cagcaagagcacaaga

SEQ ID NO: 378605 - DNA, 15 bp, Homo sapiens
cagcaagataaacac

SEQ ID NO: 378606 - DNA, 12 bp, Homo sapiens
cagcaagccggc

SEQ ID NO: 378607 - DNA, 16 bp, Homo sapiens
cagcaagcttgtagct

SEQ ID NO: 378608 - DNA, 21 bp, Homo sapiens
cagcaaggaccagtgagacag

SEQ ID NO: 378609 - DNA, 12 bp, Homo sapiens
cagcaaggcagg

SEQ ID NO: 378610 - DNA, 20 bp, Homo sapiens
cagcaaggcaggttggatgg

SEQ ID NO: 378611 - DNA, 13 bp, Homo sapiens
cagcaagtcccag

SEQ ID NO: 378612 - DNA, 23 bp, Homo sapiens
cagcaagtgctgagtctgtgaat

SEQ ID NO: 378613 - DNA, 17 bp, Homo sapiens
cagcaatagggtgcagt

SEQ ID NO: 378614 - DNA, 19 bp, Homo sapiens
cagcaatatattaccagca

SEQ ID NO: 378615 - DNA, 20 bp, Homo sapiens
cagcaatatattaccagcaa

SEQ ID NO: 378616 - DNA, 18 bp, Homo sapiens
cagcaatgcaatgtggaa

SEQ ID NO: 378617 - DNA, 11 bp, Homo sapiens
cagcacagact

SEQ ID NO: 378618 - DNA, 17 bp, Homo sapiens
cagcacagactgttccc

SEQ ID NO: 378619 - DNA, 13 bp, Homo sapiens
cagcacagagagg

SEQ ID NO: 378620 - DNA, 17 bp, Homo sapiens
cagcacagagagggggc

SEQ ID NO: 378621 - DNA, 16 bp, Homo sapiens
cagcacaggggcccca

SEQ ID NO: 378622 - DNA, 22 bp, Homo sapiens
cagcacaggggccccagatctg

SEQ ID NO: 378623 - DNA, 15 bp, Homo sapiens
cagcacatgctggcc

SEQ ID NO: 378624 - DNA, 21 bp, Homo sapiens
cagcaccaccctagtcccttc

SEQ ID NO: 378625 - DNA, 17 bp, Homo sapiens
cagcaccatctctcctc

SEQ ID NO: 378626 - DNA, 19 bp, Homo sapiens
cagcaccatctctcctcct

SEQ ID NO: 378627 - DNA, 18 bp, Homo sapiens
cagcacccagcaactcca

SEQ ID NO: 378628 - DNA, 12 bp, Homo sapiens
cagcacccccac

SEQ ID NO: 378629 - DNA, 15 bp, Homo sapiens
cagcacccccaccca

SEQ ID NO: 378630 - DNA, 13 bp, Homo sapiens
cagcaccctaaga

SEQ ID NO: 378631 - DNA, 18 bp, Homo sapiens
cagcaccctttcaccccc

SEQ ID NO: 378632 - DNA, 19 bp, Homo sapiens
cagcacctcctctctgctg

SEQ ID NO: 378633 - DNA, 20 bp, Homo sapiens
cagcacctcctctctgctgg

SEQ ID NO: 378634 - DNA, 17 bp, Homo sapiens
cagcacctggagcccac

SEQ ID NO: 378635 - DNA, 18 bp, Homo sapiens
cagcacctggagcccaca

SEQ ID NO: 378636 - DNA, 23 bp, Homo sapiens
cagcacctgtaagaaacagagca

SEQ ID NO: 378637 - DNA, 14 bp, Homo sapiens
cagcacctttgtaa

SEQ ID NO: 378638 - DNA, 14 bp, Homo sapiens
cagcactactctgt

SEQ ID NO: 378639 - DNA, 20 bp, Homo sapiens
cagcactacttacttagaga

SEQ ID NO: 378640 - DNA, 13 bp, Homo sapiens
cagcactcccagg

SEQ ID NO: 378641 - DNA, 17 bp, Homo sapiens
cagcactcccagggccc

SEQ ID NO: 378642 - DNA, 12 bp, Homo sapiens
cagcactggctc

SEQ ID NO: 378643 - DNA, 16 bp, Homo sapiens
cagcactggctctctc

SEQ ID NO: 378644 - DNA, 18 bp, Homo sapiens
cagcactggctctctcca

SEQ ID NO: 378645 - DNA, 19 bp, Homo sapiens
cagcactggctctctccag

SEQ ID NO: 378646 - DNA, 21 bp, Homo sapiens
cagcactggctctctccagga

SEQ ID NO: 378647 - DNA, 14 bp, Homo sapiens
cagcactgggaagc

SEQ ID NO: 378648 - DNA, 13 bp, Homo sapiens
cagcactgtccct

SEQ ID NO: 378649 - DNA, 14 bp, Homo sapiens
cagcactgtccctt

SEQ ID NO: 378650 - DNA, 15 bp, Homo sapiens
cagcactgtctcagt

SEQ ID NO: 378651 - DNA, 18 bp, Homo sapiens
cagcactttgggaggcct

SEQ ID NO: 378652 - DNA, 16 bp, Homo sapiens
cagcagaaacccccag

SEQ ID NO: 378653 - DNA, 17 bp, Homo sapiens
cagcagaaacccccagg

SEQ ID NO: 378654 - DNA, 19 bp, Homo sapiens
cagcagaaacccccaggag

SEQ ID NO: 378655 - DNA, 19 bp, Homo sapiens
cagcagagccgttcctggg

SEQ ID NO: 378656 - DNA, 20 bp, Homo sapiens
cagcagagttattgaatctt

SEQ ID NO: 378657 - DNA, 20 bp, Homo sapiens
cagcagcacaattctgtccc

SEQ ID NO: 378658 - DNA, 21 bp, Homo sapiens
cagcagcacaattctgtccct

SEQ ID NO: 378659 - DNA, 23 bp, Homo sapiens
cagcagcacaattctgtccctgt

SEQ ID NO: 378660 - DNA, 14 bp, Homo sapiens
cagcagcagctcaa

SEQ ID NO: 378661 - DNA, 18 bp, Homo sapiens
cagcagcccagcttcctg

SEQ ID NO: 378662 - DNA, 19 bp, Homo sapiens
cagcagcccagcttcctgg

SEQ ID NO: 378663 - DNA, 21 bp, Homo sapiens
cagcagcccagcttcctggtg

SEQ ID NO: 378664 - DNA, 23 bp, Homo sapiens
cagcagcccctgcacaaagccct

SEQ ID NO: 378665 - DNA, 16 bp, Homo sapiens
cagcagcctctgaagt

SEQ ID NO: 378666 - DNA, 18 bp, Homo sapiens
cagcagcctctgaagttg

SEQ ID NO: 378667 - DNA, 12 bp, Homo sapiens
cagcagcctgct

SEQ ID NO: 378668 - DNA, 20 bp, Homo sapiens
cagcagcctgcttcccacct

SEQ ID NO: 378669 - DNA, 21 bp, Homo sapiens
cagcagcctgcttcccacctc

SEQ ID NO: 378670 - DNA, 22 bp, Homo sapiens
cagcagcctgcttcccacctcc

SEQ ID NO: 378671 - DNA, 13 bp, Homo sapiens
cagcagcctgtga

SEQ ID NO: 378672 - DNA, 15 bp, Homo sapiens
cagcagcggcccaga

SEQ ID NO: 378673 - DNA, 15 bp, Homo sapiens
cagcagctaggactg

SEQ ID NO: 378674 - DNA, 17 bp, Homo sapiens
cagcagctaggactgag

SEQ ID NO: 378675 - DNA, 19 bp, Homo sapiens
cagcagctaggactgagga

SEQ ID NO: 378676 - DNA, 16 bp, Homo sapiens
cagcagctccgcctgg

SEQ ID NO: 378677 - DNA, 17 bp, Homo sapiens
cagcagctccgcctggc

SEQ ID NO: 378678 - DNA, 18 bp, Homo sapiens
cagcagctccgcctggca

SEQ ID NO: 378679 - DNA, 19 bp, Homo sapiens
cagcagctccgcctggcac

SEQ ID NO: 378680 - DNA, 14 bp, Homo sapiens
cagcagctgaggcc

SEQ ID NO: 378681 - DNA, 18 bp, Homo sapiens
cagcagcttcaccagagc

SEQ ID NO: 378682 - DNA, 13 bp, Homo sapiens
cagcagcttggct

SEQ ID NO: 378683 - DNA, 19 bp, Homo sapiens
cagcagcttggctgagccc

SEQ ID NO: 378684 - DNA, 16 bp, Homo sapiens
cagcaggcagaggaga

SEQ ID NO: 378685 - DNA, 14 bp, Homo sapiens
cagcaggcgtgcct

SEQ ID NO: 378686 - DNA, 16 bp, Homo sapiens
cagcagggcgggccag

SEQ ID NO: 378687 - DNA, 18 bp, Homo sapiens
cagcaggtgtggtggctc

SEQ ID NO: 378688 - DNA, 20 bp, Homo sapiens
cagcaggtgtggtggctcat

SEQ ID NO: 378689 - DNA, 21 bp, Homo sapiens
cagcaggtgtggtggctcatg

SEQ ID NO: 378690 - DNA, 19 bp, Homo sapiens
cagcaggttctctcctgtg

SEQ ID NO: 378691 - DNA, 20 bp, Homo sapiens
cagcaggttctctcctgtga

SEQ ID NO: 378692 - DNA, 19 bp, Homo sapiens
cagcagtcggttggagcga

SEQ ID NO: 378693 - DNA, 20 bp, Homo sapiens
cagcagtgctgggcccagcc

SEQ ID NO: 378694 - DNA, 16 bp, Homo sapiens
cagcagttcacttcct

SEQ ID NO: 378695 - DNA, 17 bp, Homo sapiens
cagcagttcacttccta

SEQ ID NO: 378696 - DNA, 23 bp, Homo sapiens
cagcagttgaatgacaacagaag

SEQ ID NO: 378697 - DNA, 13 bp, Homo sapiens
cagcagttgacat

SEQ ID NO: 378698 - DNA, 21 bp, Homo sapiens
cagcagttgctagcaacaact

SEQ ID NO: 378699 - DNA, 13 bp, Homo sapiens
cagcatacaaaaa

SEQ ID NO: 378700 - DNA, 20 bp, Homo sapiens
cagcatcaaacatgaaaaca

SEQ ID NO: 378701 - DNA, 22 bp, Homo sapiens
cagcatcaaacatgaaaacatt

SEQ ID NO: 378702 - DNA, 16 bp, Homo sapiens
cagcatccagcctgtg

SEQ ID NO: 378703 - DNA, 12 bp, Homo sapiens
cagcatctgatt

SEQ ID NO: 378704 - DNA, 16 bp, Homo sapiens
cagcatgccccttggc

SEQ ID NO: 378705 - DNA, 17 bp, Homo sapiens
cagcatgccccttggct

SEQ ID NO: 378706 - DNA, 20 bp, Homo sapiens
cagcatgccccttggctgga

SEQ ID NO: 378707 - DNA, 15 bp, Homo sapiens
cagcatgtctactgc

SEQ ID NO: 378708 - DNA, 15 bp, Homo sapiens
cagcatgtgccaaga

SEQ ID NO: 378709 - DNA, 16 bp, Homo sapiens
cagcatgtggggaagc

SEQ ID NO: 378710 - DNA, 18 bp, Homo sapiens
cagcatgtggggaagcaa

SEQ ID NO: 378711 - DNA, 22 bp, Homo sapiens
cagcatgtgtatttccagtgca

SEQ ID NO: 378712 - DNA, 15 bp, Homo sapiens
cagcatgtgtgtgtc

SEQ ID NO: 378713 - DNA, 15 bp, Homo sapiens
cagcattaggctttt

SEQ ID NO: 378714 - DNA, 15 bp, Homo sapiens
cagcattcaaaatag

SEQ ID NO: 378715 - DNA, 12 bp, Homo sapiens
cagcattccagc

SEQ ID NO: 378716 - DNA, 19 bp, Homo sapiens
cagcattccagctctgccc

SEQ ID NO: 378717 - DNA, 15 bp, Homo sapiens
cagcattctcactcc

SEQ ID NO: 378718 - DNA, 18 bp, Homo sapiens
cagccaaaagtaagtgga

SEQ ID NO: 378719 - DNA, 15 bp, Homo sapiens
cagccaaaccctgtc

SEQ ID NO: 378720 - DNA, 22 bp, Homo sapiens
cagccaaatgacttcatttctg

SEQ ID NO: 378721 - DNA, 17 bp, Homo sapiens
cagccaagacaaggagg

SEQ ID NO: 378722 - DNA, 15 bp, Homo sapiens
cagccaagcccaccc

SEQ ID NO: 378723 - DNA, 21 bp, Homo sapiens
cagccaaggtgctaaaaggaa

SEQ ID NO: 378724 - DNA, 22 bp, Homo sapiens
cagccaaggtgctaaaaggaat

SEQ ID NO: 378725 - DNA, 23 bp, Homo sapiens
cagccaaggtgctaaaaggaata

SEQ ID NO: 378726 - DNA, 14 bp, Homo sapiens
cagccaagtgcctt

SEQ ID NO: 378727 - DNA, 17 bp, Homo sapiens
cagccaagtgccttccg

SEQ ID NO: 378728 - DNA, 15 bp, Homo sapiens
cagccacccagccag

SEQ ID NO: 378729 - DNA, 17 bp, Homo sapiens
cagccacccagccagga

SEQ ID NO: 378730 - DNA, 17 bp, Homo sapiens
cagccaccccgggctct

SEQ ID NO: 378731 - DNA, 22 bp, Homo sapiens
cagccaccccgggctctctgct

SEQ ID NO: 378732 - DNA, 22 bp, Homo sapiens
cagccacccggatctccaggcc

SEQ ID NO: 378733 - DNA, 21 bp, Homo sapiens
cagccacctccacccccaaga

SEQ ID NO: 378734 - DNA, 12 bp, Homo sapiens
cagccaccttcc

SEQ ID NO: 378735 - DNA, 13 bp, Homo sapiens
cagccaccttcct

SEQ ID NO: 378736 - DNA, 22 bp, Homo sapiens
cagccaccttcctgactgggaa

SEQ ID NO: 378737 - DNA, 21 bp, Homo sapiens
cagccacgaggtggtagctct

SEQ ID NO: 378738 - DNA, 22 bp, Homo sapiens
cagccacgaggtggtagctctg

SEQ ID NO: 378739 - DNA, 22 bp, Homo sapiens
cagccacgggcacaagacccct

SEQ ID NO: 378740 - DNA, 22 bp, Homo sapiens
cagccacttggtttttggctct

SEQ ID NO: 378741 - DNA, 15 bp, Homo sapiens
cagccagaaactgaa

SEQ ID NO: 378742 - DNA, 20 bp, Homo sapiens
cagccagaaactgaactggc

SEQ ID NO: 378743 - DNA, 20 bp, Homo sapiens
cagccagcaatgatgtccag

SEQ ID NO: 378744 - DNA, 23 bp, Homo sapiens
cagccagcaatgatgtccagaag

SEQ ID NO: 378745 - DNA, 19 bp, Homo sapiens
cagccagcaggttctctcc

SEQ ID NO: 378746 - DNA, 23 bp, Homo sapiens
cagccagcaggttctctcctgtg

SEQ ID NO: 378747 - DNA, 14 bp, Homo sapiens
cagccagccagtct

SEQ ID NO: 378748 - DNA, 12 bp, Homo sapiens
cagccagcccag

SEQ ID NO: 378749 - DNA, 15 bp, Homo sapiens
cagccagcccagctc

SEQ ID NO: 378750 - DNA, 21 bp, Homo sapiens
cagccagcccagctccactca

SEQ ID NO: 378751 - DNA, 14 bp, Homo sapiens
cagccagcccttcc

SEQ ID NO: 378752 - DNA, 18 bp, Homo sapiens
cagccagcccttcccagg

SEQ ID NO: 378753 - DNA, 22 bp, Homo sapiens
cagccagcccttcccaggccag

SEQ ID NO: 378754 - DNA, 23 bp, Homo sapiens
cagccagcccttcccaggccagc

SEQ ID NO: 378755 - DNA, 14 bp, Homo sapiens
cagccagccgtgag

SEQ ID NO: 378756 - DNA, 23 bp, Homo sapiens
cagccagctgcccacaagccata

SEQ ID NO: 378757 - DNA, 15 bp, Homo sapiens
cagccagcttggtgg

SEQ ID NO: 378758 - DNA, 23 bp, Homo sapiens
cagccagcttggtggttatgtcc

SEQ ID NO: 378759 - DNA, 23 bp, Homo sapiens
cagccagggagcccggggcagag

SEQ ID NO: 378760 - DNA, 16 bp, Homo sapiens
cagccagtaaggcagc

SEQ ID NO: 378761 - DNA, 20 bp, Homo sapiens
cagccagtaaggcagctctg

SEQ ID NO: 378762 - DNA, 23 bp, Homo sapiens
cagccagtaaggcagctctgtcg

SEQ ID NO: 378763 - DNA, 15 bp, Homo sapiens
cagccagtcttgcct

SEQ ID NO: 378764 - DNA, 20 bp, Homo sapiens
cagccagtcttgcctaggcc

SEQ ID NO: 378765 - DNA, 22 bp, Homo sapiens
cagccagtggccgaacccccca

SEQ ID NO: 378766 - DNA, 17 bp, Homo sapiens
cagccatgggccctctg

SEQ ID NO: 378767 - DNA, 16 bp, Homo sapiens
cagccatgtccaagtt

SEQ ID NO: 378768 - DNA, 19 bp, Homo sapiens
cagccattcactgccccca

SEQ ID NO: 378769 - DNA, 18 bp, Homo sapiens
cagccattcatctgggct

SEQ ID NO: 378770 - DNA, 23 bp, Homo sapiens
cagccattcatctgggctggcag

SEQ ID NO: 378771 - DNA, 13 bp, Homo sapiens
cagccattcctgt

SEQ ID NO: 378772 - DNA, 17 bp, Homo sapiens
cagcccaacagaaggaa

SEQ ID NO: 378773 - DNA, 16 bp, Homo sapiens
cagcccaaccaggagg

SEQ ID NO: 378774 - DNA, 18 bp, Homo sapiens
cagcccaaccaggagggg

SEQ ID NO: 378775 - DNA, 22 bp, Homo sapiens
cagcccaaccgggaaaggcatc

SEQ ID NO: 378776 - DNA, 12 bp, Homo sapiens
cagcccaataaa

SEQ ID NO: 378777 - DNA, 19 bp, Homo sapiens
cagcccaataaaggtccct

SEQ ID NO: 378778 - DNA, 19 bp, Homo sapiens
cagcccacagtgctcagtt

SEQ ID NO: 378779 - DNA, 11 bp, Homo sapiens
cagcccacccc

SEQ ID NO: 378780 - DNA, 16 bp, Homo sapiens
cagcccacccccctca

SEQ ID NO: 378781 - DNA, 19 bp, Homo sapiens
cagcccacccccctcattt

SEQ ID NO: 378782 - DNA, 11 bp, Homo sapiens
cagcccaccct

SEQ ID NO: 378783 - DNA, 20 bp, Homo sapiens
cagcccagaacgggcctccc

SEQ ID NO: 378784 - DNA, 19 bp, Homo sapiens
cagcccagacccccagtgt

SEQ ID NO: 378785 - DNA, 15 bp, Homo sapiens
cagcccagcccagct

SEQ ID NO: 378786 - DNA, 12 bp, Homo sapiens
cagcccagctcc

SEQ ID NO: 378787 - DNA, 14 bp, Homo sapiens
cagcccagctccac

SEQ ID NO: 378788 - DNA, 17 bp, Homo sapiens
cagcccagctgctctgc

SEQ ID NO: 378789 - DNA, 18 bp, Homo sapiens
cagcccagctgctctgcc

SEQ ID NO: 378790 - DNA, 11 bp, Homo sapiens
cagcccagggt

SEQ ID NO: 378791 - DNA, 17 bp, Homo sapiens
cagcccagggttccccc

SEQ ID NO: 378792 - DNA, 18 bp, Homo sapiens
cagcccagggttccccca

SEQ ID NO: 378793 - DNA, 16 bp, Homo sapiens
cagcccatcttgcctc

SEQ ID NO: 378794 - DNA, 18 bp, Homo sapiens
cagcccatcttgcctcca

SEQ ID NO: 378795 - DNA, 15 bp, Homo sapiens
cagcccatgcccacc

SEQ ID NO: 378796 - DNA, 19 bp, Homo sapiens
cagcccatgcccacctgcc

SEQ ID NO: 378797 - DNA, 21 bp, Homo sapiens
cagccccacccaggagggagg

SEQ ID NO: 378798 - DNA, 21 bp, Homo sapiens
cagccccacccctaagtgccc

SEQ ID NO: 378799 - DNA, 23 bp, Homo sapiens
cagccccacccctaagtgcccaa

SEQ ID NO: 378800 - DNA, 12 bp, Homo sapiens
cagccccagcaa

SEQ ID NO: 378801 - DNA, 23 bp, Homo sapiens
cagccccagcgagtctggagacc

SEQ ID NO: 378802 - DNA, 16 bp, Homo sapiens
cagccccatagaaaac

SEQ ID NO: 378803 - DNA, 18 bp, Homo sapiens
cagccccatagaaaacaa

SEQ ID NO: 378804 - DNA, 15 bp, Homo sapiens
cagccccatccttcc

SEQ ID NO: 378805 - DNA, 14 bp, Homo sapiens
cagccccccacccc

SEQ ID NO: 378806 - DNA, 12 bp, Homo sapiens
cagccccctcca

SEQ ID NO: 378807 - DNA, 13 bp, Homo sapiens
cagccccctccac

SEQ ID NO: 378808 - DNA, 24 bp, Homo sapiens
cagccccctccacaccagtggcct

SEQ ID NO: 378809 - DNA, 14 bp, Homo sapiens
cagccccctggatg

SEQ ID NO: 378810 - DNA, 12 bp, Homo sapiens
cagccccctggc

SEQ ID NO: 378811 - DNA, 16 bp, Homo sapiens
agtactattactagta

SEQ ID NO: 378812 - DNA, 14 bp, Homo sapiens
agtactattactat

SEQ ID NO: 378813 - DNA, 22 bp, Homo sapiens
agtactattactattactattt

SEQ ID NO: 378814 - DNA, 22 bp, Homo sapiens
agtactcactaaaagttctcaa

SEQ ID NO: 378815 - DNA, 15 bp, Homo sapiens
agtactcagaggctg

SEQ ID NO: 378816 - DNA, 16 bp, Homo sapiens
agtactcctgcaaaat

SEQ ID NO: 378817 - DNA, 15 bp, Homo sapiens
agtactccttaagaa

SEQ ID NO: 378818 - DNA, 18 bp, Homo sapiens
agtactccttaagaacac

SEQ ID NO: 378819 - DNA, 13 bp, Homo sapiens
agtactctctgct

SEQ ID NO: 378820 - DNA, 17 bp, Homo sapiens
agtactctctgctctag

SEQ ID NO: 378821 - DNA, 13 bp, Homo sapiens
agtacttaatata

SEQ ID NO: 378822 - DNA, 15 bp, Homo sapiens
agtacttcaggcacg

SEQ ID NO: 378823 - DNA, 11 bp, Homo sapiens
agtacttgaaa

SEQ ID NO: 378824 - DNA, 23 bp, Homo sapiens
agtacttgggagacctgtaatca

SEQ ID NO: 378825 - DNA, 23 bp, Homo sapiens
agtacttttaacgtatgtatttc

SEQ ID NO: 378826 - DNA, 17 bp, Homo sapiens
agtagaaattttacaat

SEQ ID NO: 378827 - DNA, 16 bp, Homo sapiens
agtagaaggtcggagg

SEQ ID NO: 378828 - DNA, 14 bp, Homo sapiens
agtagaataaaaac

SEQ ID NO: 378829 - DNA, 15 bp, Homo sapiens
agtagaatctcagca

SEQ ID NO: 378830 - DNA, 20 bp, Homo sapiens
agtagacctgattttcaaaa

SEQ ID NO: 378831 - DNA, 20 bp, Homo sapiens
agtagagatggggaaagaat

SEQ ID NO: 378832 - DNA, 22 bp, Homo sapiens
agtagagatttcatagctattt

SEQ ID NO: 378833 - DNA, 17 bp, Homo sapiens
agtagagcaaagactta

SEQ ID NO: 378834 - DNA, 14 bp, Homo sapiens
agtagagtcatctc

SEQ ID NO: 378835 - DNA, 16 bp, Homo sapiens
agtagagtcatctcca

SEQ ID NO: 378836 - DNA, 23 bp, Homo sapiens
agtagagtcatctccatcagctg

SEQ ID NO: 378837 - DNA, 15 bp, Homo sapiens
agtagatggtgaaat

SEQ ID NO: 378838 - DNA, 21 bp, Homo sapiens
agtagcagtcatcatcttttt

SEQ ID NO: 378839 - DNA, 17 bp, Homo sapiens
agtagccattttgtaac

SEQ ID NO: 378840 - DNA, 20 bp, Homo sapiens
agtagccctttctgtgtgca

SEQ ID NO: 378841 - DNA, 21 bp, Homo sapiens
agtagccctttctgtgtgcac

SEQ ID NO: 378842 - DNA, 14 bp, Homo sapiens
agtagctgataaag

SEQ ID NO: 378843 - DNA, 20 bp, Homo sapiens
agtagctgccaaaaagaaca

SEQ ID NO: 378844 - DNA, 21 bp, Homo sapiens
agtagctgccaaaaagaacac

SEQ ID NO: 378845 - DNA, 21 bp, Homo sapiens
agtagctgggatgacaggcgc

SEQ ID NO: 378846 - DNA, 16 bp, Homo sapiens
agtaggaccaatgttg

SEQ ID NO: 378847 - DNA, 14 bp, Homo sapiens
agtaggcattcttt

SEQ ID NO: 378848 - DNA, 21 bp, Homo sapiens
agtaggctaaaaacattttaa

SEQ ID NO: 378849 - DNA, 17 bp, Homo sapiens
agtaggggcatggtata

SEQ ID NO: 378850 - DNA, 16 bp, Homo sapiens
agtagggttgccagtc

SEQ ID NO: 378851 - DNA, 17 bp, Homo sapiens
agtaggtccaagggcca

SEQ ID NO: 378852 - DNA, 17 bp, Homo sapiens
agtaggtctgcacacat

SEQ ID NO: 378853 - DNA, 20 bp, Homo sapiens
agtaggtgggtcttggattg

SEQ ID NO: 378854 - DNA, 17 bp, Homo sapiens
agtaggttgaggacagg

SEQ ID NO: 378855 - DNA, 13 bp, Homo sapiens
agtagtaaaatta

SEQ ID NO: 378856 - DNA, 17 bp, Homo sapiens
agtagtaaaattagaaa

SEQ ID NO: 378857 - DNA, 16 bp, Homo sapiens
agtagtaatagagcaa

SEQ ID NO: 378858 - DNA, 14 bp, Homo sapiens
agtagtacttgaaa

SEQ ID NO: 378859 - DNA, 14 bp, Homo sapiens
agtagtgcctgtga

SEQ ID NO: 378860 - DNA, 22 bp, Homo sapiens
agtagttgatgaccaatctctg

SEQ ID NO: 378861 - DNA, 12 bp, Homo sapiens
agtagtttgtat

SEQ ID NO: 378862 - DNA, 17 bp, Homo sapiens
agtagtttgtataactt

SEQ ID NO: 378863 - DNA, 15 bp, Homo sapiens
agtataaagtaaaat

SEQ ID NO: 378864 - DNA, 22 bp, Homo sapiens
agtatactgtgtgggatactta

SEQ ID NO: 378865 - DNA, 17 bp, Homo sapiens
agtatagaatgaactgt

SEQ ID NO: 378866 - DNA, 17 bp, Homo sapiens
agtatataaagttttgc

SEQ ID NO: 378867 - DNA, 17 bp, Homo sapiens
agtatataagctgttta

SEQ ID NO: 378868 - DNA, 19 bp, Homo sapiens
agtatatagccttaagtct

SEQ ID NO: 378869 - DNA, 18 bp, Homo sapiens
agtatatctaatggctgt

SEQ ID NO: 378870 - DNA, 22 bp, Homo sapiens
agtatatctatctatatataca

SEQ ID NO: 378871 - DNA, 15 bp, Homo sapiens
agtatatctggacaa

SEQ ID NO: 378872 - DNA, 16 bp, Homo sapiens
agtatatttatataat

SEQ ID NO: 378873 - DNA, 16 bp, Homo sapiens
agtatatttatttcta

SEQ ID NO: 378874 - DNA, 13 bp, Homo sapiens
agtatattttctt

SEQ ID NO: 378875 - DNA, 14 bp, Homo sapiens
agtatcaaaggcag

SEQ ID NO: 378876 - DNA, 15 bp, Homo sapiens
agtatcaaaggcaga

SEQ ID NO: 378877 - DNA, 16 bp, Homo sapiens
agtatcaaggctgcct

SEQ ID NO: 378878 - DNA, 19 bp, Homo sapiens
agtatcaaggctgcctgga

SEQ ID NO: 378879 - DNA, 21 bp, Homo sapiens
agtatcaaggctgcctggaga

SEQ ID NO: 378880 - DNA, 15 bp, Homo sapiens
agtatcaggcctgcc

SEQ ID NO: 378881 - DNA, 11 bp, Homo sapiens
agtatcatgca

SEQ ID NO: 378882 - DNA, 21 bp, Homo sapiens
agtatccaattatgtgacaac

SEQ ID NO: 378883 - DNA, 14 bp, Homo sapiens
agtatcctgctggt

SEQ ID NO: 378884 - DNA, 13 bp, Homo sapiens
agtatctggctgg

SEQ ID NO: 378885 - DNA, 14 bp, Homo sapiens
agtatctggctggg

SEQ ID NO: 378886 - DNA, 14 bp, Homo sapiens
agtatctgggaact

SEQ ID NO: 378887 - DNA, 15 bp, Homo sapiens
agtatctgtatctct

SEQ ID NO: 378888 - DNA, 11 bp, Homo sapiens
agtatcttgaa

SEQ ID NO: 378889 - DNA, 14 bp, Homo sapiens
agtatgaagacact

SEQ ID NO: 378890 - DNA, 16 bp, Homo sapiens
agtatgaataaagaca

SEQ ID NO: 378891 - DNA, 13 bp, Homo sapiens
agtatgaatgatg

SEQ ID NO: 378892 - DNA, 18 bp, Homo sapiens
agtatgagaaatacagtg

SEQ ID NO: 378893 - DNA, 20 bp, Homo sapiens
agtatgagaaatacagtgct

SEQ ID NO: 378894 - DNA, 18 bp, Homo sapiens
agtatgcaagaagaatat

SEQ ID NO: 378895 - DNA, 16 bp, Homo sapiens
agtatgtaaagtatgt

SEQ ID NO: 378896 - DNA, 21 bp, Homo sapiens
agtatgtaaagtatgtaaaca

SEQ ID NO: 378897 - DNA, 14 bp, Homo sapiens
agtatgtgtaaaat

SEQ ID NO: 378898 - DNA, 20 bp, Homo sapiens
agtatgtgtctagcaaagcc

SEQ ID NO: 378899 - DNA, 23 bp, Homo sapiens
agtattatttctccatcccctcc

SEQ ID NO: 378900 - DNA, 14 bp, Homo sapiens
agtattccacctta

SEQ ID NO: 378901 - DNA, 15 bp, Homo sapiens
agtattctcagagca

SEQ ID NO: 378902 - DNA, 18 bp, Homo sapiens
agtattgacttctttttg

SEQ ID NO: 378903 - DNA, 18 bp, Homo sapiens
agtattgccacctctggc

SEQ ID NO: 378904 - DNA, 12 bp, Homo sapiens
agtattgctaat

SEQ ID NO: 378905 - DNA, 22 bp, Homo sapiens
agtattgtccatatcagacctc

SEQ ID NO: 378906 - DNA, 12 bp, Homo sapiens
agtatttatata

SEQ ID NO: 378907 - DNA, 15 bp, Homo sapiens
agtatttatatattt

SEQ ID NO: 378908 - DNA, 16 bp, Homo sapiens
agtatttatatattta

SEQ ID NO: 378909 - DNA, 17 bp, Homo sapiens
agtatttatatatttat

SEQ ID NO: 378910 - DNA, 19 bp, Homo sapiens
agtatttatatatttataa

SEQ ID NO: 378911 - DNA, 20 bp, Homo sapiens
agtatttatatatttataac

SEQ ID NO: 378912 - DNA, 19 bp, Homo sapiens
agtatttcagatgctttag

SEQ ID NO: 378913 - DNA, 16 bp, Homo sapiens
agtatttgagagttct

SEQ ID NO: 378914 - DNA, 14 bp, Homo sapiens
agtcaaaagcctgg

SEQ ID NO: 378915 - DNA, 16 bp, Homo sapiens
agtcaaacagtgtggc

SEQ ID NO: 378916 - DNA, 21 bp, Homo sapiens
agtcaaagacgctgagtggga

SEQ ID NO: 378917 - DNA, 14 bp, Homo sapiens
agtcaaataactcc

SEQ ID NO: 378918 - DNA, 14 bp, Homo sapiens
agtcaagtcaaata

SEQ ID NO: 378919 - DNA, 16 bp, Homo sapiens
agtcaagtgtgcctgc

SEQ ID NO: 378920 - DNA, 14 bp, Homo sapiens
agtcaatcatttct

SEQ ID NO: 378921 - DNA, 15 bp, Homo sapiens
agtcaatcatttctc

SEQ ID NO: 378922 - DNA, 14 bp, Homo sapiens
agtcacacattata

SEQ ID NO: 378923 - DNA, 21 bp, Homo sapiens
agtcacacattatagaaatta

SEQ ID NO: 378924 - DNA, 16 bp, Homo sapiens
agtcacactgctagca

SEQ ID NO: 378925 - DNA, 13 bp, Homo sapiens
agtcacagccatt

SEQ ID NO: 378926 - DNA, 16 bp, Homo sapiens
agtcacagccatttca

SEQ ID NO: 378927 - DNA, 17 bp, Homo sapiens
agtcacagccatttcaa

SEQ ID NO: 378928 - DNA, 21 bp, Homo sapiens
agtcacagccgtttgaatata

SEQ ID NO: 378929 - DNA, 13 bp, Homo sapiens
agtcacagctgca

SEQ ID NO: 378930 - DNA, 18 bp, Homo sapiens
agtcacagctgcagctgg

SEQ ID NO: 378931 - DNA, 19 bp, Homo sapiens
agtcacagctgcagctggg

SEQ ID NO: 378932 - DNA, 19 bp, Homo sapiens
agtcacagctttcccaggt

SEQ ID NO: 378933 - DNA, 17 bp, Homo sapiens
agtcaccaggacttggg

SEQ ID NO: 378934 - DNA, 15 bp, Homo sapiens
agtcaccctgtggca

SEQ ID NO: 378935 - DNA, 14 bp, Homo sapiens
agtcacccttctgg

SEQ ID NO: 378936 - DNA, 17 bp, Homo sapiens
agtcacccttctgggca

SEQ ID NO: 378937 - DNA, 13 bp, Homo sapiens
agtcacctcctcc

SEQ ID NO: 378938 - DNA, 14 bp, Homo sapiens
agtcacctcctcca

SEQ ID NO: 378939 - DNA, 17 bp, Homo sapiens
agtcacctcctccactc

SEQ ID NO: 378940 - DNA, 13 bp, Homo sapiens
agtcacctgctgg

SEQ ID NO: 378941 - DNA, 13 bp, Homo sapiens
agtcaccttccag

SEQ ID NO: 378942 - DNA, 12 bp, Homo sapiens
agtcagagaaaa

SEQ ID NO: 378943 - DNA, 14 bp, Homo sapiens
agtcagagccctgg

SEQ ID NO: 378944 - DNA, 21 bp, Homo sapiens
agtcagatgagcaaggacatt

SEQ ID NO: 378945 - DNA, 23 bp, Homo sapiens
agtcagatgagcaaggacattgc

SEQ ID NO: 378946 - DNA, 18 bp, Homo sapiens
agtcagcccgaatgcctg

SEQ ID NO: 378947 - DNA, 13 bp, Homo sapiens
cagccccctggcc

SEQ ID NO: 378948 - DNA, 18 bp, Homo sapiens
cagccccgttttggggac

SEQ ID NO: 378949 - DNA, 23 bp, Homo sapiens
cagcccctaccttgagaccctct

SEQ ID NO: 378950 - DNA, 14 bp, Homo sapiens
cagcccctagcaga

SEQ ID NO: 378951 - DNA, 21 bp, Homo sapiens
cagcccctcccaccacagcag

SEQ ID NO: 378952 - DNA, 18 bp, Homo sapiens
cagcccctcggctctgcc

SEQ ID NO: 378953 - DNA, 23 bp, Homo sapiens
cagcccctgctgctcctcggcca

SEQ ID NO: 378954 - DNA, 14 bp, Homo sapiens
cagcccctgctgga

SEQ ID NO: 378955 - DNA, 17 bp, Homo sapiens
cagcccctgctggacca

SEQ ID NO: 378956 - DNA, 20 bp, Homo sapiens
cagcccctgtatggcactgg

SEQ ID NO: 378957 - DNA, 16 bp, Homo sapiens
cagccccttctcccag

SEQ ID NO: 378958 - DNA, 20 bp, Homo sapiens
cagccccttctcccagcaca

SEQ ID NO: 378959 - DNA, 17 bp, Homo sapiens
cagccccttgagaaacc

SEQ ID NO: 378960 - DNA, 18 bp, Homo sapiens
cagccccttgagaaacct

SEQ ID NO: 378961 - DNA, 19 bp, Homo sapiens
cagcccgcatgcagcagct

SEQ ID NO: 378962 - DNA, 13 bp, Homo sapiens
cagcccgcctgcc

SEQ ID NO: 378963 - DNA, 19 bp, Homo sapiens
cagcccgcctgccgtgcat

SEQ ID NO: 378964 - DNA, 22 bp, Homo sapiens
cagcccgcctgccgtgcatggc

SEQ ID NO: 378965 - DNA, 18 bp, Homo sapiens
cagcccggaccttggcag

SEQ ID NO: 378966 - DNA, 23 bp, Homo sapiens
cagcccggcctgctcccagcagc

SEQ ID NO: 378967 - DNA, 22 bp, Homo sapiens
cagcccgggagatccgccctgg

SEQ ID NO: 378968 - DNA, 19 bp, Homo sapiens
cagcccgtgaagcagtgcc

SEQ ID NO: 378969 - DNA, 20 bp, Homo sapiens
cagcccgtgaagcagtgcct

SEQ ID NO: 378970 - DNA, 23 bp, Homo sapiens
cagcccgtgaagcagtgcctcga

SEQ ID NO: 378971 - DNA, 15 bp, Homo sapiens
cagcccgtgtggccc

SEQ ID NO: 378972 - DNA, 20 bp, Homo sapiens
cagccctaaggatctctcag

SEQ ID NO: 378973 - DNA, 23 bp, Homo sapiens
cagccctagaggcgagccaggca

SEQ ID NO: 378974 - DNA, 17 bp, Homo sapiens
cagccctaggctaccct

SEQ ID NO: 378975 - DNA, 15 bp, Homo sapiens
cagccctagtgggag

SEQ ID NO: 378976 - DNA, 23 bp, Homo sapiens
cagccctagtgggagcccagcac

SEQ ID NO: 378977 - DNA, 17 bp, Homo sapiens
cagccctccagagcagg

SEQ ID NO: 378978 - DNA, 12 bp, Homo sapiens
cagccctcccag

SEQ ID NO: 378979 - DNA, 15 bp, Homo sapiens
cagccctcccagctg

SEQ ID NO: 378980 - DNA, 17 bp, Homo sapiens
cagccctcccagctggt

SEQ ID NO: 378981 - DNA, 22 bp, Homo sapiens
cagccctccctgcccctccctt

SEQ ID NO: 378982 - DNA, 15 bp, Homo sapiens
cagccctcggcctcc

SEQ ID NO: 378983 - DNA, 12 bp, Homo sapiens
cagccctgaggt

SEQ ID NO: 378984 - DNA, 22 bp, Homo sapiens
cagccctgaggtgaaagggagc

SEQ ID NO: 378985 - DNA, 11 bp, Homo sapiens
cagccctgctt

SEQ ID NO: 378986 - DNA, 12 bp, Homo sapiens
cagccctgggag

SEQ ID NO: 378987 - DNA, 13 bp, Homo sapiens
cagccctggggct

SEQ ID NO: 378988 - DNA, 19 bp, Homo sapiens
cagccctggttctccatcc

SEQ ID NO: 378989 - DNA, 20 bp, Homo sapiens
cagccctgtcagtgcagccc

SEQ ID NO: 378990 - DNA, 16 bp, Homo sapiens
cagccctgtcctggtt

SEQ ID NO: 378991 - DNA, 22 bp, Homo sapiens
cagcccttcctcctgaagcctc

SEQ ID NO: 378992 - DNA, 12 bp, Homo sapiens
cagcccttctgc

SEQ ID NO: 378993 - DNA, 18 bp, Homo sapiens
cagcccttctgcctttct

SEQ ID NO: 378994 - DNA, 12 bp, Homo sapiens
cagcccttgccc

SEQ ID NO: 378995 - DNA, 15 bp, Homo sapiens
cagcccttgccccca

SEQ ID NO: 378996 - DNA, 17 bp, Homo sapiens
cagccctttccagggca

SEQ ID NO: 378997 - DNA, 20 bp, Homo sapiens
cagccgaattgtggtgtctt

SEQ ID NO: 378998 - DNA, 17 bp, Homo sapiens
cagccgagccgggcctg

SEQ ID NO: 378999 - DNA, 19 bp, Homo sapiens
cagccgagccgggcctggg

SEQ ID NO: 379000 - DNA, 14 bp, Homo sapiens
cagccgagctcgtg

SEQ ID NO: 379001 - DNA, 23 bp, Homo sapiens
cagccgcaaatccataccccctg

SEQ ID NO: 379002 - DNA, 13 bp, Homo sapiens
cagccgccacatc

SEQ ID NO: 379003 - DNA, 14 bp, Homo sapiens
cagccgccacatcc

SEQ ID NO: 379004 - DNA, 18 bp, Homo sapiens
cagccgccattgccacca

SEQ ID NO: 379005 - DNA, 21 bp, Homo sapiens
cagccgccattgccaccagga

SEQ ID NO: 379006 - DNA, 22 bp, Homo sapiens
cagccgccattgccaccaggag

SEQ ID NO: 379007 - DNA, 23 bp, Homo sapiens
cagccgccattgccaccaggaga

SEQ ID NO: 379008 - DNA, 18 bp, Homo sapiens
cagccgccccagcccctt

SEQ ID NO: 379009 - DNA, 18 bp, Homo sapiens
cagccgccttccttgacc

SEQ ID NO: 379010 - DNA, 22 bp, Homo sapiens
cagccgccttccttgaccttcc

SEQ ID NO: 379011 - DNA, 14 bp, Homo sapiens
cagccgcgctctgc

SEQ ID NO: 379012 - DNA, 17 bp, Homo sapiens
cagccgcgctctgcccc

SEQ ID NO: 379013 - DNA, 21 bp, Homo sapiens
cagccgcgctctgcccctccg

SEQ ID NO: 379014 - DNA, 14 bp, Homo sapiens
cagccgctaggaga

SEQ ID NO: 379015 - DNA, 21 bp, Homo sapiens
cagccgctaggagagactgaa

SEQ ID NO: 379016 - DNA, 16 bp, Homo sapiens
cagccggatcttggag

SEQ ID NO: 379017 - DNA, 18 bp, Homo sapiens
cagccggcacagggtctg

SEQ ID NO: 379018 - DNA, 23 bp, Homo sapiens
cagccggcacagggtctgctctt

SEQ ID NO: 379019 - DNA, 16 bp, Homo sapiens
cagccggggcctgcct

SEQ ID NO: 379020 - DNA, 18 bp, Homo sapiens
cagccggggcctgcctag

SEQ ID NO: 379021 - DNA, 20 bp, Homo sapiens
cagccgtcccgcgttcaaga

SEQ ID NO: 379022 - DNA, 23 bp, Homo sapiens
cagccgtcccgcgttcaagactt

SEQ ID NO: 379023 - DNA, 16 bp, Homo sapiens
cagccgtgatgctcag

SEQ ID NO: 379024 - DNA, 17 bp, Homo sapiens
cagccgtgatgctcagg

SEQ ID NO: 379025 - DNA, 19 bp, Homo sapiens
cagccgtgatgctcaggct

SEQ ID NO: 379026 - DNA, 9 bp, Homo sapiens
cagccgtgc

SEQ ID NO: 379027 - DNA, 18 bp, Homo sapiens
cagccgtgccttcagctc

SEQ ID NO: 379028 - DNA, 20 bp, Homo sapiens
cagcctaggaccagttttgt

SEQ ID NO: 379029 - DNA, 17 bp, Homo sapiens
cagcctagtaggagctg

SEQ ID NO: 379030 - DNA, 18 bp, Homo sapiens
cagcctatatttcctctt

SEQ ID NO: 379031 - DNA, 22 bp, Homo sapiens
cagcctatatttcctcttctgt

SEQ ID NO: 379032 - DNA, 21 bp, Homo sapiens
cagcctatgggggctctcgga

SEQ ID NO: 379033 - DNA, 18 bp, Homo sapiens
cagcctattattttttta

SEQ ID NO: 379034 - DNA, 18 bp, Homo sapiens
cagcctcacccctgcagg

SEQ ID NO: 379035 - DNA, 15 bp, Homo sapiens
cagcctcacccttgc

SEQ ID NO: 379036 - DNA, 12 bp, Homo sapiens
cagcctcagtgc

SEQ ID NO: 379037 - DNA, 14 bp, Homo sapiens
cagcctcagtgcca

SEQ ID NO: 379038 - DNA, 17 bp, Homo sapiens
cagcctcagtgccactt

SEQ ID NO: 379039 - DNA, 13 bp, Homo sapiens
cagcctccaagaa

SEQ ID NO: 379040 - DNA, 12 bp, Homo sapiens
cagcctccagag

SEQ ID NO: 379041 - DNA, 16 bp, Homo sapiens
cagcctccagagccag

SEQ ID NO: 379042 - DNA, 14 bp, Homo sapiens
cagcctccagggcc

SEQ ID NO: 379043 - DNA, 15 bp, Homo sapiens
cagcctccagggccc

SEQ ID NO: 379044 - DNA, 14 bp, Homo sapiens
cagcctccagttgt

SEQ ID NO: 379045 - DNA, 14 bp, Homo sapiens
cagcctcccaaagt

SEQ ID NO: 379046 - DNA, 16 bp, Homo sapiens
cagcctcccaccccca

SEQ ID NO: 379047 - DNA, 19 bp, Homo sapiens
cagcctcccacccccatct

SEQ ID NO: 379048 - DNA, 12 bp, Homo sapiens
cagcctccccca

SEQ ID NO: 379049 - DNA, 16 bp, Homo sapiens
cagcctcccccaggct

SEQ ID NO: 379050 - DNA, 18 bp, Homo sapiens
cagcctcccccaggctgc

SEQ ID NO: 379051 - DNA, 21 bp, Homo sapiens
cagcctcccccaggctgcgcc

SEQ ID NO: 379052 - DNA, 18 bp, Homo sapiens
cagcctcccctcccctgg

SEQ ID NO: 379053 - DNA, 17 bp, Homo sapiens
cagcctccctgtcactc

SEQ ID NO: 379054 - DNA, 13 bp, Homo sapiens
cagcctcctcctg

SEQ ID NO: 379055 - DNA, 21 bp, Homo sapiens
cagcctcctgagcctgtgggt

SEQ ID NO: 379056 - DNA, 20 bp, Homo sapiens
cagcctcgaactcctgggct

SEQ ID NO: 379057 - DNA, 21 bp, Homo sapiens
cagcctcgaactcctgggctc

SEQ ID NO: 379058 - DNA, 19 bp, Homo sapiens
cagcctctcccggctgcct

SEQ ID NO: 379059 - DNA, 20 bp, Homo sapiens
cagcctctgaagttggacag

SEQ ID NO: 379060 - DNA, 14 bp, Homo sapiens
cagcctctgccagg

SEQ ID NO: 379061 - DNA, 15 bp, Homo sapiens
cagcctctgccaggc

SEQ ID NO: 379062 - DNA, 19 bp, Homo sapiens
cagcctctgccaggcctgt

SEQ ID NO: 379063 - DNA, 19 bp, Homo sapiens
cagcctcttaaagctgcct

SEQ ID NO: 379064 - DNA, 14 bp, Homo sapiens
cagcctgagccaca

SEQ ID NO: 379065 - DNA, 19 bp, Homo sapiens
cagcctgagctccaccctc

SEQ ID NO: 379066 - DNA, 21 bp, Homo sapiens
cagcctgagctccaccctccc

SEQ ID NO: 379067 - DNA, 16 bp, Homo sapiens
cagcctgagtctcctg

SEQ ID NO: 379068 - DNA, 18 bp, Homo sapiens
cagcctgagtctcctgtg

SEQ ID NO: 379069 - DNA, 18 bp, Homo sapiens
cagcctgcacacacctgc

SEQ ID NO: 379070 - DNA, 21 bp, Homo sapiens
cagcctgcacacacctgcctg

SEQ ID NO: 379071 - DNA, 10 bp, Homo sapiens
cagcctgctg

SEQ ID NO: 379072 - DNA, 15 bp, Homo sapiens
cagcctgctgagagc

SEQ ID NO: 379073 - DNA, 20 bp, Homo sapiens
cagcctgctgagagccccca

SEQ ID NO: 379074 - DNA, 22 bp, Homo sapiens
cagcctgctgagagcccccacc

SEQ ID NO: 379075 - DNA, 23 bp, Homo sapiens
cagcctgcttcttccccagggtt

SEQ ID NO: 379076 - DNA, 14 bp, Homo sapiens
cagcctggagccgt

SEQ ID NO: 379077 - DNA, 13 bp, Homo sapiens
cagcctggaggcc

SEQ ID NO: 379078 - DNA, 21 bp, Homo sapiens
cagcctggcacagggcagtgg

SEQ ID NO: 379079 - DNA, 19 bp, Homo sapiens
cagcctggccacgcagcca

SEQ ID NO: 379080 - DNA, 12 bp, Homo sapiens
cagcctggcccc

SEQ ID NO: 379081 - DNA, 19 bp, Homo sapiens
cagcctggccccaaatgtt

SEQ ID NO: 379082 - DNA, 17 bp, Homo sapiens
cagcctggcctcccctg

SEQ ID NO: 379083 - DNA, 21 bp, Homo sapiens
cagcctggctcccaggacacg

SEQ ID NO: 379084 - DNA, 20 bp, Homo sapiens
cagcctgggactcccagtga

SEQ ID NO: 379085 - DNA, 20 bp, Homo sapiens
cagcctgggcagccaggctg

SEQ ID NO: 379086 - DNA, 21 bp, Homo sapiens
cagcctgggcagccaggctgc

SEQ ID NO: 379087 - DNA, 16 bp, Homo sapiens
cagcctggggcctggc

SEQ ID NO: 379088 - DNA, 16 bp, Homo sapiens
cagcctgtcagccaac

SEQ ID NO: 379089 - DNA, 12 bp, Homo sapiens
cagcctgtcctg

SEQ ID NO: 379090 - DNA, 14 bp, Homo sapiens
cagcctgtcctggt

SEQ ID NO: 379091 - DNA, 22 bp, Homo sapiens
cagcctgtcttcagatcctgct

SEQ ID NO: 379092 - DNA, 15 bp, Homo sapiens
cagcctgtggcatct

SEQ ID NO: 379093 - DNA, 19 bp, Homo sapiens
cagcctgtgggagaaggga

SEQ ID NO: 379094 - DNA, 12 bp, Homo sapiens
cagcctgtggtt

SEQ ID NO: 379095 - DNA, 19 bp, Homo sapiens
cagcctgtggttacagtgc

SEQ ID NO: 379096 - DNA, 20 bp, Homo sapiens
cagcctgtggttacagtgca

SEQ ID NO: 379097 - DNA, 22 bp, Homo sapiens
cagcctgtggttacagtgcaga

SEQ ID NO: 379098 - DNA, 21 bp, Homo sapiens
cagccttagcatcccctgtga

SEQ ID NO: 379099 - DNA, 14 bp, Homo sapiens
cagccttagctgcc

SEQ ID NO: 379100 - DNA, 15 bp, Homo sapiens
cagccttcccctccc

SEQ ID NO: 379101 - DNA, 18 bp, Homo sapiens
cagccttcccctccctgt

SEQ ID NO: 379102 - DNA, 13 bp, Homo sapiens
cagccttccgagt

SEQ ID NO: 379103 - DNA, 14 bp, Homo sapiens
cagccttcctctgc

SEQ ID NO: 379104 - DNA, 20 bp, Homo sapiens
cagccttcctctgcagctga

SEQ ID NO: 379105 - DNA, 17 bp, Homo sapiens
cagccttgggcctttca

SEQ ID NO: 379106 - DNA, 18 bp, Homo sapiens
cagccttgggcctttcag

SEQ ID NO: 379107 - DNA, 13 bp, Homo sapiens
cagcctttctgta

SEQ ID NO: 379108 - DNA, 14 bp, Homo sapiens
cagcctttctgtat

SEQ ID NO: 379109 - DNA, 21 bp, Homo sapiens
cagcctttctgtatcaagccc

SEQ ID NO: 379110 - DNA, 23 bp, Homo sapiens
cagcctttctgtatcaagcccct

SEQ ID NO: 379111 - DNA, 15 bp, Homo sapiens
cagcctttctgtgga

SEQ ID NO: 379112 - DNA, 17 bp, Homo sapiens
cagcgaggcgaggctgc

SEQ ID NO: 379113 - DNA, 21 bp, Homo sapiens
cagcgaggcgaggctgcctct

SEQ ID NO: 379114 - DNA, 23 bp, Homo sapiens
cagcgaggcgaggctgcctctgg

SEQ ID NO: 379115 - DNA, 12 bp, Homo sapiens
cagcgagtctgg

SEQ ID NO: 379116 - DNA, 13 bp, Homo sapiens
cagcgcatgtgtc

SEQ ID NO: 379117 - DNA, 16 bp, Homo sapiens
cagcgcccgctgggct

SEQ ID NO: 379118 - DNA, 17 bp, Homo sapiens
cagcgcccgctgggctg

SEQ ID NO: 379119 - DNA, 19 bp, Homo sapiens
cagcgcccgctgggctgag

SEQ ID NO: 379120 - DNA, 17 bp, Homo sapiens
cagcgcctcccgccgcc

SEQ ID NO: 379121 - DNA, 21 bp, Homo sapiens
cagcgcctcccgccgcctcgg

SEQ ID NO: 379122 - DNA, 22 bp, Homo sapiens
cagcgcctgtgctgaggactcc

SEQ ID NO: 379123 - DNA, 18 bp, Homo sapiens
cagcgctccctgtcgcct

SEQ ID NO: 379124 - DNA, 16 bp, Homo sapiens
cagcgctgcccacacc

SEQ ID NO: 379125 - DNA, 17 bp, Homo sapiens
cagcgctgcccacacca

SEQ ID NO: 379126 - DNA, 13 bp, Homo sapiens
cagcggcccagat

SEQ ID NO: 379127 - DNA, 15 bp, Homo sapiens
cagcggcccagattg

SEQ ID NO: 379128 - DNA, 16 bp, Homo sapiens
cagcggcccctcccac

SEQ ID NO: 379129 - DNA, 17 bp, Homo sapiens
cagcggcccctcccaca

SEQ ID NO: 379130 - DNA, 18 bp, Homo sapiens
cagcggcccggcccacgc

SEQ ID NO: 379131 - DNA, 22 bp, Homo sapiens
cagcggcccggcccacgcagag

SEQ ID NO: 379132 - DNA, 18 bp, Homo sapiens
cagcgggagacctgtgct

SEQ ID NO: 379133 - DNA, 17 bp, Homo sapiens
cagcgggccctctgccg

SEQ ID NO: 379134 - DNA, 16 bp, Homo sapiens
cagcgggtaaaaagag

SEQ ID NO: 379135 - DNA, 23 bp, Homo sapiens
cagcggtggaaggagcctgcggc

SEQ ID NO: 379136 - DNA, 18 bp, Homo sapiens
cagcgtccggggtggtgg

SEQ ID NO: 379137 - DNA, 21 bp, Homo sapiens
cagcgtctgagcggccgcctg

SEQ ID NO: 379138 - DNA, 15 bp, Homo sapiens
cagcgtggggctaac

SEQ ID NO: 379139 - DNA, 14 bp, Homo sapiens
cagcgttcttcagg

SEQ ID NO: 379140 - DNA, 21 bp, Homo sapiens
cagcgtttagtttctagaggc

SEQ ID NO: 379141 - DNA, 22 bp, Homo sapiens
cagcgtttagtttctagaggcc

SEQ ID NO: 379142 - DNA, 15 bp, Homo sapiens
cagcgtttctccacc

SEQ ID NO: 379143 - DNA, 22 bp, Homo sapiens
cagcgtttgaggggctggcctt

SEQ ID NO: 379144 - DNA, 16 bp, Homo sapiens
cagctaaagaggtggg

SEQ ID NO: 379145 - DNA, 18 bp, Homo sapiens
cagctaaattttctgaaa

SEQ ID NO: 379146 - DNA, 20 bp, Homo sapiens
cagctaacatggaagtacta

SEQ ID NO: 379147 - DNA, 15 bp, Homo sapiens
cagctaagcctgatg

SEQ ID NO: 379148 - DNA, 21 bp, Homo sapiens
cagctaagctcaaatgtatat

SEQ ID NO: 379149 - DNA, 19 bp, Homo sapiens
cagctaaggggcaggaatc

SEQ ID NO: 379150 - DNA, 19 bp, Homo sapiens
cagctacaggggaggctga

SEQ ID NO: 379151 - DNA, 20 bp, Homo sapiens
cagctacaggggaggctgag

SEQ ID NO: 379152 - DNA, 22 bp, Homo sapiens
cagctacattcctcagctgcca

SEQ ID NO: 379153 - DNA, 14 bp, Homo sapiens
cagctacctgagac

SEQ ID NO: 379154 - DNA, 20 bp, Homo sapiens
cagctacctgagacgggcat

SEQ ID NO: 379155 - DNA, 20 bp, Homo sapiens
cagctactaacctggagaca

SEQ ID NO: 379156 - DNA, 15 bp, Homo sapiens
cagctactctgtcca

SEQ ID NO: 379157 - DNA, 19 bp, Homo sapiens
cagctactgatttttgtga

SEQ ID NO: 379158 - DNA, 15 bp, Homo sapiens
cagctacttgggaag

SEQ ID NO: 379159 - DNA, 18 bp, Homo sapiens
cagctacttgggagcctg

SEQ ID NO: 379160 - DNA, 15 bp, Homo sapiens
cagctacttgggagg

SEQ ID NO: 379161 - DNA, 16 bp, Homo sapiens
cagctagactggagtg

SEQ ID NO: 379162 - DNA, 23 bp, Homo sapiens
cagctagatttgtgtccacacta

SEQ ID NO: 379163 - DNA, 12 bp, Homo sapiens
cagctagcaagg

SEQ ID NO: 379164 - DNA, 16 bp, Homo sapiens
cagctaggactgagga

SEQ ID NO: 379165 - DNA, 15 bp, Homo sapiens
cagctaggctgagat

SEQ ID NO: 379166 - DNA, 18 bp, Homo sapiens
cagctaggttaataggag

SEQ ID NO: 379167 - DNA, 13 bp, Homo sapiens
cagctatgggagc

SEQ ID NO: 379168 - DNA, 22 bp, Homo sapiens
cagctatgggagccccagggtc

SEQ ID NO: 379169 - DNA, 23 bp, Homo sapiens
cagctatgggagccccagggtct

SEQ ID NO: 379170 - DNA, 15 bp, Homo sapiens
cagctattcacacac

SEQ ID NO: 379171 - DNA, 16 bp, Homo sapiens
cagctattcacacaca

SEQ ID NO: 379172 - DNA, 17 bp, Homo sapiens
cagctattcacacacac

SEQ ID NO: 379173 - DNA, 12 bp, Homo sapiens
cagctcaagtta

SEQ ID NO: 379174 - DNA, 16 bp, Homo sapiens
cagctcacctctgaag

SEQ ID NO: 379175 - DNA, 23 bp, Homo sapiens
cagctcagcagttcacttcctag

SEQ ID NO: 379176 - DNA, 21 bp, Homo sapiens
cagctcagccccggccactcc

SEQ ID NO: 379177 - DNA, 10 bp, Homo sapiens
cagctcagga

SEQ ID NO: 379178 - DNA, 15 bp, Homo sapiens
cagctcaggcgcagc

SEQ ID NO: 379179 - DNA, 23 bp, Homo sapiens
cagctcaggctgtttttgggtgc

SEQ ID NO: 379180 - DNA, 18 bp, Homo sapiens
cagctcaggggcagctca

SEQ ID NO: 379181 - DNA, 16 bp, Homo sapiens
cagctcatctccaagg

SEQ ID NO: 379182 - DNA, 16 bp, Homo sapiens
cagctcattcgctcca

SEQ ID NO: 379183 - DNA, 15 bp, Homo sapiens
cagctccacagggtg

SEQ ID NO: 379184 - DNA, 15 bp, Homo sapiens
cagctccactcaggg

SEQ ID NO: 379185 - DNA, 16 bp, Homo sapiens
cagctccactcagggc

SEQ ID NO: 379186 - DNA, 13 bp, Homo sapiens
cagctccactctg

SEQ ID NO: 379187 - DNA, 14 bp, Homo sapiens
cagctccactctga

SEQ ID NO: 379188 - DNA, 15 bp, Homo sapiens
cagctccactggcct

SEQ ID NO: 379189 - DNA, 17 bp, Homo sapiens
cagctccactggcctgc

SEQ ID NO: 379190 - DNA, 14 bp, Homo sapiens
cagctccaggggcc

SEQ ID NO: 379191 - DNA, 16 bp, Homo sapiens
cagctccaggggccct

SEQ ID NO: 379192 - DNA, 21 bp, Homo sapiens
cagctccaggggcccttggga

SEQ ID NO: 379193 - DNA, 13 bp, Homo sapiens
cagctccccagga

SEQ ID NO: 379194 - DNA, 14 bp, Homo sapiens
cagctccccaggag

SEQ ID NO: 379195 - DNA, 15 bp, Homo sapiens
cagctcccccttgcc

SEQ ID NO: 379196 - DNA, 19 bp, Homo sapiens
cagctcccccttgcccgcc

SEQ ID NO: 379197 - DNA, 20 bp, Homo sapiens
cagctcccttcccctgcctg

SEQ ID NO: 379198 - DNA, 19 bp, Homo sapiens
cagctccgcctggcaccca

SEQ ID NO: 379199 - DNA, 21 bp, Homo sapiens
cagctcctcctcttggagctg

SEQ ID NO: 379200 - DNA, 12 bp, Homo sapiens
cagctcctctta

SEQ ID NO: 379201 - DNA, 12 bp, Homo sapiens
cagctccttttc

SEQ ID NO: 379202 - DNA, 20 bp, Homo sapiens
cagctcgtttttcagcaccc

SEQ ID NO: 379203 - DNA, 21 bp, Homo sapiens
cagctctagacaaccctgcaa

SEQ ID NO: 379204 - DNA, 14 bp, Homo sapiens
cagctctcactggc

SEQ ID NO: 379205 - DNA, 18 bp, Homo sapiens
cagctctcagttgcagcc

SEQ ID NO: 379206 - DNA, 14 bp, Homo sapiens
cagctctccagtca

SEQ ID NO: 379207 - DNA, 16 bp, Homo sapiens
cagctctgaccctgat

SEQ ID NO: 379208 - DNA, 13 bp, Homo sapiens
cagctctgagaca

SEQ ID NO: 379209 - DNA, 19 bp, Homo sapiens
cagctctgcagcaatattc

SEQ ID NO: 379210 - DNA, 14 bp, Homo sapiens
cagctctgcccccg

SEQ ID NO: 379211 - DNA, 22 bp, Homo sapiens
cagctctgcccccgcgggttct

SEQ ID NO: 379212 - DNA, 14 bp, Homo sapiens
cagctctggccaca

SEQ ID NO: 379213 - DNA, 15 bp, Homo sapiens
cagctctggccacaa

SEQ ID NO: 379214 - DNA, 19 bp, Homo sapiens
agtcagctttgccttccac

SEQ ID NO: 379215 - DNA, 22 bp, Homo sapiens
agtcagctttgccttccacgct

SEQ ID NO: 379216 - DNA, 17 bp, Homo sapiens
agtctgaaggagaggag

SEQ ID NO: 379217 - DNA, 15 bp, Homo sapiens
agtctgacaggaaga

SEQ ID NO: 379218 - DNA, 19 bp, Homo sapiens
cagctctggctcagggccc

SEQ ID NO: 379219 - DNA, 14 bp, Homo sapiens
cagctctgggagag

SEQ ID NO: 379220 - DNA, 15 bp, Homo sapiens
cagctctgggagagg

SEQ ID NO: 379221 - DNA, 17 bp, Homo sapiens
cagctctgtggcctgtg

SEQ ID NO: 379222 - DNA, 18 bp, Homo sapiens
cagctctgtggcctgtgt

SEQ ID NO: 379223 - DNA, 23 bp, Homo sapiens
cagctctgtggcctgtgtccagc

SEQ ID NO: 379224 - DNA, 12 bp, Homo sapiens
cagctcttctgg

SEQ ID NO: 379225 - DNA, 22 bp, Homo sapiens
cagctcttctgggcagagcctg

SEQ ID NO: 379226 - DNA, 18 bp, Homo sapiens
cagctctttcctccttcc

SEQ ID NO: 379227 - DNA, 22 bp, Homo sapiens
cagctctttgaaatagtctgtg

SEQ ID NO: 379228 - DNA, 22 bp, Homo sapiens
cagctgaacagtgttggctttc

SEQ ID NO: 379229 - DNA, 19 bp, Homo sapiens
cagctgacacataatttga

SEQ ID NO: 379230 - DNA, 21 bp, Homo sapiens
cagctgacacataatttgaat

SEQ ID NO: 379231 - DNA, 17 bp, Homo sapiens
cagctgacctctgttgt

SEQ ID NO: 379232 - DNA, 18 bp, Homo sapiens
cagctgacctctgttgtc

SEQ ID NO: 379233 - DNA, 15 bp, Homo sapiens
cagctgagctggcct

SEQ ID NO: 379234 - DNA, 14 bp, Homo sapiens
cagctgagcttgag

SEQ ID NO: 379235 - DNA, 17 bp, Homo sapiens
cagctgagcttgagctc

SEQ ID NO: 379236 - DNA, 21 bp, Homo sapiens
cagctgagcttgagctcccct

SEQ ID NO: 379237 - DNA, 16 bp, Homo sapiens
cagctgaggccccagg

SEQ ID NO: 379238 - DNA, 14 bp, Homo sapiens
cagctgcacattcc

SEQ ID NO: 379239 - DNA, 15 bp, Homo sapiens
cagctgcagagacag

SEQ ID NO: 379240 - DNA, 13 bp, Homo sapiens
cagctgcagctgg

SEQ ID NO: 379241 - DNA, 17 bp, Homo sapiens
cagctgcagctgggccc

SEQ ID NO: 379242 - DNA, 16 bp, Homo sapiens
cagctgcagctgggct

SEQ ID NO: 379243 - DNA, 13 bp, Homo sapiens
cagctgcaggtgc

SEQ ID NO: 379244 - DNA, 17 bp, Homo sapiens
cagctgcaggtgcccat

SEQ ID NO: 379245 - DNA, 12 bp, Homo sapiens
cagctgcagttg

SEQ ID NO: 379246 - DNA, 22 bp, Homo sapiens
cagctgccaagcactcgagacc

SEQ ID NO: 379247 - DNA, 23 bp, Homo sapiens
cagctgccaagcactcgagacca

SEQ ID NO: 379248 - DNA, 16 bp, Homo sapiens
cagctgcccacaagcc

SEQ ID NO: 379249 - DNA, 14 bp, Homo sapiens
cagctgcctcactt

SEQ ID NO: 379250 - DNA, 14 bp, Homo sapiens
cagctgcgggtctg

SEQ ID NO: 379251 - DNA, 18 bp, Homo sapiens
cagctgctcccctccctc

SEQ ID NO: 379252 - DNA, 11 bp, Homo sapiens
cagctgctcct

SEQ ID NO: 379253 - DNA, 15 bp, Homo sapiens
cagctgctctgccca

SEQ ID NO: 379254 - DNA, 17 bp, Homo sapiens
cagctgctctgcccctt

SEQ ID NO: 379255 - DNA, 20 bp, Homo sapiens
cagctgctctgccccttggg

SEQ ID NO: 379256 - DNA, 16 bp, Homo sapiens
cagctgctcttagtgc

SEQ ID NO: 379257 - DNA, 21 bp, Homo sapiens
cagctgctcttgcatctgggc

SEQ ID NO: 379258 - DNA, 15 bp, Homo sapiens
cagctgctggagaat

SEQ ID NO: 379259 - DNA, 14 bp, Homo sapiens
cagctgctggatgt

SEQ ID NO: 379260 - DNA, 14 bp, Homo sapiens
cagctgctgtcagg

SEQ ID NO: 379261 - DNA, 15 bp, Homo sapiens
cagctgctttgttac

SEQ ID NO: 379262 - DNA, 16 bp, Homo sapiens
cagctgctttgttacc

SEQ ID NO: 379263 - DNA, 23 bp, Homo sapiens
cagctggagtggggtttgctttt

SEQ ID NO: 379264 - DNA, 13 bp, Homo sapiens
cagctggcagcgc

SEQ ID NO: 379265 - DNA, 14 bp, Homo sapiens
cagctggcagcgcc

SEQ ID NO: 379266 - DNA, 15 bp, Homo sapiens
cagctggcagcgcct

SEQ ID NO: 379267 - DNA, 22 bp, Homo sapiens
cagctggccgggttggaggcct

SEQ ID NO: 379268 - DNA, 18 bp, Homo sapiens
cagctggctctccacctt

SEQ ID NO: 379269 - DNA, 14 bp, Homo sapiens
cagctggctgggtc

SEQ ID NO: 379270 - DNA, 22 bp, Homo sapiens
cagctggctgggtcgcccctcc

SEQ ID NO: 379271 - DNA, 18 bp, Homo sapiens
cagctgggacccctccca

SEQ ID NO: 379272 - DNA, 11 bp, Homo sapiens
cagctgggcaa

SEQ ID NO: 379273 - DNA, 17 bp, Homo sapiens
cagctgggcaaagccac

SEQ ID NO: 379274 - DNA, 15 bp, Homo sapiens
cagctgggccccatg

SEQ ID NO: 379275 - DNA, 17 bp, Homo sapiens
cagctgggccccatgct

SEQ ID NO: 379276 - DNA, 18 bp, Homo sapiens
cagctgggccccatgctc

SEQ ID NO: 379277 - DNA, 20 bp, Homo sapiens
cagctgggccccatgctctg

SEQ ID NO: 379278 - DNA, 14 bp, Homo sapiens
cagctgggctctgc

SEQ ID NO: 379279 - DNA, 18 bp, Homo sapiens
cagctgggctctgccacc

SEQ ID NO: 379280 - DNA, 17 bp, Homo sapiens
cagctgggctgttggct

SEQ ID NO: 379281 - DNA, 18 bp, Homo sapiens
cagctggggagcagctga

SEQ ID NO: 379282 - DNA, 18 bp, Homo sapiens
cagctggggcccctcggc

SEQ ID NO: 379283 - DNA, 23 bp, Homo sapiens
cagctggggcccctcggctaccc

SEQ ID NO: 379284 - DNA, 19 bp, Homo sapiens
cagctggggggctgtcctg

SEQ ID NO: 379285 - DNA, 20 bp, Homo sapiens
cagctggggggctgtcctga

SEQ ID NO: 379286 - DNA, 14 bp, Homo sapiens
cagctggtggatgg

SEQ ID NO: 379287 - DNA, 22 bp, Homo sapiens
cagctggtgtcactctgcctct

SEQ ID NO: 379288 - DNA, 20 bp, Homo sapiens
cagctgtaacacagctgaga

SEQ ID NO: 379289 - DNA, 20 bp, Homo sapiens
cagctgtaagaagagactgg

SEQ ID NO: 379290 - DNA, 21 bp, Homo sapiens
cagctgtagaaaggttgattc

SEQ ID NO: 379291 - DNA, 12 bp, Homo sapiens
cagctgtagcca

SEQ ID NO: 379292 - DNA, 17 bp, Homo sapiens
cagctgtagccatggct

SEQ ID NO: 379293 - DNA, 19 bp, Homo sapiens
cagctgtagccatggctca

SEQ ID NO: 379294 - DNA, 22 bp, Homo sapiens
cagctgtagccatggctcaggc

SEQ ID NO: 379295 - DNA, 21 bp, Homo sapiens
cagctgtgactgagggcctgg

SEQ ID NO: 379296 - DNA, 19 bp, Homo sapiens
cagctgtttcatcaccaga

SEQ ID NO: 379297 - DNA, 20 bp, Homo sapiens
cagctgttttagttaaattt

SEQ ID NO: 379298 - DNA, 21 bp, Homo sapiens
cagcttatgggatccttgtct

SEQ ID NO: 379299 - DNA, 14 bp, Homo sapiens
cagcttcaccagag

SEQ ID NO: 379300 - DNA, 16 bp, Homo sapiens
cagcttcaccctgtca

SEQ ID NO: 379301 - DNA, 13 bp, Homo sapiens
cagcttcatttgt

SEQ ID NO: 379302 - DNA, 17 bp, Homo sapiens
cagcttcctgagggcta

SEQ ID NO: 379303 - DNA, 15 bp, Homo sapiens
cagcttcctggtgta

SEQ ID NO: 379304 - DNA, 21 bp, Homo sapiens
cagcttcggagggcccctgcg

SEQ ID NO: 379305 - DNA, 23 bp, Homo sapiens
cagcttcggagggcccctgcgtg

SEQ ID NO: 379306 - DNA, 14 bp, Homo sapiens
cagcttcgtgctgg

SEQ ID NO: 379307 - DNA, 21 bp, Homo sapiens
cagcttctaattttgtgctct

SEQ ID NO: 379308 - DNA, 21 bp, Homo sapiens
cagcttctggtactctcctag

SEQ ID NO: 379309 - DNA, 16 bp, Homo sapiens
cagcttcttgcttgta

SEQ ID NO: 379310 - DNA, 19 bp, Homo sapiens
cagcttcttgcttgtaaaa

SEQ ID NO: 379311 - DNA, 23 bp, Homo sapiens
cagcttctttactactgcaagtt

SEQ ID NO: 379312 - DNA, 22 bp, Homo sapiens
cagcttgcacacccatcgtctt

SEQ ID NO: 379313 - DNA, 22 bp, Homo sapiens
cagcttgcgttagaatgaggag

SEQ ID NO: 379314 - DNA, 13 bp, Homo sapiens
cagcttgctgcac

SEQ ID NO: 379315 - DNA, 19 bp, Homo sapiens
cagcttgctgccctaggct

SEQ ID NO: 379316 - DNA, 14 bp, Homo sapiens
cagcttgggagagc

SEQ ID NO: 379317 - DNA, 22 bp, Homo sapiens
cagcttgggcccagctgggctc

SEQ ID NO: 379318 - DNA, 23 bp, Homo sapiens
cagcttgggcccagctgggctct

SEQ ID NO: 379319 - DNA, 13 bp, Homo sapiens
cagcttgtttcta

SEQ ID NO: 379320 - DNA, 14 bp, Homo sapiens
cagcttgtttctat

SEQ ID NO: 379321 - DNA, 15 bp, Homo sapiens
cagcttgtttctata

SEQ ID NO: 379322 - DNA, 17 bp, Homo sapiens
cagctttcaagtgcctt

SEQ ID NO: 379323 - DNA, 13 bp, Homo sapiens
cagctttcagagc

SEQ ID NO: 379324 - DNA, 16 bp, Homo sapiens
cagctttcatgattag

SEQ ID NO: 379325 - DNA, 13 bp, Homo sapiens
cagctttcccagg

SEQ ID NO: 379326 - DNA, 21 bp, Homo sapiens
cagctttccctggctcaggga

SEQ ID NO: 379327 - DNA, 14 bp, Homo sapiens
cagctttcctgggt

SEQ ID NO: 379328 - DNA, 18 bp, Homo sapiens
cagctttgccttccacgc

SEQ ID NO: 379329 - DNA, 13 bp, Homo sapiens
cagcttttaataa

SEQ ID NO: 379330 - DNA, 14 bp, Homo sapiens
cagcttttaataaa

SEQ ID NO: 379331 - DNA, 21 bp, Homo sapiens
cagcttttaataaaattgaca

SEQ ID NO: 379332 - DNA, 19 bp, Homo sapiens
cagcttttagtacccacct

SEQ ID NO: 379333 - DNA, 16 bp, Homo sapiens
cagcttttcctccctt

SEQ ID NO: 379334 - DNA, 19 bp, Homo sapiens
cagcttttcttgccagctc

SEQ ID NO: 379335 - DNA, 21 bp, Homo sapiens
cagcttttcttgccagctcag

SEQ ID NO: 379336 - DNA, 18 bp, Homo sapiens
cagcttttgttgtttata

SEQ ID NO: 379337 - DNA, 18 bp, Homo sapiens
caggaaaaaaacttttat

SEQ ID NO: 379338 - DNA, 22 bp, Homo sapiens
caggaaaacaaatcactgtatt

SEQ ID NO: 379339 - DNA, 15 bp, Homo sapiens
caggaaaactgtttt

SEQ ID NO: 379340 - DNA, 17 bp, Homo sapiens
caggaaagatcccaagt

SEQ ID NO: 379341 - DNA, 21 bp, Homo sapiens
caggaaagggaaggccccaca

SEQ ID NO: 379342 - DNA, 23 bp, Homo sapiens
caggaaatatatatgtgtgtgta

SEQ ID NO: 379343 - DNA, 16 bp, Homo sapiens
caggaaatatgtcccc

SEQ ID NO: 379344 - DNA, 15 bp, Homo sapiens
caggaacacccagcc

SEQ ID NO: 379345 - DNA, 19 bp, Homo sapiens
caggaacacccagccccag

SEQ ID NO: 379346 - DNA, 16 bp, Homo sapiens
agtgcaatttcttctg

SEQ ID NO: 379347 - DNA, 20 bp, Homo sapiens
agtgcaatttcttctgtagc

SEQ ID NO: 379348 - DNA, 11 bp, Homo sapiens
agtgcacacct

SEQ ID NO: 379349 - DNA, 21 bp, Homo sapiens
agtgcacctctcatcagccca

SEQ ID NO: 379350 - DNA, 22 bp, Homo sapiens
agtgcacctgtggcctctcagt

SEQ ID NO: 379351 - DNA, 17 bp, Homo sapiens
agtgcagaacacctggc

SEQ ID NO: 379352 - DNA, 13 bp, Homo sapiens
agtgcagacaggc

SEQ ID NO: 379353 - DNA, 16 bp, Homo sapiens
agtgcagacaggccat

SEQ ID NO: 379354 - DNA, 21 bp, Homo sapiens
agtgcagaccccttggccagc

SEQ ID NO: 379355 - DNA, 21 bp, Homo sapiens
agtgcagcccgtgtggcccct

SEQ ID NO: 379356 - DNA, 19 bp, Homo sapiens
caggaactagactgcctgg

SEQ ID NO: 379357 - DNA, 19 bp, Homo sapiens
caggaactgaaaaccagtc

SEQ ID NO: 379358 - DNA, 23 bp, Homo sapiens
caggaagaatggtgtgtttccct

SEQ ID NO: 379359 - DNA, 20 bp, Homo sapiens
caggaagaccaaggcctcgg

SEQ ID NO: 379360 - DNA, 15 bp, Homo sapiens
caggaagactggaga

SEQ ID NO: 379361 - DNA, 16 bp, Homo sapiens
caggaagactggagac

SEQ ID NO: 379362 - DNA, 18 bp, Homo sapiens
caggaagatcttaaattt

SEQ ID NO: 379363 - DNA, 22 bp, Homo sapiens
caggaagcaaggccagccctgg

SEQ ID NO: 379364 - DNA, 13 bp, Homo sapiens
caggaagcacagg

SEQ ID NO: 379365 - DNA, 16 bp, Homo sapiens
caggaagcagggagag

SEQ ID NO: 379366 - DNA, 20 bp, Homo sapiens
caggaagcagggagagttgg

SEQ ID NO: 379367 - DNA, 14 bp, Homo sapiens
caggaagccccgct

SEQ ID NO: 379368 - DNA, 23 bp, Homo sapiens
caggaagccccgctcaggtagcc

SEQ ID NO: 379369 - DNA, 21 bp, Homo sapiens
caggaagccgcctagtgcaga

SEQ ID NO: 379370 - DNA, 18 bp, Homo sapiens
caggaagcctcctgctga

SEQ ID NO: 379371 - DNA, 13 bp, Homo sapiens
caggaaggagagc

SEQ ID NO: 379372 - DNA, 12 bp, Homo sapiens
caggaaggcagc

SEQ ID NO: 379373 - DNA, 16 bp, Homo sapiens
caggaaggcagctgct

SEQ ID NO: 379374 - DNA, 19 bp, Homo sapiens
caggaaggcagctgctctt

SEQ ID NO: 379375 - DNA, 12 bp, Homo sapiens
caggaaggcctg

SEQ ID NO: 379376 - DNA, 23 bp, Homo sapiens
caggaagggaaagcgggcagccc

SEQ ID NO: 379377 - DNA, 18 bp, Homo sapiens
caggaaggtatcacacac

SEQ ID NO: 379378 - DNA, 19 bp, Homo sapiens
caggaaggtatcacacact

SEQ ID NO: 379379 - DNA, 20 bp, Homo sapiens
caggaagtactggagaaaat

SEQ ID NO: 379380 - DNA, 16 bp, Homo sapiens
caggaagtcaggagcc

SEQ ID NO: 379381 - DNA, 17 bp, Homo sapiens
caggaagtcaggagcca

SEQ ID NO: 379382 - DNA, 22 bp, Homo sapiens
caggaagtcaggagccagcagg

SEQ ID NO: 379383 - DNA, 23 bp, Homo sapiens
caggaagtcaggagccagcaggg

SEQ ID NO: 379384 - DNA, 20 bp, Homo sapiens
caggaagtccctgagaagcc

SEQ ID NO: 379385 - DNA, 18 bp, Homo sapiens
caggaagtgggagaagtg

SEQ ID NO: 379386 - DNA, 20 bp, Homo sapiens
caggaagtgggagaagtggc

SEQ ID NO: 379387 - DNA, 23 bp, Homo sapiens
caggaagttgctgagaaatgggg

SEQ ID NO: 379388 - DNA, 17 bp, Homo sapiens
caggaataggcatttgc

SEQ ID NO: 379389 - DNA, 17 bp, Homo sapiens
caggaatggaaagcgga

SEQ ID NO: 379390 - DNA, 13 bp, Homo sapiens
caggaatgtttca

SEQ ID NO: 379391 - DNA, 20 bp, Homo sapiens
caggacacatcccggcctct

SEQ ID NO: 379392 - DNA, 22 bp, Homo sapiens
caggacacatcccggcctcttc

SEQ ID NO: 379393 - DNA, 13 bp, Homo sapiens
caggacagctgca

SEQ ID NO: 379394 - DNA, 20 bp, Homo sapiens
caggaccaagcttaaggaga

SEQ ID NO: 379395 - DNA, 12 bp, Homo sapiens
caggaccaggag

SEQ ID NO: 379396 - DNA, 17 bp, Homo sapiens
caggaccaggagccagg

SEQ ID NO: 379397 - DNA, 12 bp, Homo sapiens
caggacccaggc

SEQ ID NO: 379398 - DNA, 14 bp, Homo sapiens
caggacccaggccc

SEQ ID NO: 379399 - DNA, 15 bp, Homo sapiens
caggacccaggccct

SEQ ID NO: 379400 - DNA, 21 bp, Homo sapiens
caggacccaggccctccatgg

SEQ ID NO: 379401 - DNA, 24 bp, Homo sapiens
caggacccaggccctccatgggct

SEQ ID NO: 379402 - DNA, 12 bp, Homo sapiens
caggaccccaga

SEQ ID NO: 379403 - DNA, 14 bp, Homo sapiens
caggaccccagagg

SEQ ID NO: 379404 - DNA, 19 bp, Homo sapiens
caggaccccagagggacca

SEQ ID NO: 379405 - DNA, 13 bp, Homo sapiens
caggacccctggg

SEQ ID NO: 379406 - DNA, 15 bp, Homo sapiens
caggacccttctact

SEQ ID NO: 379407 - DNA, 22 bp, Homo sapiens
caggacccttctactttttcct

SEQ ID NO: 379408 - DNA, 21 bp, Homo sapiens
caggacctcagagtccaggcc

SEQ ID NO: 379409 - DNA, 22 bp, Homo sapiens
caggacctcagagtccaggccc

SEQ ID NO: 379410 - DNA, 20 bp, Homo sapiens
caggaccttttgaagtagtt

SEQ ID NO: 379411 - DNA, 17 bp, Homo sapiens
caggacgcagggagacc

SEQ ID NO: 379412 - DNA, 16 bp, Homo sapiens
caggacgcttctgaat

SEQ ID NO: 379413 - DNA, 16 bp, Homo sapiens
caggactccctcctca

SEQ ID NO: 379414 - DNA, 22 bp, Homo sapiens
caggactccctcctcacctctg

SEQ ID NO: 379415 - DNA, 23 bp, Homo sapiens
caggactccctcctcacctctgg

SEQ ID NO: 379416 - DNA, 13 bp, Homo sapiens
caggactctcttt

SEQ ID NO: 379417 - DNA, 16 bp, Homo sapiens
caggactctctttctt

SEQ ID NO: 379418 - DNA, 20 bp, Homo sapiens
caggactctgcccagaccac

SEQ ID NO: 379419 - DNA, 20 bp, Homo sapiens
caggactctgccccttctgt

SEQ ID NO: 379420 - DNA, 14 bp, Homo sapiens
caggactctgcctt

SEQ ID NO: 379421 - DNA, 14 bp, Homo sapiens
caggactgtgactc

SEQ ID NO: 379422 - DNA, 21 bp, Homo sapiens
caggacttaacggctccagga

SEQ ID NO: 379423 - DNA, 19 bp, Homo sapiens
caggacttggggtcaggaa

SEQ ID NO: 379424 - DNA, 19 bp, Homo sapiens
caggagaaggcctgccccc

SEQ ID NO: 379425 - DNA, 16 bp, Homo sapiens
caggagaatcgcttga

SEQ ID NO: 379426 - DNA, 22 bp, Homo sapiens
caggagaatcgcttgaacctgg

SEQ ID NO: 379427 - DNA, 15 bp, Homo sapiens
caggagaccctgtct

SEQ ID NO: 379428 - DNA, 12 bp, Homo sapiens
caggagagagag

SEQ ID NO: 379429 - DNA, 16 bp, Homo sapiens
caggagagagagagag

SEQ ID NO: 379430 - DNA, 17 bp, Homo sapiens
caggagagagagagaga

SEQ ID NO: 379431 - DNA, 15 bp, Homo sapiens
caggagagcatcacc

SEQ ID NO: 379432 - DNA, 20 bp, Homo sapiens
caggagagcatcaccaccac

SEQ ID NO: 379433 - DNA, 20 bp, Homo sapiens
caggagaggagcgggacctg

SEQ ID NO: 379434 - DNA, 14 bp, Homo sapiens
caggagcaatggga

SEQ ID NO: 379435 - DNA, 18 bp, Homo sapiens
caggagcaatgggactgg

SEQ ID NO: 379436 - DNA, 15 bp, Homo sapiens
caggagcagctgtgc

SEQ ID NO: 379437 - DNA, 16 bp, Homo sapiens
caggagcagctgtgct

SEQ ID NO: 379438 - DNA, 21 bp, Homo sapiens
caggagcagctgtgctgcacc

SEQ ID NO: 379439 - DNA, 15 bp, Homo sapiens
caggagcaggaccta

SEQ ID NO: 379440 - DNA, 12 bp, Homo sapiens
caggagccagca

SEQ ID NO: 379441 - DNA, 23 bp, Homo sapiens
caggagccagcagggcgggccag

SEQ ID NO: 379442 - DNA, 12 bp, Homo sapiens
caggagccaggt

SEQ ID NO: 379443 - DNA, 16 bp, Homo sapiens
caggagccccagccag

SEQ ID NO: 379444 - DNA, 18 bp, Homo sapiens
caggagccccagccagcc

SEQ ID NO: 379445 - DNA, 20 bp, Homo sapiens
caggagccccagccagccct

SEQ ID NO: 379446 - DNA, 21 bp, Homo sapiens
caggagccccagccagccctt

SEQ ID NO: 379447 - DNA, 15 bp, Homo sapiens
caggagcgcaagata

SEQ ID NO: 379448 - DNA, 23 bp, Homo sapiens
caggagctcttcaggcctccctc

SEQ ID NO: 379449 - DNA, 12 bp, Homo sapiens
caggagctgagt

SEQ ID NO: 379450 - DNA, 16 bp, Homo sapiens
caggagcttttttaca

SEQ ID NO: 379451 - DNA, 15 bp, Homo sapiens
caggaggaactggtc

SEQ ID NO: 379452 - DNA, 19 bp, Homo sapiens
caggaggactgccccgtgc

SEQ ID NO: 379453 - DNA, 23 bp, Homo sapiens
caggaggactgccccgtgcagac

SEQ ID NO: 379454 - DNA, 20 bp, Homo sapiens
caggaggaggaaaggtagcc

SEQ ID NO: 379455 - DNA, 16 bp, Homo sapiens
caggaggccattccag

SEQ ID NO: 379456 - DNA, 13 bp, Homo sapiens
caggaggcctggg

SEQ ID NO: 379457 - DNA, 22 bp, Homo sapiens
caggaggcctgggagggcaagg

SEQ ID NO: 379458 - DNA, 23 bp, Homo sapiens
caggaggcctgggagggcaaggg

SEQ ID NO: 379459 - DNA, 13 bp, Homo sapiens
caggaggcggcag

SEQ ID NO: 379460 - DNA, 19 bp, Homo sapiens
caggaggcggcagctcttc

SEQ ID NO: 379461 - DNA, 13 bp, Homo sapiens
caggaggctggag

SEQ ID NO: 379462 - DNA, 22 bp, Homo sapiens
caggaggctttaagctccagct

SEQ ID NO: 379463 - DNA, 12 bp, Homo sapiens
caggagggaggt

SEQ ID NO: 379464 - DNA, 23 bp, Homo sapiens
caggagggaggtttgtgagagcg

SEQ ID NO: 379465 - DNA, 22 bp, Homo sapiens
caggagggattggccgcttggc

SEQ ID NO: 379466 - DNA, 23 bp, Homo sapiens
caggagggcatcagctttccctg

SEQ ID NO: 379467 - DNA, 15 bp, Homo sapiens
caggaggggcctctg

SEQ ID NO: 379468 - DNA, 21 bp, Homo sapiens
caggaggtgtgatagagcctt

SEQ ID NO: 379469 - DNA, 17 bp, Homo sapiens
caggagtctctgccacc

SEQ ID NO: 379470 - DNA, 23 bp, Homo sapiens
caggagtctctgccacccactca

SEQ ID NO: 379471 - DNA, 16 bp, Homo sapiens
caggagtctgtgctct

SEQ ID NO: 379472 - DNA, 15 bp, Homo sapiens
caggagtctttgtaa

SEQ ID NO: 379473 - DNA, 18 bp, Homo sapiens
caggagtgggctctgagc

SEQ ID NO: 379474 - DNA, 17 bp, Homo sapiens
caggagtgggtgggaca

SEQ ID NO: 379475 - DNA, 16 bp, Homo sapiens
agtggcttttgcccca

SEQ ID NO: 379476 - DNA, 16 bp, Homo sapiens
agtgggaagagctggg

SEQ ID NO: 379477 - DNA, 17 bp, Homo sapiens
agtgggaagagctgggt

SEQ ID NO: 379478 - DNA, 20 bp, Homo sapiens
agtgggaaggacttggcgcg

SEQ ID NO: 379479 - DNA, 13 bp, Homo sapiens
agtgggagaggaa

SEQ ID NO: 379480 - DNA, 14 bp, Homo sapiens
agtgggagaggaag

SEQ ID NO: 379481 - DNA, 15 bp, Homo sapiens
agtgggagaggaagc

SEQ ID NO: 379482 - DNA, 12 bp, Homo sapiens
agtgggagccca

SEQ ID NO: 379483 - DNA, 15 bp, Homo sapiens
agtgggagcccagca

SEQ ID NO: 379484 - DNA, 13 bp, Homo sapiens
agtgggagccctg

SEQ ID NO: 379485 - DNA, 14 bp, Homo sapiens
agtgggagtgggag

SEQ ID NO: 379486 - DNA, 17 bp, Homo sapiens
agtgggagtgggagagg

SEQ ID NO: 379487 - DNA, 16 bp, Homo sapiens
agtgggcacctcagaa

SEQ ID NO: 379488 - DNA, 14 bp, Homo sapiens
agtgggcaggtggc

SEQ ID NO: 379489 - DNA, 17 bp, Homo sapiens
agtgggcaggtggccac

SEQ ID NO: 379490 - DNA, 15 bp, Homo sapiens
agtgggccggcccca

SEQ ID NO: 379491 - DNA, 17 bp, Homo sapiens
agtgggccggccccagg

SEQ ID NO: 379492 - DNA, 20 bp, Homo sapiens
agtgggccggccccaggctc

SEQ ID NO: 379493 - DNA, 22 bp, Homo sapiens
agtgggccttcattaaatgttt

SEQ ID NO: 379494 - DNA, 16 bp, Homo sapiens
caggatgaacccagga

SEQ ID NO: 379495 - DNA, 17 bp, Homo sapiens
caggatgattgtacaga

SEQ ID NO: 379496 - DNA, 18 bp, Homo sapiens
caggatgcacggtttctg

SEQ ID NO: 379497 - DNA, 23 bp, Homo sapiens
caggattccagttgcgtgtctgt

SEQ ID NO: 379498 - DNA, 17 bp, Homo sapiens
caggattgtacgtggga

SEQ ID NO: 379499 - DNA, 20 bp, Homo sapiens
caggatttaaaaactggaac

SEQ ID NO: 379500 - DNA, 17 bp, Homo sapiens
caggatttggttgttta

SEQ ID NO: 379501 - DNA, 21 bp, Homo sapiens
caggatttggtttttctcttt

SEQ ID NO: 379502 - DNA, 18 bp, Homo sapiens
caggcaaaaaagggacag

SEQ ID NO: 379503 - DNA, 15 bp, Homo sapiens
caggcaaagaggtgc

SEQ ID NO: 379504 - DNA, 13 bp, Homo sapiens
caggcaagcccct

SEQ ID NO: 379505 - DNA, 18 bp, Homo sapiens
caggcaaggttggcgact

SEQ ID NO: 379506 - DNA, 15 bp, Homo sapiens
caggcaatggcctaa

SEQ ID NO: 379507 - DNA, 15 bp, Homo sapiens
caggcacatgtgttc

SEQ ID NO: 379508 - DNA, 13 bp, Homo sapiens
caggcacctggcc

SEQ ID NO: 379509 - DNA, 18 bp, Homo sapiens
caggcacctggcctgctg

SEQ ID NO: 379510 - DNA, 19 bp, Homo sapiens
caggcacctggcctgctgg

SEQ ID NO: 379511 - DNA, 20 bp, Homo sapiens
caggcacctggcctgctggg

SEQ ID NO: 379512 - DNA, 22 bp, Homo sapiens
caggcacctggcctgctgggaa

SEQ ID NO: 379513 - DNA, 19 bp, Homo sapiens
caggcactgcgccacctgc

SEQ ID NO: 379514 - DNA, 22 bp, Homo sapiens
caggcactgcgccacctgcttc

SEQ ID NO: 379515 - DNA, 16 bp, Homo sapiens
caggcactgctgccca

SEQ ID NO: 379516 - DNA, 17 bp, Homo sapiens
caggcactggtggcatc

SEQ ID NO: 379517 - DNA, 18 bp, Homo sapiens
caggcagaaaactggcag

SEQ ID NO: 379518 - DNA, 15 bp, Homo sapiens
caggcagacacatgc

SEQ ID NO: 379519 - DNA, 17 bp, Homo sapiens
caggcagagacaataaa

SEQ ID NO: 379520 - DNA, 19 bp, Homo sapiens
caggcagagctcagcacag

SEQ ID NO: 379521 - DNA, 15 bp, Homo sapiens
caggcagaggagagt

SEQ ID NO: 379522 - DNA, 16 bp, Homo sapiens
caggcagatctgtgcc

SEQ ID NO: 379523 - DNA, 18 bp, Homo sapiens
caggcagatctgtgcccc

SEQ ID NO: 379524 - DNA, 18 bp, Homo sapiens
caggcagcgatggtctca

SEQ ID NO: 379525 - DNA, 14 bp, Homo sapiens
caggcaggcacctg

SEQ ID NO: 379526 - DNA, 16 bp, Homo sapiens
caggcaggcacctggg

SEQ ID NO: 379527 - DNA, 21 bp, Homo sapiens
caggcaggccaaggccttctc

SEQ ID NO: 379528 - DNA, 19 bp, Homo sapiens
caggcaggctgtgcgctga

SEQ ID NO: 379529 - DNA, 18 bp, Homo sapiens
caggcagggagtgtctgc

SEQ ID NO: 379530 - DNA, 20 bp, Homo sapiens
caggcagggagtgtctgcag

SEQ ID NO: 379531 - DNA, 21 bp, Homo sapiens
caggcagtctttgctcagtgg

SEQ ID NO: 379532 - DNA, 17 bp, Homo sapiens
caggcagttggccagag

SEQ ID NO: 379533 - DNA, 15 bp, Homo sapiens
caggcataggcctgg

SEQ ID NO: 379534 - DNA, 22 bp, Homo sapiens
caggcatctgtaagaagtagag

SEQ ID NO: 379535 - DNA, 14 bp, Homo sapiens
caggcatgaccctg

SEQ ID NO: 379536 - DNA, 19 bp, Homo sapiens
caggcatgaccctggagcc

SEQ ID NO: 379537 - DNA, 20 bp, Homo sapiens
caggcatgaccctggagccc

SEQ ID NO: 379538 - DNA, 23 bp, Homo sapiens
caggcatgagccaccacacctgg

SEQ ID NO: 379539 - DNA, 20 bp, Homo sapiens
caggcatgcgaatgagctgg

SEQ ID NO: 379540 - DNA, 21 bp, Homo sapiens
caggcatgcgaatgagctggg

SEQ ID NO: 379541 - DNA, 18 bp, Homo sapiens
caggcatggcccagcctg

SEQ ID NO: 379542 - DNA, 20 bp, Homo sapiens
caggcatggtagctcatgcc

SEQ ID NO: 379543 - DNA, 18 bp, Homo sapiens
caggcattgcactaaaag

SEQ ID NO: 379544 - DNA, 17 bp, Homo sapiens
caggccacacgctgccc

SEQ ID NO: 379545 - DNA, 22 bp, Homo sapiens
caggccacacgctgcccaggct

SEQ ID NO: 379546 - DNA, 16 bp, Homo sapiens
caggccaccagctgct

SEQ ID NO: 379547 - DNA, 19 bp, Homo sapiens
caggccacccactgtgggg

SEQ ID NO: 379548 - DNA, 17 bp, Homo sapiens
caggccacctgccccct

SEQ ID NO: 379549 - DNA, 18 bp, Homo sapiens
caggccacctgccccctt

SEQ ID NO: 379550 - DNA, 19 bp, Homo sapiens
caggccactctcagagact

SEQ ID NO: 379551 - DNA, 13 bp, Homo sapiens
caggccactgacc

SEQ ID NO: 379552 - DNA, 14 bp, Homo sapiens
caggccactgcaaa

SEQ ID NO: 379553 - DNA, 15 bp, Homo sapiens
caggccacttgctca

SEQ ID NO: 379554 - DNA, 20 bp, Homo sapiens
caggccagcttcgtgctgga

SEQ ID NO: 379555 - DNA, 14 bp, Homo sapiens
caggccaggcctca

SEQ ID NO: 379556 - DNA, 11 bp, Homo sapiens
caggccaggtc

SEQ ID NO: 379557 - DNA, 22 bp, Homo sapiens
caggccagtggacagagggaga

SEQ ID NO: 379558 - DNA, 18 bp, Homo sapiens
caggccatccggccccca

SEQ ID NO: 379559 - DNA, 15 bp, Homo sapiens
caggccatggaggca

SEQ ID NO: 379560 - DNA, 14 bp, Homo sapiens
caggccatggccaa

SEQ ID NO: 379561 - DNA, 16 bp, Homo sapiens
caggccatgtgagcca

SEQ ID NO: 379562 - DNA, 12 bp, Homo sapiens
caggcccacatt

SEQ ID NO: 379563 - DNA, 13 bp, Homo sapiens
caggcccagcctg

SEQ ID NO: 379564 - DNA, 18 bp, Homo sapiens
caggccccaacctgaagg

SEQ ID NO: 379565 - DNA, 15 bp, Homo sapiens
caggccccagccaag

SEQ ID NO: 379566 - DNA, 22 bp, Homo sapiens
caggccccagccaagtgccttc

SEQ ID NO: 379567 - DNA, 15 bp, Homo sapiens
caggccccagcctcc

SEQ ID NO: 379568 - DNA, 19 bp, Homo sapiens
caggccccagcctccaggc

SEQ ID NO: 379569 - DNA, 15 bp, Homo sapiens
caggccccctgcatc

SEQ ID NO: 379570 - DNA, 13 bp, Homo sapiens
caggcccctgagg

SEQ ID NO: 379571 - DNA, 18 bp, Homo sapiens
caggcccctgaggactgg

SEQ ID NO: 379572 - DNA, 20 bp, Homo sapiens
caggccctccatgggctagt

SEQ ID NO: 379573 - DNA, 14 bp, Homo sapiens
caggccctccctgt

SEQ ID NO: 379574 - DNA, 13 bp, Homo sapiens
caggccctcctgc

SEQ ID NO: 379575 - DNA, 19 bp, Homo sapiens
caggccctcctgctggctg

SEQ ID NO: 379576 - DNA, 20 bp, Homo sapiens
caggccctcctgctggctga

SEQ ID NO: 379577 - DNA, 16 bp, Homo sapiens
caggccctgcagtgtt

SEQ ID NO: 379578 - DNA, 15 bp, Homo sapiens
caggcccttcctctc

SEQ ID NO: 379579 - DNA, 19 bp, Homo sapiens
caggcccttcctctccact

SEQ ID NO: 379580 - DNA, 20 bp, Homo sapiens
caggcccttcctctccactg

SEQ ID NO: 379581 - DNA, 21 bp, Homo sapiens
caggcccttcctctccactgc

SEQ ID NO: 379582 - DNA, 21 bp, Homo sapiens
caggccgcatggcccctccag

SEQ ID NO: 379583 - DNA, 14 bp, Homo sapiens
caggccggccagcc

SEQ ID NO: 379584 - DNA, 22 bp, Homo sapiens
caggccgtcctcccgggccctc

SEQ ID NO: 379585 - DNA, 19 bp, Homo sapiens
caggccgtggctgcccaca

SEQ ID NO: 379586 - DNA, 23 bp, Homo sapiens
caggcctcacctggcttcccagg

SEQ ID NO: 379587 - DNA, 13 bp, Homo sapiens
caggcctccagcc

SEQ ID NO: 379588 - DNA, 16 bp, Homo sapiens
caggcctccagcctct

SEQ ID NO: 379589 - DNA, 19 bp, Homo sapiens
caggcctccagcctctccc

SEQ ID NO: 379590 - DNA, 15 bp, Homo sapiens
caggcctcccgcatg

SEQ ID NO: 379591 - DNA, 16 bp, Homo sapiens
caggcctccctctctc

SEQ ID NO: 379592 - DNA, 23 bp, Homo sapiens
caggcctgaaagaggctgaggcc

SEQ ID NO: 379593 - DNA, 12 bp, Homo sapiens
caggcctgccaa

SEQ ID NO: 379594 - DNA, 16 bp, Homo sapiens
caggcctgccaatgcc

SEQ ID NO: 379595 - DNA, 23 bp, Homo sapiens
caggcctgccaatgccacagcca

SEQ ID NO: 379596 - DNA, 14 bp, Homo sapiens
caggcctgccagac

SEQ ID NO: 379597 - DNA, 13 bp, Homo sapiens
caggcctgccagc

SEQ ID NO: 379598 - DNA, 16 bp, Homo sapiens
caggcctgccagcccc

SEQ ID NO: 379599 - DNA, 14 bp, Homo sapiens
caggcctgccctca

SEQ ID NO: 379600 - DNA, 11 bp, Homo sapiens
caggcctggcc

SEQ ID NO: 379601 - DNA, 15 bp, Homo sapiens
caggcctggcccagc

SEQ ID NO: 379602 - DNA, 18 bp, Homo sapiens
caggcctggcccagccag

SEQ ID NO: 379603 - DNA, 18 bp, Homo sapiens
caggcctggcctcggggc

SEQ ID NO: 379604 - DNA, 12 bp, Homo sapiens
caggcctgggac

SEQ ID NO: 379605 - DNA, 21 bp, Homo sapiens
caggcctgggacccagctact

SEQ ID NO: 379606 - DNA, 23 bp, Homo sapiens
cagggcctactgccacccgcttc

SEQ ID NO: 379607 - DNA, 16 bp, Homo sapiens
cagggcctgactttta

SEQ ID NO: 379608 - DNA, 18 bp, Homo sapiens
cagggcctgggggcagtg

SEQ ID NO: 379609 - DNA, 23 bp, Homo sapiens
cagggcctgggggcagtgactgg

SEQ ID NO: 379610 - DNA, 16 bp, Homo sapiens
cagggccttgacaagt

SEQ ID NO: 379611 - DNA, 21 bp, Homo sapiens
cagggcgctccggcagaggca

SEQ ID NO: 379612 - DNA, 23 bp, Homo sapiens
cagggcgctccggcagaggcagg

SEQ ID NO: 379613 - DNA, 16 bp, Homo sapiens
cagggcgggccaggag

SEQ ID NO: 379614 - DNA, 15 bp, Homo sapiens
cagggctaccctccc

SEQ ID NO: 379615 - DNA, 21 bp, Homo sapiens
cagggctccacgggggcctag

SEQ ID NO: 379616 - DNA, 12 bp, Homo sapiens
cagggctccctc

SEQ ID NO: 379617 - DNA, 23 bp, Homo sapiens
cagggctccctcctggagcatcc

SEQ ID NO: 379618 - DNA, 16 bp, Homo sapiens
cagggctctggcaggt

SEQ ID NO: 379619 - DNA, 21 bp, Homo sapiens
cagggctctggcaggtggcca

SEQ ID NO: 379620 - DNA, 18 bp, Homo sapiens
cagggctggagtgcgctc

SEQ ID NO: 379621 - DNA, 20 bp, Homo sapiens
cagggctggagtgcgctctt

SEQ ID NO: 379622 - DNA, 12 bp, Homo sapiens
cagggctgggca

SEQ ID NO: 379623 - DNA, 22 bp, Homo sapiens
cagggctgggcaggtcctgggg

SEQ ID NO: 379624 - DNA, 20 bp, Homo sapiens
cagggctgggctctgtcttc

SEQ ID NO: 379625 - DNA, 17 bp, Homo sapiens
cagggctgtgggtgggg

SEQ ID NO: 379626 - DNA, 21 bp, Homo sapiens
cagggcttacctgtacactga

SEQ ID NO: 379627 - DNA, 23 bp, Homo sapiens
cagggcttacctgtacactgact

SEQ ID NO: 379628 - DNA, 12 bp, Homo sapiens
cagggcttcctt

SEQ ID NO: 379629 - DNA, 17 bp, Homo sapiens
caggggactcagccctg

SEQ ID NO: 379630 - DNA, 12 bp, Homo sapiens
caggggagccag

SEQ ID NO: 379631 - DNA, 14 bp, Homo sapiens
caggggagccaggg

SEQ ID NO: 379632 - DNA, 19 bp, Homo sapiens
caggggagccagggtagag

SEQ ID NO: 379633 - DNA, 13 bp, Homo sapiens
caggggaggctga

SEQ ID NO: 379634 - DNA, 14 bp, Homo sapiens
caggggaggctgag

SEQ ID NO: 379635 - DNA, 16 bp, Homo sapiens
caggggaggctgagac

SEQ ID NO: 379636 - DNA, 14 bp, Homo sapiens
caggggagtctgct

SEQ ID NO: 379637 - DNA, 17 bp, Homo sapiens
caggggatctgggtgtg

SEQ ID NO: 379638 - DNA, 12 bp, Homo sapiens
caggggcacact

SEQ ID NO: 379639 - DNA, 12 bp, Homo sapiens
caggggcagctc

SEQ ID NO: 379640 - DNA, 15 bp, Homo sapiens
caggggcaggcctgg

SEQ ID NO: 379641 - DNA, 16 bp, Homo sapiens
caggggcatctctggg

SEQ ID NO: 379642 - DNA, 20 bp, Homo sapiens
caggggcatgtattggcctg

SEQ ID NO: 379643 - DNA, 15 bp, Homo sapiens
caggggcccaggctc

SEQ ID NO: 379644 - DNA, 15 bp, Homo sapiens
caggggccccagatc

SEQ ID NO: 379645 - DNA, 13 bp, Homo sapiens
caggggcccctcc

SEQ ID NO: 379646 - DNA, 18 bp, Homo sapiens
caggggcccctcctctgt

SEQ ID NO: 379647 - DNA, 20 bp, Homo sapiens
caggggcccctcctctgtgc

SEQ ID NO: 379648 - DNA, 18 bp, Homo sapiens
caggggcccttgggacag

SEQ ID NO: 379649 - DNA, 15 bp, Homo sapiens
caggggcggggcagg

SEQ ID NO: 379650 - DNA, 22 bp, Homo sapiens
caggggctctgcttcctcagcc

SEQ ID NO: 379651 - DNA, 14 bp, Homo sapiens
caggggctgcatcc

SEQ ID NO: 379652 - DNA, 16 bp, Homo sapiens
caggggctgcatcctc

SEQ ID NO: 379653 - DNA, 20 bp, Homo sapiens
caggggctgggcagagggga

SEQ ID NO: 379654 - DNA, 20 bp, Homo sapiens
caggggctttggaagctctg

SEQ ID NO: 379655 - DNA, 20 bp, Homo sapiens
caggggctttggtggcccct

SEQ ID NO: 379656 - DNA, 16 bp, Homo sapiens
cagggggaaaatgttt

SEQ ID NO: 379657 - DNA, 17 bp, Homo sapiens
cagggggcctgcaggcc

SEQ ID NO: 379658 - DNA, 22 bp, Homo sapiens
cagggggcctttaaagacttaa

SEQ ID NO: 379659 - DNA, 23 bp, Homo sapiens
caggggggttgggttccagacag

SEQ ID NO: 379660 - DNA, 21 bp, Homo sapiens
cagggggtggagagaccagcc

SEQ ID NO: 379661 - DNA, 14 bp, Homo sapiens
caggggtcaccttg

SEQ ID NO: 379662 - DNA, 13 bp, Homo sapiens
caggggtctccct

SEQ ID NO: 379663 - DNA, 19 bp, Homo sapiens
caggggtctccctgagcct

SEQ ID NO: 379664 - DNA, 13 bp, Homo sapiens
caggggtgggagg

SEQ ID NO: 379665 - DNA, 20 bp, Homo sapiens
caggggtgggaggctcccag

SEQ ID NO: 379666 - DNA, 21 bp, Homo sapiens
caggggtgggaggctcccaga

SEQ ID NO: 379667 - DNA, 18 bp, Homo sapiens
caggggttccagcttccc

SEQ ID NO: 379668 - DNA, 21 bp, Homo sapiens
caggggttcgagaccagtctg

SEQ ID NO: 379669 - DNA, 22 bp, Homo sapiens
caggggttgcagtgagcggaga

SEQ ID NO: 379670 - DNA, 14 bp, Homo sapiens
cagggtaaattatt

SEQ ID NO: 379671 - DNA, 19 bp, Homo sapiens
cagggtagagcaaaggaga

SEQ ID NO: 379672 - DNA, 15 bp, Homo sapiens
cagggtccctcagga

SEQ ID NO: 379673 - DNA, 16 bp, Homo sapiens
cagggtccctcaggac

SEQ ID NO: 379674 - DNA, 15 bp, Homo sapiens
cagggtccgcaccag

SEQ ID NO: 379675 - DNA, 20 bp, Homo sapiens
cagggtccgcaccagctgct

SEQ ID NO: 379676 - DNA, 13 bp, Homo sapiens
cagggtcctgtgc

SEQ ID NO: 379677 - DNA, 15 bp, Homo sapiens
cagggtcctgtgcct

SEQ ID NO: 379678 - DNA, 16 bp, Homo sapiens
cagggtctcgtcagga

SEQ ID NO: 379679 - DNA, 13 bp, Homo sapiens
cagggtcttccct

SEQ ID NO: 379680 - DNA, 13 bp, Homo sapiens
cagggtcttgggc

SEQ ID NO: 379681 - DNA, 14 bp, Homo sapiens
cagggtcttgggct

SEQ ID NO: 379682 - DNA, 15 bp, Homo sapiens
cagggtgagcagggc

SEQ ID NO: 379683 - DNA, 17 bp, Homo sapiens
cagggtgagcagggccc

SEQ ID NO: 379684 - DNA, 21 bp, Homo sapiens
cagggtgagcagggccctcag

SEQ ID NO: 379685 - DNA, 17 bp, Homo sapiens
cagggtgcaggcgcgca

SEQ ID NO: 379686 - DNA, 18 bp, Homo sapiens
cagggtgctccctcctca

SEQ ID NO: 379687 - DNA, 12 bp, Homo sapiens
cagggtggctgg

SEQ ID NO: 379688 - DNA, 19 bp, Homo sapiens
cagggtgggatgagcctct

SEQ ID NO: 379689 - DNA, 18 bp, Homo sapiens
cagggtgggcagcctatg

SEQ ID NO: 379690 - DNA, 13 bp, Homo sapiens
cagggtggggggt

SEQ ID NO: 379691 - DNA, 15 bp, Homo sapiens
cagggtggggggtga

SEQ ID NO: 379692 - DNA, 18 bp, Homo sapiens
cagggtggtgctgggact

SEQ ID NO: 379693 - DNA, 12 bp, Homo sapiens
cagggtgtgtct

SEQ ID NO: 379694 - DNA, 15 bp, Homo sapiens
cagggttccagacag

SEQ ID NO: 379695 - DNA, 15 bp, Homo sapiens
cagggttcccccagc

SEQ ID NO: 379696 - DNA, 17 bp, Homo sapiens
cagggttcccccagccc

SEQ ID NO: 379697 - DNA, 22 bp, Homo sapiens
cagggttcccccagccctgtgg

SEQ ID NO: 379698 - DNA, 21 bp, Homo sapiens
cagggttctagaaggggcgag

SEQ ID NO: 379699 - DNA, 17 bp, Homo sapiens
cagggttctcctctccc

SEQ ID NO: 379700 - DNA, 20 bp, Homo sapiens
cagggttgggcccagatctg

SEQ ID NO: 379701 - DNA, 19 bp, Homo sapiens
cagggtttatcttttgaga

SEQ ID NO: 379702 - DNA, 17 bp, Homo sapiens
cagggttttatctctgt

SEQ ID NO: 379703 - DNA, 13 bp, Homo sapiens
caggtaatgtgaa

SEQ ID NO: 379704 - DNA, 20 bp, Homo sapiens
caggtacttcctcctgatgg

SEQ ID NO: 379705 - DNA, 22 bp, Homo sapiens
caggtacttcctcctgatggcc

SEQ ID NO: 379706 - DNA, 18 bp, Homo sapiens
caggtagatcgcttgagc

SEQ ID NO: 379707 - DNA, 20 bp, Homo sapiens
caggtagatcgcttgagccc

SEQ ID NO: 379708 - DNA, 21 bp, Homo sapiens
caggtaggcccttgtcctgcc

SEQ ID NO: 379709 - DNA, 23 bp, Homo sapiens
caggtaggcccttgtcctgccag

SEQ ID NO: 379710 - DNA, 13 bp, Homo sapiens
caggtagtactgg

SEQ ID NO: 379711 - DNA, 18 bp, Homo sapiens
caggtagttgcaattgaa

SEQ ID NO: 379712 - DNA, 14 bp, Homo sapiens
caggtataaaacct

SEQ ID NO: 379713 - DNA, 23 bp, Homo sapiens
caggtatggaagggtttgtggct

SEQ ID NO: 379714 - DNA, 21 bp, Homo sapiens
caggtattttcatcaagtagc

SEQ ID NO: 379715 - DNA, 16 bp, Homo sapiens
caggtcagctgttact

SEQ ID NO: 379716 - DNA, 20 bp, Homo sapiens
caggtcccacgtctggccag

SEQ ID NO: 379717 - DNA, 13 bp, Homo sapiens
caggtcccagtgc

SEQ ID NO: 379718 - DNA, 19 bp, Homo sapiens
caggtccctggaccagcct

SEQ ID NO: 379719 - DNA, 22 bp, Homo sapiens
caggtccctggaccagcctcct

SEQ ID NO: 379720 - DNA, 15 bp, Homo sapiens
caggtcctggggagg

SEQ ID NO: 379721 - DNA, 19 bp, Homo sapiens
caggtcctggggaggctga

SEQ ID NO: 379722 - DNA, 15 bp, Homo sapiens
caggtcgggctcagc

SEQ ID NO: 379723 - DNA, 16 bp, Homo sapiens
caggtcgggctcagct

SEQ ID NO: 379724 - DNA, 17 bp, Homo sapiens
caggtcgggctcagctc

SEQ ID NO: 379725 - DNA, 14 bp, Homo sapiens
caggtctcactgct

SEQ ID NO: 379726 - DNA, 18 bp, Homo sapiens
caggtctgcaggccacca

SEQ ID NO: 379727 - DNA, 20 bp, Homo sapiens
caggtctgcaggccaccagc

SEQ ID NO: 379728 - DNA, 18 bp, Homo sapiens
caggtctgggagaggcag

SEQ ID NO: 379729 - DNA, 20 bp, Homo sapiens
caggtctgggagaggcagag

SEQ ID NO: 379730 - DNA, 13 bp, Homo sapiens
caggtgaataaag

SEQ ID NO: 379731 - DNA, 12 bp, Homo sapiens
caggtgaataac

SEQ ID NO: 379732 - DNA, 18 bp, Homo sapiens
caggtgaccttctgggaa

SEQ ID NO: 379733 - DNA, 15 bp, Homo sapiens
caggtgagtgtgagg

SEQ ID NO: 379734 - DNA, 16 bp, Homo sapiens
caggtgatccacctgc

SEQ ID NO: 379735 - DNA, 15 bp, Homo sapiens
caggtgattctgatc

SEQ ID NO: 379736 - DNA, 18 bp, Homo sapiens
agtgttcccttctggctg

SEQ ID NO: 379737 - DNA, 17 bp, Homo sapiens
agtgttcctcaccaata

SEQ ID NO: 379738 - DNA, 21 bp, Homo sapiens
agtgttcctcaccaataactt

SEQ ID NO: 379739 - DNA, 14 bp, Homo sapiens
agtgttctgagccc

SEQ ID NO: 379740 - DNA, 15 bp, Homo sapiens
agtgttctgagcccc

SEQ ID NO: 379741 - DNA, 21 bp, Homo sapiens
agtgttgattgccaaattgac

SEQ ID NO: 379742 - DNA, 18 bp, Homo sapiens
agtgttgctcttggaaag

SEQ ID NO: 379743 - DNA, 20 bp, Homo sapiens
agtgttgggattacaggcgt

SEQ ID NO: 379744 - DNA, 17 bp, Homo sapiens
agtgttggtctttctaa

SEQ ID NO: 379745 - DNA, 13 bp, Homo sapiens
agtgttgtttgta

SEQ ID NO: 379746 - DNA, 15 bp, Homo sapiens
agtgttgtttgtaaa

SEQ ID NO: 379747 - DNA, 15 bp, Homo sapiens
agtgtttatttttca

SEQ ID NO: 379748 - DNA, 21 bp, Homo sapiens
agtgtttatttttcatattgt

SEQ ID NO: 379749 - DNA, 18 bp, Homo sapiens
agtgtttctgcagaggca

SEQ ID NO: 379750 - DNA, 20 bp, Homo sapiens
agtgttttaagataaattat

SEQ ID NO: 379751 - DNA, 21 bp, Homo sapiens
agtgttttactctttttctaa

SEQ ID NO: 379752 - DNA, 17 bp, Homo sapiens
agtgttttcacctcata

SEQ ID NO: 379753 - DNA, 16 bp, Homo sapiens
agtgttttctcagaac

SEQ ID NO: 379754 - DNA, 19 bp, Homo sapiens
agtgttttctcagaacagc

SEQ ID NO: 379755 - DNA, 15 bp, Homo sapiens
agtgttttctgggat

SEQ ID NO: 379756 - DNA, 21 bp, Homo sapiens
agttaaaaaaaaaacagcctg

SEQ ID NO: 379757 - DNA, 14 bp, Homo sapiens
agttaaaaaaaata

SEQ ID NO: 379758 - DNA, 19 bp, Homo sapiens
agttaaaaaaaataataaa

SEQ ID NO: 379759 - DNA, 20 bp, Homo sapiens
agttaaaaaaaataataaat

SEQ ID NO: 379760 - DNA, 13 bp, Homo sapiens
agttaaaagcatt

SEQ ID NO: 379761 - DNA, 17 bp, Homo sapiens
agttaaaagtaaaagag

SEQ ID NO: 379762 - DNA, 19 bp, Homo sapiens
agttaaagagacaaatagt

SEQ ID NO: 379763 - DNA, 13 bp, Homo sapiens
agttaaaggcagt

SEQ ID NO: 379764 - DNA, 21 bp, Homo sapiens
agttaaaggcagtccagagct

SEQ ID NO: 379765 - DNA, 21 bp, Homo sapiens
agttaaatagagtatatgcac

SEQ ID NO: 379766 - DNA, 13 bp, Homo sapiens
agttaacatctga

SEQ ID NO: 379767 - DNA, 22 bp, Homo sapiens
agttaacttagtgtttagcatt

SEQ ID NO: 379768 - DNA, 16 bp, Homo sapiens
agttaaggtatctggt

SEQ ID NO: 379769 - DNA, 17 bp, Homo sapiens
agttaagtcgctgaaca

SEQ ID NO: 379770 - DNA, 18 bp, Homo sapiens
agttaagtcgctgaacaa

SEQ ID NO: 379771 - DNA, 13 bp, Homo sapiens
caggttggacccc

SEQ ID NO: 379772 - DNA, 14 bp, Homo sapiens
caggttggacccca

SEQ ID NO: 379773 - DNA, 17 bp, Homo sapiens
caggttggaccccagag

SEQ ID NO: 379774 - DNA, 22 bp, Homo sapiens
caggttgtctgaagtcactgca

SEQ ID NO: 379775 - DNA, 15 bp, Homo sapiens
caggttgttctgtat

SEQ ID NO: 379776 - DNA, 19 bp, Homo sapiens
caggttgttctgtataaaa

SEQ ID NO: 379777 - DNA, 11 bp, Homo sapiens
caggttttctg

SEQ ID NO: 379778 - DNA, 15 bp, Homo sapiens
caggttttctgctct

SEQ ID NO: 379779 - DNA, 24 bp, Homo sapiens
caggttttcttctaatcataacat

SEQ ID NO: 379780 - DNA, 16 bp, Homo sapiens
cagtaaataaattgtt

SEQ ID NO: 379781 - DNA, 19 bp, Homo sapiens
cagtaaataaattgtttga

SEQ ID NO: 379782 - DNA, 24 bp, Homo sapiens
cagtaaataaattgtttgaccatg

SEQ ID NO: 379783 - DNA, 18 bp, Homo sapiens
cagtaacagggccttgct

SEQ ID NO: 379784 - DNA, 18 bp, Homo sapiens
cagtaacgcgtcttcctg

SEQ ID NO: 379785 - DNA, 21 bp, Homo sapiens
cagtaacgcgtcttcctgagt

SEQ ID NO: 379786 - DNA, 17 bp, Homo sapiens
cagtaagaccggaagct

SEQ ID NO: 379787 - DNA, 21 bp, Homo sapiens
cagtaagaccggaagctcctg

SEQ ID NO: 379788 - DNA, 19 bp, Homo sapiens
cagtaagctgctctattgt

SEQ ID NO: 379789 - DNA, 12 bp, Homo sapiens
cagtaaggcagc

SEQ ID NO: 379790 - DNA, 19 bp, Homo sapiens
cagtaaggcagctctgtcg

SEQ ID NO: 379791 - DNA, 18 bp, Homo sapiens
cagtaagtataacaaact

SEQ ID NO: 379792 - DNA, 23 bp, Homo sapiens
cagtaagtataacaaactatgta

SEQ ID NO: 379793 - DNA, 21 bp, Homo sapiens
cagtacaattctttgttgctt

SEQ ID NO: 379794 - DNA, 14 bp, Homo sapiens
cagtacccacctga

SEQ ID NO: 379795 - DNA, 22 bp, Homo sapiens
cagtacctgggaaaggacccac

SEQ ID NO: 379796 - DNA, 23 bp, Homo sapiens
cagtacctgggaaaggacccacc

SEQ ID NO: 379797 - DNA, 23 bp, Homo sapiens
cagtacctgtgcctgagaattta

SEQ ID NO: 379798 - DNA, 15 bp, Homo sapiens
cagtacctttgtcac

SEQ ID NO: 379799 - DNA, 17 bp, Homo sapiens
cagtacgtcccgctgct

SEQ ID NO: 379800 - DNA, 22 bp, Homo sapiens
cagtacgtcccgctgctgtgct

SEQ ID NO: 379801 - DNA, 20 bp, Homo sapiens
cagtagaaggtcggaggctt

SEQ ID NO: 379802 - DNA, 16 bp, Homo sapiens
cagtagagagtgccct

SEQ ID NO: 379803 - DNA, 21 bp, Homo sapiens
cagtagagtagggtagaagga

SEQ ID NO: 379804 - DNA, 17 bp, Homo sapiens
cagtagagtcatctcca

SEQ ID NO: 379805 - DNA, 19 bp, Homo sapiens
cagtagatgtgcttctgaa

SEQ ID NO: 379806 - DNA, 20 bp, Homo sapiens
cagtagccattttgtaactg

SEQ ID NO: 379807 - DNA, 21 bp, Homo sapiens
cagtagccccaatatggtggc

SEQ ID NO: 379808 - DNA, 20 bp, Homo sapiens
cagtagctacggttccctgc

SEQ ID NO: 379809 - DNA, 23 bp, Homo sapiens
cagtagctccaacactttgagca

SEQ ID NO: 379810 - DNA, 13 bp, Homo sapiens
cagtagctgccaa

SEQ ID NO: 379811 - DNA, 20 bp, Homo sapiens
cagtagctgtggggagctgg

SEQ ID NO: 379812 - DNA, 21 bp, Homo sapiens
cagtagctgtggggagctggt

SEQ ID NO: 379813 - DNA, 23 bp, Homo sapiens
cagtaggcattctttagtctaca

SEQ ID NO: 379814 - DNA, 19 bp, Homo sapiens
cagtaggtccaagggccat

SEQ ID NO: 379815 - DNA, 22 bp, Homo sapiens
cagtaggtgacactatagttta

SEQ ID NO: 379816 - DNA, 18 bp, Homo sapiens
cagtaggttgaggacagg

SEQ ID NO: 379817 - DNA, 17 bp, Homo sapiens
cagtagtcacctctggg

SEQ ID NO: 379818 - DNA, 14 bp, Homo sapiens
cagtagtgccagaa

SEQ ID NO: 379819 - DNA, 16 bp, Homo sapiens
cagtataaaagacaaa

SEQ ID NO: 379820 - DNA, 13 bp, Homo sapiens
cagtatactgtgt

SEQ ID NO: 379821 - DNA, 14 bp, Homo sapiens
cagtatataagctt

SEQ ID NO: 379822 - DNA, 15 bp, Homo sapiens
cagtatataagcttt

SEQ ID NO: 379823 - DNA, 23 bp, Homo sapiens
cagtatcaaggctgcctggagaa

SEQ ID NO: 379824 - DNA, 14 bp, Homo sapiens
cagtatcactgtct

SEQ ID NO: 379825 - DNA, 12 bp, Homo sapiens
cagtatcttgaa

SEQ ID NO: 379826 - DNA, 16 bp, Homo sapiens
cagtatgaagacactg

SEQ ID NO: 379827 - DNA, 22 bp, Homo sapiens
cagtatgatggcaggagaatca

SEQ ID NO: 379828 - DNA, 12 bp, Homo sapiens
cagtatgtgtct

SEQ ID NO: 379829 - DNA, 13 bp, Homo sapiens
cagtatgtgtcta

SEQ ID NO: 379830 - DNA, 14 bp, Homo sapiens
cagtatgtgtctag

SEQ ID NO: 379831 - DNA, 14 bp, Homo sapiens
cagtattaaactct

SEQ ID NO: 379832 - DNA, 18 bp, Homo sapiens
cagtattaaactctcctt

SEQ ID NO: 379833 - DNA, 20 bp, Homo sapiens
cagtattaaactctcctttg

SEQ ID NO: 379834 - DNA, 22 bp, Homo sapiens
cagtattaaactctcctttgat

SEQ ID NO: 379835 - DNA, 14 bp, Homo sapiens
cagtattctcagag

SEQ ID NO: 379836 - DNA, 13 bp, Homo sapiens
cagtattcttgtc

SEQ ID NO: 379837 - DNA, 19 bp, Homo sapiens
cagtattcttgtcaaaaaa

SEQ ID NO: 379838 - DNA, 15 bp, Homo sapiens
cagtattgaaaactt

SEQ ID NO: 379839 - DNA, 18 bp, Homo sapiens
cagtattgaaaacttcaa

SEQ ID NO: 379840 - DNA, 15 bp, Homo sapiens
cagtattgacttctt

SEQ ID NO: 379841 - DNA, 20 bp, Homo sapiens
cagtattgagacactgtcaa

SEQ ID NO: 379842 - DNA, 21 bp, Homo sapiens
cagtattgagacactgtcaag

SEQ ID NO: 379843 - DNA, 17 bp, Homo sapiens
cagtattgccacctctg

SEQ ID NO: 379844 - DNA, 18 bp, Homo sapiens
cagtattgccacctctgg

SEQ ID NO: 379845 - DNA, 16 bp, Homo sapiens
cagtattgtgtaaagg

SEQ ID NO: 379846 - DNA, 13 bp, Homo sapiens
cagtattgttctt

SEQ ID NO: 379847 - DNA, 22 bp, Homo sapiens
cagtattgttcttgtaaaactg

SEQ ID NO: 379848 - DNA, 22 bp, Homo sapiens
cagtatttaccttcctttgtct

SEQ ID NO: 379849 - DNA, 18 bp, Homo sapiens
cagtatttattgttccca

SEQ ID NO: 379850 - DNA, 21 bp, Homo sapiens
cagtattttggagaaattatt

SEQ ID NO: 379851 - DNA, 23 bp, Homo sapiens
cagtattttggagaaattattta

SEQ ID NO: 379852 - DNA, 22 bp, Homo sapiens
cagtatttttgttgtgttctgt

SEQ ID NO: 379853 - DNA, 22 bp, Homo sapiens
cagtcaaacaagttgtgccttt

SEQ ID NO: 379854 - DNA, 17 bp, Homo sapiens
cagtcaaggagtggctt

SEQ ID NO: 379855 - DNA, 20 bp, Homo sapiens
cagtcacactgctgggaagt

SEQ ID NO: 379856 - DNA, 17 bp, Homo sapiens
cagtcacccctgtctgc

SEQ ID NO: 379857 - DNA, 17 bp, Homo sapiens
cagtcaccctgtggcaa

SEQ ID NO: 379858 - DNA, 15 bp, Homo sapiens
cagtcacccttctgg

SEQ ID NO: 379859 - DNA, 16 bp, Homo sapiens
cagtcacccttctggg

SEQ ID NO: 379860 - DNA, 21 bp, Homo sapiens
cagtcagccagcttggtggtt

SEQ ID NO: 379861 - DNA, 21 bp, Homo sapiens
cagtcagggacagcagcctcc

SEQ ID NO: 379862 - DNA, 17 bp, Homo sapiens
cagtcagttcccggagc

SEQ ID NO: 379863 - DNA, 22 bp, Homo sapiens
cagtcagttcccggagcacagc

SEQ ID NO: 379864 - DNA, 23 bp, Homo sapiens
cagtcagttcccggagcacagcc

SEQ ID NO: 379865 - DNA, 15 bp, Homo sapiens
agttcttcacctcta

SEQ ID NO: 379866 - DNA, 16 bp, Homo sapiens
agttcttcacctctat

SEQ ID NO: 379867 - DNA, 18 bp, Homo sapiens
agttcttcgggaagagag

SEQ ID NO: 379868 - DNA, 20 bp, Homo sapiens
agttcttcgggaagagagga

SEQ ID NO: 379869 - DNA, 14 bp, Homo sapiens
agttcttgaacagt

SEQ ID NO: 379870 - DNA, 16 bp, Homo sapiens
agttcttgggggaggc

SEQ ID NO: 379871 - DNA, 17 bp, Homo sapiens
agttctttgttcctgct

SEQ ID NO: 379872 - DNA, 20 bp, Homo sapiens
agttctttgttcctgctttc

SEQ ID NO: 379873 - DNA, 21 bp, Homo sapiens
agttctttgttcctgctttct

SEQ ID NO: 379874 - DNA, 19 bp, Homo sapiens
agttgaacaagatttccct

SEQ ID NO: 379875 - DNA, 16 bp, Homo sapiens
agttgaagctaagatt

SEQ ID NO: 379876 - DNA, 12 bp, Homo sapiens
agttgaattttt

SEQ ID NO: 379877 - DNA, 18 bp, Homo sapiens
agttgaattttttttaac

SEQ ID NO: 379878 - DNA, 21 bp, Homo sapiens
agttgaattttttttaacatt

SEQ ID NO: 379879 - DNA, 23 bp, Homo sapiens
agttgaattttttttaacattcc

SEQ ID NO: 379880 - DNA, 18 bp, Homo sapiens
agttgaggggagaggaaa

SEQ ID NO: 379881 - DNA, 19 bp, Homo sapiens
agttgaggggagaggaaat

SEQ ID NO: 379882 - DNA, 13 bp, Homo sapiens
agttgaggggctt

SEQ ID NO: 379883 - DNA, 21 bp, Homo sapiens
agttgaggggcttccctctgc

SEQ ID NO: 379884 - DNA, 21 bp, Homo sapiens
agttgagtacagtgaggaggg

SEQ ID NO: 379885 - DNA, 20 bp, Homo sapiens
agttgagtcgtcatcacttt

SEQ ID NO: 379886 - DNA, 17 bp, Homo sapiens
agttgagtcttcacatt

SEQ ID NO: 379887 - DNA, 17 bp, Homo sapiens
agttgataggagacttg

SEQ ID NO: 379888 - DNA, 14 bp, Homo sapiens
agttgatgaccaat

SEQ ID NO: 379889 - DNA, 23 bp, Homo sapiens
agttgatgaccaatctctgtgac

SEQ ID NO: 379890 - DNA, 16 bp, Homo sapiens
agttgatgtcgatgct

SEQ ID NO: 379891 - DNA, 23 bp, Homo sapiens
agttgattctgtcccccacgtgg

SEQ ID NO: 379892 - DNA, 15 bp, Homo sapiens
agttgcaaagcattt

SEQ ID NO: 379893 - DNA, 19 bp, Homo sapiens
agttgcaattgaattaaat

SEQ ID NO: 379894 - DNA, 11 bp, Homo sapiens
agttgcagaaa

SEQ ID NO: 379895 - DNA, 18 bp, Homo sapiens
agttgcagactcagtttg

SEQ ID NO: 379896 - DNA, 22 bp, Homo sapiens
agttgcagactcagtttgtcag

SEQ ID NO: 379897 - DNA, 22 bp, Homo sapiens
agttgccgcatattatatcaga

SEQ ID NO: 379898 - DNA, 19 bp, Homo sapiens
agttgcgtgtctgtttcct

SEQ ID NO: 379899 - DNA, 21 bp, Homo sapiens
agttgctcctacccctgtcct

SEQ ID NO: 379900 - DNA, 16 bp, Homo sapiens
agttgctgagaaatgg

SEQ ID NO: 379901 - DNA, 16 bp, Homo sapiens
agttgctgtccccttc

SEQ ID NO: 379902 - DNA, 15 bp, Homo sapiens
agttgctgtgcccca

SEQ ID NO: 379903 - DNA, 17 bp, Homo sapiens
agttggactctcaggga

SEQ ID NO: 379904 - DNA, 21 bp, Homo sapiens
agttggcagagaaggcctctt

SEQ ID NO: 379905 - DNA, 15 bp, Homo sapiens
agttggcatgaaagt

SEQ ID NO: 379906 - DNA, 15 bp, Homo sapiens
agttggctagaagaa

SEQ ID NO: 379907 - DNA, 17 bp, Homo sapiens
cagtctctccctggggt

SEQ ID NO: 379908 - DNA, 15 bp, Homo sapiens
cagtctctttaatct

SEQ ID NO: 379909 - DNA, 22 bp, Homo sapiens
cagtctctttaatcttcagttt

SEQ ID NO: 379910 - DNA, 13 bp, Homo sapiens
cagtctgaagttt

SEQ ID NO: 379911 - DNA, 13 bp, Homo sapiens
cagtctgagtcat

SEQ ID NO: 379912 - DNA, 13 bp, Homo sapiens
cagtctgctgccc

SEQ ID NO: 379913 - DNA, 23 bp, Homo sapiens
cagtctgtcatgaacatgttcct

SEQ ID NO: 379914 - DNA, 15 bp, Homo sapiens
cagtctgtctactgt

SEQ ID NO: 379915 - DNA, 18 bp, Homo sapiens
cagtctgtctactgtggt

SEQ ID NO: 379916 - DNA, 21 bp, Homo sapiens
cagtctgttccccatggccac

SEQ ID NO: 379917 - DNA, 15 bp, Homo sapiens
cagtcttcacttgca

SEQ ID NO: 379918 - DNA, 19 bp, Homo sapiens
cagtcttcacttgcactgg

SEQ ID NO: 379919 - DNA, 21 bp, Homo sapiens
cagtcttcacttgcactgggg

SEQ ID NO: 379920 - DNA, 20 bp, Homo sapiens
cagtcttgagtgggccccct

SEQ ID NO: 379921 - DNA, 22 bp, Homo sapiens
cagtcttgagtgggccccctct

SEQ ID NO: 379922 - DNA, 15 bp, Homo sapiens
cagtcttgcctaggc

SEQ ID NO: 379923 - DNA, 13 bp, Homo sapiens
cagtcttgtgctt

SEQ ID NO: 379924 - DNA, 20 bp, Homo sapiens
cagtctttgctcagtggatc

SEQ ID NO: 379925 - DNA, 21 bp, Homo sapiens
cagtctttgggggattcaaat

SEQ ID NO: 379926 - DNA, 17 bp, Homo sapiens
cagtgaacataactgta

SEQ ID NO: 379927 - DNA, 20 bp, Homo sapiens
cagtgaacataactgtaaca

SEQ ID NO: 379928 - DNA, 23 bp, Homo sapiens
cagtgaacttacacttggagccc

SEQ ID NO: 379929 - DNA, 16 bp, Homo sapiens
cagtgaagcccaggag

SEQ ID NO: 379930 - DNA, 18 bp, Homo sapiens
cagtgaagcccaggagga

SEQ ID NO: 379931 - DNA, 15 bp, Homo sapiens
cagtgaatataaatg

SEQ ID NO: 379932 - DNA, 18 bp, Homo sapiens
cagtgaatttaagcatga

SEQ ID NO: 379933 - DNA, 23 bp, Homo sapiens
cagtgacacttcagagagctggt

SEQ ID NO: 379934 - DNA, 18 bp, Homo sapiens
cagtgacagagttcacta

SEQ ID NO: 379935 - DNA, 19 bp, Homo sapiens
cagtgacctgctgggtaaa

SEQ ID NO: 379936 - DNA, 17 bp, Homo sapiens
cagtgactggcaggtgc

SEQ ID NO: 379937 - DNA, 18 bp, Homo sapiens
cagtgactggcaggtgca

SEQ ID NO: 379938 - DNA, 20 bp, Homo sapiens
cagtgactttttctgagctt

SEQ ID NO: 379939 - DNA, 22 bp, Homo sapiens
cagtgactttttctgagctttt

SEQ ID NO: 379940 - DNA, 20 bp, Homo sapiens
cagtgagattacagaggaag

SEQ ID NO: 379941 - DNA, 15 bp, Homo sapiens
cagtgagcccctccc

SEQ ID NO: 379942 - DNA, 17 bp, Homo sapiens
cagtgaggcccagggag

SEQ ID NO: 379943 - DNA, 19 bp, Homo sapiens
cagtgataggcccaaggtc

SEQ ID NO: 379944 - DNA, 21 bp, Homo sapiens
cagtgatctccatatgttaca

SEQ ID NO: 379945 - DNA, 17 bp, Homo sapiens
cagtgatggcattactc

SEQ ID NO: 379946 - DNA, 21 bp, Homo sapiens
cagtgatggcattactctgca

SEQ ID NO: 379947 - DNA, 15 bp, Homo sapiens
cagtgattctctctt

SEQ ID NO: 379948 - DNA, 23 bp, Homo sapiens
cagtgattgaagtatctgtacct

SEQ ID NO: 379949 - DNA, 19 bp, Homo sapiens
cagtgatttacatgctgat

SEQ ID NO: 379950 - DNA, 18 bp, Homo sapiens
cagtgatttttttttaga

SEQ ID NO: 379951 - DNA, 15 bp, Homo sapiens
cagtgcacccactct

SEQ ID NO: 379952 - DNA, 23 bp, Homo sapiens
cagtgcacctgtggcctctcagt

SEQ ID NO: 379953 - DNA, 14 bp, Homo sapiens
cagtgcagacaggc

SEQ ID NO: 379954 - DNA, 15 bp, Homo sapiens
cagtgcagacaggcc

SEQ ID NO: 379955 - DNA, 16 bp, Homo sapiens
cagtgcatctcagccc

SEQ ID NO: 379956 - DNA, 13 bp, Homo sapiens
cagtgcatgctgt

SEQ ID NO: 379957 - DNA, 14 bp, Homo sapiens
cagtgcatgctgtc

SEQ ID NO: 379958 - DNA, 22 bp, Homo sapiens
cagtgcatgctgtcccttacgt

SEQ ID NO: 379959 - DNA, 18 bp, Homo sapiens
cagtgcatgtgaagcatg

SEQ ID NO: 379960 - DNA, 15 bp, Homo sapiens
cagtgccaaaaacaa

SEQ ID NO: 379961 - DNA, 13 bp, Homo sapiens
cagtgccaaactt

SEQ ID NO: 379962 - DNA, 15 bp, Homo sapiens
cagtgccaaacttgg

SEQ ID NO: 379963 - DNA, 16 bp, Homo sapiens
cagtgccaaacttggg

SEQ ID NO: 379964 - DNA, 24 bp, Homo sapiens
cagtgccacctatgcctgtggtga

SEQ ID NO: 379965 - DNA, 13 bp, Homo sapiens
cagtgcccagtga

SEQ ID NO: 379966 - DNA, 18 bp, Homo sapiens
cagtgcccagtgatggca

SEQ ID NO: 379967 - DNA, 14 bp, Homo sapiens
cagtgcctcgaggc

SEQ ID NO: 379968 - DNA, 20 bp, Homo sapiens
cagtgcctcgaggcaccggc

SEQ ID NO: 379969 - DNA, 13 bp, Homo sapiens
cagtgcctgccac

SEQ ID NO: 379970 - DNA, 21 bp, Homo sapiens
cagtgcctgccactctctggg

SEQ ID NO: 379971 - DNA, 24 bp, Homo sapiens
cagtgcctgccactctctgggact

SEQ ID NO: 379972 - DNA, 18 bp, Homo sapiens
cagtgcctgggaatgtat

SEQ ID NO: 379973 - DNA, 20 bp, Homo sapiens
cagtgcctgggaatgtatta

SEQ ID NO: 379974 - DNA, 15 bp, Homo sapiens
cagtgcctgtctgga

SEQ ID NO: 379975 - DNA, 15 bp, Homo sapiens
cagtgccttccataa

SEQ ID NO: 379976 - DNA, 17 bp, Homo sapiens
cagtgccttccataatt

SEQ ID NO: 379977 - DNA, 21 bp, Homo sapiens
cagtgcgggaggaatttctga

SEQ ID NO: 379978 - DNA, 17 bp, Homo sapiens
cagtgctcagttgtact

SEQ ID NO: 379979 - DNA, 21 bp, Homo sapiens
cagtgctgaccccaggaagtg

SEQ ID NO: 379980 - DNA, 13 bp, Homo sapiens
cagtgctgccatg

SEQ ID NO: 379981 - DNA, 23 bp, Homo sapiens
cagtgctgggcccagccggggtg

SEQ ID NO: 379982 - DNA, 14 bp, Homo sapiens
cagtgctgttggtg

SEQ ID NO: 379983 - DNA, 15 bp, Homo sapiens
cagtgcttggctgcc

SEQ ID NO: 379984 - DNA, 17 bp, Homo sapiens
cagtgcttggctgcccc

SEQ ID NO: 379985 - DNA, 22 bp, Homo sapiens
cagtgcttggctgccccacagg

SEQ ID NO: 379986 - DNA, 19 bp, Homo sapiens
cagtggaacagcgggagac

SEQ ID NO: 379987 - DNA, 17 bp, Homo sapiens
cagtggaaggacactct

SEQ ID NO: 379988 - DNA, 14 bp, Homo sapiens
cagtggaagtgatt

SEQ ID NO: 379989 - DNA, 19 bp, Homo sapiens
cagtggacagagggagaag

SEQ ID NO: 379990 - DNA, 22 bp, Homo sapiens
cagtggactttccaccccctcc

SEQ ID NO: 379991 - DNA, 23 bp, Homo sapiens
cagtggactttccaccccctccc

SEQ ID NO: 379992 - DNA, 12 bp, Homo sapiens
cagtggagaggg

SEQ ID NO: 379993 - DNA, 14 bp, Homo sapiens
cagtggagagggga

SEQ ID NO: 379994 - DNA, 16 bp, Homo sapiens
agttttcagaacctct

SEQ ID NO: 379995 - DNA, 21 bp, Homo sapiens
agttttcagaacctcttcccc

SEQ ID NO: 379996 - DNA, 22 bp, Homo sapiens
agttttcagaacctcttcccca

SEQ ID NO: 379997 - DNA, 13 bp, Homo sapiens
agttttccagtat

SEQ ID NO: 379998 - DNA, 21 bp, Homo sapiens
agttttccatggtcacagaga

SEQ ID NO: 379999 - DNA, 18 bp, Homo sapiens
agttttccatttttgtca

SEQ ID NO: 380000 - DNA, 21 bp, Homo sapiens
agttttctctttgtggggctt

SEQ ID NO: 380001 - DNA, 16 bp, Homo sapiens
agttttcttttaattt

SEQ ID NO: 380002 - DNA, 17 bp, Homo sapiens
agttttcttttaatttt

SEQ ID NO: 380003 - DNA, 17 bp, Homo sapiens
agttttgaaagaaaaat

SEQ ID NO: 380004 - DNA, 13 bp, Homo sapiens
agttttgatgaaa

SEQ ID NO: 380005 - DNA, 14 bp, Homo sapiens
agttttgatgaaat

SEQ ID NO: 380006 - DNA, 19 bp, Homo sapiens
agttttgattaatgtttct

SEQ ID NO: 380007 - DNA, 20 bp, Homo sapiens
agttttgattaatgtttctt

SEQ ID NO: 380008 - DNA, 16 bp, Homo sapiens
agttttgcatttatgg

SEQ ID NO: 380009 - DNA, 13 bp, Homo sapiens
agttttgctgcta

SEQ ID NO: 380010 - DNA, 18 bp, Homo sapiens
agttttgtataaataata

SEQ ID NO: 380011 - DNA, 20 bp, Homo sapiens
agttttgtgtacagtatgtg

SEQ ID NO: 380012 - DNA, 23 bp, Homo sapiens
agttttgtgtgtatatatttaaa

SEQ ID NO: 380013 - DNA, 15 bp, Homo sapiens
agttttgttccaaca

SEQ ID NO: 380014 - DNA, 19 bp, Homo sapiens
agtttttaaaaaggccttt

SEQ ID NO: 380015 - DNA, 21 bp, Homo sapiens
agtttttaaaaaggcctttgg

SEQ ID NO: 380016 - DNA, 22 bp, Homo sapiens
agtttttaaaaaggcctttggg

SEQ ID NO: 380017 - DNA, 23 bp, Homo sapiens
agtttttaaaaaggcctttggga

SEQ ID NO: 380018 - DNA, 19 bp, Homo sapiens
agtttttaatatttattga

SEQ ID NO: 380019 - DNA, 14 bp, Homo sapiens
agtttttacagtgt

SEQ ID NO: 380020 - DNA, 17 bp, Homo sapiens
agtttttacctaccaca

SEQ ID NO: 380021 - DNA, 23 bp, Homo sapiens
agtttttacctaccacagtgtct

SEQ ID NO: 380022 - DNA, 16 bp, Homo sapiens
agtttttacttgttta

SEQ ID NO: 380023 - DNA, 16 bp, Homo sapiens
agtttttatatttgtt

SEQ ID NO: 380024 - DNA, 21 bp, Homo sapiens
agtttttcaggagcgcaagat

SEQ ID NO: 380025 - DNA, 16 bp, Homo sapiens
agtttttgatagcttt

SEQ ID NO: 380026 - DNA, 14 bp, Homo sapiens
agttttttttgtaa

SEQ ID NO: 380027 - DNA, 16 bp, Homo sapiens
agttttttttgtaaac

SEQ ID NO: 380028 - DNA, 19 bp, Homo sapiens
ataaaaaaacaatcatttg

SEQ ID NO: 380029 - DNA, 21 bp, Homo sapiens
ataaaaaaattgtaaatgttt

SEQ ID NO: 380030 - DNA, 19 bp, Homo sapiens
ataaaaaagaaaacttgtg

SEQ ID NO: 380031 - DNA, 11 bp, Homo sapiens
ataaaaaagat

SEQ ID NO: 380032 - DNA, 22 bp, Homo sapiens
ataaaaagaaaagataaagatg

SEQ ID NO: 380033 - DNA, 20 bp, Homo sapiens
ataaaaagacattcttccaa

SEQ ID NO: 380034 - DNA, 20 bp, Homo sapiens
ataaaaagcctgcaatttca

SEQ ID NO: 380035 - DNA, 22 bp, Homo sapiens
ataaaaagcctgcaatttcata

SEQ ID NO: 380036 - DNA, 19 bp, Homo sapiens
ataaaaagtgacacagcag

SEQ ID NO: 380037 - DNA, 16 bp, Homo sapiens
ataaaaataaaagaga

SEQ ID NO: 380038 - DNA, 19 bp, Homo sapiens
ataaaacattagaagaaaa

SEQ ID NO: 380039 - DNA, 11 bp, Homo sapiens
ataaaaccttt

SEQ ID NO: 380040 - DNA, 14 bp, Homo sapiens
ataaaacctttcaa

SEQ ID NO: 380041 - DNA, 21 bp, Homo sapiens
ataaaacctttcaaatttcac

SEQ ID NO: 380042 - DNA, 22 bp, Homo sapiens
ataaaacctttcaaatttcaca

SEQ ID NO: 380043 - DNA, 23 bp, Homo sapiens
ataaaactatttaaaattggcac

SEQ ID NO: 380044 - DNA, 17 bp, Homo sapiens
cagtgtcttccataatg

SEQ ID NO: 380045 - DNA, 18 bp, Homo sapiens
cagtgtcttccataatgt

SEQ ID NO: 380046 - DNA, 22 bp, Homo sapiens
cagtgtcttccataatgtataa

SEQ ID NO: 380047 - DNA, 11 bp, Homo sapiens
cagtgtgaagc

SEQ ID NO: 380048 - DNA, 21 bp, Homo sapiens
cagtgtgacagaaaaaaaaat

SEQ ID NO: 380049 - DNA, 12 bp, Homo sapiens
cagtgtgactga

SEQ ID NO: 380050 - DNA, 14 bp, Homo sapiens
cagtgtgagatttc

SEQ ID NO: 380051 - DNA, 21 bp, Homo sapiens
cagtgtgcacgagtgggaagg

SEQ ID NO: 380052 - DNA, 13 bp, Homo sapiens
cagtgtggagagg

SEQ ID NO: 380053 - DNA, 16 bp, Homo sapiens
cagtgtggatgtaaat

SEQ ID NO: 380054 - DNA, 18 bp, Homo sapiens
cagtgtggcttaaacatt

SEQ ID NO: 380055 - DNA, 21 bp, Homo sapiens
cagtgtgggaatgcggcaaga

SEQ ID NO: 380056 - DNA, 14 bp, Homo sapiens
cagtgttaaaaaat

SEQ ID NO: 380057 - DNA, 18 bp, Homo sapiens
cagtgttaaatgaaattg

SEQ ID NO: 380058 - DNA, 16 bp, Homo sapiens
cagtgttagtgggaag

SEQ ID NO: 380059 - DNA, 19 bp, Homo sapiens
cagtgttagtgggaagagc

SEQ ID NO: 380060 - DNA, 22 bp, Homo sapiens
cagtgttagtgggaagagctgg

SEQ ID NO: 380061 - DNA, 20 bp, Homo sapiens
cagtgttcctcaccaataac

SEQ ID NO: 380062 - DNA, 14 bp, Homo sapiens
cagtgttcgcttgg

SEQ ID NO: 380063 - DNA, 14 bp, Homo sapiens
cagtgttctgagcc

SEQ ID NO: 380064 - DNA, 13 bp, Homo sapiens
cagtgttcttctc

SEQ ID NO: 380065 - DNA, 18 bp, Homo sapiens
cagtgttgactgtaggcg

SEQ ID NO: 380066 - DNA, 15 bp, Homo sapiens
cagtgtttatgacga

SEQ ID NO: 380067 - DNA, 14 bp, Homo sapiens
cagtgtttccacgg

SEQ ID NO: 380068 - DNA, 14 bp, Homo sapiens
cagtgtttcccata

SEQ ID NO: 380069 - DNA, 20 bp, Homo sapiens
cagtgtttcccataattttc

SEQ ID NO: 380070 - DNA, 19 bp, Homo sapiens
cagtgtttttgcaggtgag

SEQ ID NO: 380071 - DNA, 17 bp, Homo sapiens
cagttaaacttgcaatg

SEQ ID NO: 380072 - DNA, 22 bp, Homo sapiens
cagttaactttcagaagagatg

SEQ ID NO: 380073 - DNA, 19 bp, Homo sapiens
cagttaagaaaaaaataat

SEQ ID NO: 380074 - DNA, 13 bp, Homo sapiens
cagttaccgagga

SEQ ID NO: 380075 - DNA, 13 bp, Homo sapiens
cagttactggttt

SEQ ID NO: 380076 - DNA, 13 bp, Homo sapiens
cagttactgttca

SEQ ID NO: 380077 - DNA, 15 bp, Homo sapiens
cagttagagatgcct

SEQ ID NO: 380078 - DNA, 18 bp, Homo sapiens
cagttagcccggccaagg

SEQ ID NO: 380079 - DNA, 18 bp, Homo sapiens
cagttatgtgaatgatct

SEQ ID NO: 380080 - DNA, 14 bp, Homo sapiens
cagttattaaatga

SEQ ID NO: 380081 - DNA, 17 bp, Homo sapiens
cagttattcattctgtg

SEQ ID NO: 380082 - DNA, 21 bp, Homo sapiens
cagttattcattctgtgatca

SEQ ID NO: 380083 - DNA, 22 bp, Homo sapiens
cagttcaataaacttaacttta

SEQ ID NO: 380084 - DNA, 22 bp, Homo sapiens
cagttcaatctcccgctgctgc

SEQ ID NO: 380085 - DNA, 11 bp, Homo sapiens
cagttcatctc

SEQ ID NO: 380086 - DNA, 16 bp, Homo sapiens
cagttcatgttgctca

SEQ ID NO: 380087 - DNA, 20 bp, Homo sapiens
cagttcatgttgctcagaag

SEQ ID NO: 380088 - DNA, 18 bp, Homo sapiens
cagttcattattttgtgg

SEQ ID NO: 380089 - DNA, 17 bp, Homo sapiens
cagttcccccaacctca

SEQ ID NO: 380090 - DNA, 18 bp, Homo sapiens
cagttcccccaacctcag

SEQ ID NO: 380091 - DNA, 20 bp, Homo sapiens
cagttcccccagtacctcca

SEQ ID NO: 380092 - DNA, 23 bp, Homo sapiens
cagttcccggagcacagccctgg

SEQ ID NO: 380093 - DNA, 15 bp, Homo sapiens
cagttcccttggcct

SEQ ID NO: 380094 - DNA, 18 bp, Homo sapiens
cagttcccttggcctcag

SEQ ID NO: 380095 - DNA, 23 bp, Homo sapiens
cagttcctctttgcatggaattt

SEQ ID NO: 380096 - DNA, 17 bp, Homo sapiens
cagttctctcccttcct

SEQ ID NO: 380097 - DNA, 14 bp, Homo sapiens
cagttctctttgta

SEQ ID NO: 380098 - DNA, 16 bp, Homo sapiens
cagttctgaactggaa

SEQ ID NO: 380099 - DNA, 13 bp, Homo sapiens
cagttctgatgag

SEQ ID NO: 380100 - DNA, 18 bp, Homo sapiens
cagttctgtcatatgtta

SEQ ID NO: 380101 - DNA, 12 bp, Homo sapiens
cagttcttggac

SEQ ID NO: 380102 - DNA, 19 bp, Homo sapiens
cagttgacatccaaatcta

SEQ ID NO: 380103 - DNA, 18 bp, Homo sapiens
cagttgagagagaatctc

SEQ ID NO: 380104 - DNA, 20 bp, Homo sapiens
cagttgcacttggcctctgg

SEQ ID NO: 380105 - DNA, 15 bp, Homo sapiens
cagttggactctcag

SEQ ID NO: 380106 - DNA, 17 bp, Homo sapiens
cagttggactctcaggg

SEQ ID NO: 380107 - DNA, 18 bp, Homo sapiens
cagttggactctcaggga

SEQ ID NO: 380108 - DNA, 16 bp, Homo sapiens
cagttggactgtggcc

SEQ ID NO: 380109 - DNA, 17 bp, Homo sapiens
cagttggactgtggcct

SEQ ID NO: 380110 - DNA, 22 bp, Homo sapiens
cagttggcagagaaggcctctt

SEQ ID NO: 380111 - DNA, 17 bp, Homo sapiens
cagttgggagcactgga

SEQ ID NO: 380112 - DNA, 20 bp, Homo sapiens
cagttgggagcactggagtg

SEQ ID NO: 380113 - DNA, 22 bp, Homo sapiens
cagttggggctgcgaccgccag

SEQ ID NO: 380114 - DNA, 23 bp, Homo sapiens
cagttgtaccactgctaataaat

SEQ ID NO: 380115 - DNA, 23 bp, Homo sapiens
cagttgtagcaggtttcactatt

SEQ ID NO: 380116 - DNA, 22 bp, Homo sapiens
cagttgtcccgattgtaactca

SEQ ID NO: 380117 - DNA, 19 bp, Homo sapiens
cagttgtctattctgagcc

SEQ ID NO: 380118 - DNA, 23 bp, Homo sapiens
cagttgtctattctgagccttga

SEQ ID NO: 380119 - DNA, 18 bp, Homo sapiens
cagttgttagtgtgtctt

SEQ ID NO: 380120 - DNA, 21 bp, Homo sapiens
cagttgttatattcattcttt

SEQ ID NO: 380121 - DNA, 22 bp, Homo sapiens
cagttgtttctaagagcagagt

SEQ ID NO: 380122 - DNA, 17 bp, Homo sapiens
cagtttaaacacatcaa

SEQ ID NO: 380123 - DNA, 19 bp, Homo sapiens
ataaagtacgtgtttactt

SEQ ID NO: 380124 - DNA, 15 bp, Homo sapiens
ataaagtatcatgca

SEQ ID NO: 380125 - DNA, 23 bp, Homo sapiens
ataaagtattccaccttaaatta

SEQ ID NO: 380126 - DNA, 20 bp, Homo sapiens
ataaagtctctttttctcac

SEQ ID NO: 380127 - DNA, 16 bp, Homo sapiens
ataaagtgcaattgca

SEQ ID NO: 380128 - DNA, 21 bp, Homo sapiens
ataaagttacaccgttgttgt

SEQ ID NO: 380129 - DNA, 17 bp, Homo sapiens
ataaagttattaatagc

SEQ ID NO: 380130 - DNA, 18 bp, Homo sapiens
ataaataaaaatattctc

SEQ ID NO: 380131 - DNA, 19 bp, Homo sapiens
ataaataaaattcatttct

SEQ ID NO: 380132 - DNA, 20 bp, Homo sapiens
ataaataaagaagaaaataa

SEQ ID NO: 380133 - DNA, 16 bp, Homo sapiens
ataaataaagcaaata

SEQ ID NO: 380134 - DNA, 13 bp, Homo sapiens
ataaataataaag

SEQ ID NO: 380135 - DNA, 15 bp, Homo sapiens
ataaataatattata

SEQ ID NO: 380136 - DNA, 11 bp, Homo sapiens
ataaatagcta

SEQ ID NO: 380137 - DNA, 19 bp, Homo sapiens
ataaatagctaaatggcaa

SEQ ID NO: 380138 - DNA, 15 bp, Homo sapiens
ataaatagctatatc

SEQ ID NO: 380139 - DNA, 14 bp, Homo sapiens
ataaatatactaat

SEQ ID NO: 380140 - DNA, 20 bp, Homo sapiens
ataaatatactaataaaaag

SEQ ID NO: 380141 - DNA, 23 bp, Homo sapiens
ataaatatactaataaaaaggtt

SEQ ID NO: 380142 - DNA, 23 bp, Homo sapiens
ataaatatataaaaagaaaagat

SEQ ID NO: 380143 - DNA, 14 bp, Homo sapiens
ataaatatttatgt

SEQ ID NO: 380144 - DNA, 20 bp, Homo sapiens
ataaatatttatgtagatgt

SEQ ID NO: 380145 - DNA, 15 bp, Homo sapiens
ataaatccaaagtaa

SEQ ID NO: 380146 - DNA, 14 bp, Homo sapiens
ataaatctcttctt

SEQ ID NO: 380147 - DNA, 17 bp, Homo sapiens
ataaatctgccatttca

SEQ ID NO: 380148 - DNA, 17 bp, Homo sapiens
ataaatctgtctgattc

SEQ ID NO: 380149 - DNA, 15 bp, Homo sapiens
ataaatctttggaaa

SEQ ID NO: 380150 - DNA, 18 bp, Homo sapiens
ataaatgaagtttataca

SEQ ID NO: 380151 - DNA, 21 bp, Homo sapiens
ataaatgaagtttatacagta

SEQ ID NO: 380152 - DNA, 22 bp, Homo sapiens
ataaatgaagtttatacagtac

SEQ ID NO: 380153 - DNA, 12 bp, Homo sapiens
ataaatgaccag

SEQ ID NO: 380154 - DNA, 20 bp, Homo sapiens
ataaatgaccagtttacctg

SEQ ID NO: 380155 - DNA, 12 bp, Homo sapiens
ataaatggactt

SEQ ID NO: 380156 - DNA, 17 bp, Homo sapiens
ataaatggacttgcttc

SEQ ID NO: 380157 - DNA, 15 bp, Homo sapiens
ataaatgggaaatgt

SEQ ID NO: 380158 - DNA, 21 bp, Homo sapiens
ataaatggtgagaattaaaat

SEQ ID NO: 380159 - DNA, 21 bp, Homo sapiens
ataaatgtactacatttgcat

SEQ ID NO: 380160 - DNA, 22 bp, Homo sapiens
ataaatgtactacatttgcatg

SEQ ID NO: 380161 - DNA, 18 bp, Homo sapiens
ataaatgtatcttattca

SEQ ID NO: 380162 - DNA, 17 bp, Homo sapiens
ataaatgtcccaaataa

SEQ ID NO: 380163 - DNA, 11 bp, Homo sapiens
ataaatgtgtg

SEQ ID NO: 380164 - DNA, 12 bp, Homo sapiens
ataaatgtgtgg

SEQ ID NO: 380165 - DNA, 14 bp, Homo sapiens
ataaattaagactt

SEQ ID NO: 380166 - DNA, 22 bp, Homo sapiens
ataaattaatgagttttatcca

SEQ ID NO: 380167 - DNA, 13 bp, Homo sapiens
ataaattataagt

SEQ ID NO: 380168 - DNA, 12 bp, Homo sapiens
ataaattattac

SEQ ID NO: 380169 - DNA, 20 bp, Homo sapiens
ataaattattactttaaatt

SEQ ID NO: 380170 - DNA, 13 bp, Homo sapiens
ataaattgctcct

SEQ ID NO: 380171 - DNA, 20 bp, Homo sapiens
ataaattggctcctttccca

SEQ ID NO: 380172 - DNA, 13 bp, Homo sapiens
ataaattgtttga

SEQ ID NO: 380173 - DNA, 17 bp, Homo sapiens
ataaattgtttgaccat

SEQ ID NO: 380174 - DNA, 14 bp, Homo sapiens
ataacaacactaat

SEQ ID NO: 380175 - DNA, 20 bp, Homo sapiens
ataacaagccaaacattctt

SEQ ID NO: 380176 - DNA, 12 bp, Homo sapiens
ataacacacatc

SEQ ID NO: 380177 - DNA, 14 bp, Homo sapiens
ataacacagagaga

SEQ ID NO: 380178 - DNA, 22 bp, Homo sapiens
ataacacagagagacagacttg

SEQ ID NO: 380179 - DNA, 16 bp, Homo sapiens
ataacacagatattgt

SEQ ID NO: 380180 - DNA, 15 bp, Homo sapiens
ataacactggagtgg

SEQ ID NO: 380181 - DNA, 22 bp, Homo sapiens
ataacagagaatcttgattaaa

SEQ ID NO: 380182 - DNA, 12 bp, Homo sapiens
cataacttgaaa

SEQ ID NO: 380183 - DNA, 19 bp, Homo sapiens
cataagaaaactaagaaat

SEQ ID NO: 380184 - DNA, 15 bp, Homo sapiens
cataagagaaatggt

SEQ ID NO: 380185 - DNA, 14 bp, Homo sapiens
cataagatattctt

SEQ ID NO: 380186 - DNA, 15 bp, Homo sapiens
cataagatattcttt

SEQ ID NO: 380187 - DNA, 16 bp, Homo sapiens
cataagctttttctct

SEQ ID NO: 380188 - DNA, 12 bp, Homo sapiens
cataaggcctgc

SEQ ID NO: 380189 - DNA, 15 bp, Homo sapiens
cataaggcctgccct

SEQ ID NO: 380190 - DNA, 17 bp, Homo sapiens
cataagtaattcaagaa

SEQ ID NO: 380191 - DNA, 16 bp, Homo sapiens
cataagtatacagttc

SEQ ID NO: 380192 - DNA, 17 bp, Homo sapiens
cataataagctaaagag

SEQ ID NO: 380193 - DNA, 16 bp, Homo sapiens
cataataagtttcata

SEQ ID NO: 380194 - DNA, 14 bp, Homo sapiens
cataatagaatttc

SEQ ID NO: 380195 - DNA, 19 bp, Homo sapiens
cataatagaatttcctaat

SEQ ID NO: 380196 - DNA, 21 bp, Homo sapiens
cataatatcttgaagaatatt

SEQ ID NO: 380197 - DNA, 19 bp, Homo sapiens
cataatctggactcctctg

SEQ ID NO: 380198 - DNA, 22 bp, Homo sapiens
cataatctggactcctctgtcc

SEQ ID NO: 380199 - DNA, 22 bp, Homo sapiens
cataatgagtaatgcagacatt

SEQ ID NO: 380200 - DNA, 23 bp, Homo sapiens
cataatgagtaatgcagacattt

SEQ ID NO: 380201 - DNA, 18 bp, Homo sapiens
cataatgcttaatttcta

SEQ ID NO: 380202 - DNA, 22 bp, Homo sapiens
cataatgtagtgagtgtagact

SEQ ID NO: 380203 - DNA, 18 bp, Homo sapiens
cataatgttacattatta

SEQ ID NO: 380204 - DNA, 18 bp, Homo sapiens
cataatgttagtagcact

SEQ ID NO: 380205 - DNA, 21 bp, Homo sapiens
cataatgttagtagcactgag

SEQ ID NO: 380206 - DNA, 22 bp, Homo sapiens
cataattctaagttatttactt

SEQ ID NO: 380207 - DNA, 13 bp, Homo sapiens
cataattgcaagg

SEQ ID NO: 380208 - DNA, 12 bp, Homo sapiens
cataattgtcaa

SEQ ID NO: 380209 - DNA, 15 bp, Homo sapiens
cataattgtcaaaaa

SEQ ID NO: 380210 - DNA, 12 bp, Homo sapiens
catacacacacg

SEQ ID NO: 380211 - DNA, 20 bp, Homo sapiens
catacaccttgctaacctaa

SEQ ID NO: 380212 - DNA, 13 bp, Homo sapiens
catacagcctcta

SEQ ID NO: 380213 - DNA, 23 bp, Homo sapiens
catacattgtataggccatctgt

SEQ ID NO: 380214 - DNA, 22 bp, Homo sapiens
catacatttataatgtttgcta

SEQ ID NO: 380215 - DNA, 24 bp, Homo sapiens
catacatttataatgtttgctatt

SEQ ID NO: 380216 - DNA, 12 bp, Homo sapiens
catacccatctg

SEQ ID NO: 380217 - DNA, 14 bp, Homo sapiens
cataccccctgccc

SEQ ID NO: 380218 - DNA, 16 bp, Homo sapiens
cataccccctgcccca

SEQ ID NO: 380219 - DNA, 17 bp, Homo sapiens
cataccgtttggtgtct

SEQ ID NO: 380220 - DNA, 15 bp, Homo sapiens
catacctctctctat

SEQ ID NO: 380221 - DNA, 22 bp, Homo sapiens
catacctctctctatatataca

SEQ ID NO: 380222 - DNA, 19 bp, Homo sapiens
catacctgttgtacacttg

SEQ ID NO: 380223 - DNA, 18 bp, Homo sapiens
catactatctactctcct

SEQ ID NO: 380224 - DNA, 12 bp, Homo sapiens
catactctccag

SEQ ID NO: 380225 - DNA, 14 bp, Homo sapiens
catactctccagga

SEQ ID NO: 380226 - DNA, 23 bp, Homo sapiens
catactctccaggattgtccaca

SEQ ID NO: 380227 - DNA, 24 bp, Homo sapiens
catactctccaggattgtccacaa

SEQ ID NO: 380228 - DNA, 11 bp, Homo sapiens
catactctgct

SEQ ID NO: 380229 - DNA, 14 bp, Homo sapiens
catactctgtgtaa

SEQ ID NO: 380230 - DNA, 12 bp, Homo sapiens
catactctgttg

SEQ ID NO: 380231 - DNA, 17 bp, Homo sapiens
catactctgttgcctcc

SEQ ID NO: 380232 - DNA, 16 bp, Homo sapiens
catactgatgagacaa

SEQ ID NO: 380233 - DNA, 18 bp, Homo sapiens
catactgatgagacaaca

SEQ ID NO: 380234 - DNA, 21 bp, Homo sapiens
catactgatgagacaacacac

SEQ ID NO: 380235 - DNA, 23 bp, Homo sapiens
catacttcatcgcagtggactgt

SEQ ID NO: 380236 - DNA, 21 bp, Homo sapiens
catacttgctccttgaataag

SEQ ID NO: 380237 - DNA, 15 bp, Homo sapiens
catactttctctcta

SEQ ID NO: 380238 - DNA, 22 bp, Homo sapiens
catagaaattgcctccagtcca

SEQ ID NO: 380239 - DNA, 15 bp, Homo sapiens
catagaatagcatgt

SEQ ID NO: 380240 - DNA, 21 bp, Homo sapiens
catagaatagcatgttgtaga

SEQ ID NO: 380241 - DNA, 21 bp, Homo sapiens
catagacaaaggccttaacaa

SEQ ID NO: 380242 - DNA, 11 bp, Homo sapiens
catagacacag

SEQ ID NO: 380243 - DNA, 13 bp, Homo sapiens
catagacacagta

SEQ ID NO: 380244 - DNA, 14 bp, Homo sapiens
catagactgcaaaa

SEQ ID NO: 380245 - DNA, 17 bp, Homo sapiens
catagagtcccccctcc

SEQ ID NO: 380246 - DNA, 13 bp, Homo sapiens
catagagtgagtt

SEQ ID NO: 380247 - DNA, 18 bp, Homo sapiens
catagagtttaacacaag

SEQ ID NO: 380248 - DNA, 12 bp, Homo sapiens
catagataccat

SEQ ID NO: 380249 - DNA, 18 bp, Homo sapiens
catagataccattttgaa

SEQ ID NO: 380250 - DNA, 22 bp, Homo sapiens
catagataccattttgaaatat

SEQ ID NO: 380251 - DNA, 23 bp, Homo sapiens
catagatgtccctttcttggcca

SEQ ID NO: 380252 - DNA, 22 bp, Homo sapiens
catagattcacctgtaaaactt

SEQ ID NO: 380253 - DNA, 15 bp, Homo sapiens
ataagttcattaaac

SEQ ID NO: 380254 - DNA, 13 bp, Homo sapiens
ataataaaaatca

SEQ ID NO: 380255 - DNA, 20 bp, Homo sapiens
ataataaaaatcatgcttat

SEQ ID NO: 380256 - DNA, 16 bp, Homo sapiens
ataataaagctactga

SEQ ID NO: 380257 - DNA, 15 bp, Homo sapiens
ataataaattaacat

SEQ ID NO: 380258 - DNA, 19 bp, Homo sapiens
ataataaattaacattata

SEQ ID NO: 380259 - DNA, 15 bp, Homo sapiens
ataataagctaaaga

SEQ ID NO: 380260 - DNA, 14 bp, Homo sapiens
ataataatagtact

SEQ ID NO: 380261 - DNA, 14 bp, Homo sapiens
ataataatgttctc

SEQ ID NO: 380262 - DNA, 22 bp, Homo sapiens
ataataatttttatatttaatt

SEQ ID NO: 380263 - DNA, 23 bp, Homo sapiens
ataatacatctttatcattaaac

SEQ ID NO: 380264 - DNA, 16 bp, Homo sapiens
ataatactaatttatt

SEQ ID NO: 380265 - DNA, 21 bp, Homo sapiens
ataatacttaaaaatatgtga

SEQ ID NO: 380266 - DNA, 18 bp, Homo sapiens
ataatagaatttcctaat

SEQ ID NO: 380267 - DNA, 21 bp, Homo sapiens
ataatagaatttcctaatgag

SEQ ID NO: 380268 - DNA, 23 bp, Homo sapiens
ataatagtcaatttctacttctg

SEQ ID NO: 380269 - DNA, 14 bp, Homo sapiens
ataatagtttacat

SEQ ID NO: 380270 - DNA, 18 bp, Homo sapiens
ataatataaatgaatgaa

SEQ ID NO: 380271 - DNA, 19 bp, Homo sapiens
ataatataaatgaatgaaa

SEQ ID NO: 380272 - DNA, 16 bp, Homo sapiens
ataatatcctgaataa

SEQ ID NO: 380273 - DNA, 18 bp, Homo sapiens
ataatatcctgaataact

SEQ ID NO: 380274 - DNA, 19 bp, Homo sapiens
ataatatcttgaagaatat

SEQ ID NO: 380275 - DNA, 22 bp, Homo sapiens
ataatatcttgaagaatattgt

SEQ ID NO: 380276 - DNA, 16 bp, Homo sapiens
ataatattatattgta

SEQ ID NO: 380277 - DNA, 13 bp, Homo sapiens
ataatcagcctct

SEQ ID NO: 380278 - DNA, 19 bp, Homo sapiens
ataatctggactcctctgt

SEQ ID NO: 380279 - DNA, 20 bp, Homo sapiens
ataatctggactcctctgtc

SEQ ID NO: 380280 - DNA, 20 bp, Homo sapiens
ataatctggtgttcttgcta

SEQ ID NO: 380281 - DNA, 22 bp, Homo sapiens
ataatctggtgttcttgctaac

SEQ ID NO: 380282 - DNA, 21 bp, Homo sapiens
ataatgacgtattgtgaaatt

SEQ ID NO: 380283 - DNA, 19 bp, Homo sapiens
ataatgatttaagcatttt

SEQ ID NO: 380284 - DNA, 22 bp, Homo sapiens
ataatgcactggggtaccacat

SEQ ID NO: 380285 - DNA, 16 bp, Homo sapiens
ataatggaattatgta

SEQ ID NO: 380286 - DNA, 18 bp, Homo sapiens
ataatgggaaaggttgaa

SEQ ID NO: 380287 - DNA, 15 bp, Homo sapiens
ataatggtttactgc

SEQ ID NO: 380288 - DNA, 16 bp, Homo sapiens
ataatggtttactgct

SEQ ID NO: 380289 - DNA, 22 bp, Homo sapiens
ataatggtttactgctgtcatt

SEQ ID NO: 380290 - DNA, 18 bp, Homo sapiens
ataatgtcattaatatat

SEQ ID NO: 380291 - DNA, 17 bp, Homo sapiens
ataatgtgggaagaaac

SEQ ID NO: 380292 - DNA, 19 bp, Homo sapiens
ataatgttccttagtggta

SEQ ID NO: 380293 - DNA, 16 bp, Homo sapiens
ataatgttctttaatg

SEQ ID NO: 380294 - DNA, 21 bp, Homo sapiens
ataatgttgtggtttgttgcc

SEQ ID NO: 380295 - DNA, 19 bp, Homo sapiens
ataatgttgttatttaaag

SEQ ID NO: 380296 - DNA, 19 bp, Homo sapiens
ataatgtttaatattgaga

SEQ ID NO: 380297 - DNA, 14 bp, Homo sapiens
ataatgtttgctat

SEQ ID NO: 380298 - DNA, 17 bp, Homo sapiens
ataattaaaaaaaaaac

SEQ ID NO: 380299 - DNA, 19 bp, Homo sapiens
ataattaaaaaaaaaactt

SEQ ID NO: 380300 - DNA, 14 bp, Homo sapiens
ataattaaaacaaa

SEQ ID NO: 380301 - DNA, 14 bp, Homo sapiens
ataattaaatgaaa

SEQ ID NO: 380302 - DNA, 15 bp, Homo sapiens
ataattaaatgaaat

SEQ ID NO: 380303 - DNA, 20 bp, Homo sapiens
ataattagcttgttacaatt

SEQ ID NO: 380304 - DNA, 19 bp, Homo sapiens
ataattatcacaatgtact

SEQ ID NO: 380305 - DNA, 14 bp, Homo sapiens
ataattatgacagt

SEQ ID NO: 380306 - DNA, 16 bp, Homo sapiens
ataattatgacagtta

SEQ ID NO: 380307 - DNA, 19 bp, Homo sapiens
ataattatgacagttatac

SEQ ID NO: 380308 - DNA, 18 bp, Homo sapiens
ataattatgggaacaagt

SEQ ID NO: 380309 - DNA, 18 bp, Homo sapiens
ataattatgttattgaaa

SEQ ID NO: 380310 - DNA, 23 bp, Homo sapiens
ataattatgttattgaaaaaaat

SEQ ID NO: 380311 - DNA, 12 bp, Homo sapiens
ataattccctat

SEQ ID NO: 380312 - DNA, 20 bp, Homo sapiens
ataattccctatcttttagt

SEQ ID NO: 380313 - DNA, 21 bp, Homo sapiens
ataattctaagttatttactt

SEQ ID NO: 380314 - DNA, 14 bp, Homo sapiens
ataattctactttg

SEQ ID NO: 380315 - DNA, 14 bp, Homo sapiens
ataattctatactg

SEQ ID NO: 380316 - DNA, 19 bp, Homo sapiens
ataattctatactgttgat

SEQ ID NO: 380317 - DNA, 14 bp, Homo sapiens
ataattctgtaaat

SEQ ID NO: 380318 - DNA, 22 bp, Homo sapiens
ataattgacaggattattggaa

SEQ ID NO: 380319 - DNA, 14 bp, Homo sapiens
ataattgatcaaat

SEQ ID NO: 380320 - DNA, 22 bp, Homo sapiens
catatggaaatcctgttactta

SEQ ID NO: 380321 - DNA, 20 bp, Homo sapiens
catatggagtgcctgtacaa

SEQ ID NO: 380322 - DNA, 22 bp, Homo sapiens
catatgtcttactactttaaat

SEQ ID NO: 380323 - DNA, 23 bp, Homo sapiens
catatgtcttactactttaaatc

SEQ ID NO: 380324 - DNA, 13 bp, Homo sapiens
catatgttaagca

SEQ ID NO: 380325 - DNA, 18 bp, Homo sapiens
catatgttaagcagctaa

SEQ ID NO: 380326 - DNA, 16 bp, Homo sapiens
catatgttgctcagtc

SEQ ID NO: 380327 - DNA, 23 bp, Homo sapiens
catattatatcagactgctttga

SEQ ID NO: 380328 - DNA, 14 bp, Homo sapiens
catattcacacctc

SEQ ID NO: 380329 - DNA, 21 bp, Homo sapiens
catattctattgtattatttg

SEQ ID NO: 380330 - DNA, 13 bp, Homo sapiens
catattgatgaaa

SEQ ID NO: 380331 - DNA, 14 bp, Homo sapiens
catatttacttctt

SEQ ID NO: 380332 - DNA, 20 bp, Homo sapiens
catatttcttgagtaattta

SEQ ID NO: 380333 - DNA, 21 bp, Homo sapiens
catatttcttgagtaatttaa

SEQ ID NO: 380334 - DNA, 15 bp, Homo sapiens
catatttgcaataaa

SEQ ID NO: 380335 - DNA, 12 bp, Homo sapiens
catatttgtgtt

SEQ ID NO: 380336 - DNA, 22 bp, Homo sapiens
catattttacttggaaatatta

SEQ ID NO: 380337 - DNA, 17 bp, Homo sapiens
catattttattctttta

SEQ ID NO: 380338 - DNA, 19 bp, Homo sapiens
catcaaaaagagtcttaat

SEQ ID NO: 380339 - DNA, 18 bp, Homo sapiens
catcaaaatacaacttca

SEQ ID NO: 380340 - DNA, 15 bp, Homo sapiens
catcaaacatgaaaa

SEQ ID NO: 380341 - DNA, 17 bp, Homo sapiens
catcaaacatgaaaaca

SEQ ID NO: 380342 - DNA, 18 bp, Homo sapiens
catcaaacatgaaaacat

SEQ ID NO: 380343 - DNA, 19 bp, Homo sapiens
catcaaagactccgagaag

SEQ ID NO: 380344 - DNA, 20 bp, Homo sapiens
catcaaagatgagaagccaa

SEQ ID NO: 380345 - DNA, 14 bp, Homo sapiens
catcaaataaactg

SEQ ID NO: 380346 - DNA, 14 bp, Homo sapiens
catcaaataataca

SEQ ID NO: 380347 - DNA, 15 bp, Homo sapiens
catcaaataatacat

SEQ ID NO: 380348 - DNA, 13 bp, Homo sapiens
catcaagaaaaca

SEQ ID NO: 380349 - DNA, 15 bp, Homo sapiens
catcaagaaaacagc

SEQ ID NO: 380350 - DNA, 16 bp, Homo sapiens
catcaagaaaacagca

SEQ ID NO: 380351 - DNA, 23 bp, Homo sapiens
catcaatagaaagtcatctttga

SEQ ID NO: 380352 - DNA, 20 bp, Homo sapiens
catcaatccaggatgttatt

SEQ ID NO: 380353 - DNA, 17 bp, Homo sapiens
catcaattttaacattt

SEQ ID NO: 380354 - DNA, 15 bp, Homo sapiens
catcacaatacagat

SEQ ID NO: 380355 - DNA, 11 bp, Homo sapiens
catcacacaca

SEQ ID NO: 380356 - DNA, 13 bp, Homo sapiens
catcacaggctct

SEQ ID NO: 380357 - DNA, 15 bp, Homo sapiens
catcaccccttcccc

SEQ ID NO: 380358 - DNA, 16 bp, Homo sapiens
catcaccccttcccca

SEQ ID NO: 380359 - DNA, 17 bp, Homo sapiens
catcaccccttccccat

SEQ ID NO: 380360 - DNA, 22 bp, Homo sapiens
catcacctttttgacttttcca

SEQ ID NO: 380361 - DNA, 21 bp, Homo sapiens
catcactatccatgcaccaaa

SEQ ID NO: 380362 - DNA, 22 bp, Homo sapiens
catcactatccatgcaccaaac

SEQ ID NO: 380363 - DNA, 17 bp, Homo sapiens
catcactccctggatgt

SEQ ID NO: 380364 - DNA, 21 bp, Homo sapiens
catcactggggaggacgtgat

SEQ ID NO: 380365 - DNA, 14 bp, Homo sapiens
catcacttctcccc

SEQ ID NO: 380366 - DNA, 15 bp, Homo sapiens
catcacttctccccg

SEQ ID NO: 380367 - DNA, 13 bp, Homo sapiens
catcagaagataa

SEQ ID NO: 380368 - DNA, 20 bp, Homo sapiens
catcagacctgtcttccaag

SEQ ID NO: 380369 - DNA, 23 bp, Homo sapiens
catcagataagacatatctctaa

SEQ ID NO: 380370 - DNA, 19 bp, Homo sapiens
catcagatggaaatatttt

SEQ ID NO: 380371 - DNA, 13 bp, Homo sapiens
catcagcagtgat

SEQ ID NO: 380372 - DNA, 13 bp, Homo sapiens
catcagcccaggt

SEQ ID NO: 380373 - DNA, 16 bp, Homo sapiens
catcagcccctgctgc

SEQ ID NO: 380374 - DNA, 18 bp, Homo sapiens
catcagcccctgctgctc

SEQ ID NO: 380375 - DNA, 17 bp, Homo sapiens
catcagctgtaagaaga

SEQ ID NO: 380376 - DNA, 17 bp, Homo sapiens
catcagctttccctggc

SEQ ID NO: 380377 - DNA, 18 bp, Homo sapiens
catcagctttccctggct

SEQ ID NO: 380378 - DNA, 19 bp, Homo sapiens
catcagctttccctggctc

SEQ ID NO: 380379 - DNA, 13 bp, Homo sapiens
catcaggcactgg

SEQ ID NO: 380380 - DNA, 13 bp, Homo sapiens
catcaggtgatcc

SEQ ID NO: 380381 - DNA, 18 bp, Homo sapiens
catcagtattgtgtaaag

SEQ ID NO: 380382 - DNA, 16 bp, Homo sapiens
catcagtggcatggct

SEQ ID NO: 380383 - DNA, 24 bp, Homo sapiens
atacagtcattatttaaagcacat

SEQ ID NO: 380384 - DNA, 16 bp, Homo sapiens
atacagtgctttatgg

SEQ ID NO: 380385 - DNA, 18 bp, Homo sapiens
atacagttattaaaatgt

SEQ ID NO: 380386 - DNA, 15 bp, Homo sapiens
atacagttcaataaa

SEQ ID NO: 380387 - DNA, 16 bp, Homo sapiens
atacagttgttggcct

SEQ ID NO: 380388 - DNA, 15 bp, Homo sapiens
atacagttttaaaga

SEQ ID NO: 380389 - DNA, 17 bp, Homo sapiens
atacagttttaaagaat

SEQ ID NO: 380390 - DNA, 22 bp, Homo sapiens
atacataacagggtaaattatt

SEQ ID NO: 380391 - DNA, 17 bp, Homo sapiens
atacatagtctttgttt

SEQ ID NO: 380392 - DNA, 22 bp, Homo sapiens
atacatatgagtgtggaagccg

SEQ ID NO: 380393 - DNA, 19 bp, Homo sapiens
atacatctttatcattaaa

SEQ ID NO: 380394 - DNA, 15 bp, Homo sapiens
atacatggtagcagg

SEQ ID NO: 380395 - DNA, 20 bp, Homo sapiens
atacatggttgtgacctgag

SEQ ID NO: 380396 - DNA, 18 bp, Homo sapiens
atacatggtttaaagtca

SEQ ID NO: 380397 - DNA, 13 bp, Homo sapiens
atacatgtatagt

SEQ ID NO: 380398 - DNA, 21 bp, Homo sapiens
atacatgtgccgaatgtgcag

SEQ ID NO: 380399 - DNA, 17 bp, Homo sapiens
atacattaaaataacta

SEQ ID NO: 380400 - DNA, 14 bp, Homo sapiens
atacatttaaaact

SEQ ID NO: 380401 - DNA, 15 bp, Homo sapiens
atacatttataatgt

SEQ ID NO: 380402 - DNA, 21 bp, Homo sapiens
atacatttataatgtttgcta

SEQ ID NO: 380403 - DNA, 17 bp, Homo sapiens
atacatttatcttctgt

SEQ ID NO: 380404 - DNA, 23 bp, Homo sapiens
atacatttatcttctgtttttct

SEQ ID NO: 380405 - DNA, 17 bp, Homo sapiens
atacattttatatctgg

SEQ ID NO: 380406 - DNA, 19 bp, Homo sapiens
atacattttgttatagaat

SEQ ID NO: 380407 - DNA, 23 bp, Homo sapiens
ataccacctgtacatacattgta

SEQ ID NO: 380408 - DNA, 14 bp, Homo sapiens
ataccacgaggaaa

SEQ ID NO: 380409 - DNA, 12 bp, Homo sapiens
ataccagcaaaa

SEQ ID NO: 380410 - DNA, 17 bp, Homo sapiens
ataccagcaaaagtgca

SEQ ID NO: 380411 - DNA, 13 bp, Homo sapiens
ataccagtacttg

SEQ ID NO: 380412 - DNA, 14 bp, Homo sapiens
ataccagtacttga

SEQ ID NO: 380413 - DNA, 17 bp, Homo sapiens
ataccatcagcaaagaa

SEQ ID NO: 380414 - DNA, 17 bp, Homo sapiens
ataccattttgaaatat

SEQ ID NO: 380415 - DNA, 12 bp, Homo sapiens
atacccactgca

SEQ ID NO: 380416 - DNA, 14 bp, Homo sapiens
atacccagagagaa

SEQ ID NO: 380417 - DNA, 19 bp, Homo sapiens
atacccagtgtttggggtg

SEQ ID NO: 380418 - DNA, 17 bp, Homo sapiens
ataccccaagtccacct

SEQ ID NO: 380419 - DNA, 15 bp, Homo sapiens
ataccccctgcccca

SEQ ID NO: 380420 - DNA, 19 bp, Homo sapiens
ataccccctgccccagaga

SEQ ID NO: 380421 - DNA, 21 bp, Homo sapiens
ataccctaggtctccacccct

SEQ ID NO: 380422 - DNA, 22 bp, Homo sapiens
ataccgtttggtgtctgatgtg

SEQ ID NO: 380423 - DNA, 21 bp, Homo sapiens
atacctctctctatatataca

SEQ ID NO: 380424 - DNA, 17 bp, Homo sapiens
atacctggcttttactt

SEQ ID NO: 380425 - DNA, 17 bp, Homo sapiens
atacctttaaatatcat

SEQ ID NO: 380426 - DNA, 22 bp, Homo sapiens
atacctttaaatatcattcttt

SEQ ID NO: 380427 - DNA, 13 bp, Homo sapiens
atacgactttatt

SEQ ID NO: 380428 - DNA, 18 bp, Homo sapiens
atactaaatatgaaattt

SEQ ID NO: 380429 - DNA, 15 bp, Homo sapiens
atactaaccatttct

SEQ ID NO: 380430 - DNA, 14 bp, Homo sapiens
atactaagaaaaga

SEQ ID NO: 380431 - DNA, 11 bp, Homo sapiens
atactaataaa

SEQ ID NO: 380432 - DNA, 22 bp, Homo sapiens
atactaatagagtacttaatat

SEQ ID NO: 380433 - DNA, 12 bp, Homo sapiens
atactaatttat

SEQ ID NO: 380434 - DNA, 17 bp, Homo sapiens
atactaatttattgccg

SEQ ID NO: 380435 - DNA, 23 bp, Homo sapiens
atactagaaagctctgcatgtgt

SEQ ID NO: 380436 - DNA, 14 bp, Homo sapiens
atactatatttatg

SEQ ID NO: 380437 - DNA, 17 bp, Homo sapiens
atactattggacagaca

SEQ ID NO: 380438 - DNA, 19 bp, Homo sapiens
atactatttattaaaacca

SEQ ID NO: 380439 - DNA, 16 bp, Homo sapiens
atactcaccaaaatat

SEQ ID NO: 380440 - DNA, 17 bp, Homo sapiens
atactcaccaaaatata

SEQ ID NO: 380441 - DNA, 13 bp, Homo sapiens
atactcacctcct

SEQ ID NO: 380442 - DNA, 13 bp, Homo sapiens
atactctccagga

SEQ ID NO: 380443 - DNA, 14 bp, Homo sapiens
atactctccaggat

SEQ ID NO: 380444 - DNA, 13 bp, Homo sapiens
atactctgttgcc

SEQ ID NO: 380445 - DNA, 16 bp, Homo sapiens
atactctgttgcctcc

SEQ ID NO: 380446 - DNA, 23 bp, Homo sapiens
atactctgttgcctcctctctcc

SEQ ID NO: 380447 - DNA, 15 bp, Homo sapiens
atactctttgtcttt

SEQ ID NO: 380448 - DNA, 17 bp, Homo sapiens
atactgatgagacaaca

SEQ ID NO: 380449 - DNA, 23 bp, Homo sapiens
atactgcatgtaagccaagtcat

SEQ ID NO: 380450 - DNA, 22 bp, Homo sapiens
atactgcccggggcagctgcca

SEQ ID NO: 380451 - DNA, 22 bp, Homo sapiens
atactgcttgaccgtactctca

SEQ ID NO: 380452 - DNA, 13 bp, Homo sapiens
atactggaagttt

SEQ ID NO: 380453 - DNA, 23 bp, Homo sapiens
atactggttatagttgatatgta

SEQ ID NO: 380454 - DNA, 17 bp, Homo sapiens
atactggttatcctgtg

SEQ ID NO: 380455 - DNA, 19 bp, Homo sapiens
atactgtaaggaaatgtta

SEQ ID NO: 380456 - DNA, 18 bp, Homo sapiens
atactgtcatataatgca

SEQ ID NO: 380457 - DNA, 16 bp, Homo sapiens
atactgtcttgtctca

SEQ ID NO: 380458 - DNA, 12 bp, Homo sapiens
catcctcagccc

SEQ ID NO: 380459 - DNA, 15 bp, Homo sapiens
catcctcagccccag

SEQ ID NO: 380460 - DNA, 21 bp, Homo sapiens
catcctcagccccagggccct

SEQ ID NO: 380461 - DNA, 13 bp, Homo sapiens
catcctccagggg

SEQ ID NO: 380462 - DNA, 16 bp, Homo sapiens
catcctccccttccct

SEQ ID NO: 380463 - DNA, 19 bp, Homo sapiens
catcctccccttccctgca

SEQ ID NO: 380464 - DNA, 20 bp, Homo sapiens
catcctccccttccctgcaa

SEQ ID NO: 380465 - DNA, 22 bp, Homo sapiens
catcctcctggacccagcaggg

SEQ ID NO: 380466 - DNA, 14 bp, Homo sapiens
catcctcttctgct

SEQ ID NO: 380467 - DNA, 16 bp, Homo sapiens
catcctgacctcctgg

SEQ ID NO: 380468 - DNA, 17 bp, Homo sapiens
catcctgacctcctgga

SEQ ID NO: 380469 - DNA, 20 bp, Homo sapiens
catcctgcagcctcctcctg

SEQ ID NO: 380470 - DNA, 21 bp, Homo sapiens
catcctgccaggagcagcctc

SEQ ID NO: 380471 - DNA, 23 bp, Homo sapiens
catcctggcccctccagaccctg

SEQ ID NO: 380472 - DNA, 16 bp, Homo sapiens
catcctgtacaagtgc

SEQ ID NO: 380473 - DNA, 17 bp, Homo sapiens
catccttagcaacagcc

SEQ ID NO: 380474 - DNA, 15 bp, Homo sapiens
catccttcccgcagc

SEQ ID NO: 380475 - DNA, 18 bp, Homo sapiens
catccttcccgcagcacc

SEQ ID NO: 380476 - DNA, 12 bp, Homo sapiens
catccttctgcc

SEQ ID NO: 380477 - DNA, 11 bp, Homo sapiens
catcctttttt

SEQ ID NO: 380478 - DNA, 18 bp, Homo sapiens
catccttttttaaaaaaa

SEQ ID NO: 380479 - DNA, 13 bp, Homo sapiens
catcgatatgaaa

SEQ ID NO: 380480 - DNA, 15 bp, Homo sapiens
catcgcgctccttgc

SEQ ID NO: 380481 - DNA, 14 bp, Homo sapiens
catcggtcagcagg

SEQ ID NO: 380482 - DNA, 19 bp, Homo sapiens
catcggttcaggaggagac

SEQ ID NO: 380483 - DNA, 14 bp, Homo sapiens
catcgtagaagaga

SEQ ID NO: 380484 - DNA, 16 bp, Homo sapiens
catcgtataaggaaat

SEQ ID NO: 380485 - DNA, 18 bp, Homo sapiens
catcgtgacccttcaggg

SEQ ID NO: 380486 - DNA, 16 bp, Homo sapiens
catcgtggtatgtgaa

SEQ ID NO: 380487 - DNA, 12 bp, Homo sapiens
catctaaataaa

SEQ ID NO: 380488 - DNA, 13 bp, Homo sapiens
catctactggata

SEQ ID NO: 380489 - DNA, 19 bp, Homo sapiens
catctactggataaacttg

SEQ ID NO: 380490 - DNA, 23 bp, Homo sapiens
catctagctccataattgcaagg

SEQ ID NO: 380491 - DNA, 23 bp, Homo sapiens
catctagttaagtcgctgaacaa

SEQ ID NO: 380492 - DNA, 20 bp, Homo sapiens
catctattttctcagaatct

SEQ ID NO: 380493 - DNA, 19 bp, Homo sapiens
catctcactggatgcaaag

SEQ ID NO: 380494 - DNA, 13 bp, Homo sapiens
catctcagcccac

SEQ ID NO: 380495 - DNA, 17 bp, Homo sapiens
catctcagcctcctgag

SEQ ID NO: 380496 - DNA, 20 bp, Homo sapiens
catctcagcctcctgagcct

SEQ ID NO: 380497 - DNA, 21 bp, Homo sapiens
catctcagcctcctgagcctg

SEQ ID NO: 380498 - DNA, 22 bp, Homo sapiens
catctcagcctcctgagcctgt

SEQ ID NO: 380499 - DNA, 15 bp, Homo sapiens
catctcaggccacct

SEQ ID NO: 380500 - DNA, 21 bp, Homo sapiens
catctcaggccacctgccccc

SEQ ID NO: 380501 - DNA, 13 bp, Homo sapiens
catctcaggtgcc

SEQ ID NO: 380502 - DNA, 14 bp, Homo sapiens
catctcaggtgcca

SEQ ID NO: 380503 - DNA, 21 bp, Homo sapiens
catctcatcgtcctagaaagc

SEQ ID NO: 380504 - DNA, 14 bp, Homo sapiens
catctccactccag

SEQ ID NO: 380505 - DNA, 16 bp, Homo sapiens
catctccagggagcaa

SEQ ID NO: 380506 - DNA, 20 bp, Homo sapiens
catctccagggagtcccctc

SEQ ID NO: 380507 - DNA, 22 bp, Homo sapiens
catctccagggagtcccctccc

SEQ ID NO: 380508 - DNA, 16 bp, Homo sapiens
catctccatcagctgt

SEQ ID NO: 380509 - DNA, 16 bp, Homo sapiens
catctccccaggcctc

SEQ ID NO: 380510 - DNA, 19 bp, Homo sapiens
catctccccaggcctccag

SEQ ID NO: 380511 - DNA, 21 bp, Homo sapiens
catctccccaggcctccagcc

SEQ ID NO: 380512 - DNA, 19 bp, Homo sapiens
catctcccttccacctcac

SEQ ID NO: 380513 - DNA, 20 bp, Homo sapiens
catctcctccatactcagga

SEQ ID NO: 380514 - DNA, 20 bp, Homo sapiens
catctcctcccatggccttc

SEQ ID NO: 380515 - DNA, 11 bp, Homo sapiens
catctcctctc

SEQ ID NO: 380516 - DNA, 13 bp, Homo sapiens
catctcctgtgca

SEQ ID NO: 380517 - DNA, 19 bp, Homo sapiens
catctcctgtgcatgggtg

SEQ ID NO: 380518 - DNA, 12 bp, Homo sapiens
catctccttccc

SEQ ID NO: 380519 - DNA, 21 bp, Homo sapiens
catctccttcccccagcccaa

SEQ ID NO: 380520 - DNA, 22 bp, Homo sapiens
catctctaaaaaaatacaaaaa

SEQ ID NO: 380521 - DNA, 19 bp, Homo sapiens
catctctaacagctcagga

SEQ ID NO: 380522 - DNA, 20 bp, Homo sapiens
catctctaacagctcaggat

SEQ ID NO: 380523 - DNA, 22 bp, Homo sapiens
catctctaacagctcaggatct

SEQ ID NO: 380524 - DNA, 23 bp, Homo sapiens
catctctccctcccctgccattt

SEQ ID NO: 380525 - DNA, 11 bp, Homo sapiens
catctctgcac

SEQ ID NO: 380526 - DNA, 12 bp, Homo sapiens
catctctgcctt

SEQ ID NO: 380527 - DNA, 11 bp, Homo sapiens
catctctgctg

SEQ ID NO: 380528 - DNA, 15 bp, Homo sapiens
catctctgctgaaca

SEQ ID NO: 380529 - DNA, 18 bp, Homo sapiens
catctctgctgcttctgg

SEQ ID NO: 380530 - DNA, 20 bp, Homo sapiens
catctctgctgcttctgggc

SEQ ID NO: 380531 - DNA, 21 bp, Homo sapiens
catctctgctgcttctgggcc

SEQ ID NO: 380532 - DNA, 12 bp, Homo sapiens
catctctgtaaa

SEQ ID NO: 380533 - DNA, 12 bp, Homo sapiens
catctgaaaaga

SEQ ID NO: 380534 - DNA, 15 bp, Homo sapiens
catctgacacaaaaa

SEQ ID NO: 380535 - DNA, 18 bp, Homo sapiens
catctgagaaggccctgt

SEQ ID NO: 380536 - DNA, 23 bp, Homo sapiens
catctgagaaggccctgtgccct

SEQ ID NO: 380537 - DNA, 11 bp, Homo sapiens
catctgaggag

SEQ ID NO: 380538 - DNA, 16 bp, Homo sapiens
catctgaggagtccaa

SEQ ID NO: 380539 - DNA, 17 bp, Homo sapiens
catctgaggagtccaaa

SEQ ID NO: 380540 - DNA, 22 bp, Homo sapiens
catctgatattcaaacacacag

SEQ ID NO: 380541 - DNA, 19 bp, Homo sapiens
catctgattgagtcagtgt

SEQ ID NO: 380542 - DNA, 20 bp, Homo sapiens
catctgattgagtcagtgtt

SEQ ID NO: 380543 - DNA, 13 bp, Homo sapiens
catctgcccctcc

SEQ ID NO: 380544 - DNA, 15 bp, Homo sapiens
catctgcccctcccc

SEQ ID NO: 380545 - DNA, 19 bp, Homo sapiens
catctgcccctcccccaac

SEQ ID NO: 380546 - DNA, 14 bp, Homo sapiens
catctgctcatctg

SEQ ID NO: 380547 - DNA, 18 bp, Homo sapiens
catctgctcatctgatat

SEQ ID NO: 380548 - DNA, 13 bp, Homo sapiens
catctgctctgag

SEQ ID NO: 380549 - DNA, 17 bp, Homo sapiens
catctgctcttctctta

SEQ ID NO: 380550 - DNA, 14 bp, Homo sapiens
catctgctgagctc

SEQ ID NO: 380551 - DNA, 15 bp, Homo sapiens
catctggcctggcct

SEQ ID NO: 380552 - DNA, 18 bp, Homo sapiens
catctggcctggcctggc

SEQ ID NO: 380553 - DNA, 15 bp, Homo sapiens
catctgggctggcag

SEQ ID NO: 380554 - DNA, 17 bp, Homo sapiens
catctgggctggcagag

SEQ ID NO: 380555 - DNA, 22 bp, Homo sapiens
catctgggctggcagaggggac

SEQ ID NO: 380556 - DNA, 23 bp, Homo sapiens
catctggggatggagaatgccag

SEQ ID NO: 380557 - DNA, 18 bp, Homo sapiens
catctgtaaatatcccag

SEQ ID NO: 380558 - DNA, 21 bp, Homo sapiens
catctgtaaatatcccagaga

SEQ ID NO: 380559 - DNA, 12 bp, Homo sapiens
catctgtagata

SEQ ID NO: 380560 - DNA, 19 bp, Homo sapiens
catctgtcagcttcccaac

SEQ ID NO: 380561 - DNA, 17 bp, Homo sapiens
catctgtcccactggga

SEQ ID NO: 380562 - DNA, 22 bp, Homo sapiens
catctgtcccactgggacacaa

SEQ ID NO: 380563 - DNA, 16 bp, Homo sapiens
catctgtctcaacctg

SEQ ID NO: 380564 - DNA, 13 bp, Homo sapiens
catctgtctgtcc

SEQ ID NO: 380565 - DNA, 16 bp, Homo sapiens
catctgtctgtcctac

SEQ ID NO: 380566 - DNA, 14 bp, Homo sapiens
catctgtgtcctgg

SEQ ID NO: 380567 - DNA, 15 bp, Homo sapiens
catctgtgtgaaaat

SEQ ID NO: 380568 - DNA, 12 bp, Homo sapiens
catcttaatctt

SEQ ID NO: 380569 - DNA, 13 bp, Homo sapiens
catcttaatcttt

SEQ ID NO: 380570 - DNA, 14 bp, Homo sapiens
catcttagtgcctg

SEQ ID NO: 380571 - DNA, 14 bp, Homo sapiens
catcttcatataaa

SEQ ID NO: 380572 - DNA, 16 bp, Homo sapiens
catcttcctgctgctg

SEQ ID NO: 380573 - DNA, 12 bp, Homo sapiens
catcttctcttt

SEQ ID NO: 380574 - DNA, 15 bp, Homo sapiens
catcttctctttttc

SEQ ID NO: 380575 - DNA, 16 bp, Homo sapiens
catcttgaattgtaag

SEQ ID NO: 380576 - DNA, 16 bp, Homo sapiens
catcttgagcctgagc

SEQ ID NO: 380577 - DNA, 19 bp, Homo sapiens
catcttggtagttctgtgc

SEQ ID NO: 380578 - DNA, 17 bp, Homo sapiens
catctttatcattaaac

SEQ ID NO: 380579 - DNA, 18 bp, Homo sapiens
catctttcatagttctgt

SEQ ID NO: 380580 - DNA, 21 bp, Homo sapiens
catctttcctccaaactcctg

SEQ ID NO: 380581 - DNA, 14 bp, Homo sapiens
catctttcctttgc

SEQ ID NO: 380582 - DNA, 17 bp, Homo sapiens
catctttcctttgctct

SEQ ID NO: 380583 - DNA, 17 bp, Homo sapiens
catctttgccttgggct

SEQ ID NO: 380584 - DNA, 14 bp, Homo sapiens
catcttttaatatg

SEQ ID NO: 380585 - DNA, 19 bp, Homo sapiens
catcttttaggggaagtga

SEQ ID NO: 380586 - DNA, 23 bp, Homo sapiens
catcttttgggaagccaggaaag

SEQ ID NO: 380587 - DNA, 15 bp, Homo sapiens
catgaaaaagcagct

SEQ ID NO: 380588 - DNA, 18 bp, Homo sapiens
catgaaaaagcagctacc

SEQ ID NO: 380589 - DNA, 19 bp, Homo sapiens
catgaaaaagcagctacca

SEQ ID NO: 380590 - DNA, 14 bp, Homo sapiens
catgaaaacattga

SEQ ID NO: 380591 - DNA, 18 bp, Homo sapiens
catgaaaacattgatgaa

SEQ ID NO: 380592 - DNA, 16 bp, Homo sapiens
catgaaaacgttttat

SEQ ID NO: 380593 - DNA, 22 bp, Homo sapiens
atactgtgtcatggtgatgcaa

SEQ ID NO: 380594 - DNA, 14 bp, Homo sapiens
atactgtgtgggat

SEQ ID NO: 380595 - DNA, 18 bp, Homo sapiens
atactgtgtgggatactt

SEQ ID NO: 380596 - DNA, 16 bp, Homo sapiens
atactgtttgtaatat

SEQ ID NO: 380597 - DNA, 19 bp, Homo sapiens
atacttaaaaatatgtgag

SEQ ID NO: 380598 - DNA, 21 bp, Homo sapiens
atacttaaaaatatgtgagca

SEQ ID NO: 380599 - DNA, 15 bp, Homo sapiens
atacttaaacagctt

SEQ ID NO: 380600 - DNA, 16 bp, Homo sapiens
atacttaatactgaat

SEQ ID NO: 380601 - DNA, 21 bp, Homo sapiens
atacttagtggtatgtctctt

SEQ ID NO: 380602 - DNA, 17 bp, Homo sapiens
atacttatatttcccta

SEQ ID NO: 380603 - DNA, 21 bp, Homo sapiens
atacttatatttttaataaaa

SEQ ID NO: 380604 - DNA, 20 bp, Homo sapiens
atacttatttataacattgt

SEQ ID NO: 380605 - DNA, 12 bp, Homo sapiens
atacttcctgga

SEQ ID NO: 380606 - DNA, 14 bp, Homo sapiens
atacttcctggatt

SEQ ID NO: 380607 - DNA, 22 bp, Homo sapiens
atacttcctggattttctttct

SEQ ID NO: 380608 - DNA, 17 bp, Homo sapiens
atacttctttttcatta

SEQ ID NO: 380609 - DNA, 16 bp, Homo sapiens
atacttgagtgtgcaa

SEQ ID NO: 380610 - DNA, 14 bp, Homo sapiens
atacttgatgcact

SEQ ID NO: 380611 - DNA, 16 bp, Homo sapiens
atacttgatgcactta

SEQ ID NO: 380612 - DNA, 17 bp, Homo sapiens
atacttgatgcacttat

SEQ ID NO: 380613 - DNA, 15 bp, Homo sapiens
atactttttttcaca

SEQ ID NO: 380614 - DNA, 18 bp, Homo sapiens
atagaaaaagcacagctc

SEQ ID NO: 380615 - DNA, 22 bp, Homo sapiens
atagaaaacaggaaaaaaactt

SEQ ID NO: 380616 - DNA, 19 bp, Homo sapiens
atagaaataagtggttatt

SEQ ID NO: 380617 - DNA, 15 bp, Homo sapiens
atagaaatgtatttt

SEQ ID NO: 380618 - DNA, 17 bp, Homo sapiens
atagaaatgtattttga

SEQ ID NO: 380619 - DNA, 16 bp, Homo sapiens
atagaagctgtagtag

SEQ ID NO: 380620 - DNA, 13 bp, Homo sapiens
atagaagttttat

SEQ ID NO: 380621 - DNA, 13 bp, Homo sapiens
atagaatactttt

SEQ ID NO: 380622 - DNA, 16 bp, Homo sapiens
atagaatatactgtct

SEQ ID NO: 380623 - DNA, 16 bp, Homo sapiens
atagaatcaatcagta

SEQ ID NO: 380624 - DNA, 17 bp, Homo sapiens
atagaatttttaatgtt

SEQ ID NO: 380625 - DNA, 19 bp, Homo sapiens
atagacacagtattgactt

SEQ ID NO: 380626 - DNA, 17 bp, Homo sapiens
atagacctatgataaat

SEQ ID NO: 380627 - DNA, 17 bp, Homo sapiens
atagagcaaaattgatg

SEQ ID NO: 380628 - DNA, 21 bp, Homo sapiens
atagagcaaaattgatgtgtt

SEQ ID NO: 380629 - DNA, 22 bp, Homo sapiens
atagagcaaaattgatgtgttt

SEQ ID NO: 380630 - DNA, 21 bp, Homo sapiens
atagagcacctagtccagtga

SEQ ID NO: 380631 - DNA, 15 bp, Homo sapiens
atagagcccctcctg

SEQ ID NO: 380632 - DNA, 12 bp, Homo sapiens
atagagcctttg

SEQ ID NO: 380633 - DNA, 17 bp, Homo sapiens
atagagctgggtggcct

SEQ ID NO: 380634 - DNA, 14 bp, Homo sapiens
atagagggccaaga

SEQ ID NO: 380635 - DNA, 21 bp, Homo sapiens
atagagtacttaatatactca

SEQ ID NO: 380636 - DNA, 14 bp, Homo sapiens
atagagtcacagct

SEQ ID NO: 380637 - DNA, 14 bp, Homo sapiens
atagagtgttatca

SEQ ID NO: 380638 - DNA, 16 bp, Homo sapiens
atagagtttaacacaa

SEQ ID NO: 380639 - DNA, 14 bp, Homo sapiens
atagataacagaga

SEQ ID NO: 380640 - DNA, 22 bp, Homo sapiens
atagataactgctcttttacta

SEQ ID NO: 380641 - DNA, 17 bp, Homo sapiens
atagataccattttgaa

SEQ ID NO: 380642 - DNA, 18 bp, Homo sapiens
atagatcacggcatgttt

SEQ ID NO: 380643 - DNA, 12 bp, Homo sapiens
atagatcttctg

SEQ ID NO: 380644 - DNA, 19 bp, Homo sapiens
atataataaatatatattt

SEQ ID NO: 380645 - DNA, 21 bp, Homo sapiens
atataataaatatatatttat

SEQ ID NO: 380646 - DNA, 23 bp, Homo sapiens
atataataaatatatatttatca

SEQ ID NO: 380647 - DNA, 15 bp, Homo sapiens
atataataaatggga

SEQ ID NO: 380648 - DNA, 15 bp, Homo sapiens
atataatacttaaaa

SEQ ID NO: 380649 - DNA, 14 bp, Homo sapiens
atataatgaacacg

SEQ ID NO: 380650 - DNA, 22 bp, Homo sapiens
atataatggtttactgctgtca

SEQ ID NO: 380651 - DNA, 21 bp, Homo sapiens
atataattatcggaagcagtg

SEQ ID NO: 380652 - DNA, 11 bp, Homo sapiens
atataattatg

SEQ ID NO: 380653 - DNA, 14 bp, Homo sapiens
atataattctgtaa

SEQ ID NO: 380654 - DNA, 16 bp, Homo sapiens
atataattctgtaaat

SEQ ID NO: 380655 - DNA, 21 bp, Homo sapiens
atataatttttttatgttttg

SEQ ID NO: 380656 - DNA, 21 bp, Homo sapiens
atatacaactttggaatttga

SEQ ID NO: 380657 - DNA, 21 bp, Homo sapiens
atatacagatgaaaatttgag

SEQ ID NO: 380658 - DNA, 17 bp, Homo sapiens
atatacatatacacaaa

SEQ ID NO: 380659 - DNA, 14 bp, Homo sapiens
atatacatgtatag

SEQ ID NO: 380660 - DNA, 18 bp, Homo sapiens
atatacattctttatctt

SEQ ID NO: 380661 - DNA, 22 bp, Homo sapiens
atatacatttcataaggcctgc

SEQ ID NO: 380662 - DNA, 18 bp, Homo sapiens
atatacctggcttttact

SEQ ID NO: 380663 - DNA, 14 bp, Homo sapiens
atatactaaccatt

SEQ ID NO: 380664 - DNA, 15 bp, Homo sapiens
atatactaataaaaa

SEQ ID NO: 380665 - DNA, 20 bp, Homo sapiens
atatactaataaaaaggttt

SEQ ID NO: 380666 - DNA, 20 bp, Homo sapiens
atatactgaagtcttttctg

SEQ ID NO: 380667 - DNA, 22 bp, Homo sapiens
atatactgggttcttgttttat

SEQ ID NO: 380668 - DNA, 22 bp, Homo sapiens
atatacttgtggttttcaaatt

SEQ ID NO: 380669 - DNA, 17 bp, Homo sapiens
atatagctctacacaac

SEQ ID NO: 380670 - DNA, 20 bp, Homo sapiens
atatagctctacacaacatg

SEQ ID NO: 380671 - DNA, 15 bp, Homo sapiens
atatagttgaacaag

SEQ ID NO: 380672 - DNA, 17 bp, Homo sapiens
atatagttgaacaagat

SEQ ID NO: 380673 - DNA, 17 bp, Homo sapiens
atatagttgtctttctt

SEQ ID NO: 380674 - DNA, 21 bp, Homo sapiens
atatagttgtctttctttgct

SEQ ID NO: 380675 - DNA, 19 bp, Homo sapiens
atatataaaataaatatac

SEQ ID NO: 380676 - DNA, 21 bp, Homo sapiens
atatataaaataaatatacta

SEQ ID NO: 380677 - DNA, 23 bp, Homo sapiens
atatataaaataaatatactaat

SEQ ID NO: 380678 - DNA, 22 bp, Homo sapiens
atatataatggtttactgctgt

SEQ ID NO: 380679 - DNA, 12 bp, Homo sapiens
atatatacatgt

SEQ ID NO: 380680 - DNA, 14 bp, Homo sapiens
atatatacatgtat

SEQ ID NO: 380681 - DNA, 19 bp, Homo sapiens
atatatacatgtatagtga

SEQ ID NO: 380682 - DNA, 15 bp, Homo sapiens
atatatatgagtgaa

SEQ ID NO: 380683 - DNA, 23 bp, Homo sapiens
atatatattctggctgataaaag

SEQ ID NO: 380684 - DNA, 10 bp, Homo sapiens
atatatattt

SEQ ID NO: 380685 - DNA, 13 bp, Homo sapiens
atatatcatattg

SEQ ID NO: 380686 - DNA, 15 bp, Homo sapiens
atatatctgcttcag

SEQ ID NO: 380687 - DNA, 18 bp, Homo sapiens
atatatctgcttcagtgg

SEQ ID NO: 380688 - DNA, 15 bp, Homo sapiens
atatatctttatact

SEQ ID NO: 380689 - DNA, 16 bp, Homo sapiens
atatatgatatataaa

SEQ ID NO: 380690 - DNA, 13 bp, Homo sapiens
atatatgtacagt

SEQ ID NO: 380691 - DNA, 11 bp, Homo sapiens
atatatgtatg

SEQ ID NO: 380692 - DNA, 12 bp, Homo sapiens
atatatgtatgt

SEQ ID NO: 380693 - DNA, 16 bp, Homo sapiens
atatatgtgtgtgtat

SEQ ID NO: 380694 - DNA, 19 bp, Homo sapiens
atatatgtgtgtgtatgtt

SEQ ID NO: 380695 - DNA, 18 bp, Homo sapiens
atatatgtgtgtttaaat

SEQ ID NO: 380696 - DNA, 15 bp, Homo sapiens
atatatgtttggctg

SEQ ID NO: 380697 - DNA, 12 bp, Homo sapiens
atatatgttttg

SEQ ID NO: 380698 - DNA, 13 bp, Homo sapiens
atatatgttttga

SEQ ID NO: 380699 - DNA, 15 bp, Homo sapiens
atatatgttttgaga

SEQ ID NO: 380700 - DNA, 16 bp, Homo sapiens
atatatgttttgagaa

SEQ ID NO: 380701 - DNA, 15 bp, Homo sapiens
atatattataagatt

SEQ ID NO: 380702 - DNA, 13 bp, Homo sapiens
atatattctttcc

SEQ ID NO: 380703 - DNA, 20 bp, Homo sapiens
atatattgccagtatataag

SEQ ID NO: 380704 - DNA, 21 bp, Homo sapiens
atatattgccagtatataagc

SEQ ID NO: 380705 - DNA, 12 bp, Homo sapiens
atatatttaaaa

SEQ ID NO: 380706 - DNA, 20 bp, Homo sapiens
atatatttaagcaacatctt

SEQ ID NO: 380707 - DNA, 13 bp, Homo sapiens
atatatttaatga

SEQ ID NO: 380708 - DNA, 15 bp, Homo sapiens
atatatttaatgata

SEQ ID NO: 380709 - DNA, 16 bp, Homo sapiens
atatatttaatgataa

SEQ ID NO: 380710 - DNA, 12 bp, Homo sapiens
atatatttgaaa

SEQ ID NO: 380711 - DNA, 19 bp, Homo sapiens
atatatttgaaagaagtca

SEQ ID NO: 380712 - DNA, 17 bp, Homo sapiens
atatattttattttcat

SEQ ID NO: 380713 - DNA, 13 bp, Homo sapiens
atatatttttaag

SEQ ID NO: 380714 - DNA, 14 bp, Homo sapiens
atatatttttatat

SEQ ID NO: 380715 - DNA, 21 bp, Homo sapiens
atatatttttatatttagtta

SEQ ID NO: 380716 - DNA, 21 bp, Homo sapiens
atatatttttccctgtttgcc

SEQ ID NO: 380717 - DNA, 19 bp, Homo sapiens
atatattttttaatttgat

SEQ ID NO: 380718 - DNA, 15 bp, Homo sapiens
atatattttttacaa

SEQ ID NO: 380719 - DNA, 23 bp, Homo sapiens
atatcaaaaaggagctcttcttg

SEQ ID NO: 380720 - DNA, 15 bp, Homo sapiens
atatcaacaacaagt

SEQ ID NO: 380721 - DNA, 15 bp, Homo sapiens
atatcaaggatgttc

SEQ ID NO: 380722 - DNA, 18 bp, Homo sapiens
atatcactttggtctcca

SEQ ID NO: 380723 - DNA, 14 bp, Homo sapiens
atatcagacctctg

SEQ ID NO: 380724 - DNA, 16 bp, Homo sapiens
atatcagacctctgat

SEQ ID NO: 380725 - DNA, 18 bp, Homo sapiens
atatcagacctctgatcc

SEQ ID NO: 380726 - DNA, 21 bp, Homo sapiens
atatcagcctgagtctcctgt

SEQ ID NO: 380727 - DNA, 15 bp, Homo sapiens
atatcataatgtaat

SEQ ID NO: 380728 - DNA, 15 bp, Homo sapiens
atatcatatgtatct

SEQ ID NO: 380729 - DNA, 19 bp, Homo sapiens
atatcatattggtattcac

SEQ ID NO: 380730 - DNA, 13 bp, Homo sapiens
atatcattatagc

SEQ ID NO: 380731 - DNA, 18 bp, Homo sapiens
atatcattatagcatgta

SEQ ID NO: 380732 - DNA, 15 bp, Homo sapiens
atatcattcagcaac

SEQ ID NO: 380733 - DNA, 19 bp, Homo sapiens
atatcattctttgtatctt

SEQ ID NO: 380734 - DNA, 16 bp, Homo sapiens
atatcattttattcac

SEQ ID NO: 380735 - DNA, 22 bp, Homo sapiens
catgctgctatgaagactactt

SEQ ID NO: 380736 - DNA, 13 bp, Homo sapiens
catgctgctttaa

SEQ ID NO: 380737 - DNA, 20 bp, Homo sapiens
catgctgctttaattgtgaa

SEQ ID NO: 380738 - DNA, 19 bp, Homo sapiens
catgctgctttttggcaca

SEQ ID NO: 380739 - DNA, 21 bp, Homo sapiens
catgctgctttttggcacagt

SEQ ID NO: 380740 - DNA, 20 bp, Homo sapiens
catgctggacaggtctggga

SEQ ID NO: 380741 - DNA, 16 bp, Homo sapiens
catgctggcctcccaa

SEQ ID NO: 380742 - DNA, 23 bp, Homo sapiens
catgctggcggcgcagagggaag

SEQ ID NO: 380743 - DNA, 13 bp, Homo sapiens
catgctgtccctt

SEQ ID NO: 380744 - DNA, 13 bp, Homo sapiens
catgctgtgtaag

SEQ ID NO: 380745 - DNA, 18 bp, Homo sapiens
catgctgttggcctcaag

SEQ ID NO: 380746 - DNA, 13 bp, Homo sapiens
catgcttagagca

SEQ ID NO: 380747 - DNA, 19 bp, Homo sapiens
catgcttcatgaaaatcct

SEQ ID NO: 380748 - DNA, 19 bp, Homo sapiens
catggaatttgtaagttta

SEQ ID NO: 380749 - DNA, 17 bp, Homo sapiens
catggacagggccaggg

SEQ ID NO: 380750 - DNA, 19 bp, Homo sapiens
catggacagggccagggtt

SEQ ID NO: 380751 - DNA, 15 bp, Homo sapiens
catggacccggagct

SEQ ID NO: 380752 - DNA, 15 bp, Homo sapiens
catggacctaacatt

SEQ ID NO: 380753 - DNA, 16 bp, Homo sapiens
catggacctaacattc

SEQ ID NO: 380754 - DNA, 14 bp, Homo sapiens
catggacgcctggc

SEQ ID NO: 380755 - DNA, 15 bp, Homo sapiens
catggacgcctggct

SEQ ID NO: 380756 - DNA, 16 bp, Homo sapiens
catggacgcctggctc

SEQ ID NO: 380757 - DNA, 17 bp, Homo sapiens
catggacgcctggctcc

SEQ ID NO: 380758 - DNA, 16 bp, Homo sapiens
catggagactcctgcc

SEQ ID NO: 380759 - DNA, 20 bp, Homo sapiens
catggagactcctgccctgt

SEQ ID NO: 380760 - DNA, 16 bp, Homo sapiens
catggagagcctctta

SEQ ID NO: 380761 - DNA, 16 bp, Homo sapiens
catggaggcacacagc

SEQ ID NO: 380762 - DNA, 17 bp, Homo sapiens
catggagtgtgtattgt

SEQ ID NO: 380763 - DNA, 20 bp, Homo sapiens
catggagtgtgtattgttcc

SEQ ID NO: 380764 - DNA, 13 bp, Homo sapiens
catggagtgtttg

SEQ ID NO: 380765 - DNA, 14 bp, Homo sapiens
catggatgattctt

SEQ ID NO: 380766 - DNA, 16 bp, Homo sapiens
catggatgattctttt

SEQ ID NO: 380767 - DNA, 20 bp, Homo sapiens
catggatgattcttttccca

SEQ ID NO: 380768 - DNA, 16 bp, Homo sapiens
catggatgtttcttct

SEQ ID NO: 380769 - DNA, 19 bp, Homo sapiens
catggattgattaaaagca

SEQ ID NO: 380770 - DNA, 22 bp, Homo sapiens
catggcaataaatggctcgtgg

SEQ ID NO: 380771 - DNA, 21 bp, Homo sapiens
catggcaattttgtaaattga

SEQ ID NO: 380772 - DNA, 14 bp, Homo sapiens
catggcaccagccc

SEQ ID NO: 380773 - DNA, 22 bp, Homo sapiens
catggcaccttcagactttgct

SEQ ID NO: 380774 - DNA, 21 bp, Homo sapiens
catggccaaggggccagctgc

SEQ ID NO: 380775 - DNA, 17 bp, Homo sapiens
attctgtgaagaatgaa

SEQ ID NO: 380776 - DNA, 18 bp, Homo sapiens
attctgtggattctatat

SEQ ID NO: 380777 - DNA, 19 bp, Homo sapiens
attctgtggattctatatt

SEQ ID NO: 380778 - DNA, 21 bp, Homo sapiens
attctgttaatgttaattaaa

SEQ ID NO: 380779 - DNA, 14 bp, Homo sapiens
attcttaagcactt

SEQ ID NO: 380780 - DNA, 20 bp, Homo sapiens
attcttaaggcaataaaact

SEQ ID NO: 380781 - DNA, 18 bp, Homo sapiens
attcttacaattgcactg

SEQ ID NO: 380782 - DNA, 15 bp, Homo sapiens
attcttatacacatt

SEQ ID NO: 380783 - DNA, 16 bp, Homo sapiens
attcttcaatttgaaa

SEQ ID NO: 380784 - DNA, 12 bp, Homo sapiens
attcttccctgg

SEQ ID NO: 380785 - DNA, 13 bp, Homo sapiens
attcttccctggg

SEQ ID NO: 380786 - DNA, 14 bp, Homo sapiens
attcttccctgggg

SEQ ID NO: 380787 - DNA, 20 bp, Homo sapiens
attcttccttgagctaagca

SEQ ID NO: 380788 - DNA, 23 bp, Homo sapiens
attcttctacttgtttaacattg

SEQ ID NO: 380789 - DNA, 14 bp, Homo sapiens
attcttcttttctt

SEQ ID NO: 380790 - DNA, 18 bp, Homo sapiens
attcttgaaggaaaatga

SEQ ID NO: 380791 - DNA, 16 bp, Homo sapiens
attcttgatgtaaaat

SEQ ID NO: 380792 - DNA, 19 bp, Homo sapiens
attcttgatgtaaaatctt

SEQ ID NO: 380793 - DNA, 20 bp, Homo sapiens
attcttgatgtaaaatcttg

SEQ ID NO: 380794 - DNA, 22 bp, Homo sapiens
attcttgattttcaagctttca

SEQ ID NO: 380795 - DNA, 17 bp, Homo sapiens
attcttgcactgtatcc

SEQ ID NO: 380796 - DNA, 22 bp, Homo sapiens
attcttgcactgtatccaagtt

SEQ ID NO: 380797 - DNA, 20 bp, Homo sapiens
attcttgctttcacaaatat

SEQ ID NO: 380798 - DNA, 14 bp, Homo sapiens
attcttgtcaaaaa

SEQ ID NO: 380799 - DNA, 17 bp, Homo sapiens
attcttgtcacaataaa

SEQ ID NO: 380800 - DNA, 20 bp, Homo sapiens
attcttgtccacattctact

SEQ ID NO: 380801 - DNA, 15 bp, Homo sapiens
attctttaatagaag

SEQ ID NO: 380802 - DNA, 21 bp, Homo sapiens
attctttaattgttgctttta

SEQ ID NO: 380803 - DNA, 17 bp, Homo sapiens
attctttacaaaatgaa

SEQ ID NO: 380804 - DNA, 17 bp, Homo sapiens
attctttatcttgacat

SEQ ID NO: 380805 - DNA, 18 bp, Homo sapiens
attctttccatgcagtta

SEQ ID NO: 380806 - DNA, 15 bp, Homo sapiens
attctttccccagag

SEQ ID NO: 380807 - DNA, 20 bp, Homo sapiens
attctttgacatttggtggt

SEQ ID NO: 380808 - DNA, 14 bp, Homo sapiens
attcttttaaatgg

SEQ ID NO: 380809 - DNA, 15 bp, Homo sapiens
attcttttaaatggg

SEQ ID NO: 380810 - DNA, 23 bp, Homo sapiens
attcttttaaatgggtgaaaaat

SEQ ID NO: 380811 - DNA, 15 bp, Homo sapiens
attcttttattaatg

SEQ ID NO: 380812 - DNA, 21 bp, Homo sapiens
attcttttccagaaagaaaat

SEQ ID NO: 380813 - DNA, 21 bp, Homo sapiens
attcttttttcttccccctcc

SEQ ID NO: 380814 - DNA, 14 bp, Homo sapiens
attgaaaaaaattg

SEQ ID NO: 380815 - DNA, 16 bp, Homo sapiens
attgaaaaaaattggc

SEQ ID NO: 380816 - DNA, 13 bp, Homo sapiens
attgaaaaaagag

SEQ ID NO: 380817 - DNA, 14 bp, Homo sapiens
attgaaaaaagaga

SEQ ID NO: 380818 - DNA, 15 bp, Homo sapiens
attgaaaaaagagaa

SEQ ID NO: 380819 - DNA, 15 bp, Homo sapiens
attgaaaaaccattt

SEQ ID NO: 380820 - DNA, 19 bp, Homo sapiens
attgaaaacttcaaagctg

SEQ ID NO: 380821 - DNA, 12 bp, Homo sapiens
attgaaaaggac

SEQ ID NO: 380822 - DNA, 13 bp, Homo sapiens
attgaaaaggaca

SEQ ID NO: 380823 - DNA, 19 bp, Homo sapiens
attgaaatttttaaatcat

SEQ ID NO: 380824 - DNA, 23 bp, Homo sapiens
attgaaatttttaaatcatttca

SEQ ID NO: 380825 - DNA, 14 bp, Homo sapiens
attgaacacaggca

SEQ ID NO: 380826 - DNA, 17 bp, Homo sapiens
attgaacacaggcaaag

SEQ ID NO: 380827 - DNA, 13 bp, Homo sapiens
attgaagatgtcc

SEQ ID NO: 380828 - DNA, 22 bp, Homo sapiens
attgaataatgttttttgaagt

SEQ ID NO: 380829 - DNA, 15 bp, Homo sapiens
attgaatgcgcttta

SEQ ID NO: 380830 - DNA, 14 bp, Homo sapiens
attgaatgttatat

SEQ ID NO: 380831 - DNA, 23 bp, Homo sapiens
attgaattattttgttactgtct

SEQ ID NO: 380832 - DNA, 13 bp, Homo sapiens
attgacaacattt

SEQ ID NO: 380833 - DNA, 16 bp, Homo sapiens
attgaccaagaactgc

SEQ ID NO: 380834 - DNA, 18 bp, Homo sapiens
attgaccaagaactgcat

SEQ ID NO: 380835 - DNA, 20 bp, Homo sapiens
attgaccaagaactgcatgg

SEQ ID NO: 380836 - DNA, 21 bp, Homo sapiens
attgaccctagccagagaata

SEQ ID NO: 380837 - DNA, 15 bp, Homo sapiens
attgacctcagctgc

SEQ ID NO: 380838 - DNA, 20 bp, Homo sapiens
attgacctcagctgcacatt

SEQ ID NO: 380839 - DNA, 21 bp, Homo sapiens
attgacgacaagtgctgaaca

SEQ ID NO: 380840 - DNA, 22 bp, Homo sapiens
attgacgacaagtgctgaacag

SEQ ID NO: 380841 - DNA, 14 bp, Homo sapiens
attgagacaaaaat

SEQ ID NO: 380842 - DNA, 20 bp, Homo sapiens
attgagacaaaaattatcta

SEQ ID NO: 380843 - DNA, 23 bp, Homo sapiens
attgagatcagcattcaaaatag

SEQ ID NO: 380844 - DNA, 16 bp, Homo sapiens
attgaggttaggaacc

SEQ ID NO: 380845 - DNA, 18 bp, Homo sapiens
attgagttcatcatgagc

SEQ ID NO: 380846 - DNA, 21 bp, Homo sapiens
attgataagaaccttttgagt

SEQ ID NO: 380847 - DNA, 17 bp, Homo sapiens
attgatcaaattcattt

SEQ ID NO: 380848 - DNA, 16 bp, Homo sapiens
attgatcacagatgtg

SEQ ID NO: 380849 - DNA, 15 bp, Homo sapiens
attgatcattcataa

SEQ ID NO: 380850 - DNA, 21 bp, Homo sapiens
attgatcattttccccccact

SEQ ID NO: 380851 - DNA, 23 bp, Homo sapiens
attgatcggagcctcctctctca

SEQ ID NO: 380852 - DNA, 17 bp, Homo sapiens
attgatgaaaagattta

SEQ ID NO: 380853 - DNA, 21 bp, Homo sapiens
attgatgataatacccacatt

SEQ ID NO: 380854 - DNA, 22 bp, Homo sapiens
attgatgggagaaatgaggaaa

SEQ ID NO: 380855 - DNA, 12 bp, Homo sapiens
attgatgtatat

SEQ ID NO: 380856 - DNA, 13 bp, Homo sapiens
attgattaaaagc

SEQ ID NO: 380857 - DNA, 13 bp, Homo sapiens
attgattaaactg

SEQ ID NO: 380858 - DNA, 14 bp, Homo sapiens
attgattaaactgt

SEQ ID NO: 380859 - DNA, 19 bp, Homo sapiens
attgattaaactgtatgtc

SEQ ID NO: 380860 - DNA, 14 bp, Homo sapiens
attgattgaaaaaa

SEQ ID NO: 380861 - DNA, 15 bp, Homo sapiens
attgatttgaagtgg

SEQ ID NO: 380862 - DNA, 14 bp, Homo sapiens
attgattttctttc

SEQ ID NO: 380863 - DNA, 18 bp, Homo sapiens
attgatttttaaagttta

SEQ ID NO: 380864 - DNA, 19 bp, Homo sapiens
attgatttttaaagtttaa

SEQ ID NO: 380865 - DNA, 22 bp, Homo sapiens
attgatttttaaagtttaaata

SEQ ID NO: 380866 - DNA, 23 bp, Homo sapiens
attgatttttaaagtttaaatac

SEQ ID NO: 380867 - DNA, 15 bp, Homo sapiens
attgcaaaaggttaa

SEQ ID NO: 380868 - DNA, 23 bp, Homo sapiens
attgcaaagaaaattctcaagtg

SEQ ID NO: 380869 - DNA, 19 bp, Homo sapiens
attgcacgtggcctcttga

SEQ ID NO: 380870 - DNA, 13 bp, Homo sapiens
attgcactaaaag

SEQ ID NO: 380871 - DNA, 18 bp, Homo sapiens
attgcactaaaagtgatg

SEQ ID NO: 380872 - DNA, 21 bp, Homo sapiens
attgcagaacatgagtgctga

SEQ ID NO: 380873 - DNA, 22 bp, Homo sapiens
attgcagaacatgagtgctgat

SEQ ID NO: 380874 - DNA, 14 bp, Homo sapiens
attgcagctaagct

SEQ ID NO: 380875 - DNA, 15 bp, Homo sapiens
attgcagctaagctc

SEQ ID NO: 380876 - DNA, 21 bp, Homo sapiens
attgcagctaagctcaaatgt

SEQ ID NO: 380877 - DNA, 19 bp, Homo sapiens
attgcaggccagtggacag

SEQ ID NO: 380878 - DNA, 15 bp, Homo sapiens
attgcagtaatgata

SEQ ID NO: 380879 - DNA, 14 bp, Homo sapiens
attgcagtttatat

SEQ ID NO: 380880 - DNA, 17 bp, Homo sapiens
attgcatgtatttaaga

SEQ ID NO: 380881 - DNA, 19 bp, Homo sapiens
attgcatttattgcagttt

SEQ ID NO: 380882 - DNA, 20 bp, Homo sapiens
attgccacctctggccaaat

SEQ ID NO: 380883 - DNA, 23 bp, Homo sapiens
attgccacctctggccaaatatg

SEQ ID NO: 380884 - DNA, 16 bp, Homo sapiens
attgccaggaatgttt

SEQ ID NO: 380885 - DNA, 17 bp, Homo sapiens
attgccaggaatgtttc

SEQ ID NO: 380886 - DNA, 19 bp, Homo sapiens
attgccagtatataagctg

SEQ ID NO: 380887 - DNA, 15 bp, Homo sapiens
attgccatttcttcc

SEQ ID NO: 380888 - DNA, 18 bp, Homo sapiens
attgcccatccatctgct

SEQ ID NO: 380889 - DNA, 21 bp, Homo sapiens
attgcccatgggatatgtggt

SEQ ID NO: 380890 - DNA, 14 bp, Homo sapiens
attgccccagagcc

SEQ ID NO: 380891 - DNA, 20 bp, Homo sapiens
attgccgtcctggactctgt

SEQ ID NO: 380892 - DNA, 16 bp, Homo sapiens
attgcctcccttcctc

SEQ ID NO: 380893 - DNA, 19 bp, Homo sapiens
attgcctcccttcctccgc

SEQ ID NO: 380894 - DNA, 18 bp, Homo sapiens
attgcctgggcagtgccc

SEQ ID NO: 380895 - DNA, 13 bp, Homo sapiens
attgcctttgtag

SEQ ID NO: 380896 - DNA, 14 bp, Homo sapiens
attgctacacacac

SEQ ID NO: 380897 - DNA, 16 bp, Homo sapiens
attgctagcgagccgc

SEQ ID NO: 380898 - DNA, 23 bp, Homo sapiens
attgctcaagttcattgatgacc

SEQ ID NO: 380899 - DNA, 19 bp, Homo sapiens
attgctccattttcttgtc

SEQ ID NO: 380900 - DNA, 20 bp, Homo sapiens
attgctccattttcttgtca

SEQ ID NO: 380901 - DNA, 23 bp, Homo sapiens
attgctctggaagcctgctgatt

SEQ ID NO: 380902 - DNA, 21 bp, Homo sapiens
attgctgagatgtttagtagc

SEQ ID NO: 380903 - DNA, 14 bp, Homo sapiens
attgctgtaaataa

SEQ ID NO: 380904 - DNA, 18 bp, Homo sapiens
attgctgtaaataaaaat

SEQ ID NO: 380905 - DNA, 20 bp, Homo sapiens
attgcttaaaagacattttt

SEQ ID NO: 380906 - DNA, 16 bp, Homo sapiens
attgcttacattttta

SEQ ID NO: 380907 - DNA, 22 bp, Homo sapiens
attgcttacatttttacaataa

SEQ ID NO: 380908 - DNA, 22 bp, Homo sapiens
agcccaagcttaatagccctcc

SEQ ID NO: 380909 - DNA, 12 bp, Homo sapiens
agcccaataaag

SEQ ID NO: 380910 - DNA, 13 bp, Homo sapiens
agcccaataaagg

SEQ ID NO: 380911 - DNA, 17 bp, Homo sapiens
agcccaatcactgccta

SEQ ID NO: 380912 - DNA, 14 bp, Homo sapiens
agcccacagaggac

SEQ ID NO: 380913 - DNA, 16 bp, Homo sapiens
agcccacagaggacag

SEQ ID NO: 380914 - DNA, 22 bp, Homo sapiens
agcccacaggtgtccccagccc

SEQ ID NO: 380915 - DNA, 15 bp, Homo sapiens
agcccacagtgctca

SEQ ID NO: 380916 - DNA, 14 bp, Homo sapiens
agcccacccccctc

SEQ ID NO: 380917 - DNA, 16 bp, Homo sapiens
agcccacccccctcat

SEQ ID NO: 380918 - DNA, 17 bp, Homo sapiens
agcccacccgccccaga

SEQ ID NO: 380919 - DNA, 20 bp, Homo sapiens
agcccacccgccccagagac

SEQ ID NO: 380920 - DNA, 21 bp, Homo sapiens
agcccacccgccccagagact

SEQ ID NO: 380921 - DNA, 13 bp, Homo sapiens
agcccaccctgct

SEQ ID NO: 380922 - DNA, 10 bp, Homo sapiens
agcccacctg

SEQ ID NO: 380923 - DNA, 12 bp, Homo sapiens
agcccacctggg

SEQ ID NO: 380924 - DNA, 14 bp, Homo sapiens
agcccacctgggct

SEQ ID NO: 380925 - DNA, 16 bp, Homo sapiens
agcccacctgggctgg

SEQ ID NO: 380926 - DNA, 21 bp, Homo sapiens
agcccacggctaagaggctgc

SEQ ID NO: 380927 - DNA, 12 bp, Homo sapiens
agcccactggat

SEQ ID NO: 380928 - DNA, 15 bp, Homo sapiens
agcccagaacgggcc

SEQ ID NO: 380929 - DNA, 17 bp, Homo sapiens
agcccagaacgggcctc

SEQ ID NO: 380930 - DNA, 19 bp, Homo sapiens
agcccagaacgggcctccc

SEQ ID NO: 380931 - DNA, 21 bp, Homo sapiens
agcccagaacgggcctccccg

SEQ ID NO: 380932 - DNA, 18 bp, Homo sapiens
agcccagacccccagtgt

SEQ ID NO: 380933 - DNA, 21 bp, Homo sapiens
agcccagacctcccctcttcc

SEQ ID NO: 380934 - DNA, 10 bp, Homo sapiens
agcccagaga

SEQ ID NO: 380935 - DNA, 17 bp, Homo sapiens
agcccagagagaccctg

SEQ ID NO: 380936 - DNA, 12 bp, Homo sapiens
agcccagcacac

SEQ ID NO: 380937 - DNA, 15 bp, Homo sapiens
agcccagcacactgc

SEQ ID NO: 380938 - DNA, 16 bp, Homo sapiens
agcccagcacactgct

SEQ ID NO: 380939 - DNA, 15 bp, Homo sapiens
agcccagcccagctg

SEQ ID NO: 380940 - DNA, 16 bp, Homo sapiens
agcccagcccggctga

SEQ ID NO: 380941 - DNA, 20 bp, Homo sapiens
agcccagctacattcctcag

SEQ ID NO: 380942 - DNA, 17 bp, Homo sapiens
agcccagctccactcag

SEQ ID NO: 380943 - DNA, 12 bp, Homo sapiens
agcccagctgct

SEQ ID NO: 380944 - DNA, 16 bp, Homo sapiens
agcccagctgctctgc

SEQ ID NO: 380945 - DNA, 18 bp, Homo sapiens
agcccagctgctctgccc

SEQ ID NO: 380946 - DNA, 19 bp, Homo sapiens
agcccagctgctctgccca

SEQ ID NO: 380947 - DNA, 20 bp, Homo sapiens
agcccagctgctctgcccag

SEQ ID NO: 380948 - DNA, 21 bp, Homo sapiens
agcccagctgctctgcccaga

SEQ ID NO: 380949 - DNA, 16 bp, Homo sapiens
agcccaggagtctgag

SEQ ID NO: 380950 - DNA, 20 bp, Homo sapiens
agcccaggagtttgagacaa

SEQ ID NO: 380951 - DNA, 22 bp, Homo sapiens
agcccaggattgtacgtgggag

SEQ ID NO: 380952 - DNA, 11 bp, Homo sapiens
agcccaggccg

SEQ ID NO: 380953 - DNA, 13 bp, Homo sapiens
agcccaggccgtt

SEQ ID NO: 380954 - DNA, 21 bp, Homo sapiens
agcccaggccgttccccttgg

SEQ ID NO: 380955 - DNA, 10 bp, Homo sapiens
agcccagggt

SEQ ID NO: 380956 - DNA, 17 bp, Homo sapiens
agcccagggttccccca

SEQ ID NO: 380957 - DNA, 18 bp, Homo sapiens
agcccagggttcccccag

SEQ ID NO: 380958 - DNA, 22 bp, Homo sapiens
agcccagggttcccccagccct

SEQ ID NO: 380959 - DNA, 17 bp, Homo sapiens
agcccaggtcagctgtt

SEQ ID NO: 380960 - DNA, 17 bp, Homo sapiens
agcccaggtcccagtgc

SEQ ID NO: 380961 - DNA, 17 bp, Homo sapiens
agcccagtccctggagc

SEQ ID NO: 380962 - DNA, 24 bp, Homo sapiens
agcccataggccaccccctatcct

SEQ ID NO: 380963 - DNA, 17 bp, Homo sapiens
agcccatcttgcctcca

SEQ ID NO: 380964 - DNA, 18 bp, Homo sapiens
agccccaagaaggctggg

SEQ ID NO: 380965 - DNA, 22 bp, Homo sapiens
agccccaatatggtggccctgg

SEQ ID NO: 380966 - DNA, 21 bp, Homo sapiens
agccccacccctaagtgccca

SEQ ID NO: 380967 - DNA, 22 bp, Homo sapiens
agccccacccctaagtgcccaa

SEQ ID NO: 380968 - DNA, 17 bp, Homo sapiens
agccccacttcaccccc

SEQ ID NO: 380969 - DNA, 18 bp, Homo sapiens
agccccacttcaccccca

SEQ ID NO: 380970 - DNA, 15 bp, Homo sapiens
agccccagccagccc

SEQ ID NO: 380971 - DNA, 17 bp, Homo sapiens
agccccagccagccctt

SEQ ID NO: 380972 - DNA, 21 bp, Homo sapiens
agccccagcgagtctggagac

SEQ ID NO: 380973 - DNA, 14 bp, Homo sapiens
agccccaggaccaa

SEQ ID NO: 380974 - DNA, 15 bp, Homo sapiens
agccccaggaccaag

SEQ ID NO: 380975 - DNA, 16 bp, Homo sapiens
agccccagggccctgc

SEQ ID NO: 380976 - DNA, 14 bp, Homo sapiens
agccccagggcctg

SEQ ID NO: 380977 - DNA, 17 bp, Homo sapiens
agccccagggcctgggg

SEQ ID NO: 380978 - DNA, 18 bp, Homo sapiens
agccccagggtcttccct

SEQ ID NO: 380979 - DNA, 20 bp, Homo sapiens
agccccagggtcttccctac

SEQ ID NO: 380980 - DNA, 14 bp, Homo sapiens
agccccagggtgag

SEQ ID NO: 380981 - DNA, 23 bp, Homo sapiens
agccccataattttttttttcct

SEQ ID NO: 380982 - DNA, 15 bp, Homo sapiens
agccccatagaaaac

SEQ ID NO: 380983 - DNA, 20 bp, Homo sapiens
agccccatcccaaacccttc

SEQ ID NO: 380984 - DNA, 15 bp, Homo sapiens
agccccatccttccc

SEQ ID NO: 380985 - DNA, 20 bp, Homo sapiens
agcccccaaccccgcggtgc

SEQ ID NO: 380986 - DNA, 11 bp, Homo sapiens
agcccccacca

SEQ ID NO: 380987 - DNA, 15 bp, Homo sapiens
agcccccaccagcag

SEQ ID NO: 380988 - DNA, 17 bp, Homo sapiens
agcccccaccagcagca

SEQ ID NO: 380989 - DNA, 20 bp, Homo sapiens
agcccccaccagcagcacaa

SEQ ID NO: 380990 - DNA, 14 bp, Homo sapiens
agcccccacccggg

SEQ ID NO: 380991 - DNA, 19 bp, Homo sapiens
agcccccaccttgatccca

SEQ ID NO: 380992 - DNA, 18 bp, Homo sapiens
agcccccagatagagctg

SEQ ID NO: 380993 - DNA, 21 bp, Homo sapiens
agcccccagatagagctgggt

SEQ ID NO: 380994 - DNA, 17 bp, Homo sapiens
agcccccaggctgctgg

SEQ ID NO: 380995 - DNA, 13 bp, Homo sapiens
agccccctccaca

SEQ ID NO: 380996 - DNA, 17 bp, Homo sapiens
agccccctccacaccag

SEQ ID NO: 380997 - DNA, 13 bp, Homo sapiens
agccccctctcct

SEQ ID NO: 380998 - DNA, 18 bp, Homo sapiens
agccccctctcctgaagc

SEQ ID NO: 380999 - DNA, 15 bp, Homo sapiens
agccccctcttgaga

SEQ ID NO: 381000 - DNA, 14 bp, Homo sapiens
agccccctgcaccc

SEQ ID NO: 381001 - DNA, 21 bp, Homo sapiens
agccccctgcacccacccctg

SEQ ID NO: 381002 - DNA, 20 bp, Homo sapiens
agccccctggatgtcccctg

SEQ ID NO: 381003 - DNA, 16 bp, Homo sapiens
agccccctggcccctc

SEQ ID NO: 381004 - DNA, 21 bp, Homo sapiens
agccccctggcccctcccaca

SEQ ID NO: 381005 - DNA, 17 bp, Homo sapiens
agccccctttgattgag

SEQ ID NO: 381006 - DNA, 19 bp, Homo sapiens
agccccggagcaccacggg

SEQ ID NO: 381007 - DNA, 13 bp, Homo sapiens
agccccggccact

SEQ ID NO: 381008 - DNA, 21 bp, Homo sapiens
agcccctaccttgagaccctc

SEQ ID NO: 381009 - DNA, 17 bp, Homo sapiens
agcccctatcctgcacc

SEQ ID NO: 381010 - DNA, 21 bp, Homo sapiens
agcccctcagcccttgccccc

SEQ ID NO: 381011 - DNA, 13 bp, Homo sapiens
agcccctcccacc

SEQ ID NO: 381012 - DNA, 23 bp, Homo sapiens
agcccctcccaccacagcaggtg

SEQ ID NO: 381013 - DNA, 12 bp, Homo sapiens
agcccctcccca

SEQ ID NO: 381014 - DNA, 17 bp, Homo sapiens
agcccctccccagccag

SEQ ID NO: 381015 - DNA, 22 bp, Homo sapiens
agcccctccccagccagccctt

SEQ ID NO: 381016 - DNA, 11 bp, Homo sapiens
agcccctcctc

SEQ ID NO: 381017 - DNA, 17 bp, Homo sapiens
agcccctcctctcctcg

SEQ ID NO: 381018 - DNA, 12 bp, Homo sapiens
agcccctgtgtc

SEQ ID NO: 381019 - DNA, 13 bp, Homo sapiens
agcccctgtgttg

SEQ ID NO: 381020 - DNA, 22 bp, Homo sapiens
agcccctttttcatatgttgct

SEQ ID NO: 381021 - DNA, 17 bp, Homo sapiens
agcccgatattctccct

SEQ ID NO: 381022 - DNA, 20 bp, Homo sapiens
agcccgatattctccctgac

SEQ ID NO: 381023 - DNA, 22 bp, Homo sapiens
agcccgatattctccctgacct

SEQ ID NO: 381024 - DNA, 17 bp, Homo sapiens
agcccgatccacattgc

SEQ ID NO: 381025 - DNA, 16 bp, Homo sapiens
agcccgcacccccacc

SEQ ID NO: 381026 - DNA, 19 bp, Homo sapiens
agcccgcacccccaccctt

SEQ ID NO: 381027 - DNA, 21 bp, Homo sapiens
agcccgcacccccaccctttg

SEQ ID NO: 381028 - DNA, 20 bp, Homo sapiens
agcccgcatgcagcagcttg

SEQ ID NO: 381029 - DNA, 14 bp, Homo sapiens
agcccgcccacctg

SEQ ID NO: 381030 - DNA, 18 bp, Homo sapiens
agcccgcccacctgggcc

SEQ ID NO: 381031 - DNA, 20 bp, Homo sapiens
agcccgccgtcagggtggct

SEQ ID NO: 381032 - DNA, 19 bp, Homo sapiens
agcccggatgcccacccct

SEQ ID NO: 381033 - DNA, 19 bp, Homo sapiens
agcccggcagtgcaccccc

SEQ ID NO: 381034 - DNA, 15 bp, Homo sapiens
agcccggccaaggac

SEQ ID NO: 381035 - DNA, 20 bp, Homo sapiens
agcccggccaaggacactga

SEQ ID NO: 381036 - DNA, 21 bp, Homo sapiens
agcccggccaaggacactgat

SEQ ID NO: 381037 - DNA, 19 bp, Homo sapiens
agcccggcctgctcccagc

SEQ ID NO: 381038 - DNA, 21 bp, Homo sapiens
agcccggcctgctcccagcag

SEQ ID NO: 381039 - DNA, 20 bp, Homo sapiens
agcccggcgccaccatcctg

SEQ ID NO: 381040 - DNA, 21 bp, Homo sapiens
agcccggggcagagctcagag

SEQ ID NO: 381041 - DNA, 17 bp, Homo sapiens
agcccgtcatcttccct

SEQ ID NO: 381042 - DNA, 17 bp, Homo sapiens
attgcttctctaaaaca

SEQ ID NO: 381043 - DNA, 15 bp, Homo sapiens
attgcttctgtagta

SEQ ID NO: 381044 - DNA, 22 bp, Homo sapiens
attgcttctgtagtactcctta

SEQ ID NO: 381045 - DNA, 21 bp, Homo sapiens
attgcttggactacctataaa

SEQ ID NO: 381046 - DNA, 21 bp, Homo sapiens
attgctttgaagcagttgtgt

SEQ ID NO: 381047 - DNA, 18 bp, Homo sapiens
attgctttggtcatatga

SEQ ID NO: 381048 - DNA, 13 bp, Homo sapiens
attgcttttatta

SEQ ID NO: 381049 - DNA, 20 bp, Homo sapiens
attgcttttgttgtgacttt

SEQ ID NO: 381050 - DNA, 15 bp, Homo sapiens
attggaaaaaattag

SEQ ID NO: 381051 - DNA, 13 bp, Homo sapiens
attggaaagacag

SEQ ID NO: 381052 - DNA, 16 bp, Homo sapiens
attggaagaccccacc

SEQ ID NO: 381053 - DNA, 23 bp, Homo sapiens
attggaagctgattcccagagca

SEQ ID NO: 381054 - DNA, 12 bp, Homo sapiens
attggaattaac

SEQ ID NO: 381055 - DNA, 14 bp, Homo sapiens
attggaattaacct

SEQ ID NO: 381056 - DNA, 16 bp, Homo sapiens
attggacatggtctcc

SEQ ID NO: 381057 - DNA, 18 bp, Homo sapiens
attggcacccctttctag

SEQ ID NO: 381058 - DNA, 17 bp, Homo sapiens
attggcagcttcaaaac

SEQ ID NO: 381059 - DNA, 23 bp, Homo sapiens
attggcagcttcaaaacagaacg

SEQ ID NO: 381060 - DNA, 13 bp, Homo sapiens
attggccactggg

SEQ ID NO: 381061 - DNA, 22 bp, Homo sapiens
attggccctgacaaaaaggtgc

SEQ ID NO: 381062 - DNA, 15 bp, Homo sapiens
attggctataacatg

SEQ ID NO: 381063 - DNA, 21 bp, Homo sapiens
attggctcctttcccacagtc

SEQ ID NO: 381064 - DNA, 14 bp, Homo sapiens
attggctttgtgct

SEQ ID NO: 381065 - DNA, 16 bp, Homo sapiens
attggcttttcatgcg

SEQ ID NO: 381066 - DNA, 21 bp, Homo sapiens
attggctttttaaattttcca

SEQ ID NO: 381067 - DNA, 16 bp, Homo sapiens
attgggggccctgggg

SEQ ID NO: 381068 - DNA, 17 bp, Homo sapiens
attgggtagctatactc

SEQ ID NO: 381069 - DNA, 17 bp, Homo sapiens
attgggtgtgccctggc

SEQ ID NO: 381070 - DNA, 16 bp, Homo sapiens
attgggttttatcagt

SEQ ID NO: 381071 - DNA, 20 bp, Homo sapiens
attggtccaacagtttgatg

SEQ ID NO: 381072 - DNA, 15 bp, Homo sapiens
attggtgataagtgg

SEQ ID NO: 381073 - DNA, 17 bp, Homo sapiens
attggtggttctcagca

SEQ ID NO: 381074 - DNA, 13 bp, Homo sapiens
attggtgtatatc

SEQ ID NO: 381075 - DNA, 17 bp, Homo sapiens
attggttccctttgctc

SEQ ID NO: 381076 - DNA, 15 bp, Homo sapiens
attggttctatttat

SEQ ID NO: 381077 - DNA, 17 bp, Homo sapiens
attggtttctgtttgaa

SEQ ID NO: 381078 - DNA, 23 bp, Homo sapiens
attggtttgttattcttttccag

SEQ ID NO: 381079 - DNA, 21 bp, Homo sapiens
attgtaaaacctgtcaatgat

SEQ ID NO: 381080 - DNA, 22 bp, Homo sapiens
attgtaaaatagcttgtatagt

SEQ ID NO: 381081 - DNA, 17 bp, Homo sapiens
attgtaaaattgtatag

SEQ ID NO: 381082 - DNA, 15 bp, Homo sapiens
attgtaaactttttc

SEQ ID NO: 381083 - DNA, 16 bp, Homo sapiens
attgtaaatacaagtt

SEQ ID NO: 381084 - DNA, 23 bp, Homo sapiens
attgtaaatacaagttctattta

SEQ ID NO: 381085 - DNA, 14 bp, Homo sapiens
attgtaaatagtat

SEQ ID NO: 381086 - DNA, 21 bp, Homo sapiens
attgtaaatgtttaatatctg

SEQ ID NO: 381087 - DNA, 15 bp, Homo sapiens
attgtaaggaatgat

SEQ ID NO: 381088 - DNA, 16 bp, Homo sapiens
attgtaaggaatgatt

SEQ ID NO: 381089 - DNA, 21 bp, Homo sapiens
attgtaatctttcatagccat

SEQ ID NO: 381090 - DNA, 16 bp, Homo sapiens
attgtacagctgttta

SEQ ID NO: 381091 - DNA, 20 bp, Homo sapiens
attgtacagctgtttaagat

SEQ ID NO: 381092 - DNA, 19 bp, Homo sapiens
attgtacatatggaaatcc

SEQ ID NO: 381093 - DNA, 12 bp, Homo sapiens
attgtacctctc

SEQ ID NO: 381094 - DNA, 18 bp, Homo sapiens
attgtactccagcctggg

SEQ ID NO: 381095 - DNA, 15 bp, Homo sapiens
attgtagcatttctt

SEQ ID NO: 381096 - DNA, 15 bp, Homo sapiens
attgtaggtgcaagc

SEQ ID NO: 381097 - DNA, 22 bp, Homo sapiens
attgtataaactatcagtttgt

SEQ ID NO: 381098 - DNA, 22 bp, Homo sapiens
attgtatagagatatgcagaag

SEQ ID NO: 381099 - DNA, 13 bp, Homo sapiens
attgtataggcca

SEQ ID NO: 381100 - DNA, 18 bp, Homo sapiens
attgtataggccatctgt

SEQ ID NO: 381101 - DNA, 19 bp, Homo sapiens
attgtataggccatctgta

SEQ ID NO: 381102 - DNA, 20 bp, Homo sapiens
attgtataggccatctgtaa

SEQ ID NO: 381103 - DNA, 13 bp, Homo sapiens
attgtatatatgt

SEQ ID NO: 381104 - DNA, 14 bp, Homo sapiens
attgtatctagtgc

SEQ ID NO: 381105 - DNA, 15 bp, Homo sapiens
attgtatctagtgca

SEQ ID NO: 381106 - DNA, 21 bp, Homo sapiens
attgtatctagtgcagctgat

SEQ ID NO: 381107 - DNA, 12 bp, Homo sapiens
attgtatgaaaa

SEQ ID NO: 381108 - DNA, 13 bp, Homo sapiens
attgtatgaaaat

SEQ ID NO: 381109 - DNA, 12 bp, Homo sapiens
attgtatgatgt

SEQ ID NO: 381110 - DNA, 14 bp, Homo sapiens
attgtatgtacctg

SEQ ID NO: 381111 - DNA, 15 bp, Homo sapiens
attgtattatttgga

SEQ ID NO: 381112 - DNA, 17 bp, Homo sapiens
attgtattatttggagt

SEQ ID NO: 381113 - DNA, 13 bp, Homo sapiens
attgtattcctca

SEQ ID NO: 381114 - DNA, 17 bp, Homo sapiens
attgtcaaaaaccagaa

SEQ ID NO: 381115 - DNA, 16 bp, Homo sapiens
attgtcaaagtggtga

SEQ ID NO: 381116 - DNA, 14 bp, Homo sapiens
attgtcaaatgtca

SEQ ID NO: 381117 - DNA, 17 bp, Homo sapiens
attgtccacaaatgtcc

SEQ ID NO: 381118 - DNA, 22 bp, Homo sapiens
attgtccatatcagacctctga

SEQ ID NO: 381119 - DNA, 23 bp, Homo sapiens
attgtccatatcagacctctgat

SEQ ID NO: 381120 - DNA, 20 bp, Homo sapiens
attgtcgtttcattcatttt

SEQ ID NO: 381121 - DNA, 20 bp, Homo sapiens
attgtctgacacatgctctc

SEQ ID NO: 381122 - DNA, 17 bp, Homo sapiens
attgtgaaagctccatg

SEQ ID NO: 381123 - DNA, 15 bp, Homo sapiens
attgtgaacagccaa

SEQ ID NO: 381124 - DNA, 17 bp, Homo sapiens
attgtgaactcattgct

SEQ ID NO: 381125 - DNA, 14 bp, Homo sapiens
attgtgaagtacat

SEQ ID NO: 381126 - DNA, 19 bp, Homo sapiens
attgtgaattgataataaa

SEQ ID NO: 381127 - DNA, 15 bp, Homo sapiens
attgtgaccaagtta

SEQ ID NO: 381128 - DNA, 16 bp, Homo sapiens
attgtgaccaagttat

SEQ ID NO: 381129 - DNA, 16 bp, Homo sapiens
attgtgagccaccacg

SEQ ID NO: 381130 - DNA, 16 bp, Homo sapiens
attgtgagggacatgc

SEQ ID NO: 381131 - DNA, 22 bp, Homo sapiens
attgtgcatgcaaaccaggagc

SEQ ID NO: 381132 - DNA, 16 bp, Homo sapiens
attgtgccaatatgta

SEQ ID NO: 381133 - DNA, 19 bp, Homo sapiens
attgtggctcctatctgtg

SEQ ID NO: 381134 - DNA, 21 bp, Homo sapiens
attgtgggacttattacaatt

SEQ ID NO: 381135 - DNA, 16 bp, Homo sapiens
attgtgtaaaggaaca

SEQ ID NO: 381136 - DNA, 14 bp, Homo sapiens
attgtgtctgcatt

SEQ ID NO: 381137 - DNA, 16 bp, Homo sapiens
attgtgtctgtggtcc

SEQ ID NO: 381138 - DNA, 15 bp, Homo sapiens
attgtgtgagcttct

SEQ ID NO: 381139 - DNA, 13 bp, Homo sapiens
attgtgtgatgtt

SEQ ID NO: 381140 - DNA, 17 bp, Homo sapiens
attgtgtgtcttcagga

SEQ ID NO: 381141 - DNA, 17 bp, Homo sapiens
attgtgttgtgaatgtt

SEQ ID NO: 381142 - DNA, 13 bp, Homo sapiens
attgttaaaacct

SEQ ID NO: 381143 - DNA, 17 bp, Homo sapiens
attgttaactcttgtct

SEQ ID NO: 381144 - DNA, 23 bp, Homo sapiens
attgttaagtctaaatatttcct

SEQ ID NO: 381145 - DNA, 20 bp, Homo sapiens
attgttaatattaatttata

SEQ ID NO: 381146 - DNA, 14 bp, Homo sapiens
attgttacaatttt

SEQ ID NO: 381147 - DNA, 22 bp, Homo sapiens
attgttcaaagaacccccctcc

SEQ ID NO: 381148 - DNA, 12 bp, Homo sapiens
attgttcagaag

SEQ ID NO: 381149 - DNA, 13 bp, Homo sapiens
attgttcagaaga

SEQ ID NO: 381150 - DNA, 14 bp, Homo sapiens
attgttccaagaca

SEQ ID NO: 381151 - DNA, 18 bp, Homo sapiens
attgttccaagacattgt

SEQ ID NO: 381152 - DNA, 16 bp, Homo sapiens
attgttcccagtgaca

SEQ ID NO: 381153 - DNA, 21 bp, Homo sapiens
attgttcccagtgacacttca

SEQ ID NO: 381154 - DNA, 15 bp, Homo sapiens
attgttcctctttgt

SEQ ID NO: 381155 - DNA, 17 bp, Homo sapiens
attgttctgggtgattt

SEQ ID NO: 381156 - DNA, 23 bp, Homo sapiens
attgttgaggtggtctgaatgtt

SEQ ID NO: 381157 - DNA, 21 bp, Homo sapiens
attgttgatgggcacttgaga

SEQ ID NO: 381158 - DNA, 15 bp, Homo sapiens
attgtttaattgtag

SEQ ID NO: 381159 - DNA, 18 bp, Homo sapiens
attgtttatttatcagtg

SEQ ID NO: 381160 - DNA, 15 bp, Homo sapiens
attgtttgcttattg

SEQ ID NO: 381161 - DNA, 18 bp, Homo sapiens
attgtttgcttattgttc

SEQ ID NO: 381162 - DNA, 16 bp, Homo sapiens
attgtttgtctttaac

SEQ ID NO: 381163 - DNA, 19 bp, Homo sapiens
attgttttattttggaatt

SEQ ID NO: 381164 - DNA, 14 bp, Homo sapiens
attgtttttatata

SEQ ID NO: 381165 - DNA, 16 bp, Homo sapiens
attgtttttgaattta

SEQ ID NO: 381166 - DNA, 20 bp, Homo sapiens
attgtttttgaatttaaata

SEQ ID NO: 381167 - DNA, 17 bp, Homo sapiens
atttaaaaaactcctgt

SEQ ID NO: 381168 - DNA, 20 bp, Homo sapiens
atttaaaaaactcctgtctt

SEQ ID NO: 381169 - DNA, 13 bp, Homo sapiens
atttaaaaaataa

SEQ ID NO: 381170 - DNA, 19 bp, Homo sapiens
atttaaaaaatgaatagta

SEQ ID NO: 381171 - DNA, 14 bp, Homo sapiens
atttaaaaactgga

SEQ ID NO: 381172 - DNA, 15 bp, Homo sapiens
atttaaaaactggaa

SEQ ID NO: 381173 - DNA, 16 bp, Homo sapiens
atttaaaaatctttca

SEQ ID NO: 381174 - DNA, 20 bp, Homo sapiens
atttaaaaatctttcagaat

SEQ ID NO: 381175 - DNA, 20 bp, Homo sapiens
atttaaaaatgcatgataat

SEQ ID NO: 381176 - DNA, 21 bp, Homo sapiens
atttaaaaatgcatgataatg

SEQ ID NO: 381177 - DNA, 16 bp, Homo sapiens
agcaccacggggtcgg

SEQ ID NO: 381178 - DNA, 15 bp, Homo sapiens
agcaccagcctgagc

SEQ ID NO: 381179 - DNA, 17 bp, Homo sapiens
agcaccagcctgagcca

SEQ ID NO: 381180 - DNA, 13 bp, Homo sapiens
agcaccagggaag

SEQ ID NO: 381181 - DNA, 23 bp, Homo sapiens
agcaccaggtgttaaaaaccatt

SEQ ID NO: 381182 - DNA, 12 bp, Homo sapiens
agcacccacagc

SEQ ID NO: 381183 - DNA, 13 bp, Homo sapiens
agcacccacgtga

SEQ ID NO: 381184 - DNA, 14 bp, Homo sapiens
agcaccccaaggct

SEQ ID NO: 381185 - DNA, 18 bp, Homo sapiens
agcacccccacccacctc

SEQ ID NO: 381186 - DNA, 19 bp, Homo sapiens
agcacccccacccacctcc

SEQ ID NO: 381187 - DNA, 20 bp, Homo sapiens
agcacccccacccacctcca

SEQ ID NO: 381188 - DNA, 20 bp, Homo sapiens
agcacccccagcctccccca

SEQ ID NO: 381189 - DNA, 12 bp, Homo sapiens
agcaccctgggt

SEQ ID NO: 381190 - DNA, 19 bp, Homo sapiens
agcaccgtggtgtgaggcc

SEQ ID NO: 381191 - DNA, 21 bp, Homo sapiens
agcaccgtggtgtgaggcccc

SEQ ID NO: 381192 - DNA, 22 bp, Homo sapiens
agcaccgtggtgtgaggccccc

SEQ ID NO: 381193 - DNA, 13 bp, Homo sapiens
agcacctgaaccc

SEQ ID NO: 381194 - DNA, 15 bp, Homo sapiens
agcacctgccagggc

SEQ ID NO: 381195 - DNA, 18 bp, Homo sapiens
agcacctggagcccacag

SEQ ID NO: 381196 - DNA, 14 bp, Homo sapiens
agcacctgtaagaa

SEQ ID NO: 381197 - DNA, 13 bp, Homo sapiens
agcacctgttttt

SEQ ID NO: 381198 - DNA, 18 bp, Homo sapiens
agcaccttcctcacttcc

SEQ ID NO: 381199 - DNA, 19 bp, Homo sapiens
agcaccttcctcacttcca

SEQ ID NO: 381200 - DNA, 20 bp, Homo sapiens
agcaccttcctcacttccat

SEQ ID NO: 381201 - DNA, 20 bp, Homo sapiens
agcacgggcaaagaaaacac

SEQ ID NO: 381202 - DNA, 18 bp, Homo sapiens
agcacgggcacagctgct

SEQ ID NO: 381203 - DNA, 13 bp, Homo sapiens
agcacgtggagat

SEQ ID NO: 381204 - DNA, 22 bp, Homo sapiens
agcacgtggagatagtgccagg

SEQ ID NO: 381205 - DNA, 20 bp, Homo sapiens
agcactacttacttagagat

SEQ ID NO: 381206 - DNA, 21 bp, Homo sapiens
agcactcacatgctggacagg

SEQ ID NO: 381207 - DNA, 18 bp, Homo sapiens
agcactcacgccctaagc

SEQ ID NO: 381208 - DNA, 19 bp, Homo sapiens
agcactcccagggcccgag

SEQ ID NO: 381209 - DNA, 18 bp, Homo sapiens
agcactcgagaccatcct

SEQ ID NO: 381210 - DNA, 19 bp, Homo sapiens
agcactcgagaccatcctg

SEQ ID NO: 381211 - DNA, 22 bp, Homo sapiens
agcactcgagaccatcctggcc

SEQ ID NO: 381212 - DNA, 23 bp, Homo sapiens
agcactctgagtttaccatttgt

SEQ ID NO: 381213 - DNA, 16 bp, Homo sapiens
agcactcttaaagcaa

SEQ ID NO: 381214 - DNA, 12 bp, Homo sapiens
agcactgacact

SEQ ID NO: 381215 - DNA, 19 bp, Homo sapiens
agcactggagtgcagggag

SEQ ID NO: 381216 - DNA, 23 bp, Homo sapiens
agcactggagtgcagggaggaga

SEQ ID NO: 381217 - DNA, 12 bp, Homo sapiens
agcactggccag

SEQ ID NO: 381218 - DNA, 16 bp, Homo sapiens
agcactggccagagag

SEQ ID NO: 381219 - DNA, 20 bp, Homo sapiens
agcactggccagagagggcc

SEQ ID NO: 381220 - DNA, 13 bp, Homo sapiens
agcactggctctc

SEQ ID NO: 381221 - DNA, 17 bp, Homo sapiens
agcactggctctctcca

SEQ ID NO: 381222 - DNA, 18 bp, Homo sapiens
agcactggctctctccag

SEQ ID NO: 381223 - DNA, 23 bp, Homo sapiens
agcactgggctaatttgtatgtt

SEQ ID NO: 381224 - DNA, 19 bp, Homo sapiens
agcactgggttgcagggga

SEQ ID NO: 381225 - DNA, 19 bp, Homo sapiens
agcactgtcccttgcctca

SEQ ID NO: 381226 - DNA, 17 bp, Homo sapiens
agcacttcacacagaca

SEQ ID NO: 381227 - DNA, 16 bp, Homo sapiens
agcacttccaaaattc

SEQ ID NO: 381228 - DNA, 18 bp, Homo sapiens
agcacttccaaaattctt

SEQ ID NO: 381229 - DNA, 16 bp, Homo sapiens
agcacttgcgtcctgc

SEQ ID NO: 381230 - DNA, 20 bp, Homo sapiens
agcacttgcgtcctgcagag

SEQ ID NO: 381231 - DNA, 22 bp, Homo sapiens
agcactttgaaaatatttctat

SEQ ID NO: 381232 - DNA, 15 bp, Homo sapiens
agcactttgggaggc

SEQ ID NO: 381233 - DNA, 18 bp, Homo sapiens
agcactttgggaggctga

SEQ ID NO: 381234 - DNA, 16 bp, Homo sapiens
agcagaaacccccagg

SEQ ID NO: 381235 - DNA, 21 bp, Homo sapiens
agcagaaacccccaggaggag

SEQ ID NO: 381236 - DNA, 16 bp, Homo sapiens
agcagaagtggagctg

SEQ ID NO: 381237 - DNA, 22 bp, Homo sapiens
agcagacactccagtttgccca

SEQ ID NO: 381238 - DNA, 17 bp, Homo sapiens
agcagacagcaagggct

SEQ ID NO: 381239 - DNA, 20 bp, Homo sapiens
agcagacgcagcagctggga

SEQ ID NO: 381240 - DNA, 23 bp, Homo sapiens
agcagacgcagcagctgggaccc

SEQ ID NO: 381241 - DNA, 21 bp, Homo sapiens
agcagagaattctcttatcca

SEQ ID NO: 381242 - DNA, 15 bp, Homo sapiens
agcagagacactaac

SEQ ID NO: 381243 - DNA, 18 bp, Homo sapiens
agcagagacggcagcccc

SEQ ID NO: 381244 - DNA, 13 bp, Homo sapiens
agcagagcactgt

SEQ ID NO: 381245 - DNA, 20 bp, Homo sapiens
agcagagccgttcctgggac

SEQ ID NO: 381246 - DNA, 15 bp, Homo sapiens
agcagagtcattgtt

SEQ ID NO: 381247 - DNA, 14 bp, Homo sapiens
agcagagtctgggc

SEQ ID NO: 381248 - DNA, 16 bp, Homo sapiens
agcagagtctgggcct

SEQ ID NO: 381249 - DNA, 19 bp, Homo sapiens
agcagagtctgggcctctg

SEQ ID NO: 381250 - DNA, 19 bp, Homo sapiens
agcagagttattgaatctt

SEQ ID NO: 381251 - DNA, 23 bp, Homo sapiens
agcagagttctttgcaagcttat

SEQ ID NO: 381252 - DNA, 22 bp, Homo sapiens
agcagatacatatgagtgtgga

SEQ ID NO: 381253 - DNA, 20 bp, Homo sapiens
agcagatcagtctttgtcaa

SEQ ID NO: 381254 - DNA, 17 bp, Homo sapiens
agcagatgacccctccc

SEQ ID NO: 381255 - DNA, 19 bp, Homo sapiens
agcagatggagaccccttg

SEQ ID NO: 381256 - DNA, 21 bp, Homo sapiens
agcagattttaattttgaata

SEQ ID NO: 381257 - DNA, 18 bp, Homo sapiens
agcagcacaattctgtcc

SEQ ID NO: 381258 - DNA, 22 bp, Homo sapiens
agcagcagctaggactgaggag

SEQ ID NO: 381259 - DNA, 10 bp, Homo sapiens
agcagccagc

SEQ ID NO: 381260 - DNA, 16 bp, Homo sapiens
agcagccagccagtct

SEQ ID NO: 381261 - DNA, 12 bp, Homo sapiens
agcagcccagct

SEQ ID NO: 381262 - DNA, 13 bp, Homo sapiens
agcagcccagctt

SEQ ID NO: 381263 - DNA, 16 bp, Homo sapiens
agcagccccctgcccg

SEQ ID NO: 381264 - DNA, 14 bp, Homo sapiens
agcagccctaagga

SEQ ID NO: 381265 - DNA, 18 bp, Homo sapiens
agcagccctaaggatctc

SEQ ID NO: 381266 - DNA, 14 bp, Homo sapiens
agcagcctctgcca

SEQ ID NO: 381267 - DNA, 16 bp, Homo sapiens
agcagcctctgccagg

SEQ ID NO: 381268 - DNA, 19 bp, Homo sapiens
agcagcctctgtcctggct

SEQ ID NO: 381269 - DNA, 13 bp, Homo sapiens
agcagcctgtgag

SEQ ID NO: 381270 - DNA, 18 bp, Homo sapiens
agcagcgcttcctggctg

SEQ ID NO: 381271 - DNA, 17 bp, Homo sapiens
agcagctaaattttctg

SEQ ID NO: 381272 - DNA, 13 bp, Homo sapiens
agcagctcaggcg

SEQ ID NO: 381273 - DNA, 17 bp, Homo sapiens
agcagctcaggcgcagc

SEQ ID NO: 381274 - DNA, 23 bp, Homo sapiens
agcagctcaggcgcagccctagt

SEQ ID NO: 381275 - DNA, 13 bp, Homo sapiens
agcagctccccag

SEQ ID NO: 381276 - DNA, 18 bp, Homo sapiens
agcagctccccaggagct

SEQ ID NO: 381277 - DNA, 17 bp, Homo sapiens
agcagctccgcctggca

SEQ ID NO: 381278 - DNA, 21 bp, Homo sapiens
agcagctgaagtctctttttc

SEQ ID NO: 381279 - DNA, 15 bp, Homo sapiens
agcagctgcattttt

SEQ ID NO: 381280 - DNA, 12 bp, Homo sapiens
agcagctgcggg

SEQ ID NO: 381281 - DNA, 17 bp, Homo sapiens
agcagctgcgggtctga

SEQ ID NO: 381282 - DNA, 21 bp, Homo sapiens
agcagctgcgggtctgaagga

SEQ ID NO: 381283 - DNA, 20 bp, Homo sapiens
agcagctggctctccacctt

SEQ ID NO: 381284 - DNA, 12 bp, Homo sapiens
agcagctgggca

SEQ ID NO: 381285 - DNA, 16 bp, Homo sapiens
agcagctgggcactgg

SEQ ID NO: 381286 - DNA, 15 bp, Homo sapiens
agcagctgtgctgca

SEQ ID NO: 381287 - DNA, 24 bp, Homo sapiens
agcagctgttcaacaagagtaaat

SEQ ID NO: 381288 - DNA, 18 bp, Homo sapiens
agcagcttcaccagagca

SEQ ID NO: 381289 - DNA, 13 bp, Homo sapiens
atgtaaaatcttc

SEQ ID NO: 381290 - DNA, 15 bp, Homo sapiens
atgtaaaatcttcag

SEQ ID NO: 381291 - DNA, 18 bp, Homo sapiens
atgtaaaatcttcagctg

SEQ ID NO: 381292 - DNA, 20 bp, Homo sapiens
atgtaaaatcttcagctggt

SEQ ID NO: 381293 - DNA, 14 bp, Homo sapiens
atgtaaaatcttgt

SEQ ID NO: 381294 - DNA, 15 bp, Homo sapiens
atgtaaaatcttgtc

SEQ ID NO: 381295 - DNA, 21 bp, Homo sapiens
atgtaaaatcttgtcatgtgt

SEQ ID NO: 381296 - DNA, 14 bp, Homo sapiens
atgtaaaattcata

SEQ ID NO: 381297 - DNA, 14 bp, Homo sapiens
atgtaaacaggaga

SEQ ID NO: 381298 - DNA, 19 bp, Homo sapiens
atgtaaacattcatatttg

SEQ ID NO: 381299 - DNA, 15 bp, Homo sapiens
atgtaaactcttcac

SEQ ID NO: 381300 - DNA, 19 bp, Homo sapiens
atgtaaagacaaaaaacta

SEQ ID NO: 381301 - DNA, 13 bp, Homo sapiens
atgtaaagtatgt

SEQ ID NO: 381302 - DNA, 17 bp, Homo sapiens
atgtaaattattgtaaa

SEQ ID NO: 381303 - DNA, 13 bp, Homo sapiens
atgtaaatttgta

SEQ ID NO: 381304 - DNA, 21 bp, Homo sapiens
atgtaaatttgtactatttaa

SEQ ID NO: 381305 - DNA, 21 bp, Homo sapiens
atgtaaccaagagtattccat

SEQ ID NO: 381306 - DNA, 14 bp, Homo sapiens
atgtaaccaagctg

SEQ ID NO: 381307 - DNA, 18 bp, Homo sapiens
atgtcttgagatgtatta

SEQ ID NO: 381308 - DNA, 15 bp, Homo sapiens
atgtctttaaaatga

SEQ ID NO: 381309 - DNA, 14 bp, Homo sapiens
atgtgaaagtgtaa

SEQ ID NO: 381310 - DNA, 17 bp, Homo sapiens
atgtgaaagtgtaaaat

SEQ ID NO: 381311 - DNA, 20 bp, Homo sapiens
atgtgaaatttacatcattt

SEQ ID NO: 381312 - DNA, 13 bp, Homo sapiens
atgtgaacccggg

SEQ ID NO: 381313 - DNA, 17 bp, Homo sapiens
atgtgaagcatgctttg

SEQ ID NO: 381314 - DNA, 20 bp, Homo sapiens
atgtgaagcatgctttgctg

SEQ ID NO: 381315 - DNA, 22 bp, Homo sapiens
atgtgaagcatgctttgctgct

SEQ ID NO: 381316 - DNA, 20 bp, Homo sapiens
atgtgaatgatctctctgaa

SEQ ID NO: 381317 - DNA, 17 bp, Homo sapiens
atgtgaattctgtgaag

SEQ ID NO: 381318 - DNA, 19 bp, Homo sapiens
atgtgaattctgtgaagaa

SEQ ID NO: 381319 - DNA, 20 bp, Homo sapiens
atgtgaattctgtgaagaat

SEQ ID NO: 381320 - DNA, 20 bp, Homo sapiens
atgtgaattgaagtcatcat

SEQ ID NO: 381321 - DNA, 18 bp, Homo sapiens
atgtgacaacctttgtgt

SEQ ID NO: 381322 - DNA, 20 bp, Homo sapiens
atgtgacaacctttgtgtaa

SEQ ID NO: 381323 - DNA, 18 bp, Homo sapiens
atgtgacaattttgtaca

SEQ ID NO: 381324 - DNA, 21 bp, Homo sapiens
atgtgacaattttgtacaaat

SEQ ID NO: 381325 - DNA, 14 bp, Homo sapiens
atgtgacccaccag

SEQ ID NO: 381326 - DNA, 13 bp, Homo sapiens
atgtgagaccatt

SEQ ID NO: 381327 - DNA, 14 bp, Homo sapiens
atgtgagagaaagt

SEQ ID NO: 381328 - DNA, 14 bp, Homo sapiens
atgtgagctataat

SEQ ID NO: 381329 - DNA, 14 bp, Homo sapiens
atgtgatatgtgta

SEQ ID NO: 381330 - DNA, 23 bp, Homo sapiens
atgtgatatgtgtaatatcattt

SEQ ID NO: 381331 - DNA, 15 bp, Homo sapiens
atgtgatcatctttg

SEQ ID NO: 381332 - DNA, 15 bp, Homo sapiens
atgtgattggcagct

SEQ ID NO: 381333 - DNA, 19 bp, Homo sapiens
atgtgattggcagcttcaa

SEQ ID NO: 381334 - DNA, 23 bp, Homo sapiens
atgtgattggcagcttcaaaaca

SEQ ID NO: 381335 - DNA, 16 bp, Homo sapiens
atgtgatttatgcatt

SEQ ID NO: 381336 - DNA, 20 bp, Homo sapiens
atgtgatttatttatttcta

SEQ ID NO: 381337 - DNA, 13 bp, Homo sapiens
atgtgcaattgtg

SEQ ID NO: 381338 - DNA, 15 bp, Homo sapiens
atgtgcactgtcact

SEQ ID NO: 381339 - DNA, 17 bp, Homo sapiens
atgtgcatcaggaaaca

SEQ ID NO: 381340 - DNA, 21 bp, Homo sapiens
atgtgcatttcacctgtgaca

SEQ ID NO: 381341 - DNA, 22 bp, Homo sapiens
atgtgcatttcacctgtgacaa

SEQ ID NO: 381342 - DNA, 14 bp, Homo sapiens
atgtgccatctgta

SEQ ID NO: 381343 - DNA, 14 bp, Homo sapiens
atgtgcccagagta

SEQ ID NO: 381344 - DNA, 16 bp, Homo sapiens
atgtgcccagagtagc

SEQ ID NO: 381345 - DNA, 21 bp, Homo sapiens
atgtgcccagagtagcccagg

SEQ ID NO: 381346 - DNA, 19 bp, Homo sapiens
atgtgcccagttaatcttg

SEQ ID NO: 381347 - DNA, 12 bp, Homo sapiens
atgtgcccccag

SEQ ID NO: 381348 - DNA, 21 bp, Homo sapiens
atgtgccgtgttattgtatta

SEQ ID NO: 381349 - DNA, 15 bp, Homo sapiens
atgtgcctgcaccag

SEQ ID NO: 381350 - DNA, 17 bp, Homo sapiens
atgtgcctgcgttctga

SEQ ID NO: 381351 - DNA, 13 bp, Homo sapiens
atgtgcctgtcac

SEQ ID NO: 381352 - DNA, 14 bp, Homo sapiens
atgtgcgtgtgtgc

SEQ ID NO: 381353 - DNA, 17 bp, Homo sapiens
atgtgctcatcagaaac

SEQ ID NO: 381354 - DNA, 22 bp, Homo sapiens
atgtgctgttgattctttcaat

SEQ ID NO: 381355 - DNA, 14 bp, Homo sapiens
atgtgctttgtagc

SEQ ID NO: 381356 - DNA, 17 bp, Homo sapiens
atgtggaaagtgaattt

SEQ ID NO: 381357 - DNA, 19 bp, Homo sapiens
atgtggaaagtgaatttga

SEQ ID NO: 381358 - DNA, 14 bp, Homo sapiens
atgtggaagcaggt

SEQ ID NO: 381359 - DNA, 17 bp, Homo sapiens
atgtggacttgtatgct

SEQ ID NO: 381360 - DNA, 18 bp, Homo sapiens
atgtggacttgtatgctg

SEQ ID NO: 381361 - DNA, 16 bp, Homo sapiens
atgtggagtggggcag

SEQ ID NO: 381362 - DNA, 20 bp, Homo sapiens
atgtggagttcatcttgaat

SEQ ID NO: 381363 - DNA, 24 bp, Homo sapiens
atgtggagttcatcttgaattgta

SEQ ID NO: 381364 - DNA, 17 bp, Homo sapiens
atgtggcaaagtgctgt

SEQ ID NO: 381365 - DNA, 20 bp, Homo sapiens
atgtggcaaagtgctgtacc

SEQ ID NO: 381366 - DNA, 15 bp, Homo sapiens
atgtggcagaagtgc

SEQ ID NO: 381367 - DNA, 22 bp, Homo sapiens
atgtggcagctggggagcagct

SEQ ID NO: 381368 - DNA, 17 bp, Homo sapiens
atgtggccccaggtgcc

SEQ ID NO: 381369 - DNA, 11 bp, Homo sapiens
atgtggctgaa

SEQ ID NO: 381370 - DNA, 17 bp, Homo sapiens
atgtggcttcttcaact

SEQ ID NO: 381371 - DNA, 13 bp, Homo sapiens
atgtggcttttat

SEQ ID NO: 381372 - DNA, 17 bp, Homo sapiens
atgtggcttttatttca

SEQ ID NO: 381373 - DNA, 15 bp, Homo sapiens
atgtgggaagaaaca

SEQ ID NO: 381374 - DNA, 22 bp, Homo sapiens
atgtgggaatctcccagacttg

SEQ ID NO: 381375 - DNA, 18 bp, Homo sapiens
atgtgggattatgggtca

SEQ ID NO: 381376 - DNA, 20 bp, Homo sapiens
atgtgggattatgggtcaca

SEQ ID NO: 381377 - DNA, 22 bp, Homo sapiens
atgtgggattatgggtcacagg

SEQ ID NO: 381378 - DNA, 13 bp, Homo sapiens
atgtggggccagg

SEQ ID NO: 381379 - DNA, 13 bp, Homo sapiens
atgtggtgcctga

SEQ ID NO: 381380 - DNA, 20 bp, Homo sapiens
atgtggtggcaataaatgtc

SEQ ID NO: 381381 - DNA, 15 bp, Homo sapiens
atgtggttacacact

SEQ ID NO: 381382 - DNA, 23 bp, Homo sapiens
atgtggttacttcctactgtagg

SEQ ID NO: 381383 - DNA, 19 bp, Homo sapiens
atgtgtaaatggagcttgt

SEQ ID NO: 381384 - DNA, 20 bp, Homo sapiens
atgtgtaaatggagcttgta

SEQ ID NO: 381385 - DNA, 17 bp, Homo sapiens
atgtgtaaatgttatga

SEQ ID NO: 381386 - DNA, 20 bp, Homo sapiens
atgtgtaaggatgagcagca

SEQ ID NO: 381387 - DNA, 13 bp, Homo sapiens
atgtgtaatatca

SEQ ID NO: 381388 - DNA, 17 bp, Homo sapiens
atgtgtactttattgat

SEQ ID NO: 381389 - DNA, 13 bp, Homo sapiens
atgtgtataaaaa

SEQ ID NO: 381390 - DNA, 14 bp, Homo sapiens
atgtgtatgtgttt

SEQ ID NO: 381391 - DNA, 15 bp, Homo sapiens
atgtgtcatgatttc

SEQ ID NO: 381392 - DNA, 17 bp, Homo sapiens
atgtgtcatgatttcaa

SEQ ID NO: 381393 - DNA, 17 bp, Homo sapiens
atgtgtccatgtgaaat

SEQ ID NO: 381394 - DNA, 21 bp, Homo sapiens
atgtgtccatgtgaaatttac

SEQ ID NO: 381395 - DNA, 22 bp, Homo sapiens
atgtgtcccagtgaacagtttg

SEQ ID NO: 381396 - DNA, 18 bp, Homo sapiens
atgtgtctgcaacatgga

SEQ ID NO: 381397 - DNA, 23 bp, Homo sapiens
atgtgtgagataacttccttcac

SEQ ID NO: 381398 - DNA, 16 bp, Homo sapiens
atgtgtgagtgtgtgc

SEQ ID NO: 381399 - DNA, 15 bp, Homo sapiens
atgtgtgcctgtggc

SEQ ID NO: 381400 - DNA, 18 bp, Homo sapiens
atgtgtgcctgtggcaga

SEQ ID NO: 381401 - DNA, 23 bp, Homo sapiens
atgtgtgcctgtggcagaaaaga

SEQ ID NO: 381402 - DNA, 18 bp, Homo sapiens
atgtgtgcgagtgtgtgc

SEQ ID NO: 381403 - DNA, 19 bp, Homo sapiens
atgtgtgcgagtgtgtgca

SEQ ID NO: 381404 - DNA, 15 bp, Homo sapiens
atgtgtggggcatgg

SEQ ID NO: 381405 - DNA, 20 bp, Homo sapiens
atgtgtggtgctaactgtat

SEQ ID NO: 381406 - DNA, 16 bp, Homo sapiens
atgtgtgtgcaagtgt

SEQ ID NO: 381407 - DNA, 15 bp, Homo sapiens
atgtgtgtgctcagg

SEQ ID NO: 381408 - DNA, 12 bp, Homo sapiens
atgtgtgtgtct

SEQ ID NO: 381409 - DNA, 15 bp, Homo sapiens
atgtgtgtgtctcta

SEQ ID NO: 381410 - DNA, 21 bp, Homo sapiens
atgtgtgtgtgtgtatgtgta

SEQ ID NO: 381411 - DNA, 20 bp, Homo sapiens
atgtgttgcaaattattcta

SEQ ID NO: 381412 - DNA, 22 bp, Homo sapiens
atgtgttgcaaattattctagt

SEQ ID NO: 381413 - DNA, 14 bp, Homo sapiens
atgtgttgtgatag

SEQ ID NO: 381414 - DNA, 17 bp, Homo sapiens
atgtgtttataattgtt

SEQ ID NO: 381415 - DNA, 21 bp, Homo sapiens
atgtgtttataattgttatac

SEQ ID NO: 381416 - DNA, 12 bp, Homo sapiens
atgtgtttccat

SEQ ID NO: 381417 - DNA, 18 bp, Homo sapiens
atgttaaagcatcagaga

SEQ ID NO: 381418 - DNA, 18 bp, Homo sapiens
atgttaacctcagtgtca

SEQ ID NO: 381419 - DNA, 21 bp, Homo sapiens
atgttaagcagctaaattttc

SEQ ID NO: 381420 - DNA, 14 bp, Homo sapiens
atgttaataaaggt

SEQ ID NO: 381421 - DNA, 22 bp, Homo sapiens
atgttaattaaagtaaaattat

SEQ ID NO: 381422 - DNA, 14 bp, Homo sapiens
atgttacattatta

SEQ ID NO: 381423 - DNA, 16 bp, Homo sapiens
atgttaccatcttact

SEQ ID NO: 381424 - DNA, 21 bp, Homo sapiens
atgttactgatcatgcattgt

SEQ ID NO: 381425 - DNA, 17 bp, Homo sapiens
atgttagaagtccaggc

SEQ ID NO: 381426 - DNA, 20 bp, Homo sapiens
atgttagccgggatggtctt

SEQ ID NO: 381427 - DNA, 16 bp, Homo sapiens
atgttaggagaactac

SEQ ID NO: 381428 - DNA, 15 bp, Homo sapiens
atgttagtcttaccg

SEQ ID NO: 381429 - DNA, 18 bp, Homo sapiens
atgttagtggcatatttg

SEQ ID NO: 381430 - DNA, 22 bp, Homo sapiens
atgttagtggcatatttgcttc

SEQ ID NO: 381431 - DNA, 21 bp, Homo sapiens
atgttatccaactattaagat

SEQ ID NO: 381432 - DNA, 11 bp, Homo sapiens
atgttatgaac

SEQ ID NO: 381433 - DNA, 13 bp, Homo sapiens
atgttattgaaaa

SEQ ID NO: 381434 - DNA, 14 bp, Homo sapiens
atgttattgttttc

SEQ ID NO: 381435 - DNA, 18 bp, Homo sapiens
atgttcaggagagtaaaa

SEQ ID NO: 381436 - DNA, 21 bp, Homo sapiens
atgttcattgtaatgttactg

SEQ ID NO: 381437 - DNA, 23 bp, Homo sapiens
atgttcattgtaatgttactgat

SEQ ID NO: 381438 - DNA, 12 bp, Homo sapiens
atgttccccagg

SEQ ID NO: 381439 - DNA, 11 bp, Homo sapiens
atgttccctct

SEQ ID NO: 381440 - DNA, 12 bp, Homo sapiens
atgttccctgca

SEQ ID NO: 381441 - DNA, 19 bp, Homo sapiens
atgttccctgcaccctgga

SEQ ID NO: 381442 - DNA, 20 bp, Homo sapiens
atgttccgttcatctgagga

SEQ ID NO: 381443 - DNA, 23 bp, Homo sapiens
atgttcctgaattctatttgctg

SEQ ID NO: 381444 - DNA, 17 bp, Homo sapiens
atgttctaacagatcag

SEQ ID NO: 381445 - DNA, 16 bp, Homo sapiens
atgttctgaataattt

SEQ ID NO: 381446 - DNA, 17 bp, Homo sapiens
atgttctgacattaaca

SEQ ID NO: 381447 - DNA, 20 bp, Homo sapiens
atgttctgacattaacagtt

SEQ ID NO: 381448 - DNA, 16 bp, Homo sapiens
atgttctggctttaca

SEQ ID NO: 381449 - DNA, 16 bp, Homo sapiens
atgttgatcgatgtta

SEQ ID NO: 381450 - DNA, 13 bp, Homo sapiens
atgttgcatgcct

SEQ ID NO: 381451 - DNA, 16 bp, Homo sapiens
atgttgcatgcctatg

SEQ ID NO: 381452 - DNA, 17 bp, Homo sapiens
atgttggccaggctggt

SEQ ID NO: 381453 - DNA, 19 bp, Homo sapiens
atgttggcctgtcagagct

SEQ ID NO: 381454 - DNA, 14 bp, Homo sapiens
atgttgggaaaaac

SEQ ID NO: 381455 - DNA, 21 bp, Homo sapiens
atgttgggaaaaactggcttt

SEQ ID NO: 381456 - DNA, 12 bp, Homo sapiens
atgttggtgcaa

SEQ ID NO: 381457 - DNA, 22 bp, Homo sapiens
atgttggttttttagtgcaatt

SEQ ID NO: 381458 - DNA, 19 bp, Homo sapiens
atgttgtgttgttatcatt

SEQ ID NO: 381459 - DNA, 12 bp, Homo sapiens
atgttgttattt

SEQ ID NO: 381460 - DNA, 14 bp, Homo sapiens
atgttgttatttaa

SEQ ID NO: 381461 - DNA, 15 bp, Homo sapiens
atgttgttatttaaa

SEQ ID NO: 381462 - DNA, 20 bp, Homo sapiens
atgttgttcattattggagg

SEQ ID NO: 381463 - DNA, 13 bp, Homo sapiens
atgtttaaaagca

SEQ ID NO: 381464 - DNA, 24 bp, Homo sapiens
atgtttaaaagcatactctatgtg

SEQ ID NO: 381465 - DNA, 20 bp, Homo sapiens
atgtttaaactttgtgcctt

SEQ ID NO: 381466 - DNA, 17 bp, Homo sapiens
atgtttaaatataaatg

SEQ ID NO: 381467 - DNA, 22 bp, Homo sapiens
atgtttaacaaatctaatctct

SEQ ID NO: 381468 - DNA, 14 bp, Homo sapiens
atgtttaagtgctt

SEQ ID NO: 381469 - DNA, 17 bp, Homo sapiens
atgtttaatatctgact

SEQ ID NO: 381470 - DNA, 19 bp, Homo sapiens
atgtttacactctttgtaa

SEQ ID NO: 381471 - DNA, 13 bp, Homo sapiens
atgtttacatatc

SEQ ID NO: 381472 - DNA, 20 bp, Homo sapiens
atgtttacctcactggtgca

SEQ ID NO: 381473 - DNA, 22 bp, Homo sapiens
atgtttacctcactggtgcatt

SEQ ID NO: 381474 - DNA, 16 bp, Homo sapiens
atgtttagaaataaat

SEQ ID NO: 381475 - DNA, 19 bp, Homo sapiens
atgtttagaaataaatgaa

SEQ ID NO: 381476 - DNA, 21 bp, Homo sapiens
atgtttatgagccagacaaat

SEQ ID NO: 381477 - DNA, 14 bp, Homo sapiens
atgtttattcctga

SEQ ID NO: 381478 - DNA, 17 bp, Homo sapiens
atgtttatttactaatt

SEQ ID NO: 381479 - DNA, 17 bp, Homo sapiens
atgtttcagctgcagtt

SEQ ID NO: 381480 - DNA, 22 bp, Homo sapiens
atgtttcatgttttgtgactat

SEQ ID NO: 381481 - DNA, 15 bp, Homo sapiens
atgtttccagctgcc

SEQ ID NO: 381482 - DNA, 22 bp, Homo sapiens
atgtttccaggcatgaccctgg

SEQ ID NO: 381483 - DNA, 23 bp, Homo sapiens
atgtttgccctgttcaaagtact

SEQ ID NO: 381484 - DNA, 23 bp, Homo sapiens
atgtttgtcctgaacacttttgt

SEQ ID NO: 381485 - DNA, 14 bp, Homo sapiens
atgtttgtgctgca

SEQ ID NO: 381486 - DNA, 10 bp, Homo sapiens
atgtttgtgg

SEQ ID NO: 381487 - DNA, 14 bp, Homo sapiens
atgtttgtggcctc

SEQ ID NO: 381488 - DNA, 15 bp, Homo sapiens
atgtttgtggcctca

SEQ ID NO: 381489 - DNA, 16 bp, Homo sapiens
atgtttgtggcctcag

SEQ ID NO: 381490 - DNA, 13 bp, Homo sapiens
atgtttgttttca

SEQ ID NO: 381491 - DNA, 18 bp, Homo sapiens
atgttttacaatggctgg

SEQ ID NO: 381492 - DNA, 12 bp, Homo sapiens
atgttttcattt

SEQ ID NO: 381493 - DNA, 12 bp, Homo sapiens
atgttttgagaa

SEQ ID NO: 381494 - DNA, 14 bp, Homo sapiens
atgttttgagaaaa

SEQ ID NO: 381495 - DNA, 14 bp, Homo sapiens
atgttttgatgcca

SEQ ID NO: 381496 - DNA, 12 bp, Homo sapiens
atgttttgctaa

SEQ ID NO: 381497 - DNA, 12 bp, Homo sapiens
atgttttgtaca

SEQ ID NO: 381498 - DNA, 17 bp, Homo sapiens
atgttttgtacaattac

SEQ ID NO: 381499 - DNA, 14 bp, Homo sapiens
atgttttgtgacta

SEQ ID NO: 381500 - DNA, 17 bp, Homo sapiens
atgttttgtgactatat

SEQ ID NO: 381501 - DNA, 19 bp, Homo sapiens
atgttttgtgactatatag

SEQ ID NO: 381502 - DNA, 20 bp, Homo sapiens
atgttttgtttctgaaaatt

SEQ ID NO: 381503 - DNA, 22 bp, Homo sapiens
atgtttttaaatgcataaaata

SEQ ID NO: 381504 - DNA, 21 bp, Homo sapiens
atgtttttctgccagggagct

SEQ ID NO: 381505 - DNA, 22 bp, Homo sapiens
atgtttttctgccagggagctt

SEQ ID NO: 381506 - DNA, 13 bp, Homo sapiens
atgtttttgtgta

SEQ ID NO: 381507 - DNA, 17 bp, Homo sapiens
atgttttttgaagttct

SEQ ID NO: 381508 - DNA, 13 bp, Homo sapiens
attaaaaaaataa

SEQ ID NO: 381509 - DNA, 13 bp, Homo sapiens
attaaaaattata

SEQ ID NO: 381510 - DNA, 15 bp, Homo sapiens
attaaaaattataga

SEQ ID NO: 381511 - DNA, 13 bp, Homo sapiens
attaaaacaatgt

SEQ ID NO: 381512 - DNA, 19 bp, Homo sapiens
attaaaacacaacatcttt

SEQ ID NO: 381513 - DNA, 14 bp, Homo sapiens
attaaaagcacaag

SEQ ID NO: 381514 - DNA, 22 bp, Homo sapiens
attaaaataaaacgttatctca

SEQ ID NO: 381515 - DNA, 19 bp, Homo sapiens
attaaaatagattatccca

SEQ ID NO: 381516 - DNA, 20 bp, Homo sapiens
attaaaatgattgtaaaata

SEQ ID NO: 381517 - DNA, 23 bp, Homo sapiens
attaaaatgtcggatttatcttt

SEQ ID NO: 381518 - DNA, 14 bp, Homo sapiens
attaaacacctgac

SEQ ID NO: 381519 - DNA, 14 bp, Homo sapiens
attaaacactgtaa

SEQ ID NO: 381520 - DNA, 12 bp, Homo sapiens
attaaacatgaa

SEQ ID NO: 381521 - DNA, 17 bp, Homo sapiens
attaaaccaagcagctt

SEQ ID NO: 381522 - DNA, 22 bp, Homo sapiens
attaaacgaggcaatgactgtg

SEQ ID NO: 381523 - DNA, 14 bp, Homo sapiens
attaaactaaaata

SEQ ID NO: 381524 - DNA, 16 bp, Homo sapiens
attaaactaaaataca

SEQ ID NO: 381525 - DNA, 12 bp, Homo sapiens
attaaacttcag

SEQ ID NO: 381526 - DNA, 13 bp, Homo sapiens
attaaacttcagc

SEQ ID NO: 381527 - DNA, 15 bp, Homo sapiens
attaaacttcagcaa

SEQ ID NO: 381528 - DNA, 16 bp, Homo sapiens
attaaacttcagcaac

SEQ ID NO: 381529 - DNA, 22 bp, Homo sapiens
attaaagccgccgttttcatga

SEQ ID NO: 381530 - DNA, 17 bp, Homo sapiens
attaaagcgcaaatgaa

SEQ ID NO: 381531 - DNA, 13 bp, Homo sapiens
attaaagggcaga

SEQ ID NO: 381532 - DNA, 17 bp, Homo sapiens
attaaaggtcctgccct

SEQ ID NO: 381533 - DNA, 14 bp, Homo sapiens
attaaataaataaa

SEQ ID NO: 381534 - DNA, 15 bp, Homo sapiens
attaaataattttac

SEQ ID NO: 381535 - DNA, 18 bp, Homo sapiens
attaaatatatgtatgta

SEQ ID NO: 381536 - DNA, 19 bp, Homo sapiens
attaaatatatgtatgtaa

SEQ ID NO: 381537 - DNA, 17 bp, Homo sapiens
attaaatattcagaaaa

SEQ ID NO: 381538 - DNA, 16 bp, Homo sapiens
attaaatatttaatga

SEQ ID NO: 381539 - DNA, 16 bp, Homo sapiens
attaaatcagttttgt

SEQ ID NO: 381540 - DNA, 18 bp, Homo sapiens
attaaatcagttttgtgt

SEQ ID NO: 381541 - DNA, 15 bp, Homo sapiens
attaaatgaaatact

SEQ ID NO: 381542 - DNA, 18 bp, Homo sapiens
attaaatggcacctgtat

SEQ ID NO: 381543 - DNA, 19 bp, Homo sapiens
attaaatggcacctgtata

SEQ ID NO: 381544 - DNA, 22 bp, Homo sapiens
attaaatggtgatttcttgcta

SEQ ID NO: 381545 - DNA, 23 bp, Homo sapiens
attaaattcctcctgtctcctct

SEQ ID NO: 381546 - DNA, 15 bp, Homo sapiens
attaaatttaatata

SEQ ID NO: 381547 - DNA, 15 bp, Homo sapiens
attaaatttaattag

SEQ ID NO: 381548 - DNA, 15 bp, Homo sapiens
attaaattttaatgt

SEQ ID NO: 381549 - DNA, 20 bp, Homo sapiens
attaaattttgagttctaca

SEQ ID NO: 381550 - DNA, 22 bp, Homo sapiens
attaacaggtctttgaaatatg

SEQ ID NO: 381551 - DNA, 14 bp, Homo sapiens
attaacagttttcc

SEQ ID NO: 381552 - DNA, 18 bp, Homo sapiens
attaacagttttccatga

SEQ ID NO: 381553 - DNA, 14 bp, Homo sapiens
attaacatataata

SEQ ID NO: 381554 - DNA, 22 bp, Homo sapiens
attaacatcatcaggcttggaa

SEQ ID NO: 381555 - DNA, 21 bp, Homo sapiens
attaaccccttctttcatgtt

SEQ ID NO: 381556 - DNA, 17 bp, Homo sapiens
attaactaatctattgg

SEQ ID NO: 381557 - DNA, 21 bp, Homo sapiens
attaactacatttatgagtaa

SEQ ID NO: 381558 - DNA, 13 bp, Homo sapiens
attaactctgcat

SEQ ID NO: 381559 - DNA, 20 bp, Homo sapiens
attaactctgcatagacaaa

SEQ ID NO: 381560 - DNA, 16 bp, Homo sapiens
attaactctggacctc

SEQ ID NO: 381561 - DNA, 15 bp, Homo sapiens
attaactgaagcaaa

SEQ ID NO: 381562 - DNA, 22 bp, Homo sapiens
attaactgagtagctctcctga

SEQ ID NO: 381563 - DNA, 14 bp, Homo sapiens
attaacttttgtaa

SEQ ID NO: 381564 - DNA, 19 bp, Homo sapiens
attaagactttaaaagatg

SEQ ID NO: 381565 - DNA, 14 bp, Homo sapiens
attaagatacactc

SEQ ID NO: 381566 - DNA, 14 bp, Homo sapiens
attaagatacttag

SEQ ID NO: 381567 - DNA, 23 bp, Homo sapiens
agcatttttaagggagtggcctc

SEQ ID NO: 381568 - DNA, 16 bp, Homo sapiens
agccaaaaacaataaa

SEQ ID NO: 381569 - DNA, 20 bp, Homo sapiens
agccaaaaacaataaacgaa

SEQ ID NO: 381570 - DNA, 17 bp, Homo sapiens
agccaaacattcttatt

SEQ ID NO: 381571 - DNA, 15 bp, Homo sapiens
agccaaaccctgtct

SEQ ID NO: 381572 - DNA, 19 bp, Homo sapiens
agccaaacccttgtcagtg

SEQ ID NO: 381573 - DNA, 17 bp, Homo sapiens
agccaaagagaaaagat

SEQ ID NO: 381574 - DNA, 20 bp, Homo sapiens
agccaaagagaaaagattaa

SEQ ID NO: 381575 - DNA, 13 bp, Homo sapiens
agccaaagagctc

SEQ ID NO: 381576 - DNA, 22 bp, Homo sapiens
agccaaatgcagggaggggagg

SEQ ID NO: 381577 - DNA, 15 bp, Homo sapiens
agccaaatggtttaa

SEQ ID NO: 381578 - DNA, 23 bp, Homo sapiens
agccaacaccctgtctaaaaaac

SEQ ID NO: 381579 - DNA, 21 bp, Homo sapiens
agccaacattgccttgcattt

SEQ ID NO: 381580 - DNA, 20 bp, Homo sapiens
agccaacgttcatgcatttt

SEQ ID NO: 381581 - DNA, 18 bp, Homo sapiens
agccaacttgtaaataca

SEQ ID NO: 381582 - DNA, 19 bp, Homo sapiens
agccaacttgtaaatacac

SEQ ID NO: 381583 - DNA, 20 bp, Homo sapiens
agccaacttgtaaatacacc

SEQ ID NO: 381584 - DNA, 12 bp, Homo sapiens
agccaagaagtg

SEQ ID NO: 381585 - DNA, 20 bp, Homo sapiens
agccaaggcctatgccacct

SEQ ID NO: 381586 - DNA, 17 bp, Homo sapiens
agccaagggtatccaag

SEQ ID NO: 381587 - DNA, 21 bp, Homo sapiens
agccaagtcagctttgccttc

SEQ ID NO: 381588 - DNA, 23 bp, Homo sapiens
agccaagtcagctttgccttcca

SEQ ID NO: 381589 - DNA, 14 bp, Homo sapiens
agccaagtgccttc

SEQ ID NO: 381590 - DNA, 16 bp, Homo sapiens
agccaataaataatat

SEQ ID NO: 381591 - DNA, 19 bp, Homo sapiens
agccaataaataatattat

SEQ ID NO: 381592 - DNA, 20 bp, Homo sapiens
agccaatactgagtgcctgc

SEQ ID NO: 381593 - DNA, 19 bp, Homo sapiens
agccaatggtgagggctga

SEQ ID NO: 381594 - DNA, 19 bp, Homo sapiens
agccacaaggctggccagc

SEQ ID NO: 381595 - DNA, 20 bp, Homo sapiens
agccacaaggctggccagca

SEQ ID NO: 381596 - DNA, 21 bp, Homo sapiens
agccacaggccccttttgtgg

SEQ ID NO: 381597 - DNA, 20 bp, Homo sapiens
agccaccaagggcctcacct

SEQ ID NO: 381598 - DNA, 23 bp, Homo sapiens
agccaccaccactgtccctacca

SEQ ID NO: 381599 - DNA, 21 bp, Homo sapiens
agccaccaccggggcactggc

SEQ ID NO: 381600 - DNA, 14 bp, Homo sapiens
agccaccacctgga

SEQ ID NO: 381601 - DNA, 22 bp, Homo sapiens
agccaccacgccctgcctactc

SEQ ID NO: 381602 - DNA, 14 bp, Homo sapiens
agccacccagccag

SEQ ID NO: 381603 - DNA, 16 bp, Homo sapiens
agccacccagccagga

SEQ ID NO: 381604 - DNA, 14 bp, Homo sapiens
agccaccccgggct

SEQ ID NO: 381605 - DNA, 24 bp, Homo sapiens
agccacccggatctccaggcccag

SEQ ID NO: 381606 - DNA, 20 bp, Homo sapiens
agccaccctaactgagctgc

SEQ ID NO: 381607 - DNA, 18 bp, Homo sapiens
agccacctccacccccaa

SEQ ID NO: 381608 - DNA, 22 bp, Homo sapiens
agccacctccacccccaagaaa

SEQ ID NO: 381609 - DNA, 14 bp, Homo sapiens
agccacctctccct

SEQ ID NO: 381610 - DNA, 16 bp, Homo sapiens
agccacctctccctca

SEQ ID NO: 381611 - DNA, 14 bp, Homo sapiens
agccacctgggctg

SEQ ID NO: 381612 - DNA, 19 bp, Homo sapiens
agccacctgggctgggaga

SEQ ID NO: 381613 - DNA, 22 bp, Homo sapiens
agccacctgggctgggagaagg

SEQ ID NO: 381614 - DNA, 19 bp, Homo sapiens
agccacctgtcccacctca

SEQ ID NO: 381615 - DNA, 20 bp, Homo sapiens
agccacggaccgcatcctcc

SEQ ID NO: 381616 - DNA, 19 bp, Homo sapiens
agccacggacgctggctcc

SEQ ID NO: 381617 - DNA, 14 bp, Homo sapiens
agccacgtgaatgg

SEQ ID NO: 381618 - DNA, 15 bp, Homo sapiens
agccactaccttctg

SEQ ID NO: 381619 - DNA, 16 bp, Homo sapiens
agccactacctttgtc

SEQ ID NO: 381620 - DNA, 19 bp, Homo sapiens
agccactcctgtcccgcct

SEQ ID NO: 381621 - DNA, 20 bp, Homo sapiens
agccactcgcagtcgcagga

SEQ ID NO: 381622 - DNA, 23 bp, Homo sapiens
agccactcgcagtcgcaggatcc

SEQ ID NO: 381623 - DNA, 14 bp, Homo sapiens
agccactctctgcc

SEQ ID NO: 381624 - DNA, 13 bp, Homo sapiens
agccactctgttc

SEQ ID NO: 381625 - DNA, 14 bp, Homo sapiens
agccactgtgctga

SEQ ID NO: 381626 - DNA, 17 bp, Homo sapiens
agccacttctccccaga

SEQ ID NO: 381627 - DNA, 20 bp, Homo sapiens
agccagaaccccgagcccta

SEQ ID NO: 381628 - DNA, 18 bp, Homo sapiens
agccagagaggagcacct

SEQ ID NO: 381629 - DNA, 15 bp, Homo sapiens
agccagagcccttca

SEQ ID NO: 381630 - DNA, 23 bp, Homo sapiens
agccagagcccttcactgccatg

SEQ ID NO: 381631 - DNA, 13 bp, Homo sapiens
agccagagctggg

SEQ ID NO: 381632 - DNA, 14 bp, Homo sapiens
agccagagctgggt

SEQ ID NO: 381633 - DNA, 23 bp, Homo sapiens
agccagcaatgatgtccagaaga

SEQ ID NO: 381634 - DNA, 13 bp, Homo sapiens
agccagcagggct

SEQ ID NO: 381635 - DNA, 21 bp, Homo sapiens
agccagcaggttctctcctgt

SEQ ID NO: 381636 - DNA, 18 bp, Homo sapiens
agccagccaccctaactg

SEQ ID NO: 381637 - DNA, 12 bp, Homo sapiens
agccagcccagc

SEQ ID NO: 381638 - DNA, 13 bp, Homo sapiens
agccagcccagct

SEQ ID NO: 381639 - DNA, 17 bp, Homo sapiens
agccagcccagctccac

SEQ ID NO: 381640 - DNA, 21 bp, Homo sapiens
agccagcccagctccactcag

SEQ ID NO: 381641 - DNA, 23 bp, Homo sapiens
agccagcccagctccactcaggg

SEQ ID NO: 381642 - DNA, 17 bp, Homo sapiens
agccagcccttcccagg

SEQ ID NO: 381643 - DNA, 20 bp, Homo sapiens
agccagcccttcccaggcca

SEQ ID NO: 381644 - DNA, 21 bp, Homo sapiens
agccagcccttcccaggccag

SEQ ID NO: 381645 - DNA, 14 bp, Homo sapiens
agccagcctgggac

SEQ ID NO: 381646 - DNA, 16 bp, Homo sapiens
agccagctgcccacaa

SEQ ID NO: 381647 - DNA, 20 bp, Homo sapiens
agccaggaagccccgctcag

SEQ ID NO: 381648 - DNA, 11 bp, Homo sapiens
agccaggagac

SEQ ID NO: 381649 - DNA, 17 bp, Homo sapiens
agccaggagaccctgtc

SEQ ID NO: 381650 - DNA, 18 bp, Homo sapiens
agccaggagcctcctgac

SEQ ID NO: 381651 - DNA, 14 bp, Homo sapiens
agccaggagtctgt

SEQ ID NO: 381652 - DNA, 22 bp, Homo sapiens
agccaggcaacttcagtcctgg

SEQ ID NO: 381653 - DNA, 14 bp, Homo sapiens
agccaggcctcccg

SEQ ID NO: 381654 - DNA, 15 bp, Homo sapiens
agccaggcctcccgc

SEQ ID NO: 381655 - DNA, 12 bp, Homo sapiens
agccaggcctgg

SEQ ID NO: 381656 - DNA, 14 bp, Homo sapiens
agccagggagcccg

SEQ ID NO: 381657 - DNA, 15 bp, Homo sapiens
agccagggctgtcct

SEQ ID NO: 381658 - DNA, 16 bp, Homo sapiens
agccagggctgtcctt

SEQ ID NO: 381659 - DNA, 17 bp, Homo sapiens
agccaggggtggggatg

SEQ ID NO: 381660 - DNA, 20 bp, Homo sapiens
agccagggtagagcaaagga

SEQ ID NO: 381661 - DNA, 17 bp, Homo sapiens
agccagggttccagaca

SEQ ID NO: 381662 - DNA, 23 bp, Homo sapiens
agccaggtgtcctgactgtccta

SEQ ID NO: 381663 - DNA, 20 bp, Homo sapiens
agccagtaaggcagctctgt

SEQ ID NO: 381664 - DNA, 13 bp, Homo sapiens
agccagtgaagga

SEQ ID NO: 381665 - DNA, 13 bp, Homo sapiens
agccagtgactcc

SEQ ID NO: 381666 - DNA, 15 bp, Homo sapiens
agccagtgactccag

SEQ ID NO: 381667 - DNA, 16 bp, Homo sapiens
agccagtgactccagg

SEQ ID NO: 381668 - DNA, 22 bp, Homo sapiens
agccagtgactccaggagagga

SEQ ID NO: 381669 - DNA, 21 bp, Homo sapiens
agccagtggccgaacccccca

SEQ ID NO: 381670 - DNA, 22 bp, Homo sapiens
agccagtggggtcccccctgag

SEQ ID NO: 381671 - DNA, 14 bp, Homo sapiens
agccataacttgaa

SEQ ID NO: 381672 - DNA, 18 bp, Homo sapiens
agccatagagatatttaa

SEQ ID NO: 381673 - DNA, 14 bp, Homo sapiens
agccataggcccag

SEQ ID NO: 381674 - DNA, 20 bp, Homo sapiens
agccatatattttctgagta

SEQ ID NO: 381675 - DNA, 15 bp, Homo sapiens
agccatatcaccagt

SEQ ID NO: 381676 - DNA, 18 bp, Homo sapiens
agccatattcacacctca

SEQ ID NO: 381677 - DNA, 13 bp, Homo sapiens
agccatattccag

SEQ ID NO: 381678 - DNA, 18 bp, Homo sapiens
agccatattccagcagtg

SEQ ID NO: 381679 - DNA, 18 bp, Homo sapiens
agccatcacttctccccg

SEQ ID NO: 381680 - DNA, 23 bp, Homo sapiens
agccatcttcccgcctcagcctc

SEQ ID NO: 381681 - DNA, 23 bp, Homo sapiens
agccatgatgtggagtggggcag

SEQ ID NO: 381682 - DNA, 15 bp, Homo sapiens
agccatgcctcatgc

SEQ ID NO: 381683 - DNA, 18 bp, Homo sapiens
agccatggactctacact

SEQ ID NO: 381684 - DNA, 20 bp, Homo sapiens
agccatggctcaggcaagcc

SEQ ID NO: 381685 - DNA, 21 bp, Homo sapiens
agccatggctcaggcaagccc

SEQ ID NO: 381686 - DNA, 22 bp, Homo sapiens
agccatggctcaggcaagcccc

SEQ ID NO: 381687 - DNA, 14 bp, Homo sapiens
agccatggctggca

SEQ ID NO: 381688 - DNA, 14 bp, Homo sapiens
agccatgggccctc

SEQ ID NO: 381689 - DNA, 16 bp, Homo sapiens
agccatgggcctgggc

SEQ ID NO: 381690 - DNA, 21 bp, Homo sapiens
agccatgggcctgggcctgct

SEQ ID NO: 381691 - DNA, 22 bp, Homo sapiens
agccatgggcctgggcctgctt

SEQ ID NO: 381692 - DNA, 21 bp, Homo sapiens
agccatgtaccagtgtactgc

SEQ ID NO: 381693 - DNA, 17 bp, Homo sapiens
agccattcatctgggct

SEQ ID NO: 381694 - DNA, 23 bp, Homo sapiens
agccattcatctgggctggcaga

SEQ ID NO: 381695 - DNA, 22 bp, Homo sapiens
agccattcctgttctctttgcc

SEQ ID NO: 381696 - DNA, 15 bp, Homo sapiens
agccattgaccaccc

SEQ ID NO: 381697 - DNA, 16 bp, Homo sapiens
agccattttgtaactg

SEQ ID NO: 381698 - DNA, 18 bp, Homo sapiens
agcccaaagctggagcca

SEQ ID NO: 381699 - DNA, 21 bp, Homo sapiens
agcccaagcttaatagccctc

SEQ ID NO: 381700 - DNA, 15 bp, Homo sapiens
attaagatggattct

SEQ ID NO: 381701 - DNA, 18 bp, Homo sapiens
attaagattttacaaaag

SEQ ID NO: 381702 - DNA, 22 bp, Homo sapiens
attaagctccttcagtttgaag

SEQ ID NO: 381703 - DNA, 19 bp, Homo sapiens
attaaggcaactgaacaaa

SEQ ID NO: 381704 - DNA, 20 bp, Homo sapiens
attaaggcaactgaacaaaa

SEQ ID NO: 381705 - DNA, 22 bp, Homo sapiens
attaagtattccttggcccagc

SEQ ID NO: 381706 - DNA, 17 bp, Homo sapiens
attaagttataccagca

SEQ ID NO: 381707 - DNA, 18 bp, Homo sapiens
attaagttataccagcaa

SEQ ID NO: 381708 - DNA, 14 bp, Homo sapiens
attaatacataagt

SEQ ID NO: 381709 - DNA, 17 bp, Homo sapiens
attaatacataagttaa

SEQ ID NO: 381710 - DNA, 19 bp, Homo sapiens
attaatagcttttattgta

SEQ ID NO: 381711 - DNA, 23 bp, Homo sapiens
attaatagcttttattgtataaa

SEQ ID NO: 381712 - DNA, 23 bp, Homo sapiens
attaatagtaggattattcctag

SEQ ID NO: 381713 - DNA, 16 bp, Homo sapiens
attaatcaccaaagta

SEQ ID NO: 381714 - DNA, 14 bp, Homo sapiens
attaatctctaaaa

SEQ ID NO: 381715 - DNA, 19 bp, Homo sapiens
attaatctctaaaattcta

SEQ ID NO: 381716 - DNA, 17 bp, Homo sapiens
attaatgaactgtgaca

SEQ ID NO: 381717 - DNA, 16 bp, Homo sapiens
attaatggcatgtaat

SEQ ID NO: 381718 - DNA, 20 bp, Homo sapiens
attaatggcatgtaatattc

SEQ ID NO: 381719 - DNA, 14 bp, Homo sapiens
attaatgttttgta

SEQ ID NO: 381720 - DNA, 15 bp, Homo sapiens
attaatgttttgtac

SEQ ID NO: 381721 - DNA, 16 bp, Homo sapiens
attaatgttttgtaca

SEQ ID NO: 381722 - DNA, 18 bp, Homo sapiens
attaatgttttgtacaat

SEQ ID NO: 381723 - DNA, 12 bp, Homo sapiens
attaattcatta

SEQ ID NO: 381724 - DNA, 19 bp, Homo sapiens
attaattgttttgcacttt

SEQ ID NO: 381725 - DNA, 16 bp, Homo sapiens
attaatttatcagatt

SEQ ID NO: 381726 - DNA, 15 bp, Homo sapiens
attaatttcaacata

SEQ ID NO: 381727 - DNA, 10 bp, Homo sapiens
attacaaata

SEQ ID NO: 381728 - DNA, 19 bp, Homo sapiens
attacaaattttcactgct

SEQ ID NO: 381729 - DNA, 20 bp, Homo sapiens
attacaaccggttatcagtt

SEQ ID NO: 381730 - DNA, 13 bp, Homo sapiens
attacaagtttca

SEQ ID NO: 381731 - DNA, 15 bp, Homo sapiens
attacacccatgcac

SEQ ID NO: 381732 - DNA, 18 bp, Homo sapiens
attacagagaggagaaac

SEQ ID NO: 381733 - DNA, 17 bp, Homo sapiens
attacaggaagtactgg

SEQ ID NO: 381734 - DNA, 16 bp, Homo sapiens
attacaggattaatat

SEQ ID NO: 381735 - DNA, 19 bp, Homo sapiens
attacaggattaatatatt

SEQ ID NO: 381736 - DNA, 16 bp, Homo sapiens
attacaggtgcccacc

SEQ ID NO: 381737 - DNA, 21 bp, Homo sapiens
attacaggtgtgtgccatcat

SEQ ID NO: 381738 - DNA, 22 bp, Homo sapiens
attacataaataaattaaataa

SEQ ID NO: 381739 - DNA, 15 bp, Homo sapiens
attacataacaggca

SEQ ID NO: 381740 - DNA, 20 bp, Homo sapiens
attacataacaggcattgca

SEQ ID NO: 381741 - DNA, 19 bp, Homo sapiens
attacatgtaaaacattat

SEQ ID NO: 381742 - DNA, 21 bp, Homo sapiens
attacattccttgataatgtt

SEQ ID NO: 381743 - DNA, 15 bp, Homo sapiens
attacatttatacat

SEQ ID NO: 381744 - DNA, 20 bp, Homo sapiens
attaccatcttaatctttat

SEQ ID NO: 381745 - DNA, 17 bp, Homo sapiens
attacccctcatttaaa

SEQ ID NO: 381746 - DNA, 21 bp, Homo sapiens
attactacaaaatttgaaatt

SEQ ID NO: 381747 - DNA, 19 bp, Homo sapiens
attactagtactattacta

SEQ ID NO: 381748 - DNA, 12 bp, Homo sapiens
attactgccttc

SEQ ID NO: 381749 - DNA, 14 bp, Homo sapiens
attactgccttcag

SEQ ID NO: 381750 - DNA, 13 bp, Homo sapiens
attactgtcaata

SEQ ID NO: 381751 - DNA, 21 bp, Homo sapiens
attactgttgcatttactttt

SEQ ID NO: 381752 - DNA, 17 bp, Homo sapiens
attactgtttatttctg

SEQ ID NO: 381753 - DNA, 18 bp, Homo sapiens
attactgtttatttctgt

SEQ ID NO: 381754 - DNA, 16 bp, Homo sapiens
attactttaaattata

SEQ ID NO: 381755 - DNA, 22 bp, Homo sapiens
attactttaatactcacctcct

SEQ ID NO: 381756 - DNA, 17 bp, Homo sapiens
attactttgtagatgta

SEQ ID NO: 381757 - DNA, 19 bp, Homo sapiens
attacttttgtaaatattc

SEQ ID NO: 381758 - DNA, 19 bp, Homo sapiens
attactttttaaaatgttg

SEQ ID NO: 381759 - DNA, 12 bp, Homo sapiens
attagaaaaaaa

SEQ ID NO: 381760 - DNA, 14 bp, Homo sapiens
attagaaaaaaaca

SEQ ID NO: 381761 - DNA, 19 bp, Homo sapiens
attagaaacacacttttgc

SEQ ID NO: 381762 - DNA, 15 bp, Homo sapiens
attagaaataaagca

SEQ ID NO: 381763 - DNA, 11 bp, Homo sapiens
attagaaatga

SEQ ID NO: 381764 - DNA, 13 bp, Homo sapiens
attagaaatgaat

SEQ ID NO: 381765 - DNA, 12 bp, Homo sapiens
attagaagaaaa

SEQ ID NO: 381766 - DNA, 14 bp, Homo sapiens
attagaagaaaatg

SEQ ID NO: 381767 - DNA, 19 bp, Homo sapiens
attagaagccaagacagtg

SEQ ID NO: 381768 - DNA, 18 bp, Homo sapiens
attagactgaatttaact

SEQ ID NO: 381769 - DNA, 20 bp, Homo sapiens
attagactttagaaataaat

SEQ ID NO: 381770 - DNA, 21 bp, Homo sapiens
attagagcagatgacccctcc

SEQ ID NO: 381771 - DNA, 17 bp, Homo sapiens
attagagggacagccaa

SEQ ID NO: 381772 - DNA, 13 bp, Homo sapiens
attagagggaggt

SEQ ID NO: 381773 - DNA, 22 bp, Homo sapiens
attagagggaggtgtttaaaga

SEQ ID NO: 381774 - DNA, 21 bp, Homo sapiens
attagagtgcccttaaaataa

SEQ ID NO: 381775 - DNA, 21 bp, Homo sapiens
attagattatattgagacaaa

SEQ ID NO: 381776 - DNA, 20 bp, Homo sapiens
attagattttaaaacttcat

SEQ ID NO: 381777 - DNA, 14 bp, Homo sapiens
attagcaaggctgg

SEQ ID NO: 381778 - DNA, 17 bp, Homo sapiens
attagcagtttgctttg

SEQ ID NO: 381779 - DNA, 14 bp, Homo sapiens
attagccagtcatt

SEQ ID NO: 381780 - DNA, 18 bp, Homo sapiens
attagccgggcatggtgg

SEQ ID NO: 381781 - DNA, 20 bp, Homo sapiens
attagctagactaggagacc

SEQ ID NO: 381782 - DNA, 13 bp, Homo sapiens
attagctgtaaat

SEQ ID NO: 381783 - DNA, 16 bp, Homo sapiens
attagctgtaaataca

SEQ ID NO: 381784 - DNA, 13 bp, Homo sapiens
attagcttggcat

SEQ ID NO: 381785 - DNA, 21 bp, Homo sapiens
attaggaacagagtatatatg

SEQ ID NO: 381786 - DNA, 22 bp, Homo sapiens
attaggaacagagtatatatgt

SEQ ID NO: 381787 - DNA, 20 bp, Homo sapiens
attaggaagtgtaacagctg

SEQ ID NO: 381788 - DNA, 13 bp, Homo sapiens
attaggaataaat

SEQ ID NO: 381789 - DNA, 16 bp, Homo sapiens
attaggaataaataaa

SEQ ID NO: 381790 - DNA, 14 bp, Homo sapiens
attaggatttcatg

SEQ ID NO: 381791 - DNA, 19 bp, Homo sapiens
attaggatttgccccttcc

SEQ ID NO: 381792 - DNA, 21 bp, Homo sapiens
attaggccttatgtaaggaga

SEQ ID NO: 381793 - DNA, 15 bp, Homo sapiens
attaggggttgctaa

SEQ ID NO: 381794 - DNA, 22 bp, Homo sapiens
attaggggttgctaagaagcga

SEQ ID NO: 381795 - DNA, 18 bp, Homo sapiens
attaggtctgcattttct

SEQ ID NO: 381796 - DNA, 23 bp, Homo sapiens
attagtaaaacacaagacttcag

SEQ ID NO: 381797 - DNA, 16 bp, Homo sapiens
attagtaaatgcttat

SEQ ID NO: 381798 - DNA, 14 bp, Homo sapiens
attagtatcctgtt

SEQ ID NO: 381799 - DNA, 19 bp, Homo sapiens
attagtgagatttgtattt

SEQ ID NO: 381800 - DNA, 15 bp, Homo sapiens
attataaaaatatca

SEQ ID NO: 381801 - DNA, 23 bp, Homo sapiens
attataaactctaagtgtaaaaa

SEQ ID NO: 381802 - DNA, 18 bp, Homo sapiens
attataaatccaaagtaa

SEQ ID NO: 381803 - DNA, 18 bp, Homo sapiens
attataagcattgaaatt

SEQ ID NO: 381804 - DNA, 18 bp, Homo sapiens
attataagctatgtcact

SEQ ID NO: 381805 - DNA, 18 bp, Homo sapiens
attataaggactgcatgg

SEQ ID NO: 381806 - DNA, 13 bp, Homo sapiens
attataatgaatt

SEQ ID NO: 381807 - DNA, 15 bp, Homo sapiens
attataatgcaaatt

SEQ ID NO: 381808 - DNA, 21 bp, Homo sapiens
attatacagacctaatatcat

SEQ ID NO: 381809 - DNA, 23 bp, Homo sapiens
attatacagacctaatatcattt

SEQ ID NO: 381810 - DNA, 13 bp, Homo sapiens
attataccaagag

SEQ ID NO: 381811 - DNA, 23 bp, Homo sapiens
attataccaagagtatgagaaat

SEQ ID NO: 381812 - DNA, 19 bp, Homo sapiens
attatactaagaaaagata

SEQ ID NO: 381813 - DNA, 18 bp, Homo sapiens
attatacttctttattca

SEQ ID NO: 381814 - DNA, 15 bp, Homo sapiens
attatagaaattact

SEQ ID NO: 381815 - DNA, 23 bp, Homo sapiens
attatagcacgaagctatgagaa

SEQ ID NO: 381816 - DNA, 12 bp, Homo sapiens
attatagcatgt

SEQ ID NO: 381817 - DNA, 13 bp, Homo sapiens
attatatgatatg

SEQ ID NO: 381818 - DNA, 15 bp, Homo sapiens
attatatgatatgca

SEQ ID NO: 381819 - DNA, 13 bp, Homo sapiens
attatattataat

SEQ ID NO: 381820 - DNA, 14 bp, Homo sapiens
attatattctctta

SEQ ID NO: 381821 - DNA, 21 bp, Homo sapiens
attatattgagacaaaaatta

SEQ ID NO: 381822 - DNA, 13 bp, Homo sapiens
attatattggtgg

SEQ ID NO: 381823 - DNA, 20 bp, Homo sapiens
attatattggtggttctcag

SEQ ID NO: 381824 - DNA, 18 bp, Homo sapiens
attatattgtatttaacc

SEQ ID NO: 381825 - DNA, 14 bp, Homo sapiens
attatcaagctaat

SEQ ID NO: 381826 - DNA, 16 bp, Homo sapiens
attatcaagctaataa

SEQ ID NO: 381827 - DNA, 14 bp, Homo sapiens
attatcagtgaata

SEQ ID NO: 381828 - DNA, 19 bp, Homo sapiens
attatccttttatctcaca

SEQ ID NO: 381829 - DNA, 19 bp, Homo sapiens
attatcggaagcagtgcct

SEQ ID NO: 381830 - DNA, 21 bp, Homo sapiens
attatcggaagcagtgccttc

SEQ ID NO: 381831 - DNA, 19 bp, Homo sapiens
attatcgggaacagtgttt

SEQ ID NO: 381832 - DNA, 22 bp, Homo sapiens
attatcgggaacagtgtttccc

SEQ ID NO: 381833 - DNA, 16 bp, Homo sapiens
attatcgggagcagtg

SEQ ID NO: 381834 - DNA, 22 bp, Homo sapiens
actaaagtatgtaaagtatgta

SEQ ID NO: 381835 - DNA, 22 bp, Homo sapiens
actaaagtatttaaagaaactg

SEQ ID NO: 381836 - DNA, 14 bp, Homo sapiens
actaaatagatttt

SEQ ID NO: 381837 - DNA, 19 bp, Homo sapiens
actaaatagatttttagat

SEQ ID NO: 381838 - DNA, 16 bp, Homo sapiens
actaaatatgaaattt

SEQ ID NO: 381839 - DNA, 17 bp, Homo sapiens
actaaatatgaaatttt

SEQ ID NO: 381840 - DNA, 20 bp, Homo sapiens
actaaatctgtaagctcttt

SEQ ID NO: 381841 - DNA, 21 bp, Homo sapiens
actaacaatgccttgttgtat

SEQ ID NO: 381842 - DNA, 20 bp, Homo sapiens
actaacataaaatctgtgaa

SEQ ID NO: 381843 - DNA, 23 bp, Homo sapiens
actaacataaagaaacactttct

SEQ ID NO: 381844 - DNA, 17 bp, Homo sapiens
actaacatataatgttg

SEQ ID NO: 381845 - DNA, 22 bp, Homo sapiens
actaacatcccaataaagtcct

SEQ ID NO: 381846 - DNA, 14 bp, Homo sapiens
actaaccaccattt

SEQ ID NO: 381847 - DNA, 19 bp, Homo sapiens
actaaccatccccaactcc

SEQ ID NO: 381848 - DNA, 20 bp, Homo sapiens
actaaccatccccaactcca

SEQ ID NO: 381849 - DNA, 13 bp, Homo sapiens
actaacctggaga

SEQ ID NO: 381850 - DNA, 15 bp, Homo sapiens
actaacctggagaca

SEQ ID NO: 381851 - DNA, 13 bp, Homo sapiens
actaaccttttat

SEQ ID NO: 381852 - DNA, 17 bp, Homo sapiens
actaacttgacttttaa

SEQ ID NO: 381853 - DNA, 12 bp, Homo sapiens
actaagaagtgg

SEQ ID NO: 381854 - DNA, 14 bp, Homo sapiens
actaagaataaata

SEQ ID NO: 381855 - DNA, 17 bp, Homo sapiens
actaagatgaaattgcc

SEQ ID NO: 381856 - DNA, 19 bp, Homo sapiens
actaagatgaaattgccaa

SEQ ID NO: 381857 - DNA, 16 bp, Homo sapiens
actaagccacaagaaa

SEQ ID NO: 381858 - DNA, 11 bp, Homo sapiens
actaagccagg

SEQ ID NO: 381859 - DNA, 21 bp, Homo sapiens
actaagccctcgaaccaaggc

SEQ ID NO: 381860 - DNA, 16 bp, Homo sapiens
actaagctctttgaga

SEQ ID NO: 381861 - DNA, 17 bp, Homo sapiens
actaagctctttgagaa

SEQ ID NO: 381862 - DNA, 17 bp, Homo sapiens
actaaggacaggatggc

SEQ ID NO: 381863 - DNA, 19 bp, Homo sapiens
actaataaaaaactgtgaa

SEQ ID NO: 381864 - DNA, 21 bp, Homo sapiens
actaataaaaaactgtgaacc

SEQ ID NO: 381865 - DNA, 14 bp, Homo sapiens
actaataaaaaggt

SEQ ID NO: 381866 - DNA, 15 bp, Homo sapiens
actaataaaaaggtt

SEQ ID NO: 381867 - DNA, 22 bp, Homo sapiens
actaataaaaaggtttaatttt

SEQ ID NO: 381868 - DNA, 17 bp, Homo sapiens
actaataaagtctgtct

SEQ ID NO: 381869 - DNA, 21 bp, Homo sapiens
actaatagagtacttaatata

SEQ ID NO: 381870 - DNA, 19 bp, Homo sapiens
actaatattttatgtgaga

SEQ ID NO: 381871 - DNA, 20 bp, Homo sapiens
actaatctattgggttcatt

SEQ ID NO: 381872 - DNA, 22 bp, Homo sapiens
actaatgttagaattgatttcc

SEQ ID NO: 381873 - DNA, 17 bp, Homo sapiens
actaattataatgcaaa

SEQ ID NO: 381874 - DNA, 15 bp, Homo sapiens
actaatttaaaaaat

SEQ ID NO: 381875 - DNA, 17 bp, Homo sapiens
actaatttttagatatt

SEQ ID NO: 381876 - DNA, 20 bp, Homo sapiens
actaatttttagatattcat

SEQ ID NO: 381877 - DNA, 23 bp, Homo sapiens
actaatttttagatattcattaa

SEQ ID NO: 381878 - DNA, 14 bp, Homo sapiens
actacaaaaataca

SEQ ID NO: 381879 - DNA, 13 bp, Homo sapiens
actacaaaatttg

SEQ ID NO: 381880 - DNA, 23 bp, Homo sapiens
actacaaagcttctatcccagga

SEQ ID NO: 381881 - DNA, 15 bp, Homo sapiens
actacaacctccacc

SEQ ID NO: 381882 - DNA, 22 bp, Homo sapiens
actacaacctccaccttccagg

SEQ ID NO: 381883 - DNA, 15 bp, Homo sapiens
actacagaataatgt

SEQ ID NO: 381884 - DNA, 17 bp, Homo sapiens
actacagaataatgtgt

SEQ ID NO: 381885 - DNA, 15 bp, Homo sapiens
actacatgtggttta

SEQ ID NO: 381886 - DNA, 19 bp, Homo sapiens
actacatgtggtttataga

SEQ ID NO: 381887 - DNA, 19 bp, Homo sapiens
actacattgagcccctgag

SEQ ID NO: 381888 - DNA, 11 bp, Homo sapiens
actacatttat

SEQ ID NO: 381889 - DNA, 21 bp, Homo sapiens
actaccaagaggccctgtctg

SEQ ID NO: 381890 - DNA, 13 bp, Homo sapiens
actaccacaagga

SEQ ID NO: 381891 - DNA, 19 bp, Homo sapiens
actaccaggaataatgata

SEQ ID NO: 381892 - DNA, 14 bp, Homo sapiens
actacccaaatcta

SEQ ID NO: 381893 - DNA, 20 bp, Homo sapiens
actacccatcggtgtccatt

SEQ ID NO: 381894 - DNA, 19 bp, Homo sapiens
actaccctcctgtaaaata

SEQ ID NO: 381895 - DNA, 14 bp, Homo sapiens
actacctataaatg

SEQ ID NO: 381896 - DNA, 18 bp, Homo sapiens
actactgacatgtggggc

SEQ ID NO: 381897 - DNA, 23 bp, Homo sapiens
actactgacatgtggggccaggt

SEQ ID NO: 381898 - DNA, 17 bp, Homo sapiens
actactgcaaaaagtac

SEQ ID NO: 381899 - DNA, 14 bp, Homo sapiens
actactgcaagttc

SEQ ID NO: 381900 - DNA, 16 bp, Homo sapiens
actactggtctgtact

SEQ ID NO: 381901 - DNA, 17 bp, Homo sapiens
actactggtctgtactc

SEQ ID NO: 381902 - DNA, 12 bp, Homo sapiens
actactgtacat

SEQ ID NO: 381903 - DNA, 13 bp, Homo sapiens
actactgtacatt

SEQ ID NO: 381904 - DNA, 13 bp, Homo sapiens
actactttaaatc

SEQ ID NO: 381905 - DNA, 23 bp, Homo sapiens
actactttaaatcctaccaaagt

SEQ ID NO: 381906 - DNA, 16 bp, Homo sapiens
actagacctccagctg

SEQ ID NO: 381907 - DNA, 19 bp, Homo sapiens
actagagacctctcaacag

SEQ ID NO: 381908 - DNA, 15 bp, Homo sapiens
actagatctcctgta

SEQ ID NO: 381909 - DNA, 11 bp, Homo sapiens
actagcaggca

SEQ ID NO: 381910 - DNA, 12 bp, Homo sapiens
actagccaaggc

SEQ ID NO: 381911 - DNA, 16 bp, Homo sapiens
actagccaaggctagt

SEQ ID NO: 381912 - DNA, 17 bp, Homo sapiens
actagccctctttctct

SEQ ID NO: 381913 - DNA, 18 bp, Homo sapiens
actagccctctttctctc

SEQ ID NO: 381914 - DNA, 20 bp, Homo sapiens
actagccctctttctctctg

SEQ ID NO: 381915 - DNA, 19 bp, Homo sapiens
actaggagaccagaagtga

SEQ ID NO: 381916 - DNA, 21 bp, Homo sapiens
actaggataggaactgggcct

SEQ ID NO: 381917 - DNA, 13 bp, Homo sapiens
actaggctgggtg

SEQ ID NO: 381918 - DNA, 21 bp, Homo sapiens
actagggaagaaagcagaaca

SEQ ID NO: 381919 - DNA, 16 bp, Homo sapiens
actagggattcaggct

SEQ ID NO: 381920 - DNA, 17 bp, Homo sapiens
actagggattcaggctg

SEQ ID NO: 381921 - DNA, 19 bp, Homo sapiens
actagggattcaggctgct

SEQ ID NO: 381922 - DNA, 23 bp, Homo sapiens
actagggttttggcctgcctgcg

SEQ ID NO: 381923 - DNA, 15 bp, Homo sapiens
actaggtgcccagtc

SEQ ID NO: 381924 - DNA, 19 bp, Homo sapiens
actaggtgcccagtcttga

SEQ ID NO: 381925 - DNA, 14 bp, Homo sapiens
aacatcaatgttca

SEQ ID NO: 381926 - DNA, 19 bp, Homo sapiens
aacatcaatgttcattgta

SEQ ID NO: 381927 - DNA, 13 bp, Homo sapiens
aacatcacacaca

SEQ ID NO: 381928 - DNA, 18 bp, Homo sapiens
aacatcactatccatgca

SEQ ID NO: 381929 - DNA, 22 bp, Homo sapiens
aacatctgaaaagaaatgctaa

SEQ ID NO: 381930 - DNA, 16 bp, Homo sapiens
aacatctgccttgctg

SEQ ID NO: 381931 - DNA, 16 bp, Homo sapiens
aacatcttcatataaa

SEQ ID NO: 381932 - DNA, 18 bp, Homo sapiens
aacatcttcatataaact

SEQ ID NO: 381933 - DNA, 18 bp, Homo sapiens
aacatctttccagtcctt

SEQ ID NO: 381934 - DNA, 15 bp, Homo sapiens
aacatgaaaacattg

SEQ ID NO: 381935 - DNA, 14 bp, Homo sapiens
aacatgaaatgccc

SEQ ID NO: 381936 - DNA, 14 bp, Homo sapiens
aacatgaattaaga

SEQ ID NO: 381937 - DNA, 17 bp, Homo sapiens
aacatgagtttatggga

SEQ ID NO: 381938 - DNA, 14 bp, Homo sapiens
aacatgatgtgaga

SEQ ID NO: 381939 - DNA, 17 bp, Homo sapiens
aacatgctacctgatcc

SEQ ID NO: 381940 - DNA, 21 bp, Homo sapiens
aacatgctgtgtaagctgtgt

SEQ ID NO: 381941 - DNA, 16 bp, Homo sapiens
aacatgcttcatgaaa

SEQ ID NO: 381942 - DNA, 15 bp, Homo sapiens
aacatggaagtacta

SEQ ID NO: 381943 - DNA, 18 bp, Homo sapiens
aacatggattccaaagca

SEQ ID NO: 381944 - DNA, 12 bp, Homo sapiens
aacatggccaat

SEQ ID NO: 381945 - DNA, 23 bp, Homo sapiens
aacatggccacatccaacatttc

SEQ ID NO: 381946 - DNA, 21 bp, Homo sapiens
aacatgggcattgggttctaa

SEQ ID NO: 381947 - DNA, 23 bp, Homo sapiens
aacatggtgaaaccccatctcta

SEQ ID NO: 381948 - DNA, 20 bp, Homo sapiens
aacatggtgtgtgtctctga

SEQ ID NO: 381949 - DNA, 20 bp, Homo sapiens
aacatgtatctctaatgaaa

SEQ ID NO: 381950 - DNA, 11 bp, Homo sapiens
aacatgtcatg

SEQ ID NO: 381951 - DNA, 22 bp, Homo sapiens
aacatgtcatgtaggttgtcta

SEQ ID NO: 381952 - DNA, 19 bp, Homo sapiens
aacatgtcggagtagaaat

SEQ ID NO: 381953 - DNA, 22 bp, Homo sapiens
aacatgtgcaactcttgtattg

SEQ ID NO: 381954 - DNA, 17 bp, Homo sapiens
aacatgttactgaccag

SEQ ID NO: 381955 - DNA, 15 bp, Homo sapiens
aacattaaacactgt

SEQ ID NO: 381956 - DNA, 17 bp, Homo sapiens
aacattactgccttcag

SEQ ID NO: 381957 - DNA, 20 bp, Homo sapiens
aacattagaagaaaacatat

SEQ ID NO: 381958 - DNA, 23 bp, Homo sapiens
aacattagaagaaaacatatatt

SEQ ID NO: 381959 - DNA, 22 bp, Homo sapiens
aacattcacacagggctctttg

SEQ ID NO: 381960 - DNA, 17 bp, Homo sapiens
aacattcagtactttat

SEQ ID NO: 381961 - DNA, 18 bp, Homo sapiens
aacattcagtactttatg

SEQ ID NO: 381962 - DNA, 18 bp, Homo sapiens
aacattcattcaacagct

SEQ ID NO: 381963 - DNA, 19 bp, Homo sapiens
aacattcctcatgaatgta

SEQ ID NO: 381964 - DNA, 21 bp, Homo sapiens
aacattcctcatgaatgtaaa

SEQ ID NO: 381965 - DNA, 14 bp, Homo sapiens
aacattctatttca

SEQ ID NO: 381966 - DNA, 17 bp, Homo sapiens
aacattgaccaagaact

SEQ ID NO: 381967 - DNA, 20 bp, Homo sapiens
aacattgaccaagaactgca

SEQ ID NO: 381968 - DNA, 21 bp, Homo sapiens
aacattgaccaagaactgcat

SEQ ID NO: 381969 - DNA, 22 bp, Homo sapiens
aacattgcactttataaacact

SEQ ID NO: 381970 - DNA, 13 bp, Homo sapiens
aacattgcatgta

SEQ ID NO: 381971 - DNA, 17 bp, Homo sapiens
aacattgccttgcattt

SEQ ID NO: 381972 - DNA, 23 bp, Homo sapiens
aacatttagacaatggctatatt

SEQ ID NO: 381973 - DNA, 18 bp, Homo sapiens
aacatttaggagaagttg

SEQ ID NO: 381974 - DNA, 20 bp, Homo sapiens
aacatttaggagaagttggt

SEQ ID NO: 381975 - DNA, 21 bp, Homo sapiens
aacatttctcatgtgctttgt

SEQ ID NO: 381976 - DNA, 22 bp, Homo sapiens
aacatttctcatgtgctttgta

SEQ ID NO: 381977 - DNA, 21 bp, Homo sapiens
aacatttgatgtctagataac

SEQ ID NO: 381978 - DNA, 20 bp, Homo sapiens
aacatttgctgaatatgcaa

SEQ ID NO: 381979 - DNA, 20 bp, Homo sapiens
aacatttgggagactgagct

SEQ ID NO: 381980 - DNA, 14 bp, Homo sapiens
aacatttgtacatt

SEQ ID NO: 381981 - DNA, 18 bp, Homo sapiens
aacattttttgtttcttg

SEQ ID NO: 381982 - DNA, 22 bp, Homo sapiens
aaccaacaattaggtctgcatt

SEQ ID NO: 381983 - DNA, 19 bp, Homo sapiens
aaccaacaccatcacagct

SEQ ID NO: 381984 - DNA, 15 bp, Homo sapiens
aaccaacccatgtat

SEQ ID NO: 381985 - DNA, 17 bp, Homo sapiens
aaccaacgggtctgtgg

SEQ ID NO: 381986 - DNA, 15 bp, Homo sapiens
aaccaagccttggct

SEQ ID NO: 381987 - DNA, 16 bp, Homo sapiens
aaccaagtcatgtgca

SEQ ID NO: 381988 - DNA, 22 bp, Homo sapiens
aaccaatggtgatcctctattt

SEQ ID NO: 381989 - DNA, 15 bp, Homo sapiens
aaccacacacctcac

SEQ ID NO: 381990 - DNA, 15 bp, Homo sapiens
aaccacagccctgtc

SEQ ID NO: 381991 - DNA, 17 bp, Homo sapiens
aaccaccgcatatgcat

SEQ ID NO: 381992 - DNA, 18 bp, Homo sapiens
aaccaccgcatatgcatg

SEQ ID NO: 381993 - DNA, 22 bp, Homo sapiens
aaccaccgcatatgcatgccag

SEQ ID NO: 381994 - DNA, 16 bp, Homo sapiens
aaccaccgctccccag

SEQ ID NO: 381995 - DNA, 19 bp, Homo sapiens
aaccaccgctccccagccc

SEQ ID NO: 381996 - DNA, 20 bp, Homo sapiens
aaccaccgctccccagccca

SEQ ID NO: 381997 - DNA, 18 bp, Homo sapiens
aaccactaatgttagaat

SEQ ID NO: 381998 - DNA, 19 bp, Homo sapiens
aaccactcaaattaatctt

SEQ ID NO: 381999 - DNA, 13 bp, Homo sapiens
aaccactgcttcc

SEQ ID NO: 382000 - DNA, 20 bp, Homo sapiens
aaccactgtaaaatgaaatt

SEQ ID NO: 382001 - DNA, 19 bp, Homo sapiens
aaccacttaaaaaatgtcc

SEQ ID NO: 382002 - DNA, 23 bp, Homo sapiens
aaccagaagtttctacattctct

SEQ ID NO: 382003 - DNA, 15 bp, Homo sapiens
aaccagagagaaaga

SEQ ID NO: 382004 - DNA, 23 bp, Homo sapiens
aaccagcaagtcccagacaagga

SEQ ID NO: 382005 - DNA, 16 bp, Homo sapiens
aaccagcactcccagg

SEQ ID NO: 382006 - DNA, 22 bp, Homo sapiens
aaccagctgtaacacagctgag

SEQ ID NO: 382007 - DNA, 20 bp, Homo sapiens
aaccaggaggggtctgcctc

SEQ ID NO: 382008 - DNA, 21 bp, Homo sapiens
aaccaggaggggtctgcctcc

SEQ ID NO: 382009 - DNA, 15 bp, Homo sapiens
aaccaggccttctga

SEQ ID NO: 382010 - DNA, 18 bp, Homo sapiens
aaccagggaagctgtccc

SEQ ID NO: 382011 - DNA, 13 bp, Homo sapiens
aaccagggaggag

SEQ ID NO: 382012 - DNA, 22 bp, Homo sapiens
aaccagggcaccaagcccacag

SEQ ID NO: 382013 - DNA, 23 bp, Homo sapiens
aaccagtctgaagtttcatttat

SEQ ID NO: 382014 - DNA, 16 bp, Homo sapiens
aaccagtgtctgaacc

SEQ ID NO: 382015 - DNA, 14 bp, Homo sapiens
aaccagttatgtga

SEQ ID NO: 382016 - DNA, 15 bp, Homo sapiens
aaccataaaataaat

SEQ ID NO: 382017 - DNA, 16 bp, Homo sapiens
aaccatagaactgtcc

SEQ ID NO: 382018 - DNA, 19 bp, Homo sapiens
aaccatatgattgaaaaga

SEQ ID NO: 382019 - DNA, 20 bp, Homo sapiens
aaccatatgattgaaaagaa

SEQ ID NO: 382020 - DNA, 21 bp, Homo sapiens
aaccatatgattgaaaagaag

SEQ ID NO: 382021 - DNA, 17 bp, Homo sapiens
aaccatcagttactggt

SEQ ID NO: 382022 - DNA, 16 bp, Homo sapiens
aaccatcattataaac

SEQ ID NO: 382023 - DNA, 20 bp, Homo sapiens
aaccatccatctgtggaaat

SEQ ID NO: 382024 - DNA, 16 bp, Homo sapiens
aaccatctggcctggc

SEQ ID NO: 382025 - DNA, 22 bp, Homo sapiens
aaccatgagaccactgttatca

SEQ ID NO: 382026 - DNA, 16 bp, Homo sapiens
aaccatggctgaagga

SEQ ID NO: 382027 - DNA, 22 bp, Homo sapiens
aaccatggctgaaggaaaccag

SEQ ID NO: 382028 - DNA, 13 bp, Homo sapiens
aaccattgcttca

SEQ ID NO: 382029 - DNA, 13 bp, Homo sapiens
aaccatttcttat

SEQ ID NO: 382030 - DNA, 23 bp, Homo sapiens
aaccattttgctgtcccttttcc

SEQ ID NO: 382031 - DNA, 22 bp, Homo sapiens
aaccattttttgttctgtgtcc

SEQ ID NO: 382032 - DNA, 22 bp, Homo sapiens
aacccacaagctgcctctgaca

SEQ ID NO: 382033 - DNA, 21 bp, Homo sapiens
aacccatcgtggtatgtgaat

SEQ ID NO: 382034 - DNA, 13 bp, Homo sapiens
aacccatctgtaa

SEQ ID NO: 382035 - DNA, 17 bp, Homo sapiens
aacccatcttccccgga

SEQ ID NO: 382036 - DNA, 21 bp, Homo sapiens
aacccatgcatggcctcccag

SEQ ID NO: 382037 - DNA, 23 bp, Homo sapiens
aacccattaatcttttgtagttt

SEQ ID NO: 382038 - DNA, 17 bp, Homo sapiens
aacccattcactacagg

SEQ ID NO: 382039 - DNA, 18 bp, Homo sapiens
aaccccaactcccagcct

SEQ ID NO: 382040 - DNA, 19 bp, Homo sapiens
aaccccaccttgccaagct

SEQ ID NO: 382041 - DNA, 13 bp, Homo sapiens
aaccccagcctga

SEQ ID NO: 382042 - DNA, 13 bp, Homo sapiens
aaccccatgggct

SEQ ID NO: 382043 - DNA, 13 bp, Homo sapiens
aacccccacccca

SEQ ID NO: 382044 - DNA, 11 bp, Homo sapiens
aacccccacct

SEQ ID NO: 382045 - DNA, 12 bp, Homo sapiens
aacccccacctc

SEQ ID NO: 382046 - DNA, 16 bp, Homo sapiens
aacccccacctcccgg

SEQ ID NO: 382047 - DNA, 13 bp, Homo sapiens
aacccccatcttt

SEQ ID NO: 382048 - DNA, 12 bp, Homo sapiens
aaccccccactc

SEQ ID NO: 382049 - DNA, 15 bp, Homo sapiens
aaccccccactccct

SEQ ID NO: 382050 - DNA, 23 bp, Homo sapiens
aacccccctcccagacaggccct

SEQ ID NO: 382051 - DNA, 22 bp, Homo sapiens
aacccccctccccaaggaagaa

SEQ ID NO: 382052 - DNA, 18 bp, Homo sapiens
aaccccgcggtgctctgg

SEQ ID NO: 382053 - DNA, 13 bp, Homo sapiens
aacccctgcctgg

SEQ ID NO: 382054 - DNA, 17 bp, Homo sapiens
aactcacctctcaaggt

SEQ ID NO: 382055 - DNA, 12 bp, Homo sapiens
aactcacctgct

SEQ ID NO: 382056 - DNA, 21 bp, Homo sapiens
aactcactgctcaagaagaca

SEQ ID NO: 382057 - DNA, 22 bp, Homo sapiens
aactcactgctcaagaagacat

SEQ ID NO: 382058 - DNA, 13 bp, Homo sapiens
aactcactgtgct

SEQ ID NO: 382059 - DNA, 16 bp, Homo sapiens
aactcagaatgctcta

SEQ ID NO: 382060 - DNA, 16 bp, Homo sapiens
aactcagacattccaa

SEQ ID NO: 382061 - DNA, 13 bp, Homo sapiens
aactcagccttaa

SEQ ID NO: 382062 - DNA, 10 bp, Homo sapiens
aactcaggtt

SEQ ID NO: 382063 - DNA, 15 bp, Homo sapiens
aactcagttttaact

SEQ ID NO: 382064 - DNA, 18 bp, Homo sapiens
aactcagttttaactaga

SEQ ID NO: 382065 - DNA, 16 bp, Homo sapiens
aactcatcataaaata

SEQ ID NO: 382066 - DNA, 17 bp, Homo sapiens
aactcatcataaaataa

SEQ ID NO: 382067 - DNA, 19 bp, Homo sapiens
aactcatgaacaaaatgaa

SEQ ID NO: 382068 - DNA, 19 bp, Homo sapiens
aactcatttttgccataca

SEQ ID NO: 382069 - DNA, 20 bp, Homo sapiens
aactcatttttgccatacat

SEQ ID NO: 382070 - DNA, 13 bp, Homo sapiens
aactccaaggcaa

SEQ ID NO: 382071 - DNA, 15 bp, Homo sapiens
aactccaaggcaaat

SEQ ID NO: 382072 - DNA, 17 bp, Homo sapiens
aactccaaggcaaatgt

SEQ ID NO: 382073 - DNA, 16 bp, Homo sapiens
aactccactctccttc

SEQ ID NO: 382074 - DNA, 22 bp, Homo sapiens
aactccagccacccagccagga

SEQ ID NO: 382075 - DNA, 22 bp, Homo sapiens
aactccagggttaaagaaaggc

SEQ ID NO: 382076 - DNA, 17 bp, Homo sapiens
aactccatacagcctct

SEQ ID NO: 382077 - DNA, 15 bp, Homo sapiens
aactccatgaccagg

SEQ ID NO: 382078 - DNA, 12 bp, Homo sapiens
aactccatgcct

SEQ ID NO: 382079 - DNA, 23 bp, Homo sapiens
aactccatgggattttatctgtg

SEQ ID NO: 382080 - DNA, 17 bp, Homo sapiens
aactccatggggttcga

SEQ ID NO: 382081 - DNA, 13 bp, Homo sapiens
aactcccaagaac

SEQ ID NO: 382082 - DNA, 17 bp, Homo sapiens
aactcccagccaccacc

SEQ ID NO: 382083 - DNA, 15 bp, Homo sapiens
aactcctactgcttc

SEQ ID NO: 382084 - DNA, 13 bp, Homo sapiens
aactcctgcctgt

SEQ ID NO: 382085 - DNA, 16 bp, Homo sapiens
aactcctgtcttgcta

SEQ ID NO: 382086 - DNA, 19 bp, Homo sapiens
aactccttccatccttgac

SEQ ID NO: 382087 - DNA, 13 bp, Homo sapiens
aactcgatgcact

SEQ ID NO: 382088 - DNA, 13 bp, Homo sapiens
aactcgggagcat

SEQ ID NO: 382089 - DNA, 21 bp, Homo sapiens
aactcgggagcattctgcctg

SEQ ID NO: 382090 - DNA, 13 bp, Homo sapiens
aactcgtctgatg

SEQ ID NO: 382091 - DNA, 20 bp, Homo sapiens
aactcgtctgatgttttgat

SEQ ID NO: 382092 - DNA, 16 bp, Homo sapiens
aactctaagtgtaaaa

SEQ ID NO: 382093 - DNA, 22 bp, Homo sapiens
aactctaattcccattttgcaa

SEQ ID NO: 382094 - DNA, 17 bp, Homo sapiens
aactctacccctgctcc

SEQ ID NO: 382095 - DNA, 11 bp, Homo sapiens
aactctagcct

SEQ ID NO: 382096 - DNA, 16 bp, Homo sapiens
aactctagtttgcaga

SEQ ID NO: 382097 - DNA, 21 bp, Homo sapiens
aactctatctgggcctgggct

SEQ ID NO: 382098 - DNA, 20 bp, Homo sapiens
aactctcaaaagtctatttt

SEQ ID NO: 382099 - DNA, 11 bp, Homo sapiens
aactctccaaa

SEQ ID NO: 382100 - DNA, 13 bp, Homo sapiens
aactctccccagt

SEQ ID NO: 382101 - DNA, 15 bp, Homo sapiens
aactctcctgctcct

SEQ ID NO: 382102 - DNA, 13 bp, Homo sapiens
aactctcctttga

SEQ ID NO: 382103 - DNA, 23 bp, Homo sapiens
aactctctagttccctcagtgtg

SEQ ID NO: 382104 - DNA, 20 bp, Homo sapiens
aactctctgtcttctctcca

SEQ ID NO: 382105 - DNA, 21 bp, Homo sapiens
aactctctgtcttctctccac

SEQ ID NO: 382106 - DNA, 22 bp, Homo sapiens
aactctctgtcttctctccact

SEQ ID NO: 382107 - DNA, 20 bp, Homo sapiens
aactctgcactccatggcca

SEQ ID NO: 382108 - DNA, 12 bp, Homo sapiens
aactctgcatag

SEQ ID NO: 382109 - DNA, 22 bp, Homo sapiens
aactctgtgcaggtgctgcctt

SEQ ID NO: 382110 - DNA, 17 bp, Homo sapiens
aactctgtgtcccagca

SEQ ID NO: 382111 - DNA, 19 bp, Homo sapiens
aactctgtgtcccagcacc

SEQ ID NO: 382112 - DNA, 14 bp, Homo sapiens
aactctgttccccc

SEQ ID NO: 382113 - DNA, 14 bp, Homo sapiens
aactcttcaaggcc

SEQ ID NO: 382114 - DNA, 23 bp, Homo sapiens
aactcttccccctctcccagttg

SEQ ID NO: 382115 - DNA, 13 bp, Homo sapiens
aactcttgctcac

SEQ ID NO: 382116 - DNA, 13 bp, Homo sapiens
aactcttgtattg

SEQ ID NO: 382117 - DNA, 18 bp, Homo sapiens
actctttttctaaagtgt

SEQ ID NO: 382118 - DNA, 17 bp, Homo sapiens
actgaaaacataaaaag

SEQ ID NO: 382119 - DNA, 18 bp, Homo sapiens
actgaaaacataaaaagt

SEQ ID NO: 382120 - DNA, 19 bp, Homo sapiens
actgaaaacataaaaagtt

SEQ ID NO: 382121 - DNA, 22 bp, Homo sapiens
actgaaaacatttcaaagctga

SEQ ID NO: 382122 - DNA, 20 bp, Homo sapiens
actgaaaactgtaaatacaa

SEQ ID NO: 382123 - DNA, 14 bp, Homo sapiens
actgaaagcagcag

SEQ ID NO: 382124 - DNA, 18 bp, Homo sapiens
actgaagacctccacatt

SEQ ID NO: 382125 - DNA, 13 bp, Homo sapiens
actgaagagacac

SEQ ID NO: 382126 - DNA, 22 bp, Homo sapiens
actgaagataatgaaatagtta

SEQ ID NO: 382127 - DNA, 18 bp, Homo sapiens
actgaagcaaataccaaa

SEQ ID NO: 382128 - DNA, 20 bp, Homo sapiens
actgaagcaaataccaaagc

SEQ ID NO: 382129 - DNA, 14 bp, Homo sapiens
actgaagcacgtga

SEQ ID NO: 382130 - DNA, 14 bp, Homo sapiens
actgaagcctgcag

SEQ ID NO: 382131 - DNA, 19 bp, Homo sapiens
actgaagcctgcaggagtt

SEQ ID NO: 382132 - DNA, 17 bp, Homo sapiens
actgaagcgaacatctt

SEQ ID NO: 382133 - DNA, 19 bp, Homo sapiens
actgaagcgaacatcttca

SEQ ID NO: 382134 - DNA, 20 bp, Homo sapiens
actgaagcgaacatcttcat

SEQ ID NO: 382135 - DNA, 23 bp, Homo sapiens
actgaagcgaacatcttcatata

SEQ ID NO: 382136 - DNA, 13 bp, Homo sapiens
actgaaggggcac

SEQ ID NO: 382137 - DNA, 20 bp, Homo sapiens
actgaagtgaatacatggta

SEQ ID NO: 382138 - DNA, 17 bp, Homo sapiens
actgaatatcatatgta

SEQ ID NO: 382139 - DNA, 18 bp, Homo sapiens
actgaatatcatatgtat

SEQ ID NO: 382140 - DNA, 21 bp, Homo sapiens
actgaatatttatatttcact

SEQ ID NO: 382141 - DNA, 18 bp, Homo sapiens
actgaatccatctttgta

SEQ ID NO: 382142 - DNA, 13 bp, Homo sapiens
actgaatttaact

SEQ ID NO: 382143 - DNA, 13 bp, Homo sapiens
actgaatttcttt

SEQ ID NO: 382144 - DNA, 22 bp, Homo sapiens
actgaatttctttgatttaact

SEQ ID NO: 382145 - DNA, 14 bp, Homo sapiens
actgacagaggggg

SEQ ID NO: 382146 - DNA, 12 bp, Homo sapiens
actgacatgtgg

SEQ ID NO: 382147 - DNA, 17 bp, Homo sapiens
actgaccccctcccctg

SEQ ID NO: 382148 - DNA, 20 bp, Homo sapiens
actgacctgctccgccagga

SEQ ID NO: 382149 - DNA, 18 bp, Homo sapiens
actgactaaccattgatg

SEQ ID NO: 382150 - DNA, 18 bp, Homo sapiens
actgactattcttgatgt

SEQ ID NO: 382151 - DNA, 15 bp, Homo sapiens
actgactgcagggac

SEQ ID NO: 382152 - DNA, 14 bp, Homo sapiens
actgacttctgcta

SEQ ID NO: 382153 - DNA, 15 bp, Homo sapiens
actgactttatcctc

SEQ ID NO: 382154 - DNA, 23 bp, Homo sapiens
actgagaaaacgaaactgctcta

SEQ ID NO: 382155 - DNA, 13 bp, Homo sapiens
actgagccaaaaa

SEQ ID NO: 382156 - DNA, 20 bp, Homo sapiens
actgagccagtcccaggggc

SEQ ID NO: 382157 - DNA, 14 bp, Homo sapiens
actgagccccacct

SEQ ID NO: 382158 - DNA, 21 bp, Homo sapiens
actgagcccttgcacaggcca

SEQ ID NO: 382159 - DNA, 22 bp, Homo sapiens
actgagcccttgcacaggccac

SEQ ID NO: 382160 - DNA, 13 bp, Homo sapiens
actgagctcctct

SEQ ID NO: 382161 - DNA, 16 bp, Homo sapiens
actgagctcctctggg

SEQ ID NO: 382162 - DNA, 19 bp, Homo sapiens
actgagctcctctgggcag

SEQ ID NO: 382163 - DNA, 14 bp, Homo sapiens
actgagctgccagt

SEQ ID NO: 382164 - DNA, 16 bp, Homo sapiens
actgagctgccagtgg

SEQ ID NO: 382165 - DNA, 17 bp, Homo sapiens
actgagcttctctgtga

SEQ ID NO: 382166 - DNA, 15 bp, Homo sapiens
actgaggaccagcca

SEQ ID NO: 382167 - DNA, 23 bp, Homo sapiens
actgaggatgacccggggcagct

SEQ ID NO: 382168 - DNA, 12 bp, Homo sapiens
actgaggcccag

SEQ ID NO: 382169 - DNA, 15 bp, Homo sapiens
actgaggcccagaga

SEQ ID NO: 382170 - DNA, 16 bp, Homo sapiens
actgaggcccagagag

SEQ ID NO: 382171 - DNA, 17 bp, Homo sapiens
actgaggcccagagagc

SEQ ID NO: 382172 - DNA, 18 bp, Homo sapiens
actgaggcccagagagct

SEQ ID NO: 382173 - DNA, 23 bp, Homo sapiens
actgaggcttagagagaggaggc

SEQ ID NO: 382174 - DNA, 15 bp, Homo sapiens
actgagtctgtggac

SEQ ID NO: 382175 - DNA, 16 bp, Homo sapiens
actgagtgcctgcagc

SEQ ID NO: 382176 - DNA, 23 bp, Homo sapiens
actgatatacttgagtgtgcaag

SEQ ID NO: 382177 - DNA, 16 bp, Homo sapiens
actgatatcacgggcc

SEQ ID NO: 382178 - DNA, 18 bp, Homo sapiens
actgatatcacgggcccg

SEQ ID NO: 382179 - DNA, 19 bp, Homo sapiens
actgatcatttgcagctgc

SEQ ID NO: 382180 - DNA, 22 bp, Homo sapiens
actgatcctgaacaagaaagag

SEQ ID NO: 382181 - DNA, 22 bp, Homo sapiens
actgatctctactaccacaagg

SEQ ID NO: 382182 - DNA, 20 bp, Homo sapiens
actgatgagacaacacacac

SEQ ID NO: 382183 - DNA, 20 bp, Homo sapiens
actgatggaccgggtgggcc

SEQ ID NO: 382184 - DNA, 20 bp, Homo sapiens
actggactatagcagggctg

SEQ ID NO: 382185 - DNA, 18 bp, Homo sapiens
actggagacaatgcagat

SEQ ID NO: 382186 - DNA, 23 bp, Homo sapiens
actggaggtgggcatgccaccct

SEQ ID NO: 382187 - DNA, 17 bp, Homo sapiens
actggagtcagatgagc

SEQ ID NO: 382188 - DNA, 20 bp, Homo sapiens
actggagtgaggcttccagg

SEQ ID NO: 382189 - DNA, 17 bp, Homo sapiens
actggagtgcagggagg

SEQ ID NO: 382190 - DNA, 14 bp, Homo sapiens
actggagttacatt

SEQ ID NO: 382191 - DNA, 20 bp, Homo sapiens
actggataaacttgcttcag

SEQ ID NO: 382192 - DNA, 10 bp, Homo sapiens
actggatgaa

SEQ ID NO: 382193 - DNA, 11 bp, Homo sapiens
actggatgaaa

SEQ ID NO: 382194 - DNA, 22 bp, Homo sapiens
actggatgaaataactccttct

SEQ ID NO: 382195 - DNA, 18 bp, Homo sapiens
actggatgcagaaacagt

SEQ ID NO: 382196 - DNA, 13 bp, Homo sapiens
actggattggcca

SEQ ID NO: 382197 - DNA, 14 bp, Homo sapiens
actggattggccaa

SEQ ID NO: 382198 - DNA, 12 bp, Homo sapiens
actggcagccag

SEQ ID NO: 382199 - DNA, 13 bp, Homo sapiens
actggcagctcct

SEQ ID NO: 382200 - DNA, 12 bp, Homo sapiens
actggcaggtgc

SEQ ID NO: 382201 - DNA, 13 bp, Homo sapiens
actggcaggtgca

SEQ ID NO: 382202 - DNA, 19 bp, Homo sapiens
actggccagagagggccca

SEQ ID NO: 382203 - DNA, 21 bp, Homo sapiens
actggccagagagggcccagc

SEQ ID NO: 382204 - DNA, 14 bp, Homo sapiens
actggccagaggca

SEQ ID NO: 382205 - DNA, 16 bp, Homo sapiens
actggccagaggcagc

SEQ ID NO: 382206 - DNA, 18 bp, Homo sapiens
actggccagtagctgcca

SEQ ID NO: 382207 - DNA, 15 bp, Homo sapiens
actggcccacccctc

SEQ ID NO: 382208 - DNA, 16 bp, Homo sapiens
actggcccacccctct

SEQ ID NO: 382209 - DNA, 23 bp, Homo sapiens
actggcccacccctcttccccct

SEQ ID NO: 382210 - DNA, 10 bp, Homo sapiens
actggcccca

SEQ ID NO: 382211 - DNA, 18 bp, Homo sapiens
actggctagagtcctcac

SEQ ID NO: 382212 - DNA, 22 bp, Homo sapiens
actggctcatattcctgcagcc

SEQ ID NO: 382213 - DNA, 23 bp, Homo sapiens
actggctctctccaggatccaga

SEQ ID NO: 382214 - DNA, 15 bp, Homo sapiens
actggctgcacagcc

SEQ ID NO: 382215 - DNA, 13 bp, Homo sapiens
actggctgctctg

SEQ ID NO: 382216 - DNA, 23 bp, Homo sapiens
actggctgctctgtcttggtcct

SEQ ID NO: 382217 - DNA, 11 bp, Homo sapiens
actggctgggg

SEQ ID NO: 382218 - DNA, 21 bp, Homo sapiens
actggctgtcagtatgacatt

SEQ ID NO: 382219 - DNA, 14 bp, Homo sapiens
actggctgtctgcc

SEQ ID NO: 382220 - DNA, 18 bp, Homo sapiens
actggctgtctgcctgta

SEQ ID NO: 382221 - DNA, 19 bp, Homo sapiens
actggcttctgcttgtcat

SEQ ID NO: 382222 - DNA, 20 bp, Homo sapiens
actggcttctgcttgtcatc

SEQ ID NO: 382223 - DNA, 19 bp, Homo sapiens
actgggaagataggctctg

SEQ ID NO: 382224 - DNA, 18 bp, Homo sapiens
actgggaagatgctggcc

SEQ ID NO: 382225 - DNA, 19 bp, Homo sapiens
actgggaagatgctggccc

SEQ ID NO: 382226 - DNA, 14 bp, Homo sapiens
actgggaagcatta

SEQ ID NO: 382227 - DNA, 19 bp, Homo sapiens
actgggaagcattactttg

SEQ ID NO: 382228 - DNA, 15 bp, Homo sapiens
actgggaagctggag

SEQ ID NO: 382229 - DNA, 16 bp, Homo sapiens
actgggaagctggagt

SEQ ID NO: 382230 - DNA, 16 bp, Homo sapiens
actgggagtcagagcc

SEQ ID NO: 382231 - DNA, 20 bp, Homo sapiens
actgggagtcagagccctgg

SEQ ID NO: 382232 - DNA, 18 bp, Homo sapiens
actgggatgtagagaggc

SEQ ID NO: 382233 - DNA, 18 bp, Homo sapiens
actgggattcatggcttt

SEQ ID NO: 382234 - DNA, 15 bp, Homo sapiens
actgggccccattct

SEQ ID NO: 382235 - DNA, 12 bp, Homo sapiens
actgggccggca

SEQ ID NO: 382236 - DNA, 18 bp, Homo sapiens
actgggccggcagcctgg

SEQ ID NO: 382237 - DNA, 14 bp, Homo sapiens
actgggctaatttg

SEQ ID NO: 382238 - DNA, 19 bp, Homo sapiens
actggggatcccgtgctgg

SEQ ID NO: 382239 - DNA, 17 bp, Homo sapiens
actgggggcctctgcct

SEQ ID NO: 382240 - DNA, 22 bp, Homo sapiens
actgggggcctctgcctccagg

SEQ ID NO: 382241 - DNA, 21 bp, Homo sapiens
actgggggtgccaaccacctc

SEQ ID NO: 382242 - DNA, 16 bp, Homo sapiens
actggggtgatgtttt

SEQ ID NO: 382243 - DNA, 16 bp, Homo sapiens
actgggtctcactcct

SEQ ID NO: 382244 - DNA, 21 bp, Homo sapiens
actgggttcttgttttatata

SEQ ID NO: 382245 - DNA, 22 bp, Homo sapiens
actgggttcttgttttatatac

SEQ ID NO: 382246 - DNA, 10 bp, Homo sapiens
actggtccag

SEQ ID NO: 382247 - DNA, 15 bp, Homo sapiens
actggtcctgtgtgc

SEQ ID NO: 382248 - DNA, 15 bp, Homo sapiens
actggtctgtaggga

SEQ ID NO: 382249 - DNA, 14 bp, Homo sapiens
actggtgagcagac

SEQ ID NO: 382250 - DNA, 16 bp, Homo sapiens
actggtgagcagactg

SEQ ID NO: 382251 - DNA, 15 bp, Homo sapiens
actggtgcatttaaa

SEQ ID NO: 382252 - DNA, 22 bp, Homo sapiens
actggtggcccgacagcctggc

SEQ ID NO: 382253 - DNA, 20 bp, Homo sapiens
actggtgggatctgtgccca

SEQ ID NO: 382254 - DNA, 17 bp, Homo sapiens
actggtgggcagctgag

SEQ ID NO: 382255 - DNA, 19 bp, Homo sapiens
actggttactcagctccct

SEQ ID NO: 382256 - DNA, 20 bp, Homo sapiens
actggttatagttgatatgt

SEQ ID NO: 382257 - DNA, 15 bp, Homo sapiens
actggttatcctgtg

SEQ ID NO: 382258 - DNA, 21 bp, Homo sapiens
actggttatcctgtgctacag

SEQ ID NO: 382259 - DNA, 10 bp, Homo sapiens
agttcaatgc

SEQ ID NO: 382260 - DNA, 17 bp, Homo sapiens
agttcaattgtgtctgt

SEQ ID NO: 382261 - DNA, 15 bp, Homo sapiens
agttcacaccctgca

SEQ ID NO: 382262 - DNA, 17 bp, Homo sapiens
agttcacaccctgcaag

SEQ ID NO: 382263 - DNA, 23 bp, Homo sapiens
agttcacaccctgcaaggcccac

SEQ ID NO: 382264 - DNA, 17 bp, Homo sapiens
agttcagcaccacccta

SEQ ID NO: 382265 - DNA, 15 bp, Homo sapiens
agttcagctgcttct

SEQ ID NO: 382266 - DNA, 16 bp, Homo sapiens
agttcaggaatttttg

SEQ ID NO: 382267 - DNA, 20 bp, Homo sapiens
agttcaggatttggtttttc

SEQ ID NO: 382268 - DNA, 16 bp, Homo sapiens
agttcagttcctcttt

SEQ ID NO: 382269 - DNA, 15 bp, Homo sapiens
agttcagttctgttt

SEQ ID NO: 382270 - DNA, 15 bp, Homo sapiens
agttcataaatttgt

SEQ ID NO: 382271 - DNA, 20 bp, Homo sapiens
agttcatagggtctcttcag

SEQ ID NO: 382272 - DNA, 18 bp, Homo sapiens
agttcatagtttctgtaa

SEQ ID NO: 382273 - DNA, 18 bp, Homo sapiens
agttcatccaatcctcac

SEQ ID NO: 382274 - DNA, 20 bp, Homo sapiens
agttcatccaatcctcactg

SEQ ID NO: 382275 - DNA, 19 bp, Homo sapiens
agttcatctctgctgaaca

SEQ ID NO: 382276 - DNA, 22 bp, Homo sapiens
agttcatcttgaattgtaagga

SEQ ID NO: 382277 - DNA, 17 bp, Homo sapiens
agttcatggtgatcagt

SEQ ID NO: 382278 - DNA, 16 bp, Homo sapiens
agttcattattttgtg

SEQ ID NO: 382279 - DNA, 17 bp, Homo sapiens
agttcattattttgtgg

SEQ ID NO: 382280 - DNA, 15 bp, Homo sapiens
agttccaatgtgccc

SEQ ID NO: 382281 - DNA, 18 bp, Homo sapiens
agttccagttttgttttg

SEQ ID NO: 382282 - DNA, 19 bp, Homo sapiens
agttccatggcaattttgt

SEQ ID NO: 382283 - DNA, 23 bp, Homo sapiens
agttcccccatcagttcccccag

SEQ ID NO: 382284 - DNA, 17 bp, Homo sapiens
agttccctacttcctgt

SEQ ID NO: 382285 - DNA, 15 bp, Homo sapiens
agttcccttggcctc

SEQ ID NO: 382286 - DNA, 18 bp, Homo sapiens
agttcccttggcctcaga

SEQ ID NO: 382287 - DNA, 14 bp, Homo sapiens
agttccgtctcctc

SEQ ID NO: 382288 - DNA, 19 bp, Homo sapiens
agttccgtctcctctccag

SEQ ID NO: 382289 - DNA, 13 bp, Homo sapiens
agttcctatcttt

SEQ ID NO: 382290 - DNA, 20 bp, Homo sapiens
agttcctgagtaccttctac

SEQ ID NO: 382291 - DNA, 23 bp, Homo sapiens
agttcctgggtttagctgtgaaa

SEQ ID NO: 382292 - DNA, 13 bp, Homo sapiens
agttcgagaccaa

SEQ ID NO: 382293 - DNA, 10 bp, Homo sapiens
agttctagat

SEQ ID NO: 382294 - DNA, 21 bp, Homo sapiens
agttctaggggagaagagccc

SEQ ID NO: 382295 - DNA, 19 bp, Homo sapiens
agttctatccccaagctgg

SEQ ID NO: 382296 - DNA, 15 bp, Homo sapiens
agttctcactatgtt

SEQ ID NO: 382297 - DNA, 17 bp, Homo sapiens
agttctcactatgtttc

SEQ ID NO: 382298 - DNA, 17 bp, Homo sapiens
agttctcactcctagga

SEQ ID NO: 382299 - DNA, 20 bp, Homo sapiens
agttctcagaactgttggct

SEQ ID NO: 382300 - DNA, 17 bp, Homo sapiens
agttctcatccacagag

SEQ ID NO: 382301 - DNA, 22 bp, Homo sapiens
agttctcatccacagaggccag

SEQ ID NO: 382302 - DNA, 16 bp, Homo sapiens
agttctctcccttcct

SEQ ID NO: 382303 - DNA, 13 bp, Homo sapiens
agttctctccttc

SEQ ID NO: 382304 - DNA, 13 bp, Homo sapiens
agttctgaaaact

SEQ ID NO: 382305 - DNA, 20 bp, Homo sapiens
agttctgaaggttggaactg

SEQ ID NO: 382306 - DNA, 12 bp, Homo sapiens
agttctgatgag

SEQ ID NO: 382307 - DNA, 15 bp, Homo sapiens
agttctgcaaataga

SEQ ID NO: 382308 - DNA, 18 bp, Homo sapiens
agttctgcaaatagaaaa

SEQ ID NO: 382309 - DNA, 15 bp, Homo sapiens
agttctgtgcctccc

SEQ ID NO: 382310 - DNA, 17 bp, Homo sapiens
agttctgtgcctccccc

SEQ ID NO: 382311 - DNA, 19 bp, Homo sapiens
agttctgtgcctcccccca

SEQ ID NO: 382312 - DNA, 23 bp, Homo sapiens
agttctgtgcctccccccagacc

SEQ ID NO: 382313 - DNA, 18 bp, Homo sapiens
agttctgtgtgtctggtg

SEQ ID NO: 382314 - DNA, 20 bp, Homo sapiens
agttctgttaaatatttttg

SEQ ID NO: 382315 - DNA, 21 bp, Homo sapiens
agttctgttaaatatttttgt

SEQ ID NO: 382316 - DNA, 12 bp, Homo sapiens
agttcttcacct

SEQ ID NO: 382317 - DNA, 18 bp, Homo sapiens
agttcttcacctctatcc

SEQ ID NO: 382318 - DNA, 19 bp, Homo sapiens
agttcttcgggaagagagg

SEQ ID NO: 382319 - DNA, 17 bp, Homo sapiens
agttcttggacccctga

SEQ ID NO: 382320 - DNA, 21 bp, Homo sapiens
agttcttgggggaggccaccc

SEQ ID NO: 382321 - DNA, 15 bp, Homo sapiens
agttctttgcaagct

SEQ ID NO: 382322 - DNA, 17 bp, Homo sapiens
agttctttgctgcccct

SEQ ID NO: 382323 - DNA, 18 bp, Homo sapiens
agttctttgttcctgctt

SEQ ID NO: 382324 - DNA, 19 bp, Homo sapiens
agttctttgttcctgcttt

SEQ ID NO: 382325 - DNA, 20 bp, Homo sapiens
agttgaaaatggatttttaa

SEQ ID NO: 382326 - DNA, 17 bp, Homo sapiens
agttgaagactttgttt

SEQ ID NO: 382327 - DNA, 14 bp, Homo sapiens
agttgaagagcctg

SEQ ID NO: 382328 - DNA, 21 bp, Homo sapiens
agttgaatgacaacagaagct

SEQ ID NO: 382329 - DNA, 22 bp, Homo sapiens
agttgaattttttttaacattc

SEQ ID NO: 382330 - DNA, 19 bp, Homo sapiens
agttgacatccaaatctag

SEQ ID NO: 382331 - DNA, 16 bp, Homo sapiens
agttgaccgttttcat

SEQ ID NO: 382332 - DNA, 19 bp, Homo sapiens
agttgaccgttttcatcct

SEQ ID NO: 382333 - DNA, 22 bp, Homo sapiens
agttgaccgttttcatcctggc

SEQ ID NO: 382334 - DNA, 23 bp, Homo sapiens
agttgaccgttttcatcctggcc

SEQ ID NO: 382335 - DNA, 23 bp, Homo sapiens
agttgacctttatttattaaact

SEQ ID NO: 382336 - DNA, 18 bp, Homo sapiens
agttgactggctttcctc

SEQ ID NO: 382337 - DNA, 23 bp, Homo sapiens
agttgagcacaggcaacattaca

SEQ ID NO: 382338 - DNA, 22 bp, Homo sapiens
agttgaggggcttccctctgct

SEQ ID NO: 382339 - DNA, 23 bp, Homo sapiens
agttgagtcttcacatttagaat

SEQ ID NO: 382340 - DNA, 17 bp, Homo sapiens
agttgataacccctctt

SEQ ID NO: 382341 - DNA, 20 bp, Homo sapiens
agttgatgaccaatctctgt

SEQ ID NO: 382342 - DNA, 22 bp, Homo sapiens
agttgattagcagttgaggcca

SEQ ID NO: 382343 - DNA, 20 bp, Homo sapiens
agttgcaattgaattaaatt

SEQ ID NO: 382344 - DNA, 20 bp, Homo sapiens
agttgcacttggcctctgga

SEQ ID NO: 382345 - DNA, 17 bp, Homo sapiens
agttgcagactcagttt

SEQ ID NO: 382346 - DNA, 20 bp, Homo sapiens
agttgcgacggagagaaaaa

SEQ ID NO: 382347 - DNA, 22 bp, Homo sapiens
agttgcgacggagagaaaaaag

SEQ ID NO: 382348 - DNA, 18 bp, Homo sapiens
agttgctagcaacaactt

SEQ ID NO: 382349 - DNA, 15 bp, Homo sapiens
agttgctgagaaatg

SEQ ID NO: 382350 - DNA, 18 bp, Homo sapiens
agttgctgagaaatgggg

SEQ ID NO: 382351 - DNA, 15 bp, Homo sapiens
agttggacacactgt

SEQ ID NO: 382352 - DNA, 14 bp, Homo sapiens
agttggactctcag

SEQ ID NO: 382353 - DNA, 15 bp, Homo sapiens
agttggactctcagg

SEQ ID NO: 382354 - DNA, 18 bp, Homo sapiens
agttggactgtggcctca

SEQ ID NO: 382355 - DNA, 19 bp, Homo sapiens
agttggactgtggcctcag

SEQ ID NO: 382356 - DNA, 20 bp, Homo sapiens
agttggcgttgtgggcaggc

SEQ ID NO: 382357 - DNA, 16 bp, Homo sapiens
agttggctagaagaaa

SEQ ID NO: 382358 - DNA, 23 bp, Homo sapiens
agttgggaacttcagatggacct

SEQ ID NO: 382359 - DNA, 15 bp, Homo sapiens
agttggtcttacttt

SEQ ID NO: 382360 - DNA, 23 bp, Homo sapiens
agttggttttgcatgtctgcatg

SEQ ID NO: 382361 - DNA, 16 bp, Homo sapiens
agttgtcacatcagat

SEQ ID NO: 382362 - DNA, 20 bp, Homo sapiens
agttgtcccgattgtaactc

SEQ ID NO: 382363 - DNA, 18 bp, Homo sapiens
agttgtctattctgagcc

SEQ ID NO: 382364 - DNA, 21 bp, Homo sapiens
agttgtctattctgagccttg

SEQ ID NO: 382365 - DNA, 17 bp, Homo sapiens
agttgtctgagctgctg

SEQ ID NO: 382366 - DNA, 14 bp, Homo sapiens
agttgtctttcttt

SEQ ID NO: 382367 - DNA, 19 bp, Homo sapiens
agttgtgccttttatagct

SEQ ID NO: 382368 - DNA, 23 bp, Homo sapiens
agttgtgccttttatagctatta

SEQ ID NO: 382369 - DNA, 20 bp, Homo sapiens
agttgttcaataataaatat

SEQ ID NO: 382370 - DNA, 21 bp, Homo sapiens
agttgtttcaaacagcatcaa

SEQ ID NO: 382371 - DNA, 23 bp, Homo sapiens
agttgtttctaagagcagagtct

SEQ ID NO: 382372 - DNA, 15 bp, Homo sapiens
agtttaaaaaaataa

SEQ ID NO: 382373 - DNA, 16 bp, Homo sapiens
agtttaaaaaaataac

SEQ ID NO: 382374 - DNA, 18 bp, Homo sapiens
agtttaaaaaaataacat

SEQ ID NO: 382375 - DNA, 17 bp, Homo sapiens
agtttaaaattattaaa

SEQ ID NO: 382376 - DNA, 13 bp, Homo sapiens
agtttaaatacca

SEQ ID NO: 382377 - DNA, 12 bp, Homo sapiens
agtttaacacaa

SEQ ID NO: 382378 - DNA, 15 bp, Homo sapiens
agtttacaagtgtat

SEQ ID NO: 382379 - DNA, 18 bp, Homo sapiens
agtttacagtaaataaat

SEQ ID NO: 382380 - DNA, 13 bp, Homo sapiens
agtttacattgta

SEQ ID NO: 382381 - DNA, 14 bp, Homo sapiens
agtttaccaatcaa

SEQ ID NO: 382382 - DNA, 13 bp, Homo sapiens
agtttaccatttg

SEQ ID NO: 382383 - DNA, 14 bp, Homo sapiens
agtttaccatttgt

SEQ ID NO: 382384 - DNA, 19 bp, Homo sapiens
agtttaccatttgtaataa

SEQ ID NO: 382385 - DNA, 21 bp, Homo sapiens
agtttaccatttgtaataaag

SEQ ID NO: 382386 - DNA, 20 bp, Homo sapiens
agtttagaaattacaagttt

SEQ ID NO: 382387 - DNA, 14 bp, Homo sapiens
agtttatacagttt

SEQ ID NO: 382388 - DNA, 21 bp, Homo sapiens
acagtgggtggcacctcctga

SEQ ID NO: 382389 - DNA, 13 bp, Homo sapiens
acagtgtaagctt

SEQ ID NO: 382390 - DNA, 23 bp, Homo sapiens
acagtgtaagcttagattttctg

SEQ ID NO: 382391 - DNA, 21 bp, Homo sapiens
acagtgtaatccaggggtgta

SEQ ID NO: 382392 - DNA, 24 bp, Homo sapiens
acagtgtctgtatcggagacagtg

SEQ ID NO: 382393 - DNA, 14 bp, Homo sapiens
acagtgttctgagc

SEQ ID NO: 382394 - DNA, 16 bp, Homo sapiens
acagtgttctgagccc

SEQ ID NO: 382395 - DNA, 15 bp, Homo sapiens
acagtgtttcccata

SEQ ID NO: 382396 - DNA, 23 bp, Homo sapiens
acagtgtttcccataattttctt

SEQ ID NO: 382397 - DNA, 15 bp, Homo sapiens
acagttaaacttgca

SEQ ID NO: 382398 - DNA, 16 bp, Homo sapiens
acagttaaacttgcaa

SEQ ID NO: 382399 - DNA, 14 bp, Homo sapiens
acagttaactttca

SEQ ID NO: 382400 - DNA, 23 bp, Homo sapiens
acagttcaataaacttaacttta

SEQ ID NO: 382401 - DNA, 15 bp, Homo sapiens
acagttcacaccctg

SEQ ID NO: 382402 - DNA, 12 bp, Homo sapiens
acagttcagttc

SEQ ID NO: 382403 - DNA, 21 bp, Homo sapiens
acagttcagttcctctttgca

SEQ ID NO: 382404 - DNA, 23 bp, Homo sapiens
acagttcataaatttgttgtcat

SEQ ID NO: 382405 - DNA, 15 bp, Homo sapiens
acagttcatatgtac

SEQ ID NO: 382406 - DNA, 16 bp, Homo sapiens
acagttctctccttct

SEQ ID NO: 382407 - DNA, 20 bp, Homo sapiens
acagttcttcgggaagagag

SEQ ID NO: 382408 - DNA, 24 bp, Homo sapiens
acagttcttcgggaagagaggagt

SEQ ID NO: 382409 - DNA, 13 bp, Homo sapiens
acagttggcagag

SEQ ID NO: 382410 - DNA, 14 bp, Homo sapiens
acagttggcagaga

SEQ ID NO: 382411 - DNA, 14 bp, Homo sapiens
acagttgggtgaga

SEQ ID NO: 382412 - DNA, 23 bp, Homo sapiens
acagttggttttgcatgtctgca

SEQ ID NO: 382413 - DNA, 15 bp, Homo sapiens
acagttgttggcctc

SEQ ID NO: 382414 - DNA, 17 bp, Homo sapiens
acagtttatgcagtgct

SEQ ID NO: 382415 - DNA, 19 bp, Homo sapiens
acagtttatgcagtgctgc

SEQ ID NO: 382416 - DNA, 14 bp, Homo sapiens
acagtttgatgctg

SEQ ID NO: 382417 - DNA, 21 bp, Homo sapiens
acagtttgctatttgctttag

SEQ ID NO: 382418 - DNA, 21 bp, Homo sapiens
acagtttggaagtgttaacta

SEQ ID NO: 382419 - DNA, 21 bp, Homo sapiens
acagttttaaagaatcattat

SEQ ID NO: 382420 - DNA, 16 bp, Homo sapiens
acagttttccatgaaa

SEQ ID NO: 382421 - DNA, 22 bp, Homo sapiens
acataaaaagttaaaaaaaata

SEQ ID NO: 382422 - DNA, 15 bp, Homo sapiens
acataaaacaaaacc

SEQ ID NO: 382423 - DNA, 23 bp, Homo sapiens
acataaaacaaaaccaagccttg

SEQ ID NO: 382424 - DNA, 12 bp, Homo sapiens
acataaacccat

SEQ ID NO: 382425 - DNA, 16 bp, Homo sapiens
acataaacccatctgt

SEQ ID NO: 382426 - DNA, 18 bp, Homo sapiens
acataaacccatctgtaa

SEQ ID NO: 382427 - DNA, 13 bp, Homo sapiens
acataaactgact

SEQ ID NO: 382428 - DNA, 12 bp, Homo sapiens
acataaagtaaa

SEQ ID NO: 382429 - DNA, 17 bp, Homo sapiens
acataaatctgtctgat

SEQ ID NO: 382430 - DNA, 22 bp, Homo sapiens
acataaatctgtctgattctat

SEQ ID NO: 382431 - DNA, 13 bp, Homo sapiens
acataaattagag

SEQ ID NO: 382432 - DNA, 13 bp, Homo sapiens
acataacacacat

SEQ ID NO: 382433 - DNA, 15 bp, Homo sapiens
acataactgtaacat

SEQ ID NO: 382434 - DNA, 17 bp, Homo sapiens
acataatatcttgaaga

SEQ ID NO: 382435 - DNA, 19 bp, Homo sapiens
acataatctagtttacaga

SEQ ID NO: 382436 - DNA, 22 bp, Homo sapiens
acataatgagtaatgcagacat

SEQ ID NO: 382437 - DNA, 13 bp, Homo sapiens
acatacacacacg

SEQ ID NO: 382438 - DNA, 12 bp, Homo sapiens
acatacagtgat

SEQ ID NO: 382439 - DNA, 16 bp, Homo sapiens
acatacagtgatatgg

SEQ ID NO: 382440 - DNA, 14 bp, Homo sapiens
acatactctgctta

SEQ ID NO: 382441 - DNA, 13 bp, Homo sapiens
acatagacattcc

SEQ ID NO: 382442 - DNA, 20 bp, Homo sapiens
acatagattcacctgtaaaa

SEQ ID NO: 382443 - DNA, 15 bp, Homo sapiens
acatagcccctgccc

SEQ ID NO: 382444 - DNA, 19 bp, Homo sapiens
acatagctatcaagtgtgc

SEQ ID NO: 382445 - DNA, 19 bp, Homo sapiens
acatagtgggccttcatta

SEQ ID NO: 382446 - DNA, 15 bp, Homo sapiens
acatagtggtcattt

SEQ ID NO: 382447 - DNA, 19 bp, Homo sapiens
acatagtttcttttttaat

SEQ ID NO: 382448 - DNA, 19 bp, Homo sapiens
acatagttttaaactcatt

SEQ ID NO: 382449 - DNA, 18 bp, Homo sapiens
acatataaattaatacat

SEQ ID NO: 382450 - DNA, 20 bp, Homo sapiens
acatataaattaatacataa

SEQ ID NO: 382451 - DNA, 14 bp, Homo sapiens
acatatacatctag

SEQ ID NO: 382452 - DNA, 20 bp, Homo sapiens
acatatatatattttttaat

SEQ ID NO: 382453 - DNA, 17 bp, Homo sapiens
acatatcatgtgtgaga

SEQ ID NO: 382454 - DNA, 18 bp, Homo sapiens
acatatggaaatcctgtt

SEQ ID NO: 382455 - DNA, 22 bp, Homo sapiens
acatattaagaatagtctctgg

SEQ ID NO: 382456 - DNA, 21 bp, Homo sapiens
acatattcttgctttcacaaa

SEQ ID NO: 382457 - DNA, 17 bp, Homo sapiens
acatattggaaaggtca

SEQ ID NO: 382458 - DNA, 21 bp, Homo sapiens
acatatttcttgagtaattta

SEQ ID NO: 382459 - DNA, 17 bp, Homo sapiens
acatattttcctttaga

SEQ ID NO: 382460 - DNA, 14 bp, Homo sapiens
acatcaaagactcc

SEQ ID NO: 382461 - DNA, 13 bp, Homo sapiens
acatcaagaaaac

SEQ ID NO: 382462 - DNA, 11 bp, Homo sapiens
acatcaagata

SEQ ID NO: 382463 - DNA, 14 bp, Homo sapiens
acatcaatgttcat

SEQ ID NO: 382464 - DNA, 18 bp, Homo sapiens
acatcaatgttcattgta

SEQ ID NO: 382465 - DNA, 20 bp, Homo sapiens
acatcaatgttcattgtaat

SEQ ID NO: 382466 - DNA, 20 bp, Homo sapiens
acatcagacctgtcttccaa

SEQ ID NO: 382467 - DNA, 12 bp, Homo sapiens
acatcagataag

SEQ ID NO: 382468 - DNA, 12 bp, Homo sapiens
acatcagcttga

SEQ ID NO: 382469 - DNA, 23 bp, Homo sapiens
acatcagtccacccccattgtga

SEQ ID NO: 382470 - DNA, 22 bp, Homo sapiens
acatcagtggcatggctccagt

SEQ ID NO: 382471 - DNA, 17 bp, Homo sapiens
acatcatgaattttaca

SEQ ID NO: 382472 - DNA, 14 bp, Homo sapiens
acatcatgttattt

SEQ ID NO: 382473 - DNA, 22 bp, Homo sapiens
acatcatttctttttgggagag

SEQ ID NO: 382474 - DNA, 21 bp, Homo sapiens
acatccaacatttcctcaggc

SEQ ID NO: 382475 - DNA, 20 bp, Homo sapiens
acatccatgtttgtaaaact

SEQ ID NO: 382476 - DNA, 13 bp, Homo sapiens
acatcccagcctg

SEQ ID NO: 382477 - DNA, 14 bp, Homo sapiens
acatcccagcctgt

SEQ ID NO: 382478 - DNA, 16 bp, Homo sapiens
acatcctcaaaagaaa

SEQ ID NO: 382479 - DNA, 17 bp, Homo sapiens
acatcgcttctttttca

SEQ ID NO: 382480 - DNA, 12 bp, Homo sapiens
acatctcagacc

SEQ ID NO: 382481 - DNA, 22 bp, Homo sapiens
acatctcagaccctttagccaa

SEQ ID NO: 382482 - DNA, 18 bp, Homo sapiens
acatctcccttccacctc

SEQ ID NO: 382483 - DNA, 16 bp, Homo sapiens
acatctcgagccccct

SEQ ID NO: 382484 - DNA, 20 bp, Homo sapiens
acatctcgagccccctggat

SEQ ID NO: 382485 - DNA, 11 bp, Homo sapiens
acatctgaaaa

SEQ ID NO: 382486 - DNA, 15 bp, Homo sapiens
acatctgaagtgtct

SEQ ID NO: 382487 - DNA, 20 bp, Homo sapiens
acatctgcaatatgaattca

SEQ ID NO: 382488 - DNA, 21 bp, Homo sapiens
acatctgcagctctttcttct

SEQ ID NO: 382489 - DNA, 15 bp, Homo sapiens
acatctgccttgctg

SEQ ID NO: 382490 - DNA, 16 bp, Homo sapiens
acatctgccttgctgc

SEQ ID NO: 382491 - DNA, 13 bp, Homo sapiens
acatcttcaaagc

SEQ ID NO: 382492 - DNA, 14 bp, Homo sapiens
acatcttcatataa

SEQ ID NO: 382493 - DNA, 15 bp, Homo sapiens
acatcttcatataaa

SEQ ID NO: 382494 - DNA, 16 bp, Homo sapiens
acatcttcatataaac

SEQ ID NO: 382495 - DNA, 17 bp, Homo sapiens
acatcttcatataaact

SEQ ID NO: 382496 - DNA, 23 bp, Homo sapiens
acatcttccctagagggttcctg

SEQ ID NO: 382497 - DNA, 16 bp, Homo sapiens
acatcttgtcttttcc

SEQ ID NO: 382498 - DNA, 18 bp, Homo sapiens
acatctttatcattaaac

SEQ ID NO: 382499 - DNA, 20 bp, Homo sapiens
acatctttatcattaaacat

SEQ ID NO: 382500 - DNA, 15 bp, Homo sapiens
agtgctgggcccagc

SEQ ID NO: 382501 - DNA, 18 bp, Homo sapiens
agtgctgtacccttccac

SEQ ID NO: 382502 - DNA, 22 bp, Homo sapiens
agtgctgtacccttccacctcc

SEQ ID NO: 382503 - DNA, 16 bp, Homo sapiens
agtgcttcttgtaata

SEQ ID NO: 382504 - DNA, 22 bp, Homo sapiens
agtgcttgccaccaccagatga

SEQ ID NO: 382505 - DNA, 23 bp, Homo sapiens
agtgcttgctgttcccatccctg

SEQ ID NO: 382506 - DNA, 13 bp, Homo sapiens
agtgcttggcaca

SEQ ID NO: 382507 - DNA, 19 bp, Homo sapiens
agtgctttacatgctgtgc

SEQ ID NO: 382508 - DNA, 23 bp, Homo sapiens
agtgctttacctttattaatgaa

SEQ ID NO: 382509 - DNA, 13 bp, Homo sapiens
agtgctttgtaat

SEQ ID NO: 382510 - DNA, 12 bp, Homo sapiens
agtggaaaaaag

SEQ ID NO: 382511 - DNA, 14 bp, Homo sapiens
agtggaaaaaagag

SEQ ID NO: 382512 - DNA, 14 bp, Homo sapiens
agtggaaagtgatt

SEQ ID NO: 382513 - DNA, 15 bp, Homo sapiens
agtggaaatgttcta

SEQ ID NO: 382514 - DNA, 16 bp, Homo sapiens
agtggaagaagaaaac

SEQ ID NO: 382515 - DNA, 14 bp, Homo sapiens
agtggaagagcagc

SEQ ID NO: 382516 - DNA, 19 bp, Homo sapiens
agtggaagagcagcctgat

SEQ ID NO: 382517 - DNA, 23 bp, Homo sapiens
agtggaagagcagcctgatggcc

SEQ ID NO: 382518 - DNA, 17 bp, Homo sapiens
agtggaagccactggac

SEQ ID NO: 382519 - DNA, 17 bp, Homo sapiens
agtggaatgcagggaag

SEQ ID NO: 382520 - DNA, 21 bp, Homo sapiens
agtggacagagggagaaggga

SEQ ID NO: 382521 - DNA, 23 bp, Homo sapiens
agtggacagagggagaagggaga

SEQ ID NO: 382522 - DNA, 19 bp, Homo sapiens
agtggaccttgagaccaca

SEQ ID NO: 382523 - DNA, 21 bp, Homo sapiens
agtggactcttccctctcgct

SEQ ID NO: 382524 - DNA, 22 bp, Homo sapiens
agtggactcttccctctcgctc

SEQ ID NO: 382525 - DNA, 15 bp, Homo sapiens
agtggactttccacc

SEQ ID NO: 382526 - DNA, 19 bp, Homo sapiens
agtggactttccaccccct

SEQ ID NO: 382527 - DNA, 20 bp, Homo sapiens
agtggactttccaccccctc

SEQ ID NO: 382528 - DNA, 22 bp, Homo sapiens
agtggactttccaccccctccc

SEQ ID NO: 382529 - DNA, 12 bp, Homo sapiens
agtggagaggga

SEQ ID NO: 382530 - DNA, 11 bp, Homo sapiens
agtggaggcat

SEQ ID NO: 382531 - DNA, 15 bp, Homo sapiens
agtggaggcattgtt

SEQ ID NO: 382532 - DNA, 18 bp, Homo sapiens
agtggaggggtcagcagg

SEQ ID NO: 382533 - DNA, 21 bp, Homo sapiens
agtggaggttgagtgagccgg

SEQ ID NO: 382534 - DNA, 23 bp, Homo sapiens
agtggaggttgagtgagccggga

SEQ ID NO: 382535 - DNA, 15 bp, Homo sapiens
agtggatagatgccc

SEQ ID NO: 382536 - DNA, 14 bp, Homo sapiens
agtggatcacacac

SEQ ID NO: 382537 - DNA, 13 bp, Homo sapiens
agtggatctggag

SEQ ID NO: 382538 - DNA, 17 bp, Homo sapiens
agtggatgcattcctga

SEQ ID NO: 382539 - DNA, 18 bp, Homo sapiens
agtggatgcattcctgag

SEQ ID NO: 382540 - DNA, 17 bp, Homo sapiens
agtggattctggatggc

SEQ ID NO: 382541 - DNA, 14 bp, Homo sapiens
agtggattgcattt

SEQ ID NO: 382542 - DNA, 16 bp, Homo sapiens
agtggattttcctgaa

SEQ ID NO: 382543 - DNA, 14 bp, Homo sapiens
agtggcagagccag

SEQ ID NO: 382544 - DNA, 14 bp, Homo sapiens
agtggcagccatgc

SEQ ID NO: 382545 - DNA, 21 bp, Homo sapiens
agtggcagctgtcccctctcc

SEQ ID NO: 382546 - DNA, 16 bp, Homo sapiens
agtggcatgtgctgtg

SEQ ID NO: 382547 - DNA, 14 bp, Homo sapiens
agtggccagaccag

SEQ ID NO: 382548 - DNA, 17 bp, Homo sapiens
agtggccagaccagagc

SEQ ID NO: 382549 - DNA, 21 bp, Homo sapiens
agtggcccctcacctgggcct

SEQ ID NO: 382550 - DNA, 23 bp, Homo sapiens
agtggcccctggcacctgggtgc

SEQ ID NO: 382551 - DNA, 18 bp, Homo sapiens
agtggccgaaccccccac

SEQ ID NO: 382552 - DNA, 21 bp, Homo sapiens
agtggccgaaccccccactcc

SEQ ID NO: 382553 - DNA, 20 bp, Homo sapiens
agtggcctcaaccctccctc

SEQ ID NO: 382554 - DNA, 16 bp, Homo sapiens
agtggctcatgcctgt

SEQ ID NO: 382555 - DNA, 18 bp, Homo sapiens
agtggctgacagagcagg

SEQ ID NO: 382556 - DNA, 20 bp, Homo sapiens
agtggctgggtgggcccaga

SEQ ID NO: 382557 - DNA, 23 bp, Homo sapiens
agtggctgggtgggcccagaact

SEQ ID NO: 382558 - DNA, 15 bp, Homo sapiens
agtggctggtccagg

SEQ ID NO: 382559 - DNA, 18 bp, Homo sapiens
agtggcttcagcccctgg

SEQ ID NO: 382560 - DNA, 20 bp, Homo sapiens
agtggcttggagcagaggtg

SEQ ID NO: 382561 - DNA, 19 bp, Homo sapiens
agtggcttttgccccagaa

SEQ ID NO: 382562 - DNA, 14 bp, Homo sapiens
agtgggaagagctg

SEQ ID NO: 382563 - DNA, 15 bp, Homo sapiens
agtgggaagtgaatc

SEQ ID NO: 382564 - DNA, 19 bp, Homo sapiens
agtgggacagggcatggcc

SEQ ID NO: 382565 - DNA, 21 bp, Homo sapiens
agtgggacagggcatggccag

SEQ ID NO: 382566 - DNA, 18 bp, Homo sapiens
agtgggacccatagatct

SEQ ID NO: 382567 - DNA, 21 bp, Homo sapiens
agtgggacccatagatcttct

SEQ ID NO: 382568 - DNA, 23 bp, Homo sapiens
agtgggacccatagatcttctga

SEQ ID NO: 382569 - DNA, 18 bp, Homo sapiens
agtgggagaagtggcccc

SEQ ID NO: 382570 - DNA, 11 bp, Homo sapiens
agtgggagagg

SEQ ID NO: 382571 - DNA, 18 bp, Homo sapiens
agtgggaggagagggcag

SEQ ID NO: 382572 - DNA, 18 bp, Homo sapiens
agtgggagtcaagtgtgc

SEQ ID NO: 382573 - DNA, 23 bp, Homo sapiens
agtgggagtcaagtgtgcctgct

SEQ ID NO: 382574 - DNA, 15 bp, Homo sapiens
agtgggagtgggaga

SEQ ID NO: 382575 - DNA, 20 bp, Homo sapiens
agtgggattatcgagcatgt

SEQ ID NO: 382576 - DNA, 14 bp, Homo sapiens
agtgggcacctcag

SEQ ID NO: 382577 - DNA, 13 bp, Homo sapiens
agtgggcaggtgg

SEQ ID NO: 382578 - DNA, 14 bp, Homo sapiens
agtgggctggtatt

SEQ ID NO: 382579 - DNA, 21 bp, Homo sapiens
agtgggctggtattctctcta

SEQ ID NO: 382580 - DNA, 14 bp, Homo sapiens
agtgggctttccag

SEQ ID NO: 382581 - DNA, 14 bp, Homo sapiens
agtggggaaaaaaa

SEQ ID NO: 382582 - DNA, 16 bp, Homo sapiens
agtggggaggagactc

SEQ ID NO: 382583 - DNA, 23 bp, Homo sapiens
agtggggaggggcctggcctggg

SEQ ID NO: 382584 - DNA, 21 bp, Homo sapiens
agtggggccagggtgggaggg

SEQ ID NO: 382585 - DNA, 20 bp, Homo sapiens
agtggggcccatggccccag

SEQ ID NO: 382586 - DNA, 22 bp, Homo sapiens
agtggggcccatggccccagct

SEQ ID NO: 382587 - DNA, 15 bp, Homo sapiens
agtggggccccaaag

SEQ ID NO: 382588 - DNA, 21 bp, Homo sapiens
agtggggccccaaagcccagc

SEQ ID NO: 382589 - DNA, 19 bp, Homo sapiens
agtgggggagagcaggctg

SEQ ID NO: 382590 - DNA, 15 bp, Homo sapiens
agtgggggtgcctgg

SEQ ID NO: 382591 - DNA, 19 bp, Homo sapiens
agtggggttgcaaccactg

SEQ ID NO: 382592 - DNA, 22 bp, Homo sapiens
agtggggttgcaaccactgcaa

SEQ ID NO: 382593 - DNA, 13 bp, Homo sapiens
agtgggtcacctg

SEQ ID NO: 382594 - DNA, 15 bp, Homo sapiens
agtgggtggcacctc

SEQ ID NO: 382595 - DNA, 19 bp, Homo sapiens
agtgggtgggacacagaga

SEQ ID NO: 382596 - DNA, 22 bp, Homo sapiens
agtgggtggggctgtacacacc

SEQ ID NO: 382597 - DNA, 15 bp, Homo sapiens
agtgggttttttagt

SEQ ID NO: 382598 - DNA, 14 bp, Homo sapiens
actgcctctgccac

SEQ ID NO: 382599 - DNA, 18 bp, Homo sapiens
actgcctctgccttagag

SEQ ID NO: 382600 - DNA, 12 bp, Homo sapiens
actgcctgccca

SEQ ID NO: 382601 - DNA, 19 bp, Homo sapiens
actgcctgttaagtctgag

SEQ ID NO: 382602 - DNA, 14 bp, Homo sapiens
actgccttaaaact

SEQ ID NO: 382603 - DNA, 15 bp, Homo sapiens
actgcgccacctgct

SEQ ID NO: 382604 - DNA, 15 bp, Homo sapiens
actgctaaatttacg

SEQ ID NO: 382605 - DNA, 16 bp, Homo sapiens
actgctaataaatgac

SEQ ID NO: 382606 - DNA, 22 bp, Homo sapiens
actgctaataaatgaccagttt

SEQ ID NO: 382607 - DNA, 14 bp, Homo sapiens
actgctacacttct

SEQ ID NO: 382608 - DNA, 16 bp, Homo sapiens
actgctacacttctga

SEQ ID NO: 382609 - DNA, 22 bp, Homo sapiens
actgctaggtgggccagcccct

SEQ ID NO: 382610 - DNA, 20 bp, Homo sapiens
actgctccatttataacccc

SEQ ID NO: 382611 - DNA, 23 bp, Homo sapiens
actgctccatttataaccccagc

SEQ ID NO: 382612 - DNA, 19 bp, Homo sapiens
actgctgatgctgaaataa

SEQ ID NO: 382613 - DNA, 23 bp, Homo sapiens
actgctgatgctgaaataaacta

SEQ ID NO: 382614 - DNA, 15 bp, Homo sapiens
actgctgcaccagag

SEQ ID NO: 382615 - DNA, 12 bp, Homo sapiens
actgctgcccca

SEQ ID NO: 382616 - DNA, 16 bp, Homo sapiens
actgctgctcctcttt

SEQ ID NO: 382617 - DNA, 13 bp, Homo sapiens
actgctgctgcct

SEQ ID NO: 382618 - DNA, 13 bp, Homo sapiens
actgctggctgcc

SEQ ID NO: 382619 - DNA, 15 bp, Homo sapiens
actgctggctgcctt

SEQ ID NO: 382620 - DNA, 13 bp, Homo sapiens
actgctgtcattg

SEQ ID NO: 382621 - DNA, 18 bp, Homo sapiens
actgctgtccctcctgag

SEQ ID NO: 382622 - DNA, 19 bp, Homo sapiens
actgctgttcctgctccat

SEQ ID NO: 382623 - DNA, 20 bp, Homo sapiens
actgctgttcctgctccatg

SEQ ID NO: 382624 - DNA, 14 bp, Homo sapiens
actgcttctgcttt

SEQ ID NO: 382625 - DNA, 11 bp, Homo sapiens
actgcttgcat

SEQ ID NO: 382626 - DNA, 16 bp, Homo sapiens
actgcttgcatttctt

SEQ ID NO: 382627 - DNA, 14 bp, Homo sapiens
actgctttgagaaa

SEQ ID NO: 382628 - DNA, 18 bp, Homo sapiens
actgcttttttttttcca

SEQ ID NO: 382629 - DNA, 19 bp, Homo sapiens
actgcttttttttttccag

SEQ ID NO: 382630 - DNA, 17 bp, Homo sapiens
atatacagatgaaaatt

SEQ ID NO: 382631 - DNA, 18 bp, Homo sapiens
atatacagatgaaaattt

SEQ ID NO: 382632 - DNA, 19 bp, Homo sapiens
atatacagcaggatgtgcc

SEQ ID NO: 382633 - DNA, 17 bp, Homo sapiens
atatacagtttttgtaa

SEQ ID NO: 382634 - DNA, 18 bp, Homo sapiens
atatacatctagcacagc

SEQ ID NO: 382635 - DNA, 22 bp, Homo sapiens
atatacctggcttttactttat

SEQ ID NO: 382636 - DNA, 13 bp, Homo sapiens
atatactaataaa

SEQ ID NO: 382637 - DNA, 19 bp, Homo sapiens
atatactcagggattcctt

SEQ ID NO: 382638 - DNA, 21 bp, Homo sapiens
atatactgggttcttgtttta

SEQ ID NO: 382639 - DNA, 21 bp, Homo sapiens
atatagaccccaagcattctg

SEQ ID NO: 382640 - DNA, 16 bp, Homo sapiens
atatagacctatgata

SEQ ID NO: 382641 - DNA, 20 bp, Homo sapiens
atatagacctatgataaata

SEQ ID NO: 382642 - DNA, 13 bp, Homo sapiens
atatagagatgtt

SEQ ID NO: 382643 - DNA, 16 bp, Homo sapiens
atatagagatgttttt

SEQ ID NO: 382644 - DNA, 22 bp, Homo sapiens
atatagagatgtttttaaaagt

SEQ ID NO: 382645 - DNA, 22 bp, Homo sapiens
atatagctctacacaacatgta

SEQ ID NO: 382646 - DNA, 15 bp, Homo sapiens
atataggttgtgcaa

SEQ ID NO: 382647 - DNA, 16 bp, Homo sapiens
atataggttgtgcaaa

SEQ ID NO: 382648 - DNA, 21 bp, Homo sapiens
atatagttaattgtggcttta

SEQ ID NO: 382649 - DNA, 19 bp, Homo sapiens
atatataaaaagaaaagat

SEQ ID NO: 382650 - DNA, 21 bp, Homo sapiens
atatataaaaagaaaagataa

SEQ ID NO: 382651 - DNA, 12 bp, Homo sapiens
atatataaaata

SEQ ID NO: 382652 - DNA, 16 bp, Homo sapiens
atatataaaataaata

SEQ ID NO: 382653 - DNA, 18 bp, Homo sapiens
atatataaaataaatata

SEQ ID NO: 382654 - DNA, 20 bp, Homo sapiens
atatataaaataaatatact

SEQ ID NO: 382655 - DNA, 22 bp, Homo sapiens
atatataaaataaatatactaa

SEQ ID NO: 382656 - DNA, 16 bp, Homo sapiens
atatataataaatggg

SEQ ID NO: 382657 - DNA, 14 bp, Homo sapiens
atatatacataaca

SEQ ID NO: 382658 - DNA, 13 bp, Homo sapiens
atatatacatata

SEQ ID NO: 382659 - DNA, 17 bp, Homo sapiens
atatatacatgtatagt

SEQ ID NO: 382660 - DNA, 12 bp, Homo sapiens
atatatacttgt

SEQ ID NO: 382661 - DNA, 13 bp, Homo sapiens
atatatagaatct

SEQ ID NO: 382662 - DNA, 17 bp, Homo sapiens
atatatctgcttcagtg

SEQ ID NO: 382663 - DNA, 14 bp, Homo sapiens
atatatctttatac

SEQ ID NO: 382664 - DNA, 13 bp, Homo sapiens
atatatgctactt

SEQ ID NO: 382665 - DNA, 20 bp, Homo sapiens
atatatgtgtgtttaaataa

SEQ ID NO: 382666 - DNA, 21 bp, Homo sapiens
atatattaaaaatataaacaa

SEQ ID NO: 382667 - DNA, 17 bp, Homo sapiens
atatattcatacctgtt

SEQ ID NO: 382668 - DNA, 22 bp, Homo sapiens
atatattctggctgataaaaga

SEQ ID NO: 382669 - DNA, 11 bp, Homo sapiens
atatattcttt

SEQ ID NO: 382670 - DNA, 18 bp, Homo sapiens
atatattctttccatgca

SEQ ID NO: 382671 - DNA, 13 bp, Homo sapiens
atatattgaacac

SEQ ID NO: 382672 - DNA, 21 bp, Homo sapiens
atatatttataactcatcata

SEQ ID NO: 382673 - DNA, 13 bp, Homo sapiens
atatatttgaaag

SEQ ID NO: 382674 - DNA, 17 bp, Homo sapiens
atatatttttccctgtt

SEQ ID NO: 382675 - DNA, 15 bp, Homo sapiens
atatatttttggttg

SEQ ID NO: 382676 - DNA, 20 bp, Homo sapiens
atatatttttggttgtcaat

SEQ ID NO: 382677 - DNA, 20 bp, Homo sapiens
atatattttttaatttgatg

SEQ ID NO: 382678 - DNA, 23 bp, Homo sapiens
atatattttttaatttgatgaaa

SEQ ID NO: 382679 - DNA, 14 bp, Homo sapiens
atatattttttgta

SEQ ID NO: 382680 - DNA, 22 bp, Homo sapiens
atatcaagaagtcagagaaaac

SEQ ID NO: 382681 - DNA, 20 bp, Homo sapiens
atatcaataaatagatgagt

SEQ ID NO: 382682 - DNA, 11 bp, Homo sapiens
atatcactttg

SEQ ID NO: 382683 - DNA, 13 bp, Homo sapiens
atatcactttgta

SEQ ID NO: 382684 - DNA, 14 bp, Homo sapiens
atatcagaaaaggg

SEQ ID NO: 382685 - DNA, 14 bp, Homo sapiens
atatcagcctgagt

SEQ ID NO: 382686 - DNA, 20 bp, Homo sapiens
atatcagcctgagtctcctg

SEQ ID NO: 382687 - DNA, 14 bp, Homo sapiens
atatcatattggta

SEQ ID NO: 382688 - DNA, 13 bp, Homo sapiens
atatcattctttg

SEQ ID NO: 382689 - DNA, 16 bp, Homo sapiens
atatcattctttgtat

SEQ ID NO: 382690 - DNA, 13 bp, Homo sapiens
atatcatttcata

SEQ ID NO: 382691 - DNA, 16 bp, Homo sapiens
atatcattttcctggg

SEQ ID NO: 382692 - DNA, 18 bp, Homo sapiens
atatccaaagactgtact

SEQ ID NO: 382693 - DNA, 15 bp, Homo sapiens
atatccaagtaccaa

SEQ ID NO: 382694 - DNA, 18 bp, Homo sapiens
atatccattctttctgat

SEQ ID NO: 382695 - DNA, 20 bp, Homo sapiens
atatcccagagaacaatcac

SEQ ID NO: 382696 - DNA, 17 bp, Homo sapiens
atatccctatgtcccag

SEQ ID NO: 382697 - DNA, 14 bp, Homo sapiens
atatcctgaataac

SEQ ID NO: 382698 - DNA, 19 bp, Homo sapiens
atatcctggtgtctagttt

SEQ ID NO: 382699 - DNA, 17 bp, Homo sapiens
atatcgagagtttctat

SEQ ID NO: 382700 - DNA, 13 bp, Homo sapiens
atatctatttatc

SEQ ID NO: 382701 - DNA, 20 bp, Homo sapiens
atatctatttatctgtctga

SEQ ID NO: 382702 - DNA, 22 bp, Homo sapiens
atatctctagtccctgtgttct

SEQ ID NO: 382703 - DNA, 22 bp, Homo sapiens
atatctgaacacatactagaaa

SEQ ID NO: 382704 - DNA, 20 bp, Homo sapiens
atatctgactgaaattaaac

SEQ ID NO: 382705 - DNA, 15 bp, Homo sapiens
atatctgctgtatgt

SEQ ID NO: 382706 - DNA, 21 bp, Homo sapiens
atatctgggattctactttaa

SEQ ID NO: 382707 - DNA, 17 bp, Homo sapiens
atatctgtaaatttaac

SEQ ID NO: 382708 - DNA, 16 bp, Homo sapiens
atatctgttagatgct

SEQ ID NO: 382709 - DNA, 20 bp, Homo sapiens
atatctgttttactgctttt

SEQ ID NO: 382710 - DNA, 14 bp, Homo sapiens
atatcttaaagaaa

SEQ ID NO: 382711 - DNA, 19 bp, Homo sapiens
atatcttaaagaaacagct

SEQ ID NO: 382712 - DNA, 19 bp, Homo sapiens
atatcttctgatttgtccc

SEQ ID NO: 382713 - DNA, 14 bp, Homo sapiens
atatcttgaagaat

SEQ ID NO: 382714 - DNA, 16 bp, Homo sapiens
atatcttgaagaatat

SEQ ID NO: 382715 - DNA, 22 bp, Homo sapiens
atatcttgctggattaatgttt

SEQ ID NO: 382716 - DNA, 12 bp, Homo sapiens
atatctttatac

SEQ ID NO: 382717 - DNA, 17 bp, Homo sapiens
atatctttgacctcaat

SEQ ID NO: 382718 - DNA, 14 bp, Homo sapiens
atatctttgcactg

SEQ ID NO: 382719 - DNA, 16 bp, Homo sapiens
atatgaaaatacaact

SEQ ID NO: 382720 - DNA, 17 bp, Homo sapiens
atatgaacagggcccag

SEQ ID NO: 382721 - DNA, 19 bp, Homo sapiens
atatgaagtaagttctgaa

SEQ ID NO: 382722 - DNA, 16 bp, Homo sapiens
atatgaataattatgt

SEQ ID NO: 382723 - DNA, 19 bp, Homo sapiens
atatgacaatttcaaaatg

SEQ ID NO: 382724 - DNA, 22 bp, Homo sapiens
atatgacctaaatccattttct

SEQ ID NO: 382725 - DNA, 23 bp, Homo sapiens
atatgacggaagaacatagaact

SEQ ID NO: 382726 - DNA, 14 bp, Homo sapiens
atatgacttcttgt

SEQ ID NO: 382727 - DNA, 16 bp, Homo sapiens
atatgagattggaaaa

SEQ ID NO: 382728 - DNA, 18 bp, Homo sapiens
atatgagattggaaaaaa

SEQ ID NO: 382729 - DNA, 21 bp, Homo sapiens
atatgagcttccttctgtgaa

SEQ ID NO: 382730 - DNA, 22 bp, Homo sapiens
atatgagcttccttctgtgaaa

SEQ ID NO: 382731 - DNA, 23 bp, Homo sapiens
atatgagtatctttaaatataat

SEQ ID NO: 382732 - DNA, 20 bp, Homo sapiens
atatgagtgtggaagccgga

SEQ ID NO: 382733 - DNA, 23 bp, Homo sapiens
atatgagtgtggaagccggaggg

SEQ ID NO: 382734 - DNA, 13 bp, Homo sapiens
atatgataaaaca

SEQ ID NO: 382735 - DNA, 16 bp, Homo sapiens
atatgatatgcatgta

SEQ ID NO: 382736 - DNA, 12 bp, Homo sapiens
atatgatttata

SEQ ID NO: 382737 - DNA, 14 bp, Homo sapiens
atatgcaggctgtc

SEQ ID NO: 382738 - DNA, 14 bp, Homo sapiens
atatgcatgccagg

SEQ ID NO: 382739 - DNA, 16 bp, Homo sapiens
atatgcatgccaggct

SEQ ID NO: 382740 - DNA, 20 bp, Homo sapiens
atatgcatgctgatttacca

SEQ ID NO: 382741 - DNA, 20 bp, Homo sapiens
atatgcatgtagcatataaa

SEQ ID NO: 382742 - DNA, 23 bp, Homo sapiens
atatgccccttcttgggccccag

SEQ ID NO: 382743 - DNA, 20 bp, Homo sapiens
atatgcctgaccccttgctc

SEQ ID NO: 382744 - DNA, 13 bp, Homo sapiens
atatgctttacac

SEQ ID NO: 382745 - DNA, 20 bp, Homo sapiens
atatggaacttctaatatat

SEQ ID NO: 382746 - DNA, 21 bp, Homo sapiens
atatggaggattctttcccca

SEQ ID NO: 382747 - DNA, 12 bp, Homo sapiens
atatggatattt

SEQ ID NO: 382748 - DNA, 22 bp, Homo sapiens
atatggattttctattgttact

SEQ ID NO: 382749 - DNA, 15 bp, Homo sapiens
atatggcaagaaagc

SEQ ID NO: 382750 - DNA, 19 bp, Homo sapiens
atatggcaagaaagctggt

SEQ ID NO: 382751 - DNA, 17 bp, Homo sapiens
atatggcttgtagggtg

SEQ ID NO: 382752 - DNA, 19 bp, Homo sapiens
atatgggctttctctttgg

SEQ ID NO: 382753 - DNA, 22 bp, Homo sapiens
atatggtctaccagtttgctga

SEQ ID NO: 382754 - DNA, 23 bp, Homo sapiens
atatgtagatattgttttctgta

SEQ ID NO: 382755 - DNA, 19 bp, Homo sapiens
atatgtatatctttgcact

SEQ ID NO: 382756 - DNA, 15 bp, Homo sapiens
atatgtatctaaatg

SEQ ID NO: 382757 - DNA, 19 bp, Homo sapiens
atatgtatctaaatgaaaa

SEQ ID NO: 382758 - DNA, 14 bp, Homo sapiens
atatgtatggtttt

SEQ ID NO: 382759 - DNA, 15 bp, Homo sapiens
atatgtatgtaaaaa

SEQ ID NO: 382760 - DNA, 16 bp, Homo sapiens
atatttttattttatt

SEQ ID NO: 382761 - DNA, 22 bp, Homo sapiens
atatttttccctgtttgcctat

SEQ ID NO: 382762 - DNA, 22 bp, Homo sapiens
atatttttggaaccagtaagta

SEQ ID NO: 382763 - DNA, 17 bp, Homo sapiens
atatttttttctagcta

SEQ ID NO: 382764 - DNA, 13 bp, Homo sapiens
atcaaaaagagtc

SEQ ID NO: 382765 - DNA, 17 bp, Homo sapiens
atcaaaacctgtgccag

SEQ ID NO: 382766 - DNA, 12 bp, Homo sapiens
atcaaacatgaa

SEQ ID NO: 382767 - DNA, 16 bp, Homo sapiens
atcaaagacacacagg

SEQ ID NO: 382768 - DNA, 14 bp, Homo sapiens
atcaaagcaagggc

SEQ ID NO: 382769 - DNA, 20 bp, Homo sapiens
atcaaagcaagggctccagc

SEQ ID NO: 382770 - DNA, 23 bp, Homo sapiens
atcaaagcacttggactcttgct

SEQ ID NO: 382771 - DNA, 21 bp, Homo sapiens
atcaaaggaaaatagtaatgt

SEQ ID NO: 382772 - DNA, 17 bp, Homo sapiens
atcaaaggcagaaagga

SEQ ID NO: 382773 - DNA, 15 bp, Homo sapiens
atcaaataaatttct

SEQ ID NO: 382774 - DNA, 15 bp, Homo sapiens
atcaaataatacatc

SEQ ID NO: 382775 - DNA, 20 bp, Homo sapiens
atcaaatagaaccactatga

SEQ ID NO: 382776 - DNA, 21 bp, Homo sapiens
atcaaatagaaccactatgaa

SEQ ID NO: 382777 - DNA, 22 bp, Homo sapiens
atcaaatcattcaaaactttca

SEQ ID NO: 382778 - DNA, 17 bp, Homo sapiens
atcaaatctgtatatgt

SEQ ID NO: 382779 - DNA, 22 bp, Homo sapiens
atcaaatctgtatatgttgtaa

SEQ ID NO: 382780 - DNA, 20 bp, Homo sapiens
atcaacaaaagggagaacat

SEQ ID NO: 382781 - DNA, 14 bp, Homo sapiens
atcaaccaggaaga

SEQ ID NO: 382782 - DNA, 19 bp, Homo sapiens
atcaacctgcacttcatat

SEQ ID NO: 382783 - DNA, 21 bp, Homo sapiens
atcaacctgcacttcatatct

SEQ ID NO: 382784 - DNA, 18 bp, Homo sapiens
acttgagggtaataaact

SEQ ID NO: 382785 - DNA, 19 bp, Homo sapiens
acttgagggtaataaactt

SEQ ID NO: 382786 - DNA, 21 bp, Homo sapiens
acttgattaagattttacaaa

SEQ ID NO: 382787 - DNA, 18 bp, Homo sapiens
acttgatttgcatggatt

SEQ ID NO: 382788 - DNA, 19 bp, Homo sapiens
acttgcacgcccatgtgtg

SEQ ID NO: 382789 - DNA, 20 bp, Homo sapiens
acttgccttcttcacccagc

SEQ ID NO: 382790 - DNA, 14 bp, Homo sapiens
acttgcgtcctgca

SEQ ID NO: 382791 - DNA, 20 bp, Homo sapiens
acttgcgtcctgcagaggac

SEQ ID NO: 382792 - DNA, 17 bp, Homo sapiens
acttgctcaataaaggt

SEQ ID NO: 382793 - DNA, 23 bp, Homo sapiens
acttgctcagacgagacacccta

SEQ ID NO: 382794 - DNA, 12 bp, Homo sapiens
acttgctgctgt

SEQ ID NO: 382795 - DNA, 16 bp, Homo sapiens
acttgctgctgtgcct

SEQ ID NO: 382796 - DNA, 19 bp, Homo sapiens
acttgctgctgtgcctgcg

SEQ ID NO: 382797 - DNA, 23 bp, Homo sapiens
acttgctgctgtgcctgcgtcgc

SEQ ID NO: 382798 - DNA, 23 bp, Homo sapiens
acttgctggggctcacggggcct

SEQ ID NO: 382799 - DNA, 18 bp, Homo sapiens
acttgctgtgaaatgact

SEQ ID NO: 382800 - DNA, 17 bp, Homo sapiens
acttgcttccaagccct

SEQ ID NO: 382801 - DNA, 19 bp, Homo sapiens
acttgcttccaagcccttc

SEQ ID NO: 382802 - DNA, 17 bp, Homo sapiens
acttgcttcttgtgttt

SEQ ID NO: 382803 - DNA, 22 bp, Homo sapiens
acttgctttatgccttcttatt

SEQ ID NO: 382804 - DNA, 19 bp, Homo sapiens
acttggactcttgctcttt

SEQ ID NO: 382805 - DNA, 19 bp, Homo sapiens
acttggagatctttgcttc

SEQ ID NO: 382806 - DNA, 11 bp, Homo sapiens
acttggagccg

SEQ ID NO: 382807 - DNA, 21 bp, Homo sapiens
acttggataggagcttccaga

SEQ ID NO: 382808 - DNA, 23 bp, Homo sapiens
acttggataggagcttccagatg

SEQ ID NO: 382809 - DNA, 16 bp, Homo sapiens
acttggcaacagaagc

SEQ ID NO: 382810 - DNA, 14 bp, Homo sapiens
acttggcctctgga

SEQ ID NO: 382811 - DNA, 19 bp, Homo sapiens
acttgggagcctgaggcag

SEQ ID NO: 382812 - DNA, 14 bp, Homo sapiens
acttggggaggcaa

SEQ ID NO: 382813 - DNA, 16 bp, Homo sapiens
acttggtgctgctttg

SEQ ID NO: 382814 - DNA, 22 bp, Homo sapiens
acttggtgtcctttccctccac

SEQ ID NO: 382815 - DNA, 19 bp, Homo sapiens
acttggtttttggctcttt

SEQ ID NO: 382816 - DNA, 12 bp, Homo sapiens
acttgtacagtt

SEQ ID NO: 382817 - DNA, 15 bp, Homo sapiens
acttgtatgctgccc

SEQ ID NO: 382818 - DNA, 12 bp, Homo sapiens
acttgtctgagg

SEQ ID NO: 382819 - DNA, 14 bp, Homo sapiens
acttgtctgaggcc

SEQ ID NO: 382820 - DNA, 22 bp, Homo sapiens
acttgtgtgtgggctgtgagtg

SEQ ID NO: 382821 - DNA, 17 bp, Homo sapiens
acttgtgttgctttctg

SEQ ID NO: 382822 - DNA, 13 bp, Homo sapiens
acttgtgtttgct

SEQ ID NO: 382823 - DNA, 14 bp, Homo sapiens
acttgtgtttgctt

SEQ ID NO: 382824 - DNA, 15 bp, Homo sapiens
acttgtgtttgctta

SEQ ID NO: 382825 - DNA, 19 bp, Homo sapiens
acttgtgtttgcttaaaca

SEQ ID NO: 382826 - DNA, 22 bp, Homo sapiens
acttgtgtttgcttaaacaaag

SEQ ID NO: 382827 - DNA, 18 bp, Homo sapiens
acttgtgtttgtatataa

SEQ ID NO: 382828 - DNA, 14 bp, Homo sapiens
acttgttcatttct

SEQ ID NO: 382829 - DNA, 14 bp, Homo sapiens
acttgttccagatg

SEQ ID NO: 382830 - DNA, 15 bp, Homo sapiens
acttgttccagctct

SEQ ID NO: 382831 - DNA, 16 bp, Homo sapiens
acttgttccagctctt

SEQ ID NO: 382832 - DNA, 18 bp, Homo sapiens
acttgttcttttctggta

SEQ ID NO: 382833 - DNA, 11 bp, Homo sapiens
acttgtttcct

SEQ ID NO: 382834 - DNA, 17 bp, Homo sapiens
acttgttttatgctcag

SEQ ID NO: 382835 - DNA, 13 bp, Homo sapiens
acttgttttcccc

SEQ ID NO: 382836 - DNA, 16 bp, Homo sapiens
acttgttttggatgcc

SEQ ID NO: 382837 - DNA, 15 bp, Homo sapiens
actttaaaataaaat

SEQ ID NO: 382838 - DNA, 21 bp, Homo sapiens
actttaaatcctaccaaagta

SEQ ID NO: 382839 - DNA, 18 bp, Homo sapiens
actttaaatggaataatt

SEQ ID NO: 382840 - DNA, 14 bp, Homo sapiens
actttaagcactac

SEQ ID NO: 382841 - DNA, 11 bp, Homo sapiens
actttaataat

SEQ ID NO: 382842 - DNA, 21 bp, Homo sapiens
actttaatactcacctcctcc

SEQ ID NO: 382843 - DNA, 13 bp, Homo sapiens
actttactctaag

SEQ ID NO: 382844 - DNA, 12 bp, Homo sapiens
actttagaaata

SEQ ID NO: 382845 - DNA, 19 bp, Homo sapiens
actttagggtaaaaattgc

SEQ ID NO: 382846 - DNA, 19 bp, Homo sapiens
actttagtgattgctttta

SEQ ID NO: 382847 - DNA, 14 bp, Homo sapiens
actttataaacact

SEQ ID NO: 382848 - DNA, 20 bp, Homo sapiens
actttatattttctatattt

SEQ ID NO: 382849 - DNA, 23 bp, Homo sapiens
actttatattttctatatttgta

SEQ ID NO: 382850 - DNA, 13 bp, Homo sapiens
actttatcacatt

SEQ ID NO: 382851 - DNA, 14 bp, Homo sapiens
actttatcacatta

SEQ ID NO: 382852 - DNA, 20 bp, Homo sapiens
actttatgaaaaaaatatat

SEQ ID NO: 382853 - DNA, 21 bp, Homo sapiens
actttatgaaaaaaatatatt

SEQ ID NO: 382854 - DNA, 16 bp, Homo sapiens
actttattcttgctgg

SEQ ID NO: 382855 - DNA, 16 bp, Homo sapiens
actttattgattttct

SEQ ID NO: 382856 - DNA, 13 bp, Homo sapiens
actttatttaatt

SEQ ID NO: 382857 - DNA, 15 bp, Homo sapiens
actttatttaatttc

SEQ ID NO: 382858 - DNA, 18 bp, Homo sapiens
actttatttaatttcata

SEQ ID NO: 382859 - DNA, 13 bp, Homo sapiens
actttcaaaatta

SEQ ID NO: 382860 - DNA, 17 bp, Homo sapiens
actttcacatagatgtc

SEQ ID NO: 382861 - DNA, 13 bp, Homo sapiens
actttcactttga

SEQ ID NO: 382862 - DNA, 14 bp, Homo sapiens
actttcactttgaa

SEQ ID NO: 382863 - DNA, 19 bp, Homo sapiens
actttccccatactctgtc

SEQ ID NO: 382864 - DNA, 22 bp, Homo sapiens
actttccccgtgggccatggca

SEQ ID NO: 382865 - DNA, 15 bp, Homo sapiens
actttccctagaaag

SEQ ID NO: 382866 - DNA, 14 bp, Homo sapiens
actttcctatgaca

SEQ ID NO: 382867 - DNA, 21 bp, Homo sapiens
actttcctattttcttttcca

SEQ ID NO: 382868 - DNA, 14 bp, Homo sapiens
actttcctctctct

SEQ ID NO: 382869 - DNA, 15 bp, Homo sapiens
actttcctggataaa

SEQ ID NO: 382870 - DNA, 22 bp, Homo sapiens
actttcctggataaaaaagaaa

SEQ ID NO: 382871 - DNA, 21 bp, Homo sapiens
actttccttagacccgccagg

SEQ ID NO: 382872 - DNA, 15 bp, Homo sapiens
actttctcttgtaaa

SEQ ID NO: 382873 - DNA, 23 bp, Homo sapiens
actttctgtctcaaaccctggct

SEQ ID NO: 382874 - DNA, 16 bp, Homo sapiens
actttcttgagcacca

SEQ ID NO: 382875 - DNA, 17 bp, Homo sapiens
actttcttgagcaccag

SEQ ID NO: 382876 - DNA, 15 bp, Homo sapiens
actttgaacacatct

SEQ ID NO: 382877 - DNA, 23 bp, Homo sapiens
actttgacgagtcaccttccagg

SEQ ID NO: 382878 - DNA, 18 bp, Homo sapiens
actttgagcatttttaag

SEQ ID NO: 382879 - DNA, 15 bp, Homo sapiens
actttgatctctgct

SEQ ID NO: 382880 - DNA, 18 bp, Homo sapiens
actttgatctctgcttac

SEQ ID NO: 382881 - DNA, 12 bp, Homo sapiens
actttgcatgtt

SEQ ID NO: 382882 - DNA, 16 bp, Homo sapiens
actttgccctatgaca

SEQ ID NO: 382883 - DNA, 18 bp, Homo sapiens
actttgcccttcactgtt

SEQ ID NO: 382884 - DNA, 16 bp, Homo sapiens
actttgctacgaagaa

SEQ ID NO: 382885 - DNA, 19 bp, Homo sapiens
actttggaaaacataaaaa

SEQ ID NO: 382886 - DNA, 14 bp, Homo sapiens
actttggaaggagg

SEQ ID NO: 382887 - DNA, 18 bp, Homo sapiens
actttggaagtttgtgtt

SEQ ID NO: 382888 - DNA, 21 bp, Homo sapiens
actttggaagtttgtgttctg

SEQ ID NO: 382889 - DNA, 17 bp, Homo sapiens
actttggaatgactata

SEQ ID NO: 382890 - DNA, 13 bp, Homo sapiens
atcagctgctttg

SEQ ID NO: 382891 - DNA, 15 bp, Homo sapiens
atcagcttaatttaa

SEQ ID NO: 382892 - DNA, 17 bp, Homo sapiens
atcagctttccctggct

SEQ ID NO: 382893 - DNA, 19 bp, Homo sapiens
atcagctttccctggctca

SEQ ID NO: 382894 - DNA, 22 bp, Homo sapiens
atcagctttccctggctcaggg

SEQ ID NO: 382895 - DNA, 18 bp, Homo sapiens
atcagcttttgttctaga

SEQ ID NO: 382896 - DNA, 22 bp, Homo sapiens
atcaggaaaggaagatgtaaga

SEQ ID NO: 382897 - DNA, 20 bp, Homo sapiens
atcaggaaatatatatgtgt

SEQ ID NO: 382898 - DNA, 19 bp, Homo sapiens
atcaggatgaacccaggac

SEQ ID NO: 382899 - DNA, 16 bp, Homo sapiens
atcaggcctgccagac

SEQ ID NO: 382900 - DNA, 23 bp, Homo sapiens
atcaggcttggaatgaattctct

SEQ ID NO: 382901 - DNA, 18 bp, Homo sapiens
atcagggaggtcattttg

SEQ ID NO: 382902 - DNA, 20 bp, Homo sapiens
atcaggtgatccacctgcct

SEQ ID NO: 382903 - DNA, 15 bp, Homo sapiens
atcaggttccatccc

SEQ ID NO: 382904 - DNA, 13 bp, Homo sapiens
atcagtacaattc

SEQ ID NO: 382905 - DNA, 19 bp, Homo sapiens
atcagtcataactaaataa

SEQ ID NO: 382906 - DNA, 23 bp, Homo sapiens
atcagtccacccccattgtgaat

SEQ ID NO: 382907 - DNA, 15 bp, Homo sapiens
atcagtctttgtcaa

SEQ ID NO: 382908 - DNA, 20 bp, Homo sapiens
atcagtgaatataaatgtac

SEQ ID NO: 382909 - DNA, 20 bp, Homo sapiens
atcagtgagctcaggagaga

SEQ ID NO: 382910 - DNA, 15 bp, Homo sapiens
atcagtgatgggagt

SEQ ID NO: 382911 - DNA, 20 bp, Homo sapiens
atcagtgggcaggataaact

SEQ ID NO: 382912 - DNA, 15 bp, Homo sapiens
atcagtggggcccca

SEQ ID NO: 382913 - DNA, 20 bp, Homo sapiens
atcagtggggccccaaagcc

SEQ ID NO: 382914 - DNA, 21 bp, Homo sapiens
atcagtggggccccaaagccc

SEQ ID NO: 382915 - DNA, 23 bp, Homo sapiens
atcagtgtgtctaaatttgaatg

SEQ ID NO: 382916 - DNA, 13 bp, Homo sapiens
atcagtgttaaaa

SEQ ID NO: 382917 - DNA, 20 bp, Homo sapiens
atcagtgttcttctcaagga

SEQ ID NO: 382918 - DNA, 17 bp, Homo sapiens
atcagtgtttaaataaa

SEQ ID NO: 382919 - DNA, 21 bp, Homo sapiens
atcagtgtttaaataaagacc

SEQ ID NO: 382920 - DNA, 15 bp, Homo sapiens
atcagttactggttt

SEQ ID NO: 382921 - DNA, 19 bp, Homo sapiens
atcagttcccccagtacct

SEQ ID NO: 382922 - DNA, 19 bp, Homo sapiens
agaaaaaaaataacacaga

SEQ ID NO: 382923 - DNA, 16 bp, Homo sapiens
agaaaaaagtacagaa

SEQ ID NO: 382924 - DNA, 18 bp, Homo sapiens
agaaaaaataacacacat

SEQ ID NO: 382925 - DNA, 11 bp, Homo sapiens
agaaaaacatg

SEQ ID NO: 382926 - DNA, 16 bp, Homo sapiens
agaaaaacatgtcatg

SEQ ID NO: 382927 - DNA, 18 bp, Homo sapiens
agaaaaaccaatgattca

SEQ ID NO: 382928 - DNA, 23 bp, Homo sapiens
agaaaaaccaatgattcataaca

SEQ ID NO: 382929 - DNA, 13 bp, Homo sapiens
agaaaaagaaaca

SEQ ID NO: 382930 - DNA, 14 bp, Homo sapiens
agaaaaagcacagc

SEQ ID NO: 382931 - DNA, 16 bp, Homo sapiens
agaaaaagcacagctc

SEQ ID NO: 382932 - DNA, 12 bp, Homo sapiens
agaaaaatcagt

SEQ ID NO: 382933 - DNA, 12 bp, Homo sapiens
agaaaaatcttg

SEQ ID NO: 382934 - DNA, 13 bp, Homo sapiens
agaaaaatgttct

SEQ ID NO: 382935 - DNA, 18 bp, Homo sapiens
agaaaacaatctgcccac

SEQ ID NO: 382936 - DNA, 12 bp, Homo sapiens
agaaaacacttt

SEQ ID NO: 382937 - DNA, 13 bp, Homo sapiens
agaaaacactttc

SEQ ID NO: 382938 - DNA, 14 bp, Homo sapiens
agaaaacagaaaaa

SEQ ID NO: 382939 - DNA, 15 bp, Homo sapiens
agaaaacagaaaaaa

SEQ ID NO: 382940 - DNA, 14 bp, Homo sapiens
agaaaacagccact

SEQ ID NO: 382941 - DNA, 22 bp, Homo sapiens
agaaaacaggaaaaaaactttt

SEQ ID NO: 382942 - DNA, 18 bp, Homo sapiens
agaaaacatatattttat

SEQ ID NO: 382943 - DNA, 15 bp, Homo sapiens
agaaaactgaaaatc

SEQ ID NO: 382944 - DNA, 20 bp, Homo sapiens
agaaaacttctcttctgagc

SEQ ID NO: 382945 - DNA, 15 bp, Homo sapiens
agaaaagaactgctt

SEQ ID NO: 382946 - DNA, 15 bp, Homo sapiens
agaaaagactgacct

SEQ ID NO: 382947 - DNA, 14 bp, Homo sapiens
agaaaagagaagaa

SEQ ID NO: 382948 - DNA, 18 bp, Homo sapiens
agaaaagaggagaccctg

SEQ ID NO: 382949 - DNA, 17 bp, Homo sapiens
agaaaagataaagatga

SEQ ID NO: 382950 - DNA, 13 bp, Homo sapiens
agaaaagccaagc

SEQ ID NO: 382951 - DNA, 13 bp, Homo sapiens
agaaaagccagat

SEQ ID NO: 382952 - DNA, 18 bp, Homo sapiens
agaaaagccagatgacag

SEQ ID NO: 382953 - DNA, 22 bp, Homo sapiens
agaaaagccagatgacagggag

SEQ ID NO: 382954 - DNA, 15 bp, Homo sapiens
agaaaaggaatgcaa

SEQ ID NO: 382955 - DNA, 17 bp, Homo sapiens
agaaaaggaatgcaaga

SEQ ID NO: 382956 - DNA, 19 bp, Homo sapiens
agaaaaggaatgcaagaga

SEQ ID NO: 382957 - DNA, 23 bp, Homo sapiens
agaaaatagggtggacagaagct

SEQ ID NO: 382958 - DNA, 16 bp, Homo sapiens
agaaaatatgatatat

SEQ ID NO: 382959 - DNA, 18 bp, Homo sapiens
agaaaatcctaactttca

SEQ ID NO: 382960 - DNA, 14 bp, Homo sapiens
agaaaatgaagaaa

SEQ ID NO: 382961 - DNA, 20 bp, Homo sapiens
agaaaatggacgtgttatga

SEQ ID NO: 382962 - DNA, 22 bp, Homo sapiens
agaaacacagggttttgtattc

SEQ ID NO: 382963 - DNA, 20 bp, Homo sapiens
agaaacacatcaaataaact

SEQ ID NO: 382964 - DNA, 14 bp, Homo sapiens
agaaacaccactta

SEQ ID NO: 382965 - DNA, 16 bp, Homo sapiens
agaaacaccacttaat

SEQ ID NO: 382966 - DNA, 18 bp, Homo sapiens
agaaacaccacttaatct

SEQ ID NO: 382967 - DNA, 13 bp, Homo sapiens
agaaacactttct

SEQ ID NO: 382968 - DNA, 24 bp, Homo sapiens
agaaacactttcttgagcaccagg

SEQ ID NO: 382969 - DNA, 20 bp, Homo sapiens
agaaacagctttcaagtgcc

SEQ ID NO: 382970 - DNA, 20 bp, Homo sapiens
agaaacagtgggagccctga

SEQ ID NO: 382971 - DNA, 20 bp, Homo sapiens
agaaaccattgttcagaaga

SEQ ID NO: 382972 - DNA, 16 bp, Homo sapiens
agaaaccccacttcca

SEQ ID NO: 382973 - DNA, 18 bp, Homo sapiens
agaaaccgtaattttatt

SEQ ID NO: 382974 - DNA, 23 bp, Homo sapiens
agaaacctccatcctgccaggag

SEQ ID NO: 382975 - DNA, 15 bp, Homo sapiens
agaaaccttgtttgt

SEQ ID NO: 382976 - DNA, 23 bp, Homo sapiens
agaaaccttttaaaaaaataata

SEQ ID NO: 382977 - DNA, 19 bp, Homo sapiens
agaaactgaaagtgtttta

SEQ ID NO: 382978 - DNA, 17 bp, Homo sapiens
agaaagaaaagaccctg

SEQ ID NO: 382979 - DNA, 21 bp, Homo sapiens
agaaagaaaagaccctgagac

SEQ ID NO: 382980 - DNA, 16 bp, Homo sapiens
agaaagagaaagtact

SEQ ID NO: 382981 - DNA, 18 bp, Homo sapiens
agaaagatatctatgact

SEQ ID NO: 382982 - DNA, 23 bp, Homo sapiens
agaaagcaaaaaataaaataagt

SEQ ID NO: 382983 - DNA, 20 bp, Homo sapiens
agaaagcaaatcagacacaa

SEQ ID NO: 382984 - DNA, 18 bp, Homo sapiens
agaaagcacctgttttta

SEQ ID NO: 382985 - DNA, 23 bp, Homo sapiens
agaaagcagacagcaagggcttg

SEQ ID NO: 382986 - DNA, 19 bp, Homo sapiens
agaaagcaggagcagctgt

SEQ ID NO: 382987 - DNA, 16 bp, Homo sapiens
agaaagccatattcca

SEQ ID NO: 382988 - DNA, 18 bp, Homo sapiens
agaaagccatattccagc

SEQ ID NO: 382989 - DNA, 22 bp, Homo sapiens
agaaagccatattccagcagtg

SEQ ID NO: 382990 - DNA, 24 bp, Homo sapiens
agaaagccatattccagcagtgaa

SEQ ID NO: 382991 - DNA, 13 bp, Homo sapiens
agaaagcccacct

SEQ ID NO: 382992 - DNA, 15 bp, Homo sapiens
agaaagcccacctgg

SEQ ID NO: 382993 - DNA, 17 bp, Homo sapiens
agaaagcccacctgggc

SEQ ID NO: 382994 - DNA, 21 bp, Homo sapiens
agaaagcctcctgccccctgc

SEQ ID NO: 382995 - DNA, 22 bp, Homo sapiens
agaaagcctgttcccctcactg

SEQ ID NO: 382996 - DNA, 18 bp, Homo sapiens
agaaagctatatatgaat

SEQ ID NO: 382997 - DNA, 19 bp, Homo sapiens
agaaagctctgcatgtgtg

SEQ ID NO: 382998 - DNA, 13 bp, Homo sapiens
agaaagctgtgaa

SEQ ID NO: 382999 - DNA, 15 bp, Homo sapiens
agaaagctgtgaaat

SEQ ID NO: 383000 - DNA, 14 bp, Homo sapiens
agaaaggatattta

SEQ ID NO: 383001 - DNA, 18 bp, Homo sapiens
agaaaggatatttaagaa

SEQ ID NO: 383002 - DNA, 20 bp, Homo sapiens
agaaaggatggcagcctcag

SEQ ID NO: 383003 - DNA, 13 bp, Homo sapiens
agaaaggcagaga

SEQ ID NO: 383004 - DNA, 20 bp, Homo sapiens
agaaagggcagcccctcccc

SEQ ID NO: 383005 - DNA, 21 bp, Homo sapiens
agaaagggcagcccctcccca

SEQ ID NO: 383006 - DNA, 17 bp, Homo sapiens
agaaaggggcaagaaat

SEQ ID NO: 383007 - DNA, 20 bp, Homo sapiens
agaaaggggcaagaaattca

SEQ ID NO: 383008 - DNA, 21 bp, Homo sapiens
agaaaggggcaagaaattcat

SEQ ID NO: 383009 - DNA, 21 bp, Homo sapiens
agaaaggggcaggagctcaga

SEQ ID NO: 383010 - DNA, 15 bp, Homo sapiens
agaaagtcatctttg

SEQ ID NO: 383011 - DNA, 15 bp, Homo sapiens
agaaagtgaagcaaa

SEQ ID NO: 383012 - DNA, 18 bp, Homo sapiens
agaaagtggcagagccag

SEQ ID NO: 383013 - DNA, 17 bp, Homo sapiens
agaaagtgtgagcaaac

SEQ ID NO: 383014 - DNA, 22 bp, Homo sapiens
agaaataaaaatcaacttgtgt

SEQ ID NO: 383015 - DNA, 19 bp, Homo sapiens
agaaatacaattctacatt

SEQ ID NO: 383016 - DNA, 13 bp, Homo sapiens
agaaatacagtgc

SEQ ID NO: 383017 - DNA, 16 bp, Homo sapiens
agaaatacagtgcttt

SEQ ID NO: 383018 - DNA, 21 bp, Homo sapiens
agaaatactataacatatgta

SEQ ID NO: 383019 - DNA, 16 bp, Homo sapiens
atccagcatcccaaga

SEQ ID NO: 383020 - DNA, 19 bp, Homo sapiens
atccagcatgtgtgtgtct

SEQ ID NO: 383021 - DNA, 20 bp, Homo sapiens
atccagcatgtgtgtgtctc

SEQ ID NO: 383022 - DNA, 17 bp, Homo sapiens
atccagccccatagaaa

SEQ ID NO: 383023 - DNA, 19 bp, Homo sapiens
atccagccggaggccagag

SEQ ID NO: 383024 - DNA, 13 bp, Homo sapiens
atccagcctgtgt

SEQ ID NO: 383025 - DNA, 21 bp, Homo sapiens
atccagctccctagactgcat

SEQ ID NO: 383026 - DNA, 14 bp, Homo sapiens
atccagctgtgtgt

SEQ ID NO: 383027 - DNA, 23 bp, Homo sapiens
atccaggcctgaggctgctgacg

SEQ ID NO: 383028 - DNA, 14 bp, Homo sapiens
atccagtagggaaa

SEQ ID NO: 383029 - DNA, 16 bp, Homo sapiens
atccagtagggaaaat

SEQ ID NO: 383030 - DNA, 17 bp, Homo sapiens
atccagtagggaaaata

SEQ ID NO: 383031 - DNA, 14 bp, Homo sapiens
atccatagacacag

SEQ ID NO: 383032 - DNA, 15 bp, Homo sapiens
atccatccatctcca

SEQ ID NO: 383033 - DNA, 11 bp, Homo sapiens
atccatcctgc

SEQ ID NO: 383034 - DNA, 19 bp, Homo sapiens
atccatgcggccggcctgg

SEQ ID NO: 383035 - DNA, 16 bp, Homo sapiens
atccatgggggcaggg

SEQ ID NO: 383036 - DNA, 20 bp, Homo sapiens
atccatgtactgtagttttt

SEQ ID NO: 383037 - DNA, 23 bp, Homo sapiens
atccatttaaactaaccttttat

SEQ ID NO: 383038 - DNA, 14 bp, Homo sapiens
atccattttctaaa

SEQ ID NO: 383039 - DNA, 15 bp, Homo sapiens
atccattttctaaac

SEQ ID NO: 383040 - DNA, 20 bp, Homo sapiens
atcccaaacccttcagtgcc

SEQ ID NO: 383041 - DNA, 15 bp, Homo sapiens
atcccaagatcattc

SEQ ID NO: 383042 - DNA, 20 bp, Homo sapiens
atcccaataaagtcctcttc

SEQ ID NO: 383043 - DNA, 21 bp, Homo sapiens
atcccaataaagtcctcttcc

SEQ ID NO: 383044 - DNA, 17 bp, Homo sapiens
atcccaatctttctata

SEQ ID NO: 383045 - DNA, 15 bp, Homo sapiens
atcccaccaaccctc

SEQ ID NO: 383046 - DNA, 18 bp, Homo sapiens
atcccacgcactccatga

SEQ ID NO: 383047 - DNA, 20 bp, Homo sapiens
atcccacggaaaatgccaat

SEQ ID NO: 383048 - DNA, 12 bp, Homo sapiens
atcccactccta

SEQ ID NO: 383049 - DNA, 22 bp, Homo sapiens
atcccactttctatagcagatt

SEQ ID NO: 383050 - DNA, 13 bp, Homo sapiens
atcccagaaatta

SEQ ID NO: 383051 - DNA, 17 bp, Homo sapiens
atcccagaaattagaaa

SEQ ID NO: 383052 - DNA, 14 bp, Homo sapiens
atcccagagaacaa

SEQ ID NO: 383053 - DNA, 21 bp, Homo sapiens
atcccagcacctgccagggcc

SEQ ID NO: 383054 - DNA, 22 bp, Homo sapiens
atcccagcacctgccagggccc

SEQ ID NO: 383055 - DNA, 14 bp, Homo sapiens
atcccagcactttg

SEQ ID NO: 383056 - DNA, 19 bp, Homo sapiens
atcccagcactttgggagg

SEQ ID NO: 383057 - DNA, 20 bp, Homo sapiens
atcccagcactttgggaggc

SEQ ID NO: 383058 - DNA, 15 bp, Homo sapiens
atcccagcctgtggt

SEQ ID NO: 383059 - DNA, 22 bp, Homo sapiens
agaacaaatatgattctcctct

SEQ ID NO: 383060 - DNA, 18 bp, Homo sapiens
agaacaatcactattctt

SEQ ID NO: 383061 - DNA, 19 bp, Homo sapiens
agaacaatcactattctta

SEQ ID NO: 383062 - DNA, 18 bp, Homo sapiens
agaacacctggccgggtc

SEQ ID NO: 383063 - DNA, 20 bp, Homo sapiens
agaacactcgaaaagagcac

SEQ ID NO: 383064 - DNA, 22 bp, Homo sapiens
agaacactcgaaaagagcactt

SEQ ID NO: 383065 - DNA, 14 bp, Homo sapiens
agaacagaaaacaa

SEQ ID NO: 383066 - DNA, 20 bp, Homo sapiens
agaacagaaaacaacaaaaa

SEQ ID NO: 383067 - DNA, 21 bp, Homo sapiens
agaacagaaaacaacaaaaaa

SEQ ID NO: 383068 - DNA, 22 bp, Homo sapiens
agaacagaaaacaacaaaaaat

SEQ ID NO: 383069 - DNA, 18 bp, Homo sapiens
agaacagatggctgtgaa

SEQ ID NO: 383070 - DNA, 20 bp, Homo sapiens
agaacagatggctgtgaaaa

SEQ ID NO: 383071 - DNA, 13 bp, Homo sapiens
agaacagcaggcc

SEQ ID NO: 383072 - DNA, 17 bp, Homo sapiens
agaacagcaggcccacc

SEQ ID NO: 383073 - DNA, 18 bp, Homo sapiens
agaacagccctcggcctc

SEQ ID NO: 383074 - DNA, 20 bp, Homo sapiens
agaacagctgttcctgtgtt

SEQ ID NO: 383075 - DNA, 16 bp, Homo sapiens
agaacagtacattttt

SEQ ID NO: 383076 - DNA, 17 bp, Homo sapiens
agaacagttaagcagcc

SEQ ID NO: 383077 - DNA, 11 bp, Homo sapiens
agaacatagaa

SEQ ID NO: 383078 - DNA, 17 bp, Homo sapiens
agaacatctgccttgct

SEQ ID NO: 383079 - DNA, 15 bp, Homo sapiens
agaacatgagtgctg

SEQ ID NO: 383080 - DNA, 21 bp, Homo sapiens
agaacatgagtttatgggaat

SEQ ID NO: 383081 - DNA, 17 bp, Homo sapiens
agaacattccatttgaa

SEQ ID NO: 383082 - DNA, 16 bp, Homo sapiens
agaacatttctcatgt

SEQ ID NO: 383083 - DNA, 17 bp, Homo sapiens
agaaccaaaaagaggct

SEQ ID NO: 383084 - DNA, 17 bp, Homo sapiens
agaaccaaagctcaaat

SEQ ID NO: 383085 - DNA, 23 bp, Homo sapiens
agaaccaagcttgtctttaaagt

SEQ ID NO: 383086 - DNA, 13 bp, Homo sapiens
agaaccactatga

SEQ ID NO: 383087 - DNA, 18 bp, Homo sapiens
agaaccagcactcccagg

SEQ ID NO: 383088 - DNA, 18 bp, Homo sapiens
agaaccagtgtctgaacc

SEQ ID NO: 383089 - DNA, 16 bp, Homo sapiens
agaaccatcttttgtt

SEQ ID NO: 383090 - DNA, 16 bp, Homo sapiens
agaaccccaactccca

SEQ ID NO: 383091 - DNA, 21 bp, Homo sapiens
agaaccccaactcccagccta

SEQ ID NO: 383092 - DNA, 16 bp, Homo sapiens
agaacccccctcccca

SEQ ID NO: 383093 - DNA, 22 bp, Homo sapiens
agaacccccctccccaaggaag

SEQ ID NO: 383094 - DNA, 19 bp, Homo sapiens
agaacccttctgctttcta

SEQ ID NO: 383095 - DNA, 14 bp, Homo sapiens
agaaccgagcaaag

SEQ ID NO: 383096 - DNA, 18 bp, Homo sapiens
agaacctcctattttaat

SEQ ID NO: 383097 - DNA, 14 bp, Homo sapiens
agaacctcttcccc

SEQ ID NO: 383098 - DNA, 18 bp, Homo sapiens
agaacctggtggctggag

SEQ ID NO: 383099 - DNA, 23 bp, Homo sapiens
agaaccttttgagtgccttacac

SEQ ID NO: 383100 - DNA, 13 bp, Homo sapiens
agaacctttttat

SEQ ID NO: 383101 - DNA, 20 bp, Homo sapiens
agaacgctttcagggaaaaa

SEQ ID NO: 383102 - DNA, 13 bp, Homo sapiens
agaacgggcctcc

SEQ ID NO: 383103 - DNA, 16 bp, Homo sapiens
agaacgggcctccccg

SEQ ID NO: 383104 - DNA, 19 bp, Homo sapiens
agaactcagccttaagaaa

SEQ ID NO: 383105 - DNA, 23 bp, Homo sapiens
agaactcagccttaagaaagcta

SEQ ID NO: 383106 - DNA, 15 bp, Homo sapiens
agaactcatgtgatt

SEQ ID NO: 383107 - DNA, 19 bp, Homo sapiens
agaactccggaatgaccag

SEQ ID NO: 383108 - DNA, 17 bp, Homo sapiens
agaactccttattttgt

SEQ ID NO: 383109 - DNA, 19 bp, Homo sapiens
agaactcgatgcactgacc

SEQ ID NO: 383110 - DNA, 15 bp, Homo sapiens
agaactctcctcttt

SEQ ID NO: 383111 - DNA, 13 bp, Homo sapiens
agaactctctgtc

SEQ ID NO: 383112 - DNA, 14 bp, Homo sapiens
agaactctctgtct

SEQ ID NO: 383113 - DNA, 21 bp, Homo sapiens
agaactctctgtcttctctcc

SEQ ID NO: 383114 - DNA, 13 bp, Homo sapiens
agaactctgggca

SEQ ID NO: 383115 - DNA, 14 bp, Homo sapiens
agaactgaaaacat

SEQ ID NO: 383116 - DNA, 15 bp, Homo sapiens
agaactgaaaacata

SEQ ID NO: 383117 - DNA, 16 bp, Homo sapiens
agaactgaaaacataa

SEQ ID NO: 383118 - DNA, 16 bp, Homo sapiens
agaactgagctcctct

SEQ ID NO: 383119 - DNA, 17 bp, Homo sapiens
agaactgcatggaccta

SEQ ID NO: 383120 - DNA, 20 bp, Homo sapiens
agaactgcatggacctaaca

SEQ ID NO: 383121 - DNA, 23 bp, Homo sapiens
agaactgcatggacctaacattc

SEQ ID NO: 383122 - DNA, 21 bp, Homo sapiens
agaactgccccatctcctccc

SEQ ID NO: 383123 - DNA, 15 bp, Homo sapiens
agaactgcccccact

SEQ ID NO: 383124 - DNA, 16 bp, Homo sapiens
agaactgcccccactg

SEQ ID NO: 383125 - DNA, 21 bp, Homo sapiens
agaactgcttctaagatgcca

SEQ ID NO: 383126 - DNA, 19 bp, Homo sapiens
agaactgggaaaacagtga

SEQ ID NO: 383127 - DNA, 17 bp, Homo sapiens
agaactggggtgatgtt

SEQ ID NO: 383128 - DNA, 20 bp, Homo sapiens
agaactgtcccacaaaatat

SEQ ID NO: 383129 - DNA, 22 bp, Homo sapiens
agaactgtcccacaaaatattt

SEQ ID NO: 383130 - DNA, 22 bp, Homo sapiens
agaacttcgaccctttctctga

SEQ ID NO: 383131 - DNA, 22 bp, Homo sapiens
agaacttctcgtagatgctgcc

SEQ ID NO: 383132 - DNA, 21 bp, Homo sapiens
agaactttgcacacttcaaat

SEQ ID NO: 383133 - DNA, 18 bp, Homo sapiens
agaacttttcatagatga

SEQ ID NO: 383134 - DNA, 12 bp, Homo sapiens
agaagaaaacat

SEQ ID NO: 383135 - DNA, 13 bp, Homo sapiens
agaagaaaacata

SEQ ID NO: 383136 - DNA, 15 bp, Homo sapiens
agaagaaaacatata

SEQ ID NO: 383137 - DNA, 20 bp, Homo sapiens
agaagaaagtaaaaagaaca

SEQ ID NO: 383138 - DNA, 16 bp, Homo sapiens
agaagaaagtctatgc

SEQ ID NO: 383139 - DNA, 14 bp, Homo sapiens
agaagaaccatctt

SEQ ID NO: 383140 - DNA, 17 bp, Homo sapiens
agaagacacgtgttttt

SEQ ID NO: 383141 - DNA, 16 bp, Homo sapiens
agaagacatggagact

SEQ ID NO: 383142 - DNA, 17 bp, Homo sapiens
agaagaccagtcacagc

SEQ ID NO: 383143 - DNA, 22 bp, Homo sapiens
agaagactagcagctagcaagg

SEQ ID NO: 383144 - DNA, 13 bp, Homo sapiens
agaagagaaagac

SEQ ID NO: 383145 - DNA, 16 bp, Homo sapiens
agaagagaccaagctt

SEQ ID NO: 383146 - DNA, 18 bp, Homo sapiens
agaagagactctttgcat

SEQ ID NO: 383147 - DNA, 13 bp, Homo sapiens
agaagagggagaa

SEQ ID NO: 383148 - DNA, 18 bp, Homo sapiens
agaagagggcctgtggga

SEQ ID NO: 383149 - DNA, 13 bp, Homo sapiens
atgaccaggacta

SEQ ID NO: 383150 - DNA, 14 bp, Homo sapiens
atgaccaggccacc

SEQ ID NO: 383151 - DNA, 14 bp, Homo sapiens
atgaccagtttacc

SEQ ID NO: 383152 - DNA, 11 bp, Homo sapiens
atgacccctcc

SEQ ID NO: 383153 - DNA, 19 bp, Homo sapiens
atgaccgcacgttctctgc

SEQ ID NO: 383154 - DNA, 19 bp, Homo sapiens
atgacgacgacaacgatga

SEQ ID NO: 383155 - DNA, 19 bp, Homo sapiens
atgacggaagaacatagaa

SEQ ID NO: 383156 - DNA, 17 bp, Homo sapiens
atgacgtgaatgtgtat

SEQ ID NO: 383157 - DNA, 15 bp, Homo sapiens
atgactaaagagaga

SEQ ID NO: 383158 - DNA, 23 bp, Homo sapiens
atgactataaacattaaaagaag

SEQ ID NO: 383159 - DNA, 14 bp, Homo sapiens
atgactcagaatat

SEQ ID NO: 383160 - DNA, 12 bp, Homo sapiens
atgactccagaa

SEQ ID NO: 383161 - DNA, 16 bp, Homo sapiens
atgactgcacccagct

SEQ ID NO: 383162 - DNA, 18 bp, Homo sapiens
atgactgcacccagctcc

SEQ ID NO: 383163 - DNA, 15 bp, Homo sapiens
atgactggctgtctg

SEQ ID NO: 383164 - DNA, 21 bp, Homo sapiens
atgactggctgtctgcctgta

SEQ ID NO: 383165 - DNA, 17 bp, Homo sapiens
atgactgtgaccacctt

SEQ ID NO: 383166 - DNA, 18 bp, Homo sapiens
atgactgtgaccaccttc

SEQ ID NO: 383167 - DNA, 20 bp, Homo sapiens
atgacttcagagtacatcca

SEQ ID NO: 383168 - DNA, 17 bp, Homo sapiens
atgacttcatttctgat

SEQ ID NO: 383169 - DNA, 18 bp, Homo sapiens
atgacttcatttctgatg

SEQ ID NO: 383170 - DNA, 20 bp, Homo sapiens
atgacttttccatgtatcta

SEQ ID NO: 383171 - DNA, 17 bp, Homo sapiens
atgagaaaaaaacagca

SEQ ID NO: 383172 - DNA, 11 bp, Homo sapiens
atgagaaagaa

SEQ ID NO: 383173 - DNA, 16 bp, Homo sapiens
atgagaaatacagtgc

SEQ ID NO: 383174 - DNA, 18 bp, Homo sapiens
atgagaaatacagtgctt

SEQ ID NO: 383175 - DNA, 17 bp, Homo sapiens
atgagaactaaatagat

SEQ ID NO: 383176 - DNA, 18 bp, Homo sapiens
atgagaagagggcctgtg

SEQ ID NO: 383177 - DNA, 15 bp, Homo sapiens
atgagaagtactttg

SEQ ID NO: 383178 - DNA, 16 bp, Homo sapiens
atgagaagtactttgt

SEQ ID NO: 383179 - DNA, 23 bp, Homo sapiens
atgagaagtactttgtgctgatc

SEQ ID NO: 383180 - DNA, 11 bp, Homo sapiens
atgagaagtta

SEQ ID NO: 383181 - DNA, 19 bp, Homo sapiens
atgagaatctgtgcagtca

SEQ ID NO: 383182 - DNA, 13 bp, Homo sapiens
atgagaattttat

SEQ ID NO: 383183 - DNA, 15 bp, Homo sapiens
atgagacaacacaca

SEQ ID NO: 383184 - DNA, 23 bp, Homo sapiens
atgagacttccaaacctgacaga

SEQ ID NO: 383185 - DNA, 14 bp, Homo sapiens
atgagagagtgtgg

SEQ ID NO: 383186 - DNA, 20 bp, Homo sapiens
atgagaggcacactgctaaa

SEQ ID NO: 383187 - DNA, 17 bp, Homo sapiens
atgagatggccatgctc

SEQ ID NO: 383188 - DNA, 24 bp, Homo sapiens
atgagattggtcattaaatactat

SEQ ID NO: 383189 - DNA, 18 bp, Homo sapiens
atgagattgttttatcat

SEQ ID NO: 383190 - DNA, 16 bp, Homo sapiens
atgagatttgccagca

SEQ ID NO: 383191 - DNA, 15 bp, Homo sapiens
atgagcaaggacatt

SEQ ID NO: 383192 - DNA, 21 bp, Homo sapiens
atgagccaccgcgcccagcct

SEQ ID NO: 383193 - DNA, 16 bp, Homo sapiens
atgagcctctccttgc

SEQ ID NO: 383194 - DNA, 11 bp, Homo sapiens
atgagcctgcc

SEQ ID NO: 383195 - DNA, 14 bp, Homo sapiens
atgagcctgcccgc

SEQ ID NO: 383196 - DNA, 20 bp, Homo sapiens
atgagctatttccattccag

SEQ ID NO: 383197 - DNA, 14 bp, Homo sapiens
atgagctccagacc

SEQ ID NO: 383198 - DNA, 20 bp, Homo sapiens
atgagctccagacccccagc

SEQ ID NO: 383199 - DNA, 13 bp, Homo sapiens
atgagctccctcg

SEQ ID NO: 383200 - DNA, 17 bp, Homo sapiens
atgagctgggccctggg

SEQ ID NO: 383201 - DNA, 15 bp, Homo sapiens
atgaggaaaagaaaa

SEQ ID NO: 383202 - DNA, 12 bp, Homo sapiens
atgaggaagaat

SEQ ID NO: 383203 - DNA, 13 bp, Homo sapiens
atgaggacatgtt

SEQ ID NO: 383204 - DNA, 15 bp, Homo sapiens
atgaggccgctagag

SEQ ID NO: 383205 - DNA, 23 bp, Homo sapiens
atgagggacttccctagaagtct

SEQ ID NO: 383206 - DNA, 20 bp, Homo sapiens
atgaggtaaaagagccaagt

SEQ ID NO: 383207 - DNA, 19 bp, Homo sapiens
atgaggtgctgggagggat

SEQ ID NO: 383208 - DNA, 20 bp, Homo sapiens
atgaggtggtactatgatta

SEQ ID NO: 383209 - DNA, 17 bp, Homo sapiens
atgagtaaataaactct

SEQ ID NO: 383210 - DNA, 18 bp, Homo sapiens
atgagtaaataaactctt

SEQ ID NO: 383211 - DNA, 16 bp, Homo sapiens
atgagtcccagtggga

SEQ ID NO: 383212 - DNA, 15 bp, Homo sapiens
atgagtctagtttca

SEQ ID NO: 383213 - DNA, 16 bp, Homo sapiens
atgagttcaaatactt

SEQ ID NO: 383214 - DNA, 18 bp, Homo sapiens
atgagttcaaatactttt

SEQ ID NO: 383215 - DNA, 19 bp, Homo sapiens
atgagttcaaatacttttg

SEQ ID NO: 383216 - DNA, 20 bp, Homo sapiens
atgagtttaaaaaaataaca

SEQ ID NO: 383217 - DNA, 16 bp, Homo sapiens
atgagttttacattac

SEQ ID NO: 383218 - DNA, 22 bp, Homo sapiens
atgataaaaaagtgtcctataa

SEQ ID NO: 383219 - DNA, 17 bp, Homo sapiens
atgataaaaggaatctg

SEQ ID NO: 383220 - DNA, 12 bp, Homo sapiens
atgatacagtca

SEQ ID NO: 383221 - DNA, 17 bp, Homo sapiens
atgatactgtctaagaa

SEQ ID NO: 383222 - DNA, 14 bp, Homo sapiens
atgatagacttcga

SEQ ID NO: 383223 - DNA, 19 bp, Homo sapiens
atgataggcagcactgaaa

SEQ ID NO: 383224 - DNA, 18 bp, Homo sapiens
atgatataataaatatat

SEQ ID NO: 383225 - DNA, 13 bp, Homo sapiens
atgatatataaac

SEQ ID NO: 383226 - DNA, 15 bp, Homo sapiens
atgatatgtctttaa

SEQ ID NO: 383227 - DNA, 19 bp, Homo sapiens
agagctcttcaagctgtcc

SEQ ID NO: 383228 - DNA, 21 bp, Homo sapiens
agagctcttttttagctctct

SEQ ID NO: 383229 - DNA, 17 bp, Homo sapiens
agagctgagtcggctgg

SEQ ID NO: 383230 - DNA, 18 bp, Homo sapiens
agagctgagtcggctggg

SEQ ID NO: 383231 - DNA, 14 bp, Homo sapiens
agagctggaaggca

SEQ ID NO: 383232 - DNA, 15 bp, Homo sapiens
agagctggaaggcag

SEQ ID NO: 383233 - DNA, 19 bp, Homo sapiens
agagctgggtaccaggcca

SEQ ID NO: 383234 - DNA, 21 bp, Homo sapiens
agagctgggtaccaggccacc

SEQ ID NO: 383235 - DNA, 11 bp, Homo sapiens
agagctgggtg

SEQ ID NO: 383236 - DNA, 12 bp, Homo sapiens
agagctgggtga

SEQ ID NO: 383237 - DNA, 16 bp, Homo sapiens
agagctgggtgagtgg

SEQ ID NO: 383238 - DNA, 16 bp, Homo sapiens
agagctgggtggcctg

SEQ ID NO: 383239 - DNA, 23 bp, Homo sapiens
agagctggtagttagtagcatgt

SEQ ID NO: 383240 - DNA, 20 bp, Homo sapiens
agagctggtggtgcagcctt

SEQ ID NO: 383241 - DNA, 23 bp, Homo sapiens
agagctggtggtgcagccttccc

SEQ ID NO: 383242 - DNA, 17 bp, Homo sapiens
agagctggtgtctgatt

SEQ ID NO: 383243 - DNA, 14 bp, Homo sapiens
agagctgtctggtg

SEQ ID NO: 383244 - DNA, 17 bp, Homo sapiens
agagctgttttggatga

SEQ ID NO: 383245 - DNA, 15 bp, Homo sapiens
agagcttctggcact

SEQ ID NO: 383246 - DNA, 21 bp, Homo sapiens
agagcttgattagaagccaag

SEQ ID NO: 383247 - DNA, 22 bp, Homo sapiens
agagctttctgtccttttggca

SEQ ID NO: 383248 - DNA, 22 bp, Homo sapiens
agaggaaaaacagaggatgctg

SEQ ID NO: 383249 - DNA, 18 bp, Homo sapiens
agaggaaaagtaaggtgc

SEQ ID NO: 383250 - DNA, 22 bp, Homo sapiens
agaggaaaagtaaggtgcagtt

SEQ ID NO: 383251 - DNA, 19 bp, Homo sapiens
agaggaactccttggccta

SEQ ID NO: 383252 - DNA, 19 bp, Homo sapiens
agaggaagagagagaccct

SEQ ID NO: 383253 - DNA, 18 bp, Homo sapiens
agaggacagatcaatggc

SEQ ID NO: 383254 - DNA, 14 bp, Homo sapiens
agaggacagtgctg

SEQ ID NO: 383255 - DNA, 23 bp, Homo sapiens
agaggacagtttaggacccaagg

SEQ ID NO: 383256 - DNA, 20 bp, Homo sapiens
agaggaccacagtgggtggc

SEQ ID NO: 383257 - DNA, 17 bp, Homo sapiens
agaggagaaaggtgaaa

SEQ ID NO: 383258 - DNA, 14 bp, Homo sapiens
agaggagaaggaga

SEQ ID NO: 383259 - DNA, 13 bp, Homo sapiens
agaggagaccctg

SEQ ID NO: 383260 - DNA, 14 bp, Homo sapiens
agaggagaccctgg

SEQ ID NO: 383261 - DNA, 22 bp, Homo sapiens
agaggagagaatgagagagtgt

SEQ ID NO: 383262 - DNA, 16 bp, Homo sapiens
agaggagagcatctgc

SEQ ID NO: 383263 - DNA, 21 bp, Homo sapiens
agaggagagcatctgctctga

SEQ ID NO: 383264 - DNA, 21 bp, Homo sapiens
agaggagagtacccccctgag

SEQ ID NO: 383265 - DNA, 13 bp, Homo sapiens
agaggagcacctg

SEQ ID NO: 383266 - DNA, 16 bp, Homo sapiens
agaggagcacctgaac

SEQ ID NO: 383267 - DNA, 16 bp, Homo sapiens
agaggagcaggaagca

SEQ ID NO: 383268 - DNA, 15 bp, Homo sapiens
agaggagccctcatc

SEQ ID NO: 383269 - DNA, 13 bp, Homo sapiens
agaggaggcagcc

SEQ ID NO: 383270 - DNA, 21 bp, Homo sapiens
agaggaggcagccccctccac

SEQ ID NO: 383271 - DNA, 17 bp, Homo sapiens
agaggaggggtaaatat

SEQ ID NO: 383272 - DNA, 20 bp, Homo sapiens
agaggaggtgtggagtggag

SEQ ID NO: 383273 - DNA, 22 bp, Homo sapiens
agaggaggtgtggagtggaggg

SEQ ID NO: 383274 - DNA, 16 bp, Homo sapiens
agaggagtgcgctaga

SEQ ID NO: 383275 - DNA, 15 bp, Homo sapiens
agaggagttcaatga

SEQ ID NO: 383276 - DNA, 23 bp, Homo sapiens
agaggagttcaatgatctaggtt

SEQ ID NO: 383277 - DNA, 19 bp, Homo sapiens
agaggatccgtgctgtctc

SEQ ID NO: 383278 - DNA, 20 bp, Homo sapiens
agaggatgaatgtatgtgca

SEQ ID NO: 383279 - DNA, 22 bp, Homo sapiens
agagtgggggagagcaggctgg

SEQ ID NO: 383280 - DNA, 15 bp, Homo sapiens
agagtggtggcagct

SEQ ID NO: 383281 - DNA, 19 bp, Homo sapiens
agagtggttgttgccaact

SEQ ID NO: 383282 - DNA, 22 bp, Homo sapiens
agagtggtttcattgccttcct

SEQ ID NO: 383283 - DNA, 14 bp, Homo sapiens
agagttaagaatgt

SEQ ID NO: 383284 - DNA, 16 bp, Homo sapiens
agagttcactataaat

SEQ ID NO: 383285 - DNA, 20 bp, Homo sapiens
agagttctatccccaagctg

SEQ ID NO: 383286 - DNA, 18 bp, Homo sapiens
agagttctttgctgcccc

SEQ ID NO: 383287 - DNA, 13 bp, Homo sapiens
agagttgagcaca

SEQ ID NO: 383288 - DNA, 16 bp, Homo sapiens
agagttggggaaggca

SEQ ID NO: 383289 - DNA, 14 bp, Homo sapiens
agagtttaacacaa

SEQ ID NO: 383290 - DNA, 22 bp, Homo sapiens
agagtttaacacaagtcctgtg

SEQ ID NO: 383291 - DNA, 23 bp, Homo sapiens
agagtttgtagtaaatattatga

SEQ ID NO: 383292 - DNA, 14 bp, Homo sapiens
agataaaaagatgg

SEQ ID NO: 383293 - DNA, 13 bp, Homo sapiens
agataaagatgat

SEQ ID NO: 383294 - DNA, 14 bp, Homo sapiens
agataacgcaggag

SEQ ID NO: 383295 - DNA, 15 bp, Homo sapiens
agataactgctcttt

SEQ ID NO: 383296 - DNA, 14 bp, Homo sapiens
agataacttccttc

SEQ ID NO: 383297 - DNA, 13 bp, Homo sapiens
agataagacttgt

SEQ ID NO: 383298 - DNA, 17 bp, Homo sapiens
agataagacttgtttct

SEQ ID NO: 383299 - DNA, 16 bp, Homo sapiens
agataagcaagagaga

SEQ ID NO: 383300 - DNA, 16 bp, Homo sapiens
agataatattactgtt

SEQ ID NO: 383301 - DNA, 19 bp, Homo sapiens
agataatcagtgtgtctaa

SEQ ID NO: 383302 - DNA, 19 bp, Homo sapiens
agataatggataatcttcg

SEQ ID NO: 383303 - DNA, 12 bp, Homo sapiens
agataattataa

SEQ ID NO: 383304 - DNA, 22 bp, Homo sapiens
agataatttaaccctgcctctc

SEQ ID NO: 383305 - DNA, 21 bp, Homo sapiens
agataatttgcatattctatt

SEQ ID NO: 383306 - DNA, 23 bp, Homo sapiens
agatacacaagagggactgtatt

SEQ ID NO: 383307 - DNA, 13 bp, Homo sapiens
agatacactcctg

SEQ ID NO: 383308 - DNA, 15 bp, Homo sapiens
agatacactcctgct

SEQ ID NO: 383309 - DNA, 19 bp, Homo sapiens
agatacagatccgcatgtg

SEQ ID NO: 383310 - DNA, 20 bp, Homo sapiens
agatacagatccgcatgtgt

SEQ ID NO: 383311 - DNA, 18 bp, Homo sapiens
agatacatatgagtgtgg

SEQ ID NO: 383312 - DNA, 22 bp, Homo sapiens
agatacatatgagtgtggaagc

SEQ ID NO: 383313 - DNA, 18 bp, Homo sapiens
agataccaggttgaaaga

SEQ ID NO: 383314 - DNA, 22 bp, Homo sapiens
agataccatcagcaaagaattt

SEQ ID NO: 383315 - DNA, 20 bp, Homo sapiens
agataccattttgaaatatt

SEQ ID NO: 383316 - DNA, 16 bp, Homo sapiens
agatacccagagagaa

SEQ ID NO: 383317 - DNA, 20 bp, Homo sapiens
agatacccagagagaaaaag

SEQ ID NO: 383318 - DNA, 16 bp, Homo sapiens
agatacgactttattt

SEQ ID NO: 383319 - DNA, 16 bp, Homo sapiens
agatactcaagcaggt

SEQ ID NO: 383320 - DNA, 19 bp, Homo sapiens
agatactggaagttttgca

SEQ ID NO: 383321 - DNA, 21 bp, Homo sapiens
agatactggaagttttgcatt

SEQ ID NO: 383322 - DNA, 15 bp, Homo sapiens
agatacttaaaggaa

SEQ ID NO: 383323 - DNA, 15 bp, Homo sapiens
agatacttgatgcac

SEQ ID NO: 383324 - DNA, 18 bp, Homo sapiens
agatacttgatgcactta

SEQ ID NO: 383325 - DNA, 18 bp, Homo sapiens
agatagaaataaatagct

SEQ ID NO: 383326 - DNA, 17 bp, Homo sapiens
agatagaagatgtttgc

SEQ ID NO: 383327 - DNA, 24 bp, Homo sapiens
agatagagattcccctggaccaca

SEQ ID NO: 383328 - DNA, 14 bp, Homo sapiens
agatagatttggaa

SEQ ID NO: 383329 - DNA, 21 bp, Homo sapiens
agatagctgactcattctttt

SEQ ID NO: 383330 - DNA, 13 bp, Homo sapiens
agataggggcaca

SEQ ID NO: 383331 - DNA, 13 bp, Homo sapiens
agatagtgccagg

SEQ ID NO: 383332 - DNA, 15 bp, Homo sapiens
agatagtgccaggtg

SEQ ID NO: 383333 - DNA, 15 bp, Homo sapiens
agatataactgtaca

SEQ ID NO: 383334 - DNA, 18 bp, Homo sapiens
agatatatctttatactt

SEQ ID NO: 383335 - DNA, 15 bp, Homo sapiens
agatatcagagctct

SEQ ID NO: 383336 - DNA, 19 bp, Homo sapiens
agatatcgagagtttctat

SEQ ID NO: 383337 - DNA, 15 bp, Homo sapiens
agatatctatgactg

SEQ ID NO: 383338 - DNA, 12 bp, Homo sapiens
agatatggtgga

SEQ ID NO: 383339 - DNA, 16 bp, Homo sapiens
agatatgtattacttt

SEQ ID NO: 383340 - DNA, 16 bp, Homo sapiens
agatatgtgagaactt

SEQ ID NO: 383341 - DNA, 20 bp, Homo sapiens
agatatgtgagaacttttca

SEQ ID NO: 383342 - DNA, 21 bp, Homo sapiens
agatattattcaccatgtaaa

SEQ ID NO: 383343 - DNA, 22 bp, Homo sapiens
agatattatttatcgaaagtaa

SEQ ID NO: 383344 - DNA, 12 bp, Homo sapiens
agatattcaagt

SEQ ID NO: 383345 - DNA, 16 bp, Homo sapiens
agatattcattaatag

SEQ ID NO: 383346 - DNA, 22 bp, Homo sapiens
agatattccagaccaaaataat

SEQ ID NO: 383347 - DNA, 22 bp, Homo sapiens
agatattgttttctgtaaataa

SEQ ID NO: 383348 - DNA, 16 bp, Homo sapiens
agatatttaaaagaca

SEQ ID NO: 383349 - DNA, 17 bp, Homo sapiens
agatatttatatatatt

SEQ ID NO: 383350 - DNA, 17 bp, Homo sapiens
agatatttatattttta

SEQ ID NO: 383351 - DNA, 23 bp, Homo sapiens
agatatttattgtttatttatca

SEQ ID NO: 383352 - DNA, 14 bp, Homo sapiens
agatcaaaataaaa

SEQ ID NO: 383353 - DNA, 14 bp, Homo sapiens
agatcaattaattc

SEQ ID NO: 383354 - DNA, 15 bp, Homo sapiens
agatcacaaatagtg

SEQ ID NO: 383355 - DNA, 15 bp, Homo sapiens
agatcacagcctcca

SEQ ID NO: 383356 - DNA, 16 bp, Homo sapiens
agatcacagcctccag

SEQ ID NO: 383357 - DNA, 18 bp, Homo sapiens
agatcacagcctccaggg

SEQ ID NO: 383358 - DNA, 15 bp, Homo sapiens
agatcaccagcccgg

SEQ ID NO: 383359 - DNA, 16 bp, Homo sapiens
agatcaccagcccggc

SEQ ID NO: 383360 - DNA, 17 bp, Homo sapiens
agatcacgccactgcac

SEQ ID NO: 383361 - DNA, 18 bp, Homo sapiens
agatcacgttccttcccc

SEQ ID NO: 383362 - DNA, 20 bp, Homo sapiens
agatcagcaaaccggggcct

SEQ ID NO: 383363 - DNA, 15 bp, Homo sapiens
agatcagcattcaaa

SEQ ID NO: 383364 - DNA, 18 bp, Homo sapiens
agatcagcattcaaaata

SEQ ID NO: 383365 - DNA, 20 bp, Homo sapiens
agatcagcattcaaaatagt

SEQ ID NO: 383366 - DNA, 19 bp, Homo sapiens
agatcattctccttgtaaa

SEQ ID NO: 383367 - DNA, 13 bp, Homo sapiens
agatccagactgt

SEQ ID NO: 383368 - DNA, 16 bp, Homo sapiens
agatccagggactgaa

SEQ ID NO: 383369 - DNA, 22 bp, Homo sapiens
atgcattttaaagttaaacatt

SEQ ID NO: 383370 - DNA, 12 bp, Homo sapiens
atgcattttgca

SEQ ID NO: 383371 - DNA, 18 bp, Homo sapiens
atgcattttgcagcagtg

SEQ ID NO: 383372 - DNA, 17 bp, Homo sapiens
atgccaaacagttgtac

SEQ ID NO: 383373 - DNA, 21 bp, Homo sapiens
atgccaagtaacaatgcatgc

SEQ ID NO: 383374 - DNA, 15 bp, Homo sapiens
atgccacacagagtg

SEQ ID NO: 383375 - DNA, 17 bp, Homo sapiens
atgccacagccaagccc

SEQ ID NO: 383376 - DNA, 15 bp, Homo sapiens
atgccacattttgct

SEQ ID NO: 383377 - DNA, 12 bp, Homo sapiens
atgccaccaccc

SEQ ID NO: 383378 - DNA, 18 bp, Homo sapiens
atgccaccacccacccca

SEQ ID NO: 383379 - DNA, 14 bp, Homo sapiens
atgccaccctcaca

SEQ ID NO: 383380 - DNA, 15 bp, Homo sapiens
atgccacctgcagcg

SEQ ID NO: 383381 - DNA, 19 bp, Homo sapiens
atgccactgccaggcacct

SEQ ID NO: 383382 - DNA, 20 bp, Homo sapiens
atgccactgccaggcacctg

SEQ ID NO: 383383 - DNA, 21 bp, Homo sapiens
atgccactgccaggcacctgg

SEQ ID NO: 383384 - DNA, 23 bp, Homo sapiens
atgccactgccaggcacctggcc

SEQ ID NO: 383385 - DNA, 11 bp, Homo sapiens
atgccagccca

SEQ ID NO: 383386 - DNA, 15 bp, Homo sapiens
atgccagcccaaagc

SEQ ID NO: 383387 - DNA, 14 bp, Homo sapiens
atgccaggacagct

SEQ ID NO: 383388 - DNA, 17 bp, Homo sapiens
atgccaggacagctgca

SEQ ID NO: 383389 - DNA, 22 bp, Homo sapiens
atgccagtaacgcgtcttcctg

SEQ ID NO: 383390 - DNA, 21 bp, Homo sapiens
atgccatgaggaacaaggcaa

SEQ ID NO: 383391 - DNA, 21 bp, Homo sapiens
atgccatggcctgtgctgggc

SEQ ID NO: 383392 - DNA, 22 bp, Homo sapiens
atgccattccgaccttcaccaa

SEQ ID NO: 383393 - DNA, 15 bp, Homo sapiens
atgccatttgtttat

SEQ ID NO: 383394 - DNA, 16 bp, Homo sapiens
atgccatttgtttatt

SEQ ID NO: 383395 - DNA, 12 bp, Homo sapiens
atgcccacccct

SEQ ID NO: 383396 - DNA, 19 bp, Homo sapiens
atgcccacctgcccatcac

SEQ ID NO: 383397 - DNA, 18 bp, Homo sapiens
atgcccaggtaccaccct

SEQ ID NO: 383398 - DNA, 22 bp, Homo sapiens
atgccccctaatccccttctcc

SEQ ID NO: 383399 - DNA, 17 bp, Homo sapiens
atgcccctccccagtag

SEQ ID NO: 383400 - DNA, 19 bp, Homo sapiens
atgcccgcccggggagttt

SEQ ID NO: 383401 - DNA, 13 bp, Homo sapiens
atgccctccaatc

SEQ ID NO: 383402 - DNA, 19 bp, Homo sapiens
atgccctcctaaatgtcag

SEQ ID NO: 383403 - DNA, 17 bp, Homo sapiens
atgccctgccaagcctg

SEQ ID NO: 383404 - DNA, 14 bp, Homo sapiens
atgccctggatcca

SEQ ID NO: 383405 - DNA, 22 bp, Homo sapiens
atgccctttcttgaattgcatt

SEQ ID NO: 383406 - DNA, 21 bp, Homo sapiens
atgccgaatgccctcagggga

SEQ ID NO: 383407 - DNA, 20 bp, Homo sapiens
atgccgcgggcggccaggca

SEQ ID NO: 383408 - DNA, 22 bp, Homo sapiens
atgccgcgggcggccaggcaac

SEQ ID NO: 383409 - DNA, 13 bp, Homo sapiens
atggacacaaaaa

SEQ ID NO: 383410 - DNA, 14 bp, Homo sapiens
atggacagggccag

SEQ ID NO: 383411 - DNA, 22 bp, Homo sapiens
atggacagttcacaccctgcaa

SEQ ID NO: 383412 - DNA, 14 bp, Homo sapiens
atggacatgatctt

SEQ ID NO: 383413 - DNA, 22 bp, Homo sapiens
atggacccacgaacgctcttag

SEQ ID NO: 383414 - DNA, 19 bp, Homo sapiens
atggaccgggtgggcctgg

SEQ ID NO: 383415 - DNA, 23 bp, Homo sapiens
atggaccgggtgggcctggcctg

SEQ ID NO: 383416 - DNA, 13 bp, Homo sapiens
atggacctaacat

SEQ ID NO: 383417 - DNA, 14 bp, Homo sapiens
atggacctaacatt

SEQ ID NO: 383418 - DNA, 18 bp, Homo sapiens
atggactctacactgtga

SEQ ID NO: 383419 - DNA, 17 bp, Homo sapiens
atggactcttcccccac

SEQ ID NO: 383420 - DNA, 12 bp, Homo sapiens
atggactgcaca

SEQ ID NO: 383421 - DNA, 20 bp, Homo sapiens
atggacttaattatgctaac

SEQ ID NO: 383422 - DNA, 20 bp, Homo sapiens
atggacttatttcttcaaat

SEQ ID NO: 383423 - DNA, 18 bp, Homo sapiens
atggacttgcttcttgtg

SEQ ID NO: 383424 - DNA, 12 bp, Homo sapiens
atggagaaaatg

SEQ ID NO: 383425 - DNA, 22 bp, Homo sapiens
atggagaaaccttgtctctact

SEQ ID NO: 383426 - DNA, 12 bp, Homo sapiens
atggagaaggaa

SEQ ID NO: 383427 - DNA, 20 bp, Homo sapiens
atggagaatctgctgcatag

SEQ ID NO: 383428 - DNA, 16 bp, Homo sapiens
atggagaatgccagcc

SEQ ID NO: 383429 - DNA, 18 bp, Homo sapiens
atggagaatgccagccca

SEQ ID NO: 383430 - DNA, 20 bp, Homo sapiens
atggagactccatgagaagc

SEQ ID NO: 383431 - DNA, 20 bp, Homo sapiens
atggagactcctgccctgtt

SEQ ID NO: 383432 - DNA, 21 bp, Homo sapiens
atggagactggtcctgtgtgc

SEQ ID NO: 383433 - DNA, 15 bp, Homo sapiens
atggagagagcctta

SEQ ID NO: 383434 - DNA, 14 bp, Homo sapiens
atggagaggagaac

SEQ ID NO: 383435 - DNA, 18 bp, Homo sapiens
atggagcaagtgagcact

SEQ ID NO: 383436 - DNA, 20 bp, Homo sapiens
atggagcacgaggccttcag

SEQ ID NO: 383437 - DNA, 22 bp, Homo sapiens
atggagcacgaggccttcagaa

SEQ ID NO: 383438 - DNA, 14 bp, Homo sapiens
atggagctagagag

SEQ ID NO: 383439 - DNA, 13 bp, Homo sapiens
atggagcttgtac

SEQ ID NO: 383440 - DNA, 16 bp, Homo sapiens
atggagcttgtacata

SEQ ID NO: 383441 - DNA, 18 bp, Homo sapiens
atggaggaattgggacct

SEQ ID NO: 383442 - DNA, 23 bp, Homo sapiens
atggaggattctttccccagagg

SEQ ID NO: 383443 - DNA, 17 bp, Homo sapiens
atggaggcagaatcctg

SEQ ID NO: 383444 - DNA, 19 bp, Homo sapiens
atggaggccaagcctgcag

SEQ ID NO: 383445 - DNA, 20 bp, Homo sapiens
atggaggggtggtcctgact

SEQ ID NO: 383446 - DNA, 18 bp, Homo sapiens
atggaggtgatgaaaacc

SEQ ID NO: 383447 - DNA, 22 bp, Homo sapiens
atggatccccagtgaaaactag

SEQ ID NO: 383448 - DNA, 17 bp, Homo sapiens
atggatgaattatgata

SEQ ID NO: 383449 - DNA, 16 bp, Homo sapiens
atggatgacaaagaaa

SEQ ID NO: 383450 - DNA, 13 bp, Homo sapiens
atggatgtaatat

SEQ ID NO: 383451 - DNA, 16 bp, Homo sapiens
atggatgtttcttctt

SEQ ID NO: 383452 - DNA, 14 bp, Homo sapiens
atggattaaatggc

SEQ ID NO: 383453 - DNA, 16 bp, Homo sapiens
atggattaaatggcac

SEQ ID NO: 383454 - DNA, 14 bp, Homo sapiens
atggattctcagat

SEQ ID NO: 383455 - DNA, 16 bp, Homo sapiens
atggattctcagatat

SEQ ID NO: 383456 - DNA, 16 bp, Homo sapiens
atggatttgacacact

SEQ ID NO: 383457 - DNA, 14 bp, Homo sapiens
atggatttgcctgt

SEQ ID NO: 383458 - DNA, 17 bp, Homo sapiens
atggatttggttatgat

SEQ ID NO: 383459 - DNA, 17 bp, Homo sapiens
atggcaacaaacacatt

SEQ ID NO: 383460 - DNA, 18 bp, Homo sapiens
atggcaccagccccctgg

SEQ ID NO: 383461 - DNA, 19 bp, Homo sapiens
atggcaccagccccctgga

SEQ ID NO: 383462 - DNA, 20 bp, Homo sapiens
atggcaccagccccctggat

SEQ ID NO: 383463 - DNA, 16 bp, Homo sapiens
atggcacctgtatacc

SEQ ID NO: 383464 - DNA, 17 bp, Homo sapiens
atggcacctgtggccag

SEQ ID NO: 383465 - DNA, 21 bp, Homo sapiens
atggcaccttcattctccgtt

SEQ ID NO: 383466 - DNA, 20 bp, Homo sapiens
atggcacttagctatcagaa

SEQ ID NO: 383467 - DNA, 16 bp, Homo sapiens
atggcactttagtgat

SEQ ID NO: 383468 - DNA, 19 bp, Homo sapiens
atggcagaagcgtctccct

SEQ ID NO: 383469 - DNA, 14 bp, Homo sapiens
atggcagaagggaa

SEQ ID NO: 383470 - DNA, 12 bp, Homo sapiens
atggcagcctca

SEQ ID NO: 383471 - DNA, 13 bp, Homo sapiens
atggcagcctcag

SEQ ID NO: 383472 - DNA, 18 bp, Homo sapiens
atggcagcctcagggctt

SEQ ID NO: 383473 - DNA, 19 bp, Homo sapiens
atggcagctagactggagt

SEQ ID NO: 383474 - DNA, 16 bp, Homo sapiens
atggcaggagaatcag

SEQ ID NO: 383475 - DNA, 13 bp, Homo sapiens
atggcattactct

SEQ ID NO: 383476 - DNA, 14 bp, Homo sapiens
atggcattactctg

SEQ ID NO: 383477 - DNA, 17 bp, Homo sapiens
atggcattactctgcac

SEQ ID NO: 383478 - DNA, 23 bp, Homo sapiens
atggccaaggggccagctgcccc

SEQ ID NO: 383479 - DNA, 14 bp, Homo sapiens
atggccaatagtca

SEQ ID NO: 383480 - DNA, 21 bp, Homo sapiens
atggccaatagtcatatgtga

SEQ ID NO: 383481 - DNA, 13 bp, Homo sapiens
atggccacagcca

SEQ ID NO: 383482 - DNA, 19 bp, Homo sapiens
atggccacagccacctcca

SEQ ID NO: 383483 - DNA, 20 bp, Homo sapiens
atggccaccccgtgccaccc

SEQ ID NO: 383484 - DNA, 13 bp, Homo sapiens
atggccatgctca

SEQ ID NO: 383485 - DNA, 15 bp, Homo sapiens
atggcccagcctgga

SEQ ID NO: 383486 - DNA, 19 bp, Homo sapiens
atggcccagcctggagccg

SEQ ID NO: 383487 - DNA, 14 bp, Homo sapiens
atggcccagtgtca

SEQ ID NO: 383488 - DNA, 16 bp, Homo sapiens
atggccccagctggct

SEQ ID NO: 383489 - DNA, 17 bp, Homo sapiens
atggccccagctggctg

SEQ ID NO: 383490 - DNA, 20 bp, Homo sapiens
atggccccagctggctgggt

SEQ ID NO: 383491 - DNA, 19 bp, Homo sapiens
atggccctagaactgtgcc

SEQ ID NO: 383492 - DNA, 23 bp, Homo sapiens
atggcccttcctggactggccct

SEQ ID NO: 383493 - DNA, 18 bp, Homo sapiens
atggccgggctgctgctg

SEQ ID NO: 383494 - DNA, 13 bp, Homo sapiens
atggcctcagctg

SEQ ID NO: 383495 - DNA, 14 bp, Homo sapiens
atggcctcagctgc

SEQ ID NO: 383496 - DNA, 21 bp, Homo sapiens
atggcctcagctgcctcactt

SEQ ID NO: 383497 - DNA, 19 bp, Homo sapiens
atggcctcccagccacccg

SEQ ID NO: 383498 - DNA, 22 bp, Homo sapiens
atggcctgtgctgggccagtgg

SEQ ID NO: 383499 - DNA, 20 bp, Homo sapiens
atggcctttgcttgaaagaa

SEQ ID NO: 383500 - DNA, 19 bp, Homo sapiens
atggcgattcccattgaaa

SEQ ID NO: 383501 - DNA, 21 bp, Homo sapiens
atggcgattcccattgaaaat

SEQ ID NO: 383502 - DNA, 22 bp, Homo sapiens
atggcgattcccattgaaaatg

SEQ ID NO: 383503 - DNA, 22 bp, Homo sapiens
atggcgcacccggcagcccccc

SEQ ID NO: 383504 - DNA, 14 bp, Homo sapiens
atggcgcagtgcct

SEQ ID NO: 383505 - DNA, 18 bp, Homo sapiens
atggcgcagtgcctctgg

SEQ ID NO: 383506 - DNA, 18 bp, Homo sapiens
atggcgcgggaggcacca

SEQ ID NO: 383507 - DNA, 19 bp, Homo sapiens
atggcgcgggaggcaccag

SEQ ID NO: 383508 - DNA, 15 bp, Homo sapiens
atggcggaggccatg

SEQ ID NO: 383509 - DNA, 20 bp, Homo sapiens
atggcggtgatcagcagaga

SEQ ID NO: 383510 - DNA, 18 bp, Homo sapiens
atggcgtaatgggcctgc

SEQ ID NO: 383511 - DNA, 20 bp, Homo sapiens
agatgtgacccaccagtgcc

SEQ ID NO: 383512 - DNA, 18 bp, Homo sapiens
agatgtgcaaatgcaagc

SEQ ID NO: 383513 - DNA, 16 bp, Homo sapiens
agatgtgcccagagta

SEQ ID NO: 383514 - DNA, 21 bp, Homo sapiens
agatgtgcttctgaaccgcaa

SEQ ID NO: 383515 - DNA, 23 bp, Homo sapiens
agatgtggcaaagtgctgtaccc

SEQ ID NO: 383516 - DNA, 16 bp, Homo sapiens
agatgtgtctatggct

SEQ ID NO: 383517 - DNA, 13 bp, Homo sapiens
agatgttgtttta

SEQ ID NO: 383518 - DNA, 19 bp, Homo sapiens
agatgttgttttaggggct

SEQ ID NO: 383519 - DNA, 20 bp, Homo sapiens
agatgtttttaaaagtttca

SEQ ID NO: 383520 - DNA, 15 bp, Homo sapiens
agattacaagataaa

SEQ ID NO: 383521 - DNA, 18 bp, Homo sapiens
agattactttgctgcctt

SEQ ID NO: 383522 - DNA, 14 bp, Homo sapiens
agattagagggagg

SEQ ID NO: 383523 - DNA, 16 bp, Homo sapiens
agattaggacacagtg

SEQ ID NO: 383524 - DNA, 14 bp, Homo sapiens
agattatattataa

SEQ ID NO: 383525 - DNA, 22 bp, Homo sapiens
agattatattataataatgttc

SEQ ID NO: 383526 - DNA, 21 bp, Homo sapiens
agattatattgagacaaaaat

SEQ ID NO: 383527 - DNA, 13 bp, Homo sapiens
agattatcctgtt

SEQ ID NO: 383528 - DNA, 19 bp, Homo sapiens
agattatcctgttactgaa

SEQ ID NO: 383529 - DNA, 19 bp, Homo sapiens
agattcaaaaaaaaaatat

SEQ ID NO: 383530 - DNA, 20 bp, Homo sapiens
agattcaaaaaaaaaatata

SEQ ID NO: 383531 - DNA, 17 bp, Homo sapiens
agattcacctgtaaaac

SEQ ID NO: 383532 - DNA, 19 bp, Homo sapiens
agattcacctgtaaaactt

SEQ ID NO: 383533 - DNA, 13 bp, Homo sapiens
agattcatattta

SEQ ID NO: 383534 - DNA, 19 bp, Homo sapiens
agattcatatttacttctt

SEQ ID NO: 383535 - DNA, 19 bp, Homo sapiens
agattccattttatacaag

SEQ ID NO: 383536 - DNA, 17 bp, Homo sapiens
agattccattttggaaa

SEQ ID NO: 383537 - DNA, 19 bp, Homo sapiens
agattcccggctggacttt

SEQ ID NO: 383538 - DNA, 15 bp, Homo sapiens
agattcctacttaaa

SEQ ID NO: 383539 - DNA, 21 bp, Homo sapiens
ctgccctggtccagggaagct

SEQ ID NO: 383540 - DNA, 12 bp, Homo sapiens
ctgccctggtgc

SEQ ID NO: 383541 - DNA, 17 bp, Homo sapiens
ctgccctggtgctgcca

SEQ ID NO: 383542 - DNA, 23 bp, Homo sapiens
ctgccctggtgctgccacacttc

SEQ ID NO: 383543 - DNA, 22 bp, Homo sapiens
ctgccctgtacctctctctgct

SEQ ID NO: 383544 - DNA, 12 bp, Homo sapiens
ctgccctgtcta

SEQ ID NO: 383545 - DNA, 19 bp, Homo sapiens
ctgccctgttgtgtataga

SEQ ID NO: 383546 - DNA, 21 bp, Homo sapiens
ctgcccttcagcatcctcagt

SEQ ID NO: 383547 - DNA, 14 bp, Homo sapiens
ctgcccttttcctg

SEQ ID NO: 383548 - DNA, 22 bp, Homo sapiens
ctgcccttttcctgggccttct

SEQ ID NO: 383549 - DNA, 16 bp, Homo sapiens
ctgccgaccgaggctg

SEQ ID NO: 383550 - DNA, 21 bp, Homo sapiens
ctgccgaccgaggctggagct

SEQ ID NO: 383551 - DNA, 18 bp, Homo sapiens
ctgccgaccgcctgcttc

SEQ ID NO: 383552 - DNA, 17 bp, Homo sapiens
ctgccgcaacagttttt

SEQ ID NO: 383553 - DNA, 20 bp, Homo sapiens
ctgccgccactggctgtgcc

SEQ ID NO: 383554 - DNA, 18 bp, Homo sapiens
ctgccgcctcccagcctg

SEQ ID NO: 383555 - DNA, 18 bp, Homo sapiens
ctgccgcctggggctccg

SEQ ID NO: 383556 - DNA, 22 bp, Homo sapiens
ctgccgcctgtgcccttgctgg

SEQ ID NO: 383557 - DNA, 20 bp, Homo sapiens
ctgccgggttctagtctcct

SEQ ID NO: 383558 - DNA, 21 bp, Homo sapiens
ctgccgggttctagtctcctt

SEQ ID NO: 383559 - DNA, 14 bp, Homo sapiens
ctgccggtccccca

SEQ ID NO: 383560 - DNA, 17 bp, Homo sapiens
ctgccggtcccccatgc

SEQ ID NO: 383561 - DNA, 19 bp, Homo sapiens
ctgccggtcccccatgcca

SEQ ID NO: 383562 - DNA, 16 bp, Homo sapiens
ctgccgtgagagccca

SEQ ID NO: 383563 - DNA, 22 bp, Homo sapiens
ctgccgtgagagcccaatcact

SEQ ID NO: 383564 - DNA, 18 bp, Homo sapiens
ctgccgtgcacggggcca

SEQ ID NO: 383565 - DNA, 15 bp, Homo sapiens
ctgccgtgcatggct

SEQ ID NO: 383566 - DNA, 18 bp, Homo sapiens
ctgccgtgcatggctcct

SEQ ID NO: 383567 - DNA, 23 bp, Homo sapiens
ctgccgtgggcctgtcgtgccag

SEQ ID NO: 383568 - DNA, 15 bp, Homo sapiens
ctgcctaggagctgg

SEQ ID NO: 383569 - DNA, 18 bp, Homo sapiens
ctgcctaggagctggctg

SEQ ID NO: 383570 - DNA, 18 bp, Homo sapiens
ctgcctagggttgcttgg

SEQ ID NO: 383571 - DNA, 17 bp, Homo sapiens
ctgcctatccatcctgc

SEQ ID NO: 383572 - DNA, 14 bp, Homo sapiens
ctgcctcacttcct

SEQ ID NO: 383573 - DNA, 11 bp, Homo sapiens
ctgcctcagcc

SEQ ID NO: 383574 - DNA, 14 bp, Homo sapiens
ctgcctccagaatg

SEQ ID NO: 383575 - DNA, 13 bp, Homo sapiens
ctgcctccaggag

SEQ ID NO: 383576 - DNA, 14 bp, Homo sapiens
ctgcctccaggagg

SEQ ID NO: 383577 - DNA, 17 bp, Homo sapiens
ctgcctccaggagggca

SEQ ID NO: 383578 - DNA, 15 bp, Homo sapiens
ctgcctcccacgctg

SEQ ID NO: 383579 - DNA, 14 bp, Homo sapiens
ctgcctcccaggtt

SEQ ID NO: 383580 - DNA, 12 bp, Homo sapiens
ctgcctccccaa

SEQ ID NO: 383581 - DNA, 16 bp, Homo sapiens
ctgcctccccaaccct

SEQ ID NO: 383582 - DNA, 22 bp, Homo sapiens
ctgcctccccaaccctgcccct

SEQ ID NO: 383583 - DNA, 21 bp, Homo sapiens
ctgcctcccgcccccttggct

SEQ ID NO: 383584 - DNA, 13 bp, Homo sapiens
ctgcctccctctc

SEQ ID NO: 383585 - DNA, 22 bp, Homo sapiens
ctgcctccctctcttccgggag

SEQ ID NO: 383586 - DNA, 15 bp, Homo sapiens
ctgcctccctgggga

SEQ ID NO: 383587 - DNA, 15 bp, Homo sapiens
ctgcctccctgtcca

SEQ ID NO: 383588 - DNA, 21 bp, Homo sapiens
ctgcctccggccctgccccac

SEQ ID NO: 383589 - DNA, 15 bp, Homo sapiens
ctgcctcctcttcaa

SEQ ID NO: 383590 - DNA, 17 bp, Homo sapiens
ctgcctcctgcctgccc

SEQ ID NO: 383591 - DNA, 19 bp, Homo sapiens
ctgcctcctgcctgcccct

SEQ ID NO: 383592 - DNA, 14 bp, Homo sapiens
ctgcctctaaggcc

SEQ ID NO: 383593 - DNA, 16 bp, Homo sapiens
ctgcctctaaggccaa

SEQ ID NO: 383594 - DNA, 18 bp, Homo sapiens
ctgcctctaaggccaagg

SEQ ID NO: 383595 - DNA, 15 bp, Homo sapiens
ctgcctctccccaaa

SEQ ID NO: 383596 - DNA, 17 bp, Homo sapiens
ctgcctctgccttagag

SEQ ID NO: 383597 - DNA, 11 bp, Homo sapiens
ctgcctctggg

SEQ ID NO: 383598 - DNA, 12 bp, Homo sapiens
ctgcctctgggt

SEQ ID NO: 383599 - DNA, 16 bp, Homo sapiens
ctgcctgacactgagc

SEQ ID NO: 383600 - DNA, 13 bp, Homo sapiens
ctgcctgagccca

SEQ ID NO: 383601 - DNA, 16 bp, Homo sapiens
ctgcctgagggcccct

SEQ ID NO: 383602 - DNA, 17 bp, Homo sapiens
ctgcctgagggcccctc

SEQ ID NO: 383603 - DNA, 20 bp, Homo sapiens
ctgcctgagggcccctctgc

SEQ ID NO: 383604 - DNA, 22 bp, Homo sapiens
ctgcctgagggcccctctgccc

SEQ ID NO: 383605 - DNA, 23 bp, Homo sapiens
ctgcctgagggcccctctgccca

SEQ ID NO: 383606 - DNA, 15 bp, Homo sapiens
ctgcctgcacccctg

SEQ ID NO: 383607 - DNA, 16 bp, Homo sapiens
ctgcctgcccacccgt

SEQ ID NO: 383608 - DNA, 20 bp, Homo sapiens
ctgcctgcccgcacagcagc

SEQ ID NO: 383609 - DNA, 17 bp, Homo sapiens
ctgcctgccgcccaaag

SEQ ID NO: 383610 - DNA, 12 bp, Homo sapiens
ctgcctgcctcc

SEQ ID NO: 383611 - DNA, 14 bp, Homo sapiens
ctgcctgcctccgg

SEQ ID NO: 383612 - DNA, 14 bp, Homo sapiens
ctgcctgcctggga

SEQ ID NO: 383613 - DNA, 15 bp, Homo sapiens
ctgcctgcctgtctg

SEQ ID NO: 383614 - DNA, 16 bp, Homo sapiens
ctgcctgcctgtctgt

SEQ ID NO: 383615 - DNA, 21 bp, Homo sapiens
ctgcctgcgaaacccagcgtt

SEQ ID NO: 383616 - DNA, 15 bp, Homo sapiens
ctgcctgctccttgg

SEQ ID NO: 383617 - DNA, 24 bp, Homo sapiens
ctgcctgctccttggcacccccat

SEQ ID NO: 383618 - DNA, 23 bp, Homo sapiens
ctgcctggacttggcccctgcca

SEQ ID NO: 383619 - DNA, 11 bp, Homo sapiens
ggccctggctg

SEQ ID NO: 383620 - DNA, 12 bp, Homo sapiens
ggccctggctgg

SEQ ID NO: 383621 - DNA, 22 bp, Homo sapiens
ggccctggggtccccactccct

SEQ ID NO: 383622 - DNA, 13 bp, Homo sapiens
ggcccttcctctc

SEQ ID NO: 383623 - DNA, 22 bp, Homo sapiens
ggcccttcctctccactgcctt

SEQ ID NO: 383624 - DNA, 23 bp, Homo sapiens
ggcccttcctctccactgccttc

SEQ ID NO: 383625 - DNA, 21 bp, Homo sapiens
ggcccttgcagttcagcacca

SEQ ID NO: 383626 - DNA, 16 bp, Homo sapiens
ggcccttgcccaactc

SEQ ID NO: 383627 - DNA, 21 bp, Homo sapiens
ggcccttgcccaactcccagc

SEQ ID NO: 383628 - DNA, 16 bp, Homo sapiens
ggcccttggggcctgg

SEQ ID NO: 383629 - DNA, 21 bp, Homo sapiens
ccactgccttcgatacaccgg

SEQ ID NO: 383630 - DNA, 16 bp, Homo sapiens
ccactgcgaccacaag

SEQ ID NO: 383631 - DNA, 14 bp, Homo sapiens
ccactgctaataaa

SEQ ID NO: 383632 - DNA, 11 bp, Homo sapiens
ccactggagaa

SEQ ID NO: 383633 - DNA, 20 bp, Homo sapiens
ccactggcatctctggagtg

SEQ ID NO: 383634 - DNA, 13 bp, Homo sapiens
ccactggccagct

SEQ ID NO: 383635 - DNA, 17 bp, Homo sapiens
ccactggctgtgcctcc

SEQ ID NO: 383636 - DNA, 21 bp, Homo sapiens
ccactggctgtgcctcccccg

SEQ ID NO: 383637 - DNA, 23 bp, Homo sapiens
ccactgggattcatggctttgta

SEQ ID NO: 383638 - DNA, 17 bp, Homo sapiens
ccactgggcataatgct

SEQ ID NO: 383639 - DNA, 19 bp, Homo sapiens
ccactgggtctcactcctg

SEQ ID NO: 383640 - DNA, 22 bp, Homo sapiens
ccactgtccccctacccaccga

SEQ ID NO: 383641 - DNA, 16 bp, Homo sapiens
ccactgtccctaccac

SEQ ID NO: 383642 - DNA, 18 bp, Homo sapiens
ccactgtccctaccactg

SEQ ID NO: 383643 - DNA, 19 bp, Homo sapiens
ccactgtccctaccactga

SEQ ID NO: 383644 - DNA, 14 bp, Homo sapiens
ccactgtccgcctc

SEQ ID NO: 383645 - DNA, 22 bp, Homo sapiens
ccactgtccgcctctgcccgca

SEQ ID NO: 383646 - DNA, 23 bp, Homo sapiens
ccactgtccgcctctgcccgcag

SEQ ID NO: 383647 - DNA, 15 bp, Homo sapiens
ccactgtcctttctc

SEQ ID NO: 383648 - DNA, 16 bp, Homo sapiens
ccactgtcctttctcc

SEQ ID NO: 383649 - DNA, 17 bp, Homo sapiens
ccactgtcctttctcca

SEQ ID NO: 383650 - DNA, 17 bp, Homo sapiens
ccactgtgctgaattct

SEQ ID NO: 383651 - DNA, 19 bp, Homo sapiens
ccactgtgctgaattctgc

SEQ ID NO: 383652 - DNA, 14 bp, Homo sapiens
ccactgtggccaga

SEQ ID NO: 383653 - DNA, 16 bp, Homo sapiens
ccactgtggccagagc

SEQ ID NO: 383654 - DNA, 17 bp, Homo sapiens
ccactgtggccagagct

SEQ ID NO: 383655 - DNA, 17 bp, Homo sapiens
ccactgtggggcaagcc

SEQ ID NO: 383656 - DNA, 18 bp, Homo sapiens
ccactgtggggcaagcct

SEQ ID NO: 383657 - DNA, 12 bp, Homo sapiens
ccacttaatctt

SEQ ID NO: 383658 - DNA, 13 bp, Homo sapiens
ccacttaatcttc

SEQ ID NO: 383659 - DNA, 19 bp, Homo sapiens
ccacttagccgtccatggc

SEQ ID NO: 383660 - DNA, 18 bp, Homo sapiens
ccacttatgctgctgtga

SEQ ID NO: 383661 - DNA, 14 bp, Homo sapiens
ccacttatttccat

SEQ ID NO: 383662 - DNA, 17 bp, Homo sapiens
ccacttcaagtgaccac

SEQ ID NO: 383663 - DNA, 14 bp, Homo sapiens
ccacttcaccccca

SEQ ID NO: 383664 - DNA, 12 bp, Homo sapiens
ccacttctcccc

SEQ ID NO: 383665 - DNA, 18 bp, Homo sapiens
ccacttctggtcccctgt

SEQ ID NO: 383666 - DNA, 21 bp, Homo sapiens
ccacttctggtcccctgtggt

SEQ ID NO: 383667 - DNA, 18 bp, Homo sapiens
ccacttcttaaaggcctg

SEQ ID NO: 383668 - DNA, 20 bp, Homo sapiens
ccacttcttaaaggcctgga

SEQ ID NO: 383669 - DNA, 16 bp, Homo sapiens
ccacttgacattcctt

SEQ ID NO: 383670 - DNA, 16 bp, Homo sapiens
ccacttgcactgtgct

SEQ ID NO: 383671 - DNA, 17 bp, Homo sapiens
ccacttgcactgtgctt

SEQ ID NO: 383672 - DNA, 21 bp, Homo sapiens
ccacttgcactgtgcttgctc

SEQ ID NO: 383673 - DNA, 14 bp, Homo sapiens
ccacttgctcagac

SEQ ID NO: 383674 - DNA, 16 bp, Homo sapiens
ccacttgggtcttccc

SEQ ID NO: 383675 - DNA, 16 bp, Homo sapiens
ccactttcccttcccc

SEQ ID NO: 383676 - DNA, 23 bp, Homo sapiens
ccactttgcagacctgggacttt

SEQ ID NO: 383677 - DNA, 20 bp, Homo sapiens
ccactttgttctttaggaga

SEQ ID NO: 383678 - DNA, 21 bp, Homo sapiens
ccactttgttggcccttccag

SEQ ID NO: 383679 - DNA, 17 bp, Homo sapiens
ccactttttgcagcttt

SEQ ID NO: 383680 - DNA, 23 bp, Homo sapiens
ccagaaaatatgatatatatgta

SEQ ID NO: 383681 - DNA, 20 bp, Homo sapiens
ccagaaagcaggagcagctg

SEQ ID NO: 383682 - DNA, 19 bp, Homo sapiens
ccagaaagcctcctgcccc

SEQ ID NO: 383683 - DNA, 17 bp, Homo sapiens
ccagaaaggatatttaa

SEQ ID NO: 383684 - DNA, 21 bp, Homo sapiens
ccagaaagtgaggaagcctaa

SEQ ID NO: 383685 - DNA, 18 bp, Homo sapiens
ccagaaatgccgctgtgt

SEQ ID NO: 383686 - DNA, 13 bp, Homo sapiens
ccagaaattagaa

SEQ ID NO: 383687 - DNA, 15 bp, Homo sapiens
ccagaacaaaagata

SEQ ID NO: 383688 - DNA, 17 bp, Homo sapiens
ccagaaccacactgttg

SEQ ID NO: 383689 - DNA, 19 bp, Homo sapiens
ccagaaccccaactcccag

SEQ ID NO: 383690 - DNA, 16 bp, Homo sapiens
ttttgaggcttctgtt

SEQ ID NO: 383691 - DNA, 14 bp, Homo sapiens
ttttgagttctaca

SEQ ID NO: 383692 - DNA, 18 bp, Homo sapiens
ttttgataataaattgaa

SEQ ID NO: 383693 - DNA, 13 bp, Homo sapiens
ttttgatacaaac

SEQ ID NO: 383694 - DNA, 22 bp, Homo sapiens
ttttgatacatttatcttctgt

SEQ ID NO: 383695 - DNA, 17 bp, Homo sapiens
ttttgatatgattgtaa

SEQ ID NO: 383696 - DNA, 20 bp, Homo sapiens
ttttgatgccatttgtcttt

SEQ ID NO: 383697 - DNA, 13 bp, Homo sapiens
ttttgattaatgt

SEQ ID NO: 383698 - DNA, 21 bp, Homo sapiens
ttttgattttgtttactgaaa

SEQ ID NO: 383699 - DNA, 13 bp, Homo sapiens
ttttgcacatata

SEQ ID NO: 383700 - DNA, 21 bp, Homo sapiens
ttttgcagcccagacaaatgt

SEQ ID NO: 383701 - DNA, 22 bp, Homo sapiens
ttttgcagtagagtcatctcca

SEQ ID NO: 383702 - DNA, 13 bp, Homo sapiens
ttttgcatttatg

SEQ ID NO: 383703 - DNA, 16 bp, Homo sapiens
ttttgccacctttcct

SEQ ID NO: 383704 - DNA, 22 bp, Homo sapiens
ttttgccactgcaaacaataaa

SEQ ID NO: 383705 - DNA, 13 bp, Homo sapiens
ttttgcctggctg

SEQ ID NO: 383706 - DNA, 15 bp, Homo sapiens
ttttgctcagttcca

SEQ ID NO: 383707 - DNA, 15 bp, Homo sapiens
ttttgctgattgcta

SEQ ID NO: 383708 - DNA, 17 bp, Homo sapiens
ttttgcttttatccact

SEQ ID NO: 383709 - DNA, 15 bp, Homo sapiens
ttttggaaactgttg

SEQ ID NO: 383710 - DNA, 17 bp, Homo sapiens
ttttggaaactgttggt

SEQ ID NO: 383711 - DNA, 15 bp, Homo sapiens
ttttggactttgtta

SEQ ID NO: 383712 - DNA, 15 bp, Homo sapiens
ttttggccaaagtgt

SEQ ID NO: 383713 - DNA, 16 bp, Homo sapiens
ttttggccaaagtgtt

SEQ ID NO: 383714 - DNA, 19 bp, Homo sapiens
ttttggcccccgagctggg

SEQ ID NO: 383715 - DNA, 22 bp, Homo sapiens
ttttggggaactgttgtttgat

SEQ ID NO: 383716 - DNA, 17 bp, Homo sapiens
ttttggtattacactgt

SEQ ID NO: 383717 - DNA, 19 bp, Homo sapiens
ttttggtccaaattcttta

SEQ ID NO: 383718 - DNA, 23 bp, Homo sapiens
ttttggtgatgtaaaacagaata

SEQ ID NO: 383719 - DNA, 22 bp, Homo sapiens
ttttggttgtcaatattaaata

SEQ ID NO: 383720 - DNA, 15 bp, Homo sapiens
ttttggttgtttgct

SEQ ID NO: 383721 - DNA, 19 bp, Homo sapiens
ttttgtaaatactgcttga

SEQ ID NO: 383722 - DNA, 13 bp, Homo sapiens
ttttgtaaccata

SEQ ID NO: 383723 - DNA, 23 bp, Homo sapiens
ttttgtaaccatatgattgaaaa

SEQ ID NO: 383724 - DNA, 11 bp, Homo sapiens
ttttgtaactg

SEQ ID NO: 383725 - DNA, 14 bp, Homo sapiens
ttttgtatctttaa

SEQ ID NO: 383726 - DNA, 22 bp, Homo sapiens
ttttgtatctttaaagacttga

SEQ ID NO: 383727 - DNA, 18 bp, Homo sapiens
ttttgtatgttatgaaca

SEQ ID NO: 383728 - DNA, 18 bp, Homo sapiens
ttttgtattctttactaa

SEQ ID NO: 383729 - DNA, 12 bp, Homo sapiens
ttttgtatttct

SEQ ID NO: 383730 - DNA, 15 bp, Homo sapiens
ttttgtatttttagt

SEQ ID NO: 383731 - DNA, 19 bp, Homo sapiens
ttttgtcagtctgagtcat

SEQ ID NO: 383732 - DNA, 16 bp, Homo sapiens
ttttgtcatataagat

SEQ ID NO: 383733 - DNA, 16 bp, Homo sapiens
ttttgtccccagggcc

SEQ ID NO: 383734 - DNA, 22 bp, Homo sapiens
ttttgtcctttgagaaagaaat

SEQ ID NO: 383735 - DNA, 13 bp, Homo sapiens
ttttgtcttcaac

SEQ ID NO: 383736 - DNA, 18 bp, Homo sapiens
ttttgtgatgatgctgtg

SEQ ID NO: 383737 - DNA, 21 bp, Homo sapiens
ttttgtgatgtcccaacttgt

SEQ ID NO: 383738 - DNA, 14 bp, Homo sapiens
ttttgtgcattgga

SEQ ID NO: 383739 - DNA, 22 bp, Homo sapiens
ttttgtggcttcaatctacgat

SEQ ID NO: 383740 - DNA, 21 bp, Homo sapiens
ttttgtggtcattaagcattg

SEQ ID NO: 383741 - DNA, 11 bp, Homo sapiens
ttttgtgtctt

SEQ ID NO: 383742 - DNA, 12 bp, Homo sapiens
ttttgttaatca

SEQ ID NO: 383743 - DNA, 17 bp, Homo sapiens
ttttgttaatcatcttc

SEQ ID NO: 383744 - DNA, 16 bp, Homo sapiens
ttttgttacctttatg

SEQ ID NO: 383745 - DNA, 12 bp, Homo sapiens
ttttgttataga

SEQ ID NO: 383746 - DNA, 14 bp, Homo sapiens
ttttgttatagaat

SEQ ID NO: 383747 - DNA, 23 bp, Homo sapiens
tttttaaaaaggcctttgggatt

SEQ ID NO: 383748 - DNA, 23 bp, Homo sapiens
tttttaaaaccactatgcaaaga

SEQ ID NO: 383749 - DNA, 17 bp, Homo sapiens
tttttaaagacagagtc

SEQ ID NO: 383750 - DNA, 19 bp, Homo sapiens
tttttaaatgattccaaat

SEQ ID NO: 383751 - DNA, 12 bp, Homo sapiens
tttttaactgat

SEQ ID NO: 383752 - DNA, 18 bp, Homo sapiens
tttttaagctgtttccat

SEQ ID NO: 383753 - DNA, 16 bp, Homo sapiens
tttttaagtatttata

SEQ ID NO: 383754 - DNA, 14 bp, Homo sapiens
tttttaatttatga

SEQ ID NO: 383755 - DNA, 20 bp, Homo sapiens
tttttaatttgatgaaagct

SEQ ID NO: 383756 - DNA, 18 bp, Homo sapiens
tttttacaaataaagatg

SEQ ID NO: 383757 - DNA, 14 bp, Homo sapiens
tttttacttatgcc

SEQ ID NO: 383758 - DNA, 14 bp, Homo sapiens
tttttagaacagaa

SEQ ID NO: 383759 - DNA, 17 bp, Homo sapiens
tttttagaggtgagttt

SEQ ID NO: 383760 - DNA, 13 bp, Homo sapiens
tttttagctctct

SEQ ID NO: 383761 - DNA, 16 bp, Homo sapiens
tttttcatagtgcctt

SEQ ID NO: 383762 - DNA, 17 bp, Homo sapiens
tttttcatagtgccttt

SEQ ID NO: 383763 - DNA, 13 bp, Homo sapiens
tttttcatattgt

SEQ ID NO: 383764 - DNA, 14 bp, Homo sapiens
tttttccagaattg

SEQ ID NO: 383765 - DNA, 11 bp, Homo sapiens
tttttcccagc

SEQ ID NO: 383766 - DNA, 22 bp, Homo sapiens
tttttcccagccctttccaggg

SEQ ID NO: 383767 - DNA, 13 bp, Homo sapiens
tttttccccccaa

SEQ ID NO: 383768 - DNA, 18 bp, Homo sapiens
tttttccctatcactgaa

SEQ ID NO: 383769 - DNA, 21 bp, Homo sapiens
tttttctagtttcagtaaata

SEQ ID NO: 383770 - DNA, 12 bp, Homo sapiens
tttttctcaaat

SEQ ID NO: 383771 - DNA, 13 bp, Homo sapiens
tttttctcaaata

SEQ ID NO: 383772 - DNA, 12 bp, Homo sapiens
tttttgaaaacc

SEQ ID NO: 383773 - DNA, 12 bp, Homo sapiens
tttttgaaacag

SEQ ID NO: 383774 - DNA, 19 bp, Homo sapiens
tttttgaatttaaataaag

SEQ ID NO: 383775 - DNA, 14 bp, Homo sapiens
tttttgatggctaa

SEQ ID NO: 383776 - DNA, 20 bp, Homo sapiens
tttttgccactgcaaacaat

SEQ ID NO: 383777 - DNA, 21 bp, Homo sapiens
tttttggatggcttaagcctg

SEQ ID NO: 383778 - DNA, 14 bp, Homo sapiens
tttttggtaattat

SEQ ID NO: 383779 - DNA, 11 bp, Homo sapiens
tttttgtactt

SEQ ID NO: 383780 - DNA, 20 bp, Homo sapiens
tttttgtatgttatgaacat

SEQ ID NO: 383781 - DNA, 17 bp, Homo sapiens
tttttgtcaaataaaat

SEQ ID NO: 383782 - DNA, 13 bp, Homo sapiens
tttttgttaatca

SEQ ID NO: 383783 - DNA, 22 bp, Homo sapiens
tttttgttccacaagttaaata

SEQ ID NO: 383784 - DNA, 19 bp, Homo sapiens
tttttgttgagtctctgaa

SEQ ID NO: 383785 - DNA, 16 bp, Homo sapiens
tttttgtttgttttgt

SEQ ID NO: 383786 - DNA, 12 bp, Homo sapiens
ttttttaacatt

SEQ ID NO: 383787 - DNA, 17 bp, Homo sapiens
ttttttaagtatttata

SEQ ID NO: 383788 - DNA, 12 bp, Homo sapiens
ttttttaatgta

SEQ ID NO: 383789 - DNA, 18 bp, Homo sapiens
ttttttagggtttctgat

SEQ ID NO: 383790 - DNA, 13 bp, Homo sapiens
ttttttagttgaa

SEQ ID NO: 383791 - DNA, 13 bp, Homo sapiens
ttttttatgctaa

SEQ ID NO: 383792 - DNA, 16 bp, Homo sapiens
ttttttatgctaatca

SEQ ID NO: 383793 - DNA, 12 bp, Homo sapiens
ttttttctttct

SEQ ID NO: 383794 - DNA, 13 bp, Homo sapiens
ttttttgaaacag

SEQ ID NO: 383795 - DNA, 20 bp, Homo sapiens
ttttttggaaagcacaaact

SEQ ID NO: 383796 - DNA, 14 bp, Homo sapiens
ttttttggtaatta

SEQ ID NO: 383797 - DNA, 13 bp, Homo sapiens
ttttttgtaaact

SEQ ID NO: 383798 - DNA, 19 bp, Homo sapiens
tttttttaaatgattccaa

SEQ ID NO: 383799 - DNA, 15 bp, Homo sapiens
tttttttcaagtgct

SEQ ID NO: 383800 - DNA, 12 bp, Homo sapiens
tttttttctagc

SEQ ID NO: 383801 - DNA, 17 bp, Homo sapiens
ctgcagcccttgggcag

SEQ ID NO: 383802 - DNA, 16 bp, Homo sapiens
ctgcagcctcctcctg

SEQ ID NO: 383803 - DNA, 19 bp, Homo sapiens
ctgcagcctcgaactcctg

SEQ ID NO: 383804 - DNA, 13 bp, Homo sapiens
ctgcagcctgagc

SEQ ID NO: 383805 - DNA, 15 bp, Homo sapiens
ctgcagcctgagctc

SEQ ID NO: 383806 - DNA, 21 bp, Homo sapiens
ctgcagcctgagctccaccct

SEQ ID NO: 383807 - DNA, 20 bp, Homo sapiens
ctgcagctattcacacacac

SEQ ID NO: 383808 - DNA, 21 bp, Homo sapiens
ctgcagctctttcttctttga

SEQ ID NO: 383809 - DNA, 15 bp, Homo sapiens
ctgcagctgcaccag

SEQ ID NO: 383810 - DNA, 12 bp, Homo sapiens
ctgcagctgggc

SEQ ID NO: 383811 - DNA, 13 bp, Homo sapiens
ctgcagctgggcc

SEQ ID NO: 383812 - DNA, 14 bp, Homo sapiens
ctgcagctgggccc

SEQ ID NO: 383813 - DNA, 20 bp, Homo sapiens
ctgcagctgggccccatgct

SEQ ID NO: 383814 - DNA, 21 bp, Homo sapiens
ctgcagctgggccccatgctc

SEQ ID NO: 383815 - DNA, 13 bp, Homo sapiens
ctgcagctgggct

SEQ ID NO: 383816 - DNA, 13 bp, Homo sapiens
ctgcagcttggga

SEQ ID NO: 383817 - DNA, 17 bp, Homo sapiens
ctgcagctttctggaaa

SEQ ID NO: 383818 - DNA, 15 bp, Homo sapiens
ctgcaggaacgagca

SEQ ID NO: 383819 - DNA, 20 bp, Homo sapiens
ctgcaggaacgagcactggc

SEQ ID NO: 383820 - DNA, 14 bp, Homo sapiens
ctgcaggacacaga

SEQ ID NO: 383821 - DNA, 17 bp, Homo sapiens
ctgcaggacacagatct

SEQ ID NO: 383822 - DNA, 17 bp, Homo sapiens
ctgcaggaggcctggga

SEQ ID NO: 383823 - DNA, 16 bp, Homo sapiens
ctgcaggagttaaaaa

SEQ ID NO: 383824 - DNA, 19 bp, Homo sapiens
ctgcaggatgattgtacag

SEQ ID NO: 383825 - DNA, 11 bp, Homo sapiens
ctgcaggccac

SEQ ID NO: 383826 - DNA, 15 bp, Homo sapiens
ctgcaggccccagcc

SEQ ID NO: 383827 - DNA, 19 bp, Homo sapiens
ctgcaggccccagccaagt

SEQ ID NO: 383828 - DNA, 19 bp, Homo sapiens
ctgcaggcggtatccagag

SEQ ID NO: 383829 - DNA, 22 bp, Homo sapiens
ctgcaggcggtatccagaggtg

SEQ ID NO: 383830 - DNA, 15 bp, Homo sapiens
ctgcagggagcaact

SEQ ID NO: 383831 - DNA, 20 bp, Homo sapiens
ctgcagggagcaactctcca

SEQ ID NO: 383832 - DNA, 13 bp, Homo sapiens
ctgcagggcagcc

SEQ ID NO: 383833 - DNA, 14 bp, Homo sapiens
ctgcagggcagcct

SEQ ID NO: 383834 - DNA, 15 bp, Homo sapiens
ctgcagggcagcctg

SEQ ID NO: 383835 - DNA, 20 bp, Homo sapiens
ctgcagggcagcctgtggga

SEQ ID NO: 383836 - DNA, 22 bp, Homo sapiens
ctgcagggcagcctgtgggaga

SEQ ID NO: 383837 - DNA, 16 bp, Homo sapiens
ctgcagggccaagcac

SEQ ID NO: 383838 - DNA, 18 bp, Homo sapiens
ctgcagggtggtgctggg

SEQ ID NO: 383839 - DNA, 21 bp, Homo sapiens
ctgcagggtggtgctgggact

SEQ ID NO: 383840 - DNA, 14 bp, Homo sapiens
ctgcaggtgcccat

SEQ ID NO: 383841 - DNA, 16 bp, Homo sapiens
ctgcagtagaaggtgc

SEQ ID NO: 383842 - DNA, 17 bp, Homo sapiens
ctgcagtagaaggtgcc

SEQ ID NO: 383843 - DNA, 18 bp, Homo sapiens
ctgcagtcacccctgtct

SEQ ID NO: 383844 - DNA, 12 bp, Homo sapiens
ctgcagtcctgg

SEQ ID NO: 383845 - DNA, 14 bp, Homo sapiens
ctgcagtcctggtg

SEQ ID NO: 383846 - DNA, 18 bp, Homo sapiens
ctgcagtgatggcgcggg

SEQ ID NO: 383847 - DNA, 14 bp, Homo sapiens
ctgcagtgtgagat

SEQ ID NO: 383848 - DNA, 18 bp, Homo sapiens
ctgcagtgttcgcttggc

SEQ ID NO: 383849 - DNA, 22 bp, Homo sapiens
ctgcagtttcctcatctgtcac

SEQ ID NO: 383850 - DNA, 19 bp, Homo sapiens
ctgcagtttgagacaggag

SEQ ID NO: 383851 - DNA, 15 bp, Homo sapiens
ctgcagtttttcagg

SEQ ID NO: 383852 - DNA, 18 bp, Homo sapiens
ctgcagtttttcaggagc

SEQ ID NO: 383853 - DNA, 17 bp, Homo sapiens
ctgcatacccgggcagg

SEQ ID NO: 383854 - DNA, 21 bp, Homo sapiens
ctgcatagtattccattgtgt

SEQ ID NO: 383855 - DNA, 21 bp, Homo sapiens
ctgcatatctctagtccctgt

SEQ ID NO: 383856 - DNA, 16 bp, Homo sapiens
ctgcatcagcctctgg

SEQ ID NO: 383857 - DNA, 19 bp, Homo sapiens
ctgcatcagcctctggcca

SEQ ID NO: 383858 - DNA, 17 bp, Homo sapiens
ctgcatcatctgtagat

SEQ ID NO: 383859 - DNA, 13 bp, Homo sapiens
ctgcatccaggcc

SEQ ID NO: 383860 - DNA, 18 bp, Homo sapiens
ctgcatccaggcctgagg

SEQ ID NO: 383861 - DNA, 19 bp, Homo sapiens
ctgcatccaggcctgaggc

SEQ ID NO: 383862 - DNA, 13 bp, Homo sapiens
ctgcatccctcca

SEQ ID NO: 383863 - DNA, 21 bp, Homo sapiens
ctgcatccctccaccccagtc

SEQ ID NO: 383864 - DNA, 18 bp, Homo sapiens
ctgcatcccttggcccct

SEQ ID NO: 383865 - DNA, 22 bp, Homo sapiens
ctgcatcccttggcccctctct

SEQ ID NO: 383866 - DNA, 17 bp, Homo sapiens
ctgcatcctcagcccca

SEQ ID NO: 383867 - DNA, 21 bp, Homo sapiens
ctgcatcctcagccccagggc

SEQ ID NO: 383868 - DNA, 21 bp, Homo sapiens
ctgcatctgtctgtccttcct

SEQ ID NO: 383869 - DNA, 15 bp, Homo sapiens
ctgcatgcaagctca

SEQ ID NO: 383870 - DNA, 13 bp, Homo sapiens
ctgcatgcgacag

SEQ ID NO: 383871 - DNA, 15 bp, Homo sapiens
ctgcatgctgctgga

SEQ ID NO: 383872 - DNA, 19 bp, Homo sapiens
ctgcatggacctaacattc

SEQ ID NO: 383873 - DNA, 19 bp, Homo sapiens
ctgcatggacgcctggctc

SEQ ID NO: 383874 - DNA, 20 bp, Homo sapiens
ctgcatggacgcctggctcc

SEQ ID NO: 383875 - DNA, 21 bp, Homo sapiens
ctgcatggagtgagcagtaga

SEQ ID NO: 383876 - DNA, 23 bp, Homo sapiens
ctgcatggcagaagcgtctccct

SEQ ID NO: 383877 - DNA, 17 bp, Homo sapiens
ctgcatggtaatttata

SEQ ID NO: 383878 - DNA, 22 bp, Homo sapiens
ctgcatgtaaaatcttcagctg

SEQ ID NO: 383879 - DNA, 18 bp, Homo sapiens
ctgcatgtataaatgaag

SEQ ID NO: 383880 - DNA, 15 bp, Homo sapiens
ctgcatgttaccatc

SEQ ID NO: 383881 - DNA, 22 bp, Homo sapiens
ctgcattgttattgtggaagat

SEQ ID NO: 383882 - DNA, 17 bp, Homo sapiens
ctgcatttagcacaaaa

SEQ ID NO: 383883 - DNA, 16 bp, Homo sapiens
ctgcatttataaatgt

SEQ ID NO: 383884 - DNA, 14 bp, Homo sapiens
ctgcatttgtgaaa

SEQ ID NO: 383885 - DNA, 18 bp, Homo sapiens
ctgcattttcaccccacc

SEQ ID NO: 383886 - DNA, 13 bp, Homo sapiens
ctgcattttctca

SEQ ID NO: 383887 - DNA, 15 bp, Homo sapiens
ctgcattttctcagg

SEQ ID NO: 383888 - DNA, 23 bp, Homo sapiens
ctgcatttttaaaggacaaacag

SEQ ID NO: 383889 - DNA, 22 bp, Homo sapiens
ctgccaaatgctatactgtgtc

SEQ ID NO: 383890 - DNA, 20 bp, Homo sapiens
ctgccaaattttggccaaag

SEQ ID NO: 383891 - DNA, 20 bp, Homo sapiens
ctgccaactccatgaccagg

SEQ ID NO: 383892 - DNA, 18 bp, Homo sapiens
ctgccaactttccagact

SEQ ID NO: 383893 - DNA, 19 bp, Homo sapiens
ctgccaagcactcgagacc

SEQ ID NO: 383894 - DNA, 21 bp, Homo sapiens
ctgccaagcctggagcccctg

SEQ ID NO: 383895 - DNA, 15 bp, Homo sapiens
ctgccaaggccagag

SEQ ID NO: 383896 - DNA, 18 bp, Homo sapiens
ctgccaaggccagagtgg

SEQ ID NO: 383897 - DNA, 15 bp, Homo sapiens
ctgccaagtgctctt

SEQ ID NO: 383898 - DNA, 16 bp, Homo sapiens
ctgccaagtgctcttt

SEQ ID NO: 383899 - DNA, 14 bp, Homo sapiens
ctgccaatgccaca

SEQ ID NO: 383900 - DNA, 18 bp, Homo sapiens
ctgccaatgccacagcca

SEQ ID NO: 383901 - DNA, 22 bp, Homo sapiens
ctgcccctcatttatcactctg

SEQ ID NO: 383902 - DNA, 13 bp, Homo sapiens
ctgcccctccccc

SEQ ID NO: 383903 - DNA, 14 bp, Homo sapiens
ctgcccctccccca

SEQ ID NO: 383904 - DNA, 20 bp, Homo sapiens
ctgcccctccgtccccaggg

SEQ ID NO: 383905 - DNA, 16 bp, Homo sapiens
ctgcccctgcccgaga

SEQ ID NO: 383906 - DNA, 14 bp, Homo sapiens
ctgcccctgtctgg

SEQ ID NO: 383907 - DNA, 16 bp, Homo sapiens
ctgccccttctgtttc

SEQ ID NO: 383908 - DNA, 14 bp, Homo sapiens
ctgccccttgggca

SEQ ID NO: 383909 - DNA, 19 bp, Homo sapiens
ctgccccttgggcatccac

SEQ ID NO: 383910 - DNA, 15 bp, Homo sapiens
ctgcccgagagctct

SEQ ID NO: 383911 - DNA, 13 bp, Homo sapiens
ctgcccgagctgg

SEQ ID NO: 383912 - DNA, 16 bp, Homo sapiens
ctgcccgagctggtgc

SEQ ID NO: 383913 - DNA, 17 bp, Homo sapiens
ctgcccgcacagcagcc

SEQ ID NO: 383914 - DNA, 17 bp, Homo sapiens
ctgcccgcagagcccac

SEQ ID NO: 383915 - DNA, 18 bp, Homo sapiens
ctgcccgccccaagccct

SEQ ID NO: 383916 - DNA, 18 bp, Homo sapiens
ctgcccgctgcaatgcct

SEQ ID NO: 383917 - DNA, 15 bp, Homo sapiens
ctgcccggggcagct

SEQ ID NO: 383918 - DNA, 23 bp, Homo sapiens
ctgcccggggcagctgccagaga

SEQ ID NO: 383919 - DNA, 22 bp, Homo sapiens
ctgcccggtggtttgccatgtc

SEQ ID NO: 383920 - DNA, 17 bp, Homo sapiens
ctgcccgttgccgggcc

SEQ ID NO: 383921 - DNA, 19 bp, Homo sapiens
ctgcccgttgccgggcctg

SEQ ID NO: 383922 - DNA, 21 bp, Homo sapiens
ctgcccgttgccgggcctgga

SEQ ID NO: 383923 - DNA, 22 bp, Homo sapiens
ctgcccgttgccgggcctggac

SEQ ID NO: 383924 - DNA, 23 bp, Homo sapiens
ctgcccgttgccgggcctggact

SEQ ID NO: 383925 - DNA, 18 bp, Homo sapiens
ctgccctaggctccgtca

SEQ ID NO: 383926 - DNA, 14 bp, Homo sapiens
ctgccctcactcca

SEQ ID NO: 383927 - DNA, 16 bp, Homo sapiens
ctgccctcactccact

SEQ ID NO: 383928 - DNA, 22 bp, Homo sapiens
ctgccctccagctctttcctcc

SEQ ID NO: 383929 - DNA, 14 bp, Homo sapiens
ctgccctccatccc

SEQ ID NO: 383930 - DNA, 17 bp, Homo sapiens
ctgccctccccagagca

SEQ ID NO: 383931 - DNA, 12 bp, Homo sapiens
ctgccctccccc

SEQ ID NO: 383932 - DNA, 15 bp, Homo sapiens
ctgccctcccccacg

SEQ ID NO: 383933 - DNA, 17 bp, Homo sapiens
ctgccctcccccacggc

SEQ ID NO: 383934 - DNA, 17 bp, Homo sapiens
ctgccctccctccttcc

SEQ ID NO: 383935 - DNA, 14 bp, Homo sapiens
ctgccctccctcgg

SEQ ID NO: 383936 - DNA, 22 bp, Homo sapiens
ctgccctcgtctccctggccac

SEQ ID NO: 383937 - DNA, 21 bp, Homo sapiens
ctgccctgatgcgtctaccca

SEQ ID NO: 383938 - DNA, 14 bp, Homo sapiens
ctgccctgcaccct

SEQ ID NO: 383939 - DNA, 19 bp, Homo sapiens
ctgccctgcaccttgggca

SEQ ID NO: 383940 - DNA, 20 bp, Homo sapiens
ctgccctgcaccttgggcac

SEQ ID NO: 383941 - DNA, 13 bp, Homo sapiens
ctgccctgccacc

SEQ ID NO: 383942 - DNA, 15 bp, Homo sapiens
ctgccctgccctgcc

SEQ ID NO: 383943 - DNA, 14 bp, Homo sapiens
ctgccctgcctgcc

SEQ ID NO: 383944 - DNA, 22 bp, Homo sapiens
ctgccctgctgccgcctcccag

SEQ ID NO: 383945 - DNA, 15 bp, Homo sapiens
ctgccctggtccagg

SEQ ID NO: 383946 - DNA, 22 bp, Homo sapiens
taggtgatgtttccagctgcca

SEQ ID NO: 383947 - DNA, 23 bp, Homo sapiens
taggtgcccagtcttgagtgggc

SEQ ID NO: 383948 - DNA, 14 bp, Homo sapiens
taggtgctggcctc

SEQ ID NO: 383949 - DNA, 16 bp, Homo sapiens
taggtgggccagcccc

SEQ ID NO: 383950 - DNA, 21 bp, Homo sapiens
taggtgggccagcccctccca

SEQ ID NO: 383951 - DNA, 22 bp, Homo sapiens
taggtgggtcaactccaaggca

SEQ ID NO: 383952 - DNA, 19 bp, Homo sapiens
taggtgtcccccaccccca

SEQ ID NO: 383953 - DNA, 22 bp, Homo sapiens
taggtgttgattttctgttgta

SEQ ID NO: 383954 - DNA, 14 bp, Homo sapiens
taggtgtttgggat

SEQ ID NO: 383955 - DNA, 17 bp, Homo sapiens
taggttaataggaggac

SEQ ID NO: 383956 - DNA, 16 bp, Homo sapiens
taggttgtctaaaaat

SEQ ID NO: 383957 - DNA, 15 bp, Homo sapiens
taggtttaactcaga

SEQ ID NO: 383958 - DNA, 13 bp, Homo sapiens
tagtaaaattaga

SEQ ID NO: 383959 - DNA, 19 bp, Homo sapiens
tagtaaatattatgatttt

SEQ ID NO: 383960 - DNA, 19 bp, Homo sapiens
tagtaagcctccctcctcg

SEQ ID NO: 383961 - DNA, 14 bp, Homo sapiens
tagtaatagagcaa

SEQ ID NO: 383962 - DNA, 20 bp, Homo sapiens
tagtaatagagcaaaattga

SEQ ID NO: 383963 - DNA, 15 bp, Homo sapiens
tagtacaaattataa

SEQ ID NO: 383964 - DNA, 23 bp, Homo sapiens
tagtaccaatcattttaattatt

SEQ ID NO: 383965 - DNA, 22 bp, Homo sapiens
tagtaccctatagagagggggc

SEQ ID NO: 383966 - DNA, 18 bp, Homo sapiens
tagtactagtactattgc

SEQ ID NO: 383967 - DNA, 17 bp, Homo sapiens
tagtactatatctgttt

SEQ ID NO: 383968 - DNA, 20 bp, Homo sapiens
tagtactattgctattacta

SEQ ID NO: 383969 - DNA, 17 bp, Homo sapiens
tagtactccttaagaac

SEQ ID NO: 383970 - DNA, 14 bp, Homo sapiens
tagtactctctgct

SEQ ID NO: 383971 - DNA, 15 bp, Homo sapiens
tagtactgtattggc

SEQ ID NO: 383972 - DNA, 14 bp, Homo sapiens
tagtagaacaatgt

SEQ ID NO: 383973 - DNA, 13 bp, Homo sapiens
tagtagatctgtg

SEQ ID NO: 383974 - DNA, 16 bp, Homo sapiens
tagtagccctttctgt

SEQ ID NO: 383975 - DNA, 18 bp, Homo sapiens
tagtagccctttctgtgt

SEQ ID NO: 383976 - DNA, 16 bp, Homo sapiens
tagtaggctaaaaaca

SEQ ID NO: 383977 - DNA, 22 bp, Homo sapiens
tagtagggtgagggataagcaa

SEQ ID NO: 383978 - DNA, 19 bp, Homo sapiens
tagtagttcctgctacaac

SEQ ID NO: 383979 - DNA, 22 bp, Homo sapiens
tagtagttgatgaccaatctct

SEQ ID NO: 383980 - DNA, 14 bp, Homo sapiens
tagtagtttgggtg

SEQ ID NO: 383981 - DNA, 14 bp, Homo sapiens
tagtatacccactg

SEQ ID NO: 383982 - DNA, 17 bp, Homo sapiens
tagtatacccactgcat

SEQ ID NO: 383983 - DNA, 16 bp, Homo sapiens
tagtatctggctgggt

SEQ ID NO: 383984 - DNA, 20 bp, Homo sapiens
tagtatcttcaaactttcac

SEQ ID NO: 383985 - DNA, 12 bp, Homo sapiens
tagtattaacta

SEQ ID NO: 383986 - DNA, 23 bp, Homo sapiens
tagtcaaggtgctcaataaatat

SEQ ID NO: 383987 - DNA, 17 bp, Homo sapiens
tagtcaatcaaacaggg

SEQ ID NO: 383988 - DNA, 14 bp, Homo sapiens
tagtcagatggatg

SEQ ID NO: 383989 - DNA, 18 bp, Homo sapiens
tagtcagatggatgtaga

SEQ ID NO: 383990 - DNA, 16 bp, Homo sapiens
tagtcatatgtgaaga

SEQ ID NO: 383991 - DNA, 21 bp, Homo sapiens
tagtccaaatgtgatcaactg

SEQ ID NO: 383992 - DNA, 15 bp, Homo sapiens
tagtcccttcccctc

SEQ ID NO: 383993 - DNA, 22 bp, Homo sapiens
tagtcccttcccctccctggct

SEQ ID NO: 383994 - DNA, 18 bp, Homo sapiens
tagtcctagaggacctga

SEQ ID NO: 383995 - DNA, 14 bp, Homo sapiens
tagtcctattctat

SEQ ID NO: 383996 - DNA, 13 bp, Homo sapiens
tagtcctcacctt

SEQ ID NO: 383997 - DNA, 20 bp, Homo sapiens
tagtcctcaccttctgtttt

SEQ ID NO: 383998 - DNA, 17 bp, Homo sapiens
tagtcctccaaaacaca

SEQ ID NO: 383999 - DNA, 15 bp, Homo sapiens
tagtcctccctgctc

SEQ ID NO: 384000 - DNA, 16 bp, Homo sapiens
tagtcctccctgctca

SEQ ID NO: 384001 - DNA, 20 bp, Homo sapiens
tagtcgtggagatgtcttcg

SEQ ID NO: 384002 - DNA, 21 bp, Homo sapiens
tagtcgtggagatgtcttcgt

SEQ ID NO: 384003 - DNA, 21 bp, Homo sapiens
tagtctcctttgcactgaggg

SEQ ID NO: 384004 - DNA, 18 bp, Homo sapiens
tagtctgtcagggccttg

SEQ ID NO: 384005 - DNA, 18 bp, Homo sapiens
tagtctgtgtgaaggtga

SEQ ID NO: 384006 - DNA, 22 bp, Homo sapiens
tagtcttccacaaaaaatactt

SEQ ID NO: 384007 - DNA, 17 bp, Homo sapiens
tagtctttgtttacatg

SEQ ID NO: 384008 - DNA, 19 bp, Homo sapiens
tagtgaattttaaaatgta

SEQ ID NO: 384009 - DNA, 22 bp, Homo sapiens
tagtgaattttaaaatgtagaa

SEQ ID NO: 384010 - DNA, 21 bp, Homo sapiens
tagtgacagagcccagcatcc

SEQ ID NO: 384011 - DNA, 18 bp, Homo sapiens
tagtgacccggaggccac

SEQ ID NO: 384012 - DNA, 16 bp, Homo sapiens
tagtgacttgtgtccc

SEQ ID NO: 384013 - DNA, 14 bp, Homo sapiens
tagtgatacactgt

SEQ ID NO: 384014 - DNA, 21 bp, Homo sapiens
tagtgatacactgtatctaaa

SEQ ID NO: 384015 - DNA, 22 bp, Homo sapiens
tagtgcaatttcttctgtagct

SEQ ID NO: 384016 - DNA, 16 bp, Homo sapiens
tagtgcagagaggttg

SEQ ID NO: 384017 - DNA, 13 bp, Homo sapiens
tagtgcagctgat

SEQ ID NO: 384018 - DNA, 17 bp, Homo sapiens
tagtgcagctgatttta

SEQ ID NO: 384019 - DNA, 18 bp, Homo sapiens
tagtgcagctgattttaa

SEQ ID NO: 384020 - DNA, 22 bp, Homo sapiens
tagtgcagctgattttaacaat

SEQ ID NO: 384021 - DNA, 18 bp, Homo sapiens
tagtgcagtcaccctgtg

SEQ ID NO: 384022 - DNA, 21 bp, Homo sapiens
tagatagaaataaatagctat

SEQ ID NO: 384023 - DNA, 13 bp, Homo sapiens
tagatagttttgc

SEQ ID NO: 384024 - DNA, 13 bp, Homo sapiens
tagatataaatat

SEQ ID NO: 384025 - DNA, 23 bp, Homo sapiens
tagatattcattaataggaaaga

SEQ ID NO: 384026 - DNA, 18 bp, Homo sapiens
tagatattgttttctgta

SEQ ID NO: 384027 - DNA, 17 bp, Homo sapiens
tagatcaacaataaaaa

SEQ ID NO: 384028 - DNA, 13 bp, Homo sapiens
tagatcagaacag

SEQ ID NO: 384029 - DNA, 13 bp, Homo sapiens
tagatcagtattt

SEQ ID NO: 384030 - DNA, 16 bp, Homo sapiens
tagatcagtatttcac

SEQ ID NO: 384031 - DNA, 21 bp, Homo sapiens
tagatccagatccagactgta

SEQ ID NO: 384032 - DNA, 22 bp, Homo sapiens
tagatcctgcaccccagcattc

SEQ ID NO: 384033 - DNA, 23 bp, Homo sapiens
tagatctcctatttttcagaatg

SEQ ID NO: 384034 - DNA, 20 bp, Homo sapiens
tagatctcctgtaattttgt

SEQ ID NO: 384035 - DNA, 13 bp, Homo sapiens
tagatctgagccc

SEQ ID NO: 384036 - DNA, 14 bp, Homo sapiens
tagatctgtggcga

SEQ ID NO: 384037 - DNA, 15 bp, Homo sapiens
tagatcttacatctg

SEQ ID NO: 384038 - DNA, 15 bp, Homo sapiens
tagatcttctgaaat

SEQ ID NO: 384039 - DNA, 16 bp, Homo sapiens
tagatgagggtgactg

SEQ ID NO: 384040 - DNA, 20 bp, Homo sapiens
tagatgctgaatatctgttc

SEQ ID NO: 384041 - DNA, 23 bp, Homo sapiens
tagatgctgactgtactcctccc

SEQ ID NO: 384042 - DNA, 14 bp, Homo sapiens
tagatgctgcctag

SEQ ID NO: 384043 - DNA, 23 bp, Homo sapiens
tagatggcactttagtgattgct

SEQ ID NO: 384044 - DNA, 20 bp, Homo sapiens
tagatgggcatggggtgggc

SEQ ID NO: 384045 - DNA, 18 bp, Homo sapiens
tagatgggggaactgtga

SEQ ID NO: 384046 - DNA, 16 bp, Homo sapiens
tagatggtgctgagaa

SEQ ID NO: 384047 - DNA, 19 bp, Homo sapiens
tagatggtgctgagaagct

SEQ ID NO: 384048 - DNA, 19 bp, Homo sapiens
tagatggtttgagcctgag

SEQ ID NO: 384049 - DNA, 23 bp, Homo sapiens
tagatgtccctttcttggccagt

SEQ ID NO: 384050 - DNA, 13 bp, Homo sapiens
tagattatcccac

SEQ ID NO: 384051 - DNA, 13 bp, Homo sapiens
tagattcacctgt

SEQ ID NO: 384052 - DNA, 20 bp, Homo sapiens
tagattcacctgtaaaactt

SEQ ID NO: 384053 - DNA, 23 bp, Homo sapiens
tagattcctcttgcctctctcag

SEQ ID NO: 384054 - DNA, 16 bp, Homo sapiens
tagattgcttctgtag

SEQ ID NO: 384055 - DNA, 17 bp, Homo sapiens
tagatttaccctttata

SEQ ID NO: 384056 - DNA, 15 bp, Homo sapiens
tagatttgttttgtg

SEQ ID NO: 384057 - DNA, 19 bp, Homo sapiens
tagatttgttttgtgttgt

SEQ ID NO: 384058 - DNA, 16 bp, Homo sapiens
tagattttaatcaaat

SEQ ID NO: 384059 - DNA, 17 bp, Homo sapiens
tagattttaatcaaatt

SEQ ID NO: 384060 - DNA, 13 bp, Homo sapiens
tagatttttagat

SEQ ID NO: 384061 - DNA, 14 bp, Homo sapiens
tagatttttagatt

SEQ ID NO: 384062 - DNA, 18 bp, Homo sapiens
tagcaaacagatgtttgt

SEQ ID NO: 384063 - DNA, 19 bp, Homo sapiens
tagcaacctatttgactgc

SEQ ID NO: 384064 - DNA, 21 bp, Homo sapiens
tagcaacgcctgccttctggg

SEQ ID NO: 384065 - DNA, 19 bp, Homo sapiens
tagcaagaagattctaaaa

SEQ ID NO: 384066 - DNA, 21 bp, Homo sapiens
tagcaagacccccatctctgc

SEQ ID NO: 384067 - DNA, 16 bp, Homo sapiens
tagcaagacctgttgg

SEQ ID NO: 384068 - DNA, 19 bp, Homo sapiens
tagcaagacctgttggtta

SEQ ID NO: 384069 - DNA, 14 bp, Homo sapiens
tagcaaggctgggt

SEQ ID NO: 384070 - DNA, 15 bp, Homo sapiens
tagcaagtcccatca

SEQ ID NO: 384071 - DNA, 13 bp, Homo sapiens
tagcacagctgtg

SEQ ID NO: 384072 - DNA, 12 bp, Homo sapiens
tagcactttata

SEQ ID NO: 384073 - DNA, 19 bp, Homo sapiens
tagcactttgggaggctga

SEQ ID NO: 384074 - DNA, 15 bp, Homo sapiens
tagcagacagtgttt

SEQ ID NO: 384075 - DNA, 11 bp, Homo sapiens
tagcagctcag

SEQ ID NO: 384076 - DNA, 14 bp, Homo sapiens
tagcagctcaggcg

SEQ ID NO: 384077 - DNA, 13 bp, Homo sapiens
tagcaggaaatag

SEQ ID NO: 384078 - DNA, 15 bp, Homo sapiens
tagcaggaaatagtg

SEQ ID NO: 384079 - DNA, 22 bp, Homo sapiens
tagcaggctgcagcaggcagag

SEQ ID NO: 384080 - DNA, 22 bp, Homo sapiens
tagcagggtctttgtgtgctgt

SEQ ID NO: 384081 - DNA, 17 bp, Homo sapiens
tagcagttctgcaaata

SEQ ID NO: 384082 - DNA, 19 bp, Homo sapiens
tagcatactgatgagacaa

SEQ ID NO: 384083 - DNA, 15 bp, Homo sapiens
tagcatagtaaacta

SEQ ID NO: 384084 - DNA, 18 bp, Homo sapiens
tagcatatataattttat

SEQ ID NO: 384085 - DNA, 15 bp, Homo sapiens
tagcatcccatctca

SEQ ID NO: 384086 - DNA, 18 bp, Homo sapiens
tagcatcctgattattga

SEQ ID NO: 384087 - DNA, 19 bp, Homo sapiens
tagcatcctgattattgaa

SEQ ID NO: 384088 - DNA, 15 bp, Homo sapiens
tagcatctgctcttc

SEQ ID NO: 384089 - DNA, 20 bp, Homo sapiens
tagcatctgctcttctctta

SEQ ID NO: 384090 - DNA, 13 bp, Homo sapiens
tagcatgaaaggt

SEQ ID NO: 384091 - DNA, 21 bp, Homo sapiens
tagcatgaaaggtaatctgaa

SEQ ID NO: 384092 - DNA, 17 bp, Homo sapiens
tagcatgacaagcccca

SEQ ID NO: 384093 - DNA, 22 bp, Homo sapiens
tagcatgacaagccccaggcag

SEQ ID NO: 384094 - DNA, 23 bp, Homo sapiens
tagcatgaccttttggcctttgt

SEQ ID NO: 384095 - DNA, 18 bp, Homo sapiens
tagcatgcacaaagtgta

SEQ ID NO: 384096 - DNA, 17 bp, Homo sapiens
tagcatgtaatattaaa

SEQ ID NO: 384097 - DNA, 18 bp, Homo sapiens
tagcatgtaatattaaat

SEQ ID NO: 384098 - DNA, 17 bp, Homo sapiens
tagcatgtcactaaagc

SEQ ID NO: 384099 - DNA, 21 bp, Homo sapiens
tagcatgtgtttggttctggg

SEQ ID NO: 384100 - DNA, 13 bp, Homo sapiens
tagcatgttgtag

SEQ ID NO: 384101 - DNA, 17 bp, Homo sapiens
tagcattaaaaataaaa

SEQ ID NO: 384102 - DNA, 14 bp, Homo sapiens
tagcattataccaa

SEQ ID NO: 384103 - DNA, 23 bp, Homo sapiens
tagcattgttccacacatttaaa

SEQ ID NO: 384104 - DNA, 14 bp, Homo sapiens
tagcatttttgatt

SEQ ID NO: 384105 - DNA, 20 bp, Homo sapiens
tagcatttttgatttatgca

SEQ ID NO: 384106 - DNA, 17 bp, Homo sapiens
tagccaaagagctcttt

SEQ ID NO: 384107 - DNA, 20 bp, Homo sapiens
tagccaaatggtttaacttc

SEQ ID NO: 384108 - DNA, 22 bp, Homo sapiens
tagccactggcatagccctcct

SEQ ID NO: 384109 - DNA, 18 bp, Homo sapiens
tagccagagaggagcacc

SEQ ID NO: 384110 - DNA, 14 bp, Homo sapiens
taggccgggcacag

SEQ ID NO: 384111 - DNA, 16 bp, Homo sapiens
taggcctcagtgtcct

SEQ ID NO: 384112 - DNA, 13 bp, Homo sapiens
taggcctgggtgc

SEQ ID NO: 384113 - DNA, 19 bp, Homo sapiens
taggcctgggtgctggctg

SEQ ID NO: 384114 - DNA, 20 bp, Homo sapiens
taggcctgggtgctggctgc

SEQ ID NO: 384115 - DNA, 17 bp, Homo sapiens
taggcggcgatttttgt

SEQ ID NO: 384116 - DNA, 22 bp, Homo sapiens
taggctaatcaatacccttggc

SEQ ID NO: 384117 - DNA, 21 bp, Homo sapiens
taggctctgcacagatggatt

SEQ ID NO: 384118 - DNA, 18 bp, Homo sapiens
taggctgggcccagaggc

SEQ ID NO: 384119 - DNA, 11 bp, Homo sapiens
taggctgggtg

SEQ ID NO: 384120 - DNA, 17 bp, Homo sapiens
taggctgggtgcccaca

SEQ ID NO: 384121 - DNA, 20 bp, Homo sapiens
tagggaaatccaactccagg

SEQ ID NO: 384122 - DNA, 13 bp, Homo sapiens
tagggaactctgg

SEQ ID NO: 384123 - DNA, 15 bp, Homo sapiens
tagggaactctgggg

SEQ ID NO: 384124 - DNA, 14 bp, Homo sapiens
tagggaagcaggga

SEQ ID NO: 384125 - DNA, 15 bp, Homo sapiens
tagggaagcagggac

SEQ ID NO: 384126 - DNA, 16 bp, Homo sapiens
tagggagaaatgttgt

SEQ ID NO: 384127 - DNA, 22 bp, Homo sapiens
tagggagttcatctggagggtt

SEQ ID NO: 384128 - DNA, 13 bp, Homo sapiens
tagggatctgggg

SEQ ID NO: 384129 - DNA, 19 bp, Homo sapiens
tagggcataatgatgatgg

SEQ ID NO: 384130 - DNA, 14 bp, Homo sapiens
tagggccagggctc

SEQ ID NO: 384131 - DNA, 16 bp, Homo sapiens
tagggctctaatttcc

SEQ ID NO: 384132 - DNA, 22 bp, Homo sapiens
tagggctttgtaaactccacag

SEQ ID NO: 384133 - DNA, 22 bp, Homo sapiens
tagggcttttattttttaagtt

SEQ ID NO: 384134 - DNA, 21 bp, Homo sapiens
taggggcatggtataaggaaa

SEQ ID NO: 384135 - DNA, 16 bp, Homo sapiens
tagggggaactctagc

SEQ ID NO: 384136 - DNA, 16 bp, Homo sapiens
tagggggtgggagggg

SEQ ID NO: 384137 - DNA, 23 bp, Homo sapiens
taggggtaatatattgctgctgg

SEQ ID NO: 384138 - DNA, 20 bp, Homo sapiens
taggggtgcgctcacctgca

SEQ ID NO: 384139 - DNA, 19 bp, Homo sapiens
taggggtgggggagaatgg

SEQ ID NO: 384140 - DNA, 20 bp, Homo sapiens
taggggtgggggagaatggc

SEQ ID NO: 384141 - DNA, 15 bp, Homo sapiens
tagggtctcttcagg

SEQ ID NO: 384142 - DNA, 17 bp, Homo sapiens
tagggtggacagaagct

SEQ ID NO: 384143 - DNA, 18 bp, Homo sapiens
tagggtgggcgtgctgcg

SEQ ID NO: 384144 - DNA, 15 bp, Homo sapiens
tagggttataataat

SEQ ID NO: 384145 - DNA, 18 bp, Homo sapiens
tagggttgccagtcctgc

SEQ ID NO: 384146 - DNA, 13 bp, Homo sapiens
tagggtttctgat

SEQ ID NO: 384147 - DNA, 23 bp, Homo sapiens
tagggtttgtttgctgcttttga

SEQ ID NO: 384148 - DNA, 16 bp, Homo sapiens
tagggttttggcctgc

SEQ ID NO: 384149 - DNA, 13 bp, Homo sapiens
taggtaggagacc

SEQ ID NO: 384150 - DNA, 15 bp, Homo sapiens
taggtatgaataagt

SEQ ID NO: 384151 - DNA, 15 bp, Homo sapiens
taggtcaatgaaata

SEQ ID NO: 384152 - DNA, 16 bp, Homo sapiens
taggtcaatgaaatat

SEQ ID NO: 384153 - DNA, 18 bp, Homo sapiens
taggtcagtacccacctg

SEQ ID NO: 384154 - DNA, 23 bp, Homo sapiens
taggtcagtacccacctgagctt

SEQ ID NO: 384155 - DNA, 14 bp, Homo sapiens
taggtcagtgaggc

SEQ ID NO: 384156 - DNA, 12 bp, Homo sapiens
taggtcctcact

SEQ ID NO: 384157 - DNA, 14 bp, Homo sapiens
taggtctccacccc

SEQ ID NO: 384158 - DNA, 23 bp, Homo sapiens
taggtctccacccctcaagccag

SEQ ID NO: 384159 - DNA, 15 bp, Homo sapiens
taggtctcctcaggg

SEQ ID NO: 384160 - DNA, 14 bp, Homo sapiens
taggtctgcacaca

SEQ ID NO: 384161 - DNA, 20 bp, Homo sapiens
taggtgatgtttccagctgc

SEQ ID NO: 384162 - DNA, 21 bp, Homo sapiens
taggtgatgtttccagctgcc

SEQ ID NO: 384163 - DNA, 23 bp, Homo sapiens
taattcccattttgcaaaatttc

SEQ ID NO: 384164 - DNA, 22 bp, Homo sapiens
taattcctctcactaaacttta

SEQ ID NO: 384165 - DNA, 15 bp, Homo sapiens
taattcctggcatga

SEQ ID NO: 384166 - DNA, 21 bp, Homo sapiens
taattcggaagggaaaacagt

SEQ ID NO: 384167 - DNA, 17 bp, Homo sapiens
taattctaaaagagaag

SEQ ID NO: 384168 - DNA, 18 bp, Homo sapiens
taattctagatcagagag

SEQ ID NO: 384169 - DNA, 23 bp, Homo sapiens
taattctcagaagtgaaaaagac

SEQ ID NO: 384170 - DNA, 16 bp, Homo sapiens
taattctctttcaaag

SEQ ID NO: 384171 - DNA, 22 bp, Homo sapiens
taattctgttctgatattaatt

SEQ ID NO: 384172 - DNA, 19 bp, Homo sapiens
taattcttaataggcttta

SEQ ID NO: 384173 - DNA, 15 bp, Homo sapiens
taattcttacctcat

SEQ ID NO: 384174 - DNA, 12 bp, Homo sapiens
taattctttgat

SEQ ID NO: 384175 - DNA, 20 bp, Homo sapiens
taattgacaggattattgga

SEQ ID NO: 384176 - DNA, 21 bp, Homo sapiens
taattgattaaactgtatgtc

SEQ ID NO: 384177 - DNA, 12 bp, Homo sapiens
taattgccatgt

SEQ ID NO: 384178 - DNA, 21 bp, Homo sapiens
taattgcttacatttttacaa

SEQ ID NO: 384179 - DNA, 20 bp, Homo sapiens
taattggcttttgaatcaaa

SEQ ID NO: 384180 - DNA, 16 bp, Homo sapiens
taattgtgaacagcca

SEQ ID NO: 384181 - DNA, 14 bp, Homo sapiens
taattgtggagagg

SEQ ID NO: 384182 - DNA, 16 bp, Homo sapiens
taattgtggagaggag

SEQ ID NO: 384183 - DNA, 17 bp, Homo sapiens
taattgtggctttatga

SEQ ID NO: 384184 - DNA, 13 bp, Homo sapiens
taattgtgtacaa

SEQ ID NO: 384185 - DNA, 14 bp, Homo sapiens
taattgtgtacaaa

SEQ ID NO: 384186 - DNA, 13 bp, Homo sapiens
taatttaaatgct

SEQ ID NO: 384187 - DNA, 19 bp, Homo sapiens
taatttagtcccttaaaaa

SEQ ID NO: 384188 - DNA, 18 bp, Homo sapiens
taatttatttattaagat

SEQ ID NO: 384189 - DNA, 19 bp, Homo sapiens
taatttatttattaagatg

SEQ ID NO: 384190 - DNA, 17 bp, Homo sapiens
taatttcaaaaatataa

SEQ ID NO: 384191 - DNA, 18 bp, Homo sapiens
taatttcaaaaatataac

SEQ ID NO: 384192 - DNA, 15 bp, Homo sapiens
taatttcataaattg

SEQ ID NO: 384193 - DNA, 19 bp, Homo sapiens
taatttcataaattggctc

SEQ ID NO: 384194 - DNA, 20 bp, Homo sapiens
taatttgatgaaagctgatt

SEQ ID NO: 384195 - DNA, 24 bp, Homo sapiens
taatttgatgaaagctgattactg

SEQ ID NO: 384196 - DNA, 19 bp, Homo sapiens
taatttgcatattctattg

SEQ ID NO: 384197 - DNA, 14 bp, Homo sapiens
taatttgctgctga

SEQ ID NO: 384198 - DNA, 17 bp, Homo sapiens
taatttggtttttactc

SEQ ID NO: 384199 - DNA, 13 bp, Homo sapiens
taatttgtatctg

SEQ ID NO: 384200 - DNA, 15 bp, Homo sapiens
taatttgtcactgga

SEQ ID NO: 384201 - DNA, 13 bp, Homo sapiens
taattttaaataa

SEQ ID NO: 384202 - DNA, 14 bp, Homo sapiens
taattttaatggct

SEQ ID NO: 384203 - DNA, 14 bp, Homo sapiens
taattttattcatt

SEQ ID NO: 384204 - DNA, 13 bp, Homo sapiens
taattttctaaaa

SEQ ID NO: 384205 - DNA, 21 bp, Homo sapiens
taattttctagattttctact

SEQ ID NO: 384206 - DNA, 12 bp, Homo sapiens
taattttctcaa

SEQ ID NO: 384207 - DNA, 22 bp, Homo sapiens
taattttctcaaaagcatttat

SEQ ID NO: 384208 - DNA, 15 bp, Homo sapiens
taattttgaataaat

SEQ ID NO: 384209 - DNA, 15 bp, Homo sapiens
taattttgcataaaa

SEQ ID NO: 384210 - DNA, 20 bp, Homo sapiens
taattttgtacgtatgaatg

SEQ ID NO: 384211 - DNA, 14 bp, Homo sapiens
taattttgtatctt

SEQ ID NO: 384212 - DNA, 21 bp, Homo sapiens
taatttttaaaagactttgat

SEQ ID NO: 384213 - DNA, 17 bp, Homo sapiens
taatttttacagaattg

SEQ ID NO: 384214 - DNA, 21 bp, Homo sapiens
taatttttaccccctaaggaa

SEQ ID NO: 384215 - DNA, 20 bp, Homo sapiens
taatttttgctgaattcctt

SEQ ID NO: 384216 - DNA, 22 bp, Homo sapiens
taatttttgtgtttttaataaa

SEQ ID NO: 384217 - DNA, 17 bp, Homo sapiens
taatttttttatgtttt

SEQ ID NO: 384218 - DNA, 21 bp, Homo sapiens
taatttttttatgttttgttt

SEQ ID NO: 384219 - DNA, 22 bp, Homo sapiens
taattttttttttccttttaaa

SEQ ID NO: 384220 - DNA, 15 bp, Homo sapiens
tacaaaaaaaatcaa

SEQ ID NO: 384221 - DNA, 16 bp, Homo sapiens
tacaaaaacatggcct

SEQ ID NO: 384222 - DNA, 16 bp, Homo sapiens
tacaaaaatatattaa

SEQ ID NO: 384223 - DNA, 18 bp, Homo sapiens
tacaaaaatatattaaaa

SEQ ID NO: 384224 - DNA, 12 bp, Homo sapiens
tacaaaagcaaa

SEQ ID NO: 384225 - DNA, 13 bp, Homo sapiens
tacaaaataaaaa

SEQ ID NO: 384226 - DNA, 23 bp, Homo sapiens
tacaaaataaaattatggtgaaa

SEQ ID NO: 384227 - DNA, 21 bp, Homo sapiens
tacaaaatgtgtgcttggaaa

SEQ ID NO: 384228 - DNA, 19 bp, Homo sapiens
tacaaacaaaggatttgaa

SEQ ID NO: 384229 - DNA, 15 bp, Homo sapiens
tacaaagtagagaag

SEQ ID NO: 384230 - DNA, 19 bp, Homo sapiens
tacaaatactcttaggaag

SEQ ID NO: 384231 - DNA, 17 bp, Homo sapiens
tacaaatataagatttt

SEQ ID NO: 384232 - DNA, 19 bp, Homo sapiens
tacaaattataaaaagcca

SEQ ID NO: 384233 - DNA, 20 bp, Homo sapiens
tacaaattttcactgctgct

SEQ ID NO: 384234 - DNA, 14 bp, Homo sapiens
tacaacaaacactg

SEQ ID NO: 384235 - DNA, 16 bp, Homo sapiens
tacaacaaacactgtg

SEQ ID NO: 384236 - DNA, 19 bp, Homo sapiens
tacaacaaacactgtgatg

SEQ ID NO: 384237 - DNA, 21 bp, Homo sapiens
tacaacataatctagtttaca

SEQ ID NO: 384238 - DNA, 13 bp, Homo sapiens
tacaaccagagcc

SEQ ID NO: 384239 - DNA, 22 bp, Homo sapiens
tacaaccagagccccccacaat

SEQ ID NO: 384240 - DNA, 17 bp, Homo sapiens
tacaaccggttatcagt

SEQ ID NO: 384241 - DNA, 20 bp, Homo sapiens
cttgtggccccttttacttt

SEQ ID NO: 384242 - DNA, 21 bp, Homo sapiens
cttgtggccccttttactttt

SEQ ID NO: 384243 - DNA, 14 bp, Homo sapiens
cttgtgggctggtg

SEQ ID NO: 384244 - DNA, 15 bp, Homo sapiens
cttgtgggctggtgc

SEQ ID NO: 384245 - DNA, 14 bp, Homo sapiens
cttgtgtcccatga

SEQ ID NO: 384246 - DNA, 12 bp, Homo sapiens
cttgtgtcctga

SEQ ID NO: 384247 - DNA, 15 bp, Homo sapiens
cttgtgtgagtgtga

SEQ ID NO: 384248 - DNA, 19 bp, Homo sapiens
cttgtgtgtgggctgtgag

SEQ ID NO: 384249 - DNA, 20 bp, Homo sapiens
cttgtgtgtgggctgtgagt

SEQ ID NO: 384250 - DNA, 20 bp, Homo sapiens
cttgtgtgtttattgtcaaa

SEQ ID NO: 384251 - DNA, 17 bp, Homo sapiens
cttgtgttggctgtggc

SEQ ID NO: 384252 - DNA, 17 bp, Homo sapiens
cttgtgtttgcttaaac

SEQ ID NO: 384253 - DNA, 21 bp, Homo sapiens
cttgtgtttgcttaaacaaag

SEQ ID NO: 384254 - DNA, 13 bp, Homo sapiens
cttgtgtttgtat

SEQ ID NO: 384255 - DNA, 16 bp, Homo sapiens
cttgttaagatagtta

SEQ ID NO: 384256 - DNA, 19 bp, Homo sapiens
cttgttcatgttttgctaa

SEQ ID NO: 384257 - DNA, 18 bp, Homo sapiens
cttgttcatttctgtctc

SEQ ID NO: 384258 - DNA, 19 bp, Homo sapiens
cttgttcatttctgtctcc

SEQ ID NO: 384259 - DNA, 16 bp, Homo sapiens
cttgttccagctcttt

SEQ ID NO: 384260 - DNA, 14 bp, Homo sapiens
cttgttctgttttg

SEQ ID NO: 384261 - DNA, 16 bp, Homo sapiens
cttgttcttttctggt

SEQ ID NO: 384262 - DNA, 13 bp, Homo sapiens
cttgttgcccagg

SEQ ID NO: 384263 - DNA, 19 bp, Homo sapiens
cttgttggagcctgcaggg

SEQ ID NO: 384264 - DNA, 13 bp, Homo sapiens
cttgttgtattcc

SEQ ID NO: 384265 - DNA, 14 bp, Homo sapiens
cttgttgtattcct

SEQ ID NO: 384266 - DNA, 18 bp, Homo sapiens
cttgttgtattcctgcct

SEQ ID NO: 384267 - DNA, 22 bp, Homo sapiens
cttgttgtattcctgcctttga

SEQ ID NO: 384268 - DNA, 13 bp, Homo sapiens
cttgttgttgtta

SEQ ID NO: 384269 - DNA, 17 bp, Homo sapiens
cttgtttaattctaaaa

SEQ ID NO: 384270 - DNA, 21 bp, Homo sapiens
cttgtttaattctaaaagaga

SEQ ID NO: 384271 - DNA, 22 bp, Homo sapiens
cttgtttaattctaaaagagaa

SEQ ID NO: 384272 - DNA, 19 bp, Homo sapiens
cttgtttatgatatttctt

SEQ ID NO: 384273 - DNA, 22 bp, Homo sapiens
cttgtttcaattccacctgcaa

SEQ ID NO: 384274 - DNA, 18 bp, Homo sapiens
cttgtttccctgctggcc

SEQ ID NO: 384275 - DNA, 16 bp, Homo sapiens
cttgtttcctgtgccc

SEQ ID NO: 384276 - DNA, 13 bp, Homo sapiens
cttgtttctttct

SEQ ID NO: 384277 - DNA, 14 bp, Homo sapiens
cttgtttctttctg

SEQ ID NO: 384278 - DNA, 14 bp, Homo sapiens
cttgtttgttctag

SEQ ID NO: 384279 - DNA, 14 bp, Homo sapiens
cttgtttgttttct

SEQ ID NO: 384280 - DNA, 13 bp, Homo sapiens
cttgttttgttat

SEQ ID NO: 384281 - DNA, 21 bp, Homo sapiens
cttgttttttttttccactta

SEQ ID NO: 384282 - DNA, 20 bp, Homo sapiens
ctttaaagacttaagattaa

SEQ ID NO: 384283 - DNA, 21 bp, Homo sapiens
ctttaaaggcatctacacaat

SEQ ID NO: 384284 - DNA, 13 bp, Homo sapiens
ctttaaatataat

SEQ ID NO: 384285 - DNA, 12 bp, Homo sapiens
ctttaaatatca

SEQ ID NO: 384286 - DNA, 17 bp, Homo sapiens
ctttaaatatcattctt

SEQ ID NO: 384287 - DNA, 13 bp, Homo sapiens
ctttaaatgatgt

SEQ ID NO: 384288 - DNA, 12 bp, Homo sapiens
ctttaaattata

SEQ ID NO: 384289 - DNA, 13 bp, Homo sapiens
ctttaaattatat

SEQ ID NO: 384290 - DNA, 17 bp, Homo sapiens
ctttaaattgttcctct

SEQ ID NO: 384291 - DNA, 18 bp, Homo sapiens
ctttaaattgttcctctt

SEQ ID NO: 384292 - DNA, 21 bp, Homo sapiens
ctttaacaaaacaagaaagaa

SEQ ID NO: 384293 - DNA, 14 bp, Homo sapiens
ctttctactcattt

SEQ ID NO: 384294 - DNA, 19 bp, Homo sapiens
ctttctatgtagaactgtt

SEQ ID NO: 384295 - DNA, 20 bp, Homo sapiens
ctttctatgtagaactgttc

SEQ ID NO: 384296 - DNA, 19 bp, Homo sapiens
ctttctattacccctcatt

SEQ ID NO: 384297 - DNA, 23 bp, Homo sapiens
ctttctccagaaccagtgtctga

SEQ ID NO: 384298 - DNA, 12 bp, Homo sapiens
ctttctccaggc

SEQ ID NO: 384299 - DNA, 15 bp, Homo sapiens
ctttctccaggccct

SEQ ID NO: 384300 - DNA, 19 bp, Homo sapiens
ctttctcccccgacactgc

SEQ ID NO: 384301 - DNA, 14 bp, Homo sapiens
ctttctccggggtc

SEQ ID NO: 384302 - DNA, 12 bp, Homo sapiens
ctttctcctgtg

SEQ ID NO: 384303 - DNA, 13 bp, Homo sapiens
ctttctcctgtgc

SEQ ID NO: 384304 - DNA, 14 bp, Homo sapiens
ctttctcctgtgcc

SEQ ID NO: 384305 - DNA, 21 bp, Homo sapiens
ctttctccttagtcttctcat

SEQ ID NO: 384306 - DNA, 12 bp, Homo sapiens
ctttctcctttg

SEQ ID NO: 384307 - DNA, 20 bp, Homo sapiens
ctttctctcagccttacatt

SEQ ID NO: 384308 - DNA, 16 bp, Homo sapiens
ctttctctcctttctt

SEQ ID NO: 384309 - DNA, 13 bp, Homo sapiens
ctttctctctgtg

SEQ ID NO: 384310 - DNA, 18 bp, Homo sapiens
ctttctctctgtgtggca

SEQ ID NO: 384311 - DNA, 16 bp, Homo sapiens
ctttctctgccagtga

SEQ ID NO: 384312 - DNA, 14 bp, Homo sapiens
ctttctctgcttca

SEQ ID NO: 384313 - DNA, 21 bp, Homo sapiens
ctttctgacaataaataatat

SEQ ID NO: 384314 - DNA, 23 bp, Homo sapiens
ctttctgactgcaacttctgtcc

SEQ ID NO: 384315 - DNA, 21 bp, Homo sapiens
ctttctgataactagatggtg

SEQ ID NO: 384316 - DNA, 23 bp, Homo sapiens
ctttctggaaattcttccctggg

SEQ ID NO: 384317 - DNA, 17 bp, Homo sapiens
ctttctggcctgccttc

SEQ ID NO: 384318 - DNA, 14 bp, Homo sapiens
ctttctgtctcaaa

SEQ ID NO: 384319 - DNA, 21 bp, Homo sapiens
ctttctgtgtgcaccttacca

SEQ ID NO: 384320 - DNA, 15 bp, Homo sapiens
ctttctgttggtgta

SEQ ID NO: 384321 - DNA, 22 bp, Homo sapiens
ctttctgttttttttttttgta

SEQ ID NO: 384322 - DNA, 11 bp, Homo sapiens
ctttcttcctc

SEQ ID NO: 384323 - DNA, 14 bp, Homo sapiens
ctttcttcctccag

SEQ ID NO: 384324 - DNA, 17 bp, Homo sapiens
ctttcttcctccagtct

SEQ ID NO: 384325 - DNA, 22 bp, Homo sapiens
ctttcttcctccagtctgttct

SEQ ID NO: 384326 - DNA, 12 bp, Homo sapiens
ctttcttcctct

SEQ ID NO: 384327 - DNA, 13 bp, Homo sapiens
ctttcttcctctg

SEQ ID NO: 384328 - DNA, 12 bp, Homo sapiens
ctttcttgacaa

SEQ ID NO: 384329 - DNA, 17 bp, Homo sapiens
ctttcttggtgcattcg

SEQ ID NO: 384330 - DNA, 17 bp, Homo sapiens
ctttctttacctgagac

SEQ ID NO: 384331 - DNA, 18 bp, Homo sapiens
ctttctttacctgagacc

SEQ ID NO: 384332 - DNA, 15 bp, Homo sapiens
ctttctttcagatgt

SEQ ID NO: 384333 - DNA, 16 bp, Homo sapiens
ctttctttcagatgtt

SEQ ID NO: 384334 - DNA, 15 bp, Homo sapiens
ctttctttccaaagg

SEQ ID NO: 384335 - DNA, 15 bp, Homo sapiens
ctttctttccttaat

SEQ ID NO: 384336 - DNA, 14 bp, Homo sapiens
ctttctttgctgct

SEQ ID NO: 384337 - DNA, 16 bp, Homo sapiens
ctttctttttcttctt

SEQ ID NO: 384338 - DNA, 20 bp, Homo sapiens
ctttctttttcttcttccct

SEQ ID NO: 384339 - DNA, 16 bp, Homo sapiens
ctttgaaaatatttct

SEQ ID NO: 384340 - DNA, 21 bp, Homo sapiens
ctttgaaaatatttctatgta

SEQ ID NO: 384341 - DNA, 18 bp, Homo sapiens
ctttgaacaattgtgttt

SEQ ID NO: 384342 - DNA, 14 bp, Homo sapiens
ctttgaagcagttg

SEQ ID NO: 384343 - DNA, 18 bp, Homo sapiens
ctttgaataaaaatgcac

SEQ ID NO: 384344 - DNA, 19 bp, Homo sapiens
ctttgaatttcctatctgt

SEQ ID NO: 384345 - DNA, 19 bp, Homo sapiens
ctttgaccaaactgtgggt

SEQ ID NO: 384346 - DNA, 17 bp, Homo sapiens
ctttgacctcaacctgt

SEQ ID NO: 384347 - DNA, 21 bp, Homo sapiens
ctttgacctcaacctgtgatg

SEQ ID NO: 384348 - DNA, 21 bp, Homo sapiens
ctttgacctcaatggaggttt

SEQ ID NO: 384349 - DNA, 20 bp, Homo sapiens
ctttgacgagtcaccttcca

SEQ ID NO: 384350 - DNA, 18 bp, Homo sapiens
ctttgactataacaaaat

SEQ ID NO: 384351 - DNA, 21 bp, Homo sapiens
ctttgactttatctcctgctc

SEQ ID NO: 384352 - DNA, 22 bp, Homo sapiens
ctttgactttatctcctgctct

SEQ ID NO: 384353 - DNA, 14 bp, Homo sapiens
ctttgactttcttc

SEQ ID NO: 384354 - DNA, 23 bp, Homo sapiens
ctttgagaactgcttctaagatg

SEQ ID NO: 384355 - DNA, 17 bp, Homo sapiens
ctttgagactgggtctc

SEQ ID NO: 384356 - DNA, 17 bp, Homo sapiens
ctttgaggacaaagaga

SEQ ID NO: 384357 - DNA, 18 bp, Homo sapiens
ctttgagggactgcctct

SEQ ID NO: 384358 - DNA, 20 bp, Homo sapiens
ctttgagggactgcctctgc

SEQ ID NO: 384359 - DNA, 21 bp, Homo sapiens
ctttgagggactgcctctgcc

SEQ ID NO: 384360 - DNA, 22 bp, Homo sapiens
ctttgagggactgcctctgcca

SEQ ID NO: 384361 - DNA, 21 bp, Homo sapiens
ctttgagtaccaaatccacaa

SEQ ID NO: 384362 - DNA, 13 bp, Homo sapiens
ctttgagtgatcc

SEQ ID NO: 384363 - DNA, 17 bp, Homo sapiens
ctttgagtgtcaggctc

SEQ ID NO: 384364 - DNA, 16 bp, Homo sapiens
ctttgagtttcctcag

SEQ ID NO: 384365 - DNA, 22 bp, Homo sapiens
ctttgagtttcctcaggctgct

SEQ ID NO: 384366 - DNA, 15 bp, Homo sapiens
ctttgatctctgctt

SEQ ID NO: 384367 - DNA, 16 bp, Homo sapiens
ctttgatctctgctta

SEQ ID NO: 384368 - DNA, 15 bp, Homo sapiens
ctttgattccatctc

SEQ ID NO: 384369 - DNA, 16 bp, Homo sapiens
ctttgattccatctcc

SEQ ID NO: 384370 - DNA, 18 bp, Homo sapiens
ctttgattgcacattgtt

SEQ ID NO: 384371 - DNA, 14 bp, Homo sapiens
ctttgatttaactg

SEQ ID NO: 384372 - DNA, 18 bp, Homo sapiens
ctttgcactgagggccac

SEQ ID NO: 384373 - DNA, 22 bp, Homo sapiens
ctttgcactgagggccacacta

SEQ ID NO: 384374 - DNA, 23 bp, Homo sapiens
ctttgcactgagggccacactat

SEQ ID NO: 384375 - DNA, 21 bp, Homo sapiens
ctttgcagacctgggacttta

SEQ ID NO: 384376 - DNA, 22 bp, Homo sapiens
ctttgcagccggcacagggtct

SEQ ID NO: 384377 - DNA, 15 bp, Homo sapiens
ctttgcaggctctgg

SEQ ID NO: 384378 - DNA, 16 bp, Homo sapiens
ctttgcaggctctggg

SEQ ID NO: 384379 - DNA, 12 bp, Homo sapiens
ctttgcagggct

SEQ ID NO: 384380 - DNA, 22 bp, Homo sapiens
ctttgcagggctaaggccccca

SEQ ID NO: 384381 - DNA, 22 bp, Homo sapiens
ctttgcagttggactctcaggg

SEQ ID NO: 384382 - DNA, 18 bp, Homo sapiens
tacatatcacctcatggc

SEQ ID NO: 384383 - DNA, 18 bp, Homo sapiens
tacatatggaaatcctgt

SEQ ID NO: 384384 - DNA, 14 bp, Homo sapiens
tacatattactgtt

SEQ ID NO: 384385 - DNA, 15 bp, Homo sapiens
tacatattactgttg

SEQ ID NO: 384386 - DNA, 20 bp, Homo sapiens
tacatcagttattcattctg

SEQ ID NO: 384387 - DNA, 13 bp, Homo sapiens
tacatcatttctt

SEQ ID NO: 384388 - DNA, 14 bp, Homo sapiens
tacatcccagcctg

SEQ ID NO: 384389 - DNA, 15 bp, Homo sapiens
tacatctaatgcttc

SEQ ID NO: 384390 - DNA, 22 bp, Homo sapiens
tacatctagcacagctgtgagg

SEQ ID NO: 384391 - DNA, 14 bp, Homo sapiens
tacatcttttggga

SEQ ID NO: 384392 - DNA, 15 bp, Homo sapiens
tacatcttttgggaa

SEQ ID NO: 384393 - DNA, 14 bp, Homo sapiens
tacatgactgggcc

SEQ ID NO: 384394 - DNA, 15 bp, Homo sapiens
tacatgactgggcct

SEQ ID NO: 384395 - DNA, 19 bp, Homo sapiens
tacatgcaatttattaaaa

SEQ ID NO: 384396 - DNA, 20 bp, Homo sapiens
tacatgcaatttattaaaat

SEQ ID NO: 384397 - DNA, 14 bp, Homo sapiens
tacatgcatttgag

SEQ ID NO: 384398 - DNA, 14 bp, Homo sapiens
tacatggaagaagt

SEQ ID NO: 384399 - DNA, 16 bp, Homo sapiens
tacatggttgtgacct

SEQ ID NO: 384400 - DNA, 15 bp, Homo sapiens
tacatggtttaaagt

SEQ ID NO: 384401 - DNA, 19 bp, Homo sapiens
tacatgtaaaacattatct

SEQ ID NO: 384402 - DNA, 13 bp, Homo sapiens
tacatgtagtagt

SEQ ID NO: 384403 - DNA, 15 bp, Homo sapiens
tacatgtctcatatt

SEQ ID NO: 384404 - DNA, 16 bp, Homo sapiens
tacatgtctcatattt

SEQ ID NO: 384405 - DNA, 18 bp, Homo sapiens
tacatgtctcatattttc

SEQ ID NO: 384406 - DNA, 20 bp, Homo sapiens
tacatgtgccgaatgtgcag

SEQ ID NO: 384407 - DNA, 12 bp, Homo sapiens
tacatgtgtgga

SEQ ID NO: 384408 - DNA, 19 bp, Homo sapiens
tacatgtgtggatgtgtaa

SEQ ID NO: 384409 - DNA, 19 bp, Homo sapiens
tacatgttattgttttcaa

SEQ ID NO: 384410 - DNA, 22 bp, Homo sapiens
tacatgtttccatcatttctgt

SEQ ID NO: 384411 - DNA, 12 bp, Homo sapiens
tacattaatgtt

SEQ ID NO: 384412 - DNA, 18 bp, Homo sapiens
tacattagttaagatgtc

SEQ ID NO: 384413 - DNA, 13 bp, Homo sapiens
tacattcacagca

SEQ ID NO: 384414 - DNA, 14 bp, Homo sapiens
tacattccaactta

SEQ ID NO: 384415 - DNA, 23 bp, Homo sapiens
tacattccatcacagccagccca

SEQ ID NO: 384416 - DNA, 13 bp, Homo sapiens
tacattcctcagc

SEQ ID NO: 384417 - DNA, 19 bp, Homo sapiens
tacattcctcagctgccaa

SEQ ID NO: 384418 - DNA, 12 bp, Homo sapiens
tacattcctgag

SEQ ID NO: 384419 - DNA, 13 bp, Homo sapiens
tacattcctgaga

SEQ ID NO: 384420 - DNA, 18 bp, Homo sapiens
tacattcctgagattctg

SEQ ID NO: 384421 - DNA, 22 bp, Homo sapiens
tacattccttgataatgttgtg

SEQ ID NO: 384422 - DNA, 18 bp, Homo sapiens
tacattggctttttaaat

SEQ ID NO: 384423 - DNA, 20 bp, Homo sapiens
tacattgtaatctgctttgt

SEQ ID NO: 384424 - DNA, 12 bp, Homo sapiens
tacctgagacca

SEQ ID NO: 384425 - DNA, 16 bp, Homo sapiens
tacctgataagggaga

SEQ ID NO: 384426 - DNA, 21 bp, Homo sapiens
tacctgcccccactcagcatt

SEQ ID NO: 384427 - DNA, 19 bp, Homo sapiens
tacctgccctaagggactt

SEQ ID NO: 384428 - DNA, 16 bp, Homo sapiens
tacctggaaaccagaa

SEQ ID NO: 384429 - DNA, 20 bp, Homo sapiens
tacctggcttagcgttctgt

SEQ ID NO: 384430 - DNA, 17 bp, Homo sapiens
tacctggcttttacttt

SEQ ID NO: 384431 - DNA, 11 bp, Homo sapiens
tacctgggaaa

SEQ ID NO: 384432 - DNA, 18 bp, Homo sapiens
tacctggtcaacccgctg

SEQ ID NO: 384433 - DNA, 22 bp, Homo sapiens
tacctggtcaacccgctgcttc

SEQ ID NO: 384434 - DNA, 11 bp, Homo sapiens
tacctgtagga

SEQ ID NO: 384435 - DNA, 20 bp, Homo sapiens
tacctgtagtgagaaactga

SEQ ID NO: 384436 - DNA, 17 bp, Homo sapiens
tacctgtcatctgggcc

SEQ ID NO: 384437 - DNA, 16 bp, Homo sapiens
tacctgttcagtgtcc

SEQ ID NO: 384438 - DNA, 20 bp, Homo sapiens
tacctgttcagtgtcccggg

SEQ ID NO: 384439 - DNA, 22 bp, Homo sapiens
taccttattgagcgtgattctg

SEQ ID NO: 384440 - DNA, 15 bp, Homo sapiens
taccttcagatccta

SEQ ID NO: 384441 - DNA, 17 bp, Homo sapiens
taccttcagatcctacc

SEQ ID NO: 384442 - DNA, 22 bp, Homo sapiens
taccttcagccatagcttgatt

SEQ ID NO: 384443 - DNA, 13 bp, Homo sapiens
taccttcatttca

SEQ ID NO: 384444 - DNA, 16 bp, Homo sapiens
taccttcatttcatcc

SEQ ID NO: 384445 - DNA, 19 bp, Homo sapiens
taccttcatttcatcctgt

SEQ ID NO: 384446 - DNA, 16 bp, Homo sapiens
taccttcctttgtctt

SEQ ID NO: 384447 - DNA, 17 bp, Homo sapiens
taccttcctttgtctta

SEQ ID NO: 384448 - DNA, 16 bp, Homo sapiens
taccttgagaccctct

SEQ ID NO: 384449 - DNA, 22 bp, Homo sapiens
taccttgagaccctcttctctg

SEQ ID NO: 384450 - DNA, 12 bp, Homo sapiens
tacctttaaata

SEQ ID NO: 384451 - DNA, 16 bp, Homo sapiens
tacctttaaatatcat

SEQ ID NO: 384452 - DNA, 19 bp, Homo sapiens
tacctttaaatatcattct

SEQ ID NO: 384453 - DNA, 16 bp, Homo sapiens
tacctttatggtttct

SEQ ID NO: 384454 - DNA, 12 bp, Homo sapiens
tacctttctgac

SEQ ID NO: 384455 - DNA, 16 bp, Homo sapiens
tacctttgctcttgca

SEQ ID NO: 384456 - DNA, 12 bp, Homo sapiens
tacctttgtcac

SEQ ID NO: 384457 - DNA, 16 bp, Homo sapiens
taccttttctgttgta

SEQ ID NO: 384458 - DNA, 17 bp, Homo sapiens
taccttttctgttgtac

SEQ ID NO: 384459 - DNA, 12 bp, Homo sapiens
taccttttgata

SEQ ID NO: 384460 - DNA, 17 bp, Homo sapiens
tacgactttattttctg

SEQ ID NO: 384461 - DNA, 15 bp, Homo sapiens
tacgatgttaaaaca

SEQ ID NO: 384462 - DNA, 21 bp, Homo sapiens
tacgccaaagtgcagcccttc

SEQ ID NO: 384463 - DNA, 23 bp, Homo sapiens
tacgccaaagtgcagcccttcct

SEQ ID NO: 384464 - DNA, 14 bp, Homo sapiens
tacgctctctgtct

SEQ ID NO: 384465 - DNA, 22 bp, Homo sapiens
tacggcagtcacactgctggga

SEQ ID NO: 384466 - DNA, 21 bp, Homo sapiens
tacggctatctagttgtctga

SEQ ID NO: 384467 - DNA, 18 bp, Homo sapiens
tacggtagtgatgaaatt

SEQ ID NO: 384468 - DNA, 17 bp, Homo sapiens
tacggtcatgatgtctg

SEQ ID NO: 384469 - DNA, 16 bp, Homo sapiens
tacggtgagactctga

SEQ ID NO: 384470 - DNA, 21 bp, Homo sapiens
tacggttttataaaagccttg

SEQ ID NO: 384471 - DNA, 19 bp, Homo sapiens
tacgtcccgctgctgtgct

SEQ ID NO: 384472 - DNA, 13 bp, Homo sapiens
tacgtgagtcctg

SEQ ID NO: 384473 - DNA, 14 bp, Homo sapiens
tacgtgggagaggc

SEQ ID NO: 384474 - DNA, 17 bp, Homo sapiens
tacgtgggtacccaggc

SEQ ID NO: 384475 - DNA, 22 bp, Homo sapiens
tactaaagatatcagagctctt

SEQ ID NO: 384476 - DNA, 11 bp, Homo sapiens
tactaaagcag

SEQ ID NO: 384477 - DNA, 14 bp, Homo sapiens
tactaaagcagtgt

SEQ ID NO: 384478 - DNA, 20 bp, Homo sapiens
tactaaattgtatacatttt

SEQ ID NO: 384479 - DNA, 17 bp, Homo sapiens
tactaacctggagacag

SEQ ID NO: 384480 - DNA, 13 bp, Homo sapiens
tactaaggagaat

SEQ ID NO: 384481 - DNA, 11 bp, Homo sapiens
tactaataaaa

SEQ ID NO: 384482 - DNA, 18 bp, Homo sapiens
tactaataaaaaggttta

SEQ ID NO: 384483 - DNA, 16 bp, Homo sapiens
tactaatgatgttttc

SEQ ID NO: 384484 - DNA, 19 bp, Homo sapiens
tactaattaacatataata

SEQ ID NO: 384485 - DNA, 23 bp, Homo sapiens
tactaattaacatataatatatg

SEQ ID NO: 384486 - DNA, 14 bp, Homo sapiens
tactaatttattgc

SEQ ID NO: 384487 - DNA, 18 bp, Homo sapiens
tactacaaaatttgaaat

SEQ ID NO: 384488 - DNA, 17 bp, Homo sapiens
tactacatcgccctcca

SEQ ID NO: 384489 - DNA, 15 bp, Homo sapiens
tactacatttgcatg

SEQ ID NO: 384490 - DNA, 17 bp, Homo sapiens
tactacatttgcatgcc

SEQ ID NO: 384491 - DNA, 17 bp, Homo sapiens
tactaccacaaggaaaa

SEQ ID NO: 384492 - DNA, 15 bp, Homo sapiens
tactacccgagccca

SEQ ID NO: 384493 - DNA, 17 bp, Homo sapiens
tactactagatgtcttt

SEQ ID NO: 384494 - DNA, 15 bp, Homo sapiens
tactactattctgtt

SEQ ID NO: 384495 - DNA, 13 bp, Homo sapiens
tactactttaaat

SEQ ID NO: 384496 - DNA, 23 bp, Homo sapiens
tactactttaaatcctaccaaag

SEQ ID NO: 384497 - DNA, 19 bp, Homo sapiens
tactagatgtctttaggca

SEQ ID NO: 384498 - DNA, 18 bp, Homo sapiens
tactagtactattgctat

SEQ ID NO: 384499 - DNA, 22 bp, Homo sapiens
tactagttcagacactttggaa

SEQ ID NO: 384500 - DNA, 14 bp, Homo sapiens
tactataacatatg

SEQ ID NO: 384501 - DNA, 19 bp, Homo sapiens
tactatagatataactgta

SEQ ID NO: 384502 - DNA, 16 bp, Homo sapiens
tactatatctgtttta

SEQ ID NO: 384503 - DNA, 14 bp, Homo sapiens
tactatattgctgt

SEQ ID NO: 384504 - DNA, 13 bp, Homo sapiens
tactatcctggct

SEQ ID NO: 384505 - DNA, 17 bp, Homo sapiens
tactatctactctcctc

SEQ ID NO: 384506 - DNA, 13 bp, Homo sapiens
tactatcttttca

SEQ ID NO: 384507 - DNA, 15 bp, Homo sapiens
tactatcttttcatt

SEQ ID NO: 384508 - DNA, 16 bp, Homo sapiens
tactatcttttcattt

SEQ ID NO: 384509 - DNA, 20 bp, Homo sapiens
tactatggtatatattttga

SEQ ID NO: 384510 - DNA, 20 bp, Homo sapiens
tactatgtattaccagcccc

SEQ ID NO: 384511 - DNA, 18 bp, Homo sapiens
tactattaactctgcata

SEQ ID NO: 384512 - DNA, 22 bp, Homo sapiens
tactattaagcagtaaaaactg

SEQ ID NO: 384513 - DNA, 18 bp, Homo sapiens
tactattccctttgactt

SEQ ID NO: 384514 - DNA, 23 bp, Homo sapiens
tactattccctttgacttcagct

SEQ ID NO: 384515 - DNA, 13 bp, Homo sapiens
tactattctgtta

SEQ ID NO: 384516 - DNA, 19 bp, Homo sapiens
tactattggacagacacag

SEQ ID NO: 384517 - DNA, 12 bp, Homo sapiens
tactatttaact

SEQ ID NO: 384518 - DNA, 22 bp, Homo sapiens
tactcaaccaaattaaaaattt

SEQ ID NO: 384519 - DNA, 19 bp, Homo sapiens
tactcaagcaggtttcttg

SEQ ID NO: 384520 - DNA, 21 bp, Homo sapiens
tactcacagtctctttaatct

SEQ ID NO: 384521 - DNA, 17 bp, Homo sapiens
tactcaccaaaatatag

SEQ ID NO: 384522 - DNA, 13 bp, Homo sapiens
tactcacctcctc

SEQ ID NO: 384523 - DNA, 15 bp, Homo sapiens
tactcacctcctccc

SEQ ID NO: 384524 - DNA, 14 bp, Homo sapiens
tactcacttttcac

SEQ ID NO: 384525 - DNA, 19 bp, Homo sapiens
cttttcccctcattgcatt

SEQ ID NO: 384526 - DNA, 22 bp, Homo sapiens
cttttcccctcattgcatttat

SEQ ID NO: 384527 - DNA, 20 bp, Homo sapiens
cttttcctattttcagccca

SEQ ID NO: 384528 - DNA, 13 bp, Homo sapiens
cttttccttcaga

SEQ ID NO: 384529 - DNA, 15 bp, Homo sapiens
cttttcgttaacatt

SEQ ID NO: 384530 - DNA, 16 bp, Homo sapiens
cttttcgttaacattg

SEQ ID NO: 384531 - DNA, 16 bp, Homo sapiens
cttttctagcaactgt

SEQ ID NO: 384532 - DNA, 21 bp, Homo sapiens
cttttctctttgggtttcttg

SEQ ID NO: 384533 - DNA, 23 bp, Homo sapiens
cttttctgcatcatctgtagata

SEQ ID NO: 384534 - DNA, 14 bp, Homo sapiens
cttttctggctcct

SEQ ID NO: 384535 - DNA, 17 bp, Homo sapiens
cttttctggctcctgtg

SEQ ID NO: 384536 - DNA, 18 bp, Homo sapiens
cttttctgtcaccaaatt

SEQ ID NO: 384537 - DNA, 21 bp, Homo sapiens
cttttctgtcaccaaatttgt

SEQ ID NO: 384538 - DNA, 14 bp, Homo sapiens
cttttctgttgtac

SEQ ID NO: 384539 - DNA, 18 bp, Homo sapiens
cttttcttgccagctcag

SEQ ID NO: 384540 - DNA, 20 bp, Homo sapiens
cttttcttggcgttcctgcc

SEQ ID NO: 384541 - DNA, 17 bp, Homo sapiens
cttttctttcagccaag

SEQ ID NO: 384542 - DNA, 23 bp, Homo sapiens
cttttctttgaaggatgactaca

SEQ ID NO: 384543 - DNA, 22 bp, Homo sapiens
cttttgaactgttagatgctga

SEQ ID NO: 384544 - DNA, 21 bp, Homo sapiens
cttttgaataaaaactttgct

SEQ ID NO: 384545 - DNA, 16 bp, Homo sapiens
cttttgaatcaaagaa

SEQ ID NO: 384546 - DNA, 17 bp, Homo sapiens
cttttgaatcaatctgg

SEQ ID NO: 384547 - DNA, 18 bp, Homo sapiens
cttttgaccccttcctgt

SEQ ID NO: 384548 - DNA, 23 bp, Homo sapiens
cttttgacggaaggacctatgtt

SEQ ID NO: 384549 - DNA, 18 bp, Homo sapiens
cttttgacttaaagcaga

SEQ ID NO: 384550 - DNA, 12 bp, Homo sapiens
cttttgaggctt

SEQ ID NO: 384551 - DNA, 21 bp, Homo sapiens
cttttgataaaatgttccttt

SEQ ID NO: 384552 - DNA, 15 bp, Homo sapiens
cttttgatacattta

SEQ ID NO: 384553 - DNA, 22 bp, Homo sapiens
cttttgatacatttatcttctg

SEQ ID NO: 384554 - DNA, 13 bp, Homo sapiens
gcccgtggatctg

SEQ ID NO: 384555 - DNA, 18 bp, Homo sapiens
gcccgtggatctgggcac

SEQ ID NO: 384556 - DNA, 13 bp, Homo sapiens
gcccgtgtggccc

SEQ ID NO: 384557 - DNA, 19 bp, Homo sapiens
gcccgttgccgggcctgga

SEQ ID NO: 384558 - DNA, 13 bp, Homo sapiens
gccctaagccact

SEQ ID NO: 384559 - DNA, 14 bp, Homo sapiens
gccctaagccactc

SEQ ID NO: 384560 - DNA, 21 bp, Homo sapiens
gccctacagaggtctctgccg

SEQ ID NO: 384561 - DNA, 20 bp, Homo sapiens
gccctaccagcgcccgctgg

SEQ ID NO: 384562 - DNA, 21 bp, Homo sapiens
gccctaccagcgcccgctggg

SEQ ID NO: 384563 - DNA, 15 bp, Homo sapiens
gccctagaccctccc

SEQ ID NO: 384564 - DNA, 16 bp, Homo sapiens
gccctagaccctcccc

SEQ ID NO: 384565 - DNA, 20 bp, Homo sapiens
gccctagaggcgagccaggc

SEQ ID NO: 384566 - DNA, 19 bp, Homo sapiens
gccctagcgctctcttcca

SEQ ID NO: 384567 - DNA, 20 bp, Homo sapiens
gccctaggattcctccccca

SEQ ID NO: 384568 - DNA, 21 bp, Homo sapiens
gccctaggcatactctccagg

SEQ ID NO: 384569 - DNA, 22 bp, Homo sapiens
gccctaggcatactctccagga

SEQ ID NO: 384570 - DNA, 14 bp, Homo sapiens
gccctaggctaccc

SEQ ID NO: 384571 - DNA, 12 bp, Homo sapiens
gccctaggctcc

SEQ ID NO: 384572 - DNA, 18 bp, Homo sapiens
gccctagtgggagcccag

SEQ ID NO: 384573 - DNA, 20 bp, Homo sapiens
gccctagtgggagcccagca

SEQ ID NO: 384574 - DNA, 20 bp, Homo sapiens
gccctataacccctgcctgg

SEQ ID NO: 384575 - DNA, 17 bp, Homo sapiens
gccctatttttgcaatg

SEQ ID NO: 384576 - DNA, 17 bp, Homo sapiens
gccctcaccacccactt

SEQ ID NO: 384577 - DNA, 11 bp, Homo sapiens
gccctcagagg

SEQ ID NO: 384578 - DNA, 21 bp, Homo sapiens
gccctcagtcagttcccggag

SEQ ID NO: 384579 - DNA, 23 bp, Homo sapiens
gccctcatcttgaagggcccagg

SEQ ID NO: 384580 - DNA, 17 bp, Homo sapiens
gccctccacatccctga

SEQ ID NO: 384581 - DNA, 23 bp, Homo sapiens
gccctccactgccctctgttcag

SEQ ID NO: 384582 - DNA, 15 bp, Homo sapiens
gccctccagagcagg

SEQ ID NO: 384583 - DNA, 20 bp, Homo sapiens
gccctccagagcaggagact

SEQ ID NO: 384584 - DNA, 14 bp, Homo sapiens
gccctccatgggct

SEQ ID NO: 384585 - DNA, 15 bp, Homo sapiens
gccctcccagctggt

SEQ ID NO: 384586 - DNA, 21 bp, Homo sapiens
gccctcccatgttgcatgcct

SEQ ID NO: 384587 - DNA, 22 bp, Homo sapiens
gccctcccatgttgcatgccta

SEQ ID NO: 384588 - DNA, 13 bp, Homo sapiens
gccctccccagag

SEQ ID NO: 384589 - DNA, 16 bp, Homo sapiens
gccctccccagagcac

SEQ ID NO: 384590 - DNA, 17 bp, Homo sapiens
gccctccccagagcact

SEQ ID NO: 384591 - DNA, 15 bp, Homo sapiens
gccctcccccacggc

SEQ ID NO: 384592 - DNA, 12 bp, Homo sapiens
gccctccccctc

SEQ ID NO: 384593 - DNA, 17 bp, Homo sapiens
gccctccccctcaacct

SEQ ID NO: 384594 - DNA, 10 bp, Homo sapiens
gccctccctc

SEQ ID NO: 384595 - DNA, 17 bp, Homo sapiens
gccctccctccctccac

SEQ ID NO: 384596 - DNA, 19 bp, Homo sapiens
gccctccctccctccacac

SEQ ID NO: 384597 - DNA, 15 bp, Homo sapiens
gccctccctctccca

SEQ ID NO: 384598 - DNA, 16 bp, Homo sapiens
gccctccctctcccag

SEQ ID NO: 384599 - DNA, 20 bp, Homo sapiens
gccctccctcttcccagcac

SEQ ID NO: 384600 - DNA, 21 bp, Homo sapiens
gccctccctgcccctcccttc

SEQ ID NO: 384601 - DNA, 13 bp, Homo sapiens
gccctccctgtct

SEQ ID NO: 384602 - DNA, 19 bp, Homo sapiens
gccctccctgtctccaggg

SEQ ID NO: 384603 - DNA, 22 bp, Homo sapiens
gccctccgcgggggacaggaac

SEQ ID NO: 384604 - DNA, 15 bp, Homo sapiens
gccctcctcgctgtg

SEQ ID NO: 384605 - DNA, 22 bp, Homo sapiens
gccctcctcgctgtgccaccac

SEQ ID NO: 384606 - DNA, 11 bp, Homo sapiens
gccctcctctg

SEQ ID NO: 384607 - DNA, 23 bp, Homo sapiens
gccctcctctgccccctcccccg

SEQ ID NO: 384608 - DNA, 14 bp, Homo sapiens
gccctcctgctggc

SEQ ID NO: 384609 - DNA, 18 bp, Homo sapiens
gccctcctgctggctgag

SEQ ID NO: 384610 - DNA, 20 bp, Homo sapiens
gccctccttcttgccctgag

SEQ ID NO: 384611 - DNA, 14 bp, Homo sapiens
gccctccttgccac

SEQ ID NO: 384612 - DNA, 21 bp, Homo sapiens
gccctcgaaccaaggcagcct

SEQ ID NO: 384613 - DNA, 15 bp, Homo sapiens
gccctcgctgcttct

SEQ ID NO: 384614 - DNA, 14 bp, Homo sapiens
gccctcggcctccg

SEQ ID NO: 384615 - DNA, 17 bp, Homo sapiens
gccctcgtctccctggc

SEQ ID NO: 384616 - DNA, 17 bp, Homo sapiens
gccctcgtggtggaaac

SEQ ID NO: 384617 - DNA, 14 bp, Homo sapiens
gccctctccacacc

SEQ ID NO: 384618 - DNA, 22 bp, Homo sapiens
gccctctgcccccagctgctcc

SEQ ID NO: 384619 - DNA, 21 bp, Homo sapiens
gccctctgccgaccgcctgct

SEQ ID NO: 384620 - DNA, 13 bp, Homo sapiens
gccctctgtgcct

SEQ ID NO: 384621 - DNA, 15 bp, Homo sapiens
gccctctgtgcctaa

SEQ ID NO: 384622 - DNA, 16 bp, Homo sapiens
gccctctgtgcctaat

SEQ ID NO: 384623 - DNA, 17 bp, Homo sapiens
gccctctgtgcctaata

SEQ ID NO: 384624 - DNA, 19 bp, Homo sapiens
gccctctgtgcctaataaa

SEQ ID NO: 384625 - DNA, 17 bp, Homo sapiens
gccctcttagtagggac

SEQ ID NO: 384626 - DNA, 16 bp, Homo sapiens
gccctctttctctctg

SEQ ID NO: 384627 - DNA, 17 bp, Homo sapiens
gccctctttctctctgt

SEQ ID NO: 384628 - DNA, 18 bp, Homo sapiens
gccctctttctctctgtg

SEQ ID NO: 384629 - DNA, 19 bp, Homo sapiens
gccctctttctctctgtgt

SEQ ID NO: 384630 - DNA, 22 bp, Homo sapiens
gccctctttctctctgtgtggc

SEQ ID NO: 384631 - DNA, 18 bp, Homo sapiens
gccgcccagacaccacag

SEQ ID NO: 384632 - DNA, 20 bp, Homo sapiens
gccgccccgccccagagctc

SEQ ID NO: 384633 - DNA, 18 bp, Homo sapiens
gccgcccgggcccagagg

SEQ ID NO: 384634 - DNA, 17 bp, Homo sapiens
gccgccggaagtggctc

SEQ ID NO: 384635 - DNA, 14 bp, Homo sapiens
gccgcctcccagcc

SEQ ID NO: 384636 - DNA, 15 bp, Homo sapiens
gccgcctcctccaga

SEQ ID NO: 384637 - DNA, 13 bp, Homo sapiens
gccgcctcgggcc

SEQ ID NO: 384638 - DNA, 22 bp, Homo sapiens
gccgcctcgggccgcctcctcc

SEQ ID NO: 384639 - DNA, 19 bp, Homo sapiens
gccgcctctggttccactc

SEQ ID NO: 384640 - DNA, 13 bp, Homo sapiens
gccgcctggcagg

SEQ ID NO: 384641 - DNA, 18 bp, Homo sapiens
gccgcctggggctccggt

SEQ ID NO: 384642 - DNA, 14 bp, Homo sapiens
gccgcctgtccttg

SEQ ID NO: 384643 - DNA, 22 bp, Homo sapiens
gccgcctgtgcccttgctgggt

SEQ ID NO: 384644 - DNA, 19 bp, Homo sapiens
gccgcgctctgcccctccg

SEQ ID NO: 384645 - DNA, 16 bp, Homo sapiens
gccgcgggcggccagg

SEQ ID NO: 384646 - DNA, 18 bp, Homo sapiens
gccgcgggcggccaggca

SEQ ID NO: 384647 - DNA, 16 bp, Homo sapiens
gccgctagaggcctga

SEQ ID NO: 384648 - DNA, 14 bp, Homo sapiens
gccgctcgatgcct

SEQ ID NO: 384649 - DNA, 21 bp, Homo sapiens
gccgctgggagaaaagccaga

SEQ ID NO: 384650 - DNA, 15 bp, Homo sapiens
gccggcaagcgagca

SEQ ID NO: 384651 - DNA, 21 bp, Homo sapiens
gccggcacagggtctgctctt

SEQ ID NO: 384652 - DNA, 13 bp, Homo sapiens
gccggcagcctgg

SEQ ID NO: 384653 - DNA, 17 bp, Homo sapiens
gccggcaggggcccctc

SEQ ID NO: 384654 - DNA, 14 bp, Homo sapiens
gccggccagctccc

SEQ ID NO: 384655 - DNA, 12 bp, Homo sapiens
gccggccccagg

SEQ ID NO: 384656 - DNA, 16 bp, Homo sapiens
gccggccccaggctcc

SEQ ID NO: 384657 - DNA, 23 bp, Homo sapiens
gccggccccaggctcccctggtc

SEQ ID NO: 384658 - DNA, 15 bp, Homo sapiens
gccggccccccctct

SEQ ID NO: 384659 - DNA, 14 bp, Homo sapiens
gccggcctggggcc

SEQ ID NO: 384660 - DNA, 17 bp, Homo sapiens
gccggccttggccttgg

SEQ ID NO: 384661 - DNA, 12 bp, Homo sapiens
gccggctggccg

SEQ ID NO: 384662 - DNA, 21 bp, Homo sapiens
gccggctggccggtccacccc

SEQ ID NO: 384663 - DNA, 13 bp, Homo sapiens
gccgggcacagct

SEQ ID NO: 384664 - DNA, 17 bp, Homo sapiens
gccgggcacagctgtgg

SEQ ID NO: 384665 - DNA, 19 bp, Homo sapiens
gccgggccgaatcccctcc

SEQ ID NO: 384666 - DNA, 14 bp, Homo sapiens
gccgggcctgggcc

SEQ ID NO: 384667 - DNA, 16 bp, Homo sapiens
gccgggcctgggcctc

SEQ ID NO: 384668 - DNA, 13 bp, Homo sapiens
gccgggcgcagtg

SEQ ID NO: 384669 - DNA, 23 bp, Homo sapiens
gccgggctttccagaaggccaca

SEQ ID NO: 384670 - DNA, 23 bp, Homo sapiens
gccggggaagacttgaaagaaag

SEQ ID NO: 384671 - DNA, 13 bp, Homo sapiens
gccggggctggcc

SEQ ID NO: 384672 - DNA, 21 bp, Homo sapiens
gccggggctggccctgccctc

SEQ ID NO: 384673 - DNA, 22 bp, Homo sapiens
gccgggggtgggggcctgctgt

SEQ ID NO: 384674 - DNA, 18 bp, Homo sapiens
gccgggttctagtctcct

SEQ ID NO: 384675 - DNA, 18 bp, Homo sapiens
gccgggttggaggcctca

SEQ ID NO: 384676 - DNA, 20 bp, Homo sapiens
gccgggttggaggcctcacc

SEQ ID NO: 384677 - DNA, 15 bp, Homo sapiens
gccggtcccccatgc

SEQ ID NO: 384678 - DNA, 20 bp, Homo sapiens
gccggtcccccatgccacca

SEQ ID NO: 384679 - DNA, 20 bp, Homo sapiens
gccggttgcagagaatctgt

SEQ ID NO: 384680 - DNA, 15 bp, Homo sapiens
gccggttggccggct

SEQ ID NO: 384681 - DNA, 17 bp, Homo sapiens
gccggtttgggagagac

SEQ ID NO: 384682 - DNA, 18 bp, Homo sapiens
gccgtcagccaaatgtaa

SEQ ID NO: 384683 - DNA, 14 bp, Homo sapiens
gccgtccatggcac

SEQ ID NO: 384684 - DNA, 17 bp, Homo sapiens
gccgtccatggcaccag

SEQ ID NO: 384685 - DNA, 15 bp, Homo sapiens
gccgtccctctgcct

SEQ ID NO: 384686 - DNA, 22 bp, Homo sapiens
gccgtccctgacttcccagctg

SEQ ID NO: 384687 - DNA, 18 bp, Homo sapiens
gccgtcctcccgggccct

SEQ ID NO: 384688 - DNA, 20 bp, Homo sapiens
gccgtcctcccgggccctcc

SEQ ID NO: 384689 - DNA, 16 bp, Homo sapiens
gccgtcctggactctg

SEQ ID NO: 384690 - DNA, 18 bp, Homo sapiens
gccgtctcatatttttac

SEQ ID NO: 384691 - DNA, 18 bp, Homo sapiens
gccgtctgactccagagt

SEQ ID NO: 384692 - DNA, 17 bp, Homo sapiens
gccagggtctcactgag

SEQ ID NO: 384693 - DNA, 15 bp, Homo sapiens
gccagggttccagac

SEQ ID NO: 384694 - DNA, 21 bp, Homo sapiens
gccaggtaatgtgaataaatt

SEQ ID NO: 384695 - DNA, 21 bp, Homo sapiens
gccaggtcaccctttgctgtg

SEQ ID NO: 384696 - DNA, 18 bp, Homo sapiens
gccaggtccctggaccag

SEQ ID NO: 384697 - DNA, 19 bp, Homo sapiens
gccaggtccctggaccagc

SEQ ID NO: 384698 - DNA, 22 bp, Homo sapiens
gccaggtggctcagtgccacct

SEQ ID NO: 384699 - DNA, 17 bp, Homo sapiens
gccaggttgcagctgct

SEQ ID NO: 384700 - DNA, 15 bp, Homo sapiens
gccaggttggaaaag

SEQ ID NO: 384701 - DNA, 18 bp, Homo sapiens
gccaggttgggggcagtg

SEQ ID NO: 384702 - DNA, 19 bp, Homo sapiens
gccagtaacgcgtcttcct

SEQ ID NO: 384703 - DNA, 22 bp, Homo sapiens
gccagtaacgcgtcttcctgag

SEQ ID NO: 384704 - DNA, 19 bp, Homo sapiens
gccagtaaggcagctctgt

SEQ ID NO: 384705 - DNA, 16 bp, Homo sapiens
gccagtcctgcctggc

SEQ ID NO: 384706 - DNA, 13 bp, Homo sapiens
gccagtctcccag

SEQ ID NO: 384707 - DNA, 15 bp, Homo sapiens
gccagtctgggctgc

SEQ ID NO: 384708 - DNA, 18 bp, Homo sapiens
gccagtgaagtccttcag

SEQ ID NO: 384709 - DNA, 21 bp, Homo sapiens
gccagtgaagtccttcagtga

SEQ ID NO: 384710 - DNA, 16 bp, Homo sapiens
gccagtgactccagga

SEQ ID NO: 384711 - DNA, 19 bp, Homo sapiens
gccagtgactttttctgag

SEQ ID NO: 384712 - DNA, 15 bp, Homo sapiens
gccagtgctggtcac

SEQ ID NO: 384713 - DNA, 12 bp, Homo sapiens
gccagtggacag

SEQ ID NO: 384714 - DNA, 17 bp, Homo sapiens
gccagtggacagaggga

SEQ ID NO: 384715 - DNA, 18 bp, Homo sapiens
gccagtggacagagggag

SEQ ID NO: 384716 - DNA, 18 bp, Homo sapiens
gccagtggccgaaccccc

SEQ ID NO: 384717 - DNA, 15 bp, Homo sapiens
gccagtggctggggg

SEQ ID NO: 384718 - DNA, 14 bp, Homo sapiens
gccagttggaacca

SEQ ID NO: 384719 - DNA, 15 bp, Homo sapiens
gccataacttgaaaa

SEQ ID NO: 384720 - DNA, 16 bp, Homo sapiens
gccataagcaggagtt

SEQ ID NO: 384721 - DNA, 15 bp, Homo sapiens
gccataccaggtgct

SEQ ID NO: 384722 - DNA, 14 bp, Homo sapiens
gccataccttgaga

SEQ ID NO: 384723 - DNA, 19 bp, Homo sapiens
gccataggagaggagggtt

SEQ ID NO: 384724 - DNA, 13 bp, Homo sapiens
gccatcagcccct

SEQ ID NO: 384725 - DNA, 20 bp, Homo sapiens
gccatcagcccctgctgctc

SEQ ID NO: 384726 - DNA, 21 bp, Homo sapiens
gccatcatcagcttaatttaa

SEQ ID NO: 384727 - DNA, 21 bp, Homo sapiens
gccatccaaataagaaaccta

SEQ ID NO: 384728 - DNA, 15 bp, Homo sapiens
gccatcgggtgccaa

SEQ ID NO: 384729 - DNA, 16 bp, Homo sapiens
gccatcgggtgccaaa

SEQ ID NO: 384730 - DNA, 19 bp, Homo sapiens
gccatctaatgcttgttta

SEQ ID NO: 384731 - DNA, 14 bp, Homo sapiens
gccatctgtaaata

SEQ ID NO: 384732 - DNA, 20 bp, Homo sapiens
gccatctgtaaatatcccag

SEQ ID NO: 384733 - DNA, 15 bp, Homo sapiens
gccatctgtgggcac

SEQ ID NO: 384734 - DNA, 20 bp, Homo sapiens
gccatcttcccgcctcagcc

SEQ ID NO: 384735 - DNA, 13 bp, Homo sapiens
gccatgaactttg

SEQ ID NO: 384736 - DNA, 15 bp, Homo sapiens
gccatgagctccaga

SEQ ID NO: 384737 - DNA, 16 bp, Homo sapiens
gccatgagctccagac

SEQ ID NO: 384738 - DNA, 22 bp, Homo sapiens
gccatgagctccagacccccag

SEQ ID NO: 384739 - DNA, 15 bp, Homo sapiens
gccatgatagctggg

SEQ ID NO: 384740 - DNA, 14 bp, Homo sapiens
gccatgatatcact

SEQ ID NO: 384741 - DNA, 15 bp, Homo sapiens
gccatgatgtggagt

SEQ ID NO: 384742 - DNA, 19 bp, Homo sapiens
gccatgattttggccactt

SEQ ID NO: 384743 - DNA, 21 bp, Homo sapiens
gccatgattttggccactttg

SEQ ID NO: 384744 - DNA, 15 bp, Homo sapiens
gccatgccactgcca

SEQ ID NO: 384745 - DNA, 16 bp, Homo sapiens
gccatgccactgccag

SEQ ID NO: 384746 - DNA, 20 bp, Homo sapiens
gccatgccactgccaggcac

SEQ ID NO: 384747 - DNA, 15 bp, Homo sapiens
gccatgcctcatgcc

SEQ ID NO: 384748 - DNA, 19 bp, Homo sapiens
gccatgctgctatgaagac

SEQ ID NO: 384749 - DNA, 16 bp, Homo sapiens
gccatggaagctggca

SEQ ID NO: 384750 - DNA, 17 bp, Homo sapiens
gccatggaataaaccat

SEQ ID NO: 384751 - DNA, 15 bp, Homo sapiens
gccatggaggcacac

SEQ ID NO: 384752 - DNA, 21 bp, Homo sapiens
gccatggcctgtgctgggcca

SEQ ID NO: 384753 - DNA, 18 bp, Homo sapiens
gccatggctcaggcaagc

SEQ ID NO: 384754 - DNA, 20 bp, Homo sapiens
gccatggctcaggcaagccc

SEQ ID NO: 384755 - DNA, 18 bp, Homo sapiens
gccatggctttcatcctg

SEQ ID NO: 384756 - DNA, 12 bp, Homo sapiens
gccatgggcctg

SEQ ID NO: 384757 - DNA, 13 bp, Homo sapiens
gccatgggcctgg

SEQ ID NO: 384758 - DNA, 21 bp, Homo sapiens
gccatgggcctgggcctgctt

SEQ ID NO: 384759 - DNA, 17 bp, Homo sapiens
gccatgggggcccctcg

SEQ ID NO: 384760 - DNA, 22 bp, Homo sapiens
gccatggtgggagagactgtga

SEQ ID NO: 384761 - DNA, 20 bp, Homo sapiens
gccatgtgagccaccgctgc

SEQ ID NO: 384762 - DNA, 22 bp, Homo sapiens
gccattagactgaatttaacta

SEQ ID NO: 384763 - DNA, 18 bp, Homo sapiens
gccattcactgcccccag

SEQ ID NO: 384764 - DNA, 18 bp, Homo sapiens
gccattcatctgggctgg

SEQ ID NO: 384765 - DNA, 20 bp, Homo sapiens
gccattcatctgggctggca

SEQ ID NO: 384766 - DNA, 22 bp, Homo sapiens
gccattccaagtcaacactctt

SEQ ID NO: 384767 - DNA, 12 bp, Homo sapiens
gccattcccact

SEQ ID NO: 384768 - DNA, 13 bp, Homo sapiens
gccattcccagcg

SEQ ID NO: 384769 - DNA, 16 bp, Homo sapiens
gccattccgaccttca

SEQ ID NO: 384770 - DNA, 15 bp, Homo sapiens
gccattcctgttctc

SEQ ID NO: 384771 - DNA, 20 bp, Homo sapiens
gccattctcctgcctcagcc

SEQ ID NO: 384772 - DNA, 21 bp, Homo sapiens
gccattgtactccagcctggg

SEQ ID NO: 384773 - DNA, 21 bp, Homo sapiens
gccatttatgtgagtgtgtgt

SEQ ID NO: 384774 - DNA, 20 bp, Homo sapiens
gccattttgtctggctgtgg

SEQ ID NO: 384775 - DNA, 16 bp, Homo sapiens
gcccaaagccagacag

SEQ ID NO: 384776 - DNA, 17 bp, Homo sapiens
gcccaaagccagacagc

SEQ ID NO: 384777 - DNA, 12 bp, Homo sapiens
gcccaaagctgg

SEQ ID NO: 384778 - DNA, 16 bp, Homo sapiens
gcccaaatcccctccc

SEQ ID NO: 384779 - DNA, 20 bp, Homo sapiens
gcccaaattatcaagctaat

SEQ ID NO: 384780 - DNA, 21 bp, Homo sapiens
gcccaaattatcaagctaata

SEQ ID NO: 384781 - DNA, 23 bp, Homo sapiens
gcccaaattatcaagctaataaa

SEQ ID NO: 384782 - DNA, 15 bp, Homo sapiens
gcccaaccaggaggg

SEQ ID NO: 384783 - DNA, 14 bp, Homo sapiens
gcccaacccccacc

SEQ ID NO: 384784 - DNA, 17 bp, Homo sapiens
gcccaacccccacctcc

SEQ ID NO: 384785 - DNA, 18 bp, Homo sapiens
gcccaacccccacctccc

SEQ ID NO: 384786 - DNA, 18 bp, Homo sapiens
gcccaaccgggaaaggca

SEQ ID NO: 384787 - DNA, 22 bp, Homo sapiens
gcccaagaatagatgctgactg

SEQ ID NO: 384788 - DNA, 23 bp, Homo sapiens
gcccaagacagatgccccagagc

SEQ ID NO: 384789 - DNA, 17 bp, Homo sapiens
gcccaagcatgccccac

SEQ ID NO: 384790 - DNA, 20 bp, Homo sapiens
gcccaagcccgacttgctgt

SEQ ID NO: 384791 - DNA, 12 bp, Homo sapiens
gcccaagctctt

SEQ ID NO: 384792 - DNA, 20 bp, Homo sapiens
gcccaagcttaatagccctc

SEQ ID NO: 384793 - DNA, 21 bp, Homo sapiens
gcccaagcttaatagccctcc

SEQ ID NO: 384794 - DNA, 22 bp, Homo sapiens
gcccaagggcctcccaccagag

SEQ ID NO: 384795 - DNA, 10 bp, Homo sapiens
gcccaataaa

SEQ ID NO: 384796 - DNA, 19 bp, Homo sapiens
gcccaatatgcagttctgc

SEQ ID NO: 384797 - DNA, 15 bp, Homo sapiens
gcccaatcactgcct

SEQ ID NO: 384798 - DNA, 19 bp, Homo sapiens
gcccacaataatgaataat

SEQ ID NO: 384799 - DNA, 13 bp, Homo sapiens
gcccacacacccc

SEQ ID NO: 384800 - DNA, 17 bp, Homo sapiens
caaggaggtagagaggg

SEQ ID NO: 384801 - DNA, 18 bp, Homo sapiens
caaggaggtcccaggaag

SEQ ID NO: 384802 - DNA, 18 bp, Homo sapiens
caaggagtaagtacaaat

SEQ ID NO: 384803 - DNA, 16 bp, Homo sapiens
caaggatcctctccac

SEQ ID NO: 384804 - DNA, 18 bp, Homo sapiens
caaggatgaaagacaaag

SEQ ID NO: 384805 - DNA, 19 bp, Homo sapiens
caaggatgaaagacaaaga

SEQ ID NO: 384806 - DNA, 21 bp, Homo sapiens
caaggatgaaagacaaagaag

SEQ ID NO: 384807 - DNA, 23 bp, Homo sapiens
caaggatgaaagacaaagaagga

SEQ ID NO: 384808 - DNA, 17 bp, Homo sapiens
caaggcaaggctgtcaa

SEQ ID NO: 384809 - DNA, 18 bp, Homo sapiens
caaggcaaggggtgcctg

SEQ ID NO: 384810 - DNA, 20 bp, Homo sapiens
caaggcaaggggtgcctggg

SEQ ID NO: 384811 - DNA, 17 bp, Homo sapiens
caaggcacaggctcctg

SEQ ID NO: 384812 - DNA, 16 bp, Homo sapiens
caaggcactgtactag

SEQ ID NO: 384813 - DNA, 16 bp, Homo sapiens
caaggcagcctccaga

SEQ ID NO: 384814 - DNA, 23 bp, Homo sapiens
caaggcaggtagatcgcttgagc

SEQ ID NO: 384815 - DNA, 14 bp, Homo sapiens
caaggccccagaga

SEQ ID NO: 384816 - DNA, 17 bp, Homo sapiens
caaggccccagagactc

SEQ ID NO: 384817 - DNA, 14 bp, Homo sapiens
caaggccgcccacc

SEQ ID NO: 384818 - DNA, 23 bp, Homo sapiens
caaggccgcccacctgcatcagc

SEQ ID NO: 384819 - DNA, 21 bp, Homo sapiens
caaggcctatgccacctgcag

SEQ ID NO: 384820 - DNA, 13 bp, Homo sapiens
caaggcctcagga

SEQ ID NO: 384821 - DNA, 18 bp, Homo sapiens
caaggcctcaggagagca

SEQ ID NO: 384822 - DNA, 16 bp, Homo sapiens
caaggcctgtccctgg

SEQ ID NO: 384823 - DNA, 17 bp, Homo sapiens
caaggcctgtccctggc

SEQ ID NO: 384824 - DNA, 16 bp, Homo sapiens
caaggcctgtgctgca

SEQ ID NO: 384825 - DNA, 17 bp, Homo sapiens
caaggctctcccctctc

SEQ ID NO: 384826 - DNA, 14 bp, Homo sapiens
caaggctgaaaagt

SEQ ID NO: 384827 - DNA, 17 bp, Homo sapiens
caaggctgccggctgca

SEQ ID NO: 384828 - DNA, 13 bp, Homo sapiens
caaggctgcctgg

SEQ ID NO: 384829 - DNA, 14 bp, Homo sapiens
caaggctgcctgga

SEQ ID NO: 384830 - DNA, 18 bp, Homo sapiens
caaggctgcggtttgttg

SEQ ID NO: 384831 - DNA, 13 bp, Homo sapiens
caaggctggccag

SEQ ID NO: 384832 - DNA, 23 bp, Homo sapiens
caaggctggccagcaaggcaggt

SEQ ID NO: 384833 - DNA, 13 bp, Homo sapiens
caagggaagagat

SEQ ID NO: 384834 - DNA, 14 bp, Homo sapiens
caagggagagacct

SEQ ID NO: 384835 - DNA, 15 bp, Homo sapiens
caagggagagacctc

SEQ ID NO: 384836 - DNA, 19 bp, Homo sapiens
caagggagagacctcatca

SEQ ID NO: 384837 - DNA, 20 bp, Homo sapiens
caagggagagacctcatcag

SEQ ID NO: 384838 - DNA, 22 bp, Homo sapiens
caagggatgaattgtaaaagca

SEQ ID NO: 384839 - DNA, 12 bp, Homo sapiens
caagggattctg

SEQ ID NO: 384840 - DNA, 15 bp, Homo sapiens
caagggattctggga

SEQ ID NO: 384841 - DNA, 13 bp, Homo sapiens
caagggcaggttg

SEQ ID NO: 384842 - DNA, 19 bp, Homo sapiens
caagggctccagcatccag

SEQ ID NO: 384843 - DNA, 23 bp, Homo sapiens
caagggctccagcatccagcctg

SEQ ID NO: 384844 - DNA, 21 bp, Homo sapiens
caaggggacccataggaaatc

SEQ ID NO: 384845 - DNA, 18 bp, Homo sapiens
caaggggcagtctggagg

SEQ ID NO: 384846 - DNA, 18 bp, Homo sapiens
caagggtatgggaagcca

SEQ ID NO: 384847 - DNA, 22 bp, Homo sapiens
caagggtcctacggagggacca

SEQ ID NO: 384848 - DNA, 15 bp, Homo sapiens
caagggttgcttctg

SEQ ID NO: 384849 - DNA, 22 bp, Homo sapiens
caaggtaatttcttgtgcctct

SEQ ID NO: 384850 - DNA, 16 bp, Homo sapiens
caaggtagccctggcc

SEQ ID NO: 384851 - DNA, 21 bp, Homo sapiens
caaggtagccctggccagagg

SEQ ID NO: 384852 - DNA, 14 bp, Homo sapiens
caaggtcaccaaac

SEQ ID NO: 384853 - DNA, 20 bp, Homo sapiens
caaggtccactccctgctcc

SEQ ID NO: 384854 - DNA, 18 bp, Homo sapiens
caaggtcccctccacatc

SEQ ID NO: 384855 - DNA, 15 bp, Homo sapiens
caaggtccgagctct

SEQ ID NO: 384856 - DNA, 23 bp, Homo sapiens
caaggtctccttactctgagccc

SEQ ID NO: 384857 - DNA, 16 bp, Homo sapiens
caaggtgataggaaaa

SEQ ID NO: 384858 - DNA, 22 bp, Homo sapiens
caaggtgataggaaaactgaat

SEQ ID NO: 384859 - DNA, 21 bp, Homo sapiens
caaggtgcggaccggagcggc

SEQ ID NO: 384860 - DNA, 17 bp, Homo sapiens
caaggtggccaaattat

SEQ ID NO: 384861 - DNA, 19 bp, Homo sapiens
caaggtggccaaattattt

SEQ ID NO: 384862 - DNA, 21 bp, Homo sapiens
caaggtgggcagggaggcacc

SEQ ID NO: 384863 - DNA, 18 bp, Homo sapiens
caaggtgggggagcctgg

SEQ ID NO: 384864 - DNA, 19 bp, Homo sapiens
caaggtgggggagcctgga

SEQ ID NO: 384865 - DNA, 15 bp, Homo sapiens
caaggtgtgcagtgg

SEQ ID NO: 384866 - DNA, 17 bp, Homo sapiens
caaggtgtgcagtggcc

SEQ ID NO: 384867 - DNA, 16 bp, Homo sapiens
caaggttttggagtca

SEQ ID NO: 384868 - DNA, 23 bp, Homo sapiens
caagtaaatagcaacatgcttca

SEQ ID NO: 384869 - DNA, 18 bp, Homo sapiens
caagtaagaagacatgaa

SEQ ID NO: 384870 - DNA, 22 bp, Homo sapiens
caagtaatccacctgcctcggc

SEQ ID NO: 384871 - DNA, 15 bp, Homo sapiens
caagtaatgaatttt

SEQ ID NO: 384872 - DNA, 23 bp, Homo sapiens
caagtacagccttcactggagac

SEQ ID NO: 384873 - DNA, 16 bp, Homo sapiens
caagtaccaaagtttt

SEQ ID NO: 384874 - DNA, 20 bp, Homo sapiens
caagtagatgcctgaacttg

SEQ ID NO: 384875 - DNA, 13 bp, Homo sapiens
caagtaggagaca

SEQ ID NO: 384876 - DNA, 18 bp, Homo sapiens
caagtatatttatttcta

SEQ ID NO: 384877 - DNA, 20 bp, Homo sapiens
caagtatatttatttctagc

SEQ ID NO: 384878 - DNA, 19 bp, Homo sapiens
caagtatgaataaagacac

SEQ ID NO: 384879 - DNA, 20 bp, Homo sapiens
caagtattaggggtaatata

SEQ ID NO: 384880 - DNA, 17 bp, Homo sapiens
caagtcaacactcttct

SEQ ID NO: 384881 - DNA, 17 bp, Homo sapiens
caagtcaatcatttctc

SEQ ID NO: 384882 - DNA, 15 bp, Homo sapiens
caagtcacagctgca

SEQ ID NO: 384883 - DNA, 12 bp, Homo sapiens
caagtcactaaa

SEQ ID NO: 384884 - DNA, 17 bp, Homo sapiens
caagtcatgtgcatttc

SEQ ID NO: 384885 - DNA, 20 bp, Homo sapiens
caagtccaacctgcctgtgc

SEQ ID NO: 384886 - DNA, 17 bp, Homo sapiens
caagtcccagacaagga

SEQ ID NO: 384887 - DNA, 21 bp, Homo sapiens
caagtcccgaggcagcaacag

SEQ ID NO: 384888 - DNA, 15 bp, Homo sapiens
caagtcctccctctc

SEQ ID NO: 384889 - DNA, 24 bp, Homo sapiens
caagtcctccctctctactggagt

SEQ ID NO: 384890 - DNA, 15 bp, Homo sapiens
caagtcctgcctttg

SEQ ID NO: 384891 - DNA, 12 bp, Homo sapiens
caagtcctggct

SEQ ID NO: 384892 - DNA, 13 bp, Homo sapiens
caagtcctggcta

SEQ ID NO: 384893 - DNA, 15 bp, Homo sapiens
caagtcctgtgaatt

SEQ ID NO: 384894 - DNA, 18 bp, Homo sapiens
caagtcctgtgaatttct

SEQ ID NO: 384895 - DNA, 22 bp, Homo sapiens
caagtccttacctcttccggag

SEQ ID NO: 384896 - DNA, 15 bp, Homo sapiens
caagtctcaggagga

SEQ ID NO: 384897 - DNA, 18 bp, Homo sapiens
caagtctctgctggccca

SEQ ID NO: 384898 - DNA, 23 bp, Homo sapiens
caagtctctgctggcccagccaa

SEQ ID NO: 384899 - DNA, 20 bp, Homo sapiens
caagtgacccagctcttctc

SEQ ID NO: 384900 - DNA, 16 bp, Homo sapiens
caagtgagcaaacctg

SEQ ID NO: 384901 - DNA, 18 bp, Homo sapiens
caagtgaggcaagagaaa

SEQ ID NO: 384902 - DNA, 10 bp, Homo sapiens
caagtgagtg

SEQ ID NO: 384903 - DNA, 21 bp, Homo sapiens
caagtgattctcctgcctcag

SEQ ID NO: 384904 - DNA, 22 bp, Homo sapiens
caagtgattctcctgcctcagc

SEQ ID NO: 384905 - DNA, 20 bp, Homo sapiens
caagtgattgacaactgaag

SEQ ID NO: 384906 - DNA, 22 bp, Homo sapiens
caagtgattgacaactgaagag

SEQ ID NO: 384907 - DNA, 20 bp, Homo sapiens
caagtgcaggctggcaccgc

SEQ ID NO: 384908 - DNA, 22 bp, Homo sapiens
caagtgccactgcccgagctgg

SEQ ID NO: 384909 - DNA, 13 bp, Homo sapiens
caagtgccttaat

SEQ ID NO: 384910 - DNA, 17 bp, Homo sapiens
caagtgctgaacagtgg

SEQ ID NO: 384911 - DNA, 19 bp, Homo sapiens
caagtggctaagtgtccat

SEQ ID NO: 384912 - DNA, 11 bp, Homo sapiens
caagtgtacag

SEQ ID NO: 384913 - DNA, 22 bp, Homo sapiens
tacataatgcttaatttctaaa

SEQ ID NO: 384914 - DNA, 14 bp, Homo sapiens
tacataattaaatt

SEQ ID NO: 384915 - DNA, 19 bp, Homo sapiens
tacataattttttattcaa

SEQ ID NO: 384916 - DNA, 13 bp, Homo sapiens
tacatacattgta

SEQ ID NO: 384917 - DNA, 14 bp, Homo sapiens
tacatacctctctc

SEQ ID NO: 384918 - DNA, 14 bp, Homo sapiens
tacatacttctttc

SEQ ID NO: 384919 - DNA, 17 bp, Homo sapiens
tacatacttctttcaag

SEQ ID NO: 384920 - DNA, 14 bp, Homo sapiens
tacatagagctcta

SEQ ID NO: 384921 - DNA, 19 bp, Homo sapiens
tacatagtctttgtttaca

SEQ ID NO: 384922 - DNA, 15 bp, Homo sapiens
tacatagtgaatttt

SEQ ID NO: 384923 - DNA, 15 bp, Homo sapiens
tacatagttttaaac

SEQ ID NO: 384924 - DNA, 16 bp, Homo sapiens
tactatttaactgact

SEQ ID NO: 384925 - DNA, 21 bp, Homo sapiens
tactattttgctccttttctg

SEQ ID NO: 384926 - DNA, 15 bp, Homo sapiens
tactcacagtctctt

SEQ ID NO: 384927 - DNA, 12 bp, Homo sapiens
tactcacctcct

SEQ ID NO: 384928 - DNA, 24 bp, Homo sapiens
tactcaccttgaacaccacgcttg

SEQ ID NO: 384929 - DNA, 12 bp, Homo sapiens
tactcagagcag

SEQ ID NO: 384930 - DNA, 17 bp, Homo sapiens
tactcaggagactgagt

SEQ ID NO: 384931 - DNA, 15 bp, Homo sapiens
tactcagggattcct

SEQ ID NO: 384932 - DNA, 22 bp, Homo sapiens
tactcataaggcatatacaaat

SEQ ID NO: 384933 - DNA, 19 bp, Homo sapiens
tactccactgacctggaag

SEQ ID NO: 384934 - DNA, 19 bp, Homo sapiens
tactcccccagccctcagt

SEQ ID NO: 384935 - DNA, 17 bp, Homo sapiens
tactcccttcctggcct

SEQ ID NO: 384936 - DNA, 18 bp, Homo sapiens
tactcccttcctggcctc

SEQ ID NO: 384937 - DNA, 21 bp, Homo sapiens
tactcctctgcagtgccttgg

SEQ ID NO: 384938 - DNA, 22 bp, Homo sapiens
tactccttaagaacacaaagcg

SEQ ID NO: 384939 - DNA, 18 bp, Homo sapiens
tactcgagttacagacaa

SEQ ID NO: 384940 - DNA, 16 bp, Homo sapiens
tactctacgccaaagt

SEQ ID NO: 384941 - DNA, 22 bp, Homo sapiens
tactctagcctgggccagagaa

SEQ ID NO: 384942 - DNA, 15 bp, Homo sapiens
tactctatgtgattt

SEQ ID NO: 384943 - DNA, 17 bp, Homo sapiens
tactctatgtgatttat

SEQ ID NO: 384944 - DNA, 14 bp, Homo sapiens
tactctcctcatct

SEQ ID NO: 384945 - DNA, 19 bp, Homo sapiens
tactctcctcggccccctc

SEQ ID NO: 384946 - DNA, 16 bp, Homo sapiens
tactctctgctctagc

SEQ ID NO: 384947 - DNA, 16 bp, Homo sapiens
tactctcttgccagca

SEQ ID NO: 384948 - DNA, 11 bp, Homo sapiens
tactctgagcc

SEQ ID NO: 384949 - DNA, 20 bp, Homo sapiens
tatatgaataattatgttta

SEQ ID NO: 384950 - DNA, 19 bp, Homo sapiens
tatatgacttcttgttcat

SEQ ID NO: 384951 - DNA, 13 bp, Homo sapiens
tatatgatatgca

SEQ ID NO: 384952 - DNA, 14 bp, Homo sapiens
tatatgatatgcat

SEQ ID NO: 384953 - DNA, 21 bp, Homo sapiens
tatatgatttatagtttgtac

SEQ ID NO: 384954 - DNA, 11 bp, Homo sapiens
tatatgtacag

SEQ ID NO: 384955 - DNA, 12 bp, Homo sapiens
tatatgtacagt

SEQ ID NO: 384956 - DNA, 20 bp, Homo sapiens
tatatgtacagttatacata

SEQ ID NO: 384957 - DNA, 14 bp, Homo sapiens
tatatgtatgtagt

SEQ ID NO: 384958 - DNA, 14 bp, Homo sapiens
tatatgttgtaata

SEQ ID NO: 384959 - DNA, 22 bp, Homo sapiens
tatatgtttggctgaaattatg

SEQ ID NO: 384960 - DNA, 19 bp, Homo sapiens
tatattaaaaatataaaca

SEQ ID NO: 384961 - DNA, 21 bp, Homo sapiens
tatattaccagcaagaataaa

SEQ ID NO: 384962 - DNA, 19 bp, Homo sapiens
tatattacttttgtaaata

SEQ ID NO: 384963 - DNA, 17 bp, Homo sapiens
tatattataataatgtt

SEQ ID NO: 384964 - DNA, 23 bp, Homo sapiens
tatattataataatgttctctgg

SEQ ID NO: 384965 - DNA, 12 bp, Homo sapiens
tatattatatat

SEQ ID NO: 384966 - DNA, 16 bp, Homo sapiens
tatattatcttctggt

SEQ ID NO: 384967 - DNA, 17 bp, Homo sapiens
tatattatcttctggtg

SEQ ID NO: 384968 - DNA, 23 bp, Homo sapiens
tatattcatcaaataaaccttgt

SEQ ID NO: 384969 - DNA, 21 bp, Homo sapiens
tatattcatctattttctcag

SEQ ID NO: 384970 - DNA, 13 bp, Homo sapiens
tatattcattctt

SEQ ID NO: 384971 - DNA, 16 bp, Homo sapiens
tatattgccagtatat

SEQ ID NO: 384972 - DNA, 15 bp, Homo sapiens
tatatttaattatta

SEQ ID NO: 384973 - DNA, 14 bp, Homo sapiens
tatatttataactc

SEQ ID NO: 384974 - DNA, 23 bp, Homo sapiens
tatatttataactcatcataaaa

SEQ ID NO: 384975 - DNA, 18 bp, Homo sapiens
tatatttatataattatg

SEQ ID NO: 384976 - DNA, 12 bp, Homo sapiens
tatatttatttc

SEQ ID NO: 384977 - DNA, 16 bp, Homo sapiens
tatatttcctcttctg

SEQ ID NO: 384978 - DNA, 14 bp, Homo sapiens
tatatttgaaactg

SEQ ID NO: 384979 - DNA, 14 bp, Homo sapiens
tatatttgcttttt

SEQ ID NO: 384980 - DNA, 14 bp, Homo sapiens
tatatttgtaactt

SEQ ID NO: 384981 - DNA, 18 bp, Homo sapiens
tatatttgtccagataat

SEQ ID NO: 384982 - DNA, 22 bp, Homo sapiens
tatattttatactgcactttag

SEQ ID NO: 384983 - DNA, 13 bp, Homo sapiens
tatattttatctt

SEQ ID NO: 384984 - DNA, 13 bp, Homo sapiens
tatatttttatat

SEQ ID NO: 384985 - DNA, 20 bp, Homo sapiens
tatatttttatatttagtta

SEQ ID NO: 384986 - DNA, 17 bp, Homo sapiens
tatatttttgtttgttt

SEQ ID NO: 384987 - DNA, 13 bp, Homo sapiens
tatattttttaca

SEQ ID NO: 384988 - DNA, 21 bp, Homo sapiens
tatcaaaaaaagactcagcca

SEQ ID NO: 384989 - DNA, 18 bp, Homo sapiens
tatcaaaaagtataaatt

SEQ ID NO: 384990 - DNA, 19 bp, Homo sapiens
tatcaaaactttcttttct

SEQ ID NO: 384991 - DNA, 18 bp, Homo sapiens
tatcaaacagctcaggct

SEQ ID NO: 384992 - DNA, 12 bp, Homo sapiens
tatcaaaggcag

SEQ ID NO: 384993 - DNA, 15 bp, Homo sapiens
tatcaaaggcagaaa

SEQ ID NO: 384994 - DNA, 22 bp, Homo sapiens
tatcaacatctttttcctccct

SEQ ID NO: 384995 - DNA, 17 bp, Homo sapiens
tatcaacccagaaacac

SEQ ID NO: 384996 - DNA, 23 bp, Homo sapiens
tatcaagaagtcagagaaaacac

SEQ ID NO: 384997 - DNA, 21 bp, Homo sapiens
tatcaagcagagacctttgtt

SEQ ID NO: 384998 - DNA, 23 bp, Homo sapiens
tatcaagccagtacgtgctaaca

SEQ ID NO: 384999 - DNA, 19 bp, Homo sapiens
tatcaaggatgttctggct

SEQ ID NO: 385000 - DNA, 17 bp, Homo sapiens
tatcaaggctgcctgga

SEQ ID NO: 385001 - DNA, 21 bp, Homo sapiens
tatcaaggtcgtttttttcat

SEQ ID NO: 385002 - DNA, 17 bp, Homo sapiens
tatcaagtcaatcattt

SEQ ID NO: 385003 - DNA, 17 bp, Homo sapiens
tatcaagtcccgaggca

SEQ ID NO: 385004 - DNA, 18 bp, Homo sapiens
tatcaagtcccgaggcag

SEQ ID NO: 385005 - DNA, 18 bp, Homo sapiens
tatcaagtggcatgtgct

SEQ ID NO: 385006 - DNA, 14 bp, Homo sapiens
tatcaagtgtcttc

SEQ ID NO: 385007 - DNA, 13 bp, Homo sapiens
tatcaataaagca

SEQ ID NO: 385008 - DNA, 15 bp, Homo sapiens
tatcaataaagcact

SEQ ID NO: 385009 - DNA, 21 bp, Homo sapiens
tatcacacactttctgactgc

SEQ ID NO: 385010 - DNA, 14 bp, Homo sapiens
tatcacctcatggc

SEQ ID NO: 385011 - DNA, 13 bp, Homo sapiens
tatcacctcccct

SEQ ID NO: 385012 - DNA, 13 bp, Homo sapiens
tatcacctgtcat

SEQ ID NO: 385013 - DNA, 14 bp, Homo sapiens
tatcacctttccca

SEQ ID NO: 385014 - DNA, 19 bp, Homo sapiens
tatcactaataaagtctgt

SEQ ID NO: 385015 - DNA, 17 bp, Homo sapiens
tattactgttgcattta

SEQ ID NO: 385016 - DNA, 22 bp, Homo sapiens
tattactgttgcatttactttt

SEQ ID NO: 385017 - DNA, 17 bp, Homo sapiens
tattactttaacatgcc

SEQ ID NO: 385018 - DNA, 17 bp, Homo sapiens
tattacttttctgcaat

SEQ ID NO: 385019 - DNA, 14 bp, Homo sapiens
tattacttttgtaa

SEQ ID NO: 385020 - DNA, 15 bp, Homo sapiens
tattacttttgtaaa

SEQ ID NO: 385021 - DNA, 19 bp, Homo sapiens
tattacttttgtaaatatt

SEQ ID NO: 385022 - DNA, 21 bp, Homo sapiens
tattagagtgcccttaaaata

SEQ ID NO: 385023 - DNA, 18 bp, Homo sapiens
tattagccagtcattgta

SEQ ID NO: 385024 - DNA, 22 bp, Homo sapiens
tattagcccttctccatggccc

SEQ ID NO: 385025 - DNA, 17 bp, Homo sapiens
tattagtattattaaca

SEQ ID NO: 385026 - DNA, 22 bp, Homo sapiens
tattagttccctgtctcttgaa

SEQ ID NO: 385027 - DNA, 17 bp, Homo sapiens
tattataaaaatatcaa

SEQ ID NO: 385028 - DNA, 21 bp, Homo sapiens
tattataagcattgaaattat

SEQ ID NO: 385029 - DNA, 18 bp, Homo sapiens
tattataagttgaccttt

SEQ ID NO: 385030 - DNA, 21 bp, Homo sapiens
tattataagttgacctttatt

SEQ ID NO: 385031 - DNA, 15 bp, Homo sapiens
tattatagatataaa

SEQ ID NO: 385032 - DNA, 18 bp, Homo sapiens
tattatcagtgaatataa

SEQ ID NO: 385033 - DNA, 19 bp, Homo sapiens
tattatcagtgaatataaa

SEQ ID NO: 385034 - DNA, 15 bp, Homo sapiens
tattatctagtaggt

SEQ ID NO: 385035 - DNA, 19 bp, Homo sapiens
tattatgaggctattaaaa

SEQ ID NO: 385036 - DNA, 20 bp, Homo sapiens
tattatgaggctattaaaag

SEQ ID NO: 385037 - DNA, 15 bp, Homo sapiens
tattatgtagctgaa

SEQ ID NO: 385038 - DNA, 19 bp, Homo sapiens
tattattaaatcagttttg

SEQ ID NO: 385039 - DNA, 21 bp, Homo sapiens
tattattactttttaaaatgt

SEQ ID NO: 385040 - DNA, 13 bp, Homo sapiens
tattattctgcag

SEQ ID NO: 385041 - DNA, 15 bp, Homo sapiens
tattatttgaatgga

SEQ ID NO: 385042 - DNA, 15 bp, Homo sapiens
tattattttcacctg

SEQ ID NO: 385043 - DNA, 19 bp, Homo sapiens
tattcaactaatacatggt

SEQ ID NO: 385044 - DNA, 20 bp, Homo sapiens
tattcacatatgtcttacta

SEQ ID NO: 385045 - DNA, 13 bp, Homo sapiens
tattcaccaccct

SEQ ID NO: 385046 - DNA, 16 bp, Homo sapiens
tattcaccatcatgta

SEQ ID NO: 385047 - DNA, 19 bp, Homo sapiens
tattcaccatgtaaaacaa

SEQ ID NO: 385048 - DNA, 20 bp, Homo sapiens
tattcactctcccagaggct

SEQ ID NO: 385049 - DNA, 20 bp, Homo sapiens
tattcagaacttgtaactaa

SEQ ID NO: 385050 - DNA, 22 bp, Homo sapiens
tattcagacaagcaacaggttt

SEQ ID NO: 385051 - DNA, 17 bp, Homo sapiens
tattcagagatgtacca

SEQ ID NO: 385052 - DNA, 19 bp, Homo sapiens
tattcagagatgtaccatg

SEQ ID NO: 385053 - DNA, 12 bp, Homo sapiens
tattcagagcca

SEQ ID NO: 385054 - DNA, 21 bp, Homo sapiens
tattcagcttcatttgtgtca

SEQ ID NO: 385055 - DNA, 16 bp, Homo sapiens
tattcaggagagtaga

SEQ ID NO: 385056 - DNA, 18 bp, Homo sapiens
tattcatcaaataaacct

SEQ ID NO: 385057 - DNA, 19 bp, Homo sapiens
tattcatctattttctcag

SEQ ID NO: 385058 - DNA, 19 bp, Homo sapiens
tattcatgctttctccttt

SEQ ID NO: 385059 - DNA, 20 bp, Homo sapiens
tattcatgctttctcctttt

SEQ ID NO: 385060 - DNA, 13 bp, Homo sapiens
tattcatttaaaa

SEQ ID NO: 385061 - DNA, 15 bp, Homo sapiens
tattcatttaaaatg

SEQ ID NO: 385062 - DNA, 17 bp, Homo sapiens
tattccagcgtcttcta

SEQ ID NO: 385063 - DNA, 18 bp, Homo sapiens
tattccatccatatactt

SEQ ID NO: 385064 - DNA, 15 bp, Homo sapiens
tattcccaggcaggg

SEQ ID NO: 385065 - DNA, 21 bp, Homo sapiens
tattcccatggtagactgtga

SEQ ID NO: 385066 - DNA, 22 bp, Homo sapiens
tattcccctatctctagaattt

SEQ ID NO: 385067 - DNA, 18 bp, Homo sapiens
tattccctttgacttcag

SEQ ID NO: 385068 - DNA, 17 bp, Homo sapiens
tattcctgcatttgtga

SEQ ID NO: 385069 - DNA, 15 bp, Homo sapiens
tattcctgcctttga

SEQ ID NO: 385070 - DNA, 19 bp, Homo sapiens
tattcgtgaataagttgat

SEQ ID NO: 385071 - DNA, 23 bp, Homo sapiens
tattcgtgaataagttgattctg

SEQ ID NO: 385072 - DNA, 22 bp, Homo sapiens
tattctaaatttttacttaact

SEQ ID NO: 385073 - DNA, 14 bp, Homo sapiens
tattctacatttca

SEQ ID NO: 385074 - DNA, 18 bp, Homo sapiens
tattctagtcaactgctg

SEQ ID NO: 385075 - DNA, 19 bp, Homo sapiens
tattctatatgaatttaaa

SEQ ID NO: 385076 - DNA, 16 bp, Homo sapiens
tattctatgagaacaa

SEQ ID NO: 385077 - DNA, 16 bp, Homo sapiens
tattctattgtattat

SEQ ID NO: 385078 - DNA, 14 bp, Homo sapiens
tattctcaaagcag

SEQ ID NO: 385079 - DNA, 15 bp, Homo sapiens
tattctcagagcatg

SEQ ID NO: 385080 - DNA, 11 bp, Homo sapiens
tattctccatg

SEQ ID NO: 385081 - DNA, 18 bp, Homo sapiens
tattctctgtccagggct

SEQ ID NO: 385082 - DNA, 12 bp, Homo sapiens
tattctgagcct

SEQ ID NO: 385083 - DNA, 13 bp, Homo sapiens
tattctgataatg

SEQ ID NO: 385084 - DNA, 17 bp, Homo sapiens
tattctggctgataaaa

SEQ ID NO: 385085 - DNA, 17 bp, Homo sapiens
tattctgtggattctat

SEQ ID NO: 385086 - DNA, 19 bp, Homo sapiens
tattctgtggattctatat

SEQ ID NO: 385087 - DNA, 20 bp, Homo sapiens
tattctgtggattctatatt

SEQ ID NO: 385088 - DNA, 16 bp, Homo sapiens
tattcttaagcacttt

SEQ ID NO: 385089 - DNA, 15 bp, Homo sapiens
tattcttataaaaat

SEQ ID NO: 385090 - DNA, 14 bp, Homo sapiens
tattcttcataaca

SEQ ID NO: 385091 - DNA, 14 bp, Homo sapiens
tattcttgatgtaa

SEQ ID NO: 385092 - DNA, 19 bp, Homo sapiens
tatttccttaaactgtgtg

SEQ ID NO: 385093 - DNA, 17 bp, Homo sapiens
tatttctaagcttattt

SEQ ID NO: 385094 - DNA, 23 bp, Homo sapiens
tatttctaagcttatttctaact

SEQ ID NO: 385095 - DNA, 15 bp, Homo sapiens
tatttctaagtattt

SEQ ID NO: 385096 - DNA, 17 bp, Homo sapiens
tatttctatctgcaaat

SEQ ID NO: 385097 - DNA, 16 bp, Homo sapiens
tatttctatgtaaatt

SEQ ID NO: 385098 - DNA, 19 bp, Homo sapiens
tatttctcaacaaagcaca

SEQ ID NO: 385099 - DNA, 17 bp, Homo sapiens
tatttctccatcccctc

SEQ ID NO: 385100 - DNA, 18 bp, Homo sapiens
tatttctccatcccctcc

SEQ ID NO: 385101 - DNA, 23 bp, Homo sapiens
tatttctccatcccctccctgcc

SEQ ID NO: 385102 - DNA, 21 bp, Homo sapiens
tatttctcccttcaatcctgt

SEQ ID NO: 385103 - DNA, 11 bp, Homo sapiens
tatttctgtag

SEQ ID NO: 385104 - DNA, 23 bp, Homo sapiens
tatttctgtctcataattgtcaa

SEQ ID NO: 385105 - DNA, 17 bp, Homo sapiens
tatttctgtttctcata

SEQ ID NO: 385106 - DNA, 16 bp, Homo sapiens
tatttcttatttgaaa

SEQ ID NO: 385107 - DNA, 22 bp, Homo sapiens
tatttcttcaaatccttccaaa

SEQ ID NO: 385108 - DNA, 9 bp, Homo sapiens
tatttcttt

SEQ ID NO: 385109 - DNA, 15 bp, Homo sapiens
tatttcttttatata

SEQ ID NO: 385110 - DNA, 22 bp, Homo sapiens
tatttcttttatatataaaata

SEQ ID NO: 385111 - DNA, 22 bp, Homo sapiens
tatttgaaactgctaattacac

SEQ ID NO: 385112 - DNA, 18 bp, Homo sapiens
tatttgactaaagcatca

SEQ ID NO: 385113 - DNA, 18 bp, Homo sapiens
tatttgagagttctaaat

SEQ ID NO: 385114 - DNA, 18 bp, Homo sapiens
tatttgataacattttgt

SEQ ID NO: 385115 - DNA, 15 bp, Homo sapiens
tatttgatctggtgc

SEQ ID NO: 385116 - DNA, 14 bp, Homo sapiens
tatttgatgtagtt

SEQ ID NO: 385117 - DNA, 14 bp, Homo sapiens
tatttgcaataaaa

SEQ ID NO: 385118 - DNA, 20 bp, Homo sapiens
tatttgcaataaaaaagtga

SEQ ID NO: 385119 - DNA, 16 bp, Homo sapiens
tatttgcatgttacct

SEQ ID NO: 385120 - DNA, 20 bp, Homo sapiens
tatttgccttttaaattctt

SEQ ID NO: 385121 - DNA, 13 bp, Homo sapiens
tatttgcttattt

SEQ ID NO: 385122 - DNA, 21 bp, Homo sapiens
tatttgctttagagacaggga

SEQ ID NO: 385123 - DNA, 19 bp, Homo sapiens
tatttggagtggaggcatt

SEQ ID NO: 385124 - DNA, 23 bp, Homo sapiens
tatttggagtggaggcattgttt

SEQ ID NO: 385125 - DNA, 14 bp, Homo sapiens
tatttggatatctg

SEQ ID NO: 385126 - DNA, 23 bp, Homo sapiens
tatttgtactttgtttttccatg

SEQ ID NO: 385127 - DNA, 22 bp, Homo sapiens
tatttgtagctagaatatccta

SEQ ID NO: 385128 - DNA, 22 bp, Homo sapiens
tatttgtatctctgaagcatgt

SEQ ID NO: 385129 - DNA, 23 bp, Homo sapiens
tatttgtatctctgaagcatgtt

SEQ ID NO: 385130 - DNA, 17 bp, Homo sapiens
tatttgtgtaatagaaa

SEQ ID NO: 385131 - DNA, 12 bp, Homo sapiens
tattttaaacaa

SEQ ID NO: 385132 - DNA, 19 bp, Homo sapiens
tattttaaacaaaatagaa

SEQ ID NO: 385133 - DNA, 21 bp, Homo sapiens
tattttaaactactgattgaa

SEQ ID NO: 385134 - DNA, 22 bp, Homo sapiens
tattttaaagcttggtgctaaa

SEQ ID NO: 385135 - DNA, 20 bp, Homo sapiens
tattttaatacctttaaata

SEQ ID NO: 385136 - DNA, 11 bp, Homo sapiens
tattttacaca

SEQ ID NO: 385137 - DNA, 14 bp, Homo sapiens
tattttactttgta

SEQ ID NO: 385138 - DNA, 13 bp, Homo sapiens
tattttagcagtt

SEQ ID NO: 385139 - DNA, 21 bp, Homo sapiens
tattttagcagttctgcaaat

SEQ ID NO: 385140 - DNA, 20 bp, Homo sapiens
tattttatataataaagtat

SEQ ID NO: 385141 - DNA, 19 bp, Homo sapiens
tattttattgcctttagaa

SEQ ID NO: 385142 - DNA, 19 bp, Homo sapiens
tattttcaacgcagccctg

SEQ ID NO: 385143 - DNA, 21 bp, Homo sapiens
tattttcaacgcagccctgct

SEQ ID NO: 385144 - DNA, 16 bp, Homo sapiens
tattttcaataaagaa

SEQ ID NO: 385145 - DNA, 20 bp, Homo sapiens
tattttcagtatactgtgtg

SEQ ID NO: 385146 - DNA, 23 bp, Homo sapiens
tattttcgtgcatttgtgagcca

SEQ ID NO: 385147 - DNA, 20 bp, Homo sapiens
tattttctatatttgtaact

SEQ ID NO: 385148 - DNA, 15 bp, Homo sapiens
tattttctccgaaag

SEQ ID NO: 385149 - DNA, 19 bp, Homo sapiens
tattttctgaattcataaa

SEQ ID NO: 385150 - DNA, 22 bp, Homo sapiens
tattttctgagtagcatatata

SEQ ID NO: 385151 - DNA, 22 bp, Homo sapiens
tattttctggtagatagaaata

SEQ ID NO: 385152 - DNA, 13 bp, Homo sapiens
tattttgaaaaca

SEQ ID NO: 385153 - DNA, 11 bp, Homo sapiens
tattttgaatg

SEQ ID NO: 385154 - DNA, 18 bp, Homo sapiens
tattttgataataaattg

SEQ ID NO: 385155 - DNA, 16 bp, Homo sapiens
tattttgctccttttc

SEQ ID NO: 385156 - DNA, 21 bp, Homo sapiens
tattttggaattggtgtatat

SEQ ID NO: 385157 - DNA, 18 bp, Homo sapiens
tattttggtggtagaaac

SEQ ID NO: 385158 - DNA, 21 bp, Homo sapiens
tattttggttcttagttctca

SEQ ID NO: 385159 - DNA, 20 bp, Homo sapiens
tattttgtgatgatgctgtg

SEQ ID NO: 385160 - DNA, 19 bp, Homo sapiens
tattttgtggttctatttt

SEQ ID NO: 385161 - DNA, 16 bp, Homo sapiens
tattttgttactgtct

SEQ ID NO: 385162 - DNA, 18 bp, Homo sapiens
tattttgttactgtctgt

SEQ ID NO: 385163 - DNA, 18 bp, Homo sapiens
tatttttaaattctgctc

SEQ ID NO: 385164 - DNA, 15 bp, Homo sapiens
tatttttatatagac

SEQ ID NO: 385165 - DNA, 19 bp, Homo sapiens
tatttttatatagcttgaa

SEQ ID NO: 385166 - DNA, 23 bp, Homo sapiens
tatttttatatagcttgaaacat

SEQ ID NO: 385167 - DNA, 23 bp, Homo sapiens
tatttttgttggagccactctgt

SEQ ID NO: 385168 - DNA, 14 bp, Homo sapiens
tatttttgtttgtt

SEQ ID NO: 385169 - DNA, 21 bp, Homo sapiens
tattttttaagtatttatata

SEQ ID NO: 385170 - DNA, 15 bp, Homo sapiens
tattttttaattatt

SEQ ID NO: 385171 - DNA, 16 bp, Homo sapiens
tattttttaatttgat

SEQ ID NO: 385172 - DNA, 20 bp, Homo sapiens
tattttttacaaacagatga

SEQ ID NO: 385173 - DNA, 12 bp, Homo sapiens
tattttttatga

SEQ ID NO: 385174 - DNA, 13 bp, Homo sapiens
tattttttattgt

SEQ ID NO: 385175 - DNA, 19 bp, Homo sapiens
tatttttttaactgaaaat

SEQ ID NO: 385176 - DNA, 22 bp, Homo sapiens
tatttttttaactgaaaatgta

SEQ ID NO: 385177 - DNA, 14 bp, Homo sapiens
tatttttttattct

SEQ ID NO: 385178 - DNA, 14 bp, Homo sapiens
tatttttttctacc

SEQ ID NO: 385179 - DNA, 14 bp, Homo sapiens
tatttttttctagc

SEQ ID NO: 385180 - DNA, 19 bp, Homo sapiens
tcaaaaaaagactcagcca

SEQ ID NO: 385181 - DNA, 15 bp, Homo sapiens
tcaaaaacattctta

SEQ ID NO: 385182 - DNA, 17 bp, Homo sapiens
tcaaaaagagtcttaat

SEQ ID NO: 385183 - DNA, 23 bp, Homo sapiens
tcaaaaagagtcttaattttcta

SEQ ID NO: 385184 - DNA, 16 bp, Homo sapiens
tcaaaaagtataaatt

SEQ ID NO: 385185 - DNA, 11 bp, Homo sapiens
tcaaaaagtca

SEQ ID NO: 385186 - DNA, 14 bp, Homo sapiens
tcaaaaagtgttta

SEQ ID NO: 385187 - DNA, 23 bp, Homo sapiens
tcaaaaagtgtttatttttcata

SEQ ID NO: 385188 - DNA, 14 bp, Homo sapiens
tcaaaaatataact

SEQ ID NO: 385189 - DNA, 20 bp, Homo sapiens
tcaaaaatatttatattgtc

SEQ ID NO: 385190 - DNA, 17 bp, Homo sapiens
tcaaaacacttgtaatt

SEQ ID NO: 385191 - DNA, 16 bp, Homo sapiens
tcaaaacctgtgccag

SEQ ID NO: 385192 - DNA, 17 bp, Homo sapiens
tcaaaacttggtatttt

SEQ ID NO: 385193 - DNA, 20 bp, Homo sapiens
tcaaaagaagggtaagtgct

SEQ ID NO: 385194 - DNA, 20 bp, Homo sapiens
tcaaaagcacaaaccctggg

SEQ ID NO: 385195 - DNA, 18 bp, Homo sapiens
tcaaaagccataacttga

SEQ ID NO: 385196 - DNA, 12 bp, Homo sapiens
tcaaaagcctgg

SEQ ID NO: 385197 - DNA, 20 bp, Homo sapiens
tcaaaaggagaactgtgctc

SEQ ID NO: 385198 - DNA, 21 bp, Homo sapiens
tcaaaaggagaactgtgctct

SEQ ID NO: 385199 - DNA, 17 bp, Homo sapiens
tcaaaagtccttagaat

SEQ ID NO: 385200 - DNA, 20 bp, Homo sapiens
tcaaaataaaaagtgacaca

SEQ ID NO: 385201 - DNA, 15 bp, Homo sapiens
tcaaaatacttcttt

SEQ ID NO: 385202 - DNA, 16 bp, Homo sapiens
tcaaaatagttctatt

SEQ ID NO: 385203 - DNA, 21 bp, Homo sapiens
tcaaaatagttctatttctat

SEQ ID NO: 385204 - DNA, 19 bp, Homo sapiens
tcaaaatattttttttaac

SEQ ID NO: 385205 - DNA, 16 bp, Homo sapiens
tcaaaatccttccaaa

SEQ ID NO: 385206 - DNA, 16 bp, Homo sapiens
tcaaaatgcatgtgat

SEQ ID NO: 385207 - DNA, 18 bp, Homo sapiens
tcaaaatgcatgtgattg

SEQ ID NO: 385208 - DNA, 14 bp, Homo sapiens
tcaaaatgtctgta

SEQ ID NO: 385209 - DNA, 11 bp, Homo sapiens
tcaaaatgtgc

SEQ ID NO: 385210 - DNA, 20 bp, Homo sapiens
tcaaaatgttaataaaggtt

SEQ ID NO: 385211 - DNA, 22 bp, Homo sapiens
tcaaaattataggagacttgta

SEQ ID NO: 385212 - DNA, 13 bp, Homo sapiens
tcaaaattgtgtc

SEQ ID NO: 385213 - DNA, 16 bp, Homo sapiens
tcaaacacacagtatt

SEQ ID NO: 385214 - DNA, 15 bp, Homo sapiens
tcaaacagcatcaaa

SEQ ID NO: 385215 - DNA, 19 bp, Homo sapiens
tcaaacagcatcaaaatac

SEQ ID NO: 385216 - DNA, 20 bp, Homo sapiens
tcaaacagccacgaggtggt

SEQ ID NO: 385217 - DNA, 20 bp, Homo sapiens
tcaaacagtaggttggcagt

SEQ ID NO: 385218 - DNA, 14 bp, Homo sapiens
tcaaacagtgtggc

SEQ ID NO: 385219 - DNA, 15 bp, Homo sapiens
tcaaacagtgtggct

SEQ ID NO: 385220 - DNA, 20 bp, Homo sapiens
tcaaaccccgaccacctgcc

SEQ ID NO: 385221 - DNA, 14 bp, Homo sapiens
tcaaacctgcatat

SEQ ID NO: 385222 - DNA, 15 bp, Homo sapiens
tcaaaccttaagata

SEQ ID NO: 385223 - DNA, 20 bp, Homo sapiens
tcaaaccttaagataatgga

SEQ ID NO: 385224 - DNA, 13 bp, Homo sapiens
tcaaactaaaaga

SEQ ID NO: 385225 - DNA, 14 bp, Homo sapiens
tatcgagtttgcaa

SEQ ID NO: 385226 - DNA, 16 bp, Homo sapiens
tatcgagtttgcaatg

SEQ ID NO: 385227 - DNA, 17 bp, Homo sapiens
tatcgccttttgacagc

SEQ ID NO: 385228 - DNA, 15 bp, Homo sapiens
tatcggaagcagtgc

SEQ ID NO: 385229 - DNA, 16 bp, Homo sapiens
tatcggagacagtgat

SEQ ID NO: 385230 - DNA, 14 bp, Homo sapiens
tatcgggaacagtg

SEQ ID NO: 385231 - DNA, 15 bp, Homo sapiens
tatcgggagcagtgt

SEQ ID NO: 385232 - DNA, 18 bp, Homo sapiens
tatcgggagcagtgtctt

SEQ ID NO: 385233 - DNA, 16 bp, Homo sapiens
tatctaaaaaataact

SEQ ID NO: 385234 - DNA, 19 bp, Homo sapiens
tatctaaaaaataactgtg

SEQ ID NO: 385235 - DNA, 13 bp, Homo sapiens
tatctaaatgaaa

SEQ ID NO: 385236 - DNA, 13 bp, Homo sapiens
tatctactctcct

SEQ ID NO: 385237 - DNA, 14 bp, Homo sapiens
tatctactctcctc

SEQ ID NO: 385238 - DNA, 20 bp, Homo sapiens
tatctactctcctcatctct

SEQ ID NO: 385239 - DNA, 21 bp, Homo sapiens
tatctactctcctcatctcta

SEQ ID NO: 385240 - DNA, 17 bp, Homo sapiens
tatctagaaagaaaaga

SEQ ID NO: 385241 - DNA, 20 bp, Homo sapiens
tatctagaacattcagattt

SEQ ID NO: 385242 - DNA, 14 bp, Homo sapiens
tatctagatttcta

SEQ ID NO: 385243 - DNA, 15 bp, Homo sapiens
tatctagcaagaaga

SEQ ID NO: 385244 - DNA, 20 bp, Homo sapiens
tatctagcaagaagattcta

SEQ ID NO: 385245 - DNA, 14 bp, Homo sapiens
tatctagccaaaga

SEQ ID NO: 385246 - DNA, 20 bp, Homo sapiens
tatctagtgcagctgatttt

SEQ ID NO: 385247 - DNA, 23 bp, Homo sapiens
tatctagtggtctgattttaatt

SEQ ID NO: 385248 - DNA, 21 bp, Homo sapiens
tatctatttatctgtctgagc

SEQ ID NO: 385249 - DNA, 20 bp, Homo sapiens
tatctatttgtatatataca

SEQ ID NO: 385250 - DNA, 15 bp, Homo sapiens
tatctcagaggctat

SEQ ID NO: 385251 - DNA, 13 bp, Homo sapiens
tatctcattgcaa

SEQ ID NO: 385252 - DNA, 23 bp, Homo sapiens
tatctcgaagtcttccatcagca

SEQ ID NO: 385253 - DNA, 20 bp, Homo sapiens
tatctcgctagccatatatt

SEQ ID NO: 385254 - DNA, 16 bp, Homo sapiens
tatctctagtccctgt

SEQ ID NO: 385255 - DNA, 23 bp, Homo sapiens
tatctctgaagcatgtttcatgt

SEQ ID NO: 385256 - DNA, 20 bp, Homo sapiens
tatctctgtctaccatctcc

SEQ ID NO: 385257 - DNA, 21 bp, Homo sapiens
tatctgaacacatactagaaa

SEQ ID NO: 385258 - DNA, 12 bp, Homo sapiens
tatctgactgaa

SEQ ID NO: 385259 - DNA, 17 bp, Homo sapiens
tatctgaggcactgata

SEQ ID NO: 385260 - DNA, 23 bp, Homo sapiens
tatctgaggcactgataatatgt

SEQ ID NO: 385261 - DNA, 15 bp, Homo sapiens
tatctgatatctgtt

SEQ ID NO: 385262 - DNA, 23 bp, Homo sapiens
tatctgcaatgtttttgtgtaga

SEQ ID NO: 385263 - DNA, 22 bp, Homo sapiens
tatctgcatttataaatgtgtg

SEQ ID NO: 385264 - DNA, 13 bp, Homo sapiens
tatctgcctggcc

SEQ ID NO: 385265 - DNA, 18 bp, Homo sapiens
tatctgcctggcctggct

SEQ ID NO: 385266 - DNA, 21 bp, Homo sapiens
tatctgcctggcctggctccc

SEQ ID NO: 385267 - DNA, 16 bp, Homo sapiens
tatctgggcctgggct

SEQ ID NO: 385268 - DNA, 16 bp, Homo sapiens
tatctggtatctgcat

SEQ ID NO: 385269 - DNA, 19 bp, Homo sapiens
tatctggtatctgcatgta

SEQ ID NO: 385270 - DNA, 23 bp, Homo sapiens
tatctgtaacccttgaatttcta

SEQ ID NO: 385271 - DNA, 12 bp, Homo sapiens
tatctgtctgag

SEQ ID NO: 385272 - DNA, 15 bp, Homo sapiens
tatctgtctgagccc

SEQ ID NO: 385273 - DNA, 12 bp, Homo sapiens
tatctgtcttta

SEQ ID NO: 385274 - DNA, 15 bp, Homo sapiens
tatctgtctttatga

SEQ ID NO: 385275 - DNA, 16 bp, Homo sapiens
tatctgtgatggatgg

SEQ ID NO: 385276 - DNA, 15 bp, Homo sapiens
tatctgttagatgct

SEQ ID NO: 385277 - DNA, 14 bp, Homo sapiens
tatctgttttactg

SEQ ID NO: 385278 - DNA, 23 bp, Homo sapiens
tatcttaaagaaacagctttcaa

SEQ ID NO: 385279 - DNA, 12 bp, Homo sapiens
tatcttatttat

SEQ ID NO: 385280 - DNA, 14 bp, Homo sapiens
tatcttatttatat

SEQ ID NO: 385281 - DNA, 17 bp, Homo sapiens
tatcttatttatatatg

SEQ ID NO: 385282 - DNA, 14 bp, Homo sapiens
tatcttcaaacttt

SEQ ID NO: 385283 - DNA, 16 bp, Homo sapiens
tatcttcaaactttca

SEQ ID NO: 385284 - DNA, 21 bp, Homo sapiens
tatcttcaaactttcactttg

SEQ ID NO: 385285 - DNA, 18 bp, Homo sapiens
tatcttccatatgctctt

SEQ ID NO: 385286 - DNA, 17 bp, Homo sapiens
tatcttcgttcttgtta

SEQ ID NO: 385287 - DNA, 14 bp, Homo sapiens
tatcttctgatttg

SEQ ID NO: 385288 - DNA, 18 bp, Homo sapiens
tatcttctgtttttctca

SEQ ID NO: 385289 - DNA, 21 bp, Homo sapiens
tatcttctgtttttctcaaat

SEQ ID NO: 385290 - DNA, 15 bp, Homo sapiens
tatcttgaagacttt

SEQ ID NO: 385291 - DNA, 13 bp, Homo sapiens
tatcttgtgtatg

SEQ ID NO: 385292 - DNA, 16 bp, Homo sapiens
tatctttaaataaatg

SEQ ID NO: 385293 - DNA, 17 bp, Homo sapiens
tatctttaaataaatgt

SEQ ID NO: 385294 - DNA, 17 bp, Homo sapiens
tatctttgtaattattt

SEQ ID NO: 385295 - DNA, 12 bp, Homo sapiens
tatcttttcatt

SEQ ID NO: 385296 - DNA, 14 bp, Homo sapiens
tcaatgttcattgt

SEQ ID NO: 385297 - DNA, 18 bp, Homo sapiens
tcaatgttcattgtaatg

SEQ ID NO: 385298 - DNA, 24 bp, Homo sapiens
tcaatgttcattgtaatgttactg

SEQ ID NO: 385299 - DNA, 18 bp, Homo sapiens
tcaatgtttcttctaggt

SEQ ID NO: 385300 - DNA, 14 bp, Homo sapiens
tcaatgttttcttt

SEQ ID NO: 385301 - DNA, 14 bp, Homo sapiens
tcaattaaatgtag

SEQ ID NO: 385302 - DNA, 13 bp, Homo sapiens
tcaattacaggaa

SEQ ID NO: 385303 - DNA, 21 bp, Homo sapiens
tcaattattacatttatacat

SEQ ID NO: 385304 - DNA, 23 bp, Homo sapiens
tcaatttctttctttccttaata

SEQ ID NO: 385305 - DNA, 18 bp, Homo sapiens
tcaatttgggtcccagct

SEQ ID NO: 385306 - DNA, 14 bp, Homo sapiens
tcaattttaacatt

SEQ ID NO: 385307 - DNA, 13 bp, Homo sapiens
tcaattttgtatt

SEQ ID NO: 385308 - DNA, 14 bp, Homo sapiens
tcaattttgtattt

SEQ ID NO: 385309 - DNA, 15 bp, Homo sapiens
tcaattttttaaacc

SEQ ID NO: 385310 - DNA, 20 bp, Homo sapiens
tcacaaaagctgtgtctctg

SEQ ID NO: 385311 - DNA, 16 bp, Homo sapiens
tcacaaattgatcaag

SEQ ID NO: 385312 - DNA, 18 bp, Homo sapiens
tcacaaattgatcaagat

SEQ ID NO: 385313 - DNA, 16 bp, Homo sapiens
tcacaacaacctggtc

SEQ ID NO: 385314 - DNA, 14 bp, Homo sapiens
tcacaaccttctgt

SEQ ID NO: 385315 - DNA, 20 bp, Homo sapiens
tcacaactgtttttgaagaa

SEQ ID NO: 385316 - DNA, 21 bp, Homo sapiens
tcacaactgtttttgaagaag

SEQ ID NO: 385317 - DNA, 17 bp, Homo sapiens
tcacaagcctcttctga

SEQ ID NO: 385318 - DNA, 23 bp, Homo sapiens
tcacaagctgcctccctgtccac

SEQ ID NO: 385319 - DNA, 22 bp, Homo sapiens
tcacaaggcattcaagtgtaca

SEQ ID NO: 385320 - DNA, 15 bp, Homo sapiens
tcacaatacagataa

SEQ ID NO: 385321 - DNA, 16 bp, Homo sapiens
tcacaatagacagaaa

SEQ ID NO: 385322 - DNA, 21 bp, Homo sapiens
tcacaatgttggcctgtcaga

SEQ ID NO: 385323 - DNA, 13 bp, Homo sapiens
tcacacaaagcag

SEQ ID NO: 385324 - DNA, 10 bp, Homo sapiens
tcacacacac

SEQ ID NO: 385325 - DNA, 15 bp, Homo sapiens
tcacacacagcctgg

SEQ ID NO: 385326 - DNA, 17 bp, Homo sapiens
tcacacagggctctttg

SEQ ID NO: 385327 - DNA, 19 bp, Homo sapiens
tcacacatccagacatcat

SEQ ID NO: 385328 - DNA, 17 bp, Homo sapiens
tcacaccactgccattt

SEQ ID NO: 385329 - DNA, 18 bp, Homo sapiens
tcacaccataactaggta

SEQ ID NO: 385330 - DNA, 21 bp, Homo sapiens
tcacacccctcagcgctccct

SEQ ID NO: 385331 - DNA, 14 bp, Homo sapiens
tcacaccctgcaag

SEQ ID NO: 385332 - DNA, 20 bp, Homo sapiens
tcacaccctgcaaggcccac

SEQ ID NO: 385333 - DNA, 19 bp, Homo sapiens
tcacacctcacgctctgga

SEQ ID NO: 385334 - DNA, 17 bp, Homo sapiens
tcacacctctgggcttc

SEQ ID NO: 385335 - DNA, 21 bp, Homo sapiens
tcacacctgaaaatgttagtg

SEQ ID NO: 385336 - DNA, 24 bp, Homo sapiens
tcacacctgggcccgggcaggcca

SEQ ID NO: 385337 - DNA, 19 bp, Homo sapiens
tcacactctcttcttactg

SEQ ID NO: 385338 - DNA, 13 bp, Homo sapiens
tcacactgctggg

SEQ ID NO: 385339 - DNA, 22 bp, Homo sapiens
tcacagagacacagggcatcca

SEQ ID NO: 385340 - DNA, 13 bp, Homo sapiens
tcacagccagccc

SEQ ID NO: 385341 - DNA, 16 bp, Homo sapiens
tcacagccagcccagc

SEQ ID NO: 385342 - DNA, 18 bp, Homo sapiens
tcacagccagcccagctc

SEQ ID NO: 385343 - DNA, 19 bp, Homo sapiens
tcacagccagcccagctcc

SEQ ID NO: 385344 - DNA, 20 bp, Homo sapiens
tcacagccagcccagctcca

SEQ ID NO: 385345 - DNA, 13 bp, Homo sapiens
tcacagccatttc

SEQ ID NO: 385346 - DNA, 14 bp, Homo sapiens
tcacagcctctccc

SEQ ID NO: 385347 - DNA, 14 bp, Homo sapiens
tcacagctcttgtt

SEQ ID NO: 385348 - DNA, 13 bp, Homo sapiens
tcacagctgcagc

SEQ ID NO: 385349 - DNA, 14 bp, Homo sapiens
tcacagctgcagct

SEQ ID NO: 385350 - DNA, 19 bp, Homo sapiens
tcacagctgcagctgggcc

SEQ ID NO: 385351 - DNA, 20 bp, Homo sapiens
tcacagctgcagctgggccc

SEQ ID NO: 385352 - DNA, 13 bp, Homo sapiens
tcacagcttcttt

SEQ ID NO: 385353 - DNA, 21 bp, Homo sapiens
tcacagcttctttactactgc

SEQ ID NO: 385354 - DNA, 22 bp, Homo sapiens
tcacaggacgatttcactgaca

SEQ ID NO: 385355 - DNA, 22 bp, Homo sapiens
tcacaggacgttgctttttcac

SEQ ID NO: 385356 - DNA, 16 bp, Homo sapiens
tcacaggactctgcct

SEQ ID NO: 385357 - DNA, 18 bp, Homo sapiens
tcacaggagtctttgtaa

SEQ ID NO: 385358 - DNA, 17 bp, Homo sapiens
tcacagggacagatctg

SEQ ID NO: 385359 - DNA, 15 bp, Homo sapiens
tcacaggggcggggc

SEQ ID NO: 385360 - DNA, 17 bp, Homo sapiens
tcacagtacaatgtttc

SEQ ID NO: 385361 - DNA, 19 bp, Homo sapiens
tcacagtctctttaatctt

SEQ ID NO: 385362 - DNA, 21 bp, Homo sapiens
tcacagtctctttaatcttca

SEQ ID NO: 385363 - DNA, 22 bp, Homo sapiens
tcacagttggctggatgaaatt

SEQ ID NO: 385364 - DNA, 14 bp, Homo sapiens
tcacataccctccc

SEQ ID NO: 385365 - DNA, 16 bp, Homo sapiens
tcacataccctccccc

SEQ ID NO: 385366 - DNA, 15 bp, Homo sapiens
tcacatagatgtccc

SEQ ID NO: 385367 - DNA, 16 bp, Homo sapiens
tcacatagatgtccct

SEQ ID NO: 385368 - DNA, 19 bp, Homo sapiens
tcacatatcaagtcccgag

SEQ ID NO: 385369 - DNA, 22 bp, Homo sapiens
tcacatatcaagtcccgaggca

SEQ ID NO: 385370 - DNA, 14 bp, Homo sapiens
tcacatctcccttc

SEQ ID NO: 385371 - DNA, 19 bp, Homo sapiens
tcacatctcccttccacct

SEQ ID NO: 385372 - DNA, 21 bp, Homo sapiens
tcacatctcccttccacctca

SEQ ID NO: 385373 - DNA, 14 bp, Homo sapiens
tcacatctctgcct

SEQ ID NO: 385374 - DNA, 15 bp, Homo sapiens
tcacatctttaactt

SEQ ID NO: 385375 - DNA, 14 bp, Homo sapiens
tcacatgcccgctg

SEQ ID NO: 385376 - DNA, 13 bp, Homo sapiens
tcacatgctggac

SEQ ID NO: 385377 - DNA, 15 bp, Homo sapiens
tcacattatttgcat

SEQ ID NO: 385378 - DNA, 17 bp, Homo sapiens
tcacatttgtaaatgtc

SEQ ID NO: 385379 - DNA, 19 bp, Homo sapiens
tcacattttgcctttctcg

SEQ ID NO: 385380 - DNA, 12 bp, Homo sapiens
tcaccaaaatat

SEQ ID NO: 385381 - DNA, 19 bp, Homo sapiens
tcaccaacaacagtcagcc

SEQ ID NO: 385382 - DNA, 16 bp, Homo sapiens
tcaccaccacacccct

SEQ ID NO: 385383 - DNA, 19 bp, Homo sapiens
tcaccaccacacccctgcc

SEQ ID NO: 385384 - DNA, 11 bp, Homo sapiens
tcaccaccccc

SEQ ID NO: 385385 - DNA, 14 bp, Homo sapiens
tcaccaccccctgt

SEQ ID NO: 385386 - DNA, 20 bp, Homo sapiens
tcaccaccctgggacccccc

SEQ ID NO: 385387 - DNA, 21 bp, Homo sapiens
tcaccacctcatgtcatttct

SEQ ID NO: 385388 - DNA, 17 bp, Homo sapiens
tcaccagaaatgatagc

SEQ ID NO: 385389 - DNA, 22 bp, Homo sapiens
tcaccagaattagtcctcacag

SEQ ID NO: 385390 - DNA, 21 bp, Homo sapiens
tcaccagcaacatctcgagcc

SEQ ID NO: 385391 - DNA, 16 bp, Homo sapiens
actagatggtgctgag

SEQ ID NO: 385392 - DNA, 15 bp, Homo sapiens
actagccctctttct

SEQ ID NO: 385393 - DNA, 22 bp, Homo sapiens
actagccctctttctctctgtg

SEQ ID NO: 385394 - DNA, 19 bp, Homo sapiens
actagctatctaggtggag

SEQ ID NO: 385395 - DNA, 15 bp, Homo sapiens
actaggaatcccaga

SEQ ID NO: 385396 - DNA, 17 bp, Homo sapiens
actaggatagcttcatc

SEQ ID NO: 385397 - DNA, 22 bp, Homo sapiens
actaggctgggtgcccacagcc

SEQ ID NO: 385398 - DNA, 18 bp, Homo sapiens
actagggattcaggctgc

SEQ ID NO: 385399 - DNA, 21 bp, Homo sapiens
actagggattcaggctgcttg

SEQ ID NO: 385400 - DNA, 22 bp, Homo sapiens
actagggtcctggccctcttct

SEQ ID NO: 385401 - DNA, 20 bp, Homo sapiens
actaggtgcccagtcttgag

SEQ ID NO: 385402 - DNA, 14 bp, Homo sapiens
actaggtgtcccca

SEQ ID NO: 385403 - DNA, 16 bp, Homo sapiens
actagtgctgaagctt

SEQ ID NO: 385404 - DNA, 20 bp, Homo sapiens
actagtgtttctgcagaggc

SEQ ID NO: 385405 - DNA, 20 bp, Homo sapiens
actataaagaagtaacaaaa

SEQ ID NO: 385406 - DNA, 17 bp, Homo sapiens
actataacatatgtaca

SEQ ID NO: 385407 - DNA, 19 bp, Homo sapiens
actataaccatcagttact

SEQ ID NO: 385408 - DNA, 23 bp, Homo sapiens
actataatttacctgaagtcttt

SEQ ID NO: 385409 - DNA, 16 bp, Homo sapiens
actatagcagggctgg

SEQ ID NO: 385410 - DNA, 13 bp, Homo sapiens
actatagccattt

SEQ ID NO: 385411 - DNA, 21 bp, Homo sapiens
actatatgcataaacaacagt

SEQ ID NO: 385412 - DNA, 22 bp, Homo sapiens
actatatgcataaacaacagta

SEQ ID NO: 385413 - DNA, 22 bp, Homo sapiens
actatatgtatatctttgcact

SEQ ID NO: 385414 - DNA, 13 bp, Homo sapiens
actatatgtatgg

SEQ ID NO: 385415 - DNA, 22 bp, Homo sapiens
actatcagtttgtcctgtagag

SEQ ID NO: 385416 - DNA, 20 bp, Homo sapiens
actatccaattaaaattaag

SEQ ID NO: 385417 - DNA, 23 bp, Homo sapiens
actatccttttttattgaataac

SEQ ID NO: 385418 - DNA, 15 bp, Homo sapiens
actatcggttcaagt

SEQ ID NO: 385419 - DNA, 15 bp, Homo sapiens
actatctactctcct

SEQ ID NO: 385420 - DNA, 23 bp, Homo sapiens
actatctctagagtgagaatctg

SEQ ID NO: 385421 - DNA, 11 bp, Homo sapiens
actatgaaata

SEQ ID NO: 385422 - DNA, 18 bp, Homo sapiens
actatgcacctataaata

SEQ ID NO: 385423 - DNA, 17 bp, Homo sapiens
actatgggaagctctgt

SEQ ID NO: 385424 - DNA, 18 bp, Homo sapiens
actatgggaagctctgtg

SEQ ID NO: 385425 - DNA, 18 bp, Homo sapiens
actatggtatatattttg

SEQ ID NO: 385426 - DNA, 16 bp, Homo sapiens
actatggtatttgagt

SEQ ID NO: 385427 - DNA, 19 bp, Homo sapiens
actatggttcccaataaaa

SEQ ID NO: 385428 - DNA, 23 bp, Homo sapiens
actatggttcccaataaaagtga

SEQ ID NO: 385429 - DNA, 23 bp, Homo sapiens
actatgtaatgcttatgtgttgc

SEQ ID NO: 385430 - DNA, 11 bp, Homo sapiens
actatgtgctg

SEQ ID NO: 385431 - DNA, 14 bp, Homo sapiens
actattaagcagta

SEQ ID NO: 385432 - DNA, 21 bp, Homo sapiens
actattcagaacttgtaacta

SEQ ID NO: 385433 - DNA, 15 bp, Homo sapiens
actattcagaggaaa

SEQ ID NO: 385434 - DNA, 20 bp, Homo sapiens
actattcatagaagggctag

SEQ ID NO: 385435 - DNA, 16 bp, Homo sapiens
actattccctttgact

SEQ ID NO: 385436 - DNA, 23 bp, Homo sapiens
actattctataaacatatgcaaa

SEQ ID NO: 385437 - DNA, 16 bp, Homo sapiens
actattcttaagcact

SEQ ID NO: 385438 - DNA, 20 bp, Homo sapiens
actattcttgatgtaaaatc

SEQ ID NO: 385439 - DNA, 14 bp, Homo sapiens
actattggaaagta

SEQ ID NO: 385440 - DNA, 16 bp, Homo sapiens
actattggaaagtact

SEQ ID NO: 385441 - DNA, 13 bp, Homo sapiens
actatttaaactt

SEQ ID NO: 385442 - DNA, 16 bp, Homo sapiens
actatttaaacttata

SEQ ID NO: 385443 - DNA, 15 bp, Homo sapiens
actatttaactgact

SEQ ID NO: 385444 - DNA, 17 bp, Homo sapiens
actatttaactgactat

SEQ ID NO: 385445 - DNA, 14 bp, Homo sapiens
actatttaacttga

SEQ ID NO: 385446 - DNA, 19 bp, Homo sapiens
actatttaagttatcaact

SEQ ID NO: 385447 - DNA, 16 bp, Homo sapiens
actatttgtctttcag

SEQ ID NO: 385448 - DNA, 15 bp, Homo sapiens
actcaaaacttaaca

SEQ ID NO: 385449 - DNA, 23 bp, Homo sapiens
actcaaaaggagaactgtgctct

SEQ ID NO: 385450 - DNA, 13 bp, Homo sapiens
actcaaacacaga

SEQ ID NO: 385451 - DNA, 15 bp, Homo sapiens
actcaaacacagaga

SEQ ID NO: 385452 - DNA, 20 bp, Homo sapiens
actcaaagttaacctacctg

SEQ ID NO: 385453 - DNA, 19 bp, Homo sapiens
actcaaattaatctttctt

SEQ ID NO: 385454 - DNA, 17 bp, Homo sapiens
actcaaggactttgcag

SEQ ID NO: 385455 - DNA, 13 bp, Homo sapiens
actcaaggcctcc

SEQ ID NO: 385456 - DNA, 16 bp, Homo sapiens
actcacatgctggaca

SEQ ID NO: 385457 - DNA, 18 bp, Homo sapiens
actcacatgctggacagg

SEQ ID NO: 385458 - DNA, 15 bp, Homo sapiens
actcaccaaaatata

SEQ ID NO: 385459 - DNA, 23 bp, Homo sapiens
actcaccagggtccgcaccagct

SEQ ID NO: 385460 - DNA, 11 bp, Homo sapiens
actcaccattt

SEQ ID NO: 385461 - DNA, 17 bp, Homo sapiens
actcaccatttaatcat

SEQ ID NO: 385462 - DNA, 14 bp, Homo sapiens
actcaccatttcat

SEQ ID NO: 385463 - DNA, 16 bp, Homo sapiens
actcacctaatgttta

SEQ ID NO: 385464 - DNA, 20 bp, Homo sapiens
actcacctaatgtttatgag

SEQ ID NO: 385465 - DNA, 12 bp, Homo sapiens
actcacctcctc

SEQ ID NO: 385466 - DNA, 14 bp, Homo sapiens
actcacctcctccc

SEQ ID NO: 385467 - DNA, 15 bp, Homo sapiens
actcacctcctccca

SEQ ID NO: 385468 - DNA, 16 bp, Homo sapiens
actcacctgctggccc

SEQ ID NO: 385469 - DNA, 17 bp, Homo sapiens
actcacctgctggcccc

SEQ ID NO: 385470 - DNA, 18 bp, Homo sapiens
actcacctgctggcccct

SEQ ID NO: 385471 - DNA, 19 bp, Homo sapiens
actcacctgctggcccctc

SEQ ID NO: 385472 - DNA, 22 bp, Homo sapiens
actcacgggaggaatcttttac

SEQ ID NO: 385473 - DNA, 14 bp, Homo sapiens
actcacttttcact

SEQ ID NO: 385474 - DNA, 15 bp, Homo sapiens
actcacttttcactt

SEQ ID NO: 385475 - DNA, 11 bp, Homo sapiens
actcagagcag

SEQ ID NO: 385476 - DNA, 13 bp, Homo sapiens
actcagaggctga

SEQ ID NO: 385477 - DNA, 16 bp, Homo sapiens
actcagatcactactg

SEQ ID NO: 385478 - DNA, 20 bp, Homo sapiens
actcagatcactactgcagt

SEQ ID NO: 385479 - DNA, 19 bp, Homo sapiens
actcagcaactgttagctg

SEQ ID NO: 385480 - DNA, 14 bp, Homo sapiens
actcagccaagaca

SEQ ID NO: 385481 - DNA, 16 bp, Homo sapiens
actcagccttaagaaa

SEQ ID NO: 385482 - DNA, 17 bp, Homo sapiens
actcaggatttaaaaac

SEQ ID NO: 385483 - DNA, 15 bp, Homo sapiens
actcaggcccacatt

SEQ ID NO: 385484 - DNA, 16 bp, Homo sapiens
actcaggcctgccaat

SEQ ID NO: 385485 - DNA, 16 bp, Homo sapiens
actcagggattccttc

SEQ ID NO: 385486 - DNA, 13 bp, Homo sapiens
actcagggctggc

SEQ ID NO: 385487 - DNA, 15 bp, Homo sapiens
actcaggttccagaa

SEQ ID NO: 385488 - DNA, 23 bp, Homo sapiens
actcaggtttccggctactgaca

SEQ ID NO: 385489 - DNA, 13 bp, Homo sapiens
actcagtgtattt

SEQ ID NO: 385490 - DNA, 17 bp, Homo sapiens
actcagtgtattttaaa

SEQ ID NO: 385491 - DNA, 13 bp, Homo sapiens
actcagtttgtca

SEQ ID NO: 385492 - DNA, 19 bp, Homo sapiens
actcatactgtcatataat

SEQ ID NO: 385493 - DNA, 13 bp, Homo sapiens
actcatcataaaa

SEQ ID NO: 385494 - DNA, 14 bp, Homo sapiens
actcatcataaaat

SEQ ID NO: 385495 - DNA, 13 bp, Homo sapiens
actcatctgttat

SEQ ID NO: 385496 - DNA, 14 bp, Homo sapiens
actcatctgttatc

SEQ ID NO: 385497 - DNA, 15 bp, Homo sapiens
actcatctgttatcc

SEQ ID NO: 385498 - DNA, 22 bp, Homo sapiens
actcatcttagtgcctgagagt

SEQ ID NO: 385499 - DNA, 17 bp, Homo sapiens
actcatgaacaaaatga

SEQ ID NO: 385500 - DNA, 18 bp, Homo sapiens
actcatgaacaaaatgaa

SEQ ID NO: 385501 - DNA, 22 bp, Homo sapiens
actcatgaacaaaatgaagtta

SEQ ID NO: 385502 - DNA, 23 bp, Homo sapiens
actcatgactgagtctggcaaac

SEQ ID NO: 385503 - DNA, 11 bp, Homo sapiens
actcatgccag

SEQ ID NO: 385504 - DNA, 18 bp, Homo sapiens
actcatgcggcccagcca

SEQ ID NO: 385505 - DNA, 19 bp, Homo sapiens
actcatgcggcccagccat

SEQ ID NO: 385506 - DNA, 13 bp, Homo sapiens
actcatgtgattt

SEQ ID NO: 385507 - DNA, 16 bp, Homo sapiens
actcattaatttctct

SEQ ID NO: 385508 - DNA, 18 bp, Homo sapiens
actcattaatttctctca

SEQ ID NO: 385509 - DNA, 13 bp, Homo sapiens
actcattcccagt

SEQ ID NO: 385510 - DNA, 21 bp, Homo sapiens
actcatttttgccatacatca

SEQ ID NO: 385511 - DNA, 16 bp, Homo sapiens
actccaaggcaaatgt

SEQ ID NO: 385512 - DNA, 19 bp, Homo sapiens
actccaaggcaaatgtcca

SEQ ID NO: 385513 - DNA, 17 bp, Homo sapiens
actccacctcttccttt

SEQ ID NO: 385514 - DNA, 16 bp, Homo sapiens
actccactctccttcg

SEQ ID NO: 385515 - DNA, 22 bp, Homo sapiens
actccagaatctgctgttgcca

SEQ ID NO: 385516 - DNA, 17 bp, Homo sapiens
actccagaatttcccaa

SEQ ID NO: 385517 - DNA, 21 bp, Homo sapiens
actccagcctgggcaacagag

SEQ ID NO: 385518 - DNA, 23 bp, Homo sapiens
actccagcctgggcaacagagca

SEQ ID NO: 385519 - DNA, 21 bp, Homo sapiens
actccaggaaaactgtttttc

SEQ ID NO: 385520 - DNA, 19 bp, Homo sapiens
actccaggaaggggctgga

SEQ ID NO: 385521 - DNA, 19 bp, Homo sapiens
actctcggggcccttgggg

SEQ ID NO: 385522 - DNA, 12 bp, Homo sapiens
actctctagttc

SEQ ID NO: 385523 - DNA, 22 bp, Homo sapiens
actctctagttccctcagtgtg

SEQ ID NO: 385524 - DNA, 14 bp, Homo sapiens
actctctcctctct

SEQ ID NO: 385525 - DNA, 15 bp, Homo sapiens
actctctcctctctc

SEQ ID NO: 385526 - DNA, 18 bp, Homo sapiens
actctctcctctctctcc

SEQ ID NO: 385527 - DNA, 15 bp, Homo sapiens
actctctgccagctc

SEQ ID NO: 385528 - DNA, 22 bp, Homo sapiens
actctctgccagctccacaggg

SEQ ID NO: 385529 - DNA, 17 bp, Homo sapiens
actctctgctctagcca

SEQ ID NO: 385530 - DNA, 20 bp, Homo sapiens
actctctgctctagccagga

SEQ ID NO: 385531 - DNA, 23 bp, Homo sapiens
actctctgctctagccaggagtc

SEQ ID NO: 385532 - DNA, 24 bp, Homo sapiens
actctctgctctagccaggagtct

SEQ ID NO: 385533 - DNA, 14 bp, Homo sapiens
actctctgtcttct

SEQ ID NO: 385534 - DNA, 15 bp, Homo sapiens
actctctgtcttctc

SEQ ID NO: 385535 - DNA, 19 bp, Homo sapiens
actctctgtcttctctcca

SEQ ID NO: 385536 - DNA, 14 bp, Homo sapiens
actctcttcttact

SEQ ID NO: 385537 - DNA, 13 bp, Homo sapiens
actctgaaaaaca

SEQ ID NO: 385538 - DNA, 18 bp, Homo sapiens
actctgaagtcccttcct

SEQ ID NO: 385539 - DNA, 22 bp, Homo sapiens
actctgaagtcccttcctgtcc

SEQ ID NO: 385540 - DNA, 15 bp, Homo sapiens
actctgaccttcaca

SEQ ID NO: 385541 - DNA, 13 bp, Homo sapiens
actctgagcccag

SEQ ID NO: 385542 - DNA, 14 bp, Homo sapiens
actctgagcccagg

SEQ ID NO: 385543 - DNA, 16 bp, Homo sapiens
actctgagtccactgc

SEQ ID NO: 385544 - DNA, 22 bp, Homo sapiens
actctgagtttaccatttgtaa

SEQ ID NO: 385545 - DNA, 14 bp, Homo sapiens
actctgcactactc

SEQ ID NO: 385546 - DNA, 23 bp, Homo sapiens
actctgcactactcctctgcagt

SEQ ID NO: 385547 - DNA, 19 bp, Homo sapiens
actctgcactccatggcca

SEQ ID NO: 385548 - DNA, 22 bp, Homo sapiens
actctgcatagacaaaggcctt

SEQ ID NO: 385549 - DNA, 20 bp, Homo sapiens
actctgccagggcagtgcta

SEQ ID NO: 385550 - DNA, 23 bp, Homo sapiens
actctgccccaatcgggtccaga

SEQ ID NO: 385551 - DNA, 15 bp, Homo sapiens
actctgccttccagg

SEQ ID NO: 385552 - DNA, 19 bp, Homo sapiens
actctgccttccaggcgta

SEQ ID NO: 385553 - DNA, 23 bp, Homo sapiens
actctgctgctcatgggaagaac

SEQ ID NO: 385554 - DNA, 19 bp, Homo sapiens
actctgcttggctgtcccc

SEQ ID NO: 385555 - DNA, 20 bp, Homo sapiens
actctgctttgactgagcag

SEQ ID NO: 385556 - DNA, 22 bp, Homo sapiens
actctgctttgactgagcagac

SEQ ID NO: 385557 - DNA, 16 bp, Homo sapiens
actctgggaagaatgt

SEQ ID NO: 385558 - DNA, 16 bp, Homo sapiens
actctgtaacatcact

SEQ ID NO: 385559 - DNA, 13 bp, Homo sapiens
actctgtccaggc

SEQ ID NO: 385560 - DNA, 14 bp, Homo sapiens
actctgtccaggcc

SEQ ID NO: 385561 - DNA, 15 bp, Homo sapiens
actctgtccaggcca

SEQ ID NO: 385562 - DNA, 17 bp, Homo sapiens
actctgtccaggccact

SEQ ID NO: 385563 - DNA, 12 bp, Homo sapiens
actctgtgcagg

SEQ ID NO: 385564 - DNA, 16 bp, Homo sapiens
actctgtgcaggtgct

SEQ ID NO: 385565 - DNA, 17 bp, Homo sapiens
actctgtggggccacac

SEQ ID NO: 385566 - DNA, 13 bp, Homo sapiens
actctgtgtaaat

SEQ ID NO: 385567 - DNA, 18 bp, Homo sapiens
actctgtgtaatctctga

SEQ ID NO: 385568 - DNA, 24 bp, Homo sapiens
actctgtgtgagcgtgtccacaga

SEQ ID NO: 385569 - DNA, 19 bp, Homo sapiens
actctgttcccccaccctc

SEQ ID NO: 385570 - DNA, 23 bp, Homo sapiens
actctgttcccccaccctccatg

SEQ ID NO: 385571 - DNA, 12 bp, Homo sapiens
actctgttcctg

SEQ ID NO: 385572 - DNA, 16 bp, Homo sapiens
actctgttcctggctc

SEQ ID NO: 385573 - DNA, 13 bp, Homo sapiens
actctgttgcctc

SEQ ID NO: 385574 - DNA, 16 bp, Homo sapiens
actctgttgcctcctc

SEQ ID NO: 385575 - DNA, 19 bp, Homo sapiens
actctgttgcctcctctct

SEQ ID NO: 385576 - DNA, 21 bp, Homo sapiens
actctgttgcctcctctctcc

SEQ ID NO: 385577 - DNA, 18 bp, Homo sapiens
actcttaaatatacaact

SEQ ID NO: 385578 - DNA, 20 bp, Homo sapiens
actcttaaatatacaacttt

SEQ ID NO: 385579 - DNA, 19 bp, Homo sapiens
actcttagaggtaggtgta

SEQ ID NO: 385580 - DNA, 20 bp, Homo sapiens
actcttcccccactcctctt

SEQ ID NO: 385581 - DNA, 22 bp, Homo sapiens
actcttccctctcgctcccctc

SEQ ID NO: 385582 - DNA, 13 bp, Homo sapiens
actcttgatgtga

SEQ ID NO: 385583 - DNA, 22 bp, Homo sapiens
actctttcccccaaatcttcct

SEQ ID NO: 385584 - DNA, 14 bp, Homo sapiens
actctttcttctct

SEQ ID NO: 385585 - DNA, 21 bp, Homo sapiens
actctttcttctctctttgtc

SEQ ID NO: 385586 - DNA, 11 bp, Homo sapiens
actctttgctg

SEQ ID NO: 385587 - DNA, 12 bp, Homo sapiens
actctttgctgt

SEQ ID NO: 385588 - DNA, 14 bp, Homo sapiens
actctttgttttct

SEQ ID NO: 385589 - DNA, 19 bp, Homo sapiens
actctttttctaaagtgtt

SEQ ID NO: 385590 - DNA, 20 bp, Homo sapiens
actctttttctaaagtgttg

SEQ ID NO: 385591 - DNA, 23 bp, Homo sapiens
actctttttctaaagtgttggtc

SEQ ID NO: 385592 - DNA, 16 bp, Homo sapiens
actgaaaaatctagac

SEQ ID NO: 385593 - DNA, 23 bp, Homo sapiens
actgaaaaccagtcttctccctg

SEQ ID NO: 385594 - DNA, 19 bp, Homo sapiens
actgaaaactgtaaataca

SEQ ID NO: 385595 - DNA, 23 bp, Homo sapiens
actgaaaatctaatattaaaaat

SEQ ID NO: 385596 - DNA, 19 bp, Homo sapiens
actgaaaatgtaaatttat

SEQ ID NO: 385597 - DNA, 16 bp, Homo sapiens
actgaaacatttgaca

SEQ ID NO: 385598 - DNA, 10 bp, Homo sapiens
actgaaagaa

SEQ ID NO: 385599 - DNA, 16 bp, Homo sapiens
actgaaagcagcagct

SEQ ID NO: 385600 - DNA, 19 bp, Homo sapiens
actgaaattgtttaaaagc

SEQ ID NO: 385601 - DNA, 13 bp, Homo sapiens
actgaaatttaca

SEQ ID NO: 385602 - DNA, 21 bp, Homo sapiens
actgaaccttgttgatgccag

SEQ ID NO: 385603 - DNA, 22 bp, Homo sapiens
actgaagcaaataccaaagcag

SEQ ID NO: 385604 - DNA, 16 bp, Homo sapiens
actgaagcgaacatct

SEQ ID NO: 385605 - DNA, 14 bp, Homo sapiens
actgaagcttttta

SEQ ID NO: 385606 - DNA, 17 bp, Homo sapiens
actgaagtgaatacatg

SEQ ID NO: 385607 - DNA, 18 bp, Homo sapiens
actgaagtgaatacatgg

SEQ ID NO: 385608 - DNA, 14 bp, Homo sapiens
actgaatacttgaa

SEQ ID NO: 385609 - DNA, 14 bp, Homo sapiens
actgaatttaacta

SEQ ID NO: 385610 - DNA, 23 bp, Homo sapiens
actgaatttctttgatttaactg

SEQ ID NO: 385611 - DNA, 14 bp, Homo sapiens
actgaatttgctaa

SEQ ID NO: 385612 - DNA, 18 bp, Homo sapiens
actgacatgtggggccag

SEQ ID NO: 385613 - DNA, 22 bp, Homo sapiens
actgacatgtggggccaggtca

SEQ ID NO: 385614 - DNA, 16 bp, Homo sapiens
actgacatttcacttc

SEQ ID NO: 385615 - DNA, 20 bp, Homo sapiens
actgaccagcctccatgctg

SEQ ID NO: 385616 - DNA, 16 bp, Homo sapiens
actgaccatccactct

SEQ ID NO: 385617 - DNA, 22 bp, Homo sapiens
actgaccatccactctaccctc

SEQ ID NO: 385618 - DNA, 23 bp, Homo sapiens
actgaccatccactctaccctcc

SEQ ID NO: 385619 - DNA, 18 bp, Homo sapiens
actgaccctcccttcctg

SEQ ID NO: 385620 - DNA, 17 bp, Homo sapiens
actgaccggaggcaaaa

SEQ ID NO: 385621 - DNA, 14 bp, Homo sapiens
actgacctggaaga

SEQ ID NO: 385622 - DNA, 23 bp, Homo sapiens
actgacggctgtgtatttctgta

SEQ ID NO: 385623 - DNA, 20 bp, Homo sapiens
actgactattcttgatgtaa

SEQ ID NO: 385624 - DNA, 22 bp, Homo sapiens
actgactattcttgatgtaaaa

SEQ ID NO: 385625 - DNA, 23 bp, Homo sapiens
actgactcacattgccttgagct

SEQ ID NO: 385626 - DNA, 15 bp, Homo sapiens
actgacttctgctag

SEQ ID NO: 385627 - DNA, 13 bp, Homo sapiens
actgacttgagac

SEQ ID NO: 385628 - DNA, 14 bp, Homo sapiens
actgactttatcct

SEQ ID NO: 385629 - DNA, 16 bp, Homo sapiens
actgactttttccccc

SEQ ID NO: 385630 - DNA, 22 bp, Homo sapiens
actgagacagccacttggtttt

SEQ ID NO: 385631 - DNA, 20 bp, Homo sapiens
actgagaggaggggtaaata

SEQ ID NO: 385632 - DNA, 21 bp, Homo sapiens
actgagaggaggggtaaatat

SEQ ID NO: 385633 - DNA, 23 bp, Homo sapiens
actgagaggaggggtaaatatat

SEQ ID NO: 385634 - DNA, 12 bp, Homo sapiens
actgagcagact

SEQ ID NO: 385635 - DNA, 14 bp, Homo sapiens
actgagcagactgg

SEQ ID NO: 385636 - DNA, 12 bp, Homo sapiens
actgagcccttg

SEQ ID NO: 385637 - DNA, 18 bp, Homo sapiens
actgagccgtgcagctgg

SEQ ID NO: 385638 - DNA, 19 bp, Homo sapiens
actgagccgtgcagctggg

SEQ ID NO: 385639 - DNA, 14 bp, Homo sapiens
actgagccttgtaa

SEQ ID NO: 385640 - DNA, 14 bp, Homo sapiens
actgagctcctctg

SEQ ID NO: 385641 - DNA, 18 bp, Homo sapiens
actgaggaatgatgaagc

SEQ ID NO: 385642 - DNA, 14 bp, Homo sapiens
actgaggcccagag

SEQ ID NO: 385643 - DNA, 12 bp, Homo sapiens
acgcacacacac

SEQ ID NO: 385644 - DNA, 13 bp, Homo sapiens
acgcacacacaca

SEQ ID NO: 385645 - DNA, 13 bp, Homo sapiens
acgcacacagctt

SEQ ID NO: 385646 - DNA, 17 bp, Homo sapiens
acgcacctgtagtccca

SEQ ID NO: 385647 - DNA, 19 bp, Homo sapiens
acgcacctgtagtcccagc

SEQ ID NO: 385648 - DNA, 11 bp, Homo sapiens
acgcacgcaca

SEQ ID NO: 385649 - DNA, 16 bp, Homo sapiens
acgcactccatgagca

SEQ ID NO: 385650 - DNA, 21 bp, Homo sapiens
acgcactccatgagcacccca

SEQ ID NO: 385651 - DNA, 14 bp, Homo sapiens
acgcagacacacac

SEQ ID NO: 385652 - DNA, 12 bp, Homo sapiens
acgcagagcccc

SEQ ID NO: 385653 - DNA, 15 bp, Homo sapiens
acgcagagccccgga

SEQ ID NO: 385654 - DNA, 16 bp, Homo sapiens
acgcagagccccggag

SEQ ID NO: 385655 - DNA, 19 bp, Homo sapiens
acgcagagccccggagcac

SEQ ID NO: 385656 - DNA, 17 bp, Homo sapiens
acgcagatgatccatga

SEQ ID NO: 385657 - DNA, 22 bp, Homo sapiens
acgcagcagctgggacccctcc

SEQ ID NO: 385658 - DNA, 23 bp, Homo sapiens
acgcagcagctgggacccctccc

SEQ ID NO: 385659 - DNA, 12 bp, Homo sapiens
acgcagccagga

SEQ ID NO: 385660 - DNA, 12 bp, Homo sapiens
acgcagccctgc

SEQ ID NO: 385661 - DNA, 11 bp, Homo sapiens
acgcagcctcc

SEQ ID NO: 385662 - DNA, 11 bp, Homo sapiens
acgcaggagag

SEQ ID NO: 385663 - DNA, 15 bp, Homo sapiens
acgcaggagagagag

SEQ ID NO: 385664 - DNA, 16 bp, Homo sapiens
acgcaggagagagaga

SEQ ID NO: 385665 - DNA, 18 bp, Homo sapiens
acgccaaagtgcagccct

SEQ ID NO: 385666 - DNA, 19 bp, Homo sapiens
acgccaaagtgcagccctt

SEQ ID NO: 385667 - DNA, 22 bp, Homo sapiens
acgccaaagtgcagcccttcct

SEQ ID NO: 385668 - DNA, 17 bp, Homo sapiens
acgccaataataaaaaa

SEQ ID NO: 385669 - DNA, 20 bp, Homo sapiens
acgccaataataaaaaacaa

SEQ ID NO: 385670 - DNA, 14 bp, Homo sapiens
acgccagtctccca

SEQ ID NO: 385671 - DNA, 16 bp, Homo sapiens
acgcccatgtgtgagt

SEQ ID NO: 385672 - DNA, 12 bp, Homo sapiens
acgccccagccc

SEQ ID NO: 385673 - DNA, 13 bp, Homo sapiens
acgccccagcccg

SEQ ID NO: 385674 - DNA, 15 bp, Homo sapiens
acgcccctcccaagc

SEQ ID NO: 385675 - DNA, 16 bp, Homo sapiens
acgcccctcccaagcg

SEQ ID NO: 385676 - DNA, 18 bp, Homo sapiens
acgccctccctctcccag

SEQ ID NO: 385677 - DNA, 22 bp, Homo sapiens
acgccctgcgttggagccactc

SEQ ID NO: 385678 - DNA, 18 bp, Homo sapiens
acgccggggctggccctg

SEQ ID NO: 385679 - DNA, 21 bp, Homo sapiens
acgccggggctggccctgccc

SEQ ID NO: 385680 - DNA, 13 bp, Homo sapiens
acgccgtggagca

SEQ ID NO: 385681 - DNA, 22 bp, Homo sapiens
acgcctgccctccccagagcac

SEQ ID NO: 385682 - DNA, 16 bp, Homo sapiens
acgcctggctccaggc

SEQ ID NO: 385683 - DNA, 17 bp, Homo sapiens
acgcctggctccaggct

SEQ ID NO: 385684 - DNA, 16 bp, Homo sapiens
acgcctgtaatcccag

SEQ ID NO: 385685 - DNA, 13 bp, Homo sapiens
acgcgtcttcctg

SEQ ID NO: 385686 - DNA, 14 bp, Homo sapiens
acgctcccccgcag

SEQ ID NO: 385687 - DNA, 19 bp, Homo sapiens
acgctccctccccctgccc

SEQ ID NO: 385688 - DNA, 22 bp, Homo sapiens
acgctcctgtctccaagaatgt

SEQ ID NO: 385689 - DNA, 15 bp, Homo sapiens
acgctctctgtctgg

SEQ ID NO: 385690 - DNA, 12 bp, Homo sapiens
acgctcttagct

SEQ ID NO: 385691 - DNA, 11 bp, Homo sapiens
acgctgcccag

SEQ ID NO: 385692 - DNA, 16 bp, Homo sapiens
acgctgcccaggctct

SEQ ID NO: 385693 - DNA, 11 bp, Homo sapiens
acgctggctcg

SEQ ID NO: 385694 - DNA, 14 bp, Homo sapiens
acgctggcttccag

SEQ ID NO: 385695 - DNA, 22 bp, Homo sapiens
acgctggcttccagcgggccct

SEQ ID NO: 385696 - DNA, 17 bp, Homo sapiens
acgctgggacacagacc

SEQ ID NO: 385697 - DNA, 19 bp, Homo sapiens
acgctggtagagatggagg

SEQ ID NO: 385698 - DNA, 18 bp, Homo sapiens
acgcttctgaatgctgct

SEQ ID NO: 385699 - DNA, 18 bp, Homo sapiens
acgcttgcgtatgtctgt

SEQ ID NO: 385700 - DNA, 13 bp, Homo sapiens
acgctttcatgac

SEQ ID NO: 385701 - DNA, 11 bp, Homo sapiens
acggaactctt

SEQ ID NO: 385702 - DNA, 14 bp, Homo sapiens
acggacaggaagca

SEQ ID NO: 385703 - DNA, 18 bp, Homo sapiens
acggaccgcatcctccag

SEQ ID NO: 385704 - DNA, 14 bp, Homo sapiens
acggacgggacagc

SEQ ID NO: 385705 - DNA, 18 bp, Homo sapiens
acggacgggacagcggcc

SEQ ID NO: 385706 - DNA, 12 bp, Homo sapiens
acggagagaaaa

SEQ ID NO: 385707 - DNA, 14 bp, Homo sapiens
acggagagaaaaaa

SEQ ID NO: 385708 - DNA, 14 bp, Homo sapiens
acggagttcagagg

SEQ ID NO: 385709 - DNA, 15 bp, Homo sapiens
acggagttcagaggg

SEQ ID NO: 385710 - DNA, 14 bp, Homo sapiens
acggatggaaggag

SEQ ID NO: 385711 - DNA, 17 bp, Homo sapiens
acggattattatttgta

SEQ ID NO: 385712 - DNA, 11 bp, Homo sapiens
acggcagcccc

SEQ ID NO: 385713 - DNA, 15 bp, Homo sapiens
acggcagctgtagct

SEQ ID NO: 385714 - DNA, 20 bp, Homo sapiens
acggcaggtggcctaaggct

SEQ ID NO: 385715 - DNA, 22 bp, Homo sapiens
acggcagtcacactgctgggaa

SEQ ID NO: 385716 - DNA, 14 bp, Homo sapiens
acggccacccaccc

SEQ ID NO: 385717 - DNA, 12 bp, Homo sapiens
acggccaccctc

SEQ ID NO: 385718 - DNA, 20 bp, Homo sapiens
acggccaccctccttcccgc

SEQ ID NO: 385719 - DNA, 12 bp, Homo sapiens
acggccactgca

SEQ ID NO: 385720 - DNA, 20 bp, Homo sapiens
acggcccgccgtgcctgcat

SEQ ID NO: 385721 - DNA, 14 bp, Homo sapiens
acggccgtccctga

SEQ ID NO: 385722 - DNA, 19 bp, Homo sapiens
acggcctgatgctccctcc

SEQ ID NO: 385723 - DNA, 15 bp, Homo sapiens
acggctaagaggctg

SEQ ID NO: 385724 - DNA, 16 bp, Homo sapiens
acggctaagaggctgc

SEQ ID NO: 385725 - DNA, 15 bp, Homo sapiens
acggctccgagggcg

SEQ ID NO: 385726 - DNA, 17 bp, Homo sapiens
acggctctaggtggggc

SEQ ID NO: 385727 - DNA, 19 bp, Homo sapiens
acggctctaggtggggcgg

SEQ ID NO: 385728 - DNA, 22 bp, Homo sapiens
acggctgcctgacactgagccc

SEQ ID NO: 385729 - DNA, 18 bp, Homo sapiens
acggctgtgtatttctgt

SEQ ID NO: 385730 - DNA, 19 bp, Homo sapiens
acggctgtgtatttctgta

SEQ ID NO: 385731 - DNA, 23 bp, Homo sapiens
acggctgtgtatttctgtagaat

SEQ ID NO: 385732 - DNA, 13 bp, Homo sapiens
acgggaccgggcc

SEQ ID NO: 385733 - DNA, 19 bp, Homo sapiens
acgggagagcgccacccgc

SEQ ID NO: 385734 - DNA, 21 bp, Homo sapiens
acgggcacaagacccctgctc

SEQ ID NO: 385735 - DNA, 23 bp, Homo sapiens
acgggcccgctcaacctctcaga

SEQ ID NO: 385736 - DNA, 12 bp, Homo sapiens
acgggcctcccc

SEQ ID NO: 385737 - DNA, 19 bp, Homo sapiens
acggggacacggcctctgg

SEQ ID NO: 385738 - DNA, 19 bp, Homo sapiens
acggggagtgagactcctg

SEQ ID NO: 385739 - DNA, 13 bp, Homo sapiens
acggggcagagct

SEQ ID NO: 385740 - DNA, 14 bp, Homo sapiens
acggggcagagctg

SEQ ID NO: 385741 - DNA, 15 bp, Homo sapiens
acggggccagcatcc

SEQ ID NO: 385742 - DNA, 18 bp, Homo sapiens
acggggcctccaacccat

SEQ ID NO: 385743 - DNA, 20 bp, Homo sapiens
acgggggaggccgaggcagg

SEQ ID NO: 385744 - DNA, 14 bp, Homo sapiens
acgggggctgcttc

SEQ ID NO: 385745 - DNA, 12 bp, Homo sapiens
acgggtctgtgg

SEQ ID NO: 385746 - DNA, 16 bp, Homo sapiens
acggtacttggtaaga

SEQ ID NO: 385747 - DNA, 19 bp, Homo sapiens
acggtagtgatgaaattat

SEQ ID NO: 385748 - DNA, 16 bp, Homo sapiens
tccaggccactgtggc

SEQ ID NO: 385749 - DNA, 18 bp, Homo sapiens
tccaggccactgtggcca

SEQ ID NO: 385750 - DNA, 21 bp, Homo sapiens
tccaggccactgtggccagag

SEQ ID NO: 385751 - DNA, 14 bp, Homo sapiens
tccaggccagctcc

SEQ ID NO: 385752 - DNA, 18 bp, Homo sapiens
tccaggccagctcctttt

SEQ ID NO: 385753 - DNA, 22 bp, Homo sapiens
tccaggccaggcctcatcctcc

SEQ ID NO: 385754 - DNA, 23 bp, Homo sapiens
tccaggccaggcctcatcctcct

SEQ ID NO: 385755 - DNA, 17 bp, Homo sapiens
tccaggccatggaggca

SEQ ID NO: 385756 - DNA, 20 bp, Homo sapiens
tccaggcccagcctggcccc

SEQ ID NO: 385757 - DNA, 21 bp, Homo sapiens
tccaggccccaaaaccacagc

SEQ ID NO: 385758 - DNA, 16 bp, Homo sapiens
tccaggcccctgagga

SEQ ID NO: 385759 - DNA, 21 bp, Homo sapiens
tccaggcccctgaggactgga

SEQ ID NO: 385760 - DNA, 13 bp, Homo sapiens
tccaggcctgagg

SEQ ID NO: 385761 - DNA, 14 bp, Homo sapiens
tccaggcgtagggc

SEQ ID NO: 385762 - DNA, 19 bp, Homo sapiens
tccaggcgtagggccaggg

SEQ ID NO: 385763 - DNA, 20 bp, Homo sapiens
tccaggcgtagggccagggc

SEQ ID NO: 385764 - DNA, 23 bp, Homo sapiens
tccaggcgtgggacgtggtcagg

SEQ ID NO: 385765 - DNA, 14 bp, Homo sapiens
tccaggctccaggc

SEQ ID NO: 385766 - DNA, 15 bp, Homo sapiens
tccaggctcttcctg

SEQ ID NO: 385767 - DNA, 19 bp, Homo sapiens
tccaggctcttcctggacc

SEQ ID NO: 385768 - DNA, 13 bp, Homo sapiens
tccaggctggggc

SEQ ID NO: 385769 - DNA, 14 bp, Homo sapiens
tccaggctggggcc

SEQ ID NO: 385770 - DNA, 17 bp, Homo sapiens
tccaggctggggcctgg

SEQ ID NO: 385771 - DNA, 20 bp, Homo sapiens
tccaggctggggcctggcct

SEQ ID NO: 385772 - DNA, 12 bp, Homo sapiens
tccaggctgtcc

SEQ ID NO: 385773 - DNA, 13 bp, Homo sapiens
tccaggctgtgtg

SEQ ID NO: 385774 - DNA, 23 bp, Homo sapiens
tccaggcttgggctccattccca

SEQ ID NO: 385775 - DNA, 14 bp, Homo sapiens
tccagggaagctgg

SEQ ID NO: 385776 - DNA, 18 bp, Homo sapiens
tccagggactgtacctgt

SEQ ID NO: 385777 - DNA, 18 bp, Homo sapiens
tccagggagtcccctccc

SEQ ID NO: 385778 - DNA, 15 bp, Homo sapiens
tccagggcagcagcc

SEQ ID NO: 385779 - DNA, 19 bp, Homo sapiens
tccaggggtcaccttgaga

SEQ ID NO: 385780 - DNA, 15 bp, Homo sapiens
tccagggtcttgggc

SEQ ID NO: 385781 - DNA, 15 bp, Homo sapiens
tccaggtcctttcct

SEQ ID NO: 385782 - DNA, 14 bp, Homo sapiens
tccaggtcgggctc

SEQ ID NO: 385783 - DNA, 20 bp, Homo sapiens
tccaggtcgggctcagctct

SEQ ID NO: 385784 - DNA, 23 bp, Homo sapiens
tccaggtgagtgtgagggcagca

SEQ ID NO: 385785 - DNA, 17 bp, Homo sapiens
tccaggtgattctgatc

SEQ ID NO: 385786 - DNA, 17 bp, Homo sapiens
tccaggtgccctgtggg

SEQ ID NO: 385787 - DNA, 19 bp, Homo sapiens
tccaggttccatccaccac

SEQ ID NO: 385788 - DNA, 21 bp, Homo sapiens
tccaggttccatccaccacct

SEQ ID NO: 385789 - DNA, 17 bp, Homo sapiens
tccaggttcgtatagaa

SEQ ID NO: 385790 - DNA, 21 bp, Homo sapiens
tccaggttcgtatagaaaaag

SEQ ID NO: 385791 - DNA, 19 bp, Homo sapiens
tccagtattcttgtcaaaa

SEQ ID NO: 385792 - DNA, 18 bp, Homo sapiens
tccagtattgaaaacttc

SEQ ID NO: 385793 - DNA, 16 bp, Homo sapiens
tccagtcaaagacgct

SEQ ID NO: 385794 - DNA, 14 bp, Homo sapiens
tccagtccagtttc

SEQ ID NO: 385795 - DNA, 18 bp, Homo sapiens
tccagtccccctatcctt

SEQ ID NO: 385796 - DNA, 21 bp, Homo sapiens
tccagtccccctatccttggc

SEQ ID NO: 385797 - DNA, 20 bp, Homo sapiens
tccagtcctcacatgcccgc

SEQ ID NO: 385798 - DNA, 21 bp, Homo sapiens
tccagtcctcacatgcccgct

SEQ ID NO: 385799 - DNA, 23 bp, Homo sapiens
tccagtcctcacatgcccgctgt

SEQ ID NO: 385800 - DNA, 15 bp, Homo sapiens
tccagtctccaccag

SEQ ID NO: 385801 - DNA, 14 bp, Homo sapiens
tccagtctgctgcc

SEQ ID NO: 385802 - DNA, 15 bp, Homo sapiens
tccagtctgctgccc

SEQ ID NO: 385803 - DNA, 16 bp, Homo sapiens
tccagtctgctgccct

SEQ ID NO: 385804 - DNA, 19 bp, Homo sapiens
tccagtctgctgccctcca

SEQ ID NO: 385805 - DNA, 14 bp, Homo sapiens
tccagtctgttctc

SEQ ID NO: 385806 - DNA, 15 bp, Homo sapiens
tccagtgcaaccaca

SEQ ID NO: 385807 - DNA, 15 bp, Homo sapiens
tccagtgcttccaca

SEQ ID NO: 385808 - DNA, 22 bp, Homo sapiens
tccagtggaagaagaaaacact

SEQ ID NO: 385809 - DNA, 16 bp, Homo sapiens
tccagtggcctggctc

SEQ ID NO: 385810 - DNA, 23 bp, Homo sapiens
tccagtggcctggctccgctgtg

SEQ ID NO: 385811 - DNA, 23 bp, Homo sapiens
tccagtgggaggtgagaccacct

SEQ ID NO: 385812 - DNA, 16 bp, Homo sapiens
tccagtgttgcctcct

SEQ ID NO: 385813 - DNA, 20 bp, Homo sapiens
tccagttcaggaatttttgt

SEQ ID NO: 385814 - DNA, 21 bp, Homo sapiens
tccagttcaggaatttttgtt

SEQ ID NO: 385815 - DNA, 15 bp, Homo sapiens
tccagttgcgtgtct

SEQ ID NO: 385816 - DNA, 12 bp, Homo sapiens
tccagttttgtt

SEQ ID NO: 385817 - DNA, 16 bp, Homo sapiens
tccataaagtgtaatt

SEQ ID NO: 385818 - DNA, 21 bp, Homo sapiens
tccataacctctatatcttta

SEQ ID NO: 385819 - DNA, 16 bp, Homo sapiens
tccataaggaatgtag

SEQ ID NO: 385820 - DNA, 21 bp, Homo sapiens
tccataatctggactcctctg

SEQ ID NO: 385821 - DNA, 19 bp, Homo sapiens
tccataattatgacagtta

SEQ ID NO: 385822 - DNA, 16 bp, Homo sapiens
tccatacagcctctac

SEQ ID NO: 385823 - DNA, 13 bp, Homo sapiens
tccataccccctg

SEQ ID NO: 385824 - DNA, 15 bp, Homo sapiens
tccataccccctgcc

SEQ ID NO: 385825 - DNA, 21 bp, Homo sapiens
tccataccccctgccccagag

SEQ ID NO: 385826 - DNA, 15 bp, Homo sapiens
tccatagacacagta

SEQ ID NO: 385827 - DNA, 15 bp, Homo sapiens
tccataggaatcatg

SEQ ID NO: 385828 - DNA, 16 bp, Homo sapiens
tccatcacagccagcc

SEQ ID NO: 385829 - DNA, 17 bp, Homo sapiens
tccatcacagccagccc

SEQ ID NO: 385830 - DNA, 12 bp, Homo sapiens
tccatcagcagt

SEQ ID NO: 385831 - DNA, 16 bp, Homo sapiens
tccatcagctctctgc

SEQ ID NO: 385832 - DNA, 14 bp, Homo sapiens
tccatcaggccact

SEQ ID NO: 385833 - DNA, 19 bp, Homo sapiens
tccatcaggttccatcccg

SEQ ID NO: 385834 - DNA, 21 bp, Homo sapiens
tccatcatatgcctgacccct

SEQ ID NO: 385835 - DNA, 13 bp, Homo sapiens
tccatccaccacc

SEQ ID NO: 385836 - DNA, 14 bp, Homo sapiens
tccatcccatcatc

SEQ ID NO: 385837 - DNA, 12 bp, Homo sapiens
tccatccccagt

SEQ ID NO: 385838 - DNA, 12 bp, Homo sapiens
tccatcccctcc

SEQ ID NO: 385839 - DNA, 16 bp, Homo sapiens
tccatcccctccctgc

SEQ ID NO: 385840 - DNA, 18 bp, Homo sapiens
tccatcccctccctgcct

SEQ ID NO: 385841 - DNA, 23 bp, Homo sapiens
tccatcccctccctgcctgctcc

SEQ ID NO: 385842 - DNA, 14 bp, Homo sapiens
tccatccctacccc

SEQ ID NO: 385843 - DNA, 18 bp, Homo sapiens
tccatccctaccccctaa

SEQ ID NO: 385844 - DNA, 14 bp, Homo sapiens
tccatcctgccagg

SEQ ID NO: 385845 - DNA, 17 bp, Homo sapiens
tccatcctgccaggagc

SEQ ID NO: 385846 - DNA, 17 bp, Homo sapiens
tccatcctgtacaagtg

SEQ ID NO: 385847 - DNA, 13 bp, Homo sapiens
tccatctccaggg

SEQ ID NO: 385848 - DNA, 20 bp, Homo sapiens
tccatctggggatggagaat

SEQ ID NO: 385849 - DNA, 15 bp, Homo sapiens
tccatctttctacag

SEQ ID NO: 385850 - DNA, 11 bp, Homo sapiens
tccatgaaaac

SEQ ID NO: 385851 - DNA, 18 bp, Homo sapiens
tccatgaaaacgttttat

SEQ ID NO: 385852 - DNA, 21 bp, Homo sapiens
tccatgaaaacgttttattgt

SEQ ID NO: 385853 - DNA, 21 bp, Homo sapiens
tccatgaatgtatcaggaaat

SEQ ID NO: 385854 - DNA, 19 bp, Homo sapiens
tccatgacagtagcatact

SEQ ID NO: 385855 - DNA, 20 bp, Homo sapiens
tccatgaccaggccaccatc

SEQ ID NO: 385856 - DNA, 15 bp, Homo sapiens
tccatgatggagtca

SEQ ID NO: 385857 - DNA, 15 bp, Homo sapiens
tccatgattccaagg

SEQ ID NO: 385858 - DNA, 13 bp, Homo sapiens
tccatgcaccaaa

SEQ ID NO: 385859 - DNA, 14 bp, Homo sapiens
tccatgcaccaaac

SEQ ID NO: 385860 - DNA, 21 bp, Homo sapiens
tccatgcagactcctcagatc

SEQ ID NO: 385861 - DNA, 20 bp, Homo sapiens
tccatgcagttattagaact

SEQ ID NO: 385862 - DNA, 15 bp, Homo sapiens
tccatgcctacagat

SEQ ID NO: 385863 - DNA, 21 bp, Homo sapiens
tccatgcctacagataattta

SEQ ID NO: 385864 - DNA, 21 bp, Homo sapiens
tccatgcctgagggtggagac

SEQ ID NO: 385865 - DNA, 21 bp, Homo sapiens
tccatgctcctcacctgtcta

SEQ ID NO: 385866 - DNA, 16 bp, Homo sapiens
tccatggcaattttgt

SEQ ID NO: 385867 - DNA, 13 bp, Homo sapiens
tccatggcaccag

SEQ ID NO: 385868 - DNA, 14 bp, Homo sapiens
tccatggcaccagc

SEQ ID NO: 385869 - DNA, 18 bp, Homo sapiens
tccatggcaccagccccc

SEQ ID NO: 385870 - DNA, 14 bp, Homo sapiens
tccatggccacccc

SEQ ID NO: 385871 - DNA, 14 bp, Homo sapiens
tccatggccctgcc

SEQ ID NO: 385872 - DNA, 14 bp, Homo sapiens
tccatggcttcctg

SEQ ID NO: 385873 - DNA, 15 bp, Homo sapiens
tccatggcttcctga

SEQ ID NO: 385874 - DNA, 22 bp, Homo sapiens
tccatggcttcctgagaaagcc

SEQ ID NO: 385875 - DNA, 23 bp, Homo sapiens
tcccccacccccaaagacctgcc

SEQ ID NO: 385876 - DNA, 11 bp, Homo sapiens
tcccccacctc

SEQ ID NO: 385877 - DNA, 22 bp, Homo sapiens
tcccccacgtggactctgtgct

SEQ ID NO: 385878 - DNA, 12 bp, Homo sapiens
tcccccagccag

SEQ ID NO: 385879 - DNA, 11 bp, Homo sapiens
tcccccagccc

SEQ ID NO: 385880 - DNA, 15 bp, Homo sapiens
tcccccagcccaata

SEQ ID NO: 385881 - DNA, 18 bp, Homo sapiens
tcccccagcccaataaag

SEQ ID NO: 385882 - DNA, 12 bp, Homo sapiens
tcccccagccct

SEQ ID NO: 385883 - DNA, 16 bp, Homo sapiens
tcccccagccctcagt

SEQ ID NO: 385884 - DNA, 14 bp, Homo sapiens
tcccccagccctgt

SEQ ID NO: 385885 - DNA, 16 bp, Homo sapiens
tcccccagccctgtgg

SEQ ID NO: 385886 - DNA, 18 bp, Homo sapiens
tcccccaggctgcgcctg

SEQ ID NO: 385887 - DNA, 19 bp, Homo sapiens
tcccccaggctgcgcctgc

SEQ ID NO: 385888 - DNA, 14 bp, Homo sapiens
tcccccagtacctc

SEQ ID NO: 385889 - DNA, 14 bp, Homo sapiens
tcccccatgtggct

SEQ ID NO: 385890 - DNA, 15 bp, Homo sapiens
tcccccatgtggctg

SEQ ID NO: 385891 - DNA, 16 bp, Homo sapiens
tcccccccctgtatag

SEQ ID NO: 385892 - DNA, 13 bp, Homo sapiens
tcccccctgagtg

SEQ ID NO: 385893 - DNA, 19 bp, Homo sapiens
tcccccgacactgctgcac

SEQ ID NO: 385894 - DNA, 22 bp, Homo sapiens
tcccccgacactgctgcaccag

SEQ ID NO: 385895 - DNA, 22 bp, Homo sapiens
tcccccgcagtccccagccctt

SEQ ID NO: 385896 - DNA, 15 bp, Homo sapiens
tccccctaattctta

SEQ ID NO: 385897 - DNA, 13 bp, Homo sapiens
tccccctacccac

SEQ ID NO: 385898 - DNA, 15 bp, Homo sapiens
tccccctacccaccg

SEQ ID NO: 385899 - DNA, 17 bp, Homo sapiens
tccccctatccttggca

SEQ ID NO: 385900 - DNA, 22 bp, Homo sapiens
tccccctccagtgcttggctgc

SEQ ID NO: 385901 - DNA, 23 bp, Homo sapiens
tccccctccagtgcttggctgcc

SEQ ID NO: 385902 - DNA, 14 bp, Homo sapiens
tccccctgccagca

SEQ ID NO: 385903 - DNA, 19 bp, Homo sapiens
tccccctgctccatgggca

SEQ ID NO: 385904 - DNA, 20 bp, Homo sapiens
tccccctggggcttctcctg

SEQ ID NO: 385905 - DNA, 21 bp, Homo sapiens
tccccctggggcttctcctga

SEQ ID NO: 385906 - DNA, 17 bp, Homo sapiens
tccccctgttttctgtt

SEQ ID NO: 385907 - DNA, 11 bp, Homo sapiens
tcccccttccc

SEQ ID NO: 385908 - DNA, 15 bp, Homo sapiens
tcccccttgcccgcc

SEQ ID NO: 385909 - DNA, 24 bp, Homo sapiens
tccccgaaacaggctactctcctc

SEQ ID NO: 385910 - DNA, 14 bp, Homo sapiens
tccccgacagtggc

SEQ ID NO: 385911 - DNA, 17 bp, Homo sapiens
tccccgacagtggctct

SEQ ID NO: 385912 - DNA, 20 bp, Homo sapiens
tccccgacagtggctctcca

SEQ ID NO: 385913 - DNA, 22 bp, Homo sapiens
tccccgatccccgacagtggct

SEQ ID NO: 385914 - DNA, 20 bp, Homo sapiens
tccccgcagcccgcctgccg

SEQ ID NO: 385915 - DNA, 21 bp, Homo sapiens
tccccgcagcccgcctgccgt

SEQ ID NO: 385916 - DNA, 13 bp, Homo sapiens
tccccgcctccac

SEQ ID NO: 385917 - DNA, 15 bp, Homo sapiens
tccctggctcaggga

SEQ ID NO: 385918 - DNA, 19 bp, Homo sapiens
tccctggctgcctctggga

SEQ ID NO: 385919 - DNA, 20 bp, Homo sapiens
tccctggctgtgagcagcct

SEQ ID NO: 385920 - DNA, 19 bp, Homo sapiens
tccctgggaccccctcccc

SEQ ID NO: 385921 - DNA, 17 bp, Homo sapiens
tccctggggatatgcaa

SEQ ID NO: 385922 - DNA, 17 bp, Homo sapiens
tccctgggggccttggg

SEQ ID NO: 385923 - DNA, 21 bp, Homo sapiens
tccctgggggccttgggtgag

SEQ ID NO: 385924 - DNA, 17 bp, Homo sapiens
tccctgggggtcccagg

SEQ ID NO: 385925 - DNA, 18 bp, Homo sapiens
tccctgggggtcccagga

SEQ ID NO: 385926 - DNA, 24 bp, Homo sapiens
tccctggggtttttttcatccctg

SEQ ID NO: 385927 - DNA, 14 bp, Homo sapiens
tccctggtcccttg

SEQ ID NO: 385928 - DNA, 23 bp, Homo sapiens
tccctggttttaccccagctcca

SEQ ID NO: 385929 - DNA, 15 bp, Homo sapiens
tccctgtcagaggct

SEQ ID NO: 385930 - DNA, 18 bp, Homo sapiens
tccctgtccatccccagt

SEQ ID NO: 385931 - DNA, 14 bp, Homo sapiens
tccctgtccccctc

SEQ ID NO: 385932 - DNA, 17 bp, Homo sapiens
tccctgtccctgccccg

SEQ ID NO: 385933 - DNA, 21 bp, Homo sapiens
tccctgtctccagggccccca

SEQ ID NO: 385934 - DNA, 23 bp, Homo sapiens
tccctgtctccagggcccccacc

SEQ ID NO: 385935 - DNA, 20 bp, Homo sapiens
tccctgtgtggaccatgggg

SEQ ID NO: 385936 - DNA, 17 bp, Homo sapiens
tccctgtgttgtctcta

SEQ ID NO: 385937 - DNA, 14 bp, Homo sapiens
tccctgtttgccta

SEQ ID NO: 385938 - DNA, 18 bp, Homo sapiens
tcccttaaaatagaaata

SEQ ID NO: 385939 - DNA, 15 bp, Homo sapiens
tcccttagcctctcc

SEQ ID NO: 385940 - DNA, 17 bp, Homo sapiens
tcccttagcctctccca

SEQ ID NO: 385941 - DNA, 18 bp, Homo sapiens
tcccttagcctctcccac

SEQ ID NO: 385942 - DNA, 15 bp, Homo sapiens
tcccttatttttatt

SEQ ID NO: 385943 - DNA, 21 bp, Homo sapiens
tcccttcaaccattccccatg

SEQ ID NO: 385944 - DNA, 22 bp, Homo sapiens
tcccttcaaccattccccatgg

SEQ ID NO: 385945 - DNA, 17 bp, Homo sapiens
tcccttcagtactgcag

SEQ ID NO: 385946 - DNA, 18 bp, Homo sapiens
tcccttcatctccaggga

SEQ ID NO: 385947 - DNA, 21 bp, Homo sapiens
tcccttccacctcacaactcc

SEQ ID NO: 385948 - DNA, 17 bp, Homo sapiens
tcccttccactgcctct

SEQ ID NO: 385949 - DNA, 20 bp, Homo sapiens
tcccttccactgcctctgcc

SEQ ID NO: 385950 - DNA, 13 bp, Homo sapiens
tcccttccccctg

SEQ ID NO: 385951 - DNA, 12 bp, Homo sapiens
tcccttcccctc

SEQ ID NO: 385952 - DNA, 21 bp, Homo sapiens
tcccttcccctccctggctcc

SEQ ID NO: 385953 - DNA, 17 bp, Homo sapiens
tcccttcccctgcctgg

SEQ ID NO: 385954 - DNA, 17 bp, Homo sapiens
tcccttcccttccactg

SEQ ID NO: 385955 - DNA, 20 bp, Homo sapiens
tcccttcctccgctcccctt

SEQ ID NO: 385956 - DNA, 14 bp, Homo sapiens
tcccttcctctctc

SEQ ID NO: 385957 - DNA, 16 bp, Homo sapiens
tcccttcctctctcct

SEQ ID NO: 385958 - DNA, 14 bp, Homo sapiens
tcccttcctggcct

SEQ ID NO: 385959 - DNA, 16 bp, Homo sapiens
tcccttcctggcctca

SEQ ID NO: 385960 - DNA, 14 bp, Homo sapiens
tcccttcctgtcct

SEQ ID NO: 385961 - DNA, 22 bp, Homo sapiens
tcccttctgataagactggaaa

SEQ ID NO: 385962 - DNA, 18 bp, Homo sapiens
tcccttctggctgtcagt

SEQ ID NO: 385963 - DNA, 17 bp, Homo sapiens
tcccttctttaccttca

SEQ ID NO: 385964 - DNA, 13 bp, Homo sapiens
tcccttctttcct

SEQ ID NO: 385965 - DNA, 20 bp, Homo sapiens
tcccttgcaggggtcccccc

SEQ ID NO: 385966 - DNA, 21 bp, Homo sapiens
tcccttgcaggggtcccccct

SEQ ID NO: 385967 - DNA, 21 bp, Homo sapiens
tcccttgccatcctaaaagcc

SEQ ID NO: 385968 - DNA, 20 bp, Homo sapiens
tcctccagaagcctctggct

SEQ ID NO: 385969 - DNA, 12 bp, Homo sapiens
tcctccagacca

SEQ ID NO: 385970 - DNA, 13 bp, Homo sapiens
tcctccagaccac

SEQ ID NO: 385971 - DNA, 16 bp, Homo sapiens
tcctccagaccaccag

SEQ ID NO: 385972 - DNA, 12 bp, Homo sapiens
tcctccagagga

SEQ ID NO: 385973 - DNA, 15 bp, Homo sapiens
tcctccagcccaccc

SEQ ID NO: 385974 - DNA, 22 bp, Homo sapiens
tcctccagcctcccctcccctg

SEQ ID NO: 385975 - DNA, 16 bp, Homo sapiens
tcctccatactcagga

SEQ ID NO: 385976 - DNA, 17 bp, Homo sapiens
tcctccatctttctaca

SEQ ID NO: 385977 - DNA, 15 bp, Homo sapiens
tcctccatttttgtt

SEQ ID NO: 385978 - DNA, 18 bp, Homo sapiens
tcctcccaactctggcct

SEQ ID NO: 385979 - DNA, 15 bp, Homo sapiens
tcctcccatggcctt

SEQ ID NO: 385980 - DNA, 18 bp, Homo sapiens
tcctcccatggccttccc

SEQ ID NO: 385981 - DNA, 20 bp, Homo sapiens
tcctcccatggccttccctc

SEQ ID NO: 385982 - DNA, 13 bp, Homo sapiens
tcctccccagcag

SEQ ID NO: 385983 - DNA, 16 bp, Homo sapiens
tcctccccagcaggtg

SEQ ID NO: 385984 - DNA, 15 bp, Homo sapiens
tcctcccccagagcc

SEQ ID NO: 385985 - DNA, 18 bp, Homo sapiens
tcctccccgatccccgac

SEQ ID NO: 385986 - DNA, 15 bp, Homo sapiens
tcctcccctcttgag

SEQ ID NO: 385987 - DNA, 15 bp, Homo sapiens
tcctccccttccctg

SEQ ID NO: 385988 - DNA, 17 bp, Homo sapiens
tcctccccttccctgca

SEQ ID NO: 385989 - DNA, 14 bp, Homo sapiens
tcctccccttgggc

SEQ ID NO: 385990 - DNA, 19 bp, Homo sapiens
tcctccctcatggctctgg

SEQ ID NO: 385991 - DNA, 19 bp, Homo sapiens
tcctccctcctgcaggctg

SEQ ID NO: 385992 - DNA, 13 bp, Homo sapiens
tcctccctgctca

SEQ ID NO: 385993 - DNA, 21 bp, Homo sapiens
tcctccctgctcagctggccg

SEQ ID NO: 385994 - DNA, 13 bp, Homo sapiens
tcctcccttcccc

SEQ ID NO: 385995 - DNA, 17 bp, Homo sapiens
tcctcccttccccactc

SEQ ID NO: 385996 - DNA, 16 bp, Homo sapiens
tcctcccttctttgct

SEQ ID NO: 385997 - DNA, 19 bp, Homo sapiens
tcctccgctcccctttccc

SEQ ID NO: 385998 - DNA, 15 bp, Homo sapiens
tcctccgtccaccca

SEQ ID NO: 385999 - DNA, 19 bp, Homo sapiens
tcctccgtccacccaggct

SEQ ID NO: 386000 - DNA, 14 bp, Homo sapiens
tcctccgtccagcc

SEQ ID NO: 386001 - DNA, 12 bp, Homo sapiens
tcctcctccaca

SEQ ID NO: 386002 - DNA, 13 bp, Homo sapiens
tcctcctccacag

SEQ ID NO: 386003 - DNA, 15 bp, Homo sapiens
tcctcctccagccca

SEQ ID NO: 386004 - DNA, 20 bp, Homo sapiens
tcctcctccatctttctaca

SEQ ID NO: 386005 - DNA, 14 bp, Homo sapiens
tcctcctcccaact

SEQ ID NO: 386006 - DNA, 15 bp, Homo sapiens
tcctcctcccctcct

SEQ ID NO: 386007 - DNA, 16 bp, Homo sapiens
tcctcctcccctcctc

SEQ ID NO: 386008 - DNA, 14 bp, Homo sapiens
tcctcctcctcctg

SEQ ID NO: 386009 - DNA, 17 bp, Homo sapiens
tcctcctgaagcctctg

SEQ ID NO: 386010 - DNA, 24 bp, Homo sapiens
tcctcctgaagcctctgccctgcc

SEQ ID NO: 386011 - DNA, 22 bp, Homo sapiens
tcctcctgagtgatcccatttc

SEQ ID NO: 386012 - DNA, 23 bp, Homo sapiens
tcctcctgagtgatcccatttct

SEQ ID NO: 386013 - DNA, 15 bp, Homo sapiens
tcctcctgccctgtc

SEQ ID NO: 386014 - DNA, 16 bp, Homo sapiens
tcctcctgccctgtcc

SEQ ID NO: 386015 - DNA, 20 bp, Homo sapiens
tcctcctggacccagcaggg

SEQ ID NO: 386016 - DNA, 15 bp, Homo sapiens
tcctcctgttcctgc

SEQ ID NO: 386017 - DNA, 19 bp, Homo sapiens
tcctcctgttcctgccttc

SEQ ID NO: 386018 - DNA, 14 bp, Homo sapiens
tcctcgcctaggcc

SEQ ID NO: 386019 - DNA, 19 bp, Homo sapiens
tcctcgctgtgccaccacc

SEQ ID NO: 386020 - DNA, 14 bp, Homo sapiens
tcctcggccccctc

SEQ ID NO: 386021 - DNA, 17 bp, Homo sapiens
tcctcgggcaagggccg

SEQ ID NO: 386022 - DNA, 14 bp, Homo sapiens
tcctcggtggcatt

SEQ ID NO: 386023 - DNA, 19 bp, Homo sapiens
tcctcgtccggcctgcagc

SEQ ID NO: 386024 - DNA, 22 bp, Homo sapiens
tcctctaacaggggctggtggg

SEQ ID NO: 386025 - DNA, 15 bp, Homo sapiens
tcctctatttcttta

SEQ ID NO: 386026 - DNA, 14 bp, Homo sapiens
tcctctattttgtg

SEQ ID NO: 386027 - DNA, 18 bp, Homo sapiens
tcctctcactaaacttta

SEQ ID NO: 386028 - DNA, 21 bp, Homo sapiens
tcctctcagaactcctgtgtg

SEQ ID NO: 386029 - DNA, 12 bp, Homo sapiens
tcctctcagctt

SEQ ID NO: 386030 - DNA, 14 bp, Homo sapiens
tcctctccactgcc

SEQ ID NO: 386031 - DNA, 14 bp, Homo sapiens
tcctctcctcgtcc

SEQ ID NO: 386032 - DNA, 21 bp, Homo sapiens
tcctctccttgggctcctggc

SEQ ID NO: 386033 - DNA, 23 bp, Homo sapiens
tcctctccttgggctcctggctg

SEQ ID NO: 386034 - DNA, 14 bp, Homo sapiens
tcctctcgttggta

SEQ ID NO: 386035 - DNA, 21 bp, Homo sapiens
tcctctcgttggtagttgaga

SEQ ID NO: 386036 - DNA, 16 bp, Homo sapiens
tcctctctccctgcct

SEQ ID NO: 386037 - DNA, 18 bp, Homo sapiens
tcctctctccctgcctca

SEQ ID NO: 386038 - DNA, 19 bp, Homo sapiens
tcctctctccctgcctcac

SEQ ID NO: 386039 - DNA, 21 bp, Homo sapiens
tcctctctccctgcctcacat

SEQ ID NO: 386040 - DNA, 20 bp, Homo sapiens
tcctctctctcacctacttc

SEQ ID NO: 386041 - DNA, 16 bp, Homo sapiens
tcctctctctccctcc

SEQ ID NO: 386042 - DNA, 18 bp, Homo sapiens
tcctctctctccctccac

SEQ ID NO: 386043 - DNA, 19 bp, Homo sapiens
tcctctctctccctccact

SEQ ID NO: 386044 - DNA, 21 bp, Homo sapiens
tcctctctctctctctctctg

SEQ ID NO: 386045 - DNA, 14 bp, Homo sapiens
tcctctctgctggg

SEQ ID NO: 386046 - DNA, 12 bp, Homo sapiens
tcctctctgggc

SEQ ID NO: 386047 - DNA, 14 bp, Homo sapiens
tcctctgagcagcc

SEQ ID NO: 386048 - DNA, 15 bp, Homo sapiens
tcctctgagcagcct

SEQ ID NO: 386049 - DNA, 22 bp, Homo sapiens
tcctctgagcagcctctgccag

SEQ ID NO: 386050 - DNA, 23 bp, Homo sapiens
tcctctgagcagcctctgccagg

SEQ ID NO: 386051 - DNA, 15 bp, Homo sapiens
tcctctgattatcag

SEQ ID NO: 386052 - DNA, 13 bp, Homo sapiens
tcctctgattctg

SEQ ID NO: 386053 - DNA, 17 bp, Homo sapiens
tcctctgcagcctgagc

SEQ ID NO: 386054 - DNA, 20 bp, Homo sapiens
tcctctgcaggacacagatc

SEQ ID NO: 386055 - DNA, 13 bp, Homo sapiens
tcctctgcagtgc

SEQ ID NO: 386056 - DNA, 15 bp, Homo sapiens
tcctctgcagtgcct

SEQ ID NO: 386057 - DNA, 16 bp, Homo sapiens
tcctctgccccctccc

SEQ ID NO: 386058 - DNA, 21 bp, Homo sapiens
tcctctgccccctcccccgca

SEQ ID NO: 386059 - DNA, 22 bp, Homo sapiens
tcctctgccccctcccccgcag

SEQ ID NO: 386060 - DNA, 14 bp, Homo sapiens
tcctctgccttgga

SEQ ID NO: 386061 - DNA, 15 bp, Homo sapiens
tcctctggtaaacat

SEQ ID NO: 386062 - DNA, 24 bp, Homo sapiens
tcctctggtaaacattcctccagc

SEQ ID NO: 386063 - DNA, 14 bp, Homo sapiens
tcctctgtgctccc

SEQ ID NO: 386064 - DNA, 12 bp, Homo sapiens
tcctcttacctg

SEQ ID NO: 386065 - DNA, 13 bp, Homo sapiens
tcctcttatttgc

SEQ ID NO: 386066 - DNA, 14 bp, Homo sapiens
tcctcttccttctc

SEQ ID NO: 386067 - DNA, 23 bp, Homo sapiens
tcctcttctgcttaggagagacc

SEQ ID NO: 386068 - DNA, 14 bp, Homo sapiens
tcctcttgctcaaa

SEQ ID NO: 386069 - DNA, 15 bp, Homo sapiens
tcctcttggagctga

SEQ ID NO: 386070 - DNA, 14 bp, Homo sapiens
tcctctttcccctc

SEQ ID NO: 386071 - DNA, 18 bp, Homo sapiens
tcctctttcccctccttt

SEQ ID NO: 386072 - DNA, 15 bp, Homo sapiens
tcctctttttttaaa

SEQ ID NO: 386073 - DNA, 22 bp, Homo sapiens
tcctctttttttaaaaataaat

SEQ ID NO: 386074 - DNA, 19 bp, Homo sapiens
tcctgaaacttacacacaa

SEQ ID NO: 386075 - DNA, 21 bp, Homo sapiens
tcctgaaagaaacagttaact

SEQ ID NO: 386076 - DNA, 13 bp, Homo sapiens
tcctgaagcctct

SEQ ID NO: 386077 - DNA, 15 bp, Homo sapiens
tcctgaattctattt

SEQ ID NO: 386078 - DNA, 13 bp, Homo sapiens
tcctgacaaatat

SEQ ID NO: 386079 - DNA, 22 bp, Homo sapiens
tcctgacaaatattttagaagc

SEQ ID NO: 386080 - DNA, 18 bp, Homo sapiens
tcctgacctcatgatcca

SEQ ID NO: 386081 - DNA, 21 bp, Homo sapiens
tcctgagaaacgtccatctct

SEQ ID NO: 386082 - DNA, 21 bp, Homo sapiens
tcctgagaaagcccacctggg

SEQ ID NO: 386083 - DNA, 16 bp, Homo sapiens
tcctgagaaggcgagg

SEQ ID NO: 386084 - DNA, 17 bp, Homo sapiens
tcctgagaaggcgagga

SEQ ID NO: 386085 - DNA, 23 bp, Homo sapiens
tcctgagaaggcgaggagagtgg

SEQ ID NO: 386086 - DNA, 17 bp, Homo sapiens
tcctgagattctgggaa

SEQ ID NO: 386087 - DNA, 20 bp, Homo sapiens
tcctgagattctgggaaagg

SEQ ID NO: 386088 - DNA, 20 bp, Homo sapiens
tcctgagcacccgctgacat

SEQ ID NO: 386089 - DNA, 15 bp, Homo sapiens
tcctgagccccctgc

SEQ ID NO: 386090 - DNA, 18 bp, Homo sapiens
tcctgagccccctgcacc

SEQ ID NO: 386091 - DNA, 19 bp, Homo sapiens
tcctgagccccctgcaccc

SEQ ID NO: 386092 - DNA, 13 bp, Homo sapiens
tcctgagcctgtg

SEQ ID NO: 386093 - DNA, 15 bp, Homo sapiens
tcctgagcttggcca

SEQ ID NO: 386094 - DNA, 19 bp, Homo sapiens
tcctgagcttggccagaag

SEQ ID NO: 386095 - DNA, 22 bp, Homo sapiens
tcctgagcttggccagaagggg

SEQ ID NO: 386096 - DNA, 21 bp, Homo sapiens
tcctgaggcagaacctggtgg

SEQ ID NO: 386097 - DNA, 15 bp, Homo sapiens
tcctgaggctggggc

SEQ ID NO: 386098 - DNA, 12 bp, Homo sapiens
tcctgagggcta

SEQ ID NO: 386099 - DNA, 15 bp, Homo sapiens
tcctgaggggcatct

SEQ ID NO: 386100 - DNA, 16 bp, Homo sapiens
tcctgaggtctggatt

SEQ ID NO: 386101 - DNA, 18 bp, Homo sapiens
tcctgataaacattaaac

SEQ ID NO: 386102 - DNA, 17 bp, Homo sapiens
tcctgataataattgat

SEQ ID NO: 386103 - DNA, 12 bp, Homo sapiens
actgtggccttg

SEQ ID NO: 386104 - DNA, 15 bp, Homo sapiens
actgtggccttggtc

SEQ ID NO: 386105 - DNA, 21 bp, Homo sapiens
actgtggcttctccgtcactc

SEQ ID NO: 386106 - DNA, 16 bp, Homo sapiens
actgtggggcaagcct

SEQ ID NO: 386107 - DNA, 20 bp, Homo sapiens
actgtgtaaataaactttca

SEQ ID NO: 386108 - DNA, 14 bp, Homo sapiens
actgtgtaactgcc

SEQ ID NO: 386109 - DNA, 20 bp, Homo sapiens
actgtgtcatggtgatgcaa

SEQ ID NO: 386110 - DNA, 14 bp, Homo sapiens
actgtgtgaagaaa

SEQ ID NO: 386111 - DNA, 18 bp, Homo sapiens
actgtgtggactgtgatg

SEQ ID NO: 386112 - DNA, 19 bp, Homo sapiens
actgtgtggactgtgatgc

SEQ ID NO: 386113 - DNA, 20 bp, Homo sapiens
actgtgtgggatacttagtg

SEQ ID NO: 386114 - DNA, 10 bp, Homo sapiens
actgtgtgtg

SEQ ID NO: 386115 - DNA, 20 bp, Homo sapiens
actgtgtgttgccacaggac

SEQ ID NO: 386116 - DNA, 19 bp, Homo sapiens
actgtgtttaatagtatat

SEQ ID NO: 386117 - DNA, 20 bp, Homo sapiens
actgtgtttatatgtcttgc

SEQ ID NO: 386118 - DNA, 13 bp, Homo sapiens
actgttagctttt

SEQ ID NO: 386119 - DNA, 20 bp, Homo sapiens
actgttagctttttaaaaca

SEQ ID NO: 386120 - DNA, 14 bp, Homo sapiens
actgttagtgacag

SEQ ID NO: 386121 - DNA, 18 bp, Homo sapiens
actgttcacggcagacca

SEQ ID NO: 386122 - DNA, 20 bp, Homo sapiens
actgttcatgaatacgtaaa

SEQ ID NO: 386123 - DNA, 15 bp, Homo sapiens
actgttccctctgct

SEQ ID NO: 386124 - DNA, 16 bp, Homo sapiens
actgttccctctgctc

SEQ ID NO: 386125 - DNA, 18 bp, Homo sapiens
actgttccctctgctcct

SEQ ID NO: 386126 - DNA, 19 bp, Homo sapiens
actgttctatagcagtcat

SEQ ID NO: 386127 - DNA, 21 bp, Homo sapiens
actgttctcatggagaagact

SEQ ID NO: 386128 - DNA, 13 bp, Homo sapiens
actgttgaaaatt

SEQ ID NO: 386129 - DNA, 14 bp, Homo sapiens
actgttgaaaatta

SEQ ID NO: 386130 - DNA, 21 bp, Homo sapiens
actgttgaaaattattttaaa

SEQ ID NO: 386131 - DNA, 23 bp, Homo sapiens
actgttgaaaattattttaaaca

SEQ ID NO: 386132 - DNA, 18 bp, Homo sapiens
actgttgcatttactttt

SEQ ID NO: 386133 - DNA, 21 bp, Homo sapiens
actgttgcctttgctcttata

SEQ ID NO: 386134 - DNA, 18 bp, Homo sapiens
actgtttatggtattttc

SEQ ID NO: 386135 - DNA, 15 bp, Homo sapiens
actgtttatttctgt

SEQ ID NO: 386136 - DNA, 19 bp, Homo sapiens
actgtttatttctgtttct

SEQ ID NO: 386137 - DNA, 14 bp, Homo sapiens
actgtttctctgct

SEQ ID NO: 386138 - DNA, 14 bp, Homo sapiens
actgtttcttctca

SEQ ID NO: 386139 - DNA, 15 bp, Homo sapiens
actgttttcatgtgt

SEQ ID NO: 386140 - DNA, 16 bp, Homo sapiens
actgtttttgaagaag

SEQ ID NO: 386141 - DNA, 19 bp, Homo sapiens
actgttttttcctgagctt

SEQ ID NO: 386142 - DNA, 14 bp, Homo sapiens
acttaaaaaatgtc

SEQ ID NO: 386143 - DNA, 15 bp, Homo sapiens
acttaaaaaatgtcc

SEQ ID NO: 386144 - DNA, 14 bp, Homo sapiens
acttaaaaatgtaa

SEQ ID NO: 386145 - DNA, 12 bp, Homo sapiens
acttaaaagtat

SEQ ID NO: 386146 - DNA, 17 bp, Homo sapiens
acttaaaagtattcata

SEQ ID NO: 386147 - DNA, 13 bp, Homo sapiens
acttaaacaaaaa

SEQ ID NO: 386148 - DNA, 17 bp, Homo sapiens
acttaaacaaaaacttt

SEQ ID NO: 386149 - DNA, 17 bp, Homo sapiens
acttaaaggctgtggta

SEQ ID NO: 386150 - DNA, 13 bp, Homo sapiens
acttaaatgaaag

SEQ ID NO: 386151 - DNA, 15 bp, Homo sapiens
acttaacggctccag

SEQ ID NO: 386152 - DNA, 13 bp, Homo sapiens
acttaactgtgtg

SEQ ID NO: 386153 - DNA, 17 bp, Homo sapiens
acttaactgtgtgaaga

SEQ ID NO: 386154 - DNA, 19 bp, Homo sapiens
acttaagacaaatgggact

SEQ ID NO: 386155 - DNA, 20 bp, Homo sapiens
acttaagacaaatgggactg

SEQ ID NO: 386156 - DNA, 22 bp, Homo sapiens
acttaagacaaatgggactgat

SEQ ID NO: 386157 - DNA, 23 bp, Homo sapiens
acttaagacaaatgggactgatg

SEQ ID NO: 386158 - DNA, 13 bp, Homo sapiens
acttaagattaaa

SEQ ID NO: 386159 - DNA, 19 bp, Homo sapiens
acttaaggggccaaggcag

SEQ ID NO: 386160 - DNA, 14 bp, Homo sapiens
acttaatcatatca

SEQ ID NO: 386161 - DNA, 19 bp, Homo sapiens
acttaatcttctctcttga

SEQ ID NO: 386162 - DNA, 23 bp, Homo sapiens
acttaatcttctctcttgattga

SEQ ID NO: 386163 - DNA, 16 bp, Homo sapiens
acttacactttatgca

SEQ ID NO: 386164 - DNA, 21 bp, Homo sapiens
acttacctaagtgacatttgt

SEQ ID NO: 386165 - DNA, 22 bp, Homo sapiens
acttacttagagatgctactgt

SEQ ID NO: 386166 - DNA, 24 bp, Homo sapiens
acttacttagagatgctactgtca

SEQ ID NO: 386167 - DNA, 16 bp, Homo sapiens
acttagaataaaattg

SEQ ID NO: 386168 - DNA, 15 bp, Homo sapiens
acttagatctgagcc

SEQ ID NO: 386169 - DNA, 16 bp, Homo sapiens
acttagatctgagccc

SEQ ID NO: 386170 - DNA, 17 bp, Homo sapiens
acttagatctgagccct

SEQ ID NO: 386171 - DNA, 21 bp, Homo sapiens
acttagatctgagccctccct

SEQ ID NO: 386172 - DNA, 15 bp, Homo sapiens
acttagcatgcacaa

SEQ ID NO: 386173 - DNA, 17 bp, Homo sapiens
acttagtatattttctt

SEQ ID NO: 386174 - DNA, 19 bp, Homo sapiens
acttagtcctgatgtactt

SEQ ID NO: 386175 - DNA, 20 bp, Homo sapiens
acttagtggtatgtctcttt

SEQ ID NO: 386176 - DNA, 21 bp, Homo sapiens
acttagtgtttagcattaaaa

SEQ ID NO: 386177 - DNA, 19 bp, Homo sapiens
acttataaatcatattgat

SEQ ID NO: 386178 - DNA, 20 bp, Homo sapiens
acttataaatcatattgatg

SEQ ID NO: 386179 - DNA, 18 bp, Homo sapiens
acttatatgctgaattga

SEQ ID NO: 386180 - DNA, 19 bp, Homo sapiens
acttatatgctgaattgaa

SEQ ID NO: 386181 - DNA, 15 bp, Homo sapiens
acttatatttcccta

SEQ ID NO: 386182 - DNA, 19 bp, Homo sapiens
acttatatttttaataaaa

SEQ ID NO: 386183 - DNA, 20 bp, Homo sapiens
acttatcaaaaatgcaaatt

SEQ ID NO: 386184 - DNA, 20 bp, Homo sapiens
acttatcaaatcattcaaaa

SEQ ID NO: 386185 - DNA, 14 bp, Homo sapiens
acttatgcacattt

SEQ ID NO: 386186 - DNA, 16 bp, Homo sapiens
acttatgcacatttgt

SEQ ID NO: 386187 - DNA, 17 bp, Homo sapiens
acttatgcatagatata

SEQ ID NO: 386188 - DNA, 20 bp, Homo sapiens
acttatgccgtctcatattt

SEQ ID NO: 386189 - DNA, 19 bp, Homo sapiens
acttatgctagtttattgg

SEQ ID NO: 386190 - DNA, 14 bp, Homo sapiens
acttatgctgctgt

SEQ ID NO: 386191 - DNA, 13 bp, Homo sapiens
acttattacaatt

SEQ ID NO: 386192 - DNA, 15 bp, Homo sapiens
acttattgcctgggc

SEQ ID NO: 386193 - DNA, 13 bp, Homo sapiens
acttattgctttg

SEQ ID NO: 386194 - DNA, 14 bp, Homo sapiens
acttattgctttga

SEQ ID NO: 386195 - DNA, 18 bp, Homo sapiens
acttattgctttgaaact

SEQ ID NO: 386196 - DNA, 17 bp, Homo sapiens
acttatttataacattg

SEQ ID NO: 386197 - DNA, 23 bp, Homo sapiens
acttatttataacattgtaaatg

SEQ ID NO: 386198 - DNA, 16 bp, Homo sapiens
acttatttcttcaaat

SEQ ID NO: 386199 - DNA, 22 bp, Homo sapiens
acttatttgagtgattatttgt

SEQ ID NO: 386200 - DNA, 16 bp, Homo sapiens
acttattttatttcca

SEQ ID NO: 386201 - DNA, 21 bp, Homo sapiens
acttattttctgaattcataa

SEQ ID NO: 386202 - DNA, 16 bp, Homo sapiens
acttcaaaatcagtga

SEQ ID NO: 386203 - DNA, 19 bp, Homo sapiens
acttcaaagctgaatattt

SEQ ID NO: 386204 - DNA, 17 bp, Homo sapiens
acttcaaatcagagcag

SEQ ID NO: 386205 - DNA, 19 bp, Homo sapiens
acttcaaatcagagcagtg

SEQ ID NO: 386206 - DNA, 20 bp, Homo sapiens
acttcaaatcagagcagtga

SEQ ID NO: 386207 - DNA, 18 bp, Homo sapiens
acttcaagcaccagggaa

SEQ ID NO: 386208 - DNA, 13 bp, Homo sapiens
acttcaaggccca

SEQ ID NO: 386209 - DNA, 16 bp, Homo sapiens
acttcaagttaaagtg

SEQ ID NO: 386210 - DNA, 21 bp, Homo sapiens
acttcacacagcacctcctct

SEQ ID NO: 386211 - DNA, 15 bp, Homo sapiens
acttcaccaccccct

SEQ ID NO: 386212 - DNA, 14 bp, Homo sapiens
acttcacccccaac

SEQ ID NO: 386213 - DNA, 18 bp, Homo sapiens
acttcagactctctcctc

SEQ ID NO: 386214 - DNA, 9 bp, Homo sapiens
acttcagca

SEQ ID NO: 386215 - DNA, 13 bp, Homo sapiens
acttcagcagggg

SEQ ID NO: 386216 - DNA, 16 bp, Homo sapiens
acttcagctgcctgaa

SEQ ID NO: 386217 - DNA, 17 bp, Homo sapiens
acttcaggctcttctcc

SEQ ID NO: 386218 - DNA, 20 bp, Homo sapiens
acttcaggctcttctccttt

SEQ ID NO: 386219 - DNA, 19 bp, Homo sapiens
acttcagggcagggctctg

SEQ ID NO: 386220 - DNA, 21 bp, Homo sapiens
acttcagggcagggctctgat

SEQ ID NO: 386221 - DNA, 17 bp, Homo sapiens
acttcaggttgttctgt

SEQ ID NO: 386222 - DNA, 22 bp, Homo sapiens
acttcaggttgttctgtataaa

SEQ ID NO: 386223 - DNA, 18 bp, Homo sapiens
acttcattctaaaccaaa

SEQ ID NO: 386224 - DNA, 22 bp, Homo sapiens
acttcattctaaaccaaaacag

SEQ ID NO: 386225 - DNA, 14 bp, Homo sapiens
acttcattcttgaa

SEQ ID NO: 386226 - DNA, 20 bp, Homo sapiens
acttcatttctgatgtgaaa

SEQ ID NO: 386227 - DNA, 17 bp, Homo sapiens
acttcatttggtgctgg

SEQ ID NO: 386228 - DNA, 18 bp, Homo sapiens
acttccaatttacatact

SEQ ID NO: 386229 - DNA, 16 bp, Homo sapiens
acttccatacagctct

SEQ ID NO: 386230 - DNA, 20 bp, Homo sapiens
acttccattctttcttcctc

SEQ ID NO: 386231 - DNA, 15 bp, Homo sapiens
acttcccagctggca

SEQ ID NO: 386232 - DNA, 13 bp, Homo sapiens
acttccccatccc

SEQ ID NO: 386233 - DNA, 14 bp, Homo sapiens
acttccccttccaa

SEQ ID NO: 386234 - DNA, 14 bp, Homo sapiens
acttccccttggga

SEQ ID NO: 386235 - DNA, 23 bp, Homo sapiens
acttccccttgggatgggcacag

SEQ ID NO: 386236 - DNA, 18 bp, Homo sapiens
acttccctagaagtcttc

SEQ ID NO: 386237 - DNA, 21 bp, Homo sapiens
tcctgatagtcacctgctggt

SEQ ID NO: 386238 - DNA, 23 bp, Homo sapiens
tcctgatggtacaggaaagctca

SEQ ID NO: 386239 - DNA, 13 bp, Homo sapiens
tcctgatgttttt

SEQ ID NO: 386240 - DNA, 17 bp, Homo sapiens
tcctgatgtttttccca

SEQ ID NO: 386241 - DNA, 21 bp, Homo sapiens
tcctgattattgaatgttata

SEQ ID NO: 386242 - DNA, 15 bp, Homo sapiens
tcctgatttgagttt

SEQ ID NO: 386243 - DNA, 17 bp, Homo sapiens
tcctgcaatctccaggg

SEQ ID NO: 386244 - DNA, 18 bp, Homo sapiens
tcctgcaatctccagggc

SEQ ID NO: 386245 - DNA, 13 bp, Homo sapiens
tcctgcaccccag

SEQ ID NO: 386246 - DNA, 15 bp, Homo sapiens
tcctgcaccccagca

SEQ ID NO: 386247 - DNA, 16 bp, Homo sapiens
tcctgcaccccagcat

SEQ ID NO: 386248 - DNA, 20 bp, Homo sapiens
tcctgcaccccagcattcca

SEQ ID NO: 386249 - DNA, 23 bp, Homo sapiens
tcctgcaccccagcattccagct

SEQ ID NO: 386250 - DNA, 13 bp, Homo sapiens
tcctgcaccctct

SEQ ID NO: 386251 - DNA, 20 bp, Homo sapiens
tcctgcacgccgtggagcat

SEQ ID NO: 386252 - DNA, 12 bp, Homo sapiens
tcctgcagagct

SEQ ID NO: 386253 - DNA, 14 bp, Homo sapiens
tcctgcagagctgg

SEQ ID NO: 386254 - DNA, 20 bp, Homo sapiens
tcctgcagaggaccacagtg

SEQ ID NO: 386255 - DNA, 15 bp, Homo sapiens
tcctgcagcctcctc

SEQ ID NO: 386256 - DNA, 19 bp, Homo sapiens
tcctgcagcctcctcctga

SEQ ID NO: 386257 - DNA, 17 bp, Homo sapiens
tcctgcagcctggaggc

SEQ ID NO: 386258 - DNA, 23 bp, Homo sapiens
tcctgcaggaacgagcactggcc

SEQ ID NO: 386259 - DNA, 24 bp, Homo sapiens
tcctgcaggaacgagcactggcca

SEQ ID NO: 386260 - DNA, 12 bp, Homo sapiens
tcctgcaggctg

SEQ ID NO: 386261 - DNA, 18 bp, Homo sapiens
tcctgcagtagaaggtgc

SEQ ID NO: 386262 - DNA, 24 bp, Homo sapiens
tcctgcagtagaaggtgccgtgag

SEQ ID NO: 386263 - DNA, 16 bp, Homo sapiens
tcctgcatccctccac

SEQ ID NO: 386264 - DNA, 15 bp, Homo sapiens
tcctgcatctttcat

SEQ ID NO: 386265 - DNA, 16 bp, Homo sapiens
tcctgcatttgtgaaa

SEQ ID NO: 386266 - DNA, 11 bp, Homo sapiens
tcctgccaaaa

SEQ ID NO: 386267 - DNA, 22 bp, Homo sapiens
tcctgccaagtggtttctatga

SEQ ID NO: 386268 - DNA, 20 bp, Homo sapiens
tcctgccacctggggcagtc

SEQ ID NO: 386269 - DNA, 10 bp, Homo sapiens
tcctgccagc

SEQ ID NO: 386270 - DNA, 12 bp, Homo sapiens
tcctgccagctg

SEQ ID NO: 386271 - DNA, 13 bp, Homo sapiens
tcctgccagctgc

SEQ ID NO: 386272 - DNA, 11 bp, Homo sapiens
tcctgccagga

SEQ ID NO: 386273 - DNA, 13 bp, Homo sapiens
tcctgccaggagc

SEQ ID NO: 386274 - DNA, 20 bp, Homo sapiens
tcctgcccagctctgaccct

SEQ ID NO: 386275 - DNA, 14 bp, Homo sapiens
tcctgcccagtgtt

SEQ ID NO: 386276 - DNA, 15 bp, Homo sapiens
tcctgccccaggcct

SEQ ID NO: 386277 - DNA, 14 bp, Homo sapiens
tcctgccccctgcc

SEQ ID NO: 386278 - DNA, 21 bp, Homo sapiens
tcctgccccctgccagtgaag

SEQ ID NO: 386279 - DNA, 14 bp, Homo sapiens
tcctgccctacaga

SEQ ID NO: 386280 - DNA, 23 bp, Homo sapiens
tcctgccctgtacctctctctgc

SEQ ID NO: 386281 - DNA, 15 bp, Homo sapiens
tcctgccctgtccct

SEQ ID NO: 386282 - DNA, 12 bp, Homo sapiens
tcctgccctgtt

SEQ ID NO: 386283 - DNA, 18 bp, Homo sapiens
tcctgccctgttgtgtat

SEQ ID NO: 386284 - DNA, 17 bp, Homo sapiens
tcctgcctcagcctccg

SEQ ID NO: 386285 - DNA, 15 bp, Homo sapiens
tcctgcctcagcctt

SEQ ID NO: 386286 - DNA, 20 bp, Homo sapiens
tcctgcctcagccttccaag

SEQ ID NO: 386287 - DNA, 11 bp, Homo sapiens
tcctgcctctc

SEQ ID NO: 386288 - DNA, 20 bp, Homo sapiens
tcctgcctgcccctctcccg

SEQ ID NO: 386289 - DNA, 14 bp, Homo sapiens
tcctgcctggccag

SEQ ID NO: 386290 - DNA, 16 bp, Homo sapiens
tcctgcctggccaggc

SEQ ID NO: 386291 - DNA, 15 bp, Homo sapiens
tcctgccttctcttc

SEQ ID NO: 386292 - DNA, 12 bp, Homo sapiens
tcctgcctttta

SEQ ID NO: 386293 - DNA, 17 bp, Homo sapiens
tcctgctagctgtagaa

SEQ ID NO: 386294 - DNA, 22 bp, Homo sapiens
tcctgctatttcccaagctgga

SEQ ID NO: 386295 - DNA, 21 bp, Homo sapiens
tcctgctccatgactggctgt

SEQ ID NO: 386296 - DNA, 15 bp, Homo sapiens
tcctgctctctaccc

SEQ ID NO: 386297 - DNA, 24 bp, Homo sapiens
tcctgctctctacccagcccatct

SEQ ID NO: 386298 - DNA, 22 bp, Homo sapiens
tcctgctgctcgggaaggcctg

SEQ ID NO: 386299 - DNA, 22 bp, Homo sapiens
tcctgctgctgtaactgctgag

SEQ ID NO: 386300 - DNA, 24 bp, Homo sapiens
tcctgctgctgtaactgctgagcc

SEQ ID NO: 386301 - DNA, 16 bp, Homo sapiens
tcctgctggatgcgtg

SEQ ID NO: 386302 - DNA, 13 bp, Homo sapiens
tcctgctggctga

SEQ ID NO: 386303 - DNA, 14 bp, Homo sapiens
tcctgctggctgag

SEQ ID NO: 386304 - DNA, 10 bp, Homo sapiens
tcctgctgtg

SEQ ID NO: 386305 - DNA, 21 bp, Homo sapiens
tcctgctttacaggatcatgt

SEQ ID NO: 386306 - DNA, 15 bp, Homo sapiens
tcctgctttctcttt

SEQ ID NO: 386307 - DNA, 16 bp, Homo sapiens
tcctgctttctctttc

SEQ ID NO: 386308 - DNA, 18 bp, Homo sapiens
tcctgctttctctttcag

SEQ ID NO: 386309 - DNA, 19 bp, Homo sapiens
tcctggaatgaagcatgta

SEQ ID NO: 386310 - DNA, 17 bp, Homo sapiens
tcctggacccagcaggg

SEQ ID NO: 386311 - DNA, 14 bp, Homo sapiens
tcctggactggccc

SEQ ID NO: 386312 - DNA, 14 bp, Homo sapiens
tcctggagagtctc

SEQ ID NO: 386313 - DNA, 19 bp, Homo sapiens
tcctggagagtctcactcc

SEQ ID NO: 386314 - DNA, 10 bp, Homo sapiens
tcctggagcc

SEQ ID NO: 386315 - DNA, 16 bp, Homo sapiens
tcctggagccccagaa

SEQ ID NO: 386316 - DNA, 18 bp, Homo sapiens
tcctggaggatgaccagg

SEQ ID NO: 386317 - DNA, 20 bp, Homo sapiens
tcctggattttctttctatg

SEQ ID NO: 386318 - DNA, 22 bp, Homo sapiens
tcctggcaagtgacccagctct

SEQ ID NO: 386319 - DNA, 21 bp, Homo sapiens
tcctggcaatagtgtgttctg

SEQ ID NO: 386320 - DNA, 23 bp, Homo sapiens
tcctggcagggcaggcagagctc

SEQ ID NO: 386321 - DNA, 22 bp, Homo sapiens
tcctggcatgggaatgaatgtc

SEQ ID NO: 386322 - DNA, 14 bp, Homo sapiens
tcctggccccgggc

SEQ ID NO: 386323 - DNA, 21 bp, Homo sapiens
tcctggccccgggctctggcc

SEQ ID NO: 386324 - DNA, 22 bp, Homo sapiens
tcctggccccgggctctggcca

SEQ ID NO: 386325 - DNA, 12 bp, Homo sapiens
tcctggcccctc

SEQ ID NO: 386326 - DNA, 22 bp, Homo sapiens
tcctggcccctccagaccctgc

SEQ ID NO: 386327 - DNA, 12 bp, Homo sapiens
tcctggccctct

SEQ ID NO: 386328 - DNA, 22 bp, Homo sapiens
tcctggcctcactggctggggc

SEQ ID NO: 386329 - DNA, 20 bp, Homo sapiens
tcctggcctcagccagctgc

SEQ ID NO: 386330 - DNA, 18 bp, Homo sapiens
tcctggccttctgaactc

SEQ ID NO: 386331 - DNA, 24 bp, Homo sapiens
tcctggctacatcccagcctgtgg

SEQ ID NO: 386332 - DNA, 17 bp, Homo sapiens
tcctggctcacagccac

SEQ ID NO: 386333 - DNA, 14 bp, Homo sapiens
tcctggctctgatt

SEQ ID NO: 386334 - DNA, 15 bp, Homo sapiens
tcctggctgccaggc

SEQ ID NO: 386335 - DNA, 16 bp, Homo sapiens
tcctggctttgcccaa

SEQ ID NO: 386336 - DNA, 23 bp, Homo sapiens
tcctggctttgcccaacctcagc

SEQ ID NO: 386337 - DNA, 19 bp, Homo sapiens
tcctgggaaggagggagct

SEQ ID NO: 386338 - DNA, 15 bp, Homo sapiens
tcctgggagacccat

SEQ ID NO: 386339 - DNA, 17 bp, Homo sapiens
tcctgggcagcccagag

SEQ ID NO: 386340 - DNA, 13 bp, Homo sapiens
tcctgggcccagg

SEQ ID NO: 386341 - DNA, 19 bp, Homo sapiens
tcctgggcccctccctacc

SEQ ID NO: 386342 - DNA, 20 bp, Homo sapiens
tcctgggcccctccctacct

SEQ ID NO: 386343 - DNA, 22 bp, Homo sapiens
tcctgggcccctccctacctca

SEQ ID NO: 386344 - DNA, 15 bp, Homo sapiens
tcctgggcctgtccc

SEQ ID NO: 386345 - DNA, 15 bp, Homo sapiens
tcctgggccttctca

SEQ ID NO: 386346 - DNA, 21 bp, Homo sapiens
tcctgggccttctcagctctc

SEQ ID NO: 386347 - DNA, 22 bp, Homo sapiens
tcctgggccttctcagctctcc

SEQ ID NO: 386348 - DNA, 13 bp, Homo sapiens
tcctgggcgccct

SEQ ID NO: 386349 - DNA, 14 bp, Homo sapiens
tcctgggcgccctg

SEQ ID NO: 386350 - DNA, 16 bp, Homo sapiens
tcctgggcgccctgga

SEQ ID NO: 386351 - DNA, 20 bp, Homo sapiens
tcctgggcgccctggaagcc

SEQ ID NO: 386352 - DNA, 14 bp, Homo sapiens
tcctggggaggctg

SEQ ID NO: 386353 - DNA, 19 bp, Homo sapiens
tcctggggccccgctggga

SEQ ID NO: 386354 - DNA, 20 bp, Homo sapiens
tcctggggccccgctgggat

SEQ ID NO: 386355 - DNA, 21 bp, Homo sapiens
tcctggggccccgctgggatt

SEQ ID NO: 386356 - DNA, 15 bp, Homo sapiens
tcctggggctccctt

SEQ ID NO: 386357 - DNA, 18 bp, Homo sapiens
tcctggggtggttggagg

SEQ ID NO: 386358 - DNA, 12 bp, Homo sapiens
tcctgggtgagt

SEQ ID NO: 386359 - DNA, 15 bp, Homo sapiens
tcctggtacagcagg

SEQ ID NO: 386360 - DNA, 18 bp, Homo sapiens
tcctggtacagcagggtc

SEQ ID NO: 386361 - DNA, 14 bp, Homo sapiens
tcctggtcaaagct

SEQ ID NO: 386362 - DNA, 17 bp, Homo sapiens
tcctggtcaaagctcct

SEQ ID NO: 386363 - DNA, 20 bp, Homo sapiens
tcctggtcttgagatgtctt

SEQ ID NO: 386364 - DNA, 14 bp, Homo sapiens
tcctggtgaggaca

SEQ ID NO: 386365 - DNA, 17 bp, Homo sapiens
tcctggtgaggcccagc

SEQ ID NO: 386366 - DNA, 19 bp, Homo sapiens
tcctggtggggctgagcct

SEQ ID NO: 386367 - DNA, 16 bp, Homo sapiens
tcctggtgtctagttt

SEQ ID NO: 386368 - DNA, 22 bp, Homo sapiens
tcctggttccttcctatgccca

SEQ ID NO: 386369 - DNA, 15 bp, Homo sapiens
tcctgtaaaatccat

SEQ ID NO: 386370 - DNA, 15 bp, Homo sapiens
tcctgtaattttgta

SEQ ID NO: 386371 - DNA, 20 bp, Homo sapiens
tcccttgcctcaatgccagt

SEQ ID NO: 386372 - DNA, 18 bp, Homo sapiens
tcccttggaaacctgccc

SEQ ID NO: 386373 - DNA, 22 bp, Homo sapiens
tcccttggatgtagtctgaggc

SEQ ID NO: 386374 - DNA, 16 bp, Homo sapiens
tcccttggccacggcc

SEQ ID NO: 386375 - DNA, 15 bp, Homo sapiens
tcccttggcccctct

SEQ ID NO: 386376 - DNA, 16 bp, Homo sapiens
tcccttggcccctctc

SEQ ID NO: 386377 - DNA, 12 bp, Homo sapiens
tcccttggcctc

SEQ ID NO: 386378 - DNA, 20 bp, Homo sapiens
tccctttacatctgtgttct

SEQ ID NO: 386379 - DNA, 13 bp, Homo sapiens
tccctttccctac

SEQ ID NO: 386380 - DNA, 13 bp, Homo sapiens
tccctttcccttc

SEQ ID NO: 386381 - DNA, 22 bp, Homo sapiens
tccctttctcttctgactggta

SEQ ID NO: 386382 - DNA, 15 bp, Homo sapiens
tccctttctgggagg

SEQ ID NO: 386383 - DNA, 13 bp, Homo sapiens
tccctttgacttc

SEQ ID NO: 386384 - DNA, 20 bp, Homo sapiens
tccctttgctccaccccact

SEQ ID NO: 386385 - DNA, 19 bp, Homo sapiens
tccctttgtggactttatt

SEQ ID NO: 386386 - DNA, 22 bp, Homo sapiens
tccctttgtggactttatttaa

SEQ ID NO: 386387 - DNA, 12 bp, Homo sapiens
tcccttttcctt

SEQ ID NO: 386388 - DNA, 22 bp, Homo sapiens
tccgacaaccgatgctccagcc

SEQ ID NO: 386389 - DNA, 23 bp, Homo sapiens
tccgacaaccgatgctccagcca

SEQ ID NO: 386390 - DNA, 16 bp, Homo sapiens
tccgagccagctctgg

SEQ ID NO: 386391 - DNA, 20 bp, Homo sapiens
tccgagcgacggctcctccc

SEQ ID NO: 386392 - DNA, 15 bp, Homo sapiens
tccgaggctccccgc

SEQ ID NO: 386393 - DNA, 19 bp, Homo sapiens
tccgaggctccccgcctcc

SEQ ID NO: 386394 - DNA, 16 bp, Homo sapiens
tccgagggcggccagg

SEQ ID NO: 386395 - DNA, 19 bp, Homo sapiens
tccgcaggctatttgttca

SEQ ID NO: 386396 - DNA, 15 bp, Homo sapiens
tccgcatgtgtctgt

SEQ ID NO: 386397 - DNA, 18 bp, Homo sapiens
tccgcatgtgtctgtatt

SEQ ID NO: 386398 - DNA, 14 bp, Homo sapiens
tccgcccagcctct

SEQ ID NO: 386399 - DNA, 15 bp, Homo sapiens
tccgcccagcctctc

SEQ ID NO: 386400 - DNA, 19 bp, Homo sapiens
tccgcccagcctctccccg

SEQ ID NO: 386401 - DNA, 15 bp, Homo sapiens
tccgcccgcccaccc

SEQ ID NO: 386402 - DNA, 15 bp, Homo sapiens
tccgccctgggctct

SEQ ID NO: 386403 - DNA, 18 bp, Homo sapiens
tccgcctacctcagcctc

SEQ ID NO: 386404 - DNA, 16 bp, Homo sapiens
tccgcctctgagccag

SEQ ID NO: 386405 - DNA, 18 bp, Homo sapiens
tccgcctctgagccagga

SEQ ID NO: 386406 - DNA, 21 bp, Homo sapiens
tccgcctctgagccaggagcc

SEQ ID NO: 386407 - DNA, 17 bp, Homo sapiens
tccgctcccctttccca

SEQ ID NO: 386408 - DNA, 18 bp, Homo sapiens
tccgctcccctttcccat

SEQ ID NO: 386409 - DNA, 20 bp, Homo sapiens
tccgctcccctttcccatca

SEQ ID NO: 386410 - DNA, 13 bp, Homo sapiens
tccgctctgaggc

SEQ ID NO: 386411 - DNA, 21 bp, Homo sapiens
tccggcagaggcagggccctg

SEQ ID NO: 386412 - DNA, 14 bp, Homo sapiens
tccggcctgcagcc

SEQ ID NO: 386413 - DNA, 20 bp, Homo sapiens
tccggcctgcagcccagaac

SEQ ID NO: 386414 - DNA, 17 bp, Homo sapiens
tccgggcaggggagcca

SEQ ID NO: 386415 - DNA, 14 bp, Homo sapiens
tccggggtctgtgc

SEQ ID NO: 386416 - DNA, 20 bp, Homo sapiens
tccggggtctgtgctgtgcc

SEQ ID NO: 386417 - DNA, 14 bp, Homo sapiens
tccgggtgccattc

SEQ ID NO: 386418 - DNA, 22 bp, Homo sapiens
tccgggtgcgtgaccggcccgc

SEQ ID NO: 386419 - DNA, 22 bp, Homo sapiens
tccgtcaccagaattagtcctc

SEQ ID NO: 386420 - DNA, 21 bp, Homo sapiens
tccgtccacccaggctgcact

SEQ ID NO: 386421 - DNA, 14 bp, Homo sapiens
tccgtccccagggt

SEQ ID NO: 386422 - DNA, 19 bp, Homo sapiens
tccgtgatccatccatctc

SEQ ID NO: 386423 - DNA, 23 bp, Homo sapiens
tccgtgatccatccatctccagg

SEQ ID NO: 386424 - DNA, 21 bp, Homo sapiens
tccgtgggtcatcccagcacc

SEQ ID NO: 386425 - DNA, 19 bp, Homo sapiens
tccgtggttcactttggtc

SEQ ID NO: 386426 - DNA, 20 bp, Homo sapiens
tccgttaacctttttgtaaa

SEQ ID NO: 386427 - DNA, 14 bp, Homo sapiens
tccgttcccacctc

SEQ ID NO: 386428 - DNA, 20 bp, Homo sapiens
tccgttcccacctctgagga

SEQ ID NO: 386429 - DNA, 16 bp, Homo sapiens
tccgtttatgggcctt

SEQ ID NO: 386430 - DNA, 18 bp, Homo sapiens
tccgtttatgggccttgc

SEQ ID NO: 386431 - DNA, 19 bp, Homo sapiens
tcctaaagtgaagaagcca

SEQ ID NO: 386432 - DNA, 23 bp, Homo sapiens
tcctaaatatccaaagactgtac

SEQ ID NO: 386433 - DNA, 14 bp, Homo sapiens
tcctaacaggatga

SEQ ID NO: 386434 - DNA, 19 bp, Homo sapiens
tcctaatgagatatatctt

SEQ ID NO: 386435 - DNA, 14 bp, Homo sapiens
tcctacaaccaggt

SEQ ID NO: 386436 - DNA, 23 bp, Homo sapiens
tcctacaagagcagcctgtggca

SEQ ID NO: 386437 - DNA, 17 bp, Homo sapiens
tcctacaagatttagaa

SEQ ID NO: 386438 - DNA, 18 bp, Homo sapiens
tcctacaagatttagaaa

SEQ ID NO: 386439 - DNA, 21 bp, Homo sapiens
tcctacaagatttagaaaaaa

SEQ ID NO: 386440 - DNA, 15 bp, Homo sapiens
tcctacaatatatat

SEQ ID NO: 386441 - DNA, 13 bp, Homo sapiens
tcctacagcccct

SEQ ID NO: 386442 - DNA, 15 bp, Homo sapiens
tcctacatacttctt

SEQ ID NO: 386443 - DNA, 16 bp, Homo sapiens
tcctacccaaccactc

SEQ ID NO: 386444 - DNA, 21 bp, Homo sapiens
tcctaccccacctcatgcctg

SEQ ID NO: 386445 - DNA, 14 bp, Homo sapiens
tcctaccctcccac

SEQ ID NO: 386446 - DNA, 15 bp, Homo sapiens
tcctacttaaacaaa

SEQ ID NO: 386447 - DNA, 22 bp, Homo sapiens
tcctacttaaacaaaaactttc

SEQ ID NO: 386448 - DNA, 18 bp, Homo sapiens
tcctagacttgaaagttt

SEQ ID NO: 386449 - DNA, 19 bp, Homo sapiens
tcctagagacagaagcagg

SEQ ID NO: 386450 - DNA, 18 bp, Homo sapiens
tcctagagcatctgtccc

SEQ ID NO: 386451 - DNA, 15 bp, Homo sapiens
tcctagaggtgggca

SEQ ID NO: 386452 - DNA, 19 bp, Homo sapiens
tcctagaggtgggcagctg

SEQ ID NO: 386453 - DNA, 14 bp, Homo sapiens
tcctagataaaaag

SEQ ID NO: 386454 - DNA, 15 bp, Homo sapiens
tcctagataaaaaga

SEQ ID NO: 386455 - DNA, 18 bp, Homo sapiens
tcctagatggcagtcact

SEQ ID NO: 386456 - DNA, 14 bp, Homo sapiens
tcctagctgtgtgc

SEQ ID NO: 386457 - DNA, 14 bp, Homo sapiens
tcctaggagagcca

SEQ ID NO: 386458 - DNA, 22 bp, Homo sapiens
tcctaggggccgagggaaatgc

SEQ ID NO: 386459 - DNA, 14 bp, Homo sapiens
tcctaggggtgcgc

SEQ ID NO: 386460 - DNA, 17 bp, Homo sapiens
tcctagtgtctattccc

SEQ ID NO: 386461 - DNA, 21 bp, Homo sapiens
tcctagtgtctattccctgga

SEQ ID NO: 386462 - DNA, 19 bp, Homo sapiens
tcctagttccattcttggt

SEQ ID NO: 386463 - DNA, 23 bp, Homo sapiens
tcctagttcttaagcatttgcgt

SEQ ID NO: 386464 - DNA, 13 bp, Homo sapiens
tcctatactggtt

SEQ ID NO: 386465 - DNA, 14 bp, Homo sapiens
tcctatcacctccc

SEQ ID NO: 386466 - DNA, 17 bp, Homo sapiens
tcctatcttttatttca

SEQ ID NO: 386467 - DNA, 16 bp, Homo sapiens
tcctatgtggcagctg

SEQ ID NO: 386468 - DNA, 18 bp, Homo sapiens
tcctattaatcttcagct

SEQ ID NO: 386469 - DNA, 14 bp, Homo sapiens
tcctattctattgc

SEQ ID NO: 386470 - DNA, 17 bp, Homo sapiens
tcctatttgttttcatg

SEQ ID NO: 386471 - DNA, 15 bp, Homo sapiens
tcctatttttcagaa

SEQ ID NO: 386472 - DNA, 18 bp, Homo sapiens
tcctcacagcctctccct

SEQ ID NO: 386473 - DNA, 15 bp, Homo sapiens
tcctcacatgcccgc

SEQ ID NO: 386474 - DNA, 22 bp, Homo sapiens
tcctcaccaataacttcagaga

SEQ ID NO: 386475 - DNA, 23 bp, Homo sapiens
tcctcaccccagtgcctgtctgg

SEQ ID NO: 386476 - DNA, 21 bp, Homo sapiens
tcctcacccccacccctgtac

SEQ ID NO: 386477 - DNA, 21 bp, Homo sapiens
tcctcacctctggactggcta

SEQ ID NO: 386478 - DNA, 15 bp, Homo sapiens
tcctcactgcccgca

SEQ ID NO: 386479 - DNA, 13 bp, Homo sapiens
tcctcactgggtg

SEQ ID NO: 386480 - DNA, 15 bp, Homo sapiens
tcctcactgggtggg

SEQ ID NO: 386481 - DNA, 16 bp, Homo sapiens
tcctcagccccagggc

SEQ ID NO: 386482 - DNA, 13 bp, Homo sapiens
tcctcaggctgct

SEQ ID NO: 386483 - DNA, 19 bp, Homo sapiens
tcctcagggtccctcagga

SEQ ID NO: 386484 - DNA, 20 bp, Homo sapiens
tcctcagggtccctcaggac

SEQ ID NO: 386485 - DNA, 13 bp, Homo sapiens
tcctcagggtggg

SEQ ID NO: 386486 - DNA, 16 bp, Homo sapiens
tcctcagggtgggggg

SEQ ID NO: 386487 - DNA, 18 bp, Homo sapiens
tcctcagtctttggggga

SEQ ID NO: 386488 - DNA, 17 bp, Homo sapiens
tcctcatcctgcttctc

SEQ ID NO: 386489 - DNA, 20 bp, Homo sapiens
tcctcatctctaacagctca

SEQ ID NO: 386490 - DNA, 23 bp, Homo sapiens
tcctcatctctaacagctcagga

SEQ ID NO: 386491 - DNA, 17 bp, Homo sapiens
tcctcatgaatgtaaat

SEQ ID NO: 386492 - DNA, 16 bp, Homo sapiens
tcctccaaactcctgc

SEQ ID NO: 386493 - DNA, 17 bp, Homo sapiens
tcctccaaactcctgcc

SEQ ID NO: 386494 - DNA, 20 bp, Homo sapiens
tcctccaaagcctgggcaga

SEQ ID NO: 386495 - DNA, 19 bp, Homo sapiens
tcctccaacgttaaaagac

SEQ ID NO: 386496 - DNA, 24 bp, Homo sapiens
tcctccaagaagccctccttgcca

SEQ ID NO: 386497 - DNA, 15 bp, Homo sapiens
tcctccaagtcttca

SEQ ID NO: 386498 - DNA, 15 bp, Homo sapiens
tcctccacagtgctg

SEQ ID NO: 386499 - DNA, 19 bp, Homo sapiens
tcctccaccacaagagctc

SEQ ID NO: 386500 - DNA, 16 bp, Homo sapiens
tcctccactcactcca

SEQ ID NO: 386501 - DNA, 18 bp, Homo sapiens
tcctccactcactccagc

SEQ ID NO: 386502 - DNA, 20 bp, Homo sapiens
tcctccactcactccagccc

SEQ ID NO: 386503 - DNA, 13 bp, Homo sapiens
tcctccactccac

SEQ ID NO: 386504 - DNA, 19 bp, Homo sapiens
tcctccagaagcctctggc

SEQ ID NO: 386505 - DNA, 14 bp, Homo sapiens
acttccctttctgc

SEQ ID NO: 386506 - DNA, 20 bp, Homo sapiens
acttcctagagcatctgtcc

SEQ ID NO: 386507 - DNA, 14 bp, Homo sapiens
acttcctcctcctc

SEQ ID NO: 386508 - DNA, 22 bp, Homo sapiens
acttcctggattttctttctat

SEQ ID NO: 386509 - DNA, 23 bp, Homo sapiens
acttcctggtgaggcccagcctg

SEQ ID NO: 386510 - DNA, 19 bp, Homo sapiens
acttccttcacatctccca

SEQ ID NO: 386511 - DNA, 13 bp, Homo sapiens
acttccttcctgc

SEQ ID NO: 386512 - DNA, 14 bp, Homo sapiens
acttcgaaaacaga

SEQ ID NO: 386513 - DNA, 20 bp, Homo sapiens
acttcgctattcccaggcag

SEQ ID NO: 386514 - DNA, 22 bp, Homo sapiens
acttcgctattcccaggcaggg

SEQ ID NO: 386515 - DNA, 18 bp, Homo sapiens
acttcgtcttctaatttc

SEQ ID NO: 386516 - DNA, 15 bp, Homo sapiens
acttctaatatattt

SEQ ID NO: 386517 - DNA, 14 bp, Homo sapiens
acttctaattgcca

SEQ ID NO: 386518 - DNA, 18 bp, Homo sapiens
acttctaggaggatgctg

SEQ ID NO: 386519 - DNA, 22 bp, Homo sapiens
acttctaggaggatgctgtgcc

SEQ ID NO: 386520 - DNA, 17 bp, Homo sapiens
acttctatttatttatt

SEQ ID NO: 386521 - DNA, 22 bp, Homo sapiens
acttctattttcaagtggaaac

SEQ ID NO: 386522 - DNA, 16 bp, Homo sapiens
acttctccccgcagcc

SEQ ID NO: 386523 - DNA, 21 bp, Homo sapiens
acttctcgtagatgctgccta

SEQ ID NO: 386524 - DNA, 22 bp, Homo sapiens
acttctcgtagatgctgcctag

SEQ ID NO: 386525 - DNA, 16 bp, Homo sapiens
acttctcttctgagcc

SEQ ID NO: 386526 - DNA, 15 bp, Homo sapiens
acttctgaccacact

SEQ ID NO: 386527 - DNA, 13 bp, Homo sapiens
acttctggaaggc

SEQ ID NO: 386528 - DNA, 17 bp, Homo sapiens
acttctggaaggctggc

SEQ ID NO: 386529 - DNA, 19 bp, Homo sapiens
acttctggaaggctggctg

SEQ ID NO: 386530 - DNA, 16 bp, Homo sapiens
acttctggtcccctgt

SEQ ID NO: 386531 - DNA, 23 bp, Homo sapiens
acttctggtcccctgtggtgatg

SEQ ID NO: 386532 - DNA, 22 bp, Homo sapiens
acttctggttgtatttctatat

SEQ ID NO: 386533 - DNA, 23 bp, Homo sapiens
acttctggttgtatttctatatt

SEQ ID NO: 386534 - DNA, 22 bp, Homo sapiens
acttcttcatccatagacacag

SEQ ID NO: 386535 - DNA, 23 bp, Homo sapiens
acttcttgttcatgttttgctaa

SEQ ID NO: 386536 - DNA, 15 bp, Homo sapiens
acttctttttcatta

SEQ ID NO: 386537 - DNA, 19 bp, Homo sapiens
acttctttttggcattatc

SEQ ID NO: 386538 - DNA, 15 bp, Homo sapiens
acttgaagcacaagt

SEQ ID NO: 386539 - DNA, 15 bp, Homo sapiens
acttgaatgtacaaa

SEQ ID NO: 386540 - DNA, 17 bp, Homo sapiens
acttgaatgtacaaaga

SEQ ID NO: 386541 - DNA, 19 bp, Homo sapiens
acttgaatgtacaaagata

SEQ ID NO: 386542 - DNA, 13 bp, Homo sapiens
acttgacattcct

SEQ ID NO: 386543 - DNA, 22 bp, Homo sapiens
acttgaccccgacgccacagcc

SEQ ID NO: 386544 - DNA, 20 bp, Homo sapiens
acttgagcaccgtcatggct

SEQ ID NO: 386545 - DNA, 11 bp, Homo sapiens
acttgagccca

SEQ ID NO: 386546 - DNA, 15 bp, Homo sapiens
acttgagcccactcc

SEQ ID NO: 386547 - DNA, 18 bp, Homo sapiens
acttgagcccaggaagtc

SEQ ID NO: 386548 - DNA, 16 bp, Homo sapiens
acttgaggacacatgt

SEQ ID NO: 386549 - DNA, 19 bp, Homo sapiens
acttgaggacacatgtcca

SEQ ID NO: 386550 - DNA, 24 bp, Homo sapiens
acttgagttggagtactatattta

SEQ ID NO: 386551 - DNA, 21 bp, Homo sapiens
acttgagttttatttatttta

SEQ ID NO: 386552 - DNA, 21 bp, Homo sapiens
acttgatgaataaacactttt

SEQ ID NO: 386553 - DNA, 12 bp, Homo sapiens
acttgatgcact

SEQ ID NO: 386554 - DNA, 17 bp, Homo sapiens
acttgattaagatttta

SEQ ID NO: 386555 - DNA, 19 bp, Homo sapiens
acttgattaagattttaca

SEQ ID NO: 386556 - DNA, 14 bp, Homo sapiens
acttgatttgcatg

SEQ ID NO: 386557 - DNA, 15 bp, Homo sapiens
acttgatttgcatgg

SEQ ID NO: 386558 - DNA, 16 bp, Homo sapiens
acttgatttgcatgga

SEQ ID NO: 386559 - DNA, 23 bp, Homo sapiens
acttgcactgggggaacagatgc

SEQ ID NO: 386560 - DNA, 15 bp, Homo sapiens
acttgcactgtgctt

SEQ ID NO: 386561 - DNA, 16 bp, Homo sapiens
acttgcgtcctgcaga

SEQ ID NO: 386562 - DNA, 17 bp, Homo sapiens
acttgcgtcctgcagag

SEQ ID NO: 386563 - DNA, 20 bp, Homo sapiens
acttgctagtgatacactgt

SEQ ID NO: 386564 - DNA, 22 bp, Homo sapiens
acttgctagtgatacactgtat

SEQ ID NO: 386565 - DNA, 14 bp, Homo sapiens
acttgctcaataaa

SEQ ID NO: 386566 - DNA, 15 bp, Homo sapiens
acttgctggggctca

SEQ ID NO: 386567 - DNA, 14 bp, Homo sapiens
acttggaaataata

SEQ ID NO: 386568 - DNA, 18 bp, Homo sapiens
acttggaatttgtaacct

SEQ ID NO: 386569 - DNA, 21 bp, Homo sapiens
acttggaatttgtaacctcag

SEQ ID NO: 386570 - DNA, 23 bp, Homo sapiens
acttggagagggacgaagaaagg

SEQ ID NO: 386571 - DNA, 17 bp, Homo sapiens
acttggagatctttgct

SEQ ID NO: 386572 - DNA, 14 bp, Homo sapiens
acttggagcccgtg

SEQ ID NO: 386573 - DNA, 16 bp, Homo sapiens
acttggagcccgtgca

SEQ ID NO: 386574 - DNA, 17 bp, Homo sapiens
acttggccgcttcccta

SEQ ID NO: 386575 - DNA, 15 bp, Homo sapiens
acttgggagcctgag

SEQ ID NO: 386576 - DNA, 11 bp, Homo sapiens
acttgggatgt

SEQ ID NO: 386577 - DNA, 17 bp, Homo sapiens
acttgggggcagagcag

SEQ ID NO: 386578 - DNA, 16 bp, Homo sapiens
acttggtaagagggag

SEQ ID NO: 386579 - DNA, 16 bp, Homo sapiens
acttggtgtactgggt

SEQ ID NO: 386580 - DNA, 16 bp, Homo sapiens
acttggttctgcttca

SEQ ID NO: 386581 - DNA, 17 bp, Homo sapiens
acttggttctgcttcaa

SEQ ID NO: 386582 - DNA, 22 bp, Homo sapiens
acttggtttgttatatcaggga

SEQ ID NO: 386583 - DNA, 20 bp, Homo sapiens
acttggtttttggctctttc

SEQ ID NO: 386584 - DNA, 15 bp, Homo sapiens
acttgtaaatacacc

SEQ ID NO: 386585 - DNA, 20 bp, Homo sapiens
acttgtaggaatctgccttc

SEQ ID NO: 386586 - DNA, 17 bp, Homo sapiens
acttgtagggatgcctt

SEQ ID NO: 386587 - DNA, 16 bp, Homo sapiens
acttgtagtttagtgt

SEQ ID NO: 386588 - DNA, 14 bp, Homo sapiens
acttgtatgaaaga

SEQ ID NO: 386589 - DNA, 18 bp, Homo sapiens
acttgtattaaagacaga

SEQ ID NO: 386590 - DNA, 22 bp, Homo sapiens
acttgtcactacaaaaatacaa

SEQ ID NO: 386591 - DNA, 15 bp, Homo sapiens
acttgtctgaggcct

SEQ ID NO: 386592 - DNA, 15 bp, Homo sapiens
acttgtcttgctctt

SEQ ID NO: 386593 - DNA, 15 bp, Homo sapiens
acttgtctttttctg

SEQ ID NO: 386594 - DNA, 20 bp, Homo sapiens
acttgtgcctcttgggagac

SEQ ID NO: 386595 - DNA, 15 bp, Homo sapiens
acttgtgctatagtg

SEQ ID NO: 386596 - DNA, 16 bp, Homo sapiens
acttgtggtatagtat

SEQ ID NO: 386597 - DNA, 17 bp, Homo sapiens
acttgtggttttcaaat

SEQ ID NO: 386598 - DNA, 23 bp, Homo sapiens
acttgtgtcccatgatccctgtg

SEQ ID NO: 386599 - DNA, 21 bp, Homo sapiens
acttgtgtgtgggctgtgagt

SEQ ID NO: 386600 - DNA, 19 bp, Homo sapiens
acttgttcatttctgtctc

SEQ ID NO: 386601 - DNA, 21 bp, Homo sapiens
acttgtttaattctaaaagag

SEQ ID NO: 386602 - DNA, 13 bp, Homo sapiens
acttgtttctttc

SEQ ID NO: 386603 - DNA, 13 bp, Homo sapiens
acttgttttggat

SEQ ID NO: 386604 - DNA, 15 bp, Homo sapiens
actttaaaagatgaa

SEQ ID NO: 386605 - DNA, 12 bp, Homo sapiens
actttaaagtat

SEQ ID NO: 386606 - DNA, 14 bp, Homo sapiens
actttaaattatat

SEQ ID NO: 386607 - DNA, 16 bp, Homo sapiens
actttaaattatatga

SEQ ID NO: 386608 - DNA, 12 bp, Homo sapiens
actttaataata

SEQ ID NO: 386609 - DNA, 19 bp, Homo sapiens
actttaatactcacctcct

SEQ ID NO: 386610 - DNA, 20 bp, Homo sapiens
actttaatactcacctcctc

SEQ ID NO: 386611 - DNA, 20 bp, Homo sapiens
actttaattgcttaaaagac

SEQ ID NO: 386612 - DNA, 20 bp, Homo sapiens
actttagaagtgcatttctg

SEQ ID NO: 386613 - DNA, 16 bp, Homo sapiens
actttagctagtatct

SEQ ID NO: 386614 - DNA, 23 bp, Homo sapiens
actttagggatctggggaaggac

SEQ ID NO: 386615 - DNA, 22 bp, Homo sapiens
actttagggctaaccagttctc

SEQ ID NO: 386616 - DNA, 19 bp, Homo sapiens
actttagggggtgggaggg

SEQ ID NO: 386617 - DNA, 15 bp, Homo sapiens
actttagtgattgct

SEQ ID NO: 386618 - DNA, 17 bp, Homo sapiens
actttagtgattgcttt

SEQ ID NO: 386619 - DNA, 18 bp, Homo sapiens
actttagtgattgctttt

SEQ ID NO: 386620 - DNA, 15 bp, Homo sapiens
actttataagccaat

SEQ ID NO: 386621 - DNA, 16 bp, Homo sapiens
actttatattttctat

SEQ ID NO: 386622 - DNA, 17 bp, Homo sapiens
actttatctcctgctct

SEQ ID NO: 386623 - DNA, 13 bp, Homo sapiens
actttatgaaaaa

SEQ ID NO: 386624 - DNA, 23 bp, Homo sapiens
actttatgaaaaaaatatatttt

SEQ ID NO: 386625 - DNA, 14 bp, Homo sapiens
actttatgtactgc

SEQ ID NO: 386626 - DNA, 12 bp, Homo sapiens
actttattcttg

SEQ ID NO: 386627 - DNA, 19 bp, Homo sapiens
actttattgattttctttc

SEQ ID NO: 386628 - DNA, 20 bp, Homo sapiens
actttattgattttctttct

SEQ ID NO: 386629 - DNA, 12 bp, Homo sapiens
actttatttctg

SEQ ID NO: 386630 - DNA, 20 bp, Homo sapiens
actttattttatataataaa

SEQ ID NO: 386631 - DNA, 24 bp, Homo sapiens
actttattttctggtagatagaaa

SEQ ID NO: 386632 - DNA, 20 bp, Homo sapiens
actttcaaaattaaatctgt

SEQ ID NO: 386633 - DNA, 14 bp, Homo sapiens
actttcagaactgc

SEQ ID NO: 386634 - DNA, 13 bp, Homo sapiens
actttccaacttt

SEQ ID NO: 386635 - DNA, 18 bp, Homo sapiens
actttccaccccctccct

SEQ ID NO: 386636 - DNA, 17 bp, Homo sapiens
actttccatgacagtag

SEQ ID NO: 386637 - DNA, 19 bp, Homo sapiens
actttccatgacagtagca

SEQ ID NO: 386638 - DNA, 14 bp, Homo sapiens
actttcccttcccc

SEQ ID NO: 386639 - DNA, 12 bp, Homo sapiens
actttcctctct

SEQ ID NO: 386640 - DNA, 17 bp, Homo sapiens
actttctgtctcaaacc

SEQ ID NO: 386641 - DNA, 23 bp, Homo sapiens
actttcttaatatcactttggtc

SEQ ID NO: 386642 - DNA, 20 bp, Homo sapiens
actttcttctgaatatttta

SEQ ID NO: 386643 - DNA, 20 bp, Homo sapiens
actttcttgagcaccaggtg

SEQ ID NO: 386644 - DNA, 15 bp, Homo sapiens
actttgaaaatattt

SEQ ID NO: 386645 - DNA, 17 bp, Homo sapiens
actttgaaaatatttct

SEQ ID NO: 386646 - DNA, 19 bp, Homo sapiens
actttgactaatacccaaa

SEQ ID NO: 386647 - DNA, 22 bp, Homo sapiens
actttgatttacagtgcctgta

SEQ ID NO: 386648 - DNA, 17 bp, Homo sapiens
actttgccaaggctctc

SEQ ID NO: 386649 - DNA, 22 bp, Homo sapiens
actttgccaaggctctcccctc

SEQ ID NO: 386650 - DNA, 23 bp, Homo sapiens
actttgccagcttttcctccctt

SEQ ID NO: 386651 - DNA, 21 bp, Homo sapiens
actttgcccagggtcctgtgc

SEQ ID NO: 386652 - DNA, 22 bp, Homo sapiens
actttgcccagggtcctgtgcc

SEQ ID NO: 386653 - DNA, 23 bp, Homo sapiens
actttgcccagggtcctgtgcct

SEQ ID NO: 386654 - DNA, 14 bp, Homo sapiens
actttgctctgggt

SEQ ID NO: 386655 - DNA, 14 bp, Homo sapiens
actttgcttcccat

SEQ ID NO: 386656 - DNA, 17 bp, Homo sapiens
actttggaagtttgtgt

SEQ ID NO: 386657 - DNA, 19 bp, Homo sapiens
actttgggattctttccat

SEQ ID NO: 386658 - DNA, 22 bp, Homo sapiens
actttgtacttgtgtttgctta

SEQ ID NO: 386659 - DNA, 20 bp, Homo sapiens
actttgtcacttctgctgta

SEQ ID NO: 386660 - DNA, 21 bp, Homo sapiens
actttgtcccctcacctccac

SEQ ID NO: 386661 - DNA, 18 bp, Homo sapiens
actttgtgagtattctat

SEQ ID NO: 386662 - DNA, 14 bp, Homo sapiens
actttgtgcaatat

SEQ ID NO: 386663 - DNA, 17 bp, Homo sapiens
actttgtggatgtcttc

SEQ ID NO: 386664 - DNA, 14 bp, Homo sapiens
actttgtgtctttt

SEQ ID NO: 386665 - DNA, 19 bp, Homo sapiens
actttgtgtcttttgttct

SEQ ID NO: 386666 - DNA, 21 bp, Homo sapiens
actttgtgtcttttgttctct

SEQ ID NO: 386667 - DNA, 19 bp, Homo sapiens
actttgttctttaggagat

SEQ ID NO: 386668 - DNA, 19 bp, Homo sapiens
actttgttggcccttccag

SEQ ID NO: 386669 - DNA, 21 bp, Homo sapiens
actttgttggcccttccagtg

SEQ ID NO: 386670 - DNA, 22 bp, Homo sapiens
acttttaacgtatgtatttcat

SEQ ID NO: 386671 - DNA, 17 bp, Homo sapiens
acttttaacttcacctt

SEQ ID NO: 386672 - DNA, 23 bp, Homo sapiens
acttttaagacttaatctttgct

SEQ ID NO: 386673 - DNA, 14 bp, Homo sapiens
acttttaaggcagt

SEQ ID NO: 386674 - DNA, 21 bp, Homo sapiens
acttttacagcttttctcttt

SEQ ID NO: 386675 - DNA, 18 bp, Homo sapiens
acttttataaattaaata

SEQ ID NO: 386676 - DNA, 15 bp, Homo sapiens
acttttatttgcaac

SEQ ID NO: 386677 - DNA, 22 bp, Homo sapiens
acttttatttgcaacatttaca

SEQ ID NO: 386678 - DNA, 16 bp, Homo sapiens
acttttccaagccctt

SEQ ID NO: 386679 - DNA, 12 bp, Homo sapiens
acttttcgttaa

SEQ ID NO: 386680 - DNA, 16 bp, Homo sapiens
acttttcgttaacatt

SEQ ID NO: 386681 - DNA, 17 bp, Homo sapiens
acttttctattaaaagt

SEQ ID NO: 386682 - DNA, 17 bp, Homo sapiens
acttttcttaaaaagtt

SEQ ID NO: 386683 - DNA, 14 bp, Homo sapiens
acttttctttgaag

SEQ ID NO: 386684 - DNA, 22 bp, Homo sapiens
acttttgaagaacaaaaggctt

SEQ ID NO: 386685 - DNA, 13 bp, Homo sapiens
acttttgcacata

SEQ ID NO: 386686 - DNA, 13 bp, Homo sapiens
acttttgtaaata

SEQ ID NO: 386687 - DNA, 19 bp, Homo sapiens
acttttgtaaatattcttg

SEQ ID NO: 386688 - DNA, 16 bp, Homo sapiens
acttttgtgtattctg

SEQ ID NO: 386689 - DNA, 17 bp, Homo sapiens
acttttgtgtattctgt

SEQ ID NO: 386690 - DNA, 14 bp, Homo sapiens
actttttaaaatat

SEQ ID NO: 386691 - DNA, 16 bp, Homo sapiens
actttttaaaatataa

SEQ ID NO: 386692 - DNA, 16 bp, Homo sapiens
actttttaaacagtgt

SEQ ID NO: 386693 - DNA, 22 bp, Homo sapiens
actttttagccagtgacttttt

SEQ ID NO: 386694 - DNA, 12 bp, Homo sapiens
actttttcaatg

SEQ ID NO: 386695 - DNA, 12 bp, Homo sapiens
actttttccttc

SEQ ID NO: 386696 - DNA, 15 bp, Homo sapiens
actttttgcagcttt

SEQ ID NO: 386697 - DNA, 17 bp, Homo sapiens
acttttttcctgtcaat

SEQ ID NO: 386698 - DNA, 13 bp, Homo sapiens
acttttttctcta

SEQ ID NO: 386699 - DNA, 12 bp, Homo sapiens
acttttttggaa

SEQ ID NO: 386700 - DNA, 15 bp, Homo sapiens
agaaaaaaaaaaaga

SEQ ID NO: 386701 - DNA, 14 bp, Homo sapiens
agaaaaaaacaaac

SEQ ID NO: 386702 - DNA, 14 bp, Homo sapiens
agaaaaaaataatt

SEQ ID NO: 386703 - DNA, 14 bp, Homo sapiens
agaaaaacatgtca

SEQ ID NO: 386704 - DNA, 14 bp, Homo sapiens
agaaaaaccaatga

SEQ ID NO: 386705 - DNA, 16 bp, Homo sapiens
agaaaaaccaatgatt

SEQ ID NO: 386706 - DNA, 20 bp, Homo sapiens
agaaaaaccaatgattcata

SEQ ID NO: 386707 - DNA, 12 bp, Homo sapiens
agaaaaagagag

SEQ ID NO: 386708 - DNA, 12 bp, Homo sapiens
agaaaaaggaaa

SEQ ID NO: 386709 - DNA, 22 bp, Homo sapiens
agaaaacaagatgagattggca

SEQ ID NO: 386710 - DNA, 23 bp, Homo sapiens
agaaaacaattgttctgggtgat

SEQ ID NO: 386711 - DNA, 16 bp, Homo sapiens
agaaaacactttcctg

SEQ ID NO: 386712 - DNA, 12 bp, Homo sapiens
agaaaacagcaa

SEQ ID NO: 386713 - DNA, 14 bp, Homo sapiens
agaaaacatatatt

SEQ ID NO: 386714 - DNA, 13 bp, Homo sapiens
agaaaacatgtaa

SEQ ID NO: 386715 - DNA, 20 bp, Homo sapiens
agaaaacggttaaaactgtc

SEQ ID NO: 386716 - DNA, 21 bp, Homo sapiens
agaaaagaatccctgttcatt

SEQ ID NO: 386717 - DNA, 16 bp, Homo sapiens
agaaaagacacttcaa

SEQ ID NO: 386718 - DNA, 16 bp, Homo sapiens
agaaaagaccctgaga

SEQ ID NO: 386719 - DNA, 18 bp, Homo sapiens
agaaaagaccctgagact

SEQ ID NO: 386720 - DNA, 17 bp, Homo sapiens
agaaaagagaagaaaga

SEQ ID NO: 386721 - DNA, 15 bp, Homo sapiens
agaaaagataaagat

SEQ ID NO: 386722 - DNA, 16 bp, Homo sapiens
agaaaagataaagatg

SEQ ID NO: 386723 - DNA, 21 bp, Homo sapiens
agaaaagcagacgcagcagct

SEQ ID NO: 386724 - DNA, 16 bp, Homo sapiens
agaaaaggaatgcaag

SEQ ID NO: 386725 - DNA, 18 bp, Homo sapiens
agaaaatagggtggacag

SEQ ID NO: 386726 - DNA, 23 bp, Homo sapiens
agaaaatattatgtgtttccata

SEQ ID NO: 386727 - DNA, 18 bp, Homo sapiens
agaaaatgagatgggttg

SEQ ID NO: 386728 - DNA, 16 bp, Homo sapiens
agaaaatggaacatta

SEQ ID NO: 386729 - DNA, 23 bp, Homo sapiens
agaaaatggacgtgttatgactc

SEQ ID NO: 386730 - DNA, 23 bp, Homo sapiens
agaaaatggatgacaaagaaaat

SEQ ID NO: 386731 - DNA, 23 bp, Homo sapiens
agaaaatgtgtctgcaacatgga

SEQ ID NO: 386732 - DNA, 10 bp, Homo sapiens
agaaacacaa

SEQ ID NO: 386733 - DNA, 19 bp, Homo sapiens
agaaacacagggttttgta

SEQ ID NO: 386734 - DNA, 15 bp, Homo sapiens
agaaacacagttttg

SEQ ID NO: 386735 - DNA, 11 bp, Homo sapiens
agaaacacttt

SEQ ID NO: 386736 - DNA, 16 bp, Homo sapiens
agaaacagctttcaag

SEQ ID NO: 386737 - DNA, 19 bp, Homo sapiens
agaaacagctttcaagtgc

SEQ ID NO: 386738 - DNA, 19 bp, Homo sapiens
agaaacagtgggagccctg

SEQ ID NO: 386739 - DNA, 21 bp, Homo sapiens
agaaacagtgggagccctgac

SEQ ID NO: 386740 - DNA, 16 bp, Homo sapiens
agaaaccaagtgggct

SEQ ID NO: 386741 - DNA, 18 bp, Homo sapiens
agaaaccaagtgggctgg

SEQ ID NO: 386742 - DNA, 21 bp, Homo sapiens
agaaaccagttatgtgaatga

SEQ ID NO: 386743 - DNA, 17 bp, Homo sapiens
agaaacccccaggagga

SEQ ID NO: 386744 - DNA, 19 bp, Homo sapiens
agaaacccctggggaccat

SEQ ID NO: 386745 - DNA, 18 bp, Homo sapiens
agaaacctccatcctgcc

SEQ ID NO: 386746 - DNA, 17 bp, Homo sapiens
agaaaccttaatatgtg

SEQ ID NO: 386747 - DNA, 16 bp, Homo sapiens
agaaacgtccatctct

SEQ ID NO: 386748 - DNA, 15 bp, Homo sapiens
agaaactcaccccca

SEQ ID NO: 386749 - DNA, 16 bp, Homo sapiens
agaaactctacataat

SEQ ID NO: 386750 - DNA, 12 bp, Homo sapiens
agaaactgaaag

SEQ ID NO: 386751 - DNA, 15 bp, Homo sapiens
agaaactgagtcctg

SEQ ID NO: 386752 - DNA, 22 bp, Homo sapiens
agaaactttgatctctgcttac

SEQ ID NO: 386753 - DNA, 14 bp, Homo sapiens
agaaagaaaatgaa

SEQ ID NO: 386754 - DNA, 12 bp, Homo sapiens
agaaagaagccc

SEQ ID NO: 386755 - DNA, 12 bp, Homo sapiens
agaaagaatgag

SEQ ID NO: 386756 - DNA, 13 bp, Homo sapiens
agaaagaatgaga

SEQ ID NO: 386757 - DNA, 22 bp, Homo sapiens
agaaagaatgagaaagaaaagg

SEQ ID NO: 386758 - DNA, 13 bp, Homo sapiens
agaaagcaaaaaa

SEQ ID NO: 386759 - DNA, 18 bp, Homo sapiens
agaaagcaaatcagacac

SEQ ID NO: 386760 - DNA, 18 bp, Homo sapiens
agaaagcaggagcagctg

SEQ ID NO: 386761 - DNA, 20 bp, Homo sapiens
agaaagcccacctgggctgg

SEQ ID NO: 386762 - DNA, 22 bp, Homo sapiens
agaaagcccctcacctcaggac

SEQ ID NO: 386763 - DNA, 12 bp, Homo sapiens
agaaagcctcct

SEQ ID NO: 386764 - DNA, 16 bp, Homo sapiens
agaaagctctgcatgt

SEQ ID NO: 386765 - DNA, 19 bp, Homo sapiens
agaaagctggcaacatgaa

SEQ ID NO: 386766 - DNA, 21 bp, Homo sapiens
agaaaggatatttaagaaaat

SEQ ID NO: 386767 - DNA, 23 bp, Homo sapiens
agaaaggattaagatacactcct

SEQ ID NO: 386768 - DNA, 18 bp, Homo sapiens
agaaagggagcagagaag

SEQ ID NO: 386769 - DNA, 17 bp, Homo sapiens
agaaagggcagcccctc

SEQ ID NO: 386770 - DNA, 23 bp, Homo sapiens
agaaaggggcaggagctcagatg

SEQ ID NO: 386771 - DNA, 15 bp, Homo sapiens
agaaagggtctgata

SEQ ID NO: 386772 - DNA, 18 bp, Homo sapiens
agaaaggtgaaacacaca

SEQ ID NO: 386773 - DNA, 19 bp, Homo sapiens
agaaaggtgaaacacacac

SEQ ID NO: 386774 - DNA, 18 bp, Homo sapiens
agaaaggttgattctcat

SEQ ID NO: 386775 - DNA, 14 bp, Homo sapiens
agaaagtaaaaaga

SEQ ID NO: 386776 - DNA, 13 bp, Homo sapiens
agaaagtctatgc

SEQ ID NO: 386777 - DNA, 23 bp, Homo sapiens
agaaagtgaagcaaatcagaaac

SEQ ID NO: 386778 - DNA, 15 bp, Homo sapiens
agaaagtgaataaaa

SEQ ID NO: 386779 - DNA, 16 bp, Homo sapiens
agaaagtgaataaaaa

SEQ ID NO: 386780 - DNA, 15 bp, Homo sapiens
agaaagtgtgcttta

SEQ ID NO: 386781 - DNA, 23 bp, Homo sapiens
agaaagtgtgctttatgctgaaa

SEQ ID NO: 386782 - DNA, 12 bp, Homo sapiens
agaaagtttccc

SEQ ID NO: 386783 - DNA, 19 bp, Homo sapiens
agaaataaatagctatatc

SEQ ID NO: 386784 - DNA, 15 bp, Homo sapiens
agaaataatggtctt

SEQ ID NO: 386785 - DNA, 16 bp, Homo sapiens
agaaatataaaaataa

SEQ ID NO: 386786 - DNA, 14 bp, Homo sapiens
agaaatatgcagaa

SEQ ID NO: 386787 - DNA, 21 bp, Homo sapiens
agaaatcaattttttaaacca

SEQ ID NO: 386788 - DNA, 19 bp, Homo sapiens
agaaatcacaggggcgggg

SEQ ID NO: 386789 - DNA, 16 bp, Homo sapiens
agaaatcattgtagaa

SEQ ID NO: 386790 - DNA, 21 bp, Homo sapiens
agaaatccatatcttaaagaa

SEQ ID NO: 386791 - DNA, 18 bp, Homo sapiens
agaaatcccagttcatgt

SEQ ID NO: 386792 - DNA, 20 bp, Homo sapiens
agaaatcgccttatgagaac

SEQ ID NO: 386793 - DNA, 18 bp, Homo sapiens
agaaatctcacttttctc

SEQ ID NO: 386794 - DNA, 19 bp, Homo sapiens
agaaatgaataatttccca

SEQ ID NO: 386795 - DNA, 23 bp, Homo sapiens
agaaatgaccaatattatactaa

SEQ ID NO: 386796 - DNA, 13 bp, Homo sapiens
agaaatgctgcct

SEQ ID NO: 386797 - DNA, 14 bp, Homo sapiens
agaaatgctgcctg

SEQ ID NO: 386798 - DNA, 16 bp, Homo sapiens
agaaatggctttccac

SEQ ID NO: 386799 - DNA, 21 bp, Homo sapiens
agaaatgtattttgaaaacac

SEQ ID NO: 386800 - DNA, 23 bp, Homo sapiens
agaaatgttggttacatgaatga

SEQ ID NO: 386801 - DNA, 14 bp, Homo sapiens
agaaattacaagtt

SEQ ID NO: 386802 - DNA, 16 bp, Homo sapiens
agaaattcattaaaga

SEQ ID NO: 386803 - DNA, 14 bp, Homo sapiens
agaaattccctgga

SEQ ID NO: 386804 - DNA, 24 bp, Homo sapiens
agaaattccctggaccagatgctg

SEQ ID NO: 386805 - DNA, 18 bp, Homo sapiens
agaaattctgttaatgtt

SEQ ID NO: 386806 - DNA, 23 bp, Homo sapiens
agaaatttattcttatcttagga

SEQ ID NO: 386807 - DNA, 12 bp, Homo sapiens
agaaattttcaa

SEQ ID NO: 386808 - DNA, 17 bp, Homo sapiens
agaaatttttatcagtt

SEQ ID NO: 386809 - DNA, 14 bp, Homo sapiens
agaacaacaacaaa

SEQ ID NO: 386810 - DNA, 17 bp, Homo sapiens
agaacaaccaaaatctt

SEQ ID NO: 386811 - DNA, 17 bp, Homo sapiens
agaacaaggaattgctt

SEQ ID NO: 386812 - DNA, 17 bp, Homo sapiens
agaacaaggtagttttt

SEQ ID NO: 386813 - DNA, 17 bp, Homo sapiens
agaacaagtcacagctg

SEQ ID NO: 386814 - DNA, 18 bp, Homo sapiens
agaacaagtcacagctgc

SEQ ID NO: 386815 - DNA, 19 bp, Homo sapiens
agaacaagtcacagctgca

SEQ ID NO: 386816 - DNA, 19 bp, Homo sapiens
agaacaagtgcctcctgga

SEQ ID NO: 386817 - DNA, 12 bp, Homo sapiens
agaacaatagaa

SEQ ID NO: 386818 - DNA, 22 bp, Homo sapiens
agaacacaaagcggggggaggg

SEQ ID NO: 386819 - DNA, 16 bp, Homo sapiens
agaacacagcatgtgc

SEQ ID NO: 386820 - DNA, 17 bp, Homo sapiens
agaacacatttctaatt

SEQ ID NO: 386821 - DNA, 17 bp, Homo sapiens
agaacaccaagacttga

SEQ ID NO: 386822 - DNA, 12 bp, Homo sapiens
agaacagaaaac

SEQ ID NO: 386823 - DNA, 13 bp, Homo sapiens
agaacagaaaaca

SEQ ID NO: 386824 - DNA, 19 bp, Homo sapiens
agaacagatctccaaagct

SEQ ID NO: 386825 - DNA, 13 bp, Homo sapiens
agaacagcagatg

SEQ ID NO: 386826 - DNA, 18 bp, Homo sapiens
agaacagcaggcccacct

SEQ ID NO: 386827 - DNA, 19 bp, Homo sapiens
agaacagcaggcccaccta

SEQ ID NO: 386828 - DNA, 23 bp, Homo sapiens
agaacagcagggtagtctggttt

SEQ ID NO: 386829 - DNA, 20 bp, Homo sapiens
agaacaggcttggcaaagaa

SEQ ID NO: 386830 - DNA, 15 bp, Homo sapiens
agaacagtacatttt

SEQ ID NO: 386831 - DNA, 14 bp, Homo sapiens
agaacagtgatttt

SEQ ID NO: 386832 - DNA, 21 bp, Homo sapiens
agaacagttaagcagccgcca

SEQ ID NO: 386833 - DNA, 14 bp, Homo sapiens
agaacatgaaatgc

SEQ ID NO: 386834 - DNA, 16 bp, Homo sapiens
agaacatgagtgctga

SEQ ID NO: 386835 - DNA, 19 bp, Homo sapiens
agaacatggccaatagtca

SEQ ID NO: 386836 - DNA, 20 bp, Homo sapiens
agaacatggtgtgtgtctct

SEQ ID NO: 386837 - DNA, 22 bp, Homo sapiens
agaacatggtgtgtgtctctga

SEQ ID NO: 386838 - DNA, 19 bp, Homo sapiens
agaaccagcactcccaggg

SEQ ID NO: 386839 - DNA, 14 bp, Homo sapiens
agaacccagatgat

SEQ ID NO: 386840 - DNA, 15 bp, Homo sapiens
agaaccccaactccc

SEQ ID NO: 386841 - DNA, 13 bp, Homo sapiens
agaacccccctcc

SEQ ID NO: 386842 - DNA, 20 bp, Homo sapiens
agaaccgagcaaagatcaaa

SEQ ID NO: 386843 - DNA, 22 bp, Homo sapiens
agaaccgagcaaagatcaaaat

SEQ ID NO: 386844 - DNA, 15 bp, Homo sapiens
agaaccgcattttga

SEQ ID NO: 386845 - DNA, 14 bp, Homo sapiens
agaacctttgtcaa

SEQ ID NO: 386846 - DNA, 13 bp, Homo sapiens
agaacgcacccca

SEQ ID NO: 386847 - DNA, 15 bp, Homo sapiens
agaacgcaccccact

SEQ ID NO: 386848 - DNA, 18 bp, Homo sapiens
agaacgccagtctcccag

SEQ ID NO: 386849 - DNA, 20 bp, Homo sapiens
agaacgccagtctcccaggc

SEQ ID NO: 386850 - DNA, 17 bp, Homo sapiens
agaacgggcctccccgg

SEQ ID NO: 386851 - DNA, 21 bp, Homo sapiens
agaacgggttctcccatgggg

SEQ ID NO: 386852 - DNA, 16 bp, Homo sapiens
agaactactaaagtgc

SEQ ID NO: 386853 - DNA, 22 bp, Homo sapiens
agaactagtggtggctctgaga

SEQ ID NO: 386854 - DNA, 15 bp, Homo sapiens
agaactcagccttaa

SEQ ID NO: 386855 - DNA, 18 bp, Homo sapiens
agaactcatgtgatttac

SEQ ID NO: 386856 - DNA, 21 bp, Homo sapiens
agaactccttattttgtatta

SEQ ID NO: 386857 - DNA, 12 bp, Homo sapiens
agaactcgatgc

SEQ ID NO: 386858 - DNA, 16 bp, Homo sapiens
agaactcgatgcactg

SEQ ID NO: 386859 - DNA, 17 bp, Homo sapiens
agaactcgatgcactga

SEQ ID NO: 386860 - DNA, 18 bp, Homo sapiens
agaactcgatgcactgac

SEQ ID NO: 386861 - DNA, 22 bp, Homo sapiens
agaactcgcaatccgagccagc

SEQ ID NO: 386862 - DNA, 12 bp, Homo sapiens
agaactctcaga

SEQ ID NO: 386863 - DNA, 19 bp, Homo sapiens
agaactgaaaacataaaaa

SEQ ID NO: 386864 - DNA, 15 bp, Homo sapiens
agaactgactttctc

SEQ ID NO: 386865 - DNA, 15 bp, Homo sapiens
agaactgagctcctc

SEQ ID NO: 386866 - DNA, 22 bp, Homo sapiens
agaactgagctcctctgggcag

SEQ ID NO: 386867 - DNA, 17 bp, Homo sapiens
agaactgatgacactga

SEQ ID NO: 386868 - DNA, 14 bp, Homo sapiens
agaactgccccatc

SEQ ID NO: 386869 - DNA, 19 bp, Homo sapiens
agaactgctaccatgaagt

SEQ ID NO: 386870 - DNA, 22 bp, Homo sapiens
agaactgctaccatgaagtgaa

SEQ ID NO: 386871 - DNA, 19 bp, Homo sapiens
agaactgcttgcatttctt

SEQ ID NO: 386872 - DNA, 22 bp, Homo sapiens
agaactgcttgcatttctttat

SEQ ID NO: 386873 - DNA, 17 bp, Homo sapiens
agaactgggaaaacagt

SEQ ID NO: 386874 - DNA, 17 bp, Homo sapiens
agaactggttcttgcct

SEQ ID NO: 386875 - DNA, 18 bp, Homo sapiens
agaactggttcttgcctt

SEQ ID NO: 386876 - DNA, 20 bp, Homo sapiens
agaactggttcttgccttcc

SEQ ID NO: 386877 - DNA, 19 bp, Homo sapiens
agaactgtatgtcagacat

SEQ ID NO: 386878 - DNA, 21 bp, Homo sapiens
agaacttcgaccctttctctg

SEQ ID NO: 386879 - DNA, 23 bp, Homo sapiens
agaacttctcgtagatgctgcct

SEQ ID NO: 386880 - DNA, 20 bp, Homo sapiens
agaactttgcacacttcaaa

SEQ ID NO: 386881 - DNA, 22 bp, Homo sapiens
agaacttttcatagatgaactt

SEQ ID NO: 386882 - DNA, 14 bp, Homo sapiens
agaagaaaataacc

SEQ ID NO: 386883 - DNA, 14 bp, Homo sapiens
agaagaaagcaaaa

SEQ ID NO: 386884 - DNA, 22 bp, Homo sapiens
agaagaaattatttaatatgca

SEQ ID NO: 386885 - DNA, 12 bp, Homo sapiens
agaagaacagta

SEQ ID NO: 386886 - DNA, 13 bp, Homo sapiens
agaagaatataaa

SEQ ID NO: 386887 - DNA, 15 bp, Homo sapiens
agaagaatataaata

SEQ ID NO: 386888 - DNA, 16 bp, Homo sapiens
agaagaatattcagga

SEQ ID NO: 386889 - DNA, 18 bp, Homo sapiens
agaagaatattcaggact

SEQ ID NO: 386890 - DNA, 13 bp, Homo sapiens
agaagacacacag

SEQ ID NO: 386891 - DNA, 14 bp, Homo sapiens
agaagacacacagc

SEQ ID NO: 386892 - DNA, 16 bp, Homo sapiens
agaagacatgaaccaa

SEQ ID NO: 386893 - DNA, 20 bp, Homo sapiens
agaagacatggagactcctg

SEQ ID NO: 386894 - DNA, 21 bp, Homo sapiens
agaagaccacaaaaattgact

SEQ ID NO: 386895 - DNA, 19 bp, Homo sapiens
agaagacctccctgtgaga

SEQ ID NO: 386896 - DNA, 16 bp, Homo sapiens
agaagactagcagcta

SEQ ID NO: 386897 - DNA, 21 bp, Homo sapiens
agaagagaccaagcttgtttc

SEQ ID NO: 386898 - DNA, 15 bp, Homo sapiens
agaagagatgtggca

SEQ ID NO: 386899 - DNA, 20 bp, Homo sapiens
agaagagcatccggcatgag

SEQ ID NO: 386900 - DNA, 12 bp, Homo sapiens
agaagagccctg

SEQ ID NO: 386901 - DNA, 17 bp, Homo sapiens
agaagagccctggacac

SEQ ID NO: 386902 - DNA, 21 bp, Homo sapiens
agaagagggagaaggagaggc

SEQ ID NO: 386903 - DNA, 16 bp, Homo sapiens
agaagagggcctgtgg

SEQ ID NO: 386904 - DNA, 20 bp, Homo sapiens
agaagagtttttattacaaa

SEQ ID NO: 386905 - DNA, 15 bp, Homo sapiens
agaagataatgttct

SEQ ID NO: 386906 - DNA, 11 bp, Homo sapiens
agaagatatct

SEQ ID NO: 386907 - DNA, 21 bp, Homo sapiens
agaaggtgcttgggcttctgc

SEQ ID NO: 386908 - DNA, 20 bp, Homo sapiens
agaaggtgggggttggctgg

SEQ ID NO: 386909 - DNA, 16 bp, Homo sapiens
agaagtatccaattat

SEQ ID NO: 386910 - DNA, 16 bp, Homo sapiens
agaagtatttttgtct

SEQ ID NO: 386911 - DNA, 18 bp, Homo sapiens
agaagtcactcaattgtt

SEQ ID NO: 386912 - DNA, 21 bp, Homo sapiens
agaagtcagagaaaacacttt

SEQ ID NO: 386913 - DNA, 20 bp, Homo sapiens
agaagtcagttggagaaaat

SEQ ID NO: 386914 - DNA, 22 bp, Homo sapiens
agaagtcctccctcctgcaggc

SEQ ID NO: 386915 - DNA, 24 bp, Homo sapiens
agaagtcctccctcctgcaggctg

SEQ ID NO: 386916 - DNA, 14 bp, Homo sapiens
agaagtcttcatgg

SEQ ID NO: 386917 - DNA, 14 bp, Homo sapiens
agaagtgaaaaaga

SEQ ID NO: 386918 - DNA, 15 bp, Homo sapiens
agaagtgcatttctg

SEQ ID NO: 386919 - DNA, 19 bp, Homo sapiens
agaagtgcatttctgaata

SEQ ID NO: 386920 - DNA, 24 bp, Homo sapiens
agaagtgcatttctgaatagaaat

SEQ ID NO: 386921 - DNA, 14 bp, Homo sapiens
agaagtgcccctgc

SEQ ID NO: 386922 - DNA, 22 bp, Homo sapiens
agaagtgcccctgctgcctccc

SEQ ID NO: 386923 - DNA, 23 bp, Homo sapiens
agaagtgctctttgtggcagtgg

SEQ ID NO: 386924 - DNA, 13 bp, Homo sapiens
agaagtggcccct

SEQ ID NO: 386925 - DNA, 13 bp, Homo sapiens
agaagtgggagtg

SEQ ID NO: 386926 - DNA, 21 bp, Homo sapiens
agaagtgggagtgggagagga

SEQ ID NO: 386927 - DNA, 17 bp, Homo sapiens
agaagtgggattcagga

SEQ ID NO: 386928 - DNA, 22 bp, Homo sapiens
agaagtgggattcaggaatggg

SEQ ID NO: 386929 - DNA, 15 bp, Homo sapiens
agaagtggtgttcca

SEQ ID NO: 386930 - DNA, 19 bp, Homo sapiens
agaagtgtccgagaactaa

SEQ ID NO: 386931 - DNA, 23 bp, Homo sapiens
agaagttcatgggcacctcatgg

SEQ ID NO: 386932 - DNA, 16 bp, Homo sapiens
agaagtttagatttta

SEQ ID NO: 386933 - DNA, 20 bp, Homo sapiens
agaagtttgggctaacattt

SEQ ID NO: 386934 - DNA, 21 bp, Homo sapiens
agaagtttgggctaacattta

SEQ ID NO: 386935 - DNA, 23 bp, Homo sapiens
agaagttttaacttccagtggct

SEQ ID NO: 386936 - DNA, 23 bp, Homo sapiens
agaataaagccttgtgatcactt

SEQ ID NO: 386937 - DNA, 17 bp, Homo sapiens
agaataaagtccaaagt

SEQ ID NO: 386938 - DNA, 12 bp, Homo sapiens
agaataaataaa

SEQ ID NO: 386939 - DNA, 14 bp, Homo sapiens
agaataaataaaga

SEQ ID NO: 386940 - DNA, 19 bp, Homo sapiens
agaataaataaagaagaaa

SEQ ID NO: 386941 - DNA, 13 bp, Homo sapiens
agaataaatgggt

SEQ ID NO: 386942 - DNA, 15 bp, Homo sapiens
agaataaatttggga

SEQ ID NO: 386943 - DNA, 20 bp, Homo sapiens
agaataagaaaacaatcaca

SEQ ID NO: 386944 - DNA, 15 bp, Homo sapiens
agaataattgtgtac

SEQ ID NO: 386945 - DNA, 16 bp, Homo sapiens
agaataattgtgtaca

SEQ ID NO: 386946 - DNA, 22 bp, Homo sapiens
agaataattgtgtacaaagtag

SEQ ID NO: 386947 - DNA, 22 bp, Homo sapiens
agaataatttggaatcagctat

SEQ ID NO: 386948 - DNA, 13 bp, Homo sapiens
agaatacaattca

SEQ ID NO: 386949 - DNA, 14 bp, Homo sapiens
agaatacagaaaat

SEQ ID NO: 386950 - DNA, 20 bp, Homo sapiens
agaatacagaaaatgctttt

SEQ ID NO: 386951 - DNA, 20 bp, Homo sapiens
agaatactgttaaaggaaaa

SEQ ID NO: 386952 - DNA, 12 bp, Homo sapiens
agaatacttttt

SEQ ID NO: 386953 - DNA, 13 bp, Homo sapiens
agaatagtgcctc

SEQ ID NO: 386954 - DNA, 15 bp, Homo sapiens
agaatagtgcctcag

SEQ ID NO: 386955 - DNA, 14 bp, Homo sapiens
agaatataattatc

SEQ ID NO: 386956 - DNA, 21 bp, Homo sapiens
agaatatactgtcttgtctca

SEQ ID NO: 386957 - DNA, 11 bp, Homo sapiens
agaatatctgg

SEQ ID NO: 386958 - DNA, 13 bp, Homo sapiens
agaatatgataaa

SEQ ID NO: 386959 - DNA, 15 bp, Homo sapiens
agaatattgttaaaa

SEQ ID NO: 386960 - DNA, 18 bp, Homo sapiens
agaatattgttaaaacct

SEQ ID NO: 386961 - DNA, 11 bp, Homo sapiens
agaatatttat

SEQ ID NO: 386962 - DNA, 22 bp, Homo sapiens
agaatatttattacctctgata

SEQ ID NO: 386963 - DNA, 18 bp, Homo sapiens
agaatcaaacctttttat

SEQ ID NO: 386964 - DNA, 19 bp, Homo sapiens
agaatcacctaattaattt

SEQ ID NO: 386965 - DNA, 21 bp, Homo sapiens
agaatcatgctgttgcattta

SEQ ID NO: 386966 - DNA, 18 bp, Homo sapiens
agaatcccactttctata

SEQ ID NO: 386967 - DNA, 16 bp, Homo sapiens
agaatccctgttcatt

SEQ ID NO: 386968 - DNA, 12 bp, Homo sapiens
agaatcctgcct

SEQ ID NO: 386969 - DNA, 13 bp, Homo sapiens
agaatcctgcctc

SEQ ID NO: 386970 - DNA, 20 bp, Homo sapiens
agaatcctggccctctgtgt

SEQ ID NO: 386971 - DNA, 22 bp, Homo sapiens
agaatcctggccctctgtgttg

SEQ ID NO: 386972 - DNA, 22 bp, Homo sapiens
agaatcgatgggggatgcttca

SEQ ID NO: 386973 - DNA, 13 bp, Homo sapiens
agaatctcagcac

SEQ ID NO: 386974 - DNA, 14 bp, Homo sapiens
agaatctgagggca

SEQ ID NO: 386975 - DNA, 17 bp, Homo sapiens
agaatctgctgcatagc

SEQ ID NO: 386976 - DNA, 17 bp, Homo sapiens
agaatctgctgttgcca

SEQ ID NO: 386977 - DNA, 18 bp, Homo sapiens
agaatctgctgttgccat

SEQ ID NO: 386978 - DNA, 19 bp, Homo sapiens
agaatctggctcctgtttc

SEQ ID NO: 386979 - DNA, 14 bp, Homo sapiens
agaatctgtgcagt

SEQ ID NO: 386980 - DNA, 20 bp, Homo sapiens
agaatctgtgcagtcatcaa

SEQ ID NO: 386981 - DNA, 19 bp, Homo sapiens
agaatgagaaagaaaagga

SEQ ID NO: 386982 - DNA, 16 bp, Homo sapiens
agaatgagagagtgtg

SEQ ID NO: 386983 - DNA, 23 bp, Homo sapiens
agaatgcagattcctgggcctgt

SEQ ID NO: 386984 - DNA, 16 bp, Homo sapiens
agaatgccagcccaaa

SEQ ID NO: 386985 - DNA, 18 bp, Homo sapiens
agaatgccagcccaaagc

SEQ ID NO: 386986 - DNA, 23 bp, Homo sapiens
agaatgctctacttctttttctt

SEQ ID NO: 386987 - DNA, 14 bp, Homo sapiens
agaatggaatagaa

SEQ ID NO: 386988 - DNA, 20 bp, Homo sapiens
agaatggcatggtaggctac

SEQ ID NO: 386989 - DNA, 22 bp, Homo sapiens
agaatggcccagtcctctccca

SEQ ID NO: 386990 - DNA, 13 bp, Homo sapiens
agaatggctctgg

SEQ ID NO: 386991 - DNA, 14 bp, Homo sapiens
agaatggctctggc

SEQ ID NO: 386992 - DNA, 22 bp, Homo sapiens
agaatggctgactgttgccttt

SEQ ID NO: 386993 - DNA, 18 bp, Homo sapiens
agaatggctttggtctct

SEQ ID NO: 386994 - DNA, 18 bp, Homo sapiens
tcccgccttcctcctcca

SEQ ID NO: 386995 - DNA, 13 bp, Homo sapiens
tcccgctcagccc

SEQ ID NO: 386996 - DNA, 16 bp, Homo sapiens
tcccgctcagccctcc

SEQ ID NO: 386997 - DNA, 20 bp, Homo sapiens
tcccgctcagccctccctgc

SEQ ID NO: 386998 - DNA, 15 bp, Homo sapiens
tcccgctgctgctgc

SEQ ID NO: 386999 - DNA, 16 bp, Homo sapiens
tcccgctgctgtgctc

SEQ ID NO: 387000 - DNA, 16 bp, Homo sapiens
tcccggataggctaat

SEQ ID NO: 387001 - DNA, 12 bp, Homo sapiens
tcccggctgcct

SEQ ID NO: 387002 - DNA, 19 bp, Homo sapiens
tcccggctttgcagggaga

SEQ ID NO: 387003 - DNA, 15 bp, Homo sapiens
tcccgggccctccct

SEQ ID NO: 387004 - DNA, 21 bp, Homo sapiens
tcccggggcagggcagccgtc

SEQ ID NO: 387005 - DNA, 14 bp, Homo sapiens
tcccggggctccac

SEQ ID NO: 387006 - DNA, 16 bp, Homo sapiens
tcccggtcctctgcat

SEQ ID NO: 387007 - DNA, 20 bp, Homo sapiens
tcccgtacctcttcccatga

SEQ ID NO: 387008 - DNA, 15 bp, Homo sapiens
tcccgtgctggaaga

SEQ ID NO: 387009 - DNA, 14 bp, Homo sapiens
tcccgttttacaga

SEQ ID NO: 387010 - DNA, 19 bp, Homo sapiens
tccctaaaatacatttaaa

SEQ ID NO: 387011 - DNA, 13 bp, Homo sapiens
tccctaaagccct

SEQ ID NO: 387012 - DNA, 19 bp, Homo sapiens
tccctaagaattcccagat

SEQ ID NO: 387013 - DNA, 20 bp, Homo sapiens
tccctaattctcttcgctgt

SEQ ID NO: 387014 - DNA, 21 bp, Homo sapiens
tccctaattctcttcgctgtg

SEQ ID NO: 387015 - DNA, 16 bp, Homo sapiens
tccctacccacagggc

SEQ ID NO: 387016 - DNA, 19 bp, Homo sapiens
tccctacccacagggcctg

SEQ ID NO: 387017 - DNA, 16 bp, Homo sapiens
tccctaccctcttctc

SEQ ID NO: 387018 - DNA, 19 bp, Homo sapiens
tccctaccgagtctcttct

SEQ ID NO: 387019 - DNA, 11 bp, Homo sapiens
tccctacctca

SEQ ID NO: 387020 - DNA, 16 bp, Homo sapiens
tccctacctcaacctg

SEQ ID NO: 387021 - DNA, 21 bp, Homo sapiens
tccctacctcaacctgtaaat

SEQ ID NO: 387022 - DNA, 13 bp, Homo sapiens
tccctacctcagg

SEQ ID NO: 387023 - DNA, 15 bp, Homo sapiens
tccctacctcaggca

SEQ ID NO: 387024 - DNA, 17 bp, Homo sapiens
tccctacctcaggcagg

SEQ ID NO: 387025 - DNA, 19 bp, Homo sapiens
tccctactaacatcccaat

SEQ ID NO: 387026 - DNA, 20 bp, Homo sapiens
tccctactaacatcccaata

SEQ ID NO: 387027 - DNA, 14 bp, Homo sapiens
tccctacttccaag

SEQ ID NO: 387028 - DNA, 16 bp, Homo sapiens
tccctacttccaagaa

SEQ ID NO: 387029 - DNA, 13 bp, Homo sapiens
tccctagactgca

SEQ ID NO: 387030 - DNA, 18 bp, Homo sapiens
tccctagagggttcctgt

SEQ ID NO: 387031 - DNA, 16 bp, Homo sapiens
tccctagcaaaatgct

SEQ ID NO: 387032 - DNA, 15 bp, Homo sapiens
tccctagggctgggt

SEQ ID NO: 387033 - DNA, 16 bp, Homo sapiens
tccctaggtgggtcaa

SEQ ID NO: 387034 - DNA, 20 bp, Homo sapiens
tccctagtgacccggaggcc

SEQ ID NO: 387035 - DNA, 18 bp, Homo sapiens
tccctagttacccaccct

SEQ ID NO: 387036 - DNA, 19 bp, Homo sapiens
tccctatatgcacccctgg

SEQ ID NO: 387037 - DNA, 22 bp, Homo sapiens
tccctatatgcacccctggaac

SEQ ID NO: 387038 - DNA, 22 bp, Homo sapiens
tccctcaacaagggagagacct

SEQ ID NO: 387039 - DNA, 14 bp, Homo sapiens
tccctcagcccctc

SEQ ID NO: 387040 - DNA, 17 bp, Homo sapiens
tccctcagcccctcttg

SEQ ID NO: 387041 - DNA, 11 bp, Homo sapiens
agacccccacc

SEQ ID NO: 387042 - DNA, 14 bp, Homo sapiens
agacccccacccct

SEQ ID NO: 387043 - DNA, 17 bp, Homo sapiens
agacccccaccccttcc

SEQ ID NO: 387044 - DNA, 17 bp, Homo sapiens
agacccctctggccagg

SEQ ID NO: 387045 - DNA, 21 bp, Homo sapiens
agacccctctggccaggatgg

SEQ ID NO: 387046 - DNA, 15 bp, Homo sapiens
agacccctggctttt

SEQ ID NO: 387047 - DNA, 15 bp, Homo sapiens
agaccctcttctctg

SEQ ID NO: 387048 - DNA, 20 bp, Homo sapiens
agaccctgccaactttccag

SEQ ID NO: 387049 - DNA, 21 bp, Homo sapiens
agaccctgccaactttccaga

SEQ ID NO: 387050 - DNA, 13 bp, Homo sapiens
agaccctgcctga

SEQ ID NO: 387051 - DNA, 20 bp, Homo sapiens
agaccctggaattcagcacc

SEQ ID NO: 387052 - DNA, 13 bp, Homo sapiens
agaccctgtcttt

SEQ ID NO: 387053 - DNA, 21 bp, Homo sapiens
agaccctgtctttgctgttta

SEQ ID NO: 387054 - DNA, 16 bp, Homo sapiens
agacccttgaagatgt

SEQ ID NO: 387055 - DNA, 17 bp, Homo sapiens
agaccgcttcacccctg

SEQ ID NO: 387056 - DNA, 19 bp, Homo sapiens
agaccgcttcacccctgca

SEQ ID NO: 387057 - DNA, 20 bp, Homo sapiens
agaccgcttcacccctgcac

SEQ ID NO: 387058 - DNA, 16 bp, Homo sapiens
agaccggaagctcctg

SEQ ID NO: 387059 - DNA, 20 bp, Homo sapiens
agaccggaattgagaggtgg

SEQ ID NO: 387060 - DNA, 24 bp, Homo sapiens
agaccggccgcatgtctgcatggc

SEQ ID NO: 387061 - DNA, 20 bp, Homo sapiens
agacctaatatcattttatt

SEQ ID NO: 387062 - DNA, 22 bp, Homo sapiens
agacctaatatcattttattca

SEQ ID NO: 387063 - DNA, 18 bp, Homo sapiens
agacctacattccctctc

SEQ ID NO: 387064 - DNA, 20 bp, Homo sapiens
agacctacattccctctcct

SEQ ID NO: 387065 - DNA, 15 bp, Homo sapiens
agacctatgataaat

SEQ ID NO: 387066 - DNA, 16 bp, Homo sapiens
agacctatgataaata

SEQ ID NO: 387067 - DNA, 16 bp, Homo sapiens
agacctcatcaggatg

SEQ ID NO: 387068 - DNA, 22 bp, Homo sapiens
agacctcatcaggatgaaccca

SEQ ID NO: 387069 - DNA, 16 bp, Homo sapiens
agacctcatctccaag

SEQ ID NO: 387070 - DNA, 22 bp, Homo sapiens
agacctcatctccaagatagca

SEQ ID NO: 387071 - DNA, 17 bp, Homo sapiens
agacctccctgtgagag

SEQ ID NO: 387072 - DNA, 11 bp, Homo sapiens
agacctctgat

SEQ ID NO: 387073 - DNA, 12 bp, Homo sapiens
agacctctgatc

SEQ ID NO: 387074 - DNA, 14 bp, Homo sapiens
agacctctgatccc

SEQ ID NO: 387075 - DNA, 14 bp, Homo sapiens
agacctgactcagg

SEQ ID NO: 387076 - DNA, 18 bp, Homo sapiens
agacctgactcaggcatc

SEQ ID NO: 387077 - DNA, 14 bp, Homo sapiens
agacctggaaccag

SEQ ID NO: 387078 - DNA, 23 bp, Homo sapiens
agacctgtcttccaaggagacca

SEQ ID NO: 387079 - DNA, 17 bp, Homo sapiens
tcctgtacaagtgctca

SEQ ID NO: 387080 - DNA, 14 bp, Homo sapiens
tcctgtcaccggcc

SEQ ID NO: 387081 - DNA, 19 bp, Homo sapiens
tcctgtccactctcggggc

SEQ ID NO: 387082 - DNA, 12 bp, Homo sapiens
tcctgtcccctc

SEQ ID NO: 387083 - DNA, 18 bp, Homo sapiens
tcctgtcccttctcttaa

SEQ ID NO: 387084 - DNA, 22 bp, Homo sapiens
tcctgtccgccctcttcccctc

SEQ ID NO: 387085 - DNA, 14 bp, Homo sapiens
tcctgtctcagcct

SEQ ID NO: 387086 - DNA, 14 bp, Homo sapiens
tcctgtctcccctc

SEQ ID NO: 387087 - DNA, 18 bp, Homo sapiens
tcctgtctcccctctgct

SEQ ID NO: 387088 - DNA, 19 bp, Homo sapiens
tcctgtctcccctctgctg

SEQ ID NO: 387089 - DNA, 15 bp, Homo sapiens
tcctgtctcctctgt

SEQ ID NO: 387090 - DNA, 17 bp, Homo sapiens
tcctgtctcctctgtca

SEQ ID NO: 387091 - DNA, 14 bp, Homo sapiens
tcctgtctggccca

SEQ ID NO: 387092 - DNA, 15 bp, Homo sapiens
tcctgtgactgtttt

SEQ ID NO: 387093 - DNA, 12 bp, Homo sapiens
tcctgtgagcaa

SEQ ID NO: 387094 - DNA, 15 bp, Homo sapiens
tcctgtgcatgggtg

SEQ ID NO: 387095 - DNA, 21 bp, Homo sapiens
tcctgtgccaggactctcttt

SEQ ID NO: 387096 - DNA, 13 bp, Homo sapiens
tcctgtgctacag

SEQ ID NO: 387097 - DNA, 20 bp, Homo sapiens
tcctgtgctttctgcatgct

SEQ ID NO: 387098 - DNA, 17 bp, Homo sapiens
tcctgtgtcatctgtca

SEQ ID NO: 387099 - DNA, 21 bp, Homo sapiens
tcctgtgtccacatctaacaa

SEQ ID NO: 387100 - DNA, 16 bp, Homo sapiens
tcctgtgtggagaggg

SEQ ID NO: 387101 - DNA, 18 bp, Homo sapiens
tcctgtgtggagagggaa

SEQ ID NO: 387102 - DNA, 20 bp, Homo sapiens
tcctgttcatgacagctact

SEQ ID NO: 387103 - DNA, 21 bp, Homo sapiens
tcctgttcctgccttctcttc

SEQ ID NO: 387104 - DNA, 12 bp, Homo sapiens
tcctgttctcag

SEQ ID NO: 387105 - DNA, 19 bp, Homo sapiens
tcctgttctcagagctcca

SEQ ID NO: 387106 - DNA, 12 bp, Homo sapiens
tcctgttctgaa

SEQ ID NO: 387107 - DNA, 16 bp, Homo sapiens
tcctgttggctgctgc

SEQ ID NO: 387108 - DNA, 19 bp, Homo sapiens
tcctgttggctgctgccac

SEQ ID NO: 387109 - DNA, 13 bp, Homo sapiens
tcctgtttccatg

SEQ ID NO: 387110 - DNA, 22 bp, Homo sapiens
tcctgtttcccttcccttccac

SEQ ID NO: 387111 - DNA, 13 bp, Homo sapiens
tcctgtttctaag

SEQ ID NO: 387112 - DNA, 13 bp, Homo sapiens
tcctgtttctcat

SEQ ID NO: 387113 - DNA, 17 bp, Homo sapiens
tccttaaactgtgtgga

SEQ ID NO: 387114 - DNA, 23 bp, Homo sapiens
tccttaaaggcaccatctaatag

SEQ ID NO: 387115 - DNA, 14 bp, Homo sapiens
tccttaaagttctg

SEQ ID NO: 387116 - DNA, 22 bp, Homo sapiens
tccttaaccaccgcatatgcat

SEQ ID NO: 387117 - DNA, 23 bp, Homo sapiens
tccttaaccaccgcatatgcatg

SEQ ID NO: 387118 - DNA, 16 bp, Homo sapiens
tccttaagaacacaaa

SEQ ID NO: 387119 - DNA, 20 bp, Homo sapiens
tccttaataaatttaagttt

SEQ ID NO: 387120 - DNA, 22 bp, Homo sapiens
tccttaccgtgggcactgaagg

SEQ ID NO: 387121 - DNA, 16 bp, Homo sapiens
tccttactctgagccc

SEQ ID NO: 387122 - DNA, 14 bp, Homo sapiens
tccttagcaagggg

SEQ ID NO: 387123 - DNA, 16 bp, Homo sapiens
tccttagcagctcagg

SEQ ID NO: 387124 - DNA, 13 bp, Homo sapiens
tccttaggcttac

SEQ ID NO: 387125 - DNA, 23 bp, Homo sapiens
tccttaggcttacaatgtgcact

SEQ ID NO: 387126 - DNA, 24 bp, Homo sapiens
tccttaggcttacaatgtgcactg

SEQ ID NO: 387127 - DNA, 16 bp, Homo sapiens
tccttagtcttctcat

SEQ ID NO: 387128 - DNA, 23 bp, Homo sapiens
tccttatttcaagggttgcttct

SEQ ID NO: 387129 - DNA, 15 bp, Homo sapiens
tccttcactccctgt

SEQ ID NO: 387130 - DNA, 22 bp, Homo sapiens
tccttcactccctgtcatagtt

SEQ ID NO: 387131 - DNA, 15 bp, Homo sapiens
tccttcactctgaca

SEQ ID NO: 387132 - DNA, 23 bp, Homo sapiens
tccttcagagctcttcaagctgt

SEQ ID NO: 387133 - DNA, 18 bp, Homo sapiens
tccttcagagtgaatcat

SEQ ID NO: 387134 - DNA, 19 bp, Homo sapiens
tccttcagtgagcccctcc

SEQ ID NO: 387135 - DNA, 20 bp, Homo sapiens
tccttcagtgagcccctccc

SEQ ID NO: 387136 - DNA, 21 bp, Homo sapiens
tccttcagtgagcccctcccc

SEQ ID NO: 387137 - DNA, 23 bp, Homo sapiens
tccttcagtgagcccctccccag

SEQ ID NO: 387138 - DNA, 21 bp, Homo sapiens
tccttcatgcttttctcatgg

SEQ ID NO: 387139 - DNA, 19 bp, Homo sapiens
tccttcattccgttaggaa

SEQ ID NO: 387140 - DNA, 18 bp, Homo sapiens
tccttccaaaaattatta

SEQ ID NO: 387141 - DNA, 20 bp, Homo sapiens
tccttccaactgctgcccca

SEQ ID NO: 387142 - DNA, 19 bp, Homo sapiens
tccttccaagtcttcctga

SEQ ID NO: 387143 - DNA, 17 bp, Homo sapiens
tccttccacctccctcc

SEQ ID NO: 387144 - DNA, 16 bp, Homo sapiens
tccttccatccctacc

SEQ ID NO: 387145 - DNA, 17 bp, Homo sapiens
tccttccatccctaccc

SEQ ID NO: 387146 - DNA, 21 bp, Homo sapiens
tccttcccaactcactgtgct

SEQ ID NO: 387147 - DNA, 22 bp, Homo sapiens
tccttcccaactcactgtgctc

SEQ ID NO: 387148 - DNA, 23 bp, Homo sapiens
tccttcccaactcactgtgctcc

SEQ ID NO: 387149 - DNA, 20 bp, Homo sapiens
tccttcccacggccactgca

SEQ ID NO: 387150 - DNA, 15 bp, Homo sapiens
tccttcccatgcctg

SEQ ID NO: 387151 - DNA, 16 bp, Homo sapiens
tccttcccatgcctgt

SEQ ID NO: 387152 - DNA, 23 bp, Homo sapiens
tccttcccatgcctgtctctgtt

SEQ ID NO: 387153 - DNA, 18 bp, Homo sapiens
tccttcccatttctctac

SEQ ID NO: 387154 - DNA, 16 bp, Homo sapiens
tccttcccccagccca

SEQ ID NO: 387155 - DNA, 20 bp, Homo sapiens
tccttcccccagcccaataa

SEQ ID NO: 387156 - DNA, 22 bp, Homo sapiens
tccttcccccagcccaataaag

SEQ ID NO: 387157 - DNA, 14 bp, Homo sapiens
tccttcccgcagca

SEQ ID NO: 387158 - DNA, 16 bp, Homo sapiens
tccttccgctctgagg

SEQ ID NO: 387159 - DNA, 21 bp, Homo sapiens
tccttcctacacccttggact

SEQ ID NO: 387160 - DNA, 12 bp, Homo sapiens
tccttcctatgc

SEQ ID NO: 387161 - DNA, 16 bp, Homo sapiens
tccttcctatgcccag

SEQ ID NO: 387162 - DNA, 18 bp, Homo sapiens
tccttcctatgcccaggt

SEQ ID NO: 387163 - DNA, 21 bp, Homo sapiens
tccttcctgccccaaaattat

SEQ ID NO: 387164 - DNA, 13 bp, Homo sapiens
tccttcctgttct

SEQ ID NO: 387165 - DNA, 14 bp, Homo sapiens
tccttcctgttctg

SEQ ID NO: 387166 - DNA, 16 bp, Homo sapiens
tccttcctgttctgaa

SEQ ID NO: 387167 - DNA, 13 bp, Homo sapiens
tccttctcccctc

SEQ ID NO: 387168 - DNA, 14 bp, Homo sapiens
tccttctcccctcc

SEQ ID NO: 387169 - DNA, 16 bp, Homo sapiens
tccttctcccctccag

SEQ ID NO: 387170 - DNA, 14 bp, Homo sapiens
tccttctcgtcttc

SEQ ID NO: 387171 - DNA, 11 bp, Homo sapiens
tccttctcttt

SEQ ID NO: 387172 - DNA, 14 bp, Homo sapiens
tccttcttcctcaa

SEQ ID NO: 387173 - DNA, 15 bp, Homo sapiens
tccttcttgccctga

SEQ ID NO: 387174 - DNA, 16 bp, Homo sapiens
tccttgaaacagaaaa

SEQ ID NO: 387175 - DNA, 22 bp, Homo sapiens
tccttgaccttcctctggggct

SEQ ID NO: 387176 - DNA, 12 bp, Homo sapiens
tccttgataatg

SEQ ID NO: 387177 - DNA, 13 bp, Homo sapiens
tccttgccacccc

SEQ ID NO: 387178 - DNA, 15 bp, Homo sapiens
tccttgccctgggcc

SEQ ID NO: 387179 - DNA, 16 bp, Homo sapiens
tccttgccgctgggag

SEQ ID NO: 387180 - DNA, 18 bp, Homo sapiens
tccttgcctcctgtgtaa

SEQ ID NO: 387181 - DNA, 15 bp, Homo sapiens
tccttgccttcaaac

SEQ ID NO: 387182 - DNA, 18 bp, Homo sapiens
tccttgccttctttactc

SEQ ID NO: 387183 - DNA, 14 bp, Homo sapiens
tccttgctctccct

SEQ ID NO: 387184 - DNA, 14 bp, Homo sapiens
tccttgctttctct

SEQ ID NO: 387185 - DNA, 16 bp, Homo sapiens
tccttggagagcagct

SEQ ID NO: 387186 - DNA, 18 bp, Homo sapiens
tccttggagagcagctgg

SEQ ID NO: 387187 - DNA, 20 bp, Homo sapiens
tccttggagagcagctggct

SEQ ID NO: 387188 - DNA, 21 bp, Homo sapiens
tccttggatttgcatttttgt

SEQ ID NO: 387189 - DNA, 16 bp, Homo sapiens
tccttggcaccaaaga

SEQ ID NO: 387190 - DNA, 12 bp, Homo sapiens
tccttggcccag

SEQ ID NO: 387191 - DNA, 23 bp, Homo sapiens
tccttggcccagcagcggcccag

SEQ ID NO: 387192 - DNA, 13 bp, Homo sapiens
tccttggcctagc

SEQ ID NO: 387193 - DNA, 18 bp, Homo sapiens
tccttgggctcctggctg

SEQ ID NO: 387194 - DNA, 21 bp, Homo sapiens
tccttgggctcctggctgcca

SEQ ID NO: 387195 - DNA, 21 bp, Homo sapiens
tccttggggaggggtcagctc

SEQ ID NO: 387196 - DNA, 22 bp, Homo sapiens
tccttggtggccgggggtgggg

SEQ ID NO: 387197 - DNA, 19 bp, Homo sapiens
tccttggttccctcttccc

SEQ ID NO: 387198 - DNA, 14 bp, Homo sapiens
tccttgtcaccagc

SEQ ID NO: 387199 - DNA, 15 bp, Homo sapiens
tccttgtcaccagca

SEQ ID NO: 387200 - DNA, 16 bp, Homo sapiens
tccttgttggtcagag

SEQ ID NO: 387201 - DNA, 17 bp, Homo sapiens
tcctttaactatcagag

SEQ ID NO: 387202 - DNA, 20 bp, Homo sapiens
tcctttacaactaaataaca

SEQ ID NO: 387203 - DNA, 21 bp, Homo sapiens
tcctttacaactaaataacac

SEQ ID NO: 387204 - DNA, 16 bp, Homo sapiens
tcctttaggcagcctg

SEQ ID NO: 387205 - DNA, 17 bp, Homo sapiens
tcctttaggcagcctgc

SEQ ID NO: 387206 - DNA, 16 bp, Homo sapiens
tcctttatatttagtg

SEQ ID NO: 387207 - DNA, 13 bp, Homo sapiens
tcctttcaagggg

SEQ ID NO: 387208 - DNA, 16 bp, Homo sapiens
tcctttcacaaccttc

SEQ ID NO: 387209 - DNA, 19 bp, Homo sapiens
tcctttcacaaccttctgt

SEQ ID NO: 387210 - DNA, 13 bp, Homo sapiens
tcctttcatcctc

SEQ ID NO: 387211 - DNA, 21 bp, Homo sapiens
tcctttccagtggcctggctc

SEQ ID NO: 387212 - DNA, 14 bp, Homo sapiens
tcctttccctccac

SEQ ID NO: 387213 - DNA, 14 bp, Homo sapiens
tcctttctccaggc

SEQ ID NO: 387214 - DNA, 16 bp, Homo sapiens
tcctttctccaggccc

SEQ ID NO: 387215 - DNA, 17 bp, Homo sapiens
tcctttctccaggccct

SEQ ID NO: 387216 - DNA, 14 bp, Homo sapiens
tcctttctttaaac

SEQ ID NO: 387217 - DNA, 14 bp, Homo sapiens
tcctttgagaaaga

SEQ ID NO: 387218 - DNA, 16 bp, Homo sapiens
tcctttgagaaagaaa

SEQ ID NO: 387219 - DNA, 14 bp, Homo sapiens
tcctttgagggcag

SEQ ID NO: 387220 - DNA, 17 bp, Homo sapiens
tcctttgcactgagggc

SEQ ID NO: 387221 - DNA, 22 bp, Homo sapiens
tcctttggagggagggctgacc

SEQ ID NO: 387222 - DNA, 19 bp, Homo sapiens
tccttttaaaacacttcca

SEQ ID NO: 387223 - DNA, 15 bp, Homo sapiens
tccttttagcctagt

SEQ ID NO: 387224 - DNA, 20 bp, Homo sapiens
tccttttataagatttaatt

SEQ ID NO: 387225 - DNA, 13 bp, Homo sapiens
tccttttctgtga

SEQ ID NO: 387226 - DNA, 20 bp, Homo sapiens
tccttttgtccccagggccc

SEQ ID NO: 387227 - DNA, 16 bp, Homo sapiens
tcctttttaaatgaga

SEQ ID NO: 387228 - DNA, 14 bp, Homo sapiens
tccttttttataca

SEQ ID NO: 387229 - DNA, 15 bp, Homo sapiens
tccttttttctttct

SEQ ID NO: 387230 - DNA, 12 bp, Homo sapiens
tcctttttttcc

SEQ ID NO: 387231 - DNA, 20 bp, Homo sapiens
tcgaaaacagatgagaagac

SEQ ID NO: 387232 - DNA, 14 bp, Homo sapiens
tcgaaaagagcact

SEQ ID NO: 387233 - DNA, 16 bp, Homo sapiens
tcgaaccaaggcagcc

SEQ ID NO: 387234 - DNA, 19 bp, Homo sapiens
tcgaaccaaggcagcctcc

SEQ ID NO: 387235 - DNA, 22 bp, Homo sapiens
tcgaaccaaggcagcctccaga

SEQ ID NO: 387236 - DNA, 18 bp, Homo sapiens
tcgaagctcagcccaccc

SEQ ID NO: 387237 - DNA, 20 bp, Homo sapiens
tcgaagtcttccatcagcag

SEQ ID NO: 387238 - DNA, 14 bp, Homo sapiens
tcgaccccaaagcc

SEQ ID NO: 387239 - DNA, 16 bp, Homo sapiens
tcgactcaggatccag

SEQ ID NO: 387240 - DNA, 21 bp, Homo sapiens
tcgactctttgcaacagcact

SEQ ID NO: 387241 - DNA, 14 bp, Homo sapiens
tcgagacacttgcc

SEQ ID NO: 387242 - DNA, 23 bp, Homo sapiens
tcgagaccatcctggcccctcca

SEQ ID NO: 387243 - DNA, 15 bp, Homo sapiens
tcgtgacctacaggg

SEQ ID NO: 387244 - DNA, 17 bp, Homo sapiens
tcgtgacctacagggaa

SEQ ID NO: 387245 - DNA, 20 bp, Homo sapiens
tcgtgcactctgctaatcat

SEQ ID NO: 387246 - DNA, 13 bp, Homo sapiens
tcgtgcatgtaat

SEQ ID NO: 387247 - DNA, 22 bp, Homo sapiens
tcgtgcattggaagaccccacc

SEQ ID NO: 387248 - DNA, 14 bp, Homo sapiens
tcgtgcatttgtga

SEQ ID NO: 387249 - DNA, 17 bp, Homo sapiens
tcgtgcatttgtgagcc

SEQ ID NO: 387250 - DNA, 17 bp, Homo sapiens
tcgtgcctataaatagt

SEQ ID NO: 387251 - DNA, 14 bp, Homo sapiens
tcgtgctggaggaa

SEQ ID NO: 387252 - DNA, 23 bp, Homo sapiens
tcgtggaaagggtgctgcttccc

SEQ ID NO: 387253 - DNA, 24 bp, Homo sapiens
tcgtggaaagggtgctgcttccct

SEQ ID NO: 387254 - DNA, 12 bp, Homo sapiens
tcgtggacacct

SEQ ID NO: 387255 - DNA, 13 bp, Homo sapiens
tcgtggacacctg

SEQ ID NO: 387256 - DNA, 17 bp, Homo sapiens
tcgtggacacctgccct

SEQ ID NO: 387257 - DNA, 18 bp, Homo sapiens
tcgtggacacctgccctg

SEQ ID NO: 387258 - DNA, 20 bp, Homo sapiens
tcgtggacacctgccctgcc

SEQ ID NO: 387259 - DNA, 17 bp, Homo sapiens
tcgtggagatgtcttcg

SEQ ID NO: 387260 - DNA, 16 bp, Homo sapiens
tcgtggagccacaggc

SEQ ID NO: 387261 - DNA, 18 bp, Homo sapiens
tcgtggagccacaggcag

SEQ ID NO: 387262 - DNA, 11 bp, Homo sapiens
tcgtggccttc

SEQ ID NO: 387263 - DNA, 15 bp, Homo sapiens
tcgtgtaaattatgt

SEQ ID NO: 387264 - DNA, 20 bp, Homo sapiens
tcgtgtagtggaagagcagc

SEQ ID NO: 387265 - DNA, 22 bp, Homo sapiens
tcgtgtagtggaagagcagcct

SEQ ID NO: 387266 - DNA, 23 bp, Homo sapiens
tcgtgtgcatgagaatgtcattt

SEQ ID NO: 387267 - DNA, 13 bp, Homo sapiens
tcgtgttctctcc

SEQ ID NO: 387268 - DNA, 22 bp, Homo sapiens
tcgttaactgtgtatgtacata

SEQ ID NO: 387269 - DNA, 14 bp, Homo sapiens
tcgttcccttgtgt

SEQ ID NO: 387270 - DNA, 20 bp, Homo sapiens
tcgttccggttatgttgtgt

SEQ ID NO: 387271 - DNA, 15 bp, Homo sapiens
tcgttcttgttctgt

SEQ ID NO: 387272 - DNA, 17 bp, Homo sapiens
tcgttcttgttctgttt

SEQ ID NO: 387273 - DNA, 23 bp, Homo sapiens
tcgtttgatagtgcttcttgtaa

SEQ ID NO: 387274 - DNA, 16 bp, Homo sapiens
tcgtttgggctcaagg

SEQ ID NO: 387275 - DNA, 16 bp, Homo sapiens
tcgttttctttgctgt

SEQ ID NO: 387276 - DNA, 20 bp, Homo sapiens
tcgttttctttgctgtgcca

SEQ ID NO: 387277 - DNA, 21 bp, Homo sapiens
tcgttttctttgctgtgccaa

SEQ ID NO: 387278 - DNA, 14 bp, Homo sapiens
tctaaaaaataact

SEQ ID NO: 387279 - DNA, 17 bp, Homo sapiens
tctaaaaaataactgtg

SEQ ID NO: 387280 - DNA, 18 bp, Homo sapiens
tctaaaaagtcaattcat

SEQ ID NO: 387281 - DNA, 12 bp, Homo sapiens
tctaaaaataaa

SEQ ID NO: 387282 - DNA, 16 bp, Homo sapiens
tctaaaaataaaatga

SEQ ID NO: 387283 - DNA, 23 bp, Homo sapiens
tctaaaaataaaatgcatttaaa

SEQ ID NO: 387284 - DNA, 13 bp, Homo sapiens
tctaaaacaaaat

SEQ ID NO: 387285 - DNA, 16 bp, Homo sapiens
tctaaaacaaaatctg

SEQ ID NO: 387286 - DNA, 13 bp, Homo sapiens
tctaaaactatgg

SEQ ID NO: 387287 - DNA, 23 bp, Homo sapiens
tctaaaactatggttcccaataa

SEQ ID NO: 387288 - DNA, 17 bp, Homo sapiens
tctaaaagattctttaa

SEQ ID NO: 387289 - DNA, 18 bp, Homo sapiens
tctaaaagattctttaaa

SEQ ID NO: 387290 - DNA, 12 bp, Homo sapiens
tctaaaagcacc

SEQ ID NO: 387291 - DNA, 22 bp, Homo sapiens
tctaaaatactcaccaaaatat

SEQ ID NO: 387292 - DNA, 12 bp, Homo sapiens
tctaaacacaca

SEQ ID NO: 387293 - DNA, 19 bp, Homo sapiens
tctaaacagatgtccctga

SEQ ID NO: 387294 - DNA, 22 bp, Homo sapiens
tctaaacagatgtccctgaagt

SEQ ID NO: 387295 - DNA, 14 bp, Homo sapiens
tctaaacattaatc

SEQ ID NO: 387296 - DNA, 13 bp, Homo sapiens
tctaaaccaaaac

SEQ ID NO: 387297 - DNA, 15 bp, Homo sapiens
tctaaactgttttca

SEQ ID NO: 387298 - DNA, 12 bp, Homo sapiens
tctaaagtttac

SEQ ID NO: 387299 - DNA, 16 bp, Homo sapiens
tctaaagtttacagta

SEQ ID NO: 387300 - DNA, 22 bp, Homo sapiens
tctaaagtttacagtaaataaa

SEQ ID NO: 387301 - DNA, 15 bp, Homo sapiens
tctaaatagatactt

SEQ ID NO: 387302 - DNA, 20 bp, Homo sapiens
tctaaatagatacttttgat

SEQ ID NO: 387303 - DNA, 13 bp, Homo sapiens
tctaaatatttcc

SEQ ID NO: 387304 - DNA, 23 bp, Homo sapiens
tctaaatatttccttaaactgtg

SEQ ID NO: 387305 - DNA, 16 bp, Homo sapiens
tctaaatcataatcat

SEQ ID NO: 387306 - DNA, 17 bp, Homo sapiens
tctaaatgaaaagagaa

SEQ ID NO: 387307 - DNA, 16 bp, Homo sapiens
tctaaatgattatctt

SEQ ID NO: 387308 - DNA, 20 bp, Homo sapiens
tctaaatgattatcttgaaa

SEQ ID NO: 387309 - DNA, 13 bp, Homo sapiens
tctaaatttgaat

SEQ ID NO: 387310 - DNA, 23 bp, Homo sapiens
tctaaatttgaatgttaagcaga

SEQ ID NO: 387311 - DNA, 20 bp, Homo sapiens
tctaacactagtctgtgtgc

SEQ ID NO: 387312 - DNA, 19 bp, Homo sapiens
tctaacagctcaggatctc

SEQ ID NO: 387313 - DNA, 18 bp, Homo sapiens
tctaacaggggctggtgg

SEQ ID NO: 387314 - DNA, 17 bp, Homo sapiens
tctaacattactgcctt

SEQ ID NO: 387315 - DNA, 21 bp, Homo sapiens
tctaagaaatggctttccaca

SEQ ID NO: 387316 - DNA, 23 bp, Homo sapiens
tctaagacattcaccaacaacag

SEQ ID NO: 387317 - DNA, 21 bp, Homo sapiens
tctaagatagtaacaatgaag

SEQ ID NO: 387318 - DNA, 16 bp, Homo sapiens
tctaagcaatttcttg

SEQ ID NO: 387319 - DNA, 22 bp, Homo sapiens
tctaagccaactttaattgctt

SEQ ID NO: 387320 - DNA, 16 bp, Homo sapiens
tctaagccagttttca

SEQ ID NO: 387321 - DNA, 17 bp, Homo sapiens
tctaagcctttccataa

SEQ ID NO: 387322 - DNA, 18 bp, Homo sapiens
tctaagcttatttctaac

SEQ ID NO: 387323 - DNA, 22 bp, Homo sapiens
tctaaggaagatcactttgctc

SEQ ID NO: 387324 - DNA, 17 bp, Homo sapiens
tctaaggatagcctttg

SEQ ID NO: 387325 - DNA, 20 bp, Homo sapiens
tctaaggatagcctttgtag

SEQ ID NO: 387326 - DNA, 21 bp, Homo sapiens
tctaaggatagcctttgtagg

SEQ ID NO: 387327 - DNA, 17 bp, Homo sapiens
tctaagtcagtttcaca

SEQ ID NO: 387328 - DNA, 22 bp, Homo sapiens
tctaagtctccaagaatacaga

SEQ ID NO: 387329 - DNA, 22 bp, Homo sapiens
tctaatagaactcagttttaac

SEQ ID NO: 387330 - DNA, 17 bp, Homo sapiens
tctaatagaagtccatg

SEQ ID NO: 387331 - DNA, 21 bp, Homo sapiens
tctaatagcgggttactttca

SEQ ID NO: 387332 - DNA, 17 bp, Homo sapiens
tctaatatcattcacta

SEQ ID NO: 387333 - DNA, 17 bp, Homo sapiens
tctaatcgaaagaaaat

SEQ ID NO: 387334 - DNA, 21 bp, Homo sapiens
tctaatctcttattctaataa

SEQ ID NO: 387335 - DNA, 14 bp, Homo sapiens
tctaatgcttgttt

SEQ ID NO: 387336 - DNA, 20 bp, Homo sapiens
tctaatgcttgtttatgata

SEQ ID NO: 387337 - DNA, 22 bp, Homo sapiens
tctaatggctgtggcattgttg

SEQ ID NO: 387338 - DNA, 15 bp, Homo sapiens
tctaatgtcttcatt

SEQ ID NO: 387339 - DNA, 14 bp, Homo sapiens
tctaatgtgtgaat

SEQ ID NO: 387340 - DNA, 13 bp, Homo sapiens
tctaattgccatg

SEQ ID NO: 387341 - DNA, 23 bp, Homo sapiens
tctaatttatcttgtctctgggc

SEQ ID NO: 387342 - DNA, 12 bp, Homo sapiens
tctaatttgaat

SEQ ID NO: 387343 - DNA, 15 bp, Homo sapiens
tctaatttgctgctg

SEQ ID NO: 387344 - DNA, 23 bp, Homo sapiens
tctaattttgtgctctttcctgc

SEQ ID NO: 387345 - DNA, 16 bp, Homo sapiens
tctaatttttaagcaa

SEQ ID NO: 387346 - DNA, 16 bp, Homo sapiens
tctacaaccagagccc

SEQ ID NO: 387347 - DNA, 21 bp, Homo sapiens
tctacacagcagtatgaatga

SEQ ID NO: 387348 - DNA, 22 bp, Homo sapiens
tctacacagcagtatgaatgat

SEQ ID NO: 387349 - DNA, 14 bp, Homo sapiens
tctacactctcctg

SEQ ID NO: 387350 - DNA, 16 bp, Homo sapiens
tctacactctcctggg

SEQ ID NO: 387351 - DNA, 17 bp, Homo sapiens
tctacactctcctgggc

SEQ ID NO: 387352 - DNA, 18 bp, Homo sapiens
tctacactctcctgggcc

SEQ ID NO: 387353 - DNA, 13 bp, Homo sapiens
tctacactgtgaa

SEQ ID NO: 387354 - DNA, 14 bp, Homo sapiens
tctacactgtgaac

SEQ ID NO: 387355 - DNA, 15 bp, Homo sapiens
tctacagaacaaaga

SEQ ID NO: 387356 - DNA, 16 bp, Homo sapiens
tctacagaacaaagaa

SEQ ID NO: 387357 - DNA, 23 bp, Homo sapiens
tctacagttaattatgtgcatat

SEQ ID NO: 387358 - DNA, 22 bp, Homo sapiens
tctacataggcaaagttttcca

SEQ ID NO: 387359 - DNA, 13 bp, Homo sapiens
tctacatgactgg

SEQ ID NO: 387360 - DNA, 17 bp, Homo sapiens
tctacatgactgggcct

SEQ ID NO: 387361 - DNA, 20 bp, Homo sapiens
tctacatgtgccaccaacat

SEQ ID NO: 387362 - DNA, 16 bp, Homo sapiens
tctaccaagacataat

SEQ ID NO: 387363 - DNA, 20 bp, Homo sapiens
tctaccaagacataatgcac

SEQ ID NO: 387364 - DNA, 12 bp, Homo sapiens
tctaccatctcc

SEQ ID NO: 387365 - DNA, 17 bp, Homo sapiens
tctaccattttctggtt

SEQ ID NO: 387366 - DNA, 12 bp, Homo sapiens
tctacccagact

SEQ ID NO: 387367 - DNA, 12 bp, Homo sapiens
tctacccagccc

SEQ ID NO: 387368 - DNA, 13 bp, Homo sapiens
tctacccagccca

SEQ ID NO: 387369 - DNA, 15 bp, Homo sapiens
tctacccagcccatc

SEQ ID NO: 387370 - DNA, 21 bp, Homo sapiens
tctacccagcccatcttgcct

SEQ ID NO: 387371 - DNA, 18 bp, Homo sapiens
tctacccatgagcctgcc

SEQ ID NO: 387372 - DNA, 23 bp, Homo sapiens
tctacccatgagcctgcccgctg

SEQ ID NO: 387373 - DNA, 15 bp, Homo sapiens
tctacctgcaggact

SEQ ID NO: 387374 - DNA, 21 bp, Homo sapiens
tctacctttttttctctccta

SEQ ID NO: 387375 - DNA, 15 bp, Homo sapiens
tctacgtataaatat

SEQ ID NO: 387376 - DNA, 22 bp, Homo sapiens
tctacgtataaatatgaaatga

SEQ ID NO: 387377 - DNA, 23 bp, Homo sapiens
tctactaatttttagatattcat

SEQ ID NO: 387378 - DNA, 16 bp, Homo sapiens
tctactcatgccagat

SEQ ID NO: 387379 - DNA, 20 bp, Homo sapiens
tctactctcctcatctctaa

SEQ ID NO: 387380 - DNA, 19 bp, Homo sapiens
tctactggataaacttgct

SEQ ID NO: 387381 - DNA, 12 bp, Homo sapiens
tctacttctgtg

SEQ ID NO: 387382 - DNA, 18 bp, Homo sapiens
tctacttgatatttcctt

SEQ ID NO: 387383 - DNA, 19 bp, Homo sapiens
tctactttgactaataccc

SEQ ID NO: 387384 - DNA, 15 bp, Homo sapiens
tctactttttccttc

SEQ ID NO: 387385 - DNA, 20 bp, Homo sapiens
tctactttttccttcctgcc

SEQ ID NO: 387386 - DNA, 16 bp, Homo sapiens
tctagaaaagcttcct

SEQ ID NO: 387387 - DNA, 19 bp, Homo sapiens
tctagaaaagcttcctagc

SEQ ID NO: 387388 - DNA, 20 bp, Homo sapiens
tctagaaaagcttcctagct

SEQ ID NO: 387389 - DNA, 20 bp, Homo sapiens
tctagaaagaaaagaccctg

SEQ ID NO: 387390 - DNA, 23 bp, Homo sapiens
tctagaaagaaaagaccctgaga

SEQ ID NO: 387391 - DNA, 13 bp, Homo sapiens
tctagaaggggcg

SEQ ID NO: 387392 - DNA, 17 bp, Homo sapiens
tctagacaaccctgcaa

SEQ ID NO: 387393 - DNA, 16 bp, Homo sapiens
tctagacagtattgcc

SEQ ID NO: 387394 - DNA, 22 bp, Homo sapiens
tctagacagtattgccacctct

SEQ ID NO: 387395 - DNA, 23 bp, Homo sapiens
tctagacagtattgccacctctg

SEQ ID NO: 387396 - DNA, 18 bp, Homo sapiens
tctagacgcccctcccaa

SEQ ID NO: 387397 - DNA, 13 bp, Homo sapiens
tctagacttcccc

SEQ ID NO: 387398 - DNA, 14 bp, Homo sapiens
tctagacttcccca

SEQ ID NO: 387399 - DNA, 15 bp, Homo sapiens
tctagacttccccat

SEQ ID NO: 387400 - DNA, 19 bp, Homo sapiens
tctagacttccccatcccg

SEQ ID NO: 387401 - DNA, 23 bp, Homo sapiens
tctagagagggaattctcttggc

SEQ ID NO: 387402 - DNA, 18 bp, Homo sapiens
tctagagctatgcacacc

SEQ ID NO: 387403 - DNA, 19 bp, Homo sapiens
tctagagctatgcacacca

SEQ ID NO: 387404 - DNA, 14 bp, Homo sapiens
tctagagtaattat

SEQ ID NO: 387405 - DNA, 20 bp, Homo sapiens
tctagagtgagaatctggct

SEQ ID NO: 387406 - DNA, 17 bp, Homo sapiens
tctagatatgagaaata

SEQ ID NO: 387407 - DNA, 17 bp, Homo sapiens
tctagatggatgaatta

SEQ ID NO: 387408 - DNA, 21 bp, Homo sapiens
tctagcaactgttggataata

SEQ ID NO: 387409 - DNA, 17 bp, Homo sapiens
tctagcaagaagattct

SEQ ID NO: 387410 - DNA, 18 bp, Homo sapiens
tctagcaagaagattcta

SEQ ID NO: 387411 - DNA, 22 bp, Homo sapiens
tctagcaagaagattctaaaac

SEQ ID NO: 387412 - DNA, 16 bp, Homo sapiens
tctagccaaagagctc

SEQ ID NO: 387413 - DNA, 15 bp, Homo sapiens
tctagccaggcctcc

SEQ ID NO: 387414 - DNA, 16 bp, Homo sapiens
tctagccaggcctccc

SEQ ID NO: 387415 - DNA, 18 bp, Homo sapiens
tctagccttaaggggggc

SEQ ID NO: 387416 - DNA, 16 bp, Homo sapiens
tctagctagaaatatg

SEQ ID NO: 387417 - DNA, 21 bp, Homo sapiens
tctagctataacaactctatt

SEQ ID NO: 387418 - DNA, 20 bp, Homo sapiens
tctaggcatctcctctcccc

SEQ ID NO: 387419 - DNA, 19 bp, Homo sapiens
tctaggcgaggcgaagctg

SEQ ID NO: 387420 - DNA, 21 bp, Homo sapiens
tctaggcgaggcgaagctgag

SEQ ID NO: 387421 - DNA, 20 bp, Homo sapiens
tctaggggagaagagccctg

SEQ ID NO: 387422 - DNA, 18 bp, Homo sapiens
tctagggttgctggagcc

SEQ ID NO: 387423 - DNA, 22 bp, Homo sapiens
tctagggttgctggagcctgag

SEQ ID NO: 387424 - DNA, 18 bp, Homo sapiens
tctaggtcagtacccacc

SEQ ID NO: 387425 - DNA, 13 bp, Homo sapiens
tctagtagaacaa

SEQ ID NO: 387426 - DNA, 16 bp, Homo sapiens
tctagtagaacaatgt

SEQ ID NO: 387427 - DNA, 16 bp, Homo sapiens
tctagtaggtctgcac

SEQ ID NO: 387428 - DNA, 19 bp, Homo sapiens
tctagtccctgtgttctgc

SEQ ID NO: 387429 - DNA, 16 bp, Homo sapiens
tctagtcctattctat

SEQ ID NO: 387430 - DNA, 23 bp, Homo sapiens
tctagtcctggatgactcggtct

SEQ ID NO: 387431 - DNA, 12 bp, Homo sapiens
tctagtctctga

SEQ ID NO: 387432 - DNA, 19 bp, Homo sapiens
tctagtgcagctgatttta

SEQ ID NO: 387433 - DNA, 21 bp, Homo sapiens
tctagtggaaagattgtgtct

SEQ ID NO: 387434 - DNA, 22 bp, Homo sapiens
tctagtggaaagattgtgtctg

SEQ ID NO: 387435 - DNA, 15 bp, Homo sapiens
tctagttaagtcgct

SEQ ID NO: 387436 - DNA, 15 bp, Homo sapiens
tctagttaggccacg

SEQ ID NO: 387437 - DNA, 14 bp, Homo sapiens
tctagttcaatgcc

SEQ ID NO: 387438 - DNA, 15 bp, Homo sapiens
tctagtttcagtaaa

SEQ ID NO: 387439 - DNA, 20 bp, Homo sapiens
tctagtttgcatacttcctg

SEQ ID NO: 387440 - DNA, 14 bp, Homo sapiens
tctataaaatgagg

SEQ ID NO: 387441 - DNA, 20 bp, Homo sapiens
tctataaagcgatatacaga

SEQ ID NO: 387442 - DNA, 19 bp, Homo sapiens
tctataacagatcctttca

SEQ ID NO: 387443 - DNA, 22 bp, Homo sapiens
tctataacagatcctttcaaaa

SEQ ID NO: 387444 - DNA, 20 bp, Homo sapiens
tctataataaatgggcacag

SEQ ID NO: 387445 - DNA, 23 bp, Homo sapiens
tctataataaatgggcacagtat

SEQ ID NO: 387446 - DNA, 17 bp, Homo sapiens
tctatacattcctgaga

SEQ ID NO: 387447 - DNA, 22 bp, Homo sapiens
tctatactgtttgtaatataca

SEQ ID NO: 387448 - DNA, 14 bp, Homo sapiens
tctatagcagtcat

SEQ ID NO: 387449 - DNA, 18 bp, Homo sapiens
tctataggaacatatgaa

SEQ ID NO: 387450 - DNA, 20 bp, Homo sapiens
tctatataaaatgtattcaa

SEQ ID NO: 387451 - DNA, 22 bp, Homo sapiens
tctatatatacatgtatagtga

SEQ ID NO: 387452 - DNA, 14 bp, Homo sapiens
tctatatctttaaa

SEQ ID NO: 387453 - DNA, 22 bp, Homo sapiens
tctatattccgggtgccattcc

SEQ ID NO: 387454 - DNA, 12 bp, Homo sapiens
tctatatttcat

SEQ ID NO: 387455 - DNA, 21 bp, Homo sapiens
tctatatttcatattgagatc

SEQ ID NO: 387456 - DNA, 16 bp, Homo sapiens
tctatatttgtaactt

SEQ ID NO: 387457 - DNA, 18 bp, Homo sapiens
tctatcaagtcaatcatt

SEQ ID NO: 387458 - DNA, 23 bp, Homo sapiens
tctatcaagtcaatcatttctca

SEQ ID NO: 387459 - DNA, 20 bp, Homo sapiens
tctatcaggaaaacaaatca

SEQ ID NO: 387460 - DNA, 23 bp, Homo sapiens
tctatcctgttaacactgtaata

SEQ ID NO: 387461 - DNA, 20 bp, Homo sapiens
tctatctatatatacatata

SEQ ID NO: 387462 - DNA, 22 bp, Homo sapiens
tctatgacaataaattttatct

SEQ ID NO: 387463 - DNA, 22 bp, Homo sapiens
tctatgagaacaagtcacagct

SEQ ID NO: 387464 - DNA, 13 bp, Homo sapiens
tctatgatcagaa

SEQ ID NO: 387465 - DNA, 22 bp, Homo sapiens
tctatgatcagaactgggaaaa

SEQ ID NO: 387466 - DNA, 14 bp, Homo sapiens
tctatgcctgtatt

SEQ ID NO: 387467 - DNA, 15 bp, Homo sapiens
tctatggattcactt

SEQ ID NO: 387468 - DNA, 22 bp, Homo sapiens
tctatggattcacttctattta

SEQ ID NO: 387469 - DNA, 15 bp, Homo sapiens
tctatgtaaaaatat

SEQ ID NO: 387470 - DNA, 13 bp, Homo sapiens
tctatgtaaatta

SEQ ID NO: 387471 - DNA, 17 bp, Homo sapiens
tctatgtaaattattgt

SEQ ID NO: 387472 - DNA, 22 bp, Homo sapiens
tctatgtaaattattgtaaact

SEQ ID NO: 387473 - DNA, 16 bp, Homo sapiens
tctatgtccaacagag

SEQ ID NO: 387474 - DNA, 14 bp, Homo sapiens
tctattacccctca

SEQ ID NO: 387475 - DNA, 18 bp, Homo sapiens
tctattacccctcattta

SEQ ID NO: 387476 - DNA, 15 bp, Homo sapiens
tctattactctgaca

SEQ ID NO: 387477 - DNA, 14 bp, Homo sapiens
tctattctctgcaa

SEQ ID NO: 387478 - DNA, 16 bp, Homo sapiens
tctattctctgcaatt

SEQ ID NO: 387479 - DNA, 13 bp, Homo sapiens
tctattctgagcc

SEQ ID NO: 387480 - DNA, 14 bp, Homo sapiens
tctattctgagcct

SEQ ID NO: 387481 - DNA, 15 bp, Homo sapiens
tctattctgagcctt

SEQ ID NO: 387482 - DNA, 17 bp, Homo sapiens
tctattctgagccttga

SEQ ID NO: 387483 - DNA, 17 bp, Homo sapiens
tctattgtagcatttct

SEQ ID NO: 387484 - DNA, 18 bp, Homo sapiens
tctattgtagcatttctt

SEQ ID NO: 387485 - DNA, 19 bp, Homo sapiens
tctattgtagcatttcttg

SEQ ID NO: 387486 - DNA, 20 bp, Homo sapiens
tctattgtagcatttcttga

SEQ ID NO: 387487 - DNA, 18 bp, Homo sapiens
tctattgtgggacttatt

SEQ ID NO: 387488 - DNA, 12 bp, Homo sapiens
tctattgttact

SEQ ID NO: 387489 - DNA, 16 bp, Homo sapiens
tctattgtttctttca

SEQ ID NO: 387490 - DNA, 15 bp, Homo sapiens
tctatttaaaaaatg

SEQ ID NO: 387491 - DNA, 14 bp, Homo sapiens
tctatttaagtgta

SEQ ID NO: 387492 - DNA, 14 bp, Homo sapiens
tctatttattaagt

SEQ ID NO: 387493 - DNA, 19 bp, Homo sapiens
tctatttcggaaatacact

SEQ ID NO: 387494 - DNA, 13 bp, Homo sapiens
tctatttctatct

SEQ ID NO: 387495 - DNA, 14 bp, Homo sapiens
tctatttctatctg

SEQ ID NO: 387496 - DNA, 16 bp, Homo sapiens
tctatttctatctgca

SEQ ID NO: 387497 - DNA, 19 bp, Homo sapiens
tctatttctatctgcaaat

SEQ ID NO: 387498 - DNA, 16 bp, Homo sapiens
tctattttactttgta

SEQ ID NO: 387499 - DNA, 16 bp, Homo sapiens
tctattttgtctgata

SEQ ID NO: 387500 - DNA, 13 bp, Homo sapiens
tctatttttgtct

SEQ ID NO: 387501 - DNA, 23 bp, Homo sapiens
tctccaggcccagcctggcccca

SEQ ID NO: 387502 - DNA, 20 bp, Homo sapiens
tctccagggagtcccctccc

SEQ ID NO: 387503 - DNA, 17 bp, Homo sapiens
tctccagggctgcccct

SEQ ID NO: 387504 - DNA, 19 bp, Homo sapiens
tctccaggtgattctgatc

SEQ ID NO: 387505 - DNA, 22 bp, Homo sapiens
tctccataaagcacattttaag

SEQ ID NO: 387506 - DNA, 13 bp, Homo sapiens
tctccatcagctg

SEQ ID NO: 387507 - DNA, 18 bp, Homo sapiens
tctccatcataggctgac

SEQ ID NO: 387508 - DNA, 19 bp, Homo sapiens
tctccatcccctccctgcc

SEQ ID NO: 387509 - DNA, 14 bp, Homo sapiens
tctccatctgtttg

SEQ ID NO: 387510 - DNA, 17 bp, Homo sapiens
tctccatggccctgcca

SEQ ID NO: 387511 - DNA, 21 bp, Homo sapiens
agagccaacctcggcttgtgg

SEQ ID NO: 387512 - DNA, 11 bp, Homo sapiens
agagccaaggc

SEQ ID NO: 387513 - DNA, 16 bp, Homo sapiens
agagccaaggcctatg

SEQ ID NO: 387514 - DNA, 19 bp, Homo sapiens
agagccaaggcctatgcca

SEQ ID NO: 387515 - DNA, 22 bp, Homo sapiens
agagccaaggcctatgccacct

SEQ ID NO: 387516 - DNA, 13 bp, Homo sapiens
agagccaagtcct

SEQ ID NO: 387517 - DNA, 16 bp, Homo sapiens
agatagatttggaata

SEQ ID NO: 387518 - DNA, 14 bp, Homo sapiens
agatagctccttca

SEQ ID NO: 387519 - DNA, 12 bp, Homo sapiens
agatagttttgc

SEQ ID NO: 387520 - DNA, 19 bp, Homo sapiens
agatatcagagctcttaat

SEQ ID NO: 387521 - DNA, 17 bp, Homo sapiens
agatatgaacagggccc

SEQ ID NO: 387522 - DNA, 13 bp, Homo sapiens
agatattatttat

SEQ ID NO: 387523 - DNA, 14 bp, Homo sapiens
tctctttggtttct

SEQ ID NO: 387524 - DNA, 17 bp, Homo sapiens
tctctttgttctaaaga

SEQ ID NO: 387525 - DNA, 15 bp, Homo sapiens
tctctttttcttcct

SEQ ID NO: 387526 - DNA, 13 bp, Homo sapiens
tctctttttggag

SEQ ID NO: 387527 - DNA, 17 bp, Homo sapiens
tctctttttggaggtgc

SEQ ID NO: 387528 - DNA, 15 bp, Homo sapiens
tctgaaaacggccct

SEQ ID NO: 387529 - DNA, 17 bp, Homo sapiens
tctgaaaacggccctct

SEQ ID NO: 387530 - DNA, 14 bp, Homo sapiens
tctgaaaactgttt

SEQ ID NO: 387531 - DNA, 22 bp, Homo sapiens
tctgaaaagcaattgccctgta

SEQ ID NO: 387532 - DNA, 16 bp, Homo sapiens
tctgaaacttcccaac

SEQ ID NO: 387533 - DNA, 15 bp, Homo sapiens
tctgaaagaatcatt

SEQ ID NO: 387534 - DNA, 15 bp, Homo sapiens
tctgaaagctgcttc

SEQ ID NO: 387535 - DNA, 16 bp, Homo sapiens
tctgaaagctgcttct

SEQ ID NO: 387536 - DNA, 13 bp, Homo sapiens
tctgaaaggaaaa

SEQ ID NO: 387537 - DNA, 14 bp, Homo sapiens
tctgaaaggaaaag

SEQ ID NO: 387538 - DNA, 14 bp, Homo sapiens
tctgaaatgaaaca

SEQ ID NO: 387539 - DNA, 21 bp, Homo sapiens
tctgaacccttgtgcttggtg

SEQ ID NO: 387540 - DNA, 20 bp, Homo sapiens
tctgaactgctgctggtcac

SEQ ID NO: 387541 - DNA, 16 bp, Homo sapiens
tctgaactttggaagc

SEQ ID NO: 387542 - DNA, 23 bp, Homo sapiens
tctgaactttgtttccagaaatt

SEQ ID NO: 387543 - DNA, 14 bp, Homo sapiens
tctgaagatggaag

SEQ ID NO: 387544 - DNA, 21 bp, Homo sapiens
tctgaaggaatagccagagag

SEQ ID NO: 387545 - DNA, 13 bp, Homo sapiens
tctgaaggagagg

SEQ ID NO: 387546 - DNA, 16 bp, Homo sapiens
tctgaaggagaggagt

SEQ ID NO: 387547 - DNA, 18 bp, Homo sapiens
tctgaaggcaaatataag

SEQ ID NO: 387548 - DNA, 15 bp, Homo sapiens
tctgaagtcactgca

SEQ ID NO: 387549 - DNA, 18 bp, Homo sapiens
tctgaagtcactgcacag

SEQ ID NO: 387550 - DNA, 16 bp, Homo sapiens
tctgaagtttcattta

SEQ ID NO: 387551 - DNA, 18 bp, Homo sapiens
tctgaagtttcatttatg

SEQ ID NO: 387552 - DNA, 14 bp, Homo sapiens
tctgaataacttga

SEQ ID NO: 387553 - DNA, 15 bp, Homo sapiens
tctgaataacttgaa

SEQ ID NO: 387554 - DNA, 16 bp, Homo sapiens
tctgaatagaaatggg

SEQ ID NO: 387555 - DNA, 17 bp, Homo sapiens
tctgaatattaagaaac

SEQ ID NO: 387556 - DNA, 21 bp, Homo sapiens
tctgaatattaagaaacaatt

SEQ ID NO: 387557 - DNA, 22 bp, Homo sapiens
tctgaatcgagtgagacaaaat

SEQ ID NO: 387558 - DNA, 15 bp, Homo sapiens
tctgaatctctcaaa

SEQ ID NO: 387559 - DNA, 18 bp, Homo sapiens
tctgaatctctcaaaatg

SEQ ID NO: 387560 - DNA, 22 bp, Homo sapiens
tctgaatgggagccagaattca

SEQ ID NO: 387561 - DNA, 19 bp, Homo sapiens
tctgaattcataaaaataa

SEQ ID NO: 387562 - DNA, 15 bp, Homo sapiens
tctgacacatgctct

SEQ ID NO: 387563 - DNA, 16 bp, Homo sapiens
tctgacacatgctctc

SEQ ID NO: 387564 - DNA, 23 bp, Homo sapiens
tctgacagcagcctgtgagggag

SEQ ID NO: 387565 - DNA, 16 bp, Homo sapiens
tctgacaggaagactg

SEQ ID NO: 387566 - DNA, 23 bp, Homo sapiens
tctgacagttactcttcagtttt

SEQ ID NO: 387567 - DNA, 16 bp, Homo sapiens
tctgacattaacagtt

SEQ ID NO: 387568 - DNA, 22 bp, Homo sapiens
tctgacattaacagttttccat

SEQ ID NO: 387569 - DNA, 23 bp, Homo sapiens
tctgacattaacagttttccatg

SEQ ID NO: 387570 - DNA, 22 bp, Homo sapiens
tctgaccacacttcctgtccag

SEQ ID NO: 387571 - DNA, 17 bp, Homo sapiens
tctgacccactgatctc

SEQ ID NO: 387572 - DNA, 14 bp, Homo sapiens
tctgaccctctcca

SEQ ID NO: 387573 - DNA, 22 bp, Homo sapiens
tctgacctgcccccgctctgcc

SEQ ID NO: 387574 - DNA, 23 bp, Homo sapiens
tctgacctgcccccgctctgcca

SEQ ID NO: 387575 - DNA, 15 bp, Homo sapiens
tctgacggccctgca

SEQ ID NO: 387576 - DNA, 12 bp, Homo sapiens
tctgactccaga

SEQ ID NO: 387577 - DNA, 19 bp, Homo sapiens
tctgactccagagtctgag

SEQ ID NO: 387578 - DNA, 21 bp, Homo sapiens
tctgactccagagtctgagcc

SEQ ID NO: 387579 - DNA, 21 bp, Homo sapiens
tctgactgaaggggcttggct

SEQ ID NO: 387580 - DNA, 12 bp, Homo sapiens
tctgactgtgtg

SEQ ID NO: 387581 - DNA, 14 bp, Homo sapiens
tctgagaagaggag

SEQ ID NO: 387582 - DNA, 16 bp, Homo sapiens
tctgagaagaggagcc

SEQ ID NO: 387583 - DNA, 19 bp, Homo sapiens
tctgagaagaggagccctc

SEQ ID NO: 387584 - DNA, 11 bp, Homo sapiens
tctgagatcag

SEQ ID NO: 387585 - DNA, 11 bp, Homo sapiens
tctgagcagcc

SEQ ID NO: 387586 - DNA, 19 bp, Homo sapiens
tctgagcagcctctgccag

SEQ ID NO: 387587 - DNA, 13 bp, Homo sapiens
tctgagcagtggg

SEQ ID NO: 387588 - DNA, 14 bp, Homo sapiens
tctgagcagtgggg

SEQ ID NO: 387589 - DNA, 13 bp, Homo sapiens
tctgagcccaggc

SEQ ID NO: 387590 - DNA, 18 bp, Homo sapiens
tctgagcccccggctagt

SEQ ID NO: 387591 - DNA, 21 bp, Homo sapiens
tctgagccccctgtgcccacc

SEQ ID NO: 387592 - DNA, 16 bp, Homo sapiens
tctgagcccctgggac

SEQ ID NO: 387593 - DNA, 15 bp, Homo sapiens
tctgagccctccctc

SEQ ID NO: 387594 - DNA, 19 bp, Homo sapiens
tctgagccctccctcttcc

SEQ ID NO: 387595 - DNA, 21 bp, Homo sapiens
tctgagccctccctcttccca

SEQ ID NO: 387596 - DNA, 18 bp, Homo sapiens
tctgagccctgccctcac

SEQ ID NO: 387597 - DNA, 18 bp, Homo sapiens
tctgagcctctctcggtc

SEQ ID NO: 387598 - DNA, 21 bp, Homo sapiens
tctgagcggccgcctgtcctt

SEQ ID NO: 387599 - DNA, 12 bp, Homo sapiens
tctgagctgctg

SEQ ID NO: 387600 - DNA, 14 bp, Homo sapiens
tctgagctgttatc

SEQ ID NO: 387601 - DNA, 23 bp, Homo sapiens
tctgaggagtaaaaagactactg

SEQ ID NO: 387602 - DNA, 19 bp, Homo sapiens
tctgaggagtccaaaatat

SEQ ID NO: 387603 - DNA, 23 bp, Homo sapiens
tctgaggcacctgcatatctcta

SEQ ID NO: 387604 - DNA, 18 bp, Homo sapiens
tctgaggccccaggccct

SEQ ID NO: 387605 - DNA, 12 bp, Homo sapiens
tctgaggcctca

SEQ ID NO: 387606 - DNA, 21 bp, Homo sapiens
tctgaggcctcatccctcgga

SEQ ID NO: 387607 - DNA, 15 bp, Homo sapiens
tctgagtccagctcc

SEQ ID NO: 387608 - DNA, 12 bp, Homo sapiens
tctgagtggtgt

SEQ ID NO: 387609 - DNA, 17 bp, Homo sapiens
tctgataatgtattgca

SEQ ID NO: 387610 - DNA, 22 bp, Homo sapiens
tctgatattaatttatcagatt

SEQ ID NO: 387611 - DNA, 20 bp, Homo sapiens
tctgatattccatgaatgta

SEQ ID NO: 387612 - DNA, 22 bp, Homo sapiens
tctgatattccatgaatgtatc

SEQ ID NO: 387613 - DNA, 12 bp, Homo sapiens
tctgatcaaagc

SEQ ID NO: 387614 - DNA, 16 bp, Homo sapiens
tctgatcccataaaga

SEQ ID NO: 387615 - DNA, 23 bp, Homo sapiens
tctgatcccctttggttttacta

SEQ ID NO: 387616 - DNA, 22 bp, Homo sapiens
tctgatccctgatcaagcttca

SEQ ID NO: 387617 - DNA, 20 bp, Homo sapiens
tctgatggtgagctgggaag

SEQ ID NO: 387618 - DNA, 15 bp, Homo sapiens
tctgatgtgtgccca

SEQ ID NO: 387619 - DNA, 15 bp, Homo sapiens
tctgattaatccatt

SEQ ID NO: 387620 - DNA, 18 bp, Homo sapiens
tctgattatcaggtactg

SEQ ID NO: 387621 - DNA, 13 bp, Homo sapiens
tctgattccatat

SEQ ID NO: 387622 - DNA, 16 bp, Homo sapiens
tctgattggacatttt

SEQ ID NO: 387623 - DNA, 23 bp, Homo sapiens
tctgattggacattttcttcaga

SEQ ID NO: 387624 - DNA, 15 bp, Homo sapiens
tctgcaaaggagggc

SEQ ID NO: 387625 - DNA, 17 bp, Homo sapiens
tctgcaaaggagggcct

SEQ ID NO: 387626 - DNA, 14 bp, Homo sapiens
tctgcaaatagaaa

SEQ ID NO: 387627 - DNA, 16 bp, Homo sapiens
tctgcaaatagtttca

SEQ ID NO: 387628 - DNA, 16 bp, Homo sapiens
tctgcaacagcctgtt

SEQ ID NO: 387629 - DNA, 12 bp, Homo sapiens
tctgcaacatgg

SEQ ID NO: 387630 - DNA, 13 bp, Homo sapiens
tctgcaacatgga

SEQ ID NO: 387631 - DNA, 15 bp, Homo sapiens
tctgcaacatggatt

SEQ ID NO: 387632 - DNA, 19 bp, Homo sapiens
tctgcaactagccaaggct

SEQ ID NO: 387633 - DNA, 20 bp, Homo sapiens
tctgcaagcacatctgcatt

SEQ ID NO: 387634 - DNA, 19 bp, Homo sapiens
tctgcaatttgtttaaaga

SEQ ID NO: 387635 - DNA, 21 bp, Homo sapiens
tctgcaatttgtttaaagaat

SEQ ID NO: 387636 - DNA, 22 bp, Homo sapiens
tctgcacacataacacacatca

SEQ ID NO: 387637 - DNA, 13 bp, Homo sapiens
tctgcacagatgg

SEQ ID NO: 387638 - DNA, 22 bp, Homo sapiens
tctgcacctgtctcatagcctc

SEQ ID NO: 387639 - DNA, 12 bp, Homo sapiens
tctgcactactc

SEQ ID NO: 387640 - DNA, 14 bp, Homo sapiens
tctgcactactcct

SEQ ID NO: 387641 - DNA, 18 bp, Homo sapiens
tctgcactactcctctgc

SEQ ID NO: 387642 - DNA, 13 bp, Homo sapiens
tctgcactccatg

SEQ ID NO: 387643 - DNA, 17 bp, Homo sapiens
tctgcactccatggcca

SEQ ID NO: 387644 - DNA, 18 bp, Homo sapiens
tctgcactccatggccac

SEQ ID NO: 387645 - DNA, 17 bp, Homo sapiens
tctgcagaggcagcagg

SEQ ID NO: 387646 - DNA, 22 bp, Homo sapiens
tctgcagaggcagcaggagcca

SEQ ID NO: 387647 - DNA, 19 bp, Homo sapiens
tctgcagcccttgggcagt

SEQ ID NO: 387648 - DNA, 24 bp, Homo sapiens
tctgcagcctgagctccaccctcc

SEQ ID NO: 387649 - DNA, 14 bp, Homo sapiens
tctgcagctgacct

SEQ ID NO: 387650 - DNA, 15 bp, Homo sapiens
tctgcagctgtttta

SEQ ID NO: 387651 - DNA, 12 bp, Homo sapiens
tctgcaggacac

SEQ ID NO: 387652 - DNA, 12 bp, Homo sapiens
tctgcaggccac

SEQ ID NO: 387653 - DNA, 13 bp, Homo sapiens
tctgcaggccacc

SEQ ID NO: 387654 - DNA, 13 bp, Homo sapiens
tctgcagggagca

SEQ ID NO: 387655 - DNA, 17 bp, Homo sapiens
tctgcagggcagcctgt

SEQ ID NO: 387656 - DNA, 18 bp, Homo sapiens
tctgcagggcagcctgtg

SEQ ID NO: 387657 - DNA, 21 bp, Homo sapiens
tctgcagggcagcctgtggga

SEQ ID NO: 387658 - DNA, 16 bp, Homo sapiens
tctgcagtcctggtgg

SEQ ID NO: 387659 - DNA, 14 bp, Homo sapiens
tctgcagtgccttg

SEQ ID NO: 387660 - DNA, 15 bp, Homo sapiens
tctgcagtgccttgg

SEQ ID NO: 387661 - DNA, 12 bp, Homo sapiens
tctgcatagaca

SEQ ID NO: 387662 - DNA, 17 bp, Homo sapiens
tctgcatctcctgtctt

SEQ ID NO: 387663 - DNA, 18 bp, Homo sapiens
tctgcatctcctgtcttt

SEQ ID NO: 387664 - DNA, 17 bp, Homo sapiens
tctgcatgtaaaatctt

SEQ ID NO: 387665 - DNA, 22 bp, Homo sapiens
tctgcattgttattgtggaaga

SEQ ID NO: 387666 - DNA, 14 bp, Homo sapiens
tctgcatttagcac

SEQ ID NO: 387667 - DNA, 17 bp, Homo sapiens
tctgcatttataaatgt

SEQ ID NO: 387668 - DNA, 20 bp, Homo sapiens
tctgcatttataaatgtgtg

SEQ ID NO: 387669 - DNA, 21 bp, Homo sapiens
tctgcattttcaccccaccct

SEQ ID NO: 387670 - DNA, 12 bp, Homo sapiens
tctgcattttct

SEQ ID NO: 387671 - DNA, 13 bp, Homo sapiens
tctgcattttctc

SEQ ID NO: 387672 - DNA, 13 bp, Homo sapiens
tctgccaagccct

SEQ ID NO: 387673 - DNA, 13 bp, Homo sapiens
tctgccacccact

SEQ ID NO: 387674 - DNA, 14 bp, Homo sapiens
tctgccaccctacc

SEQ ID NO: 387675 - DNA, 18 bp, Homo sapiens
tctgccaccctacctgtt

SEQ ID NO: 387676 - DNA, 17 bp, Homo sapiens
tctgccagctccacagg

SEQ ID NO: 387677 - DNA, 21 bp, Homo sapiens
tctgccagctccacagggtgg

SEQ ID NO: 387678 - DNA, 13 bp, Homo sapiens
tctgccaggccca

SEQ ID NO: 387679 - DNA, 22 bp, Homo sapiens
tctgccaggcctgtatgaggct

SEQ ID NO: 387680 - DNA, 19 bp, Homo sapiens
tctgccagggagcttgaaa

SEQ ID NO: 387681 - DNA, 12 bp, Homo sapiens
tctgccagggca

SEQ ID NO: 387682 - DNA, 16 bp, Homo sapiens
tctgccagggcagtgc

SEQ ID NO: 387683 - DNA, 17 bp, Homo sapiens
tctgccagggcagtgct

SEQ ID NO: 387684 - DNA, 19 bp, Homo sapiens
tctgccagtgacagacagg

SEQ ID NO: 387685 - DNA, 23 bp, Homo sapiens
tctgccagtgacagacaggctct

SEQ ID NO: 387686 - DNA, 15 bp, Homo sapiens
tctgccatcagcccc

SEQ ID NO: 387687 - DNA, 19 bp, Homo sapiens
tctgccatgtttttgcaaa

SEQ ID NO: 387688 - DNA, 15 bp, Homo sapiens
tctgcccaactttca

SEQ ID NO: 387689 - DNA, 10 bp, Homo sapiens
tctgcccacc

SEQ ID NO: 387690 - DNA, 16 bp, Homo sapiens
tctgcccagagctggg

SEQ ID NO: 387691 - DNA, 12 bp, Homo sapiens
tctgcccagctt

SEQ ID NO: 387692 - DNA, 16 bp, Homo sapiens
tctgcccagcttgggc

SEQ ID NO: 387693 - DNA, 13 bp, Homo sapiens
tctgccccaagca

SEQ ID NO: 387694 - DNA, 14 bp, Homo sapiens
tctgccccaagcag

SEQ ID NO: 387695 - DNA, 16 bp, Homo sapiens
tctgccccaagccccc

SEQ ID NO: 387696 - DNA, 13 bp, Homo sapiens
tctgccccaccct

SEQ ID NO: 387697 - DNA, 16 bp, Homo sapiens
tctgcccccagctgct

SEQ ID NO: 387698 - DNA, 22 bp, Homo sapiens
tctgcccccgcgggttctagac

SEQ ID NO: 387699 - DNA, 19 bp, Homo sapiens
tctgcccccgttccagctg

SEQ ID NO: 387700 - DNA, 14 bp, Homo sapiens
tctgccccctcccc

SEQ ID NO: 387701 - DNA, 20 bp, Homo sapiens
tctgccccctcccccgcaga

SEQ ID NO: 387702 - DNA, 23 bp, Homo sapiens
tctgccccctcccccgcagacag

SEQ ID NO: 387703 - DNA, 18 bp, Homo sapiens
tctgcccctcccccaacc

SEQ ID NO: 387704 - DNA, 21 bp, Homo sapiens
tctgccccttgaccccacacg

SEQ ID NO: 387705 - DNA, 13 bp, Homo sapiens
tctgccctgcctc

SEQ ID NO: 387706 - DNA, 16 bp, Homo sapiens
tctgcccttcctttcc

SEQ ID NO: 387707 - DNA, 21 bp, Homo sapiens
tctgccgaccgcctgcttcac

SEQ ID NO: 387708 - DNA, 15 bp, Homo sapiens
tctgccgcctggggc

SEQ ID NO: 387709 - DNA, 13 bp, Homo sapiens
tctgccggctctt

SEQ ID NO: 387710 - DNA, 18 bp, Homo sapiens
tctgccggtcccccatgc

SEQ ID NO: 387711 - DNA, 22 bp, Homo sapiens
tctgccggtcccccatgccacc

SEQ ID NO: 387712 - DNA, 17 bp, Homo sapiens
tctgccgtgagagccca

SEQ ID NO: 387713 - DNA, 21 bp, Homo sapiens
tctgcctaggagctggctggc

SEQ ID NO: 387714 - DNA, 15 bp, Homo sapiens
tctgcctccaggagg

SEQ ID NO: 387715 - DNA, 17 bp, Homo sapiens
tctgcctgcctcatgct

SEQ ID NO: 387716 - DNA, 19 bp, Homo sapiens
tctgcctgcctcatgctct

SEQ ID NO: 387717 - DNA, 22 bp, Homo sapiens
tctgcctgcctcatgctctcta

SEQ ID NO: 387718 - DNA, 15 bp, Homo sapiens
tctgcctggcctggc

SEQ ID NO: 387719 - DNA, 16 bp, Homo sapiens
tctgcctggcctggct

SEQ ID NO: 387720 - DNA, 12 bp, Homo sapiens
tctgcctgggcc

SEQ ID NO: 387721 - DNA, 13 bp, Homo sapiens
tctgcctgggcct

SEQ ID NO: 387722 - DNA, 14 bp, Homo sapiens
tctgcctgggcctg

SEQ ID NO: 387723 - DNA, 18 bp, Homo sapiens
tctgcctgggcctgtgca

SEQ ID NO: 387724 - DNA, 19 bp, Homo sapiens
tctgcctgggcctgtgcag

SEQ ID NO: 387725 - DNA, 14 bp, Homo sapiens
tctgcctgtctccc

SEQ ID NO: 387726 - DNA, 18 bp, Homo sapiens
tctgcctgtggccttgcc

SEQ ID NO: 387727 - DNA, 12 bp, Homo sapiens
tctgccttccag

SEQ ID NO: 387728 - DNA, 18 bp, Homo sapiens
tctgccttccagcccaga

SEQ ID NO: 387729 - DNA, 20 bp, Homo sapiens
tctgccttccagcccagacc

SEQ ID NO: 387730 - DNA, 13 bp, Homo sapiens
tctgccttccagg

SEQ ID NO: 387731 - DNA, 14 bp, Homo sapiens
tctgccttccaggc

SEQ ID NO: 387732 - DNA, 18 bp, Homo sapiens
tctgccttgatggagaag

SEQ ID NO: 387733 - DNA, 15 bp, Homo sapiens
tctgccttgctgcac

SEQ ID NO: 387734 - DNA, 20 bp, Homo sapiens
tctgccttgctgcacctgag

SEQ ID NO: 387735 - DNA, 13 bp, Homo sapiens
tctgcgcccttgt

SEQ ID NO: 387736 - DNA, 13 bp, Homo sapiens
tctgcgccgctgt

SEQ ID NO: 387737 - DNA, 23 bp, Homo sapiens
tctgcgtgtgatttgtctctgag

SEQ ID NO: 387738 - DNA, 14 bp, Homo sapiens
tctgctaataaaac

SEQ ID NO: 387739 - DNA, 14 bp, Homo sapiens
tctgctaggcgctg

SEQ ID NO: 387740 - DNA, 21 bp, Homo sapiens
tctgctaggcgctggggagac

SEQ ID NO: 387741 - DNA, 17 bp, Homo sapiens
tctgctatattttcatg

SEQ ID NO: 387742 - DNA, 20 bp, Homo sapiens
tctgctcacattccctctca

SEQ ID NO: 387743 - DNA, 10 bp, Homo sapiens
tctgctccac

SEQ ID NO: 387744 - DNA, 12 bp, Homo sapiens
tctgctccacca

SEQ ID NO: 387745 - DNA, 14 bp, Homo sapiens
tctgctccaccaca

SEQ ID NO: 387746 - DNA, 14 bp, Homo sapiens
tctgctccaccctt

SEQ ID NO: 387747 - DNA, 15 bp, Homo sapiens
tctgctccacccttg

SEQ ID NO: 387748 - DNA, 18 bp, Homo sapiens
tctgctccacccttggcc

SEQ ID NO: 387749 - DNA, 20 bp, Homo sapiens
tctgctccacccttggcctg

SEQ ID NO: 387750 - DNA, 23 bp, Homo sapiens
tctgctccacccttggcctgtct

SEQ ID NO: 387751 - DNA, 13 bp, Homo sapiens
tctgctccatgca

SEQ ID NO: 387752 - DNA, 13 bp, Homo sapiens
tctgctcccagcc

SEQ ID NO: 387753 - DNA, 15 bp, Homo sapiens
tctgctcccagcccc

SEQ ID NO: 387754 - DNA, 20 bp, Homo sapiens
tctgctccgtgtgtctcatg

SEQ ID NO: 387755 - DNA, 23 bp, Homo sapiens
tctgctcctcacccccacccctg

SEQ ID NO: 387756 - DNA, 14 bp, Homo sapiens
tctgctcggccgtc

SEQ ID NO: 387757 - DNA, 18 bp, Homo sapiens
tctgctcggccgtcttca

SEQ ID NO: 387758 - DNA, 15 bp, Homo sapiens
tctgctctagccagg

SEQ ID NO: 387759 - DNA, 16 bp, Homo sapiens
tctgctctagccagga

SEQ ID NO: 387760 - DNA, 18 bp, Homo sapiens
tctgctctagccaggagt

SEQ ID NO: 387761 - DNA, 21 bp, Homo sapiens
tctgctctgtccaattccaga

SEQ ID NO: 387762 - DNA, 18 bp, Homo sapiens
tctgctctgtgcctggga

SEQ ID NO: 387763 - DNA, 15 bp, Homo sapiens
tctgctctttctctg

SEQ ID NO: 387764 - DNA, 16 bp, Homo sapiens
tctgctctttctctgc

SEQ ID NO: 387765 - DNA, 17 bp, Homo sapiens
tctgctctttctctgcc

SEQ ID NO: 387766 - DNA, 18 bp, Homo sapiens
tctgctctttctctgcca

SEQ ID NO: 387767 - DNA, 19 bp, Homo sapiens
tctgctctttctctgccag

SEQ ID NO: 387768 - DNA, 13 bp, Homo sapiens
tctgctgaaggaa

SEQ ID NO: 387769 - DNA, 12 bp, Homo sapiens
tctgctgcccac

SEQ ID NO: 387770 - DNA, 15 bp, Homo sapiens
tctgctgcctctgaa

SEQ ID NO: 387771 - DNA, 20 bp, Homo sapiens
tctgctgcctctgaaaatat

SEQ ID NO: 387772 - DNA, 19 bp, Homo sapiens
tctgctgcttctgggcctg

SEQ ID NO: 387773 - DNA, 22 bp, Homo sapiens
tctgctggataaaatgaggttc

SEQ ID NO: 387774 - DNA, 15 bp, Homo sapiens
tctgctggcctggat

SEQ ID NO: 387775 - DNA, 18 bp, Homo sapiens
tctgctggcctggatctc

SEQ ID NO: 387776 - DNA, 16 bp, Homo sapiens
tctgctgggtttccac

SEQ ID NO: 387777 - DNA, 22 bp, Homo sapiens
tctgctgtaagacggccttgga

SEQ ID NO: 387778 - DNA, 21 bp, Homo sapiens
tctgctgtattgatatcacta

SEQ ID NO: 387779 - DNA, 14 bp, Homo sapiens
tctgctgtcctgca

SEQ ID NO: 387780 - DNA, 19 bp, Homo sapiens
agatggtgccccctggggg

SEQ ID NO: 387781 - DNA, 15 bp, Homo sapiens
agatggttccctttg

SEQ ID NO: 387782 - DNA, 18 bp, Homo sapiens
agatggtttgagcctgag

SEQ ID NO: 387783 - DNA, 15 bp, Homo sapiens
agatgtaatgacaga

SEQ ID NO: 387784 - DNA, 19 bp, Homo sapiens
agatgtaatgacagagagt

SEQ ID NO: 387785 - DNA, 22 bp, Homo sapiens
agatgtaatgtagttctttgtt

SEQ ID NO: 387786 - DNA, 16 bp, Homo sapiens
agatgtactgagagga

SEQ ID NO: 387787 - DNA, 12 bp, Homo sapiens
agatgtagcatt

SEQ ID NO: 387788 - DNA, 21 bp, Homo sapiens
agatgtagcattgttccacac

SEQ ID NO: 387789 - DNA, 17 bp, Homo sapiens
agatgtaggctccacct

SEQ ID NO: 387790 - DNA, 17 bp, Homo sapiens
agatgtatccttccaat

SEQ ID NO: 387791 - DNA, 15 bp, Homo sapiens
agatgtatgaaggct

SEQ ID NO: 387792 - DNA, 20 bp, Homo sapiens
agatgtattaacctacctgt

SEQ ID NO: 387793 - DNA, 16 bp, Homo sapiens
agatgtattatgcaaa

SEQ ID NO: 387794 - DNA, 21 bp, Homo sapiens
agatgtattatgcaaagtacc

SEQ ID NO: 387795 - DNA, 16 bp, Homo sapiens
agatgtattcagagcc

SEQ ID NO: 387796 - DNA, 19 bp, Homo sapiens
agatgtcaaatatctcaga

SEQ ID NO: 387797 - DNA, 18 bp, Homo sapiens
agatgtcagccgagccgg

SEQ ID NO: 387798 - DNA, 18 bp, Homo sapiens
agcaacaggttttataat

SEQ ID NO: 387799 - DNA, 15 bp, Homo sapiens
agcaacatcagcttg

SEQ ID NO: 387800 - DNA, 15 bp, Homo sapiens
agcaacatgcttcat

SEQ ID NO: 387801 - DNA, 19 bp, Homo sapiens
agcaacccctgtacccagc

SEQ ID NO: 387802 - DNA, 21 bp, Homo sapiens
agcaacccctgtacccagctc

SEQ ID NO: 387803 - DNA, 23 bp, Homo sapiens
agcaacccctgtacccagctcct

SEQ ID NO: 387804 - DNA, 18 bp, Homo sapiens
agcaaccctacagtatat

SEQ ID NO: 387805 - DNA, 19 bp, Homo sapiens
agcaaccctacagtatata

SEQ ID NO: 387806 - DNA, 21 bp, Homo sapiens
agcaaccctacagtatataag

SEQ ID NO: 387807 - DNA, 22 bp, Homo sapiens
agcaaccctcctatcacctccc

SEQ ID NO: 387808 - DNA, 14 bp, Homo sapiens
agcaacgcctgcct

SEQ ID NO: 387809 - DNA, 18 bp, Homo sapiens
agcaacgcctgccttctg

SEQ ID NO: 387810 - DNA, 21 bp, Homo sapiens
agcaactctccactccatatt

SEQ ID NO: 387811 - DNA, 14 bp, Homo sapiens
agcaactgtgcagc

SEQ ID NO: 387812 - DNA, 15 bp, Homo sapiens
agcaactgttagctg

SEQ ID NO: 387813 - DNA, 19 bp, Homo sapiens
agcaactgttagctgggaa

SEQ ID NO: 387814 - DNA, 12 bp, Homo sapiens
agcaactgttgg

SEQ ID NO: 387815 - DNA, 20 bp, Homo sapiens
agcaacttgtctttttctgg

SEQ ID NO: 387816 - DNA, 23 bp, Homo sapiens
agcaacttgtctttttctggact

SEQ ID NO: 387817 - DNA, 22 bp, Homo sapiens
agcaagaaaaaagtacagaaca

SEQ ID NO: 387818 - DNA, 18 bp, Homo sapiens
agcaagaagattctaaaa

SEQ ID NO: 387819 - DNA, 20 bp, Homo sapiens
agcaagacaatgacactgga

SEQ ID NO: 387820 - DNA, 18 bp, Homo sapiens
agcaagacctgttggtta

SEQ ID NO: 387821 - DNA, 14 bp, Homo sapiens
tctgcttgtgttaa

SEQ ID NO: 387822 - DNA, 14 bp, Homo sapiens
tctgctttctatta

SEQ ID NO: 387823 - DNA, 15 bp, Homo sapiens
tctgctttcttgcca

SEQ ID NO: 387824 - DNA, 18 bp, Homo sapiens
tctgctttgttaatgaaa

SEQ ID NO: 387825 - DNA, 18 bp, Homo sapiens
tctggaaaaaaaaaaata

SEQ ID NO: 387826 - DNA, 14 bp, Homo sapiens
tctggaaagggcac

SEQ ID NO: 387827 - DNA, 19 bp, Homo sapiens
tctggaaaggggggagctg

SEQ ID NO: 387828 - DNA, 16 bp, Homo sapiens
tctggaatgtaatcaa

SEQ ID NO: 387829 - DNA, 18 bp, Homo sapiens
tctggaatgtaatcaatg

SEQ ID NO: 387830 - DNA, 15 bp, Homo sapiens
tctggactctgcccc

SEQ ID NO: 387831 - DNA, 19 bp, Homo sapiens
tctggactctgccccaatc

SEQ ID NO: 387832 - DNA, 20 bp, Homo sapiens
tctggactctgccccaatcg

SEQ ID NO: 387833 - DNA, 17 bp, Homo sapiens
tctggactgaagcctgc

SEQ ID NO: 387834 - DNA, 15 bp, Homo sapiens
tctggactggctaga

SEQ ID NO: 387835 - DNA, 16 bp, Homo sapiens
tctggagaccaggact

SEQ ID NO: 387836 - DNA, 20 bp, Homo sapiens
tctggagaccaggactctgc

SEQ ID NO: 387837 - DNA, 23 bp, Homo sapiens
tctggagaccaggactctgcctt

SEQ ID NO: 387838 - DNA, 21 bp, Homo sapiens
tctggagtctgaaggagagga

SEQ ID NO: 387839 - DNA, 23 bp, Homo sapiens
tctggagtctgaaggagaggagt

SEQ ID NO: 387840 - DNA, 19 bp, Homo sapiens
tctggatgcacagatgcca

SEQ ID NO: 387841 - DNA, 22 bp, Homo sapiens
tctggatgcacagatgccatgg

SEQ ID NO: 387842 - DNA, 22 bp, Homo sapiens
tctggatggccgggctgctgct

SEQ ID NO: 387843 - DNA, 21 bp, Homo sapiens
tctggatttttacaaataaag

SEQ ID NO: 387844 - DNA, 18 bp, Homo sapiens
tctggcaaacatgtgcaa

SEQ ID NO: 387845 - DNA, 19 bp, Homo sapiens
tctggcaggtggccagggc

SEQ ID NO: 387846 - DNA, 18 bp, Homo sapiens
tctggcagttctggaatg

SEQ ID NO: 387847 - DNA, 13 bp, Homo sapiens
tctggccactctg

SEQ ID NO: 387848 - DNA, 19 bp, Homo sapiens
tctggccagacggcccgcc

SEQ ID NO: 387849 - DNA, 15 bp, Homo sapiens
tctggcctcagacca

SEQ ID NO: 387850 - DNA, 16 bp, Homo sapiens
tctggcctcagaccaa

SEQ ID NO: 387851 - DNA, 11 bp, Homo sapiens
tctggcctgcc

SEQ ID NO: 387852 - DNA, 19 bp, Homo sapiens
tctggcctggcctggccct

SEQ ID NO: 387853 - DNA, 21 bp, Homo sapiens
tctggcctggcctggccctgc

SEQ ID NO: 387854 - DNA, 21 bp, Homo sapiens
tctggcctttcctctctcctg

SEQ ID NO: 387855 - DNA, 14 bp, Homo sapiens
tctggccttttcct

SEQ ID NO: 387856 - DNA, 15 bp, Homo sapiens
tctggcgagccctta

SEQ ID NO: 387857 - DNA, 17 bp, Homo sapiens
tctggctaaggcatcat

SEQ ID NO: 387858 - DNA, 21 bp, Homo sapiens
tctggctagaggccagcccca

SEQ ID NO: 387859 - DNA, 16 bp, Homo sapiens
tctggctccgaaaaac

SEQ ID NO: 387860 - DNA, 13 bp, Homo sapiens
tctggctgcctgg

SEQ ID NO: 387861 - DNA, 20 bp, Homo sapiens
tctggctgcctggcccaggg

SEQ ID NO: 387862 - DNA, 15 bp, Homo sapiens
tctggctggagagga

SEQ ID NO: 387863 - DNA, 14 bp, Homo sapiens
tctggctgtggccc

SEQ ID NO: 387864 - DNA, 13 bp, Homo sapiens
tctggcttctgca

SEQ ID NO: 387865 - DNA, 15 bp, Homo sapiens
tctggctttgttctt

SEQ ID NO: 387866 - DNA, 19 bp, Homo sapiens
tctggctttgttcttgtca

SEQ ID NO: 387867 - DNA, 15 bp, Homo sapiens
tctgggaactcccaa

SEQ ID NO: 387868 - DNA, 10 bp, Homo sapiens
tctgggaaga

SEQ ID NO: 387869 - DNA, 15 bp, Homo sapiens
tctgggaagaatgtc

SEQ ID NO: 387870 - DNA, 15 bp, Homo sapiens
tctgggaaggcaaca

SEQ ID NO: 387871 - DNA, 17 bp, Homo sapiens
tctgggactctcctcct

SEQ ID NO: 387872 - DNA, 21 bp, Homo sapiens
tctgggactctcctcctcccc

SEQ ID NO: 387873 - DNA, 17 bp, Homo sapiens
tctgggagtgttctgtt

SEQ ID NO: 387874 - DNA, 23 bp, Homo sapiens
tctgggatatatggaggattctt

SEQ ID NO: 387875 - DNA, 15 bp, Homo sapiens
tctgggatgtagaac

SEQ ID NO: 387876 - DNA, 15 bp, Homo sapiens
tctgggattctactt

SEQ ID NO: 387877 - DNA, 16 bp, Homo sapiens
tctgggcagagcctgt

SEQ ID NO: 387878 - DNA, 17 bp, Homo sapiens
tctgggcagagcctgtc

SEQ ID NO: 387879 - DNA, 14 bp, Homo sapiens
tctgggcaggacct

SEQ ID NO: 387880 - DNA, 18 bp, Homo sapiens
tctgggcaggacctcaga

SEQ ID NO: 387881 - DNA, 12 bp, Homo sapiens
tctgggcatggt

SEQ ID NO: 387882 - DNA, 17 bp, Homo sapiens
tctgggcctgggctagg

SEQ ID NO: 387883 - DNA, 13 bp, Homo sapiens
tctgggctcaggg

SEQ ID NO: 387884 - DNA, 16 bp, Homo sapiens
tctgggctcagggctg

SEQ ID NO: 387885 - DNA, 22 bp, Homo sapiens
tctgggctcctggaaccaatcc

SEQ ID NO: 387886 - DNA, 21 bp, Homo sapiens
tctggggaagggaaccagccc

SEQ ID NO: 387887 - DNA, 22 bp, Homo sapiens
tctggggaagggaaccagccct

SEQ ID NO: 387888 - DNA, 16 bp, Homo sapiens
tctggggcctttatca

SEQ ID NO: 387889 - DNA, 16 bp, Homo sapiens
tctggggctctgggat

SEQ ID NO: 387890 - DNA, 19 bp, Homo sapiens
tctgggggactagaacaca

SEQ ID NO: 387891 - DNA, 17 bp, Homo sapiens
tctgggtgatttctaga

SEQ ID NO: 387892 - DNA, 19 bp, Homo sapiens
tctgggtgatttctagaat

SEQ ID NO: 387893 - DNA, 20 bp, Homo sapiens
tctgggtggtaactgccagc

SEQ ID NO: 387894 - DNA, 16 bp, Homo sapiens
tctgggttctgggtgg

SEQ ID NO: 387895 - DNA, 17 bp, Homo sapiens
tctggtaacctgtggtg

SEQ ID NO: 387896 - DNA, 15 bp, Homo sapiens
tctggtactctccta

SEQ ID NO: 387897 - DNA, 14 bp, Homo sapiens
tctggtatctgcat

SEQ ID NO: 387898 - DNA, 15 bp, Homo sapiens
tctggtccacacacc

SEQ ID NO: 387899 - DNA, 21 bp, Homo sapiens
tctggtcccctgtggtgatgt

SEQ ID NO: 387900 - DNA, 15 bp, Homo sapiens
tctggtgactgcagc

SEQ ID NO: 387901 - DNA, 15 bp, Homo sapiens
tctggtgccaatcct

SEQ ID NO: 387902 - DNA, 17 bp, Homo sapiens
tctggtgcgtgtggccc

SEQ ID NO: 387903 - DNA, 19 bp, Homo sapiens
tctggtgcgtgtggccctg

SEQ ID NO: 387904 - DNA, 21 bp, Homo sapiens
tctggtgcgtgtggccctgtg

SEQ ID NO: 387905 - DNA, 21 bp, Homo sapiens
tctggtgggaaaatgtccccc

SEQ ID NO: 387906 - DNA, 16 bp, Homo sapiens
tctggtgttctcaatg

SEQ ID NO: 387907 - DNA, 23 bp, Homo sapiens
tctggttccactcagcttggttc

SEQ ID NO: 387908 - DNA, 14 bp, Homo sapiens
tctggttggaggcc

SEQ ID NO: 387909 - DNA, 16 bp, Homo sapiens
tctggttgtatttcta

SEQ ID NO: 387910 - DNA, 13 bp, Homo sapiens
tctggtttggggc

SEQ ID NO: 387911 - DNA, 23 bp, Homo sapiens
tctggtttggggcgaggcagagg

SEQ ID NO: 387912 - DNA, 18 bp, Homo sapiens
tctgtaaactcaaaactt

SEQ ID NO: 387913 - DNA, 14 bp, Homo sapiens
tctgtaaataacct

SEQ ID NO: 387914 - DNA, 23 bp, Homo sapiens
tctgtaacatcactatccatgca

SEQ ID NO: 387915 - DNA, 20 bp, Homo sapiens
tctgtaacccttgaatttct

SEQ ID NO: 387916 - DNA, 23 bp, Homo sapiens
tctgtaattggcttttgaatcaa

SEQ ID NO: 387917 - DNA, 18 bp, Homo sapiens
tctgtacatattactgtt

SEQ ID NO: 387918 - DNA, 22 bp, Homo sapiens
tctgtaccatagcgctgctctt

SEQ ID NO: 387919 - DNA, 23 bp, Homo sapiens
tctgtacctgcccccactcagca

SEQ ID NO: 387920 - DNA, 15 bp, Homo sapiens
tctgtagacttctgg

SEQ ID NO: 387921 - DNA, 23 bp, Homo sapiens
tctgtagaggagcctggagtcgg

SEQ ID NO: 387922 - DNA, 16 bp, Homo sapiens
tctgtagctccctcct

SEQ ID NO: 387923 - DNA, 23 bp, Homo sapiens
tctgtagctcctcaactcaccta

SEQ ID NO: 387924 - DNA, 13 bp, Homo sapiens
tctgtaggagaga

SEQ ID NO: 387925 - DNA, 15 bp, Homo sapiens
tctgtagggctggac

SEQ ID NO: 387926 - DNA, 14 bp, Homo sapiens
tctgtataaataat

SEQ ID NO: 387927 - DNA, 17 bp, Homo sapiens
tcttaaataaaactatt

SEQ ID NO: 387928 - DNA, 19 bp, Homo sapiens
tcttaaataaaactattta

SEQ ID NO: 387929 - DNA, 22 bp, Homo sapiens
tcttaaatatgtggagttcatc

SEQ ID NO: 387930 - DNA, 19 bp, Homo sapiens
tcttaacaatttctgtcct

SEQ ID NO: 387931 - DNA, 12 bp, Homo sapiens
tcttaagcactt

SEQ ID NO: 387932 - DNA, 15 bp, Homo sapiens
tcttaagcactttga

SEQ ID NO: 387933 - DNA, 23 bp, Homo sapiens
tcttaagggggccttggaatcta

SEQ ID NO: 387934 - DNA, 19 bp, Homo sapiens
tcttaatataactgcctta

SEQ ID NO: 387935 - DNA, 15 bp, Homo sapiens
tcttaatatcacttt

SEQ ID NO: 387936 - DNA, 11 bp, Homo sapiens
tcttaatcttt

SEQ ID NO: 387937 - DNA, 19 bp, Homo sapiens
tcttaattttttttaatgt

SEQ ID NO: 387938 - DNA, 16 bp, Homo sapiens
tcttacaattgcactg

SEQ ID NO: 387939 - DNA, 19 bp, Homo sapiens
tcttacaattgcactgctg

SEQ ID NO: 387940 - DNA, 22 bp, Homo sapiens
tcttaccccgtccctttccctg

SEQ ID NO: 387941 - DNA, 15 bp, Homo sapiens
tcttaccctctcttt

SEQ ID NO: 387942 - DNA, 15 bp, Homo sapiens
tcttacccttctgtg

SEQ ID NO: 387943 - DNA, 17 bp, Homo sapiens
tcttacctcatttgcat

SEQ ID NO: 387944 - DNA, 16 bp, Homo sapiens
tcttacgctatttctg

SEQ ID NO: 387945 - DNA, 18 bp, Homo sapiens
tcttacgctctgctcaat

SEQ ID NO: 387946 - DNA, 12 bp, Homo sapiens
tcttactgcttg

SEQ ID NO: 387947 - DNA, 14 bp, Homo sapiens
tcttactgtatttg

SEQ ID NO: 387948 - DNA, 14 bp, Homo sapiens
tcttagaaatactt

SEQ ID NO: 387949 - DNA, 23 bp, Homo sapiens
tcttagaacagatggctgtgaaa

SEQ ID NO: 387950 - DNA, 12 bp, Homo sapiens
tcttagagagag

SEQ ID NO: 387951 - DNA, 14 bp, Homo sapiens
tcttagctttacat

SEQ ID NO: 387952 - DNA, 15 bp, Homo sapiens
tcttagctttacatt

SEQ ID NO: 387953 - DNA, 19 bp, Homo sapiens
tcttagctttacattttca

SEQ ID NO: 387954 - DNA, 15 bp, Homo sapiens
tcttaggaagagaaa

SEQ ID NO: 387955 - DNA, 23 bp, Homo sapiens
tcttagtcgaatgttagattcct

SEQ ID NO: 387956 - DNA, 16 bp, Homo sapiens
tcttagttctcactgt

SEQ ID NO: 387957 - DNA, 20 bp, Homo sapiens
tcttagtttcagaagtactg

SEQ ID NO: 387958 - DNA, 14 bp, Homo sapiens
tcttagtttttaaa

SEQ ID NO: 387959 - DNA, 20 bp, Homo sapiens
tcttctcatagcattaacta

SEQ ID NO: 387960 - DNA, 15 bp, Homo sapiens
tcttctctcttgatt

SEQ ID NO: 387961 - DNA, 14 bp, Homo sapiens
tcttctctctttgt

SEQ ID NO: 387962 - DNA, 15 bp, Homo sapiens
tcttctgaagatgga

SEQ ID NO: 387963 - DNA, 16 bp, Homo sapiens
tcttctgcctgttata

SEQ ID NO: 387964 - DNA, 14 bp, Homo sapiens
tcttctgctccacc

SEQ ID NO: 387965 - DNA, 20 bp, Homo sapiens
tcttctgctccacccttggc

SEQ ID NO: 387966 - DNA, 23 bp, Homo sapiens
tcttctgctccacccttggcctg

SEQ ID NO: 387967 - DNA, 18 bp, Homo sapiens
tcttctgggcagagcctg

SEQ ID NO: 387968 - DNA, 14 bp, Homo sapiens
tcttctgtagctat

SEQ ID NO: 387969 - DNA, 20 bp, Homo sapiens
tcttctgtagctattctttg

SEQ ID NO: 387970 - DNA, 12 bp, Homo sapiens
tcttctgttttt

SEQ ID NO: 387971 - DNA, 18 bp, Homo sapiens
tcttctgtttttctcaaa

SEQ ID NO: 387972 - DNA, 21 bp, Homo sapiens
tcttcttattcatgctttctc

SEQ ID NO: 387973 - DNA, 15 bp, Homo sapiens
tcttcttctcaagca

SEQ ID NO: 387974 - DNA, 15 bp, Homo sapiens
tcttctttctcctgt

SEQ ID NO: 387975 - DNA, 19 bp, Homo sapiens
tcttctttgactataacaa

SEQ ID NO: 387976 - DNA, 16 bp, Homo sapiens
tcttctttttttgtga

SEQ ID NO: 387977 - DNA, 14 bp, Homo sapiens
tcttgaactcctga

SEQ ID NO: 387978 - DNA, 22 bp, Homo sapiens
tcttgaagacttttctttcagc

SEQ ID NO: 387979 - DNA, 15 bp, Homo sapiens
tcttgaagggcccag

SEQ ID NO: 387980 - DNA, 16 bp, Homo sapiens
tcttgaagtccagtgt

SEQ ID NO: 387981 - DNA, 21 bp, Homo sapiens
tcttgaagtgatcatttcaca

SEQ ID NO: 387982 - DNA, 13 bp, Homo sapiens
tcttgacaaaacc

SEQ ID NO: 387983 - DNA, 18 bp, Homo sapiens
tcttgacctgaactctgc

SEQ ID NO: 387984 - DNA, 14 bp, Homo sapiens
tcttgactcaggtg

SEQ ID NO: 387985 - DNA, 24 bp, Homo sapiens
tcttgactcaggtggtgtccttct

SEQ ID NO: 387986 - DNA, 16 bp, Homo sapiens
tcttgagatgtcttct

SEQ ID NO: 387987 - DNA, 22 bp, Homo sapiens
tcttgagcaaggcaagaagtgg

SEQ ID NO: 387988 - DNA, 12 bp, Homo sapiens
tcttgagcagac

SEQ ID NO: 387989 - DNA, 14 bp, Homo sapiens
tcttgagcagtggc

SEQ ID NO: 387990 - DNA, 19 bp, Homo sapiens
tcttgagccctcctggaat

SEQ ID NO: 387991 - DNA, 14 bp, Homo sapiens
tcttgagggagctt

SEQ ID NO: 387992 - DNA, 19 bp, Homo sapiens
tcttgatgaaacaaaaata

SEQ ID NO: 387993 - DNA, 16 bp, Homo sapiens
tcttgattgattttta

SEQ ID NO: 387994 - DNA, 18 bp, Homo sapiens
tcttgattgatttttaaa

SEQ ID NO: 387995 - DNA, 19 bp, Homo sapiens
tcttgattttcaagctttc

SEQ ID NO: 387996 - DNA, 12 bp, Homo sapiens
tcttgcactgta

SEQ ID NO: 387997 - DNA, 18 bp, Homo sapiens
tcttgcagagaagccttg

SEQ ID NO: 387998 - DNA, 22 bp, Homo sapiens
tcttgcattgaatttagtcatt

SEQ ID NO: 387999 - DNA, 16 bp, Homo sapiens
tcttgccactgcctct

SEQ ID NO: 388000 - DNA, 17 bp, Homo sapiens
tcttgccactgcctctt

SEQ ID NO: 388001 - DNA, 12 bp, Homo sapiens
tcttgcccccca

SEQ ID NO: 388002 - DNA, 13 bp, Homo sapiens
tcttgccctgagc

SEQ ID NO: 388003 - DNA, 17 bp, Homo sapiens
tcttgccgaggagccag

SEQ ID NO: 388004 - DNA, 20 bp, Homo sapiens
tcttgcctccatggtgcctc

SEQ ID NO: 388005 - DNA, 13 bp, Homo sapiens
tcttgcctctctc

SEQ ID NO: 388006 - DNA, 16 bp, Homo sapiens
tcttgcctctctcagg

SEQ ID NO: 388007 - DNA, 12 bp, Homo sapiens
tcttgccttccc

SEQ ID NO: 388008 - DNA, 14 bp, Homo sapiens
tcttgccttcccct

SEQ ID NO: 388009 - DNA, 17 bp, Homo sapiens
tcttgcggcaccgccca

SEQ ID NO: 388010 - DNA, 18 bp, Homo sapiens
tcttgctctatctctcaa

SEQ ID NO: 388011 - DNA, 19 bp, Homo sapiens
tcttgctctttctactctg

SEQ ID NO: 388012 - DNA, 13 bp, Homo sapiens
tcttgctgtgaaa

SEQ ID NO: 388013 - DNA, 17 bp, Homo sapiens
tcttgctttcacaaata

SEQ ID NO: 388014 - DNA, 18 bp, Homo sapiens
tcttgctttcacaaatat

SEQ ID NO: 388015 - DNA, 21 bp, Homo sapiens
tcttgctttcacaaatatagt

SEQ ID NO: 388016 - DNA, 14 bp, Homo sapiens
tcttgctttctttg

SEQ ID NO: 388017 - DNA, 21 bp, Homo sapiens
tcttggacacttaattctgtt

SEQ ID NO: 388018 - DNA, 14 bp, Homo sapiens
tcttggagaggagg

SEQ ID NO: 388019 - DNA, 12 bp, Homo sapiens
tcttggagctga

SEQ ID NO: 388020 - DNA, 13 bp, Homo sapiens
tcttggagctgag

SEQ ID NO: 388021 - DNA, 19 bp, Homo sapiens
tcttggcattttcctcgcc

SEQ ID NO: 388022 - DNA, 17 bp, Homo sapiens
tcttggcgttcctgcca

SEQ ID NO: 388023 - DNA, 13 bp, Homo sapiens
tcttggcttctgg

SEQ ID NO: 388024 - DNA, 18 bp, Homo sapiens
tcttggcttctgggacct

SEQ ID NO: 388025 - DNA, 16 bp, Homo sapiens
tcttgggaactccact

SEQ ID NO: 388026 - DNA, 16 bp, Homo sapiens
tcttgggccccagacc

SEQ ID NO: 388027 - DNA, 13 bp, Homo sapiens
tcttgggccctcc

SEQ ID NO: 388028 - DNA, 14 bp, Homo sapiens
tcttgggctactgg

SEQ ID NO: 388029 - DNA, 18 bp, Homo sapiens
tcttgggctactggcagc

SEQ ID NO: 388030 - DNA, 13 bp, Homo sapiens
tcttggggctcgc

SEQ ID NO: 388031 - DNA, 16 bp, Homo sapiens
tcttggggctcgcccc

SEQ ID NO: 388032 - DNA, 11 bp, Homo sapiens
tcttgggggtc

SEQ ID NO: 388033 - DNA, 14 bp, Homo sapiens
tcttgggggtcagg

SEQ ID NO: 388034 - DNA, 21 bp, Homo sapiens
tcttgggggtcaggggggaga

SEQ ID NO: 388035 - DNA, 15 bp, Homo sapiens
tcttggtagagattc

SEQ ID NO: 388036 - DNA, 19 bp, Homo sapiens
tcttggtagttctgtgcct

SEQ ID NO: 388037 - DNA, 17 bp, Homo sapiens
tcttggtcagatttgaa

SEQ ID NO: 388038 - DNA, 20 bp, Homo sapiens
tcttggtctctttctttcca

SEQ ID NO: 388039 - DNA, 21 bp, Homo sapiens
tcttggtctctttctttccaa

SEQ ID NO: 388040 - DNA, 20 bp, Homo sapiens
tcttggtgccttttgtgtga

SEQ ID NO: 388041 - DNA, 18 bp, Homo sapiens
tcttggttagagaagtaa

SEQ ID NO: 388042 - DNA, 21 bp, Homo sapiens
tcttgtaaaactgtgacattc

SEQ ID NO: 388043 - DNA, 20 bp, Homo sapiens
tcttgtaaacctggagggtt

SEQ ID NO: 388044 - DNA, 16 bp, Homo sapiens
tcttgtagtagtctca

SEQ ID NO: 388045 - DNA, 14 bp, Homo sapiens
tcttgtattttctt

SEQ ID NO: 388046 - DNA, 13 bp, Homo sapiens
tcttgtcatcttt

SEQ ID NO: 388047 - DNA, 15 bp, Homo sapiens
tcttgtcatctttta

SEQ ID NO: 388048 - DNA, 14 bp, Homo sapiens
tcttgtccacattc

SEQ ID NO: 388049 - DNA, 15 bp, Homo sapiens
tcttgtccacattct

SEQ ID NO: 388050 - DNA, 20 bp, Homo sapiens
tcttgtccctttccctacct

SEQ ID NO: 388051 - DNA, 13 bp, Homo sapiens
tcttgtctctggg

SEQ ID NO: 388052 - DNA, 16 bp, Homo sapiens
tcttgtcttttcccct

SEQ ID NO: 388053 - DNA, 23 bp, Homo sapiens
tcttgtcttttcccctcattgca

SEQ ID NO: 388054 - DNA, 18 bp, Homo sapiens
tcttgtgactagtgctga

SEQ ID NO: 388055 - DNA, 19 bp, Homo sapiens
tcttgtgactagtgctgaa

SEQ ID NO: 388056 - DNA, 23 bp, Homo sapiens
tcttgtgactagtgctgaagctt

SEQ ID NO: 388057 - DNA, 18 bp, Homo sapiens
tcttgtgctagaatactt

SEQ ID NO: 388058 - DNA, 21 bp, Homo sapiens
tcttgtgctagaatacttttt

SEQ ID NO: 388059 - DNA, 12 bp, Homo sapiens
tcttgtgctgag

SEQ ID NO: 388060 - DNA, 13 bp, Homo sapiens
tcttgtgtcctga

SEQ ID NO: 388061 - DNA, 16 bp, Homo sapiens
tcttgtgtgtttattg

SEQ ID NO: 388062 - DNA, 13 bp, Homo sapiens
tcttgtgttggct

SEQ ID NO: 388063 - DNA, 19 bp, Homo sapiens
tcttgttcatgttttgcta

SEQ ID NO: 388064 - DNA, 15 bp, Homo sapiens
tcttgttgcatcttt

SEQ ID NO: 388065 - DNA, 21 bp, Homo sapiens
tcttgttgctcaaaaaatgag

SEQ ID NO: 388066 - DNA, 21 bp, Homo sapiens
tcttgtttggagggatcattt

SEQ ID NO: 388067 - DNA, 14 bp, Homo sapiens
tcttgttttgttat

SEQ ID NO: 388068 - DNA, 20 bp, Homo sapiens
tcttgttttgttatataaaa

SEQ ID NO: 388069 - DNA, 23 bp, Homo sapiens
tctttaaaatgattcacttttat

SEQ ID NO: 388070 - DNA, 21 bp, Homo sapiens
tctttaaaatttaagtatctt

SEQ ID NO: 388071 - DNA, 15 bp, Homo sapiens
tctttaaactactga

SEQ ID NO: 388072 - DNA, 14 bp, Homo sapiens
tctttaaataaatg

SEQ ID NO: 388073 - DNA, 16 bp, Homo sapiens
tctttaaataaatgtg

SEQ ID NO: 388074 - DNA, 14 bp, Homo sapiens
tctttaaatataat

SEQ ID NO: 388075 - DNA, 22 bp, Homo sapiens
tctttaacatacatctaagtca

SEQ ID NO: 388076 - DNA, 21 bp, Homo sapiens
tctttaaccagtctgaagttt

SEQ ID NO: 388077 - DNA, 23 bp, Homo sapiens
tctttaaggaagaataaaaaaga

SEQ ID NO: 388078 - DNA, 14 bp, Homo sapiens
tctttaatcttcag

SEQ ID NO: 388079 - DNA, 15 bp, Homo sapiens
tctttaattgttgct

SEQ ID NO: 388080 - DNA, 20 bp, Homo sapiens
tctttacaaactgaagataa

SEQ ID NO: 388081 - DNA, 13 bp, Homo sapiens
tctttacctgaga

SEQ ID NO: 388082 - DNA, 18 bp, Homo sapiens
tctttacctgagaccagt

SEQ ID NO: 388083 - DNA, 20 bp, Homo sapiens
tctttactcccttcctggcc

SEQ ID NO: 388084 - DNA, 23 bp, Homo sapiens
tctttagggagacccaataaaga

SEQ ID NO: 388085 - DNA, 15 bp, Homo sapiens
tctttagtgccggct

SEQ ID NO: 388086 - DNA, 13 bp, Homo sapiens
tctttatgatttc

SEQ ID NO: 388087 - DNA, 15 bp, Homo sapiens
tctttattaacctca

SEQ ID NO: 388088 - DNA, 18 bp, Homo sapiens
tctttattaacctcagca

SEQ ID NO: 388089 - DNA, 20 bp, Homo sapiens
tctttattcttattactatt

SEQ ID NO: 388090 - DNA, 15 bp, Homo sapiens
agcaccttcctcact

SEQ ID NO: 388091 - DNA, 15 bp, Homo sapiens
agcaccttgaatgga

SEQ ID NO: 388092 - DNA, 15 bp, Homo sapiens
agcaccttgttctta

SEQ ID NO: 388093 - DNA, 23 bp, Homo sapiens
agcacgaagctatgagaataact

SEQ ID NO: 388094 - DNA, 22 bp, Homo sapiens
agcacgggcacagctgctgtgc

SEQ ID NO: 388095 - DNA, 18 bp, Homo sapiens
agcacgtcgccatccgtc

SEQ ID NO: 388096 - DNA, 17 bp, Homo sapiens
agcacgtggagatagtg

SEQ ID NO: 388097 - DNA, 17 bp, Homo sapiens
agcactacataaactga

SEQ ID NO: 388098 - DNA, 14 bp, Homo sapiens
agcactcacatgct

SEQ ID NO: 388099 - DNA, 18 bp, Homo sapiens
agcactcctgatttttat

SEQ ID NO: 388100 - DNA, 20 bp, Homo sapiens
agcactcgagaccatcctgg

SEQ ID NO: 388101 - DNA, 21 bp, Homo sapiens
agcactcgagaccatcctggc

SEQ ID NO: 388102 - DNA, 19 bp, Homo sapiens
agcactctgagtttaccat

SEQ ID NO: 388103 - DNA, 19 bp, Homo sapiens
agcactgccattagactga

SEQ ID NO: 388104 - DNA, 14 bp, Homo sapiens
agcactggccagag

SEQ ID NO: 388105 - DNA, 19 bp, Homo sapiens
agcactggccagagagggc

SEQ ID NO: 388106 - DNA, 17 bp, Homo sapiens
agcactgggaagctgga

SEQ ID NO: 388107 - DNA, 17 bp, Homo sapiens
agcactgggagaactaa

SEQ ID NO: 388108 - DNA, 16 bp, Homo sapiens
agcactgtcccttgcc

SEQ ID NO: 388109 - DNA, 20 bp, Homo sapiens
agcactgtctcagtttcact

SEQ ID NO: 388110 - DNA, 17 bp, Homo sapiens
agcactgtgtaaccagc

SEQ ID NO: 388111 - DNA, 22 bp, Homo sapiens
agcactgtgtttatatgtcttg

SEQ ID NO: 388112 - DNA, 15 bp, Homo sapiens
agcacttgcgtcctg

SEQ ID NO: 388113 - DNA, 19 bp, Homo sapiens
agcacttgcgtcctgcaga

SEQ ID NO: 388114 - DNA, 22 bp, Homo sapiens
agcacttgcgtcctgcagagga

SEQ ID NO: 388115 - DNA, 16 bp, Homo sapiens
agcactttgggaggct

SEQ ID NO: 388116 - DNA, 17 bp, Homo sapiens
agcagaaacccccagga

SEQ ID NO: 388117 - DNA, 20 bp, Homo sapiens
agcagaacagttaagcagcc

SEQ ID NO: 388118 - DNA, 23 bp, Homo sapiens
agcagaatcctcagttggaatca

SEQ ID NO: 388119 - DNA, 19 bp, Homo sapiens
agcagaatctttgcaagaa

SEQ ID NO: 388120 - DNA, 21 bp, Homo sapiens
agcagacagtgttttctggga

SEQ ID NO: 388121 - DNA, 14 bp, Homo sapiens
agcagactggtgag

SEQ ID NO: 388122 - DNA, 14 bp, Homo sapiens
agcagagaattctc

SEQ ID NO: 388123 - DNA, 14 bp, Homo sapiens
agcagagacctttg

SEQ ID NO: 388124 - DNA, 10 bp, Homo sapiens
agcagagccg

SEQ ID NO: 388125 - DNA, 13 bp, Homo sapiens
agcagagccgccc

SEQ ID NO: 388126 - DNA, 15 bp, Homo sapiens
agcagagccgttcct

SEQ ID NO: 388127 - DNA, 17 bp, Homo sapiens
agcagagccgttcctgg

SEQ ID NO: 388128 - DNA, 18 bp, Homo sapiens
agcagagccgttcctggg

SEQ ID NO: 388129 - DNA, 19 bp, Homo sapiens
agcagagccgttcctggga

SEQ ID NO: 388130 - DNA, 17 bp, Homo sapiens
agcagaggctggcctca

SEQ ID NO: 388131 - DNA, 15 bp, Homo sapiens
agcagaggtggaaaa

SEQ ID NO: 388132 - DNA, 15 bp, Homo sapiens
agcagagttctttgc

SEQ ID NO: 388133 - DNA, 15 bp, Homo sapiens
agcagatggaaagaa

SEQ ID NO: 388134 - DNA, 14 bp, Homo sapiens
agcagatggtccca

SEQ ID NO: 388135 - DNA, 13 bp, Homo sapiens
agcagattttaat

SEQ ID NO: 388136 - DNA, 15 bp, Homo sapiens
agcagcacaattctg

SEQ ID NO: 388137 - DNA, 22 bp, Homo sapiens
agcagcacaattctgtccctgt

SEQ ID NO: 388138 - DNA, 14 bp, Homo sapiens
agcagcacttataa

SEQ ID NO: 388139 - DNA, 15 bp, Homo sapiens
agcagcacttataaa

SEQ ID NO: 388140 - DNA, 16 bp, Homo sapiens
agcagcagctgaggcc

SEQ ID NO: 388141 - DNA, 16 bp, Homo sapiens
tgaactgttagatgct

SEQ ID NO: 388142 - DNA, 17 bp, Homo sapiens
tgaactgttagatgctg

SEQ ID NO: 388143 - DNA, 12 bp, Homo sapiens
tgaacttaacat

SEQ ID NO: 388144 - DNA, 14 bp, Homo sapiens
tgaacttaacatgc

SEQ ID NO: 388145 - DNA, 15 bp, Homo sapiens
tgaacttaacatgct

SEQ ID NO: 388146 - DNA, 19 bp, Homo sapiens
tgaacttaacatgctgtgt

SEQ ID NO: 388147 - DNA, 16 bp, Homo sapiens
tgaacttacacttgga

SEQ ID NO: 388148 - DNA, 21 bp, Homo sapiens
tgaactttctcttcatacttt

SEQ ID NO: 388149 - DNA, 16 bp, Homo sapiens
tgaactttttaacaaa

SEQ ID NO: 388150 - DNA, 17 bp, Homo sapiens
tgaactttttaacaaat

SEQ ID NO: 388151 - DNA, 19 bp, Homo sapiens
tgaagaaaaaggctggctg

SEQ ID NO: 388152 - DNA, 18 bp, Homo sapiens
tgaagaaaagtgggccag

SEQ ID NO: 388153 - DNA, 11 bp, Homo sapiens
tgaagaatatt

SEQ ID NO: 388154 - DNA, 13 bp, Homo sapiens
tgaagaatattgt

SEQ ID NO: 388155 - DNA, 21 bp, Homo sapiens
tgaagaattaatgacaacaaa

SEQ ID NO: 388156 - DNA, 18 bp, Homo sapiens
tgaagaatttgttcttgt

SEQ ID NO: 388157 - DNA, 15 bp, Homo sapiens
tgaagacactgtcaa

SEQ ID NO: 388158 - DNA, 17 bp, Homo sapiens
tgaagacactgtcaatg

SEQ ID NO: 388159 - DNA, 22 bp, Homo sapiens
tgaagagacttctgcttttcaa

SEQ ID NO: 388160 - DNA, 13 bp, Homo sapiens
tgaagagcgctcc

SEQ ID NO: 388161 - DNA, 18 bp, Homo sapiens
tgaagagggagaagcatg

SEQ ID NO: 388162 - DNA, 18 bp, Homo sapiens
tgaagataccatcagcaa

SEQ ID NO: 388163 - DNA, 11 bp, Homo sapiens
tgaagatctca

SEQ ID NO: 388164 - DNA, 12 bp, Homo sapiens
tgaagatgtagc

SEQ ID NO: 388165 - DNA, 15 bp, Homo sapiens
tgaagattctcctgt

SEQ ID NO: 388166 - DNA, 19 bp, Homo sapiens
tgaagattctcctgtgcta

SEQ ID NO: 388167 - DNA, 14 bp, Homo sapiens
tgaagcaaatcaga

SEQ ID NO: 388168 - DNA, 15 bp, Homo sapiens
tgaagcaaatcagaa

SEQ ID NO: 388169 - DNA, 19 bp, Homo sapiens
tgaagcacaagttcctggt

SEQ ID NO: 388170 - DNA, 13 bp, Homo sapiens
tgaagcagtcttg

SEQ ID NO: 388171 - DNA, 19 bp, Homo sapiens
tgaagcagtgcctcgaggc

SEQ ID NO: 388172 - DNA, 23 bp, Homo sapiens
tgaagcagtgcctcgaggcaccg

SEQ ID NO: 388173 - DNA, 14 bp, Homo sapiens
tgaagcagttgtgt

SEQ ID NO: 388174 - DNA, 16 bp, Homo sapiens
tgaagcatgtttcatg

SEQ ID NO: 388175 - DNA, 20 bp, Homo sapiens
tgaagcatgtttcatgtttt

SEQ ID NO: 388176 - DNA, 13 bp, Homo sapiens
tgaagcccaggag

SEQ ID NO: 388177 - DNA, 15 bp, Homo sapiens
tgaagccctaagtaa

SEQ ID NO: 388178 - DNA, 16 bp, Homo sapiens
tgaagccctccaaaag

SEQ ID NO: 388179 - DNA, 22 bp, Homo sapiens
tgaagccctccaaaagcactta

SEQ ID NO: 388180 - DNA, 13 bp, Homo sapiens
tgaagccctttgc

SEQ ID NO: 388181 - DNA, 19 bp, Homo sapiens
tgaagcctctgccctgcct

SEQ ID NO: 388182 - DNA, 16 bp, Homo sapiens
tgaagcgaacatcttc

SEQ ID NO: 388183 - DNA, 18 bp, Homo sapiens
tgaagcgaacatcttcat

SEQ ID NO: 388184 - DNA, 19 bp, Homo sapiens
tgaagcgaacatcttcata

SEQ ID NO: 388185 - DNA, 11 bp, Homo sapiens
tgaagctgggg

SEQ ID NO: 388186 - DNA, 17 bp, Homo sapiens
tgaagcttattaatgct

SEQ ID NO: 388187 - DNA, 19 bp, Homo sapiens
tgaagcttattaatgctaa

SEQ ID NO: 388188 - DNA, 20 bp, Homo sapiens
tgaagcttattaatgctaag

SEQ ID NO: 388189 - DNA, 22 bp, Homo sapiens
tgaagcttattaatgctaaggg

SEQ ID NO: 388190 - DNA, 23 bp, Homo sapiens
tgaagcttattaatgctaagggc

SEQ ID NO: 388191 - DNA, 21 bp, Homo sapiens
tgaaggaatagccagagagga

SEQ ID NO: 388192 - DNA, 20 bp, Homo sapiens
tgaaggactggattggccaa

SEQ ID NO: 388193 - DNA, 20 bp, Homo sapiens
tgaaggagagcccttcattt

SEQ ID NO: 388194 - DNA, 13 bp, Homo sapiens
tgaaggagaggag

SEQ ID NO: 388195 - DNA, 20 bp, Homo sapiens
tgaaggagattttccttcct

SEQ ID NO: 388196 - DNA, 14 bp, Homo sapiens
tgaaggcagtctga

SEQ ID NO: 388197 - DNA, 19 bp, Homo sapiens
tgaaggccatcatctctgt

SEQ ID NO: 388198 - DNA, 15 bp, Homo sapiens
tgaaggccttgttaa

SEQ ID NO: 388199 - DNA, 23 bp, Homo sapiens
tgaagggtgacatcccaggaggg

SEQ ID NO: 388200 - DNA, 15 bp, Homo sapiens
tgaaggttaggattt

SEQ ID NO: 388201 - DNA, 15 bp, Homo sapiens
tgaaggttctggtaa

SEQ ID NO: 388202 - DNA, 23 bp, Homo sapiens
tgaaggttggaactgctgccatg

SEQ ID NO: 388203 - DNA, 15 bp, Homo sapiens
tgaagtagtttgtat

SEQ ID NO: 388204 - DNA, 22 bp, Homo sapiens
tgaagtcaaaccttaagataat

SEQ ID NO: 388205 - DNA, 14 bp, Homo sapiens
tgaagtcactgcac

SEQ ID NO: 388206 - DNA, 19 bp, Homo sapiens
tgaagtcatcataaaaggt

SEQ ID NO: 388207 - DNA, 21 bp, Homo sapiens
tgaagtcattgtcgctcagca

SEQ ID NO: 388208 - DNA, 18 bp, Homo sapiens
tgaagtcccttcctgtcc

SEQ ID NO: 388209 - DNA, 20 bp, Homo sapiens
tgaagtcccttcctgtcctg

SEQ ID NO: 388210 - DNA, 23 bp, Homo sapiens
tgaagtccttcagtgagcccctc

SEQ ID NO: 388211 - DNA, 18 bp, Homo sapiens
tgaagtctgcttaccaaa

SEQ ID NO: 388212 - DNA, 22 bp, Homo sapiens
tgaagtctgcttaccaaaacat

SEQ ID NO: 388213 - DNA, 18 bp, Homo sapiens
tgaagtcttgcattgaat

SEQ ID NO: 388214 - DNA, 14 bp, Homo sapiens
tgaagtgaatacat

SEQ ID NO: 388215 - DNA, 16 bp, Homo sapiens
tgaagtgtggctggtg

SEQ ID NO: 388216 - DNA, 21 bp, Homo sapiens
tgaagtgtggctggtgtcccc

SEQ ID NO: 388217 - DNA, 16 bp, Homo sapiens
tgaagtgtggggcggg

SEQ ID NO: 388218 - DNA, 19 bp, Homo sapiens
tgaagttcatggtgatcag

SEQ ID NO: 388219 - DNA, 17 bp, Homo sapiens
tgaagtttacaatcaaa

SEQ ID NO: 388220 - DNA, 11 bp, Homo sapiens
agcagtggctg

SEQ ID NO: 388221 - DNA, 13 bp, Homo sapiens
agcagtggggagc

SEQ ID NO: 388222 - DNA, 13 bp, Homo sapiens
agcagtgtcatca

SEQ ID NO: 388223 - DNA, 15 bp, Homo sapiens
agcagtgtcttccat

SEQ ID NO: 388224 - DNA, 17 bp, Homo sapiens
agcagtgtcttccataa

SEQ ID NO: 388225 - DNA, 16 bp, Homo sapiens
agcagtgtgtctcctg

SEQ ID NO: 388226 - DNA, 15 bp, Homo sapiens
agcagttcacttcct

SEQ ID NO: 388227 - DNA, 16 bp, Homo sapiens
agcagttcacttccta

SEQ ID NO: 388228 - DNA, 13 bp, Homo sapiens
agcagttctgcaa

SEQ ID NO: 388229 - DNA, 20 bp, Homo sapiens
agcagttgacatccaaatct

SEQ ID NO: 388230 - DNA, 21 bp, Homo sapiens
agcagttgacatccaaatcta

SEQ ID NO: 388231 - DNA, 23 bp, Homo sapiens
agcagttgagtcgtcatcacttt

SEQ ID NO: 388232 - DNA, 14 bp, Homo sapiens
agcagttgatatta

SEQ ID NO: 388233 - DNA, 12 bp, Homo sapiens
agcagttgctag

SEQ ID NO: 388234 - DNA, 21 bp, Homo sapiens
agcagttgctagcaacaactt

SEQ ID NO: 388235 - DNA, 18 bp, Homo sapiens
agcagttgggagtacata

SEQ ID NO: 388236 - DNA, 16 bp, Homo sapiens
agcatacaaaaatata

SEQ ID NO: 388237 - DNA, 14 bp, Homo sapiens
agcatacatttata

SEQ ID NO: 388238 - DNA, 20 bp, Homo sapiens
agcatacatttataatgttt

SEQ ID NO: 388239 - DNA, 16 bp, Homo sapiens
agcatagtaaactacg

SEQ ID NO: 388240 - DNA, 12 bp, Homo sapiens
agcatataaatg

SEQ ID NO: 388241 - DNA, 14 bp, Homo sapiens
agcatataaatgtt

SEQ ID NO: 388242 - DNA, 11 bp, Homo sapiens
agcatatataa

SEQ ID NO: 388243 - DNA, 16 bp, Homo sapiens
agcatcaaaatacaac

SEQ ID NO: 388244 - DNA, 15 bp, Homo sapiens
agcatcaaacatgaa

SEQ ID NO: 388245 - DNA, 19 bp, Homo sapiens
agcatcaaacatgaaaaca

SEQ ID NO: 388246 - DNA, 17 bp, Homo sapiens
agcatcaaataatacat

SEQ ID NO: 388247 - DNA, 12 bp, Homo sapiens
agcatccagcct

SEQ ID NO: 388248 - DNA, 13 bp, Homo sapiens
agcatccagcctg

SEQ ID NO: 388249 - DNA, 14 bp, Homo sapiens
agcatccagcctgt

SEQ ID NO: 388250 - DNA, 16 bp, Homo sapiens
agcatccagcctgtgt

SEQ ID NO: 388251 - DNA, 20 bp, Homo sapiens
agcatccctgaggagccagg

SEQ ID NO: 388252 - DNA, 18 bp, Homo sapiens
agcatcccttctgccccc

SEQ ID NO: 388253 - DNA, 22 bp, Homo sapiens
agcatcccttctgcccccgttc

SEQ ID NO: 388254 - DNA, 15 bp, Homo sapiens
agcatcctcagttcc

SEQ ID NO: 388255 - DNA, 16 bp, Homo sapiens
agcatcctcagttcct

SEQ ID NO: 388256 - DNA, 22 bp, Homo sapiens
agcatctgagaaggccctgtgc

SEQ ID NO: 388257 - DNA, 13 bp, Homo sapiens
agcatctgctctg

SEQ ID NO: 388258 - DNA, 16 bp, Homo sapiens
agcatctgctctgaga

SEQ ID NO: 388259 - DNA, 13 bp, Homo sapiens
agcatctgctctt

SEQ ID NO: 388260 - DNA, 19 bp, Homo sapiens
agcatctggctaaggcatc

SEQ ID NO: 388261 - DNA, 15 bp, Homo sapiens
agcatctgtcccact

SEQ ID NO: 388262 - DNA, 21 bp, Homo sapiens
agcatctgtcccactgggaca

SEQ ID NO: 388263 - DNA, 21 bp, Homo sapiens
agcatgaaaggtaatctgaaa

SEQ ID NO: 388264 - DNA, 23 bp, Homo sapiens
agcatgacctgtgaccagcactg

SEQ ID NO: 388265 - DNA, 12 bp, Homo sapiens
agcatgaccttt

SEQ ID NO: 388266 - DNA, 20 bp, Homo sapiens
agcatgattctttaatagaa

SEQ ID NO: 388267 - DNA, 16 bp, Homo sapiens
agcatgcacaaagtgt

SEQ ID NO: 388268 - DNA, 19 bp, Homo sapiens
agcatgcacaaagtgtatt

SEQ ID NO: 388269 - DNA, 21 bp, Homo sapiens
agcatgccccacccacccctc

SEQ ID NO: 388270 - DNA, 12 bp, Homo sapiens
agcatgcccctt

SEQ ID NO: 388271 - DNA, 17 bp, Homo sapiens
agcatgctcagtattga

SEQ ID NO: 388272 - DNA, 14 bp, Homo sapiens
agcatgctttgctg

SEQ ID NO: 388273 - DNA, 19 bp, Homo sapiens
agcatgctttgctgctatg

SEQ ID NO: 388274 - DNA, 15 bp, Homo sapiens
agcatggactctggg

SEQ ID NO: 388275 - DNA, 16 bp, Homo sapiens
agcatggactctgggt

SEQ ID NO: 388276 - DNA, 22 bp, Homo sapiens
agcatgggactgtgcctttggg

SEQ ID NO: 388277 - DNA, 13 bp, Homo sapiens
agcatgtaatggt

SEQ ID NO: 388278 - DNA, 21 bp, Homo sapiens
agcatgtactgagccttgtaa

SEQ ID NO: 388279 - DNA, 12 bp, Homo sapiens
agcatgtagctc

SEQ ID NO: 388280 - DNA, 22 bp, Homo sapiens
tgacacatgctctcaatatata

SEQ ID NO: 388281 - DNA, 11 bp, Homo sapiens
tgacaccctaa

SEQ ID NO: 388282 - DNA, 19 bp, Homo sapiens
tgacacctaccatgctgct

SEQ ID NO: 388283 - DNA, 15 bp, Homo sapiens
tgacactgagcccca

SEQ ID NO: 388284 - DNA, 19 bp, Homo sapiens
tgacacttcagagagctgg

SEQ ID NO: 388285 - DNA, 20 bp, Homo sapiens
tgacacttcagagagctggt

SEQ ID NO: 388286 - DNA, 22 bp, Homo sapiens
tgacagagcgagactctgtctc

SEQ ID NO: 388287 - DNA, 11 bp, Homo sapiens
tgacagatgtc

SEQ ID NO: 388288 - DNA, 22 bp, Homo sapiens
tgacagatgtcagccgagccgg

SEQ ID NO: 388289 - DNA, 23 bp, Homo sapiens
tgacagcagcctgtgagggagtg

SEQ ID NO: 388290 - DNA, 20 bp, Homo sapiens
tgacagcagtcggttggagc

SEQ ID NO: 388291 - DNA, 21 bp, Homo sapiens
tgacagctactaacctggaga

SEQ ID NO: 388292 - DNA, 13 bp, Homo sapiens
tgacagctgttcc

SEQ ID NO: 388293 - DNA, 14 bp, Homo sapiens
tgacagctgttcca

SEQ ID NO: 388294 - DNA, 15 bp, Homo sapiens
tgacaggaagactgg

SEQ ID NO: 388295 - DNA, 15 bp, Homo sapiens
tgacaggcagacaca

SEQ ID NO: 388296 - DNA, 19 bp, Homo sapiens
tgacaggcagacacatgct

SEQ ID NO: 388297 - DNA, 18 bp, Homo sapiens
tgacagggagctggggaa

SEQ ID NO: 388298 - DNA, 12 bp, Homo sapiens
tgacagtgcctt

SEQ ID NO: 388299 - DNA, 23 bp, Homo sapiens
tgacatcaactgcatcaagatgt

SEQ ID NO: 388300 - DNA, 23 bp, Homo sapiens
tgacatcaggtgatccacctgcc

SEQ ID NO: 388301 - DNA, 12 bp, Homo sapiens
tgacatccaaat

SEQ ID NO: 388302 - DNA, 13 bp, Homo sapiens
tgacatccaagct

SEQ ID NO: 388303 - DNA, 20 bp, Homo sapiens
tgacatcccaggaggggcct

SEQ ID NO: 388304 - DNA, 21 bp, Homo sapiens
tgacatgaaaattacaacaga

SEQ ID NO: 388305 - DNA, 19 bp, Homo sapiens
tgacatgattccttcctgt

SEQ ID NO: 388306 - DNA, 13 bp, Homo sapiens
tgacatgcacagt

SEQ ID NO: 388307 - DNA, 17 bp, Homo sapiens
tgacatgcgggctgggc

SEQ ID NO: 388308 - DNA, 20 bp, Homo sapiens
tgacatgcgggctgggcagc

SEQ ID NO: 388309 - DNA, 14 bp, Homo sapiens
tgacatggagttcc

SEQ ID NO: 388310 - DNA, 14 bp, Homo sapiens
tgacatgtggaaag

SEQ ID NO: 388311 - DNA, 15 bp, Homo sapiens
tgacatgtgtcaagc

SEQ ID NO: 388312 - DNA, 13 bp, Homo sapiens
tgacatgttttat

SEQ ID NO: 388313 - DNA, 13 bp, Homo sapiens
tgacattcccctc

SEQ ID NO: 388314 - DNA, 18 bp, Homo sapiens
tgacattccttgtcacca

SEQ ID NO: 388315 - DNA, 21 bp, Homo sapiens
tgacattccttgtcaccagca

SEQ ID NO: 388316 - DNA, 14 bp, Homo sapiens
tgacatttctcaaa

SEQ ID NO: 388317 - DNA, 22 bp, Homo sapiens
tgacatttgtcctgcagagctg

SEQ ID NO: 388318 - DNA, 17 bp, Homo sapiens
tgacattttgtagctag

SEQ ID NO: 388319 - DNA, 15 bp, Homo sapiens
tgaccaaactgtggg

SEQ ID NO: 388320 - DNA, 16 bp, Homo sapiens
tgaccaagaactgcat

SEQ ID NO: 388321 - DNA, 23 bp, Homo sapiens
tgaccaatcctatgtcatttcta

SEQ ID NO: 388322 - DNA, 13 bp, Homo sapiens
tgaccaatctctg

SEQ ID NO: 388323 - DNA, 15 bp, Homo sapiens
tgaccaattgccctg

SEQ ID NO: 388324 - DNA, 17 bp, Homo sapiens
tgaccaattgccctgcc

SEQ ID NO: 388325 - DNA, 19 bp, Homo sapiens
tgaccaattgccctgccag

SEQ ID NO: 388326 - DNA, 15 bp, Homo sapiens
tgaccacacttcctg

SEQ ID NO: 388327 - DNA, 18 bp, Homo sapiens
tgaccacacttcctgtcc

SEQ ID NO: 388328 - DNA, 23 bp, Homo sapiens
tgaccacacttcctgtccagaga

SEQ ID NO: 388329 - DNA, 21 bp, Homo sapiens
tgaccaccttctgtccccagc

SEQ ID NO: 388330 - DNA, 15 bp, Homo sapiens
tgaccagaagggaaa

SEQ ID NO: 388331 - DNA, 19 bp, Homo sapiens
tgaccagcaccatctctcc

SEQ ID NO: 388332 - DNA, 20 bp, Homo sapiens
tgaccagcaccatctctcct

SEQ ID NO: 388333 - DNA, 18 bp, Homo sapiens
tgaccagcactgtctcag

SEQ ID NO: 388334 - DNA, 21 bp, Homo sapiens
tgaccagcctccatgctgcct

SEQ ID NO: 388335 - DNA, 12 bp, Homo sapiens
tgaccaggacta

SEQ ID NO: 388336 - DNA, 14 bp, Homo sapiens
tgaccaggccacca

SEQ ID NO: 388337 - DNA, 22 bp, Homo sapiens
tgaccatccactctaccctccc

SEQ ID NO: 388338 - DNA, 14 bp, Homo sapiens
tgacccaattaagt

SEQ ID NO: 388339 - DNA, 13 bp, Homo sapiens
tgacccaccagtg

SEQ ID NO: 388340 - DNA, 16 bp, Homo sapiens
tgacccaccagtgcct

SEQ ID NO: 388341 - DNA, 20 bp, Homo sapiens
tgacccactgatctctacta

SEQ ID NO: 388342 - DNA, 13 bp, Homo sapiens
tgacccagtgaga

SEQ ID NO: 388343 - DNA, 14 bp, Homo sapiens
agcatgtctctgct

SEQ ID NO: 388344 - DNA, 16 bp, Homo sapiens
agcatgtctctgcttc

SEQ ID NO: 388345 - DNA, 17 bp, Homo sapiens
agcatgtctctgcttcc

SEQ ID NO: 388346 - DNA, 20 bp, Homo sapiens
agcatgtctctgcttccatg

SEQ ID NO: 388347 - DNA, 17 bp, Homo sapiens
agcatgtggcatgttca

SEQ ID NO: 388348 - DNA, 18 bp, Homo sapiens
agcatgtggcatgttcat

SEQ ID NO: 388349 - DNA, 15 bp, Homo sapiens
agcatgtggggaagc

SEQ ID NO: 388350 - DNA, 19 bp, Homo sapiens
agcatgtggggaagcaaga

SEQ ID NO: 388351 - DNA, 16 bp, Homo sapiens
agcatgtgggggaagg

SEQ ID NO: 388352 - DNA, 17 bp, Homo sapiens
agcatgtgggggaaggc

SEQ ID NO: 388353 - DNA, 23 bp, Homo sapiens
agcatgtgggggaaggccttgct

SEQ ID NO: 388354 - DNA, 15 bp, Homo sapiens
agcatgtgtcagagt

SEQ ID NO: 388355 - DNA, 17 bp, Homo sapiens
agcatgtgtcagagtgt

SEQ ID NO: 388356 - DNA, 21 bp, Homo sapiens
agcatgttgagccaggcctgg

SEQ ID NO: 388357 - DNA, 21 bp, Homo sapiens
agcatgttgttttttcatagt

SEQ ID NO: 388358 - DNA, 22 bp, Homo sapiens
agcatgttgttttttcatagtg

SEQ ID NO: 388359 - DNA, 14 bp, Homo sapiens
agcatgtttcatgt

SEQ ID NO: 388360 - DNA, 14 bp, Homo sapiens
agcattaactaatc

SEQ ID NO: 388361 - DNA, 22 bp, Homo sapiens
agcattattcctggtcaaagct

SEQ ID NO: 388362 - DNA, 17 bp, Homo sapiens
agcattatttgaaaaca

SEQ ID NO: 388363 - DNA, 15 bp, Homo sapiens
agcattcaaaatagt

SEQ ID NO: 388364 - DNA, 17 bp, Homo sapiens
agcattccagctctgcc

SEQ ID NO: 388365 - DNA, 20 bp, Homo sapiens
agcattccagctctgccccc

SEQ ID NO: 388366 - DNA, 21 bp, Homo sapiens
agcattccttagcagctcagg

SEQ ID NO: 388367 - DNA, 22 bp, Homo sapiens
agcattctcactcctacctggt

SEQ ID NO: 388368 - DNA, 20 bp, Homo sapiens
agcattctggggtggggctt

SEQ ID NO: 388369 - DNA, 19 bp, Homo sapiens
agcattcttgtcacaataa

SEQ ID NO: 388370 - DNA, 17 bp, Homo sapiens
agcattgtttgcttatt

SEQ ID NO: 388371 - DNA, 12 bp, Homo sapiens
agcatttatcat

SEQ ID NO: 388372 - DNA, 16 bp, Homo sapiens
agcatttatcattctt

SEQ ID NO: 388373 - DNA, 19 bp, Homo sapiens
agcatttccaacaccacag

SEQ ID NO: 388374 - DNA, 20 bp, Homo sapiens
agcatttggaaggaaaggaa

SEQ ID NO: 388375 - DNA, 23 bp, Homo sapiens
agcatttggtggcctaatttaca

SEQ ID NO: 388376 - DNA, 19 bp, Homo sapiens
agcattttactgtctgtaa

SEQ ID NO: 388377 - DNA, 21 bp, Homo sapiens
agcattttaggtcccagaatg

SEQ ID NO: 388378 - DNA, 16 bp, Homo sapiens
agcatttttgatttat

SEQ ID NO: 388379 - DNA, 18 bp, Homo sapiens
agcatttttgatttatgc

SEQ ID NO: 388380 - DNA, 13 bp, Homo sapiens
agccaaaagtaag

SEQ ID NO: 388381 - DNA, 21 bp, Homo sapiens
agccaaagagaaaagattaaa

SEQ ID NO: 388382 - DNA, 19 bp, Homo sapiens
agccaaatgacttcatttc

SEQ ID NO: 388383 - DNA, 20 bp, Homo sapiens
agccaaatgcagggagggga

SEQ ID NO: 388384 - DNA, 14 bp, Homo sapiens
agccaacccctgtg

SEQ ID NO: 388385 - DNA, 19 bp, Homo sapiens
agccaagacagtggcagca

SEQ ID NO: 388386 - DNA, 20 bp, Homo sapiens
agccaagcaaaccaatggtg

SEQ ID NO: 388387 - DNA, 13 bp, Homo sapiens
agccaaggtgcta

SEQ ID NO: 388388 - DNA, 22 bp, Homo sapiens
agccaaggtgctaaaaggaata

SEQ ID NO: 388389 - DNA, 16 bp, Homo sapiens
agccaagtcctccctc

SEQ ID NO: 388390 - DNA, 17 bp, Homo sapiens
agccaatggtgagggct

SEQ ID NO: 388391 - DNA, 23 bp, Homo sapiens
agccaatggtgagggctgagagg

SEQ ID NO: 388392 - DNA, 17 bp, Homo sapiens
agccaatttgtctccta

SEQ ID NO: 388393 - DNA, 15 bp, Homo sapiens
agccacaaggctggc

SEQ ID NO: 388394 - DNA, 14 bp, Homo sapiens
agccacaccacagg

SEQ ID NO: 388395 - DNA, 16 bp, Homo sapiens
agccacagaaatgtgt

SEQ ID NO: 388396 - DNA, 13 bp, Homo sapiens
agccacagtgggg

SEQ ID NO: 388397 - DNA, 16 bp, Homo sapiens
agccaccaagggcctc

SEQ ID NO: 388398 - DNA, 18 bp, Homo sapiens
agccaccaagggcctcac

SEQ ID NO: 388399 - DNA, 11 bp, Homo sapiens
agccaccaccg

SEQ ID NO: 388400 - DNA, 19 bp, Homo sapiens
agccaccatgtatgtggaa

SEQ ID NO: 388401 - DNA, 19 bp, Homo sapiens
agccacccagccaggaggg

SEQ ID NO: 388402 - DNA, 19 bp, Homo sapiens
agccaccccgggctctctg

SEQ ID NO: 388403 - DNA, 20 bp, Homo sapiens
agccaccccgggctctctgc

SEQ ID NO: 388404 - DNA, 21 bp, Homo sapiens
agccaccccgggctctctgct

SEQ ID NO: 388405 - DNA, 23 bp, Homo sapiens
agccaccccgggctctctgctgt

SEQ ID NO: 388406 - DNA, 20 bp, Homo sapiens
agccacccggatctccaggc

SEQ ID NO: 388407 - DNA, 22 bp, Homo sapiens
agccaccctaactgagctgcca

SEQ ID NO: 388408 - DNA, 23 bp, Homo sapiens
agccaccctaactgagctgccag

SEQ ID NO: 388409 - DNA, 13 bp, Homo sapiens
agccccacccagg

SEQ ID NO: 388410 - DNA, 11 bp, Homo sapiens
agccccacccc

SEQ ID NO: 388411 - DNA, 22 bp, Homo sapiens
agccccacctctccaagtctct

SEQ ID NO: 388412 - DNA, 20 bp, Homo sapiens
agccccacttcacccccaac

SEQ ID NO: 388413 - DNA, 15 bp, Homo sapiens
agccccagaacccca

SEQ ID NO: 388414 - DNA, 12 bp, Homo sapiens
agccccagccag

SEQ ID NO: 388415 - DNA, 13 bp, Homo sapiens
agccccagccagc

SEQ ID NO: 388416 - DNA, 14 bp, Homo sapiens
agccccagccagcc

SEQ ID NO: 388417 - DNA, 17 bp, Homo sapiens
agccccagcccagccca

SEQ ID NO: 388418 - DNA, 18 bp, Homo sapiens
agccccagcgagtctgga

SEQ ID NO: 388419 - DNA, 12 bp, Homo sapiens
agccccagctga

SEQ ID NO: 388420 - DNA, 11 bp, Homo sapiens
agccccaggac

SEQ ID NO: 388421 - DNA, 13 bp, Homo sapiens
agccccagggccc

SEQ ID NO: 388422 - DNA, 13 bp, Homo sapiens
agccccagggcct

SEQ ID NO: 388423 - DNA, 16 bp, Homo sapiens
agccccagggcctggg

SEQ ID NO: 388424 - DNA, 12 bp, Homo sapiens
agccccagggtg

SEQ ID NO: 388425 - DNA, 19 bp, Homo sapiens
agccccatccttcccgcag

SEQ ID NO: 388426 - DNA, 22 bp, Homo sapiens
agcccccaccttgatcccaatc

SEQ ID NO: 388427 - DNA, 23 bp, Homo sapiens
agcccccagatagagctgggtgg

SEQ ID NO: 388428 - DNA, 18 bp, Homo sapiens
agcccccaggctgctgga

SEQ ID NO: 388429 - DNA, 16 bp, Homo sapiens
agccccccacaatgat

SEQ ID NO: 388430 - DNA, 22 bp, Homo sapiens
agccccccccttgaatctgcag

SEQ ID NO: 388431 - DNA, 22 bp, Homo sapiens
agcccccgccccgccccacatt

SEQ ID NO: 388432 - DNA, 23 bp, Homo sapiens
agcccccgccccgccccacattc

SEQ ID NO: 388433 - DNA, 14 bp, Homo sapiens
agccccctctcctg

SEQ ID NO: 388434 - DNA, 22 bp, Homo sapiens
agccccctgcacccacccctgc

SEQ ID NO: 388435 - DNA, 23 bp, Homo sapiens
agccccctggatgtcccctgtcc

SEQ ID NO: 388436 - DNA, 12 bp, Homo sapiens
agccccctggcc

SEQ ID NO: 388437 - DNA, 13 bp, Homo sapiens
agccccctgtcct

SEQ ID NO: 388438 - DNA, 15 bp, Homo sapiens
agccccctgtccttc

SEQ ID NO: 388439 - DNA, 23 bp, Homo sapiens
agccccctgtccttcccacggcc

SEQ ID NO: 388440 - DNA, 12 bp, Homo sapiens
agccccctgtgc

SEQ ID NO: 388441 - DNA, 14 bp, Homo sapiens
agccccctgtgccc

SEQ ID NO: 388442 - DNA, 15 bp, Homo sapiens
agccccctgtgccca

SEQ ID NO: 388443 - DNA, 20 bp, Homo sapiens
agccccgcaaaacccactga

SEQ ID NO: 388444 - DNA, 21 bp, Homo sapiens
agccccgctcctcccctcttg

SEQ ID NO: 388445 - DNA, 14 bp, Homo sapiens
agccccggagcacc

SEQ ID NO: 388446 - DNA, 19 bp, Homo sapiens
agccccggccactccctgc

SEQ ID NO: 388447 - DNA, 16 bp, Homo sapiens
agccccgttttgggga

SEQ ID NO: 388448 - DNA, 21 bp, Homo sapiens
agcccctaccccacaccaggc

SEQ ID NO: 388449 - DNA, 23 bp, Homo sapiens
agcccctatcctgcaccctctgc

SEQ ID NO: 388450 - DNA, 15 bp, Homo sapiens
agcccctcacctcag

SEQ ID NO: 388451 - DNA, 22 bp, Homo sapiens
agcccctcacctcaggacccca

SEQ ID NO: 388452 - DNA, 14 bp, Homo sapiens
agcccctcagccct

SEQ ID NO: 388453 - DNA, 17 bp, Homo sapiens
agcccctcagcccttgc

SEQ ID NO: 388454 - DNA, 18 bp, Homo sapiens
agcccctcagcccttgcc

SEQ ID NO: 388455 - DNA, 17 bp, Homo sapiens
agcccctcccaccacag

SEQ ID NO: 388456 - DNA, 18 bp, Homo sapiens
agcccctcccaccacagc

SEQ ID NO: 388457 - DNA, 14 bp, Homo sapiens
agcccctccccagc

SEQ ID NO: 388458 - DNA, 16 bp, Homo sapiens
agcccctccccagcca

SEQ ID NO: 388459 - DNA, 14 bp, Homo sapiens
agcccctcctctcc

SEQ ID NO: 388460 - DNA, 23 bp, Homo sapiens
agcccctcctctgagcagcctct

SEQ ID NO: 388461 - DNA, 16 bp, Homo sapiens
agcccctcttgccccc

SEQ ID NO: 388462 - DNA, 17 bp, Homo sapiens
agcccctcttgcccccc

SEQ ID NO: 388463 - DNA, 20 bp, Homo sapiens
agcccctcttgccccccacc

SEQ ID NO: 388464 - DNA, 22 bp, Homo sapiens
agcccctcttgccccccacccc

SEQ ID NO: 388465 - DNA, 23 bp, Homo sapiens
agcccctcttgccccccacccca

SEQ ID NO: 388466 - DNA, 14 bp, Homo sapiens
agcccctgaggaca

SEQ ID NO: 388467 - DNA, 12 bp, Homo sapiens
agcccctgcccc

SEQ ID NO: 388468 - DNA, 17 bp, Homo sapiens
agcccctggggcctaga

SEQ ID NO: 388469 - DNA, 18 bp, Homo sapiens
agccccttctcccagcac

SEQ ID NO: 388470 - DNA, 20 bp, Homo sapiens
agccccttgctctcccctgc

SEQ ID NO: 388471 - DNA, 23 bp, Homo sapiens
agccccttgctctcccctgccct

SEQ ID NO: 388472 - DNA, 23 bp, Homo sapiens
agcccctttttcatatgttgctc

SEQ ID NO: 388473 - DNA, 18 bp, Homo sapiens
agcccgaatttctcactc

SEQ ID NO: 388474 - DNA, 16 bp, Homo sapiens
agcccgatattctccc

SEQ ID NO: 388475 - DNA, 23 bp, Homo sapiens
agcccgatattctccctgacctt

SEQ ID NO: 388476 - DNA, 15 bp, Homo sapiens
agcccgcacccccac

SEQ ID NO: 388477 - DNA, 14 bp, Homo sapiens
agcccgcatgcagc

SEQ ID NO: 388478 - DNA, 22 bp, Homo sapiens
agcccgcccacctgggccctag

SEQ ID NO: 388479 - DNA, 21 bp, Homo sapiens
agcccgctggagcatgagctc

SEQ ID NO: 388480 - DNA, 14 bp, Homo sapiens
tgaccccacacgcc

SEQ ID NO: 388481 - DNA, 21 bp, Homo sapiens
tgaccccacttatgctgctgt

SEQ ID NO: 388482 - DNA, 23 bp, Homo sapiens
tgaccccacttatgctgctgtga

SEQ ID NO: 388483 - DNA, 18 bp, Homo sapiens
tgaccccatctctgctgc

SEQ ID NO: 388484 - DNA, 22 bp, Homo sapiens
tgaccccgacgccacagcccag

SEQ ID NO: 388485 - DNA, 12 bp, Homo sapiens
tgacccggggca

SEQ ID NO: 388486 - DNA, 12 bp, Homo sapiens
tgaccctgcaga

SEQ ID NO: 388487 - DNA, 14 bp, Homo sapiens
tgacccttcagggc

SEQ ID NO: 388488 - DNA, 15 bp, Homo sapiens
tgacccttcagggcc

SEQ ID NO: 388489 - DNA, 18 bp, Homo sapiens
tgaccggcccgccacctt

SEQ ID NO: 388490 - DNA, 21 bp, Homo sapiens
tgaccggcccgccaccttgta

SEQ ID NO: 388491 - DNA, 20 bp, Homo sapiens
tgaccggggtcctgaggctg

SEQ ID NO: 388492 - DNA, 15 bp, Homo sapiens
tgaccgtactctcac

SEQ ID NO: 388493 - DNA, 17 bp, Homo sapiens
tgaccgttttcatcctg

SEQ ID NO: 388494 - DNA, 23 bp, Homo sapiens
tgaccgttttcatcctggcctcc

SEQ ID NO: 388495 - DNA, 19 bp, Homo sapiens
tgacctaaatccattttct

SEQ ID NO: 388496 - DNA, 15 bp, Homo sapiens
tgacctcaacaaaga

SEQ ID NO: 388497 - DNA, 14 bp, Homo sapiens
tgacctcaatggag

SEQ ID NO: 388498 - DNA, 14 bp, Homo sapiens
tgacctcactgtga

SEQ ID NO: 388499 - DNA, 18 bp, Homo sapiens
tgacctcatgatccaccc

SEQ ID NO: 388500 - DNA, 22 bp, Homo sapiens
tgacctccctctaatttatctt

SEQ ID NO: 388501 - DNA, 17 bp, Homo sapiens
tgacctctgttgtcctc

SEQ ID NO: 388502 - DNA, 18 bp, Homo sapiens
tgacctctgttgtcctcc

SEQ ID NO: 388503 - DNA, 22 bp, Homo sapiens
tgacctctgttgtcctcccctt

SEQ ID NO: 388504 - DNA, 14 bp, Homo sapiens
tgacctgaactctg

SEQ ID NO: 388505 - DNA, 14 bp, Homo sapiens
tgacctggaagagc

SEQ ID NO: 388506 - DNA, 22 bp, Homo sapiens
tgacctggaagagctgggtacc

SEQ ID NO: 388507 - DNA, 19 bp, Homo sapiens
tgaccttagcgttctggac

SEQ ID NO: 388508 - DNA, 23 bp, Homo sapiens
tgaccttcacagggacagatctg

SEQ ID NO: 388509 - DNA, 16 bp, Homo sapiens
tgaccttcctctgggg

SEQ ID NO: 388510 - DNA, 18 bp, Homo sapiens
tgaccttcctctggggct

SEQ ID NO: 388511 - DNA, 23 bp, Homo sapiens
tgaccttcctctggggctctagg

SEQ ID NO: 388512 - DNA, 17 bp, Homo sapiens
tgaccttgaactcctgg

SEQ ID NO: 388513 - DNA, 20 bp, Homo sapiens
tgaccttgaactcctgggct

SEQ ID NO: 388514 - DNA, 16 bp, Homo sapiens
tgaccttgatgtcttg

SEQ ID NO: 388515 - DNA, 16 bp, Homo sapiens
tgaccttgcaacttca

SEQ ID NO: 388516 - DNA, 13 bp, Homo sapiens
tgaccttggagga

SEQ ID NO: 388517 - DNA, 18 bp, Homo sapiens
tgaccttggctgactggg

SEQ ID NO: 388518 - DNA, 19 bp, Homo sapiens
tgaccttggctgactgggg

SEQ ID NO: 388519 - DNA, 20 bp, Homo sapiens
tgaccttggctgactggggc

SEQ ID NO: 388520 - DNA, 21 bp, Homo sapiens
tgaccttggctgactggggct

SEQ ID NO: 388521 - DNA, 23 bp, Homo sapiens
tgaccttttggcctttgtaagac

SEQ ID NO: 388522 - DNA, 15 bp, Homo sapiens
tgacgacaagtgctg

SEQ ID NO: 388523 - DNA, 15 bp, Homo sapiens
tgacgaggctgggcc

SEQ ID NO: 388524 - DNA, 21 bp, Homo sapiens
tgacgccctgcgttggagcca

SEQ ID NO: 388525 - DNA, 20 bp, Homo sapiens
tgacggcgcccccagtgtgc

SEQ ID NO: 388526 - DNA, 22 bp, Homo sapiens
tgacggtcctttaggcagcctg

SEQ ID NO: 388527 - DNA, 17 bp, Homo sapiens
tgacgtattgtgaaatt

SEQ ID NO: 388528 - DNA, 20 bp, Homo sapiens
tgacgtattgtgaaatttgt

SEQ ID NO: 388529 - DNA, 18 bp, Homo sapiens
tgacgttgatctcctggt

SEQ ID NO: 388530 - DNA, 17 bp, Homo sapiens
tgactaaagagagaatg

SEQ ID NO: 388531 - DNA, 20 bp, Homo sapiens
tgactaccacttatttctaa

SEQ ID NO: 388532 - DNA, 19 bp, Homo sapiens
tgactagacgttcatttgt

SEQ ID NO: 388533 - DNA, 13 bp, Homo sapiens
tgactagtacaaa

SEQ ID NO: 388534 - DNA, 17 bp, Homo sapiens
tgactagtacaaattat

SEQ ID NO: 388535 - DNA, 21 bp, Homo sapiens
tgactagtgctgaagcttatt

SEQ ID NO: 388536 - DNA, 15 bp, Homo sapiens
tgactataacaaaat

SEQ ID NO: 388537 - DNA, 19 bp, Homo sapiens
tgactatatagagatgttt

SEQ ID NO: 388538 - DNA, 20 bp, Homo sapiens
tgactattcttgatgtaaaa

SEQ ID NO: 388539 - DNA, 22 bp, Homo sapiens
tgactattcttgatgtaaaatc

SEQ ID NO: 388540 - DNA, 23 bp, Homo sapiens
tgactcaacatgttactgaccag

SEQ ID NO: 388541 - DNA, 20 bp, Homo sapiens
tgactcacattgccttgagc

SEQ ID NO: 388542 - DNA, 16 bp, Homo sapiens
tgactcagatgtctct

SEQ ID NO: 388543 - DNA, 21 bp, Homo sapiens
tgactcaggtggtgtccttct

SEQ ID NO: 388544 - DNA, 19 bp, Homo sapiens
tgactccagaatttcccaa

SEQ ID NO: 388545 - DNA, 13 bp, Homo sapiens
tgactccagagtc

SEQ ID NO: 388546 - DNA, 19 bp, Homo sapiens
tgactccagagtctgagcc

SEQ ID NO: 388547 - DNA, 20 bp, Homo sapiens
tgactccagagtctgagccc

SEQ ID NO: 388548 - DNA, 17 bp, Homo sapiens
tgactcccaaagagctg

SEQ ID NO: 388549 - DNA, 20 bp, Homo sapiens
tgactcccaaagagctgcct

SEQ ID NO: 388550 - DNA, 15 bp, Homo sapiens
tgactcgtctgactg

SEQ ID NO: 388551 - DNA, 22 bp, Homo sapiens
tgactgaaagaagaacagctgt

SEQ ID NO: 388552 - DNA, 17 bp, Homo sapiens
tgactgaagcgaacatc

SEQ ID NO: 388553 - DNA, 19 bp, Homo sapiens
tgactgaagcgaacatctt

SEQ ID NO: 388554 - DNA, 20 bp, Homo sapiens
tgactgagggcctggtcacc

SEQ ID NO: 388555 - DNA, 21 bp, Homo sapiens
tgactgatcctgaacaagaaa

SEQ ID NO: 388556 - DNA, 17 bp, Homo sapiens
tgactgcaacttctgtc

SEQ ID NO: 388557 - DNA, 18 bp, Homo sapiens
tgactgcacccagctcca

SEQ ID NO: 388558 - DNA, 19 bp, Homo sapiens
tgactgcacccagctccag

SEQ ID NO: 388559 - DNA, 11 bp, Homo sapiens
tgactgctgct

SEQ ID NO: 388560 - DNA, 12 bp, Homo sapiens
tgactggcaggt

SEQ ID NO: 388561 - DNA, 16 bp, Homo sapiens
tgactggccccaggga

SEQ ID NO: 388562 - DNA, 16 bp, Homo sapiens
tgactggctgtctgcc

SEQ ID NO: 388563 - DNA, 19 bp, Homo sapiens
tgactggggctggggtgag

SEQ ID NO: 388564 - DNA, 17 bp, Homo sapiens
tgactgggggcctctgc

SEQ ID NO: 388565 - DNA, 21 bp, Homo sapiens
tgactgggggcctctgcctcc

SEQ ID NO: 388566 - DNA, 22 bp, Homo sapiens
tgactgggggcctctgcctcca

SEQ ID NO: 388567 - DNA, 17 bp, Homo sapiens
tgactgtactcctccca

SEQ ID NO: 388568 - DNA, 22 bp, Homo sapiens
tgactgtaggcgcccctggggt

SEQ ID NO: 388569 - DNA, 17 bp, Homo sapiens
tgactgtcccattctcc

SEQ ID NO: 388570 - DNA, 15 bp, Homo sapiens
tgactgtgaccacct

SEQ ID NO: 388571 - DNA, 11 bp, Homo sapiens
tgactgtgtgt

SEQ ID NO: 388572 - DNA, 19 bp, Homo sapiens
tgactgtttggcttataaa

SEQ ID NO: 388573 - DNA, 22 bp, Homo sapiens
tgactgtttggcttataaacac

SEQ ID NO: 388574 - DNA, 16 bp, Homo sapiens
tgacttaactgcattt

SEQ ID NO: 388575 - DNA, 19 bp, Homo sapiens
tgacttattgattaagtat

SEQ ID NO: 388576 - DNA, 18 bp, Homo sapiens
tgacttcaagatgcctct

SEQ ID NO: 388577 - DNA, 17 bp, Homo sapiens
tgacttcagactctctc

SEQ ID NO: 388578 - DNA, 15 bp, Homo sapiens
tgacttcagcagggg

SEQ ID NO: 388579 - DNA, 23 bp, Homo sapiens
tgacttcagcaggggtgggaggc

SEQ ID NO: 388580 - DNA, 16 bp, Homo sapiens
tgacttcagctgcctg

SEQ ID NO: 388581 - DNA, 19 bp, Homo sapiens
tgacttcagctgcctgaaa

SEQ ID NO: 388582 - DNA, 14 bp, Homo sapiens
tgacttcccagctg

SEQ ID NO: 388583 - DNA, 18 bp, Homo sapiens
tgacttcccagctggcag

SEQ ID NO: 388584 - DNA, 22 bp, Homo sapiens
tgacttcccagctggcagcgcc

SEQ ID NO: 388585 - DNA, 14 bp, Homo sapiens
tgacttcctggtga

SEQ ID NO: 388586 - DNA, 20 bp, Homo sapiens
tgacttcgactgtgacctgt

SEQ ID NO: 388587 - DNA, 17 bp, Homo sapiens
tgacttctaatatcatt

SEQ ID NO: 388588 - DNA, 20 bp, Homo sapiens
tgacttctatcctgttaaca

SEQ ID NO: 388589 - DNA, 11 bp, Homo sapiens
tgacttctctc

SEQ ID NO: 388590 - DNA, 13 bp, Homo sapiens
tgacttctgagca

SEQ ID NO: 388591 - DNA, 12 bp, Homo sapiens
tgacttctgcta

SEQ ID NO: 388592 - DNA, 19 bp, Homo sapiens
tgacttctgctaggtagag

SEQ ID NO: 388593 - DNA, 14 bp, Homo sapiens
tgacttgaatgtac

SEQ ID NO: 388594 - DNA, 16 bp, Homo sapiens
tgacttgaatgtacaa

SEQ ID NO: 388595 - DNA, 20 bp, Homo sapiens
tgacttgaatgtacaaagat

SEQ ID NO: 388596 - DNA, 12 bp, Homo sapiens
tgacttgcttta

SEQ ID NO: 388597 - DNA, 15 bp, Homo sapiens
tgacttgctttagtt

SEQ ID NO: 388598 - DNA, 23 bp, Homo sapiens
tgactttgaacacatctcttagt

SEQ ID NO: 388599 - DNA, 14 bp, Homo sapiens
tgacttttacagct

SEQ ID NO: 388600 - DNA, 21 bp, Homo sapiens
tgacttttacagcttttctct

SEQ ID NO: 388601 - DNA, 18 bp, Homo sapiens
tgacttttattatgggta

SEQ ID NO: 388602 - DNA, 18 bp, Homo sapiens
tgacttttccatgtatct

SEQ ID NO: 388603 - DNA, 22 bp, Homo sapiens
tgacttttccatgtatctacct

SEQ ID NO: 388604 - DNA, 13 bp, Homo sapiens
tgacttttgaaga

SEQ ID NO: 388605 - DNA, 14 bp, Homo sapiens
tgacttttgaagaa

SEQ ID NO: 388606 - DNA, 17 bp, Homo sapiens
tgacttttgaagaacaa

SEQ ID NO: 388607 - DNA, 18 bp, Homo sapiens
tgactttttaaaatataa

SEQ ID NO: 388608 - DNA, 15 bp, Homo sapiens
tgagaaaaaaacagc

SEQ ID NO: 388609 - DNA, 23 bp, Homo sapiens
tgagaaagaaaaggaatgcaaga

SEQ ID NO: 388610 - DNA, 17 bp, Homo sapiens
tgagaaatacagtgctt

SEQ ID NO: 388611 - DNA, 15 bp, Homo sapiens
tgagaaatataaaaa

SEQ ID NO: 388612 - DNA, 18 bp, Homo sapiens
tgagaaatataaaaataa

SEQ ID NO: 388613 - DNA, 13 bp, Homo sapiens
gcaaggcctgtgc

SEQ ID NO: 388614 - DNA, 14 bp, Homo sapiens
gcaaggcctgtgct

SEQ ID NO: 388615 - DNA, 18 bp, Homo sapiens
gcaaggctgtcaattaca

SEQ ID NO: 388616 - DNA, 14 bp, Homo sapiens
gcaagggcatcagg

SEQ ID NO: 388617 - DNA, 19 bp, Homo sapiens
gcaagggcatcaggcactg

SEQ ID NO: 388618 - DNA, 20 bp, Homo sapiens
gcaagggcatcaggcactgg

SEQ ID NO: 388619 - DNA, 10 bp, Homo sapiens
gcaagggctc

SEQ ID NO: 388620 - DNA, 11 bp, Homo sapiens
gcaagggctcc

SEQ ID NO: 388621 - DNA, 15 bp, Homo sapiens
gcaagggctccagca

SEQ ID NO: 388622 - DNA, 16 bp, Homo sapiens
gcaagggctccagcat

SEQ ID NO: 388623 - DNA, 20 bp, Homo sapiens
gcaagggctccagcatccag

SEQ ID NO: 388624 - DNA, 21 bp, Homo sapiens
gcaagggctccagcatccagc

SEQ ID NO: 388625 - DNA, 22 bp, Homo sapiens
gcaagggctccagcatccagcc

SEQ ID NO: 388626 - DNA, 23 bp, Homo sapiens
gcaagggggtgtcatctgaggag

SEQ ID NO: 388627 - DNA, 17 bp, Homo sapiens
gcaaggtgagggatgcc

SEQ ID NO: 388628 - DNA, 20 bp, Homo sapiens
gcaaggtgggggagcctgga

SEQ ID NO: 388629 - DNA, 22 bp, Homo sapiens
gcaagtccatagctgagctgga

SEQ ID NO: 388630 - DNA, 22 bp, Homo sapiens
gcaagtcccagacaaggagagc

SEQ ID NO: 388631 - DNA, 22 bp, Homo sapiens
gcaagtgagcaaacctgcccca

SEQ ID NO: 388632 - DNA, 17 bp, Homo sapiens
gcaagtgaggcaagaga

SEQ ID NO: 388633 - DNA, 19 bp, Homo sapiens
gcaagtgaggcaagagaaa

SEQ ID NO: 388634 - DNA, 15 bp, Homo sapiens
gcaagtgtctgtgtg

SEQ ID NO: 388635 - DNA, 19 bp, Homo sapiens
gcaagtgtgtgcatgtgtg

SEQ ID NO: 388636 - DNA, 17 bp, Homo sapiens
gcaagtgtttctgttct

SEQ ID NO: 388637 - DNA, 13 bp, Homo sapiens
gcaagttcaagac

SEQ ID NO: 388638 - DNA, 22 bp, Homo sapiens
gcaagtttctagctagaaatat

SEQ ID NO: 388639 - DNA, 21 bp, Homo sapiens
gcaataaagtgtagcaccctg

SEQ ID NO: 388640 - DNA, 12 bp, Homo sapiens
gcaataaatgaa

SEQ ID NO: 388641 - DNA, 21 bp, Homo sapiens
gcaataaatggctcgtgggct

SEQ ID NO: 388642 - DNA, 18 bp, Homo sapiens
gcaataaatgtcccaaat

SEQ ID NO: 388643 - DNA, 19 bp, Homo sapiens
gcaataagttcattaaaca

SEQ ID NO: 388644 - DNA, 22 bp, Homo sapiens
gcaataagttcattaaacagaa

SEQ ID NO: 388645 - DNA, 14 bp, Homo sapiens
gcaatagagactgt

SEQ ID NO: 388646 - DNA, 19 bp, Homo sapiens
gcaatatcaacaacaagtt

SEQ ID NO: 388647 - DNA, 19 bp, Homo sapiens
gcaatatgaggggactgca

SEQ ID NO: 388648 - DNA, 14 bp, Homo sapiens
gcaatcctcctgag

SEQ ID NO: 388649 - DNA, 14 bp, Homo sapiens
gcaatcttatgttg

SEQ ID NO: 388650 - DNA, 15 bp, Homo sapiens
gcaatcttgctgtga

SEQ ID NO: 388651 - DNA, 11 bp, Homo sapiens
gcaatgaatta

SEQ ID NO: 388652 - DNA, 16 bp, Homo sapiens
gcaatgacatcttcaa

SEQ ID NO: 388653 - DNA, 17 bp, Homo sapiens
gcaatgatgtccagaag

SEQ ID NO: 388654 - DNA, 23 bp, Homo sapiens
gcaatgggactggagtcagatga

SEQ ID NO: 388655 - DNA, 18 bp, Homo sapiens
gcaatgtcacaacctctc

SEQ ID NO: 388656 - DNA, 17 bp, Homo sapiens
gcaatgtcttaaataaa

SEQ ID NO: 388657 - DNA, 22 bp, Homo sapiens
gcaatgttccgttcatctgagg

SEQ ID NO: 388658 - DNA, 23 bp, Homo sapiens
gcaatgttccgttcatctgagga

SEQ ID NO: 388659 - DNA, 14 bp, Homo sapiens
gcaattatttaaag

SEQ ID NO: 388660 - DNA, 11 bp, Homo sapiens
gcaattcaact

SEQ ID NO: 388661 - DNA, 15 bp, Homo sapiens
gcaattccgcattta

SEQ ID NO: 388662 - DNA, 23 bp, Homo sapiens
gcaattctcctgcctcagcctcc

SEQ ID NO: 388663 - DNA, 18 bp, Homo sapiens
gcaattgaattaaattag

SEQ ID NO: 388664 - DNA, 13 bp, Homo sapiens
gcaattgccctgt

SEQ ID NO: 388665 - DNA, 14 bp, Homo sapiens
gcaatttcatatgc

SEQ ID NO: 388666 - DNA, 17 bp, Homo sapiens
gcaatttgtttaaagaa

SEQ ID NO: 388667 - DNA, 13 bp, Homo sapiens
tcccaccaactct

SEQ ID NO: 388668 - DNA, 15 bp, Homo sapiens
tcccaccaactctgc

SEQ ID NO: 388669 - DNA, 19 bp, Homo sapiens
tcccaccaactctgcactc

SEQ ID NO: 388670 - DNA, 20 bp, Homo sapiens
tcccaccaactctgcactcc

SEQ ID NO: 388671 - DNA, 23 bp, Homo sapiens
tcccaccaactctgcactccatg

SEQ ID NO: 388672 - DNA, 17 bp, Homo sapiens
tcccaccccggcctcca

SEQ ID NO: 388673 - DNA, 22 bp, Homo sapiens
tcccacccggccacagctgctg

SEQ ID NO: 388674 - DNA, 14 bp, Homo sapiens
tcccacctccagcc

SEQ ID NO: 388675 - DNA, 16 bp, Homo sapiens
tcccacctccagccca

SEQ ID NO: 388676 - DNA, 13 bp, Homo sapiens
tcccacctccagt

SEQ ID NO: 388677 - DNA, 13 bp, Homo sapiens
tcccacgctggga

SEQ ID NO: 388678 - DNA, 20 bp, Homo sapiens
tcccacggaaaatgccaatc

SEQ ID NO: 388679 - DNA, 14 bp, Homo sapiens
tcccacggccactg

SEQ ID NO: 388680 - DNA, 16 bp, Homo sapiens
tcccacggccactgca

SEQ ID NO: 388681 - DNA, 18 bp, Homo sapiens
tcccacggccactgcagt

SEQ ID NO: 388682 - DNA, 16 bp, Homo sapiens
tcccacgtctggccag

SEQ ID NO: 388683 - DNA, 19 bp, Homo sapiens
tcccacgtctggccaggca

SEQ ID NO: 388684 - DNA, 22 bp, Homo sapiens
tcccactaagctttctcctttg

SEQ ID NO: 388685 - DNA, 21 bp, Homo sapiens
tcccactgatatcacgggccc

SEQ ID NO: 388686 - DNA, 20 bp, Homo sapiens
tcccactgtcctttctccag

SEQ ID NO: 388687 - DNA, 22 bp, Homo sapiens
tcccactgtcctttctccaggc

SEQ ID NO: 388688 - DNA, 18 bp, Homo sapiens
tcccacttatcaaatcat

SEQ ID NO: 388689 - DNA, 16 bp, Homo sapiens
tcccagaaccacactg

SEQ ID NO: 388690 - DNA, 17 bp, Homo sapiens
tcccagaaccacactgt

SEQ ID NO: 388691 - DNA, 18 bp, Homo sapiens
tcccagaaggacctcctg

SEQ ID NO: 388692 - DNA, 20 bp, Homo sapiens
tcccagaaggacctcctgag

SEQ ID NO: 388693 - DNA, 15 bp, Homo sapiens
tcccagacaggccct

SEQ ID NO: 388694 - DNA, 15 bp, Homo sapiens
tcccagacccagggc

SEQ ID NO: 388695 - DNA, 17 bp, Homo sapiens
tcccagacccagggcag

SEQ ID NO: 388696 - DNA, 19 bp, Homo sapiens
tcccagacccagggcagtg

SEQ ID NO: 388697 - DNA, 19 bp, Homo sapiens
tcccagacttgtttcctgt

SEQ ID NO: 388698 - DNA, 17 bp, Homo sapiens
tcccagactttctacac

SEQ ID NO: 388699 - DNA, 22 bp, Homo sapiens
tcccagagaacaatcactattc

SEQ ID NO: 388700 - DNA, 23 bp, Homo sapiens
tcccagagaacaatcactattct

SEQ ID NO: 388701 - DNA, 21 bp, Homo sapiens
tcccagagcaggaggcccctg

SEQ ID NO: 388702 - DNA, 14 bp, Homo sapiens
tcccagagcccgct

SEQ ID NO: 388703 - DNA, 22 bp, Homo sapiens
tcccagaggtggggaagagagc

SEQ ID NO: 388704 - DNA, 20 bp, Homo sapiens
tcccagaggttatctgcctg

SEQ ID NO: 388705 - DNA, 21 bp, Homo sapiens
tcccagaggttatctgcctgg

SEQ ID NO: 388706 - DNA, 16 bp, Homo sapiens
tcccagcacatttcct

SEQ ID NO: 388707 - DNA, 18 bp, Homo sapiens
tcccagcacctgccaggg

SEQ ID NO: 388708 - DNA, 16 bp, Homo sapiens
tcccagcacctggcac

SEQ ID NO: 388709 - DNA, 18 bp, Homo sapiens
tcccagcagcccaagctt

SEQ ID NO: 388710 - DNA, 11 bp, Homo sapiens
tcccagcatct

SEQ ID NO: 388711 - DNA, 17 bp, Homo sapiens
tcccagcatctgattga

SEQ ID NO: 388712 - DNA, 14 bp, Homo sapiens
tcccagcatttgtc

SEQ ID NO: 388713 - DNA, 12 bp, Homo sapiens
tcccagccacca

SEQ ID NO: 388714 - DNA, 13 bp, Homo sapiens
tcccagccacccc

SEQ ID NO: 388715 - DNA, 18 bp, Homo sapiens
tcccagccacgttggtgg

SEQ ID NO: 388716 - DNA, 21 bp, Homo sapiens
tcccagccacgttggtggtat

SEQ ID NO: 388717 - DNA, 19 bp, Homo sapiens
tcccagcccctggtactcc

SEQ ID NO: 388718 - DNA, 16 bp, Homo sapiens
tcccagccctttccag

SEQ ID NO: 388719 - DNA, 14 bp, Homo sapiens
tcccagcctgctga

SEQ ID NO: 388720 - DNA, 18 bp, Homo sapiens
tcccagcctgctgagagc

SEQ ID NO: 388721 - DNA, 15 bp, Homo sapiens
tcccagcctgtggtt

SEQ ID NO: 388722 - DNA, 17 bp, Homo sapiens
tcccagctacttgggaa

SEQ ID NO: 388723 - DNA, 23 bp, Homo sapiens
tcccagctacttgggagcctgag

SEQ ID NO: 388724 - DNA, 18 bp, Homo sapiens
tcccagctacttgggagg

SEQ ID NO: 388725 - DNA, 18 bp, Homo sapiens
tcccagctggtgtcactc

SEQ ID NO: 388726 - DNA, 20 bp, Homo sapiens
tcccagctggtgtcactctg

SEQ ID NO: 388727 - DNA, 15 bp, Homo sapiens
tcccaggaagcaggg

SEQ ID NO: 388728 - DNA, 17 bp, Homo sapiens
tcccaggaagcagggag

SEQ ID NO: 388729 - DNA, 11 bp, Homo sapiens
tcccaggacac

SEQ ID NO: 388730 - DNA, 16 bp, Homo sapiens
tcccaggaccctgggt

SEQ ID NO: 388731 - DNA, 19 bp, Homo sapiens
tcccaggaggggcctctga

SEQ ID NO: 388732 - DNA, 12 bp, Homo sapiens
tcccaggcaggg

SEQ ID NO: 388733 - DNA, 18 bp, Homo sapiens
tcccaggccccctgcatc

SEQ ID NO: 388734 - DNA, 20 bp, Homo sapiens
tcccaggccccctgcatcta

SEQ ID NO: 388735 - DNA, 15 bp, Homo sapiens
tcccaggcccgagat

SEQ ID NO: 388736 - DNA, 20 bp, Homo sapiens
tcccaggccgcatggcccct

SEQ ID NO: 388737 - DNA, 20 bp, Homo sapiens
tcccaggcgccccttccccc

SEQ ID NO: 388738 - DNA, 18 bp, Homo sapiens
tcccaggggtctccctga

SEQ ID NO: 388739 - DNA, 21 bp, Homo sapiens
tcccaggggtctccctgagcc

SEQ ID NO: 388740 - DNA, 23 bp, Homo sapiens
tcccaggggtctccctgagcctg

SEQ ID NO: 388741 - DNA, 16 bp, Homo sapiens
tcccagtctctggcag

SEQ ID NO: 388742 - DNA, 15 bp, Homo sapiens
tcccagtgacacttc

SEQ ID NO: 388743 - DNA, 19 bp, Homo sapiens
gctaattttctcaaaagca

SEQ ID NO: 388744 - DNA, 16 bp, Homo sapiens
gctacaaaatgtgtgc

SEQ ID NO: 388745 - DNA, 17 bp, Homo sapiens
gctacaacttcagcagt

SEQ ID NO: 388746 - DNA, 21 bp, Homo sapiens
gctacaatcctaccttttgat

SEQ ID NO: 388747 - DNA, 15 bp, Homo sapiens
gctacacttacaagt

SEQ ID NO: 388748 - DNA, 14 bp, Homo sapiens
gctacacttctgat

SEQ ID NO: 388749 - DNA, 23 bp, Homo sapiens
gctacagagaaaatcaaagcagt

SEQ ID NO: 388750 - DNA, 19 bp, Homo sapiens
gctacaggaagcaccccat

SEQ ID NO: 388751 - DNA, 17 bp, Homo sapiens
gctacaggggaggctga

SEQ ID NO: 388752 - DNA, 21 bp, Homo sapiens
gctacagttgaacagaactgc

SEQ ID NO: 388753 - DNA, 14 bp, Homo sapiens
gctacatcccagcc

SEQ ID NO: 388754 - DNA, 15 bp, Homo sapiens
gctacattcctcagc

SEQ ID NO: 388755 - DNA, 17 bp, Homo sapiens
gctacattcctcagctg

SEQ ID NO: 388756 - DNA, 18 bp, Homo sapiens
gctaccaattgtttcttg

SEQ ID NO: 388757 - DNA, 21 bp, Homo sapiens
gctaccccttctttgcagggc

SEQ ID NO: 388758 - DNA, 22 bp, Homo sapiens
gctaccccttctttgcagggct

SEQ ID NO: 388759 - DNA, 17 bp, Homo sapiens
tgcagatttctcacctg

SEQ ID NO: 388760 - DNA, 20 bp, Homo sapiens
tgcagcagcaacacaatgtt

SEQ ID NO: 388761 - DNA, 22 bp, Homo sapiens
tgcagcagcaacacaatgttat

SEQ ID NO: 388762 - DNA, 19 bp, Homo sapiens
tgcagcagcccagcttcct

SEQ ID NO: 388763 - DNA, 19 bp, Homo sapiens
tgcagcagcttgctgcacc

SEQ ID NO: 388764 - DNA, 14 bp, Homo sapiens
tgcagcaggcagag

SEQ ID NO: 388765 - DNA, 22 bp, Homo sapiens
tgcagcagtgagtctcttcaga

SEQ ID NO: 388766 - DNA, 17 bp, Homo sapiens
tgcagcatacaaaaata

SEQ ID NO: 388767 - DNA, 22 bp, Homo sapiens
tgcagcatgacctgtgaccagc

SEQ ID NO: 388768 - DNA, 20 bp, Homo sapiens
tgcagcccacagaggacagt

SEQ ID NO: 388769 - DNA, 19 bp, Homo sapiens
tgcagcccagaacgggcct

SEQ ID NO: 388770 - DNA, 20 bp, Homo sapiens
tgcagcccagaacgggcctc

SEQ ID NO: 388771 - DNA, 18 bp, Homo sapiens
tgcagcccatgcccacct

SEQ ID NO: 388772 - DNA, 21 bp, Homo sapiens
tgcagcccatgcccacctgcc

SEQ ID NO: 388773 - DNA, 17 bp, Homo sapiens
tgcagccccaggaccaa

SEQ ID NO: 388774 - DNA, 12 bp, Homo sapiens
tgcagcccctcc

SEQ ID NO: 388775 - DNA, 20 bp, Homo sapiens
tgcagcccggcgccaccatc

SEQ ID NO: 388776 - DNA, 22 bp, Homo sapiens
tgcagcccggcgccaccatcct

SEQ ID NO: 388777 - DNA, 19 bp, Homo sapiens
tgcagcccgtgtggcccct

SEQ ID NO: 388778 - DNA, 21 bp, Homo sapiens
tgcagcccgtgtggccccttc

SEQ ID NO: 388779 - DNA, 23 bp, Homo sapiens
tgcagcccgtgtggccccttcac

SEQ ID NO: 388780 - DNA, 14 bp, Homo sapiens
tgcagccctgctgc

SEQ ID NO: 388781 - DNA, 12 bp, Homo sapiens
tgcagcccttcc

SEQ ID NO: 388782 - DNA, 22 bp, Homo sapiens
tgcagcccttcctcctgaagcc

SEQ ID NO: 388783 - DNA, 19 bp, Homo sapiens
tgcagcccttgggcagttc

SEQ ID NO: 388784 - DNA, 17 bp, Homo sapiens
tgcagccgccttccttg

SEQ ID NO: 388785 - DNA, 18 bp, Homo sapiens
tgcagccggcacagggtc

SEQ ID NO: 388786 - DNA, 23 bp, Homo sapiens
tgcagcctagtaggagctgagct

SEQ ID NO: 388787 - DNA, 20 bp, Homo sapiens
tgcagcctcgaactcctggg

SEQ ID NO: 388788 - DNA, 23 bp, Homo sapiens
tgcagcctcgaactcctgggctc

SEQ ID NO: 388789 - DNA, 14 bp, Homo sapiens
tgcagcctctgcct

SEQ ID NO: 388790 - DNA, 13 bp, Homo sapiens
tgcagcctgagct

SEQ ID NO: 388791 - DNA, 21 bp, Homo sapiens
tgcagcctgagctccaccctc

SEQ ID NO: 388792 - DNA, 15 bp, Homo sapiens
tgcagcctggaggcc

SEQ ID NO: 388793 - DNA, 23 bp, Homo sapiens
tgcagcctttgcctccccggctc

SEQ ID NO: 388794 - DNA, 16 bp, Homo sapiens
tgcagcgccacccagt

SEQ ID NO: 388795 - DNA, 18 bp, Homo sapiens
tgcagcgcctcctggaca

SEQ ID NO: 388796 - DNA, 20 bp, Homo sapiens
tgcagctctgcagcaatatt

SEQ ID NO: 388797 - DNA, 21 bp, Homo sapiens
tgcagctgacctctgttgtcc

SEQ ID NO: 388798 - DNA, 15 bp, Homo sapiens
tgcagctgattttaa

SEQ ID NO: 388799 - DNA, 19 bp, Homo sapiens
tgcagctgattttaacaat

SEQ ID NO: 388800 - DNA, 14 bp, Homo sapiens
tgcagctgctggtt

SEQ ID NO: 388801 - DNA, 16 bp, Homo sapiens
tgcagctgggatttga

SEQ ID NO: 388802 - DNA, 16 bp, Homo sapiens
tgcaggaacgagcact

SEQ ID NO: 388803 - DNA, 17 bp, Homo sapiens
tgcaggaacgagcactg

SEQ ID NO: 388804 - DNA, 21 bp, Homo sapiens
tgcaggaacgagcactggcca

SEQ ID NO: 388805 - DNA, 19 bp, Homo sapiens
tgcaggaagagatgctcta

SEQ ID NO: 388806 - DNA, 16 bp, Homo sapiens
tgcaggaataaggcct

SEQ ID NO: 388807 - DNA, 12 bp, Homo sapiens
tgcaggaggcct

SEQ ID NO: 388808 - DNA, 14 bp, Homo sapiens
tgcaggaggcctgg

SEQ ID NO: 388809 - DNA, 16 bp, Homo sapiens
tgcaggaggcctggga

SEQ ID NO: 388810 - DNA, 17 bp, Homo sapiens
tgcaggaggcctgggag

SEQ ID NO: 388811 - DNA, 18 bp, Homo sapiens
tgcaggaggcctgggagg

SEQ ID NO: 388812 - DNA, 19 bp, Homo sapiens
tgcaggaggcctgggaggg

SEQ ID NO: 388813 - DNA, 15 bp, Homo sapiens
tgcaggcagccttga

SEQ ID NO: 388814 - DNA, 22 bp, Homo sapiens
tgcaggcccagaggagccaagt

SEQ ID NO: 388815 - DNA, 13 bp, Homo sapiens
tgcaggccccagc

SEQ ID NO: 388816 - DNA, 17 bp, Homo sapiens
tgcaggccccagccaag

SEQ ID NO: 388817 - DNA, 21 bp, Homo sapiens
tgcaggccccagccaagtgcc

SEQ ID NO: 388818 - DNA, 19 bp, Homo sapiens
tgcaggcgcgcaccgccca

SEQ ID NO: 388819 - DNA, 21 bp, Homo sapiens
tgcaggcgcgcaccgcccaac

SEQ ID NO: 388820 - DNA, 20 bp, Homo sapiens
tgcaggcggtatccagaggt

SEQ ID NO: 388821 - DNA, 21 bp, Homo sapiens
tgcaggcggtatccagaggtg

SEQ ID NO: 388822 - DNA, 12 bp, Homo sapiens
tgcaggctctgg

SEQ ID NO: 388823 - DNA, 16 bp, Homo sapiens
tgcaggctctgggctc

SEQ ID NO: 388824 - DNA, 19 bp, Homo sapiens
tgcaggctctgggctcagg

SEQ ID NO: 388825 - DNA, 22 bp, Homo sapiens
tgcaggctctgggctcagggct

SEQ ID NO: 388826 - DNA, 18 bp, Homo sapiens
tgcaggctggcaccgcct

SEQ ID NO: 388827 - DNA, 17 bp, Homo sapiens
tgcaggctgtctcattt

SEQ ID NO: 388828 - DNA, 13 bp, Homo sapiens
tgcagggaagagg

SEQ ID NO: 388829 - DNA, 13 bp, Homo sapiens
tgcagggagggga

SEQ ID NO: 388830 - DNA, 16 bp, Homo sapiens
tgcagggaggggaggc

SEQ ID NO: 388831 - DNA, 14 bp, Homo sapiens
tgcagggcagcctg

SEQ ID NO: 388832 - DNA, 15 bp, Homo sapiens
tgcagggcagcctgt

SEQ ID NO: 388833 - DNA, 19 bp, Homo sapiens
tgcagggctaaggccccca

SEQ ID NO: 388834 - DNA, 23 bp, Homo sapiens
tgcaggtacttcctcctgatggc

SEQ ID NO: 388835 - DNA, 24 bp, Homo sapiens
tgcaggtacttcctcctgatggcc

SEQ ID NO: 388836 - DNA, 13 bp, Homo sapiens
tgcagtataaaat

SEQ ID NO: 388837 - DNA, 16 bp, Homo sapiens
tgcagtataaaatgta

SEQ ID NO: 388838 - DNA, 18 bp, Homo sapiens
tgcagtcatcaacaaaag

SEQ ID NO: 388839 - DNA, 13 bp, Homo sapiens
tgcagtgaattgt

SEQ ID NO: 388840 - DNA, 19 bp, Homo sapiens
tgcagtggccccatccagc

SEQ ID NO: 388841 - DNA, 15 bp, Homo sapiens
tgcagtgtcttgtaa

SEQ ID NO: 388842 - DNA, 18 bp, Homo sapiens
tgcagtgtgcctgtcact

SEQ ID NO: 388843 - DNA, 19 bp, Homo sapiens
tgcagttcagcaccaccct

SEQ ID NO: 388844 - DNA, 16 bp, Homo sapiens
tgcagttcattatttt

SEQ ID NO: 388845 - DNA, 14 bp, Homo sapiens
tgcagttcctgagt

SEQ ID NO: 388846 - DNA, 17 bp, Homo sapiens
tgcagttgaagagcctg

SEQ ID NO: 388847 - DNA, 19 bp, Homo sapiens
tgcagtttgagacaggaga

SEQ ID NO: 388848 - DNA, 15 bp, Homo sapiens
tgcagtttttcagga

SEQ ID NO: 388849 - DNA, 18 bp, Homo sapiens
tgcataaacaatccaaat

SEQ ID NO: 388850 - DNA, 23 bp, Homo sapiens
tgcataaacaatccaaatgcatt

SEQ ID NO: 388851 - DNA, 15 bp, Homo sapiens
tgcataaatgttata

SEQ ID NO: 388852 - DNA, 22 bp, Homo sapiens
tgcataagtgaaaatcttacaa

SEQ ID NO: 388853 - DNA, 17 bp, Homo sapiens
tgcataagttaacttcc

SEQ ID NO: 388854 - DNA, 19 bp, Homo sapiens
tgcataataagctaaagag

SEQ ID NO: 388855 - DNA, 22 bp, Homo sapiens
tgcataataagctaaagaggct

SEQ ID NO: 388856 - DNA, 24 bp, Homo sapiens
tgcataataagctaaagaggctga

SEQ ID NO: 388857 - DNA, 12 bp, Homo sapiens
tgcataatacta

SEQ ID NO: 388858 - DNA, 22 bp, Homo sapiens
tgcataatactaatttattgcc

SEQ ID NO: 388859 - DNA, 18 bp, Homo sapiens
tgcatacttcctggattt

SEQ ID NO: 388860 - DNA, 13 bp, Homo sapiens
tgcatagacaaag

SEQ ID NO: 388861 - DNA, 19 bp, Homo sapiens
tgcatagacaaaggcctta

SEQ ID NO: 388862 - DNA, 16 bp, Homo sapiens
tgcatatcctgagcca

SEQ ID NO: 388863 - DNA, 18 bp, Homo sapiens
tgcatatcctgagccatc

SEQ ID NO: 388864 - DNA, 20 bp, Homo sapiens
tgcatatcctggtgtctagt

SEQ ID NO: 388865 - DNA, 20 bp, Homo sapiens
tgcatatctctagtccctgt

SEQ ID NO: 388866 - DNA, 13 bp, Homo sapiens
tgcatattctatt

SEQ ID NO: 388867 - DNA, 22 bp, Homo sapiens
tgcatattctattgtattattt

SEQ ID NO: 388868 - DNA, 23 bp, Homo sapiens
tgcatattctattgtattatttg

SEQ ID NO: 388869 - DNA, 14 bp, Homo sapiens
tgcatcaaccagga

SEQ ID NO: 388870 - DNA, 19 bp, Homo sapiens
tgcatcaagatgtgacatg

SEQ ID NO: 388871 - DNA, 20 bp, Homo sapiens
tgcatcagcctctggccaga

SEQ ID NO: 388872 - DNA, 16 bp, Homo sapiens
gctcactctttccccc

SEQ ID NO: 388873 - DNA, 15 bp, Homo sapiens
gctcactgcagcctc

SEQ ID NO: 388874 - DNA, 18 bp, Homo sapiens
gctcactgcagcctctgc

SEQ ID NO: 388875 - DNA, 12 bp, Homo sapiens
gctcagaacaca

SEQ ID NO: 388876 - DNA, 21 bp, Homo sapiens
gctcagaacaccccgctctgg

SEQ ID NO: 388877 - DNA, 17 bp, Homo sapiens
gctcagacgagacaccc

SEQ ID NO: 388878 - DNA, 21 bp, Homo sapiens
gctcagcacagcctcacccct

SEQ ID NO: 388879 - DNA, 16 bp, Homo sapiens
gctcagcccacccccc

SEQ ID NO: 388880 - DNA, 12 bp, Homo sapiens
gctcagccccag

SEQ ID NO: 388881 - DNA, 17 bp, Homo sapiens
gctcagccccagcccag

SEQ ID NO: 388882 - DNA, 15 bp, Homo sapiens
gctcagccccggcca

SEQ ID NO: 388883 - DNA, 16 bp, Homo sapiens
gctcagccccggccac

SEQ ID NO: 388884 - DNA, 18 bp, Homo sapiens
gctcagccccggccactc

SEQ ID NO: 388885 - DNA, 19 bp, Homo sapiens
gctcagccccggccactcc

SEQ ID NO: 388886 - DNA, 20 bp, Homo sapiens
gctcagccccggccactccc

SEQ ID NO: 388887 - DNA, 15 bp, Homo sapiens
gctcagccctccctg

SEQ ID NO: 388888 - DNA, 13 bp, Homo sapiens
gctcagctctggc

SEQ ID NO: 388889 - DNA, 14 bp, Homo sapiens
gctcagctctggct

SEQ ID NO: 388890 - DNA, 18 bp, Homo sapiens
gctcagctctggctcaca

SEQ ID NO: 388891 - DNA, 21 bp, Homo sapiens
gctcagctctggctcacagac

SEQ ID NO: 388892 - DNA, 14 bp, Homo sapiens
gctcagctggccgg

SEQ ID NO: 388893 - DNA, 16 bp, Homo sapiens
gctcaggacccaggcc

SEQ ID NO: 388894 - DNA, 11 bp, Homo sapiens
gctcaggagaa

SEQ ID NO: 388895 - DNA, 16 bp, Homo sapiens
gctcaggcaagcccct

SEQ ID NO: 388896 - DNA, 23 bp, Homo sapiens
tgcatgctgctttaattgtgaat

SEQ ID NO: 388897 - DNA, 15 bp, Homo sapiens
tgcatgctgtccctt

SEQ ID NO: 388898 - DNA, 17 bp, Homo sapiens
tgcatggacctaacatt

SEQ ID NO: 388899 - DNA, 17 bp, Homo sapiens
tgcatggagtgtttgac

SEQ ID NO: 388900 - DNA, 22 bp, Homo sapiens
tgcatggcagcaggcctgttgc

SEQ ID NO: 388901 - DNA, 17 bp, Homo sapiens
tgcatggccacagccac

SEQ ID NO: 388902 - DNA, 16 bp, Homo sapiens
tgcatggcctcccagc

SEQ ID NO: 388903 - DNA, 23 bp, Homo sapiens
tgcatggcctctaagagtgcccg

SEQ ID NO: 388904 - DNA, 21 bp, Homo sapiens
tgcatggctcctgtctggctc

SEQ ID NO: 388905 - DNA, 17 bp, Homo sapiens
tgcatgggtgaagggag

SEQ ID NO: 388906 - DNA, 19 bp, Homo sapiens
tgcatggtaatttatagtt

SEQ ID NO: 388907 - DNA, 19 bp, Homo sapiens
tgcatgtaaaatcttcagc

SEQ ID NO: 388908 - DNA, 20 bp, Homo sapiens
tgcatgtaaaatcttcagct

SEQ ID NO: 388909 - DNA, 20 bp, Homo sapiens
tgcatgtagcatataaatgt

SEQ ID NO: 388910 - DNA, 15 bp, Homo sapiens
tgcatgtataaatga

SEQ ID NO: 388911 - DNA, 21 bp, Homo sapiens
tgcatgtattcactaaaataa

SEQ ID NO: 388912 - DNA, 17 bp, Homo sapiens
tgcatgtatttaagaaa

SEQ ID NO: 388913 - DNA, 12 bp, Homo sapiens
tgcatgtctgca

SEQ ID NO: 388914 - DNA, 11 bp, Homo sapiens
tgcatgtgtgt

SEQ ID NO: 388915 - DNA, 22 bp, Homo sapiens
tgcatgtgtgttgtccttcagc

SEQ ID NO: 388916 - DNA, 14 bp, Homo sapiens
tgcatgttaccatc

SEQ ID NO: 388917 - DNA, 11 bp, Homo sapiens
tgcatgttctt

SEQ ID NO: 388918 - DNA, 21 bp, Homo sapiens
tgcatgttcttgttttgttat

SEQ ID NO: 388919 - DNA, 21 bp, Homo sapiens
tgcatgttcttttctggaaaa

SEQ ID NO: 388920 - DNA, 17 bp, Homo sapiens
tgcattaacttttgtaa

SEQ ID NO: 388921 - DNA, 18 bp, Homo sapiens
tgcattacagagaggaga

SEQ ID NO: 388922 - DNA, 22 bp, Homo sapiens
tgcattactattaactctgcat

SEQ ID NO: 388923 - DNA, 22 bp, Homo sapiens
tgcattcatgttttaaaagttt

SEQ ID NO: 388924 - DNA, 20 bp, Homo sapiens
tgcattcttttaaagtttta

SEQ ID NO: 388925 - DNA, 22 bp, Homo sapiens
tgcattgaatttagtcattatt

SEQ ID NO: 388926 - DNA, 20 bp, Homo sapiens
tgcattggaagaccccaccc

SEQ ID NO: 388927 - DNA, 22 bp, Homo sapiens
tgcattggataacaccaccatt

SEQ ID NO: 388928 - DNA, 22 bp, Homo sapiens
tgcattgtctccttccacaatg

SEQ ID NO: 388929 - DNA, 17 bp, Homo sapiens
tgcattgtcttgtggag

SEQ ID NO: 388930 - DNA, 15 bp, Homo sapiens
tgcatttataaatgt

SEQ ID NO: 388931 - DNA, 20 bp, Homo sapiens
tgcatttataaatgtgtggt

SEQ ID NO: 388932 - DNA, 16 bp, Homo sapiens
tgcatttattgcagtt

SEQ ID NO: 388933 - DNA, 14 bp, Homo sapiens
tgcatttcctgaca

SEQ ID NO: 388934 - DNA, 21 bp, Homo sapiens
tgcattttaaagttaaacatt

SEQ ID NO: 388935 - DNA, 14 bp, Homo sapiens
tgcattttctcagg

SEQ ID NO: 388936 - DNA, 18 bp, Homo sapiens
tgcattttgcagcagtga

SEQ ID NO: 388937 - DNA, 17 bp, Homo sapiens
tgcatttttaaaggaca

SEQ ID NO: 388938 - DNA, 15 bp, Homo sapiens
tgcatttttaccttt

SEQ ID NO: 388939 - DNA, 20 bp, Homo sapiens
tgcatttttatcatgtaaca

SEQ ID NO: 388940 - DNA, 19 bp, Homo sapiens
tgcatttttatctgtgagt

SEQ ID NO: 388941 - DNA, 16 bp, Homo sapiens
tgcatttttgtgaaat

SEQ ID NO: 388942 - DNA, 19 bp, Homo sapiens
tgccaaaatcattttaatg

SEQ ID NO: 388943 - DNA, 22 bp, Homo sapiens
tgccaaagctagggtggccctt

SEQ ID NO: 388944 - DNA, 18 bp, Homo sapiens
tgccaaagggaaatatca

SEQ ID NO: 388945 - DNA, 23 bp, Homo sapiens
tgccaaagtgtctacatgtgcca

SEQ ID NO: 388946 - DNA, 20 bp, Homo sapiens
tgccaaataaagttaaaagt

SEQ ID NO: 388947 - DNA, 23 bp, Homo sapiens
tgccaaattttggccaaagtgtt

SEQ ID NO: 388948 - DNA, 18 bp, Homo sapiens
tgccaacctgatgcccct

SEQ ID NO: 388949 - DNA, 13 bp, Homo sapiens
tgccaactaagcc

SEQ ID NO: 388950 - DNA, 19 bp, Homo sapiens
tgccaactccatgaccagg

SEQ ID NO: 388951 - DNA, 16 bp, Homo sapiens
tgccaactcgggagca

SEQ ID NO: 388952 - DNA, 16 bp, Homo sapiens
tgccaactttccagac

SEQ ID NO: 388953 - DNA, 16 bp, Homo sapiens
tgccaagaaaatgaag

SEQ ID NO: 388954 - DNA, 15 bp, Homo sapiens
tgccaaggagcccct

SEQ ID NO: 388955 - DNA, 18 bp, Homo sapiens
tgccaaggaggtcccagg

SEQ ID NO: 388956 - DNA, 20 bp, Homo sapiens
tgccaaggaggtcccaggaa

SEQ ID NO: 388957 - DNA, 22 bp, Homo sapiens
tgccaaggaggtcccaggaagt

SEQ ID NO: 388958 - DNA, 20 bp, Homo sapiens
tgccaaggccagagtggcct

SEQ ID NO: 388959 - DNA, 15 bp, Homo sapiens
tgccaaggccgccca

SEQ ID NO: 388960 - DNA, 20 bp, Homo sapiens
tgccaaggccgcccacctgc

SEQ ID NO: 388961 - DNA, 18 bp, Homo sapiens
tgccaagtcctgcctttg

SEQ ID NO: 388962 - DNA, 18 bp, Homo sapiens
tgccaagtctcaggagga

SEQ ID NO: 388963 - DNA, 16 bp, Homo sapiens
tgccaatatgtattgt

SEQ ID NO: 388964 - DNA, 19 bp, Homo sapiens
tgccaatatgtattgtaaa

SEQ ID NO: 388965 - DNA, 20 bp, Homo sapiens
tgccaatgaggtctgaaatg

SEQ ID NO: 388966 - DNA, 18 bp, Homo sapiens
tgccacaaattgaaagct

SEQ ID NO: 388967 - DNA, 22 bp, Homo sapiens
tgccacaaattgaaagcttcca

SEQ ID NO: 388968 - DNA, 13 bp, Homo sapiens
tgccacacagagt

SEQ ID NO: 388969 - DNA, 19 bp, Homo sapiens
tgccacacagtgggccggc

SEQ ID NO: 388970 - DNA, 16 bp, Homo sapiens
tgccacacgtctgacc

SEQ ID NO: 388971 - DNA, 13 bp, Homo sapiens
tgccacacttcag

SEQ ID NO: 388972 - DNA, 14 bp, Homo sapiens
tgccacacttcagg

SEQ ID NO: 388973 - DNA, 15 bp, Homo sapiens
tgccacacttcaggc

SEQ ID NO: 388974 - DNA, 16 bp, Homo sapiens
tgccacacttcaggct

SEQ ID NO: 388975 - DNA, 22 bp, Homo sapiens
tgccacacttcaggctcttctc

SEQ ID NO: 388976 - DNA, 23 bp, Homo sapiens
tgccacacttcaggctcttctcc

SEQ ID NO: 388977 - DNA, 22 bp, Homo sapiens
tgccacagctggagctctcaaa

SEQ ID NO: 388978 - DNA, 14 bp, Homo sapiens
tgccacaggacaca

SEQ ID NO: 388979 - DNA, 20 bp, Homo sapiens
tgccacaggacacagtcaga

SEQ ID NO: 388980 - DNA, 23 bp, Homo sapiens
tgccacaggctgcaagctgcagg

SEQ ID NO: 388981 - DNA, 18 bp, Homo sapiens
tgccaccaaatctgtcta

SEQ ID NO: 388982 - DNA, 11 bp, Homo sapiens
tgccaccaata

SEQ ID NO: 388983 - DNA, 16 bp, Homo sapiens
tgccaccaataaaaat

SEQ ID NO: 388984 - DNA, 16 bp, Homo sapiens
tgccaccaccagatga

SEQ ID NO: 388985 - DNA, 14 bp, Homo sapiens
tgccaccacccacc

SEQ ID NO: 388986 - DNA, 15 bp, Homo sapiens
tgccaccacccctcc

SEQ ID NO: 388987 - DNA, 17 bp, Homo sapiens
tgccaccacgtctgcca

SEQ ID NO: 388988 - DNA, 19 bp, Homo sapiens
tgccaccacgtctgccagg

SEQ ID NO: 388989 - DNA, 23 bp, Homo sapiens
tgccaccacgtctgccaggccca

SEQ ID NO: 388990 - DNA, 14 bp, Homo sapiens
tgccaccaggagaa

SEQ ID NO: 388991 - DNA, 17 bp, Homo sapiens
tgccacccaccagggcg

SEQ ID NO: 388992 - DNA, 14 bp, Homo sapiens
tgccacccactcag

SEQ ID NO: 388993 - DNA, 15 bp, Homo sapiens
tgccacccactcagg

SEQ ID NO: 388994 - DNA, 17 bp, Homo sapiens
tgccacccgtaggcagc

SEQ ID NO: 388995 - DNA, 21 bp, Homo sapiens
tgccacccgtaggcagcctct

SEQ ID NO: 388996 - DNA, 22 bp, Homo sapiens
tgccacccgtaggcagcctctc

SEQ ID NO: 388997 - DNA, 13 bp, Homo sapiens
tgccaccctacct

SEQ ID NO: 388998 - DNA, 14 bp, Homo sapiens
tgccaccctacctg

SEQ ID NO: 388999 - DNA, 12 bp, Homo sapiens
tgccaccctcac

SEQ ID NO: 389000 - DNA, 13 bp, Homo sapiens
tgccaccctcaca

SEQ ID NO: 389001 - DNA, 15 bp, Homo sapiens
tgccaccctcacaca

SEQ ID NO: 389002 - DNA, 11 bp, Homo sapiens
tgcccagagct

SEQ ID NO: 389003 - DNA, 15 bp, Homo sapiens
tgcccagagtagccc

SEQ ID NO: 389004 - DNA, 15 bp, Homo sapiens
tgcccagccctccca

SEQ ID NO: 389005 - DNA, 16 bp, Homo sapiens
tgcccagccctcccag

SEQ ID NO: 389006 - DNA, 20 bp, Homo sapiens
tgcccagccctcccagctgg

SEQ ID NO: 389007 - DNA, 12 bp, Homo sapiens
tgcccagctcag

SEQ ID NO: 389008 - DNA, 17 bp, Homo sapiens
tgcccagctcagagggt

SEQ ID NO: 389009 - DNA, 13 bp, Homo sapiens
tgcccagctctga

SEQ ID NO: 389010 - DNA, 13 bp, Homo sapiens
tgcccagcttggg

SEQ ID NO: 389011 - DNA, 20 bp, Homo sapiens
tgcccagcttgggcccagct

SEQ ID NO: 389012 - DNA, 20 bp, Homo sapiens
tgcccaggccggccagcctc

SEQ ID NO: 389013 - DNA, 17 bp, Homo sapiens
tgcccaggcctgcctgt

SEQ ID NO: 389014 - DNA, 10 bp, Homo sapiens
tgcccaggct

SEQ ID NO: 389015 - DNA, 15 bp, Homo sapiens
tgcccaggctctgct

SEQ ID NO: 389016 - DNA, 16 bp, Homo sapiens
tgcccaggctctgctg

SEQ ID NO: 389017 - DNA, 17 bp, Homo sapiens
tgcccaggctctgctga

SEQ ID NO: 389018 - DNA, 19 bp, Homo sapiens
tgcccaggctctgctgact

SEQ ID NO: 389019 - DNA, 13 bp, Homo sapiens
tgcccaggctgga

SEQ ID NO: 389020 - DNA, 18 bp, Homo sapiens
tgcccagggtcctgtgcc

SEQ ID NO: 389021 - DNA, 19 bp, Homo sapiens
tgcccagtcttgagtgggc

SEQ ID NO: 389022 - DNA, 12 bp, Homo sapiens
tgcccagtgttg

SEQ ID NO: 389023 - DNA, 23 bp, Homo sapiens
tgcccagttaatcttgctttctt

SEQ ID NO: 389024 - DNA, 23 bp, Homo sapiens
tgcccagttagcccggccaagga

SEQ ID NO: 389025 - DNA, 18 bp, Homo sapiens
tgcccagttcatcccaat

SEQ ID NO: 389026 - DNA, 20 bp, Homo sapiens
tgcccatcacagggttgggc

SEQ ID NO: 389027 - DNA, 16 bp, Homo sapiens
tgcccatcctgtctgt

SEQ ID NO: 389028 - DNA, 18 bp, Homo sapiens
tgcccatgggatatgtgg

SEQ ID NO: 389029 - DNA, 17 bp, Homo sapiens
tgccccaagaggctagc

SEQ ID NO: 389030 - DNA, 21 bp, Homo sapiens
tgccccaagcagccagccagt

SEQ ID NO: 389031 - DNA, 21 bp, Homo sapiens
tgccccaatcgggtccagaga

SEQ ID NO: 389032 - DNA, 20 bp, Homo sapiens
tgccccacacaggcctggcc

SEQ ID NO: 389033 - DNA, 15 bp, Homo sapiens
tgccccacacggact

SEQ ID NO: 389034 - DNA, 12 bp, Homo sapiens
tgccccacagct

SEQ ID NO: 389035 - DNA, 15 bp, Homo sapiens
tgccccacaggccac

SEQ ID NO: 389036 - DNA, 17 bp, Homo sapiens
tgccccacaggccacac

SEQ ID NO: 389037 - DNA, 20 bp, Homo sapiens
tgccccacaggccacacgct

SEQ ID NO: 389038 - DNA, 21 bp, Homo sapiens
tgccccacaggccacacgctg

SEQ ID NO: 389039 - DNA, 22 bp, Homo sapiens
tgccccacaggccacacgctgc

SEQ ID NO: 389040 - DNA, 23 bp, Homo sapiens
tgccccacaggccacacgctgcc

SEQ ID NO: 389041 - DNA, 23 bp, Homo sapiens
tgccccacccacccctcctgggc

SEQ ID NO: 389042 - DNA, 15 bp, Homo sapiens
tgccccacctgccac

SEQ ID NO: 389043 - DNA, 19 bp, Homo sapiens
tgccccagagaagcctcag

SEQ ID NO: 389044 - DNA, 20 bp, Homo sapiens
tgccccagagaagcctcagt

SEQ ID NO: 389045 - DNA, 13 bp, Homo sapiens
tgccccagagctg

SEQ ID NO: 389046 - DNA, 14 bp, Homo sapiens
tgccccagagctgt

SEQ ID NO: 389047 - DNA, 23 bp, Homo sapiens
tgccccagagctgtttatggcct

SEQ ID NO: 389048 - DNA, 19 bp, Homo sapiens
tgccccagctgactgtggc

SEQ ID NO: 389049 - DNA, 12 bp, Homo sapiens
tgccccagctgg

SEQ ID NO: 389050 - DNA, 17 bp, Homo sapiens
tgccccagctgggctgt

SEQ ID NO: 389051 - DNA, 21 bp, Homo sapiens
tgccccatctcctcccatggc

SEQ ID NO: 389052 - DNA, 17 bp, Homo sapiens
tgccccatgataaaata

SEQ ID NO: 389053 - DNA, 12 bp, Homo sapiens
tgcccccactgt

SEQ ID NO: 389054 - DNA, 20 bp, Homo sapiens
tgcccccagaaagcctcctg

SEQ ID NO: 389055 - DNA, 19 bp, Homo sapiens
tgcccccagaccccatcca

SEQ ID NO: 389056 - DNA, 14 bp, Homo sapiens
tgccccccacccca

SEQ ID NO: 389057 - DNA, 13 bp, Homo sapiens
tgcccccctcctc

SEQ ID NO: 389058 - DNA, 15 bp, Homo sapiens
tgcccccctcctcca

SEQ ID NO: 389059 - DNA, 17 bp, Homo sapiens
tgcccccctcctccagt

SEQ ID NO: 389060 - DNA, 18 bp, Homo sapiens
tgcccccctcctccagta

SEQ ID NO: 389061 - DNA, 14 bp, Homo sapiens
tgccccccttccca

SEQ ID NO: 389062 - DNA, 19 bp, Homo sapiens
tgccccccttcccacccct

SEQ ID NO: 389063 - DNA, 18 bp, Homo sapiens
tgcccccgcgggttctag

SEQ ID NO: 389064 - DNA, 19 bp, Homo sapiens
tgcccccgcgggttctaga

SEQ ID NO: 389065 - DNA, 20 bp, Homo sapiens
tgcccccgcgggttctagac

SEQ ID NO: 389066 - DNA, 23 bp, Homo sapiens
tgcccccgctctgccatcagccc

SEQ ID NO: 389067 - DNA, 16 bp, Homo sapiens
tgcccccgttccagct

SEQ ID NO: 389068 - DNA, 17 bp, Homo sapiens
tgcccccgttccagctg

SEQ ID NO: 389069 - DNA, 23 bp, Homo sapiens
tgccccctaatccccttctcccc

SEQ ID NO: 389070 - DNA, 14 bp, Homo sapiens
tgccccctcccccg

SEQ ID NO: 389071 - DNA, 19 bp, Homo sapiens
tgccccctcccccgcagac

SEQ ID NO: 389072 - DNA, 20 bp, Homo sapiens
tgccccctcccccgcagaca

SEQ ID NO: 389073 - DNA, 21 bp, Homo sapiens
tgccccctcccccgcagacag

SEQ ID NO: 389074 - DNA, 11 bp, Homo sapiens
tgccccctgcc

SEQ ID NO: 389075 - DNA, 13 bp, Homo sapiens
tgccccctgccag

SEQ ID NO: 389076 - DNA, 14 bp, Homo sapiens
tgccccctgccagt

SEQ ID NO: 389077 - DNA, 18 bp, Homo sapiens
tgccccgccccccagagc

SEQ ID NO: 389078 - DNA, 20 bp, Homo sapiens
tgccccgccccccagagcca

SEQ ID NO: 389079 - DNA, 21 bp, Homo sapiens
tgccccgccccccagagccag

SEQ ID NO: 389080 - DNA, 17 bp, Homo sapiens
tgccccgctttgcggac

SEQ ID NO: 389081 - DNA, 18 bp, Homo sapiens
tgccccggaggaagcttg

SEQ ID NO: 389082 - DNA, 18 bp, Homo sapiens
tgccccgtcaccatctca

SEQ ID NO: 389083 - DNA, 21 bp, Homo sapiens
tgccccgtcaccatctcaggc

SEQ ID NO: 389084 - DNA, 22 bp, Homo sapiens
tgccccgtccacggctctaggt

SEQ ID NO: 389085 - DNA, 23 bp, Homo sapiens
tgccccgtcccctgggccaccct

SEQ ID NO: 389086 - DNA, 19 bp, Homo sapiens
tgccccgttccctgtcaga

SEQ ID NO: 389087 - DNA, 17 bp, Homo sapiens
tgcccctcccatggccc

SEQ ID NO: 389088 - DNA, 20 bp, Homo sapiens
tgcccctcccatggcccagc

SEQ ID NO: 389089 - DNA, 17 bp, Homo sapiens
tgcccctccccagccct

SEQ ID NO: 389090 - DNA, 22 bp, Homo sapiens
tgcccctcccccaacccccacc

SEQ ID NO: 389091 - DNA, 23 bp, Homo sapiens
tgcccctcccccaacccccaccc

SEQ ID NO: 389092 - DNA, 13 bp, Homo sapiens
tgcccctcccttc

SEQ ID NO: 389093 - DNA, 19 bp, Homo sapiens
tgcccctccgtccccaggg

SEQ ID NO: 389094 - DNA, 15 bp, Homo sapiens
tgcccctgcagggga

SEQ ID NO: 389095 - DNA, 14 bp, Homo sapiens
tgcccctgctgcct

SEQ ID NO: 389096 - DNA, 22 bp, Homo sapiens
tgccccttaagggttgaaggca

SEQ ID NO: 389097 - DNA, 19 bp, Homo sapiens
tgccccttcccatctcttc

SEQ ID NO: 389098 - DNA, 15 bp, Homo sapiens
tgccccttctacact

SEQ ID NO: 389099 - DNA, 20 bp, Homo sapiens
tgccccttctacactctcct

SEQ ID NO: 389100 - DNA, 22 bp, Homo sapiens
tgccccttctacactctcctgg

SEQ ID NO: 389101 - DNA, 15 bp, Homo sapiens
tgccccttcttgggc

SEQ ID NO: 389102 - DNA, 17 bp, Homo sapiens
tgccccttgaccccaca

SEQ ID NO: 389103 - DNA, 21 bp, Homo sapiens
tgccccttgaccccacacgcc

SEQ ID NO: 389104 - DNA, 22 bp, Homo sapiens
tgccccttggctggatcaggga

SEQ ID NO: 389105 - DNA, 21 bp, Homo sapiens
tgccccttgggcatccaccca

SEQ ID NO: 389106 - DNA, 13 bp, Homo sapiens
tgcccgagagctc

SEQ ID NO: 389107 - DNA, 15 bp, Homo sapiens
tgcccgagagctctt

SEQ ID NO: 389108 - DNA, 21 bp, Homo sapiens
tgcccgagagctcttagtttt

SEQ ID NO: 389109 - DNA, 19 bp, Homo sapiens
tgcccgagctggtgcatta

SEQ ID NO: 389110 - DNA, 20 bp, Homo sapiens
tgcccgagctggtgcattac

SEQ ID NO: 389111 - DNA, 13 bp, Homo sapiens
tgcccgcacagca

SEQ ID NO: 389112 - DNA, 14 bp, Homo sapiens
tgcccgcacagcag

SEQ ID NO: 389113 - DNA, 19 bp, Homo sapiens
tgcccgcacagcagcctgc

SEQ ID NO: 389114 - DNA, 20 bp, Homo sapiens
tgcccgcacagcagcctgct

SEQ ID NO: 389115 - DNA, 13 bp, Homo sapiens
tgcccgccagcca

SEQ ID NO: 389116 - DNA, 16 bp, Homo sapiens
tgcccgccagcctcag

SEQ ID NO: 389117 - DNA, 18 bp, Homo sapiens
tgcccgccagcctcagtg

SEQ ID NO: 389118 - DNA, 20 bp, Homo sapiens
tgcccgcccacctctgctgc

SEQ ID NO: 389119 - DNA, 16 bp, Homo sapiens
tgcccgccccaagccc

SEQ ID NO: 389120 - DNA, 15 bp, Homo sapiens
tgcccgcccggggag

SEQ ID NO: 389121 - DNA, 16 bp, Homo sapiens
tgcccgcccggggagt

SEQ ID NO: 389122 - DNA, 12 bp, Homo sapiens
tgcccgcctagg

SEQ ID NO: 389123 - DNA, 18 bp, Homo sapiens
tgcccgcctaggagttga

SEQ ID NO: 389124 - DNA, 16 bp, Homo sapiens
tgcccgctcccacagc

SEQ ID NO: 389125 - DNA, 19 bp, Homo sapiens
tgcccgctgcaatgcctag

SEQ ID NO: 389126 - DNA, 21 bp, Homo sapiens
tgcccggagattggacggcct

SEQ ID NO: 389127 - DNA, 18 bp, Homo sapiens
tgcccggggcagctgcca

SEQ ID NO: 389128 - DNA, 23 bp, Homo sapiens
tgcccggggcagctgccagagaa

SEQ ID NO: 389129 - DNA, 15 bp, Homo sapiens
tgcccgttgccgggc

SEQ ID NO: 389130 - DNA, 18 bp, Homo sapiens
tgccctaggctccgtcag

SEQ ID NO: 389131 - DNA, 16 bp, Homo sapiens
tgccctataacccctg

SEQ ID NO: 389132 - DNA, 22 bp, Homo sapiens
gctctgcccctccgtccccagg

SEQ ID NO: 389133 - DNA, 23 bp, Homo sapiens
gctctgcccctccgtccccaggg

SEQ ID NO: 389134 - DNA, 14 bp, Homo sapiens
gctctgccccttgg

SEQ ID NO: 389135 - DNA, 20 bp, Homo sapiens
gctctgccctccctccttcc

SEQ ID NO: 389136 - DNA, 12 bp, Homo sapiens
gctctgctcaat

SEQ ID NO: 389137 - DNA, 16 bp, Homo sapiens
gctctgctgacttctg

SEQ ID NO: 389138 - DNA, 18 bp, Homo sapiens
gctctggaagcctgctga

SEQ ID NO: 389139 - DNA, 20 bp, Homo sapiens
gctctggaagcctgctgatt

SEQ ID NO: 389140 - DNA, 17 bp, Homo sapiens
gctctggagccacctgt

SEQ ID NO: 389141 - DNA, 21 bp, Homo sapiens
gctctggcggcttcctgtcca

SEQ ID NO: 389142 - DNA, 14 bp, Homo sapiens
gctctggctcacag

SEQ ID NO: 389143 - DNA, 14 bp, Homo sapiens
gctctggctccctg

SEQ ID NO: 389144 - DNA, 15 bp, Homo sapiens
gctctggctggagag

SEQ ID NO: 389145 - DNA, 12 bp, Homo sapiens
gctctgggctca

SEQ ID NO: 389146 - DNA, 14 bp, Homo sapiens
gctctgggctcagg

SEQ ID NO: 389147 - DNA, 15 bp, Homo sapiens
gctctgggctcaggg

SEQ ID NO: 389148 - DNA, 16 bp, Homo sapiens
gctctgggctcagggc

SEQ ID NO: 389149 - DNA, 17 bp, Homo sapiens
gctctgggctcagggct

SEQ ID NO: 389150 - DNA, 23 bp, Homo sapiens
gctctgggctcagggctggagtg

SEQ ID NO: 389151 - DNA, 20 bp, Homo sapiens
gctctggggatttctgggat

SEQ ID NO: 389152 - DNA, 18 bp, Homo sapiens
gctctgggtgaggtaggc

SEQ ID NO: 389153 - DNA, 15 bp, Homo sapiens
gctctgtattctgca

SEQ ID NO: 389154 - DNA, 15 bp, Homo sapiens
gctctgtcctctgtc

SEQ ID NO: 389155 - DNA, 12 bp, Homo sapiens
gctctgtggcct

SEQ ID NO: 389156 - DNA, 13 bp, Homo sapiens
gctctgtggcctg

SEQ ID NO: 389157 - DNA, 15 bp, Homo sapiens
gctctgtggcctgtg

SEQ ID NO: 389158 - DNA, 16 bp, Homo sapiens
gctctgtggcctgtgt

SEQ ID NO: 389159 - DNA, 20 bp, Homo sapiens
gctctgtggcctgtgtccag

SEQ ID NO: 389160 - DNA, 16 bp, Homo sapiens
gctctgtgttgccatg

SEQ ID NO: 389161 - DNA, 14 bp, Homo sapiens
gctctgttgcaggt

SEQ ID NO: 389162 - DNA, 19 bp, Homo sapiens
gctctgttttgacataatg

SEQ ID NO: 389163 - DNA, 21 bp, Homo sapiens
gctcttagtcctccctgctca

SEQ ID NO: 389164 - DNA, 23 bp, Homo sapiens
gctcttagtcctccctgctcagc

SEQ ID NO: 389165 - DNA, 14 bp, Homo sapiens
gctcttagttttta

SEQ ID NO: 389166 - DNA, 22 bp, Homo sapiens
gctcttagtttttaaaaaggcc

SEQ ID NO: 389167 - DNA, 15 bp, Homo sapiens
gctcttcaccaggaa

SEQ ID NO: 389168 - DNA, 15 bp, Homo sapiens
gctcttcaggcctcc

SEQ ID NO: 389169 - DNA, 18 bp, Homo sapiens
gctcttcaggcctccctc

SEQ ID NO: 389170 - DNA, 14 bp, Homo sapiens
gctcttcctggacc

SEQ ID NO: 389171 - DNA, 15 bp, Homo sapiens
gctcttcctggacct

SEQ ID NO: 389172 - DNA, 18 bp, Homo sapiens
gctcttcctggacctgag

SEQ ID NO: 389173 - DNA, 23 bp, Homo sapiens
gctcttctacgtataaatatgaa

SEQ ID NO: 389174 - DNA, 15 bp, Homo sapiens
gctcttctgggcaga

SEQ ID NO: 389175 - DNA, 18 bp, Homo sapiens
gctcttctgggcagagcc

SEQ ID NO: 389176 - DNA, 21 bp, Homo sapiens
gctcttctgggcagagcctgt

SEQ ID NO: 389177 - DNA, 17 bp, Homo sapiens
tgcctggcgggcagccc

SEQ ID NO: 389178 - DNA, 14 bp, Homo sapiens
tgcctggctgtgga

SEQ ID NO: 389179 - DNA, 18 bp, Homo sapiens
tgcctggctgtggaggcc

SEQ ID NO: 389180 - DNA, 21 bp, Homo sapiens
tgcctggctgtggaggcctga

SEQ ID NO: 389181 - DNA, 18 bp, Homo sapiens
tgcctgggaaccttcctg

SEQ ID NO: 389182 - DNA, 15 bp, Homo sapiens
tgcctgggaatgtat

SEQ ID NO: 389183 - DNA, 13 bp, Homo sapiens
tgcctgggcagtg

SEQ ID NO: 389184 - DNA, 16 bp, Homo sapiens
tgcctgggcctgtgca

SEQ ID NO: 389185 - DNA, 17 bp, Homo sapiens
tgcctgggcctgtgcag

SEQ ID NO: 389186 - DNA, 13 bp, Homo sapiens
tgcctgtaaacat

SEQ ID NO: 389187 - DNA, 19 bp, Homo sapiens
tgcctgtaatctttttctc

SEQ ID NO: 389188 - DNA, 16 bp, Homo sapiens
tgcctgtacaagctga

SEQ ID NO: 389189 - DNA, 18 bp, Homo sapiens
tgcctgtagagccagcct

SEQ ID NO: 389190 - DNA, 15 bp, Homo sapiens
tgcctgtagtcccag

SEQ ID NO: 389191 - DNA, 13 bp, Homo sapiens
tgcctgtagttag

SEQ ID NO: 389192 - DNA, 21 bp, Homo sapiens
tgcctgtagttaggaaataaa

SEQ ID NO: 389193 - DNA, 23 bp, Homo sapiens
tgcctgtagttaggaaataaaac

SEQ ID NO: 389194 - DNA, 15 bp, Homo sapiens
tgcctgtatttccaa

SEQ ID NO: 389195 - DNA, 20 bp, Homo sapiens
tgcctgtccagcctgggcag

SEQ ID NO: 389196 - DNA, 11 bp, Homo sapiens
tgcctgtccct

SEQ ID NO: 389197 - DNA, 23 bp, Homo sapiens
tgcctgtgaccggggtcctgagg

SEQ ID NO: 389198 - DNA, 19 bp, Homo sapiens
tgcctgtgccacccaccag

SEQ ID NO: 389199 - DNA, 18 bp, Homo sapiens
tgcctgtggcagaaaaga

SEQ ID NO: 389200 - DNA, 21 bp, Homo sapiens
tgcctgtggccttgcccgcca

SEQ ID NO: 389201 - DNA, 23 bp, Homo sapiens
tgcctgtggtgaagtgtggctgg

SEQ ID NO: 389202 - DNA, 16 bp, Homo sapiens
tgcctgtgtgctccgg

SEQ ID NO: 389203 - DNA, 18 bp, Homo sapiens
tgcctgttataactctgc

SEQ ID NO: 389204 - DNA, 19 bp, Homo sapiens
tgcctgttataactctgca

SEQ ID NO: 389205 - DNA, 20 bp, Homo sapiens
tgcctgttataactctgcac

SEQ ID NO: 389206 - DNA, 12 bp, Homo sapiens
tgcctgttcctt

SEQ ID NO: 389207 - DNA, 15 bp, Homo sapiens
tgccttaaaacttta

SEQ ID NO: 389208 - DNA, 23 bp, Homo sapiens
tgccttaataagaatggttgcct

SEQ ID NO: 389209 - DNA, 20 bp, Homo sapiens
tgccttacagacagaatata

SEQ ID NO: 389210 - DNA, 19 bp, Homo sapiens
tgccttagaggagcccacg

SEQ ID NO: 389211 - DNA, 13 bp, Homo sapiens
tgccttcagccct

SEQ ID NO: 389212 - DNA, 17 bp, Homo sapiens
tgccttcagctctacag

SEQ ID NO: 389213 - DNA, 18 bp, Homo sapiens
tgccttcagctctacagc

SEQ ID NO: 389214 - DNA, 14 bp, Homo sapiens
tgccttccacgctg

SEQ ID NO: 389215 - DNA, 17 bp, Homo sapiens
tgccttccagcccagac

SEQ ID NO: 389216 - DNA, 21 bp, Homo sapiens
tgccttccaggcgtagggcca

SEQ ID NO: 389217 - DNA, 23 bp, Homo sapiens
tgccttccaggcgtagggccagg

SEQ ID NO: 389218 - DNA, 13 bp, Homo sapiens
tgccttccataat

SEQ ID NO: 389219 - DNA, 20 bp, Homo sapiens
tgccttccccttgaacctca

SEQ ID NO: 389220 - DNA, 22 bp, Homo sapiens
tgccttccccttgaacctcatt

SEQ ID NO: 389221 - DNA, 22 bp, Homo sapiens
tgccttccgtgggtcatcccag

SEQ ID NO: 389222 - DNA, 22 bp, Homo sapiens
tgccttctagattcactgtctt

SEQ ID NO: 389223 - DNA, 13 bp, Homo sapiens
tgccttctcttct

SEQ ID NO: 389224 - DNA, 20 bp, Homo sapiens
tgccttctgacggccctgca

SEQ ID NO: 389225 - DNA, 14 bp, Homo sapiens
tgccttcttcaccc

SEQ ID NO: 389226 - DNA, 17 bp, Homo sapiens
tgccttcttcacccagc

SEQ ID NO: 389227 - DNA, 13 bp, Homo sapiens
tgccttctttact

SEQ ID NO: 389228 - DNA, 23 bp, Homo sapiens
tgccttgagacccccaagcttcc

SEQ ID NO: 389229 - DNA, 16 bp, Homo sapiens
tgccttgagcttttca

SEQ ID NO: 389230 - DNA, 16 bp, Homo sapiens
tgccttgatggagaag

SEQ ID NO: 389231 - DNA, 22 bp, Homo sapiens
tgccttgatggagaaggaaaag

SEQ ID NO: 389232 - DNA, 12 bp, Homo sapiens
tgccttgcattt

SEQ ID NO: 389233 - DNA, 13 bp, Homo sapiens
tgccttgcatttg

SEQ ID NO: 389234 - DNA, 15 bp, Homo sapiens
tgccttgcatttgta

SEQ ID NO: 389235 - DNA, 11 bp, Homo sapiens
tgccttgggct

SEQ ID NO: 389236 - DNA, 19 bp, Homo sapiens
tgccttggggaatttcctc

SEQ ID NO: 389237 - DNA, 20 bp, Homo sapiens
tgccttggggaatttcctct

SEQ ID NO: 389238 - DNA, 16 bp, Homo sapiens
tgccttggggacaaga

SEQ ID NO: 389239 - DNA, 18 bp, Homo sapiens
tgccttgtccctctcact

SEQ ID NO: 389240 - DNA, 19 bp, Homo sapiens
tgccttgtgtacagttatt

SEQ ID NO: 389241 - DNA, 18 bp, Homo sapiens
tgcctttagcgtgtaaat

SEQ ID NO: 389242 - DNA, 22 bp, Homo sapiens
tgcctttccccattcattcctg

SEQ ID NO: 389243 - DNA, 23 bp, Homo sapiens
tgcctttccccattcattcctga

SEQ ID NO: 389244 - DNA, 19 bp, Homo sapiens
tgcctttgagtttcctcag

SEQ ID NO: 389245 - DNA, 13 bp, Homo sapiens
tgcctttgatgtg

SEQ ID NO: 389246 - DNA, 21 bp, Homo sapiens
tgcctttgcagttggactctc

SEQ ID NO: 389247 - DNA, 17 bp, Homo sapiens
tgcctttgctcttataa

SEQ ID NO: 389248 - DNA, 18 bp, Homo sapiens
tgcctttgctcttataaa

SEQ ID NO: 389249 - DNA, 11 bp, Homo sapiens
tgcctttgtaa

SEQ ID NO: 389250 - DNA, 12 bp, Homo sapiens
tgcctttgtaag

SEQ ID NO: 389251 - DNA, 16 bp, Homo sapiens
tgcctttgtaagttat

SEQ ID NO: 389252 - DNA, 13 bp, Homo sapiens
tgccttttatagc

SEQ ID NO: 389253 - DNA, 17 bp, Homo sapiens
tgccttttatagctatt

SEQ ID NO: 389254 - DNA, 23 bp, Homo sapiens
tgccttttgggtttgccttaatt

SEQ ID NO: 389255 - DNA, 13 bp, Homo sapiens
tgcctttttcctt

SEQ ID NO: 389256 - DNA, 14 bp, Homo sapiens
tgcctttttcctta

SEQ ID NO: 389257 - DNA, 18 bp, Homo sapiens
tgcctttttgtttttgta

SEQ ID NO: 389258 - DNA, 21 bp, Homo sapiens
tgcctttttgtttttgtaaaa

SEQ ID NO: 389259 - DNA, 19 bp, Homo sapiens
tgcgaatgagctgggccct

SEQ ID NO: 389260 - DNA, 19 bp, Homo sapiens
tgcgagtgtgtgcatgtgt

SEQ ID NO: 389261 - DNA, 22 bp, Homo sapiens
tgcgagtgtgtgcatgtgtgtg

SEQ ID NO: 389262 - DNA, 15 bp, Homo sapiens
aatgcaaattaaagg

SEQ ID NO: 389263 - DNA, 9 bp, Homo sapiens
aatgcaaga

SEQ ID NO: 389264 - DNA, 17 bp, Homo sapiens
aatgcaagagaaggaga

SEQ ID NO: 389265 - DNA, 19 bp, Homo sapiens
aatgcacgtagctgaggcc

SEQ ID NO: 389266 - DNA, 16 bp, Homo sapiens
aatgcagacacacaac

SEQ ID NO: 389267 - DNA, 17 bp, Homo sapiens
aatgcagacacacaaca

SEQ ID NO: 389268 - DNA, 14 bp, Homo sapiens
aatgcagacattta

SEQ ID NO: 389269 - DNA, 16 bp, Homo sapiens
aatgcagattcctggg

SEQ ID NO: 389270 - DNA, 21 bp, Homo sapiens
aatgcagattcctgggcctgt

SEQ ID NO: 389271 - DNA, 14 bp, Homo sapiens
aatgcagtataaaa

SEQ ID NO: 389272 - DNA, 15 bp, Homo sapiens
aatgcagttttaaga

SEQ ID NO: 389273 - DNA, 19 bp, Homo sapiens
aatgcatatcctgagccat

SEQ ID NO: 389274 - DNA, 14 bp, Homo sapiens
aatgcatgatattg

SEQ ID NO: 389275 - DNA, 19 bp, Homo sapiens
aatgcatgatattgtatgt

SEQ ID NO: 389276 - DNA, 20 bp, Homo sapiens
aatgcatgtaaggtcttctt

SEQ ID NO: 389277 - DNA, 21 bp, Homo sapiens
aatgcatgtaaggtcttcttg

SEQ ID NO: 389278 - DNA, 21 bp, Homo sapiens
aatgcattaccttctgttcct

SEQ ID NO: 389279 - DNA, 13 bp, Homo sapiens
aatgcattcaaaa

SEQ ID NO: 389280 - DNA, 17 bp, Homo sapiens
aatgcattgtcttgtgg

SEQ ID NO: 389281 - DNA, 12 bp, Homo sapiens
aatgcatttaaa

SEQ ID NO: 389282 - DNA, 20 bp, Homo sapiens
aatgcatttaaactcatttg

SEQ ID NO: 389283 - DNA, 21 bp, Homo sapiens
aatgcatttaaactcatttga

SEQ ID NO: 389284 - DNA, 18 bp, Homo sapiens
aatgcatttttaagaatt

SEQ ID NO: 389285 - DNA, 15 bp, Homo sapiens
aatgccacagccaag

SEQ ID NO: 389286 - DNA, 17 bp, Homo sapiens
aatgccacagccaagcc

SEQ ID NO: 389287 - DNA, 14 bp, Homo sapiens
aatgccagcccaaa

SEQ ID NO: 389288 - DNA, 22 bp, Homo sapiens
aatgccctcaggggacttgaat

SEQ ID NO: 389289 - DNA, 18 bp, Homo sapiens
aatgccctcctaaatgtc

SEQ ID NO: 389290 - DNA, 12 bp, Homo sapiens
aatgccctgcca

SEQ ID NO: 389291 - DNA, 15 bp, Homo sapiens
aatgccttgttgtat

SEQ ID NO: 389292 - DNA, 21 bp, Homo sapiens
aatgcgctcttcaccaggaag

SEQ ID NO: 389293 - DNA, 14 bp, Homo sapiens
aatgcgctttattg

SEQ ID NO: 389294 - DNA, 17 bp, Homo sapiens
aatgctaagggcaggcc

SEQ ID NO: 389295 - DNA, 21 bp, Homo sapiens
aatgctacctctgatcaaagc

SEQ ID NO: 389296 - DNA, 19 bp, Homo sapiens
aatgctagaaaatcgagtt

SEQ ID NO: 389297 - DNA, 12 bp, Homo sapiens
aatgctatggac

SEQ ID NO: 389298 - DNA, 14 bp, Homo sapiens
aatgctatggactg

SEQ ID NO: 389299 - DNA, 15 bp, Homo sapiens
aatgctatggactgc

SEQ ID NO: 389300 - DNA, 16 bp, Homo sapiens
aatgctatggactgca

SEQ ID NO: 389301 - DNA, 19 bp, Homo sapiens
aatgctatggactgcacaa

SEQ ID NO: 389302 - DNA, 18 bp, Homo sapiens
aatgctcaatgtgctgtt

SEQ ID NO: 389303 - DNA, 22 bp, Homo sapiens
aatgctgcacaccagttactgt

SEQ ID NO: 389304 - DNA, 14 bp, Homo sapiens
aatgctgcctgcct

SEQ ID NO: 389305 - DNA, 15 bp, Homo sapiens
aatgctgcctgcctg

SEQ ID NO: 389306 - DNA, 22 bp, Homo sapiens
aatgctgccttcccatgaatct

SEQ ID NO: 389307 - DNA, 19 bp, Homo sapiens
aatgctgcgcccttcccca

SEQ ID NO: 389308 - DNA, 15 bp, Homo sapiens
aatgctggttttcct

SEQ ID NO: 389309 - DNA, 23 bp, Homo sapiens
aatgctggttttcctaaatgcag

SEQ ID NO: 389310 - DNA, 12 bp, Homo sapiens
aatgctgtgtta

SEQ ID NO: 389311 - DNA, 15 bp, Homo sapiens
aatgcttctgagagc

SEQ ID NO: 389312 - DNA, 19 bp, Homo sapiens
aatgcttgatgagaagaac

SEQ ID NO: 389313 - DNA, 19 bp, Homo sapiens
aatgcttggaatatctgct

SEQ ID NO: 389314 - DNA, 22 bp, Homo sapiens
aatgcttggaatatctgctgta

SEQ ID NO: 389315 - DNA, 19 bp, Homo sapiens
aatgcttgtacagttgatg

SEQ ID NO: 389316 - DNA, 20 bp, Homo sapiens
aatgcttgtggattgagggt

SEQ ID NO: 389317 - DNA, 14 bp, Homo sapiens
aatgctttgattgt

SEQ ID NO: 389318 - DNA, 16 bp, Homo sapiens
tgctctcccctgccct

SEQ ID NO: 389319 - DNA, 17 bp, Homo sapiens
tgctctcccctgccctg

SEQ ID NO: 389320 - DNA, 21 bp, Homo sapiens
tgctctccctcttctcaagtg

SEQ ID NO: 389321 - DNA, 19 bp, Homo sapiens
tgctctcctaccccacctc

SEQ ID NO: 389322 - DNA, 16 bp, Homo sapiens
tgctctcctcttgcca

SEQ ID NO: 389323 - DNA, 15 bp, Homo sapiens
tgctctccttcactc

SEQ ID NO: 389324 - DNA, 18 bp, Homo sapiens
tgctctccttgccctggg

SEQ ID NO: 389325 - DNA, 21 bp, Homo sapiens
tgctctccttgccctgggcca

SEQ ID NO: 389326 - DNA, 14 bp, Homo sapiens
tgctctctacccag

SEQ ID NO: 389327 - DNA, 19 bp, Homo sapiens
tgctctctacccagcccat

SEQ ID NO: 389328 - DNA, 20 bp, Homo sapiens
tgctctctacccagcccatc

SEQ ID NO: 389329 - DNA, 20 bp, Homo sapiens
tgctctgagaagaggagccc

SEQ ID NO: 389330 - DNA, 23 bp, Homo sapiens
tgctctgagaagaggagccctca

SEQ ID NO: 389331 - DNA, 11 bp, Homo sapiens
tgctctgcagc

SEQ ID NO: 389332 - DNA, 14 bp, Homo sapiens
tgctctgcagccca

SEQ ID NO: 389333 - DNA, 11 bp, Homo sapiens
tgctctgccca

SEQ ID NO: 389334 - DNA, 12 bp, Homo sapiens
tgctctgcccag

SEQ ID NO: 389335 - DNA, 16 bp, Homo sapiens
tgctctgccccaagcc

SEQ ID NO: 389336 - DNA, 13 bp, Homo sapiens
tgctctggaagcc

SEQ ID NO: 389337 - DNA, 16 bp, Homo sapiens
tgctctggaagcctgc

SEQ ID NO: 389338 - DNA, 17 bp, Homo sapiens
tgctctggaagcctgct

SEQ ID NO: 389339 - DNA, 18 bp, Homo sapiens
tgctctggaagcctgctg

SEQ ID NO: 389340 - DNA, 13 bp, Homo sapiens
tgctctggcggct

SEQ ID NO: 389341 - DNA, 24 bp, Homo sapiens
tgctctggcggcttcctgtccact

SEQ ID NO: 389342 - DNA, 19 bp, Homo sapiens
tgctctggggatttctggg

SEQ ID NO: 389343 - DNA, 22 bp, Homo sapiens
tgctctgtccaattccagagct

SEQ ID NO: 389344 - DNA, 17 bp, Homo sapiens
tgctctgtgcctgggat

SEQ ID NO: 389345 - DNA, 23 bp, Homo sapiens
tgctctgtgcctgggatcagtgg

SEQ ID NO: 389346 - DNA, 18 bp, Homo sapiens
tgctctgttttgcatgga

SEQ ID NO: 389347 - DNA, 13 bp, Homo sapiens
tgctcttgcatct

SEQ ID NO: 389348 - DNA, 17 bp, Homo sapiens
tgctcttggaaagctga

SEQ ID NO: 389349 - DNA, 16 bp, Homo sapiens
tgctctttctactctg

SEQ ID NO: 389350 - DNA, 22 bp, Homo sapiens
tgctctttctctgccagtgaca

SEQ ID NO: 389351 - DNA, 21 bp, Homo sapiens
tgctctttcttcttccacaca

SEQ ID NO: 389352 - DNA, 24 bp, Homo sapiens
tgctctttgtggcagtggccaggc

SEQ ID NO: 389353 - DNA, 23 bp, Homo sapiens
tgctgaaaaccatctggcctggc

SEQ ID NO: 389354 - DNA, 15 bp, Homo sapiens
tgctgaaacaggaga

SEQ ID NO: 389355 - DNA, 18 bp, Homo sapiens
tgctgaacaaaaaataaa

SEQ ID NO: 389356 - DNA, 20 bp, Homo sapiens
tgctgaacaaaaaataaaaa

SEQ ID NO: 389357 - DNA, 14 bp, Homo sapiens
tgctgaactgtgca

SEQ ID NO: 389358 - DNA, 21 bp, Homo sapiens
tgctgaagcttattaatgcta

SEQ ID NO: 389359 - DNA, 23 bp, Homo sapiens
tgctgaagcttattaatgctaag

SEQ ID NO: 389360 - DNA, 18 bp, Homo sapiens
tgctgaagtacagtccca

SEQ ID NO: 389361 - DNA, 19 bp, Homo sapiens
tgctgaagtacagtcccag

SEQ ID NO: 389362 - DNA, 19 bp, Homo sapiens
tgctgaataacaacaattt

SEQ ID NO: 389363 - DNA, 14 bp, Homo sapiens
tgctgaatatctgt

SEQ ID NO: 389364 - DNA, 13 bp, Homo sapiens
tgctgaatgtcat

SEQ ID NO: 389365 - DNA, 14 bp, Homo sapiens
tgctgaccttggag

SEQ ID NO: 389366 - DNA, 22 bp, Homo sapiens
tgctgactgtactcctcccagg

SEQ ID NO: 389367 - DNA, 12 bp, Homo sapiens
tgctgagaaatg

SEQ ID NO: 389368 - DNA, 22 bp, Homo sapiens
tgctgagatgtttagtagctga

SEQ ID NO: 389369 - DNA, 12 bp, Homo sapiens
tgctgagccact

SEQ ID NO: 389370 - DNA, 13 bp, Homo sapiens
tgctgagccactc

SEQ ID NO: 389371 - DNA, 10 bp, Homo sapiens
tgctgagctt

SEQ ID NO: 389372 - DNA, 14 bp, Homo sapiens
tgctgagcttagcc

SEQ ID NO: 389373 - DNA, 21 bp, Homo sapiens
tgctgagcttagccttgtgcc

SEQ ID NO: 389374 - DNA, 10 bp, Homo sapiens
tgctgaggag

SEQ ID NO: 389375 - DNA, 18 bp, Homo sapiens
tgctgagggaccttggag

SEQ ID NO: 389376 - DNA, 16 bp, Homo sapiens
tgctgatgctgaaata

SEQ ID NO: 389377 - DNA, 16 bp, Homo sapiens
tgctgatggcttgaca

SEQ ID NO: 389378 - DNA, 17 bp, Homo sapiens
tgctgatgtaggagctg

SEQ ID NO: 389379 - DNA, 14 bp, Homo sapiens
tgctgcaatacatt

SEQ ID NO: 389380 - DNA, 20 bp, Homo sapiens
tgctgcacaccagttactgt

SEQ ID NO: 389381 - DNA, 14 bp, Homo sapiens
tgctgcaccagagt

SEQ ID NO: 389382 - DNA, 22 bp, Homo sapiens
tgctgcacctgaggcccagcag

SEQ ID NO: 389383 - DNA, 18 bp, Homo sapiens
tgctgcagacaaaaagaa

SEQ ID NO: 389384 - DNA, 13 bp, Homo sapiens
tgctgcagactca

SEQ ID NO: 389385 - DNA, 18 bp, Homo sapiens
tgctgcagtcatctactt

SEQ ID NO: 389386 - DNA, 15 bp, Homo sapiens
tgctgcatagctcta

SEQ ID NO: 389387 - DNA, 20 bp, Homo sapiens
tgctgcatagctctatttta

SEQ ID NO: 389388 - DNA, 20 bp, Homo sapiens
tgctgcatgcgacagcgtcc

SEQ ID NO: 389389 - DNA, 20 bp, Homo sapiens
tgctgccaagtcctgccttt

SEQ ID NO: 389390 - DNA, 19 bp, Homo sapiens
tgctgccacacttcaggct

SEQ ID NO: 389391 - DNA, 22 bp, Homo sapiens
tgctgccacacttcaggctctt

SEQ ID NO: 389392 - DNA, 17 bp, Homo sapiens
aatgtattttgaaaaca

SEQ ID NO: 389393 - DNA, 16 bp, Homo sapiens
aatgtcaaggtgctgt

SEQ ID NO: 389394 - DNA, 21 bp, Homo sapiens
aatgtcagtgtgactgatctc

SEQ ID NO: 389395 - DNA, 12 bp, Homo sapiens
aatgtcatctct

SEQ ID NO: 389396 - DNA, 18 bp, Homo sapiens
aatgtcattatgtagaaa

SEQ ID NO: 389397 - DNA, 22 bp, Homo sapiens
aatgtcattatttgataacatt

SEQ ID NO: 389398 - DNA, 15 bp, Homo sapiens
aatgtcatttgctaa

SEQ ID NO: 389399 - DNA, 21 bp, Homo sapiens
aatgtcatttgctaatgaatt

SEQ ID NO: 389400 - DNA, 18 bp, Homo sapiens
aatgtccatgatggaata

SEQ ID NO: 389401 - DNA, 22 bp, Homo sapiens
aatgtcccaaataaatttataa

SEQ ID NO: 389402 - DNA, 15 bp, Homo sapiens
aatgtcccccacctc

SEQ ID NO: 389403 - DNA, 18 bp, Homo sapiens
aatgtcctccagaagcct

SEQ ID NO: 389404 - DNA, 16 bp, Homo sapiens
aatgtcctgcctttta

SEQ ID NO: 389405 - DNA, 22 bp, Homo sapiens
aatgtcctgtggtgacaggccc

SEQ ID NO: 389406 - DNA, 13 bp, Homo sapiens
aatgtcctttccc

SEQ ID NO: 389407 - DNA, 20 bp, Homo sapiens
aatgtcgagtatattattat

SEQ ID NO: 389408 - DNA, 23 bp, Homo sapiens
aatgtctgtagctcctcaactca

SEQ ID NO: 389409 - DNA, 21 bp, Homo sapiens
aatgtcttcatttcattgtat

SEQ ID NO: 389410 - DNA, 17 bp, Homo sapiens
aatgtcttgtaagcaaa

SEQ ID NO: 389411 - DNA, 18 bp, Homo sapiens
aatgtgatcaactgttca

SEQ ID NO: 389412 - DNA, 19 bp, Homo sapiens
aatgtgatcatctttgctg

SEQ ID NO: 389413 - DNA, 15 bp, Homo sapiens
aatgtgcagtgtctt

SEQ ID NO: 389414 - DNA, 12 bp, Homo sapiens
aatgtgcccctg

SEQ ID NO: 389415 - DNA, 22 bp, Homo sapiens
aatgtgccgtctttggttcctc

SEQ ID NO: 389416 - DNA, 22 bp, Homo sapiens
aatgtgctgcaaagagttatat

SEQ ID NO: 389417 - DNA, 18 bp, Homo sapiens
aatgtgctgttgattctt

SEQ ID NO: 389418 - DNA, 21 bp, Homo sapiens
aatgtgcttttccatctaaaa

SEQ ID NO: 389419 - DNA, 15 bp, Homo sapiens
aatgtggatgctctt

SEQ ID NO: 389420 - DNA, 18 bp, Homo sapiens
aatgtgggagcagcggtt

SEQ ID NO: 389421 - DNA, 19 bp, Homo sapiens
aatgtgggtagtcattctt

SEQ ID NO: 389422 - DNA, 17 bp, Homo sapiens
aatgtggtggcaataaa

SEQ ID NO: 389423 - DNA, 21 bp, Homo sapiens
aatgtgtatttactgtactaa

SEQ ID NO: 389424 - DNA, 13 bp, Homo sapiens
aatgttaacaact

SEQ ID NO: 389425 - DNA, 23 bp, Homo sapiens
aatgttaattcagcactgatttc

SEQ ID NO: 389426 - DNA, 18 bp, Homo sapiens
aatgttactgatcatgca

SEQ ID NO: 389427 - DNA, 22 bp, Homo sapiens
aatgttactgatcatgcattgt

SEQ ID NO: 389428 - DNA, 18 bp, Homo sapiens
aatgttagaattgatttc

SEQ ID NO: 389429 - DNA, 18 bp, Homo sapiens
aatgttagagtttaattt

SEQ ID NO: 389430 - DNA, 21 bp, Homo sapiens
aatgttagagtttaattttgt

SEQ ID NO: 389431 - DNA, 23 bp, Homo sapiens
aatgttatttgttattttcagta

SEQ ID NO: 389432 - DNA, 10 bp, Homo sapiens
aatgttcatt

SEQ ID NO: 389433 - DNA, 20 bp, Homo sapiens
aatgttcattctatgacaat

SEQ ID NO: 389434 - DNA, 21 bp, Homo sapiens
aatgttcattgtaatgttact

SEQ ID NO: 389435 - DNA, 20 bp, Homo sapiens
aatgttccctgcaccctgga

SEQ ID NO: 389436 - DNA, 14 bp, Homo sapiens
aatgttctgacatt

SEQ ID NO: 389437 - DNA, 19 bp, Homo sapiens
aatgttctgacattaacag

SEQ ID NO: 389438 - DNA, 20 bp, Homo sapiens
aatgttctgacattaacagt

SEQ ID NO: 389439 - DNA, 15 bp, Homo sapiens
aatgttctttaatgt

SEQ ID NO: 389440 - DNA, 23 bp, Homo sapiens
aatgttctttcctttcatcctca

SEQ ID NO: 389441 - DNA, 13 bp, Homo sapiens
aatgttgaccttt

SEQ ID NO: 389442 - DNA, 21 bp, Homo sapiens
aatgttggaactctgtgcagg

SEQ ID NO: 389443 - DNA, 22 bp, Homo sapiens
aatgttgtagttacctactgag

SEQ ID NO: 389444 - DNA, 16 bp, Homo sapiens
aatgtttaaatataaa

SEQ ID NO: 389445 - DNA, 21 bp, Homo sapiens
aatgtttaatatctgactgaa

SEQ ID NO: 389446 - DNA, 20 bp, Homo sapiens
aatgtttacactctttgtaa

SEQ ID NO: 389447 - DNA, 23 bp, Homo sapiens
aatgtttacactctttgtaagag

SEQ ID NO: 389448 - DNA, 15 bp, Homo sapiens
aatgtttatgagcca

SEQ ID NO: 389449 - DNA, 22 bp, Homo sapiens
aatgtttatgagccagacaaat

SEQ ID NO: 389450 - DNA, 14 bp, Homo sapiens
aatgtttccaggca

SEQ ID NO: 389451 - DNA, 13 bp, Homo sapiens
aatgtttccttta

SEQ ID NO: 389452 - DNA, 23 bp, Homo sapiens
aatgtttgccctgttcaaagtac

SEQ ID NO: 389453 - DNA, 12 bp, Homo sapiens
aatgtttgctat

SEQ ID NO: 389454 - DNA, 13 bp, Homo sapiens
aatgtttgtcatt

SEQ ID NO: 389455 - DNA, 20 bp, Homo sapiens
tgctggcacatttccccaga

SEQ ID NO: 389456 - DNA, 17 bp, Homo sapiens
tgctggccagcctgggg

SEQ ID NO: 389457 - DNA, 13 bp, Homo sapiens
tgctggcccctca

SEQ ID NO: 389458 - DNA, 18 bp, Homo sapiens
tgctggccgggcacagct

SEQ ID NO: 389459 - DNA, 19 bp, Homo sapiens
tgctggccgggcacagctg

SEQ ID NO: 389460 - DNA, 23 bp, Homo sapiens
tgctggcctcaaacagccacgag

SEQ ID NO: 389461 - DNA, 23 bp, Homo sapiens
tgctggcctgcgcctgcacctgc

SEQ ID NO: 389462 - DNA, 12 bp, Homo sapiens
tgctggcctgga

SEQ ID NO: 389463 - DNA, 18 bp, Homo sapiens
tgctggcctggatctccc

SEQ ID NO: 389464 - DNA, 16 bp, Homo sapiens
tgctggcggcgcagag

SEQ ID NO: 389465 - DNA, 17 bp, Homo sapiens
tgctggcggcgcagagg

SEQ ID NO: 389466 - DNA, 16 bp, Homo sapiens
tgctggctccacgccc

SEQ ID NO: 389467 - DNA, 16 bp, Homo sapiens
tgctggctcccagggc

SEQ ID NO: 389468 - DNA, 18 bp, Homo sapiens
tgctggctcccagggcca

SEQ ID NO: 389469 - DNA, 16 bp, Homo sapiens
tgctggctgaggcttg

SEQ ID NO: 389470 - DNA, 13 bp, Homo sapiens
tgctggctgcctt

SEQ ID NO: 389471 - DNA, 19 bp, Homo sapiens
tgctgggaaccccgcagcc

SEQ ID NO: 389472 - DNA, 21 bp, Homo sapiens
tgctgggaaccccgcagcccg

SEQ ID NO: 389473 - DNA, 23 bp, Homo sapiens
tgctgggaaccccgcagcccgtg

SEQ ID NO: 389474 - DNA, 15 bp, Homo sapiens
tgctgggactgagcc

SEQ ID NO: 389475 - DNA, 16 bp, Homo sapiens
tgctgggactgagcca

SEQ ID NO: 389476 - DNA, 15 bp, Homo sapiens
tgctgggcccagccg

SEQ ID NO: 389477 - DNA, 16 bp, Homo sapiens
tgctgggcctctgcct

SEQ ID NO: 389478 - DNA, 17 bp, Homo sapiens
tgctggggagtccctgc

SEQ ID NO: 389479 - DNA, 18 bp, Homo sapiens
tgctggggcatgtgtgcc

SEQ ID NO: 389480 - DNA, 16 bp, Homo sapiens
tgctgggtgcctccca

SEQ ID NO: 389481 - DNA, 15 bp, Homo sapiens
tgctgggtgggaatg

SEQ ID NO: 389482 - DNA, 14 bp, Homo sapiens
tgctggttttccta

SEQ ID NO: 389483 - DNA, 18 bp, Homo sapiens
tgctggttttggtttcca

SEQ ID NO: 389484 - DNA, 17 bp, Homo sapiens
tgctgtaacctgaagtc

SEQ ID NO: 389485 - DNA, 16 bp, Homo sapiens
tgctgtaactgctgag

SEQ ID NO: 389486 - DNA, 16 bp, Homo sapiens
tgctgtaagacggcct

SEQ ID NO: 389487 - DNA, 19 bp, Homo sapiens
tgctgtaagcacctgggct

SEQ ID NO: 389488 - DNA, 20 bp, Homo sapiens
tgctgtacccttccacctcc

SEQ ID NO: 389489 - DNA, 18 bp, Homo sapiens
tgctgtacctttctgaca

SEQ ID NO: 389490 - DNA, 16 bp, Homo sapiens
tgctgtatacaaacag

SEQ ID NO: 389491 - DNA, 22 bp, Homo sapiens
tgctgtatacaaacaggtgcta

SEQ ID NO: 389492 - DNA, 17 bp, Homo sapiens
tgctgtcattgtccatg

SEQ ID NO: 389493 - DNA, 14 bp, Homo sapiens
tgctgtcctgcagt

SEQ ID NO: 389494 - DNA, 12 bp, Homo sapiens
tgctgtctcctt

SEQ ID NO: 389495 - DNA, 17 bp, Homo sapiens
tgctgtctggctttccc

SEQ ID NO: 389496 - DNA, 17 bp, Homo sapiens
tgctgtgaaacagtgtg

SEQ ID NO: 389497 - DNA, 16 bp, Homo sapiens
tgctgtgaaatgactg

SEQ ID NO: 389498 - DNA, 19 bp, Homo sapiens
tgctgtgaccatttataat

SEQ ID NO: 389499 - DNA, 19 bp, Homo sapiens
tgctgtgaggaatgctctg

SEQ ID NO: 389500 - DNA, 23 bp, Homo sapiens
tgctgtgaggaatgctctgtgcc

SEQ ID NO: 389501 - DNA, 18 bp, Homo sapiens
tgctgtgaggctgtcctg

SEQ ID NO: 389502 - DNA, 19 bp, Homo sapiens
tgctgtgaggctgtcctgt

SEQ ID NO: 389503 - DNA, 16 bp, Homo sapiens
tgctgtgccaaagcag

SEQ ID NO: 389504 - DNA, 22 bp, Homo sapiens
tgctgtgccaaagcaggtcaga

SEQ ID NO: 389505 - DNA, 17 bp, Homo sapiens
tgctgtgccaggactgt

SEQ ID NO: 389506 - DNA, 13 bp, Homo sapiens
tgctgtgcctgct

SEQ ID NO: 389507 - DNA, 19 bp, Homo sapiens
tgctgtgcctgctagagca

SEQ ID NO: 389508 - DNA, 16 bp, Homo sapiens
tgctgtggttcctggg

SEQ ID NO: 389509 - DNA, 17 bp, Homo sapiens
tgctgtggttcctgggg

SEQ ID NO: 389510 - DNA, 18 bp, Homo sapiens
tgctgtgttaaataaacc

SEQ ID NO: 389511 - DNA, 14 bp, Homo sapiens
tgctgttactgtta

SEQ ID NO: 389512 - DNA, 18 bp, Homo sapiens
tgctgttgattctttcaa

SEQ ID NO: 389513 - DNA, 17 bp, Homo sapiens
tgctgttgccatagccc

SEQ ID NO: 389514 - DNA, 15 bp, Homo sapiens
tgctgttggcctcaa

SEQ ID NO: 389515 - DNA, 23 bp, Homo sapiens
tgctgttgtcattgctttactgg

SEQ ID NO: 389516 - DNA, 22 bp, Homo sapiens
tgctgtttagcttcctccagag

SEQ ID NO: 389517 - DNA, 16 bp, Homo sapiens
tgctgtttatatatat

SEQ ID NO: 389518 - DNA, 17 bp, Homo sapiens
tgctgttttatgtcata

SEQ ID NO: 389519 - DNA, 17 bp, Homo sapiens
tgctgttttttgttttt

SEQ ID NO: 389520 - DNA, 18 bp, Homo sapiens
tgcttaaaaatcattgat

SEQ ID NO: 389521 - DNA, 20 bp, Homo sapiens
gctgcctgccgcccaaagag

SEQ ID NO: 389522 - DNA, 21 bp, Homo sapiens
gctgcctgccggccgcccaga

SEQ ID NO: 389523 - DNA, 19 bp, Homo sapiens
gctgcctgcctccggccct

SEQ ID NO: 389524 - DNA, 13 bp, Homo sapiens
gctgcctgcctgt

SEQ ID NO: 389525 - DNA, 16 bp, Homo sapiens
gctgcctgcctgtctg

SEQ ID NO: 389526 - DNA, 17 bp, Homo sapiens
gctgcctggagaaagga

SEQ ID NO: 389527 - DNA, 12 bp, Homo sapiens
gctgcctggcgg

SEQ ID NO: 389528 - DNA, 16 bp, Homo sapiens
gctgcctggcgggcag

SEQ ID NO: 389529 - DNA, 22 bp, Homo sapiens
gctgcctggcgggcagcccctg

SEQ ID NO: 389530 - DNA, 23 bp, Homo sapiens
gctgcctggcgggcagcccctgc

SEQ ID NO: 389531 - DNA, 19 bp, Homo sapiens
gctgcctgtagttaggaaa

SEQ ID NO: 389532 - DNA, 21 bp, Homo sapiens
gctgccttcccatgaatctgt

SEQ ID NO: 389533 - DNA, 23 bp, Homo sapiens
gctgccttctgacggccctgcaa

SEQ ID NO: 389534 - DNA, 15 bp, Homo sapiens
gctgcgaccgccaga

SEQ ID NO: 389535 - DNA, 15 bp, Homo sapiens
gctgcgcctgcccgc

SEQ ID NO: 389536 - DNA, 17 bp, Homo sapiens
gctgcgcctgcccgccc

SEQ ID NO: 389537 - DNA, 18 bp, Homo sapiens
gctgcgcctgcccgcccg

SEQ ID NO: 389538 - DNA, 22 bp, Homo sapiens
gctgcgcctgcccgcccgccgg

SEQ ID NO: 389539 - DNA, 15 bp, Homo sapiens
gctgcggcacccttg

SEQ ID NO: 389540 - DNA, 16 bp, Homo sapiens
gctgcgggcccagctg

SEQ ID NO: 389541 - DNA, 18 bp, Homo sapiens
gctgcgggcccagctgag

SEQ ID NO: 389542 - DNA, 17 bp, Homo sapiens
gctgcggtgggcagcca

SEQ ID NO: 389543 - DNA, 20 bp, Homo sapiens
gctgctaatcttcagggcac

SEQ ID NO: 389544 - DNA, 17 bp, Homo sapiens
gctgctaccgccctggg

SEQ ID NO: 389545 - DNA, 18 bp, Homo sapiens
gctgctaccgccctgggc

SEQ ID NO: 389546 - DNA, 20 bp, Homo sapiens
gctgctaccgccctgggctg

SEQ ID NO: 389547 - DNA, 22 bp, Homo sapiens
gctgctaccgccctgggctgga

SEQ ID NO: 389548 - DNA, 19 bp, Homo sapiens
gctgctatgaaaatgagca

SEQ ID NO: 389549 - DNA, 14 bp, Homo sapiens
gctgctatgctgtt

SEQ ID NO: 389550 - DNA, 16 bp, Homo sapiens
gctgctcccagcctct

SEQ ID NO: 389551 - DNA, 13 bp, Homo sapiens
gctgctccccacc

SEQ ID NO: 389552 - DNA, 17 bp, Homo sapiens
gctgctccccacccgcc

SEQ ID NO: 389553 - DNA, 17 bp, Homo sapiens
gctgctccttccttcac

SEQ ID NO: 389554 - DNA, 18 bp, Homo sapiens
gctgctcgggaaggcctg

SEQ ID NO: 389555 - DNA, 19 bp, Homo sapiens
gctgctcgggaaggcctga

SEQ ID NO: 389556 - DNA, 21 bp, Homo sapiens
gctgctcgggaaggcctgagg

SEQ ID NO: 389557 - DNA, 13 bp, Homo sapiens
gctgctctagctg

SEQ ID NO: 389558 - DNA, 16 bp, Homo sapiens
gctgctctagctggca

SEQ ID NO: 389559 - DNA, 17 bp, Homo sapiens
gctgctctagctggcag

SEQ ID NO: 389560 - DNA, 12 bp, Homo sapiens
gctgctctatat

SEQ ID NO: 389561 - DNA, 13 bp, Homo sapiens
gctgctctgccca

SEQ ID NO: 389562 - DNA, 14 bp, Homo sapiens
gctgctctgcccag

SEQ ID NO: 389563 - DNA, 19 bp, Homo sapiens
gctgctctgcccagagctg

SEQ ID NO: 389564 - DNA, 21 bp, Homo sapiens
gctgctctgcccagagctggg

SEQ ID NO: 389565 - DNA, 22 bp, Homo sapiens
gctgctcttatgccatttgttt

SEQ ID NO: 389566 - DNA, 16 bp, Homo sapiens
gctgctgatgtaggag

SEQ ID NO: 389567 - DNA, 20 bp, Homo sapiens
gctgctgctaatcttcaggg

SEQ ID NO: 389568 - DNA, 12 bp, Homo sapiens
gctgctggagaa

SEQ ID NO: 389569 - DNA, 12 bp, Homo sapiens
gctgctggagga

SEQ ID NO: 389570 - DNA, 22 bp, Homo sapiens
gctgctggatgtcaccaagaag

SEQ ID NO: 389571 - DNA, 12 bp, Homo sapiens
gctgctggccag

SEQ ID NO: 389572 - DNA, 15 bp, Homo sapiens
gctgctggcttgcag

SEQ ID NO: 389573 - DNA, 23 bp, Homo sapiens
gctgctgtaaagttgaggggaga

SEQ ID NO: 389574 - DNA, 16 bp, Homo sapiens
gctgctgtaactgctg

SEQ ID NO: 389575 - DNA, 17 bp, Homo sapiens
gctgctgtaactgctga

SEQ ID NO: 389576 - DNA, 20 bp, Homo sapiens
gctgctgtaactgctgagcc

SEQ ID NO: 389577 - DNA, 22 bp, Homo sapiens
gctgctgtaactgctgagccac

SEQ ID NO: 389578 - DNA, 11 bp, Homo sapiens
gctgctgtgcc

SEQ ID NO: 389579 - DNA, 15 bp, Homo sapiens
gctgctgtgccagga

SEQ ID NO: 389580 - DNA, 22 bp, Homo sapiens
gctgctgtgccaggactgtgac

SEQ ID NO: 389581 - DNA, 18 bp, Homo sapiens
gctgctgtgctctgggga

SEQ ID NO: 389582 - DNA, 12 bp, Homo sapiens
gctgcttccagg

SEQ ID NO: 389583 - DNA, 12 bp, Homo sapiens
gctgcttccctc

SEQ ID NO: 389584 - DNA, 15 bp, Homo sapiens
gctgcttccctctgc

SEQ ID NO: 389585 - DNA, 17 bp, Homo sapiens
gctgcttctccacctcc

SEQ ID NO: 389586 - DNA, 14 bp, Homo sapiens
gctgcttctgggcc

SEQ ID NO: 389587 - DNA, 15 bp, Homo sapiens
gctgcttctgggcct

SEQ ID NO: 389588 - DNA, 14 bp, Homo sapiens
gctgcttctgtgca

SEQ ID NO: 389589 - DNA, 22 bp, Homo sapiens
gctgcttgaaacttcagccctg

SEQ ID NO: 389590 - DNA, 23 bp, Homo sapiens
gctgcttggacctcgtgctttaa

SEQ ID NO: 389591 - DNA, 23 bp, Homo sapiens
gctgctttaattgtgaattgata

SEQ ID NO: 389592 - DNA, 13 bp, Homo sapiens
gctgctttgcttc

SEQ ID NO: 389593 - DNA, 20 bp, Homo sapiens
gctgctttgttaccttaaaa

SEQ ID NO: 389594 - DNA, 19 bp, Homo sapiens
gctgcttttgatggctatg

SEQ ID NO: 389595 - DNA, 16 bp, Homo sapiens
gctggaaagaggagaa

SEQ ID NO: 389596 - DNA, 20 bp, Homo sapiens
gctggaaagaggagaaggag

SEQ ID NO: 389597 - DNA, 19 bp, Homo sapiens
tgcttggacctcgtgcttt

SEQ ID NO: 389598 - DNA, 20 bp, Homo sapiens
tgcttggacctcgtgcttta

SEQ ID NO: 389599 - DNA, 21 bp, Homo sapiens
tgcttggatccatacaaaact

SEQ ID NO: 389600 - DNA, 14 bp, Homo sapiens
tgcttggctgcccc

SEQ ID NO: 389601 - DNA, 17 bp, Homo sapiens
tgcttggctgccccaca

SEQ ID NO: 389602 - DNA, 14 bp, Homo sapiens
tgcttggctgtccc

SEQ ID NO: 389603 - DNA, 16 bp, Homo sapiens
tgcttggggcctggcg

SEQ ID NO: 389604 - DNA, 12 bp, Homo sapiens
tgcttgtaaaaa

SEQ ID NO: 389605 - DNA, 19 bp, Homo sapiens
tgcttgtaacaagaaaaca

SEQ ID NO: 389606 - DNA, 23 bp, Homo sapiens
tgcttgtcatccacacaacacca

SEQ ID NO: 389607 - DNA, 20 bp, Homo sapiens
tgcttgtgcctcccttccca

SEQ ID NO: 389608 - DNA, 23 bp, Homo sapiens
tgcttgtgcctcccttcccagtg

SEQ ID NO: 389609 - DNA, 15 bp, Homo sapiens
tgcttgtgttaagta

SEQ ID NO: 389610 - DNA, 18 bp, Homo sapiens
tgcttgtgttgggcccca

SEQ ID NO: 389611 - DNA, 14 bp, Homo sapiens
tgcttgttcttcct

SEQ ID NO: 389612 - DNA, 20 bp, Homo sapiens
tgcttgtttatgatatttct

SEQ ID NO: 389613 - DNA, 17 bp, Homo sapiens
tgctttaaagtacctgt

SEQ ID NO: 389614 - DNA, 21 bp, Homo sapiens
tgctttaaagtacctgtagtg

SEQ ID NO: 389615 - DNA, 20 bp, Homo sapiens
tgctttaattgtgaattgat

SEQ ID NO: 389616 - DNA, 20 bp, Homo sapiens
tgctttacaggatcatgtaa

SEQ ID NO: 389617 - DNA, 23 bp, Homo sapiens
tgctttacaggatcatgtaaatg

SEQ ID NO: 389618 - DNA, 20 bp, Homo sapiens
tgctttacatgctgtgctct

SEQ ID NO: 389619 - DNA, 18 bp, Homo sapiens
tgctttacctttattaat

SEQ ID NO: 389620 - DNA, 21 bp, Homo sapiens
tgctttacctttattaatgaa

SEQ ID NO: 389621 - DNA, 13 bp, Homo sapiens
tgctttatgctga

SEQ ID NO: 389622 - DNA, 14 bp, Homo sapiens
tgctttatgctgaa

SEQ ID NO: 389623 - DNA, 15 bp, Homo sapiens
tgctttatgctgaaa

SEQ ID NO: 389624 - DNA, 17 bp, Homo sapiens
tgctttcaacttaaatc

SEQ ID NO: 389625 - DNA, 20 bp, Homo sapiens
tgctttcaacttaaatcact

SEQ ID NO: 389626 - DNA, 19 bp, Homo sapiens
tgctttcaattacaaagca

SEQ ID NO: 389627 - DNA, 15 bp, Homo sapiens
tgctttcgtagcccc

SEQ ID NO: 389628 - DNA, 18 bp, Homo sapiens
tgctttcgtagcccctgc

SEQ ID NO: 389629 - DNA, 21 bp, Homo sapiens
tgctttctattacccctcatt

SEQ ID NO: 389630 - DNA, 15 bp, Homo sapiens
tgctttctcaaaatt

SEQ ID NO: 389631 - DNA, 14 bp, Homo sapiens
tgctttctctttca

SEQ ID NO: 389632 - DNA, 17 bp, Homo sapiens
tgctttcttgccacaca

SEQ ID NO: 389633 - DNA, 14 bp, Homo sapiens
tgctttgaagcagt

SEQ ID NO: 389634 - DNA, 15 bp, Homo sapiens
tgctttgaagcagtt

SEQ ID NO: 389635 - DNA, 14 bp, Homo sapiens
tgctttgcacagga

SEQ ID NO: 389636 - DNA, 12 bp, Homo sapiens
tgctttgctgct

SEQ ID NO: 389637 - DNA, 16 bp, Homo sapiens
tgctttgctgctatga

SEQ ID NO: 389638 - DNA, 20 bp, Homo sapiens
tgctttgctggagtcctgtt

SEQ ID NO: 389639 - DNA, 16 bp, Homo sapiens
tgctttggatacacac

SEQ ID NO: 389640 - DNA, 15 bp, Homo sapiens
tgctttggctgactg

SEQ ID NO: 389641 - DNA, 16 bp, Homo sapiens
tgctttggctgactgg

SEQ ID NO: 389642 - DNA, 17 bp, Homo sapiens
tgctttgggaggccaag

SEQ ID NO: 389643 - DNA, 15 bp, Homo sapiens
tgctttgggctgccc

SEQ ID NO: 389644 - DNA, 16 bp, Homo sapiens
tgctttgggctgccct

SEQ ID NO: 389645 - DNA, 19 bp, Homo sapiens
tgctttgggctgccctggt

SEQ ID NO: 389646 - DNA, 19 bp, Homo sapiens
tgctttgggctttgcaggc

SEQ ID NO: 389647 - DNA, 23 bp, Homo sapiens
tgctttgggctttgcaggctctg

SEQ ID NO: 389648 - DNA, 16 bp, Homo sapiens
tgctttgtagcttaaa

SEQ ID NO: 389649 - DNA, 24 bp, Homo sapiens
tgctttgtccatgatgtccttgtt

SEQ ID NO: 389650 - DNA, 21 bp, Homo sapiens
tgctttgttaccttaaaacta

SEQ ID NO: 389651 - DNA, 20 bp, Homo sapiens
gctggccgagggtcctggct

SEQ ID NO: 389652 - DNA, 24 bp, Homo sapiens
gctggccgagggtcctggctcctg

SEQ ID NO: 389653 - DNA, 15 bp, Homo sapiens
gctggccgggcacag

SEQ ID NO: 389654 - DNA, 21 bp, Homo sapiens
gctggccgggttggaggcctc

SEQ ID NO: 389655 - DNA, 18 bp, Homo sapiens
gctggccggtccaccccg

SEQ ID NO: 389656 - DNA, 12 bp, Homo sapiens
gctggcctcaga

SEQ ID NO: 389657 - DNA, 13 bp, Homo sapiens
gctggcctcagac

SEQ ID NO: 389658 - DNA, 15 bp, Homo sapiens
gctggcctggatctc

SEQ ID NO: 389659 - DNA, 13 bp, Homo sapiens
gctggccttcctg

SEQ ID NO: 389660 - DNA, 23 bp, Homo sapiens
gctggccttcctgccctacagag

SEQ ID NO: 389661 - DNA, 15 bp, Homo sapiens
gctggcggaacctgg

SEQ ID NO: 389662 - DNA, 17 bp, Homo sapiens
gctggcggaacctggct

SEQ ID NO: 389663 - DNA, 18 bp, Homo sapiens
gctggcggaacctggctg

SEQ ID NO: 389664 - DNA, 16 bp, Homo sapiens
gctggcggcgcagagg

SEQ ID NO: 389665 - DNA, 17 bp, Homo sapiens
gctggcggcgcagaggg

SEQ ID NO: 389666 - DNA, 17 bp, Homo sapiens
gctggctcccagggcca

SEQ ID NO: 389667 - DNA, 17 bp, Homo sapiens
gctggctccccaaaggg

SEQ ID NO: 389668 - DNA, 23 bp, Homo sapiens
gctggctgaggcttgggcccagt

SEQ ID NO: 389669 - DNA, 11 bp, Homo sapiens
gctggctgggg

SEQ ID NO: 389670 - DNA, 21 bp, Homo sapiens
gctggctgggggcctcactcc

SEQ ID NO: 389671 - DNA, 23 bp, Homo sapiens
gctggcttccagcgggccctctg

SEQ ID NO: 389672 - DNA, 15 bp, Homo sapiens
gctggcttctccctg

SEQ ID NO: 389673 - DNA, 22 bp, Homo sapiens
gctggctttttgtcaaataaaa

SEQ ID NO: 389674 - DNA, 15 bp, Homo sapiens
gctgggaagaatgta

SEQ ID NO: 389675 - DNA, 12 bp, Homo sapiens
gctgggaccctc

SEQ ID NO: 389676 - DNA, 15 bp, Homo sapiens
gctgggactgagcca

SEQ ID NO: 389677 - DNA, 16 bp, Homo sapiens
gctgggagaaaagcca

SEQ ID NO: 389678 - DNA, 19 bp, Homo sapiens
gctgggagaaaagccagat

SEQ ID NO: 389679 - DNA, 15 bp, Homo sapiens
gctgggagaaggtgc

SEQ ID NO: 389680 - DNA, 10 bp, Homo sapiens
gctgggagag

SEQ ID NO: 389681 - DNA, 11 bp, Homo sapiens
gctgggagagc

SEQ ID NO: 389682 - DNA, 12 bp, Homo sapiens
gctgggagagcc

SEQ ID NO: 389683 - DNA, 16 bp, Homo sapiens
gctgggagctctgcag

SEQ ID NO: 389684 - DNA, 16 bp, Homo sapiens
gctgggagggggccct

SEQ ID NO: 389685 - DNA, 18 bp, Homo sapiens
gctgggatagaggggtca

SEQ ID NO: 389686 - DNA, 17 bp, Homo sapiens
gctgggattacagggat

SEQ ID NO: 389687 - DNA, 23 bp, Homo sapiens
gctgggatttcttcgctgctcta

SEQ ID NO: 389688 - DNA, 15 bp, Homo sapiens
gctgggcaaagccac

SEQ ID NO: 389689 - DNA, 12 bp, Homo sapiens
gctgggcagctg

SEQ ID NO: 389690 - DNA, 14 bp, Homo sapiens
gctgggcagctgtt

SEQ ID NO: 389691 - DNA, 18 bp, Homo sapiens
gctgggcagggccgcagg

SEQ ID NO: 389692 - DNA, 17 bp, Homo sapiens
gctgggcaggtcctggg

SEQ ID NO: 389693 - DNA, 18 bp, Homo sapiens
gctgggcaggtcctgggg

SEQ ID NO: 389694 - DNA, 12 bp, Homo sapiens
gctgggcccaga

SEQ ID NO: 389695 - DNA, 14 bp, Homo sapiens
gctgggcccagagg

SEQ ID NO: 389696 - DNA, 19 bp, Homo sapiens
gctgggcccagaggcacag

SEQ ID NO: 389697 - DNA, 14 bp, Homo sapiens
gctgggcccagccg

SEQ ID NO: 389698 - DNA, 16 bp, Homo sapiens
gctgggcccagccggg

SEQ ID NO: 389699 - DNA, 19 bp, Homo sapiens
gctgggccccccagctcag

SEQ ID NO: 389700 - DNA, 21 bp, Homo sapiens
gctgggccccccagctcaggg

SEQ ID NO: 389701 - DNA, 18 bp, Homo sapiens
gctgggctgagcccctac

SEQ ID NO: 389702 - DNA, 19 bp, Homo sapiens
gctgggctgagcccctacc

SEQ ID NO: 389703 - DNA, 19 bp, Homo sapiens
gctgggctgttggctgggg

SEQ ID NO: 389704 - DNA, 16 bp, Homo sapiens
gctggggagggagaga

SEQ ID NO: 389705 - DNA, 14 bp, Homo sapiens
gctggggagtccct

SEQ ID NO: 389706 - DNA, 18 bp, Homo sapiens
gctggggcagaggggcag

SEQ ID NO: 389707 - DNA, 19 bp, Homo sapiens
gctggggcagaggggcagc

SEQ ID NO: 389708 - DNA, 20 bp, Homo sapiens
gctggggcagaggggcagcc

SEQ ID NO: 389709 - DNA, 13 bp, Homo sapiens
gctggggccacaa

SEQ ID NO: 389710 - DNA, 20 bp, Homo sapiens
gctggggcccctcggctacc

SEQ ID NO: 389711 - DNA, 13 bp, Homo sapiens
gctggggcctggc

SEQ ID NO: 389712 - DNA, 15 bp, Homo sapiens
gctggggcctggcct

SEQ ID NO: 389713 - DNA, 14 bp, Homo sapiens
gctggggctggcac

SEQ ID NO: 389714 - DNA, 19 bp, Homo sapiens
gctgggggcatgggggagg

SEQ ID NO: 389715 - DNA, 16 bp, Homo sapiens
gctgggggccatgagc

SEQ ID NO: 389716 - DNA, 23 bp, Homo sapiens
gctgggggccatgagctccagac

SEQ ID NO: 389717 - DNA, 14 bp, Homo sapiens
gctgggggcctcac

SEQ ID NO: 389718 - DNA, 22 bp, Homo sapiens
gctgggggtgaggggccaggcc

SEQ ID NO: 389719 - DNA, 21 bp, Homo sapiens
gctgggtaaactgtggatgat

SEQ ID NO: 389720 - DNA, 22 bp, Homo sapiens
gctgggtaatgtgaaggcccaa

SEQ ID NO: 389721 - DNA, 17 bp, Homo sapiens
gctgggtcggccctgcc

SEQ ID NO: 389722 - DNA, 19 bp, Homo sapiens
gctgggtcggccctgccca

SEQ ID NO: 389723 - DNA, 15 bp, Homo sapiens
gctgggtgcccacag

SEQ ID NO: 389724 - DNA, 16 bp, Homo sapiens
gctgggtgcccacagc

SEQ ID NO: 389725 - DNA, 20 bp, Homo sapiens
gctgggtgtattaggactgg

SEQ ID NO: 389726 - DNA, 20 bp, Homo sapiens
gctgggtttccacacagcct

SEQ ID NO: 389727 - DNA, 15 bp, Homo sapiens
gctggtaaactattt

SEQ ID NO: 389728 - DNA, 13 bp, Homo sapiens
gctggtagttagt

SEQ ID NO: 389729 - DNA, 17 bp, Homo sapiens
gctggtattctctctat

SEQ ID NO: 389730 - DNA, 19 bp, Homo sapiens
gctggtattctctctatgc

SEQ ID NO: 389731 - DNA, 18 bp, Homo sapiens
gctggtcactgccatgga

SEQ ID NO: 389732 - DNA, 14 bp, Homo sapiens
gctggtccagggct

SEQ ID NO: 389733 - DNA, 19 bp, Homo sapiens
gctggtctcaaactcctga

SEQ ID NO: 389734 - DNA, 15 bp, Homo sapiens
gctggtgacagcctt

SEQ ID NO: 389735 - DNA, 13 bp, Homo sapiens
gctggtgcattac

SEQ ID NO: 389736 - DNA, 21 bp, Homo sapiens
tggaaggagagaggttgagga

SEQ ID NO: 389737 - DNA, 13 bp, Homo sapiens
tggaaggagcctg

SEQ ID NO: 389738 - DNA, 14 bp, Homo sapiens
tggaaggctggctg

SEQ ID NO: 389739 - DNA, 15 bp, Homo sapiens
tggaaggctggctga

SEQ ID NO: 389740 - DNA, 17 bp, Homo sapiens
tggaagggaagaaaagg

SEQ ID NO: 389741 - DNA, 15 bp, Homo sapiens
tggaagggactagga

SEQ ID NO: 389742 - DNA, 18 bp, Homo sapiens
tggaagggttctggctgc

SEQ ID NO: 389743 - DNA, 22 bp, Homo sapiens
tggaaggtccgagtctttttag

SEQ ID NO: 389744 - DNA, 18 bp, Homo sapiens
tggaagtactataattta

SEQ ID NO: 389745 - DNA, 14 bp, Homo sapiens
tggaagtatttgag

SEQ ID NO: 389746 - DNA, 12 bp, Homo sapiens
tggaagtctcaa

SEQ ID NO: 389747 - DNA, 13 bp, Homo sapiens
tggaagtctgcgc

SEQ ID NO: 389748 - DNA, 16 bp, Homo sapiens
tggaagtttgtgttct

SEQ ID NO: 389749 - DNA, 17 bp, Homo sapiens
tggaataaggagaatga

SEQ ID NO: 389750 - DNA, 18 bp, Homo sapiens
tggaatagggaactgtaa

SEQ ID NO: 389751 - DNA, 22 bp, Homo sapiens
tggaatatctgctgtatgtcaa

SEQ ID NO: 389752 - DNA, 18 bp, Homo sapiens
tggaatcccacttatcaa

SEQ ID NO: 389753 - DNA, 15 bp, Homo sapiens
tggaatcccagctcc

SEQ ID NO: 389754 - DNA, 20 bp, Homo sapiens
tggaatcttctctttgacaa

SEQ ID NO: 389755 - DNA, 18 bp, Homo sapiens
tggaatgacatgtgtcaa

SEQ ID NO: 389756 - DNA, 17 bp, Homo sapiens
tggaatggggacctggg

SEQ ID NO: 389757 - DNA, 20 bp, Homo sapiens
tggaatgtgcccctggccca

SEQ ID NO: 389758 - DNA, 15 bp, Homo sapiens
tggaattaaaacaat

SEQ ID NO: 389759 - DNA, 17 bp, Homo sapiens
tggaattaacctggtgc

SEQ ID NO: 389760 - DNA, 22 bp, Homo sapiens
tggaattacctgataagggaga

SEQ ID NO: 389761 - DNA, 15 bp, Homo sapiens
tggaattatgtataa

SEQ ID NO: 389762 - DNA, 13 bp, Homo sapiens
tggaattcagcac

SEQ ID NO: 389763 - DNA, 17 bp, Homo sapiens
tggaattcagcaccctg

SEQ ID NO: 389764 - DNA, 20 bp, Homo sapiens
tggaattcagcaccctgggt

SEQ ID NO: 389765 - DNA, 18 bp, Homo sapiens
tggaattggtgtatatca

SEQ ID NO: 389766 - DNA, 17 bp, Homo sapiens
tggaatttgtaacctca

SEQ ID NO: 389767 - DNA, 18 bp, Homo sapiens
tggaatttgtaacctcag

SEQ ID NO: 389768 - DNA, 14 bp, Homo sapiens
tggaatttgtaagt

SEQ ID NO: 389769 - DNA, 16 bp, Homo sapiens
tggacaagaagctgct

SEQ ID NO: 389770 - DNA, 17 bp, Homo sapiens
tggacaagaagctgcta

SEQ ID NO: 389771 - DNA, 13 bp, Homo sapiens
tggacaaggaagg

SEQ ID NO: 389772 - DNA, 13 bp, Homo sapiens
tggacacccctgc

SEQ ID NO: 389773 - DNA, 15 bp, Homo sapiens
tggacaccggaaaca

SEQ ID NO: 389774 - DNA, 13 bp, Homo sapiens
tggacacctgccc

SEQ ID NO: 389775 - DNA, 14 bp, Homo sapiens
tggacacctgccct

SEQ ID NO: 389776 - DNA, 15 bp, Homo sapiens
tggacacctgccctg

SEQ ID NO: 389777 - DNA, 16 bp, Homo sapiens
tggacacctgccctgc

SEQ ID NO: 389778 - DNA, 23 bp, Homo sapiens
tggacacctgccctgccctgcca

SEQ ID NO: 389779 - DNA, 22 bp, Homo sapiens
tggacacgcgtgattgaccctt

SEQ ID NO: 389780 - DNA, 14 bp, Homo sapiens
tggacactgtggaa

SEQ ID NO: 389781 - DNA, 17 bp, Homo sapiens
tggacacttaattctgt

SEQ ID NO: 389782 - DNA, 20 bp, Homo sapiens
tggaggaaggtgctgagctt

SEQ ID NO: 389783 - DNA, 17 bp, Homo sapiens
tggaggaatgctccccc

SEQ ID NO: 389784 - DNA, 13 bp, Homo sapiens
tggaggaggaggc

SEQ ID NO: 389785 - DNA, 14 bp, Homo sapiens
tggaggaggaggca

SEQ ID NO: 389786 - DNA, 15 bp, Homo sapiens
tggaggaggaggcaa

SEQ ID NO: 389787 - DNA, 21 bp, Homo sapiens
tggaggatgaatagatgtgat

SEQ ID NO: 389788 - DNA, 22 bp, Homo sapiens
tggaggcacacagctgcagaga

SEQ ID NO: 389789 - DNA, 17 bp, Homo sapiens
tggaggcattcccagag

SEQ ID NO: 389790 - DNA, 15 bp, Homo sapiens
tggaggccaagcctg

SEQ ID NO: 389791 - DNA, 20 bp, Homo sapiens
tggaggcccttttctggctc

SEQ ID NO: 389792 - DNA, 22 bp, Homo sapiens
tggaggcccttttctggctcct

SEQ ID NO: 389793 - DNA, 12 bp, Homo sapiens
tggaggcctcac

SEQ ID NO: 389794 - DNA, 19 bp, Homo sapiens
tggaggcctggtctggagc

SEQ ID NO: 389795 - DNA, 21 bp, Homo sapiens
tggaggcctggtctggagccc

SEQ ID NO: 389796 - DNA, 20 bp, Homo sapiens
tggagggattgaacacaggc

SEQ ID NO: 389797 - DNA, 21 bp, Homo sapiens
tggagggattgaacacaggca

SEQ ID NO: 389798 - DNA, 22 bp, Homo sapiens
tggagggattgaacacaggcaa

SEQ ID NO: 389799 - DNA, 21 bp, Homo sapiens
tggagggttgatatattcttt

SEQ ID NO: 389800 - DNA, 20 bp, Homo sapiens
tggaggtacgaaaagagggg

SEQ ID NO: 389801 - DNA, 15 bp, Homo sapiens
tggaggtatttgaaa

SEQ ID NO: 389802 - DNA, 22 bp, Homo sapiens
tggaggtgagatcacagcctcc

SEQ ID NO: 389803 - DNA, 23 bp, Homo sapiens
tggaggtgagatcacagcctcca

SEQ ID NO: 389804 - DNA, 12 bp, Homo sapiens
tggaggtgatga

SEQ ID NO: 389805 - DNA, 13 bp, Homo sapiens
tggaggtgggcat

SEQ ID NO: 389806 - DNA, 14 bp, Homo sapiens
tggaggtgggcatg

SEQ ID NO: 389807 - DNA, 16 bp, Homo sapiens
tggaggtggggcatgg

SEQ ID NO: 389808 - DNA, 19 bp, Homo sapiens
tggaggttctcagagccaa

SEQ ID NO: 389809 - DNA, 23 bp, Homo sapiens
tggaggttctcagagccaagtcc

SEQ ID NO: 389810 - DNA, 21 bp, Homo sapiens
tggaggttgccgtgagccaag

SEQ ID NO: 389811 - DNA, 14 bp, Homo sapiens
tggagtcagatgag

SEQ ID NO: 389812 - DNA, 23 bp, Homo sapiens
tggagtcagatgagcaaggacat

SEQ ID NO: 389813 - DNA, 22 bp, Homo sapiens
tggagtcagtttttttaaaaag

SEQ ID NO: 389814 - DNA, 19 bp, Homo sapiens
tggagtccagacctgggcc

SEQ ID NO: 389815 - DNA, 23 bp, Homo sapiens
tggagtccagacctgggccctgg

SEQ ID NO: 389816 - DNA, 18 bp, Homo sapiens
tggagtctgaaggagagg

SEQ ID NO: 389817 - DNA, 19 bp, Homo sapiens
tggagtctgaaggagagga

SEQ ID NO: 389818 - DNA, 21 bp, Homo sapiens
tggagtctgaaggagaggagt

SEQ ID NO: 389819 - DNA, 23 bp, Homo sapiens
tggagtctgaaggagaggagtgc

SEQ ID NO: 389820 - DNA, 22 bp, Homo sapiens
tggagtgaggcttccaggctct

SEQ ID NO: 389821 - DNA, 23 bp, Homo sapiens
tggagtgaggcttccaggctctt

SEQ ID NO: 389822 - DNA, 17 bp, Homo sapiens
tggagtgcaatgacaca

SEQ ID NO: 389823 - DNA, 15 bp, Homo sapiens
tggagtgcagggagg

SEQ ID NO: 389824 - DNA, 22 bp, Homo sapiens
tggagtgcgctcttggtccctg

SEQ ID NO: 389825 - DNA, 23 bp, Homo sapiens
tggagtgcgctcttggtccctgg

SEQ ID NO: 389826 - DNA, 14 bp, Homo sapiens
tggagtgctggctc

SEQ ID NO: 389827 - DNA, 14 bp, Homo sapiens
tggagtggaggcat

SEQ ID NO: 389828 - DNA, 15 bp, Homo sapiens
tggagtggaggcatt

SEQ ID NO: 389829 - DNA, 16 bp, Homo sapiens
tggagtggaggcattg

SEQ ID NO: 389830 - DNA, 19 bp, Homo sapiens
tggagtgtgtattgttccc

SEQ ID NO: 389831 - DNA, 20 bp, Homo sapiens
tggagtgtgtattgttccca

SEQ ID NO: 389832 - DNA, 20 bp, Homo sapiens
tggagtgtgtgggggtctgg

SEQ ID NO: 389833 - DNA, 20 bp, Homo sapiens
tggagttcatcttgaattgt

SEQ ID NO: 389834 - DNA, 15 bp, Homo sapiens
tggagttcccgtgca

SEQ ID NO: 389835 - DNA, 22 bp, Homo sapiens
tggagttgaaagagttaagaat

SEQ ID NO: 389836 - DNA, 13 bp, Homo sapiens
tggataaaacatt

SEQ ID NO: 389837 - DNA, 22 bp, Homo sapiens
tggatacaccgaatgaccaggt

SEQ ID NO: 389838 - DNA, 13 bp, Homo sapiens
tggatagatgccc

SEQ ID NO: 389839 - DNA, 17 bp, Homo sapiens
tggatagatgccctgct

SEQ ID NO: 389840 - DNA, 18 bp, Homo sapiens
tggataggagcttccaga

SEQ ID NO: 389841 - DNA, 19 bp, Homo sapiens
tggatatcgtcattttgca

SEQ ID NO: 389842 - DNA, 13 bp, Homo sapiens
tggatatctgtta

SEQ ID NO: 389843 - DNA, 14 bp, Homo sapiens
tggatatctgttag

SEQ ID NO: 389844 - DNA, 19 bp, Homo sapiens
tggatatgtgtaaatgtta

SEQ ID NO: 389845 - DNA, 13 bp, Homo sapiens
tggatattttcaa

SEQ ID NO: 389846 - DNA, 22 bp, Homo sapiens
tggatattttcaaattgtatct

SEQ ID NO: 389847 - DNA, 23 bp, Homo sapiens
tggatcaaaatctgtagagcagg

SEQ ID NO: 389848 - DNA, 20 bp, Homo sapiens
tggatcaagcttgtgtactt

SEQ ID NO: 389849 - DNA, 12 bp, Homo sapiens
tggatcacctgt

SEQ ID NO: 389850 - DNA, 12 bp, Homo sapiens
tggatcaggaaa

SEQ ID NO: 389851 - DNA, 20 bp, Homo sapiens
tggatcccctctgtctacaa

SEQ ID NO: 389852 - DNA, 16 bp, Homo sapiens
tggatcctgtgtggag

SEQ ID NO: 389853 - DNA, 18 bp, Homo sapiens
tggatctgctccatgcag

SEQ ID NO: 389854 - DNA, 18 bp, Homo sapiens
tggatctggagtctgaag

SEQ ID NO: 389855 - DNA, 22 bp, Homo sapiens
tggatgaagattctcctgtgct

SEQ ID NO: 389856 - DNA, 17 bp, Homo sapiens
tggatgaatgcagtata

SEQ ID NO: 389857 - DNA, 19 bp, Homo sapiens
tggatgcacagatgccatg

SEQ ID NO: 389858 - DNA, 21 bp, Homo sapiens
tggatgcagttgtatagtttt

SEQ ID NO: 389859 - DNA, 18 bp, Homo sapiens
tggatgccaaggagcccc

SEQ ID NO: 389860 - DNA, 19 bp, Homo sapiens
tggatgccaaggagcccct

SEQ ID NO: 389861 - DNA, 17 bp, Homo sapiens
tggatggaggtgatgaa

SEQ ID NO: 389862 - DNA, 13 bp, Homo sapiens
tggatggatctgc

SEQ ID NO: 389863 - DNA, 17 bp, Homo sapiens
tggatggccgggctgct

SEQ ID NO: 389864 - DNA, 14 bp, Homo sapiens
tggatgggagtggg

SEQ ID NO: 389865 - DNA, 18 bp, Homo sapiens
tggatgggcattgggctg

SEQ ID NO: 389866 - DNA, 23 bp, Homo sapiens
tggatgggcattgggctgacacc

SEQ ID NO: 389867 - DNA, 12 bp, Homo sapiens
tggatggtgact

SEQ ID NO: 389868 - DNA, 18 bp, Homo sapiens
tggatgtcccctgtccca

SEQ ID NO: 389869 - DNA, 14 bp, Homo sapiens
tggatgtcttcctt

SEQ ID NO: 389870 - DNA, 15 bp, Homo sapiens
tggattctatatttc

SEQ ID NO: 389871 - DNA, 21 bp, Homo sapiens
tggattctatatttcatattg

SEQ ID NO: 389872 - DNA, 14 bp, Homo sapiens
tggattctcagata

SEQ ID NO: 389873 - DNA, 13 bp, Homo sapiens
tggattctggatg

SEQ ID NO: 389874 - DNA, 15 bp, Homo sapiens
tggattggccaaaca

SEQ ID NO: 389875 - DNA, 22 bp, Homo sapiens
tggatttatgttgtatagatta

SEQ ID NO: 389876 - DNA, 20 bp, Homo sapiens
gcttattcatctgtttttct

SEQ ID NO: 389877 - DNA, 13 bp, Homo sapiens
gcttattgttcca

SEQ ID NO: 389878 - DNA, 22 bp, Homo sapiens
gcttatttatattcagagatgt

SEQ ID NO: 389879 - DNA, 13 bp, Homo sapiens
gcttatttctaac

SEQ ID NO: 389880 - DNA, 23 bp, Homo sapiens
gcttcaagtctgtgcctggagct

SEQ ID NO: 389881 - DNA, 21 bp, Homo sapiens
gcttcaagtgttgctcttgga

SEQ ID NO: 389882 - DNA, 21 bp, Homo sapiens
gcttcacacccctcagcgctc

SEQ ID NO: 389883 - DNA, 18 bp, Homo sapiens
gcttcacagtacttccca

SEQ ID NO: 389884 - DNA, 16 bp, Homo sapiens
gcttcaccagtctgtc

SEQ ID NO: 389885 - DNA, 17 bp, Homo sapiens
gcttcaccagtctgtct

SEQ ID NO: 389886 - DNA, 21 bp, Homo sapiens
gcttcaccagtctgtctactg

SEQ ID NO: 389887 - DNA, 17 bp, Homo sapiens
gcttcacccctgcactt

SEQ ID NO: 389888 - DNA, 20 bp, Homo sapiens
gcttcacccctgcacttcag

SEQ ID NO: 389889 - DNA, 15 bp, Homo sapiens
gcttcaccctgtcaa

SEQ ID NO: 389890 - DNA, 24 bp, Homo sapiens
gcttcacggactctttgctgttga

SEQ ID NO: 389891 - DNA, 19 bp, Homo sapiens
gcttcagcccctggggtac

SEQ ID NO: 389892 - DNA, 17 bp, Homo sapiens
gcttcagggctgggcag

SEQ ID NO: 389893 - DNA, 14 bp, Homo sapiens
gcttcagtctctgc

SEQ ID NO: 389894 - DNA, 14 bp, Homo sapiens
gcttcagtggagaa

SEQ ID NO: 389895 - DNA, 18 bp, Homo sapiens
gcttcagttgttttcccg

SEQ ID NO: 389896 - DNA, 15 bp, Homo sapiens
gcttcataggcagag

SEQ ID NO: 389897 - DNA, 21 bp, Homo sapiens
gcttcataggcagagcccgcc

SEQ ID NO: 389898 - DNA, 16 bp, Homo sapiens
gcttcatatctctccc

SEQ ID NO: 389899 - DNA, 13 bp, Homo sapiens
gcttcatgccttt

SEQ ID NO: 389900 - DNA, 17 bp, Homo sapiens
gcttcatgcctttgtaa

SEQ ID NO: 389901 - DNA, 17 bp, Homo sapiens
gcttccagatgtctaaa

SEQ ID NO: 389902 - DNA, 18 bp, Homo sapiens
gcttccagcgggccctct

SEQ ID NO: 389903 - DNA, 11 bp, Homo sapiens
gcttccaggat

SEQ ID NO: 389904 - DNA, 22 bp, Homo sapiens
gcttccaggataaggagactga

SEQ ID NO: 389905 - DNA, 13 bp, Homo sapiens
gcttccaggctct

SEQ ID NO: 389906 - DNA, 21 bp, Homo sapiens
gcttccaggctcttcctggac

SEQ ID NO: 389907 - DNA, 21 bp, Homo sapiens
gcttccagttggactgtggcc

SEQ ID NO: 389908 - DNA, 12 bp, Homo sapiens
gcttccattcca

SEQ ID NO: 389909 - DNA, 20 bp, Homo sapiens
gcttccatttgtgtgtgtgc

SEQ ID NO: 389910 - DNA, 20 bp, Homo sapiens
gcttcccaaactcccaggac

SEQ ID NO: 389911 - DNA, 15 bp, Homo sapiens
tggcaccgccttctc

SEQ ID NO: 389912 - DNA, 19 bp, Homo sapiens
tggcacctcctgagaaggc

SEQ ID NO: 389913 - DNA, 22 bp, Homo sapiens
tggcaccttcagactttgcttc

SEQ ID NO: 389914 - DNA, 15 bp, Homo sapiens
tggcacgcacctgta

SEQ ID NO: 389915 - DNA, 23 bp, Homo sapiens
tggcacgcacctgtagtcccagc

SEQ ID NO: 389916 - DNA, 19 bp, Homo sapiens
tggcactgactgggcatag

SEQ ID NO: 389917 - DNA, 17 bp, Homo sapiens
tggcagaaaagaggaga

SEQ ID NO: 389918 - DNA, 22 bp, Homo sapiens
tggcagaaaagaggagaccctg

SEQ ID NO: 389919 - DNA, 20 bp, Homo sapiens
tggcagaaatcccagttcat

SEQ ID NO: 389920 - DNA, 22 bp, Homo sapiens
tggcagaagcgtctcccttggc

SEQ ID NO: 389921 - DNA, 15 bp, Homo sapiens
tggcagaagggaatt

SEQ ID NO: 389922 - DNA, 19 bp, Homo sapiens
tggcagaagggaattgctc

SEQ ID NO: 389923 - DNA, 15 bp, Homo sapiens
tggcagagaagagac

SEQ ID NO: 389924 - DNA, 17 bp, Homo sapiens
tggcagagaaggcctct

SEQ ID NO: 389925 - DNA, 19 bp, Homo sapiens
tggcagaggggacagagtt

SEQ ID NO: 389926 - DNA, 17 bp, Homo sapiens
tggcagattttacaaaa

SEQ ID NO: 389927 - DNA, 15 bp, Homo sapiens
tggcagccagggagc

SEQ ID NO: 389928 - DNA, 20 bp, Homo sapiens
tggcagccatgcctcatgcc

SEQ ID NO: 389929 - DNA, 14 bp, Homo sapiens
tggcagccgagctc

SEQ ID NO: 389930 - DNA, 19 bp, Homo sapiens
tggcagccgtgccttcagc

SEQ ID NO: 389931 - DNA, 15 bp, Homo sapiens
tggcagcctcagggc

SEQ ID NO: 389932 - DNA, 16 bp, Homo sapiens
tggcagcctcagggct

SEQ ID NO: 389933 - DNA, 15 bp, Homo sapiens
tggcagcgcctcccg

SEQ ID NO: 389934 - DNA, 22 bp, Homo sapiens
tggcagcgcctcccgccgcctc

SEQ ID NO: 389935 - DNA, 24 bp, Homo sapiens
tggcagcgcctcccgccgcctcgg

SEQ ID NO: 389936 - DNA, 22 bp, Homo sapiens
tggcagctagactggagtgagg

SEQ ID NO: 389937 - DNA, 16 bp, Homo sapiens
tggcagctcctctcct

SEQ ID NO: 389938 - DNA, 17 bp, Homo sapiens
tggcagctcctctcctt

SEQ ID NO: 389939 - DNA, 23 bp, Homo sapiens
tggcagctcctctccttgggctc

SEQ ID NO: 389940 - DNA, 13 bp, Homo sapiens
tggcagctctcca

SEQ ID NO: 389941 - DNA, 14 bp, Homo sapiens
tggcagctctccag

SEQ ID NO: 389942 - DNA, 15 bp, Homo sapiens
tggcagctctccagt

SEQ ID NO: 389943 - DNA, 17 bp, Homo sapiens
tggcagctctccagtca

SEQ ID NO: 389944 - DNA, 13 bp, Homo sapiens
tggcagctgggga

SEQ ID NO: 389945 - DNA, 17 bp, Homo sapiens
tggcagctggggagcag

SEQ ID NO: 389946 - DNA, 14 bp, Homo sapiens
tggcagctgtcccc

SEQ ID NO: 389947 - DNA, 14 bp, Homo sapiens
tggcagcttcaaaa

SEQ ID NO: 389948 - DNA, 19 bp, Homo sapiens
tggcaggacacatcccggc

SEQ ID NO: 389949 - DNA, 19 bp, Homo sapiens
tggcaggagaatcagcctg

SEQ ID NO: 389950 - DNA, 19 bp, Homo sapiens
tggcagggaggtcaggccc

SEQ ID NO: 389951 - DNA, 21 bp, Homo sapiens
tggcagggaggtcaggccctg

SEQ ID NO: 389952 - DNA, 15 bp, Homo sapiens
tggcagggcaggcag

SEQ ID NO: 389953 - DNA, 17 bp, Homo sapiens
tggcagggcaggcagag

SEQ ID NO: 389954 - DNA, 19 bp, Homo sapiens
tggcagggcaggcagagct

SEQ ID NO: 389955 - DNA, 18 bp, Homo sapiens
tggcaggtgcagatgggc

SEQ ID NO: 389956 - DNA, 20 bp, Homo sapiens
tggcaggtgcagatgggctg

SEQ ID NO: 389957 - DNA, 17 bp, Homo sapiens
tggcaggtggccagggc

SEQ ID NO: 389958 - DNA, 17 bp, Homo sapiens
tggcagtcactgaattc

SEQ ID NO: 389959 - DNA, 14 bp, Homo sapiens
tggcagtggccagg

SEQ ID NO: 389960 - DNA, 15 bp, Homo sapiens
tggcagtggccaggc

SEQ ID NO: 389961 - DNA, 16 bp, Homo sapiens
tggcagtggccaggca

SEQ ID NO: 389962 - DNA, 13 bp, Homo sapiens
tggcagtgggaga

SEQ ID NO: 389963 - DNA, 16 bp, Homo sapiens
tggcatcgtagaagag

SEQ ID NO: 389964 - DNA, 21 bp, Homo sapiens
tggcatctctccccatatata

SEQ ID NO: 389965 - DNA, 15 bp, Homo sapiens
tggcatctgacacaa

SEQ ID NO: 389966 - DNA, 17 bp, Homo sapiens
tggcatgaagattttct

SEQ ID NO: 389967 - DNA, 15 bp, Homo sapiens
tggcatgggaatgaa

SEQ ID NO: 389968 - DNA, 22 bp, Homo sapiens
tggcatgggaatgaatgtcagt

SEQ ID NO: 389969 - DNA, 19 bp, Homo sapiens
tggcatggtggcacgtgcc

SEQ ID NO: 389970 - DNA, 19 bp, Homo sapiens
tggcatgtgaaaagtaaaa

SEQ ID NO: 389971 - DNA, 18 bp, Homo sapiens
tggcattctacacctgga

SEQ ID NO: 389972 - DNA, 19 bp, Homo sapiens
tggcattgtccctgtgcct

SEQ ID NO: 389973 - DNA, 15 bp, Homo sapiens
tggcatttgctgaat

SEQ ID NO: 389974 - DNA, 21 bp, Homo sapiens
tggcatttgtgatcatgagat

SEQ ID NO: 389975 - DNA, 19 bp, Homo sapiens
tggcatttttagctccttg

SEQ ID NO: 389976 - DNA, 22 bp, Homo sapiens
tggccaaaaagaatctgcattt

SEQ ID NO: 389977 - DNA, 19 bp, Homo sapiens
tggccaaacatcagacctg

SEQ ID NO: 389978 - DNA, 21 bp, Homo sapiens
tggccaaacatcagacctgtc

SEQ ID NO: 389979 - DNA, 14 bp, Homo sapiens
tggccaaagtgtta

SEQ ID NO: 389980 - DNA, 12 bp, Homo sapiens
tggccaaatatg

SEQ ID NO: 389981 - DNA, 17 bp, Homo sapiens
tggccaaatatgcactt

SEQ ID NO: 389982 - DNA, 19 bp, Homo sapiens
tggccaaatatgcactttc

SEQ ID NO: 389983 - DNA, 20 bp, Homo sapiens
tggccaaattatttgtgtaa

SEQ ID NO: 389984 - DNA, 22 bp, Homo sapiens
tggccaacatcgtgaaaccctg

SEQ ID NO: 389985 - DNA, 18 bp, Homo sapiens
tggccaacgtggacctgc

SEQ ID NO: 389986 - DNA, 16 bp, Homo sapiens
tggccaagggggtgga

SEQ ID NO: 389987 - DNA, 13 bp, Homo sapiens
tggccacagccac

SEQ ID NO: 389988 - DNA, 16 bp, Homo sapiens
tggccacagccacctc

SEQ ID NO: 389989 - DNA, 16 bp, Homo sapiens
tggccaccccgtgcca

SEQ ID NO: 389990 - DNA, 20 bp, Homo sapiens
tggccaccccgtgccacccg

SEQ ID NO: 389991 - DNA, 20 bp, Homo sapiens
tggccacctctctcctttgc

SEQ ID NO: 389992 - DNA, 14 bp, Homo sapiens
tggccacgcagcca

SEQ ID NO: 389993 - DNA, 15 bp, Homo sapiens
tggccacgcagccag

SEQ ID NO: 389994 - DNA, 17 bp, Homo sapiens
tggccacgcagccagga

SEQ ID NO: 389995 - DNA, 22 bp, Homo sapiens
tggccacggcctgggagggtgg

SEQ ID NO: 389996 - DNA, 20 bp, Homo sapiens
tggccactccagacccctgg

SEQ ID NO: 389997 - DNA, 19 bp, Homo sapiens
tggccactgggtctcactc

SEQ ID NO: 389998 - DNA, 21 bp, Homo sapiens
tggccactgggtctcactcct

SEQ ID NO: 389999 - DNA, 21 bp, Homo sapiens
tggccactttgcagacctggg

SEQ ID NO: 390000 - DNA, 15 bp, Homo sapiens
tggccagaccagagc

SEQ ID NO: 390001 - DNA, 13 bp, Homo sapiens
tggccagagagcc

SEQ ID NO: 390002 - DNA, 17 bp, Homo sapiens
tggccagagagggccca

SEQ ID NO: 390003 - DNA, 12 bp, Homo sapiens
tggccagagctg

SEQ ID NO: 390004 - DNA, 13 bp, Homo sapiens
tggccagagctgg

SEQ ID NO: 390005 - DNA, 14 bp, Homo sapiens
tggccagaggcttg

SEQ ID NO: 390006 - DNA, 17 bp, Homo sapiens
tggccagcaaggcaggt

SEQ ID NO: 390007 - DNA, 12 bp, Homo sapiens
tggccagcagct

SEQ ID NO: 390008 - DNA, 14 bp, Homo sapiens
tggccagcagcttg

SEQ ID NO: 390009 - DNA, 15 bp, Homo sapiens
tggccagcctggggc

SEQ ID NO: 390010 - DNA, 20 bp, Homo sapiens
tggccagcctggggcctggc

SEQ ID NO: 390011 - DNA, 21 bp, Homo sapiens
tggccagcctggggcctggca

SEQ ID NO: 390012 - DNA, 22 bp, Homo sapiens
tggccagcctggggcctggcag

SEQ ID NO: 390013 - DNA, 17 bp, Homo sapiens
gcttgtcagagctggga

SEQ ID NO: 390014 - DNA, 21 bp, Homo sapiens
gcttgtgcctcccttcccagt

SEQ ID NO: 390015 - DNA, 13 bp, Homo sapiens
gcttgtgggctgg

SEQ ID NO: 390016 - DNA, 13 bp, Homo sapiens
gcttgtgtacttg

SEQ ID NO: 390017 - DNA, 12 bp, Homo sapiens
gcttgtgttaag

SEQ ID NO: 390018 - DNA, 22 bp, Homo sapiens
gcttgtgttgggccccagggaa

SEQ ID NO: 390019 - DNA, 15 bp, Homo sapiens
gcttgttatttataa

SEQ ID NO: 390020 - DNA, 11 bp, Homo sapiens
gcttgttcttc

SEQ ID NO: 390021 - DNA, 21 bp, Homo sapiens
gcttgtttaaggttcttgctg

SEQ ID NO: 390022 - DNA, 23 bp, Homo sapiens
gcttgttttcttgccaatgaggt

SEQ ID NO: 390023 - DNA, 14 bp, Homo sapiens
gctttaacaaaaca

SEQ ID NO: 390024 - DNA, 21 bp, Homo sapiens
gctttaacaaaacaagaaaga

SEQ ID NO: 390025 - DNA, 23 bp, Homo sapiens
gctttaacaaaacaagaaagaaa

SEQ ID NO: 390026 - DNA, 16 bp, Homo sapiens
gctttaagctccagct

SEQ ID NO: 390027 - DNA, 23 bp, Homo sapiens
gctttaagctccagctttaaggg

SEQ ID NO: 390028 - DNA, 17 bp, Homo sapiens
gctttacaggatcatgt

SEQ ID NO: 390029 - DNA, 18 bp, Homo sapiens
gctttacaggatcatgta

SEQ ID NO: 390030 - DNA, 20 bp, Homo sapiens
gctttacatgctgtgctctt

SEQ ID NO: 390031 - DNA, 15 bp, Homo sapiens
gctttacattttatt

SEQ ID NO: 390032 - DNA, 20 bp, Homo sapiens
gctttacctttattaatgaa

SEQ ID NO: 390033 - DNA, 13 bp, Homo sapiens
gctttagagacag

SEQ ID NO: 390034 - DNA, 15 bp, Homo sapiens
gctttagagacaggg

SEQ ID NO: 390035 - DNA, 17 bp, Homo sapiens
gctttatgaagttaaca

SEQ ID NO: 390036 - DNA, 23 bp, Homo sapiens
gctttattttttaagtatttata

SEQ ID NO: 390037 - DNA, 21 bp, Homo sapiens
gctttcaacttaaatcactga

SEQ ID NO: 390038 - DNA, 15 bp, Homo sapiens
gctttcaagtgcctt

SEQ ID NO: 390039 - DNA, 13 bp, Homo sapiens
gctttcacaaata

SEQ ID NO: 390040 - DNA, 16 bp, Homo sapiens
gctttcagagccagtg

SEQ ID NO: 390041 - DNA, 12 bp, Homo sapiens
ggaacaggagga

SEQ ID NO: 390042 - DNA, 17 bp, Homo sapiens
ggaacaggaggaactgg

SEQ ID NO: 390043 - DNA, 18 bp, Homo sapiens
ggaacagtgtttcccata

SEQ ID NO: 390044 - DNA, 13 bp, Homo sapiens
ggaaccagagcca

SEQ ID NO: 390045 - DNA, 16 bp, Homo sapiens
ggaaccagccctccag

SEQ ID NO: 390046 - DNA, 19 bp, Homo sapiens
ggaaccagccctccagagc

SEQ ID NO: 390047 - DNA, 22 bp, Homo sapiens
ggaaccagccctccagagcagg

SEQ ID NO: 390048 - DNA, 23 bp, Homo sapiens
ggaaccagtaggttgaggacagg

SEQ ID NO: 390049 - DNA, 18 bp, Homo sapiens
ggaaccccgcagcccgtg

SEQ ID NO: 390050 - DNA, 17 bp, Homo sapiens
ggaacccggtcccaggc

SEQ ID NO: 390051 - DNA, 20 bp, Homo sapiens
ggaacctagtactctctgct

SEQ ID NO: 390052 - DNA, 12 bp, Homo sapiens
ggaacctccctg

SEQ ID NO: 390053 - DNA, 13 bp, Homo sapiens
ggaacctggacca

SEQ ID NO: 390054 - DNA, 19 bp, Homo sapiens
ggaacctggaccaaagctg

SEQ ID NO: 390055 - DNA, 22 bp, Homo sapiens
ggaacgagcactggccagagag

SEQ ID NO: 390056 - DNA, 13 bp, Homo sapiens
ggaacgcagcctc

SEQ ID NO: 390057 - DNA, 16 bp, Homo sapiens
ggaacgcagcctccag

SEQ ID NO: 390058 - DNA, 20 bp, Homo sapiens
ggaactagactgcctgggtt

SEQ ID NO: 390059 - DNA, 21 bp, Homo sapiens
ggaactcaaaggactgacctg

SEQ ID NO: 390060 - DNA, 13 bp, Homo sapiens
ggaactccactct

SEQ ID NO: 390061 - DNA, 19 bp, Homo sapiens
ggaactccactctccttcg

SEQ ID NO: 390062 - DNA, 23 bp, Homo sapiens
ggaactcccaagaacagcaggcc

SEQ ID NO: 390063 - DNA, 13 bp, Homo sapiens
ggaactccttggc

SEQ ID NO: 390064 - DNA, 16 bp, Homo sapiens
ggaactcgaacttgaa

SEQ ID NO: 390065 - DNA, 19 bp, Homo sapiens
ggaactctatctgggcctg

SEQ ID NO: 390066 - DNA, 23 bp, Homo sapiens
ggaactctatctgggcctgggct

SEQ ID NO: 390067 - DNA, 20 bp, Homo sapiens
ggaactctcctgctcctcag

SEQ ID NO: 390068 - DNA, 19 bp, Homo sapiens
ggaactgaagacctccaca

SEQ ID NO: 390069 - DNA, 13 bp, Homo sapiens
ggaactgggaaga

SEQ ID NO: 390070 - DNA, 19 bp, Homo sapiens
ggaactggtccaggccagg

SEQ ID NO: 390071 - DNA, 21 bp, Homo sapiens
ggaactggtccaggccaggcc

SEQ ID NO: 390072 - DNA, 19 bp, Homo sapiens
ggaactggtttttctgttc

SEQ ID NO: 390073 - DNA, 23 bp, Homo sapiens
ggaactggtttttctgttccctg

SEQ ID NO: 390074 - DNA, 21 bp, Homo sapiens
ggaacttgctgctgtgcctgc

SEQ ID NO: 390075 - DNA, 18 bp, Homo sapiens
ggaactttagggggtggg

SEQ ID NO: 390076 - DNA, 13 bp, Homo sapiens
ggaagaacataga

SEQ ID NO: 390077 - DNA, 14 bp, Homo sapiens
ggaagaacatagaa

SEQ ID NO: 390078 - DNA, 16 bp, Homo sapiens
ggaagaacatagaact

SEQ ID NO: 390079 - DNA, 16 bp, Homo sapiens
ggaagaagtatatttt

SEQ ID NO: 390080 - DNA, 21 bp, Homo sapiens
ggaagaccagctttgcagtga

SEQ ID NO: 390081 - DNA, 23 bp, Homo sapiens
ggaagaccccacccaagcttggc

SEQ ID NO: 390082 - DNA, 21 bp, Homo sapiens
ggaagacttagatctgagccc

SEQ ID NO: 390083 - DNA, 15 bp, Homo sapiens
ggaagacttggccca

SEQ ID NO: 390084 - DNA, 21 bp, Homo sapiens
ggaagacttggcccaggaaaa

SEQ ID NO: 390085 - DNA, 11 bp, Homo sapiens
ggaagagagag

SEQ ID NO: 390086 - DNA, 20 bp, Homo sapiens
ggaagagaggagttcaatga

SEQ ID NO: 390087 - DNA, 21 bp, Homo sapiens
ggaagagaggagttcaatgat

SEQ ID NO: 390088 - DNA, 18 bp, Homo sapiens
ggaagagaggcacctgct

SEQ ID NO: 390089 - DNA, 19 bp, Homo sapiens
ggaagagaggcacctgctg

SEQ ID NO: 390090 - DNA, 15 bp, Homo sapiens
ggaagaggccttggg

SEQ ID NO: 390091 - DNA, 18 bp, Homo sapiens
ggaagaggccttgggggt

SEQ ID NO: 390092 - DNA, 17 bp, Homo sapiens
ggaagaggttctcagca

SEQ ID NO: 390093 - DNA, 17 bp, Homo sapiens
ggaagataggctctgca

SEQ ID NO: 390094 - DNA, 21 bp, Homo sapiens
ggaagataggctctgcacaga

SEQ ID NO: 390095 - DNA, 18 bp, Homo sapiens
ggaagatcttgagagctg

SEQ ID NO: 390096 - DNA, 23 bp, Homo sapiens
ggaagatcttgagagctgctgag

SEQ ID NO: 390097 - DNA, 17 bp, Homo sapiens
ggaagatgctggcccca

SEQ ID NO: 390098 - DNA, 19 bp, Homo sapiens
ggaagcaagacgtcctgga

SEQ ID NO: 390099 - DNA, 14 bp, Homo sapiens
ggaagcaaggccag

SEQ ID NO: 390100 - DNA, 16 bp, Homo sapiens
ggaagcacaggccagg

SEQ ID NO: 390101 - DNA, 13 bp, Homo sapiens
ggaagcaccccat

SEQ ID NO: 390102 - DNA, 22 bp, Homo sapiens
ggaagcaccccatgccaaagct

SEQ ID NO: 390103 - DNA, 22 bp, Homo sapiens
ggaagcagatacatatgagtgt

SEQ ID NO: 390104 - DNA, 11 bp, Homo sapiens
ggaagcaggga

SEQ ID NO: 390105 - DNA, 15 bp, Homo sapiens
ggaagccacgtgctg

SEQ ID NO: 390106 - DNA, 18 bp, Homo sapiens
ggaagccacgtgctggag

SEQ ID NO: 390107 - DNA, 20 bp, Homo sapiens
ggaagccatattcacacctc

SEQ ID NO: 390108 - DNA, 12 bp, Homo sapiens
ggaagcccaccc

SEQ ID NO: 390109 - DNA, 13 bp, Homo sapiens
ggaagcccacccg

SEQ ID NO: 390110 - DNA, 15 bp, Homo sapiens
ggaagcccacccgcc

SEQ ID NO: 390111 - DNA, 21 bp, Homo sapiens
ggaagcccacccgccccagag

SEQ ID NO: 390112 - DNA, 23 bp, Homo sapiens
ggaagcccacccgccccagagac

SEQ ID NO: 390113 - DNA, 24 bp, Homo sapiens
ggaagcccacccgccccagagact

SEQ ID NO: 390114 - DNA, 15 bp, Homo sapiens
ggaagccccgctcag

SEQ ID NO: 390115 - DNA, 16 bp, Homo sapiens
ggaagccggcggccca

SEQ ID NO: 390116 - DNA, 15 bp, Homo sapiens
ggaagccgtctgact

SEQ ID NO: 390117 - DNA, 12 bp, Homo sapiens
ggaagcctgtcc

SEQ ID NO: 390118 - DNA, 14 bp, Homo sapiens
ggaagccttgccca

SEQ ID NO: 390119 - DNA, 20 bp, Homo sapiens
ggaagctccagtcctgctct

SEQ ID NO: 390120 - DNA, 17 bp, Homo sapiens
ggaagctgattcccaga

SEQ ID NO: 390121 - DNA, 11 bp, Homo sapiens
ggaagctgcag

SEQ ID NO: 390122 - DNA, 12 bp, Homo sapiens
ggaagctgcagc

SEQ ID NO: 390123 - DNA, 13 bp, Homo sapiens
ggaagctgcagct

SEQ ID NO: 390124 - DNA, 18 bp, Homo sapiens
ggaagctgcagcttggga

SEQ ID NO: 390125 - DNA, 16 bp, Homo sapiens
ggaagctggcaggaga

SEQ ID NO: 390126 - DNA, 19 bp, Homo sapiens
ggaagctggcaggagacac

SEQ ID NO: 390127 - DNA, 18 bp, Homo sapiens
ggaagctggccgagggtc

SEQ ID NO: 390128 - DNA, 18 bp, Homo sapiens
ggaagctgtactcagagc

SEQ ID NO: 390129 - DNA, 15 bp, Homo sapiens
ggaagcttgagcctc

SEQ ID NO: 390130 - DNA, 16 bp, Homo sapiens
ggaagcttgagcctcc

SEQ ID NO: 390131 - DNA, 22 bp, Homo sapiens
ggaaggaccaacccatgccctg

SEQ ID NO: 390132 - DNA, 17 bp, Homo sapiens
ggaaggacctatgtttg

SEQ ID NO: 390133 - DNA, 16 bp, Homo sapiens
ggaaggagagcctgct

SEQ ID NO: 390134 - DNA, 12 bp, Homo sapiens
ggaaggagcctg

SEQ ID NO: 390135 - DNA, 16 bp, Homo sapiens
ggaaggagggagctgc

SEQ ID NO: 390136 - DNA, 14 bp, Homo sapiens
ggaaggaggtgcct

SEQ ID NO: 390137 - DNA, 12 bp, Homo sapiens
ggaaggcagctg

SEQ ID NO: 390138 - DNA, 18 bp, Homo sapiens
ggaaggcagggcagaggg

SEQ ID NO: 390139 - DNA, 20 bp, Homo sapiens
ggaaggcagggcagagggaa

SEQ ID NO: 390140 - DNA, 23 bp, Homo sapiens
ggaaggcctgagggaagcccacc

SEQ ID NO: 390141 - DNA, 12 bp, Homo sapiens
ggaaggcctggg

SEQ ID NO: 390142 - DNA, 13 bp, Homo sapiens
ggaaggcggggga

SEQ ID NO: 390143 - DNA, 19 bp, Homo sapiens
ggaaggcttggtcccatcg

SEQ ID NO: 390144 - DNA, 13 bp, Homo sapiens
ggaagggaaccag

SEQ ID NO: 390145 - DNA, 16 bp, Homo sapiens
ggaagggaaccagccc

SEQ ID NO: 390146 - DNA, 18 bp, Homo sapiens
ggaagggaaccagccctc

SEQ ID NO: 390147 - DNA, 16 bp, Homo sapiens
ggaagggactaggagc

SEQ ID NO: 390148 - DNA, 21 bp, Homo sapiens
ggaagggcaggaaggagagcc

SEQ ID NO: 390149 - DNA, 12 bp, Homo sapiens
ggaagggccagt

SEQ ID NO: 390150 - DNA, 19 bp, Homo sapiens
ggaaggggcgtgtccctcc

SEQ ID NO: 390151 - DNA, 15 bp, Homo sapiens
ggaaggggtgggagc

SEQ ID NO: 390152 - DNA, 16 bp, Homo sapiens
ggaaggtgaccgccca

SEQ ID NO: 390153 - DNA, 16 bp, Homo sapiens
ggaaggtgctgagctt

SEQ ID NO: 390154 - DNA, 16 bp, Homo sapiens
ggaagtactggagaaa

SEQ ID NO: 390155 - DNA, 21 bp, Homo sapiens
tggctaactatatttgctttt

SEQ ID NO: 390156 - DNA, 14 bp, Homo sapiens
tggctaaggcacca

SEQ ID NO: 390157 - DNA, 17 bp, Homo sapiens
tggctaattcaatttat

SEQ ID NO: 390158 - DNA, 20 bp, Homo sapiens
tggctacatcccagcctgtg

SEQ ID NO: 390159 - DNA, 21 bp, Homo sapiens
tggctagaggccagccccacc

SEQ ID NO: 390160 - DNA, 23 bp, Homo sapiens
tggctaggggccgagtccaggag

SEQ ID NO: 390161 - DNA, 16 bp, Homo sapiens
tggctagtactgtatt

SEQ ID NO: 390162 - DNA, 13 bp, Homo sapiens
tggctataaatat

SEQ ID NO: 390163 - DNA, 21 bp, Homo sapiens
tggctatatggcaagaaagct

SEQ ID NO: 390164 - DNA, 13 bp, Homo sapiens
tggctatattaat

SEQ ID NO: 390165 - DNA, 23 bp, Homo sapiens
tggctatctgcatttataaatgt

SEQ ID NO: 390166 - DNA, 14 bp, Homo sapiens
tggctcacgcctgt

SEQ ID NO: 390167 - DNA, 17 bp, Homo sapiens
tggctcactgcagcctc

SEQ ID NO: 390168 - DNA, 18 bp, Homo sapiens
tggctcactgcagcctcg

SEQ ID NO: 390169 - DNA, 18 bp, Homo sapiens
tggctcaggcaagcccct

SEQ ID NO: 390170 - DNA, 14 bp, Homo sapiens
tggctcagtgccac

SEQ ID NO: 390171 - DNA, 12 bp, Homo sapiens
tgggaagatgct

SEQ ID NO: 390172 - DNA, 17 bp, Homo sapiens
tgggaagatgctggccc

SEQ ID NO: 390173 - DNA, 18 bp, Homo sapiens
tgggaagatgctggcccc

SEQ ID NO: 390174 - DNA, 19 bp, Homo sapiens
tgggaagatgctggcccca

SEQ ID NO: 390175 - DNA, 21 bp, Homo sapiens
tgggaagccatattcacacct

SEQ ID NO: 390176 - DNA, 21 bp, Homo sapiens
tgggaagctgtactcagagca

SEQ ID NO: 390177 - DNA, 17 bp, Homo sapiens
tgggaagcttgagcctc

SEQ ID NO: 390178 - DNA, 19 bp, Homo sapiens
tgggaaggagggagctgct

SEQ ID NO: 390179 - DNA, 14 bp, Homo sapiens
tgggaaggctaagt

SEQ ID NO: 390180 - DNA, 19 bp, Homo sapiens
tgggaagggagagttcttt

SEQ ID NO: 390181 - DNA, 21 bp, Homo sapiens
tgggaatgaatgtcagtgtga

SEQ ID NO: 390182 - DNA, 14 bp, Homo sapiens
tgggaattgtgtga

SEQ ID NO: 390183 - DNA, 17 bp, Homo sapiens
tgggaattgtgtgatgt

SEQ ID NO: 390184 - DNA, 18 bp, Homo sapiens
tgggacacagagaccccc

SEQ ID NO: 390185 - DNA, 12 bp, Homo sapiens
tgggacagccag

SEQ ID NO: 390186 - DNA, 21 bp, Homo sapiens
tgggacagccagagctgggtg

SEQ ID NO: 390187 - DNA, 13 bp, Homo sapiens
tgggacagctagg

SEQ ID NO: 390188 - DNA, 16 bp, Homo sapiens
tgggacagggcatggc

SEQ ID NO: 390189 - DNA, 13 bp, Homo sapiens
tgggacccagcta

SEQ ID NO: 390190 - DNA, 19 bp, Homo sapiens
tgggaccgccagatggggc

SEQ ID NO: 390191 - DNA, 21 bp, Homo sapiens
tgggaccgccagatggggcct

SEQ ID NO: 390192 - DNA, 23 bp, Homo sapiens
tgggaccgccagatggggcctct

SEQ ID NO: 390193 - DNA, 21 bp, Homo sapiens
tgggacctgctgctccatgga

SEQ ID NO: 390194 - DNA, 18 bp, Homo sapiens
tgggacgtggtcagggca

SEQ ID NO: 390195 - DNA, 18 bp, Homo sapiens
tgggactaaatgccctgc

SEQ ID NO: 390196 - DNA, 19 bp, Homo sapiens
tgggactagcctggcttgg

SEQ ID NO: 390197 - DNA, 22 bp, Homo sapiens
tgggactctcctcctcccctcc

SEQ ID NO: 390198 - DNA, 16 bp, Homo sapiens
tgggactgagccagtc

SEQ ID NO: 390199 - DNA, 18 bp, Homo sapiens
tgggactgatgtcatctt

SEQ ID NO: 390200 - DNA, 18 bp, Homo sapiens
tgggactgctgcttctta

SEQ ID NO: 390201 - DNA, 16 bp, Homo sapiens
tgggactggagtcaga

SEQ ID NO: 390202 - DNA, 21 bp, Homo sapiens
tgggactggagtcagatgagc

SEQ ID NO: 390203 - DNA, 16 bp, Homo sapiens
tgggactggcccaccc

SEQ ID NO: 390204 - DNA, 17 bp, Homo sapiens
tgggactggcccacccc

SEQ ID NO: 390205 - DNA, 18 bp, Homo sapiens
tgggactggcccacccct

SEQ ID NO: 390206 - DNA, 16 bp, Homo sapiens
tgggactgtcttgaga

SEQ ID NO: 390207 - DNA, 17 bp, Homo sapiens
tgggactgtgcctttgg

SEQ ID NO: 390208 - DNA, 15 bp, Homo sapiens
tgggagaaaagccag

SEQ ID NO: 390209 - DNA, 15 bp, Homo sapiens
tgggagaagtggccc

SEQ ID NO: 390210 - DNA, 13 bp, Homo sapiens
tgggagagccaag

SEQ ID NO: 390211 - DNA, 15 bp, Homo sapiens
tgggagagcccctgg

SEQ ID NO: 390212 - DNA, 19 bp, Homo sapiens
tgggagagcccctggggcc

SEQ ID NO: 390213 - DNA, 18 bp, Homo sapiens
tgggagagctggtggtgc

SEQ ID NO: 390214 - DNA, 14 bp, Homo sapiens
tgggagaggaagcc

SEQ ID NO: 390215 - DNA, 16 bp, Homo sapiens
tgggagaggcagaaag

SEQ ID NO: 390216 - DNA, 16 bp, Homo sapiens
tgggagaggcagagtg

SEQ ID NO: 390217 - DNA, 17 bp, Homo sapiens
tgggagagggagcaagc

SEQ ID NO: 390218 - DNA, 21 bp, Homo sapiens
tgggagagggagcaagccttc

SEQ ID NO: 390219 - DNA, 15 bp, Homo sapiens
tgggagattggcttt

SEQ ID NO: 390220 - DNA, 12 bp, Homo sapiens
tgggagcactgg

SEQ ID NO: 390221 - DNA, 23 bp, Homo sapiens
tgggagccaatactgagtgcctg

SEQ ID NO: 390222 - DNA, 17 bp, Homo sapiens
tgggagccacttctccc

SEQ ID NO: 390223 - DNA, 13 bp, Homo sapiens
tgggagcccagca

SEQ ID NO: 390224 - DNA, 14 bp, Homo sapiens
tgggagccccaggg

SEQ ID NO: 390225 - DNA, 22 bp, Homo sapiens
tgggagccccagggtcttccct

SEQ ID NO: 390226 - DNA, 23 bp, Homo sapiens
tgggagccccagggtcttcccta

SEQ ID NO: 390227 - DNA, 17 bp, Homo sapiens
tgggagcctcgcccctc

SEQ ID NO: 390228 - DNA, 22 bp, Homo sapiens
tgggagcctgcaaactcactgc

SEQ ID NO: 390229 - DNA, 13 bp, Homo sapiens
tgggaggaaagta

SEQ ID NO: 390230 - DNA, 11 bp, Homo sapiens
tgggaggcagg

SEQ ID NO: 390231 - DNA, 12 bp, Homo sapiens
tgggaggccaag

SEQ ID NO: 390232 - DNA, 14 bp, Homo sapiens
tgggaggccaaggc

SEQ ID NO: 390233 - DNA, 17 bp, Homo sapiens
tgggaggcccctggtgg

SEQ ID NO: 390234 - DNA, 18 bp, Homo sapiens
tgggaggcctaggcgggc

SEQ ID NO: 390235 - DNA, 14 bp, Homo sapiens
tgggaggcgcgagc

SEQ ID NO: 390236 - DNA, 14 bp, Homo sapiens
tgggaggcgtgccc

SEQ ID NO: 390237 - DNA, 17 bp, Homo sapiens
tgggaggcgtgcccccc

SEQ ID NO: 390238 - DNA, 22 bp, Homo sapiens
tgggaggcgtgcccccctcctc

SEQ ID NO: 390239 - DNA, 14 bp, Homo sapiens
tgggaggctcccag

SEQ ID NO: 390240 - DNA, 15 bp, Homo sapiens
tgggaggctcccaga

SEQ ID NO: 390241 - DNA, 11 bp, Homo sapiens
tgggaggctga

SEQ ID NO: 390242 - DNA, 16 bp, Homo sapiens
tgggagggggcccttc

SEQ ID NO: 390243 - DNA, 18 bp, Homo sapiens
tgggagtacatatggtag

SEQ ID NO: 390244 - DNA, 22 bp, Homo sapiens
tgggagtagcatggactctggg

SEQ ID NO: 390245 - DNA, 21 bp, Homo sapiens
tgggagtcaagtgtgcctgct

SEQ ID NO: 390246 - DNA, 22 bp, Homo sapiens
tgggagtcagagccctggctgg

SEQ ID NO: 390247 - DNA, 18 bp, Homo sapiens
tgggagtccactttcctc

SEQ ID NO: 390248 - DNA, 19 bp, Homo sapiens
tgggagtccactttcctct

SEQ ID NO: 390249 - DNA, 20 bp, Homo sapiens
tgggagtccactttcctctc

SEQ ID NO: 390250 - DNA, 14 bp, Homo sapiens
tgggagtgggagag

SEQ ID NO: 390251 - DNA, 13 bp, Homo sapiens
tgggagtgggcac

SEQ ID NO: 390252 - DNA, 15 bp, Homo sapiens
tgggagtgggcacct

SEQ ID NO: 390253 - DNA, 22 bp, Homo sapiens
tgggagtgggcacctcagaaag

SEQ ID NO: 390254 - DNA, 12 bp, Homo sapiens
tgggataaatag

SEQ ID NO: 390255 - DNA, 21 bp, Homo sapiens
tgggataacagaggcaggagt

SEQ ID NO: 390256 - DNA, 20 bp, Homo sapiens
tgggatcaaagctaggaaag

SEQ ID NO: 390257 - DNA, 21 bp, Homo sapiens
tgggatcaaagctaggaaagg

SEQ ID NO: 390258 - DNA, 22 bp, Homo sapiens
tgggatcaaagctaggaaaggc

SEQ ID NO: 390259 - DNA, 15 bp, Homo sapiens
tgggatcctccctca

SEQ ID NO: 390260 - DNA, 19 bp, Homo sapiens
tgggatcctccctcatggc

SEQ ID NO: 390261 - DNA, 13 bp, Homo sapiens
tgggatcctggag

SEQ ID NO: 390262 - DNA, 20 bp, Homo sapiens
tgggatgcttgcctagggcc

SEQ ID NO: 390263 - DNA, 15 bp, Homo sapiens
tgggatgggcacagg

SEQ ID NO: 390264 - DNA, 13 bp, Homo sapiens
tgggatgtcctct

SEQ ID NO: 390265 - DNA, 22 bp, Homo sapiens
tgggatgttcagcactgtccct

SEQ ID NO: 390266 - DNA, 21 bp, Homo sapiens
tgggattacagggatgagcca

SEQ ID NO: 390267 - DNA, 16 bp, Homo sapiens
tgggattacaggtgtg

SEQ ID NO: 390268 - DNA, 20 bp, Homo sapiens
tgggattatgggtcacagga

SEQ ID NO: 390269 - DNA, 13 bp, Homo sapiens
tgggattcaattt

SEQ ID NO: 390270 - DNA, 17 bp, Homo sapiens
tgggattctactttaag

SEQ ID NO: 390271 - DNA, 19 bp, Homo sapiens
tgggattgggggctggtgc

SEQ ID NO: 390272 - DNA, 18 bp, Homo sapiens
tgggatttcttcgctgct

SEQ ID NO: 390273 - DNA, 12 bp, Homo sapiens
tgggatttgaac

SEQ ID NO: 390274 - DNA, 19 bp, Homo sapiens
tgggattttatctgtggat

SEQ ID NO: 390275 - DNA, 21 bp, Homo sapiens
tgggcaaagccacaaggctgg

SEQ ID NO: 390276 - DNA, 14 bp, Homo sapiens
tgggcaacatagca

SEQ ID NO: 390277 - DNA, 16 bp, Homo sapiens
tgggcaaggcctttgg

SEQ ID NO: 390278 - DNA, 19 bp, Homo sapiens
tgggcaagtcccttgacct

SEQ ID NO: 390279 - DNA, 15 bp, Homo sapiens
tgggcaagtgattga

SEQ ID NO: 390280 - DNA, 22 bp, Homo sapiens
tgggcaccaagagccaatggag

SEQ ID NO: 390281 - DNA, 15 bp, Homo sapiens
tgggcacccacctcc

SEQ ID NO: 390282 - DNA, 17 bp, Homo sapiens
tgggcacccacctccac

SEQ ID NO: 390283 - DNA, 15 bp, Homo sapiens
tgggcacctctgctg

SEQ ID NO: 390284 - DNA, 16 bp, Homo sapiens
tgggcacctctgctgt

SEQ ID NO: 390285 - DNA, 17 bp, Homo sapiens
tgggcacctggggagtg

SEQ ID NO: 390286 - DNA, 19 bp, Homo sapiens
tgggcacctggggagtggg

SEQ ID NO: 390287 - DNA, 20 bp, Homo sapiens
tgggcacctggggagtggga

SEQ ID NO: 390288 - DNA, 21 bp, Homo sapiens
tgggcacgctgtgggcaggtg

SEQ ID NO: 390289 - DNA, 21 bp, Homo sapiens
tgggcacgggagagcgccacc

SEQ ID NO: 390290 - DNA, 15 bp, Homo sapiens
tgggcagaaatgtgc

SEQ ID NO: 390291 - DNA, 15 bp, Homo sapiens
tgggcagaagataga

SEQ ID NO: 390292 - DNA, 18 bp, Homo sapiens
tgggcagaagatagagat

SEQ ID NO: 390293 - DNA, 16 bp, Homo sapiens
tgggcagaggggagag

SEQ ID NO: 390294 - DNA, 18 bp, Homo sapiens
tgggcagccatcttgaat

SEQ ID NO: 390295 - DNA, 18 bp, Homo sapiens
tgggcagcccagagagac

SEQ ID NO: 390296 - DNA, 16 bp, Homo sapiens
tgggcagggccgcagg

SEQ ID NO: 390297 - DNA, 20 bp, Homo sapiens
ggacctctactttccaggct

SEQ ID NO: 390298 - DNA, 14 bp, Homo sapiens
ggacctctgggctt

SEQ ID NO: 390299 - DNA, 21 bp, Homo sapiens
ggacctgaagggtgacatccc

SEQ ID NO: 390300 - DNA, 17 bp, Homo sapiens
ggacctgagtctgctat

SEQ ID NO: 390301 - DNA, 23 bp, Homo sapiens
tggggagcacttgcgtcctgcag

SEQ ID NO: 390302 - DNA, 14 bp, Homo sapiens
tggggagcagctga

SEQ ID NO: 390303 - DNA, 16 bp, Homo sapiens
tggggagccaacagaa

SEQ ID NO: 390304 - DNA, 17 bp, Homo sapiens
ggagaggaaaagtaagg

SEQ ID NO: 390305 - DNA, 17 bp, Homo sapiens
ggagaggaactccttgg

SEQ ID NO: 390306 - DNA, 14 bp, Homo sapiens
ggagaggaagcaca

SEQ ID NO: 390307 - DNA, 13 bp, Homo sapiens
ggagaggaagcca

SEQ ID NO: 390308 - DNA, 12 bp, Homo sapiens
ggagaggagaac

SEQ ID NO: 390309 - DNA, 12 bp, Homo sapiens
ggagaggagaga

SEQ ID NO: 390310 - DNA, 23 bp, Homo sapiens
ggagaggagagcatctgctctga

SEQ ID NO: 390311 - DNA, 15 bp, Homo sapiens
ggagaggcagaaagg

SEQ ID NO: 390312 - DNA, 16 bp, Homo sapiens
ggagaggcagagtgcc

SEQ ID NO: 390313 - DNA, 13 bp, Homo sapiens
ggagaggccatga

SEQ ID NO: 390314 - DNA, 18 bp, Homo sapiens
ggagaggctctgaaagct

SEQ ID NO: 390315 - DNA, 13 bp, Homo sapiens
ggagaggctgtct

SEQ ID NO: 390316 - DNA, 16 bp, Homo sapiens
ggagaggctgtctggg

SEQ ID NO: 390317 - DNA, 19 bp, Homo sapiens
ggagagggaatgtgaaatt

SEQ ID NO: 390318 - DNA, 22 bp, Homo sapiens
ggagagggagtacaaagacagg

SEQ ID NO: 390319 - DNA, 22 bp, Homo sapiens
ggagaggggaagggccagtctg

SEQ ID NO: 390320 - DNA, 21 bp, Homo sapiens
ggagaggttataggtcactcc

SEQ ID NO: 390321 - DNA, 17 bp, Homo sapiens
ggagagtcccagagcag

SEQ ID NO: 390322 - DNA, 20 bp, Homo sapiens
ggagagtcccagagcaggag

SEQ ID NO: 390323 - DNA, 19 bp, Homo sapiens
ggagagttctttgctgccc

SEQ ID NO: 390324 - DNA, 22 bp, Homo sapiens
ggagagttctttgctgcccctg

SEQ ID NO: 390325 - DNA, 15 bp, Homo sapiens
ggagatagtgccagg

SEQ ID NO: 390326 - DNA, 21 bp, Homo sapiens
ggagatccgccctgggctctg

SEQ ID NO: 390327 - DNA, 19 bp, Homo sapiens
ggagatcggggccagaggc

SEQ ID NO: 390328 - DNA, 20 bp, Homo sapiens
ggagatggaagttgcagtga

SEQ ID NO: 390329 - DNA, 13 bp, Homo sapiens
ggagatggagaaa

SEQ ID NO: 390330 - DNA, 18 bp, Homo sapiens
ggagatgtaatgacagag

SEQ ID NO: 390331 - DNA, 12 bp, Homo sapiens
ggagatgtcttc

SEQ ID NO: 390332 - DNA, 14 bp, Homo sapiens
ggagatgtcttcgt

SEQ ID NO: 390333 - DNA, 17 bp, Homo sapiens
ggagattggacggcctg

SEQ ID NO: 390334 - DNA, 19 bp, Homo sapiens
ggagattttaggtgttgat

SEQ ID NO: 390335 - DNA, 17 bp, Homo sapiens
ggagattttccttccta

SEQ ID NO: 390336 - DNA, 16 bp, Homo sapiens
ggagcaaaaggcagct

SEQ ID NO: 390337 - DNA, 22 bp, Homo sapiens
ggagcaatgggactggagtcag

SEQ ID NO: 390338 - DNA, 18 bp, Homo sapiens
ggagcacaaaagcctctc

SEQ ID NO: 390339 - DNA, 17 bp, Homo sapiens
ggagcacagccctggga

SEQ ID NO: 390340 - DNA, 18 bp, Homo sapiens
ggagcacagccctgggag

SEQ ID NO: 390341 - DNA, 18 bp, Homo sapiens
ggagcacccccagcctcc

SEQ ID NO: 390342 - DNA, 19 bp, Homo sapiens
ggagcacccccagcctccc

SEQ ID NO: 390343 - DNA, 15 bp, Homo sapiens
ggagcaccgaggcca

SEQ ID NO: 390344 - DNA, 22 bp, Homo sapiens
ggagcacctgaaccccatgggc

SEQ ID NO: 390345 - DNA, 12 bp, Homo sapiens
ggagcacgaggc

SEQ ID NO: 390346 - DNA, 18 bp, Homo sapiens
ggagcactggagtgcagg

SEQ ID NO: 390347 - DNA, 21 bp, Homo sapiens
ggagcacttgcgtcctgcaga

SEQ ID NO: 390348 - DNA, 22 bp, Homo sapiens
ggagcacttgcgtcctgcagag

SEQ ID NO: 390349 - DNA, 16 bp, Homo sapiens
ggagcagagacggcag

SEQ ID NO: 390350 - DNA, 17 bp, Homo sapiens
ggagcagagacggcagc

SEQ ID NO: 390351 - DNA, 23 bp, Homo sapiens
ggagcagagacggcagccccatc

SEQ ID NO: 390352 - DNA, 16 bp, Homo sapiens
ggagcagcagctgagg

SEQ ID NO: 390353 - DNA, 17 bp, Homo sapiens
ggagcagcctccaagaa

SEQ ID NO: 390354 - DNA, 18 bp, Homo sapiens
ggagcagcctccaagaaa

SEQ ID NO: 390355 - DNA, 20 bp, Homo sapiens
ggagcagcctccaagaaact

SEQ ID NO: 390356 - DNA, 16 bp, Homo sapiens
ggagcagctgtgctgc

SEQ ID NO: 390357 - DNA, 16 bp, Homo sapiens
ggagcaggaagcaagg

SEQ ID NO: 390358 - DNA, 17 bp, Homo sapiens
ggagcaggaagcaaggc

SEQ ID NO: 390359 - DNA, 19 bp, Homo sapiens
ggagcaggaggaggaaagg

SEQ ID NO: 390360 - DNA, 18 bp, Homo sapiens
ggagcaggcggtggggag

SEQ ID NO: 390361 - DNA, 17 bp, Homo sapiens
ggagcagtgtcttccat

SEQ ID NO: 390362 - DNA, 14 bp, Homo sapiens
ggagcatgggcctg

SEQ ID NO: 390363 - DNA, 20 bp, Homo sapiens
ggagcattctgcctgcctgg

SEQ ID NO: 390364 - DNA, 21 bp, Homo sapiens
ggagcattctgcctgcctggg

SEQ ID NO: 390365 - DNA, 23 bp, Homo sapiens
ggagcattttgtgtcttaagaaa

SEQ ID NO: 390366 - DNA, 20 bp, Homo sapiens
ggagccaatgaacagctcct

SEQ ID NO: 390367 - DNA, 21 bp, Homo sapiens
ggagccaatggtgagggctga

SEQ ID NO: 390368 - DNA, 19 bp, Homo sapiens
ggagccacctgggctggga

SEQ ID NO: 390369 - DNA, 23 bp, Homo sapiens
ggagccacctgggctgggagaag

SEQ ID NO: 390370 - DNA, 13 bp, Homo sapiens
ggagccacctgtc

SEQ ID NO: 390371 - DNA, 16 bp, Homo sapiens
ggagccacctgtccca

SEQ ID NO: 390372 - DNA, 21 bp, Homo sapiens
ggagccagaattcactaggag

SEQ ID NO: 390373 - DNA, 23 bp, Homo sapiens
ggagccagcagggcgggccagga

SEQ ID NO: 390374 - DNA, 17 bp, Homo sapiens
ggagcccaggcctggcc

SEQ ID NO: 390375 - DNA, 21 bp, Homo sapiens
ggagcccataggccaccccct

SEQ ID NO: 390376 - DNA, 19 bp, Homo sapiens
ggagccccagccagccctt

SEQ ID NO: 390377 - DNA, 14 bp, Homo sapiens
ggagccccagggtc

SEQ ID NO: 390378 - DNA, 21 bp, Homo sapiens
ggagcccccagatagagctgg

SEQ ID NO: 390379 - DNA, 13 bp, Homo sapiens
ggagcccccgccc

SEQ ID NO: 390380 - DNA, 20 bp, Homo sapiens
ggagcccccgccccgcccca

SEQ ID NO: 390381 - DNA, 22 bp, Homo sapiens
ggagcccctcctctgagcagcc

SEQ ID NO: 390382 - DNA, 14 bp, Homo sapiens
ggagcccgcacccc

SEQ ID NO: 390383 - DNA, 20 bp, Homo sapiens
ggagcccgcacccccaccct

SEQ ID NO: 390384 - DNA, 19 bp, Homo sapiens
ggagcccggggcagagctc

SEQ ID NO: 390385 - DNA, 22 bp, Homo sapiens
ggagcccggggcagagctcaga

SEQ ID NO: 390386 - DNA, 19 bp, Homo sapiens
ggagccctgaccttggctg

SEQ ID NO: 390387 - DNA, 19 bp, Homo sapiens
ggagccctggggtttccac

SEQ ID NO: 390388 - DNA, 17 bp, Homo sapiens
ggagcctgaggcaggag

SEQ ID NO: 390389 - DNA, 17 bp, Homo sapiens
ggagcctgcggctgctg

SEQ ID NO: 390390 - DNA, 22 bp, Homo sapiens
ggagcctgcggctgctggcaca

SEQ ID NO: 390391 - DNA, 12 bp, Homo sapiens
ggagcctggagt

SEQ ID NO: 390392 - DNA, 12 bp, Homo sapiens
ggagcctgtgtt

SEQ ID NO: 390393 - DNA, 19 bp, Homo sapiens
ggagcggccgcctgcgggc

SEQ ID NO: 390394 - DNA, 17 bp, Homo sapiens
ggagcgggacctgtggc

SEQ ID NO: 390395 - DNA, 17 bp, Homo sapiens
ggagctaacactggccc

SEQ ID NO: 390396 - DNA, 18 bp, Homo sapiens
ggagctaacactggcccc

SEQ ID NO: 390397 - DNA, 17 bp, Homo sapiens
ggagctagcccagtccc

SEQ ID NO: 390398 - DNA, 11 bp, Homo sapiens
ggagctctgct

SEQ ID NO: 390399 - DNA, 17 bp, Homo sapiens
ggagctcttcaggcctc

SEQ ID NO: 390400 - DNA, 18 bp, Homo sapiens
ggagctcttcaggcctcc

SEQ ID NO: 390401 - DNA, 20 bp, Homo sapiens
ggagctcttcaggcctccct

SEQ ID NO: 390402 - DNA, 19 bp, Homo sapiens
ggagctgaaagggagcccc

SEQ ID NO: 390403 - DNA, 18 bp, Homo sapiens
ggagctgagatgagcccc

SEQ ID NO: 390404 - DNA, 16 bp, Homo sapiens
ggagctgagtcacctc

SEQ ID NO: 390405 - DNA, 18 bp, Homo sapiens
ggagctgatttccaggcc

SEQ ID NO: 390406 - DNA, 22 bp, Homo sapiens
ggagctgcagcgcctcctggac

SEQ ID NO: 390407 - DNA, 13 bp, Homo sapiens
ggagctggctggc

SEQ ID NO: 390408 - DNA, 18 bp, Homo sapiens
ggagctggctggcaggtg

SEQ ID NO: 390409 - DNA, 18 bp, Homo sapiens
ggagctggtgacagcctt

SEQ ID NO: 390410 - DNA, 22 bp, Homo sapiens
ggaggaaaaccaagccgtggct

SEQ ID NO: 390411 - DNA, 14 bp, Homo sapiens
ggaggaactggtcc

SEQ ID NO: 390412 - DNA, 21 bp, Homo sapiens
ggaggaactggtccaggccag

SEQ ID NO: 390413 - DNA, 13 bp, Homo sapiens
ggaggaaggagag

SEQ ID NO: 390414 - DNA, 22 bp, Homo sapiens
ggaggaaggagcctatggcatc

SEQ ID NO: 390415 - DNA, 14 bp, Homo sapiens
ggaggaaggtgctg

SEQ ID NO: 390416 - DNA, 15 bp, Homo sapiens
ggaggaaggtgctga

SEQ ID NO: 390417 - DNA, 20 bp, Homo sapiens
ggaggaatcgaggaaccaga

SEQ ID NO: 390418 - DNA, 18 bp, Homo sapiens
ggaggaatcttttactgt

SEQ ID NO: 390419 - DNA, 16 bp, Homo sapiens
ggaggaatgctccccc

SEQ ID NO: 390420 - DNA, 17 bp, Homo sapiens
ggaggaatgctccccca

SEQ ID NO: 390421 - DNA, 21 bp, Homo sapiens
ggaggaatttctgagtggcca

SEQ ID NO: 390422 - DNA, 14 bp, Homo sapiens
ggaggacctctggg

SEQ ID NO: 390423 - DNA, 22 bp, Homo sapiens
ggaggacggttgtaagcagttg

SEQ ID NO: 390424 - DNA, 16 bp, Homo sapiens
ggaggagactcaggcc

SEQ ID NO: 390425 - DNA, 22 bp, Homo sapiens
ggaggagactcaggcccacatt

SEQ ID NO: 390426 - DNA, 14 bp, Homo sapiens
ggaggagagagatg

SEQ ID NO: 390427 - DNA, 13 bp, Homo sapiens
ggaggaggaggca

SEQ ID NO: 390428 - DNA, 19 bp, Homo sapiens
ggaggagggcggggggcac

SEQ ID NO: 390429 - DNA, 15 bp, Homo sapiens
ggaggatgctgtgcc

SEQ ID NO: 390430 - DNA, 13 bp, Homo sapiens
ggatcgtggccaa

SEQ ID NO: 390431 - DNA, 12 bp, Homo sapiens
ggatctaccagc

SEQ ID NO: 390432 - DNA, 16 bp, Homo sapiens
ggatctagccatggct

SEQ ID NO: 390433 - DNA, 12 bp, Homo sapiens
ggatctccaggc

SEQ ID NO: 390434 - DNA, 19 bp, Homo sapiens
ggatctccaggcccagcct

SEQ ID NO: 390435 - DNA, 22 bp, Homo sapiens
ggatctccaggcccagcctggc

SEQ ID NO: 390436 - DNA, 13 bp, Homo sapiens
ggatctctcagga

SEQ ID NO: 390437 - DNA, 19 bp, Homo sapiens
ggatctgctccatgcagat

SEQ ID NO: 390438 - DNA, 22 bp, Homo sapiens
ggatctggagtctgaaggagag

SEQ ID NO: 390439 - DNA, 23 bp, Homo sapiens
ggatctgttgtgtacgtggagag

SEQ ID NO: 390440 - DNA, 20 bp, Homo sapiens
ggatcttctccctcccctca

SEQ ID NO: 390441 - DNA, 14 bp, Homo sapiens
ggatgaaaaaataa

SEQ ID NO: 390442 - DNA, 21 bp, Homo sapiens
ggatgaatgcagtataaaatg

SEQ ID NO: 390443 - DNA, 16 bp, Homo sapiens
ggatgacaaagaaaat

SEQ ID NO: 390444 - DNA, 18 bp, Homo sapiens
tgggttcattattggaat

SEQ ID NO: 390445 - DNA, 12 bp, Homo sapiens
tgggttccagac

SEQ ID NO: 390446 - DNA, 19 bp, Homo sapiens
tgggttccagacagagtgg

SEQ ID NO: 390447 - DNA, 17 bp, Homo sapiens
tgggttctgatattgcc

SEQ ID NO: 390448 - DNA, 14 bp, Homo sapiens
tgggttctgggtgg

SEQ ID NO: 390449 - DNA, 16 bp, Homo sapiens
tgggttcttgttttat

SEQ ID NO: 390450 - DNA, 14 bp, Homo sapiens
tgggtttcaattta

SEQ ID NO: 390451 - DNA, 16 bp, Homo sapiens
tgggtttcggggtgaa

SEQ ID NO: 390452 - DNA, 21 bp, Homo sapiens
tgggtttctctgtgctctgaa

SEQ ID NO: 390453 - DNA, 20 bp, Homo sapiens
tgggttttcaggggctttgg

SEQ ID NO: 390454 - DNA, 22 bp, Homo sapiens
tgggtttttgttacctttatgg

SEQ ID NO: 390455 - DNA, 24 bp, Homo sapiens
tggtaaacattcctccagcctccc

SEQ ID NO: 390456 - DNA, 21 bp, Homo sapiens
tggtaaactatttgtctttca

SEQ ID NO: 390457 - DNA, 17 bp, Homo sapiens
tggtaaagatattattc

SEQ ID NO: 390458 - DNA, 18 bp, Homo sapiens
tggtaaagatattattca

SEQ ID NO: 390459 - DNA, 16 bp, Homo sapiens
tggtaacaagaggagc

SEQ ID NO: 390460 - DNA, 21 bp, Homo sapiens
tggtaacaagaggagcaggaa

SEQ ID NO: 390461 - DNA, 13 bp, Homo sapiens
tggtaacagctat

SEQ ID NO: 390462 - DNA, 13 bp, Homo sapiens
tggtaagggaaaa

SEQ ID NO: 390463 - DNA, 16 bp, Homo sapiens
tggtaagggccaagtc

SEQ ID NO: 390464 - DNA, 12 bp, Homo sapiens
tggtaagtggag

SEQ ID NO: 390465 - DNA, 22 bp, Homo sapiens
tggtaatttgtatctgaaggag

SEQ ID NO: 390466 - DNA, 14 bp, Homo sapiens
tggtacagcagggt

SEQ ID NO: 390467 - DNA, 13 bp, Homo sapiens
tggtaccagagcc

SEQ ID NO: 390468 - DNA, 19 bp, Homo sapiens
tggtaccagccctggggct

SEQ ID NO: 390469 - DNA, 14 bp, Homo sapiens
tggtaccctggcag

SEQ ID NO: 390470 - DNA, 16 bp, Homo sapiens
tggtaccctggcagag

SEQ ID NO: 390471 - DNA, 17 bp, Homo sapiens
tggtactcccccagccc

SEQ ID NO: 390472 - DNA, 17 bp, Homo sapiens
tggtactctcctagaga

SEQ ID NO: 390473 - DNA, 16 bp, Homo sapiens
tggtagaagccagtac

SEQ ID NO: 390474 - DNA, 17 bp, Homo sapiens
tggtagcatgacctttt

SEQ ID NO: 390475 - DNA, 23 bp, Homo sapiens
tggtagctcatgcctgtaaccct

SEQ ID NO: 390476 - DNA, 21 bp, Homo sapiens
tggtagcttttcccttctttt

SEQ ID NO: 390477 - DNA, 16 bp, Homo sapiens
tggtaggaaagcaccg

SEQ ID NO: 390478 - DNA, 18 bp, Homo sapiens
tggtaggaatagcatgtc

SEQ ID NO: 390479 - DNA, 17 bp, Homo sapiens
tggtagttagtagcatg

SEQ ID NO: 390480 - DNA, 18 bp, Homo sapiens
tggtagttctgtgcctcc

SEQ ID NO: 390481 - DNA, 14 bp, Homo sapiens
tggtatagtattag

SEQ ID NO: 390482 - DNA, 22 bp, Homo sapiens
tggtatgaacttgaggacacat

SEQ ID NO: 390483 - DNA, 23 bp, Homo sapiens
tggtatgaacttgaggacacatg

SEQ ID NO: 390484 - DNA, 19 bp, Homo sapiens
tggtatgcagcatacaaaa

SEQ ID NO: 390485 - DNA, 19 bp, Homo sapiens
tggtatgggtttctcccag

SEQ ID NO: 390486 - DNA, 15 bp, Homo sapiens
tggtatgtctcttta

SEQ ID NO: 390487 - DNA, 21 bp, Homo sapiens
tggtatgtgacatgcgggctg

SEQ ID NO: 390488 - DNA, 18 bp, Homo sapiens
tggtattacactgtattt

SEQ ID NO: 390489 - DNA, 22 bp, Homo sapiens
tggtattggccgatgagctggt

SEQ ID NO: 390490 - DNA, 14 bp, Homo sapiens
tggtcaacacttaa

SEQ ID NO: 390491 - DNA, 18 bp, Homo sapiens
tggtcaacttgagcatgt

SEQ ID NO: 390492 - DNA, 18 bp, Homo sapiens
tggtcacaagtaggagac

SEQ ID NO: 390493 - DNA, 23 bp, Homo sapiens
tggtcacaagtaggagacacaga

SEQ ID NO: 390494 - DNA, 14 bp, Homo sapiens
tggtcacagagaac

SEQ ID NO: 390495 - DNA, 15 bp, Homo sapiens
tggtcacccccaccc

SEQ ID NO: 390496 - DNA, 18 bp, Homo sapiens
tggtcactaaccaacaag

SEQ ID NO: 390497 - DNA, 21 bp, Homo sapiens
tggtcactaaccaacaaggtt

SEQ ID NO: 390498 - DNA, 14 bp, Homo sapiens
tggtcactgccatg

SEQ ID NO: 390499 - DNA, 10 bp, Homo sapiens
tggtcagagg

SEQ ID NO: 390500 - DNA, 21 bp, Homo sapiens
tggtcagagtaagctgctttt

SEQ ID NO: 390501 - DNA, 15 bp, Homo sapiens
tggtcagatttgaac

SEQ ID NO: 390502 - DNA, 16 bp, Homo sapiens
tggtcagatttgaact

SEQ ID NO: 390503 - DNA, 15 bp, Homo sapiens
tggtcagcagaaacc

SEQ ID NO: 390504 - DNA, 21 bp, Homo sapiens
tggtcagcagaaacccccagg

SEQ ID NO: 390505 - DNA, 13 bp, Homo sapiens
tggtcagtgtgca

SEQ ID NO: 390506 - DNA, 17 bp, Homo sapiens
tggtcagtgtggagagg

SEQ ID NO: 390507 - DNA, 22 bp, Homo sapiens
tggtcagtttggttgtgtaaga

SEQ ID NO: 390508 - DNA, 18 bp, Homo sapiens
tggtcatcgtgacagcag

SEQ ID NO: 390509 - DNA, 20 bp, Homo sapiens
tggtcatgaattcatactct

SEQ ID NO: 390510 - DNA, 14 bp, Homo sapiens
tggtcattaaatac

SEQ ID NO: 390511 - DNA, 20 bp, Homo sapiens
tggtccacacaccacagaag

SEQ ID NO: 390512 - DNA, 19 bp, Homo sapiens
tggtccaggcttgggctcc

SEQ ID NO: 390513 - DNA, 13 bp, Homo sapiens
tggtccagggcta

SEQ ID NO: 390514 - DNA, 14 bp, Homo sapiens
tggtcccaggaagc

SEQ ID NO: 390515 - DNA, 21 bp, Homo sapiens
tggtcccaggaagcagggaga

SEQ ID NO: 390516 - DNA, 19 bp, Homo sapiens
tggtcccataggagcagcc

SEQ ID NO: 390517 - DNA, 14 bp, Homo sapiens
tggtccctcgtcca

SEQ ID NO: 390518 - DNA, 15 bp, Homo sapiens
tggtcccttcttccc

SEQ ID NO: 390519 - DNA, 20 bp, Homo sapiens
tggtcctaagtccctgcccc

SEQ ID NO: 390520 - DNA, 12 bp, Homo sapiens
tggtcctgactc

SEQ ID NO: 390521 - DNA, 19 bp, Homo sapiens
tggtcctgactcaacatgt

SEQ ID NO: 390522 - DNA, 19 bp, Homo sapiens
tggtccttctgaccccact

SEQ ID NO: 390523 - DNA, 13 bp, Homo sapiens
tggtctatttctc

SEQ ID NO: 390524 - DNA, 18 bp, Homo sapiens
tggtctccatatcagctc

SEQ ID NO: 390525 - DNA, 21 bp, Homo sapiens
tggtctccatttttcccagga

SEQ ID NO: 390526 - DNA, 11 bp, Homo sapiens
tggtctcctct

SEQ ID NO: 390527 - DNA, 14 bp, Homo sapiens
tggtctcctctcag

SEQ ID NO: 390528 - DNA, 21 bp, Homo sapiens
tggtctcctctgattatcagg

SEQ ID NO: 390529 - DNA, 22 bp, Homo sapiens
tggtctctgctgaaggttgtaa

SEQ ID NO: 390530 - DNA, 12 bp, Homo sapiens
tggtctcttcca

SEQ ID NO: 390531 - DNA, 13 bp, Homo sapiens
tggtctcttgctt

SEQ ID NO: 390532 - DNA, 17 bp, Homo sapiens
tggtctctttctttcca

SEQ ID NO: 390533 - DNA, 12 bp, Homo sapiens
tggtctgaatgt

SEQ ID NO: 390534 - DNA, 19 bp, Homo sapiens
tggtctgaatgttctgaca

SEQ ID NO: 390535 - DNA, 20 bp, Homo sapiens
tggtctggagcccctatcct

SEQ ID NO: 390536 - DNA, 23 bp, Homo sapiens
tggtctgtactccttggatttgc

SEQ ID NO: 390537 - DNA, 21 bp, Homo sapiens
tggtctgtttccaggtcagaa

SEQ ID NO: 390538 - DNA, 15 bp, Homo sapiens
tggtcttagctttac

SEQ ID NO: 390539 - DNA, 11 bp, Homo sapiens
tggtcttggag

SEQ ID NO: 390540 - DNA, 18 bp, Homo sapiens
tggtcttggagaggaggt

SEQ ID NO: 390541 - DNA, 15 bp, Homo sapiens
tggtctttctggaga

SEQ ID NO: 390542 - DNA, 17 bp, Homo sapiens
tggtctttctggagagg

SEQ ID NO: 390543 - DNA, 11 bp, Homo sapiens
tggtgaacagt

SEQ ID NO: 390544 - DNA, 17 bp, Homo sapiens
tggtgaagtgtggctgg

SEQ ID NO: 390545 - DNA, 13 bp, Homo sapiens
tggtgacaggcag

SEQ ID NO: 390546 - DNA, 15 bp, Homo sapiens
tggtgacaggcagac

SEQ ID NO: 390547 - DNA, 17 bp, Homo sapiens
tggtgacttttgaagaa

SEQ ID NO: 390548 - DNA, 16 bp, Homo sapiens
tggtgaggaagctcca

SEQ ID NO: 390549 - DNA, 17 bp, Homo sapiens
tggtgaggcccagcctg

SEQ ID NO: 390550 - DNA, 18 bp, Homo sapiens
tggtgaggcccagcctgt

SEQ ID NO: 390551 - DNA, 19 bp, Homo sapiens
tggtgaggcccagcctgtc

SEQ ID NO: 390552 - DNA, 17 bp, Homo sapiens
tggtgaggttgggcagc

SEQ ID NO: 390553 - DNA, 15 bp, Homo sapiens
tggtgatcctctatt

SEQ ID NO: 390554 - DNA, 17 bp, Homo sapiens
tggtgatcctctatttt

SEQ ID NO: 390555 - DNA, 18 bp, Homo sapiens
tggtgatcctctattttg

SEQ ID NO: 390556 - DNA, 21 bp, Homo sapiens
tggtgatcctctattttgtga

SEQ ID NO: 390557 - DNA, 21 bp, Homo sapiens
tggtgatctgtagacttctgg

SEQ ID NO: 390558 - DNA, 13 bp, Homo sapiens
tggtgatgcaagt

SEQ ID NO: 390559 - DNA, 14 bp, Homo sapiens
tggtgatgtgcctg

SEQ ID NO: 390560 - DNA, 20 bp, Homo sapiens
tggtgcaaggccatctgctt

SEQ ID NO: 390561 - DNA, 15 bp, Homo sapiens
tggtgcagccttccc

SEQ ID NO: 390562 - DNA, 18 bp, Homo sapiens
tggtgcagccttcccctc

SEQ ID NO: 390563 - DNA, 19 bp, Homo sapiens
tggtgcagccttcccctcc

SEQ ID NO: 390564 - DNA, 14 bp, Homo sapiens
tggtgcagtaacca

SEQ ID NO: 390565 - DNA, 14 bp, Homo sapiens
tggtgcagtgaaga

SEQ ID NO: 390566 - DNA, 19 bp, Homo sapiens
tggtgcattacagagagga

SEQ ID NO: 390567 - DNA, 11 bp, Homo sapiens
tggtgcattcg

SEQ ID NO: 390568 - DNA, 22 bp, Homo sapiens
tggtgctcacgactcttcctgc

SEQ ID NO: 390569 - DNA, 13 bp, Homo sapiens
tggtgctgccaca

SEQ ID NO: 390570 - DNA, 18 bp, Homo sapiens
tggtgctgccacacttca

SEQ ID NO: 390571 - DNA, 19 bp, Homo sapiens
tggtgctgcgcccagggag

SEQ ID NO: 390572 - DNA, 15 bp, Homo sapiens
tggtgctgggactga

SEQ ID NO: 390573 - DNA, 21 bp, Homo sapiens
tggtggaagaggttctcagca

SEQ ID NO: 390574 - DNA, 22 bp, Homo sapiens
tggtggaagaggttctcagcaa

SEQ ID NO: 390575 - DNA, 22 bp, Homo sapiens
tggtggacagggcccccggcca

SEQ ID NO: 390576 - DNA, 19 bp, Homo sapiens
tggtggagaatctgagggc

SEQ ID NO: 390577 - DNA, 22 bp, Homo sapiens
tggtggaggaaacttccaactt

SEQ ID NO: 390578 - DNA, 22 bp, Homo sapiens
ggatgagcagcaggcgtgcctc

SEQ ID NO: 390579 - DNA, 19 bp, Homo sapiens
ggatgagcctctccttgcc

SEQ ID NO: 390580 - DNA, 15 bp, Homo sapiens
ggatgagctggaagg

SEQ ID NO: 390581 - DNA, 17 bp, Homo sapiens
ggatgaggtgctgggag

SEQ ID NO: 390582 - DNA, 20 bp, Homo sapiens
ggatgcacagatgccatggc

SEQ ID NO: 390583 - DNA, 18 bp, Homo sapiens
ggatgcacggtttctgtt

SEQ ID NO: 390584 - DNA, 19 bp, Homo sapiens
ggatgcagtgcctttcccc

SEQ ID NO: 390585 - DNA, 18 bp, Homo sapiens
ggatgccaaggagcccct

SEQ ID NO: 390586 - DNA, 23 bp, Homo sapiens
ggatgcgtgccctgacccctgca

SEQ ID NO: 390587 - DNA, 11 bp, Homo sapiens
ggatgctgaag

SEQ ID NO: 390588 - DNA, 22 bp, Homo sapiens
ggatgcttcatgtgaacgtggg

SEQ ID NO: 390589 - DNA, 19 bp, Homo sapiens
ggatggaaaaggaagacta

SEQ ID NO: 390590 - DNA, 15 bp, Homo sapiens
ggatggaaggagaga

SEQ ID NO: 390591 - DNA, 19 bp, Homo sapiens
ggatggagaatgccagccc

SEQ ID NO: 390592 - DNA, 19 bp, Homo sapiens
ggatggaggggtggtcctg

SEQ ID NO: 390593 - DNA, 21 bp, Homo sapiens
ggatggaggggtggtcctgac

SEQ ID NO: 390594 - DNA, 20 bp, Homo sapiens
ggatggcagcctcagggctt

SEQ ID NO: 390595 - DNA, 16 bp, Homo sapiens
ggatggccgatggggc

SEQ ID NO: 390596 - DNA, 21 bp, Homo sapiens
ggatggcgtgtcccctgcctg

SEQ ID NO: 390597 - DNA, 15 bp, Homo sapiens
ggatgggagtgagac

SEQ ID NO: 390598 - DNA, 22 bp, Homo sapiens
ggatgggagtgggcacctcaga

SEQ ID NO: 390599 - DNA, 15 bp, Homo sapiens
ggatgggatttcatg

SEQ ID NO: 390600 - DNA, 17 bp, Homo sapiens
ggatgggcacaggctgc

SEQ ID NO: 390601 - DNA, 17 bp, Homo sapiens
ggatgggcattgggctg

SEQ ID NO: 390602 - DNA, 18 bp, Homo sapiens
ggatggggagcagctggg

SEQ ID NO: 390603 - DNA, 14 bp, Homo sapiens
ggatggggccacag

SEQ ID NO: 390604 - DNA, 17 bp, Homo sapiens
ggatgggggtgcaggca

SEQ ID NO: 390605 - DNA, 20 bp, Homo sapiens
ggatggtgacttttgaagaa

SEQ ID NO: 390606 - DNA, 22 bp, Homo sapiens
ggatgtatccatgggggcaggg

SEQ ID NO: 390607 - DNA, 23 bp, Homo sapiens
ggatgtatccatgggggcagggc

SEQ ID NO: 390608 - DNA, 23 bp, Homo sapiens
ggatgtcctctttactcccttcc

SEQ ID NO: 390609 - DNA, 17 bp, Homo sapiens
ggatgtcttccttggag

SEQ ID NO: 390610 - DNA, 18 bp, Homo sapiens
ggatgtgtgtctcacccc

SEQ ID NO: 390611 - DNA, 18 bp, Homo sapiens
ggattaacctctgcacta

SEQ ID NO: 390612 - DNA, 19 bp, Homo sapiens
ggattatgggtcacaggaa

SEQ ID NO: 390613 - DNA, 17 bp, Homo sapiens
ggattattcatttaaaa

SEQ ID NO: 390614 - DNA, 21 bp, Homo sapiens
ggattattcatttaaaatgat

SEQ ID NO: 390615 - DNA, 22 bp, Homo sapiens
ggattattcatttaaaatgatt

SEQ ID NO: 390616 - DNA, 11 bp, Homo sapiens
ggattcaaatg

SEQ ID NO: 390617 - DNA, 14 bp, Homo sapiens
ggattcaaatgcat

SEQ ID NO: 390618 - DNA, 13 bp, Homo sapiens
ggattcaggctgc

SEQ ID NO: 390619 - DNA, 15 bp, Homo sapiens
ggattcatggctttg

SEQ ID NO: 390620 - DNA, 21 bp, Homo sapiens
ggattccttctaagtgtactt

SEQ ID NO: 390621 - DNA, 20 bp, Homo sapiens
ggattctactttaagcacta

SEQ ID NO: 390622 - DNA, 15 bp, Homo sapiens
ggattctggatggcc

SEQ ID NO: 390623 - DNA, 23 bp, Homo sapiens
ggattctgggaagcttgagcctc

SEQ ID NO: 390624 - DNA, 15 bp, Homo sapiens
ggattctttccccag

SEQ ID NO: 390625 - DNA, 17 bp, Homo sapiens
ggattctttccccagag

SEQ ID NO: 390626 - DNA, 14 bp, Homo sapiens
ggattgaagccctc

SEQ ID NO: 390627 - DNA, 14 bp, Homo sapiens
ggattgggggctgg

SEQ ID NO: 390628 - DNA, 17 bp, Homo sapiens
ggattgggtcgtggtgg

SEQ ID NO: 390629 - DNA, 18 bp, Homo sapiens
ggattgtccacaaatgtc

SEQ ID NO: 390630 - DNA, 17 bp, Homo sapiens
ggattgtttctggtgac

SEQ ID NO: 390631 - DNA, 16 bp, Homo sapiens
ggatttcaagggactg

SEQ ID NO: 390632 - DNA, 19 bp, Homo sapiens
ggatttcttcgctgctcta

SEQ ID NO: 390633 - DNA, 14 bp, Homo sapiens
ggatttgaaaacac

SEQ ID NO: 390634 - DNA, 13 bp, Homo sapiens
ggatttggttgtt

SEQ ID NO: 390635 - DNA, 17 bp, Homo sapiens
ggattttgtgttttttc

SEQ ID NO: 390636 - DNA, 21 bp, Homo sapiens
ggatttttacaaataaagatg

SEQ ID NO: 390637 - DNA, 17 bp, Homo sapiens
ggcaaaaaagggacagc

SEQ ID NO: 390638 - DNA, 23 bp, Homo sapiens
ggcaaacaggcagttggccagag

SEQ ID NO: 390639 - DNA, 11 bp, Homo sapiens
ggcaaacattt

SEQ ID NO: 390640 - DNA, 20 bp, Homo sapiens
ggcaaagaactgccccatct

SEQ ID NO: 390641 - DNA, 23 bp, Homo sapiens
ggcaaagaactgccccatctcct

SEQ ID NO: 390642 - DNA, 22 bp, Homo sapiens
ggcaaagaggtgctgctttgct

SEQ ID NO: 390643 - DNA, 20 bp, Homo sapiens
ggcaaagccacaaggctggc

SEQ ID NO: 390644 - DNA, 19 bp, Homo sapiens
ggcaaatgccaggacagct

SEQ ID NO: 390645 - DNA, 22 bp, Homo sapiens
ggcaaatgtccaagcatcagca

SEQ ID NO: 390646 - DNA, 16 bp, Homo sapiens
ggcaacagtgttctga

SEQ ID NO: 390647 - DNA, 20 bp, Homo sapiens
ggcaacagtgttctgagccc

SEQ ID NO: 390648 - DNA, 19 bp, Homo sapiens
ggcaaccccctcggagcct

SEQ ID NO: 390649 - DNA, 16 bp, Homo sapiens
ggcaactattaataat

SEQ ID NO: 390650 - DNA, 14 bp, Homo sapiens
ggcaactgtggaag

SEQ ID NO: 390651 - DNA, 23 bp, Homo sapiens
ggcaacttcagtcctgggagacc

SEQ ID NO: 390652 - DNA, 11 bp, Homo sapiens
ggcaagaagac

SEQ ID NO: 390653 - DNA, 18 bp, Homo sapiens
ggcaagaagactgtattt

SEQ ID NO: 390654 - DNA, 17 bp, Homo sapiens
ggcaagacttttctttg

SEQ ID NO: 390655 - DNA, 14 bp, Homo sapiens
ggcaagagaaatga

SEQ ID NO: 390656 - DNA, 21 bp, Homo sapiens
ggcaagagctcaggagaaggc

SEQ ID NO: 390657 - DNA, 19 bp, Homo sapiens
ggcaagagggaaggtgacc

SEQ ID NO: 390658 - DNA, 18 bp, Homo sapiens
ggcaagcccctcagccct

SEQ ID NO: 390659 - DNA, 22 bp, Homo sapiens
ggcaagcccctcagcccttgcc

SEQ ID NO: 390660 - DNA, 21 bp, Homo sapiens
ggcaaggatgaaagacaaaga

SEQ ID NO: 390661 - DNA, 22 bp, Homo sapiens
ggcaaggcagctcccaggttta

SEQ ID NO: 390662 - DNA, 18 bp, Homo sapiens
ggcaaggctgccggctgc

SEQ ID NO: 390663 - DNA, 15 bp, Homo sapiens
ggcaaggctgtcaat

SEQ ID NO: 390664 - DNA, 16 bp, Homo sapiens
ggcaaggctgtcaatt

SEQ ID NO: 390665 - DNA, 15 bp, Homo sapiens
ggcaaggggtttcca

SEQ ID NO: 390666 - DNA, 16 bp, Homo sapiens
ggcaaggtctccttac

SEQ ID NO: 390667 - DNA, 14 bp, Homo sapiens
ggcaaggtggggga

SEQ ID NO: 390668 - DNA, 17 bp, Homo sapiens
ggcaaggtgggggagcc

SEQ ID NO: 390669 - DNA, 20 bp, Homo sapiens
ggcaagtgaggcaagagaaa

SEQ ID NO: 390670 - DNA, 13 bp, Homo sapiens
ggcaagtgattga

SEQ ID NO: 390671 - DNA, 22 bp, Homo sapiens
ggcaataaatgtcccaaataaa

SEQ ID NO: 390672 - DNA, 14 bp, Homo sapiens
ggcaatgactgtga

SEQ ID NO: 390673 - DNA, 18 bp, Homo sapiens
ggcaattattttggatct

SEQ ID NO: 390674 - DNA, 15 bp, Homo sapiens
ggcacaaatgcacct

SEQ ID NO: 390675 - DNA, 17 bp, Homo sapiens
ggcacaccactgccctg

SEQ ID NO: 390676 - DNA, 22 bp, Homo sapiens
ggcacaccactgccctgcctgc

SEQ ID NO: 390677 - DNA, 23 bp, Homo sapiens
ggcacaccactgccctgcctgcc

SEQ ID NO: 390678 - DNA, 21 bp, Homo sapiens
ggcacactacagagcagctcc

SEQ ID NO: 390679 - DNA, 23 bp, Homo sapiens
ggcacactacagagcagctcccc

SEQ ID NO: 390680 - DNA, 21 bp, Homo sapiens
ggcacagacttcacacagcac

SEQ ID NO: 390681 - DNA, 22 bp, Homo sapiens
ggcacagacttctggaaggctg

SEQ ID NO: 390682 - DNA, 15 bp, Homo sapiens
ggcacagctgctgtg

SEQ ID NO: 390683 - DNA, 16 bp, Homo sapiens
ggcacagctgctgtgc

SEQ ID NO: 390684 - DNA, 22 bp, Homo sapiens
ggcacaggctgccccacccctc

SEQ ID NO: 390685 - DNA, 12 bp, Homo sapiens
ggcacagggtct

SEQ ID NO: 390686 - DNA, 10 bp, Homo sapiens
ggcaccaaag

SEQ ID NO: 390687 - DNA, 18 bp, Homo sapiens
ggcaccaaagatgcagcc

SEQ ID NO: 390688 - DNA, 23 bp, Homo sapiens
ggcaccactagggtcctggccct

SEQ ID NO: 390689 - DNA, 13 bp, Homo sapiens
ggcaccagcagca

SEQ ID NO: 390690 - DNA, 13 bp, Homo sapiens
ggcagggctctga

SEQ ID NO: 390691 - DNA, 16 bp, Homo sapiens
ggcaggggagccaggg

SEQ ID NO: 390692 - DNA, 15 bp, Homo sapiens
ggcaggggagtctgc

SEQ ID NO: 390693 - DNA, 19 bp, Homo sapiens
ggcaggggcccctcctctg

SEQ ID NO: 390694 - DNA, 21 bp, Homo sapiens
ggcaggggcccctcctctgtg

SEQ ID NO: 390695 - DNA, 15 bp, Homo sapiens
ggcaggggctctgct

SEQ ID NO: 390696 - DNA, 16 bp, Homo sapiens
ggcaggggctgcatcc

SEQ ID NO: 390697 - DNA, 19 bp, Homo sapiens
ggcaggggctgggcagagg

SEQ ID NO: 390698 - DNA, 20 bp, Homo sapiens
ggcaggtcccgagccccctg

SEQ ID NO: 390699 - DNA, 21 bp, Homo sapiens
ggcaggtcccgagccccctgt

SEQ ID NO: 390700 - DNA, 19 bp, Homo sapiens
ggcaggtcctggggaggct

SEQ ID NO: 390701 - DNA, 13 bp, Homo sapiens
ggcaggtggccac

SEQ ID NO: 390702 - DNA, 16 bp, Homo sapiens
ggcaggtggcctaagg

SEQ ID NO: 390703 - DNA, 12 bp, Homo sapiens
ggcaggtgggag

SEQ ID NO: 390704 - DNA, 17 bp, Homo sapiens
ggcaggtgggagcttga

SEQ ID NO: 390705 - DNA, 22 bp, Homo sapiens
ggcaggtgttgggacctgctgc

SEQ ID NO: 390706 - DNA, 19 bp, Homo sapiens
ggcaggttggatgggagtg

SEQ ID NO: 390707 - DNA, 18 bp, Homo sapiens
ggcagtatggcggaggcc

SEQ ID NO: 390708 - DNA, 19 bp, Homo sapiens
ggcagtcacctgcccagat

SEQ ID NO: 390709 - DNA, 13 bp, Homo sapiens
ggcagtccagagc

SEQ ID NO: 390710 - DNA, 19 bp, Homo sapiens
ggcagtgacgtgagtgggg

SEQ ID NO: 390711 - DNA, 13 bp, Homo sapiens
ggcagtgactggc

SEQ ID NO: 390712 - DNA, 15 bp, Homo sapiens
ggcagtgactggcag

SEQ ID NO: 390713 - DNA, 16 bp, Homo sapiens
ggcagtgcccaccatg

SEQ ID NO: 390714 - DNA, 13 bp, Homo sapiens
ggcagtggagagg

SEQ ID NO: 390715 - DNA, 17 bp, Homo sapiens
ggcagttagagatgcct

SEQ ID NO: 390716 - DNA, 19 bp, Homo sapiens
ggcagtttttgttccttcc

SEQ ID NO: 390717 - DNA, 20 bp, Homo sapiens
ggcataccgtttggtgtctg

SEQ ID NO: 390718 - DNA, 18 bp, Homo sapiens
tgtaagaatccaaagtgg

SEQ ID NO: 390719 - DNA, 11 bp, Homo sapiens
tgtaagacaca

SEQ ID NO: 390720 - DNA, 19 bp, Homo sapiens
tgtaagacacacagccttt

SEQ ID NO: 390721 - DNA, 20 bp, Homo sapiens
tgtaagacacacagcctttc

SEQ ID NO: 390722 - DNA, 22 bp, Homo sapiens
tgtaagacacacagcctttctg

SEQ ID NO: 390723 - DNA, 17 bp, Homo sapiens
tgtaagagaatgttgaa

SEQ ID NO: 390724 - DNA, 18 bp, Homo sapiens
tgtaagagcaccttcctc

SEQ ID NO: 390725 - DNA, 11 bp, Homo sapiens
tgtaagatgtt

SEQ ID NO: 390726 - DNA, 19 bp, Homo sapiens
tgtaagattttattttcaa

SEQ ID NO: 390727 - DNA, 21 bp, Homo sapiens
tgtaagcacctgggctgagga

SEQ ID NO: 390728 - DNA, 22 bp, Homo sapiens
tgtaagcattctgagctgggct

SEQ ID NO: 390729 - DNA, 13 bp, Homo sapiens
tgtaaggaatgat

SEQ ID NO: 390730 - DNA, 18 bp, Homo sapiens
tgtaaggaatgattaatt

SEQ ID NO: 390731 - DNA, 20 bp, Homo sapiens
tgtaaggactcagtgttgac

SEQ ID NO: 390732 - DNA, 14 bp, Homo sapiens
tgtaaggtcttctt

SEQ ID NO: 390733 - DNA, 21 bp, Homo sapiens
tgtaagtaaatgtctgtggcc

SEQ ID NO: 390734 - DNA, 19 bp, Homo sapiens
tgtaagtttatgtctaaag

SEQ ID NO: 390735 - DNA, 20 bp, Homo sapiens
tgtaataaaaagtatatgtt

SEQ ID NO: 390736 - DNA, 13 bp, Homo sapiens
tgtaataaagtat

SEQ ID NO: 390737 - DNA, 16 bp, Homo sapiens
tgtaatagaaaactga

SEQ ID NO: 390738 - DNA, 18 bp, Homo sapiens
tgtaatagaaaactgaaa

SEQ ID NO: 390739 - DNA, 20 bp, Homo sapiens
tgtaatagaaaactgaaaat

SEQ ID NO: 390740 - DNA, 18 bp, Homo sapiens
tgtaatatcatttcataa

SEQ ID NO: 390741 - DNA, 14 bp, Homo sapiens
tgtaatatgatttt

SEQ ID NO: 390742 - DNA, 15 bp, Homo sapiens
tgtaatatttcttca

SEQ ID NO: 390743 - DNA, 20 bp, Homo sapiens
tgtaatatttcttcaagtga

SEQ ID NO: 390744 - DNA, 16 bp, Homo sapiens
tgtaatcccagctact

SEQ ID NO: 390745 - DNA, 15 bp, Homo sapiens
tgtaatctctgatta

SEQ ID NO: 390746 - DNA, 19 bp, Homo sapiens
tgtaatctgctttgttaat

SEQ ID NO: 390747 - DNA, 14 bp, Homo sapiens
tgtaatcttaaaag

SEQ ID NO: 390748 - DNA, 17 bp, Homo sapiens
tgtaatctttttctcca

SEQ ID NO: 390749 - DNA, 21 bp, Homo sapiens
tgtaatgacagagagttctgg

SEQ ID NO: 390750 - DNA, 14 bp, Homo sapiens
tgtaatgtatctta

SEQ ID NO: 390751 - DNA, 13 bp, Homo sapiens
tgtaatgttactg

SEQ ID NO: 390752 - DNA, 13 bp, Homo sapiens
tgtaattcaagct

SEQ ID NO: 390753 - DNA, 13 bp, Homo sapiens
tgtaattctaaat

SEQ ID NO: 390754 - DNA, 14 bp, Homo sapiens
tgtaattgcttaca

SEQ ID NO: 390755 - DNA, 15 bp, Homo sapiens
tgtaattgcttacat

SEQ ID NO: 390756 - DNA, 23 bp, Homo sapiens
tgtaattgcttacatttttacaa

SEQ ID NO: 390757 - DNA, 15 bp, Homo sapiens
tgtaattgtttgtct

SEQ ID NO: 390758 - DNA, 21 bp, Homo sapiens
tgtaattttaaataaaagtga

SEQ ID NO: 390759 - DNA, 17 bp, Homo sapiens
tgtaattttgtagtagt

SEQ ID NO: 390760 - DNA, 21 bp, Homo sapiens
tgtacaaaatcgattggcttt

SEQ ID NO: 390761 - DNA, 22 bp, Homo sapiens
tgtacaaagatacttgatgcac

SEQ ID NO: 390762 - DNA, 21 bp, Homo sapiens
tgtacaaagtagagaagtatc

SEQ ID NO: 390763 - DNA, 17 bp, Homo sapiens
tgtacaagtgctcagtt

SEQ ID NO: 390764 - DNA, 22 bp, Homo sapiens
tgtacaagtgctcagttccaat

SEQ ID NO: 390765 - DNA, 19 bp, Homo sapiens
tgtacaagttttgtataaa

SEQ ID NO: 390766 - DNA, 16 bp, Homo sapiens
tgtacacttgggtgaa

SEQ ID NO: 390767 - DNA, 20 bp, Homo sapiens
tgtacagattgctgcttctg

SEQ ID NO: 390768 - DNA, 13 bp, Homo sapiens
tgtacagtatgtg

SEQ ID NO: 390769 - DNA, 18 bp, Homo sapiens
tgtacagtatgttcaaag

SEQ ID NO: 390770 - DNA, 22 bp, Homo sapiens
tgtacagtatttaccttccttt

SEQ ID NO: 390771 - DNA, 15 bp, Homo sapiens
tgtacagtctgtcat

SEQ ID NO: 390772 - DNA, 18 bp, Homo sapiens
tgtacagtctgtcatgaa

SEQ ID NO: 390773 - DNA, 23 bp, Homo sapiens
tgtacagtctgtcatgaacatgt

SEQ ID NO: 390774 - DNA, 17 bp, Homo sapiens
tgtacagtgtctgtgcc

SEQ ID NO: 390775 - DNA, 23 bp, Homo sapiens
tgtacagttaactctcccaggtg

SEQ ID NO: 390776 - DNA, 15 bp, Homo sapiens
tgtacagttatacat

SEQ ID NO: 390777 - DNA, 20 bp, Homo sapiens
tgtacagttcagttcctctt

SEQ ID NO: 390778 - DNA, 21 bp, Homo sapiens
tgtacatatggaaatcctgtt

SEQ ID NO: 390779 - DNA, 20 bp, Homo sapiens
tgtacatatttgagactagt

SEQ ID NO: 390780 - DNA, 17 bp, Homo sapiens
tgtacatttatgtgtga

SEQ ID NO: 390781 - DNA, 18 bp, Homo sapiens
tgtacatttatgtgtgaa

SEQ ID NO: 390782 - DNA, 17 bp, Homo sapiens
tgtacattttttttcaa

SEQ ID NO: 390783 - DNA, 13 bp, Homo sapiens
tgtaccactgcta

SEQ ID NO: 390784 - DNA, 15 bp, Homo sapiens
tgtaccactgctaat

SEQ ID NO: 390785 - DNA, 16 bp, Homo sapiens
tgtaccactgctaata

SEQ ID NO: 390786 - DNA, 18 bp, Homo sapiens
tgtaccactgctaataaa

SEQ ID NO: 390787 - DNA, 20 bp, Homo sapiens
tgtaccagtgtactgctttc

SEQ ID NO: 390788 - DNA, 12 bp, Homo sapiens
tgtaccatgtac

SEQ ID NO: 390789 - DNA, 15 bp, Homo sapiens
tgtaccattctgttg

SEQ ID NO: 390790 - DNA, 20 bp, Homo sapiens
tgtacccagccaccttcctg

SEQ ID NO: 390791 - DNA, 12 bp, Homo sapiens
tgtacccagctc

SEQ ID NO: 390792 - DNA, 16 bp, Homo sapiens
tgtacccttccacctc

SEQ ID NO: 390793 - DNA, 13 bp, Homo sapiens
tgtacctctctct

SEQ ID NO: 390794 - DNA, 18 bp, Homo sapiens
tgtacctctctctgctcc

SEQ ID NO: 390795 - DNA, 20 bp, Homo sapiens
tgtacctctctctgctcctc

SEQ ID NO: 390796 - DNA, 21 bp, Homo sapiens
tgtacctgcccccactcagca

SEQ ID NO: 390797 - DNA, 22 bp, Homo sapiens
tgtacctgcccccactcagcat

SEQ ID NO: 390798 - DNA, 16 bp, Homo sapiens
tgtacctgtaggaaac

SEQ ID NO: 390799 - DNA, 17 bp, Homo sapiens
tgtactaagccaggagg

SEQ ID NO: 390800 - DNA, 16 bp, Homo sapiens
tgtactacatttgcat

SEQ ID NO: 390801 - DNA, 15 bp, Homo sapiens
tgtactatatgtata

SEQ ID NO: 390802 - DNA, 18 bp, Homo sapiens
tgtactatttaactgact

SEQ ID NO: 390803 - DNA, 14 bp, Homo sapiens
tgtactcagagcag

SEQ ID NO: 390804 - DNA, 19 bp, Homo sapiens
tgtactcagagcagagcaa

SEQ ID NO: 390805 - DNA, 23 bp, Homo sapiens
tgtactgagaggaggggtaaata

SEQ ID NO: 390806 - DNA, 18 bp, Homo sapiens
tgtactgctagtacctgt

SEQ ID NO: 390807 - DNA, 21 bp, Homo sapiens
tgtactggccagtgtcatttt

SEQ ID NO: 390808 - DNA, 16 bp, Homo sapiens
tgtactgtaaagaatt

SEQ ID NO: 390809 - DNA, 20 bp, Homo sapiens
tgtacttcataagatattct

SEQ ID NO: 390810 - DNA, 21 bp, Homo sapiens
tgtacttcgtcttctaatttc

SEQ ID NO: 390811 - DNA, 15 bp, Homo sapiens
tgtacttcttcatcc

SEQ ID NO: 390812 - DNA, 22 bp, Homo sapiens
tgtacttgtgtttgcttaaaca

SEQ ID NO: 390813 - DNA, 21 bp, Homo sapiens
tgtactttgatttacagtgcc

SEQ ID NO: 390814 - DNA, 16 bp, Homo sapiens
tgtacttttaaggcag

SEQ ID NO: 390815 - DNA, 22 bp, Homo sapiens
tgtagaaaaatactgattttaa

SEQ ID NO: 390816 - DNA, 21 bp, Homo sapiens
tgtagaaacacagttttgaaa

SEQ ID NO: 390817 - DNA, 23 bp, Homo sapiens
tgtagaaacacagttttgaaaga

SEQ ID NO: 390818 - DNA, 16 bp, Homo sapiens
tgtagaaagatacact

SEQ ID NO: 390819 - DNA, 12 bp, Homo sapiens
tgtagaaatgta

SEQ ID NO: 390820 - DNA, 14 bp, Homo sapiens
tgtagaagagggag

SEQ ID NO: 390821 - DNA, 15 bp, Homo sapiens
tgtagaagagggaga

SEQ ID NO: 390822 - DNA, 21 bp, Homo sapiens
tgtagaagatggactctgaaa

SEQ ID NO: 390823 - DNA, 15 bp, Homo sapiens
tgtagaatgctgtag

SEQ ID NO: 390824 - DNA, 17 bp, Homo sapiens
tgtagaatgctgtagaa

SEQ ID NO: 390825 - DNA, 12 bp, Homo sapiens
tgtagagacttc

SEQ ID NO: 390826 - DNA, 20 bp, Homo sapiens
tgtagagacttccgtcaccc

SEQ ID NO: 390827 - DNA, 13 bp, Homo sapiens
tgtagagccagcc

SEQ ID NO: 390828 - DNA, 14 bp, Homo sapiens
tgtagagcttctgg

SEQ ID NO: 390829 - DNA, 20 bp, Homo sapiens
tgtagagtggcgattgaatg

SEQ ID NO: 390830 - DNA, 20 bp, Homo sapiens
tgtagatacaatcagctgct

SEQ ID NO: 390831 - DNA, 20 bp, Homo sapiens
tgtagatgggggaactgtga

SEQ ID NO: 390832 - DNA, 21 bp, Homo sapiens
tgtagatgggggaactgtgaa

SEQ ID NO: 390833 - DNA, 17 bp, Homo sapiens
tgtagatgtattttcaa

SEQ ID NO: 390834 - DNA, 16 bp, Homo sapiens
tgtagattgtgtaaat

SEQ ID NO: 390835 - DNA, 16 bp, Homo sapiens
tgtagcaggtttcact

SEQ ID NO: 390836 - DNA, 18 bp, Homo sapiens
tgtagcaggtttcactat

SEQ ID NO: 390837 - DNA, 12 bp, Homo sapiens
tgtagcattgtt

SEQ ID NO: 390838 - DNA, 14 bp, Homo sapiens
tgtagccatggctc

SEQ ID NO: 390839 - DNA, 16 bp, Homo sapiens
tgtagccatggctcag

SEQ ID NO: 390840 - DNA, 16 bp, Homo sapiens
tgtagcccacacttga

SEQ ID NO: 390841 - DNA, 17 bp, Homo sapiens
tgtagcgtcctgaggaa

SEQ ID NO: 390842 - DNA, 19 bp, Homo sapiens
tgtagcgtcctgaggaata

SEQ ID NO: 390843 - DNA, 18 bp, Homo sapiens
tgtagctagtttaaaatt

SEQ ID NO: 390844 - DNA, 21 bp, Homo sapiens
tgtagctagtttaaaattatt

SEQ ID NO: 390845 - DNA, 14 bp, Homo sapiens
tgtagctattcttt

SEQ ID NO: 390846 - DNA, 15 bp, Homo sapiens
tgtagctccctcctc

SEQ ID NO: 390847 - DNA, 19 bp, Homo sapiens
tgtagctccctcctcccat

SEQ ID NO: 390848 - DNA, 21 bp, Homo sapiens
tgtagctccctcctcccatct

SEQ ID NO: 390849 - DNA, 13 bp, Homo sapiens
tgtagctgtcctc

SEQ ID NO: 390850 - DNA, 16 bp, Homo sapiens
tgtagcttaaaaaaag

SEQ ID NO: 390851 - DNA, 20 bp, Homo sapiens
tgtaggaaaagctgttccca

SEQ ID NO: 390852 - DNA, 16 bp, Homo sapiens
tgtaggaaacagaaaa

SEQ ID NO: 390853 - DNA, 18 bp, Homo sapiens
tgtaggaatctgccttcc

SEQ ID NO: 390854 - DNA, 14 bp, Homo sapiens
tgtaggactgtata

SEQ ID NO: 390855 - DNA, 15 bp, Homo sapiens
tgtaggagagactgg

SEQ ID NO: 390856 - DNA, 18 bp, Homo sapiens
tgtaggagtaaagataaa

SEQ ID NO: 390857 - DNA, 12 bp, Homo sapiens
tgtaggagtgag

SEQ ID NO: 390858 - DNA, 17 bp, Homo sapiens
tgtaggcgcccctgggg

SEQ ID NO: 390859 - DNA, 18 bp, Homo sapiens
tgtaggcgcccctggggt

SEQ ID NO: 390860 - DNA, 14 bp, Homo sapiens
tgtaggctccacct

SEQ ID NO: 390861 - DNA, 12 bp, Homo sapiens
tgtagggaactc

SEQ ID NO: 390862 - DNA, 13 bp, Homo sapiens
tgtagggtttcta

SEQ ID NO: 390863 - DNA, 15 bp, Homo sapiens
tgtaggtcaatgaaa

SEQ ID NO: 390864 - DNA, 18 bp, Homo sapiens
tgtaggtcaatgaaatat

SEQ ID NO: 390865 - DNA, 17 bp, Homo sapiens
tgtaggttgtctaaaaa

SEQ ID NO: 390866 - DNA, 23 bp, Homo sapiens
tgtagtaaatattatgattttat

SEQ ID NO: 390867 - DNA, 19 bp, Homo sapiens
tgtagtcccacttacttgg

SEQ ID NO: 390868 - DNA, 17 bp, Homo sapiens
tgtagtgagtgtagact

SEQ ID NO: 390869 - DNA, 15 bp, Homo sapiens
tgtagtggaagagca

SEQ ID NO: 390870 - DNA, 20 bp, Homo sapiens
tgtagtggaagagcagcctg

SEQ ID NO: 390871 - DNA, 15 bp, Homo sapiens
tgtagtgtgtttgtg

SEQ ID NO: 390872 - DNA, 23 bp, Homo sapiens
tgtagtgtgtttgtgagtatgtg

SEQ ID NO: 390873 - DNA, 18 bp, Homo sapiens
tgtagttacctactgagt

SEQ ID NO: 390874 - DNA, 14 bp, Homo sapiens
tgtagttaggaaat

SEQ ID NO: 390875 - DNA, 15 bp, Homo sapiens
tgtagttaggaaata

SEQ ID NO: 390876 - DNA, 15 bp, Homo sapiens
tgtagttttacttgg

SEQ ID NO: 390877 - DNA, 17 bp, Homo sapiens
tgtagttttacttggtg

SEQ ID NO: 390878 - DNA, 17 bp, Homo sapiens
tgtagtttttgctgaag

SEQ ID NO: 390879 - DNA, 13 bp, Homo sapiens
tgtataaataata

SEQ ID NO: 390880 - DNA, 21 bp, Homo sapiens
tgtataaataataaagaactc

SEQ ID NO: 390881 - DNA, 23 bp, Homo sapiens
tgtataaatgaagtttatacagt

SEQ ID NO: 390882 - DNA, 16 bp, Homo sapiens
tgtatacattttgtta

SEQ ID NO: 390883 - DNA, 21 bp, Homo sapiens
tgtataccatgatgcatggag

SEQ ID NO: 390884 - DNA, 19 bp, Homo sapiens
tgtatagatgcaagatatt

SEQ ID NO: 390885 - DNA, 20 bp, Homo sapiens
tgtatagatgcaagatattt

SEQ ID NO: 390886 - DNA, 17 bp, Homo sapiens
tgtataggccatctgta

SEQ ID NO: 390887 - DNA, 20 bp, Homo sapiens
tgtataggccatctgtaaat

SEQ ID NO: 390888 - DNA, 21 bp, Homo sapiens
tgtataggccatctgtaaata

SEQ ID NO: 390889 - DNA, 18 bp, Homo sapiens
tgtataggtagatccaga

SEQ ID NO: 390890 - DNA, 19 bp, Homo sapiens
tgtatagtgcctaaaattg

SEQ ID NO: 390891 - DNA, 22 bp, Homo sapiens
tgtatagttttataaaactcag

SEQ ID NO: 390892 - DNA, 12 bp, Homo sapiens
tgtatatacatt

SEQ ID NO: 390893 - DNA, 13 bp, Homo sapiens
tgtatatatacat

SEQ ID NO: 390894 - DNA, 14 bp, Homo sapiens
tgtatatatacata

SEQ ID NO: 390895 - DNA, 17 bp, Homo sapiens
tgtatatatacataaca

SEQ ID NO: 390896 - DNA, 15 bp, Homo sapiens
tgtatatatgtgtgt

SEQ ID NO: 390897 - DNA, 20 bp, Homo sapiens
tgtatatatgtgtgtttaaa

SEQ ID NO: 390898 - DNA, 18 bp, Homo sapiens
tgtatatcatgaagcctt

SEQ ID NO: 390899 - DNA, 20 bp, Homo sapiens
tgtatatccttccaaaaaat

SEQ ID NO: 390900 - DNA, 18 bp, Homo sapiens
tgtatatcctttctaaca

SEQ ID NO: 390901 - DNA, 14 bp, Homo sapiens
tgtatatctttgca

SEQ ID NO: 390902 - DNA, 13 bp, Homo sapiens
tgtatattactga

SEQ ID NO: 390903 - DNA, 20 bp, Homo sapiens
tgtatattatcttctggtgc

SEQ ID NO: 390904 - DNA, 16 bp, Homo sapiens
tgtatatttaacttct

SEQ ID NO: 390905 - DNA, 16 bp, Homo sapiens
tgtatatttgaaactg

SEQ ID NO: 390906 - DNA, 22 bp, Homo sapiens
tgtatcaaactcgtctgatgtt

SEQ ID NO: 390907 - DNA, 21 bp, Homo sapiens
tgtatcaaatctgtatatgtt

SEQ ID NO: 390908 - DNA, 22 bp, Homo sapiens
tgtatcaccctcagctggcgga

SEQ ID NO: 390909 - DNA, 21 bp, Homo sapiens
tgtatcaggaaatatatatgt

SEQ ID NO: 390910 - DNA, 21 bp, Homo sapiens
tgtatccaagttatttgatct

SEQ ID NO: 390911 - DNA, 19 bp, Homo sapiens
tgtatcctccattgtatct

SEQ ID NO: 390912 - DNA, 15 bp, Homo sapiens
tgtatcctggggctc

SEQ ID NO: 390913 - DNA, 19 bp, Homo sapiens
tgtatcctggggctccctt

SEQ ID NO: 390914 - DNA, 15 bp, Homo sapiens
tgtatctaaaaaata

SEQ ID NO: 390915 - DNA, 20 bp, Homo sapiens
tgtatctaaaaaataactgt

SEQ ID NO: 390916 - DNA, 21 bp, Homo sapiens
tgtatctagtgcagctgattt

SEQ ID NO: 390917 - DNA, 17 bp, Homo sapiens
tgtatctctgaagcatg

SEQ ID NO: 390918 - DNA, 22 bp, Homo sapiens
tgtatctctgaagcatgtttca

SEQ ID NO: 390919 - DNA, 13 bp, Homo sapiens
tgtatctgagcag

SEQ ID NO: 390920 - DNA, 12 bp, Homo sapiens
tgtatcttaaat

SEQ ID NO: 390921 - DNA, 13 bp, Homo sapiens
tgtatcttattta

SEQ ID NO: 390922 - DNA, 18 bp, Homo sapiens
tgtatcttatttatatat

SEQ ID NO: 390923 - DNA, 15 bp, Homo sapiens
tgtatgaaaatcctt

SEQ ID NO: 390924 - DNA, 22 bp, Homo sapiens
tgtatgaaaatccttttaacca

SEQ ID NO: 390925 - DNA, 16 bp, Homo sapiens
tgtatgaagtactttt

SEQ ID NO: 390926 - DNA, 18 bp, Homo sapiens
tgtatgatgtgttgtgat

SEQ ID NO: 390927 - DNA, 18 bp, Homo sapiens
tgtatgcacgtgtgcaca

SEQ ID NO: 390928 - DNA, 14 bp, Homo sapiens
tgtatgcactttgt

SEQ ID NO: 390929 - DNA, 17 bp, Homo sapiens
tgtatggagagaaaaca

SEQ ID NO: 390930 - DNA, 17 bp, Homo sapiens
tgtatgtatgtgtagtg

SEQ ID NO: 390931 - DNA, 21 bp, Homo sapiens
tgtatgtcagacatccatgtt

SEQ ID NO: 390932 - DNA, 12 bp, Homo sapiens
tgtatgtgaaag

SEQ ID NO: 390933 - DNA, 13 bp, Homo sapiens
tgtatgtgaaagt

SEQ ID NO: 390934 - DNA, 23 bp, Homo sapiens
tgtatgtgaaagtgtaaaataga

SEQ ID NO: 390935 - DNA, 17 bp, Homo sapiens
tgtatgtgcactgtcac

SEQ ID NO: 390936 - DNA, 19 bp, Homo sapiens
tgtatgtgtttataattgt

SEQ ID NO: 390937 - DNA, 15 bp, Homo sapiens
tgtatgttatgaaca

SEQ ID NO: 390938 - DNA, 16 bp, Homo sapiens
tgtatgttatgaacat

SEQ ID NO: 390939 - DNA, 23 bp, Homo sapiens
tgtatgttgtgaagatgtttgca

SEQ ID NO: 390940 - DNA, 15 bp, Homo sapiens
tgtattaaacttgaa

SEQ ID NO: 390941 - DNA, 19 bp, Homo sapiens
tgtattaattataccagtg

SEQ ID NO: 390942 - DNA, 15 bp, Homo sapiens
tgtattaccagcccc

SEQ ID NO: 390943 - DNA, 14 bp, Homo sapiens
tgtattagccagtc

SEQ ID NO: 390944 - DNA, 17 bp, Homo sapiens
tgtattagccagtcatt

SEQ ID NO: 390945 - DNA, 20 bp, Homo sapiens
tgtattagccagtcattgta

SEQ ID NO: 390946 - DNA, 21 bp, Homo sapiens
tgtattagccagtcattgtaa

SEQ ID NO: 390947 - DNA, 23 bp, Homo sapiens
tgtattaggactggctttgtccc

SEQ ID NO: 390948 - DNA, 21 bp, Homo sapiens
tgtattcaagcaaacatcaaa

SEQ ID NO: 390949 - DNA, 14 bp, Homo sapiens
tgtattcactaaaa

SEQ ID NO: 390950 - DNA, 20 bp, Homo sapiens
ggccacatccaacatttcct

SEQ ID NO: 390951 - DNA, 23 bp, Homo sapiens
ggccaccagctccactggcctgc

SEQ ID NO: 390952 - DNA, 20 bp, Homo sapiens
ggccaccatctgtaccctgc

SEQ ID NO: 390953 - DNA, 21 bp, Homo sapiens
ggccaccatgcactcaataaa

SEQ ID NO: 390954 - DNA, 22 bp, Homo sapiens
ggccacccaccagggctcagct

SEQ ID NO: 390955 - DNA, 23 bp, Homo sapiens
ggccacccaccagggctcagctc

SEQ ID NO: 390956 - DNA, 13 bp, Homo sapiens
ggccacccaccct

SEQ ID NO: 390957 - DNA, 19 bp, Homo sapiens
ggccaccccaaaccccagc

SEQ ID NO: 390958 - DNA, 21 bp, Homo sapiens
ggccaccccaaaccccagccc

SEQ ID NO: 390959 - DNA, 20 bp, Homo sapiens
ggccaccccgtgccacccgt

SEQ ID NO: 390960 - DNA, 10 bp, Homo sapiens
ggccaccctc

SEQ ID NO: 390961 - DNA, 19 bp, Homo sapiens
ggccacccttggcctgtcc

SEQ ID NO: 390962 - DNA, 13 bp, Homo sapiens
ggccacctgcagg

SEQ ID NO: 390963 - DNA, 14 bp, Homo sapiens
ggccacctgccccc

SEQ ID NO: 390964 - DNA, 18 bp, Homo sapiens
ggccacgcagccaggaca

SEQ ID NO: 390965 - DNA, 13 bp, Homo sapiens
ggccacggcctgg

SEQ ID NO: 390966 - DNA, 14 bp, Homo sapiens
ggccacgggggagg

SEQ ID NO: 390967 - DNA, 22 bp, Homo sapiens
ggccacgtatagtcctagctga

SEQ ID NO: 390968 - DNA, 20 bp, Homo sapiens
ggccactgcagtcacccctg

SEQ ID NO: 390969 - DNA, 14 bp, Homo sapiens
ggccactggcatct

SEQ ID NO: 390970 - DNA, 17 bp, Homo sapiens
ggccactgtggccagag

SEQ ID NO: 390971 - DNA, 17 bp, Homo sapiens
ggccactttgcagacct

SEQ ID NO: 390972 - DNA, 13 bp, Homo sapiens
ggccagaaggagg

SEQ ID NO: 390973 - DNA, 14 bp, Homo sapiens
ggccagaaggaggg

SEQ ID NO: 390974 - DNA, 22 bp, Homo sapiens
ggccagaaggagggcagagcca

SEQ ID NO: 390975 - DNA, 15 bp, Homo sapiens
ggccagactggctgc

SEQ ID NO: 390976 - DNA, 22 bp, Homo sapiens
ggccagactggctgcacagccc

SEQ ID NO: 390977 - DNA, 23 bp, Homo sapiens
ggccagagagcctggtgctgctg

SEQ ID NO: 390978 - DNA, 12 bp, Homo sapiens
ggccagagaggg

SEQ ID NO: 390979 - DNA, 16 bp, Homo sapiens
ggccagagagggccca

SEQ ID NO: 390980 - DNA, 18 bp, Homo sapiens
ggccagagagggcccagc

SEQ ID NO: 390981 - DNA, 15 bp, Homo sapiens
ggccagagcacctca

SEQ ID NO: 390982 - DNA, 19 bp, Homo sapiens
ggccagagcacctcaggac

SEQ ID NO: 390983 - DNA, 14 bp, Homo sapiens
ggccagagctccca

SEQ ID NO: 390984 - DNA, 16 bp, Homo sapiens
ggccagagctggaagg

SEQ ID NO: 390985 - DNA, 18 bp, Homo sapiens
ggccagagctggaaggca

SEQ ID NO: 390986 - DNA, 19 bp, Homo sapiens
ggccagagctggaaggcag

SEQ ID NO: 390987 - DNA, 20 bp, Homo sapiens
ggccagagctggaaggcagg

SEQ ID NO: 390988 - DNA, 23 bp, Homo sapiens
ggccagagctggaaggcagggca

SEQ ID NO: 390989 - DNA, 17 bp, Homo sapiens
ggccagaggcagaaccc

SEQ ID NO: 390990 - DNA, 13 bp, Homo sapiens
ggccagaggcagc

SEQ ID NO: 390991 - DNA, 14 bp, Homo sapiens
ggccagagtggcct

SEQ ID NO: 390992 - DNA, 16 bp, Homo sapiens
ggccagagtggcctgg

SEQ ID NO: 390993 - DNA, 18 bp, Homo sapiens
ggccagagtggcctggcc

SEQ ID NO: 390994 - DNA, 20 bp, Homo sapiens
ggccagatgttgttcctggc

SEQ ID NO: 390995 - DNA, 16 bp, Homo sapiens
ggccagcaaggcaggt

SEQ ID NO: 390996 - DNA, 19 bp, Homo sapiens
ggccagcatccatgcggcc

SEQ ID NO: 390997 - DNA, 14 bp, Homo sapiens
aatttgaatggatt

SEQ ID NO: 390998 - DNA, 19 bp, Homo sapiens
aatttgatggtgaatatta

SEQ ID NO: 390999 - DNA, 21 bp, Homo sapiens
aatttgatggtgaatattaca

SEQ ID NO: 391000 - DNA, 19 bp, Homo sapiens
aatttgcatattctattgt

SEQ ID NO: 391001 - DNA, 12 bp, Homo sapiens
aatttgggcctc

SEQ ID NO: 391002 - DNA, 15 bp, Homo sapiens
aatttgggcctcttg

SEQ ID NO: 391003 - DNA, 20 bp, Homo sapiens
aatttggtcttagctttaca

SEQ ID NO: 391004 - DNA, 15 bp, Homo sapiens
aatttgtaagtttat

SEQ ID NO: 391005 - DNA, 15 bp, Homo sapiens
aatttgtaattgctt

SEQ ID NO: 391006 - DNA, 17 bp, Homo sapiens
aatttgtagggtttcta

SEQ ID NO: 391007 - DNA, 18 bp, Homo sapiens
aatttgtatctgaaggag

SEQ ID NO: 391008 - DNA, 19 bp, Homo sapiens
aatttgtatctgaaggaga

SEQ ID NO: 391009 - DNA, 20 bp, Homo sapiens
aatttgtatctgaaggagat

SEQ ID NO: 391010 - DNA, 12 bp, Homo sapiens
aatttgtcactg

SEQ ID NO: 391011 - DNA, 16 bp, Homo sapiens
aatttgtctcctactc

SEQ ID NO: 391012 - DNA, 18 bp, Homo sapiens
aatttgttatacttcaaa

SEQ ID NO: 391013 - DNA, 19 bp, Homo sapiens
aatttgttgtcatgtgtat

SEQ ID NO: 391014 - DNA, 14 bp, Homo sapiens
aatttgtttaaaga

SEQ ID NO: 391015 - DNA, 15 bp, Homo sapiens
aatttgtttaaagaa

SEQ ID NO: 391016 - DNA, 17 bp, Homo sapiens
aattttaaaaaataaca

SEQ ID NO: 391017 - DNA, 20 bp, Homo sapiens
aattttaaaaaataacatat

SEQ ID NO: 391018 - DNA, 15 bp, Homo sapiens
aattttaaaagcata

SEQ ID NO: 391019 - DNA, 18 bp, Homo sapiens
aattttaaataaaagtga

SEQ ID NO: 391020 - DNA, 23 bp, Homo sapiens
aattttaacaaacgcattaagag

SEQ ID NO: 391021 - DNA, 21 bp, Homo sapiens
aattttaacgtaactctttct

SEQ ID NO: 391022 - DNA, 16 bp, Homo sapiens
aattttacatgtctca

SEQ ID NO: 391023 - DNA, 11 bp, Homo sapiens
aattttacttc

SEQ ID NO: 391024 - DNA, 13 bp, Homo sapiens
aattttatattct

SEQ ID NO: 391025 - DNA, 19 bp, Homo sapiens
aattttatgaactgcatgt

SEQ ID NO: 391026 - DNA, 19 bp, Homo sapiens
aattttcaagtaattgtga

SEQ ID NO: 391027 - DNA, 19 bp, Homo sapiens
aattttccattaatttcaa

SEQ ID NO: 391028 - DNA, 20 bp, Homo sapiens
aattttccattaatttcaac

SEQ ID NO: 391029 - DNA, 11 bp, Homo sapiens
aattttctaag

SEQ ID NO: 391030 - DNA, 21 bp, Homo sapiens
aattttgaataaataaatgta

SEQ ID NO: 391031 - DNA, 15 bp, Homo sapiens
aattttgaggtcttt

SEQ ID NO: 391032 - DNA, 17 bp, Homo sapiens
aattttggccaaagtgt

SEQ ID NO: 391033 - DNA, 18 bp, Homo sapiens
aattttggtgatgtaaaa

SEQ ID NO: 391034 - DNA, 21 bp, Homo sapiens
aattttggtgatgtaaaacag

SEQ ID NO: 391035 - DNA, 13 bp, Homo sapiens
aattttgtacaaa

SEQ ID NO: 391036 - DNA, 13 bp, Homo sapiens
aattttgtacgta

SEQ ID NO: 391037 - DNA, 17 bp, Homo sapiens
aatttttaaaagacttt

SEQ ID NO: 391038 - DNA, 13 bp, Homo sapiens
aatttttaagcaa

SEQ ID NO: 391039 - DNA, 13 bp, Homo sapiens
aatttttaatgtt

SEQ ID NO: 391040 - DNA, 14 bp, Homo sapiens
aatttttacagaat

SEQ ID NO: 391041 - DNA, 13 bp, Homo sapiens
aatttttgttttg

SEQ ID NO: 391042 - DNA, 17 bp, Homo sapiens
aatttttttaaggaaaa

SEQ ID NO: 391043 - DNA, 23 bp, Homo sapiens
aatttttttatgttttgtttctg

SEQ ID NO: 391044 - DNA, 19 bp, Homo sapiens
aatttttttcaatatttat

SEQ ID NO: 391045 - DNA, 14 bp, Homo sapiens
aattttttttaaca

SEQ ID NO: 391046 - DNA, 18 bp, Homo sapiens
aattttttttaacattcc

SEQ ID NO: 391047 - DNA, 19 bp, Homo sapiens
aattttttttaatgtacaa

SEQ ID NO: 391048 - DNA, 20 bp, Homo sapiens
aattttttttaatgtacaag

SEQ ID NO: 391049 - DNA, 22 bp, Homo sapiens
aattttttttggttgtttgctg

SEQ ID NO: 391050 - DNA, 19 bp, Homo sapiens
acaaaaaaagttgaaggcc

SEQ ID NO: 391051 - DNA, 14 bp, Homo sapiens
acaaaaaacaatat

SEQ ID NO: 391052 - DNA, 18 bp, Homo sapiens
acaaaaaacaatatttat

SEQ ID NO: 391053 - DNA, 15 bp, Homo sapiens
acaaaaaccagcagg

SEQ ID NO: 391054 - DNA, 15 bp, Homo sapiens
acaaaaactttccat

SEQ ID NO: 391055 - DNA, 17 bp, Homo sapiens
acaaaaactttccatga

SEQ ID NO: 391056 - DNA, 18 bp, Homo sapiens
acaaaaagtttccatatg

SEQ ID NO: 391057 - DNA, 21 bp, Homo sapiens
acaaaaatatattaaaaatat

SEQ ID NO: 391058 - DNA, 20 bp, Homo sapiens
acaaaaattatctatttgta

SEQ ID NO: 391059 - DNA, 15 bp, Homo sapiens
acaaaacaagaaaga

SEQ ID NO: 391060 - DNA, 17 bp, Homo sapiens
acaaaaccaagccttgg

SEQ ID NO: 391061 - DNA, 21 bp, Homo sapiens
acaaaacttaaaagtattcat

SEQ ID NO: 391062 - DNA, 11 bp, Homo sapiens
acaaaagatgt

SEQ ID NO: 391063 - DNA, 21 bp, Homo sapiens
acaaaagatgtatccttccaa

SEQ ID NO: 391064 - DNA, 23 bp, Homo sapiens
acaaaagcaagactgttgctcaa

SEQ ID NO: 391065 - DNA, 16 bp, Homo sapiens
acaaaagctgtgtctc

SEQ ID NO: 391066 - DNA, 22 bp, Homo sapiens
acaaaaggctttggcaacagaa

SEQ ID NO: 391067 - DNA, 19 bp, Homo sapiens
acaaaagggaaaaaagcaa

SEQ ID NO: 391068 - DNA, 16 bp, Homo sapiens
acaaaagtgctttgga

SEQ ID NO: 391069 - DNA, 20 bp, Homo sapiens
acaaaatccagctatgaata

SEQ ID NO: 391070 - DNA, 18 bp, Homo sapiens
acaaaatctaaaacaaaa

SEQ ID NO: 391071 - DNA, 22 bp, Homo sapiens
acaaaatctaaaacaaaatctg

SEQ ID NO: 391072 - DNA, 16 bp, Homo sapiens
acaaaatgaatgcatt

SEQ ID NO: 391073 - DNA, 23 bp, Homo sapiens
acaaaatgtgtgcttggaaaatg

SEQ ID NO: 391074 - DNA, 14 bp, Homo sapiens
acaaacaaaactta

SEQ ID NO: 391075 - DNA, 13 bp, Homo sapiens
acaaaccctgggg

SEQ ID NO: 391076 - DNA, 21 bp, Homo sapiens
acaaaccctggggactctgct

SEQ ID NO: 391077 - DNA, 21 bp, Homo sapiens
acaaaccgagtgcaatgaatg

SEQ ID NO: 391078 - DNA, 17 bp, Homo sapiens
acaaacgcattaagagg

SEQ ID NO: 391079 - DNA, 19 bp, Homo sapiens
acaaacgtaatttgttata

SEQ ID NO: 391080 - DNA, 14 bp, Homo sapiens
acaaggttgctgtt

SEQ ID NO: 391081 - DNA, 19 bp, Homo sapiens
acaaggttggcaccccagc

SEQ ID NO: 391082 - DNA, 22 bp, Homo sapiens
acaagtaaagctagacaaaggc

SEQ ID NO: 391083 - DNA, 15 bp, Homo sapiens
acaagtaggagacac

SEQ ID NO: 391084 - DNA, 16 bp, Homo sapiens
acaagtaggagacaca

SEQ ID NO: 391085 - DNA, 19 bp, Homo sapiens
acaagtatacttatatttc

SEQ ID NO: 391086 - DNA, 23 bp, Homo sapiens
acaagtatgaataaagacaccta

SEQ ID NO: 391087 - DNA, 16 bp, Homo sapiens
acaagtcacagctgca

SEQ ID NO: 391088 - DNA, 18 bp, Homo sapiens
acaagtcacagctgcagc

SEQ ID NO: 391089 - DNA, 23 bp, Homo sapiens
acaagtcattttaactttatcac

SEQ ID NO: 391090 - DNA, 14 bp, Homo sapiens
acaagtgcctcctg

SEQ ID NO: 391091 - DNA, 18 bp, Homo sapiens
acaagttaaggtatctgg

SEQ ID NO: 391092 - DNA, 20 bp, Homo sapiens
acaagttaaggtatctggta

SEQ ID NO: 391093 - DNA, 21 bp, Homo sapiens
acaagttggctagaagaaagt

SEQ ID NO: 391094 - DNA, 19 bp, Homo sapiens
acaagttgtttggtacttt

SEQ ID NO: 391095 - DNA, 16 bp, Homo sapiens
acaagtttatgtggca

SEQ ID NO: 391096 - DNA, 12 bp, Homo sapiens
acaagtttcagt

SEQ ID NO: 391097 - DNA, 15 bp, Homo sapiens
acaagtttcagtaat

SEQ ID NO: 391098 - DNA, 22 bp, Homo sapiens
acaagtttcagtaatagctgaa

SEQ ID NO: 391099 - DNA, 14 bp, Homo sapiens
acaagttttaaata

SEQ ID NO: 391100 - DNA, 13 bp, Homo sapiens
acaataaacgaaa

SEQ ID NO: 391101 - DNA, 23 bp, Homo sapiens
acaataaacgaaacacagaactc

SEQ ID NO: 391102 - DNA, 13 bp, Homo sapiens
acaataaatgtat

SEQ ID NO: 391103 - DNA, 20 bp, Homo sapiens
acaataaatgtattcaaata

SEQ ID NO: 391104 - DNA, 16 bp, Homo sapiens
acaataactactgtgt

SEQ ID NO: 391105 - DNA, 14 bp, Homo sapiens
acaataataaatgt

SEQ ID NO: 391106 - DNA, 15 bp, Homo sapiens
acaataatgaataat

SEQ ID NO: 391107 - DNA, 14 bp, Homo sapiens
acaatacagataac

SEQ ID NO: 391108 - DNA, 13 bp, Homo sapiens
acaatagacagaa

SEQ ID NO: 391109 - DNA, 16 bp, Homo sapiens
acaatagacagaaaca

SEQ ID NO: 391110 - DNA, 20 bp, Homo sapiens
acaatagctttaccctcagg

SEQ ID NO: 391111 - DNA, 18 bp, Homo sapiens
acaataggtgcttattct

SEQ ID NO: 391112 - DNA, 20 bp, Homo sapiens
acaatatcattttcctggga

SEQ ID NO: 391113 - DNA, 19 bp, Homo sapiens
acaatatgagtaatgttta

SEQ ID NO: 391114 - DNA, 16 bp, Homo sapiens
acaatatgtatagcat

SEQ ID NO: 391115 - DNA, 21 bp, Homo sapiens
acaatatgtgttttttaatat

SEQ ID NO: 391116 - DNA, 19 bp, Homo sapiens
acaatcaaaggaaaatagt

SEQ ID NO: 391117 - DNA, 13 bp, Homo sapiens
acaatcactattc

SEQ ID NO: 391118 - DNA, 13 bp, Homo sapiens
acaatcagctgct

SEQ ID NO: 391119 - DNA, 14 bp, Homo sapiens
acaatcagctgctt

SEQ ID NO: 391120 - DNA, 18 bp, Homo sapiens
acaatcagctgctttgtt

SEQ ID NO: 391121 - DNA, 15 bp, Homo sapiens
acaatcatctattga

SEQ ID NO: 391122 - DNA, 17 bp, Homo sapiens
acaatcatctattgagt

SEQ ID NO: 391123 - DNA, 18 bp, Homo sapiens
acaatcatgaaatatgca

SEQ ID NO: 391124 - DNA, 12 bp, Homo sapiens
acaatccaaatg

SEQ ID NO: 391125 - DNA, 18 bp, Homo sapiens
acaatccaaatgcattca

SEQ ID NO: 391126 - DNA, 20 bp, Homo sapiens
acaatcccaatctttctata

SEQ ID NO: 391127 - DNA, 20 bp, Homo sapiens
acaatcccagcatctgattg

SEQ ID NO: 391128 - DNA, 13 bp, Homo sapiens
acaatctgtaatt

SEQ ID NO: 391129 - DNA, 21 bp, Homo sapiens
acaatgactgctttgtttgga

SEQ ID NO: 391130 - DNA, 19 bp, Homo sapiens
acaatgatgatgataatga

SEQ ID NO: 391131 - DNA, 21 bp, Homo sapiens
acaatgatgattaaacacctg

SEQ ID NO: 391132 - DNA, 22 bp, Homo sapiens
acaatgatgattaaacacctga

SEQ ID NO: 391133 - DNA, 19 bp, Homo sapiens
acaatgcagatgccagagc

SEQ ID NO: 391134 - DNA, 12 bp, Homo sapiens
acaatggcagct

SEQ ID NO: 391135 - DNA, 12 bp, Homo sapiens
acaatggctggg

SEQ ID NO: 391136 - DNA, 16 bp, Homo sapiens
acaatggctgggtttg

SEQ ID NO: 391137 - DNA, 17 bp, Homo sapiens
acaatggggtgggccca

SEQ ID NO: 391138 - DNA, 23 bp, Homo sapiens
tgtcaaatgtcattatgtagaaa

SEQ ID NO: 391139 - DNA, 22 bp, Homo sapiens
tgtcaaccttgtgtgagtgtga

SEQ ID NO: 391140 - DNA, 14 bp, Homo sapiens
tgtcaacttctggc

SEQ ID NO: 391141 - DNA, 15 bp, Homo sapiens
tgtcaactttatgca

SEQ ID NO: 391142 - DNA, 17 bp, Homo sapiens
tgtcaactttcatttga

SEQ ID NO: 391143 - DNA, 22 bp, Homo sapiens
tgtcaactttcatttgaaagtg

SEQ ID NO: 391144 - DNA, 14 bp, Homo sapiens
tgtcaagaaagagc

SEQ ID NO: 391145 - DNA, 19 bp, Homo sapiens
tgtcaagtacaagcaagac

SEQ ID NO: 391146 - DNA, 16 bp, Homo sapiens
tgtcaagtctctgctg

SEQ ID NO: 391147 - DNA, 19 bp, Homo sapiens
tgtcaagtctctgctggcc

SEQ ID NO: 391148 - DNA, 18 bp, Homo sapiens
tgtcaagttaacaaggaa

SEQ ID NO: 391149 - DNA, 21 bp, Homo sapiens
tgtcaataaacagcttcatgc

SEQ ID NO: 391150 - DNA, 21 bp, Homo sapiens
tgtcaatattaaatacagaca

SEQ ID NO: 391151 - DNA, 22 bp, Homo sapiens
tgtcaatgaggttatgagaaaa

SEQ ID NO: 391152 - DNA, 17 bp, Homo sapiens
tgtcaatgctatggact

SEQ ID NO: 391153 - DNA, 19 bp, Homo sapiens
tgtcaattacaggaagtac

SEQ ID NO: 391154 - DNA, 17 bp, Homo sapiens
tgtcacaacctctctga

SEQ ID NO: 391155 - DNA, 16 bp, Homo sapiens
tgtcacaataaatgta

SEQ ID NO: 391156 - DNA, 14 bp, Homo sapiens
tgtcacaatcctaa

SEQ ID NO: 391157 - DNA, 12 bp, Homo sapiens
tgtcacagctct

SEQ ID NO: 391158 - DNA, 19 bp, Homo sapiens
tgtcaccagcaacatctcg

SEQ ID NO: 391159 - DNA, 16 bp, Homo sapiens
tgtcacccagcaaggc

SEQ ID NO: 391160 - DNA, 22 bp, Homo sapiens
tgtcacctttcttcttgtgtct

SEQ ID NO: 391161 - DNA, 15 bp, Homo sapiens
tgtcacgctctggtg

SEQ ID NO: 391162 - DNA, 16 bp, Homo sapiens
tgtcactactcacagt

SEQ ID NO: 391163 - DNA, 17 bp, Homo sapiens
tgtcactactggtctgt

SEQ ID NO: 391164 - DNA, 16 bp, Homo sapiens
tgtcactctgcctcta

SEQ ID NO: 391165 - DNA, 19 bp, Homo sapiens
tgtcactctgcctctaagg

SEQ ID NO: 391166 - DNA, 13 bp, Homo sapiens
tgtcactgagctg

SEQ ID NO: 391167 - DNA, 12 bp, Homo sapiens
tgtcactgtggt

SEQ ID NO: 391168 - DNA, 13 bp, Homo sapiens
tgtcactgtttct

SEQ ID NO: 391169 - DNA, 15 bp, Homo sapiens
tgtcacttgactctt

SEQ ID NO: 391170 - DNA, 21 bp, Homo sapiens
tgtcacttttttcctgtcaat

SEQ ID NO: 391171 - DNA, 22 bp, Homo sapiens
tgtcacttttttcctgtcaata

SEQ ID NO: 391172 - DNA, 17 bp, Homo sapiens
tgtcagaatttctttgt

SEQ ID NO: 391173 - DNA, 23 bp, Homo sapiens
tgtcagacatccatgtttgtaaa

SEQ ID NO: 391174 - DNA, 14 bp, Homo sapiens
tgtcagactttaaa

SEQ ID NO: 391175 - DNA, 23 bp, Homo sapiens
tgtcagactttaaagaataatat

SEQ ID NO: 391176 - DNA, 13 bp, Homo sapiens
tgtcagagctggg

SEQ ID NO: 391177 - DNA, 14 bp, Homo sapiens
tgtcagagctggga

SEQ ID NO: 391178 - DNA, 12 bp, Homo sapiens
tgtcagaggcta

SEQ ID NO: 391179 - DNA, 22 bp, Homo sapiens
tgtcagccctgctgtcagacct

SEQ ID NO: 391180 - DNA, 20 bp, Homo sapiens
tgtcagccgagccgggcctg

SEQ ID NO: 391181 - DNA, 21 bp, Homo sapiens
tgtcagccgagccgggcctgg

SEQ ID NO: 391182 - DNA, 23 bp, Homo sapiens
tgtcagccgagccgggcctgggg

SEQ ID NO: 391183 - DNA, 23 bp, Homo sapiens
tgtcagcgcaggtttagtttact

SEQ ID NO: 391184 - DNA, 23 bp, Homo sapiens
tgtcagctgagcttgagctcccc

SEQ ID NO: 391185 - DNA, 18 bp, Homo sapiens
tgtcagctgtagaaaggt

SEQ ID NO: 391186 - DNA, 17 bp, Homo sapiens
tgtcagctgttgtcaca

SEQ ID NO: 391187 - DNA, 15 bp, Homo sapiens
tgtcagcttcccaac

SEQ ID NO: 391188 - DNA, 14 bp, Homo sapiens
tgtcaggctctgaa

SEQ ID NO: 391189 - DNA, 17 bp, Homo sapiens
tgtcagtagtgccagaa

SEQ ID NO: 391190 - DNA, 17 bp, Homo sapiens
tgtcagtagtgcctgtg

SEQ ID NO: 391191 - DNA, 17 bp, Homo sapiens
tgtcagtcgtgttgctt

SEQ ID NO: 391192 - DNA, 17 bp, Homo sapiens
tgtcagtctacaggcct

SEQ ID NO: 391193 - DNA, 14 bp, Homo sapiens
tgtcagtgtgactg

SEQ ID NO: 391194 - DNA, 19 bp, Homo sapiens
tgtcagtgtgactgatctc

SEQ ID NO: 391195 - DNA, 18 bp, Homo sapiens
tgtcagtttgtgaagtga

SEQ ID NO: 391196 - DNA, 17 bp, Homo sapiens
tgtcatactctgtgtaa

SEQ ID NO: 391197 - DNA, 20 bp, Homo sapiens
tgtcatatatggggggccaa

SEQ ID NO: 391198 - DNA, 14 bp, Homo sapiens
tgtcatcaatccag

SEQ ID NO: 391199 - DNA, 18 bp, Homo sapiens
tgtcatcactccctggat

SEQ ID NO: 391200 - DNA, 15 bp, Homo sapiens
tgtcatcagaagata

SEQ ID NO: 391201 - DNA, 14 bp, Homo sapiens
tgtcatcagatgga

SEQ ID NO: 391202 - DNA, 22 bp, Homo sapiens
tgtcatcattgtatatatgtgt

SEQ ID NO: 391203 - DNA, 23 bp, Homo sapiens
tgtcatccacacaacaccaggac

SEQ ID NO: 391204 - DNA, 13 bp, Homo sapiens
tgtcatctgagga

SEQ ID NO: 391205 - DNA, 15 bp, Homo sapiens
tgtcatctgaggagt

SEQ ID NO: 391206 - DNA, 13 bp, Homo sapiens
tgtcatctgggcc

SEQ ID NO: 391207 - DNA, 14 bp, Homo sapiens
tgtcatctgggcca

SEQ ID NO: 391208 - DNA, 14 bp, Homo sapiens
tgtcatctgtcagc

SEQ ID NO: 391209 - DNA, 22 bp, Homo sapiens
tgtcatcttttagagtaaacta

SEQ ID NO: 391210 - DNA, 15 bp, Homo sapiens
acacacagctgggca

SEQ ID NO: 391211 - DNA, 13 bp, Homo sapiens
acacacaggagga

SEQ ID NO: 391212 - DNA, 24 bp, Homo sapiens
acacacaggagtcctttcttttga

SEQ ID NO: 391213 - DNA, 21 bp, Homo sapiens
acacacatataaacatcacac

SEQ ID NO: 391214 - DNA, 21 bp, Homo sapiens
acacaccccacaccccagccc

SEQ ID NO: 391215 - DNA, 23 bp, Homo sapiens
acacaccccacaccccagcccac

SEQ ID NO: 391216 - DNA, 19 bp, Homo sapiens
acacaccctccagcacaga

SEQ ID NO: 391217 - DNA, 13 bp, Homo sapiens
acacacctgcctg

SEQ ID NO: 391218 - DNA, 16 bp, Homo sapiens
acacacgcagacacac

SEQ ID NO: 391219 - DNA, 15 bp, Homo sapiens
acacactcagcagcc

SEQ ID NO: 391220 - DNA, 19 bp, Homo sapiens
acacactcagcagccccct

SEQ ID NO: 391221 - DNA, 10 bp, Homo sapiens
acacactgta

SEQ ID NO: 391222 - DNA, 16 bp, Homo sapiens
acacagaactcagcct

SEQ ID NO: 391223 - DNA, 19 bp, Homo sapiens
acacagagtggtctttctg

SEQ ID NO: 391224 - DNA, 13 bp, Homo sapiens
acacagatattgt

SEQ ID NO: 391225 - DNA, 21 bp, Homo sapiens
acacagatggcacctgtggcc

SEQ ID NO: 391226 - DNA, 16 bp, Homo sapiens
acacagcaattttgta

SEQ ID NO: 391227 - DNA, 14 bp, Homo sapiens
acacagcatgtgcc

SEQ ID NO: 391228 - DNA, 14 bp, Homo sapiens
acacagcatgtgta

SEQ ID NO: 391229 - DNA, 13 bp, Homo sapiens
acacagcctggcc

SEQ ID NO: 391230 - DNA, 12 bp, Homo sapiens
acacagcctgtc

SEQ ID NO: 391231 - DNA, 17 bp, Homo sapiens
acacagcctgtcttcag

SEQ ID NO: 391232 - DNA, 21 bp, Homo sapiens
acacagcgacgctcccctgag

SEQ ID NO: 391233 - DNA, 22 bp, Homo sapiens
acacagctgagagacttttaat

SEQ ID NO: 391234 - DNA, 21 bp, Homo sapiens
acacagctgagctggcctatt

SEQ ID NO: 391235 - DNA, 19 bp, Homo sapiens
acacagctgggcaaagcca

SEQ ID NO: 391236 - DNA, 23 bp, Homo sapiens
acacagcttttagtacccacctg

SEQ ID NO: 391237 - DNA, 18 bp, Homo sapiens
acacaggagtcctttctt

SEQ ID NO: 391238 - DNA, 20 bp, Homo sapiens
acacaggcaaagaggtgctg

SEQ ID NO: 391239 - DNA, 18 bp, Homo sapiens
acacaggcctggcccagc

SEQ ID NO: 391240 - DNA, 20 bp, Homo sapiens
acacaggcctggcccagcca

SEQ ID NO: 391241 - DNA, 21 bp, Homo sapiens
acacaggcctggcccagccag

SEQ ID NO: 391242 - DNA, 24 bp, Homo sapiens
acacaggcctggcccagccagcag

SEQ ID NO: 391243 - DNA, 19 bp, Homo sapiens
acacagggctctttgatgg

SEQ ID NO: 391244 - DNA, 17 bp, Homo sapiens
acacaggggaggtgata

SEQ ID NO: 391245 - DNA, 15 bp, Homo sapiens
acacagggttttgta

SEQ ID NO: 391246 - DNA, 19 bp, Homo sapiens
acacagtagctccaacact

SEQ ID NO: 391247 - DNA, 21 bp, Homo sapiens
acacagtagctccaacacttt

SEQ ID NO: 391248 - DNA, 13 bp, Homo sapiens
acacagtgggccg

SEQ ID NO: 391249 - DNA, 20 bp, Homo sapiens
acacagtgggccggccccag

SEQ ID NO: 391250 - DNA, 22 bp, Homo sapiens
acacagtgggccggccccaggc

SEQ ID NO: 391251 - DNA, 23 bp, Homo sapiens
acacagtgggccggccccaggct

SEQ ID NO: 391252 - DNA, 19 bp, Homo sapiens
acacagttcacaaacagta

SEQ ID NO: 391253 - DNA, 14 bp, Homo sapiens
acacagttttgaaa

SEQ ID NO: 391254 - DNA, 14 bp, Homo sapiens
acacataaaagtaa

SEQ ID NO: 391255 - DNA, 21 bp, Homo sapiens
acacataaatctgtctgattc

SEQ ID NO: 391256 - DNA, 14 bp, Homo sapiens
acacataacacaca

SEQ ID NO: 391257 - DNA, 16 bp, Homo sapiens
acacataacacacatc

SEQ ID NO: 391258 - DNA, 22 bp, Homo sapiens
acacatagattcacctgtaaaa

SEQ ID NO: 391259 - DNA, 17 bp, Homo sapiens
acacatagtttcttttt

SEQ ID NO: 391260 - DNA, 10 bp, Homo sapiens
acacatattc

SEQ ID NO: 391261 - DNA, 20 bp, Homo sapiens
acacatccagacatcatgaa

SEQ ID NO: 391262 - DNA, 22 bp, Homo sapiens
acacatcccggcctcttccacc

SEQ ID NO: 391263 - DNA, 12 bp, Homo sapiens
acacatctcctc

SEQ ID NO: 391264 - DNA, 14 bp, Homo sapiens
acacatgctctcaa

SEQ ID NO: 391265 - DNA, 19 bp, Homo sapiens
acacatgctctcaatatat

SEQ ID NO: 391266 - DNA, 23 bp, Homo sapiens
acacattatattctcttatgata

SEQ ID NO: 391267 - DNA, 19 bp, Homo sapiens
acacattatgttagagagg

SEQ ID NO: 391268 - DNA, 21 bp, Homo sapiens
acacattgaatgcgctttatt

SEQ ID NO: 391269 - DNA, 18 bp, Homo sapiens
acacatttaaaacatttg

SEQ ID NO: 391270 - DNA, 14 bp, Homo sapiens
acaccaaataaata

SEQ ID NO: 391271 - DNA, 15 bp, Homo sapiens
acaccaaattgctga

SEQ ID NO: 391272 - DNA, 18 bp, Homo sapiens
acaccaaattgctgagat

SEQ ID NO: 391273 - DNA, 21 bp, Homo sapiens
acaccaaattgctgagatgtt

SEQ ID NO: 391274 - DNA, 11 bp, Homo sapiens
acaccacagac

SEQ ID NO: 391275 - DNA, 17 bp, Homo sapiens
acaccacagacacacac

SEQ ID NO: 391276 - DNA, 15 bp, Homo sapiens
acaccacagacgcca

SEQ ID NO: 391277 - DNA, 18 bp, Homo sapiens
acaccacaggatctgaac

SEQ ID NO: 391278 - DNA, 20 bp, Homo sapiens
acaccacaggatctgaactt

SEQ ID NO: 391279 - DNA, 22 bp, Homo sapiens
tgtctggctcggacccacccca

SEQ ID NO: 391280 - DNA, 14 bp, Homo sapiens
tgtctggctgtacg

SEQ ID NO: 391281 - DNA, 19 bp, Homo sapiens
tgtctggctgtggcccctc

SEQ ID NO: 391282 - DNA, 17 bp, Homo sapiens
tgtctgggaaagcagag

SEQ ID NO: 391283 - DNA, 22 bp, Homo sapiens
tgtctggggccgaggggccagg

SEQ ID NO: 391284 - DNA, 22 bp, Homo sapiens
tgtctggtgggtggagtcaggc

SEQ ID NO: 391285 - DNA, 15 bp, Homo sapiens
tgtctggttttaaca

SEQ ID NO: 391286 - DNA, 14 bp, Homo sapiens
tgtctgtaagagaa

SEQ ID NO: 391287 - DNA, 13 bp, Homo sapiens
tgtctgtagtgtt

SEQ ID NO: 391288 - DNA, 18 bp, Homo sapiens
tgtctgtccatctgtctg

SEQ ID NO: 391289 - DNA, 15 bp, Homo sapiens
tgtctgtctgtccca

SEQ ID NO: 391290 - DNA, 16 bp, Homo sapiens
tgtctgtgccatggat

SEQ ID NO: 391291 - DNA, 12 bp, Homo sapiens
tgtctgtgtgca

SEQ ID NO: 391292 - DNA, 15 bp, Homo sapiens
tgtctgtgtgctgta

SEQ ID NO: 391293 - DNA, 21 bp, Homo sapiens
tgtctgttgcttattgggagt

SEQ ID NO: 391294 - DNA, 13 bp, Homo sapiens
tgtctgtttcctt

SEQ ID NO: 391295 - DNA, 15 bp, Homo sapiens
tgtctgtttccttct

SEQ ID NO: 391296 - DNA, 22 bp, Homo sapiens
tgtcttacaaggcaggcctttc

SEQ ID NO: 391297 - DNA, 17 bp, Homo sapiens
tgtcttactactttaaa

SEQ ID NO: 391298 - DNA, 16 bp, Homo sapiens
tgtcttataagaaaac

SEQ ID NO: 391299 - DNA, 22 bp, Homo sapiens
tgtcttatatatatttctttgt

SEQ ID NO: 391300 - DNA, 22 bp, Homo sapiens
tgtcttcaaccctgccctgcac

SEQ ID NO: 391301 - DNA, 23 bp, Homo sapiens
tgtcttcaaccctgccctgcacc

SEQ ID NO: 391302 - DNA, 19 bp, Homo sapiens
tgtcttcatccttagcaac

SEQ ID NO: 391303 - DNA, 17 bp, Homo sapiens
tgtcttcatttcattgt

SEQ ID NO: 391304 - DNA, 21 bp, Homo sapiens
tgtcttcatttcattgtatga

SEQ ID NO: 391305 - DNA, 13 bp, Homo sapiens
tgtcttccaagga

SEQ ID NO: 391306 - DNA, 13 bp, Homo sapiens
tgtcttccataat

SEQ ID NO: 391307 - DNA, 14 bp, Homo sapiens
tgtcttcctggtca

SEQ ID NO: 391308 - DNA, 21 bp, Homo sapiens
tgtcttctctccacttctggt

SEQ ID NO: 391309 - DNA, 12 bp, Homo sapiens
tgtcttctgcct

SEQ ID NO: 391310 - DNA, 14 bp, Homo sapiens
tgtcttctgcctgt

SEQ ID NO: 391311 - DNA, 18 bp, Homo sapiens
tgtcttctgcctgttata

SEQ ID NO: 391312 - DNA, 23 bp, Homo sapiens
tgtcttgctagacaaggttgctg

SEQ ID NO: 391313 - DNA, 15 bp, Homo sapiens
tgtcttgtcatcttt

SEQ ID NO: 391314 - DNA, 15 bp, Homo sapiens
tgtctttaagaacta

SEQ ID NO: 391315 - DNA, 19 bp, Homo sapiens
tgtctttaggcagcagctt

SEQ ID NO: 391316 - DNA, 13 bp, Homo sapiens
tgtctttattctt

SEQ ID NO: 391317 - DNA, 19 bp, Homo sapiens
tgtctttcagatacatggt

SEQ ID NO: 391318 - DNA, 13 bp, Homo sapiens
tgtctttcctaga

SEQ ID NO: 391319 - DNA, 14 bp, Homo sapiens
tgtctttcctccct

SEQ ID NO: 391320 - DNA, 16 bp, Homo sapiens
tgtctttcctcccttc

SEQ ID NO: 391321 - DNA, 13 bp, Homo sapiens
tgtctttctttgc

SEQ ID NO: 391322 - DNA, 21 bp, Homo sapiens
tgtctttgctgtttatatata

SEQ ID NO: 391323 - DNA, 23 bp, Homo sapiens
tgtcttttaatgatactgtctaa

SEQ ID NO: 391324 - DNA, 20 bp, Homo sapiens
tgtcttttatgcagatagaa

SEQ ID NO: 391325 - DNA, 14 bp, Homo sapiens
tgtcttttcccctc

SEQ ID NO: 391326 - DNA, 14 bp, Homo sapiens
tgtctttttccttt

SEQ ID NO: 391327 - DNA, 17 bp, Homo sapiens
tgtcttttttttcatcc

SEQ ID NO: 391328 - DNA, 13 bp, Homo sapiens
tgtgaaaagtaaa

SEQ ID NO: 391329 - DNA, 17 bp, Homo sapiens
tgtgaaaagtaaaacag

SEQ ID NO: 391330 - DNA, 13 bp, Homo sapiens
tgtgaaaattaca

SEQ ID NO: 391331 - DNA, 18 bp, Homo sapiens
tgtgaaacagtgtggatg

SEQ ID NO: 391332 - DNA, 15 bp, Homo sapiens
tgtgaaagtctcctg

SEQ ID NO: 391333 - DNA, 14 bp, Homo sapiens
tgtgaaatttacat

SEQ ID NO: 391334 - DNA, 14 bp, Homo sapiens
tgtgaaatttgtta

SEQ ID NO: 391335 - DNA, 19 bp, Homo sapiens
tgtgaaccaactgccttaa

SEQ ID NO: 391336 - DNA, 20 bp, Homo sapiens
tgtgaactagggaagctcag

SEQ ID NO: 391337 - DNA, 20 bp, Homo sapiens
tgtgaacttggggaacaagg

SEQ ID NO: 391338 - DNA, 18 bp, Homo sapiens
tgtgaagagggagaagca

SEQ ID NO: 391339 - DNA, 18 bp, Homo sapiens
tgtgaagataatttgcat

SEQ ID NO: 391340 - DNA, 15 bp, Homo sapiens
tgtgcctcccttccg

SEQ ID NO: 391341 - DNA, 14 bp, Homo sapiens
tgtgcctgcaccag

SEQ ID NO: 391342 - DNA, 16 bp, Homo sapiens
tgtgcctgcaccagga

SEQ ID NO: 391343 - DNA, 18 bp, Homo sapiens
tgtgcctgcaccaggaga

SEQ ID NO: 391344 - DNA, 20 bp, Homo sapiens
tgtgcctgctagagcaaccc

SEQ ID NO: 391345 - DNA, 18 bp, Homo sapiens
tgtgcctgctatccagcc

SEQ ID NO: 391346 - DNA, 19 bp, Homo sapiens
tgtgcctgctatccagccg

SEQ ID NO: 391347 - DNA, 20 bp, Homo sapiens
tgtgcctgctatccagccgc

SEQ ID NO: 391348 - DNA, 18 bp, Homo sapiens
tgtgcctgtaatcttttt

SEQ ID NO: 391349 - DNA, 22 bp, Homo sapiens
tgtgcctgtaatctttttctcc

SEQ ID NO: 391350 - DNA, 13 bp, Homo sapiens
tgtgcctgtggca

SEQ ID NO: 391351 - DNA, 15 bp, Homo sapiens
tgtgcctgtggcaga

SEQ ID NO: 391352 - DNA, 15 bp, Homo sapiens
tgtgccttttatagc

SEQ ID NO: 391353 - DNA, 16 bp, Homo sapiens
tgtgcgtgaaacacac

SEQ ID NO: 391354 - DNA, 20 bp, Homo sapiens
tgtgcgtgcatgtgtgttca

SEQ ID NO: 391355 - DNA, 19 bp, Homo sapiens
tgtgcgtgctgtctgtcct

SEQ ID NO: 391356 - DNA, 15 bp, Homo sapiens
tgtgcgttttagagt

SEQ ID NO: 391357 - DNA, 16 bp, Homo sapiens
tgtgctaagttgtctt

SEQ ID NO: 391358 - DNA, 20 bp, Homo sapiens
tgtgctacagaaaataatct

SEQ ID NO: 391359 - DNA, 18 bp, Homo sapiens
tgtgctacagagaaaatc

SEQ ID NO: 391360 - DNA, 13 bp, Homo sapiens
tgtgctacctcta

SEQ ID NO: 391361 - DNA, 21 bp, Homo sapiens
tgtgctacctctaacaccaca

SEQ ID NO: 391362 - DNA, 19 bp, Homo sapiens
tgtgctatagtgtatacca

SEQ ID NO: 391363 - DNA, 18 bp, Homo sapiens
tgtgctcacccattgtct

SEQ ID NO: 391364 - DNA, 23 bp, Homo sapiens
tgtgctcctaaaggcagcaacca

SEQ ID NO: 391365 - DNA, 22 bp, Homo sapiens
tgtgctctgaatgggagccaga

SEQ ID NO: 391366 - DNA, 13 bp, Homo sapiens
tgtgctctgggga

SEQ ID NO: 391367 - DNA, 19 bp, Homo sapiens
tgtgctctttcctgccctt

SEQ ID NO: 391368 - DNA, 15 bp, Homo sapiens
tgtgctctttgaaga

SEQ ID NO: 391369 - DNA, 19 bp, Homo sapiens
tgtgctgaattctgcaatg

SEQ ID NO: 391370 - DNA, 17 bp, Homo sapiens
tgtgctgaggactccct

SEQ ID NO: 391371 - DNA, 20 bp, Homo sapiens
tgtgctgaggactccctcca

SEQ ID NO: 391372 - DNA, 12 bp, Homo sapiens
tgtgcttgttct

SEQ ID NO: 391373 - DNA, 14 bp, Homo sapiens
tgtgcttgttcttc

SEQ ID NO: 391374 - DNA, 14 bp, Homo sapiens
tgtgctttagcttg

SEQ ID NO: 391375 - DNA, 17 bp, Homo sapiens
tgtgctttatgctgaaa

SEQ ID NO: 391376 - DNA, 14 bp, Homo sapiens
tgtgctttgtagct

SEQ ID NO: 391377 - DNA, 16 bp, Homo sapiens
tgtgctttgtagctta

SEQ ID NO: 391378 - DNA, 21 bp, Homo sapiens
tgtgctttgtagcttaaaaaa

SEQ ID NO: 391379 - DNA, 22 bp, Homo sapiens
tgtgcttttgcaaaagaagttg

SEQ ID NO: 391380 - DNA, 15 bp, Homo sapiens
tgtggaaaaaatatt

SEQ ID NO: 391381 - DNA, 18 bp, Homo sapiens
tgtggaaaacaatttgca

SEQ ID NO: 391382 - DNA, 13 bp, Homo sapiens
tgtggaaaggatt

SEQ ID NO: 391383 - DNA, 21 bp, Homo sapiens
tgtggaaaggattctaaacag

SEQ ID NO: 391384 - DNA, 15 bp, Homo sapiens
tgtggaacactaaag

SEQ ID NO: 391385 - DNA, 23 bp, Homo sapiens
tgtggaattacataacaggcatt

SEQ ID NO: 391386 - DNA, 16 bp, Homo sapiens
tgtggacactgtggaa

SEQ ID NO: 391387 - DNA, 15 bp, Homo sapiens
tgtggactgtgatgc

SEQ ID NO: 391388 - DNA, 10 bp, Homo sapiens
tgtggacttt

SEQ ID NO: 391389 - DNA, 16 bp, Homo sapiens
tgtggagaggagagaa

SEQ ID NO: 391390 - DNA, 17 bp, Homo sapiens
tgtggagagggaatgtg

SEQ ID NO: 391391 - DNA, 19 bp, Homo sapiens
tgtggagagggaatgtgaa

SEQ ID NO: 391392 - DNA, 21 bp, Homo sapiens
tgtggagcaaaaggcagctca

SEQ ID NO: 391393 - DNA, 20 bp, Homo sapiens
tgtggagcacaaaagcctct

SEQ ID NO: 391394 - DNA, 16 bp, Homo sapiens
tgtggagcccgcaccc

SEQ ID NO: 391395 - DNA, 19 bp, Homo sapiens
tgtggagcccgcaccccca

SEQ ID NO: 391396 - DNA, 11 bp, Homo sapiens
tgtggagctgc

SEQ ID NO: 391397 - DNA, 15 bp, Homo sapiens
tgtggagctgcttcc

SEQ ID NO: 391398 - DNA, 12 bp, Homo sapiens
tgtggaggcctg

SEQ ID NO: 391399 - DNA, 13 bp, Homo sapiens
tgtggaggcctga

SEQ ID NO: 391400 - DNA, 21 bp, Homo sapiens
tgtggagggattgaacacagg

SEQ ID NO: 391401 - DNA, 19 bp, Homo sapiens
tgtggagtggaggggtcag

SEQ ID NO: 391402 - DNA, 14 bp, Homo sapiens
tgtggagttattca

SEQ ID NO: 391403 - DNA, 21 bp, Homo sapiens
tgtggagttcatcttgaattg

SEQ ID NO: 391404 - DNA, 15 bp, Homo sapiens
tgtggataagggaga

SEQ ID NO: 391405 - DNA, 14 bp, Homo sapiens
tgtggatgaaaaaa

SEQ ID NO: 391406 - DNA, 23 bp, Homo sapiens
tgtggatggaggtgatgaaaacc

SEQ ID NO: 391407 - DNA, 17 bp, Homo sapiens
tgtggatgtgtaaatgg

SEQ ID NO: 391408 - DNA, 23 bp, Homo sapiens
tgtggatgtgtaaatggagcttg

SEQ ID NO: 391409 - DNA, 18 bp, Homo sapiens
tgtggattctatatttca

SEQ ID NO: 391410 - DNA, 21 bp, Homo sapiens
tgtggattctatatttcatat

SEQ ID NO: 391411 - DNA, 19 bp, Homo sapiens
tgtggcagtggccaggcag

SEQ ID NO: 391412 - DNA, 17 bp, Homo sapiens
tgtggcatctttgcctt

SEQ ID NO: 391413 - DNA, 14 bp, Homo sapiens
tgtggccagagctg

SEQ ID NO: 391414 - DNA, 15 bp, Homo sapiens
tgtggccagagctgg

SEQ ID NO: 391415 - DNA, 19 bp, Homo sapiens
tgtggccagagctggaagg

SEQ ID NO: 391416 - DNA, 22 bp, Homo sapiens
tgtggccagagctggaaggcag

SEQ ID NO: 391417 - DNA, 15 bp, Homo sapiens
tgtggccccaggtgc

SEQ ID NO: 391418 - DNA, 12 bp, Homo sapiens
tgtggcccctcc

SEQ ID NO: 391419 - DNA, 13 bp, Homo sapiens
tgtggccccttca

SEQ ID NO: 391420 - DNA, 16 bp, Homo sapiens
tgtggccctgtgggag

SEQ ID NO: 391421 - DNA, 21 bp, Homo sapiens
ggcccctctgttctggtggcc

SEQ ID NO: 391422 - DNA, 20 bp, Homo sapiens
ggcccctggcacgtcctcca

SEQ ID NO: 391423 - DNA, 17 bp, Homo sapiens
ggcccctggcccagcgg

SEQ ID NO: 391424 - DNA, 22 bp, Homo sapiens
ggccccttcacttctgaccaca

SEQ ID NO: 391425 - DNA, 15 bp, Homo sapiens
ggcccgagcgcgtgc

SEQ ID NO: 391426 - DNA, 22 bp, Homo sapiens
ggcccgagcgcgtgccttcccc

SEQ ID NO: 391427 - DNA, 18 bp, Homo sapiens
ggcccgctcaacctctca

SEQ ID NO: 391428 - DNA, 20 bp, Homo sapiens
ggcccgctcaacctctcaga

SEQ ID NO: 391429 - DNA, 13 bp, Homo sapiens
ggcccggcccacg

SEQ ID NO: 391430 - DNA, 15 bp, Homo sapiens
ggcccggcccacgca

SEQ ID NO: 391431 - DNA, 19 bp, Homo sapiens
ggcccggcccacgcagagc

SEQ ID NO: 391432 - DNA, 21 bp, Homo sapiens
ggcccggcccacgcagagccc

SEQ ID NO: 391433 - DNA, 13 bp, Homo sapiens
ggcccgggaggag

SEQ ID NO: 391434 - DNA, 22 bp, Homo sapiens
ggcccgggaggaggatccgggc

SEQ ID NO: 391435 - DNA, 16 bp, Homo sapiens
ggcccgggcaggccag

SEQ ID NO: 391436 - DNA, 20 bp, Homo sapiens
ggcccgtgcgcagccgcgct

SEQ ID NO: 391437 - DNA, 12 bp, Homo sapiens
ggccctaggcat

SEQ ID NO: 391438 - DNA, 22 bp, Homo sapiens
ggccctaggcatactctccagg

SEQ ID NO: 391439 - DNA, 14 bp, Homo sapiens
ggccctcagaggaa

SEQ ID NO: 391440 - DNA, 17 bp, Homo sapiens
ggccctccatgggctag

SEQ ID NO: 391441 - DNA, 23 bp, Homo sapiens
ggccctcccttggaaacctgccc

SEQ ID NO: 391442 - DNA, 16 bp, Homo sapiens
ggccctccgcggggga

SEQ ID NO: 391443 - DNA, 21 bp, Homo sapiens
ggccctgacaaaaaggtgcta

SEQ ID NO: 391444 - DNA, 18 bp, Homo sapiens
ggccctgcacctgtgcag

SEQ ID NO: 391445 - DNA, 17 bp, Homo sapiens
ggccctgcaggaggcct

SEQ ID NO: 391446 - DNA, 19 bp, Homo sapiens
ggccctgcaggaggcctgg

SEQ ID NO: 391447 - DNA, 22 bp, Homo sapiens
ggccctgcaggaggcctgggag

SEQ ID NO: 391448 - DNA, 17 bp, Homo sapiens
ggccctgccccacacag

SEQ ID NO: 391449 - DNA, 21 bp, Homo sapiens
ggccctgccccacacaggcct

SEQ ID NO: 391450 - DNA, 22 bp, Homo sapiens
ggccctgccccacacaggcctg

SEQ ID NO: 391451 - DNA, 16 bp, Homo sapiens
ggccctgccctccccc

SEQ ID NO: 391452 - DNA, 19 bp, Homo sapiens
ggccctgccctcccccacg

SEQ ID NO: 391453 - DNA, 13 bp, Homo sapiens
ggccctggctccc

SEQ ID NO: 391454 - DNA, 21 bp, Homo sapiens
ggccctggctggggacttggc

SEQ ID NO: 391455 - DNA, 19 bp, Homo sapiens
ggccctggggaagaggcct

SEQ ID NO: 391456 - DNA, 21 bp, Homo sapiens
ggccctggggaagaggccttg

SEQ ID NO: 391457 - DNA, 19 bp, Homo sapiens
ggccctggggtccccactc

SEQ ID NO: 391458 - DNA, 17 bp, Homo sapiens
ggccctggggtctctga

SEQ ID NO: 391459 - DNA, 20 bp, Homo sapiens
ggccctggggtctctgagca

SEQ ID NO: 391460 - DNA, 21 bp, Homo sapiens
ggccctggggtctctgagcag

SEQ ID NO: 391461 - DNA, 15 bp, Homo sapiens
ggccctggttccccc

SEQ ID NO: 391462 - DNA, 19 bp, Homo sapiens
ggccctgtcagagccgcca

SEQ ID NO: 391463 - DNA, 17 bp, Homo sapiens
ggccctgtgggagtcca

SEQ ID NO: 391464 - DNA, 15 bp, Homo sapiens
ggccctgttgtgggg

SEQ ID NO: 391465 - DNA, 17 bp, Homo sapiens
ggccctgttgtgggggt

SEQ ID NO: 391466 - DNA, 18 bp, Homo sapiens
ggcccttcctctccactg

SEQ ID NO: 391467 - DNA, 19 bp, Homo sapiens
ggcccttcctctccactgc

SEQ ID NO: 391468 - DNA, 20 bp, Homo sapiens
ggcccttgcccaactcccag

SEQ ID NO: 391469 - DNA, 18 bp, Homo sapiens
ggcccttgggacagccag

SEQ ID NO: 391470 - DNA, 13 bp, Homo sapiens
ggcctgcccccct

SEQ ID NO: 391471 - DNA, 18 bp, Homo sapiens
ggcctgccccccttccca

SEQ ID NO: 391472 - DNA, 22 bp, Homo sapiens
ggcctgccccccttcccacccc

SEQ ID NO: 391473 - DNA, 18 bp, Homo sapiens
ggcctgctcccagcagcc

SEQ ID NO: 391474 - DNA, 11 bp, Homo sapiens
ggcctgctgcg

SEQ ID NO: 391475 - DNA, 12 bp, Homo sapiens
ggcctgctggga

SEQ ID NO: 391476 - DNA, 22 bp, Homo sapiens
ggcctgctgggaaccccgcagc

SEQ ID NO: 391477 - DNA, 16 bp, Homo sapiens
ggcctgcttttccagg

SEQ ID NO: 391478 - DNA, 17 bp, Homo sapiens
ggcctgcttttccagga

SEQ ID NO: 391479 - DNA, 20 bp, Homo sapiens
ggcctgcttttccaggatcc

SEQ ID NO: 391480 - DNA, 24 bp, Homo sapiens
ggcctggaaccagggaggagagga

SEQ ID NO: 391481 - DNA, 21 bp, Homo sapiens
ggcctggactttcctgcaact

SEQ ID NO: 391482 - DNA, 20 bp, Homo sapiens
ggcctggagcgtttgctgtg

SEQ ID NO: 391483 - DNA, 23 bp, Homo sapiens
ggcctggagcgtttgctgtgcca

SEQ ID NO: 391484 - DNA, 24 bp, Homo sapiens
ggcctggagcgtttgctgtgccag

SEQ ID NO: 391485 - DNA, 21 bp, Homo sapiens
ggcctggatctccccactcta

SEQ ID NO: 391486 - DNA, 14 bp, Homo sapiens
ggcctggcagccgt

SEQ ID NO: 391487 - DNA, 11 bp, Homo sapiens
ggcctggccca

SEQ ID NO: 391488 - DNA, 16 bp, Homo sapiens
ggcctggcccagccag

SEQ ID NO: 391489 - DNA, 17 bp, Homo sapiens
ggcctggcccagccagc

SEQ ID NO: 391490 - DNA, 18 bp, Homo sapiens
ggcctggcccagccagca

SEQ ID NO: 391491 - DNA, 18 bp, Homo sapiens
ggcctggccctgccctga

SEQ ID NO: 391492 - DNA, 20 bp, Homo sapiens
ggcctggcctatttaagccc

SEQ ID NO: 391493 - DNA, 22 bp, Homo sapiens
ggcctggcctatttaagccccc

SEQ ID NO: 391494 - DNA, 19 bp, Homo sapiens
ggcctggcctcggggcagg

SEQ ID NO: 391495 - DNA, 12 bp, Homo sapiens
ggcctggcctga

SEQ ID NO: 391496 - DNA, 14 bp, Homo sapiens
ggcctggcctgagc

SEQ ID NO: 391497 - DNA, 14 bp, Homo sapiens
ggcctggcctggcc

SEQ ID NO: 391498 - DNA, 17 bp, Homo sapiens
ggcctggcctggccctg

SEQ ID NO: 391499 - DNA, 15 bp, Homo sapiens
ggcctggctccccac

SEQ ID NO: 391500 - DNA, 12 bp, Homo sapiens
ggcctggctccg

SEQ ID NO: 391501 - DNA, 18 bp, Homo sapiens
ggcctggcttgctccagg

SEQ ID NO: 391502 - DNA, 13 bp, Homo sapiens
ggcctgggagggc

SEQ ID NO: 391503 - DNA, 14 bp, Homo sapiens
ggcctgggagggtg

SEQ ID NO: 391504 - DNA, 12 bp, Homo sapiens
ggcctgggcctg

SEQ ID NO: 391505 - DNA, 13 bp, Homo sapiens
ggcctgggcctgc

SEQ ID NO: 391506 - DNA, 15 bp, Homo sapiens
ggcctgggcctgctt

SEQ ID NO: 391507 - DNA, 23 bp, Homo sapiens
ggcctggggatgtaaccaagctg

SEQ ID NO: 391508 - DNA, 22 bp, Homo sapiens
ggcctggggctgccgtgcacgg

SEQ ID NO: 391509 - DNA, 17 bp, Homo sapiens
ggcctgggggcagtgac

SEQ ID NO: 391510 - DNA, 20 bp, Homo sapiens
ggcctgggggcagtgactgg

SEQ ID NO: 391511 - DNA, 18 bp, Homo sapiens
ggcctgggtctccctggt

SEQ ID NO: 391512 - DNA, 20 bp, Homo sapiens
ggcctgggtggggcagggcc

SEQ ID NO: 391513 - DNA, 15 bp, Homo sapiens
ggcctggtcaccaca

SEQ ID NO: 391514 - DNA, 19 bp, Homo sapiens
ggcctggtcagcagagccg

SEQ ID NO: 391515 - DNA, 19 bp, Homo sapiens
ggcctgtccacctgtgctg

SEQ ID NO: 391516 - DNA, 15 bp, Homo sapiens
ggcctgtcgtgccag

SEQ ID NO: 391517 - DNA, 17 bp, Homo sapiens
ggcctgtctcatcccca

SEQ ID NO: 391518 - DNA, 23 bp, Homo sapiens
ggcctgtctcatccccaggggtc

SEQ ID NO: 391519 - DNA, 13 bp, Homo sapiens
ggcctgtgcagca

SEQ ID NO: 391520 - DNA, 16 bp, Homo sapiens
ggcctgtgcagcagcc

SEQ ID NO: 391521 - DNA, 17 bp, Homo sapiens
ggcctgtgcagcagccc

SEQ ID NO: 391522 - DNA, 21 bp, Homo sapiens
ggcctgtgcagcagcccagct

SEQ ID NO: 391523 - DNA, 20 bp, Homo sapiens
ggcctgtgggagcctgcaaa

SEQ ID NO: 391524 - DNA, 15 bp, Homo sapiens
ggcctgtgtccagca

SEQ ID NO: 391525 - DNA, 17 bp, Homo sapiens
ggcctgtgtccagcagc

SEQ ID NO: 391526 - DNA, 22 bp, Homo sapiens
ggcctgtgtgttgccaggcagg

SEQ ID NO: 391527 - DNA, 14 bp, Homo sapiens
ggcctgttctgtag

SEQ ID NO: 391528 - DNA, 20 bp, Homo sapiens
ggcctgttctgtaggagaga

SEQ ID NO: 391529 - DNA, 23 bp, Homo sapiens
ggcctgttctgtaggagagactg

SEQ ID NO: 391530 - DNA, 19 bp, Homo sapiens
ggcctgtttctgcagccct

SEQ ID NO: 391531 - DNA, 20 bp, Homo sapiens
ggcctgtttctgcagccctt

SEQ ID NO: 391532 - DNA, 23 bp, Homo sapiens
ggccttccccttttgcctggctg

SEQ ID NO: 391533 - DNA, 15 bp, Homo sapiens
ggccttccctcccca

SEQ ID NO: 391534 - DNA, 14 bp, Homo sapiens
ggccttcctgccct

SEQ ID NO: 391535 - DNA, 13 bp, Homo sapiens
ggccttgctgtca

SEQ ID NO: 391536 - DNA, 19 bp, Homo sapiens
ggccttggttcctccagca

SEQ ID NO: 391537 - DNA, 16 bp, Homo sapiens
ggcctttaaagactta

SEQ ID NO: 391538 - DNA, 21 bp, Homo sapiens
ggcctttcaggaagggagagg

SEQ ID NO: 391539 - DNA, 13 bp, Homo sapiens
ggcctttcctctc

SEQ ID NO: 391540 - DNA, 22 bp, Homo sapiens
ggcctttcctgtgccaacctga

SEQ ID NO: 391541 - DNA, 23 bp, Homo sapiens
ggcctttgcttatgaatatttat

SEQ ID NO: 391542 - DNA, 11 bp, Homo sapiens
ggcctttggga

SEQ ID NO: 391543 - DNA, 20 bp, Homo sapiens
ggcctttgtaagacacacag

SEQ ID NO: 391544 - DNA, 13 bp, Homo sapiens
ggcgactgtcatg

SEQ ID NO: 391545 - DNA, 15 bp, Homo sapiens
ggcgagcccttagcc

SEQ ID NO: 391546 - DNA, 16 bp, Homo sapiens
ggcgagcccttagcct

SEQ ID NO: 391547 - DNA, 18 bp, Homo sapiens
ggcgagcccttagccttg

SEQ ID NO: 391548 - DNA, 19 bp, Homo sapiens
ggcgaggcgaagctgagcg

SEQ ID NO: 391549 - DNA, 22 bp, Homo sapiens
ggcgaggcgggggagcctggag

SEQ ID NO: 391550 - DNA, 16 bp, Homo sapiens
ggcgaggctgcctctg

SEQ ID NO: 391551 - DNA, 18 bp, Homo sapiens
ggcgaggctgcctctggg

SEQ ID NO: 391552 - DNA, 19 bp, Homo sapiens
ggcgagtcccggagcccca

SEQ ID NO: 391553 - DNA, 17 bp, Homo sapiens
ggcgatccacctgtctc

SEQ ID NO: 391554 - DNA, 18 bp, Homo sapiens
ggcgcacccggcagcccc

SEQ ID NO: 391555 - DNA, 12 bp, Homo sapiens
ggcgcagcccct

SEQ ID NO: 391556 - DNA, 18 bp, Homo sapiens
ggcgcagcccctggagct

SEQ ID NO: 391557 - DNA, 12 bp, Homo sapiens
ggcgcagcccta

SEQ ID NO: 391558 - DNA, 16 bp, Homo sapiens
ggcgcagtgcctctgg

SEQ ID NO: 391559 - DNA, 15 bp, Homo sapiens
ggcgccaccatcctg

SEQ ID NO: 391560 - DNA, 14 bp, Homo sapiens
ggcgcccacctgcc

SEQ ID NO: 391561 - DNA, 18 bp, Homo sapiens
tgtgttttggtatgcact

SEQ ID NO: 391562 - DNA, 16 bp, Homo sapiens
tgtgttttggttaata

SEQ ID NO: 391563 - DNA, 15 bp, Homo sapiens
tgtgttttgtctgag

SEQ ID NO: 391564 - DNA, 19 bp, Homo sapiens
tgtgttttttttcctttgc

SEQ ID NO: 391565 - DNA, 23 bp, Homo sapiens
tgttaaaaaccattataaaatct

SEQ ID NO: 391566 - DNA, 21 bp, Homo sapiens
tgttaaagaggcgtcttgtat

SEQ ID NO: 391567 - DNA, 14 bp, Homo sapiens
tgttaaagttgttt

SEQ ID NO: 391568 - DNA, 22 bp, Homo sapiens
tgttaaatatcagtagaaactc

SEQ ID NO: 391569 - DNA, 18 bp, Homo sapiens
tgttaaatatttttgtac

SEQ ID NO: 391570 - DNA, 18 bp, Homo sapiens
tgttaaatgaaattgtaa

SEQ ID NO: 391571 - DNA, 21 bp, Homo sapiens
tgttaacatggacatgatctt

SEQ ID NO: 391572 - DNA, 17 bp, Homo sapiens
tgttaactcttgtctat

SEQ ID NO: 391573 - DNA, 15 bp, Homo sapiens
tgttaagctcaggat

SEQ ID NO: 391574 - DNA, 17 bp, Homo sapiens
tgttaagctcaggattt

SEQ ID NO: 391575 - DNA, 22 bp, Homo sapiens
tgttaataaagtgcactgccac

SEQ ID NO: 391576 - DNA, 14 bp, Homo sapiens
tgttaatcctagct

SEQ ID NO: 391577 - DNA, 23 bp, Homo sapiens
tgttaatcttaggggagagcttt

SEQ ID NO: 391578 - DNA, 19 bp, Homo sapiens
tgttaatgaaaatgtcaga

SEQ ID NO: 391579 - DNA, 20 bp, Homo sapiens
tgttaattcagcactgattt

SEQ ID NO: 391580 - DNA, 19 bp, Homo sapiens
tgttaattgattaaactgt

SEQ ID NO: 391581 - DNA, 17 bp, Homo sapiens
tgttacacaatatgtgt

SEQ ID NO: 391582 - DNA, 15 bp, Homo sapiens
tgttacacatacaca

SEQ ID NO: 391583 - DNA, 18 bp, Homo sapiens
tgttaccatgtcactgtg

SEQ ID NO: 391584 - DNA, 12 bp, Homo sapiens
tgttaccttaaa

SEQ ID NO: 391585 - DNA, 17 bp, Homo sapiens
tgttaccttaaaactag

SEQ ID NO: 391586 - DNA, 22 bp, Homo sapiens
tgttacggcagtcacactgctg

SEQ ID NO: 391587 - DNA, 15 bp, Homo sapiens
tgttactctggttct

SEQ ID NO: 391588 - DNA, 20 bp, Homo sapiens
tgttactgatcatgcattgt

SEQ ID NO: 391589 - DNA, 13 bp, Homo sapiens
tgttactgtctgt

SEQ ID NO: 391590 - DNA, 17 bp, Homo sapiens
tgttactgtctgtagtg

SEQ ID NO: 391591 - DNA, 14 bp, Homo sapiens
tgttacttaaacat

SEQ ID NO: 391592 - DNA, 15 bp, Homo sapiens
tgttagaattgattt

SEQ ID NO: 391593 - DNA, 17 bp, Homo sapiens
tgttagaattgatttcc

SEQ ID NO: 391594 - DNA, 21 bp, Homo sapiens
tgttagagaggtagcgagctg

SEQ ID NO: 391595 - DNA, 23 bp, Homo sapiens
tgttagagaggtagcgagctgct

SEQ ID NO: 391596 - DNA, 12 bp, Homo sapiens
tgttagatgctg

SEQ ID NO: 391597 - DNA, 14 bp, Homo sapiens
tgttaggctgggcc

SEQ ID NO: 391598 - DNA, 16 bp, Homo sapiens
tgttaggctgggccca

SEQ ID NO: 391599 - DNA, 18 bp, Homo sapiens
tgttaggctgggcccaga

SEQ ID NO: 391600 - DNA, 15 bp, Homo sapiens
tgttgggacctgctg

SEQ ID NO: 391601 - DNA, 20 bp, Homo sapiens
tgttgggacctgctgctcca

SEQ ID NO: 391602 - DNA, 17 bp, Homo sapiens
tgttgtacgtaaagctt

SEQ ID NO: 391603 - DNA, 23 bp, Homo sapiens
tgttgtaggaaaagctgttccca

SEQ ID NO: 391604 - DNA, 15 bp, Homo sapiens
tgttgtcatgtgtat

SEQ ID NO: 391605 - DNA, 15 bp, Homo sapiens
tgttgtcattgcttt

SEQ ID NO: 391606 - DNA, 19 bp, Homo sapiens
tgttgtcattgctttactg

SEQ ID NO: 391607 - DNA, 17 bp, Homo sapiens
tgttgtgactggcaccc

SEQ ID NO: 391608 - DNA, 20 bp, Homo sapiens
tgttgtgatgtattctagct

SEQ ID NO: 391609 - DNA, 22 bp, Homo sapiens
tgttgtgggggtgtcacagagg

SEQ ID NO: 391610 - DNA, 24 bp, Homo sapiens
tgttgtgggggtgtcacagaggca

SEQ ID NO: 391611 - DNA, 16 bp, Homo sapiens
tgttgtggtttgttgc

SEQ ID NO: 391612 - DNA, 21 bp, Homo sapiens
tgttgtgtacgtggagaggga

SEQ ID NO: 391613 - DNA, 13 bp, Homo sapiens
tgttgttatttaa

SEQ ID NO: 391614 - DNA, 14 bp, Homo sapiens
tgttgttgttttat

SEQ ID NO: 391615 - DNA, 15 bp, Homo sapiens
tgttgtttgatgtgt

SEQ ID NO: 391616 - DNA, 13 bp, Homo sapiens
tgttgtttgtaaa

SEQ ID NO: 391617 - DNA, 15 bp, Homo sapiens
tgttgtttgtaaata

SEQ ID NO: 391618 - DNA, 11 bp, Homo sapiens
tgttgttttgt

SEQ ID NO: 391619 - DNA, 20 bp, Homo sapiens
tgtttaaaaaaataacatct

SEQ ID NO: 391620 - DNA, 14 bp, Homo sapiens
tgtttaaagaataa

SEQ ID NO: 391621 - DNA, 12 bp, Homo sapiens
tgtttaaagaga

SEQ ID NO: 391622 - DNA, 15 bp, Homo sapiens
tgtttaaataaagta

SEQ ID NO: 391623 - DNA, 17 bp, Homo sapiens
tgtttaaataaagtatc

SEQ ID NO: 391624 - DNA, 22 bp, Homo sapiens
tgtttaaatataaatctgatca

SEQ ID NO: 391625 - DNA, 16 bp, Homo sapiens
tgtttaaatataaatg

SEQ ID NO: 391626 - DNA, 22 bp, Homo sapiens
tgtttaaatataaatgtttaaa

SEQ ID NO: 391627 - DNA, 20 bp, Homo sapiens
tgtttaagtgcttggttgaa

SEQ ID NO: 391628 - DNA, 14 bp, Homo sapiens
tgtttaatagtata

SEQ ID NO: 391629 - DNA, 18 bp, Homo sapiens
tgtttaatagtatatcta

SEQ ID NO: 391630 - DNA, 15 bp, Homo sapiens
tgtttaattgtaggt

SEQ ID NO: 391631 - DNA, 23 bp, Homo sapiens
tgtttacagcactactctgtgcc

SEQ ID NO: 391632 - DNA, 16 bp, Homo sapiens
tgtttaccctccctgt

SEQ ID NO: 391633 - DNA, 22 bp, Homo sapiens
tgtttaccctccctgtcccctg

SEQ ID NO: 391634 - DNA, 20 bp, Homo sapiens
tgtttacctcactggtgcat

SEQ ID NO: 391635 - DNA, 22 bp, Homo sapiens
tgtttagcattaaaaataaaag

SEQ ID NO: 391636 - DNA, 13 bp, Homo sapiens
tgtttagcttcct

SEQ ID NO: 391637 - DNA, 14 bp, Homo sapiens
tgtttagtaataca

SEQ ID NO: 391638 - DNA, 21 bp, Homo sapiens
tgtttatatacagtacacaga

SEQ ID NO: 391639 - DNA, 18 bp, Homo sapiens
tgtttatatgtcttgcaa

SEQ ID NO: 391640 - DNA, 21 bp, Homo sapiens
tgtttatattgtttttatata

SEQ ID NO: 391641 - DNA, 14 bp, Homo sapiens
tgtttatgaagaaa

SEQ ID NO: 391642 - DNA, 19 bp, Homo sapiens
tgtttatgatatttcttgc

SEQ ID NO: 391643 - DNA, 15 bp, Homo sapiens
tgtttatggcctcag

SEQ ID NO: 391644 - DNA, 14 bp, Homo sapiens
tgtttatttataga

SEQ ID NO: 391645 - DNA, 15 bp, Homo sapiens
tgtttatttatcagt

SEQ ID NO: 391646 - DNA, 12 bp, Homo sapiens
tgtttatttttc

SEQ ID NO: 391647 - DNA, 19 bp, Homo sapiens
tgtttatttttcatattgt

SEQ ID NO: 391648 - DNA, 17 bp, Homo sapiens
tgtttcagctgcagttg

SEQ ID NO: 391649 - DNA, 22 bp, Homo sapiens
tgtttcagctgcagttgaagag

SEQ ID NO: 391650 - DNA, 19 bp, Homo sapiens
tgtttcaggacagctgctt

SEQ ID NO: 391651 - DNA, 16 bp, Homo sapiens
tgtttcaggtggaaca

SEQ ID NO: 391652 - DNA, 15 bp, Homo sapiens
tgtttccagctgcca

SEQ ID NO: 391653 - DNA, 23 bp, Homo sapiens
tgtttccaggcatgaccctggag

SEQ ID NO: 391654 - DNA, 17 bp, Homo sapiens
tgtttccaggtcagaaa

SEQ ID NO: 391655 - DNA, 15 bp, Homo sapiens
tgtttcccctcagaa

SEQ ID NO: 391656 - DNA, 13 bp, Homo sapiens
tgtttcccctgca

SEQ ID NO: 391657 - DNA, 19 bp, Homo sapiens
tgtttccctagactctgta

SEQ ID NO: 391658 - DNA, 13 bp, Homo sapiens
tgtttccctgctg

SEQ ID NO: 391659 - DNA, 17 bp, Homo sapiens
tgtttccctgctggcca

SEQ ID NO: 391660 - DNA, 18 bp, Homo sapiens
tgtttcccttcccttcca

SEQ ID NO: 391661 - DNA, 16 bp, Homo sapiens
tgtttcctattaatct

SEQ ID NO: 391662 - DNA, 23 bp, Homo sapiens
tgtttcctgtgcccatcatctct

SEQ ID NO: 391663 - DNA, 22 bp, Homo sapiens
tgtttcggagacgggaccgggc

SEQ ID NO: 391664 - DNA, 14 bp, Homo sapiens
tgtttctaagagca

SEQ ID NO: 391665 - DNA, 14 bp, Homo sapiens
tgtttctatactgt

SEQ ID NO: 391666 - DNA, 13 bp, Homo sapiens
tgtttctctgctg

SEQ ID NO: 391667 - DNA, 14 bp, Homo sapiens
tgtttctctgctgt

SEQ ID NO: 391668 - DNA, 13 bp, Homo sapiens
tgtttctgaaaat

SEQ ID NO: 391669 - DNA, 14 bp, Homo sapiens
tgtttctgaaaatt

SEQ ID NO: 391670 - DNA, 16 bp, Homo sapiens
tgtttctgacccactg

SEQ ID NO: 391671 - DNA, 17 bp, Homo sapiens
tgtttctgacccactga

SEQ ID NO: 391672 - DNA, 16 bp, Homo sapiens
tgtttctgcagaggca

SEQ ID NO: 391673 - DNA, 22 bp, Homo sapiens
tgtttctgcagcccttgggcag

SEQ ID NO: 391674 - DNA, 16 bp, Homo sapiens
tgtttcttaaatggaa

SEQ ID NO: 391675 - DNA, 12 bp, Homo sapiens
tgtttcttctca

SEQ ID NO: 391676 - DNA, 12 bp, Homo sapiens
tgtttctttctg

SEQ ID NO: 391677 - DNA, 15 bp, Homo sapiens
tgtttctttctgtct

SEQ ID NO: 391678 - DNA, 20 bp, Homo sapiens
tgtttctttctgtctctctc

SEQ ID NO: 391679 - DNA, 20 bp, Homo sapiens
tgtttcttttgcttaggaaa

SEQ ID NO: 391680 - DNA, 19 bp, Homo sapiens
tgtttgaaaatattatctt

SEQ ID NO: 391681 - DNA, 20 bp, Homo sapiens
tgtttgaattttcaaaggct

SEQ ID NO: 391682 - DNA, 16 bp, Homo sapiens
tgtttgatgtgtatgt

SEQ ID NO: 391683 - DNA, 18 bp, Homo sapiens
tgtttgatgtgtatgtgt

SEQ ID NO: 391684 - DNA, 19 bp, Homo sapiens
tgtttgatgtgtatgtgtt

SEQ ID NO: 391685 - DNA, 20 bp, Homo sapiens
tgtttgccttctacttttaa

SEQ ID NO: 391686 - DNA, 15 bp, Homo sapiens
tgtttgctcagaaca

SEQ ID NO: 391687 - DNA, 15 bp, Homo sapiens
tgtttgctgcttttg

SEQ ID NO: 391688 - DNA, 15 bp, Homo sapiens
tgtttgctgtttttt

SEQ ID NO: 391689 - DNA, 15 bp, Homo sapiens
tgtttgcttattgtt

SEQ ID NO: 391690 - DNA, 21 bp, Homo sapiens
tgtttgcttattgttccaaga

SEQ ID NO: 391691 - DNA, 23 bp, Homo sapiens
tgtttgcttattgttccaagaca

SEQ ID NO: 391692 - DNA, 20 bp, Homo sapiens
tgtttggcttataaacacat

SEQ ID NO: 391693 - DNA, 18 bp, Homo sapiens
tgtttgggaggctggagt

SEQ ID NO: 391694 - DNA, 16 bp, Homo sapiens
tgtttggttctggggc

SEQ ID NO: 391695 - DNA, 15 bp, Homo sapiens
tgtttgtaaattaat

SEQ ID NO: 391696 - DNA, 19 bp, Homo sapiens
tgtttgtaaattaatactt

SEQ ID NO: 391697 - DNA, 13 bp, Homo sapiens
tgtttgtaagatt

SEQ ID NO: 391698 - DNA, 15 bp, Homo sapiens
tgtttgtaagattta

SEQ ID NO: 391699 - DNA, 21 bp, Homo sapiens
tgtttgtacacaacacctaaa

SEQ ID NO: 391700 - DNA, 21 bp, Homo sapiens
tgtttgtataccatgatgcat

SEQ ID NO: 391701 - DNA, 15 bp, Homo sapiens
tgtttgtcattttga

SEQ ID NO: 391702 - DNA, 13 bp, Homo sapiens
tgtttgtccagtt

SEQ ID NO: 391703 - DNA, 18 bp, Homo sapiens
ggctctgagaaggggagg

SEQ ID NO: 391704 - DNA, 19 bp, Homo sapiens
ggctctgcatacacatgca

SEQ ID NO: 391705 - DNA, 14 bp, Homo sapiens
ggctctgccaccct

SEQ ID NO: 391706 - DNA, 17 bp, Homo sapiens
ggctctgcgtcccactg

SEQ ID NO: 391707 - DNA, 18 bp, Homo sapiens
ggctctgcttcctcagcc

SEQ ID NO: 391708 - DNA, 18 bp, Homo sapiens
ggctctggccaccctggc

SEQ ID NO: 391709 - DNA, 14 bp, Homo sapiens
ggctctggctccct

SEQ ID NO: 391710 - DNA, 16 bp, Homo sapiens
ggctctggctccctgg

SEQ ID NO: 391711 - DNA, 14 bp, Homo sapiens
ggctctgggctcag

SEQ ID NO: 391712 - DNA, 18 bp, Homo sapiens
ggctctgggttcgggaag

SEQ ID NO: 391713 - DNA, 16 bp, Homo sapiens
ggctctgtattctgca

SEQ ID NO: 391714 - DNA, 18 bp, Homo sapiens
ggctcttagcagcttcca

SEQ ID NO: 391715 - DNA, 19 bp, Homo sapiens
ggctcttagcagcttccag

SEQ ID NO: 391716 - DNA, 17 bp, Homo sapiens
ggctcttcctggacctg

SEQ ID NO: 391717 - DNA, 19 bp, Homo sapiens
ggctcttcctggacctgag

SEQ ID NO: 391718 - DNA, 14 bp, Homo sapiens
ggctcttctccttt

SEQ ID NO: 391719 - DNA, 13 bp, Homo sapiens
ggctctttccttg

SEQ ID NO: 391720 - DNA, 19 bp, Homo sapiens
ggctgacagagcaggtctg

SEQ ID NO: 391721 - DNA, 22 bp, Homo sapiens
ggctgaccaacattcaaaagca

SEQ ID NO: 391722 - DNA, 19 bp, Homo sapiens
ggctgactagaagggccag

SEQ ID NO: 391723 - DNA, 13 bp, Homo sapiens
ggctgactggggc

SEQ ID NO: 391724 - DNA, 16 bp, Homo sapiens
ggctgactggggctgg

SEQ ID NO: 391725 - DNA, 18 bp, Homo sapiens
ggctgactggggctgggg

SEQ ID NO: 391726 - DNA, 15 bp, Homo sapiens
ggctgactgggggcc

SEQ ID NO: 391727 - DNA, 12 bp, Homo sapiens
ggctgagactgg

SEQ ID NO: 391728 - DNA, 13 bp, Homo sapiens
ggctgagactgga

SEQ ID NO: 391729 - DNA, 20 bp, Homo sapiens
ggctgagagccccagctgac

SEQ ID NO: 391730 - DNA, 19 bp, Homo sapiens
ggctgagagggctgtggct

SEQ ID NO: 391731 - DNA, 18 bp, Homo sapiens
ttaaatcctaccaaagta

SEQ ID NO: 391732 - DNA, 14 bp, Homo sapiens
ttaaatgaaattgt

SEQ ID NO: 391733 - DNA, 19 bp, Homo sapiens
ttaaatgcaaattaaaggg

SEQ ID NO: 391734 - DNA, 22 bp, Homo sapiens
ttaaatggaataattagcttgt

SEQ ID NO: 391735 - DNA, 11 bp, Homo sapiens
ttaaatggcac

SEQ ID NO: 391736 - DNA, 15 bp, Homo sapiens
ttaaatggcacctgt

SEQ ID NO: 391737 - DNA, 17 bp, Homo sapiens
ttaaatggcacctgtat

SEQ ID NO: 391738 - DNA, 11 bp, Homo sapiens
ttaaatggcat

SEQ ID NO: 391739 - DNA, 18 bp, Homo sapiens
ttaaatgtaaagacaaaa

SEQ ID NO: 391740 - DNA, 19 bp, Homo sapiens
ttaaattaaacaatttatt

SEQ ID NO: 391741 - DNA, 14 bp, Homo sapiens
ttaaattaaagcaa

SEQ ID NO: 391742 - DNA, 15 bp, Homo sapiens
ttaaattaaagcaaa

SEQ ID NO: 391743 - DNA, 21 bp, Homo sapiens
ttaaattacacagttcacaaa

SEQ ID NO: 391744 - DNA, 13 bp, Homo sapiens
ttaaattataagg

SEQ ID NO: 391745 - DNA, 18 bp, Homo sapiens
ttaaattataaggactgc

SEQ ID NO: 391746 - DNA, 23 bp, Homo sapiens
ttaaattctctctaacataacaa

SEQ ID NO: 391747 - DNA, 19 bp, Homo sapiens
ttaaattgttcctctttgt

SEQ ID NO: 391748 - DNA, 19 bp, Homo sapiens
ttaaatttaaaacaatgaa

SEQ ID NO: 391749 - DNA, 20 bp, Homo sapiens
ttaaatttaaaacaatgaat

SEQ ID NO: 391750 - DNA, 18 bp, Homo sapiens
ttaaattttaatgtaaaa

SEQ ID NO: 391751 - DNA, 13 bp, Homo sapiens
ttaaattttcacc

SEQ ID NO: 391752 - DNA, 13 bp, Homo sapiens
ttaaattttccat

SEQ ID NO: 391753 - DNA, 19 bp, Homo sapiens
ttaacaaaacaagaaagaa

SEQ ID NO: 391754 - DNA, 21 bp, Homo sapiens
ttaacaaacgtaatttgttat

SEQ ID NO: 391755 - DNA, 21 bp, Homo sapiens
ttaacaacaataacactgtct

SEQ ID NO: 391756 - DNA, 22 bp, Homo sapiens
ttaacaacaataacactgtctc

SEQ ID NO: 391757 - DNA, 21 bp, Homo sapiens
ttaacaataactactgtgttc

SEQ ID NO: 391758 - DNA, 16 bp, Homo sapiens
ttaacacaagtcctgt

SEQ ID NO: 391759 - DNA, 18 bp, Homo sapiens
ttaacactgtaatatctt

SEQ ID NO: 391760 - DNA, 21 bp, Homo sapiens
ttaacactgtaatatctttaa

SEQ ID NO: 391761 - DNA, 14 bp, Homo sapiens
ttaacagctttctc

SEQ ID NO: 391762 - DNA, 18 bp, Homo sapiens
ttaacaggttttcttcta

SEQ ID NO: 391763 - DNA, 13 bp, Homo sapiens
ttaacagttttcc

SEQ ID NO: 391764 - DNA, 22 bp, Homo sapiens
ttaacataaagaaatcatactt

SEQ ID NO: 391765 - DNA, 15 bp, Homo sapiens
ttaacatacatctaa

SEQ ID NO: 391766 - DNA, 22 bp, Homo sapiens
ttaacatcatcaggcttggaat

SEQ ID NO: 391767 - DNA, 23 bp, Homo sapiens
ttaacatgctgtgtaagctgtgt

SEQ ID NO: 391768 - DNA, 14 bp, Homo sapiens
ttaacattgaccaa

SEQ ID NO: 391769 - DNA, 22 bp, Homo sapiens
ttaacattgaccaagaactgca

SEQ ID NO: 391770 - DNA, 23 bp, Homo sapiens
ttaacattgaccaagaactgcat

SEQ ID NO: 391771 - DNA, 12 bp, Homo sapiens
ttaaccaaagaa

SEQ ID NO: 391772 - DNA, 23 bp, Homo sapiens
ttaaccaaagaaagtgggtcacc

SEQ ID NO: 391773 - DNA, 19 bp, Homo sapiens
ttaaccaccgcatatgcat

SEQ ID NO: 391774 - DNA, 23 bp, Homo sapiens
ttaaccaccgcatatgcatgcca

SEQ ID NO: 391775 - DNA, 16 bp, Homo sapiens
ttaacccaatggagac

SEQ ID NO: 391776 - DNA, 16 bp, Homo sapiens
ttaacccattattcct

SEQ ID NO: 391777 - DNA, 15 bp, Homo sapiens
ttaacctcagtgtca

SEQ ID NO: 391778 - DNA, 19 bp, Homo sapiens
ttaacctcagtgtcattta

SEQ ID NO: 391779 - DNA, 14 bp, Homo sapiens
ttaacctttttgta

SEQ ID NO: 391780 - DNA, 18 bp, Homo sapiens
ttaacctttttgtaaata

SEQ ID NO: 391781 - DNA, 19 bp, Homo sapiens
ttaacggctccaggatttt

SEQ ID NO: 391782 - DNA, 21 bp, Homo sapiens
ttaacgtatgtatttcattgc

SEQ ID NO: 391783 - DNA, 23 bp, Homo sapiens
ttaactaatatgggcattgtagt

SEQ ID NO: 391784 - DNA, 15 bp, Homo sapiens
ttaactaatttgaat

SEQ ID NO: 391785 - DNA, 20 bp, Homo sapiens
ttaactaatttgaatgtggt

SEQ ID NO: 391786 - DNA, 13 bp, Homo sapiens
ttaactacattta

SEQ ID NO: 391787 - DNA, 16 bp, Homo sapiens
ttaactacatttatga

SEQ ID NO: 391788 - DNA, 14 bp, Homo sapiens
ttaactagaattta

SEQ ID NO: 391789 - DNA, 15 bp, Homo sapiens
ttaactagaatttat

SEQ ID NO: 391790 - DNA, 14 bp, Homo sapiens
ttaactcagatcac

SEQ ID NO: 391791 - DNA, 16 bp, Homo sapiens
ttaactccgtttccaa

SEQ ID NO: 391792 - DNA, 19 bp, Homo sapiens
ttaactgaaaatgtaaatt

SEQ ID NO: 391793 - DNA, 21 bp, Homo sapiens
ttaactgaacaatggccctgt

SEQ ID NO: 391794 - DNA, 13 bp, Homo sapiens
ttaactgcatata

SEQ ID NO: 391795 - DNA, 18 bp, Homo sapiens
ttaactgtgtgaagaaat

SEQ ID NO: 391796 - DNA, 22 bp, Homo sapiens
ttaacttaaaagattcactaaa

SEQ ID NO: 391797 - DNA, 17 bp, Homo sapiens
ttaacttctattttcaa

SEQ ID NO: 391798 - DNA, 19 bp, Homo sapiens
ttaacttgtttggtagtta

SEQ ID NO: 391799 - DNA, 16 bp, Homo sapiens
ttaactttaagtttca

SEQ ID NO: 391800 - DNA, 13 bp, Homo sapiens
ttaacttttgtaa

SEQ ID NO: 391801 - DNA, 17 bp, Homo sapiens
ttaagaaaaaaataatt

SEQ ID NO: 391802 - DNA, 15 bp, Homo sapiens
ttaagaaaaacatgt

SEQ ID NO: 391803 - DNA, 21 bp, Homo sapiens
ttaagaaaacccgacaacatt

SEQ ID NO: 391804 - DNA, 17 bp, Homo sapiens
ttaagaaaatacaataa

SEQ ID NO: 391805 - DNA, 18 bp, Homo sapiens
ttaagacaaatgggactg

SEQ ID NO: 391806 - DNA, 17 bp, Homo sapiens
ttaagacttaatctttg

SEQ ID NO: 391807 - DNA, 20 bp, Homo sapiens
ttaagacttaatctttgctg

SEQ ID NO: 391808 - DNA, 15 bp, Homo sapiens
ttaagagaatgaatt

SEQ ID NO: 391809 - DNA, 21 bp, Homo sapiens
ttaagagtgggggagagcagg

SEQ ID NO: 391810 - DNA, 21 bp, Homo sapiens
ttaagatacactcctgctgtg

SEQ ID NO: 391811 - DNA, 14 bp, Homo sapiens
ttaagatggattct

SEQ ID NO: 391812 - DNA, 19 bp, Homo sapiens
ttaagatggtcatattatt

SEQ ID NO: 391813 - DNA, 15 bp, Homo sapiens
ttaagattccatttt

SEQ ID NO: 391814 - DNA, 15 bp, Homo sapiens
ttaagattttacaaa

SEQ ID NO: 391815 - DNA, 19 bp, Homo sapiens
ttaagcaacatctttttaa

SEQ ID NO: 391816 - DNA, 14 bp, Homo sapiens
ttaagcactacata

SEQ ID NO: 391817 - DNA, 15 bp, Homo sapiens
ttaagcactcttaaa

SEQ ID NO: 391818 - DNA, 13 bp, Homo sapiens
ttaagcactttga

SEQ ID NO: 391819 - DNA, 17 bp, Homo sapiens
ttaagcactttgaaaat

SEQ ID NO: 391820 - DNA, 20 bp, Homo sapiens
ttaagcactttgaaaatatt

SEQ ID NO: 391821 - DNA, 16 bp, Homo sapiens
ttaagcagcctttctg

SEQ ID NO: 391822 - DNA, 12 bp, Homo sapiens
ttaagcatgagt

SEQ ID NO: 391823 - DNA, 14 bp, Homo sapiens
ttaagcattgtttg

SEQ ID NO: 391824 - DNA, 19 bp, Homo sapiens
ttaagcattgtttgcttat

SEQ ID NO: 391825 - DNA, 22 bp, Homo sapiens
ttaagcattgtttgcttattgt

SEQ ID NO: 391826 - DNA, 23 bp, Homo sapiens
ttaagcattgtttgcttattgtt

SEQ ID NO: 391827 - DNA, 23 bp, Homo sapiens
ttaagccccctcttgagaggggt

SEQ ID NO: 391828 - DNA, 15 bp, Homo sapiens
ttaagctccagcttt

SEQ ID NO: 391829 - DNA, 14 bp, Homo sapiens
ttaaggaaaattag

SEQ ID NO: 391830 - DNA, 15 bp, Homo sapiens
ttaaggaagaataaa

SEQ ID NO: 391831 - DNA, 20 bp, Homo sapiens
ttaaggaagaataaaaaaga

SEQ ID NO: 391832 - DNA, 19 bp, Homo sapiens
ttaaggacaaaaatgaact

SEQ ID NO: 391833 - DNA, 23 bp, Homo sapiens
ttaaggggggcagggagtgatga

SEQ ID NO: 391834 - DNA, 17 bp, Homo sapiens
ttaaggtgggtccagga

SEQ ID NO: 391835 - DNA, 14 bp, Homo sapiens
ttaagtatatctat

SEQ ID NO: 391836 - DNA, 16 bp, Homo sapiens
ttaagtcgctgaacaa

SEQ ID NO: 391837 - DNA, 21 bp, Homo sapiens
ttaagtcgggaaattctgctg

SEQ ID NO: 391838 - DNA, 18 bp, Homo sapiens
ttaagtcttactgttttg

SEQ ID NO: 391839 - DNA, 16 bp, Homo sapiens
ttaagtgctttgtaat

SEQ ID NO: 391840 - DNA, 15 bp, Homo sapiens
ttaagtttcaggata

SEQ ID NO: 391841 - DNA, 16 bp, Homo sapiens
ttaataaaactgcaca

SEQ ID NO: 391842 - DNA, 21 bp, Homo sapiens
ttaataaaactgcacagtgct

SEQ ID NO: 391843 - DNA, 23 bp, Homo sapiens
ttaataaacgtccacagagtata

SEQ ID NO: 391844 - DNA, 14 bp, Homo sapiens
ttaataaagacagg

SEQ ID NO: 391845 - DNA, 22 bp, Homo sapiens
ttaataaaggtttcgttgcatg

SEQ ID NO: 391846 - DNA, 20 bp, Homo sapiens
ttaataactttgctggaaaa

SEQ ID NO: 391847 - DNA, 17 bp, Homo sapiens
ttaatacctttaaatat

SEQ ID NO: 391848 - DNA, 15 bp, Homo sapiens
ttaatactcacctcc

SEQ ID NO: 391849 - DNA, 21 bp, Homo sapiens
gggactgtctttcagatacat

SEQ ID NO: 391850 - DNA, 21 bp, Homo sapiens
gggacttcaaaatcagtgatg

SEQ ID NO: 391851 - DNA, 24 bp, Homo sapiens
gggacttcaaaatcagtgatggga

SEQ ID NO: 391852 - DNA, 22 bp, Homo sapiens
gggacttccctagaagtcttca

SEQ ID NO: 391853 - DNA, 18 bp, Homo sapiens
gggacttgaatctttcca

SEQ ID NO: 391854 - DNA, 20 bp, Homo sapiens
gggagaaaaagaaacacaag

SEQ ID NO: 391855 - DNA, 15 bp, Homo sapiens
gggagaaaagccaga

SEQ ID NO: 391856 - DNA, 19 bp, Homo sapiens
gggagaacacatttctaat

SEQ ID NO: 391857 - DNA, 16 bp, Homo sapiens
gggagaagagccctgg

SEQ ID NO: 391858 - DNA, 14 bp, Homo sapiens
gggagaaggagagg

SEQ ID NO: 391859 - DNA, 15 bp, Homo sapiens
gggagaaggagaggc

SEQ ID NO: 391860 - DNA, 19 bp, Homo sapiens
ttacctaaacagatataaa

SEQ ID NO: 391861 - DNA, 21 bp, Homo sapiens
ttacctaccacagtgtctgta

SEQ ID NO: 391862 - DNA, 17 bp, Homo sapiens
ttacctattgctgtaaa

SEQ ID NO: 391863 - DNA, 13 bp, Homo sapiens
ttacctcatttgc

SEQ ID NO: 391864 - DNA, 14 bp, Homo sapiens
ttacctcatttgca

SEQ ID NO: 391865 - DNA, 15 bp, Homo sapiens
ttacctcatttgcat

SEQ ID NO: 391866 - DNA, 11 bp, Homo sapiens
ttacctctgat

SEQ ID NO: 391867 - DNA, 19 bp, Homo sapiens
ttacctgtaatagcctcac

SEQ ID NO: 391868 - DNA, 23 bp, Homo sapiens
ttaccttaaaactaggcatttgt

SEQ ID NO: 391869 - DNA, 20 bp, Homo sapiens
ttaccttcatttcatcctgt

SEQ ID NO: 391870 - DNA, 15 bp, Homo sapiens
ttacctttattaatg

SEQ ID NO: 391871 - DNA, 18 bp, Homo sapiens
ttaccttttctgttgtac

SEQ ID NO: 391872 - DNA, 13 bp, Homo sapiens
ttacgtatatttc

SEQ ID NO: 391873 - DNA, 15 bp, Homo sapiens
ttacgtatatttcat

SEQ ID NO: 391874 - DNA, 23 bp, Homo sapiens
ttacgttgcatccacaggattcc

SEQ ID NO: 391875 - DNA, 16 bp, Homo sapiens
ttactaaacattttgt

SEQ ID NO: 391876 - DNA, 12 bp, Homo sapiens
ttactaaatcta

SEQ ID NO: 391877 - DNA, 19 bp, Homo sapiens
ttactaaattgtatacatt

SEQ ID NO: 391878 - DNA, 19 bp, Homo sapiens
ttactaagacatagtctct

SEQ ID NO: 391879 - DNA, 21 bp, Homo sapiens
ttactaagatgaaattgccaa

SEQ ID NO: 391880 - DNA, 22 bp, Homo sapiens
ttactaagatgaaattgccaaa

SEQ ID NO: 391881 - DNA, 23 bp, Homo sapiens
ttactacataattaaattttaat

SEQ ID NO: 391882 - DNA, 18 bp, Homo sapiens
ttactacatgtgggagct

SEQ ID NO: 391883 - DNA, 17 bp, Homo sapiens
ttactactattctgtta

SEQ ID NO: 391884 - DNA, 15 bp, Homo sapiens
ttactactgcaagtt

SEQ ID NO: 391885 - DNA, 14 bp, Homo sapiens
ttactactttaaat

SEQ ID NO: 391886 - DNA, 21 bp, Homo sapiens
ttactagtactagtactatga

SEQ ID NO: 391887 - DNA, 22 bp, Homo sapiens
ttactatcctggctttgcccaa

SEQ ID NO: 391888 - DNA, 12 bp, Homo sapiens
ttactattaact

SEQ ID NO: 391889 - DNA, 19 bp, Homo sapiens
ttactattaagcagtaaaa

SEQ ID NO: 391890 - DNA, 21 bp, Homo sapiens
ttactcaaagttaacctacct

SEQ ID NO: 391891 - DNA, 13 bp, Homo sapiens
ttactcaaccaaa

SEQ ID NO: 391892 - DNA, 11 bp, Homo sapiens
ttactcccctt

SEQ ID NO: 391893 - DNA, 20 bp, Homo sapiens
ttactccccttgagctgaga

SEQ ID NO: 391894 - DNA, 14 bp, Homo sapiens
ttactcccttcctg

SEQ ID NO: 391895 - DNA, 19 bp, Homo sapiens
ttactcccttcctggcctc

SEQ ID NO: 391896 - DNA, 16 bp, Homo sapiens
ttactctgacataaac

SEQ ID NO: 391897 - DNA, 17 bp, Homo sapiens
ttactctgagcccaggc

SEQ ID NO: 391898 - DNA, 12 bp, Homo sapiens
ttactgaccagc

SEQ ID NO: 391899 - DNA, 13 bp, Homo sapiens
ttactgagcttct

SEQ ID NO: 391900 - DNA, 16 bp, Homo sapiens
ttactgagcttctctg

SEQ ID NO: 391901 - DNA, 13 bp, Homo sapiens
ttactgatcatgc

SEQ ID NO: 391902 - DNA, 16 bp, Homo sapiens
ttactgatcatgcatt

SEQ ID NO: 391903 - DNA, 21 bp, Homo sapiens
ttactgatcttacctttatga

SEQ ID NO: 391904 - DNA, 22 bp, Homo sapiens
ttactgcagcctttgcctcccc

SEQ ID NO: 391905 - DNA, 13 bp, Homo sapiens
ttactgccttcag

SEQ ID NO: 391906 - DNA, 12 bp, Homo sapiens
ttactgggaagc

SEQ ID NO: 391907 - DNA, 12 bp, Homo sapiens
ttactggtttca

SEQ ID NO: 391908 - DNA, 23 bp, Homo sapiens
ttactgtatttgggatatgagtt

SEQ ID NO: 391909 - DNA, 13 bp, Homo sapiens
ttactgtcaataa

SEQ ID NO: 391910 - DNA, 22 bp, Homo sapiens
ttactgtctggttttaacaatt

SEQ ID NO: 391911 - DNA, 23 bp, Homo sapiens
ttactgtctggttttaacaattt

SEQ ID NO: 391912 - DNA, 16 bp, Homo sapiens
ttactgtctgtagtgt

SEQ ID NO: 391913 - DNA, 17 bp, Homo sapiens
ttactgtctgtagtgtt

SEQ ID NO: 391914 - DNA, 14 bp, Homo sapiens
ttactgtctttatt

SEQ ID NO: 391915 - DNA, 15 bp, Homo sapiens
ttactgttaaccatt

SEQ ID NO: 391916 - DNA, 13 bp, Homo sapiens
ttactgttcatgg

SEQ ID NO: 391917 - DNA, 14 bp, Homo sapiens
ttactgttcttatt

SEQ ID NO: 391918 - DNA, 15 bp, Homo sapiens
ttactgttgcattta

SEQ ID NO: 391919 - DNA, 20 bp, Homo sapiens
ttactgttgcatttactttt

SEQ ID NO: 391920 - DNA, 16 bp, Homo sapiens
ttactgtttatttctg

SEQ ID NO: 391921 - DNA, 16 bp, Homo sapiens
ttacttaaagcttgtt

SEQ ID NO: 391922 - DNA, 14 bp, Homo sapiens
ttacttgacctcct

SEQ ID NO: 391923 - DNA, 12 bp, Homo sapiens
ttacttgatcat

SEQ ID NO: 391924 - DNA, 19 bp, Homo sapiens
ttacttggaaataataaat

SEQ ID NO: 391925 - DNA, 17 bp, Homo sapiens
ttacttggaaatattaa

SEQ ID NO: 391926 - DNA, 14 bp, Homo sapiens
ttacttgtaaattg

SEQ ID NO: 391927 - DNA, 16 bp, Homo sapiens
ttacttgttcatttct

SEQ ID NO: 391928 - DNA, 16 bp, Homo sapiens
ttacttgtttaattct

SEQ ID NO: 391929 - DNA, 17 bp, Homo sapiens
ttacttttctgcaatgt

SEQ ID NO: 391930 - DNA, 14 bp, Homo sapiens
ttactttttaaaca

SEQ ID NO: 391931 - DNA, 17 bp, Homo sapiens
ttactttttaaacagtg

SEQ ID NO: 391932 - DNA, 13 bp, Homo sapiens
ttactttttatga

SEQ ID NO: 391933 - DNA, 18 bp, Homo sapiens
ttacttttttatagctta

SEQ ID NO: 391934 - DNA, 23 bp, Homo sapiens
ttagaaaaaagtttacaacataa

SEQ ID NO: 391935 - DNA, 17 bp, Homo sapiens
ttagaaacatggttttg

SEQ ID NO: 391936 - DNA, 18 bp, Homo sapiens
ttagaaaccttaatatgt

SEQ ID NO: 391937 - DNA, 22 bp, Homo sapiens
ttagaaagaagcccaatattat

SEQ ID NO: 391938 - DNA, 21 bp, Homo sapiens
ttagaaagtagccacgtatgg

SEQ ID NO: 391939 - DNA, 17 bp, Homo sapiens
ttagaaatgaccaatat

SEQ ID NO: 391940 - DNA, 13 bp, Homo sapiens
ttagaaattacaa

SEQ ID NO: 391941 - DNA, 22 bp, Homo sapiens
ttagaaattacaagtttcagta

SEQ ID NO: 391942 - DNA, 17 bp, Homo sapiens
ttagaaattgcatttcc

SEQ ID NO: 391943 - DNA, 16 bp, Homo sapiens
ttagaacagaaaacaa

SEQ ID NO: 391944 - DNA, 20 bp, Homo sapiens
ttagaacccttctgctttct

SEQ ID NO: 391945 - DNA, 13 bp, Homo sapiens
ttagaacctttct

SEQ ID NO: 391946 - DNA, 21 bp, Homo sapiens
ttagaagaaaacatatatttt

SEQ ID NO: 391947 - DNA, 22 bp, Homo sapiens
ttagaagaaaacatatatttta

SEQ ID NO: 391948 - DNA, 17 bp, Homo sapiens
ttagaagtgcatttctg

SEQ ID NO: 391949 - DNA, 15 bp, Homo sapiens
ttagaataaaattgt

SEQ ID NO: 391950 - DNA, 21 bp, Homo sapiens
ttagaatgattccctcttgct

SEQ ID NO: 391951 - DNA, 22 bp, Homo sapiens
ttagaatttgaaaggaaaaaca

SEQ ID NO: 391952 - DNA, 18 bp, Homo sapiens
ttagacaaccatagaact

SEQ ID NO: 391953 - DNA, 23 bp, Homo sapiens
ttagacagtcaaggagtggctta

SEQ ID NO: 391954 - DNA, 16 bp, Homo sapiens
ttagacccgccaggtc

SEQ ID NO: 391955 - DNA, 23 bp, Homo sapiens
ttagacctcatctccaagatagc

SEQ ID NO: 391956 - DNA, 18 bp, Homo sapiens
ttagactttagaaataaa

SEQ ID NO: 391957 - DNA, 12 bp, Homo sapiens
ttagagaataag

SEQ ID NO: 391958 - DNA, 12 bp, Homo sapiens
ttagagacaggg

SEQ ID NO: 391959 - DNA, 20 bp, Homo sapiens
ttagagacagggtcctgcta

SEQ ID NO: 391960 - DNA, 16 bp, Homo sapiens
ttagagatgctactgt

SEQ ID NO: 391961 - DNA, 18 bp, Homo sapiens
ttagagatgctactgtca

SEQ ID NO: 391962 - DNA, 18 bp, Homo sapiens
ttagagattaatttgtgt

SEQ ID NO: 391963 - DNA, 20 bp, Homo sapiens
ttagagtgcccttaaaataa

SEQ ID NO: 391964 - DNA, 17 bp, Homo sapiens
ttagatgagggtgactg

SEQ ID NO: 391965 - DNA, 21 bp, Homo sapiens
ttagatgtttaccttcagcca

SEQ ID NO: 391966 - DNA, 17 bp, Homo sapiens
ttagattcctacttaaa

SEQ ID NO: 391967 - DNA, 18 bp, Homo sapiens
ttagattcctacttaaac

SEQ ID NO: 391968 - DNA, 20 bp, Homo sapiens
ttagattcctacttaaacaa

SEQ ID NO: 391969 - DNA, 22 bp, Homo sapiens
ttagattcctacttaaacaaaa

SEQ ID NO: 391970 - DNA, 15 bp, Homo sapiens
ttagattttctgtaa

SEQ ID NO: 391971 - DNA, 20 bp, Homo sapiens
ttagcacccttctgctgtat

SEQ ID NO: 391972 - DNA, 18 bp, Homo sapiens
ttagcagttctgcaaata

SEQ ID NO: 391973 - DNA, 21 bp, Homo sapiens
ttagcatgacaagccccaggc

SEQ ID NO: 391974 - DNA, 17 bp, Homo sapiens
ttagcattaaaaataaa

SEQ ID NO: 391975 - DNA, 16 bp, Homo sapiens
ttagcattgaaataat

SEQ ID NO: 391976 - DNA, 19 bp, Homo sapiens
ttagccaggtaatgtgaat

SEQ ID NO: 391977 - DNA, 13 bp, Homo sapiens
ttagccgggcgtg

SEQ ID NO: 391978 - DNA, 13 bp, Homo sapiens
ttagcctctccca

SEQ ID NO: 391979 - DNA, 18 bp, Homo sapiens
ttagccttgtgccctgcc

SEQ ID NO: 391980 - DNA, 21 bp, Homo sapiens
ttagcgtagctaagtgaaaag

SEQ ID NO: 391981 - DNA, 21 bp, Homo sapiens
ttagcgttctggactctgccc

SEQ ID NO: 391982 - DNA, 15 bp, Homo sapiens
ttagcgttctgtttc

SEQ ID NO: 391983 - DNA, 14 bp, Homo sapiens
ttagctaaaaatat

SEQ ID NO: 391984 - DNA, 13 bp, Homo sapiens
ttagctcagcccc

SEQ ID NO: 391985 - DNA, 19 bp, Homo sapiens
ttagctcagccccagccca

SEQ ID NO: 391986 - DNA, 13 bp, Homo sapiens
ttagctccttgaa

SEQ ID NO: 391987 - DNA, 15 bp, Homo sapiens
ttagctccttgaaga

SEQ ID NO: 391988 - DNA, 18 bp, Homo sapiens
ttagctctcttaaatgaa

SEQ ID NO: 391989 - DNA, 15 bp, Homo sapiens
ttagctggacatgct

SEQ ID NO: 391990 - DNA, 12 bp, Homo sapiens
ttagctttacat

SEQ ID NO: 391991 - DNA, 16 bp, Homo sapiens
ttatttatatatgaag

SEQ ID NO: 391992 - DNA, 14 bp, Homo sapiens
ttatttatgcctct

SEQ ID NO: 391993 - DNA, 20 bp, Homo sapiens
ttatttatgcctctgtattt

SEQ ID NO: 391994 - DNA, 13 bp, Homo sapiens
ttatttattaaga

SEQ ID NO: 391995 - DNA, 22 bp, Homo sapiens
ttatttattcagcttcatttgt

SEQ ID NO: 391996 - DNA, 14 bp, Homo sapiens
ttatttatttaata

SEQ ID NO: 391997 - DNA, 23 bp, Homo sapiens
ttatttcaaaatatacattcaaa

SEQ ID NO: 391998 - DNA, 15 bp, Homo sapiens
ttatttccagttttt

SEQ ID NO: 391999 - DNA, 21 bp, Homo sapiens
ttatttccatcatgtcagagc

SEQ ID NO: 392000 - DNA, 16 bp, Homo sapiens
ttatttctaagtattt

SEQ ID NO: 392001 - DNA, 21 bp, Homo sapiens
ttatttctgtctcataattgt

SEQ ID NO: 392002 - DNA, 11 bp, Homo sapiens
ttatttgaaag

SEQ ID NO: 392003 - DNA, 15 bp, Homo sapiens
ttatttgccttttaa

SEQ ID NO: 392004 - DNA, 14 bp, Homo sapiens
ttatttgtacagtt

SEQ ID NO: 392005 - DNA, 21 bp, Homo sapiens
ttatttgtcggggaagatgaa

SEQ ID NO: 392006 - DNA, 16 bp, Homo sapiens
ttattttaaacaaaat

SEQ ID NO: 392007 - DNA, 14 bp, Homo sapiens
ttattttaaattat

SEQ ID NO: 392008 - DNA, 21 bp, Homo sapiens
ttattttaaattataaggact

SEQ ID NO: 392009 - DNA, 23 bp, Homo sapiens
ttattttagacaaccatagaact

SEQ ID NO: 392010 - DNA, 21 bp, Homo sapiens
ttattttagcagttctgcaaa

SEQ ID NO: 392011 - DNA, 22 bp, Homo sapiens
gggtccaggaaggcagctgctc

SEQ ID NO: 392012 - DNA, 16 bp, Homo sapiens
gggtccgcaccagctg

SEQ ID NO: 392013 - DNA, 22 bp, Homo sapiens
gggtccgcaccagctgctctgc

SEQ ID NO: 392014 - DNA, 14 bp, Homo sapiens
gggtcctgctgctc

SEQ ID NO: 392015 - DNA, 13 bp, Homo sapiens
gggtcctggctcc

SEQ ID NO: 392016 - DNA, 18 bp, Homo sapiens
gggtccttccctctcccc

SEQ ID NO: 392017 - DNA, 16 bp, Homo sapiens
gggtcggaagcctgtc

SEQ ID NO: 392018 - DNA, 18 bp, Homo sapiens
gggtcggaagcctgtcct

SEQ ID NO: 392019 - DNA, 21 bp, Homo sapiens
gggtcgggggaggagcacccc

SEQ ID NO: 392020 - DNA, 14 bp, Homo sapiens
gggtcgtgaggcaa

SEQ ID NO: 392021 - DNA, 15 bp, Homo sapiens
gggtctatacattcc

SEQ ID NO: 392022 - DNA, 13 bp, Homo sapiens
gggtctccctgag

SEQ ID NO: 392023 - DNA, 15 bp, Homo sapiens
gggtctctgagcagt

SEQ ID NO: 392024 - DNA, 14 bp, Homo sapiens
gggtctgaaaggaa

SEQ ID NO: 392025 - DNA, 20 bp, Homo sapiens
gggtctgctctttctctgcc

SEQ ID NO: 392026 - DNA, 21 bp, Homo sapiens
gggtctgctctttctctgcca

SEQ ID NO: 392027 - DNA, 15 bp, Homo sapiens
gggtctgggaggcag

SEQ ID NO: 392028 - DNA, 14 bp, Homo sapiens
gggtctggtgccaa

SEQ ID NO: 392029 - DNA, 19 bp, Homo sapiens
gggtctgtgggactggccc

SEQ ID NO: 392030 - DNA, 17 bp, Homo sapiens
gggtcttgggctactgg

SEQ ID NO: 392031 - DNA, 18 bp, Homo sapiens
gggtctttactgggaagc

SEQ ID NO: 392032 - DNA, 19 bp, Homo sapiens
gggtgaagagaaccgagca

SEQ ID NO: 392033 - DNA, 13 bp, Homo sapiens
gggtgaagctggg

SEQ ID NO: 392034 - DNA, 18 bp, Homo sapiens
gggtgacagagtgagtga

SEQ ID NO: 392035 - DNA, 18 bp, Homo sapiens
gggtgacagtgccttctc

SEQ ID NO: 392036 - DNA, 21 bp, Homo sapiens
gggtgactgaatttgggcctc

SEQ ID NO: 392037 - DNA, 17 bp, Homo sapiens
gggtgagacagtggggg

SEQ ID NO: 392038 - DNA, 17 bp, Homo sapiens
gggtgagcagggccctc

SEQ ID NO: 392039 - DNA, 19 bp, Homo sapiens
gggtgagcagggccctcag

SEQ ID NO: 392040 - DNA, 11 bp, Homo sapiens
gggtgagccag

SEQ ID NO: 392041 - DNA, 15 bp, Homo sapiens
gggtgaggcgtggga

SEQ ID NO: 392042 - DNA, 19 bp, Homo sapiens
gggtgcacccactcaccag

SEQ ID NO: 392043 - DNA, 19 bp, Homo sapiens
gggtgcaggcagccttgac

SEQ ID NO: 392044 - DNA, 18 bp, Homo sapiens
gggtgccaaataaatgct

SEQ ID NO: 392045 - DNA, 18 bp, Homo sapiens
gggtgccaaccacctctg

SEQ ID NO: 392046 - DNA, 18 bp, Homo sapiens
gggtgccatccacatttt

SEQ ID NO: 392047 - DNA, 20 bp, Homo sapiens
gggtgcctcccacacttgct

SEQ ID NO: 392048 - DNA, 12 bp, Homo sapiens
gggtgcctgagc

SEQ ID NO: 392049 - DNA, 13 bp, Homo sapiens
gggtgcctgagcc

SEQ ID NO: 392050 - DNA, 21 bp, Homo sapiens
gggtgcctggtgcgctgtgct

SEQ ID NO: 392051 - DNA, 19 bp, Homo sapiens
gggtgcgctcacctgcagc

SEQ ID NO: 392052 - DNA, 18 bp, Homo sapiens
gggtgcgtgaccggcccg

SEQ ID NO: 392053 - DNA, 21 bp, Homo sapiens
gggtgctctggctggagagga

SEQ ID NO: 392054 - DNA, 15 bp, Homo sapiens
gggtggacgagggag

SEQ ID NO: 392055 - DNA, 17 bp, Homo sapiens
gggtggcacctcctgag

SEQ ID NO: 392056 - DNA, 23 bp, Homo sapiens
gggtggcctaagagttgagctct

SEQ ID NO: 392057 - DNA, 17 bp, Homo sapiens
gggtgggcagcctatgg

SEQ ID NO: 392058 - DNA, 22 bp, Homo sapiens
gggtgggcatcaaagatgagaa

SEQ ID NO: 392059 - DNA, 11 bp, Homo sapiens
gggtggggatg

SEQ ID NO: 392060 - DNA, 13 bp, Homo sapiens
gggtggggcggga

SEQ ID NO: 392061 - DNA, 14 bp, Homo sapiens
gggtgggggcctgc

SEQ ID NO: 392062 - DNA, 24 bp, Homo sapiens
gggtgggggcctgctgtgggtcag

SEQ ID NO: 392063 - DNA, 18 bp, Homo sapiens
gggtggggtgcctgagcc

SEQ ID NO: 392064 - DNA, 14 bp, Homo sapiens
gggtggtgctggga

SEQ ID NO: 392065 - DNA, 18 bp, Homo sapiens
gggtggtgctgggactga

SEQ ID NO: 392066 - DNA, 17 bp, Homo sapiens
gggtgtcatctgaggag

SEQ ID NO: 392067 - DNA, 14 bp, Homo sapiens
gggtgtgcatgcca

SEQ ID NO: 392068 - DNA, 15 bp, Homo sapiens
gggtgtgccctggct

SEQ ID NO: 392069 - DNA, 14 bp, Homo sapiens
gggtgtggcacgca

SEQ ID NO: 392070 - DNA, 14 bp, Homo sapiens
gggtgtggcttgga

SEQ ID NO: 392071 - DNA, 16 bp, Homo sapiens
gggttacaaactgcaa

SEQ ID NO: 392072 - DNA, 16 bp, Homo sapiens
gggttagcaatattta

SEQ ID NO: 392073 - DNA, 22 bp, Homo sapiens
gggttagcctggtgacaggcag

SEQ ID NO: 392074 - DNA, 20 bp, Homo sapiens
gggttatgtgtatgtgccat

SEQ ID NO: 392075 - DNA, 16 bp, Homo sapiens
gggttcaaaatgtctg

SEQ ID NO: 392076 - DNA, 20 bp, Homo sapiens
gggttcagaaatgctgcctg

SEQ ID NO: 392077 - DNA, 13 bp, Homo sapiens
gggttcattattg

SEQ ID NO: 392078 - DNA, 17 bp, Homo sapiens
gggttcattattggaat

SEQ ID NO: 392079 - DNA, 14 bp, Homo sapiens
gggttccagacagg

SEQ ID NO: 392080 - DNA, 13 bp, Homo sapiens
gggttccaggctg

SEQ ID NO: 392081 - DNA, 13 bp, Homo sapiens
gggttcgggaaga

SEQ ID NO: 392082 - DNA, 16 bp, Homo sapiens
gggttctagaaggggc

SEQ ID NO: 392083 - DNA, 21 bp, Homo sapiens
gggttctcttcattcccactg

SEQ ID NO: 392084 - DNA, 12 bp, Homo sapiens
gggttctgtatt

SEQ ID NO: 392085 - DNA, 17 bp, Homo sapiens
gggttctttcttcctct

SEQ ID NO: 392086 - DNA, 19 bp, Homo sapiens
gggttctttcttcctctgc

SEQ ID NO: 392087 - DNA, 17 bp, Homo sapiens
gggttgaaggcagtctg

SEQ ID NO: 392088 - DNA, 17 bp, Homo sapiens
gggttgccagtcctgca

SEQ ID NO: 392089 - DNA, 14 bp, Homo sapiens
gggttgctggagcc

SEQ ID NO: 392090 - DNA, 16 bp, Homo sapiens
gggttgcttgggccac

SEQ ID NO: 392091 - DNA, 20 bp, Homo sapiens
gggttggctgggcccagaag

SEQ ID NO: 392092 - DNA, 13 bp, Homo sapiens
gggttggctgggt

SEQ ID NO: 392093 - DNA, 17 bp, Homo sapiens
gggttggctgttccaga

SEQ ID NO: 392094 - DNA, 15 bp, Homo sapiens
gggttggggtggggc

SEQ ID NO: 392095 - DNA, 22 bp, Homo sapiens
gggtttagcaggctgcagcagg

SEQ ID NO: 392096 - DNA, 20 bp, Homo sapiens
gggtttcaccatgttagccg

SEQ ID NO: 392097 - DNA, 16 bp, Homo sapiens
gggtttccacacaggc

SEQ ID NO: 392098 - DNA, 23 bp, Homo sapiens
gggttttattgtccttcagagct

SEQ ID NO: 392099 - DNA, 12 bp, Homo sapiens
gggttttgtatt

SEQ ID NO: 392100 - DNA, 22 bp, Homo sapiens
gggttttttagttgaatttttt

SEQ ID NO: 392101 - DNA, 15 bp, Homo sapiens
ggtaaaaagagaagg

SEQ ID NO: 392102 - DNA, 23 bp, Homo sapiens
ggtaaacattcctccagcctccc

SEQ ID NO: 392103 - DNA, 20 bp, Homo sapiens
ggtaaatatatgttttgaga

SEQ ID NO: 392104 - DNA, 14 bp, Homo sapiens
ggtaactgccagcc

SEQ ID NO: 392105 - DNA, 19 bp, Homo sapiens
ggtaagttgttaagagtgg

SEQ ID NO: 392106 - DNA, 15 bp, Homo sapiens
ggtaataaacttaga

SEQ ID NO: 392107 - DNA, 20 bp, Homo sapiens
ggtaatcaatgaatattgaa

SEQ ID NO: 392108 - DNA, 15 bp, Homo sapiens
ggtaattaaggcagc

SEQ ID NO: 392109 - DNA, 21 bp, Homo sapiens
ggtacagcagggtcttgctgt

SEQ ID NO: 392110 - DNA, 19 bp, Homo sapiens
ggtaccagagcctatggaa

SEQ ID NO: 392111 - DNA, 17 bp, Homo sapiens
ggtaccaggccacccac

SEQ ID NO: 392112 - DNA, 20 bp, Homo sapiens
ggtaccaggccacccactgt

SEQ ID NO: 392113 - DNA, 22 bp, Homo sapiens
ggtaccagtgttagtgggaaga

SEQ ID NO: 392114 - DNA, 16 bp, Homo sapiens
ggtaccctggcagaga

SEQ ID NO: 392115 - DNA, 14 bp, Homo sapiens
ggtacttcctcctg

SEQ ID NO: 392116 - DNA, 19 bp, Homo sapiens
ggtacttggtaagagggag

SEQ ID NO: 392117 - DNA, 18 bp, Homo sapiens
ggtactttattcttgctg

SEQ ID NO: 392118 - DNA, 11 bp, Homo sapiens
ggtagaagcca

SEQ ID NO: 392119 - DNA, 22 bp, Homo sapiens
ggtagaagcccttctaccttcc

SEQ ID NO: 392120 - DNA, 15 bp, Homo sapiens
ggtagaaggaaagca

SEQ ID NO: 392121 - DNA, 15 bp, Homo sapiens
ttcagtggtttgttc

SEQ ID NO: 392122 - DNA, 13 bp, Homo sapiens
ttcagtgtcccgg

SEQ ID NO: 392123 - DNA, 18 bp, Homo sapiens
ttcagtgtcccgggcccg

SEQ ID NO: 392124 - DNA, 17 bp, Homo sapiens
ttcagttaagaaaaaaa

SEQ ID NO: 392125 - DNA, 18 bp, Homo sapiens
ttcagttaagaaaaaaat

SEQ ID NO: 392126 - DNA, 21 bp, Homo sapiens
ttcagttaagaaaaaaataat

SEQ ID NO: 392127 - DNA, 17 bp, Homo sapiens
ttcagttattaaatgat

SEQ ID NO: 392128 - DNA, 19 bp, Homo sapiens
ttcagtttgaaggctgcac

SEQ ID NO: 392129 - DNA, 19 bp, Homo sapiens
ttcataaacaacttaatgt

SEQ ID NO: 392130 - DNA, 19 bp, Homo sapiens
ttcataaatttgttgtcat

SEQ ID NO: 392131 - DNA, 22 bp, Homo sapiens
ttcataaatttgttgtcatgtg

SEQ ID NO: 392132 - DNA, 13 bp, Homo sapiens
ttcataacaatgt

SEQ ID NO: 392133 - DNA, 16 bp, Homo sapiens
ttcataagatattctt

SEQ ID NO: 392134 - DNA, 22 bp, Homo sapiens
ttcataagatattctttacaaa

SEQ ID NO: 392135 - DNA, 14 bp, Homo sapiens
ttcatacattccta

SEQ ID NO: 392136 - DNA, 20 bp, Homo sapiens
ttcataccagtcagtattcc

SEQ ID NO: 392137 - DNA, 14 bp, Homo sapiens
ttcatagctattta

SEQ ID NO: 392138 - DNA, 15 bp, Homo sapiens
ttcatagctccttgg

SEQ ID NO: 392139 - DNA, 19 bp, Homo sapiens
ttcatagggtctcttcagg

SEQ ID NO: 392140 - DNA, 14 bp, Homo sapiens
ttcatagtgccttt

SEQ ID NO: 392141 - DNA, 13 bp, Homo sapiens
ttcatagttctgt

SEQ ID NO: 392142 - DNA, 16 bp, Homo sapiens
ttcatagttctgttaa

SEQ ID NO: 392143 - DNA, 23 bp, Homo sapiens
ttcatagttctgttaaatatttt

SEQ ID NO: 392144 - DNA, 13 bp, Homo sapiens
ttcatatccagct

SEQ ID NO: 392145 - DNA, 22 bp, Homo sapiens
ttcatatcctccgccctttttg

SEQ ID NO: 392146 - DNA, 14 bp, Homo sapiens
ttcatatctctccc

SEQ ID NO: 392147 - DNA, 13 bp, Homo sapiens
ttcatatgctgta

SEQ ID NO: 392148 - DNA, 15 bp, Homo sapiens
ttcatattgagatca

SEQ ID NO: 392149 - DNA, 14 bp, Homo sapiens
ttcatattgtgcca

SEQ ID NO: 392150 - DNA, 18 bp, Homo sapiens
ttcatatttgcaataaaa

SEQ ID NO: 392151 - DNA, 15 bp, Homo sapiens
ttcatcagtgttaaa

SEQ ID NO: 392152 - DNA, 20 bp, Homo sapiens
ttcatccaatcctcactggg

SEQ ID NO: 392153 - DNA, 16 bp, Homo sapiens
ttcatcctcagcaagt

SEQ ID NO: 392154 - DNA, 14 bp, Homo sapiens
ttcatcctggcctc

SEQ ID NO: 392155 - DNA, 16 bp, Homo sapiens
ttcatcctggcctcct

SEQ ID NO: 392156 - DNA, 13 bp, Homo sapiens
ttcatcctgtgtc

SEQ ID NO: 392157 - DNA, 22 bp, Homo sapiens
ttcatcctgtgtcccctgacct

SEQ ID NO: 392158 - DNA, 17 bp, Homo sapiens
ggtcttttgacatgtgg

SEQ ID NO: 392159 - DNA, 13 bp, Homo sapiens
ggtgaaacacaca

SEQ ID NO: 392160 - DNA, 10 bp, Homo sapiens
ggtgaaatta

SEQ ID NO: 392161 - DNA, 23 bp, Homo sapiens
ggtgaaatttattagttaatata

SEQ ID NO: 392162 - DNA, 13 bp, Homo sapiens
ggtgaacagaaca

SEQ ID NO: 392163 - DNA, 19 bp, Homo sapiens
ggtgaagatgggaacgcag

SEQ ID NO: 392164 - DNA, 14 bp, Homo sapiens
ggtgaagctgggga

SEQ ID NO: 392165 - DNA, 16 bp, Homo sapiens
ggtgaagggagagcca

SEQ ID NO: 392166 - DNA, 20 bp, Homo sapiens
ggtgaagtgtggctggtgtc

SEQ ID NO: 392167 - DNA, 13 bp, Homo sapiens
ggtgaatattaca

SEQ ID NO: 392168 - DNA, 13 bp, Homo sapiens
ggtgacagagcga

SEQ ID NO: 392169 - DNA, 20 bp, Homo sapiens
ggtgacagagcgagactctg

SEQ ID NO: 392170 - DNA, 22 bp, Homo sapiens
ggtgaccagcaccatctctcct

SEQ ID NO: 392171 - DNA, 15 bp, Homo sapiens
ggtgaccttctggga

SEQ ID NO: 392172 - DNA, 22 bp, Homo sapiens
ggtgagacagtgggggtgcctg

SEQ ID NO: 392173 - DNA, 20 bp, Homo sapiens
ggtgagatacccagagagaa

SEQ ID NO: 392174 - DNA, 19 bp, Homo sapiens
ggtgagcagaagtggagct

SEQ ID NO: 392175 - DNA, 18 bp, Homo sapiens
ggtgagcagactggtggg

SEQ ID NO: 392176 - DNA, 18 bp, Homo sapiens
ggtgagcagggccctcag

SEQ ID NO: 392177 - DNA, 22 bp, Homo sapiens
ggtgagcagggccctcagagga

SEQ ID NO: 392178 - DNA, 13 bp, Homo sapiens
ggtgaggagcaca

SEQ ID NO: 392179 - DNA, 12 bp, Homo sapiens
ggtgaggcaggg

SEQ ID NO: 392180 - DNA, 20 bp, Homo sapiens
ggtgaggcgtgggatccaga

SEQ ID NO: 392181 - DNA, 15 bp, Homo sapiens
ggtgagggaggcctg

SEQ ID NO: 392182 - DNA, 14 bp, Homo sapiens
ggtgagggctgaga

SEQ ID NO: 392183 - DNA, 18 bp, Homo sapiens
ggtgaggggccaggccat

SEQ ID NO: 392184 - DNA, 17 bp, Homo sapiens
ggtgaggggctggcact

SEQ ID NO: 392185 - DNA, 15 bp, Homo sapiens
ggtgagtttttcttt

SEQ ID NO: 392186 - DNA, 15 bp, Homo sapiens
ggtgataagtggaaa

SEQ ID NO: 392187 - DNA, 16 bp, Homo sapiens
ggtgataagtggaaaa

SEQ ID NO: 392188 - DNA, 18 bp, Homo sapiens
ggtgataagtggaaaaaa

SEQ ID NO: 392189 - DNA, 16 bp, Homo sapiens
ggtgatagcattgctt

SEQ ID NO: 392190 - DNA, 19 bp, Homo sapiens
ggtgataggcaaggatgaa

SEQ ID NO: 392191 - DNA, 20 bp, Homo sapiens
ggtgatccgcctacctcagc

SEQ ID NO: 392192 - DNA, 17 bp, Homo sapiens
ggtgatcctctattttg

SEQ ID NO: 392193 - DNA, 17 bp, Homo sapiens
ggtgatcgcacaaggac

SEQ ID NO: 392194 - DNA, 19 bp, Homo sapiens
ggtgatctgtagacttctg

SEQ ID NO: 392195 - DNA, 17 bp, Homo sapiens
ggtgatgggggcatggg

SEQ ID NO: 392196 - DNA, 19 bp, Homo sapiens
ggtgatgtttccagctgcc

SEQ ID NO: 392197 - DNA, 16 bp, Homo sapiens
ggtgatgttttacttt

SEQ ID NO: 392198 - DNA, 18 bp, Homo sapiens
ggtgattttcctgtgtcc

SEQ ID NO: 392199 - DNA, 16 bp, Homo sapiens
ggtgcaacccttaccc

SEQ ID NO: 392200 - DNA, 13 bp, Homo sapiens
ggtgcacatgaca

SEQ ID NO: 392201 - DNA, 19 bp, Homo sapiens
ggtgcagcggtggaaggag

SEQ ID NO: 392202 - DNA, 21 bp, Homo sapiens
ggtgcagcggtggaaggagcc

SEQ ID NO: 392203 - DNA, 23 bp, Homo sapiens
ggtgcagcggtggaaggagcctg

SEQ ID NO: 392204 - DNA, 17 bp, Homo sapiens
ggtgcaggcagccttga

SEQ ID NO: 392205 - DNA, 21 bp, Homo sapiens
ggtgcaggcgcgcaccgccca

SEQ ID NO: 392206 - DNA, 13 bp, Homo sapiens
ggtgcagtgaaga

SEQ ID NO: 392207 - DNA, 12 bp, Homo sapiens
ggtgcagtggct

SEQ ID NO: 392208 - DNA, 18 bp, Homo sapiens
ggtgcagttttccaggaa

SEQ ID NO: 392209 - DNA, 23 bp, Homo sapiens
ggtgccaaacaaaaaggttctca

SEQ ID NO: 392210 - DNA, 17 bp, Homo sapiens
ggtgccaccaataaaaa

SEQ ID NO: 392211 - DNA, 13 bp, Homo sapiens
ggtgccactccct

SEQ ID NO: 392212 - DNA, 23 bp, Homo sapiens
ggtgccacttcttaaaggcctgg

SEQ ID NO: 392213 - DNA, 20 bp, Homo sapiens
ggtgccagccttcctctgca

SEQ ID NO: 392214 - DNA, 23 bp, Homo sapiens
ggtgccagccttcctctgcagct

SEQ ID NO: 392215 - DNA, 18 bp, Homo sapiens
ggtgccaggctgtaagca

SEQ ID NO: 392216 - DNA, 15 bp, Homo sapiens
ggtgccatcacgctt

SEQ ID NO: 392217 - DNA, 23 bp, Homo sapiens
ggtgccccacagctacctgagac

SEQ ID NO: 392218 - DNA, 13 bp, Homo sapiens
ggtgccctccact

SEQ ID NO: 392219 - DNA, 19 bp, Homo sapiens
ggtgcctcccacacttgct

SEQ ID NO: 392220 - DNA, 15 bp, Homo sapiens
ggtgcctgagagcag

SEQ ID NO: 392221 - DNA, 13 bp, Homo sapiens
ggtgcctgtgacc

SEQ ID NO: 392222 - DNA, 14 bp, Homo sapiens
ggtgcggaccggag

SEQ ID NO: 392223 - DNA, 15 bp, Homo sapiens
ggtgcgtggctgtgg

SEQ ID NO: 392224 - DNA, 20 bp, Homo sapiens
ggtgcgtggctgtggcacag

SEQ ID NO: 392225 - DNA, 24 bp, Homo sapiens
ggtgctagtgggccctctctctgg

SEQ ID NO: 392226 - DNA, 14 bp, Homo sapiens
ggtgctcaaagatg

SEQ ID NO: 392227 - DNA, 22 bp, Homo sapiens
ggtgctcacgactcttcctgca

SEQ ID NO: 392228 - DNA, 11 bp, Homo sapiens
ggtgctgcttt

SEQ ID NO: 392229 - DNA, 19 bp, Homo sapiens
ggtgctggaggcagactcg

SEQ ID NO: 392230 - DNA, 22 bp, Homo sapiens
ggtgctggaggcagactcgagg

SEQ ID NO: 392231 - DNA, 16 bp, Homo sapiens
ggtgcttgctgtgtga

SEQ ID NO: 392232 - DNA, 21 bp, Homo sapiens
ggtgcttgttccctctccctg

SEQ ID NO: 392233 - DNA, 13 bp, Homo sapiens
ggtggaaggagcc

SEQ ID NO: 392234 - DNA, 18 bp, Homo sapiens
ggtggagaatctgagggc

SEQ ID NO: 392235 - DNA, 15 bp, Homo sapiens
ggtggagtcaggctt

SEQ ID NO: 392236 - DNA, 22 bp, Homo sapiens
ggtggagtgaggttagttctgt

SEQ ID NO: 392237 - DNA, 15 bp, Homo sapiens
ggtggagttgaaaga

SEQ ID NO: 392238 - DNA, 13 bp, Homo sapiens
ggtggcatcccag

SEQ ID NO: 392239 - DNA, 14 bp, Homo sapiens
ggtggccacagcag

SEQ ID NO: 392240 - DNA, 17 bp, Homo sapiens
ggtggccaggcctgcca

SEQ ID NO: 392241 - DNA, 19 bp, Homo sapiens
ggtggccaggcctgccagc

SEQ ID NO: 392242 - DNA, 14 bp, Homo sapiens
ggtggccagggctc

SEQ ID NO: 392243 - DNA, 16 bp, Homo sapiens
ggtggcccgacagcct

SEQ ID NO: 392244 - DNA, 18 bp, Homo sapiens
ggtggcccgacagcctgg

SEQ ID NO: 392245 - DNA, 12 bp, Homo sapiens
ggtggccctggg

SEQ ID NO: 392246 - DNA, 14 bp, Homo sapiens
ggtggctggtcacg

SEQ ID NO: 392247 - DNA, 22 bp, Homo sapiens
ggtggcttgggacttgggagag

SEQ ID NO: 392248 - DNA, 14 bp, Homo sapiens
ggtgggcccagaac

SEQ ID NO: 392249 - DNA, 13 bp, Homo sapiens
ggtgggcctctgg

SEQ ID NO: 392250 - DNA, 13 bp, Homo sapiens
ggtgggcctggcc

SEQ ID NO: 392251 - DNA, 16 bp, Homo sapiens
ggtggggaagagagcc

SEQ ID NO: 392252 - DNA, 19 bp, Homo sapiens
ggtttcattgccttcctac

SEQ ID NO: 392253 - DNA, 16 bp, Homo sapiens
ggtttccacacaggcc

SEQ ID NO: 392254 - DNA, 14 bp, Homo sapiens
ggtttccacatgct

SEQ ID NO: 392255 - DNA, 21 bp, Homo sapiens
ggtttctagggtgggccccag

SEQ ID NO: 392256 - DNA, 18 bp, Homo sapiens
ggtttctgccctgcccac

SEQ ID NO: 392257 - DNA, 13 bp, Homo sapiens
ggtttctgttctg

SEQ ID NO: 392258 - DNA, 17 bp, Homo sapiens
ggtttgggcagtggaga

SEQ ID NO: 392259 - DNA, 19 bp, Homo sapiens
ggtttgggcagtggagagg

SEQ ID NO: 392260 - DNA, 21 bp, Homo sapiens
ggtttgtgagccttgctgcca

SEQ ID NO: 392261 - DNA, 22 bp, Homo sapiens
ggtttgttattcttttccagaa

SEQ ID NO: 392262 - DNA, 16 bp, Homo sapiens
ggttttaaatgtgttg

SEQ ID NO: 392263 - DNA, 17 bp, Homo sapiens
ggttttaccccagctcc

SEQ ID NO: 392264 - DNA, 18 bp, Homo sapiens
ggttttaccccagctcca

SEQ ID NO: 392265 - DNA, 14 bp, Homo sapiens
ggttttggagtcag

SEQ ID NO: 392266 - DNA, 17 bp, Homo sapiens
ggttttgttaggggtgg

SEQ ID NO: 392267 - DNA, 13 bp, Homo sapiens
ggtttttgctctc

SEQ ID NO: 392268 - DNA, 16 bp, Homo sapiens
ggtttttggctctttc

SEQ ID NO: 392269 - DNA, 20 bp, Homo sapiens
ggtttttggctctttcagag

SEQ ID NO: 392270 - DNA, 14 bp, Homo sapiens
ggttttttagttga

SEQ ID NO: 392271 - DNA, 22 bp, Homo sapiens
gtaaaaaccctgctaaatgact

SEQ ID NO: 392272 - DNA, 15 bp, Homo sapiens
gtaaaaagagaaggc

SEQ ID NO: 392273 - DNA, 18 bp, Homo sapiens
gtaaaaatgaaggaatta

SEQ ID NO: 392274 - DNA, 12 bp, Homo sapiens
gtaaaacaaaaa

SEQ ID NO: 392275 - DNA, 21 bp, Homo sapiens
gtaaaacacatacaaaagaat

SEQ ID NO: 392276 - DNA, 20 bp, Homo sapiens
gtaaaacagatttgttcatt

SEQ ID NO: 392277 - DNA, 11 bp, Homo sapiens
gtaaaactgtg

SEQ ID NO: 392278 - DNA, 15 bp, Homo sapiens
gtaaaactgtgacat

SEQ ID NO: 392279 - DNA, 16 bp, Homo sapiens
gtaaaactgtgacatt

SEQ ID NO: 392280 - DNA, 15 bp, Homo sapiens
gtaaaagagccaagt

SEQ ID NO: 392281 - DNA, 21 bp, Homo sapiens
gtaaaatcttcagctggtgga

SEQ ID NO: 392282 - DNA, 12 bp, Homo sapiens
gtaaaatcttgt

SEQ ID NO: 392283 - DNA, 16 bp, Homo sapiens
gtaaaatcttgtcatg

SEQ ID NO: 392284 - DNA, 21 bp, Homo sapiens
gtaaaatcttgtcatgtgtat

SEQ ID NO: 392285 - DNA, 22 bp, Homo sapiens
gtaaaatcttgtcatgtgtata

SEQ ID NO: 392286 - DNA, 23 bp, Homo sapiens
gtaaaatcttgtcatgtgtataa

SEQ ID NO: 392287 - DNA, 20 bp, Homo sapiens
gtaaaatgtgaagtgaatga

SEQ ID NO: 392288 - DNA, 16 bp, Homo sapiens
gtaaaattcatagcat

SEQ ID NO: 392289 - DNA, 20 bp, Homo sapiens
gtaaacatgtgttttaattc

SEQ ID NO: 392290 - DNA, 18 bp, Homo sapiens
gtaaactacggtaccagt

SEQ ID NO: 392291 - DNA, 15 bp, Homo sapiens
gtaaactcaaaactt

SEQ ID NO: 392292 - DNA, 13 bp, Homo sapiens
gtaaactcttcac

SEQ ID NO: 392293 - DNA, 14 bp, Homo sapiens
gtaaactgccctgt

SEQ ID NO: 392294 - DNA, 16 bp, Homo sapiens
gtaaactgtggatgat

SEQ ID NO: 392295 - DNA, 14 bp, Homo sapiens
gtaaataaaaatag

SEQ ID NO: 392296 - DNA, 17 bp, Homo sapiens
gtaaataaaagtacaaa

SEQ ID NO: 392297 - DNA, 18 bp, Homo sapiens
gtaaataaattgtttgac

SEQ ID NO: 392298 - DNA, 11 bp, Homo sapiens
gtaaataagag

SEQ ID NO: 392299 - DNA, 18 bp, Homo sapiens
ttccatccaccaccttgc

SEQ ID NO: 392300 - DNA, 20 bp, Homo sapiens
ttccatccaccaccttgcca

SEQ ID NO: 392301 - DNA, 17 bp, Homo sapiens
ttccatccataaatcca

SEQ ID NO: 392302 - DNA, 15 bp, Homo sapiens
ttccatccctacccc

SEQ ID NO: 392303 - DNA, 21 bp, Homo sapiens
ttccatcctgtacaagtgctc

SEQ ID NO: 392304 - DNA, 24 bp, Homo sapiens
ttccatcctgtacaagtgctcagt

SEQ ID NO: 392305 - DNA, 12 bp, Homo sapiens
ttccatctaaaa

SEQ ID NO: 392306 - DNA, 15 bp, Homo sapiens
ttccatctcattaca

SEQ ID NO: 392307 - DNA, 22 bp, Homo sapiens
ttccatgaaaacgttttattgt

SEQ ID NO: 392308 - DNA, 12 bp, Homo sapiens
ttccatgaatgt

SEQ ID NO: 392309 - DNA, 15 bp, Homo sapiens
ttccatgaatgtatc

SEQ ID NO: 392310 - DNA, 20 bp, Homo sapiens
ttccatgaatgtatcaggaa

SEQ ID NO: 392311 - DNA, 13 bp, Homo sapiens
ttccatgacagta

SEQ ID NO: 392312 - DNA, 21 bp, Homo sapiens
ttccatgcagttattagaact

SEQ ID NO: 392313 - DNA, 13 bp, Homo sapiens
ttccatgcctgag

SEQ ID NO: 392314 - DNA, 18 bp, Homo sapiens
ttccatgcctgagggtgg

SEQ ID NO: 392315 - DNA, 17 bp, Homo sapiens
ttccatggcttcctgag

SEQ ID NO: 392316 - DNA, 18 bp, Homo sapiens
ttccatgtcgcctctgca

SEQ ID NO: 392317 - DNA, 20 bp, Homo sapiens
ttccatgtcgcctctgcatt

SEQ ID NO: 392318 - DNA, 15 bp, Homo sapiens
ttccatgtgcccagt

SEQ ID NO: 392319 - DNA, 17 bp, Homo sapiens
ttccatgtgcccagtta

SEQ ID NO: 392320 - DNA, 17 bp, Homo sapiens
ttccatgtgttttgctt

SEQ ID NO: 392321 - DNA, 18 bp, Homo sapiens
ttccattaatttcaacat

SEQ ID NO: 392322 - DNA, 13 bp, Homo sapiens
ttccattccagaa

SEQ ID NO: 392323 - DNA, 14 bp, Homo sapiens
ttccattctttctt

SEQ ID NO: 392324 - DNA, 18 bp, Homo sapiens
ttccattctttcttcctc

SEQ ID NO: 392325 - DNA, 20 bp, Homo sapiens
ttccattcttttaaatgggt

SEQ ID NO: 392326 - DNA, 20 bp, Homo sapiens
ttccattgctcccagtgcca

SEQ ID NO: 392327 - DNA, 18 bp, Homo sapiens
ttccatttcttcagaggg

SEQ ID NO: 392328 - DNA, 14 bp, Homo sapiens
ttccatttgtgtgt

SEQ ID NO: 392329 - DNA, 19 bp, Homo sapiens
ttccatttttgtcagtctg

SEQ ID NO: 392330 - DNA, 17 bp, Homo sapiens
ttcccaaaccaagtgcc

SEQ ID NO: 392331 - DNA, 17 bp, Homo sapiens
ttcccaacagccttagc

SEQ ID NO: 392332 - DNA, 16 bp, Homo sapiens
ttcccaacttccctgt

SEQ ID NO: 392333 - DNA, 14 bp, Homo sapiens
ttcccaattaggaa

SEQ ID NO: 392334 - DNA, 15 bp, Homo sapiens
ttcccacacatattc

SEQ ID NO: 392335 - DNA, 19 bp, Homo sapiens
ttcccacccactagccctc

SEQ ID NO: 392336 - DNA, 14 bp, Homo sapiens
ttcccacctccctg

SEQ ID NO: 392337 - DNA, 16 bp, Homo sapiens
ttcccacctccctgcc

SEQ ID NO: 392338 - DNA, 17 bp, Homo sapiens
ttcccacctctgaggac

SEQ ID NO: 392339 - DNA, 15 bp, Homo sapiens
ttcccacgacaaaaa

SEQ ID NO: 392340 - DNA, 16 bp, Homo sapiens
ttcccacggccactgc

SEQ ID NO: 392341 - DNA, 20 bp, Homo sapiens
ttcccactaagctttctcct

SEQ ID NO: 392342 - DNA, 16 bp, Homo sapiens
ttcccactttcattca

SEQ ID NO: 392343 - DNA, 18 bp, Homo sapiens
ttcccagcaaagttttca

SEQ ID NO: 392344 - DNA, 13 bp, Homo sapiens
ttcccaggcaggg

SEQ ID NO: 392345 - DNA, 22 bp, Homo sapiens
ttcccaggcagggagggaaacc

SEQ ID NO: 392346 - DNA, 17 bp, Homo sapiens
ttcccagtgaattcttg

SEQ ID NO: 392347 - DNA, 11 bp, Homo sapiens
ttcccataatt

SEQ ID NO: 392348 - DNA, 19 bp, Homo sapiens
ttcccatcaccccttcccc

SEQ ID NO: 392349 - DNA, 13 bp, Homo sapiens
ttcccatgactgc

SEQ ID NO: 392350 - DNA, 19 bp, Homo sapiens
ttcccatgcctgtctctgt

SEQ ID NO: 392351 - DNA, 17 bp, Homo sapiens
ttcccattgtggctcct

SEQ ID NO: 392352 - DNA, 16 bp, Homo sapiens
ttcccatttgctcctt

SEQ ID NO: 392353 - DNA, 20 bp, Homo sapiens
ttcccatttgtaatgtatct

SEQ ID NO: 392354 - DNA, 14 bp, Homo sapiens
ttcccattttgcaa

SEQ ID NO: 392355 - DNA, 19 bp, Homo sapiens
ttcccattttgcaaaattt

SEQ ID NO: 392356 - DNA, 18 bp, Homo sapiens
ttccccaaccacttcatt

SEQ ID NO: 392357 - DNA, 22 bp, Homo sapiens
ttccccaccccagctcatgccc

SEQ ID NO: 392358 - DNA, 17 bp, Homo sapiens
ttccccaccttccccca

SEQ ID NO: 392359 - DNA, 15 bp, Homo sapiens
ttccccactctgctc

SEQ ID NO: 392360 - DNA, 23 bp, Homo sapiens
ttccccactgacagcctcccacc

SEQ ID NO: 392361 - DNA, 20 bp, Homo sapiens
ttccccagggttctgtattg

SEQ ID NO: 392362 - DNA, 21 bp, Homo sapiens
ttccccatttcctcttccttc

SEQ ID NO: 392363 - DNA, 22 bp, Homo sapiens
ttcccccaaatcttcctctgga

SEQ ID NO: 392364 - DNA, 13 bp, Homo sapiens
ttcccccagccca

SEQ ID NO: 392365 - DNA, 21 bp, Homo sapiens
ttcccccagcccaataaaggt

SEQ ID NO: 392366 - DNA, 16 bp, Homo sapiens
ttcccccaggcgcctg

SEQ ID NO: 392367 - DNA, 12 bp, Homo sapiens
ttccccccactc

SEQ ID NO: 392368 - DNA, 19 bp, Homo sapiens
ttccccctccaatcccacc

SEQ ID NO: 392369 - DNA, 14 bp, Homo sapiens
ttccccctctccca

SEQ ID NO: 392370 - DNA, 18 bp, Homo sapiens
ttccccctctcccagttg

SEQ ID NO: 392371 - DNA, 19 bp, Homo sapiens
ttcccctaacctcattccc

SEQ ID NO: 392372 - DNA, 16 bp, Homo sapiens
ttccccttttgccaat

SEQ ID NO: 392373 - DNA, 20 bp, Homo sapiens
ttccccttttgcctggctgt

SEQ ID NO: 392374 - DNA, 22 bp, Homo sapiens
ttccccttttgcctggctgtgg

SEQ ID NO: 392375 - DNA, 21 bp, Homo sapiens
ttcccgagcaaagtctaaagt

SEQ ID NO: 392376 - DNA, 14 bp, Homo sapiens
ttcccgcagcacca

SEQ ID NO: 392377 - DNA, 15 bp, Homo sapiens
ttcccgcagcaccag

SEQ ID NO: 392378 - DNA, 22 bp, Homo sapiens
ttcccgcagcaccagcctgagc

SEQ ID NO: 392379 - DNA, 20 bp, Homo sapiens
ttcccgcctcagcctctcaa

SEQ ID NO: 392380 - DNA, 12 bp, Homo sapiens
ttcccgctcagc

SEQ ID NO: 392381 - DNA, 16 bp, Homo sapiens
ttcccgctcagccctc

SEQ ID NO: 392382 - DNA, 18 bp, Homo sapiens
ttcccgctcagccctccc

SEQ ID NO: 392383 - DNA, 17 bp, Homo sapiens
gtagacccctggctggt

SEQ ID NO: 392384 - DNA, 16 bp, Homo sapiens
gtagacctgattttca

SEQ ID NO: 392385 - DNA, 19 bp, Homo sapiens
gtagactggccatgcaagt

SEQ ID NO: 392386 - DNA, 23 bp, Homo sapiens
gtagacttctggttgtatttcta

SEQ ID NO: 392387 - DNA, 18 bp, Homo sapiens
gtagagactagggaaggg

SEQ ID NO: 392388 - DNA, 22 bp, Homo sapiens
gtagagacttccgtcacccttg

SEQ ID NO: 392389 - DNA, 18 bp, Homo sapiens
gtagagagcaaagatggc

SEQ ID NO: 392390 - DNA, 14 bp, Homo sapiens
gtagagaggacagt

SEQ ID NO: 392391 - DNA, 17 bp, Homo sapiens
gtagagaggggactggg

SEQ ID NO: 392392 - DNA, 17 bp, Homo sapiens
gtagagcaaaggagaca

SEQ ID NO: 392393 - DNA, 17 bp, Homo sapiens
gtagagcatgacttatt

SEQ ID NO: 392394 - DNA, 12 bp, Homo sapiens
gtagaggagcct

SEQ ID NO: 392395 - DNA, 17 bp, Homo sapiens
gtagaggagcctggagt

SEQ ID NO: 392396 - DNA, 21 bp, Homo sapiens
gtagaggcatttgtcttagag

SEQ ID NO: 392397 - DNA, 23 bp, Homo sapiens
gtagagtcatctccatcagctgt

SEQ ID NO: 392398 - DNA, 15 bp, Homo sapiens
gtagatacaatcagc

SEQ ID NO: 392399 - DNA, 20 bp, Homo sapiens
gtagatacaatcagctgctt

SEQ ID NO: 392400 - DNA, 23 bp, Homo sapiens
gtagatacagatccgcatgtgtc

SEQ ID NO: 392401 - DNA, 19 bp, Homo sapiens
gtagatattgttttctgta

SEQ ID NO: 392402 - DNA, 19 bp, Homo sapiens
gtagatcgcttgagcccag

SEQ ID NO: 392403 - DNA, 20 bp, Homo sapiens
gtagatcgcttgagcccagg

SEQ ID NO: 392404 - DNA, 15 bp, Homo sapiens
gtagatctgtggcga

SEQ ID NO: 392405 - DNA, 19 bp, Homo sapiens
gtagatgggggaactgtga

SEQ ID NO: 392406 - DNA, 21 bp, Homo sapiens
gtagattgatctaaggcatgc

SEQ ID NO: 392407 - DNA, 14 bp, Homo sapiens
gtagattgcttctg

SEQ ID NO: 392408 - DNA, 21 bp, Homo sapiens
gtagattgtgtaaattcctgt

SEQ ID NO: 392409 - DNA, 16 bp, Homo sapiens
gtagatttgttttgtg

SEQ ID NO: 392410 - DNA, 17 bp, Homo sapiens
gtagcaagatctttaca

SEQ ID NO: 392411 - DNA, 13 bp, Homo sapiens
gtagcatacattt

SEQ ID NO: 392412 - DNA, 13 bp, Homo sapiens
gtagcatataaat

SEQ ID NO: 392413 - DNA, 13 bp, Homo sapiens
gtagcatatataa

SEQ ID NO: 392414 - DNA, 19 bp, Homo sapiens
gtagccactctctgcccac

SEQ ID NO: 392415 - DNA, 14 bp, Homo sapiens
gtagccagcacctg

SEQ ID NO: 392416 - DNA, 16 bp, Homo sapiens
gtagccaggaagcccc

SEQ ID NO: 392417 - DNA, 21 bp, Homo sapiens
gtagccatggctcaggcaagc

SEQ ID NO: 392418 - DNA, 21 bp, Homo sapiens
gtagcccacacttgagaggat

SEQ ID NO: 392419 - DNA, 17 bp, Homo sapiens
gtagcccaggtcactgt

SEQ ID NO: 392420 - DNA, 14 bp, Homo sapiens
gtagccccaagaag

SEQ ID NO: 392421 - DNA, 23 bp, Homo sapiens
gtagccccaagaaggctggggct

SEQ ID NO: 392422 - DNA, 15 bp, Homo sapiens
gtagccctggccaga

SEQ ID NO: 392423 - DNA, 23 bp, Homo sapiens
gtagcggaaaagttgtcttaaaa

SEQ ID NO: 392424 - DNA, 14 bp, Homo sapiens
gtagctatttattt

SEQ ID NO: 392425 - DNA, 13 bp, Homo sapiens
gtagctccctcct

SEQ ID NO: 392426 - DNA, 18 bp, Homo sapiens
gtagctccctcctcccat

SEQ ID NO: 392427 - DNA, 20 bp, Homo sapiens
gtagctccctcctcccatct

SEQ ID NO: 392428 - DNA, 17 bp, Homo sapiens
gtagctgggatgacagg

SEQ ID NO: 392429 - DNA, 21 bp, Homo sapiens
gtagctgggattacaggtgtg

SEQ ID NO: 392430 - DNA, 12 bp, Homo sapiens
gtagctgtcctc

SEQ ID NO: 392431 - DNA, 17 bp, Homo sapiens
gtagctgtggggagctg

SEQ ID NO: 392432 - DNA, 18 bp, Homo sapiens
gtagctgtggggagctgg

SEQ ID NO: 392433 - DNA, 17 bp, Homo sapiens
gtagctttcccaaataa

SEQ ID NO: 392434 - DNA, 17 bp, Homo sapiens
gtaggaaacagaaaaga

SEQ ID NO: 392435 - DNA, 19 bp, Homo sapiens
gtaggaaacagaaaagaga

SEQ ID NO: 392436 - DNA, 20 bp, Homo sapiens
gtaggaaaccaccctgaggg

SEQ ID NO: 392437 - DNA, 22 bp, Homo sapiens
gtaggaaagcaccgcagcatgt

SEQ ID NO: 392438 - DNA, 15 bp, Homo sapiens
gtaggaatctgcctt

SEQ ID NO: 392439 - DNA, 20 bp, Homo sapiens
gtaggagacacagatggcac

SEQ ID NO: 392440 - DNA, 23 bp, Homo sapiens
gtaggagacacagatggcacctg

SEQ ID NO: 392441 - DNA, 14 bp, Homo sapiens
gtaggagagactgg

SEQ ID NO: 392442 - DNA, 21 bp, Homo sapiens
gtaggagagactggccagagg

SEQ ID NO: 392443 - DNA, 18 bp, Homo sapiens
gtaggagtaaagataaaa

SEQ ID NO: 392444 - DNA, 16 bp, Homo sapiens
gtaggcaaggctgccg

SEQ ID NO: 392445 - DNA, 21 bp, Homo sapiens
ttcggcattggttccctttgc

SEQ ID NO: 392446 - DNA, 11 bp, Homo sapiens
ttcgggaagaa

SEQ ID NO: 392447 - DNA, 12 bp, Homo sapiens
ttcggtgcttcc

SEQ ID NO: 392448 - DNA, 13 bp, Homo sapiens
ttcggtgcttccc

SEQ ID NO: 392449 - DNA, 19 bp, Homo sapiens
ttcgtagctttcccaaata

SEQ ID NO: 392450 - DNA, 17 bp, Homo sapiens
ttcgtatagaaaaagca

SEQ ID NO: 392451 - DNA, 22 bp, Homo sapiens
ttcgtattgcaaataagactct

SEQ ID NO: 392452 - DNA, 20 bp, Homo sapiens
ttcgtcacaggagtctttgt

SEQ ID NO: 392453 - DNA, 18 bp, Homo sapiens
ttcgtctgcgattttatc

SEQ ID NO: 392454 - DNA, 13 bp, Homo sapiens
ttcgtctgtccca

SEQ ID NO: 392455 - DNA, 17 bp, Homo sapiens
ttcgtgcatttgtgagc

SEQ ID NO: 392456 - DNA, 11 bp, Homo sapiens
ttcgtgctgga

SEQ ID NO: 392457 - DNA, 15 bp, Homo sapiens
ttcgtgctggaggaa

SEQ ID NO: 392458 - DNA, 19 bp, Homo sapiens
ttcgtgcttcctcctgaca

SEQ ID NO: 392459 - DNA, 18 bp, Homo sapiens
ttcgtggagccacaggca

SEQ ID NO: 392460 - DNA, 17 bp, Homo sapiens
ttcgtggtgatcaatta

SEQ ID NO: 392461 - DNA, 19 bp, Homo sapiens
ttcgttaactgtgtatgta

SEQ ID NO: 392462 - DNA, 11 bp, Homo sapiens
ttcgtttgttt

SEQ ID NO: 392463 - DNA, 15 bp, Homo sapiens
ttcgtttgtttgttt

SEQ ID NO: 392464 - DNA, 20 bp, Homo sapiens
ttctaaacagatgtccctga

SEQ ID NO: 392465 - DNA, 13 bp, Homo sapiens
ttctaaagataat

SEQ ID NO: 392466 - DNA, 13 bp, Homo sapiens
ttctaaagatgga

SEQ ID NO: 392467 - DNA, 13 bp, Homo sapiens
ttctaaagtgttg

SEQ ID NO: 392468 - DNA, 18 bp, Homo sapiens
ttctaaatcataatcatc

SEQ ID NO: 392469 - DNA, 23 bp, Homo sapiens
ttctaacagatcagaacatgaaa

SEQ ID NO: 392470 - DNA, 14 bp, Homo sapiens
ttctaactaaacta

SEQ ID NO: 392471 - DNA, 13 bp, Homo sapiens
ttctaactaagga

SEQ ID NO: 392472 - DNA, 16 bp, Homo sapiens
ttctaagattgtacat

SEQ ID NO: 392473 - DNA, 21 bp, Homo sapiens
ttctaagttcatgtttgtaaa

SEQ ID NO: 392474 - DNA, 18 bp, Homo sapiens
ttctaatagaactcagtt

SEQ ID NO: 392475 - DNA, 15 bp, Homo sapiens
ttctaatcataacat

SEQ ID NO: 392476 - DNA, 14 bp, Homo sapiens
ttctaatccatgtg

SEQ ID NO: 392477 - DNA, 14 bp, Homo sapiens
ttctaatgtcttca

SEQ ID NO: 392478 - DNA, 15 bp, Homo sapiens
ttctaatttgaatga

SEQ ID NO: 392479 - DNA, 22 bp, Homo sapiens
ttctaatttgctgctgataatg

SEQ ID NO: 392480 - DNA, 17 bp, Homo sapiens
ttctacaaccagagccc

SEQ ID NO: 392481 - DNA, 18 bp, Homo sapiens
ttctacaaccagagcccc

SEQ ID NO: 392482 - DNA, 23 bp, Homo sapiens
ttctacaaccagagccccccaca

SEQ ID NO: 392483 - DNA, 12 bp, Homo sapiens
ttctacacctgg

SEQ ID NO: 392484 - DNA, 13 bp, Homo sapiens
ttctacacctgga

SEQ ID NO: 392485 - DNA, 17 bp, Homo sapiens
ttctacactctcctggg

SEQ ID NO: 392486 - DNA, 14 bp, Homo sapiens
ttctacagttaatt

SEQ ID NO: 392487 - DNA, 18 bp, Homo sapiens
ttctacatgactgggcct

SEQ ID NO: 392488 - DNA, 22 bp, Homo sapiens
ttctacatgactgggcctccct

SEQ ID NO: 392489 - DNA, 13 bp, Homo sapiens
ttctacattctct

SEQ ID NO: 392490 - DNA, 15 bp, Homo sapiens
ttctacctcttccag

SEQ ID NO: 392491 - DNA, 22 bp, Homo sapiens
ttctacgtataaatatgaaatg

SEQ ID NO: 392492 - DNA, 20 bp, Homo sapiens
ttctacttcttgtgctttac

SEQ ID NO: 392493 - DNA, 15 bp, Homo sapiens
ttctacttttaaaga

SEQ ID NO: 392494 - DNA, 16 bp, Homo sapiens
ttctactttttccttc

SEQ ID NO: 392495 - DNA, 17 bp, Homo sapiens
ttctactttttccttcc

SEQ ID NO: 392496 - DNA, 13 bp, Homo sapiens
ttctagaaaagct

SEQ ID NO: 392497 - DNA, 17 bp, Homo sapiens
ttctagaaagcctgttc

SEQ ID NO: 392498 - DNA, 18 bp, Homo sapiens
ttctagacgcccctccca

SEQ ID NO: 392499 - DNA, 21 bp, Homo sapiens
ttctagacgcccctcccaagc

SEQ ID NO: 392500 - DNA, 17 bp, Homo sapiens
ttctagacttccccatc

SEQ ID NO: 392501 - DNA, 15 bp, Homo sapiens
ttctagactttctgt

SEQ ID NO: 392502 - DNA, 19 bp, Homo sapiens
ttctagatcctgcacccca

SEQ ID NO: 392503 - DNA, 14 bp, Homo sapiens
ttctagcaactgtt

SEQ ID NO: 392504 - DNA, 14 bp, Homo sapiens
ttctagcaattgct

SEQ ID NO: 392505 - DNA, 12 bp, Homo sapiens
ttctagcacatc

SEQ ID NO: 392506 - DNA, 17 bp, Homo sapiens
ttctagcacatcatggc

SEQ ID NO: 392507 - DNA, 17 bp, Homo sapiens
ttctagctaatgtaata

SEQ ID NO: 392508 - DNA, 16 bp, Homo sapiens
ttctagctagaaatat

SEQ ID NO: 392509 - DNA, 18 bp, Homo sapiens
ttctagctagaaatatga

SEQ ID NO: 392510 - DNA, 23 bp, Homo sapiens
ttctagctataacaactctattt

SEQ ID NO: 392511 - DNA, 20 bp, Homo sapiens
ttctagctgttgagctgttt

SEQ ID NO: 392512 - DNA, 17 bp, Homo sapiens
ttctaggcatctcctct

SEQ ID NO: 392513 - DNA, 13 bp, Homo sapiens
ttctctttcctct

SEQ ID NO: 392514 - DNA, 20 bp, Homo sapiens
ttctctttcctctaactcat

SEQ ID NO: 392515 - DNA, 13 bp, Homo sapiens
ttctctttctctc

SEQ ID NO: 392516 - DNA, 16 bp, Homo sapiens
ttctctttctctcctt

SEQ ID NO: 392517 - DNA, 16 bp, Homo sapiens
ttctctttgccttgat

SEQ ID NO: 392518 - DNA, 19 bp, Homo sapiens
ttctctttgtaaggacttg

SEQ ID NO: 392519 - DNA, 22 bp, Homo sapiens
ttctctttgtggggcttggcgt

SEQ ID NO: 392520 - DNA, 13 bp, Homo sapiens
ttctcttttcctc

SEQ ID NO: 392521 - DNA, 15 bp, Homo sapiens
ttctctttttccaga

SEQ ID NO: 392522 - DNA, 19 bp, Homo sapiens
ttctctttttcttgtaaac

SEQ ID NO: 392523 - DNA, 16 bp, Homo sapiens
ttctgaagatctcaga

SEQ ID NO: 392524 - DNA, 18 bp, Homo sapiens
ttctgaaggtgcccagga

SEQ ID NO: 392525 - DNA, 22 bp, Homo sapiens
ttctgaatattttatctttcct

SEQ ID NO: 392526 - DNA, 14 bp, Homo sapiens
ttctgaatgctgct

SEQ ID NO: 392527 - DNA, 13 bp, Homo sapiens
ttctgaattcata

SEQ ID NO: 392528 - DNA, 19 bp, Homo sapiens
ttctgacaaaaagtttcca

SEQ ID NO: 392529 - DNA, 20 bp, Homo sapiens
ttctgacattaacagttttc

SEQ ID NO: 392530 - DNA, 22 bp, Homo sapiens
ttctgacattaacagttttcca

SEQ ID NO: 392531 - DNA, 13 bp, Homo sapiens
ttctgaccacact

SEQ ID NO: 392532 - DNA, 14 bp, Homo sapiens
ttctgaccacactt

SEQ ID NO: 392533 - DNA, 13 bp, Homo sapiens
ttctgacctcagc

SEQ ID NO: 392534 - DNA, 23 bp, Homo sapiens
ttctgactgcaacttctgtccct

SEQ ID NO: 392535 - DNA, 19 bp, Homo sapiens
ttctgagaactgactttct

SEQ ID NO: 392536 - DNA, 22 bp, Homo sapiens
ttctgagcctctttaacagctt

SEQ ID NO: 392537 - DNA, 15 bp, Homo sapiens
ttctgataatgtatt

SEQ ID NO: 392538 - DNA, 22 bp, Homo sapiens
ttctgatatgcagttttcctta

SEQ ID NO: 392539 - DNA, 13 bp, Homo sapiens
ttctgatattaat

SEQ ID NO: 392540 - DNA, 16 bp, Homo sapiens
ttctgatgtctctaaa

SEQ ID NO: 392541 - DNA, 15 bp, Homo sapiens
ttctgattagaaatg

SEQ ID NO: 392542 - DNA, 15 bp, Homo sapiens
ttctgattcttcaaa

SEQ ID NO: 392543 - DNA, 17 bp, Homo sapiens
ttctgcaaatagaaaac

SEQ ID NO: 392544 - DNA, 15 bp, Homo sapiens
ttctgcaactagcca

SEQ ID NO: 392545 - DNA, 22 bp, Homo sapiens
ttctgcaagcacatctgcattt

SEQ ID NO: 392546 - DNA, 22 bp, Homo sapiens
ttctgcaatgttattattggct

SEQ ID NO: 392547 - DNA, 22 bp, Homo sapiens
ttctgcagcatgacctgtgacc

SEQ ID NO: 392548 - DNA, 23 bp, Homo sapiens
ttctgcagcatgacctgtgacca

SEQ ID NO: 392549 - DNA, 19 bp, Homo sapiens
ttctgcagcccttgggcag

SEQ ID NO: 392550 - DNA, 12 bp, Homo sapiens
ttctgcattact

SEQ ID NO: 392551 - DNA, 21 bp, Homo sapiens
ttctgcattactattaactct

SEQ ID NO: 392552 - DNA, 15 bp, Homo sapiens
ttctgccagggagct

SEQ ID NO: 392553 - DNA, 16 bp, Homo sapiens
ttctgccagggagctt

SEQ ID NO: 392554 - DNA, 18 bp, Homo sapiens
ttctgcccaaatcccctc

SEQ ID NO: 392555 - DNA, 16 bp, Homo sapiens
ttctgccccctcaggg

SEQ ID NO: 392556 - DNA, 16 bp, Homo sapiens
ttctgcctgcctggga

SEQ ID NO: 392557 - DNA, 15 bp, Homo sapiens
ttctgctcacattcc

SEQ ID NO: 392558 - DNA, 20 bp, Homo sapiens
ttctgctcacattccctctc

SEQ ID NO: 392559 - DNA, 9 bp, Homo sapiens
ttctgctcc

SEQ ID NO: 392560 - DNA, 15 bp, Homo sapiens
ttctgctccaccctt

SEQ ID NO: 392561 - DNA, 12 bp, Homo sapiens
ttctgctgcttg

SEQ ID NO: 392562 - DNA, 12 bp, Homo sapiens
ttctgctggcct

SEQ ID NO: 392563 - DNA, 14 bp, Homo sapiens
ttctgcttaggaga

SEQ ID NO: 392564 - DNA, 21 bp, Homo sapiens
ttctggaccttgttgttgtta

SEQ ID NO: 392565 - DNA, 16 bp, Homo sapiens
ttctggactctgcccc

SEQ ID NO: 392566 - DNA, 22 bp, Homo sapiens
ttctggatggccgggctgctgc

SEQ ID NO: 392567 - DNA, 17 bp, Homo sapiens
ttctggcctttcctctc

SEQ ID NO: 392568 - DNA, 20 bp, Homo sapiens
ttctggcctttcctctctcc

SEQ ID NO: 392569 - DNA, 17 bp, Homo sapiens
ttctggctcctcaaaca

SEQ ID NO: 392570 - DNA, 11 bp, Homo sapiens
ttctggctgcc

SEQ ID NO: 392571 - DNA, 20 bp, Homo sapiens
ttctggctgccccaacctgc

SEQ ID NO: 392572 - DNA, 13 bp, Homo sapiens
ttctggctgggga

SEQ ID NO: 392573 - DNA, 16 bp, Homo sapiens
ttctgggaaaggtgct

SEQ ID NO: 392574 - DNA, 17 bp, Homo sapiens
ttctgggaaaggtgctc

SEQ ID NO: 392575 - DNA, 21 bp, Homo sapiens
ttctgggaaaggtgctcaaag

SEQ ID NO: 392576 - DNA, 17 bp, Homo sapiens
ttctgggaaatggcttg

SEQ ID NO: 392577 - DNA, 20 bp, Homo sapiens
ttctgggaagcttgagcctc

SEQ ID NO: 392578 - DNA, 13 bp, Homo sapiens
ttctgggaaggga

SEQ ID NO: 392579 - DNA, 23 bp, Homo sapiens
ttctgggatatatggaggattct

SEQ ID NO: 392580 - DNA, 17 bp, Homo sapiens
ttctgggcagagcctgt

SEQ ID NO: 392581 - DNA, 15 bp, Homo sapiens
ttctggggccccacc

SEQ ID NO: 392582 - DNA, 21 bp, Homo sapiens
ttctggggcccctttttactc

SEQ ID NO: 392583 - DNA, 13 bp, Homo sapiens
ttctgggtgattt

SEQ ID NO: 392584 - DNA, 16 bp, Homo sapiens
ttctgggtgatttcta

SEQ ID NO: 392585 - DNA, 18 bp, Homo sapiens
ttctgggtggttgccctt

SEQ ID NO: 392586 - DNA, 17 bp, Homo sapiens
ttctgggttctgggtgg

SEQ ID NO: 392587 - DNA, 17 bp, Homo sapiens
ttctggtaacctgtggt

SEQ ID NO: 392588 - DNA, 21 bp, Homo sapiens
acagaaatcagaggagagacg

SEQ ID NO: 392589 - DNA, 19 bp, Homo sapiens
acagaacaaatgtttgttt

SEQ ID NO: 392590 - DNA, 15 bp, Homo sapiens
acagaacaacaacaa

SEQ ID NO: 392591 - DNA, 17 bp, Homo sapiens
acagaacaacaacaaag

SEQ ID NO: 392592 - DNA, 14 bp, Homo sapiens
acagaacatttctc

SEQ ID NO: 392593 - DNA, 16 bp, Homo sapiens
acagaacctttgtcaa

SEQ ID NO: 392594 - DNA, 22 bp, Homo sapiens
acagaagaattttttttttaag

SEQ ID NO: 392595 - DNA, 15 bp, Homo sapiens
acagaagacacgtgt

SEQ ID NO: 392596 - DNA, 19 bp, Homo sapiens
acagaagacacgtgttttt

SEQ ID NO: 392597 - DNA, 23 bp, Homo sapiens
acagaagacacgtgtttttgtat

SEQ ID NO: 392598 - DNA, 22 bp, Homo sapiens
acagaagcagttgagtcgtcat

SEQ ID NO: 392599 - DNA, 18 bp, Homo sapiens
acagaagcttcagaagtt

SEQ ID NO: 392600 - DNA, 19 bp, Homo sapiens
acagaagcttcagaagttt

SEQ ID NO: 392601 - DNA, 20 bp, Homo sapiens
acagaaggcaaagtttccat

SEQ ID NO: 392602 - DNA, 22 bp, Homo sapiens
acagaaggcaaagtttccatgt

SEQ ID NO: 392603 - DNA, 16 bp, Homo sapiens
acagaattgcttgttt

SEQ ID NO: 392604 - DNA, 13 bp, Homo sapiens
acagacaaagcgt

SEQ ID NO: 392605 - DNA, 13 bp, Homo sapiens
acagacacacaca

SEQ ID NO: 392606 - DNA, 23 bp, Homo sapiens
acagacacacacacgcacgcaca

SEQ ID NO: 392607 - DNA, 14 bp, Homo sapiens
acagacacacgcac

SEQ ID NO: 392608 - DNA, 18 bp, Homo sapiens
acagacctaatatcattt

SEQ ID NO: 392609 - DNA, 18 bp, Homo sapiens
acagacggacgggacagc

SEQ ID NO: 392610 - DNA, 23 bp, Homo sapiens
acagacggacgggacagcggccc

SEQ ID NO: 392611 - DNA, 17 bp, Homo sapiens
acagactatttaacttg

SEQ ID NO: 392612 - DNA, 19 bp, Homo sapiens
acagactgttccctccaag

SEQ ID NO: 392613 - DNA, 21 bp, Homo sapiens
acagacttccaccatgtgcat

SEQ ID NO: 392614 - DNA, 19 bp, Homo sapiens
acagacttctggaaggctg

SEQ ID NO: 392615 - DNA, 14 bp, Homo sapiens
acagacttgagaac

SEQ ID NO: 392616 - DNA, 17 bp, Homo sapiens
acagacttgagaacttg

SEQ ID NO: 392617 - DNA, 21 bp, Homo sapiens
acagagacccccgtgccaaat

SEQ ID NO: 392618 - DNA, 16 bp, Homo sapiens
acagagaggagaaaca

SEQ ID NO: 392619 - DNA, 18 bp, Homo sapiens
acagagaggagaaacaca

SEQ ID NO: 392620 - DNA, 21 bp, Homo sapiens
acagagagggcaccatcacaa

SEQ ID NO: 392621 - DNA, 15 bp, Homo sapiens
acagagatgccatga

SEQ ID NO: 392622 - DNA, 15 bp, Homo sapiens
acagagcaagactct

SEQ ID NO: 392623 - DNA, 13 bp, Homo sapiens
acagagcagctcc

SEQ ID NO: 392624 - DNA, 16 bp, Homo sapiens
acagagcagctcccca

SEQ ID NO: 392625 - DNA, 18 bp, Homo sapiens
acagagcagctccccagg

SEQ ID NO: 392626 - DNA, 18 bp, Homo sapiens
acagagctgacaaaattt

SEQ ID NO: 392627 - DNA, 12 bp, Homo sapiens
acagaggacagt

SEQ ID NO: 392628 - DNA, 16 bp, Homo sapiens
acagaggatgctgaag

SEQ ID NO: 392629 - DNA, 17 bp, Homo sapiens
acagagtatatatgtac

SEQ ID NO: 392630 - DNA, 18 bp, Homo sapiens
acagagtctgacaggaag

SEQ ID NO: 392631 - DNA, 16 bp, Homo sapiens
acagagtggactcttc

SEQ ID NO: 392632 - DNA, 17 bp, Homo sapiens
acagagtggactcttcc

SEQ ID NO: 392633 - DNA, 20 bp, Homo sapiens
acagagtgtggtccctccac

SEQ ID NO: 392634 - DNA, 13 bp, Homo sapiens
acagataagcaag

SEQ ID NO: 392635 - DNA, 20 bp, Homo sapiens
acagataatgatagtgtttt

SEQ ID NO: 392636 - DNA, 14 bp, Homo sapiens
acagataatgcttt

SEQ ID NO: 392637 - DNA, 17 bp, Homo sapiens
acagataatttattttg

SEQ ID NO: 392638 - DNA, 22 bp, Homo sapiens
acagataatttattttgtattt

SEQ ID NO: 392639 - DNA, 20 bp, Homo sapiens
acagatactcctccaaggtt

SEQ ID NO: 392640 - DNA, 18 bp, Homo sapiens
acagatactgaaacattt

SEQ ID NO: 392641 - DNA, 21 bp, Homo sapiens
acagatactggaagttttgca

SEQ ID NO: 392642 - DNA, 22 bp, Homo sapiens
acagatactggaagttttgcat

SEQ ID NO: 392643 - DNA, 16 bp, Homo sapiens
gtatttggatatctgt

SEQ ID NO: 392644 - DNA, 20 bp, Homo sapiens
gtatttggtaacttgctgtg

SEQ ID NO: 392645 - DNA, 19 bp, Homo sapiens
gtattttcgtgcatttgtg

SEQ ID NO: 392646 - DNA, 14 bp, Homo sapiens
gtattttcttcaaa

SEQ ID NO: 392647 - DNA, 21 bp, Homo sapiens
gtattttcttcccatttgtaa

SEQ ID NO: 392648 - DNA, 15 bp, Homo sapiens
gtattttgaaaacac

SEQ ID NO: 392649 - DNA, 11 bp, Homo sapiens
gtattttgaat

SEQ ID NO: 392650 - DNA, 17 bp, Homo sapiens
gtattttggagaaatta

SEQ ID NO: 392651 - DNA, 18 bp, Homo sapiens
gtatttttagagattaat

SEQ ID NO: 392652 - DNA, 21 bp, Homo sapiens
gtatttttcaggtaggccctt

SEQ ID NO: 392653 - DNA, 15 bp, Homo sapiens
gtatttttgaataaa

SEQ ID NO: 392654 - DNA, 13 bp, Homo sapiens
gtcaaaaaccaga

SEQ ID NO: 392655 - DNA, 16 bp, Homo sapiens
gtcaaacagtgtggct

SEQ ID NO: 392656 - DNA, 23 bp, Homo sapiens
gtcaaactttcacctcagatttt

SEQ ID NO: 392657 - DNA, 12 bp, Homo sapiens
gtcaaagaaatg

SEQ ID NO: 392658 - DNA, 16 bp, Homo sapiens
gtcaaagaaatgctga

SEQ ID NO: 392659 - DNA, 19 bp, Homo sapiens
gtcaaagtgaaagacattt

SEQ ID NO: 392660 - DNA, 18 bp, Homo sapiens
gtcaaagtggtgagaggc

SEQ ID NO: 392661 - DNA, 20 bp, Homo sapiens
gtcaaatggatgtaatatag

SEQ ID NO: 392662 - DNA, 21 bp, Homo sapiens
gtcaacaagtatgaataaaga

SEQ ID NO: 392663 - DNA, 14 bp, Homo sapiens
gtcaacactcttct

SEQ ID NO: 392664 - DNA, 19 bp, Homo sapiens
gtcaacactcttcttgagc

SEQ ID NO: 392665 - DNA, 19 bp, Homo sapiens
gtcaacacttaagggtttt

SEQ ID NO: 392666 - DNA, 22 bp, Homo sapiens
gtcaacacttaagggttttaga

SEQ ID NO: 392667 - DNA, 16 bp, Homo sapiens
gtcaacccgctgcttc

SEQ ID NO: 392668 - DNA, 17 bp, Homo sapiens
gtcaactccaaggcaaa

SEQ ID NO: 392669 - DNA, 21 bp, Homo sapiens
gtcaactccaaggcaaatgtc

SEQ ID NO: 392670 - DNA, 23 bp, Homo sapiens
gtcaactgctgttttatgtcata

SEQ ID NO: 392671 - DNA, 15 bp, Homo sapiens
gtcaacttctggctc

SEQ ID NO: 392672 - DNA, 17 bp, Homo sapiens
gtcaacttgagcatgtt

SEQ ID NO: 392673 - DNA, 16 bp, Homo sapiens
gtcaactttcatttga

SEQ ID NO: 392674 - DNA, 20 bp, Homo sapiens
gtcaagattaagttatacca

SEQ ID NO: 392675 - DNA, 14 bp, Homo sapiens
gtcaagattttgaa

SEQ ID NO: 392676 - DNA, 15 bp, Homo sapiens
gtcaaggagtggctt

SEQ ID NO: 392677 - DNA, 20 bp, Homo sapiens
gtcaagggggctgctctgca

SEQ ID NO: 392678 - DNA, 14 bp, Homo sapiens
gtcaagtcatgatg

SEQ ID NO: 392679 - DNA, 20 bp, Homo sapiens
gtcaagttattaatttcttc

SEQ ID NO: 392680 - DNA, 21 bp, Homo sapiens
gtcaagttcatagtttctgta

SEQ ID NO: 392681 - DNA, 17 bp, Homo sapiens
gtcaagttccgtctcct

SEQ ID NO: 392682 - DNA, 13 bp, Homo sapiens
gtcaataaacagc

SEQ ID NO: 392683 - DNA, 20 bp, Homo sapiens
gtcaataaacagcttcatgc

SEQ ID NO: 392684 - DNA, 19 bp, Homo sapiens
gtcaataattgtggagagg

SEQ ID NO: 392685 - DNA, 20 bp, Homo sapiens
gtcaatattaaatacagaca

SEQ ID NO: 392686 - DNA, 12 bp, Homo sapiens
gtcaatccaaga

SEQ ID NO: 392687 - DNA, 13 bp, Homo sapiens
gtcaatgaaaagc

SEQ ID NO: 392688 - DNA, 17 bp, Homo sapiens
gtcaatgaaatatttgc

SEQ ID NO: 392689 - DNA, 20 bp, Homo sapiens
gtcaatgaaatatttgctta

SEQ ID NO: 392690 - DNA, 14 bp, Homo sapiens
gtcaatgtttgctt

SEQ ID NO: 392691 - DNA, 16 bp, Homo sapiens
gtcaatgtttgcttta

SEQ ID NO: 392692 - DNA, 19 bp, Homo sapiens
gtcacaagtaggagacaca

SEQ ID NO: 392693 - DNA, 21 bp, Homo sapiens
gtcacaccctccccattagta

SEQ ID NO: 392694 - DNA, 13 bp, Homo sapiens
gtcacagaggcag

SEQ ID NO: 392695 - DNA, 15 bp, Homo sapiens
gtcacagaggcagtg

SEQ ID NO: 392696 - DNA, 22 bp, Homo sapiens
gtcacagcagtacttgctcaat

SEQ ID NO: 392697 - DNA, 16 bp, Homo sapiens
gtcacagctcttgttt

SEQ ID NO: 392698 - DNA, 11 bp, Homo sapiens
gtcacagctgc

SEQ ID NO: 392699 - DNA, 13 bp, Homo sapiens
gtcacagctgcag

SEQ ID NO: 392700 - DNA, 17 bp, Homo sapiens
gtcacagctgcagctgg

SEQ ID NO: 392701 - DNA, 15 bp, Homo sapiens
gtcacagctttccca

SEQ ID NO: 392702 - DNA, 20 bp, Homo sapiens
gtcacatatcaagtcccgag

SEQ ID NO: 392703 - DNA, 12 bp, Homo sapiens
gtcacatgcttg

SEQ ID NO: 392704 - DNA, 15 bp, Homo sapiens
gtcaccaaatttgta

SEQ ID NO: 392705 - DNA, 16 bp, Homo sapiens
gtcaccaggacttggg

SEQ ID NO: 392706 - DNA, 16 bp, Homo sapiens
gtcaccatctcaggcc

SEQ ID NO: 392707 - DNA, 17 bp, Homo sapiens
gtcaccatctcaggcca

SEQ ID NO: 392708 - DNA, 15 bp, Homo sapiens
gtcaccctgcagagc

SEQ ID NO: 392709 - DNA, 13 bp, Homo sapiens
gtcaccctgtgac

SEQ ID NO: 392710 - DNA, 19 bp, Homo sapiens
gtcaccctgtgaccctctc

SEQ ID NO: 392711 - DNA, 16 bp, Homo sapiens
gtcacccttctgggca

SEQ ID NO: 392712 - DNA, 17 bp, Homo sapiens
gtcacctcctccactca

SEQ ID NO: 392713 - DNA, 12 bp, Homo sapiens
gtcacctgcaag

SEQ ID NO: 392714 - DNA, 13 bp, Homo sapiens
gtcacctgcaagc

SEQ ID NO: 392715 - DNA, 23 bp, Homo sapiens
gtcacctgcccagatcccagaag

SEQ ID NO: 392716 - DNA, 19 bp, Homo sapiens
gtcacctgctggttgttgc

SEQ ID NO: 392717 - DNA, 22 bp, Homo sapiens
gtcacctgctggttgttgccag

SEQ ID NO: 392718 - DNA, 23 bp, Homo sapiens
gtcacctgctggttgttgccagg

SEQ ID NO: 392719 - DNA, 14 bp, Homo sapiens
gtcacctgtgctac

SEQ ID NO: 392720 - DNA, 14 bp, Homo sapiens
gtcaccttcctggg

SEQ ID NO: 392721 - DNA, 19 bp, Homo sapiens
gtcactaaccaacaaggtt

SEQ ID NO: 392722 - DNA, 12 bp, Homo sapiens
gtcactctgcct

SEQ ID NO: 392723 - DNA, 13 bp, Homo sapiens
gtcactctgcctc

SEQ ID NO: 392724 - DNA, 14 bp, Homo sapiens
gtcactctgcctct

SEQ ID NO: 392725 - DNA, 23 bp, Homo sapiens
gtcactctgcctctaaggccaag

SEQ ID NO: 392726 - DNA, 14 bp, Homo sapiens
gtcactgagctgtg

SEQ ID NO: 392727 - DNA, 20 bp, Homo sapiens
gtcactgcacagtgcatctc

SEQ ID NO: 392728 - DNA, 20 bp, Homo sapiens
gtcactgccatggaggcaca

SEQ ID NO: 392729 - DNA, 17 bp, Homo sapiens
gtcactggaacctccct

SEQ ID NO: 392730 - DNA, 18 bp, Homo sapiens
acagtgatctccatatgt

SEQ ID NO: 392731 - DNA, 21 bp, Homo sapiens
acagtgatctccatatgttac

SEQ ID NO: 392732 - DNA, 24 bp, Homo sapiens
acagtgatgctgtgctatgaattt

SEQ ID NO: 392733 - DNA, 19 bp, Homo sapiens
acagtgattaaagcaagag

SEQ ID NO: 392734 - DNA, 21 bp, Homo sapiens
acagtgattaaagcaagagaa

SEQ ID NO: 392735 - DNA, 15 bp, Homo sapiens
acagtgcagacaggc

SEQ ID NO: 392736 - DNA, 17 bp, Homo sapiens
acagtgcagacaggcca

SEQ ID NO: 392737 - DNA, 15 bp, Homo sapiens
acagtgcatctcagc

SEQ ID NO: 392738 - DNA, 21 bp, Homo sapiens
acagtgcctgggaatgtatta

SEQ ID NO: 392739 - DNA, 18 bp, Homo sapiens
acagtgctgaccccagga

SEQ ID NO: 392740 - DNA, 12 bp, Homo sapiens
acagtgctgctt

SEQ ID NO: 392741 - DNA, 15 bp, Homo sapiens
acagtgctgcttctc

SEQ ID NO: 392742 - DNA, 14 bp, Homo sapiens
acagtgctttatgg

SEQ ID NO: 392743 - DNA, 13 bp, Homo sapiens
acagtggctgggt

SEQ ID NO: 392744 - DNA, 19 bp, Homo sapiens
acagtgggccggccccagg

SEQ ID NO: 392745 - DNA, 14 bp, Homo sapiens
acagtggggcccat

SEQ ID NO: 392746 - DNA, 18 bp, Homo sapiens
acagtggggcccatggcc

SEQ ID NO: 392747 - DNA, 23 bp, Homo sapiens
acagtggggcccatggccccagc

SEQ ID NO: 392748 - DNA, 23 bp, Homo sapiens
acagtggttctacaatctattta

SEQ ID NO: 392749 - DNA, 19 bp, Homo sapiens
acagtgtaatccaggggtg

SEQ ID NO: 392750 - DNA, 23 bp, Homo sapiens
acagtgtctgtatcggagacagt

SEQ ID NO: 392751 - DNA, 16 bp, Homo sapiens
acagtgtctgtgccat

SEQ ID NO: 392752 - DNA, 19 bp, Homo sapiens
acagtgtggcttaaacatt

SEQ ID NO: 392753 - DNA, 14 bp, Homo sapiens
acagtgttaaatga

SEQ ID NO: 392754 - DNA, 15 bp, Homo sapiens
acagtgttctgagcc

SEQ ID NO: 392755 - DNA, 14 bp, Homo sapiens
acagtgtttatgac

SEQ ID NO: 392756 - DNA, 16 bp, Homo sapiens
acagttaactttcaga

SEQ ID NO: 392757 - DNA, 18 bp, Homo sapiens
acagttactcttcagttt

SEQ ID NO: 392758 - DNA, 21 bp, Homo sapiens
acagttcaataaacttaactt

SEQ ID NO: 392759 - DNA, 14 bp, Homo sapiens
acagttcacaccct

SEQ ID NO: 392760 - DNA, 18 bp, Homo sapiens
acagttcacaccctgcaa

SEQ ID NO: 392761 - DNA, 19 bp, Homo sapiens
acagttcacaccctgcaag

SEQ ID NO: 392762 - DNA, 20 bp, Homo sapiens
acagttcacaccctgcaagg

SEQ ID NO: 392763 - DNA, 16 bp, Homo sapiens
acagttcagttcctct

SEQ ID NO: 392764 - DNA, 22 bp, Homo sapiens
acagttcataaatttgttgtca

SEQ ID NO: 392765 - DNA, 13 bp, Homo sapiens
acagttctgtcat

SEQ ID NO: 392766 - DNA, 18 bp, Homo sapiens
acagttgtaccactgcta

SEQ ID NO: 392767 - DNA, 20 bp, Homo sapiens
acagttgtctattctgagcc

SEQ ID NO: 392768 - DNA, 22 bp, Homo sapiens
acagtttgcaatcttatgttga

SEQ ID NO: 392769 - DNA, 13 bp, Homo sapiens
acagttttaaaga

SEQ ID NO: 392770 - DNA, 14 bp, Homo sapiens
acagttttaaagaa

SEQ ID NO: 392771 - DNA, 14 bp, Homo sapiens
acagttttccatga

SEQ ID NO: 392772 - DNA, 15 bp, Homo sapiens
acagttttccatgaa

SEQ ID NO: 392773 - DNA, 21 bp, Homo sapiens
acagttttccatgaaaacgtt

SEQ ID NO: 392774 - DNA, 15 bp, Homo sapiens
acatggagactcctg

SEQ ID NO: 392775 - DNA, 14 bp, Homo sapiens
acatggagttcccg

SEQ ID NO: 392776 - DNA, 19 bp, Homo sapiens
acatggattccaaagcatt

SEQ ID NO: 392777 - DNA, 22 bp, Homo sapiens
acatggccgggccctctgtagc

SEQ ID NO: 392778 - DNA, 22 bp, Homo sapiens
acatggggcctggcccacgccc

SEQ ID NO: 392779 - DNA, 20 bp, Homo sapiens
acatggggttggctgggccc

SEQ ID NO: 392780 - DNA, 14 bp, Homo sapiens
acatggtagcaggg

SEQ ID NO: 392781 - DNA, 19 bp, Homo sapiens
acatggtccatttcatgtg

SEQ ID NO: 392782 - DNA, 23 bp, Homo sapiens
acatggtccatttcatgtgatct

SEQ ID NO: 392783 - DNA, 19 bp, Homo sapiens
acatggtgtgtgtctctga

SEQ ID NO: 392784 - DNA, 19 bp, Homo sapiens
acatgtaataaaaagtata

SEQ ID NO: 392785 - DNA, 19 bp, Homo sapiens
acatgtatctctaatgaaa

SEQ ID NO: 392786 - DNA, 12 bp, Homo sapiens
acatgtcatgta

SEQ ID NO: 392787 - DNA, 15 bp, Homo sapiens
acatgtctcatattt

SEQ ID NO: 392788 - DNA, 16 bp, Homo sapiens
acatgtctcatatttt

SEQ ID NO: 392789 - DNA, 18 bp, Homo sapiens
acatgtctcatattttca

SEQ ID NO: 392790 - DNA, 21 bp, Homo sapiens
acatgtctttggcttcagaat

SEQ ID NO: 392791 - DNA, 17 bp, Homo sapiens
acatgtgccaccaacat

SEQ ID NO: 392792 - DNA, 19 bp, Homo sapiens
acatgtggaaaactcacag

SEQ ID NO: 392793 - DNA, 20 bp, Homo sapiens
acatgtggggacagggctgg

SEQ ID NO: 392794 - DNA, 16 bp, Homo sapiens
acatgtgtgcgtgtgc

SEQ ID NO: 392795 - DNA, 14 bp, Homo sapiens
acatgttatatatt

SEQ ID NO: 392796 - DNA, 15 bp, Homo sapiens
acatgttatatattt

SEQ ID NO: 392797 - DNA, 17 bp, Homo sapiens
acatgttattgttttca

SEQ ID NO: 392798 - DNA, 23 bp, Homo sapiens
acatgtttttgttttctttgaat

SEQ ID NO: 392799 - DNA, 18 bp, Homo sapiens
acattaaaagaagactgg

SEQ ID NO: 392800 - DNA, 18 bp, Homo sapiens
acattaaacactgtaatc

SEQ ID NO: 392801 - DNA, 11 bp, Homo sapiens
acattaacagt

SEQ ID NO: 392802 - DNA, 19 bp, Homo sapiens
acattaagtattccttggc

SEQ ID NO: 392803 - DNA, 17 bp, Homo sapiens
acattaatcaccaaagt

SEQ ID NO: 392804 - DNA, 22 bp, Homo sapiens
acattaattgaggcttacagta

SEQ ID NO: 392805 - DNA, 20 bp, Homo sapiens
acattaccctaatggctgct

SEQ ID NO: 392806 - DNA, 16 bp, Homo sapiens
acattactgccttcag

SEQ ID NO: 392807 - DNA, 15 bp, Homo sapiens
acattagaagaaaac

SEQ ID NO: 392808 - DNA, 22 bp, Homo sapiens
acattagaagaaaacatatatt

SEQ ID NO: 392809 - DNA, 15 bp, Homo sapiens
acattatagaaatta

SEQ ID NO: 392810 - DNA, 23 bp, Homo sapiens
acattatcttttggctctgaaga

SEQ ID NO: 392811 - DNA, 21 bp, Homo sapiens
acattcaaaaacatggccaca

SEQ ID NO: 392812 - DNA, 13 bp, Homo sapiens
acattcacagcac

SEQ ID NO: 392813 - DNA, 14 bp, Homo sapiens
acattcaccaacaa

SEQ ID NO: 392814 - DNA, 20 bp, Homo sapiens
acattccagtgtattttctg

SEQ ID NO: 392815 - DNA, 21 bp, Homo sapiens
acattccatcacagccagccc

SEQ ID NO: 392816 - DNA, 23 bp, Homo sapiens
acattccatcacagccagcccag

SEQ ID NO: 392817 - DNA, 21 bp, Homo sapiens
acattcccctcccacctctcc

SEQ ID NO: 392818 - DNA, 13 bp, Homo sapiens
acattccctctca

SEQ ID NO: 392819 - DNA, 13 bp, Homo sapiens
acattccctctcc

SEQ ID NO: 392820 - DNA, 15 bp, Homo sapiens
acattccctctcctg

SEQ ID NO: 392821 - DNA, 17 bp, Homo sapiens
acattccctctcctgcc

SEQ ID NO: 392822 - DNA, 18 bp, Homo sapiens
acattccctctcctgccc

SEQ ID NO: 392823 - DNA, 21 bp, Homo sapiens
acattccctctcctgcccaga

SEQ ID NO: 392824 - DNA, 16 bp, Homo sapiens
acattccgtttacatt

SEQ ID NO: 392825 - DNA, 16 bp, Homo sapiens
acattcctcagctgcc

SEQ ID NO: 392826 - DNA, 22 bp, Homo sapiens
acattcctcagctgccaagcac

SEQ ID NO: 392827 - DNA, 17 bp, Homo sapiens
acattcctcatgaatgt

SEQ ID NO: 392828 - DNA, 12 bp, Homo sapiens
acattcctccag

SEQ ID NO: 392829 - DNA, 14 bp, Homo sapiens
acattcctgagatt

SEQ ID NO: 392830 - DNA, 19 bp, Homo sapiens
acattcgatctcattcagt

SEQ ID NO: 392831 - DNA, 21 bp, Homo sapiens
acattcgatctcattcagtat

SEQ ID NO: 392832 - DNA, 23 bp, Homo sapiens
acattcgatctcattcagtatta

SEQ ID NO: 392833 - DNA, 12 bp, Homo sapiens
acattctccctt

SEQ ID NO: 392834 - DNA, 14 bp, Homo sapiens
acattctctatttt

SEQ ID NO: 392835 - DNA, 19 bp, Homo sapiens
acattcttccaaaaagatt

SEQ ID NO: 392836 - DNA, 18 bp, Homo sapiens
acattgaagtaatgaatt

SEQ ID NO: 392837 - DNA, 17 bp, Homo sapiens
acattgaccaagaactg

SEQ ID NO: 392838 - DNA, 19 bp, Homo sapiens
acattgaccaagaactgca

SEQ ID NO: 392839 - DNA, 14 bp, Homo sapiens
acattgatgaatga

SEQ ID NO: 392840 - DNA, 21 bp, Homo sapiens
acattgcactttataaacact

SEQ ID NO: 392841 - DNA, 13 bp, Homo sapiens
acattgccccaag

SEQ ID NO: 392842 - DNA, 15 bp, Homo sapiens
acattgccttgcatt

SEQ ID NO: 392843 - DNA, 16 bp, Homo sapiens
acattgccttgcattt

SEQ ID NO: 392844 - DNA, 18 bp, Homo sapiens
acattgccttgcatttgt

SEQ ID NO: 392845 - DNA, 22 bp, Homo sapiens
acattgccttgcatttgtacct

SEQ ID NO: 392846 - DNA, 15 bp, Homo sapiens
acattggctttttaa

SEQ ID NO: 392847 - DNA, 15 bp, Homo sapiens
acattgtataggcca

SEQ ID NO: 392848 - DNA, 19 bp, Homo sapiens
acattgtattttactttgt

SEQ ID NO: 392849 - DNA, 22 bp, Homo sapiens
acattgtattttactttgtgca

SEQ ID NO: 392850 - DNA, 23 bp, Homo sapiens
acattgtattttactttgtgcaa

SEQ ID NO: 392851 - DNA, 14 bp, Homo sapiens
acatttaaaacatt

SEQ ID NO: 392852 - DNA, 14 bp, Homo sapiens
acatttaaaactta

SEQ ID NO: 392853 - DNA, 17 bp, Homo sapiens
acatttaatacagcagt

SEQ ID NO: 392854 - DNA, 17 bp, Homo sapiens
acatttaggagaagttg

SEQ ID NO: 392855 - DNA, 15 bp, Homo sapiens
acatttataatgttt

SEQ ID NO: 392856 - DNA, 18 bp, Homo sapiens
acatttataatgtttgct

SEQ ID NO: 392857 - DNA, 13 bp, Homo sapiens
acatttatacatc

SEQ ID NO: 392858 - DNA, 19 bp, Homo sapiens
acatttatcttctgttttt

SEQ ID NO: 392859 - DNA, 16 bp, Homo sapiens
acatttcaaagctgag

SEQ ID NO: 392860 - DNA, 14 bp, Homo sapiens
acatttcaaagttt

SEQ ID NO: 392861 - DNA, 17 bp, Homo sapiens
acatttcaaatctgtag

SEQ ID NO: 392862 - DNA, 20 bp, Homo sapiens
acatttcacctactttgtaa

SEQ ID NO: 392863 - DNA, 18 bp, Homo sapiens
acatttcataaggcctgc

SEQ ID NO: 392864 - DNA, 13 bp, Homo sapiens
acatttcctctct

SEQ ID NO: 392865 - DNA, 15 bp, Homo sapiens
acatttgacacataa

SEQ ID NO: 392866 - DNA, 21 bp, Homo sapiens
acatttgacacataaaagtaa

SEQ ID NO: 392867 - DNA, 15 bp, Homo sapiens
acatttgatgtctag

SEQ ID NO: 392868 - DNA, 12 bp, Homo sapiens
acatttgcatgc

SEQ ID NO: 392869 - DNA, 15 bp, Homo sapiens
acatttgtacattcc

SEQ ID NO: 392870 - DNA, 16 bp, Homo sapiens
acatttgtacattcct

SEQ ID NO: 392871 - DNA, 14 bp, Homo sapiens
gtccagaggctgca

SEQ ID NO: 392872 - DNA, 12 bp, Homo sapiens
gtccagcagctg

SEQ ID NO: 392873 - DNA, 13 bp, Homo sapiens
gtccagcagctgc

SEQ ID NO: 392874 - DNA, 15 bp, Homo sapiens
gtccagcagctgcgg

SEQ ID NO: 392875 - DNA, 22 bp, Homo sapiens
gtccagccgccattgccaccag

SEQ ID NO: 392876 - DNA, 19 bp, Homo sapiens
gtccagctccttaaactga

SEQ ID NO: 392877 - DNA, 16 bp, Homo sapiens
gtccaggaaggcagct

SEQ ID NO: 392878 - DNA, 17 bp, Homo sapiens
gtccaggaaggcagctg

SEQ ID NO: 392879 - DNA, 20 bp, Homo sapiens
gtccaggaaggcagctgctc

SEQ ID NO: 392880 - DNA, 22 bp, Homo sapiens
gtccaggaaggcagctgctctt

SEQ ID NO: 392881 - DNA, 16 bp, Homo sapiens
gtccaggagccccagc

SEQ ID NO: 392882 - DNA, 14 bp, Homo sapiens
gtccaggccactgt

SEQ ID NO: 392883 - DNA, 15 bp, Homo sapiens
gtccaggccactgtg

SEQ ID NO: 392884 - DNA, 17 bp, Homo sapiens
gtccaggccactgtggc

SEQ ID NO: 392885 - DNA, 23 bp, Homo sapiens
gtccaggccactgtggccagagc

SEQ ID NO: 392886 - DNA, 15 bp, Homo sapiens
gtccaggccaggcct

SEQ ID NO: 392887 - DNA, 24 bp, Homo sapiens
gtccaggccaggcctcatcctcct

SEQ ID NO: 392888 - DNA, 13 bp, Homo sapiens
gtccagggaagag

SEQ ID NO: 392889 - DNA, 15 bp, Homo sapiens
gtccagggaagctgg

SEQ ID NO: 392890 - DNA, 20 bp, Homo sapiens
gtccagggaagctggccgag

SEQ ID NO: 392891 - DNA, 11 bp, Homo sapiens
gtccagggctt

SEQ ID NO: 392892 - DNA, 17 bp, Homo sapiens
gtccagtttgtgcaaga

SEQ ID NO: 392893 - DNA, 22 bp, Homo sapiens
gtccagtttgtgcaagacaccc

SEQ ID NO: 392894 - DNA, 18 bp, Homo sapiens
gtccatatcagacctctg

SEQ ID NO: 392895 - DNA, 18 bp, Homo sapiens
gtccatctctctccctta

SEQ ID NO: 392896 - DNA, 18 bp, Homo sapiens
gtccatgcctacagataa

SEQ ID NO: 392897 - DNA, 21 bp, Homo sapiens
gtccatggcaccagccccctg

SEQ ID NO: 392898 - DNA, 18 bp, Homo sapiens
gtccatgtgaaatttaca

SEQ ID NO: 392899 - DNA, 14 bp, Homo sapiens
gtccatgtgtgtgc

SEQ ID NO: 392900 - DNA, 17 bp, Homo sapiens
gtccattatctgctgtt

SEQ ID NO: 392901 - DNA, 16 bp, Homo sapiens
gtccattgcaaaaggt

SEQ ID NO: 392902 - DNA, 20 bp, Homo sapiens
gtccatttcatgtgatctat

SEQ ID NO: 392903 - DNA, 13 bp, Homo sapiens
gtcccaaggagct

SEQ ID NO: 392904 - DNA, 23 bp, Homo sapiens
accaactctgcactccatggcca

SEQ ID NO: 392905 - DNA, 13 bp, Homo sapiens
accaactgagcca

SEQ ID NO: 392906 - DNA, 12 bp, Homo sapiens
accaactgcctt

SEQ ID NO: 392907 - DNA, 21 bp, Homo sapiens
accaagccccttggccctctc

SEQ ID NO: 392908 - DNA, 12 bp, Homo sapiens
accaagccttgg

SEQ ID NO: 392909 - DNA, 20 bp, Homo sapiens
accaaggcagcctccagagc

SEQ ID NO: 392910 - DNA, 23 bp, Homo sapiens
accaaggcagcctccagagccag

SEQ ID NO: 392911 - DNA, 24 bp, Homo sapiens
accaaggcagcctccagagccagc

SEQ ID NO: 392912 - DNA, 21 bp, Homo sapiens
accaaggccagccacaccaca

SEQ ID NO: 392913 - DNA, 20 bp, Homo sapiens
accaagtcctggctacatcc

SEQ ID NO: 392914 - DNA, 22 bp, Homo sapiens
accaagtgccttgagctgcctg

SEQ ID NO: 392915 - DNA, 15 bp, Homo sapiens
accaagtgggctggt

SEQ ID NO: 392916 - DNA, 23 bp, Homo sapiens
accaagttataaatcaatgtcac

SEQ ID NO: 392917 - DNA, 14 bp, Homo sapiens
accaagttcattac

SEQ ID NO: 392918 - DNA, 12 bp, Homo sapiens
accaataaaaat

SEQ ID NO: 392919 - DNA, 17 bp, Homo sapiens
accaataaaacaagaat

SEQ ID NO: 392920 - DNA, 16 bp, Homo sapiens
accaataacttcagag

SEQ ID NO: 392921 - DNA, 19 bp, Homo sapiens
accaataacttcagagaag

SEQ ID NO: 392922 - DNA, 20 bp, Homo sapiens
accaataacttcagagaagt

SEQ ID NO: 392923 - DNA, 22 bp, Homo sapiens
accaatattaccatcttaatct

SEQ ID NO: 392924 - DNA, 22 bp, Homo sapiens
accaatcccgtgaaagaattat

SEQ ID NO: 392925 - DNA, 15 bp, Homo sapiens
accaatctctgtgac

SEQ ID NO: 392926 - DNA, 21 bp, Homo sapiens
accaatgattcataacaatgt

SEQ ID NO: 392927 - DNA, 16 bp, Homo sapiens
accaatgctgttgtaa

SEQ ID NO: 392928 - DNA, 17 bp, Homo sapiens
accaattcctcatttgt

SEQ ID NO: 392929 - DNA, 16 bp, Homo sapiens
accaattgccctgcca

SEQ ID NO: 392930 - DNA, 18 bp, Homo sapiens
accaattgccctgccagg

SEQ ID NO: 392931 - DNA, 20 bp, Homo sapiens
accacaagccaccttttgta

SEQ ID NO: 392932 - DNA, 18 bp, Homo sapiens
accacacacacccttccc

SEQ ID NO: 392933 - DNA, 18 bp, Homo sapiens
accacactgaatctcccc

SEQ ID NO: 392934 - DNA, 13 bp, Homo sapiens
accacacttcctg

SEQ ID NO: 392935 - DNA, 15 bp, Homo sapiens
accacagatactgaa

SEQ ID NO: 392936 - DNA, 14 bp, Homo sapiens
accacagccctgtc

SEQ ID NO: 392937 - DNA, 16 bp, Homo sapiens
accacagccctgtcag

SEQ ID NO: 392938 - DNA, 14 bp, Homo sapiens
accacagctgctgg

SEQ ID NO: 392939 - DNA, 23 bp, Homo sapiens
accacagggttcaaaatgtctgt

SEQ ID NO: 392940 - DNA, 14 bp, Homo sapiens
accacatatacagc

SEQ ID NO: 392941 - DNA, 20 bp, Homo sapiens
accacatcctccgtccagcc

SEQ ID NO: 392942 - DNA, 24 bp, Homo sapiens
accacatggtccatttcatgtgat

SEQ ID NO: 392943 - DNA, 19 bp, Homo sapiens
accaccaagccctgcaaat

SEQ ID NO: 392944 - DNA, 16 bp, Homo sapiens
accaccacacccctgc

SEQ ID NO: 392945 - DNA, 17 bp, Homo sapiens
accaccagccccagcaa

SEQ ID NO: 392946 - DNA, 13 bp, Homo sapiens
accacccacccca

SEQ ID NO: 392947 - DNA, 19 bp, Homo sapiens
accaccccagctgctcccc

SEQ ID NO: 392948 - DNA, 15 bp, Homo sapiens
accacccctccctct

SEQ ID NO: 392949 - DNA, 22 bp, Homo sapiens
accacccctccctctgctctca

SEQ ID NO: 392950 - DNA, 21 bp, Homo sapiens
accaccctagtcccttcccct

SEQ ID NO: 392951 - DNA, 16 bp, Homo sapiens
accaccgcatatgcat

SEQ ID NO: 392952 - DNA, 20 bp, Homo sapiens
accaccgcatatgcatgcca

SEQ ID NO: 392953 - DNA, 23 bp, Homo sapiens
accaccgcatatgcatgccaggc

SEQ ID NO: 392954 - DNA, 15 bp, Homo sapiens
accaccgccctcctc

SEQ ID NO: 392955 - DNA, 18 bp, Homo sapiens
accaccgccctcctcgct

SEQ ID NO: 392956 - DNA, 18 bp, Homo sapiens
accaccgctccccagccc

SEQ ID NO: 392957 - DNA, 19 bp, Homo sapiens
accaccgctccccagccca

SEQ ID NO: 392958 - DNA, 20 bp, Homo sapiens
accaccggggcactggctgc

SEQ ID NO: 392959 - DNA, 23 bp, Homo sapiens
accaccggggcactggctgctct

SEQ ID NO: 392960 - DNA, 15 bp, Homo sapiens
accacctcactcctg

SEQ ID NO: 392961 - DNA, 12 bp, Homo sapiens
accacctcatgt

SEQ ID NO: 392962 - DNA, 16 bp, Homo sapiens
accacctcatgtcatt

SEQ ID NO: 392963 - DNA, 15 bp, Homo sapiens
accacctctcaatat

SEQ ID NO: 392964 - DNA, 14 bp, Homo sapiens
accacctctctgtc

SEQ ID NO: 392965 - DNA, 13 bp, Homo sapiens
accacctgtacat

SEQ ID NO: 392966 - DNA, 14 bp, Homo sapiens
accacctgtacata

SEQ ID NO: 392967 - DNA, 16 bp, Homo sapiens
accaccttctgtcccc

SEQ ID NO: 392968 - DNA, 20 bp, Homo sapiens
accaccttgccaatggtgta

SEQ ID NO: 392969 - DNA, 18 bp, Homo sapiens
accacgcttgacaggaca

SEQ ID NO: 392970 - DNA, 21 bp, Homo sapiens
accacggacgtttccatcagg

SEQ ID NO: 392971 - DNA, 15 bp, Homo sapiens
accacgtctgccagg

SEQ ID NO: 392972 - DNA, 16 bp, Homo sapiens
accacgtctgccaggc

SEQ ID NO: 392973 - DNA, 17 bp, Homo sapiens
accacgtctgccaggcc

SEQ ID NO: 392974 - DNA, 18 bp, Homo sapiens
accacgtctgtcttcaca

SEQ ID NO: 392975 - DNA, 20 bp, Homo sapiens
accactaggaatcccagagg

SEQ ID NO: 392976 - DNA, 19 bp, Homo sapiens
accactagggtcctggccc

SEQ ID NO: 392977 - DNA, 14 bp, Homo sapiens
accactatttaagt

SEQ ID NO: 392978 - DNA, 17 bp, Homo sapiens
accactgagcccttgca

SEQ ID NO: 392979 - DNA, 18 bp, Homo sapiens
accactgccctgcctgcc

SEQ ID NO: 392980 - DNA, 20 bp, Homo sapiens
accactgccctgcctgccca

SEQ ID NO: 392981 - DNA, 19 bp, Homo sapiens
accactgctgtgaacaagt

SEQ ID NO: 392982 - DNA, 14 bp, Homo sapiens
accactgggcctgc

SEQ ID NO: 392983 - DNA, 16 bp, Homo sapiens
accactggtctgtagg

SEQ ID NO: 392984 - DNA, 16 bp, Homo sapiens
accactgtccctacca

SEQ ID NO: 392985 - DNA, 19 bp, Homo sapiens
accactgtccctaccactg

SEQ ID NO: 392986 - DNA, 18 bp, Homo sapiens
accacttaaaaaatgtcc

SEQ ID NO: 392987 - DNA, 15 bp, Homo sapiens
accacttatttctaa

SEQ ID NO: 392988 - DNA, 17 bp, Homo sapiens
accacttcattcttgaa

SEQ ID NO: 392989 - DNA, 15 bp, Homo sapiens
accactttttgcagc

SEQ ID NO: 392990 - DNA, 20 bp, Homo sapiens
accactttttgcagctttct

SEQ ID NO: 392991 - DNA, 18 bp, Homo sapiens
accagaacgcaccccact

SEQ ID NO: 392992 - DNA, 16 bp, Homo sapiens
accagaagggaaacag

SEQ ID NO: 392993 - DNA, 20 bp, Homo sapiens
accagaagtgaatgggaaag

SEQ ID NO: 392994 - DNA, 14 bp, Homo sapiens
accagaataaaata

SEQ ID NO: 392995 - DNA, 22 bp, Homo sapiens
accagaattagtcctcacagcc

SEQ ID NO: 392996 - DNA, 14 bp, Homo sapiens
accagagccatgga

SEQ ID NO: 392997 - DNA, 10 bp, Homo sapiens
accagagccc

SEQ ID NO: 392998 - DNA, 16 bp, Homo sapiens
accagagccccccaca

SEQ ID NO: 392999 - DNA, 19 bp, Homo sapiens
accagagccccccacaatg

SEQ ID NO: 393000 - DNA, 20 bp, Homo sapiens
accagagccccccacaatga

SEQ ID NO: 393001 - DNA, 14 bp, Homo sapiens
accagagctctgga

SEQ ID NO: 393002 - DNA, 12 bp, Homo sapiens
accagaggtggg

SEQ ID NO: 393003 - DNA, 21 bp, Homo sapiens
accagatgacacataaatctg

SEQ ID NO: 393004 - DNA, 15 bp, Homo sapiens
accagcaagtcccag

SEQ ID NO: 393005 - DNA, 20 bp, Homo sapiens
accagcaagtcccagacaag

SEQ ID NO: 393006 - DNA, 14 bp, Homo sapiens
accagcactcccag

SEQ ID NO: 393007 - DNA, 17 bp, Homo sapiens
accagcactcccagggc

SEQ ID NO: 393008 - DNA, 14 bp, Homo sapiens
accagcagcacaat

SEQ ID NO: 393009 - DNA, 14 bp, Homo sapiens
gtccggaggcagca

SEQ ID NO: 393010 - DNA, 15 bp, Homo sapiens
gtccgtccgcccgcc

SEQ ID NO: 393011 - DNA, 19 bp, Homo sapiens
gtccgtccgcccgcccacc

SEQ ID NO: 393012 - DNA, 16 bp, Homo sapiens
gtcctaactggtatag

SEQ ID NO: 393013 - DNA, 18 bp, Homo sapiens
gtcctaagtccctgcccc

SEQ ID NO: 393014 - DNA, 23 bp, Homo sapiens
gtcctacaatatcattttcctgg

SEQ ID NO: 393015 - DNA, 16 bp, Homo sapiens
gtcctacccgcccgcg

SEQ ID NO: 393016 - DNA, 14 bp, Homo sapiens
gtcctacggaggga

SEQ ID NO: 393017 - DNA, 22 bp, Homo sapiens
gtcctaggggccgagggaaatg

SEQ ID NO: 393018 - DNA, 21 bp, Homo sapiens
gtcctatggagcctctgcaga

SEQ ID NO: 393019 - DNA, 15 bp, Homo sapiens
gtcctcacaagcctc

SEQ ID NO: 393020 - DNA, 17 bp, Homo sapiens
gtcctcacagcctagga

SEQ ID NO: 393021 - DNA, 21 bp, Homo sapiens
gtcctcagagggtccctaggt

SEQ ID NO: 393022 - DNA, 20 bp, Homo sapiens
gtcctcagggctctaccaag

SEQ ID NO: 393023 - DNA, 23 bp, Homo sapiens
gtcctcatctataaaatgaggga

SEQ ID NO: 393024 - DNA, 14 bp, Homo sapiens
gtcctcattcttct

SEQ ID NO: 393025 - DNA, 20 bp, Homo sapiens
gtcctccaccggtgcctcct

SEQ ID NO: 393026 - DNA, 22 bp, Homo sapiens
gtcctccagaagcctctggcta

SEQ ID NO: 393027 - DNA, 15 bp, Homo sapiens
gtcctccccttgggc

SEQ ID NO: 393028 - DNA, 15 bp, Homo sapiens
gtcctcccgggccct

SEQ ID NO: 393029 - DNA, 16 bp, Homo sapiens
gtcctcccgggccctc

SEQ ID NO: 393030 - DNA, 17 bp, Homo sapiens
gtcctcccgggccctcc

SEQ ID NO: 393031 - DNA, 12 bp, Homo sapiens
gtcctccctgct

SEQ ID NO: 393032 - DNA, 13 bp, Homo sapiens
gtcctccctgctc

SEQ ID NO: 393033 - DNA, 17 bp, Homo sapiens
gtcctccctgctcagct

SEQ ID NO: 393034 - DNA, 16 bp, Homo sapiens
gtctgtcttcacagct

SEQ ID NO: 393035 - DNA, 15 bp, Homo sapiens
gtctgtgccatggat

SEQ ID NO: 393036 - DNA, 18 bp, Homo sapiens
gtctgtgggactggccca

SEQ ID NO: 393037 - DNA, 20 bp, Homo sapiens
gtctgtgtgatgaactttct

SEQ ID NO: 393038 - DNA, 15 bp, Homo sapiens
gtctgtgtgctgtgg

SEQ ID NO: 393039 - DNA, 21 bp, Homo sapiens
gtctgttccccatggccactt

SEQ ID NO: 393040 - DNA, 14 bp, Homo sapiens
gtctgttctcacat

SEQ ID NO: 393041 - DNA, 22 bp, Homo sapiens
gtctgtttcaatgacctgtatt

SEQ ID NO: 393042 - DNA, 22 bp, Homo sapiens
gtcttacaaggcaggcctttcc

SEQ ID NO: 393043 - DNA, 22 bp, Homo sapiens
gtcttacattggctttttaaat

SEQ ID NO: 393044 - DNA, 23 bp, Homo sapiens
gtcttaccgaataaggtaccaag

SEQ ID NO: 393045 - DNA, 14 bp, Homo sapiens
gtcttactacttta

SEQ ID NO: 393046 - DNA, 15 bp, Homo sapiens
gtcttactactttaa

SEQ ID NO: 393047 - DNA, 20 bp, Homo sapiens
gtcttactactttaaatcct

SEQ ID NO: 393048 - DNA, 13 bp, Homo sapiens
gtcttactttgtg

SEQ ID NO: 393049 - DNA, 12 bp, Homo sapiens
gtcttagcttta

SEQ ID NO: 393050 - DNA, 16 bp, Homo sapiens
gtcttagctttacatt

SEQ ID NO: 393051 - DNA, 16 bp, Homo sapiens
gtcttataagaaaaca

SEQ ID NO: 393052 - DNA, 16 bp, Homo sapiens
gtcttcacagctctgt

SEQ ID NO: 393053 - DNA, 17 bp, Homo sapiens
gtcttcacatttagaat

SEQ ID NO: 393054 - DNA, 17 bp, Homo sapiens
gtcttcagcgagaccct

SEQ ID NO: 393055 - DNA, 13 bp, Homo sapiens
gtcttccaaggag

SEQ ID NO: 393056 - DNA, 19 bp, Homo sapiens
gtcttccaaggagaccaag

SEQ ID NO: 393057 - DNA, 15 bp, Homo sapiens
gtcttccatcagcag

SEQ ID NO: 393058 - DNA, 19 bp, Homo sapiens
gtcttccatcagcagtgat

SEQ ID NO: 393059 - DNA, 17 bp, Homo sapiens
gtcttccattttgccac

SEQ ID NO: 393060 - DNA, 16 bp, Homo sapiens
gtcttccctagggctg

SEQ ID NO: 393061 - DNA, 22 bp, Homo sapiens
gtcttcctcctcagtcttctca

SEQ ID NO: 393062 - DNA, 17 bp, Homo sapiens
gtcttcctctctctcac

SEQ ID NO: 393063 - DNA, 19 bp, Homo sapiens
gtcttcctgagtggtgcca

SEQ ID NO: 393064 - DNA, 16 bp, Homo sapiens
gtcttcgtacagttct

SEQ ID NO: 393065 - DNA, 23 bp, Homo sapiens
gtcttctcatagcattaactaat

SEQ ID NO: 393066 - DNA, 13 bp, Homo sapiens
gtcttctccctgt

SEQ ID NO: 393067 - DNA, 14 bp, Homo sapiens
gtcttctccctgtc

SEQ ID NO: 393068 - DNA, 13 bp, Homo sapiens
gtcttctctccac

SEQ ID NO: 393069 - DNA, 16 bp, Homo sapiens
gtcttcttacatgcat

SEQ ID NO: 393070 - DNA, 18 bp, Homo sapiens
gtcttctttctcctgtgg

SEQ ID NO: 393071 - DNA, 18 bp, Homo sapiens
gtcttgacctgaactctg

SEQ ID NO: 393072 - DNA, 18 bp, Homo sapiens
gtcttgagagcgctggcc

SEQ ID NO: 393073 - DNA, 14 bp, Homo sapiens
gtcttgagatgtat

SEQ ID NO: 393074 - DNA, 13 bp, Homo sapiens
gtcttgagtgggc

SEQ ID NO: 393075 - DNA, 18 bp, Homo sapiens
gtcttgagtgggccccct

SEQ ID NO: 393076 - DNA, 20 bp, Homo sapiens
gtcttggagaggaggtgtgg

SEQ ID NO: 393077 - DNA, 19 bp, Homo sapiens
gtcttgggctactggcagc

SEQ ID NO: 393078 - DNA, 20 bp, Homo sapiens
gtcttgggctactggcagct

SEQ ID NO: 393079 - DNA, 24 bp, Homo sapiens
gtcttgggctactggcagctcctc

SEQ ID NO: 393080 - DNA, 17 bp, Homo sapiens
gtcttggtgccttttgt

SEQ ID NO: 393081 - DNA, 19 bp, Homo sapiens
gtcttgtgactagtgctga

SEQ ID NO: 393082 - DNA, 15 bp, Homo sapiens
gtctttactgggaag

SEQ ID NO: 393083 - DNA, 23 bp, Homo sapiens
gtctttactgggaagcagttaag

SEQ ID NO: 393084 - DNA, 20 bp, Homo sapiens
gtctttagtgatgcaataaa

SEQ ID NO: 393085 - DNA, 13 bp, Homo sapiens
gtctttatgattt

SEQ ID NO: 393086 - DNA, 19 bp, Homo sapiens
gtctttatgatttcatgat

SEQ ID NO: 393087 - DNA, 15 bp, Homo sapiens
gtctttattcttatt

SEQ ID NO: 393088 - DNA, 19 bp, Homo sapiens
gtctttcacagtaccatct

SEQ ID NO: 393089 - DNA, 22 bp, Homo sapiens
gtctttcctcccttctttgctt

SEQ ID NO: 393090 - DNA, 20 bp, Homo sapiens
gtctttctaatgtagctatt

SEQ ID NO: 393091 - DNA, 22 bp, Homo sapiens
gtctttctttgctgctgtggaa

SEQ ID NO: 393092 - DNA, 18 bp, Homo sapiens
gtctttgctgtttatata

SEQ ID NO: 393093 - DNA, 17 bp, Homo sapiens
gtctttggttcctcatg

SEQ ID NO: 393094 - DNA, 19 bp, Homo sapiens
gtctttggttcctcatggc

SEQ ID NO: 393095 - DNA, 16 bp, Homo sapiens
gtctttgtaatgcttg

SEQ ID NO: 393096 - DNA, 16 bp, Homo sapiens
gtctttgtacagacaa

SEQ ID NO: 393097 - DNA, 15 bp, Homo sapiens
gtctttgtgtgctgt

SEQ ID NO: 393098 - DNA, 16 bp, Homo sapiens
gtcttttcaggtttgt

SEQ ID NO: 393099 - DNA, 16 bp, Homo sapiens
gtcttttgacatgtgg

SEQ ID NO: 393100 - DNA, 13 bp, Homo sapiens
gtcttttgttctc

SEQ ID NO: 393101 - DNA, 18 bp, Homo sapiens
gtcttttgttctctcttg

SEQ ID NO: 393102 - DNA, 17 bp, Homo sapiens
gtctttttccttcctga

SEQ ID NO: 393103 - DNA, 13 bp, Homo sapiens
gtctttttccttt

SEQ ID NO: 393104 - DNA, 16 bp, Homo sapiens
gtctttttctggactg

SEQ ID NO: 393105 - DNA, 15 bp, Homo sapiens
gtcttttttttcatc

SEQ ID NO: 393106 - DNA, 22 bp, Homo sapiens
gtgaaaagagtatgtagtggct

SEQ ID NO: 393107 - DNA, 22 bp, Homo sapiens
gtgaaaagtatggcagtgggag

SEQ ID NO: 393108 - DNA, 13 bp, Homo sapiens
gtgaaacacacac

SEQ ID NO: 393109 - DNA, 21 bp, Homo sapiens
gtgaaacacacacacattctt

SEQ ID NO: 393110 - DNA, 18 bp, Homo sapiens
gtgaaacacaccaggctg

SEQ ID NO: 393111 - DNA, 20 bp, Homo sapiens
gtgaaacacaccaggctgtg

SEQ ID NO: 393112 - DNA, 18 bp, Homo sapiens
gtgaaacttgtgctatag

SEQ ID NO: 393113 - DNA, 15 bp, Homo sapiens
gtgaaagaattattt

SEQ ID NO: 393114 - DNA, 22 bp, Homo sapiens
gtgaaagaattatttttgtgtt

SEQ ID NO: 393115 - DNA, 13 bp, Homo sapiens
gtgaaaggaaagt

SEQ ID NO: 393116 - DNA, 13 bp, Homo sapiens
gtgaaagtgtaaa

SEQ ID NO: 393117 - DNA, 15 bp, Homo sapiens
gtgaaagtgtaaaat

SEQ ID NO: 393118 - DNA, 22 bp, Homo sapiens
gtgaaatttacagttactgcct

SEQ ID NO: 393119 - DNA, 22 bp, Homo sapiens
gtgaaatttacatcatttcttt

SEQ ID NO: 393120 - DNA, 21 bp, Homo sapiens
gtgaaatttattagttaatat

SEQ ID NO: 393121 - DNA, 15 bp, Homo sapiens
gtgaaatttgttaat

SEQ ID NO: 393122 - DNA, 17 bp, Homo sapiens
gtgaaatttgttaatat

SEQ ID NO: 393123 - DNA, 14 bp, Homo sapiens
gtgaaattttggtg

SEQ ID NO: 393124 - DNA, 22 bp, Homo sapiens
gtgaacagattgctacacacac

SEQ ID NO: 393125 - DNA, 22 bp, Homo sapiens
gtgaactaatttggtttttact

SEQ ID NO: 393126 - DNA, 23 bp, Homo sapiens
gtgaactaatttggtttttactc

SEQ ID NO: 393127 - DNA, 16 bp, Homo sapiens
gtgaagacagagcaga

SEQ ID NO: 393128 - DNA, 16 bp, Homo sapiens
gtgaagaggggccaga

SEQ ID NO: 393129 - DNA, 18 bp, Homo sapiens
gtgaagatgtttgcaata

SEQ ID NO: 393130 - DNA, 16 bp, Homo sapiens
gtgaagcagtgcctcg

SEQ ID NO: 393131 - DNA, 17 bp, Homo sapiens
gtgaagcatgctttgct

SEQ ID NO: 393132 - DNA, 15 bp, Homo sapiens
gtgaagcccaggagg

SEQ ID NO: 393133 - DNA, 12 bp, Homo sapiens
gtgaagcccttt

SEQ ID NO: 393134 - DNA, 14 bp, Homo sapiens
gtgaagctgaaccc

SEQ ID NO: 393135 - DNA, 12 bp, Homo sapiens
gtgaagctgggg

SEQ ID NO: 393136 - DNA, 18 bp, Homo sapiens
gtgaagctggggacagct

SEQ ID NO: 393137 - DNA, 23 bp, Homo sapiens
gtgaaggcccaagagcagagtct

SEQ ID NO: 393138 - DNA, 14 bp, Homo sapiens
gtgaagtgattgac

SEQ ID NO: 393139 - DNA, 15 bp, Homo sapiens
gtgaagtgtggctgg

SEQ ID NO: 393140 - DNA, 23 bp, Homo sapiens
gtgaagtgtggctggtgtcccct

SEQ ID NO: 393141 - DNA, 18 bp, Homo sapiens
gtgaataaaaaccctgta

SEQ ID NO: 393142 - DNA, 24 bp, Homo sapiens
gtgaataataaatacacaatgaat

SEQ ID NO: 393143 - DNA, 17 bp, Homo sapiens
gtgaatacaattaaagg

SEQ ID NO: 393144 - DNA, 18 bp, Homo sapiens
gtgaatacatggtagcag

SEQ ID NO: 393145 - DNA, 19 bp, Homo sapiens
gtgaatgagtaaataaact

SEQ ID NO: 393146 - DNA, 20 bp, Homo sapiens
gtgaatgtcttccttttctt

SEQ ID NO: 393147 - DNA, 21 bp, Homo sapiens
gtgaatgttgtcctgtgtcat

SEQ ID NO: 393148 - DNA, 14 bp, Homo sapiens
gtgaattgaagtca

SEQ ID NO: 393149 - DNA, 13 bp, Homo sapiens
gtgaattgataat

SEQ ID NO: 393150 - DNA, 14 bp, Homo sapiens
gtgaattgataata

SEQ ID NO: 393151 - DNA, 19 bp, Homo sapiens
gtgaatttcttcactgttg

SEQ ID NO: 393152 - DNA, 14 bp, Homo sapiens
gtgacaaaggatga

SEQ ID NO: 393153 - DNA, 16 bp, Homo sapiens
gtgacaacctttgtgt

SEQ ID NO: 393154 - DNA, 21 bp, Homo sapiens
gtgacaacctttgtgtaataa

SEQ ID NO: 393155 - DNA, 14 bp, Homo sapiens
gtgacaaggcccca

SEQ ID NO: 393156 - DNA, 18 bp, Homo sapiens
gtgacaaggccccagaga

SEQ ID NO: 393157 - DNA, 16 bp, Homo sapiens
gtgacaattttgtaca

SEQ ID NO: 393158 - DNA, 22 bp, Homo sapiens
gtgacacagcagcttcaccaga

SEQ ID NO: 393159 - DNA, 20 bp, Homo sapiens
gtgacacttcagagagctgg

SEQ ID NO: 393160 - DNA, 16 bp, Homo sapiens
gtgacagacaggctct

SEQ ID NO: 393161 - DNA, 17 bp, Homo sapiens
gtgacagacaggctctt

SEQ ID NO: 393162 - DNA, 23 bp, Homo sapiens
gtgacagccttgggcctttcagt

SEQ ID NO: 393163 - DNA, 19 bp, Homo sapiens
gtgacagggcaagaccctg

SEQ ID NO: 393164 - DNA, 16 bp, Homo sapiens
gtgccgtgagcaggct

SEQ ID NO: 393165 - DNA, 20 bp, Homo sapiens
gtgccgtgtgttgcatgcag

SEQ ID NO: 393166 - DNA, 18 bp, Homo sapiens
ttgaaaagaagaaagtct

SEQ ID NO: 393167 - DNA, 22 bp, Homo sapiens
ttgaaaagaagaaagtctatgc

SEQ ID NO: 393168 - DNA, 23 bp, Homo sapiens
ttgaaaagaagaaagtctatgct

SEQ ID NO: 393169 - DNA, 21 bp, Homo sapiens
ttgaaaatatttctatgtaaa

SEQ ID NO: 393170 - DNA, 19 bp, Homo sapiens
ttgaaaccaccttttatta

SEQ ID NO: 393171 - DNA, 17 bp, Homo sapiens
ttgaaagaagtcaaatg

SEQ ID NO: 393172 - DNA, 18 bp, Homo sapiens
ttgaaagaagtcaaatga

SEQ ID NO: 393173 - DNA, 20 bp, Homo sapiens
ttgaaagaagtcaaatgaat

SEQ ID NO: 393174 - DNA, 20 bp, Homo sapiens
ttgaaagagaaccagtttca

SEQ ID NO: 393175 - DNA, 12 bp, Homo sapiens
ttgaaagctgtg

SEQ ID NO: 393176 - DNA, 20 bp, Homo sapiens
ttgaaaggagaaaaaaaaag

SEQ ID NO: 393177 - DNA, 21 bp, Homo sapiens
ttgaaagttttccagtattga

SEQ ID NO: 393178 - DNA, 20 bp, Homo sapiens
ttgaaatcaccttttctaaa

SEQ ID NO: 393179 - DNA, 15 bp, Homo sapiens
ttgaaatccaaacta

SEQ ID NO: 393180 - DNA, 11 bp, Homo sapiens
ttgaaattata

SEQ ID NO: 393181 - DNA, 20 bp, Homo sapiens
ttgaaatttttaaatcattt

SEQ ID NO: 393182 - DNA, 14 bp, Homo sapiens
ttgaaccaaaacat

SEQ ID NO: 393183 - DNA, 20 bp, Homo sapiens
ttgaacctttttttttgaaa

SEQ ID NO: 393184 - DNA, 23 bp, Homo sapiens
ttgaacctttttttttgaaacag

SEQ ID NO: 393185 - DNA, 13 bp, Homo sapiens
ttgaactatattt

SEQ ID NO: 393186 - DNA, 19 bp, Homo sapiens
ttgaagacatatcatgtgt

SEQ ID NO: 393187 - DNA, 19 bp, Homo sapiens
ttgaagacttttctttcag

SEQ ID NO: 393188 - DNA, 17 bp, Homo sapiens
ttgaagaggggaggggc

SEQ ID NO: 393189 - DNA, 11 bp, Homo sapiens
ttgaagatgta

SEQ ID NO: 393190 - DNA, 21 bp, Homo sapiens
ttgaagatgtagcttccaaat

SEQ ID NO: 393191 - DNA, 12 bp, Homo sapiens
ttgaagatgtcc

SEQ ID NO: 393192 - DNA, 15 bp, Homo sapiens
ttgaagcagttgtgt

SEQ ID NO: 393193 - DNA, 23 bp, Homo sapiens
ttgaagccaagtcagctttgcct

SEQ ID NO: 393194 - DNA, 14 bp, Homo sapiens
ttgaagctaagatt

SEQ ID NO: 393195 - DNA, 17 bp, Homo sapiens
ttgaaggaaaatgatac

SEQ ID NO: 393196 - DNA, 13 bp, Homo sapiens
ttgaaggactaca

SEQ ID NO: 393197 - DNA, 13 bp, Homo sapiens
ttgaaggcagtct

SEQ ID NO: 393198 - DNA, 18 bp, Homo sapiens
ttgaagtaatcccgccac

SEQ ID NO: 393199 - DNA, 16 bp, Homo sapiens
ttgaagtaatgaattt

SEQ ID NO: 393200 - DNA, 17 bp, Homo sapiens
ttgaagtaatgaatttt

SEQ ID NO: 393201 - DNA, 21 bp, Homo sapiens
ttgaagttcatggtgatcagt

SEQ ID NO: 393202 - DNA, 20 bp, Homo sapiens
ttgaataaaaaacatttgta

SEQ ID NO: 393203 - DNA, 16 bp, Homo sapiens
ttgaataaaaatgcac

SEQ ID NO: 393204 - DNA, 22 bp, Homo sapiens
ttgaataaactccccagcgtat

SEQ ID NO: 393205 - DNA, 19 bp, Homo sapiens
ttgaataaagttgaagcta

SEQ ID NO: 393206 - DNA, 13 bp, Homo sapiens
ttgaataatgttt

SEQ ID NO: 393207 - DNA, 18 bp, Homo sapiens
ttgaatacattaaaagaa

SEQ ID NO: 393208 - DNA, 16 bp, Homo sapiens
ttgaataccattaaaa

SEQ ID NO: 393209 - DNA, 19 bp, Homo sapiens
ttgaataccattaaaactg

SEQ ID NO: 393210 - DNA, 15 bp, Homo sapiens
ttgaatctttccaat

SEQ ID NO: 393211 - DNA, 12 bp, Homo sapiens
ttgaatgaaaaa

SEQ ID NO: 393212 - DNA, 15 bp, Homo sapiens
ttgaatgaaaaattt

SEQ ID NO: 393213 - DNA, 20 bp, Homo sapiens
ttgaatgaaaaatttaagca

SEQ ID NO: 393214 - DNA, 22 bp, Homo sapiens
ttgaatgaaaaatttaagcatt

SEQ ID NO: 393215 - DNA, 20 bp, Homo sapiens
ttgaatgacaacagaagctt

SEQ ID NO: 393216 - DNA, 21 bp, Homo sapiens
ttgaatgacaacagaagcttc

SEQ ID NO: 393217 - DNA, 12 bp, Homo sapiens
ttgaatgatgcc

SEQ ID NO: 393218 - DNA, 19 bp, Homo sapiens
ttgaatggattaaatggca

SEQ ID NO: 393219 - DNA, 20 bp, Homo sapiens
ttgaatggattaaatggcac

SEQ ID NO: 393220 - DNA, 16 bp, Homo sapiens
ttgaatggtgcagaaa

SEQ ID NO: 393221 - DNA, 20 bp, Homo sapiens
ttgaatggtgttgtatgcct

SEQ ID NO: 393222 - DNA, 13 bp, Homo sapiens
ttgaatgtacaaa

SEQ ID NO: 393223 - DNA, 20 bp, Homo sapiens
ttgaatgtccccattctata

SEQ ID NO: 393224 - DNA, 14 bp, Homo sapiens
ttgaatgttaagca

SEQ ID NO: 393225 - DNA, 15 bp, Homo sapiens
ttgaatgttatatca

SEQ ID NO: 393226 - DNA, 14 bp, Homo sapiens
ttgaattaaaaaaa

SEQ ID NO: 393227 - DNA, 23 bp, Homo sapiens
ttgaattaaattaggaataaata

SEQ ID NO: 393228 - DNA, 12 bp, Homo sapiens
ttgaattacaac

SEQ ID NO: 393229 - DNA, 18 bp, Homo sapiens
ttgaattattttgttact

SEQ ID NO: 393230 - DNA, 14 bp, Homo sapiens
ttgaattgtaagga

SEQ ID NO: 393231 - DNA, 15 bp, Homo sapiens
ttgaatttaaataaa

SEQ ID NO: 393232 - DNA, 16 bp, Homo sapiens
ttgaatttcctatctg

SEQ ID NO: 393233 - DNA, 22 bp, Homo sapiens
ttgaatttcctatctgtatgtc

SEQ ID NO: 393234 - DNA, 18 bp, Homo sapiens
ttgaattttcaaaggctt

SEQ ID NO: 393235 - DNA, 21 bp, Homo sapiens
ttgacaaaacctaacttgcgc

SEQ ID NO: 393236 - DNA, 15 bp, Homo sapiens
ttgacaattcctaga

SEQ ID NO: 393237 - DNA, 17 bp, Homo sapiens
ttgacacactcaccatt

SEQ ID NO: 393238 - DNA, 18 bp, Homo sapiens
ttgacacataaaagtaat

SEQ ID NO: 393239 - DNA, 20 bp, Homo sapiens
ttgacacataaaagtaatta

SEQ ID NO: 393240 - DNA, 16 bp, Homo sapiens
ttgacaccagggccag

SEQ ID NO: 393241 - DNA, 14 bp, Homo sapiens
ttgacatgtggaaa

SEQ ID NO: 393242 - DNA, 11 bp, Homo sapiens
ttgacattcct

SEQ ID NO: 393243 - DNA, 21 bp, Homo sapiens
ttgacattgtatgtatctatt

SEQ ID NO: 393244 - DNA, 16 bp, Homo sapiens
ttgaccctactgtgga

SEQ ID NO: 393245 - DNA, 22 bp, Homo sapiens
ttgaccgtactctcacatgtgg

SEQ ID NO: 393246 - DNA, 21 bp, Homo sapiens
ttgaccgttttcatcctggcc

SEQ ID NO: 393247 - DNA, 23 bp, Homo sapiens
ttgacctcagctgcacattcctg

SEQ ID NO: 393248 - DNA, 13 bp, Homo sapiens
ttgacctttattt

SEQ ID NO: 393249 - DNA, 19 bp, Homo sapiens
ttgactaaacagcaaaagt

SEQ ID NO: 393250 - DNA, 15 bp, Homo sapiens
ttgactaaagcatca

SEQ ID NO: 393251 - DNA, 20 bp, Homo sapiens
ttgactgaagcgaacatctt

SEQ ID NO: 393252 - DNA, 23 bp, Homo sapiens
ttgactgaagcgaacatcttcat

SEQ ID NO: 393253 - DNA, 12 bp, Homo sapiens
ttgactgctgct

SEQ ID NO: 393254 - DNA, 15 bp, Homo sapiens
ttgactgctgctccc

SEQ ID NO: 393255 - DNA, 22 bp, Homo sapiens
ttgactgtaggcgcccctgggg

SEQ ID NO: 393256 - DNA, 14 bp, Homo sapiens
ttgacttcagcagg

SEQ ID NO: 393257 - DNA, 23 bp, Homo sapiens
ttgacttcagctgcctgaaacag

SEQ ID NO: 393258 - DNA, 10 bp, Homo sapiens
ttgagaaacc

SEQ ID NO: 393259 - DNA, 23 bp, Homo sapiens
ttgagaaaccttattgtacctct

SEQ ID NO: 393260 - DNA, 20 bp, Homo sapiens
ttgagaactgcttctaagat

SEQ ID NO: 393261 - DNA, 20 bp, Homo sapiens
ttgagaatattataaaaata

SEQ ID NO: 393262 - DNA, 23 bp, Homo sapiens
ttgagacaaaaattatctatttg

SEQ ID NO: 393263 - DNA, 16 bp, Homo sapiens
ttgagacaagccctgg

SEQ ID NO: 393264 - DNA, 15 bp, Homo sapiens
ttgagacactgtcaa

SEQ ID NO: 393265 - DNA, 13 bp, Homo sapiens
ttgagacattcca

SEQ ID NO: 393266 - DNA, 23 bp, Homo sapiens
ttgagaccaagccggtgcccacc

SEQ ID NO: 393267 - DNA, 16 bp, Homo sapiens
ttgagaccctcttctc

SEQ ID NO: 393268 - DNA, 23 bp, Homo sapiens
ttgagactatttaaacttataaa

SEQ ID NO: 393269 - DNA, 18 bp, Homo sapiens
ttgagagcgctggcctct

SEQ ID NO: 393270 - DNA, 18 bp, Homo sapiens
ttgagaggcatgacagct

SEQ ID NO: 393271 - DNA, 12 bp, Homo sapiens
ttgagattagag

SEQ ID NO: 393272 - DNA, 11 bp, Homo sapiens
ttgagcacagg

SEQ ID NO: 393273 - DNA, 19 bp, Homo sapiens
ttgagcacaggcaacatta

SEQ ID NO: 393274 - DNA, 23 bp, Homo sapiens
ttgagcacaggcaacattacaaa

SEQ ID NO: 393275 - DNA, 12 bp, Homo sapiens
ttgagcctcccc

SEQ ID NO: 393276 - DNA, 18 bp, Homo sapiens
ttgagcctcccccaaagc

SEQ ID NO: 393277 - DNA, 19 bp, Homo sapiens
ttgagctcccctggagcca

SEQ ID NO: 393278 - DNA, 15 bp, Homo sapiens
ttgaggacacatgtc

SEQ ID NO: 393279 - DNA, 22 bp, Homo sapiens
ttgaggacctccacctgggaga

SEQ ID NO: 393280 - DNA, 16 bp, Homo sapiens
ttgaggatcatatgaa

SEQ ID NO: 393281 - DNA, 21 bp, Homo sapiens
ttgaggcaaaggccagcagca

SEQ ID NO: 393282 - DNA, 13 bp, Homo sapiens
ttgaggcagagtc

SEQ ID NO: 393283 - DNA, 15 bp, Homo sapiens
ttgaggccaggctag

SEQ ID NO: 393284 - DNA, 19 bp, Homo sapiens
ttgaggccgcatctttctt

SEQ ID NO: 393285 - DNA, 23 bp, Homo sapiens
ttgagggacaaatttaaaacaaa

SEQ ID NO: 393286 - DNA, 14 bp, Homo sapiens
ttgagggaccaata

SEQ ID NO: 393287 - DNA, 17 bp, Homo sapiens
ttgagggactgcctctg

SEQ ID NO: 393288 - DNA, 20 bp, Homo sapiens
ttgagggactgcctctgcca

SEQ ID NO: 393289 - DNA, 13 bp, Homo sapiens
ttgagggtaggag

SEQ ID NO: 393290 - DNA, 18 bp, Homo sapiens
ttgagggtgtaaccagta

SEQ ID NO: 393291 - DNA, 21 bp, Homo sapiens
ttgaggtaccagttgtattta

SEQ ID NO: 393292 - DNA, 23 bp, Homo sapiens
ttgaggtagaccaggatttctaa

SEQ ID NO: 393293 - DNA, 16 bp, Homo sapiens
ttgaggtcaagtaaga

SEQ ID NO: 393294 - DNA, 16 bp, Homo sapiens
gtggggaggcagaggg

SEQ ID NO: 393295 - DNA, 14 bp, Homo sapiens
gtggggagggtggg

SEQ ID NO: 393296 - DNA, 21 bp, Homo sapiens
gtggggcccaagcatgcccca

SEQ ID NO: 393297 - DNA, 13 bp, Homo sapiens
gtggggccccaaa

SEQ ID NO: 393298 - DNA, 21 bp, Homo sapiens
gtggggccccaaagcccagcc

SEQ ID NO: 393299 - DNA, 23 bp, Homo sapiens
gtggggcctccttgtccaggtct

SEQ ID NO: 393300 - DNA, 13 bp, Homo sapiens
gtggggctgagcc

SEQ ID NO: 393301 - DNA, 11 bp, Homo sapiens
gtggggctggg

SEQ ID NO: 393302 - DNA, 12 bp, Homo sapiens
gtggggctgggg

SEQ ID NO: 393303 - DNA, 16 bp, Homo sapiens
gtgggggagcctggag

SEQ ID NO: 393304 - DNA, 15 bp, Homo sapiens
gtgggggcctgctgt

SEQ ID NO: 393305 - DNA, 18 bp, Homo sapiens
gtgggggcctgctgtggg

SEQ ID NO: 393306 - DNA, 12 bp, Homo sapiens
gtggggggtgac

SEQ ID NO: 393307 - DNA, 15 bp, Homo sapiens
gtgggggtctgggag

SEQ ID NO: 393308 - DNA, 16 bp, Homo sapiens
gtgggggtctgggagg

SEQ ID NO: 393309 - DNA, 19 bp, Homo sapiens
gtgggggtgcctggtgcgc

SEQ ID NO: 393310 - DNA, 18 bp, Homo sapiens
gtggggtaaggaggagaa

SEQ ID NO: 393311 - DNA, 18 bp, Homo sapiens
ttgccacaggacacagtc

SEQ ID NO: 393312 - DNA, 15 bp, Homo sapiens
ttgccactgcaaaca

SEQ ID NO: 393313 - DNA, 18 bp, Homo sapiens
ttgccactgcctcttcct

SEQ ID NO: 393314 - DNA, 14 bp, Homo sapiens
ttgccagagatgga

SEQ ID NO: 393315 - DNA, 13 bp, Homo sapiens
ttgccagcacagg

SEQ ID NO: 393316 - DNA, 12 bp, Homo sapiens
ttgccagctttt

SEQ ID NO: 393317 - DNA, 18 bp, Homo sapiens
ttgccagcttttcctccc

SEQ ID NO: 393318 - DNA, 19 bp, Homo sapiens
ttgccagcttttcctccct

SEQ ID NO: 393319 - DNA, 18 bp, Homo sapiens
ttgccaggaatgtttcag

SEQ ID NO: 393320 - DNA, 13 bp, Homo sapiens
ttgccaggggcat

SEQ ID NO: 393321 - DNA, 17 bp, Homo sapiens
ttgccatcgggtgccaa

SEQ ID NO: 393322 - DNA, 20 bp, Homo sapiens
ttgccatgacaacttctaat

SEQ ID NO: 393323 - DNA, 14 bp, Homo sapiens
ttgccatgctgcta

SEQ ID NO: 393324 - DNA, 17 bp, Homo sapiens
ttgccattggacagttg

SEQ ID NO: 393325 - DNA, 18 bp, Homo sapiens
ttgccattggacagttgt

SEQ ID NO: 393326 - DNA, 16 bp, Homo sapiens
ttgccatttcttccca

SEQ ID NO: 393327 - DNA, 17 bp, Homo sapiens
ttgcccaacctcagcaa

SEQ ID NO: 393328 - DNA, 18 bp, Homo sapiens
ttgcccacacctgcctct

SEQ ID NO: 393329 - DNA, 20 bp, Homo sapiens
ttgcccaggctggagtgcag

SEQ ID NO: 393330 - DNA, 14 bp, Homo sapiens
ttgccccagagccc

SEQ ID NO: 393331 - DNA, 13 bp, Homo sapiens
ttgccccagtcct

SEQ ID NO: 393332 - DNA, 21 bp, Homo sapiens
ttgccccatgataaaataagt

SEQ ID NO: 393333 - DNA, 15 bp, Homo sapiens
ttgcccccatccctc

SEQ ID NO: 393334 - DNA, 16 bp, Homo sapiens
ttgccccccaccccag

SEQ ID NO: 393335 - DNA, 19 bp, Homo sapiens
ttgccccccaccccagcct

SEQ ID NO: 393336 - DNA, 14 bp, Homo sapiens
ttgcccgccagcca

SEQ ID NO: 393337 - DNA, 15 bp, Homo sapiens
ttgcccgccagccag

SEQ ID NO: 393338 - DNA, 16 bp, Homo sapiens
ttgcccgccagcctca

SEQ ID NO: 393339 - DNA, 22 bp, Homo sapiens
ttgcccgccagcctcagtgcca

SEQ ID NO: 393340 - DNA, 23 bp, Homo sapiens
ttgcccgccagcctcagtgccac

SEQ ID NO: 393341 - DNA, 13 bp, Homo sapiens
ttgcccgctccca

SEQ ID NO: 393342 - DNA, 21 bp, Homo sapiens
ttgcccgctcccacagcttcc

SEQ ID NO: 393343 - DNA, 20 bp, Homo sapiens
ttgccctgagctttccgggg

SEQ ID NO: 393344 - DNA, 12 bp, Homo sapiens
ttgccctgggcc

SEQ ID NO: 393345 - DNA, 23 bp, Homo sapiens
ttgccctggtttcactggcccaa

SEQ ID NO: 393346 - DNA, 14 bp, Homo sapiens
ttgccgagagaggc

SEQ ID NO: 393347 - DNA, 24 bp, Homo sapiens
ttgccgctgggagagccaaggcct

SEQ ID NO: 393348 - DNA, 14 bp, Homo sapiens
ttgccgggcctgga

SEQ ID NO: 393349 - DNA, 15 bp, Homo sapiens
ttgccgggcctggac

SEQ ID NO: 393350 - DNA, 18 bp, Homo sapiens
ttgccgggcctggactgt

SEQ ID NO: 393351 - DNA, 16 bp, Homo sapiens
ttgccgggcctgggcc

SEQ ID NO: 393352 - DNA, 17 bp, Homo sapiens
ttgccgtgttggatttc

SEQ ID NO: 393353 - DNA, 12 bp, Homo sapiens
ttgcctcccttc

SEQ ID NO: 393354 - DNA, 13 bp, Homo sapiens
ttgcctcccttcc

SEQ ID NO: 393355 - DNA, 16 bp, Homo sapiens
ttgcctcccttcctcc

SEQ ID NO: 393356 - DNA, 19 bp, Homo sapiens
ttgcctcctctctccctgc

SEQ ID NO: 393357 - DNA, 14 bp, Homo sapiens
ttgcctctctcagg

SEQ ID NO: 393358 - DNA, 12 bp, Homo sapiens
ttgcctggctgt

SEQ ID NO: 393359 - DNA, 16 bp, Homo sapiens
ttgcctggctgtggag

SEQ ID NO: 393360 - DNA, 20 bp, Homo sapiens
ttgcctggctgtggaggcct

SEQ ID NO: 393361 - DNA, 12 bp, Homo sapiens
ttgcctgtgcca

SEQ ID NO: 393362 - DNA, 19 bp, Homo sapiens
ttgccttcttcacccagct

SEQ ID NO: 393363 - DNA, 13 bp, Homo sapiens
ttgccttgcattt

SEQ ID NO: 393364 - DNA, 20 bp, Homo sapiens
ttgccttgggctgctcctca

SEQ ID NO: 393365 - DNA, 18 bp, Homo sapiens
ttgcctttaggcaggaag

SEQ ID NO: 393366 - DNA, 19 bp, Homo sapiens
ttgcgacggagagaaaaaa

SEQ ID NO: 393367 - DNA, 22 bp, Homo sapiens
ttgcgacggagagaaaaaagaa

SEQ ID NO: 393368 - DNA, 14 bp, Homo sapiens
ttgcgtatgtctgt

SEQ ID NO: 393369 - DNA, 18 bp, Homo sapiens
ttgcgtatgtctgttacc

SEQ ID NO: 393370 - DNA, 17 bp, Homo sapiens
ttgcgtggatcaagctt

SEQ ID NO: 393371 - DNA, 16 bp, Homo sapiens
ttgcgttacacccttt

SEQ ID NO: 393372 - DNA, 22 bp, Homo sapiens
ttgctaagataattaaatgaaa

SEQ ID NO: 393373 - DNA, 20 bp, Homo sapiens
ttgctaataaagatgtctgc

SEQ ID NO: 393374 - DNA, 15 bp, Homo sapiens
ttgctaattttctca

SEQ ID NO: 393375 - DNA, 23 bp, Homo sapiens
ttgctaattttctcaaaagcatt

SEQ ID NO: 393376 - DNA, 20 bp, Homo sapiens
ttgctagacaaggttgctgt

SEQ ID NO: 393377 - DNA, 19 bp, Homo sapiens
ttgctagcaacaacttact

SEQ ID NO: 393378 - DNA, 20 bp, Homo sapiens
ttgctagcaacaacttacta

SEQ ID NO: 393379 - DNA, 13 bp, Homo sapiens
ttgctagccctgg

SEQ ID NO: 393380 - DNA, 20 bp, Homo sapiens
ttgctagtgatacactgtat

SEQ ID NO: 393381 - DNA, 23 bp, Homo sapiens
ttgctagtgatacactgtatcta

SEQ ID NO: 393382 - DNA, 18 bp, Homo sapiens
ttgctcaaaaaatgagct

SEQ ID NO: 393383 - DNA, 19 bp, Homo sapiens
ttgctcaataaaggtcata

SEQ ID NO: 393384 - DNA, 16 bp, Homo sapiens
ttgctcagtgcctcct

SEQ ID NO: 393385 - DNA, 21 bp, Homo sapiens
ttgctcagtgcctcctggccg

SEQ ID NO: 393386 - DNA, 14 bp, Homo sapiens
ttgctccagggtct

SEQ ID NO: 393387 - DNA, 22 bp, Homo sapiens
ttgctccagtaaaatcttgcct

SEQ ID NO: 393388 - DNA, 14 bp, Homo sapiens
ttgctcccaaccca

SEQ ID NO: 393389 - DNA, 12 bp, Homo sapiens
ttgctcccagtg

SEQ ID NO: 393390 - DNA, 19 bp, Homo sapiens
ttgctcctacccctgtcct

SEQ ID NO: 393391 - DNA, 19 bp, Homo sapiens
ttgctcctgcatgcaacta

SEQ ID NO: 393392 - DNA, 22 bp, Homo sapiens
ttgctcctgtttaactccctag

SEQ ID NO: 393393 - DNA, 16 bp, Homo sapiens
ttgctctccctcttct

SEQ ID NO: 393394 - DNA, 23 bp, Homo sapiens
ttgctctccctcttctcaagtgc

SEQ ID NO: 393395 - DNA, 20 bp, Homo sapiens
ttgctctctggccttttcct

SEQ ID NO: 393396 - DNA, 20 bp, Homo sapiens
ttgctctgttacccaggctg

SEQ ID NO: 393397 - DNA, 16 bp, Homo sapiens
ttgctctttctactct

SEQ ID NO: 393398 - DNA, 19 bp, Homo sapiens
ttgctgaataacaacaatt

SEQ ID NO: 393399 - DNA, 14 bp, Homo sapiens
ttgctgagcaccct

SEQ ID NO: 393400 - DNA, 20 bp, Homo sapiens
ttgctgagcaccctctccgg

SEQ ID NO: 393401 - DNA, 20 bp, Homo sapiens
ttgctgatggcttgacatgt

SEQ ID NO: 393402 - DNA, 20 bp, Homo sapiens
ttgctgctaccgccctgggc

SEQ ID NO: 393403 - DNA, 21 bp, Homo sapiens
ttgctgctaccgccctgggct

SEQ ID NO: 393404 - DNA, 16 bp, Homo sapiens
ttgctgctatgaaaat

SEQ ID NO: 393405 - DNA, 18 bp, Homo sapiens
ttgctggagtgctggctc

SEQ ID NO: 393406 - DNA, 20 bp, Homo sapiens
ttgctggggccgaaagaaca

SEQ ID NO: 393407 - DNA, 15 bp, Homo sapiens
ttgctggtcactgcc

SEQ ID NO: 393408 - DNA, 12 bp, Homo sapiens
ttgctgtagaga

SEQ ID NO: 393409 - DNA, 22 bp, Homo sapiens
ttgctgtcatgtgaatccctca

SEQ ID NO: 393410 - DNA, 16 bp, Homo sapiens
ttgctgtcccttttcc

SEQ ID NO: 393411 - DNA, 15 bp, Homo sapiens
ttgctgtctggcttt

SEQ ID NO: 393412 - DNA, 18 bp, Homo sapiens
ttgctgtctggctttccc

SEQ ID NO: 393413 - DNA, 14 bp, Homo sapiens
ttgctgtgaggctg

SEQ ID NO: 393414 - DNA, 17 bp, Homo sapiens
ttgctgtgaggctgtcc

SEQ ID NO: 393415 - DNA, 11 bp, Homo sapiens
ttgctgtgcca

SEQ ID NO: 393416 - DNA, 16 bp, Homo sapiens
ttgctgtgccaggagg

SEQ ID NO: 393417 - DNA, 12 bp, Homo sapiens
ttgctgttgacg

SEQ ID NO: 393418 - DNA, 22 bp, Homo sapiens
ttgctgttgttcagaagttgtt

SEQ ID NO: 393419 - DNA, 16 bp, Homo sapiens
ttgctgttttgttctg

SEQ ID NO: 393420 - DNA, 21 bp, Homo sapiens
ttgctgttttgttctgtggtt

SEQ ID NO: 393421 - DNA, 14 bp, Homo sapiens
ttgcttaaaagaca

SEQ ID NO: 393422 - DNA, 13 bp, Homo sapiens
ttgcttacatttt

SEQ ID NO: 393423 - DNA, 15 bp, Homo sapiens
ttgcttattcttgag

SEQ ID NO: 393424 - DNA, 16 bp, Homo sapiens
ttgcttatttatattc

SEQ ID NO: 393425 - DNA, 15 bp, Homo sapiens
gttaagaatgtcgat

SEQ ID NO: 393426 - DNA, 17 bp, Homo sapiens
gttaagacaacaggcat

SEQ ID NO: 393427 - DNA, 19 bp, Homo sapiens
gttaagatactcaagcagg

SEQ ID NO: 393428 - DNA, 12 bp, Homo sapiens
gttaagccatat

SEQ ID NO: 393429 - DNA, 19 bp, Homo sapiens
gttaagccccctcctcacc

SEQ ID NO: 393430 - DNA, 19 bp, Homo sapiens
gttaaggggatctaaaagg

SEQ ID NO: 393431 - DNA, 16 bp, Homo sapiens
gttaataaaggtttcg

SEQ ID NO: 393432 - DNA, 23 bp, Homo sapiens
gttaatattaatttatatttgtc

SEQ ID NO: 393433 - DNA, 18 bp, Homo sapiens
gttaatattggaagtgaa

SEQ ID NO: 393434 - DNA, 19 bp, Homo sapiens
gttaatcacttaacctgct

SEQ ID NO: 393435 - DNA, 12 bp, Homo sapiens
gttaatcatctt

SEQ ID NO: 393436 - DNA, 17 bp, Homo sapiens
gttaatcatcttctctt

SEQ ID NO: 393437 - DNA, 17 bp, Homo sapiens
gttaatgaaaatgtcag

SEQ ID NO: 393438 - DNA, 23 bp, Homo sapiens
gttaatgatggttgatgggttct

SEQ ID NO: 393439 - DNA, 21 bp, Homo sapiens
gttaattcagcactgatttca

SEQ ID NO: 393440 - DNA, 13 bp, Homo sapiens
gttaattgattaa

SEQ ID NO: 393441 - DNA, 17 bp, Homo sapiens
gttaatttaaagctgtt

SEQ ID NO: 393442 - DNA, 14 bp, Homo sapiens
gttaatttttccta

SEQ ID NO: 393443 - DNA, 13 bp, Homo sapiens
gttacaaactgca

SEQ ID NO: 393444 - DNA, 23 bp, Homo sapiens
gttacaaactgcaatagagactg

SEQ ID NO: 393445 - DNA, 11 bp, Homo sapiens
gttacacatac

SEQ ID NO: 393446 - DNA, 12 bp, Homo sapiens
gttacacccttt

SEQ ID NO: 393447 - DNA, 22 bp, Homo sapiens
gttacactgttattttcagcat

SEQ ID NO: 393448 - DNA, 13 bp, Homo sapiens
gttacagacaaag

SEQ ID NO: 393449 - DNA, 15 bp, Homo sapiens
gttacagacaaagcg

SEQ ID NO: 393450 - DNA, 22 bp, Homo sapiens
gttacaggcaccgagaatgttg

SEQ ID NO: 393451 - DNA, 18 bp, Homo sapiens
gttacatcctgctacact

SEQ ID NO: 393452 - DNA, 20 bp, Homo sapiens
gttacccaggctggagtgca

SEQ ID NO: 393453 - DNA, 16 bp, Homo sapiens
gttaccgagtatctgt

SEQ ID NO: 393454 - DNA, 21 bp, Homo sapiens
gttactaagatgaaattgcca

SEQ ID NO: 393455 - DNA, 13 bp, Homo sapiens
gttactgaggacc

SEQ ID NO: 393456 - DNA, 20 bp, Homo sapiens
ttgggtcccagctaaagagg

SEQ ID NO: 393457 - DNA, 22 bp, Homo sapiens
ttgggtggtttgtgagccttgc

SEQ ID NO: 393458 - DNA, 15 bp, Homo sapiens
ttgggtgtgccctgg

SEQ ID NO: 393459 - DNA, 16 bp, Homo sapiens
ttgggttaagtatgag

SEQ ID NO: 393460 - DNA, 19 bp, Homo sapiens
ttgggttagcaatatttat

SEQ ID NO: 393461 - DNA, 20 bp, Homo sapiens
ttgggttaggagaagtcaag

SEQ ID NO: 393462 - DNA, 17 bp, Homo sapiens
ttgggttccaaccaggc

SEQ ID NO: 393463 - DNA, 20 bp, Homo sapiens
ttgggttccaaccaggcagt

SEQ ID NO: 393464 - DNA, 12 bp, Homo sapiens
ttgggttccaga

SEQ ID NO: 393465 - DNA, 14 bp, Homo sapiens
ttgggttccagaca

SEQ ID NO: 393466 - DNA, 15 bp, Homo sapiens
ttgggttccagacag

SEQ ID NO: 393467 - DNA, 19 bp, Homo sapiens
ttggtaatgatgattcaat

SEQ ID NO: 393468 - DNA, 22 bp, Homo sapiens
ttggtactactagatgtcttta

SEQ ID NO: 393469 - DNA, 22 bp, Homo sapiens
ttggtagttctgtgcctccccc

SEQ ID NO: 393470 - DNA, 21 bp, Homo sapiens
ttggtattatataattcaagg

SEQ ID NO: 393471 - DNA, 23 bp, Homo sapiens
ttggtcacaagtaggagacacag

SEQ ID NO: 393472 - DNA, 13 bp, Homo sapiens
ttggtcagaggag

SEQ ID NO: 393473 - DNA, 22 bp, Homo sapiens
ttggtcattcctaatgcattag

SEQ ID NO: 393474 - DNA, 15 bp, Homo sapiens
ttggtccctggtccc

SEQ ID NO: 393475 - DNA, 19 bp, Homo sapiens
ttggtctccatttttccca

SEQ ID NO: 393476 - DNA, 18 bp, Homo sapiens
ttggtcttactttgtgca

SEQ ID NO: 393477 - DNA, 17 bp, Homo sapiens
ttggtcttagctttaca

SEQ ID NO: 393478 - DNA, 18 bp, Homo sapiens
ttggtcttagctttacat

SEQ ID NO: 393479 - DNA, 17 bp, Homo sapiens
ttggtctttctaatgta

SEQ ID NO: 393480 - DNA, 12 bp, Homo sapiens
ttggtgaataac

SEQ ID NO: 393481 - DNA, 14 bp, Homo sapiens
ttggtgaataacct

SEQ ID NO: 393482 - DNA, 17 bp, Homo sapiens
ttggtgaggaggaggca

SEQ ID NO: 393483 - DNA, 21 bp, Homo sapiens
ttggtgatgtaaaacagaata

SEQ ID NO: 393484 - DNA, 19 bp, Homo sapiens
ttggtgcaattaactctgg

SEQ ID NO: 393485 - DNA, 13 bp, Homo sapiens
ttggtgctgcttt

SEQ ID NO: 393486 - DNA, 18 bp, Homo sapiens
ttggtggcctaatttaca

SEQ ID NO: 393487 - DNA, 20 bp, Homo sapiens
ttggtggcctaatttacaag

SEQ ID NO: 393488 - DNA, 21 bp, Homo sapiens
ttggtgggtctatgttcccca

SEQ ID NO: 393489 - DNA, 21 bp, Homo sapiens
ttggtggtgcagccccaggac

SEQ ID NO: 393490 - DNA, 12 bp, Homo sapiens
ttggtgtactgg

SEQ ID NO: 393491 - DNA, 17 bp, Homo sapiens
ttggtgtatatcatgaa

SEQ ID NO: 393492 - DNA, 18 bp, Homo sapiens
ttggttcatcagtgttaa

SEQ ID NO: 393493 - DNA, 15 bp, Homo sapiens
ttggttcctcatggc

SEQ ID NO: 393494 - DNA, 13 bp, Homo sapiens
ttggttctggggc

SEQ ID NO: 393495 - DNA, 14 bp, Homo sapiens
ttggttctggggcc

SEQ ID NO: 393496 - DNA, 17 bp, Homo sapiens
ttggttgggggctcctg

SEQ ID NO: 393497 - DNA, 15 bp, Homo sapiens
ttggtttttctcttt

SEQ ID NO: 393498 - DNA, 12 bp, Homo sapiens
ttgtaaaaaagg

SEQ ID NO: 393499 - DNA, 21 bp, Homo sapiens
ttgtaaaacctgtcaatgata

SEQ ID NO: 393500 - DNA, 19 bp, Homo sapiens
ttgtaaaactgtgacattc

SEQ ID NO: 393501 - DNA, 15 bp, Homo sapiens
ttgtaaaatagcttg

SEQ ID NO: 393502 - DNA, 22 bp, Homo sapiens
ttgtaaacaaactgtgtaactg

SEQ ID NO: 393503 - DNA, 14 bp, Homo sapiens
ttgtaaacatgtgt

SEQ ID NO: 393504 - DNA, 15 bp, Homo sapiens
ttgtaaacatgtgtt

SEQ ID NO: 393505 - DNA, 22 bp, Homo sapiens
ttgtaaactgtatcaaatctgt

SEQ ID NO: 393506 - DNA, 21 bp, Homo sapiens
ttgtaaactttttcaatggtt

SEQ ID NO: 393507 - DNA, 13 bp, Homo sapiens
ttgtaaataagag

SEQ ID NO: 393508 - DNA, 11 bp, Homo sapiens
ttgtaaatatt

SEQ ID NO: 393509 - DNA, 23 bp, Homo sapiens
ttgtaaatattaaaccataagat

SEQ ID NO: 393510 - DNA, 20 bp, Homo sapiens
ttgtaacaactaattataat

SEQ ID NO: 393511 - DNA, 16 bp, Homo sapiens
ttgtaacaagaaaaca

SEQ ID NO: 393512 - DNA, 20 bp, Homo sapiens
ttgtaacctcagctctggga

SEQ ID NO: 393513 - DNA, 12 bp, Homo sapiens
ttgtaactaaag

SEQ ID NO: 393514 - DNA, 15 bp, Homo sapiens
ttgtaactttgcatg

SEQ ID NO: 393515 - DNA, 17 bp, Homo sapiens
ttgtaactttgcatgtt

SEQ ID NO: 393516 - DNA, 18 bp, Homo sapiens
ttgtaagacacacagcct

SEQ ID NO: 393517 - DNA, 20 bp, Homo sapiens
ttgtaagacacacagccttt

SEQ ID NO: 393518 - DNA, 14 bp, Homo sapiens
ttgtaaggaatgat

SEQ ID NO: 393519 - DNA, 13 bp, Homo sapiens
ttgtaaggacttg

SEQ ID NO: 393520 - DNA, 16 bp, Homo sapiens
ttgtaaggacttgtgc

SEQ ID NO: 393521 - DNA, 22 bp, Homo sapiens
ttgtaaggatataaaaagtaca

SEQ ID NO: 393522 - DNA, 14 bp, Homo sapiens
ttgtaaggtactga

SEQ ID NO: 393523 - DNA, 21 bp, Homo sapiens
ttgtaagtgagagagacaaga

SEQ ID NO: 393524 - DNA, 14 bp, Homo sapiens
ttgtaagtttatgt

SEQ ID NO: 393525 - DNA, 12 bp, Homo sapiens
ttgtaatatttc

SEQ ID NO: 393526 - DNA, 22 bp, Homo sapiens
ttgtaatatttcttcaagtgag

SEQ ID NO: 393527 - DNA, 15 bp, Homo sapiens
ttgtaatgtatctta

SEQ ID NO: 393528 - DNA, 15 bp, Homo sapiens
ttgtaatgttactga

SEQ ID NO: 393529 - DNA, 14 bp, Homo sapiens
ttgtaattctaaat

SEQ ID NO: 393530 - DNA, 17 bp, Homo sapiens
ttgtaattctaaatgaa

SEQ ID NO: 393531 - DNA, 18 bp, Homo sapiens
ttgtaattgcttacattt

SEQ ID NO: 393532 - DNA, 18 bp, Homo sapiens
ttgtacaaagtaaaaata

SEQ ID NO: 393533 - DNA, 16 bp, Homo sapiens
ttgtacagctgtttaa

SEQ ID NO: 393534 - DNA, 18 bp, Homo sapiens
ttgtacagtgtctgtgcc

SEQ ID NO: 393535 - DNA, 11 bp, Homo sapiens
ttgtacagttc

SEQ ID NO: 393536 - DNA, 13 bp, Homo sapiens
ttgtaccactgct

SEQ ID NO: 393537 - DNA, 23 bp, Homo sapiens
ttgtaccactgctaataaatgac

SEQ ID NO: 393538 - DNA, 11 bp, Homo sapiens
ttgtacctctc

SEQ ID NO: 393539 - DNA, 22 bp, Homo sapiens
ttgtaccttattgatctttgcc

SEQ ID NO: 393540 - DNA, 21 bp, Homo sapiens
ttgtacgtaaagcttaaattg

SEQ ID NO: 393541 - DNA, 14 bp, Homo sapiens
ttgtactccagcct

SEQ ID NO: 393542 - DNA, 16 bp, Homo sapiens
ttgtactccagcctgg

SEQ ID NO: 393543 - DNA, 17 bp, Homo sapiens
ttgtactccagcctggg

SEQ ID NO: 393544 - DNA, 18 bp, Homo sapiens
ttgtacttgttcttttct

SEQ ID NO: 393545 - DNA, 12 bp, Homo sapiens
ttgtagaaacac

SEQ ID NO: 393546 - DNA, 22 bp, Homo sapiens
ttgtagaaacacagttttgaaa

SEQ ID NO: 393547 - DNA, 20 bp, Homo sapiens
ttgtagatacaatcagctgc

SEQ ID NO: 393548 - DNA, 18 bp, Homo sapiens
ttgtagatgtattttcaa

SEQ ID NO: 393549 - DNA, 14 bp, Homo sapiens
ttgtagctagaata

SEQ ID NO: 393550 - DNA, 20 bp, Homo sapiens
ttgtagctagtttaaaatta

SEQ ID NO: 393551 - DNA, 23 bp, Homo sapiens
ttgtaggaaaagctgttcccatg

SEQ ID NO: 393552 - DNA, 20 bp, Homo sapiens
ttgtaggaatctgccttcca

SEQ ID NO: 393553 - DNA, 15 bp, Homo sapiens
ttgtagggtgaggcg

SEQ ID NO: 393554 - DNA, 13 bp, Homo sapiens
ttgtagggtttct

SEQ ID NO: 393555 - DNA, 14 bp, Homo sapiens
ttgtagggtttcta

SEQ ID NO: 393556 - DNA, 20 bp, Homo sapiens
gttctggaaaagaactgttt

SEQ ID NO: 393557 - DNA, 17 bp, Homo sapiens
gttctggacctccccct

SEQ ID NO: 393558 - DNA, 16 bp, Homo sapiens
gttctggactctgccc

SEQ ID NO: 393559 - DNA, 21 bp, Homo sapiens
gttctggctttacattttatt

SEQ ID NO: 393560 - DNA, 14 bp, Homo sapiens
gttctggggcccct

SEQ ID NO: 393561 - DNA, 23 bp, Homo sapiens
gttctggtatgaacttgaggaca

SEQ ID NO: 393562 - DNA, 17 bp, Homo sapiens
gttctggttagctcagc

SEQ ID NO: 393563 - DNA, 21 bp, Homo sapiens
gttctgtaaaatggaaaactt

SEQ ID NO: 393564 - DNA, 21 bp, Homo sapiens
gttctgtaatggaactgaccc

SEQ ID NO: 393565 - DNA, 19 bp, Homo sapiens
gttctgtaggagagactgg

SEQ ID NO: 393566 - DNA, 19 bp, Homo sapiens
gttctgtattgcagctaag

SEQ ID NO: 393567 - DNA, 20 bp, Homo sapiens
gttctgtgcctccccccaga

SEQ ID NO: 393568 - DNA, 19 bp, Homo sapiens
gttctgtgggcttggcctt

SEQ ID NO: 393569 - DNA, 11 bp, Homo sapiens
gttctgtgtct

SEQ ID NO: 393570 - DNA, 16 bp, Homo sapiens
gttctgtgtctgctgt

SEQ ID NO: 393571 - DNA, 15 bp, Homo sapiens
gttctgtgtctgtgt

SEQ ID NO: 393572 - DNA, 14 bp, Homo sapiens
gttcttaaaagcat

SEQ ID NO: 393573 - DNA, 14 bp, Homo sapiens
gttcttactgcttg

SEQ ID NO: 393574 - DNA, 14 bp, Homo sapiens
gttcttcacctcta

SEQ ID NO: 393575 - DNA, 17 bp, Homo sapiens
gttcttcaggagatgat

SEQ ID NO: 393576 - DNA, 13 bp, Homo sapiens
gttcttcccctcc

SEQ ID NO: 393577 - DNA, 16 bp, Homo sapiens
gttcttcctcttacct

SEQ ID NO: 393578 - DNA, 22 bp, Homo sapiens
gttcttcgggaagagaggagtt

SEQ ID NO: 393579 - DNA, 17 bp, Homo sapiens
gttcttgtaaaactgtg

SEQ ID NO: 393580 - DNA, 18 bp, Homo sapiens
gttcttgtaaaactgtga

SEQ ID NO: 393581 - DNA, 14 bp, Homo sapiens
gttcttgttctgtt

SEQ ID NO: 393582 - DNA, 16 bp, Homo sapiens
gttcttgttctgtttt

SEQ ID NO: 393583 - DNA, 16 bp, Homo sapiens
gttcttgttttgttat

SEQ ID NO: 393584 - DNA, 18 bp, Homo sapiens
gttctttcacccttttct

SEQ ID NO: 393585 - DNA, 15 bp, Homo sapiens
gttctttcttcctct

SEQ ID NO: 393586 - DNA, 17 bp, Homo sapiens
gttctttcttcctctgc

SEQ ID NO: 393587 - DNA, 19 bp, Homo sapiens
gttctttcttcctctgctg

SEQ ID NO: 393588 - DNA, 16 bp, Homo sapiens
gttctttgcaagctta

SEQ ID NO: 393589 - DNA, 22 bp, Homo sapiens
gttctttgctgcccctgtctgg

SEQ ID NO: 393590 - DNA, 16 bp, Homo sapiens
gttctttgttcctgct

SEQ ID NO: 393591 - DNA, 14 bp, Homo sapiens
gttcttttctggaa

SEQ ID NO: 393592 - DNA, 15 bp, Homo sapiens
gttcttttgatacat

SEQ ID NO: 393593 - DNA, 18 bp, Homo sapiens
gttcttttgatacattta

SEQ ID NO: 393594 - DNA, 22 bp, Homo sapiens
gttctttttaaaaagttgcaca

SEQ ID NO: 393595 - DNA, 13 bp, Homo sapiens
gttgaaaaaagaa

SEQ ID NO: 393596 - DNA, 22 bp, Homo sapiens
gttgaaaatgagcctgtaatcc

SEQ ID NO: 393597 - DNA, 19 bp, Homo sapiens
gttgaaaattattttaaac

SEQ ID NO: 393598 - DNA, 22 bp, Homo sapiens
gttgaaaattcaaaaagtgttt

SEQ ID NO: 393599 - DNA, 20 bp, Homo sapiens
gttgaaattatgtatgttta

SEQ ID NO: 393600 - DNA, 16 bp, Homo sapiens
gttgacaccaagaaac

SEQ ID NO: 393601 - DNA, 21 bp, Homo sapiens
gttgacttattttctctgtgt

SEQ ID NO: 393602 - DNA, 13 bp, Homo sapiens
acccacccctgcc

SEQ ID NO: 393603 - DNA, 15 bp, Homo sapiens
acccacccctgccca

SEQ ID NO: 393604 - DNA, 16 bp, Homo sapiens
acccaccctctggtcc

SEQ ID NO: 393605 - DNA, 21 bp, Homo sapiens
acccaccgatggagcccccag

SEQ ID NO: 393606 - DNA, 15 bp, Homo sapiens
acccacctcagcctc

SEQ ID NO: 393607 - DNA, 13 bp, Homo sapiens
acccacggctctc

SEQ ID NO: 393608 - DNA, 21 bp, Homo sapiens
acccacgtgagagaatctgcc

SEQ ID NO: 393609 - DNA, 22 bp, Homo sapiens
acccacgtgagagaatctgcct

SEQ ID NO: 393610 - DNA, 21 bp, Homo sapiens
acccactagccctctttctct

SEQ ID NO: 393611 - DNA, 24 bp, Homo sapiens
acccactagccctctttctctctg

SEQ ID NO: 393612 - DNA, 12 bp, Homo sapiens
acccactcagga

SEQ ID NO: 393613 - DNA, 15 bp, Homo sapiens
acccactcaggattg

SEQ ID NO: 393614 - DNA, 12 bp, Homo sapiens
acccagaaggaa

SEQ ID NO: 393615 - DNA, 15 bp, Homo sapiens
acccagaaggaaccc

SEQ ID NO: 393616 - DNA, 23 bp, Homo sapiens
acccagaaggaacccggtcccag

SEQ ID NO: 393617 - DNA, 19 bp, Homo sapiens
acccagaatgtagcatctg

SEQ ID NO: 393618 - DNA, 14 bp, Homo sapiens
acccagagaatata

SEQ ID NO: 393619 - DNA, 14 bp, Homo sapiens
acccagaggaggca

SEQ ID NO: 393620 - DNA, 15 bp, Homo sapiens
acccagatgatctct

SEQ ID NO: 393621 - DNA, 17 bp, Homo sapiens
acccagcaactccaact

SEQ ID NO: 393622 - DNA, 21 bp, Homo sapiens
acccagcaaggcacaggctcc

SEQ ID NO: 393623 - DNA, 13 bp, Homo sapiens
acccagccacctt

SEQ ID NO: 393624 - DNA, 18 bp, Homo sapiens
acccagccaccttcctga

SEQ ID NO: 393625 - DNA, 14 bp, Homo sapiens
acccagcccatctt

SEQ ID NO: 393626 - DNA, 10 bp, Homo sapiens
acccagcccc

SEQ ID NO: 393627 - DNA, 20 bp, Homo sapiens
acccagccccttgagaaacc

SEQ ID NO: 393628 - DNA, 21 bp, Homo sapiens
acccagccccttgagaaacct

SEQ ID NO: 393629 - DNA, 17 bp, Homo sapiens
acccagctactctgtcc

SEQ ID NO: 393630 - DNA, 19 bp, Homo sapiens
acccagctactctgtccag

SEQ ID NO: 393631 - DNA, 22 bp, Homo sapiens
acccagctactctgtccaggcc

SEQ ID NO: 393632 - DNA, 21 bp, Homo sapiens
acccagctccaggggcccttg

SEQ ID NO: 393633 - DNA, 11 bp, Homo sapiens
acccagctcct

SEQ ID NO: 393634 - DNA, 22 bp, Homo sapiens
acccagctccttttgtccccag

SEQ ID NO: 393635 - DNA, 11 bp, Homo sapiens
acccaggaagg

SEQ ID NO: 393636 - DNA, 17 bp, Homo sapiens
acccaggagtgtggcca

SEQ ID NO: 393637 - DNA, 15 bp, Homo sapiens
acccaggctgcactg

SEQ ID NO: 393638 - DNA, 19 bp, Homo sapiens
acccaggctggagtgcagt

SEQ ID NO: 393639 - DNA, 20 bp, Homo sapiens
acccaggctggagtgcagtg

SEQ ID NO: 393640 - DNA, 21 bp, Homo sapiens
acccagggctccctcctggag

SEQ ID NO: 393641 - DNA, 22 bp, Homo sapiens
acccagggctccctcctggagc

SEQ ID NO: 393642 - DNA, 16 bp, Homo sapiens
acccagtctgttcccc

SEQ ID NO: 393643 - DNA, 23 bp, Homo sapiens
acccagtgctgccatgccactgc

SEQ ID NO: 393644 - DNA, 22 bp, Homo sapiens
acccagtggcataccgtttggt

SEQ ID NO: 393645 - DNA, 19 bp, Homo sapiens
acccatcggtgtccattta

SEQ ID NO: 393646 - DNA, 14 bp, Homo sapiens
acccatctgtaata

SEQ ID NO: 393647 - DNA, 16 bp, Homo sapiens
acccatcttccccgga

SEQ ID NO: 393648 - DNA, 19 bp, Homo sapiens
acccatcttcctgctgctg

SEQ ID NO: 393649 - DNA, 12 bp, Homo sapiens
acccatgagcct

SEQ ID NO: 393650 - DNA, 15 bp, Homo sapiens
acccatgcatggcct

SEQ ID NO: 393651 - DNA, 15 bp, Homo sapiens
acccatgttgggaaa

SEQ ID NO: 393652 - DNA, 15 bp, Homo sapiens
acccattgtctcatt

SEQ ID NO: 393653 - DNA, 16 bp, Homo sapiens
acccattgtctcattg

SEQ ID NO: 393654 - DNA, 17 bp, Homo sapiens
accccaaaccccagccc

SEQ ID NO: 393655 - DNA, 14 bp, Homo sapiens
accccaactcccag

SEQ ID NO: 393656 - DNA, 15 bp, Homo sapiens
accccaactctcccc

SEQ ID NO: 393657 - DNA, 16 bp, Homo sapiens
accccaactctcccca

SEQ ID NO: 393658 - DNA, 20 bp, Homo sapiens
accccaactctccccagtgc

SEQ ID NO: 393659 - DNA, 16 bp, Homo sapiens
accccacaccccagcc

SEQ ID NO: 393660 - DNA, 19 bp, Homo sapiens
accccacaccccagcccac

SEQ ID NO: 393661 - DNA, 19 bp, Homo sapiens
accccacacgccggggctg

SEQ ID NO: 393662 - DNA, 22 bp, Homo sapiens
accccacacgccggggctggcc

SEQ ID NO: 393663 - DNA, 11 bp, Homo sapiens
accccacagat

SEQ ID NO: 393664 - DNA, 13 bp, Homo sapiens
accccaccacaca

SEQ ID NO: 393665 - DNA, 16 bp, Homo sapiens
accccactcacagaga

SEQ ID NO: 393666 - DNA, 18 bp, Homo sapiens
accccactcacagagaca

SEQ ID NO: 393667 - DNA, 20 bp, Homo sapiens
accccacttatgctgctgtg

SEQ ID NO: 393668 - DNA, 18 bp, Homo sapiens
accccagagggaccagct

SEQ ID NO: 393669 - DNA, 19 bp, Homo sapiens
accccagagggaccagctg

SEQ ID NO: 393670 - DNA, 16 bp, Homo sapiens
accccagcattccagc

SEQ ID NO: 393671 - DNA, 14 bp, Homo sapiens
accccagcctgacc

SEQ ID NO: 393672 - DNA, 18 bp, Homo sapiens
accccagcctggccacgc

SEQ ID NO: 393673 - DNA, 10 bp, Homo sapiens
accccagctc

SEQ ID NO: 393674 - DNA, 20 bp, Homo sapiens
accccagcttttcttgccag

SEQ ID NO: 393675 - DNA, 21 bp, Homo sapiens
accccagcttttcttgccagc

SEQ ID NO: 393676 - DNA, 23 bp, Homo sapiens
accccagcttttcttgccagctc

SEQ ID NO: 393677 - DNA, 21 bp, Homo sapiens
accccaggccataccaggtgc

SEQ ID NO: 393678 - DNA, 15 bp, Homo sapiens
accccagtccccggg

SEQ ID NO: 393679 - DNA, 22 bp, Homo sapiens
accccagtccccgggaaaggcc

SEQ ID NO: 393680 - DNA, 18 bp, Homo sapiens
accccagtgcctgtctgg

SEQ ID NO: 393681 - DNA, 21 bp, Homo sapiens
accccagtgcctgtctggagc

SEQ ID NO: 393682 - DNA, 16 bp, Homo sapiens
accccagttcatctct

SEQ ID NO: 393683 - DNA, 20 bp, Homo sapiens
accccagttcatctctgctg

SEQ ID NO: 393684 - DNA, 15 bp, Homo sapiens
accccagttctaggg

SEQ ID NO: 393685 - DNA, 21 bp, Homo sapiens
accccatagtgaccggctgct

SEQ ID NO: 393686 - DNA, 14 bp, Homo sapiens
gtttctgtttgaat

SEQ ID NO: 393687 - DNA, 16 bp, Homo sapiens
gtttctgtttgaattt

SEQ ID NO: 393688 - DNA, 19 bp, Homo sapiens
gtttctgtttgaattttca

SEQ ID NO: 393689 - DNA, 19 bp, Homo sapiens
gtttctttctgtctctctc

SEQ ID NO: 393690 - DNA, 20 bp, Homo sapiens
gtttctttctgtctctctct

SEQ ID NO: 393691 - DNA, 22 bp, Homo sapiens
gtttgaaacactcgtgtgcatg

SEQ ID NO: 393692 - DNA, 16 bp, Homo sapiens
gtttgaaccaagaact

SEQ ID NO: 393693 - DNA, 13 bp, Homo sapiens
gtttgaaggctgc

SEQ ID NO: 393694 - DNA, 15 bp, Homo sapiens
gtttgaattttcaaa

SEQ ID NO: 393695 - DNA, 18 bp, Homo sapiens
gtttgagacaagccctgg

SEQ ID NO: 393696 - DNA, 16 bp, Homo sapiens
gtttgaggttaaaata

SEQ ID NO: 393697 - DNA, 19 bp, Homo sapiens
gtttgaggttaaaatataa

SEQ ID NO: 393698 - DNA, 17 bp, Homo sapiens
gtttgatagtgcttctt

SEQ ID NO: 393699 - DNA, 20 bp, Homo sapiens
gtttgatagtgcttcttgta

SEQ ID NO: 393700 - DNA, 17 bp, Homo sapiens
gtttgatcatagaattg

SEQ ID NO: 393701 - DNA, 14 bp, Homo sapiens
gtttgatccttgtt

SEQ ID NO: 393702 - DNA, 15 bp, Homo sapiens
gtttgatttcattaa

SEQ ID NO: 393703 - DNA, 15 bp, Homo sapiens
gtttgcacacttgtg

SEQ ID NO: 393704 - DNA, 22 bp, Homo sapiens
gtttgccttaattcttacctca

SEQ ID NO: 393705 - DNA, 13 bp, Homo sapiens
gtttgctaagtga

SEQ ID NO: 393706 - DNA, 18 bp, Homo sapiens
gtttgctcagaacacatt

SEQ ID NO: 393707 - DNA, 17 bp, Homo sapiens
gtttgctgtgccaggag

SEQ ID NO: 393708 - DNA, 14 bp, Homo sapiens
gtttgcttaaacaa

SEQ ID NO: 393709 - DNA, 16 bp, Homo sapiens
gtttgcttaaacaaag

SEQ ID NO: 393710 - DNA, 13 bp, Homo sapiens
gtttgcttattgt

SEQ ID NO: 393711 - DNA, 16 bp, Homo sapiens
gtttgcttattgttcc

SEQ ID NO: 393712 - DNA, 19 bp, Homo sapiens
gtttgcttctaaaggtttc

SEQ ID NO: 393713 - DNA, 15 bp, Homo sapiens
gtttggcaatagttt

SEQ ID NO: 393714 - DNA, 19 bp, Homo sapiens
gtttggcaatagtttgcat

SEQ ID NO: 393715 - DNA, 16 bp, Homo sapiens
gtttggcgggccaagg

SEQ ID NO: 393716 - DNA, 16 bp, Homo sapiens
gtttggctgtaattta

SEQ ID NO: 393717 - DNA, 21 bp, Homo sapiens
gtttgggagagaccattgcat

SEQ ID NO: 393718 - DNA, 18 bp, Homo sapiens
gtttgggcagtggagagg

SEQ ID NO: 393719 - DNA, 18 bp, Homo sapiens
gtttgggcccctcagagc

SEQ ID NO: 393720 - DNA, 15 bp, Homo sapiens
gtttggggagcagag

SEQ ID NO: 393721 - DNA, 17 bp, Homo sapiens
gtttggggcgaggcaga

SEQ ID NO: 393722 - DNA, 16 bp, Homo sapiens
gtttggtagttagcca

SEQ ID NO: 393723 - DNA, 13 bp, Homo sapiens
gtttgtaaaacta

SEQ ID NO: 393724 - DNA, 14 bp, Homo sapiens
gtttgtaatctgta

SEQ ID NO: 393725 - DNA, 15 bp, Homo sapiens
gtttgtatataaatg

SEQ ID NO: 393726 - DNA, 16 bp, Homo sapiens
gtttgtatataaatgg

SEQ ID NO: 393727 - DNA, 15 bp, Homo sapiens
gtttgtctgtcttca

SEQ ID NO: 393728 - DNA, 22 bp, Homo sapiens
gtttgtgagccttgctgccaag

SEQ ID NO: 393729 - DNA, 13 bp, Homo sapiens
gtttgtggctggg

SEQ ID NO: 393730 - DNA, 20 bp, Homo sapiens
gtttgtggctgggggcagga

SEQ ID NO: 393731 - DNA, 21 bp, Homo sapiens
gtttgtgtgtctatttggcaa

SEQ ID NO: 393732 - DNA, 20 bp, Homo sapiens
gtttgtgttctgtttgttaa

SEQ ID NO: 393733 - DNA, 13 bp, Homo sapiens
gtttgtttgctgc

SEQ ID NO: 393734 - DNA, 20 bp, Homo sapiens
gtttgtttgctgcttttgat

SEQ ID NO: 393735 - DNA, 15 bp, Homo sapiens
gtttgtttgttttgt

SEQ ID NO: 393736 - DNA, 17 bp, Homo sapiens
gtttgttttcaaaatac

SEQ ID NO: 393737 - DNA, 21 bp, Homo sapiens
gttttaaaataaaaattctga

SEQ ID NO: 393738 - DNA, 15 bp, Homo sapiens
gttttaaagaagtct

SEQ ID NO: 393739 - DNA, 15 bp, Homo sapiens
gttttaaatgtgttg

SEQ ID NO: 393740 - DNA, 21 bp, Homo sapiens
gttttaacctcaggttccaaa

SEQ ID NO: 393741 - DNA, 17 bp, Homo sapiens
gttttagtgccaggctg

SEQ ID NO: 393742 - DNA, 18 bp, Homo sapiens
gttttatataatgcatgt

SEQ ID NO: 393743 - DNA, 11 bp, Homo sapiens
gttttatcagt

SEQ ID NO: 393744 - DNA, 17 bp, Homo sapiens
gttttatgtcatactct

SEQ ID NO: 393745 - DNA, 20 bp, Homo sapiens
gttttattcaccatcatgta

SEQ ID NO: 393746 - DNA, 22 bp, Homo sapiens
gttttattgatgtgaaattaaa

SEQ ID NO: 393747 - DNA, 18 bp, Homo sapiens
gttttcaccatctttcta

SEQ ID NO: 393748 - DNA, 18 bp, Homo sapiens
accctggcagagaagaga

SEQ ID NO: 393749 - DNA, 21 bp, Homo sapiens
accctggcccgcccctcgctg

SEQ ID NO: 393750 - DNA, 15 bp, Homo sapiens
accctgggacccccc

SEQ ID NO: 393751 - DNA, 20 bp, Homo sapiens
accctgggatgggccaccca

SEQ ID NO: 393752 - DNA, 11 bp, Homo sapiens
accctggggac

SEQ ID NO: 393753 - DNA, 18 bp, Homo sapiens
accctggggcctggacct

SEQ ID NO: 393754 - DNA, 20 bp, Homo sapiens
accctgggtgccattcccag

SEQ ID NO: 393755 - DNA, 15 bp, Homo sapiens
accctgtaaaagaca

SEQ ID NO: 393756 - DNA, 21 bp, Homo sapiens
accctgtcaagttaacaagga

SEQ ID NO: 393757 - DNA, 22 bp, Homo sapiens
accctgtcaagttaacaaggaa

SEQ ID NO: 393758 - DNA, 22 bp, Homo sapiens
accctgttgagtatttgctgtt

SEQ ID NO: 393759 - DNA, 18 bp, Homo sapiens
acccttcacgctggcttc

SEQ ID NO: 393760 - DNA, 17 bp, Homo sapiens
acccttcagaccccagt

SEQ ID NO: 393761 - DNA, 14 bp, Homo sapiens
acccttcagggcca

SEQ ID NO: 393762 - DNA, 15 bp, Homo sapiens
acccttcagggccag

SEQ ID NO: 393763 - DNA, 16 bp, Homo sapiens
acccttcagggccaga

SEQ ID NO: 393764 - DNA, 17 bp, Homo sapiens
acccttcagggccagaa

SEQ ID NO: 393765 - DNA, 16 bp, Homo sapiens
acccttccccactccc

SEQ ID NO: 393766 - DNA, 13 bp, Homo sapiens
acccttctgcttt

SEQ ID NO: 393767 - DNA, 17 bp, Homo sapiens
acccttctgtgcccagc

SEQ ID NO: 393768 - DNA, 21 bp, Homo sapiens
acccttctgtgcccagctcag

SEQ ID NO: 393769 - DNA, 19 bp, Homo sapiens
acccttgaatttctagaca

SEQ ID NO: 393770 - DNA, 14 bp, Homo sapiens
acccttgcattaga

SEQ ID NO: 393771 - DNA, 16 bp, Homo sapiens
acccttgcattagaaa

SEQ ID NO: 393772 - DNA, 23 bp, Homo sapiens
acccttgccaaggccgcccacct

SEQ ID NO: 393773 - DNA, 15 bp, Homo sapiens
acccttggacttgag

SEQ ID NO: 393774 - DNA, 18 bp, Homo sapiens
acccttggcactgatggg

SEQ ID NO: 393775 - DNA, 13 bp, Homo sapiens
acccttggcctgt

SEQ ID NO: 393776 - DNA, 16 bp, Homo sapiens
acccttggcctgtcca

SEQ ID NO: 393777 - DNA, 14 bp, Homo sapiens
accctttcaccccc

SEQ ID NO: 393778 - DNA, 16 bp, Homo sapiens
accctttcacccccaa

SEQ ID NO: 393779 - DNA, 22 bp, Homo sapiens
accctttccaacccctttgctg

SEQ ID NO: 393780 - DNA, 23 bp, Homo sapiens
acccttttggcccccgagctggg

SEQ ID NO: 393781 - DNA, 19 bp, Homo sapiens
accgagcaaagatcaaaat

SEQ ID NO: 393782 - DNA, 14 bp, Homo sapiens
accgaggttcccag

SEQ ID NO: 393783 - DNA, 14 bp, Homo sapiens
accgagtgaaccta

SEQ ID NO: 393784 - DNA, 18 bp, Homo sapiens
accgagtgtggagctgct

SEQ ID NO: 393785 - DNA, 19 bp, Homo sapiens
accgagtgtggagctgctt

SEQ ID NO: 393786 - DNA, 22 bp, Homo sapiens
accgagtgtggagctgcttcca

SEQ ID NO: 393787 - DNA, 13 bp, Homo sapiens
accgatgctccag

SEQ ID NO: 393788 - DNA, 15 bp, Homo sapiens
accgatgctccagcc

SEQ ID NO: 393789 - DNA, 23 bp, Homo sapiens
accgatgctccagccaacccctg

SEQ ID NO: 393790 - DNA, 13 bp, Homo sapiens
accgatggagccc

SEQ ID NO: 393791 - DNA, 18 bp, Homo sapiens
accgatggtcccaggaag

SEQ ID NO: 393792 - DNA, 13 bp, Homo sapiens
accgcagcatgtg

SEQ ID NO: 393793 - DNA, 14 bp, Homo sapiens
accgcagcatgtgg

SEQ ID NO: 393794 - DNA, 16 bp, Homo sapiens
accgcagcctgtcagc

SEQ ID NO: 393795 - DNA, 13 bp, Homo sapiens
accgcatatgcat

SEQ ID NO: 393796 - DNA, 15 bp, Homo sapiens
accgcatatgcatgc

SEQ ID NO: 393797 - DNA, 21 bp, Homo sapiens
accgcatatgcatgccaggct

SEQ ID NO: 393798 - DNA, 13 bp, Homo sapiens
accgcatcctcca

SEQ ID NO: 393799 - DNA, 14 bp, Homo sapiens
accgcatcctccag

SEQ ID NO: 393800 - DNA, 18 bp, Homo sapiens
accgcatctgctcatctg

SEQ ID NO: 393801 - DNA, 24 bp, Homo sapiens
accgcatctgctcatctgatattc

SEQ ID NO: 393802 - DNA, 12 bp, Homo sapiens
accgccatgcaa

SEQ ID NO: 393803 - DNA, 23 bp, Homo sapiens
accgccatgcaactccatgccta

SEQ ID NO: 393804 - DNA, 17 bp, Homo sapiens
accgcccaacccccacc

SEQ ID NO: 393805 - DNA, 18 bp, Homo sapiens
accgcccaacccccacct

SEQ ID NO: 393806 - DNA, 14 bp, Homo sapiens
accgcccacccaca

SEQ ID NO: 393807 - DNA, 16 bp, Homo sapiens
accgcccacccacacc

SEQ ID NO: 393808 - DNA, 14 bp, Homo sapiens
accgcccagctctc

SEQ ID NO: 393809 - DNA, 17 bp, Homo sapiens
accgcccagctctccca

SEQ ID NO: 393810 - DNA, 19 bp, Homo sapiens
accgcccagctctcccaca

SEQ ID NO: 393811 - DNA, 12 bp, Homo sapiens
accgccctcctc

SEQ ID NO: 393812 - DNA, 13 bp, Homo sapiens
accgccctcctcg

SEQ ID NO: 393813 - DNA, 13 bp, Homo sapiens
accgccctgggct

SEQ ID NO: 393814 - DNA, 14 bp, Homo sapiens
accgccctgggctg

SEQ ID NO: 393815 - DNA, 17 bp, Homo sapiens
accgccctgggctggac

SEQ ID NO: 393816 - DNA, 14 bp, Homo sapiens
accgcctgcttcac

SEQ ID NO: 393817 - DNA, 18 bp, Homo sapiens
taaaatggtttgtcctga

SEQ ID NO: 393818 - DNA, 14 bp, Homo sapiens
taaaatgtaaaaac

SEQ ID NO: 393819 - DNA, 16 bp, Homo sapiens
taaaatgtagaagaaa

SEQ ID NO: 393820 - DNA, 19 bp, Homo sapiens
taaaatgtagaagaaagca

SEQ ID NO: 393821 - DNA, 20 bp, Homo sapiens
taaaatgtagaagaaagcaa

SEQ ID NO: 393822 - DNA, 18 bp, Homo sapiens
taaaatgtgatttttctg

SEQ ID NO: 393823 - DNA, 23 bp, Homo sapiens
taaaatgtgggattatgggtcac

SEQ ID NO: 393824 - DNA, 15 bp, Homo sapiens
taaaatgttcctttt

SEQ ID NO: 393825 - DNA, 22 bp, Homo sapiens
taaaattagtgagatttgtatt

SEQ ID NO: 393826 - DNA, 18 bp, Homo sapiens
taaaattatggtgaaatt

SEQ ID NO: 393827 - DNA, 13 bp, Homo sapiens
taaaattattaaa

SEQ ID NO: 393828 - DNA, 14 bp, Homo sapiens
taaaattattaaaa

SEQ ID NO: 393829 - DNA, 15 bp, Homo sapiens
taaaattattaaaaa

SEQ ID NO: 393830 - DNA, 20 bp, Homo sapiens
taaaattattaaaaattata

SEQ ID NO: 393831 - DNA, 13 bp, Homo sapiens
taaaattcaacaa

SEQ ID NO: 393832 - DNA, 23 bp, Homo sapiens
taaaattcaagaaaataaaacta

SEQ ID NO: 393833 - DNA, 15 bp, Homo sapiens
taaaattcaccccca

SEQ ID NO: 393834 - DNA, 14 bp, Homo sapiens
taaaattggcacca

SEQ ID NO: 393835 - DNA, 16 bp, Homo sapiens
taaaattgtaaaattg

SEQ ID NO: 393836 - DNA, 14 bp, Homo sapiens
taaaattgtatgaa

SEQ ID NO: 393837 - DNA, 23 bp, Homo sapiens
taaacaaaaactttccatgacag

SEQ ID NO: 393838 - DNA, 17 bp, Homo sapiens
taaacaaaaagaacaat

SEQ ID NO: 393839 - DNA, 22 bp, Homo sapiens
taaacaaactgtgtaactgccc

SEQ ID NO: 393840 - DNA, 13 bp, Homo sapiens
taaacaataaatg

SEQ ID NO: 393841 - DNA, 13 bp, Homo sapiens
taaacaatgttca

SEQ ID NO: 393842 - DNA, 13 bp, Homo sapiens
taaacacatagat

SEQ ID NO: 393843 - DNA, 16 bp, Homo sapiens
taaacacatagattca

SEQ ID NO: 393844 - DNA, 20 bp, Homo sapiens
taaacacatagattcacctg

SEQ ID NO: 393845 - DNA, 16 bp, Homo sapiens
taaacacatcaataaa

SEQ ID NO: 393846 - DNA, 18 bp, Homo sapiens
taaacacccttcacatac

SEQ ID NO: 393847 - DNA, 13 bp, Homo sapiens
taaacacctgaca

SEQ ID NO: 393848 - DNA, 22 bp, Homo sapiens
taaacactcagctgttcagatt

SEQ ID NO: 393849 - DNA, 16 bp, Homo sapiens
taaacactgtaatctt

SEQ ID NO: 393850 - DNA, 17 bp, Homo sapiens
taaacactgtaatctta

SEQ ID NO: 393851 - DNA, 20 bp, Homo sapiens
taaacactgtaatcttaaaa

SEQ ID NO: 393852 - DNA, 16 bp, Homo sapiens
taaacagatataaatg

SEQ ID NO: 393853 - DNA, 17 bp, Homo sapiens
taaacagatgtccctga

SEQ ID NO: 393854 - DNA, 19 bp, Homo sapiens
taaacagggcatctccagg

SEQ ID NO: 393855 - DNA, 14 bp, Homo sapiens
taaacatatgcaaa

SEQ ID NO: 393856 - DNA, 12 bp, Homo sapiens
taaacatgtgtt

SEQ ID NO: 393857 - DNA, 22 bp, Homo sapiens
taaacattaatcaatcatctgt

SEQ ID NO: 393858 - DNA, 23 bp, Homo sapiens
taaacattcctccagcctcccct

SEQ ID NO: 393859 - DNA, 21 bp, Homo sapiens
taaaccaaacggaactcttca

SEQ ID NO: 393860 - DNA, 22 bp, Homo sapiens
taaaccaccagtgcccaaagtc

SEQ ID NO: 393861 - DNA, 21 bp, Homo sapiens
taaaccaggtttagacagtat

SEQ ID NO: 393862 - DNA, 17 bp, Homo sapiens
taaacccctgggtaact

SEQ ID NO: 393863 - DNA, 19 bp, Homo sapiens
taaacctcaaaatgtctaa

SEQ ID NO: 393864 - DNA, 13 bp, Homo sapiens
taaacctgggcaa

SEQ ID NO: 393865 - DNA, 15 bp, Homo sapiens
taaacgaaacacaga

SEQ ID NO: 393866 - DNA, 13 bp, Homo sapiens
taaacgaaacatt

SEQ ID NO: 393867 - DNA, 16 bp, Homo sapiens
taaacgaaacatttag

SEQ ID NO: 393868 - DNA, 22 bp, Homo sapiens
taaacgtgatgatcagctgttt

SEQ ID NO: 393869 - DNA, 18 bp, Homo sapiens
taaactaaccttttatca

SEQ ID NO: 393870 - DNA, 12 bp, Homo sapiens
taaactagcaaa

SEQ ID NO: 393871 - DNA, 19 bp, Homo sapiens
taaactcaaaacttaacat

SEQ ID NO: 393872 - DNA, 15 bp, Homo sapiens
taaactcttcaaggc

SEQ ID NO: 393873 - DNA, 17 bp, Homo sapiens
taaactcttcaaggcca

SEQ ID NO: 393874 - DNA, 18 bp, Homo sapiens
taaactcttcaaggccaa

SEQ ID NO: 393875 - DNA, 22 bp, Homo sapiens
taaactgaaaactcccatttac

SEQ ID NO: 393876 - DNA, 13 bp, Homo sapiens
taaactgactttt

SEQ ID NO: 393877 - DNA, 21 bp, Homo sapiens
taaactgactttttcccccca

SEQ ID NO: 393878 - DNA, 15 bp, Homo sapiens
taaactgccctgtct

SEQ ID NO: 393879 - DNA, 21 bp, Homo sapiens
taaactggagaggctaacctc

SEQ ID NO: 393880 - DNA, 18 bp, Homo sapiens
taaactgtatgtcttata

SEQ ID NO: 393881 - DNA, 17 bp, Homo sapiens
taaactgtgagataaat

SEQ ID NO: 393882 - DNA, 12 bp, Homo sapiens
taaactgtgttt

SEQ ID NO: 393883 - DNA, 13 bp, Homo sapiens
taaactgtgttta

SEQ ID NO: 393884 - DNA, 14 bp, Homo sapiens
taaactgttttcat

SEQ ID NO: 393885 - DNA, 17 bp, Homo sapiens
taaactgttttcatgtg

SEQ ID NO: 393886 - DNA, 18 bp, Homo sapiens
taaactgttttcatgtgt

SEQ ID NO: 393887 - DNA, 20 bp, Homo sapiens
taaacttaactttaactgaa

SEQ ID NO: 393888 - DNA, 13 bp, Homo sapiens
taaacttcagcaa

SEQ ID NO: 393889 - DNA, 21 bp, Homo sapiens
taaacttgcaatgaaaagaaa

SEQ ID NO: 393890 - DNA, 19 bp, Homo sapiens
taaactttcagaactgcta

SEQ ID NO: 393891 - DNA, 19 bp, Homo sapiens
taaactttgtcacttctgc

SEQ ID NO: 393892 - DNA, 14 bp, Homo sapiens
taaactttttcaat

SEQ ID NO: 393893 - DNA, 17 bp, Homo sapiens
taaagaaaaaaaaggca

SEQ ID NO: 393894 - DNA, 11 bp, Homo sapiens
taaagaaaaac

SEQ ID NO: 393895 - DNA, 15 bp, Homo sapiens
tttacaacaaacact

SEQ ID NO: 393896 - DNA, 17 bp, Homo sapiens
tttacaacaaacactgt

SEQ ID NO: 393897 - DNA, 16 bp, Homo sapiens
tttacactctttgtaa

SEQ ID NO: 393898 - DNA, 20 bp, Homo sapiens
tttacagataaggaaactga

SEQ ID NO: 393899 - DNA, 15 bp, Homo sapiens
tttacagcactactc

SEQ ID NO: 393900 - DNA, 16 bp, Homo sapiens
tttacagcactactct

SEQ ID NO: 393901 - DNA, 15 bp, Homo sapiens
tttacagctgcctgc

SEQ ID NO: 393902 - DNA, 15 bp, Homo sapiens
tttacagtaaataaa

SEQ ID NO: 393903 - DNA, 20 bp, Homo sapiens
tttacagtaaataaattgtt

SEQ ID NO: 393904 - DNA, 15 bp, Homo sapiens
tttacatatctgttt

SEQ ID NO: 393905 - DNA, 18 bp, Homo sapiens
tttacatgaattgcattt

SEQ ID NO: 393906 - DNA, 20 bp, Homo sapiens
tttacatgcaatttattaaa

SEQ ID NO: 393907 - DNA, 14 bp, Homo sapiens
tttacatgtctcat

SEQ ID NO: 393908 - DNA, 18 bp, Homo sapiens
tttacattacaaatttct

SEQ ID NO: 393909 - DNA, 15 bp, Homo sapiens
tttacattgtaaata

SEQ ID NO: 393910 - DNA, 18 bp, Homo sapiens
tttacattttatttatta

SEQ ID NO: 393911 - DNA, 20 bp, Homo sapiens
tttaccatttgtaataaagt

SEQ ID NO: 393912 - DNA, 18 bp, Homo sapiens
tttacccaaaaactaaat

SEQ ID NO: 393913 - DNA, 15 bp, Homo sapiens
tttaccctcctctat

SEQ ID NO: 393914 - DNA, 15 bp, Homo sapiens
tttaccctttataga

SEQ ID NO: 393915 - DNA, 16 bp, Homo sapiens
tttaccctttatagaa

SEQ ID NO: 393916 - DNA, 18 bp, Homo sapiens
tttacctgaagtctttgt

SEQ ID NO: 393917 - DNA, 20 bp, Homo sapiens
tttaccttcatttcatcctg

SEQ ID NO: 393918 - DNA, 21 bp, Homo sapiens
tttacgtatatttcattgaat

SEQ ID NO: 393919 - DNA, 15 bp, Homo sapiens
tttactaaagcagtg

SEQ ID NO: 393920 - DNA, 22 bp, Homo sapiens
tttactaagccacaagaaattt

SEQ ID NO: 393921 - DNA, 19 bp, Homo sapiens
tttactaattttctagatt

SEQ ID NO: 393922 - DNA, 21 bp, Homo sapiens
tttactacataattaaatttt

SEQ ID NO: 393923 - DNA, 18 bp, Homo sapiens
tttactactattctgtta

SEQ ID NO: 393924 - DNA, 13 bp, Homo sapiens
tttactatctttt

SEQ ID NO: 393925 - DNA, 13 bp, Homo sapiens
tttactccccttg

SEQ ID NO: 393926 - DNA, 18 bp, Homo sapiens
tttactcggcgtgctcct

SEQ ID NO: 393927 - DNA, 17 bp, Homo sapiens
tttactctttttctaaa

SEQ ID NO: 393928 - DNA, 21 bp, Homo sapiens
tttactgagcttctctgtgaa

SEQ ID NO: 393929 - DNA, 14 bp, Homo sapiens
tttactgtctgtaa

SEQ ID NO: 393930 - DNA, 19 bp, Homo sapiens
tttactgtctgtaagagaa

SEQ ID NO: 393931 - DNA, 13 bp, Homo sapiens
tttacttcttata

SEQ ID NO: 393932 - DNA, 22 bp, Homo sapiens
tttacttcttatacatttgata

SEQ ID NO: 393933 - DNA, 19 bp, Homo sapiens
tttacttgaggatcatatg

SEQ ID NO: 393934 - DNA, 18 bp, Homo sapiens
tttacttggtgaggagga

SEQ ID NO: 393935 - DNA, 23 bp, Homo sapiens
tttacttgttcatttctgtctcc

SEQ ID NO: 393936 - DNA, 22 bp, Homo sapiens
tttactttattaatatgagtta

SEQ ID NO: 393937 - DNA, 15 bp, Homo sapiens
tttactttttaaaca

SEQ ID NO: 393938 - DNA, 23 bp, Homo sapiens
tttagaaaaaagtttacaacata

SEQ ID NO: 393939 - DNA, 23 bp, Homo sapiens
tttagaaagaagcccaatattat

SEQ ID NO: 393940 - DNA, 14 bp, Homo sapiens
tttagaaatataat

SEQ ID NO: 393941 - DNA, 19 bp, Homo sapiens
tttagaatcaagtctgtga

SEQ ID NO: 393942 - DNA, 20 bp, Homo sapiens
tttagaatttgaaaggaaaa

SEQ ID NO: 393943 - DNA, 23 bp, Homo sapiens
tttagacaaccatagaactgtcc

SEQ ID NO: 393944 - DNA, 19 bp, Homo sapiens
tttagacctcatctccaag

SEQ ID NO: 393945 - DNA, 21 bp, Homo sapiens
tttagagatgaattaaattta

SEQ ID NO: 393946 - DNA, 15 bp, Homo sapiens
tttagcagttctgca

SEQ ID NO: 393947 - DNA, 12 bp, Homo sapiens
acctccatcctg

SEQ ID NO: 393948 - DNA, 14 bp, Homo sapiens
acctccattaaatg

SEQ ID NO: 393949 - DNA, 17 bp, Homo sapiens
acctcccactttgggga

SEQ ID NO: 393950 - DNA, 19 bp, Homo sapiens
acctcccccaaaccctgct

SEQ ID NO: 393951 - DNA, 23 bp, Homo sapiens
acctcccccaaaccctgcttctg

SEQ ID NO: 393952 - DNA, 13 bp, Homo sapiens
acctccccctctt

SEQ ID NO: 393953 - DNA, 17 bp, Homo sapiens
acctcccctccttgcct

SEQ ID NO: 393954 - DNA, 10 bp, Homo sapiens
acctccctcc

SEQ ID NO: 393955 - DNA, 13 bp, Homo sapiens
acctccctgccca

SEQ ID NO: 393956 - DNA, 21 bp, Homo sapiens
acctccctgcccaggccggcc

SEQ ID NO: 393957 - DNA, 17 bp, Homo sapiens
acctccctgggcctgtc

SEQ ID NO: 393958 - DNA, 22 bp, Homo sapiens
acctccctgggcctgtctcaga

SEQ ID NO: 393959 - DNA, 12 bp, Homo sapiens
acctcctaccct

SEQ ID NO: 393960 - DNA, 16 bp, Homo sapiens
acctcctaccctccca

SEQ ID NO: 393961 - DNA, 18 bp, Homo sapiens
acctcctaccctcccacc

SEQ ID NO: 393962 - DNA, 15 bp, Homo sapiens
acctcctagaggtgg

SEQ ID NO: 393963 - DNA, 23 bp, Homo sapiens
acctcctagaggtgggcagctgg

SEQ ID NO: 393964 - DNA, 16 bp, Homo sapiens
acctcctatccttgga

SEQ ID NO: 393965 - DNA, 22 bp, Homo sapiens
acctcctattttaattggaatt

SEQ ID NO: 393966 - DNA, 13 bp, Homo sapiens
acctcctccaaga

SEQ ID NO: 393967 - DNA, 23 bp, Homo sapiens
acctcctccaagaagccctcctt

SEQ ID NO: 393968 - DNA, 13 bp, Homo sapiens
acctcctccactc

SEQ ID NO: 393969 - DNA, 12 bp, Homo sapiens
acctcctctctg

SEQ ID NO: 393970 - DNA, 13 bp, Homo sapiens
acctcctctcttg

SEQ ID NO: 393971 - DNA, 19 bp, Homo sapiens
acctcctgagaaggcgagg

SEQ ID NO: 393972 - DNA, 21 bp, Homo sapiens
acctcctgagaaggcgaggag

SEQ ID NO: 393973 - DNA, 23 bp, Homo sapiens
acctcctgatagtagtaaaatta

SEQ ID NO: 393974 - DNA, 16 bp, Homo sapiens
acctcctgcaataaaa

SEQ ID NO: 393975 - DNA, 18 bp, Homo sapiens
acctccttgtcactttat

SEQ ID NO: 393976 - DNA, 21 bp, Homo sapiens
acctcgcggcgcagcccctgg

SEQ ID NO: 393977 - DNA, 13 bp, Homo sapiens
acctcggctgtgt

SEQ ID NO: 393978 - DNA, 18 bp, Homo sapiens
acctcggcttgtgggctg

SEQ ID NO: 393979 - DNA, 14 bp, Homo sapiens
acctcgtgctttaa

SEQ ID NO: 393980 - DNA, 17 bp, Homo sapiens
acctcgtgctttaagtg

SEQ ID NO: 393981 - DNA, 19 bp, Homo sapiens
acctctaacaccacactga

SEQ ID NO: 393982 - DNA, 15 bp, Homo sapiens
acctctactttccag

SEQ ID NO: 393983 - DNA, 20 bp, Homo sapiens
acctctatatgttgctgaaa

SEQ ID NO: 393984 - DNA, 15 bp, Homo sapiens
acctctatccaaaga

SEQ ID NO: 393985 - DNA, 21 bp, Homo sapiens
acctctcaatattcaataaag

SEQ ID NO: 393986 - DNA, 18 bp, Homo sapiens
acctctccaagtctctct

SEQ ID NO: 393987 - DNA, 22 bp, Homo sapiens
acctctccaagtctctctgtga

SEQ ID NO: 393988 - DNA, 14 bp, Homo sapiens
acctctctctgctc

SEQ ID NO: 393989 - DNA, 18 bp, Homo sapiens
acctctctgtctttttcc

SEQ ID NO: 393990 - DNA, 21 bp, Homo sapiens
acctctctgtctttttccttc

SEQ ID NO: 393991 - DNA, 12 bp, Homo sapiens
acctctcttgtg

SEQ ID NO: 393992 - DNA, 19 bp, Homo sapiens
acctctcttgtgagccata

SEQ ID NO: 393993 - DNA, 20 bp, Homo sapiens
acctctgaaaacggccctct

SEQ ID NO: 393994 - DNA, 15 bp, Homo sapiens
acctctgaagtctct

SEQ ID NO: 393995 - DNA, 15 bp, Homo sapiens
acctctgatcaaagc

SEQ ID NO: 393996 - DNA, 16 bp, Homo sapiens
acctctgatcaaagca

SEQ ID NO: 393997 - DNA, 21 bp, Homo sapiens
acctctgcactactgacatgt

SEQ ID NO: 393998 - DNA, 18 bp, Homo sapiens
acctctgcctcccaggtt

SEQ ID NO: 393999 - DNA, 14 bp, Homo sapiens
acctctgctgccca

SEQ ID NO: 394000 - DNA, 20 bp, Homo sapiens
acctctgctgcccacggcca

SEQ ID NO: 394001 - DNA, 19 bp, Homo sapiens
acctctggccaaatatgca

SEQ ID NO: 394002 - DNA, 12 bp, Homo sapiens
acctctggccct

SEQ ID NO: 394003 - DNA, 15 bp, Homo sapiens
acctctggccctgtt

SEQ ID NO: 394004 - DNA, 16 bp, Homo sapiens
acctctggctccttca

SEQ ID NO: 394005 - DNA, 15 bp, Homo sapiens
acctctgggccctgc

SEQ ID NO: 394006 - DNA, 17 bp, Homo sapiens
acctctgttgtcctccc

SEQ ID NO: 394007 - DNA, 21 bp, Homo sapiens
acctcttccaggaagcacagg

SEQ ID NO: 394008 - DNA, 16 bp, Homo sapiens
acctcttcccatgact

SEQ ID NO: 394009 - DNA, 13 bp, Homo sapiens
acctcttccccag

SEQ ID NO: 394010 - DNA, 14 bp, Homo sapiens
acctcttccccaga

SEQ ID NO: 394011 - DNA, 19 bp, Homo sapiens
acctcttccggagatgtag

SEQ ID NO: 394012 - DNA, 18 bp, Homo sapiens
acctcttttctgcatcat

SEQ ID NO: 394013 - DNA, 23 bp, Homo sapiens
acctcttttgagactttgcccag

SEQ ID NO: 394014 - DNA, 19 bp, Homo sapiens
acctgaaaaaaagtttaca

SEQ ID NO: 394015 - DNA, 12 bp, Homo sapiens
acctgaaaagat

SEQ ID NO: 394016 - DNA, 15 bp, Homo sapiens
acctgaaaatgttag

SEQ ID NO: 394017 - DNA, 13 bp, Homo sapiens
acctgaaagcctg

SEQ ID NO: 394018 - DNA, 14 bp, Homo sapiens
acctgaaagcctgt

SEQ ID NO: 394019 - DNA, 16 bp, Homo sapiens
acctgaaagcctgtct

SEQ ID NO: 394020 - DNA, 18 bp, Homo sapiens
acctgaaagcctgtctct

SEQ ID NO: 394021 - DNA, 20 bp, Homo sapiens
acctgaacacttattgcttt

SEQ ID NO: 394022 - DNA, 19 bp, Homo sapiens
acctgaattttggctgtgt

SEQ ID NO: 394023 - DNA, 16 bp, Homo sapiens
acctgacaatggcagc

SEQ ID NO: 394024 - DNA, 22 bp, Homo sapiens
acctgacaatggcagctagact

SEQ ID NO: 394025 - DNA, 17 bp, Homo sapiens
acctgacctctgaagag

SEQ ID NO: 394026 - DNA, 20 bp, Homo sapiens
acctgacctctgaagagctg

SEQ ID NO: 394027 - DNA, 23 bp, Homo sapiens
acctgagaccagttgggagcact

SEQ ID NO: 394028 - DNA, 22 bp, Homo sapiens
acctgagacgggcatcgcagga

SEQ ID NO: 394029 - DNA, 23 bp, Homo sapiens
acctgagacgggcatcgcaggag

SEQ ID NO: 394030 - DNA, 12 bp, Homo sapiens
acctgagctgcc

SEQ ID NO: 394031 - DNA, 13 bp, Homo sapiens
acctgaggcccag

SEQ ID NO: 394032 - DNA, 18 bp, Homo sapiens
acctgaggcccagcagag

SEQ ID NO: 394033 - DNA, 21 bp, Homo sapiens
acctgagtcggccccacatgg

SEQ ID NO: 394034 - DNA, 18 bp, Homo sapiens
acctgagtctgctatatt

SEQ ID NO: 394035 - DNA, 19 bp, Homo sapiens
acctgatgtacctgatgct

SEQ ID NO: 394036 - DNA, 12 bp, Homo sapiens
acctgcaagccc

SEQ ID NO: 394037 - DNA, 17 bp, Homo sapiens
acctgcaagccccaggg

SEQ ID NO: 394038 - DNA, 18 bp, Homo sapiens
acctgcaagccccagggc

SEQ ID NO: 394039 - DNA, 20 bp, Homo sapiens
acctgcaagccccagggcct

SEQ ID NO: 394040 - DNA, 11 bp, Homo sapiens
tttcccacagt

SEQ ID NO: 394041 - DNA, 13 bp, Homo sapiens
tttcccaccagct

SEQ ID NO: 394042 - DNA, 16 bp, Homo sapiens
tttcccaccagctccc

SEQ ID NO: 394043 - DNA, 12 bp, Homo sapiens
tttcccataatt

SEQ ID NO: 394044 - DNA, 16 bp, Homo sapiens
tttcccatcaccagaa

SEQ ID NO: 394045 - DNA, 19 bp, Homo sapiens
tttccccaggggaaaatga

SEQ ID NO: 394046 - DNA, 21 bp, Homo sapiens
tttccccaggggaaaatgaag

SEQ ID NO: 394047 - DNA, 19 bp, Homo sapiens
tttcccccaaatcttcctc

SEQ ID NO: 394048 - DNA, 12 bp, Homo sapiens
tttcccccaggc

SEQ ID NO: 394049 - DNA, 13 bp, Homo sapiens
tttccccccactc

SEQ ID NO: 394050 - DNA, 17 bp, Homo sapiens
tttccccccactctccc

SEQ ID NO: 394051 - DNA, 19 bp, Homo sapiens
tttccccccactctcccca

SEQ ID NO: 394052 - DNA, 23 bp, Homo sapiens
tttccccccactctccccacact

SEQ ID NO: 394053 - DNA, 21 bp, Homo sapiens
tttcccctcattgcatttatt

SEQ ID NO: 394054 - DNA, 16 bp, Homo sapiens
tttcccctccctgggt

SEQ ID NO: 394055 - DNA, 18 bp, Homo sapiens
tttcccctgtggtttgtt

SEQ ID NO: 394056 - DNA, 22 bp, Homo sapiens
tttcccgagcaaagtctaaagt

SEQ ID NO: 394057 - DNA, 20 bp, Homo sapiens
tttccctcctgacaaatatt

SEQ ID NO: 394058 - DNA, 15 bp, Homo sapiens
tttccctgcatccct

SEQ ID NO: 394059 - DNA, 20 bp, Homo sapiens
tttcccttctggacactgag

SEQ ID NO: 394060 - DNA, 13 bp, Homo sapiens
tttccgagtcaag

SEQ ID NO: 394061 - DNA, 16 bp, Homo sapiens
tttcctaacaaaagat

SEQ ID NO: 394062 - DNA, 18 bp, Homo sapiens
tttcctaacaggattaga

SEQ ID NO: 394063 - DNA, 18 bp, Homo sapiens
tttcctagttttatgttt

SEQ ID NO: 394064 - DNA, 16 bp, Homo sapiens
tttcctatgactaatt

SEQ ID NO: 394065 - DNA, 22 bp, Homo sapiens
tttcctccaaactcctgcctgt

SEQ ID NO: 394066 - DNA, 14 bp, Homo sapiens
tttcctccccagca

SEQ ID NO: 394067 - DNA, 16 bp, Homo sapiens
tttcctcctttatcac

SEQ ID NO: 394068 - DNA, 17 bp, Homo sapiens
tttcctcctttatcaca

SEQ ID NO: 394069 - DNA, 19 bp, Homo sapiens
tttcctcgcagatgataaa

SEQ ID NO: 394070 - DNA, 24 bp, Homo sapiens
tttcctctctctctctctctctgt

SEQ ID NO: 394071 - DNA, 12 bp, Homo sapiens
tttcctcttcct

SEQ ID NO: 394072 - DNA, 23 bp, Homo sapiens
tttcctgacagaaggactcaggt

SEQ ID NO: 394073 - DNA, 13 bp, Homo sapiens
tttcctgagcttg

SEQ ID NO: 394074 - DNA, 18 bp, Homo sapiens
tttcctgagcttggccag

SEQ ID NO: 394075 - DNA, 22 bp, Homo sapiens
tttcctgagcttggccagaagg

SEQ ID NO: 394076 - DNA, 12 bp, Homo sapiens
tttcctgggagt

SEQ ID NO: 394077 - DNA, 16 bp, Homo sapiens
tttgaaagaagtcaaa

SEQ ID NO: 394078 - DNA, 13 bp, Homo sapiens
tttgaaaggaaaa

SEQ ID NO: 394079 - DNA, 17 bp, Homo sapiens
tttgaaaggaaaaacag

SEQ ID NO: 394080 - DNA, 21 bp, Homo sapiens
tttgaaagtgggtttcaattt

SEQ ID NO: 394081 - DNA, 16 bp, Homo sapiens
tttgaaatatgcatgt

SEQ ID NO: 394082 - DNA, 21 bp, Homo sapiens
tttgaaatcaccttttctaaa

SEQ ID NO: 394083 - DNA, 16 bp, Homo sapiens
tttgaaatccaaacta

SEQ ID NO: 394084 - DNA, 16 bp, Homo sapiens
tttgaacacttactgt

SEQ ID NO: 394085 - DNA, 11 bp, Homo sapiens
tttgaactcac

SEQ ID NO: 394086 - DNA, 14 bp, Homo sapiens
tttgaactgagccg

SEQ ID NO: 394087 - DNA, 17 bp, Homo sapiens
tttgaactgttagatgc

SEQ ID NO: 394088 - DNA, 22 bp, Homo sapiens
tttgaagatgccgcatttggat

SEQ ID NO: 394089 - DNA, 18 bp, Homo sapiens
tttgaagcagttgtgtca

SEQ ID NO: 394090 - DNA, 13 bp, Homo sapiens
tttgaagttctgg

SEQ ID NO: 394091 - DNA, 16 bp, Homo sapiens
tttgaataccattaaa

SEQ ID NO: 394092 - DNA, 14 bp, Homo sapiens
tttgaatcaatctg

SEQ ID NO: 394093 - DNA, 12 bp, Homo sapiens
tttgaatggatt

SEQ ID NO: 394094 - DNA, 19 bp, Homo sapiens
tttgaatgtgatcatcttt

SEQ ID NO: 394095 - DNA, 13 bp, Homo sapiens
tttgaattttcaa

SEQ ID NO: 394096 - DNA, 13 bp, Homo sapiens
tttgacacataaa

SEQ ID NO: 394097 - DNA, 18 bp, Homo sapiens
tttgacacataaaagtaa

SEQ ID NO: 394098 - DNA, 16 bp, Homo sapiens
tttgacatgaaaagat

SEQ ID NO: 394099 - DNA, 17 bp, Homo sapiens
tttgacattgtatgtat

SEQ ID NO: 394100 - DNA, 22 bp, Homo sapiens
tttgacattgtatgtatctatt

SEQ ID NO: 394101 - DNA, 20 bp, Homo sapiens
tttgacatttggtggtactt

SEQ ID NO: 394102 - DNA, 15 bp, Homo sapiens
tttgaccccttcctg

SEQ ID NO: 394103 - DNA, 22 bp, Homo sapiens
tttgaccccttcctgtctggcc

SEQ ID NO: 394104 - DNA, 14 bp, Homo sapiens
tttgacggatgatt

SEQ ID NO: 394105 - DNA, 18 bp, Homo sapiens
tttgactttcttctgaat

SEQ ID NO: 394106 - DNA, 19 bp, Homo sapiens
tttgagaccaacctgggta

SEQ ID NO: 394107 - DNA, 23 bp, Homo sapiens
tttgagagcctttggtgaataac

SEQ ID NO: 394108 - DNA, 20 bp, Homo sapiens
tttgaggagcagcttcagtt

SEQ ID NO: 394109 - DNA, 15 bp, Homo sapiens
tttgaggagtggttt

SEQ ID NO: 394110 - DNA, 19 bp, Homo sapiens
tttgaggagtggtttttct

SEQ ID NO: 394111 - DNA, 23 bp, Homo sapiens
tttgagggacaaatttaaaacaa

SEQ ID NO: 394112 - DNA, 18 bp, Homo sapiens
tttgagggactgcctctg

SEQ ID NO: 394113 - DNA, 20 bp, Homo sapiens
tttgagggactgcctctgcc

SEQ ID NO: 394114 - DNA, 19 bp, Homo sapiens
tttgagtcaaaagcctggg

SEQ ID NO: 394115 - DNA, 19 bp, Homo sapiens
tttgagtgtcaggctctga

SEQ ID NO: 394116 - DNA, 15 bp, Homo sapiens
tttgagttcaaattt

SEQ ID NO: 394117 - DNA, 12 bp, Homo sapiens
tttgagttctac

SEQ ID NO: 394118 - DNA, 21 bp, Homo sapiens
tttgatacatttatcttctgt

SEQ ID NO: 394119 - DNA, 22 bp, Homo sapiens
tttgatatgggctttctctttg

SEQ ID NO: 394120 - DNA, 15 bp, Homo sapiens
tttgatattatgtgg

SEQ ID NO: 394121 - DNA, 15 bp, Homo sapiens
tttgatgctgagtca

SEQ ID NO: 394122 - DNA, 16 bp, Homo sapiens
tttgatgctgagtcat

SEQ ID NO: 394123 - DNA, 16 bp, Homo sapiens
tttgatgtcagccttg

SEQ ID NO: 394124 - DNA, 20 bp, Homo sapiens
tttgattaatgtttcttaaa

SEQ ID NO: 394125 - DNA, 22 bp, Homo sapiens
tttgcagacatattttcttaca

SEQ ID NO: 394126 - DNA, 13 bp, Homo sapiens
tttgcagctgctg

SEQ ID NO: 394127 - DNA, 14 bp, Homo sapiens
tttgcagctgctgg

SEQ ID NO: 394128 - DNA, 15 bp, Homo sapiens
tttgcagctgctggt

SEQ ID NO: 394129 - DNA, 18 bp, Homo sapiens
tttgcagctgctggtttt

SEQ ID NO: 394130 - DNA, 19 bp, Homo sapiens
tttgcagcttccttccaag

SEQ ID NO: 394131 - DNA, 13 bp, Homo sapiens
tttgcaggctctg

SEQ ID NO: 394132 - DNA, 15 bp, Homo sapiens
tttgcagggagacca

SEQ ID NO: 394133 - DNA, 20 bp, Homo sapiens
tttgcagttggactctcagg

SEQ ID NO: 394134 - DNA, 15 bp, Homo sapiens
tttgcatgtctgcat

SEQ ID NO: 394135 - DNA, 14 bp, Homo sapiens
tttgcattgtgtga

SEQ ID NO: 394136 - DNA, 20 bp, Homo sapiens
tttgcatttttgtattttgt

SEQ ID NO: 394137 - DNA, 15 bp, Homo sapiens
tttgccacctttcct

SEQ ID NO: 394138 - DNA, 14 bp, Homo sapiens
tttgccatgctgct

SEQ ID NO: 394139 - DNA, 14 bp, Homo sapiens
tttgccatgtcgct

SEQ ID NO: 394140 - DNA, 17 bp, Homo sapiens
tttgcccaacctcagca

SEQ ID NO: 394141 - DNA, 22 bp, Homo sapiens
tttgccccaacttaagtttaga

SEQ ID NO: 394142 - DNA, 23 bp, Homo sapiens
tttgccccaacttaagtttagaa

SEQ ID NO: 394143 - DNA, 23 bp, Homo sapiens
tttgccccatgataaaataagta

SEQ ID NO: 394144 - DNA, 19 bp, Homo sapiens
tttgccctggtttcactgg

SEQ ID NO: 394145 - DNA, 21 bp, Homo sapiens
tttgcccttcaggacccttct

SEQ ID NO: 394146 - DNA, 18 bp, Homo sapiens
tttgcctggttttgtctt

SEQ ID NO: 394147 - DNA, 16 bp, Homo sapiens
tttgccttaattctta

SEQ ID NO: 394148 - DNA, 20 bp, Homo sapiens
tttgccttaggaagtgactt

SEQ ID NO: 394149 - DNA, 17 bp, Homo sapiens
tttgcgatgtgttttat

SEQ ID NO: 394150 - DNA, 15 bp, Homo sapiens
tttgcgcaaacttta

SEQ ID NO: 394151 - DNA, 14 bp, Homo sapiens
tttgcggacgggct

SEQ ID NO: 394152 - DNA, 14 bp, Homo sapiens
tttgctaatgaatt

SEQ ID NO: 394153 - DNA, 21 bp, Homo sapiens
tttgctagagctaacagacat

SEQ ID NO: 394154 - DNA, 18 bp, Homo sapiens
tttgctatcatatattat

SEQ ID NO: 394155 - DNA, 13 bp, Homo sapiens
tttgctattgaca

SEQ ID NO: 394156 - DNA, 19 bp, Homo sapiens
tttgctcagaacacattct

SEQ ID NO: 394157 - DNA, 12 bp, Homo sapiens
tttgctccaccc

SEQ ID NO: 394158 - DNA, 13 bp, Homo sapiens
tttgctcccagtt

SEQ ID NO: 394159 - DNA, 15 bp, Homo sapiens
tttgctgaagaagac

SEQ ID NO: 394160 - DNA, 19 bp, Homo sapiens
tttgctgaaggattatatg

SEQ ID NO: 394161 - DNA, 18 bp, Homo sapiens
tttgctgaattcctttac

SEQ ID NO: 394162 - DNA, 19 bp, Homo sapiens
tttgctgaattcctttaca

SEQ ID NO: 394163 - DNA, 13 bp, Homo sapiens
tttgctgcccctg

SEQ ID NO: 394164 - DNA, 12 bp, Homo sapiens
tttgctgcctta

SEQ ID NO: 394165 - DNA, 22 bp, Homo sapiens
tttgctgctaccgccctgggct

SEQ ID NO: 394166 - DNA, 22 bp, Homo sapiens
tttgctgctatgaaaatgagca

SEQ ID NO: 394167 - DNA, 23 bp, Homo sapiens
tttgctgctatgaaaatgagcat

SEQ ID NO: 394168 - DNA, 14 bp, Homo sapiens
tttgctgctgataa

SEQ ID NO: 394169 - DNA, 15 bp, Homo sapiens
tttgctgctgtggaa

SEQ ID NO: 394170 - DNA, 17 bp, Homo sapiens
tttgctgcttttgatgg

SEQ ID NO: 394171 - DNA, 15 bp, Homo sapiens
tttgctggaaaatct

SEQ ID NO: 394172 - DNA, 19 bp, Homo sapiens
tttgctggaaaatctgtaa

SEQ ID NO: 394173 - DNA, 16 bp, Homo sapiens
tttgctggagtcctgt

SEQ ID NO: 394174 - DNA, 19 bp, Homo sapiens
tttgctggagtcctgttct

SEQ ID NO: 394175 - DNA, 23 bp, Homo sapiens
tttgctgtatacaaacaggtgct

SEQ ID NO: 394176 - DNA, 17 bp, Homo sapiens
tttgctgtgaggctgtc

SEQ ID NO: 394177 - DNA, 15 bp, Homo sapiens
tttgcttattgttcc

SEQ ID NO: 394178 - DNA, 17 bp, Homo sapiens
tttgcttattgttccaa

SEQ ID NO: 394179 - DNA, 19 bp, Homo sapiens
tttgcttattgttccaaga

SEQ ID NO: 394180 - DNA, 18 bp, Homo sapiens
tttgcttatttatattca

SEQ ID NO: 394181 - DNA, 14 bp, Homo sapiens
tttgctttttgctt

SEQ ID NO: 394182 - DNA, 18 bp, Homo sapiens
tttggaagtttgtgttct

SEQ ID NO: 394183 - DNA, 15 bp, Homo sapiens
taacatgtatcccaa

SEQ ID NO: 394184 - DNA, 10 bp, Homo sapiens
taacattcct

SEQ ID NO: 394185 - DNA, 20 bp, Homo sapiens
taacattcctcatgaatgta

SEQ ID NO: 394186 - DNA, 22 bp, Homo sapiens
taacattcctcatgaatgtaaa

SEQ ID NO: 394187 - DNA, 18 bp, Homo sapiens
taacattgaccaagaact

SEQ ID NO: 394188 - DNA, 12 bp, Homo sapiens
taacattgcact

SEQ ID NO: 394189 - DNA, 23 bp, Homo sapiens
taacattgcactttataaacact

SEQ ID NO: 394190 - DNA, 15 bp, Homo sapiens
taacattgtaaatga

SEQ ID NO: 394191 - DNA, 15 bp, Homo sapiens
taacatttaggagaa

SEQ ID NO: 394192 - DNA, 16 bp, Homo sapiens
taacatttaggagaag

SEQ ID NO: 394193 - DNA, 19 bp, Homo sapiens
taacatttaggagaagttg

SEQ ID NO: 394194 - DNA, 14 bp, Homo sapiens
taaccaaaaaatgt

SEQ ID NO: 394195 - DNA, 16 bp, Homo sapiens
taaccaactgaacgac

SEQ ID NO: 394196 - DNA, 11 bp, Homo sapiens
taaccaagctg

SEQ ID NO: 394197 - DNA, 19 bp, Homo sapiens
taaccaattcctcatttgt

SEQ ID NO: 394198 - DNA, 18 bp, Homo sapiens
taaccaccgcatatgcat

SEQ ID NO: 394199 - DNA, 20 bp, Homo sapiens
taaccaccgcatatgcatgc

SEQ ID NO: 394200 - DNA, 19 bp, Homo sapiens
taaccacgtctgtcttcac

SEQ ID NO: 394201 - DNA, 13 bp, Homo sapiens
taaccactgcttc

SEQ ID NO: 394202 - DNA, 23 bp, Homo sapiens
taaccaggccccagcctccaggc

SEQ ID NO: 394203 - DNA, 23 bp, Homo sapiens
taaccagtctgaagtttcattta

SEQ ID NO: 394204 - DNA, 16 bp, Homo sapiens
taaccatcagttactg

SEQ ID NO: 394205 - DNA, 16 bp, Homo sapiens
taaccattttaaccta

SEQ ID NO: 394206 - DNA, 14 bp, Homo sapiens
taacccaaaagatt

SEQ ID NO: 394207 - DNA, 23 bp, Homo sapiens
taacccgctcatcactggatgaa

SEQ ID NO: 394208 - DNA, 15 bp, Homo sapiens
ttttaaaatcaactt

SEQ ID NO: 394209 - DNA, 23 bp, Homo sapiens
ttttaaacaaaatagaagctgta

SEQ ID NO: 394210 - DNA, 12 bp, Homo sapiens
ttttaaacagtg

SEQ ID NO: 394211 - DNA, 13 bp, Homo sapiens
ttttaaacagtgt

SEQ ID NO: 394212 - DNA, 19 bp, Homo sapiens
ttttaaagaagtctcttaa

SEQ ID NO: 394213 - DNA, 16 bp, Homo sapiens
ttttaaaggacaaaca

SEQ ID NO: 394214 - DNA, 22 bp, Homo sapiens
ttttaaagggagccatgctctt

SEQ ID NO: 394215 - DNA, 23 bp, Homo sapiens
ttttaaatctgaaggttctggta

SEQ ID NO: 394216 - DNA, 18 bp, Homo sapiens
ttttaaatgattccaaat

SEQ ID NO: 394217 - DNA, 13 bp, Homo sapiens
ttttaaattcttt

SEQ ID NO: 394218 - DNA, 13 bp, Homo sapiens
ttttaaattttat

SEQ ID NO: 394219 - DNA, 13 bp, Homo sapiens
ttttaacattcct

SEQ ID NO: 394220 - DNA, 21 bp, Homo sapiens
ttttaacctcaggttccaaat

SEQ ID NO: 394221 - DNA, 22 bp, Homo sapiens
ttttaacgtatgtatttcattg

SEQ ID NO: 394222 - DNA, 12 bp, Homo sapiens
ttttaactcacc

SEQ ID NO: 394223 - DNA, 17 bp, Homo sapiens
ttttaactgaaaatgta

SEQ ID NO: 394224 - DNA, 20 bp, Homo sapiens
ttttaactgaaaatgtaaat

SEQ ID NO: 394225 - DNA, 14 bp, Homo sapiens
ttttaactgctgca

SEQ ID NO: 394226 - DNA, 15 bp, Homo sapiens
ttttaacttcacctt

SEQ ID NO: 394227 - DNA, 14 bp, Homo sapiens
ttttaacttctata

SEQ ID NO: 394228 - DNA, 16 bp, Homo sapiens
ttttaactttaagttt

SEQ ID NO: 394229 - DNA, 19 bp, Homo sapiens
ttttaactttaagtttcag

SEQ ID NO: 394230 - DNA, 11 bp, Homo sapiens
ttttaagaaat

SEQ ID NO: 394231 - DNA, 22 bp, Homo sapiens
ttttaagataaattataagtta

SEQ ID NO: 394232 - DNA, 12 bp, Homo sapiens
ttttaagctgtt

SEQ ID NO: 394233 - DNA, 23 bp, Homo sapiens
ttttaagggtttgtggaaaatga

SEQ ID NO: 394234 - DNA, 17 bp, Homo sapiens
ttttaagtatttatata

SEQ ID NO: 394235 - DNA, 19 bp, Homo sapiens
ttttaagtatttatatatt

SEQ ID NO: 394236 - DNA, 13 bp, Homo sapiens
ttttaataaaatt

SEQ ID NO: 394237 - DNA, 21 bp, Homo sapiens
ttttaataaaattgacaacat

SEQ ID NO: 394238 - DNA, 12 bp, Homo sapiens
ttttaatacagg

SEQ ID NO: 394239 - DNA, 16 bp, Homo sapiens
ttttaatacctttaaa

SEQ ID NO: 394240 - DNA, 23 bp, Homo sapiens
ttttaatatactaaccatttctt

SEQ ID NO: 394241 - DNA, 22 bp, Homo sapiens
ttttaatatttatgtttaagtg

SEQ ID NO: 394242 - DNA, 22 bp, Homo sapiens
ttttaatcagacaaagtaattc

SEQ ID NO: 394243 - DNA, 20 bp, Homo sapiens
ttttaatgtacaagttttgt

SEQ ID NO: 394244 - DNA, 20 bp, Homo sapiens
ttttaatgtcatttgttaaa

SEQ ID NO: 394245 - DNA, 21 bp, Homo sapiens
ttttaatgtgagacagcaagt

SEQ ID NO: 394246 - DNA, 22 bp, Homo sapiens
ttttaattccaatatgatgact

SEQ ID NO: 394247 - DNA, 22 bp, Homo sapiens
ttttaatttatttattaagatg

SEQ ID NO: 394248 - DNA, 19 bp, Homo sapiens
ttttaatttgatgaaagct

SEQ ID NO: 394249 - DNA, 10 bp, Homo sapiens
ttttacaaaa

SEQ ID NO: 394250 - DNA, 12 bp, Homo sapiens
ttttacaaaaca

SEQ ID NO: 394251 - DNA, 13 bp, Homo sapiens
ttttacaaaacat

SEQ ID NO: 394252 - DNA, 18 bp, Homo sapiens
ttttacaaacagatgaaa

SEQ ID NO: 394253 - DNA, 16 bp, Homo sapiens
ttttacagctgcctgc

SEQ ID NO: 394254 - DNA, 21 bp, Homo sapiens
ttttacagttacttccttcct

SEQ ID NO: 394255 - DNA, 14 bp, Homo sapiens
ttttacatacagtg

SEQ ID NO: 394256 - DNA, 20 bp, Homo sapiens
ttttacattacaaatttctg

SEQ ID NO: 394257 - DNA, 23 bp, Homo sapiens
ttttactgcttttaacttctgat

SEQ ID NO: 394258 - DNA, 12 bp, Homo sapiens
ttttactgtttt

SEQ ID NO: 394259 - DNA, 15 bp, Homo sapiens
ttttactttgtgcaa

SEQ ID NO: 394260 - DNA, 20 bp, Homo sapiens
ttttagacctcatctccaag

SEQ ID NO: 394261 - DNA, 15 bp, Homo sapiens
ttttagagtaaacta

SEQ ID NO: 394262 - DNA, 18 bp, Homo sapiens
ttttagattcctacttaa

SEQ ID NO: 394263 - DNA, 23 bp, Homo sapiens
ttttagattcctacttaaacaaa

SEQ ID NO: 394264 - DNA, 11 bp, Homo sapiens
ttttagcatgt

SEQ ID NO: 394265 - DNA, 22 bp, Homo sapiens
ttttagctggtggcaataaata

SEQ ID NO: 394266 - DNA, 18 bp, Homo sapiens
ttttaggcagggatttga

SEQ ID NO: 394267 - DNA, 15 bp, Homo sapiens
ttttagtacccacct

SEQ ID NO: 394268 - DNA, 19 bp, Homo sapiens
ttttagtgttttgcaaggg

SEQ ID NO: 394269 - DNA, 18 bp, Homo sapiens
ttttagttaaatttctgg

SEQ ID NO: 394270 - DNA, 16 bp, Homo sapiens
ttttataaattaaata

SEQ ID NO: 394271 - DNA, 14 bp, Homo sapiens
ttttataactcatg

SEQ ID NO: 394272 - DNA, 16 bp, Homo sapiens
ttttataagatttaat

SEQ ID NO: 394273 - DNA, 21 bp, Homo sapiens
ttttataagatttaattgtaa

SEQ ID NO: 394274 - DNA, 19 bp, Homo sapiens
ttttataaggctgactctt

SEQ ID NO: 394275 - DNA, 20 bp, Homo sapiens
ttttataaggctgactctta

SEQ ID NO: 394276 - DNA, 10 bp, Homo sapiens
ttttatacca

SEQ ID NO: 394277 - DNA, 16 bp, Homo sapiens
ttttatactgcacttt

SEQ ID NO: 394278 - DNA, 19 bp, Homo sapiens
ttttatagcttaactaatt

SEQ ID NO: 394279 - DNA, 22 bp, Homo sapiens
ttttatataataaagtattcca

SEQ ID NO: 394280 - DNA, 13 bp, Homo sapiens
ttttatatataaa

SEQ ID NO: 394281 - DNA, 23 bp, Homo sapiens
ttttatatataaaataaatatac

SEQ ID NO: 394282 - DNA, 13 bp, Homo sapiens
ttttatatctgta

SEQ ID NO: 394283 - DNA, 14 bp, Homo sapiens
ttttatatctgtaa

SEQ ID NO: 394284 - DNA, 20 bp, Homo sapiens
ttttatattacttttgtaaa

SEQ ID NO: 394285 - DNA, 22 bp, Homo sapiens
ttttatattacttttgtaaata

SEQ ID NO: 394286 - DNA, 18 bp, Homo sapiens
ttttatatttgttatgat

SEQ ID NO: 394287 - DNA, 18 bp, Homo sapiens
ttttatattttatactgc

SEQ ID NO: 394288 - DNA, 15 bp, Homo sapiens
ttttatcatgacatg

SEQ ID NO: 394289 - DNA, 14 bp, Homo sapiens
ttttatcatttcta

SEQ ID NO: 394290 - DNA, 20 bp, Homo sapiens
ttttatcatttctactgaag

SEQ ID NO: 394291 - DNA, 13 bp, Homo sapiens
ttttatctcttct

SEQ ID NO: 394292 - DNA, 20 bp, Homo sapiens
ttttatctgaaatcaattaa

SEQ ID NO: 394293 - DNA, 21 bp, Homo sapiens
ttttatctgaaatcaattaaa

SEQ ID NO: 394294 - DNA, 15 bp, Homo sapiens
ttttatctgtgagtt

SEQ ID NO: 394295 - DNA, 13 bp, Homo sapiens
ttttatctgtgga

SEQ ID NO: 394296 - DNA, 22 bp, Homo sapiens
ttttatcttggtagtacatttt

SEQ ID NO: 394297 - DNA, 13 bp, Homo sapiens
ttttatgcagata

SEQ ID NO: 394298 - DNA, 22 bp, Homo sapiens
ttttatgtcatactctgtgtaa

SEQ ID NO: 394299 - DNA, 13 bp, Homo sapiens
ttttatgtttgta

SEQ ID NO: 394300 - DNA, 15 bp, Homo sapiens
ttttatgtttgtaca

SEQ ID NO: 394301 - DNA, 18 bp, Homo sapiens
ttttattacattagttaa

SEQ ID NO: 394302 - DNA, 18 bp, Homo sapiens
ttttattattcagaatta

SEQ ID NO: 394303 - DNA, 22 bp, Homo sapiens
ttttattattcagaattataca

SEQ ID NO: 394304 - DNA, 12 bp, Homo sapiens
ttttattcacat

SEQ ID NO: 394305 - DNA, 14 bp, Homo sapiens
ttttattgaataac

SEQ ID NO: 394306 - DNA, 15 bp, Homo sapiens
ttttattgatgtgaa

SEQ ID NO: 394307 - DNA, 20 bp, Homo sapiens
ttttattgtataaactatca

SEQ ID NO: 394308 - DNA, 11 bp, Homo sapiens
ttttattgtgt

SEQ ID NO: 394309 - DNA, 14 bp, Homo sapiens
ttttattgttttca

SEQ ID NO: 394310 - DNA, 14 bp, Homo sapiens
ttttatttccatca

SEQ ID NO: 394311 - DNA, 19 bp, Homo sapiens
ttttatttctaagtattta

SEQ ID NO: 394312 - DNA, 15 bp, Homo sapiens
ttttattttcaagca

SEQ ID NO: 394313 - DNA, 18 bp, Homo sapiens
ttttattttcaagcaaat

SEQ ID NO: 394314 - DNA, 15 bp, Homo sapiens
ttttattttttaagt

SEQ ID NO: 394315 - DNA, 18 bp, Homo sapiens
ttttattttttccctcct

SEQ ID NO: 394316 - DNA, 10 bp, Homo sapiens
ttttcaaaat

SEQ ID NO: 394317 - DNA, 14 bp, Homo sapiens
ttttcaataaagaa

SEQ ID NO: 394318 - DNA, 23 bp, Homo sapiens
ttttcaataaagaaaaaaatagt

SEQ ID NO: 394319 - DNA, 15 bp, Homo sapiens
ttttcacagttctct

SEQ ID NO: 394320 - DNA, 20 bp, Homo sapiens
ttttcaccccacccttcccc

SEQ ID NO: 394321 - DNA, 12 bp, Homo sapiens
ttttcacctcat

SEQ ID NO: 394322 - DNA, 19 bp, Homo sapiens
ttttcactgctggctgcct

SEQ ID NO: 394323 - DNA, 21 bp, Homo sapiens
ttttcactggagttacattaa

SEQ ID NO: 394324 - DNA, 17 bp, Homo sapiens
ttttcactgtttcctat

SEQ ID NO: 394325 - DNA, 17 bp, Homo sapiens
ttttcagaacctcttcc

SEQ ID NO: 394326 - DNA, 15 bp, Homo sapiens
ttttcagaagaaatt

SEQ ID NO: 394327 - DNA, 21 bp, Homo sapiens
ttttcagaaggttattttctt

SEQ ID NO: 394328 - DNA, 20 bp, Homo sapiens
ttttcagcacccccacccac

SEQ ID NO: 394329 - DNA, 15 bp, Homo sapiens
ttttcagtaccaaag

SEQ ID NO: 394330 - DNA, 15 bp, Homo sapiens
taagttgtcttacac

SEQ ID NO: 394331 - DNA, 20 bp, Homo sapiens
taagtttagaaattacaagt

SEQ ID NO: 394332 - DNA, 22 bp, Homo sapiens
taagtttatccaaatcttgaat

SEQ ID NO: 394333 - DNA, 20 bp, Homo sapiens
taataaaaaatggaaagaat

SEQ ID NO: 394334 - DNA, 17 bp, Homo sapiens
taataaaaatttgttta

SEQ ID NO: 394335 - DNA, 19 bp, Homo sapiens
taataaaacaatactcaaa

SEQ ID NO: 394336 - DNA, 18 bp, Homo sapiens
taataaaactgcacagtg

SEQ ID NO: 394337 - DNA, 22 bp, Homo sapiens
taataaaactgcacagtgctgt

SEQ ID NO: 394338 - DNA, 21 bp, Homo sapiens
tacaagccattctaaggaaat

SEQ ID NO: 394339 - DNA, 18 bp, Homo sapiens
tacaaggagggcctctgg

SEQ ID NO: 394340 - DNA, 19 bp, Homo sapiens
tacaaggagggcctctggt

SEQ ID NO: 394341 - DNA, 17 bp, Homo sapiens
ttttgttttgtctatat

SEQ ID NO: 394342 - DNA, 15 bp, Homo sapiens
tttttaaaaaggcct

SEQ ID NO: 394343 - DNA, 16 bp, Homo sapiens
tttttaaaaaggcctt

SEQ ID NO: 394344 - DNA, 17 bp, Homo sapiens
tttttaaaaaggccttt

SEQ ID NO: 394345 - DNA, 14 bp, Homo sapiens
tttttaaaagactt

SEQ ID NO: 394346 - DNA, 22 bp, Homo sapiens
tttttaaaagtttcaatgtgat

SEQ ID NO: 394347 - DNA, 22 bp, Homo sapiens
tttttaaagaaaatgtgtctgc

SEQ ID NO: 394348 - DNA, 16 bp, Homo sapiens
tttttaaagcttttga

SEQ ID NO: 394349 - DNA, 12 bp, Homo sapiens
tttttaaattat

SEQ ID NO: 394350 - DNA, 18 bp, Homo sapiens
tttttaaattctgctcct

SEQ ID NO: 394351 - DNA, 20 bp, Homo sapiens
tttttaaattttatttcctg

SEQ ID NO: 394352 - DNA, 17 bp, Homo sapiens
tttttaactgaaaatgt

SEQ ID NO: 394353 - DNA, 18 bp, Homo sapiens
tttttaactgaaaatgta

SEQ ID NO: 394354 - DNA, 13 bp, Homo sapiens
tttttaagacttt

SEQ ID NO: 394355 - DNA, 21 bp, Homo sapiens
tttttaagacttttctttcct

SEQ ID NO: 394356 - DNA, 21 bp, Homo sapiens
tttttaaggtgagttctcact

SEQ ID NO: 394357 - DNA, 14 bp, Homo sapiens
tttttaagttcaat

SEQ ID NO: 394358 - DNA, 17 bp, Homo sapiens
tttttaataaagacagg

SEQ ID NO: 394359 - DNA, 21 bp, Homo sapiens
tttttaatatgtaaggaatgc

SEQ ID NO: 394360 - DNA, 17 bp, Homo sapiens
tttttaatatttattga

SEQ ID NO: 394361 - DNA, 16 bp, Homo sapiens
tttttaatttatttat

SEQ ID NO: 394362 - DNA, 17 bp, Homo sapiens
tttttaatttgatgaaa

SEQ ID NO: 394363 - DNA, 19 bp, Homo sapiens
tttttacaagttttaaata

SEQ ID NO: 394364 - DNA, 19 bp, Homo sapiens
tttttaccgttcacttccc

SEQ ID NO: 394365 - DNA, 14 bp, Homo sapiens
tttttactcaacca

SEQ ID NO: 394366 - DNA, 16 bp, Homo sapiens
tttttactcaaccaaa

SEQ ID NO: 394367 - DNA, 19 bp, Homo sapiens
tttttagagattaatttgt

SEQ ID NO: 394368 - DNA, 21 bp, Homo sapiens
tttttatataagttaaagaga

SEQ ID NO: 394369 - DNA, 18 bp, Homo sapiens
tttttatatagcttgaaa

SEQ ID NO: 394370 - DNA, 13 bp, Homo sapiens
tttttatattact

SEQ ID NO: 394371 - DNA, 14 bp, Homo sapiens
tttttatattactt

SEQ ID NO: 394372 - DNA, 20 bp, Homo sapiens
tttttatattacttttgtaa

SEQ ID NO: 394373 - DNA, 15 bp, Homo sapiens
tttttatatttagtt

SEQ ID NO: 394374 - DNA, 18 bp, Homo sapiens
tttttatattttatactg

SEQ ID NO: 394375 - DNA, 18 bp, Homo sapiens
tttttatcatttctactg

SEQ ID NO: 394376 - DNA, 19 bp, Homo sapiens
tttttatctagaacattca

SEQ ID NO: 394377 - DNA, 16 bp, Homo sapiens
tttttcaatatttatt

SEQ ID NO: 394378 - DNA, 19 bp, Homo sapiens
tttttcacctgaaacactt

SEQ ID NO: 394379 - DNA, 14 bp, Homo sapiens
tttttccactttgt

SEQ ID NO: 394380 - DNA, 20 bp, Homo sapiens
tttttccactttgttcttta

SEQ ID NO: 394381 - DNA, 23 bp, Homo sapiens
tttttcctaacaaaagatgaaag

SEQ ID NO: 394382 - DNA, 13 bp, Homo sapiens
tttttcctgtcaa

SEQ ID NO: 394383 - DNA, 14 bp, Homo sapiens
tttttcctgtcaat

SEQ ID NO: 394384 - DNA, 14 bp, Homo sapiens
tttttcctgtcctt

SEQ ID NO: 394385 - DNA, 16 bp, Homo sapiens
tttttcgtttgtttgt

SEQ ID NO: 394386 - DNA, 18 bp, Homo sapiens
tttttctacttttaaaga

SEQ ID NO: 394387 - DNA, 12 bp, Homo sapiens
tttttctctcaa

SEQ ID NO: 394388 - DNA, 14 bp, Homo sapiens
tttttctcttctgt

SEQ ID NO: 394389 - DNA, 13 bp, Homo sapiens
tttttcttggggt

SEQ ID NO: 394390 - DNA, 11 bp, Homo sapiens
tttttgaagaa

SEQ ID NO: 394391 - DNA, 20 bp, Homo sapiens
tttttgagacagagtctcgc

SEQ ID NO: 394392 - DNA, 14 bp, Homo sapiens
tttttgatagcttt

SEQ ID NO: 394393 - DNA, 13 bp, Homo sapiens
tttttgatgtcag

SEQ ID NO: 394394 - DNA, 20 bp, Homo sapiens
tttttggaggtgcttaagca

SEQ ID NO: 394395 - DNA, 18 bp, Homo sapiens
tttttggttgtcaatatt

SEQ ID NO: 394396 - DNA, 13 bp, Homo sapiens
tttttgtaaactg

SEQ ID NO: 394397 - DNA, 14 bp, Homo sapiens
tttttgtaaactgt

SEQ ID NO: 394398 - DNA, 12 bp, Homo sapiens
tttttgtaaata

SEQ ID NO: 394399 - DNA, 14 bp, Homo sapiens
tttttgtactgtgc

SEQ ID NO: 394400 - DNA, 13 bp, Homo sapiens
tttttgtgtttct

SEQ ID NO: 394401 - DNA, 17 bp, Homo sapiens
tttttgttttgttttgt

SEQ ID NO: 394402 - DNA, 13 bp, Homo sapiens
tttttgtttttta

SEQ ID NO: 394403 - DNA, 23 bp, Homo sapiens
ttttttaaatgattccaaataaa

SEQ ID NO: 394404 - DNA, 11 bp, Homo sapiens
ttttttaactg

SEQ ID NO: 394405 - DNA, 15 bp, Homo sapiens
ttttttatgttttgt

SEQ ID NO: 394406 - DNA, 18 bp, Homo sapiens
ttttttcaatatttatta

SEQ ID NO: 394407 - DNA, 19 bp, Homo sapiens
ttttttcacctgaaacact

SEQ ID NO: 394408 - DNA, 14 bp, Homo sapiens
ttttttcctgtcaa

SEQ ID NO: 394409 - DNA, 11 bp, Homo sapiens
ttttttctacc

SEQ ID NO: 394410 - DNA, 12 bp, Homo sapiens
ttttttctcttc

SEQ ID NO: 394411 - DNA, 14 bp, Homo sapiens
ttttttctggtaag

SEQ ID NO: 394412 - DNA, 13 bp, Homo sapiens
ttttttgatcctg

SEQ ID NO: 394413 - DNA, 18 bp, Homo sapiens
ttttttggttgtttgctg

SEQ ID NO: 394414 - DNA, 13 bp, Homo sapiens
ttttttgtatttc

SEQ ID NO: 394415 - DNA, 21 bp, Homo sapiens
tttttttaatagtcattccaa

SEQ ID NO: 394416 - DNA, 13 bp, Homo sapiens
tttttttgtaaac

SEQ ID NO: 394417 - DNA, 17 bp, Homo sapiens
gcgccttctacctgcag

SEQ ID NO: 394418 - DNA, 14 bp, Homo sapiens
gcgcgcaccgccca

SEQ ID NO: 394419 - DNA, 22 bp, Homo sapiens
gcgcgcaccgcccaacccccac

SEQ ID NO: 394420 - DNA, 20 bp, Homo sapiens
gcgcggatgtagcatgttct

SEQ ID NO: 394421 - DNA, 15 bp, Homo sapiens
gcgcgggagagagtg

SEQ ID NO: 394422 - DNA, 17 bp, Homo sapiens
gcgcgggaggcaccagc

SEQ ID NO: 394423 - DNA, 19 bp, Homo sapiens
gcgcggtggctcacgcctg

SEQ ID NO: 394424 - DNA, 13 bp, Homo sapiens
gcgcgtctgcccc

SEQ ID NO: 394425 - DNA, 13 bp, Homo sapiens
gcgctcacctgca

SEQ ID NO: 394426 - DNA, 10 bp, Homo sapiens
gcgctcagga

SEQ ID NO: 394427 - DNA, 13 bp, Homo sapiens
gcgctcaggaccc

SEQ ID NO: 394428 - DNA, 23 bp, Homo sapiens
gcgctccaggccactctcagaga

SEQ ID NO: 394429 - DNA, 19 bp, Homo sapiens
gcgctccctgtcgcctgcg

SEQ ID NO: 394430 - DNA, 21 bp, Homo sapiens
gcgctccggcagaggcagggc

SEQ ID NO: 394431 - DNA, 12 bp, Homo sapiens
gcgctcctctgc

SEQ ID NO: 394432 - DNA, 17 bp, Homo sapiens
gcgctcctctgcagcct

SEQ ID NO: 394433 - DNA, 13 bp, Homo sapiens
gcgctcctctgcc

SEQ ID NO: 394434 - DNA, 20 bp, Homo sapiens
gcgctctgcccctccgtccc

SEQ ID NO: 394435 - DNA, 16 bp, Homo sapiens
gcgctcttcaccagga

SEQ ID NO: 394436 - DNA, 17 bp, Homo sapiens
gcgctcttggtccctgg

SEQ ID NO: 394437 - DNA, 18 bp, Homo sapiens
gcgctcttggtccctggt

SEQ ID NO: 394438 - DNA, 13 bp, Homo sapiens
gcgctgcccacac

SEQ ID NO: 394439 - DNA, 18 bp, Homo sapiens
gcgctggaatccagaagg

SEQ ID NO: 394440 - DNA, 22 bp, Homo sapiens
gcgctggaatccagaaggaagc

SEQ ID NO: 394441 - DNA, 11 bp, Homo sapiens
gcgctgtgctc

SEQ ID NO: 394442 - DNA, 17 bp, Homo sapiens
gcgctgtgctccagcag

SEQ ID NO: 394443 - DNA, 14 bp, Homo sapiens
gcggaacctggctg

SEQ ID NO: 394444 - DNA, 21 bp, Homo sapiens
gcggaagtacttccctcaggc

SEQ ID NO: 394445 - DNA, 18 bp, Homo sapiens
gcggaccggagcggctga

SEQ ID NO: 394446 - DNA, 19 bp, Homo sapiens
gcggactccatggcccttc

SEQ ID NO: 394447 - DNA, 20 bp, Homo sapiens
gcggaggggcttggagcaga

SEQ ID NO: 394448 - DNA, 21 bp, Homo sapiens
gcggaggggcttggagcagag

SEQ ID NO: 394449 - DNA, 23 bp, Homo sapiens
gcggaggggcttggagcagagac

SEQ ID NO: 394450 - DNA, 18 bp, Homo sapiens
gcggcacgccaacagccc

SEQ ID NO: 394451 - DNA, 20 bp, Homo sapiens
gcggcacgccaacagccccc

SEQ ID NO: 394452 - DNA, 15 bp, Homo sapiens
gcggcagccccactt

SEQ ID NO: 394453 - DNA, 21 bp, Homo sapiens
gcggcagctcttctgggcaga

SEQ ID NO: 394454 - DNA, 17 bp, Homo sapiens
gcggcccggcccacgca

SEQ ID NO: 394455 - DNA, 23 bp, Homo sapiens
gcggcccggcccacgcagagccc

SEQ ID NO: 394456 - DNA, 16 bp, Homo sapiens
gcggccgcctgtcctt

SEQ ID NO: 394457 - DNA, 13 bp, Homo sapiens
gcggccggcctgg

SEQ ID NO: 394458 - DNA, 17 bp, Homo sapiens
gcggccggcctggggcc

SEQ ID NO: 394459 - DNA, 18 bp, Homo sapiens
gcggccggcctggggccg

SEQ ID NO: 394460 - DNA, 23 bp, Homo sapiens
gcggccggcctggggccgggctg

SEQ ID NO: 394461 - DNA, 20 bp, Homo sapiens
gcggcctttgttgctcagca

SEQ ID NO: 394462 - DNA, 14 bp, Homo sapiens
gcggctaggccggc

SEQ ID NO: 394463 - DNA, 21 bp, Homo sapiens
gcggctaggccggccagctcc

SEQ ID NO: 394464 - DNA, 16 bp, Homo sapiens
gcggctgagagcccca

SEQ ID NO: 394465 - DNA, 22 bp, Homo sapiens
gcggctgagagccccagctgac

SEQ ID NO: 394466 - DNA, 14 bp, Homo sapiens
gcggctgaggacgg

SEQ ID NO: 394467 - DNA, 19 bp, Homo sapiens
gcggcttcctgtccactct

SEQ ID NO: 394468 - DNA, 19 bp, Homo sapiens
gcggcttcgcgctggaatc

SEQ ID NO: 394469 - DNA, 23 bp, Homo sapiens
gcgggaatactcttggtcacctc

SEQ ID NO: 394470 - DNA, 16 bp, Homo sapiens
gcgggagacctgtgct

SEQ ID NO: 394471 - DNA, 13 bp, Homo sapiens
gcgggcagcccct

SEQ ID NO: 394472 - DNA, 14 bp, Homo sapiens
gcgggcagcccctg

SEQ ID NO: 394473 - DNA, 21 bp, Homo sapiens
gcgggcagcccctgctggacc

SEQ ID NO: 394474 - DNA, 22 bp, Homo sapiens
gcgggcagcccctgctggacca

SEQ ID NO: 394475 - DNA, 19 bp, Homo sapiens
gcgggcagtgacgtgagtg

SEQ ID NO: 394476 - DNA, 14 bp, Homo sapiens
gcgggcgctgctgg

SEQ ID NO: 394477 - DNA, 16 bp, Homo sapiens
gcgggcggccaggcaa

SEQ ID NO: 394478 - DNA, 14 bp, Homo sapiens
gcgggctgggcagc

SEQ ID NO: 394479 - DNA, 16 bp, Homo sapiens
gcggggaccctgccga

SEQ ID NO: 394480 - DNA, 19 bp, Homo sapiens
gcggggccttgtctcttcc

SEQ ID NO: 394481 - DNA, 20 bp, Homo sapiens
gcgggggctaactggcccca

SEQ ID NO: 394482 - DNA, 11 bp, Homo sapiens
gcggggggagg

SEQ ID NO: 394483 - DNA, 14 bp, Homo sapiens
gcgggtaaaaagag

SEQ ID NO: 394484 - DNA, 24 bp, Homo sapiens
gcgggtagatgatttctagcaggc

SEQ ID NO: 394485 - DNA, 22 bp, Homo sapiens
gcgggtatgaagtgtggggcgg

SEQ ID NO: 394486 - DNA, 13 bp, Homo sapiens
gcgggttctagac

SEQ ID NO: 394487 - DNA, 11 bp, Homo sapiens
gcggtacccca

SEQ ID NO: 394488 - DNA, 16 bp, Homo sapiens
gcggtaggtgctggcc

SEQ ID NO: 394489 - DNA, 23 bp, Homo sapiens
gcggtcaataattgtggagagga

SEQ ID NO: 394490 - DNA, 22 bp, Homo sapiens
gcggtccccatccccaccagct

SEQ ID NO: 394491 - DNA, 17 bp, Homo sapiens
gcggtgaggcaggggag

SEQ ID NO: 394492 - DNA, 19 bp, Homo sapiens
gcggtgatcagcagagaga

SEQ ID NO: 394493 - DNA, 13 bp, Homo sapiens
gcggtgctctggc

SEQ ID NO: 394494 - DNA, 17 bp, Homo sapiens
gcggtggaaggagcctg

SEQ ID NO: 394495 - DNA, 19 bp, Homo sapiens
gcggttcaggtcagggcta

SEQ ID NO: 394496 - DNA, 14 bp, Homo sapiens
gcgtaatgggcctg

SEQ ID NO: 394497 - DNA, 17 bp, Homo sapiens
gcgtagggccagggctc

SEQ ID NO: 394498 - DNA, 22 bp, Homo sapiens
gcgtccactttcccttcccctg

SEQ ID NO: 394499 - DNA, 21 bp, Homo sapiens
gcgtccggggtggtggacagg

SEQ ID NO: 394500 - DNA, 18 bp, Homo sapiens
gcgtcctgacgccctgcg

SEQ ID NO: 394501 - DNA, 16 bp, Homo sapiens
gcgtcctgaggaataa

SEQ ID NO: 394502 - DNA, 19 bp, Homo sapiens
gcgtctctgtcgtggacac

SEQ ID NO: 394503 - DNA, 18 bp, Homo sapiens
gcgtctgagcggccgcct

SEQ ID NO: 394504 - DNA, 13 bp, Homo sapiens
gcgtcttcctgag

SEQ ID NO: 394505 - DNA, 21 bp, Homo sapiens
gcgtcttcctgagtggtgcca

SEQ ID NO: 394506 - DNA, 14 bp, Homo sapiens
gcgtcttgtatttt

SEQ ID NO: 394507 - DNA, 16 bp, Homo sapiens
gcgtcttgtattttct

SEQ ID NO: 394508 - DNA, 20 bp, Homo sapiens
gcgtgaccggcccgccacct

SEQ ID NO: 394509 - DNA, 16 bp, Homo sapiens
gcgtgacggacatcca

SEQ ID NO: 394510 - DNA, 17 bp, Homo sapiens
gcgtgcccccctcctcc

SEQ ID NO: 394511 - DNA, 14 bp, Homo sapiens
gcgtgccctcgctg

SEQ ID NO: 394512 - DNA, 19 bp, Homo sapiens
gcgtgctgtctgtcctatg

SEQ ID NO: 394513 - DNA, 19 bp, Homo sapiens
gcgtggcctccgtgaccca

SEQ ID NO: 394514 - DNA, 20 bp, Homo sapiens
gcgtggcgcagtggccctga

SEQ ID NO: 394515 - DNA, 15 bp, Homo sapiens
gcgtggctgtggcac

SEQ ID NO: 394516 - DNA, 22 bp, Homo sapiens
gcgtggtgtggagtgtgtgtct

SEQ ID NO: 394517 - DNA, 16 bp, Homo sapiens
gcgtgtctctgccatg

SEQ ID NO: 394518 - DNA, 23 bp, Homo sapiens
gcgtgtgatttgtctctgagccc

SEQ ID NO: 394519 - DNA, 12 bp, Homo sapiens
cctggaatgaag

SEQ ID NO: 394520 - DNA, 19 bp, Homo sapiens
cctggaatgaagcatgtag

SEQ ID NO: 394521 - DNA, 19 bp, Homo sapiens
cctggaattcaccctctca

SEQ ID NO: 394522 - DNA, 21 bp, Homo sapiens
cctggaattcagcaccctggg

SEQ ID NO: 394523 - DNA, 14 bp, Homo sapiens
cctggaccaaagct

SEQ ID NO: 394524 - DNA, 16 bp, Homo sapiens
cctggaccaaagctga

SEQ ID NO: 394525 - DNA, 22 bp, Homo sapiens
cctggaccaccagccccagcaa

SEQ ID NO: 394526 - DNA, 18 bp, Homo sapiens
cctggacccagcaggggc

SEQ ID NO: 394527 - DNA, 20 bp, Homo sapiens
cctggacctgagtcggcccc

SEQ ID NO: 394528 - DNA, 13 bp, Homo sapiens
cctggacctgcct

SEQ ID NO: 394529 - DNA, 21 bp, Homo sapiens
cctggactggcccttgcccaa

SEQ ID NO: 394530 - DNA, 13 bp, Homo sapiens
cctggactttcct

SEQ ID NO: 394531 - DNA, 14 bp, Homo sapiens
cctggagcagcagc

SEQ ID NO: 394532 - DNA, 12 bp, Homo sapiens
cctggagccagc

SEQ ID NO: 394533 - DNA, 14 bp, Homo sapiens
cctggagccagcag

SEQ ID NO: 394534 - DNA, 18 bp, Homo sapiens
cctggagccagcagggct

SEQ ID NO: 394535 - DNA, 20 bp, Homo sapiens
cctggagccagcagggctgt

SEQ ID NO: 394536 - DNA, 14 bp, Homo sapiens
cctggagcccggca

SEQ ID NO: 394537 - DNA, 15 bp, Homo sapiens
cctggagcccggcag

SEQ ID NO: 394538 - DNA, 18 bp, Homo sapiens
cctggagcgtttgctgtg

SEQ ID NO: 394539 - DNA, 22 bp, Homo sapiens
cctggagcgtttgctgtgccag

SEQ ID NO: 394540 - DNA, 13 bp, Homo sapiens
cctggagctcctg

SEQ ID NO: 394541 - DNA, 18 bp, Homo sapiens
cctggagctcctgctggg

SEQ ID NO: 394542 - DNA, 14 bp, Homo sapiens
cctggagctcctgg

SEQ ID NO: 394543 - DNA, 16 bp, Homo sapiens
cctggaggatttcatc

SEQ ID NO: 394544 - DNA, 23 bp, Homo sapiens
cctggagggttgatatattcttt

SEQ ID NO: 394545 - DNA, 24 bp, Homo sapiens
cctggagtcggatctagccatggc

SEQ ID NO: 394546 - DNA, 15 bp, Homo sapiens
cctggagttctggtt

SEQ ID NO: 394547 - DNA, 14 bp, Homo sapiens
ggcctgatggagag

SEQ ID NO: 394548 - DNA, 16 bp, Homo sapiens
ggcctgatggagagga

SEQ ID NO: 394549 - DNA, 15 bp, Homo sapiens
ggcctgcaggcccca

SEQ ID NO: 394550 - DNA, 20 bp, Homo sapiens
ggcctgccaatgccacagcc

SEQ ID NO: 394551 - DNA, 20 bp, Homo sapiens
ggcctgccaggctcctctcc

SEQ ID NO: 394552 - DNA, 15 bp, Homo sapiens
ggcctgcccaatgct

SEQ ID NO: 394553 - DNA, 12 bp, Homo sapiens
ggcctgcccccc

SEQ ID NO: 394554 - DNA, 21 bp, Homo sapiens
ggcctgccccccttcccaccc

SEQ ID NO: 394555 - DNA, 23 bp, Homo sapiens
ggcctgccccccttcccacccct

SEQ ID NO: 394556 - DNA, 21 bp, Homo sapiens
ggcctgccctcacgctctcca

SEQ ID NO: 394557 - DNA, 17 bp, Homo sapiens
ggcctgcctagcactca

SEQ ID NO: 394558 - DNA, 11 bp, Homo sapiens
ggcctgcctgt

SEQ ID NO: 394559 - DNA, 20 bp, Homo sapiens
ggcctgctaaggctcctcct

SEQ ID NO: 394560 - DNA, 21 bp, Homo sapiens
ggcctgctaaggctcctcctt

SEQ ID NO: 394561 - DNA, 17 bp, Homo sapiens
ggcctgctcccagcagc

SEQ ID NO: 394562 - DNA, 24 bp, Homo sapiens
ggcctgcttttccaggatcctgca

SEQ ID NO: 394563 - DNA, 13 bp, Homo sapiens
ggcctggacctgc

SEQ ID NO: 394564 - DNA, 22 bp, Homo sapiens
ggcctggacctgcctcctgcct

SEQ ID NO: 394565 - DNA, 15 bp, Homo sapiens
ggcctggactgtcct

SEQ ID NO: 394566 - DNA, 15 bp, Homo sapiens
ggcctggcagggagg

SEQ ID NO: 394567 - DNA, 14 bp, Homo sapiens
ggcctggccctgcc

SEQ ID NO: 394568 - DNA, 16 bp, Homo sapiens
ggcctggcctcggggc

SEQ ID NO: 394569 - DNA, 21 bp, Homo sapiens
ggcctggcctcggggcagggc

SEQ ID NO: 394570 - DNA, 13 bp, Homo sapiens
ggcctggcctgag

SEQ ID NO: 394571 - DNA, 15 bp, Homo sapiens
ggcctggcctgagct

SEQ ID NO: 394572 - DNA, 14 bp, Homo sapiens
ggcctggctcccca

SEQ ID NO: 394573 - DNA, 14 bp, Homo sapiens
ggcctggctccgct

SEQ ID NO: 394574 - DNA, 17 bp, Homo sapiens
ggcctggcttgctccag

SEQ ID NO: 394575 - DNA, 16 bp, Homo sapiens
ggcctgggacccagct

SEQ ID NO: 394576 - DNA, 12 bp, Homo sapiens
ggcctgggcctc

SEQ ID NO: 394577 - DNA, 18 bp, Homo sapiens
ggcctgggcctcctggga

SEQ ID NO: 394578 - DNA, 13 bp, Homo sapiens
ggcctgggctagg

SEQ ID NO: 394579 - DNA, 22 bp, Homo sapiens
ggcctggggccgggctggcttc

SEQ ID NO: 394580 - DNA, 14 bp, Homo sapiens
ggcctggggctcct

SEQ ID NO: 394581 - DNA, 15 bp, Homo sapiens
ggcctgggggcagtg

SEQ ID NO: 394582 - DNA, 19 bp, Homo sapiens
ggcctgggggcagtgactg

SEQ ID NO: 394583 - DNA, 19 bp, Homo sapiens
ggcctgggtctgtgtctct

SEQ ID NO: 394584 - DNA, 21 bp, Homo sapiens
ggcctgggtgctggctgccca

SEQ ID NO: 394585 - DNA, 22 bp, Homo sapiens
ggcctgggtggggcagggcctg

SEQ ID NO: 394586 - DNA, 13 bp, Homo sapiens
ggcctggtcagca

SEQ ID NO: 394587 - DNA, 21 bp, Homo sapiens
ggcctggtccatgatggagtc

SEQ ID NO: 394588 - DNA, 14 bp, Homo sapiens
ggcctggtctggag

SEQ ID NO: 394589 - DNA, 16 bp, Homo sapiens
ggcctggtctggagcc

SEQ ID NO: 394590 - DNA, 17 bp, Homo sapiens
ggcctgtccacctgtgc

SEQ ID NO: 394591 - DNA, 17 bp, Homo sapiens
ggcctgtccctggccat

SEQ ID NO: 394592 - DNA, 19 bp, Homo sapiens
ggcctgtctcatccccagg

SEQ ID NO: 394593 - DNA, 20 bp, Homo sapiens
ggcctgtgaggtaactggga

SEQ ID NO: 394594 - DNA, 15 bp, Homo sapiens
ggcctgtgctgggcc

SEQ ID NO: 394595 - DNA, 17 bp, Homo sapiens
ggcctgtgggagcctgc

SEQ ID NO: 394596 - DNA, 18 bp, Homo sapiens
ggcctgtgtccagcagct

SEQ ID NO: 394597 - DNA, 19 bp, Homo sapiens
ggcctgtgtccagcagctg

SEQ ID NO: 394598 - DNA, 21 bp, Homo sapiens
ggcctgtgtccagcagctgcg

SEQ ID NO: 394599 - DNA, 15 bp, Homo sapiens
ggcctgtgtgtaagc

SEQ ID NO: 394600 - DNA, 22 bp, Homo sapiens
ggcctgttctgtaggagagact

SEQ ID NO: 394601 - DNA, 13 bp, Homo sapiens
ggccttcctgccc

SEQ ID NO: 394602 - DNA, 15 bp, Homo sapiens
ggccttctcagctct

SEQ ID NO: 394603 - DNA, 22 bp, Homo sapiens
ggccttctttctagagagggaa

SEQ ID NO: 394604 - DNA, 20 bp, Homo sapiens
ggccttggggccagactggc

SEQ ID NO: 394605 - DNA, 18 bp, Homo sapiens
ggccttggttcctccagc

SEQ ID NO: 394606 - DNA, 13 bp, Homo sapiens
ggcctttcaggaa

SEQ ID NO: 394607 - DNA, 15 bp, Homo sapiens
ggcctttcaggaagg

SEQ ID NO: 394608 - DNA, 16 bp, Homo sapiens
ggcctttcagtcccaa

SEQ ID NO: 394609 - DNA, 18 bp, Homo sapiens
ggcctttgtaagacacac

SEQ ID NO: 394610 - DNA, 19 bp, Homo sapiens
ggcctttgtaagacacaca

SEQ ID NO: 394611 - DNA, 21 bp, Homo sapiens
ggcctttgtaagacacacagc

SEQ ID NO: 394612 - DNA, 17 bp, Homo sapiens
ggcgaatctacagaaca

SEQ ID NO: 394613 - DNA, 13 bp, Homo sapiens
ggcgagccaggca

SEQ ID NO: 394614 - DNA, 11 bp, Homo sapiens
ggcgagccctt

SEQ ID NO: 394615 - DNA, 11 bp, Homo sapiens
ggcgaggcaga

SEQ ID NO: 394616 - DNA, 19 bp, Homo sapiens
ggcgaggcagaggacagat

SEQ ID NO: 394617 - DNA, 15 bp, Homo sapiens
ggcgaggctgcctct

SEQ ID NO: 394618 - DNA, 19 bp, Homo sapiens
ggcgaggctgcctctgggt

SEQ ID NO: 394619 - DNA, 15 bp, Homo sapiens
ggcgagggaggggag

SEQ ID NO: 394620 - DNA, 20 bp, Homo sapiens
ggcgagggaggggaggtggc

SEQ ID NO: 394621 - DNA, 17 bp, Homo sapiens
ggcgatatgagagggat

SEQ ID NO: 394622 - DNA, 20 bp, Homo sapiens
ggcgcacccggcagcccccc

SEQ ID NO: 394623 - DNA, 13 bp, Homo sapiens
ggcgcagagggaa

SEQ ID NO: 394624 - DNA, 18 bp, Homo sapiens
ggcgcagccctagtggga

SEQ ID NO: 394625 - DNA, 12 bp, Homo sapiens
ggcgcccacctg

SEQ ID NO: 394626 - DNA, 15 bp, Homo sapiens
ggcgcccacctgccc

SEQ ID NO: 394627 - DNA, 16 bp, Homo sapiens
ggcgcccacctgccca

SEQ ID NO: 394628 - DNA, 17 bp, Homo sapiens
ggcgcccacctgcccag

SEQ ID NO: 394629 - DNA, 21 bp, Homo sapiens
ggcgcccattcgtctgtccca

SEQ ID NO: 394630 - DNA, 12 bp, Homo sapiens
ggcgccctggaa

SEQ ID NO: 394631 - DNA, 14 bp, Homo sapiens
ggcgccctggaagc

SEQ ID NO: 394632 - DNA, 18 bp, Homo sapiens
ggcgcctgcgctcctctg

SEQ ID NO: 394633 - DNA, 19 bp, Homo sapiens
ggcgcctgcgctcctctgc

SEQ ID NO: 394634 - DNA, 20 bp, Homo sapiens
ggcgcctgcgctcctctgca

SEQ ID NO: 394635 - DNA, 21 bp, Homo sapiens
ggcgcctgcgctcctctgcag

SEQ ID NO: 394636 - DNA, 13 bp, Homo sapiens
ggcgcgcaccgcc

SEQ ID NO: 394637 - DNA, 15 bp, Homo sapiens
ggcgcgcaccgccca

SEQ ID NO: 394638 - DNA, 12 bp, Homo sapiens
ggcgcggttcag

SEQ ID NO: 394639 - DNA, 14 bp, Homo sapiens
ggcgcgtctgcccc

SEQ ID NO: 394640 - DNA, 17 bp, Homo sapiens
ggcgcgtctgccccacc

SEQ ID NO: 394641 - DNA, 20 bp, Homo sapiens
ggcgcgtctgccccaccctc

SEQ ID NO: 394642 - DNA, 16 bp, Homo sapiens
ggcgctattacaaata

SEQ ID NO: 394643 - DNA, 11 bp, Homo sapiens
ggcgctcagga

SEQ ID NO: 394644 - DNA, 20 bp, Homo sapiens
ggcgctcaggacccaggccc

SEQ ID NO: 394645 - DNA, 16 bp, Homo sapiens
ggcgctccggcagagg

SEQ ID NO: 394646 - DNA, 17 bp, Homo sapiens
ggcgctccggcagaggc

SEQ ID NO: 394647 - DNA, 14 bp, Homo sapiens
ggcgctgctgggag

SEQ ID NO: 394648 - DNA, 14 bp, Homo sapiens
ggcggaacctggct

SEQ ID NO: 394649 - DNA, 16 bp, Homo sapiens
ggcggaacctggctgc

SEQ ID NO: 394650 - DNA, 16 bp, Homo sapiens
ggcggatcacaaggtc

SEQ ID NO: 394651 - DNA, 22 bp, Homo sapiens
ggcggatcacaaggtcaggagt

SEQ ID NO: 394652 - DNA, 19 bp, Homo sapiens
ggcggctggaaagaggaga

SEQ ID NO: 394653 - DNA, 17 bp, Homo sapiens
ggcggcttcctgtccac

SEQ ID NO: 394654 - DNA, 18 bp, Homo sapiens
ggcggcttcctgtccact

SEQ ID NO: 394655 - DNA, 20 bp, Homo sapiens
ggcggcttcgcgctggaatc

SEQ ID NO: 394656 - DNA, 16 bp, Homo sapiens
ggcgggagatggaccc

SEQ ID NO: 394657 - DNA, 14 bp, Homo sapiens
ggcgggcagcccct

SEQ ID NO: 394658 - DNA, 14 bp, Homo sapiens
ggcgggccaggaga

SEQ ID NO: 394659 - DNA, 12 bp, Homo sapiens
ggcggggcagga

SEQ ID NO: 394660 - DNA, 16 bp, Homo sapiens
ggcggggccaggatgg

SEQ ID NO: 394661 - DNA, 14 bp, Homo sapiens
ggcgggggagcctg

SEQ ID NO: 394662 - DNA, 17 bp, Homo sapiens
ggcgggggagcctggag

SEQ ID NO: 394663 - DNA, 14 bp, Homo sapiens
ggcgggggatcctg

SEQ ID NO: 394664 - DNA, 23 bp, Homo sapiens
ggcgggggatcctggagcccctg

SEQ ID NO: 394665 - DNA, 19 bp, Homo sapiens
ggcggtgaccgctgcagga

SEQ ID NO: 394666 - DNA, 15 bp, Homo sapiens
ggcgtaatgggcctg

SEQ ID NO: 394667 - DNA, 13 bp, Homo sapiens
ggcgtagggccag

SEQ ID NO: 394668 - DNA, 18 bp, Homo sapiens
ggcgtagggccagggctc

SEQ ID NO: 394669 - DNA, 12 bp, Homo sapiens
ggcgtgatctcg

SEQ ID NO: 394670 - DNA, 19 bp, Homo sapiens
ggcgtgcccccctcctcca

SEQ ID NO: 394671 - DNA, 22 bp, Homo sapiens
ggcgtgcccccctcctccagta

SEQ ID NO: 394672 - DNA, 12 bp, Homo sapiens
ggcgtgctcctt

SEQ ID NO: 394673 - DNA, 13 bp, Homo sapiens
ggcgtgctccttt

SEQ ID NO: 394674 - DNA, 16 bp, Homo sapiens
ggcgtgggatccagag

SEQ ID NO: 394675 - DNA, 22 bp, Homo sapiens
ggcgtggggggagctctggtgg

SEQ ID NO: 394676 - DNA, 23 bp, Homo sapiens
ggcgtgtccctcctcttcctgta

SEQ ID NO: 394677 - DNA, 18 bp, Homo sapiens
ggcgtgtgtccctgtggt

SEQ ID NO: 394678 - DNA, 15 bp, Homo sapiens
ggcgttctcctgctt

SEQ ID NO: 394679 - DNA, 16 bp, Homo sapiens
ggctaaaaacatttta

SEQ ID NO: 394680 - DNA, 19 bp, Homo sapiens
ggctaaagaagacacacag

SEQ ID NO: 394681 - DNA, 17 bp, Homo sapiens
ggctaactatatttgct

SEQ ID NO: 394682 - DNA, 22 bp, Homo sapiens
ctacgaccccagagtgactgac

SEQ ID NO: 394683 - DNA, 13 bp, Homo sapiens
ctacgctcctgtc

SEQ ID NO: 394684 - DNA, 14 bp, Homo sapiens
ctacgctcctgtct

SEQ ID NO: 394685 - DNA, 21 bp, Homo sapiens
ctacggagggaccaggtgtct

SEQ ID NO: 394686 - DNA, 17 bp, Homo sapiens
ctacggtagtgatgaaa

SEQ ID NO: 394687 - DNA, 20 bp, Homo sapiens
ctacggtagtgatgaaatta

SEQ ID NO: 394688 - DNA, 21 bp, Homo sapiens
ctacgtataaatatgaaatga

SEQ ID NO: 394689 - DNA, 15 bp, Homo sapiens
ctactaaaaatgcaa

SEQ ID NO: 394690 - DNA, 12 bp, Homo sapiens
ctactaaagtgc

SEQ ID NO: 394691 - DNA, 16 bp, Homo sapiens
ctactaacctggagac

SEQ ID NO: 394692 - DNA, 18 bp, Homo sapiens
ctactaacctggagacag

SEQ ID NO: 394693 - DNA, 23 bp, Homo sapiens
ctactaagaaaatagagatgagc

SEQ ID NO: 394694 - DNA, 17 bp, Homo sapiens
ctactaccacaaggaaa

SEQ ID NO: 394695 - DNA, 19 bp, Homo sapiens
ctactaccacaaggaaaat

SEQ ID NO: 394696 - DNA, 17 bp, Homo sapiens
ctactatgtgcgagaca

SEQ ID NO: 394697 - DNA, 16 bp, Homo sapiens
ctactatgtgctgggt

SEQ ID NO: 394698 - DNA, 20 bp, Homo sapiens
ctactatgtgctgggtgcct

SEQ ID NO: 394699 - DNA, 17 bp, Homo sapiens
ctactcacagtctcttt

SEQ ID NO: 394700 - DNA, 20 bp, Homo sapiens
ctactcctctgcagtgcctt

SEQ ID NO: 394701 - DNA, 16 bp, Homo sapiens
ctactctgtccaggcc

SEQ ID NO: 394702 - DNA, 13 bp, Homo sapiens
ctactctgtgtaa

SEQ ID NO: 394703 - DNA, 22 bp, Homo sapiens
ctactcttaaatatacaacttt

SEQ ID NO: 394704 - DNA, 15 bp, Homo sapiens
ctactcttgtcattt

SEQ ID NO: 394705 - DNA, 20 bp, Homo sapiens
ctactctttggcactttttc

SEQ ID NO: 394706 - DNA, 17 bp, Homo sapiens
ctactgagccacggacc

SEQ ID NO: 394707 - DNA, 13 bp, Homo sapiens
ctactgagtaggc

SEQ ID NO: 394708 - DNA, 16 bp, Homo sapiens
ctactgattgaatgtt

SEQ ID NO: 394709 - DNA, 16 bp, Homo sapiens
ctactgatttcctttg

SEQ ID NO: 394710 - DNA, 13 bp, Homo sapiens
ctactgcaagttc

SEQ ID NO: 394711 - DNA, 17 bp, Homo sapiens
ctactgcagctttacat

SEQ ID NO: 394712 - DNA, 17 bp, Homo sapiens
ctactgcttcctctgaa

SEQ ID NO: 394713 - DNA, 22 bp, Homo sapiens
ctactgcttcctctgaatatta

SEQ ID NO: 394714 - DNA, 22 bp, Homo sapiens
ctactggataaacttgcttcag

SEQ ID NO: 394715 - DNA, 11 bp, Homo sapiens
ctactggcagc

SEQ ID NO: 394716 - DNA, 12 bp, Homo sapiens
ctactggcagct

SEQ ID NO: 394717 - DNA, 16 bp, Homo sapiens
ctactggcagctcctc

SEQ ID NO: 394718 - DNA, 14 bp, Homo sapiens
ctactggtctgtac

SEQ ID NO: 394719 - DNA, 12 bp, Homo sapiens
ctactgtacatt

SEQ ID NO: 394720 - DNA, 19 bp, Homo sapiens
ctactgtagaactgcaatt

SEQ ID NO: 394721 - DNA, 21 bp, Homo sapiens
ctactgtagaactgcaatttc

SEQ ID NO: 394722 - DNA, 13 bp, Homo sapiens
ctactgtcagtgt

SEQ ID NO: 394723 - DNA, 17 bp, Homo sapiens
ctactgtcagtgtcctc

SEQ ID NO: 394724 - DNA, 14 bp, Homo sapiens
ctactgtgttcctg

SEQ ID NO: 394725 - DNA, 19 bp, Homo sapiens
ctactgtgttcctggcaat

SEQ ID NO: 394726 - DNA, 14 bp, Homo sapiens
ctacttaaacaaaa

SEQ ID NO: 394727 - DNA, 16 bp, Homo sapiens
ctacttaaacaaaaac

SEQ ID NO: 394728 - DNA, 15 bp, Homo sapiens
ctacttaattccttt

SEQ ID NO: 394729 - DNA, 15 bp, Homo sapiens
ctacttcctcctcct

SEQ ID NO: 394730 - DNA, 16 bp, Homo sapiens
ctacttcctcctcctc

SEQ ID NO: 394731 - DNA, 15 bp, Homo sapiens
ctacttctgtgtctg

SEQ ID NO: 394732 - DNA, 18 bp, Homo sapiens
ctacttctgtgtctgtca

SEQ ID NO: 394733 - DNA, 20 bp, Homo sapiens
ctacttctgtgtctgtcacc

SEQ ID NO: 394734 - DNA, 21 bp, Homo sapiens
ctacttctgtgtctgtcacca

SEQ ID NO: 394735 - DNA, 14 bp, Homo sapiens
ctacttctttttct

SEQ ID NO: 394736 - DNA, 14 bp, Homo sapiens
ctacttgagagtgg

SEQ ID NO: 394737 - DNA, 19 bp, Homo sapiens
ctacttgatatttccttca

SEQ ID NO: 394738 - DNA, 16 bp, Homo sapiens
ctacttgggagcctga

SEQ ID NO: 394739 - DNA, 18 bp, Homo sapiens
ctacttgggagcctgagg

SEQ ID NO: 394740 - DNA, 23 bp, Homo sapiens
ctacttgggagcctgaggcagga

SEQ ID NO: 394741 - DNA, 17 bp, Homo sapiens
ctacttgtgactgaagg

SEQ ID NO: 394742 - DNA, 14 bp, Homo sapiens
ctacttttacttgt

SEQ ID NO: 394743 - DNA, 19 bp, Homo sapiens
ctacttttacttgttcatt

SEQ ID NO: 394744 - DNA, 14 bp, Homo sapiens
ctagaaaaaacata

SEQ ID NO: 394745 - DNA, 17 bp, Homo sapiens
ctagaaaagcttcctag

SEQ ID NO: 394746 - DNA, 23 bp, Homo sapiens
ctagaaagaaaagaccctgagac

SEQ ID NO: 394747 - DNA, 20 bp, Homo sapiens
ctagaaagccatattccagc

SEQ ID NO: 394748 - DNA, 21 bp, Homo sapiens
ctagaaagccatattccagca

SEQ ID NO: 394749 - DNA, 15 bp, Homo sapiens
ctagaaagcccctca

SEQ ID NO: 394750 - DNA, 20 bp, Homo sapiens
ctagaaagcccctcacctca

SEQ ID NO: 394751 - DNA, 22 bp, Homo sapiens
ctagaaagctctgcatgtgtgt

SEQ ID NO: 394752 - DNA, 19 bp, Homo sapiens
ctagaaagtggcagagcca

SEQ ID NO: 394753 - DNA, 17 bp, Homo sapiens
ctagaaatatgatttta

SEQ ID NO: 394754 - DNA, 23 bp, Homo sapiens
ctagaagaaagtaaaaagaacaa

SEQ ID NO: 394755 - DNA, 20 bp, Homo sapiens
ctagaagggccagtcctgcc

SEQ ID NO: 394756 - DNA, 14 bp, Homo sapiens
ctagaatcctgctt

SEQ ID NO: 394757 - DNA, 16 bp, Homo sapiens
ctagaatcctgcttta

SEQ ID NO: 394758 - DNA, 21 bp, Homo sapiens
ctagaatggaaaactgcctgt

SEQ ID NO: 394759 - DNA, 12 bp, Homo sapiens
ctagaatttatt

SEQ ID NO: 394760 - DNA, 16 bp, Homo sapiens
ctagacaaaggcccag

SEQ ID NO: 394761 - DNA, 17 bp, Homo sapiens
ctagacaaaggcccaga

SEQ ID NO: 394762 - DNA, 13 bp, Homo sapiens
ctagacaaccctg

SEQ ID NO: 394763 - DNA, 15 bp, Homo sapiens
ctagacagtattgcc

SEQ ID NO: 394764 - DNA, 16 bp, Homo sapiens
ctagacctccagctgt

SEQ ID NO: 394765 - DNA, 20 bp, Homo sapiens
ctagacgagcaggcttcttc

SEQ ID NO: 394766 - DNA, 21 bp, Homo sapiens
ctagacgagcaggcttcttcc

SEQ ID NO: 394767 - DNA, 15 bp, Homo sapiens
ctagacgcccctccc

SEQ ID NO: 394768 - DNA, 16 bp, Homo sapiens
ctagacgcccctccca

SEQ ID NO: 394769 - DNA, 17 bp, Homo sapiens
ctagacgcccctcccaa

SEQ ID NO: 394770 - DNA, 14 bp, Homo sapiens
ctagactaggagac

SEQ ID NO: 394771 - DNA, 18 bp, Homo sapiens
ctagactaggagaccaga

SEQ ID NO: 394772 - DNA, 14 bp, Homo sapiens
ctagactggagtga

SEQ ID NO: 394773 - DNA, 19 bp, Homo sapiens
ctagacttcccaacagcct

SEQ ID NO: 394774 - DNA, 14 bp, Homo sapiens
ctagacttccccat

SEQ ID NO: 394775 - DNA, 20 bp, Homo sapiens
ctagacttgaaagttttcca

SEQ ID NO: 394776 - DNA, 15 bp, Homo sapiens
ctagagacagaagca

SEQ ID NO: 394777 - DNA, 20 bp, Homo sapiens
ctagagacagaagcaggctg

SEQ ID NO: 394778 - DNA, 23 bp, Homo sapiens
ctagagacgcaccttgctgcagt

SEQ ID NO: 394779 - DNA, 20 bp, Homo sapiens
ctagagaggggcctctggct

SEQ ID NO: 394780 - DNA, 19 bp, Homo sapiens
ctagagattcttagctctt

SEQ ID NO: 394781 - DNA, 14 bp, Homo sapiens
ctagagcaacccct

SEQ ID NO: 394782 - DNA, 16 bp, Homo sapiens
ctagagcaacccctgt

SEQ ID NO: 394783 - DNA, 15 bp, Homo sapiens
ctagagcagggatta

SEQ ID NO: 394784 - DNA, 18 bp, Homo sapiens
ctagaggcaacagtgttc

SEQ ID NO: 394785 - DNA, 17 bp, Homo sapiens
ctagaggccagccccac

SEQ ID NO: 394786 - DNA, 22 bp, Homo sapiens
ctagaggccagccccacccagg

SEQ ID NO: 394787 - DNA, 23 bp, Homo sapiens
ctagaggccagccccacccagga

SEQ ID NO: 394788 - DNA, 17 bp, Homo sapiens
ctagaggcgagccaggc

SEQ ID NO: 394789 - DNA, 19 bp, Homo sapiens
ctagagggttcctgtagac

SEQ ID NO: 394790 - DNA, 16 bp, Homo sapiens
ctagaggtgggcagct

SEQ ID NO: 394791 - DNA, 21 bp, Homo sapiens
ctagaggtgggcagctgggcc

SEQ ID NO: 394792 - DNA, 23 bp, Homo sapiens
ctagaggtgggcagctgggcccc

SEQ ID NO: 394793 - DNA, 19 bp, Homo sapiens
ctagagtcctcactcccag

SEQ ID NO: 394794 - DNA, 16 bp, Homo sapiens
ctagagtctgaacagc

SEQ ID NO: 394795 - DNA, 16 bp, Homo sapiens
ctagagttttatcaac

SEQ ID NO: 394796 - DNA, 16 bp, Homo sapiens
ctagataacttaaata

SEQ ID NO: 394797 - DNA, 18 bp, Homo sapiens
ctagataacttaaataat

SEQ ID NO: 394798 - DNA, 17 bp, Homo sapiens
ctagatagctattaaga

SEQ ID NO: 394799 - DNA, 16 bp, Homo sapiens
ctagatagctgactca

SEQ ID NO: 394800 - DNA, 18 bp, Homo sapiens
ctagatcagagagcaaga

SEQ ID NO: 394801 - DNA, 18 bp, Homo sapiens
ctagatcctgcaccccag

SEQ ID NO: 394802 - DNA, 19 bp, Homo sapiens
ctagatcctgcaccccagc

SEQ ID NO: 394803 - DNA, 21 bp, Homo sapiens
ctagatgagaattcagctgcc

SEQ ID NO: 394804 - DNA, 20 bp, Homo sapiens
ctagatgggcatggggtggg

SEQ ID NO: 394805 - DNA, 19 bp, Homo sapiens
ctagatggtgctgagaagc

SEQ ID NO: 394806 - DNA, 22 bp, Homo sapiens
ctagatggtgctgagaagcttt

SEQ ID NO: 394807 - DNA, 13 bp, Homo sapiens
ctagcaaaatgct

SEQ ID NO: 394808 - DNA, 18 bp, Homo sapiens
aaaatgtgtgcttggaaa

SEQ ID NO: 394809 - DNA, 19 bp, Homo sapiens
aaaatgtgtgcttggaaaa

SEQ ID NO: 394810 - DNA, 18 bp, Homo sapiens
aaaatgttaacaacttga

SEQ ID NO: 394811 - DNA, 14 bp, Homo sapiens
aaaatgttctgaca

SEQ ID NO: 394812 - DNA, 18 bp, Homo sapiens
aaaattatggtgaaatta

SEQ ID NO: 394813 - DNA, 18 bp, Homo sapiens
aaaattattaaaaattat

SEQ ID NO: 394814 - DNA, 19 bp, Homo sapiens
aaaattattaaaaattata

SEQ ID NO: 394815 - DNA, 20 bp, Homo sapiens
aaaattattccctgaattgt

SEQ ID NO: 394816 - DNA, 20 bp, Homo sapiens
aaaattatttgccttttaaa

SEQ ID NO: 394817 - DNA, 19 bp, Homo sapiens
aaaattattttaaacaaaa

SEQ ID NO: 394818 - DNA, 16 bp, Homo sapiens
aaaattcaaaaagtgt

SEQ ID NO: 394819 - DNA, 23 bp, Homo sapiens
ctagccaaatggtttaacttctg

SEQ ID NO: 394820 - DNA, 16 bp, Homo sapiens
ctagccaacatggtga

SEQ ID NO: 394821 - DNA, 13 bp, Homo sapiens
ctagccagagaat

SEQ ID NO: 394822 - DNA, 17 bp, Homo sapiens
ctagccagagcccttca

SEQ ID NO: 394823 - DNA, 13 bp, Homo sapiens
ctagccaggagtc

SEQ ID NO: 394824 - DNA, 21 bp, Homo sapiens
ctagccaggagtctgtgctct

SEQ ID NO: 394825 - DNA, 17 bp, Homo sapiens
ctagccaggcctcccgc

SEQ ID NO: 394826 - DNA, 18 bp, Homo sapiens
ctagccaggcctcccgca

SEQ ID NO: 394827 - DNA, 12 bp, Homo sapiens
ctagcccaccct

SEQ ID NO: 394828 - DNA, 18 bp, Homo sapiens
ctagcccaccctgctgcc

SEQ ID NO: 394829 - DNA, 20 bp, Homo sapiens
ctagcccaccctgctgcctt

SEQ ID NO: 394830 - DNA, 23 bp, Homo sapiens
ctagcccagtccctggagctgtc

SEQ ID NO: 394831 - DNA, 12 bp, Homo sapiens
ctagccccaggg

SEQ ID NO: 394832 - DNA, 13 bp, Homo sapiens
ctagccccagggt

SEQ ID NO: 394833 - DNA, 21 bp, Homo sapiens
ctagccccagggtgagcaggg

SEQ ID NO: 394834 - DNA, 15 bp, Homo sapiens
ctagctagaaatatg

SEQ ID NO: 394835 - DNA, 16 bp, Homo sapiens
ctagctagaaatatga

SEQ ID NO: 394836 - DNA, 17 bp, Homo sapiens
ctagctataacaactct

SEQ ID NO: 394837 - DNA, 22 bp, Homo sapiens
ctagctataacaactctatttt

SEQ ID NO: 394838 - DNA, 15 bp, Homo sapiens
ctagctatgtgacct

SEQ ID NO: 394839 - DNA, 21 bp, Homo sapiens
ctagctatttctatgtatgtg

SEQ ID NO: 394840 - DNA, 22 bp, Homo sapiens
ctagctggcaggacacatcccg

SEQ ID NO: 394841 - DNA, 12 bp, Homo sapiens
ctagctgtgtgc

SEQ ID NO: 394842 - DNA, 20 bp, Homo sapiens
ctagcttatctccctgcttc

SEQ ID NO: 394843 - DNA, 21 bp, Homo sapiens
ctagcttatctccctgcttca

SEQ ID NO: 394844 - DNA, 18 bp, Homo sapiens
ctaggaaagagttgagca

SEQ ID NO: 394845 - DNA, 14 bp, Homo sapiens
ctaggaaaggcaga

SEQ ID NO: 394846 - DNA, 15 bp, Homo sapiens
ctaggaaaggcagaa

SEQ ID NO: 394847 - DNA, 22 bp, Homo sapiens
ctaggacatctctgtaaaaagc

SEQ ID NO: 394848 - DNA, 16 bp, Homo sapiens
ctaggacatgttccct

SEQ ID NO: 394849 - DNA, 15 bp, Homo sapiens
ctaggaccagttttg

SEQ ID NO: 394850 - DNA, 18 bp, Homo sapiens
ctaggaccagttttgtat

SEQ ID NO: 394851 - DNA, 17 bp, Homo sapiens
ctaggactcaggcctgc

SEQ ID NO: 394852 - DNA, 20 bp, Homo sapiens
ctaggactcaggcctgccaa

SEQ ID NO: 394853 - DNA, 18 bp, Homo sapiens
ctaggactgaggagtggg

SEQ ID NO: 394854 - DNA, 18 bp, Homo sapiens
ctaggactttagggatct

SEQ ID NO: 394855 - DNA, 18 bp, Homo sapiens
ctaggagaccagaagtga

SEQ ID NO: 394856 - DNA, 20 bp, Homo sapiens
ctaggagagactgaaagcag

SEQ ID NO: 394857 - DNA, 21 bp, Homo sapiens
ctaggagagactgaaagcagc

SEQ ID NO: 394858 - DNA, 13 bp, Homo sapiens
ctaggagagccaa

SEQ ID NO: 394859 - DNA, 16 bp, Homo sapiens
ctaggagctggctggc

SEQ ID NO: 394860 - DNA, 22 bp, Homo sapiens
ctaggagctggctggcaggtgt

SEQ ID NO: 394861 - DNA, 19 bp, Homo sapiens
ctaggagctggggagggag

SEQ ID NO: 394862 - DNA, 14 bp, Homo sapiens
ctaggaggatgctg

SEQ ID NO: 394863 - DNA, 18 bp, Homo sapiens
ctaggaggatgctgtgcc

SEQ ID NO: 394864 - DNA, 21 bp, Homo sapiens
ctaggagggagccttgtgaga

SEQ ID NO: 394865 - DNA, 23 bp, Homo sapiens
ctaggagttgagtacagtgagga

SEQ ID NO: 394866 - DNA, 21 bp, Homo sapiens
ctaggataatttttaaaagag

SEQ ID NO: 394867 - DNA, 16 bp, Homo sapiens
ctaggatcccactggc

SEQ ID NO: 394868 - DNA, 15 bp, Homo sapiens
ctaggattcctcccc

SEQ ID NO: 394869 - DNA, 18 bp, Homo sapiens
ctaggcagttagagatgc

SEQ ID NO: 394870 - DNA, 15 bp, Homo sapiens
ctaggcatactctcc

SEQ ID NO: 394871 - DNA, 18 bp, Homo sapiens
ctaggcatactctccagg

SEQ ID NO: 394872 - DNA, 19 bp, Homo sapiens
ctaggcatactctccagga

SEQ ID NO: 394873 - DNA, 16 bp, Homo sapiens
ctaggcatttgtaaat

SEQ ID NO: 394874 - DNA, 22 bp, Homo sapiens
ctaggcatttgtaaatattaaa

SEQ ID NO: 394875 - DNA, 19 bp, Homo sapiens
ctaggccaaatgcacaagc

SEQ ID NO: 394876 - DNA, 16 bp, Homo sapiens
ctaggccggccagctc

SEQ ID NO: 394877 - DNA, 18 bp, Homo sapiens
ctaggccggccagctccc

SEQ ID NO: 394878 - DNA, 19 bp, Homo sapiens
ctaggccggccagctcccc

SEQ ID NO: 394879 - DNA, 14 bp, Homo sapiens
ctaggcctcagtgt

SEQ ID NO: 394880 - DNA, 16 bp, Homo sapiens
ctaggcgaggcgaagc

SEQ ID NO: 394881 - DNA, 19 bp, Homo sapiens
ctaggctgggtgcccacag

SEQ ID NO: 394882 - DNA, 14 bp, Homo sapiens
ctagggaaggccac

SEQ ID NO: 394883 - DNA, 18 bp, Homo sapiens
ctagggaaggccacctgc

SEQ ID NO: 394884 - DNA, 21 bp, Homo sapiens
ctagggaggaccttatctgtg

SEQ ID NO: 394885 - DNA, 20 bp, Homo sapiens
ctagggattcaggctgcttg

SEQ ID NO: 394886 - DNA, 20 bp, Homo sapiens
ctaggggccgagtccaggag

SEQ ID NO: 394887 - DNA, 23 bp, Homo sapiens
ctaggggccgagtccaggagccc

SEQ ID NO: 394888 - DNA, 16 bp, Homo sapiens
ctagggtgcctgctct

SEQ ID NO: 394889 - DNA, 15 bp, Homo sapiens
ctagggtgggcccca

SEQ ID NO: 394890 - DNA, 17 bp, Homo sapiens
ctagggtgggccccagc

SEQ ID NO: 394891 - DNA, 18 bp, Homo sapiens
ctagggttccactggaga

SEQ ID NO: 394892 - DNA, 19 bp, Homo sapiens
ctagggttccactggagaa

SEQ ID NO: 394893 - DNA, 16 bp, Homo sapiens
ctagggttttggcctg

SEQ ID NO: 394894 - DNA, 20 bp, Homo sapiens
ctaggtaatttttacagaat

SEQ ID NO: 394895 - DNA, 16 bp, Homo sapiens
ctaggtagaggcattt

SEQ ID NO: 394896 - DNA, 18 bp, Homo sapiens
ctaggtataaaaaataag

SEQ ID NO: 394897 - DNA, 20 bp, Homo sapiens
ctaggtatcattcaactctc

SEQ ID NO: 394898 - DNA, 22 bp, Homo sapiens
ctaggtatcattcaactctcca

SEQ ID NO: 394899 - DNA, 17 bp, Homo sapiens
ctaggtcagtacccacc

SEQ ID NO: 394900 - DNA, 22 bp, Homo sapiens
ctaggtcagtacccacctgagc

SEQ ID NO: 394901 - DNA, 13 bp, Homo sapiens
ctaggtctccacc

SEQ ID NO: 394902 - DNA, 14 bp, Homo sapiens
ctaggtctccaccc

SEQ ID NO: 394903 - DNA, 16 bp, Homo sapiens
ctaggtctcctcaggg

SEQ ID NO: 394904 - DNA, 15 bp, Homo sapiens
ctaggtgcccagtct

SEQ ID NO: 394905 - DNA, 22 bp, Homo sapiens
ctaggtgtccccaacgtcccct

SEQ ID NO: 394906 - DNA, 13 bp, Homo sapiens
ctaggttctaaaa

SEQ ID NO: 394907 - DNA, 12 bp, Homo sapiens
ctaggtttaact

SEQ ID NO: 394908 - DNA, 16 bp, Homo sapiens
ctaggtttaactcaga

SEQ ID NO: 394909 - DNA, 14 bp, Homo sapiens
ctagtaaagacata

SEQ ID NO: 394910 - DNA, 21 bp, Homo sapiens
ctagtaccctatagagagggg

SEQ ID NO: 394911 - DNA, 12 bp, Homo sapiens
ctagtactatta

SEQ ID NO: 394912 - DNA, 15 bp, Homo sapiens
ctagtactctctgct

SEQ ID NO: 394913 - DNA, 18 bp, Homo sapiens
ctagtactctctgctcta

SEQ ID NO: 394914 - DNA, 13 bp, Homo sapiens
ctagtactgtatt

SEQ ID NO: 394915 - DNA, 14 bp, Homo sapiens
ctagtactgtattg

SEQ ID NO: 394916 - DNA, 22 bp, Homo sapiens
ctagtacttgggagacctgtaa

SEQ ID NO: 394917 - DNA, 16 bp, Homo sapiens
ctagtagaacaatgta

SEQ ID NO: 394918 - DNA, 18 bp, Homo sapiens
ctagtagagcaaagactt

SEQ ID NO: 394919 - DNA, 18 bp, Homo sapiens
ctagtaggagctgagctt

SEQ ID NO: 394920 - DNA, 17 bp, Homo sapiens
ctagtcaactgctgttt

SEQ ID NO: 394921 - DNA, 18 bp, Homo sapiens
ctagtcaactgctgtttt

SEQ ID NO: 394922 - DNA, 17 bp, Homo sapiens
ctagtccccctgttttc

SEQ ID NO: 394923 - DNA, 23 bp, Homo sapiens
ctagtcccttcccctccctggct

SEQ ID NO: 394924 - DNA, 23 bp, Homo sapiens
ctagtccggacccacctcacccc

SEQ ID NO: 394925 - DNA, 18 bp, Homo sapiens
ctagtcctattctattgc

SEQ ID NO: 394926 - DNA, 21 bp, Homo sapiens
ctagtcgtggagatgtcttcg

SEQ ID NO: 394927 - DNA, 20 bp, Homo sapiens
ctagtctcctttgcactgag

SEQ ID NO: 394928 - DNA, 18 bp, Homo sapiens
ctagtctgtgtgctgtgg

SEQ ID NO: 394929 - DNA, 14 bp, Homo sapiens
ctagtgacccggag

SEQ ID NO: 394930 - DNA, 18 bp, Homo sapiens
ctagtgacttgtgtccca

SEQ ID NO: 394931 - DNA, 14 bp, Homo sapiens
ctagtgagctgggc

SEQ ID NO: 394932 - DNA, 16 bp, Homo sapiens
ctagtgagctgggcat

SEQ ID NO: 394933 - DNA, 21 bp, Homo sapiens
ctagtgatacactgtatctaa

SEQ ID NO: 394934 - DNA, 17 bp, Homo sapiens
ctagtgatttctggggc

SEQ ID NO: 394935 - DNA, 23 bp, Homo sapiens
ctagtgatttctggggccccacc

SEQ ID NO: 394936 - DNA, 14 bp, Homo sapiens
ctagtgatttttgg

SEQ ID NO: 394937 - DNA, 18 bp, Homo sapiens
aaaccagaatgattttga

SEQ ID NO: 394938 - DNA, 13 bp, Homo sapiens
aaaccagcaggtg

SEQ ID NO: 394939 - DNA, 15 bp, Homo sapiens
aaaccatctggcctg

SEQ ID NO: 394940 - DNA, 13 bp, Homo sapiens
aaaccatgactgt

SEQ ID NO: 394941 - DNA, 12 bp, Homo sapiens
aaaccattgctt

SEQ ID NO: 394942 - DNA, 18 bp, Homo sapiens
aaaccattgttcagaaga

SEQ ID NO: 394943 - DNA, 20 bp, Homo sapiens
aaacccacgcgtgttctgaa

SEQ ID NO: 394944 - DNA, 15 bp, Homo sapiens
aaacccatctgtaat

SEQ ID NO: 394945 - DNA, 16 bp, Homo sapiens
aaacccatctgtaata

SEQ ID NO: 394946 - DNA, 18 bp, Homo sapiens
aaaccccagccccaactc

SEQ ID NO: 394947 - DNA, 12 bp, Homo sapiens
aaacccccagga

SEQ ID NO: 394948 - DNA, 13 bp, Homo sapiens
aaacccccaggag

SEQ ID NO: 394949 - DNA, 20 bp, Homo sapiens
aaacccgacaacatttctgc

SEQ ID NO: 394950 - DNA, 12 bp, Homo sapiens
aaaccctgcttc

SEQ ID NO: 394951 - DNA, 20 bp, Homo sapiens
aaaccctgcttctgctgccc

SEQ ID NO: 394952 - DNA, 17 bp, Homo sapiens
aaaccctggcttgcttg

SEQ ID NO: 394953 - DNA, 15 bp, Homo sapiens
aaaccgtaattttat

SEQ ID NO: 394954 - DNA, 13 bp, Homo sapiens
aaaccgtccctga

SEQ ID NO: 394955 - DNA, 21 bp, Homo sapiens
aaacctaatgtctgtataaat

SEQ ID NO: 394956 - DNA, 22 bp, Homo sapiens
aaacctaatgtctgtataaata

SEQ ID NO: 394957 - DNA, 20 bp, Homo sapiens
ctagtgtttctgcagaggca

SEQ ID NO: 394958 - DNA, 20 bp, Homo sapiens
ctagttaacctagaagtatt

SEQ ID NO: 394959 - DNA, 13 bp, Homo sapiens
ctagttacccacc

SEQ ID NO: 394960 - DNA, 15 bp, Homo sapiens
ctagttacccaccct

SEQ ID NO: 394961 - DNA, 12 bp, Homo sapiens
ctagttcatcca

SEQ ID NO: 394962 - DNA, 20 bp, Homo sapiens
ctagttctcaatcactgctc

SEQ ID NO: 394963 - DNA, 17 bp, Homo sapiens
ctagttcttaagcattt

SEQ ID NO: 394964 - DNA, 16 bp, Homo sapiens
ctagttgctcttgctt

SEQ ID NO: 394965 - DNA, 16 bp, Homo sapiens
ctagtttaaaattatt

SEQ ID NO: 394966 - DNA, 21 bp, Homo sapiens
ctagtttacagaaaaatcttg

SEQ ID NO: 394967 - DNA, 16 bp, Homo sapiens
ctagtttcagtaaata

SEQ ID NO: 394968 - DNA, 20 bp, Homo sapiens
ctagtttgcatacttcctgg

SEQ ID NO: 394969 - DNA, 16 bp, Homo sapiens
ctagttttttttgtaa

SEQ ID NO: 394970 - DNA, 13 bp, Homo sapiens
ctataaaatgagg

SEQ ID NO: 394971 - DNA, 12 bp, Homo sapiens
ctataaacatta

SEQ ID NO: 394972 - DNA, 20 bp, Homo sapiens
ctataaacattaaaagaaga

SEQ ID NO: 394973 - DNA, 18 bp, Homo sapiens
ctataaatatattgtata

SEQ ID NO: 394974 - DNA, 22 bp, Homo sapiens
ctataaatatattgtatatttg

SEQ ID NO: 394975 - DNA, 16 bp, Homo sapiens
ctataaatggtgtttt

SEQ ID NO: 394976 - DNA, 18 bp, Homo sapiens
ctataaatggtgtttttt

SEQ ID NO: 394977 - DNA, 21 bp, Homo sapiens
ctataaattcaacacttattt

SEQ ID NO: 394978 - DNA, 18 bp, Homo sapiens
ctataacaactctatttt

SEQ ID NO: 394979 - DNA, 15 bp, Homo sapiens
ctataagaagtagca

SEQ ID NO: 394980 - DNA, 19 bp, Homo sapiens
ctataatcccagcactttg

SEQ ID NO: 394981 - DNA, 21 bp, Homo sapiens
ctataattctatactgttgat

SEQ ID NO: 394982 - DNA, 22 bp, Homo sapiens
ctataatttacctgaagtcttt

SEQ ID NO: 394983 - DNA, 21 bp, Homo sapiens
ctatacaaattttcagaaggt

SEQ ID NO: 394984 - DNA, 11 bp, Homo sapiens
ctatacattcc

SEQ ID NO: 394985 - DNA, 12 bp, Homo sapiens
ctatacattcct

SEQ ID NO: 394986 - DNA, 16 bp, Homo sapiens
ctatacattcctgaga

SEQ ID NO: 394987 - DNA, 21 bp, Homo sapiens
ctataccctaggtctccaccc

SEQ ID NO: 394988 - DNA, 16 bp, Homo sapiens
ctatactggttatagt

SEQ ID NO: 394989 - DNA, 21 bp, Homo sapiens
ctatactgtgtcatggtgatg

SEQ ID NO: 394990 - DNA, 19 bp, Homo sapiens
ctatagagaaacccctggg

SEQ ID NO: 394991 - DNA, 23 bp, Homo sapiens
ctatagccatttgccccaactta

SEQ ID NO: 394992 - DNA, 20 bp, Homo sapiens
ctatataaagtactactgta

SEQ ID NO: 394993 - DNA, 15 bp, Homo sapiens
ctatatagagatgtt

SEQ ID NO: 394994 - DNA, 19 bp, Homo sapiens
ctatatagtacctttgctc

SEQ ID NO: 394995 - DNA, 17 bp, Homo sapiens
ctatatatacatgtata

SEQ ID NO: 394996 - DNA, 23 bp, Homo sapiens
ctatatatgaataattatgttta

SEQ ID NO: 394997 - DNA, 15 bp, Homo sapiens
ctatatccatgtact

SEQ ID NO: 394998 - DNA, 20 bp, Homo sapiens
ctatatccatgtactgtagt

SEQ ID NO: 394999 - DNA, 18 bp, Homo sapiens
ctatatgatttatagttt

SEQ ID NO: 395000 - DNA, 13 bp, Homo sapiens
ctatatggcaaga

SEQ ID NO: 395001 - DNA, 19 bp, Homo sapiens
ctatatgtggcattccttt

SEQ ID NO: 395002 - DNA, 21 bp, Homo sapiens
ctatatgtggcattcctttct

SEQ ID NO: 395003 - DNA, 20 bp, Homo sapiens
ctatattccgggtgccattc

SEQ ID NO: 395004 - DNA, 13 bp, Homo sapiens
ctatatttacaaa

SEQ ID NO: 395005 - DNA, 16 bp, Homo sapiens
ctatatttgtaacttt

SEQ ID NO: 395006 - DNA, 21 bp, Homo sapiens
ctatatttgtaactttgcatg

SEQ ID NO: 395007 - DNA, 23 bp, Homo sapiens
ctatatttgtaactttgcatgtt

SEQ ID NO: 395008 - DNA, 17 bp, Homo sapiens
ctatcaagtcaatcatt

SEQ ID NO: 395009 - DNA, 19 bp, Homo sapiens
ctatcaagtcaatcatttc

SEQ ID NO: 395010 - DNA, 21 bp, Homo sapiens
ctatcaagtcaatcatttctc

SEQ ID NO: 395011 - DNA, 15 bp, Homo sapiens
ctatcacctcccctc

SEQ ID NO: 395012 - DNA, 12 bp, Homo sapiens
ctatcacctgtc

SEQ ID NO: 395013 - DNA, 13 bp, Homo sapiens
ctatcacctgtca

SEQ ID NO: 395014 - DNA, 13 bp, Homo sapiens
ctatcatggcata

SEQ ID NO: 395015 - DNA, 23 bp, Homo sapiens
ctatccaaagaacttgatttgca

SEQ ID NO: 395016 - DNA, 18 bp, Homo sapiens
ctatccacagaacctttg

SEQ ID NO: 395017 - DNA, 21 bp, Homo sapiens
ctatccacagaacctttgtca

SEQ ID NO: 395018 - DNA, 22 bp, Homo sapiens
ctatccacagaacctttgtcaa

SEQ ID NO: 395019 - DNA, 19 bp, Homo sapiens
ctatccagccgcaaatcca

SEQ ID NO: 395020 - DNA, 15 bp, Homo sapiens
ctatcccttctcaga

SEQ ID NO: 395021 - DNA, 23 bp, Homo sapiens
ctatcctgacttctaatatcatt

SEQ ID NO: 395022 - DNA, 19 bp, Homo sapiens
ctatcctgcaatttctccc

SEQ ID NO: 395023 - DNA, 20 bp, Homo sapiens
ctatcctgcaatttctcccg

SEQ ID NO: 395024 - DNA, 14 bp, Homo sapiens
ctatcctgcaccct

SEQ ID NO: 395025 - DNA, 18 bp, Homo sapiens
ctatcctgcaccctctgc

SEQ ID NO: 395026 - DNA, 12 bp, Homo sapiens
ctatcctggctt

SEQ ID NO: 395027 - DNA, 21 bp, Homo sapiens
ctatccttggagagcagctgg

SEQ ID NO: 395028 - DNA, 12 bp, Homo sapiens
ctatccttggca

SEQ ID NO: 395029 - DNA, 18 bp, Homo sapiens
ctatccttggcaccaaag

SEQ ID NO: 395030 - DNA, 18 bp, Homo sapiens
ctatcgagtttgcaatgt

SEQ ID NO: 395031 - DNA, 21 bp, Homo sapiens
ctatcgatctggaaagagctg

SEQ ID NO: 395032 - DNA, 16 bp, Homo sapiens
ctatctaatccttaaa

SEQ ID NO: 395033 - DNA, 20 bp, Homo sapiens
ctatctaggtggagttgaaa

SEQ ID NO: 395034 - DNA, 22 bp, Homo sapiens
ctatctaggtggagttgaaaga

SEQ ID NO: 395035 - DNA, 22 bp, Homo sapiens
ctatctgcaatgtttttgtgta

SEQ ID NO: 395036 - DNA, 22 bp, Homo sapiens
ctatctgcatttataaatgtgt

SEQ ID NO: 395037 - DNA, 13 bp, Homo sapiens
ctatctgggcctg

SEQ ID NO: 395038 - DNA, 16 bp, Homo sapiens
ctatctgggcctgggc

SEQ ID NO: 395039 - DNA, 15 bp, Homo sapiens
ctatcttttatttca

SEQ ID NO: 395040 - DNA, 16 bp, Homo sapiens
ctatcttttatttcat

SEQ ID NO: 395041 - DNA, 18 bp, Homo sapiens
ctatcttttatttcattc

SEQ ID NO: 395042 - DNA, 22 bp, Homo sapiens
ctatcttttgaaagtttgttct

SEQ ID NO: 395043 - DNA, 21 bp, Homo sapiens
ctatgaaagcaacaactttgt

SEQ ID NO: 395044 - DNA, 18 bp, Homo sapiens
ctatgaagactactttta

SEQ ID NO: 395045 - DNA, 17 bp, Homo sapiens
ctatgaattctaagtga

SEQ ID NO: 395046 - DNA, 15 bp, Homo sapiens
ctatgacaataaatt

SEQ ID NO: 395047 - DNA, 16 bp, Homo sapiens
ctatgacaataaattt

SEQ ID NO: 395048 - DNA, 18 bp, Homo sapiens
ctatgacactcatcaggt

SEQ ID NO: 395049 - DNA, 21 bp, Homo sapiens
ctatgagaacaagtcacagct

SEQ ID NO: 395050 - DNA, 16 bp, Homo sapiens
ctatgagagatgtgtc

SEQ ID NO: 395051 - DNA, 19 bp, Homo sapiens
ctatgagatggccatgctc

SEQ ID NO: 395052 - DNA, 23 bp, Homo sapiens
ctatgaggaataattatttattt

SEQ ID NO: 395053 - DNA, 17 bp, Homo sapiens
ctatgatttgtagctct

SEQ ID NO: 395054 - DNA, 12 bp, Homo sapiens
ctatgcaaaatg

SEQ ID NO: 395055 - DNA, 15 bp, Homo sapiens
ctatgcaaagaactc

SEQ ID NO: 395056 - DNA, 16 bp, Homo sapiens
ctatgcaaatcagtct

SEQ ID NO: 395057 - DNA, 16 bp, Homo sapiens
ctatgcacaccaaatt

SEQ ID NO: 395058 - DNA, 20 bp, Homo sapiens
ctatgcatatcagttgagct

SEQ ID NO: 395059 - DNA, 22 bp, Homo sapiens
ctatgcccaggtaccacccttc

SEQ ID NO: 395060 - DNA, 14 bp, Homo sapiens
ctatgcctgtattt

SEQ ID NO: 395061 - DNA, 16 bp, Homo sapiens
ctatgcctgtatttcc

SEQ ID NO: 395062 - DNA, 18 bp, Homo sapiens
ctatgcctgtatttccaa

SEQ ID NO: 395063 - DNA, 13 bp, Homo sapiens
ctatgcctgtggt

SEQ ID NO: 395064 - DNA, 14 bp, Homo sapiens
ctatgctgcctagg

SEQ ID NO: 395065 - DNA, 18 bp, Homo sapiens
ctatgctggggtacacag

SEQ ID NO: 395066 - DNA, 22 bp, Homo sapiens
ctatggaaagggtgtggcttgg

SEQ ID NO: 395067 - DNA, 15 bp, Homo sapiens
aaagaaaaaaatagt

SEQ ID NO: 395068 - DNA, 19 bp, Homo sapiens
aaagaaaaaaatagtttta

SEQ ID NO: 395069 - DNA, 13 bp, Homo sapiens
aaagaaaacacac

SEQ ID NO: 395070 - DNA, 17 bp, Homo sapiens
aaagaaaacattccaga

SEQ ID NO: 395071 - DNA, 14 bp, Homo sapiens
aaagaaaagataaa

SEQ ID NO: 395072 - DNA, 21 bp, Homo sapiens
aaagaaaaggaatgcaagaga

SEQ ID NO: 395073 - DNA, 16 bp, Homo sapiens
aaagaaaatgtgtctg

SEQ ID NO: 395074 - DNA, 12 bp, Homo sapiens
aaagaaacacca

SEQ ID NO: 395075 - DNA, 22 bp, Homo sapiens
aaagaaacaccacttaatcttc

SEQ ID NO: 395076 - DNA, 20 bp, Homo sapiens
aaagaaaccccaaactcagg

SEQ ID NO: 395077 - DNA, 19 bp, Homo sapiens
aaagaaaccgtaattttat

SEQ ID NO: 395078 - DNA, 15 bp, Homo sapiens
aaagaaaggcagaga

SEQ ID NO: 395079 - DNA, 13 bp, Homo sapiens
aaagaaagtgagt

SEQ ID NO: 395080 - DNA, 20 bp, Homo sapiens
aaagaacccccctccccaag

SEQ ID NO: 395081 - DNA, 23 bp, Homo sapiens
aaagaacggcatgtgaattctgt

SEQ ID NO: 395082 - DNA, 14 bp, Homo sapiens
aaagaactgcccca

SEQ ID NO: 395083 - DNA, 15 bp, Homo sapiens
aaagaactgccccat

SEQ ID NO: 395084 - DNA, 18 bp, Homo sapiens
aaagaacttgatttgcat

SEQ ID NO: 395085 - DNA, 16 bp, Homo sapiens
aaagaagaaaataacc

SEQ ID NO: 395086 - DNA, 16 bp, Homo sapiens
aaagaagaaccatctt

SEQ ID NO: 395087 - DNA, 15 bp, Homo sapiens
aaagaagacacacag

SEQ ID NO: 395088 - DNA, 14 bp, Homo sapiens
aaagaagactggaa

SEQ ID NO: 395089 - DNA, 20 bp, Homo sapiens
aaagaagcccaatattataa

SEQ ID NO: 395090 - DNA, 12 bp, Homo sapiens
aaagaaggaaaa

SEQ ID NO: 395091 - DNA, 23 bp, Homo sapiens
aaagaagtttgggctaacattta

SEQ ID NO: 395092 - DNA, 16 bp, Homo sapiens
aaagaatagtgcctca

SEQ ID NO: 395093 - DNA, 23 bp, Homo sapiens
aaagaatcattatttattaaatt

SEQ ID NO: 395094 - DNA, 14 bp, Homo sapiens
ggctaactggcccc

SEQ ID NO: 395095 - DNA, 15 bp, Homo sapiens
ggctaactggcccca

SEQ ID NO: 395096 - DNA, 16 bp, Homo sapiens
ggctaactggccccag

SEQ ID NO: 395097 - DNA, 18 bp, Homo sapiens
ggctaactggccccaggc

SEQ ID NO: 395098 - DNA, 16 bp, Homo sapiens
ggctaagaggctgctg

SEQ ID NO: 395099 - DNA, 18 bp, Homo sapiens
ggctaagatactgctgat

SEQ ID NO: 395100 - DNA, 19 bp, Homo sapiens
ggctaagatactgctgatg

SEQ ID NO: 395101 - DNA, 15 bp, Homo sapiens
ggctaaggcccccaa

SEQ ID NO: 395102 - DNA, 12 bp, Homo sapiens
ggctaaggcctc

SEQ ID NO: 395103 - DNA, 19 bp, Homo sapiens
ggctaaggcctcttgctgg

SEQ ID NO: 395104 - DNA, 23 bp, Homo sapiens
ggctaaggcctcttgctggtgca

SEQ ID NO: 395105 - DNA, 15 bp, Homo sapiens
ggctaagtccagctc

SEQ ID NO: 395106 - DNA, 15 bp, Homo sapiens
ggctaattaaataaa

SEQ ID NO: 395107 - DNA, 13 bp, Homo sapiens
ggctacatcccag

SEQ ID NO: 395108 - DNA, 19 bp, Homo sapiens
ggctacatcccagcctgtg

SEQ ID NO: 395109 - DNA, 14 bp, Homo sapiens
ggctactggcagct

SEQ ID NO: 395110 - DNA, 17 bp, Homo sapiens
ggctactggcagctcct

SEQ ID NO: 395111 - DNA, 22 bp, Homo sapiens
ggctagaggacatattcacagt

SEQ ID NO: 395112 - DNA, 16 bp, Homo sapiens
ggctagaggccagccc

SEQ ID NO: 395113 - DNA, 14 bp, Homo sapiens
ggctagagtcctca

SEQ ID NO: 395114 - DNA, 19 bp, Homo sapiens
ggctagagtcctcactccc

SEQ ID NO: 395115 - DNA, 15 bp, Homo sapiens
ggctagccccagggt

SEQ ID NO: 395116 - DNA, 16 bp, Homo sapiens
ggctagccccagggtg

SEQ ID NO: 395117 - DNA, 23 bp, Homo sapiens
ggctaggtatcattcaactctcc

SEQ ID NO: 395118 - DNA, 18 bp, Homo sapiens
ggctagtgtgagtggcag

SEQ ID NO: 395119 - DNA, 20 bp, Homo sapiens
ggctagtgtgagtggcagcc

SEQ ID NO: 395120 - DNA, 24 bp, Homo sapiens
ggctagtgtgagtggcagccatgc

SEQ ID NO: 395121 - DNA, 19 bp, Homo sapiens
ggctatgggggcactgagg

SEQ ID NO: 395122 - DNA, 13 bp, Homo sapiens
ggctatttgttca

SEQ ID NO: 395123 - DNA, 14 bp, Homo sapiens
ggctcaaggattca

SEQ ID NO: 395124 - DNA, 22 bp, Homo sapiens
ggctcaaggcaccgcagcctgt

SEQ ID NO: 395125 - DNA, 16 bp, Homo sapiens
ggctcacagccaccac

SEQ ID NO: 395126 - DNA, 19 bp, Homo sapiens
ggctcacagccaccacctg

SEQ ID NO: 395127 - DNA, 20 bp, Homo sapiens
ggctcacagccaccacctgg

SEQ ID NO: 395128 - DNA, 17 bp, Homo sapiens
ggctcacgcctgtaatc

SEQ ID NO: 395129 - DNA, 18 bp, Homo sapiens
ggctcactgcagcctcga

SEQ ID NO: 395130 - DNA, 14 bp, Homo sapiens
ggctcagctccttg

SEQ ID NO: 395131 - DNA, 18 bp, Homo sapiens
ggctcagctctggctcac

SEQ ID NO: 395132 - DNA, 20 bp, Homo sapiens
ggctcaggcaagcccctcag

SEQ ID NO: 395133 - DNA, 17 bp, Homo sapiens
ggctcagggcccacctc

SEQ ID NO: 395134 - DNA, 15 bp, Homo sapiens
ggctcagtgccacct

SEQ ID NO: 395135 - DNA, 15 bp, Homo sapiens
ggctccacgccctgg

SEQ ID NO: 395136 - DNA, 15 bp, Homo sapiens
ggctccacgggggcc

SEQ ID NO: 395137 - DNA, 14 bp, Homo sapiens
ggctccagcatcca

SEQ ID NO: 395138 - DNA, 21 bp, Homo sapiens
ggctccagcatccagcctgtg

SEQ ID NO: 395139 - DNA, 12 bp, Homo sapiens
ggctccaggctg

SEQ ID NO: 395140 - DNA, 13 bp, Homo sapiens
ggctccagggcca

SEQ ID NO: 395141 - DNA, 17 bp, Homo sapiens
ggctccagggccagggt

SEQ ID NO: 395142 - DNA, 15 bp, Homo sapiens
ggctccagtctgctg

SEQ ID NO: 395143 - DNA, 18 bp, Homo sapiens
ggctccatgctcctcact

SEQ ID NO: 395144 - DNA, 13 bp, Homo sapiens
ggctccattccca

SEQ ID NO: 395145 - DNA, 17 bp, Homo sapiens
ggctcccaagggaggcc

SEQ ID NO: 395146 - DNA, 23 bp, Homo sapiens
ggctcccaatcagcttttgttct

SEQ ID NO: 395147 - DNA, 15 bp, Homo sapiens
ggctcccacagagac

SEQ ID NO: 395148 - DNA, 18 bp, Homo sapiens
ggctcccacaggcccttc

SEQ ID NO: 395149 - DNA, 21 bp, Homo sapiens
ggctcccacaggcccttcctc

SEQ ID NO: 395150 - DNA, 14 bp, Homo sapiens
ggctcccaggacac

SEQ ID NO: 395151 - DNA, 19 bp, Homo sapiens
ggctcccatgaccatactg

SEQ ID NO: 395152 - DNA, 13 bp, Homo sapiens
ggctccccgcctc

SEQ ID NO: 395153 - DNA, 12 bp, Homo sapiens
ggctcccctcta

SEQ ID NO: 395154 - DNA, 19 bp, Homo sapiens
ggctcccggggcagggcag

SEQ ID NO: 395155 - DNA, 18 bp, Homo sapiens
ggctccctcctggagcat

SEQ ID NO: 395156 - DNA, 22 bp, Homo sapiens
ggctccgtcagtatcaggcctg

SEQ ID NO: 395157 - DNA, 22 bp, Homo sapiens
ggctcctacaggcgctccaggc

SEQ ID NO: 395158 - DNA, 20 bp, Homo sapiens
ggctcctatctgtgttttga

SEQ ID NO: 395159 - DNA, 17 bp, Homo sapiens
ggctcctccccgatccc

SEQ ID NO: 395160 - DNA, 17 bp, Homo sapiens
ggctcctggaaccaatc

SEQ ID NO: 395161 - DNA, 18 bp, Homo sapiens
ggctcctggctgccaggc

SEQ ID NO: 395162 - DNA, 19 bp, Homo sapiens
ggctcctggctgccaggcg

SEQ ID NO: 395163 - DNA, 13 bp, Homo sapiens
ggctcctgtctgg

SEQ ID NO: 395164 - DNA, 13 bp, Homo sapiens
ggctcctttccca

SEQ ID NO: 395165 - DNA, 16 bp, Homo sapiens
ggctcctttcccacag

SEQ ID NO: 395166 - DNA, 21 bp, Homo sapiens
ggctcctttctccagccagca

SEQ ID NO: 395167 - DNA, 18 bp, Homo sapiens
ggctcgagtgcccctgca

SEQ ID NO: 395168 - DNA, 15 bp, Homo sapiens
ggctcgccccaccca

SEQ ID NO: 395169 - DNA, 15 bp, Homo sapiens
ggctcggacccaccc

SEQ ID NO: 395170 - DNA, 16 bp, Homo sapiens
ggctcggacccacccc

SEQ ID NO: 395171 - DNA, 19 bp, Homo sapiens
ggctcggacccaccccaac

SEQ ID NO: 395172 - DNA, 14 bp, Homo sapiens
ggctcgtggccttc

SEQ ID NO: 395173 - DNA, 18 bp, Homo sapiens
ggctcgtgggctctggct

SEQ ID NO: 395174 - DNA, 22 bp, Homo sapiens
ggctctagggttgctggagcct

SEQ ID NO: 395175 - DNA, 21 bp, Homo sapiens
ggctctcacccccatccctgg

SEQ ID NO: 395176 - DNA, 19 bp, Homo sapiens
ggctctccaaaggggctgc

SEQ ID NO: 395177 - DNA, 20 bp, Homo sapiens
ggctctccaaaggggctgct

SEQ ID NO: 395178 - DNA, 21 bp, Homo sapiens
ggctctccaaaggggctgctg

SEQ ID NO: 395179 - DNA, 21 bp, Homo sapiens
ggctctccaccttgttacaca

SEQ ID NO: 395180 - DNA, 22 bp, Homo sapiens
ggctctcccctctcgccccatc

SEQ ID NO: 395181 - DNA, 16 bp, Homo sapiens
ggctctccctctctgc

SEQ ID NO: 395182 - DNA, 14 bp, Homo sapiens
ggctctctccagga

SEQ ID NO: 395183 - DNA, 16 bp, Homo sapiens
ggctctgaaagctgct

SEQ ID NO: 395184 - DNA, 21 bp, Homo sapiens
ggctctgaaagctgcttctgg

SEQ ID NO: 395185 - DNA, 17 bp, Homo sapiens
ggctctgaatctctcaa

SEQ ID NO: 395186 - DNA, 12 bp, Homo sapiens
ggctctgcacag

SEQ ID NO: 395187 - DNA, 18 bp, Homo sapiens
ggctctgcgtcccactga

SEQ ID NO: 395188 - DNA, 18 bp, Homo sapiens
ggctctggcaggtggcca

SEQ ID NO: 395189 - DNA, 20 bp, Homo sapiens
ggctctggcaggtggccagg

SEQ ID NO: 395190 - DNA, 23 bp, Homo sapiens
ggctctggcaggtggccagggct

SEQ ID NO: 395191 - DNA, 13 bp, Homo sapiens
ggctctggccacc

SEQ ID NO: 395192 - DNA, 16 bp, Homo sapiens
ggctctgggctcaggg

SEQ ID NO: 395193 - DNA, 21 bp, Homo sapiens
ggctcttagcagcttccagat

SEQ ID NO: 395194 - DNA, 16 bp, Homo sapiens
ggctcttcctggacct

SEQ ID NO: 395195 - DNA, 13 bp, Homo sapiens
ggctcttctcctt

SEQ ID NO: 395196 - DNA, 16 bp, Homo sapiens
ggctcttctcctttca

SEQ ID NO: 395197 - DNA, 22 bp, Homo sapiens
ctcaaggactttgcagccggca

SEQ ID NO: 395198 - DNA, 20 bp, Homo sapiens
ctcaaggcaccgcagcctgt

SEQ ID NO: 395199 - DNA, 22 bp, Homo sapiens
ctcaaggcaccgcagcctgtca

SEQ ID NO: 395200 - DNA, 23 bp, Homo sapiens
ctcaaggcaccgcagcctgtcag

SEQ ID NO: 395201 - DNA, 14 bp, Homo sapiens
ctcaaggcctccag

SEQ ID NO: 395202 - DNA, 12 bp, Homo sapiens
ctcaaggctgca

SEQ ID NO: 395203 - DNA, 17 bp, Homo sapiens
ctcaagtcttgacaatt

SEQ ID NO: 395204 - DNA, 9 bp, Homo sapiens
ctcaagtgc

SEQ ID NO: 395205 - DNA, 18 bp, Homo sapiens
ctcaagttagcatttcaa

SEQ ID NO: 395206 - DNA, 16 bp, Homo sapiens
ctcaagttcaatatgg

SEQ ID NO: 395207 - DNA, 13 bp, Homo sapiens
ctcaatatataat

SEQ ID NO: 395208 - DNA, 15 bp, Homo sapiens
ctcaatcaagaaaat

SEQ ID NO: 395209 - DNA, 23 bp, Homo sapiens
ctcaatcactgctcccccgtgtg

SEQ ID NO: 395210 - DNA, 18 bp, Homo sapiens
ctcaatgaaaccttcctc

SEQ ID NO: 395211 - DNA, 20 bp, Homo sapiens
ctcaatgcattgtcttgtgg

SEQ ID NO: 395212 - DNA, 21 bp, Homo sapiens
ctcaatgcattgtcttgtgga

SEQ ID NO: 395213 - DNA, 14 bp, Homo sapiens
ctcaatgccctgcc

SEQ ID NO: 395214 - DNA, 16 bp, Homo sapiens
ctcaatgccctgccat

SEQ ID NO: 395215 - DNA, 17 bp, Homo sapiens
ctcaatgccctgccatt

SEQ ID NO: 395216 - DNA, 18 bp, Homo sapiens
ctcaatgccctgccatta

SEQ ID NO: 395217 - DNA, 14 bp, Homo sapiens
ctcaatgcttttct

SEQ ID NO: 395218 - DNA, 15 bp, Homo sapiens
ctcaatgcttttcta

SEQ ID NO: 395219 - DNA, 21 bp, Homo sapiens
ctcaatggggaattttttgat

SEQ ID NO: 395220 - DNA, 13 bp, Homo sapiens
ctcaatgtgctgt

SEQ ID NO: 395221 - DNA, 15 bp, Homo sapiens
ctcaattgtttttgt

SEQ ID NO: 395222 - DNA, 14 bp, Homo sapiens
ctcacaaagataag

SEQ ID NO: 395223 - DNA, 19 bp, Homo sapiens
ctcacaactgtttttgaag

SEQ ID NO: 395224 - DNA, 18 bp, Homo sapiens
ctcacaagcctcttctga

SEQ ID NO: 395225 - DNA, 21 bp, Homo sapiens
ctcacacacacagctgggcaa

SEQ ID NO: 395226 - DNA, 17 bp, Homo sapiens
ctcacagaacccttgga

SEQ ID NO: 395227 - DNA, 23 bp, Homo sapiens
ctcacagactggagacaatgcag

SEQ ID NO: 395228 - DNA, 12 bp, Homo sapiens
ctcacagccacc

SEQ ID NO: 395229 - DNA, 13 bp, Homo sapiens
ctcacagccacca

SEQ ID NO: 395230 - DNA, 13 bp, Homo sapiens
ctcacagcctctc

SEQ ID NO: 395231 - DNA, 18 bp, Homo sapiens
ctcacagcctctccctta

SEQ ID NO: 395232 - DNA, 18 bp, Homo sapiens
ggctgcacagcccaacca

SEQ ID NO: 395233 - DNA, 21 bp, Homo sapiens
ggctgcacagcccaaccagga

SEQ ID NO: 395234 - DNA, 20 bp, Homo sapiens
ggctgcaccctgtatggagc

SEQ ID NO: 395235 - DNA, 13 bp, Homo sapiens
ggctgcacctcct

SEQ ID NO: 395236 - DNA, 20 bp, Homo sapiens
ggctgcacctcctaccctcc

SEQ ID NO: 395237 - DNA, 22 bp, Homo sapiens
ggctgcacctcctaccctccca

SEQ ID NO: 395238 - DNA, 14 bp, Homo sapiens
ggctgcagtgagcc

SEQ ID NO: 395239 - DNA, 16 bp, Homo sapiens
ggctgcatcctcagcc

SEQ ID NO: 395240 - DNA, 19 bp, Homo sapiens
ggctgcatcctcagcccca

SEQ ID NO: 395241 - DNA, 15 bp, Homo sapiens
ggctgccaaggccag

SEQ ID NO: 395242 - DNA, 13 bp, Homo sapiens
ggctgccaccaag

SEQ ID NO: 395243 - DNA, 23 bp, Homo sapiens
ggctgccaggcgttggtgccact

SEQ ID NO: 395244 - DNA, 18 bp, Homo sapiens
ggctgccatgtgaagagg

SEQ ID NO: 395245 - DNA, 19 bp, Homo sapiens
ggctgcccacgctcctgcc

SEQ ID NO: 395246 - DNA, 22 bp, Homo sapiens
ggctgccctggtgctgccacac

SEQ ID NO: 395247 - DNA, 11 bp, Homo sapiens
ggctgcctgcc

SEQ ID NO: 395248 - DNA, 19 bp, Homo sapiens
ggctgcctggagaaaggat

SEQ ID NO: 395249 - DNA, 13 bp, Homo sapiens
ggctgcctggccc

SEQ ID NO: 395250 - DNA, 14 bp, Homo sapiens
ggctgcctggccca

SEQ ID NO: 395251 - DNA, 16 bp, Homo sapiens
ggctgcctggccccca

SEQ ID NO: 395252 - DNA, 17 bp, Homo sapiens
ggctgcgcctgcccgcc

SEQ ID NO: 395253 - DNA, 18 bp, Homo sapiens
ggctgcggtgggcagcca

SEQ ID NO: 395254 - DNA, 20 bp, Homo sapiens
ggctgctccccacccgcctc

SEQ ID NO: 395255 - DNA, 12 bp, Homo sapiens
ggctgctgccac

SEQ ID NO: 395256 - DNA, 23 bp, Homo sapiens
ggctgctgctgatgtaggagctg

SEQ ID NO: 395257 - DNA, 12 bp, Homo sapiens
ggctgctggagg

SEQ ID NO: 395258 - DNA, 16 bp, Homo sapiens
ggctgctggaggaaaa

SEQ ID NO: 395259 - DNA, 16 bp, Homo sapiens
ggctgctggggcatgt

SEQ ID NO: 395260 - DNA, 12 bp, Homo sapiens
ggctgcttctcc

SEQ ID NO: 395261 - DNA, 22 bp, Homo sapiens
ggctggaaagaggagaaggaga

SEQ ID NO: 395262 - DNA, 23 bp, Homo sapiens
ggctggaacactgtactgaggaa

SEQ ID NO: 395263 - DNA, 16 bp, Homo sapiens
ggctggacctatgtcc

SEQ ID NO: 395264 - DNA, 22 bp, Homo sapiens
ggctggacctatgtcctaagga

SEQ ID NO: 395265 - DNA, 12 bp, Homo sapiens
ggctggactgga

SEQ ID NO: 395266 - DNA, 18 bp, Homo sapiens
ggctggactggaggtggg

SEQ ID NO: 395267 - DNA, 22 bp, Homo sapiens
ggctggacttttgcagcttcct

SEQ ID NO: 395268 - DNA, 13 bp, Homo sapiens
ggctggcaagcag

SEQ ID NO: 395269 - DNA, 19 bp, Homo sapiens
ggctggcaccgccttctct

SEQ ID NO: 395270 - DNA, 15 bp, Homo sapiens
ggctggcagagggga

SEQ ID NO: 395271 - DNA, 16 bp, Homo sapiens
ggctggcagctctcca

SEQ ID NO: 395272 - DNA, 12 bp, Homo sapiens
ggctggccagca

SEQ ID NO: 395273 - DNA, 22 bp, Homo sapiens
ggctggccagcaaggcaggttg

SEQ ID NO: 395274 - DNA, 10 bp, Homo sapiens
ggctggccct

SEQ ID NO: 395275 - DNA, 13 bp, Homo sapiens
ggctggccctgcc

SEQ ID NO: 395276 - DNA, 17 bp, Homo sapiens
ggctggccctgccctcc

SEQ ID NO: 395277 - DNA, 22 bp, Homo sapiens
ggctggccctgccctcccccac

SEQ ID NO: 395278 - DNA, 14 bp, Homo sapiens
ggctggccttcctg

SEQ ID NO: 395279 - DNA, 17 bp, Homo sapiens
ggctgggagcctcgccc

SEQ ID NO: 395280 - DNA, 11 bp, Homo sapiens
ggctgggaggg

SEQ ID NO: 395281 - DNA, 12 bp, Homo sapiens
ggctgggcagag

SEQ ID NO: 395282 - DNA, 13 bp, Homo sapiens
ggctgggcagagg

SEQ ID NO: 395283 - DNA, 16 bp, Homo sapiens
ggctgggcagagggga

SEQ ID NO: 395284 - DNA, 13 bp, Homo sapiens
ggctgggcagggc

SEQ ID NO: 395285 - DNA, 15 bp, Homo sapiens
ggctgggcagggccg

SEQ ID NO: 395286 - DNA, 18 bp, Homo sapiens
ggctgggcagggccgcag

SEQ ID NO: 395287 - DNA, 18 bp, Homo sapiens
ggctgggccaagccaggg

SEQ ID NO: 395288 - DNA, 14 bp, Homo sapiens
ggctgggcccagag

SEQ ID NO: 395289 - DNA, 19 bp, Homo sapiens
ggctgggccccccagctca

SEQ ID NO: 395290 - DNA, 22 bp, Homo sapiens
ggctgggccccccagctcaggg

SEQ ID NO: 395291 - DNA, 15 bp, Homo sapiens
ggctggggacttggc

SEQ ID NO: 395292 - DNA, 13 bp, Homo sapiens
ggctggggcctgg

SEQ ID NO: 395293 - DNA, 16 bp, Homo sapiens
ggctggggcctggcct

SEQ ID NO: 395294 - DNA, 19 bp, Homo sapiens
ggctggggcctggcctatt

SEQ ID NO: 395295 - DNA, 22 bp, Homo sapiens
ggctggggcttttgtgccagga

SEQ ID NO: 395296 - DNA, 14 bp, Homo sapiens
ggctgggggcagga

SEQ ID NO: 395297 - DNA, 19 bp, Homo sapiens
ggctgggggcatgggggag

SEQ ID NO: 395298 - DNA, 23 bp, Homo sapiens
ggctgggggtgaggggccaggcc

SEQ ID NO: 395299 - DNA, 17 bp, Homo sapiens
ggctgggggtgctagac

SEQ ID NO: 395300 - DNA, 20 bp, Homo sapiens
ggctgggtaatgtgaaggcc

SEQ ID NO: 395301 - DNA, 14 bp, Homo sapiens
ggctgggtcgcccc

SEQ ID NO: 395302 - DNA, 18 bp, Homo sapiens
ggctgggtcggccctgcc

SEQ ID NO: 395303 - DNA, 19 bp, Homo sapiens
ggctgggttttcaggggct

SEQ ID NO: 395304 - DNA, 23 bp, Homo sapiens
ggctgggttttcaggggctttgg

SEQ ID NO: 395305 - DNA, 16 bp, Homo sapiens
ggctggtattctctct

SEQ ID NO: 395306 - DNA, 22 bp, Homo sapiens
ggctggtattctctctatgcaa

SEQ ID NO: 395307 - DNA, 13 bp, Homo sapiens
ggctggtccaggg

SEQ ID NO: 395308 - DNA, 10 bp, Homo sapiens
ggctggtgcc

SEQ ID NO: 395309 - DNA, 16 bp, Homo sapiens
ggctggtgccccacag

SEQ ID NO: 395310 - DNA, 15 bp, Homo sapiens
ggctggtgggcacca

SEQ ID NO: 395311 - DNA, 18 bp, Homo sapiens
ggctggtgtccccttccc

SEQ ID NO: 395312 - DNA, 22 bp, Homo sapiens
ggctggtgtccccttcccctgc

SEQ ID NO: 395313 - DNA, 22 bp, Homo sapiens
ggctgtaaatcctagacttgaa

SEQ ID NO: 395314 - DNA, 19 bp, Homo sapiens
ggctgtacacaccctccag

SEQ ID NO: 395315 - DNA, 22 bp, Homo sapiens
ggctgtacacaccctccagcac

SEQ ID NO: 395316 - DNA, 14 bp, Homo sapiens
ggctgtattttctt

SEQ ID NO: 395317 - DNA, 19 bp, Homo sapiens
ggctgtcagtcgtgttgct

SEQ ID NO: 395318 - DNA, 22 bp, Homo sapiens
ggctgtcctgtacattgtggga

SEQ ID NO: 395319 - DNA, 10 bp, Homo sapiens
ggctgtcctt

SEQ ID NO: 395320 - DNA, 22 bp, Homo sapiens
ggctgtccttagactccttctc

SEQ ID NO: 395321 - DNA, 17 bp, Homo sapiens
ggctgtcgtccccctcc

SEQ ID NO: 395322 - DNA, 13 bp, Homo sapiens
ggctgtctgcctg

SEQ ID NO: 395323 - DNA, 14 bp, Homo sapiens
ggctgtgagcagcc

SEQ ID NO: 395324 - DNA, 21 bp, Homo sapiens
ggctgtgcacattctcccttg

SEQ ID NO: 395325 - DNA, 13 bp, Homo sapiens
ggctgtgcctctg

SEQ ID NO: 395326 - DNA, 12 bp, Homo sapiens
ggctgtggagca

SEQ ID NO: 395327 - DNA, 22 bp, Homo sapiens
ggctgtggagcaaaaggcagct

SEQ ID NO: 395328 - DNA, 17 bp, Homo sapiens
ctcagagctccacagaa

SEQ ID NO: 395329 - DNA, 20 bp, Homo sapiens
ctcagaggagtctgggaagg

SEQ ID NO: 395330 - DNA, 20 bp, Homo sapiens
ctcagaggctatagctggga

SEQ ID NO: 395331 - DNA, 23 bp, Homo sapiens
ctcagaggctgacactgacattt

SEQ ID NO: 395332 - DNA, 17 bp, Homo sapiens
ctcagagggtccctagg

SEQ ID NO: 395333 - DNA, 23 bp, Homo sapiens
ctcagatccctcggtcagcaccg

SEQ ID NO: 395334 - DNA, 19 bp, Homo sapiens
ctcagatgaaaataaaata

SEQ ID NO: 395335 - DNA, 16 bp, Homo sapiens
ctcagattgggattaa

SEQ ID NO: 395336 - DNA, 15 bp, Homo sapiens
ctcagcaaattcttg

SEQ ID NO: 395337 - DNA, 16 bp, Homo sapiens
ctcagcaaggggctct

SEQ ID NO: 395338 - DNA, 20 bp, Homo sapiens
ctcagcaaggggctctgccc

SEQ ID NO: 395339 - DNA, 11 bp, Homo sapiens
ctcagcaagtg

SEQ ID NO: 395340 - DNA, 11 bp, Homo sapiens
ctcagcagccc

SEQ ID NO: 395341 - DNA, 19 bp, Homo sapiens
ctcagcagccccctgcccg

SEQ ID NO: 395342 - DNA, 18 bp, Homo sapiens
ctcagcagttcacttcct

SEQ ID NO: 395343 - DNA, 13 bp, Homo sapiens
ctcagccagctgc

SEQ ID NO: 395344 - DNA, 14 bp, Homo sapiens
ctcagccagctgcc

SEQ ID NO: 395345 - DNA, 18 bp, Homo sapiens
ctcagccagctgcccaca

SEQ ID NO: 395346 - DNA, 11 bp, Homo sapiens
ctcagcccacc

SEQ ID NO: 395347 - DNA, 16 bp, Homo sapiens
ctcagccccagcccag

SEQ ID NO: 395348 - DNA, 12 bp, Homo sapiens
ctcagccccagg

SEQ ID NO: 395349 - DNA, 21 bp, Homo sapiens
ctcagccccagggccctgctc

SEQ ID NO: 395350 - DNA, 23 bp, Homo sapiens
ctcagccccagggccctgctcag

SEQ ID NO: 395351 - DNA, 21 bp, Homo sapiens
ctcagccccggccactccctg

SEQ ID NO: 395352 - DNA, 13 bp, Homo sapiens
ctcagcccctctt

SEQ ID NO: 395353 - DNA, 23 bp, Homo sapiens
ctcagccctagaggcgagccagg

SEQ ID NO: 395354 - DNA, 20 bp, Homo sapiens
ctcagccctccctgcccctc

SEQ ID NO: 395355 - DNA, 21 bp, Homo sapiens
ctcagccctccctgcccctcc

SEQ ID NO: 395356 - DNA, 19 bp, Homo sapiens
ctcagccctgaaaataaca

SEQ ID NO: 395357 - DNA, 14 bp, Homo sapiens
ctcagcccttgccc

SEQ ID NO: 395358 - DNA, 22 bp, Homo sapiens
ctcagcctcccaaagtgctggg

SEQ ID NO: 395359 - DNA, 20 bp, Homo sapiens
ctcagcctcccaaagtgttg

SEQ ID NO: 395360 - DNA, 13 bp, Homo sapiens
ctcagcctcctga

SEQ ID NO: 395361 - DNA, 16 bp, Homo sapiens
ctcagcctcctgagcc

SEQ ID NO: 395362 - DNA, 19 bp, Homo sapiens
ctcagcctcctgagcctgt

SEQ ID NO: 395363 - DNA, 21 bp, Homo sapiens
ctcagccttaagaaagctata

SEQ ID NO: 395364 - DNA, 14 bp, Homo sapiens
ctcagcgctccctg

SEQ ID NO: 395365 - DNA, 13 bp, Homo sapiens
ctcagcgctgccc

SEQ ID NO: 395366 - DNA, 17 bp, Homo sapiens
ctcagcgctgcccacac

SEQ ID NO: 395367 - DNA, 19 bp, Homo sapiens
ctcagcgctgcccacacca

SEQ ID NO: 395368 - DNA, 15 bp, Homo sapiens
ctcagctcccaaggc

SEQ ID NO: 395369 - DNA, 19 bp, Homo sapiens
ctcagctcccaaggctctg

SEQ ID NO: 395370 - DNA, 21 bp, Homo sapiens
ggcttggccacaacctgaaag

SEQ ID NO: 395371 - DNA, 14 bp, Homo sapiens
ggcttggccttgtg

SEQ ID NO: 395372 - DNA, 14 bp, Homo sapiens
ggcttgggaccgcc

SEQ ID NO: 395373 - DNA, 14 bp, Homo sapiens
ggcttgggcccagt

SEQ ID NO: 395374 - DNA, 15 bp, Homo sapiens
ggcttggggcttcct

SEQ ID NO: 395375 - DNA, 16 bp, Homo sapiens
ggcttgtagggtgagg

SEQ ID NO: 395376 - DNA, 17 bp, Homo sapiens
ggcttgtcagagctggg

SEQ ID NO: 395377 - DNA, 14 bp, Homo sapiens
ggcttgtgggctgg

SEQ ID NO: 395378 - DNA, 16 bp, Homo sapiens
ggctttacattttatt

SEQ ID NO: 395379 - DNA, 15 bp, Homo sapiens
ggctttcatcctgtg

SEQ ID NO: 395380 - DNA, 23 bp, Homo sapiens
ggctttctccggggtctgtgctg

SEQ ID NO: 395381 - DNA, 17 bp, Homo sapiens
ggctttgcaggctctgg

SEQ ID NO: 395382 - DNA, 15 bp, Homo sapiens
ggctttgcagggaga

SEQ ID NO: 395383 - DNA, 22 bp, Homo sapiens
ggctttgccatgggcctgctgc

SEQ ID NO: 395384 - DNA, 20 bp, Homo sapiens
ggctttgtaaactccacagg

SEQ ID NO: 395385 - DNA, 18 bp, Homo sapiens
ggctttgtcccacagctt

SEQ ID NO: 395386 - DNA, 15 bp, Homo sapiens
ggcttttatttttta

SEQ ID NO: 395387 - DNA, 19 bp, Homo sapiens
ggcttttctctttcctcta

SEQ ID NO: 395388 - DNA, 23 bp, Homo sapiens
ggctttttgtcaaataaaatgaa

SEQ ID NO: 395389 - DNA, 13 bp, Homo sapiens
gggaaaaaaaaaa

SEQ ID NO: 395390 - DNA, 21 bp, Homo sapiens
gggaaaaaaaaaaaagaaaag

SEQ ID NO: 395391 - DNA, 21 bp, Homo sapiens
gggaaaaaagttttgatgaaa

SEQ ID NO: 395392 - DNA, 16 bp, Homo sapiens
gggaaaaactggcttt

SEQ ID NO: 395393 - DNA, 20 bp, Homo sapiens
gggaaaatgtcccccacctc

SEQ ID NO: 395394 - DNA, 16 bp, Homo sapiens
gggaaaatgtgaagct

SEQ ID NO: 395395 - DNA, 15 bp, Homo sapiens
gggaaagccacctct

SEQ ID NO: 395396 - DNA, 12 bp, Homo sapiens
gggaaaggtgct

SEQ ID NO: 395397 - DNA, 15 bp, Homo sapiens
gggaaaggtgctcaa

SEQ ID NO: 395398 - DNA, 16 bp, Homo sapiens
gggaaaggtgctcaaa

SEQ ID NO: 395399 - DNA, 19 bp, Homo sapiens
gggaaatacaagaagagaa

SEQ ID NO: 395400 - DNA, 19 bp, Homo sapiens
gggaacaagggtggcatcc

SEQ ID NO: 395401 - DNA, 15 bp, Homo sapiens
gggaacactggcctg

SEQ ID NO: 395402 - DNA, 12 bp, Homo sapiens
gggaacagtgtt

SEQ ID NO: 395403 - DNA, 15 bp, Homo sapiens
gggaaccccgcagcc

SEQ ID NO: 395404 - DNA, 17 bp, Homo sapiens
gggaaccccgcagcccg

SEQ ID NO: 395405 - DNA, 18 bp, Homo sapiens
gggaaccccgcagcccgt

SEQ ID NO: 395406 - DNA, 20 bp, Homo sapiens
gggaacccgactgtgaaagt

SEQ ID NO: 395407 - DNA, 14 bp, Homo sapiens
gggaacgcagcctc

SEQ ID NO: 395408 - DNA, 21 bp, Homo sapiens
gggaactgggaagatgctggc

SEQ ID NO: 395409 - DNA, 15 bp, Homo sapiens
gggaagagagcctgc

SEQ ID NO: 395410 - DNA, 11 bp, Homo sapiens
gggaagagagg

SEQ ID NO: 395411 - DNA, 17 bp, Homo sapiens
gggaagagaggagttca

SEQ ID NO: 395412 - DNA, 24 bp, Homo sapiens
gggaagagaggagttcaatgatct

SEQ ID NO: 395413 - DNA, 13 bp, Homo sapiens
gggaagaggcctt

SEQ ID NO: 395414 - DNA, 21 bp, Homo sapiens
gggaagagggcagtacctggg

SEQ ID NO: 395415 - DNA, 22 bp, Homo sapiens
gggaagatgaaaccgtccctga

SEQ ID NO: 395416 - DNA, 15 bp, Homo sapiens
gggaagcccacccgc

SEQ ID NO: 395417 - DNA, 19 bp, Homo sapiens
gggaagcccacccgcccca

SEQ ID NO: 395418 - DNA, 20 bp, Homo sapiens
gggaagcccacccgccccag

SEQ ID NO: 395419 - DNA, 21 bp, Homo sapiens
gggaagcccacccgccccaga

SEQ ID NO: 395420 - DNA, 23 bp, Homo sapiens
gggaagcccacccgccccagaga

SEQ ID NO: 395421 - DNA, 20 bp, Homo sapiens
gggaagcttgagcctccccc

SEQ ID NO: 395422 - DNA, 21 bp, Homo sapiens
gggaagcttgagcctccccca

SEQ ID NO: 395423 - DNA, 12 bp, Homo sapiens
gggaaggcctga

SEQ ID NO: 395424 - DNA, 13 bp, Homo sapiens
gggaaggcctgag

SEQ ID NO: 395425 - DNA, 14 bp, Homo sapiens
gggaaggcctgagg

SEQ ID NO: 395426 - DNA, 21 bp, Homo sapiens
gggaaggcctgagggaagccc

SEQ ID NO: 395427 - DNA, 23 bp, Homo sapiens
gggaaggcctgagggaagcccac

SEQ ID NO: 395428 - DNA, 22 bp, Homo sapiens
gggaagggagcaccagatgaca

SEQ ID NO: 395429 - DNA, 22 bp, Homo sapiens
gggaagggccagtctgggctgc

SEQ ID NO: 395430 - DNA, 21 bp, Homo sapiens
gggaaggggcgtgtccctcct

SEQ ID NO: 395431 - DNA, 14 bp, Homo sapiens
gggaagtggcttaa

SEQ ID NO: 395432 - DNA, 23 bp, Homo sapiens
gggaatctgatcccataaagaaa

SEQ ID NO: 395433 - DNA, 22 bp, Homo sapiens
gggaatgcgctcttcaccagga

SEQ ID NO: 395434 - DNA, 23 bp, Homo sapiens
gggaatgcgctcttcaccaggaa

SEQ ID NO: 395435 - DNA, 18 bp, Homo sapiens
gggaatggatggggagaa

SEQ ID NO: 395436 - DNA, 20 bp, Homo sapiens
gggaatgtattattctgcag

SEQ ID NO: 395437 - DNA, 15 bp, Homo sapiens
gggaatgttccctgc

SEQ ID NO: 395438 - DNA, 16 bp, Homo sapiens
gggaatgttccctgca

SEQ ID NO: 395439 - DNA, 21 bp, Homo sapiens
gggaatgttccctgcaccctg

SEQ ID NO: 395440 - DNA, 16 bp, Homo sapiens
gggaattttatctttt

SEQ ID NO: 395441 - DNA, 22 bp, Homo sapiens
gggaattttcattggatgcagt

SEQ ID NO: 395442 - DNA, 18 bp, Homo sapiens
gggacaaaacccaccttg

SEQ ID NO: 395443 - DNA, 18 bp, Homo sapiens
gggacaaatttaaaacaa

SEQ ID NO: 395444 - DNA, 19 bp, Homo sapiens
gggacaagggattctggga

SEQ ID NO: 395445 - DNA, 12 bp, Homo sapiens
gggacacagaga

SEQ ID NO: 395446 - DNA, 20 bp, Homo sapiens
gggacacggcctctggggag

SEQ ID NO: 395447 - DNA, 16 bp, Homo sapiens
gggacactacaaacat

SEQ ID NO: 395448 - DNA, 20 bp, Homo sapiens
gggacagatcttgagcaagg

SEQ ID NO: 395449 - DNA, 14 bp, Homo sapiens
gggacagcagcctc

SEQ ID NO: 395450 - DNA, 15 bp, Homo sapiens
gggacagcagcctcc

SEQ ID NO: 395451 - DNA, 15 bp, Homo sapiens
gggacagtattctca

SEQ ID NO: 395452 - DNA, 20 bp, Homo sapiens
gggacatggtgtgccacagg

SEQ ID NO: 395453 - DNA, 13 bp, Homo sapiens
gggaccaaggacc

SEQ ID NO: 395454 - DNA, 17 bp, Homo sapiens
gggaccaaggacccctc

SEQ ID NO: 395455 - DNA, 16 bp, Homo sapiens
gggaccacagctgctg

SEQ ID NO: 395456 - DNA, 12 bp, Homo sapiens
gggaccaggagc

SEQ ID NO: 395457 - DNA, 13 bp, Homo sapiens
gggaccaggagct

SEQ ID NO: 395458 - DNA, 15 bp, Homo sapiens
ctcagtttggctgta

SEQ ID NO: 395459 - DNA, 21 bp, Homo sapiens
ctcagtttggctgtaatttaa

SEQ ID NO: 395460 - DNA, 18 bp, Homo sapiens
ctcagttttatcattttc

SEQ ID NO: 395461 - DNA, 15 bp, Homo sapiens
ctcataactcattgt

SEQ ID NO: 395462 - DNA, 15 bp, Homo sapiens
ctcataattgtcaaa

SEQ ID NO: 395463 - DNA, 18 bp, Homo sapiens
ctcatacctttaaaggaa

SEQ ID NO: 395464 - DNA, 18 bp, Homo sapiens
ctcatagcattaactaat

SEQ ID NO: 395465 - DNA, 22 bp, Homo sapiens
ctcatattcctgcagcctggag

SEQ ID NO: 395466 - DNA, 15 bp, Homo sapiens
ctcatatttttacaa

SEQ ID NO: 395467 - DNA, 15 bp, Homo sapiens
ctcatcactggatga

SEQ ID NO: 395468 - DNA, 22 bp, Homo sapiens
ctcatcagcccaggtcccagtg

SEQ ID NO: 395469 - DNA, 13 bp, Homo sapiens
ctcatcaggatga

SEQ ID NO: 395470 - DNA, 24 bp, Homo sapiens
ctcatcagtgtcctcttgctcaaa

SEQ ID NO: 395471 - DNA, 16 bp, Homo sapiens
ctcatcataaaataaa

SEQ ID NO: 395472 - DNA, 19 bp, Homo sapiens
ctcatccactaggtgccca

SEQ ID NO: 395473 - DNA, 19 bp, Homo sapiens
ctcatccaggtcctttcct

SEQ ID NO: 395474 - DNA, 23 bp, Homo sapiens
ctcatccaggtcctttccttctc

SEQ ID NO: 395475 - DNA, 14 bp, Homo sapiens
ctcatcccacgcac

SEQ ID NO: 395476 - DNA, 19 bp, Homo sapiens
ctcatcccacgcactccat

SEQ ID NO: 395477 - DNA, 20 bp, Homo sapiens
ctcatcccctcgtcctgtcc

SEQ ID NO: 395478 - DNA, 13 bp, Homo sapiens
ctcatcctcccaa

SEQ ID NO: 395479 - DNA, 22 bp, Homo sapiens
ctcatcctcctggacccagcag

SEQ ID NO: 395480 - DNA, 20 bp, Homo sapiens
ctcatctccaaggatcctct

SEQ ID NO: 395481 - DNA, 18 bp, Homo sapiens
ctcatctctaacagctca

SEQ ID NO: 395482 - DNA, 13 bp, Homo sapiens
ctcatctgatatt

SEQ ID NO: 395483 - DNA, 13 bp, Homo sapiens
ctcatgaatgtaa

SEQ ID NO: 395484 - DNA, 15 bp, Homo sapiens
ctcatgaatgtaaat

SEQ ID NO: 395485 - DNA, 18 bp, Homo sapiens
ctcatgccacaccttctt

SEQ ID NO: 395486 - DNA, 13 bp, Homo sapiens
ctcatgccagatt

SEQ ID NO: 395487 - DNA, 22 bp, Homo sapiens
ctcatgccccctttcagatgtc

SEQ ID NO: 395488 - DNA, 16 bp, Homo sapiens
ctcatgcctggccccc

SEQ ID NO: 395489 - DNA, 20 bp, Homo sapiens
ctcatggactccaggatcct

SEQ ID NO: 395490 - DNA, 17 bp, Homo sapiens
ctcatggcaggcatctg

SEQ ID NO: 395491 - DNA, 23 bp, Homo sapiens
ctcatggctgttatctgtcttta

SEQ ID NO: 395492 - DNA, 16 bp, Homo sapiens
ctcatgggcccctctg

SEQ ID NO: 395493 - DNA, 15 bp, Homo sapiens
ctcatgtcatttctc

SEQ ID NO: 395494 - DNA, 21 bp, Homo sapiens
ctcatgtcatttctcatggat

SEQ ID NO: 395495 - DNA, 14 bp, Homo sapiens
ctcatgtgctttgt

SEQ ID NO: 395496 - DNA, 16 bp, Homo sapiens
ctcatgtgctttgtag

SEQ ID NO: 395497 - DNA, 18 bp, Homo sapiens
ctcatgtgctttgtagct

SEQ ID NO: 395498 - DNA, 17 bp, Homo sapiens
ctcatgtttgtgcatgt

SEQ ID NO: 395499 - DNA, 12 bp, Homo sapiens
ctcattaatttc

SEQ ID NO: 395500 - DNA, 18 bp, Homo sapiens
ctcattaccgtctgtgat

SEQ ID NO: 395501 - DNA, 13 bp, Homo sapiens
ctcattatttcat

SEQ ID NO: 395502 - DNA, 16 bp, Homo sapiens
ctcattcactgtcctg

SEQ ID NO: 395503 - DNA, 18 bp, Homo sapiens
ctcattcatattcctgcc

SEQ ID NO: 395504 - DNA, 22 bp, Homo sapiens
ctcattcctctgtccccgagcc

SEQ ID NO: 395505 - DNA, 22 bp, Homo sapiens
ctcattcttttcagcttgtttc

SEQ ID NO: 395506 - DNA, 19 bp, Homo sapiens
ctcatttacgtaaaaagat

SEQ ID NO: 395507 - DNA, 20 bp, Homo sapiens
ctcatttagcattgaaataa

SEQ ID NO: 395508 - DNA, 13 bp, Homo sapiens
gggagagtgaggt

SEQ ID NO: 395509 - DNA, 21 bp, Homo sapiens
gggagagttgaccgttttcat

SEQ ID NO: 395510 - DNA, 14 bp, Homo sapiens
gggagatccgccct

SEQ ID NO: 395511 - DNA, 16 bp, Homo sapiens
gggagatccgccctgg

SEQ ID NO: 395512 - DNA, 23 bp, Homo sapiens
gggagatccgccctgggctctgg

SEQ ID NO: 395513 - DNA, 14 bp, Homo sapiens
gggagatgctggga

SEQ ID NO: 395514 - DNA, 14 bp, Homo sapiens
gggagatggtcagt

SEQ ID NO: 395515 - DNA, 17 bp, Homo sapiens
gggagattaaaaccaga

SEQ ID NO: 395516 - DNA, 23 bp, Homo sapiens
gggagattaaaaccagagagaaa

SEQ ID NO: 395517 - DNA, 14 bp, Homo sapiens
gggagcaagacaga

SEQ ID NO: 395518 - DNA, 16 bp, Homo sapiens
gggagcaagccttcct

SEQ ID NO: 395519 - DNA, 14 bp, Homo sapiens
gggagcactggagt

SEQ ID NO: 395520 - DNA, 20 bp, Homo sapiens
gggagcacttgcgtcctgca

SEQ ID NO: 395521 - DNA, 19 bp, Homo sapiens
gggagcattctgcctgcct

SEQ ID NO: 395522 - DNA, 21 bp, Homo sapiens
gggagcattctgcctgcctgg

SEQ ID NO: 395523 - DNA, 19 bp, Homo sapiens
gggagccacttctccccag

SEQ ID NO: 395524 - DNA, 11 bp, Homo sapiens
gggagccaggg

SEQ ID NO: 395525 - DNA, 11 bp, Homo sapiens
gggagcccagc

SEQ ID NO: 395526 - DNA, 13 bp, Homo sapiens
gggagccccaggg

SEQ ID NO: 395527 - DNA, 14 bp, Homo sapiens
gggagccccagggt

SEQ ID NO: 395528 - DNA, 21 bp, Homo sapiens
gggagccccagggtcttccct

SEQ ID NO: 395529 - DNA, 16 bp, Homo sapiens
gggagcccccgccccg

SEQ ID NO: 395530 - DNA, 14 bp, Homo sapiens
gggagcccggggca

SEQ ID NO: 395531 - DNA, 20 bp, Homo sapiens
gggagccctgaccttggctg

SEQ ID NO: 395532 - DNA, 23 bp, Homo sapiens
gggagcctcgcccctccagtgtt

SEQ ID NO: 395533 - DNA, 13 bp, Homo sapiens
gggagcctggagc

SEQ ID NO: 395534 - DNA, 18 bp, Homo sapiens
gggagcctggagcccctg

SEQ ID NO: 395535 - DNA, 21 bp, Homo sapiens
gggagcctggagcccctgtgt

SEQ ID NO: 395536 - DNA, 14 bp, Homo sapiens
gggagctctgcttg

SEQ ID NO: 395537 - DNA, 21 bp, Homo sapiens
gggaggaacgtggttcagaga

SEQ ID NO: 395538 - DNA, 15 bp, Homo sapiens
gggaggacctctggg

SEQ ID NO: 395539 - DNA, 12 bp, Homo sapiens
gggaggactccg

SEQ ID NO: 395540 - DNA, 15 bp, Homo sapiens
gggaggagactcagg

SEQ ID NO: 395541 - DNA, 12 bp, Homo sapiens
gggaggagcctt

SEQ ID NO: 395542 - DNA, 16 bp, Homo sapiens
gggaggagccttggag

SEQ ID NO: 395543 - DNA, 22 bp, Homo sapiens
gggaggagccttggagtgtaat

SEQ ID NO: 395544 - DNA, 15 bp, Homo sapiens
gggaggccgaggcag

SEQ ID NO: 395545 - DNA, 20 bp, Homo sapiens
gggaggccgaggcaggggct

SEQ ID NO: 395546 - DNA, 17 bp, Homo sapiens
gggaggcctaggcgggc

SEQ ID NO: 395547 - DNA, 12 bp, Homo sapiens
gggaggctgaga

SEQ ID NO: 395548 - DNA, 12 bp, Homo sapiens
gggaggggaggc

SEQ ID NO: 395549 - DNA, 16 bp, Homo sapiens
gggaggggcctggcct

SEQ ID NO: 395550 - DNA, 13 bp, Homo sapiens
gggagggggaggg

SEQ ID NO: 395551 - DNA, 19 bp, Homo sapiens
gggagggggcccttccaga

SEQ ID NO: 395552 - DNA, 17 bp, Homo sapiens
gggaggggtcagctctg

SEQ ID NO: 395553 - DNA, 16 bp, Homo sapiens
gggaggtcaggccctg

SEQ ID NO: 395554 - DNA, 18 bp, Homo sapiens
gggaggtgagaccacctc

SEQ ID NO: 395555 - DNA, 22 bp, Homo sapiens
gggaggtgtttaaagagaggtt

SEQ ID NO: 395556 - DNA, 17 bp, Homo sapiens
gggagtacctgctgccc

SEQ ID NO: 395557 - DNA, 19 bp, Homo sapiens
gggagtcaagtgtgcctgc

SEQ ID NO: 395558 - DNA, 21 bp, Homo sapiens
gggagtcagagccctggctgg

SEQ ID NO: 395559 - DNA, 23 bp, Homo sapiens
gggagtccactttcctctctctc

SEQ ID NO: 395560 - DNA, 20 bp, Homo sapiens
gggagtctccctccgactcc

SEQ ID NO: 395561 - DNA, 18 bp, Homo sapiens
gggagtgggacagagtct

SEQ ID NO: 395562 - DNA, 20 bp, Homo sapiens
gggagtgggacagagtctgg

SEQ ID NO: 395563 - DNA, 15 bp, Homo sapiens
gggagtgggagagga

SEQ ID NO: 395564 - DNA, 16 bp, Homo sapiens
gggagtgggagaggaa

SEQ ID NO: 395565 - DNA, 12 bp, Homo sapiens
gggagtgggcac

SEQ ID NO: 395566 - DNA, 11 bp, Homo sapiens
gggagtgggtg

SEQ ID NO: 395567 - DNA, 22 bp, Homo sapiens
gggagttgtcaagtctctgctg

SEQ ID NO: 395568 - DNA, 23 bp, Homo sapiens
gggatatccctatgtcccagccc

SEQ ID NO: 395569 - DNA, 22 bp, Homo sapiens
gggatcagagtctggcctgcca

SEQ ID NO: 395570 - DNA, 18 bp, Homo sapiens
gggatcagtggggcccca

SEQ ID NO: 395571 - DNA, 16 bp, Homo sapiens
gggatccagagagaag

SEQ ID NO: 395572 - DNA, 21 bp, Homo sapiens
gggatcctggagcccctgtgt

SEQ ID NO: 395573 - DNA, 16 bp, Homo sapiens
gggatctggggaagga

SEQ ID NO: 395574 - DNA, 17 bp, Homo sapiens
gggatctgtgcccagag

SEQ ID NO: 395575 - DNA, 22 bp, Homo sapiens
gggatcttctccctcccctcac

SEQ ID NO: 395576 - DNA, 17 bp, Homo sapiens
gggatgccatctgtggg

SEQ ID NO: 395577 - DNA, 21 bp, Homo sapiens
gggatgctatctcgctagcca

SEQ ID NO: 395578 - DNA, 15 bp, Homo sapiens
gggatgtcttgagat

SEQ ID NO: 395579 - DNA, 16 bp, Homo sapiens
gggattcatggctttg

SEQ ID NO: 395580 - DNA, 13 bp, Homo sapiens
gggatttctggga

SEQ ID NO: 395581 - DNA, 19 bp, Homo sapiens
gggatttcttcgctgctct

SEQ ID NO: 395582 - DNA, 19 bp, Homo sapiens
gggatttgaaccaggcctt

SEQ ID NO: 395583 - DNA, 18 bp, Homo sapiens
gggatttgaactgagccg

SEQ ID NO: 395584 - DNA, 20 bp, Homo sapiens
gggcaaagaactgccccatc

SEQ ID NO: 395585 - DNA, 21 bp, Homo sapiens
gggcaaagccacaaggctggc

SEQ ID NO: 395586 - DNA, 14 bp, Homo sapiens
gggcaacgaagaaa

SEQ ID NO: 395587 - DNA, 15 bp, Homo sapiens
gggcaacgaagaaaa

SEQ ID NO: 395588 - DNA, 22 bp, Homo sapiens
ctccagacccctaccctttccc

SEQ ID NO: 395589 - DNA, 18 bp, Homo sapiens
ctccagactcgagagggc

SEQ ID NO: 395590 - DNA, 14 bp, Homo sapiens
ctccagagccagcc

SEQ ID NO: 395591 - DNA, 17 bp, Homo sapiens
ctccagagccagcctgg

SEQ ID NO: 395592 - DNA, 19 bp, Homo sapiens
ctccagagccagcctggga

SEQ ID NO: 395593 - DNA, 17 bp, Homo sapiens
ctccagagtctgagccc

SEQ ID NO: 395594 - DNA, 20 bp, Homo sapiens
ctccagatatgaacagggcc

SEQ ID NO: 395595 - DNA, 16 bp, Homo sapiens
ctccagcagtgctggg

SEQ ID NO: 395596 - DNA, 20 bp, Homo sapiens
ctccagcagtgctgggccca

SEQ ID NO: 395597 - DNA, 22 bp, Homo sapiens
ctccagcagtgctgggcccagc

SEQ ID NO: 395598 - DNA, 13 bp, Homo sapiens
ctccagcatccag

SEQ ID NO: 395599 - DNA, 15 bp, Homo sapiens
ctccagcatccagcc

SEQ ID NO: 395600 - DNA, 13 bp, Homo sapiens
ctccagccaaccc

SEQ ID NO: 395601 - DNA, 14 bp, Homo sapiens
ctccagccaacccc

SEQ ID NO: 395602 - DNA, 17 bp, Homo sapiens
ctccagccaacccctgt

SEQ ID NO: 395603 - DNA, 18 bp, Homo sapiens
ctccagccaacccctgtg

SEQ ID NO: 395604 - DNA, 20 bp, Homo sapiens
ctccagccaacccctgtgga

SEQ ID NO: 395605 - DNA, 20 bp, Homo sapiens
ctccagccacccagccagga

SEQ ID NO: 395606 - DNA, 18 bp, Homo sapiens
ctccagccacttatttcc

SEQ ID NO: 395607 - DNA, 23 bp, Homo sapiens
ctccagccagcaatgatgtccag

SEQ ID NO: 395608 - DNA, 21 bp, Homo sapiens
ctccagcccacagtgctcagt

SEQ ID NO: 395609 - DNA, 19 bp, Homo sapiens
ctccagcccgagtggtctc

SEQ ID NO: 395610 - DNA, 22 bp, Homo sapiens
ctccagcccgagtggtctcctc

SEQ ID NO: 395611 - DNA, 12 bp, Homo sapiens
ctccagcctctc

SEQ ID NO: 395612 - DNA, 21 bp, Homo sapiens
ctccagcctctcccggctgcc

SEQ ID NO: 395613 - DNA, 21 bp, Homo sapiens
ctccagcctgggtgacagagc

SEQ ID NO: 395614 - DNA, 21 bp, Homo sapiens
ctccagcgagtaccccagcca

SEQ ID NO: 395615 - DNA, 23 bp, Homo sapiens
ctccagcggttgccttttttatc

SEQ ID NO: 395616 - DNA, 20 bp, Homo sapiens
ctccagcttctggtactctc

SEQ ID NO: 395617 - DNA, 21 bp, Homo sapiens
ctccagcttctggtactctcc

SEQ ID NO: 395618 - DNA, 16 bp, Homo sapiens
ctccaggaaggggctg

SEQ ID NO: 395619 - DNA, 18 bp, Homo sapiens
ctccaggaaggggctgga

SEQ ID NO: 395620 - DNA, 20 bp, Homo sapiens
ctccaggaaggggctggact

SEQ ID NO: 395621 - DNA, 21 bp, Homo sapiens
ctccaggaaggggctggactg

SEQ ID NO: 395622 - DNA, 16 bp, Homo sapiens
ctccaggattgtccac

SEQ ID NO: 395623 - DNA, 16 bp, Homo sapiens
ctccaggcatgctggc

SEQ ID NO: 395624 - DNA, 17 bp, Homo sapiens
ctccaggcatgctggcc

SEQ ID NO: 395625 - DNA, 19 bp, Homo sapiens
ctccaggcatgctggcctc

SEQ ID NO: 395626 - DNA, 17 bp, Homo sapiens
ctccaggccagctcctt

SEQ ID NO: 395627 - DNA, 22 bp, Homo sapiens
ctccaggccagctccttttctg

SEQ ID NO: 395628 - DNA, 12 bp, Homo sapiens
ctccaggcccag

SEQ ID NO: 395629 - DNA, 17 bp, Homo sapiens
ctccaggcccagcctgg

SEQ ID NO: 395630 - DNA, 20 bp, Homo sapiens
ctccaggcccagcctggccc

SEQ ID NO: 395631 - DNA, 21 bp, Homo sapiens
ctccaggcccagcctggcccc

SEQ ID NO: 395632 - DNA, 15 bp, Homo sapiens
ctccaggctgactgg

SEQ ID NO: 395633 - DNA, 18 bp, Homo sapiens
ctccaggctgactggggg

SEQ ID NO: 395634 - DNA, 17 bp, Homo sapiens
ctccaggctggggcctg

SEQ ID NO: 395635 - DNA, 19 bp, Homo sapiens
ctccaggctggggcctggc

SEQ ID NO: 395636 - DNA, 21 bp, Homo sapiens
ctccaggctggggcctggcct

SEQ ID NO: 395637 - DNA, 17 bp, Homo sapiens
ctccagggccagggtgt

SEQ ID NO: 395638 - DNA, 15 bp, Homo sapiens
ctccagggcccccac

SEQ ID NO: 395639 - DNA, 15 bp, Homo sapiens
ctccagggctgcccc

SEQ ID NO: 395640 - DNA, 18 bp, Homo sapiens
ctccagggctgcccctgt

SEQ ID NO: 395641 - DNA, 18 bp, Homo sapiens
ctccagggggcctgcagg

SEQ ID NO: 395642 - DNA, 19 bp, Homo sapiens
ctccagggggcctgcaggc

SEQ ID NO: 395643 - DNA, 22 bp, Homo sapiens
ctccagggggcctgcaggcccc

SEQ ID NO: 395644 - DNA, 20 bp, Homo sapiens
ctccagggtcttgggctact

SEQ ID NO: 395645 - DNA, 18 bp, Homo sapiens
gggcagctggcaggagag

SEQ ID NO: 395646 - DNA, 17 bp, Homo sapiens
gggcagctgggccccac

SEQ ID NO: 395647 - DNA, 19 bp, Homo sapiens
gggcaggaaggagagcctg

SEQ ID NO: 395648 - DNA, 18 bp, Homo sapiens
gggcaggagggccctacc

SEQ ID NO: 395649 - DNA, 11 bp, Homo sapiens
gggcaggccag

SEQ ID NO: 395650 - DNA, 14 bp, Homo sapiens
gggcaggcctggga

SEQ ID NO: 395651 - DNA, 19 bp, Homo sapiens
gggcaggcctgggacccag

SEQ ID NO: 395652 - DNA, 19 bp, Homo sapiens
gggcaggcggtccccatcc

SEQ ID NO: 395653 - DNA, 13 bp, Homo sapiens
gggcagggcagcc

SEQ ID NO: 395654 - DNA, 12 bp, Homo sapiens
gggcagggcagg

SEQ ID NO: 395655 - DNA, 20 bp, Homo sapiens
gggcagggcatctcctgtgc

SEQ ID NO: 395656 - DNA, 11 bp, Homo sapiens
gggcagggccg

SEQ ID NO: 395657 - DNA, 18 bp, Homo sapiens
gggcagggccgcagggcg

SEQ ID NO: 395658 - DNA, 13 bp, Homo sapiens
gggcagggcctgg

SEQ ID NO: 395659 - DNA, 21 bp, Homo sapiens
gggcaggggagccagggtaga

SEQ ID NO: 395660 - DNA, 18 bp, Homo sapiens
gggcagggtgggcagcct

SEQ ID NO: 395661 - DNA, 17 bp, Homo sapiens
gggcagggttctagaag

SEQ ID NO: 395662 - DNA, 13 bp, Homo sapiens
gggcaggtcctgg

SEQ ID NO: 395663 - DNA, 23 bp, Homo sapiens
gggcaggtcctggggaggctgag

SEQ ID NO: 395664 - DNA, 14 bp, Homo sapiens
gggcagtctggagg

SEQ ID NO: 395665 - DNA, 15 bp, Homo sapiens
gggcagtctggaggg

SEQ ID NO: 395666 - DNA, 17 bp, Homo sapiens
gggcagtctggaggggc

SEQ ID NO: 395667 - DNA, 12 bp, Homo sapiens
gggcagtgactg

SEQ ID NO: 395668 - DNA, 18 bp, Homo sapiens
gggcagtgactggcaggt

SEQ ID NO: 395669 - DNA, 14 bp, Homo sapiens
gggcagtggagagg

SEQ ID NO: 395670 - DNA, 16 bp, Homo sapiens
gggcagtggagagggg

SEQ ID NO: 395671 - DNA, 19 bp, Homo sapiens
gggcagtggagaggggact

SEQ ID NO: 395672 - DNA, 15 bp, Homo sapiens
gggcagtggggagca

SEQ ID NO: 395673 - DNA, 22 bp, Homo sapiens
gggcagttctcactcctaggag

SEQ ID NO: 395674 - DNA, 19 bp, Homo sapiens
gggcatcagctttccctgg

SEQ ID NO: 395675 - DNA, 20 bp, Homo sapiens
gggcatcagctttccctggc

SEQ ID NO: 395676 - DNA, 23 bp, Homo sapiens
gggcatcagctttccctggctca

SEQ ID NO: 395677 - DNA, 14 bp, Homo sapiens
gggcatcaggcact

SEQ ID NO: 395678 - DNA, 22 bp, Homo sapiens
gggcatccacccagtgctgcca

SEQ ID NO: 395679 - DNA, 14 bp, Homo sapiens
gggcatctccagga

SEQ ID NO: 395680 - DNA, 20 bp, Homo sapiens
gggcatctgagtccagctcc

SEQ ID NO: 395681 - DNA, 15 bp, Homo sapiens
gggcatgccaccctc

SEQ ID NO: 395682 - DNA, 19 bp, Homo sapiens
gggcatgccaccctcacac

SEQ ID NO: 395683 - DNA, 18 bp, Homo sapiens
gggcatggacagggccag

SEQ ID NO: 395684 - DNA, 21 bp, Homo sapiens
gggcatggacagggccagggt

SEQ ID NO: 395685 - DNA, 23 bp, Homo sapiens
gggcatggacagggccagggttg

SEQ ID NO: 395686 - DNA, 16 bp, Homo sapiens
gggcatggccagcagc

SEQ ID NO: 395687 - DNA, 15 bp, Homo sapiens
gggcatggccaggtg

SEQ ID NO: 395688 - DNA, 19 bp, Homo sapiens
gggcatggtaccagccctg

SEQ ID NO: 395689 - DNA, 16 bp, Homo sapiens
gggcatggtagctcaa

SEQ ID NO: 395690 - DNA, 22 bp, Homo sapiens
gggcatgtattggcctggaggt

SEQ ID NO: 395691 - DNA, 23 bp, Homo sapiens
gggcatgtgtgcctgtggcagaa

SEQ ID NO: 395692 - DNA, 21 bp, Homo sapiens
gggcatttcttgcgagcctcg

SEQ ID NO: 395693 - DNA, 11 bp, Homo sapiens
gggccaacacc

SEQ ID NO: 395694 - DNA, 16 bp, Homo sapiens
gggccaacaccaggga

SEQ ID NO: 395695 - DNA, 18 bp, Homo sapiens
gggccaagccagggatgg

SEQ ID NO: 395696 - DNA, 20 bp, Homo sapiens
gggccaagccagggttccag

SEQ ID NO: 395697 - DNA, 15 bp, Homo sapiens
gggccaagtcccacc

SEQ ID NO: 395698 - DNA, 19 bp, Homo sapiens
gggccacctccccaggccg

SEQ ID NO: 395699 - DNA, 22 bp, Homo sapiens
gggccacctccccaggccgtgg

SEQ ID NO: 395700 - DNA, 16 bp, Homo sapiens
gggccactgccctctc

SEQ ID NO: 395701 - DNA, 20 bp, Homo sapiens
gggccactgggccccattct

SEQ ID NO: 395702 - DNA, 18 bp, Homo sapiens
gggccagaaggagggcag

SEQ ID NO: 395703 - DNA, 22 bp, Homo sapiens
gggccagactggctgcacagcc

SEQ ID NO: 395704 - DNA, 12 bp, Homo sapiens
gggccagcccct

SEQ ID NO: 395705 - DNA, 11 bp, Homo sapiens
gggccagctgc

SEQ ID NO: 395706 - DNA, 11 bp, Homo sapiens
gggccaggaga

SEQ ID NO: 395707 - DNA, 15 bp, Homo sapiens
gggccagtcaggctg

SEQ ID NO: 395708 - DNA, 15 bp, Homo sapiens
gggccagtcctgcct

SEQ ID NO: 395709 - DNA, 18 bp, Homo sapiens
gggccagtcctgcctggc

SEQ ID NO: 395710 - DNA, 19 bp, Homo sapiens
gggccagtcctgcctggcc

SEQ ID NO: 395711 - DNA, 20 bp, Homo sapiens
gggccagtcctgcctggcca

SEQ ID NO: 395712 - DNA, 22 bp, Homo sapiens
gggccagtcctgcctggccagg

SEQ ID NO: 395713 - DNA, 16 bp, Homo sapiens
gggccagtctgggctg

SEQ ID NO: 395714 - DNA, 17 bp, Homo sapiens
gggccagtggctggggg

SEQ ID NO: 395715 - DNA, 18 bp, Homo sapiens
gggccatgaactttgtcc

SEQ ID NO: 395716 - DNA, 19 bp, Homo sapiens
gggccatggaagctggcag

SEQ ID NO: 395717 - DNA, 17 bp, Homo sapiens
ctcccaccccggcctcc

SEQ ID NO: 395718 - DNA, 15 bp, Homo sapiens
ctcccacccggccac

SEQ ID NO: 395719 - DNA, 20 bp, Homo sapiens
ctcccacccggccacagctg

SEQ ID NO: 395720 - DNA, 21 bp, Homo sapiens
ctcccacccggccacagctgc

SEQ ID NO: 395721 - DNA, 23 bp, Homo sapiens
ctcccacccggccacagctgctg

SEQ ID NO: 395722 - DNA, 15 bp, Homo sapiens
ctcccacctccagtc

SEQ ID NO: 395723 - DNA, 23 bp, Homo sapiens
ctcccacctctccttttgaggct

SEQ ID NO: 395724 - DNA, 20 bp, Homo sapiens
ctcccacgctgggacacaga

SEQ ID NO: 395725 - DNA, 21 bp, Homo sapiens
ctcccacgctgggacacagac

SEQ ID NO: 395726 - DNA, 22 bp, Homo sapiens
ctcccacgctgggacacagacc

SEQ ID NO: 395727 - DNA, 16 bp, Homo sapiens
ctcccagacaggccct

SEQ ID NO: 395728 - DNA, 18 bp, Homo sapiens
ctcccagacccagggcag

SEQ ID NO: 395729 - DNA, 21 bp, Homo sapiens
ctcccagaggctcctggagcc

SEQ ID NO: 395730 - DNA, 12 bp, Homo sapiens
ctcccagccacc

SEQ ID NO: 395731 - DNA, 22 bp, Homo sapiens
ctcccagccaccaccactgtcc

SEQ ID NO: 395732 - DNA, 13 bp, Homo sapiens
ctcccagcctgct

SEQ ID NO: 395733 - DNA, 20 bp, Homo sapiens
ctcccagcctgctgagagcc

SEQ ID NO: 395734 - DNA, 11 bp, Homo sapiens
ctcccaggaca

SEQ ID NO: 395735 - DNA, 12 bp, Homo sapiens
ctcccaggacac

SEQ ID NO: 395736 - DNA, 20 bp, Homo sapiens
ctcccaggacgcagggagac

SEQ ID NO: 395737 - DNA, 22 bp, Homo sapiens
ctcccaggacgcagggagaccc

SEQ ID NO: 395738 - DNA, 21 bp, Homo sapiens
ctcccaggagttgttgaacta

SEQ ID NO: 395739 - DNA, 15 bp, Homo sapiens
ctcccaggccccctg

SEQ ID NO: 395740 - DNA, 14 bp, Homo sapiens
ctcccaggcgcccc

SEQ ID NO: 395741 - DNA, 12 bp, Homo sapiens
ctcccagggcca

SEQ ID NO: 395742 - DNA, 21 bp, Homo sapiens
ctcccagggccatgaactttg

SEQ ID NO: 395743 - DNA, 12 bp, Homo sapiens
ctcccagggccc

SEQ ID NO: 395744 - DNA, 13 bp, Homo sapiens
ctcccagggcccg

SEQ ID NO: 395745 - DNA, 16 bp, Homo sapiens
ctcccagggcccgagc

SEQ ID NO: 395746 - DNA, 14 bp, Homo sapiens
ctcccagtcctcca

SEQ ID NO: 395747 - DNA, 18 bp, Homo sapiens
ctcccagttctctaggga

SEQ ID NO: 395748 - DNA, 15 bp, Homo sapiens
ctcccatagtgctgg

SEQ ID NO: 395749 - DNA, 16 bp, Homo sapiens
ctcccatccagcgtct

SEQ ID NO: 395750 - DNA, 17 bp, Homo sapiens
ctcccatccagcgtctg

SEQ ID NO: 395751 - DNA, 15 bp, Homo sapiens
ctcccatctccttcc

SEQ ID NO: 395752 - DNA, 21 bp, Homo sapiens
ctcccatctccttcccccagc

SEQ ID NO: 395753 - DNA, 23 bp, Homo sapiens
ctcccatctccttcccccagccc

SEQ ID NO: 395754 - DNA, 22 bp, Homo sapiens
ctcccatgcacacaaacacctc

SEQ ID NO: 395755 - DNA, 13 bp, Homo sapiens
ctcccatggccca

SEQ ID NO: 395756 - DNA, 14 bp, Homo sapiens
ctcccatggcccag

SEQ ID NO: 395757 - DNA, 18 bp, Homo sapiens
ctcccatggcccagcagc

SEQ ID NO: 395758 - DNA, 14 bp, Homo sapiens
ctcccatggccttc

SEQ ID NO: 395759 - DNA, 18 bp, Homo sapiens
ctcccatgggggctccag

SEQ ID NO: 395760 - DNA, 23 bp, Homo sapiens
ctcccatgggggctccagacatt

SEQ ID NO: 395761 - DNA, 16 bp, Homo sapiens
ctccccaaagggtgtg

SEQ ID NO: 395762 - DNA, 17 bp, Homo sapiens
ctccccaaccctgcccc

SEQ ID NO: 395763 - DNA, 23 bp, Homo sapiens
ctccccaactccttcctctttgc

SEQ ID NO: 395764 - DNA, 14 bp, Homo sapiens
ctccccaaggaaga

SEQ ID NO: 395765 - DNA, 21 bp, Homo sapiens
ctccccacactaacctgggtt

SEQ ID NO: 395766 - DNA, 21 bp, Homo sapiens
ctccccacagtcctcacagcc

SEQ ID NO: 395767 - DNA, 22 bp, Homo sapiens
ctccccacagtcctcacagcct

SEQ ID NO: 395768 - DNA, 18 bp, Homo sapiens
ctccccacccattttccc

SEQ ID NO: 395769 - DNA, 12 bp, Homo sapiens
ctccccacccct

SEQ ID NO: 395770 - DNA, 18 bp, Homo sapiens
ctccccacccctgccttt

SEQ ID NO: 395771 - DNA, 14 bp, Homo sapiens
ctccccacccgccc

SEQ ID NO: 395772 - DNA, 21 bp, Homo sapiens
ctccccacgagtcacctgcaa

SEQ ID NO: 395773 - DNA, 22 bp, Homo sapiens
ctccccacgagtcacctgcaag

SEQ ID NO: 395774 - DNA, 24 bp, Homo sapiens
ctccccacgagtcacctgcaagcc

SEQ ID NO: 395775 - DNA, 23 bp, Homo sapiens
ctccccacggggcctcgggacct

SEQ ID NO: 395776 - DNA, 21 bp, Homo sapiens
ctccccacgtggcacctcctc

SEQ ID NO: 395777 - DNA, 12 bp, Homo sapiens
ctccccactcta

SEQ ID NO: 395778 - DNA, 16 bp, Homo sapiens
ctccccagcaggtggg

SEQ ID NO: 395779 - DNA, 19 bp, Homo sapiens
ctccccagcaggtggggag

SEQ ID NO: 395780 - DNA, 18 bp, Homo sapiens
ctccccagccagcccttc

SEQ ID NO: 395781 - DNA, 21 bp, Homo sapiens
ctccccagccagcccttccct

SEQ ID NO: 395782 - DNA, 13 bp, Homo sapiens
gggccgcctcctc

SEQ ID NO: 395783 - DNA, 20 bp, Homo sapiens
gggccgcctcctccagactc

SEQ ID NO: 395784 - DNA, 15 bp, Homo sapiens
gggccggcagcctgg

SEQ ID NO: 395785 - DNA, 22 bp, Homo sapiens
gggccgggctggcttctccctg

SEQ ID NO: 395786 - DNA, 14 bp, Homo sapiens
gggcctcactccag

SEQ ID NO: 395787 - DNA, 19 bp, Homo sapiens
gggcctcccatagtgctgg

SEQ ID NO: 395788 - DNA, 22 bp, Homo sapiens
gggcctccttcccatgcctgtc

SEQ ID NO: 395789 - DNA, 14 bp, Homo sapiens
gggcctcgggacct

SEQ ID NO: 395790 - DNA, 12 bp, Homo sapiens
gggcctctggct

SEQ ID NO: 395791 - DNA, 14 bp, Homo sapiens
gggcctctggctgc

SEQ ID NO: 395792 - DNA, 16 bp, Homo sapiens
gggcctgacccggccc

SEQ ID NO: 395793 - DNA, 21 bp, Homo sapiens
gggcctgacccggcccctacc

SEQ ID NO: 395794 - DNA, 11 bp, Homo sapiens
gggcctgactt

SEQ ID NO: 395795 - DNA, 14 bp, Homo sapiens
gggcctgcaggccc

SEQ ID NO: 395796 - DNA, 12 bp, Homo sapiens
gggcctgcccaa

SEQ ID NO: 395797 - DNA, 13 bp, Homo sapiens
gggcctggacctg

SEQ ID NO: 395798 - DNA, 11 bp, Homo sapiens
gggcctggact

SEQ ID NO: 395799 - DNA, 15 bp, Homo sapiens
gggcctggcctgagc

SEQ ID NO: 395800 - DNA, 14 bp, Homo sapiens
gggcctgggcctcc

SEQ ID NO: 395801 - DNA, 20 bp, Homo sapiens
gggcctgggggcagtgactg

SEQ ID NO: 395802 - DNA, 16 bp, Homo sapiens
gggcctgtcgtgccag

SEQ ID NO: 395803 - DNA, 20 bp, Homo sapiens
gggcctgtcgtgccagtcct

SEQ ID NO: 395804 - DNA, 16 bp, Homo sapiens
gggcctgtgcagcagc

SEQ ID NO: 395805 - DNA, 14 bp, Homo sapiens
gggccttctcagct

SEQ ID NO: 395806 - DNA, 23 bp, Homo sapiens
gggccttgctacctcaaggggga

SEQ ID NO: 395807 - DNA, 16 bp, Homo sapiens
gggccttgtctcttcc

SEQ ID NO: 395808 - DNA, 13 bp, Homo sapiens
gggccttgtgtgc

SEQ ID NO: 395809 - DNA, 14 bp, Homo sapiens
gggccttgtgtgct

SEQ ID NO: 395810 - DNA, 16 bp, Homo sapiens
gggcctttcagtccca

SEQ ID NO: 395811 - DNA, 20 bp, Homo sapiens
gggcgagactccgtctcaaa

SEQ ID NO: 395812 - DNA, 16 bp, Homo sapiens
gggcgaggcagaggac

SEQ ID NO: 395813 - DNA, 21 bp, Homo sapiens
gggcgaggcgggggagcctgg

SEQ ID NO: 395814 - DNA, 12 bp, Homo sapiens
gggcgagggagg

SEQ ID NO: 395815 - DNA, 22 bp, Homo sapiens
gggcgcagtggctcacgcctgt

SEQ ID NO: 395816 - DNA, 12 bp, Homo sapiens
gggcgctcagga

SEQ ID NO: 395817 - DNA, 20 bp, Homo sapiens
gggcgctccggcagaggcag

SEQ ID NO: 395818 - DNA, 12 bp, Homo sapiens
gggcggccaggc

SEQ ID NO: 395819 - DNA, 14 bp, Homo sapiens
gggcggccaggcaa

SEQ ID NO: 395820 - DNA, 13 bp, Homo sapiens
gggcgggccagga

SEQ ID NO: 395821 - DNA, 14 bp, Homo sapiens
gggcgggccaggag

SEQ ID NO: 395822 - DNA, 12 bp, Homo sapiens
gggcggggcagg

SEQ ID NO: 395823 - DNA, 16 bp, Homo sapiens
gggcggggcaggaatg

SEQ ID NO: 395824 - DNA, 21 bp, Homo sapiens
gggcgggggtctatacattcc

SEQ ID NO: 395825 - DNA, 13 bp, Homo sapiens
gggcgtgtccctc

SEQ ID NO: 395826 - DNA, 14 bp, Homo sapiens
gggcgtgtccctcc

SEQ ID NO: 395827 - DNA, 17 bp, Homo sapiens
gggcgtgtccctcctct

SEQ ID NO: 395828 - DNA, 15 bp, Homo sapiens
gggctaaggcctctt

SEQ ID NO: 395829 - DNA, 20 bp, Homo sapiens
gggctaaggcctcttgctgg

SEQ ID NO: 395830 - DNA, 17 bp, Homo sapiens
gggctaagtccagctct

SEQ ID NO: 395831 - DNA, 22 bp, Homo sapiens
gggctaattctgggaagggaga

SEQ ID NO: 395832 - DNA, 15 bp, Homo sapiens
gggctactggcagct

SEQ ID NO: 395833 - DNA, 18 bp, Homo sapiens
gggctactggcagctcct

SEQ ID NO: 395834 - DNA, 19 bp, Homo sapiens
gggctagtgtgagtggcag

SEQ ID NO: 395835 - DNA, 21 bp, Homo sapiens
gggctagtgtgagtggcagcc

SEQ ID NO: 395836 - DNA, 14 bp, Homo sapiens
gggctatggcaagg

SEQ ID NO: 395837 - DNA, 17 bp, Homo sapiens
gggctatggcaaggggg

SEQ ID NO: 395838 - DNA, 14 bp, Homo sapiens
gggctattccctgg

SEQ ID NO: 395839 - DNA, 17 bp, Homo sapiens
gggctattccctggaga

SEQ ID NO: 395840 - DNA, 13 bp, Homo sapiens
gggctatttctct

SEQ ID NO: 395841 - DNA, 17 bp, Homo sapiens
gggctatttctctcccc

SEQ ID NO: 395842 - DNA, 16 bp, Homo sapiens
gggctcaagcagtcta

SEQ ID NO: 395843 - DNA, 23 bp, Homo sapiens
gggctcaaggcaccgcagcctgt

SEQ ID NO: 395844 - DNA, 15 bp, Homo sapiens
gggctcagggctgga

SEQ ID NO: 395845 - DNA, 12 bp, Homo sapiens
gggctccctcct

SEQ ID NO: 395846 - DNA, 21 bp, Homo sapiens
gggctccctcctggagcatcc

SEQ ID NO: 395847 - DNA, 16 bp, Homo sapiens
gggctcctggctgcca

SEQ ID NO: 395848 - DNA, 15 bp, Homo sapiens
ctcccgctgctgctg

SEQ ID NO: 395849 - DNA, 16 bp, Homo sapiens
ctcccgctgctgctgc

SEQ ID NO: 395850 - DNA, 17 bp, Homo sapiens
ctcccgctgctgctgct

SEQ ID NO: 395851 - DNA, 20 bp, Homo sapiens
ctcccggctatgggggcact

SEQ ID NO: 395852 - DNA, 14 bp, Homo sapiens
ctcccggctgcctg

SEQ ID NO: 395853 - DNA, 15 bp, Homo sapiens
ctcccgggccacgcc

SEQ ID NO: 395854 - DNA, 23 bp, Homo sapiens
ctcccgggccacgccccagcccg

SEQ ID NO: 395855 - DNA, 15 bp, Homo sapiens
ctcccgggccctccc

SEQ ID NO: 395856 - DNA, 16 bp, Homo sapiens
ctcccgggccctccct

SEQ ID NO: 395857 - DNA, 20 bp, Homo sapiens
ctcccgggccctcccttgga

SEQ ID NO: 395858 - DNA, 16 bp, Homo sapiens
ctcccggggcagggca

SEQ ID NO: 395859 - DNA, 15 bp, Homo sapiens
ctcccggtgcccaag

SEQ ID NO: 395860 - DNA, 23 bp, Homo sapiens
ctcccgtccgtccgcccgcccac

SEQ ID NO: 395861 - DNA, 16 bp, Homo sapiens
ctccctaaagccctct

SEQ ID NO: 395862 - DNA, 23 bp, Homo sapiens
ctccctaaccactaatgttagaa

SEQ ID NO: 395863 - DNA, 11 bp, Homo sapiens
ctccctacctc

SEQ ID NO: 395864 - DNA, 15 bp, Homo sapiens
ctccctacttccaag

SEQ ID NO: 395865 - DNA, 15 bp, Homo sapiens
ctccctagactgcat

SEQ ID NO: 395866 - DNA, 17 bp, Homo sapiens
ctccctagactgcatcc

SEQ ID NO: 395867 - DNA, 21 bp, Homo sapiens
ctccctagtgacccggaggcc

SEQ ID NO: 395868 - DNA, 17 bp, Homo sapiens
ctccctagttacccacc

SEQ ID NO: 395869 - DNA, 17 bp, Homo sapiens
ctccctataatgctgga

SEQ ID NO: 395870 - DNA, 12 bp, Homo sapiens
ctccctcagccc

SEQ ID NO: 395871 - DNA, 17 bp, Homo sapiens
ctccctcagctctctgg

SEQ ID NO: 395872 - DNA, 19 bp, Homo sapiens
ctccctcagctctctggga

SEQ ID NO: 395873 - DNA, 18 bp, Homo sapiens
ctccctccacacctccac

SEQ ID NO: 395874 - DNA, 20 bp, Homo sapiens
ctccctccacacctccaccc

SEQ ID NO: 395875 - DNA, 15 bp, Homo sapiens
ctccctccactcctc

SEQ ID NO: 395876 - DNA, 16 bp, Homo sapiens
ctccctccactcctcc

SEQ ID NO: 395877 - DNA, 12 bp, Homo sapiens
ctccctccatgg

SEQ ID NO: 395878 - DNA, 17 bp, Homo sapiens
ctccctccatggcagga

SEQ ID NO: 395879 - DNA, 13 bp, Homo sapiens
ctccctccccacc

SEQ ID NO: 395880 - DNA, 14 bp, Homo sapiens
ctccctccccagtg

SEQ ID NO: 395881 - DNA, 13 bp, Homo sapiens
ctccctcccctgc

SEQ ID NO: 395882 - DNA, 14 bp, Homo sapiens
ctccctcccctgcc

SEQ ID NO: 395883 - DNA, 16 bp, Homo sapiens
ctccctccctccacac

SEQ ID NO: 395884 - DNA, 16 bp, Homo sapiens
ctccctccctgcaggg

SEQ ID NO: 395885 - DNA, 17 bp, Homo sapiens
ctccctccgactccaga

SEQ ID NO: 395886 - DNA, 18 bp, Homo sapiens
ctccctccgactccagat

SEQ ID NO: 395887 - DNA, 17 bp, Homo sapiens
ctccctcctcacctctg

SEQ ID NO: 395888 - DNA, 22 bp, Homo sapiens
ctccctcctggagcatcccagg

SEQ ID NO: 395889 - DNA, 12 bp, Homo sapiens
ctccctcctggc

SEQ ID NO: 395890 - DNA, 14 bp, Homo sapiens
ctccctcctggctc

SEQ ID NO: 395891 - DNA, 18 bp, Homo sapiens
ctccctcctggctcacag

SEQ ID NO: 395892 - DNA, 20 bp, Homo sapiens
ctccctcctggctcacagcc

SEQ ID NO: 395893 - DNA, 14 bp, Homo sapiens
ctccctcgcatccg

SEQ ID NO: 395894 - DNA, 15 bp, Homo sapiens
ctccctcgctgtatg

SEQ ID NO: 395895 - DNA, 15 bp, Homo sapiens
ctccctcggccccac

SEQ ID NO: 395896 - DNA, 17 bp, Homo sapiens
ctccctctctcttctgc

SEQ ID NO: 395897 - DNA, 20 bp, Homo sapiens
ctccctctctcttctgctcc

SEQ ID NO: 395898 - DNA, 21 bp, Homo sapiens
ctccctctctcttctgctcca

SEQ ID NO: 395899 - DNA, 22 bp, Homo sapiens
ctccctctctcttctgctccac

SEQ ID NO: 395900 - DNA, 14 bp, Homo sapiens
ctccctctgcccca

SEQ ID NO: 395901 - DNA, 20 bp, Homo sapiens
ctccctctgccccaagcagc

SEQ ID NO: 395902 - DNA, 21 bp, Homo sapiens
ctccctctgccccaagcagcc

SEQ ID NO: 395903 - DNA, 12 bp, Homo sapiens
ctccctctgctc

SEQ ID NO: 395904 - DNA, 15 bp, Homo sapiens
ctccctctgctctca

SEQ ID NO: 395905 - DNA, 13 bp, Homo sapiens
ctccctcttccca

SEQ ID NO: 395906 - DNA, 14 bp, Homo sapiens
ctccctcttcccag

SEQ ID NO: 395907 - DNA, 15 bp, Homo sapiens
ctccctcttcccagc

SEQ ID NO: 395908 - DNA, 16 bp, Homo sapiens
ctccctcttcccagca

SEQ ID NO: 395909 - DNA, 15 bp, Homo sapiens
ctccctcttctcaag

SEQ ID NO: 395910 - DNA, 23 bp, Homo sapiens
ctccctgaaaatgtttttctgcc

SEQ ID NO: 395911 - DNA, 15 bp, Homo sapiens
ctccctgaccctgca

SEQ ID NO: 395912 - DNA, 12 bp, Homo sapiens
ctccctgagcct

SEQ ID NO: 395913 - DNA, 19 bp, Homo sapiens
ctccctgagcctgccccag

SEQ ID NO: 395914 - DNA, 19 bp, Homo sapiens
ctccctgcacaagccaggg

SEQ ID NO: 395915 - DNA, 16 bp, Homo sapiens
ctccctgccaactcca

SEQ ID NO: 395916 - DNA, 22 bp, Homo sapiens
ctccctgccaccgtcacacagt

SEQ ID NO: 395917 - DNA, 14 bp, Homo sapiens
ctccctgcccctcc

SEQ ID NO: 395918 - DNA, 17 bp, Homo sapiens
ctccctgcccctccctt

SEQ ID NO: 395919 - DNA, 13 bp, Homo sapiens
ctccctgcctcac

SEQ ID NO: 395920 - DNA, 18 bp, Homo sapiens
ctccctgcctcacatctc

SEQ ID NO: 395921 - DNA, 14 bp, Homo sapiens
ctccctgcctgctc

SEQ ID NO: 395922 - DNA, 15 bp, Homo sapiens
ggggactcagccctg

SEQ ID NO: 395923 - DNA, 24 bp, Homo sapiens
ggggactgggagtcagagccctgg

SEQ ID NO: 395924 - DNA, 16 bp, Homo sapiens
ggggacttggatagga

SEQ ID NO: 395925 - DNA, 16 bp, Homo sapiens
ggggagaatggctctg

SEQ ID NO: 395926 - DNA, 17 bp, Homo sapiens
ggggagacacctcagag

SEQ ID NO: 395927 - DNA, 14 bp, Homo sapiens
ggggagcagagaca

SEQ ID NO: 395928 - DNA, 15 bp, Homo sapiens
ggggagcctggagcc

SEQ ID NO: 395929 - DNA, 18 bp, Homo sapiens
ggggagcctggagcccct

SEQ ID NO: 395930 - DNA, 13 bp, Homo sapiens
ggggagctggtgg

SEQ ID NO: 395931 - DNA, 12 bp, Homo sapiens
ggggaggcaaga

SEQ ID NO: 395932 - DNA, 21 bp, Homo sapiens
ggggaggccaagtgcaggctg

SEQ ID NO: 395933 - DNA, 11 bp, Homo sapiens
ggggaggcttt

SEQ ID NO: 395934 - DNA, 18 bp, Homo sapiens
ggggagggctgcctgaaa

SEQ ID NO: 395935 - DNA, 21 bp, Homo sapiens
ggggagtccagggctcccgga

SEQ ID NO: 395936 - DNA, 21 bp, Homo sapiens
ggggagtctgcttgtcttaga

SEQ ID NO: 395937 - DNA, 18 bp, Homo sapiens
ggggatcctggagcccct

SEQ ID NO: 395938 - DNA, 13 bp, Homo sapiens
ggggatgcttcat

SEQ ID NO: 395939 - DNA, 21 bp, Homo sapiens
ggggatggagaatgccagccc

SEQ ID NO: 395940 - DNA, 18 bp, Homo sapiens
ggggattcaaatgcatga

SEQ ID NO: 395941 - DNA, 19 bp, Homo sapiens
ggggatttcaagggactgg

SEQ ID NO: 395942 - DNA, 14 bp, Homo sapiens
ggggatttctccca

SEQ ID NO: 395943 - DNA, 15 bp, Homo sapiens
ggggatttctcccag

SEQ ID NO: 395944 - DNA, 22 bp, Homo sapiens
ggggcaagagctcaggagaagg

SEQ ID NO: 395945 - DNA, 23 bp, Homo sapiens
ggggcaagagctcaggagaaggc

SEQ ID NO: 395946 - DNA, 17 bp, Homo sapiens
ggggcaaggtgggggag

SEQ ID NO: 395947 - DNA, 16 bp, Homo sapiens
ggggcacaccactgcc

SEQ ID NO: 395948 - DNA, 17 bp, Homo sapiens
ggggcagagctcagagg

SEQ ID NO: 395949 - DNA, 14 bp, Homo sapiens
ggggcagagctgag

SEQ ID NO: 395950 - DNA, 19 bp, Homo sapiens
ggggcagctgccagagaag

SEQ ID NO: 395951 - DNA, 21 bp, Homo sapiens
ggggcagggaaggggaggcag

SEQ ID NO: 395952 - DNA, 17 bp, Homo sapiens
ggggcagtctggagggg

SEQ ID NO: 395953 - DNA, 18 bp, Homo sapiens
ggggcatccttgaggacc

SEQ ID NO: 395954 - DNA, 22 bp, Homo sapiens
ggggcatctgagtccagctccc

SEQ ID NO: 395955 - DNA, 14 bp, Homo sapiens
ggggcatctgcccc

SEQ ID NO: 395956 - DNA, 17 bp, Homo sapiens
ggggcatggttccttcc

SEQ ID NO: 395957 - DNA, 19 bp, Homo sapiens
ggggcatgtattggcctgg

SEQ ID NO: 395958 - DNA, 22 bp, Homo sapiens
ggggccactctctactggtagg

SEQ ID NO: 395959 - DNA, 13 bp, Homo sapiens
ggggccagactgg

SEQ ID NO: 395960 - DNA, 20 bp, Homo sapiens
ggggccaggatggcgtgtcc

SEQ ID NO: 395961 - DNA, 21 bp, Homo sapiens
ggggcccaagcatgccccacc

SEQ ID NO: 395962 - DNA, 14 bp, Homo sapiens
ggggcccaggggct

SEQ ID NO: 395963 - DNA, 18 bp, Homo sapiens
ggggcccaggggctttgg

SEQ ID NO: 395964 - DNA, 14 bp, Homo sapiens
ggggccccaaagcc

SEQ ID NO: 395965 - DNA, 14 bp, Homo sapiens
ggggccccagggct

SEQ ID NO: 395966 - DNA, 18 bp, Homo sapiens
ggggccccggggctggca

SEQ ID NO: 395967 - DNA, 12 bp, Homo sapiens
ggggcccctcgg

SEQ ID NO: 395968 - DNA, 22 bp, Homo sapiens
ggggcccttccagattgggggc

SEQ ID NO: 395969 - DNA, 21 bp, Homo sapiens
ggggccgagtccaggagcccc

SEQ ID NO: 395970 - DNA, 17 bp, Homo sapiens
ggggcctagggagccgc

SEQ ID NO: 395971 - DNA, 17 bp, Homo sapiens
ggggcctcacccagaag

SEQ ID NO: 395972 - DNA, 12 bp, Homo sapiens
ggggcctccctg

SEQ ID NO: 395973 - DNA, 20 bp, Homo sapiens
ggggcctccttgtccaggtc

SEQ ID NO: 395974 - DNA, 22 bp, Homo sapiens
ggggcctctgcctccaggaggg

SEQ ID NO: 395975 - DNA, 20 bp, Homo sapiens
ggggcctctggctgcctggc

SEQ ID NO: 395976 - DNA, 22 bp, Homo sapiens
ggggcctctggctgcctggccc

SEQ ID NO: 395977 - DNA, 13 bp, Homo sapiens
ggggcctgcaggc

SEQ ID NO: 395978 - DNA, 15 bp, Homo sapiens
ggggcctggacctgc

SEQ ID NO: 395979 - DNA, 13 bp, Homo sapiens
gggtctatacatt

SEQ ID NO: 395980 - DNA, 17 bp, Homo sapiens
gggtctatacattcctg

SEQ ID NO: 395981 - DNA, 19 bp, Homo sapiens
gggtctatacattcctgag

SEQ ID NO: 395982 - DNA, 14 bp, Homo sapiens
gggtctccctgagc

SEQ ID NO: 395983 - DNA, 16 bp, Homo sapiens
gggtctccctgagcct

SEQ ID NO: 395984 - DNA, 17 bp, Homo sapiens
gggtctccctgagcctg

SEQ ID NO: 395985 - DNA, 22 bp, Homo sapiens
gggtctctgagcagtggggagc

SEQ ID NO: 395986 - DNA, 22 bp, Homo sapiens
gggtctgaaggaatagccagag

SEQ ID NO: 395987 - DNA, 12 bp, Homo sapiens
gggtctgcctcc

SEQ ID NO: 395988 - DNA, 18 bp, Homo sapiens
gggtctgcctcccacgct

SEQ ID NO: 395989 - DNA, 22 bp, Homo sapiens
gggtctgctctttctctgccag

SEQ ID NO: 395990 - DNA, 17 bp, Homo sapiens
gggtctgggaggcaggt

SEQ ID NO: 395991 - DNA, 17 bp, Homo sapiens
gggtctgtgctgtgcct

SEQ ID NO: 395992 - DNA, 19 bp, Homo sapiens
gggtctgtgctgtgcctgc

SEQ ID NO: 395993 - DNA, 20 bp, Homo sapiens
gggtcttcagggggccaggt

SEQ ID NO: 395994 - DNA, 23 bp, Homo sapiens
gggtcttccctacctcaggcagg

SEQ ID NO: 395995 - DNA, 22 bp, Homo sapiens
gggtcttgggctactggcagct

SEQ ID NO: 395996 - DNA, 18 bp, Homo sapiens
gggtgaaaagtatggcag

SEQ ID NO: 395997 - DNA, 14 bp, Homo sapiens
gggtgaagggagag

SEQ ID NO: 395998 - DNA, 15 bp, Homo sapiens
gggtgacatcccagg

SEQ ID NO: 395999 - DNA, 11 bp, Homo sapiens
gggtgaccagg

SEQ ID NO: 396000 - DNA, 13 bp, Homo sapiens
gggtgaccaggtc

SEQ ID NO: 396001 - DNA, 20 bp, Homo sapiens
gggtgactgaatttgggcct

SEQ ID NO: 396002 - DNA, 22 bp, Homo sapiens
gggtgactgaatttgggcctct

SEQ ID NO: 396003 - DNA, 19 bp, Homo sapiens
gggtgagaatcctgcctct

SEQ ID NO: 396004 - DNA, 12 bp, Homo sapiens
gggtgagagagg

SEQ ID NO: 396005 - DNA, 22 bp, Homo sapiens
gggtgaggggccaggccatggc

SEQ ID NO: 396006 - DNA, 13 bp, Homo sapiens
gggtgaggtaggc

SEQ ID NO: 396007 - DNA, 15 bp, Homo sapiens
gggtgatttctagaa

SEQ ID NO: 396008 - DNA, 21 bp, Homo sapiens
gggtgcaatgataatgaagaa

SEQ ID NO: 396009 - DNA, 23 bp, Homo sapiens
gggtgcacccactcaccagggtc

SEQ ID NO: 396010 - DNA, 14 bp, Homo sapiens
gggtgcagcagtga

SEQ ID NO: 396011 - DNA, 13 bp, Homo sapiens
gggtgcctggtgc

SEQ ID NO: 396012 - DNA, 20 bp, Homo sapiens
gggtgcgtgaccggcccgcc

SEQ ID NO: 396013 - DNA, 14 bp, Homo sapiens
gggtggacagaagc

SEQ ID NO: 396014 - DNA, 20 bp, Homo sapiens
gggtggacgcaattgtggga

SEQ ID NO: 396015 - DNA, 13 bp, Homo sapiens
gggtgggacacag

SEQ ID NO: 396016 - DNA, 13 bp, Homo sapiens
gggtgggagccaa

SEQ ID NO: 396017 - DNA, 14 bp, Homo sapiens
gggtgggaggctcc

SEQ ID NO: 396018 - DNA, 15 bp, Homo sapiens
gggtgggcaggaaaa

SEQ ID NO: 396019 - DNA, 13 bp, Homo sapiens
gggtgggcccaga

SEQ ID NO: 396020 - DNA, 14 bp, Homo sapiens
gggtgggcccagaa

SEQ ID NO: 396021 - DNA, 15 bp, Homo sapiens
gggtgggcccagaac

SEQ ID NO: 396022 - DNA, 12 bp, Homo sapiens
gggtgggcctct

SEQ ID NO: 396023 - DNA, 23 bp, Homo sapiens
gggtggggacgtcctgccacctg

SEQ ID NO: 396024 - DNA, 14 bp, Homo sapiens
gggtggggcttgga

SEQ ID NO: 396025 - DNA, 17 bp, Homo sapiens
gggtggggcttggaagg

SEQ ID NO: 396026 - DNA, 17 bp, Homo sapiens
gggtggggtagggctga

SEQ ID NO: 396027 - DNA, 16 bp, Homo sapiens
gggtggggtgcctgag

SEQ ID NO: 396028 - DNA, 19 bp, Homo sapiens
gggtgtcacagaggcagtg

SEQ ID NO: 396029 - DNA, 17 bp, Homo sapiens
gggtgtgcacatctctg

SEQ ID NO: 396030 - DNA, 12 bp, Homo sapiens
gggtgtgccctg

SEQ ID NO: 396031 - DNA, 21 bp, Homo sapiens
gggtgtggcacgcacctgtag

SEQ ID NO: 396032 - DNA, 16 bp, Homo sapiens
gggtgtggggtggggt

SEQ ID NO: 396033 - DNA, 17 bp, Homo sapiens
gggttaaagaaaggcag

SEQ ID NO: 396034 - DNA, 12 bp, Homo sapiens
gggttacaaact

SEQ ID NO: 396035 - DNA, 17 bp, Homo sapiens
gggttagcaatatttat

SEQ ID NO: 396036 - DNA, 21 bp, Homo sapiens
gggttagcctggtgacaggca

SEQ ID NO: 396037 - DNA, 20 bp, Homo sapiens
gggttcacgccattctcctg

SEQ ID NO: 396038 - DNA, 19 bp, Homo sapiens
gggttcagaaatgctgcct

SEQ ID NO: 396039 - DNA, 21 bp, Homo sapiens
gggttcagaaatgctgcctgc

SEQ ID NO: 396040 - DNA, 13 bp, Homo sapiens
gggttcaggggac

SEQ ID NO: 396041 - DNA, 12 bp, Homo sapiens
gggttccagaca

SEQ ID NO: 396042 - DNA, 23 bp, Homo sapiens
gggttccagacagagtggatctg

SEQ ID NO: 396043 - DNA, 16 bp, Homo sapiens
gggttccagcttccct

SEQ ID NO: 396044 - DNA, 14 bp, Homo sapiens
gggttcccccagcc

SEQ ID NO: 396045 - DNA, 15 bp, Homo sapiens
gggttcccccagccc

SEQ ID NO: 396046 - DNA, 12 bp, Homo sapiens
gggttctagacg

SEQ ID NO: 396047 - DNA, 19 bp, Homo sapiens
gggttctagacgcccctcc

SEQ ID NO: 396048 - DNA, 18 bp, Homo sapiens
gggttctcctctcccctc

SEQ ID NO: 396049 - DNA, 22 bp, Homo sapiens
gggttctgtaaaatggaaaact

SEQ ID NO: 396050 - DNA, 14 bp, Homo sapiens
gggttctttcttcc

SEQ ID NO: 396051 - DNA, 18 bp, Homo sapiens
gggttgcagtggagaggg

SEQ ID NO: 396052 - DNA, 19 bp, Homo sapiens
gggttgcagtggagaggga

SEQ ID NO: 396053 - DNA, 15 bp, Homo sapiens
gggttgctggagcct

SEQ ID NO: 396054 - DNA, 17 bp, Homo sapiens
gggttggaggcctcacc

SEQ ID NO: 396055 - DNA, 19 bp, Homo sapiens
gggttggctgttccagact

SEQ ID NO: 396056 - DNA, 14 bp, Homo sapiens
gggttgggcccaga

SEQ ID NO: 396057 - DNA, 22 bp, Homo sapiens
gggttgggcccagatctggtcc

SEQ ID NO: 396058 - DNA, 15 bp, Homo sapiens
gggttgggttccaga

SEQ ID NO: 396059 - DNA, 19 bp, Homo sapiens
gggttgtggcccccgcccc

SEQ ID NO: 396060 - DNA, 17 bp, Homo sapiens
gggtttacaacaaacac

SEQ ID NO: 396061 - DNA, 17 bp, Homo sapiens
gggtttagcaggctgca

SEQ ID NO: 396062 - DNA, 19 bp, Homo sapiens
gggtttagcaggctgcagc

SEQ ID NO: 396063 - DNA, 19 bp, Homo sapiens
gggtttctgccctgcccac

SEQ ID NO: 396064 - DNA, 20 bp, Homo sapiens
gggtttggcgggccaaggac

SEQ ID NO: 396065 - DNA, 12 bp, Homo sapiens
ctcctctgtcag

SEQ ID NO: 396066 - DNA, 21 bp, Homo sapiens
ctcctctgtcagtttgtgaag

SEQ ID NO: 396067 - DNA, 14 bp, Homo sapiens
ctcctctgtgctcc

SEQ ID NO: 396068 - DNA, 18 bp, Homo sapiens
ctcctcttcaactgacca

SEQ ID NO: 396069 - DNA, 19 bp, Homo sapiens
ctcctcttcaccccggcag

SEQ ID NO: 396070 - DNA, 23 bp, Homo sapiens
ctcctcttcttttttttcattat

SEQ ID NO: 396071 - DNA, 16 bp, Homo sapiens
ctcctcttgccactgc

SEQ ID NO: 396072 - DNA, 18 bp, Homo sapiens
ctcctcttgccactgcct

SEQ ID NO: 396073 - DNA, 15 bp, Homo sapiens
ctcctcttggagctg

SEQ ID NO: 396074 - DNA, 20 bp, Homo sapiens
ctcctcttggagctgagatg

SEQ ID NO: 396075 - DNA, 20 bp, Homo sapiens
ctcctctttgttttgtttta

SEQ ID NO: 396076 - DNA, 23 bp, Homo sapiens
ctcctgacagcgacagaaaacct

SEQ ID NO: 396077 - DNA, 17 bp, Homo sapiens
ctcctgacatcaggtga

SEQ ID NO: 396078 - DNA, 13 bp, Homo sapiens
ctcctgacctcag

SEQ ID NO: 396079 - DNA, 17 bp, Homo sapiens
ctcctgacctcaggtga

SEQ ID NO: 396080 - DNA, 18 bp, Homo sapiens
ctcctgacctcatgatcc

SEQ ID NO: 396081 - DNA, 20 bp, Homo sapiens
ctcctgacttagcccgtcac

SEQ ID NO: 396082 - DNA, 22 bp, Homo sapiens
ctcctgacttagcccgtcaccc

SEQ ID NO: 396083 - DNA, 18 bp, Homo sapiens
ctcctgagaaggcgagga

SEQ ID NO: 396084 - DNA, 22 bp, Homo sapiens
ctcctgagaaggcgaggagagt

SEQ ID NO: 396085 - DNA, 14 bp, Homo sapiens
ctcctgagcctgtg

SEQ ID NO: 396086 - DNA, 19 bp, Homo sapiens
ctcctgaggggcatctgcc

SEQ ID NO: 396087 - DNA, 22 bp, Homo sapiens
ctcctgaggggcatctgcccct

SEQ ID NO: 396088 - DNA, 13 bp, Homo sapiens
ctcctgaggtctg

SEQ ID NO: 396089 - DNA, 18 bp, Homo sapiens
ctcctgaggtctggattg

SEQ ID NO: 396090 - DNA, 21 bp, Homo sapiens
ctcctgagtagctggattaca

SEQ ID NO: 396091 - DNA, 21 bp, Homo sapiens
ctcctgatagtcacctgctgg

SEQ ID NO: 396092 - DNA, 13 bp, Homo sapiens
ctcctgatggcca

SEQ ID NO: 396093 - DNA, 15 bp, Homo sapiens
ctcctgatggccaag

SEQ ID NO: 396094 - DNA, 20 bp, Homo sapiens
ctcctgatggccaagagcat

SEQ ID NO: 396095 - DNA, 16 bp, Homo sapiens
ctcctgatgtttttcc

SEQ ID NO: 396096 - DNA, 17 bp, Homo sapiens
ctcctgatgtttttccc

SEQ ID NO: 396097 - DNA, 21 bp, Homo sapiens
ctcctgattgctctggaagcc

SEQ ID NO: 396098 - DNA, 14 bp, Homo sapiens
ctcctgattttgta

SEQ ID NO: 396099 - DNA, 15 bp, Homo sapiens
ctcctgattttgtag

SEQ ID NO: 396100 - DNA, 22 bp, Homo sapiens
ctcctgcaggctggctgttggc

SEQ ID NO: 396101 - DNA, 12 bp, Homo sapiens
ctcctgcatgca

SEQ ID NO: 396102 - DNA, 12 bp, Homo sapiens
ctcctgcccaga

SEQ ID NO: 396103 - DNA, 13 bp, Homo sapiens
ctcctgcccagct

SEQ ID NO: 396104 - DNA, 18 bp, Homo sapiens
ctcctgccccctgccagt

SEQ ID NO: 396105 - DNA, 16 bp, Homo sapiens
ctcctgccctgtccct

SEQ ID NO: 396106 - DNA, 13 bp, Homo sapiens
ctcctgccctgtt

SEQ ID NO: 396107 - DNA, 14 bp, Homo sapiens
ctcctgcctcagcc

SEQ ID NO: 396108 - DNA, 17 bp, Homo sapiens
ctcctgcctcagccttc

SEQ ID NO: 396109 - DNA, 21 bp, Homo sapiens
ctcctgcctcagccttccaag

SEQ ID NO: 396110 - DNA, 17 bp, Homo sapiens
ctcctgcctgcccctct

SEQ ID NO: 396111 - DNA, 11 bp, Homo sapiens
ctcctgcctgt

SEQ ID NO: 396112 - DNA, 20 bp, Homo sapiens
ctcctgctgagtggtccaca

SEQ ID NO: 396113 - DNA, 16 bp, Homo sapiens
ctcctgctggctgagg

SEQ ID NO: 396114 - DNA, 23 bp, Homo sapiens
ctcctgcttgtactaagccagga

SEQ ID NO: 396115 - DNA, 16 bp, Homo sapiens
ctcctggaaccaatcc

SEQ ID NO: 396116 - DNA, 16 bp, Homo sapiens
ctcctggacacggcct

SEQ ID NO: 396117 - DNA, 18 bp, Homo sapiens
ctcctggacccagcaggg

SEQ ID NO: 396118 - DNA, 20 bp, Homo sapiens
ctcctggacccagcaggggc

SEQ ID NO: 396119 - DNA, 17 bp, Homo sapiens
ctcctggagcatcccag

SEQ ID NO: 396120 - DNA, 13 bp, Homo sapiens
ctcctggagccag

SEQ ID NO: 396121 - DNA, 14 bp, Homo sapiens
ctcctggctgccag

SEQ ID NO: 396122 - DNA, 17 bp, Homo sapiens
ctcctggctgccaggcg

SEQ ID NO: 396123 - DNA, 22 bp, Homo sapiens
ctcctgggaaggctactcacct

SEQ ID NO: 396124 - DNA, 17 bp, Homo sapiens
ctcctgggcccaggcag

SEQ ID NO: 396125 - DNA, 22 bp, Homo sapiens
ctcctgggcccctccctacctc

SEQ ID NO: 396126 - DNA, 23 bp, Homo sapiens
ctcctgggcccctccctacctca

SEQ ID NO: 396127 - DNA, 14 bp, Homo sapiens
ctcctgggctcaag

SEQ ID NO: 396128 - DNA, 15 bp, Homo sapiens
ctcctgggctcaagc

SEQ ID NO: 396129 - DNA, 13 bp, Homo sapiens
ctcctgggctcag

SEQ ID NO: 396130 - DNA, 20 bp, Homo sapiens
ctcctgggggttctttcttc

SEQ ID NO: 396131 - DNA, 19 bp, Homo sapiens
ctcctgggttcaagcgatt

SEQ ID NO: 396132 - DNA, 17 bp, Homo sapiens
ctcctgtagccactggc

SEQ ID NO: 396133 - DNA, 19 bp, Homo sapiens
ctcctgtagccactggcat

SEQ ID NO: 396134 - DNA, 20 bp, Homo sapiens
ctcctgtagccactggcata

SEQ ID NO: 396135 - DNA, 19 bp, Homo sapiens
ctcctgtctcctctgtcag

SEQ ID NO: 396136 - DNA, 14 bp, Homo sapiens
ctcctgtctggctc

SEQ ID NO: 396137 - DNA, 17 bp, Homo sapiens
ctcctgtctggctcgga

SEQ ID NO: 396138 - DNA, 16 bp, Homo sapiens
ctcctgtgcatgggtg

SEQ ID NO: 396139 - DNA, 22 bp, Homo sapiens
ctcctgtgcccacatcccaggc

SEQ ID NO: 396140 - DNA, 18 bp, Homo sapiens
ctcctgtgtagctgggat

SEQ ID NO: 396141 - DNA, 14 bp, Homo sapiens
ctcctgtgtgtgga

SEQ ID NO: 396142 - DNA, 14 bp, Homo sapiens
ctcctgttcctgcc

SEQ ID NO: 396143 - DNA, 21 bp, Homo sapiens
ctcctgttcctgccttctctt

SEQ ID NO: 396144 - DNA, 21 bp, Homo sapiens
ctccttaatatgatctgtgga

SEQ ID NO: 396145 - DNA, 22 bp, Homo sapiens
ctccttaatatgatctgtggag

SEQ ID NO: 396146 - DNA, 15 bp, Homo sapiens
ctccttactctgagc

SEQ ID NO: 396147 - DNA, 22 bp, Homo sapiens
ctccttactctgagcccaggcc

SEQ ID NO: 396148 - DNA, 23 bp, Homo sapiens
ctccttactctgagcccaggccg

SEQ ID NO: 396149 - DNA, 22 bp, Homo sapiens
ctccttagccctgtctgctagg

SEQ ID NO: 396150 - DNA, 19 bp, Homo sapiens
ctccttatagacacttgct

SEQ ID NO: 396151 - DNA, 20 bp, Homo sapiens
ctccttatagacacttgctc

SEQ ID NO: 396152 - DNA, 16 bp, Homo sapiens
ctccttatttatcaac

SEQ ID NO: 396153 - DNA, 15 bp, Homo sapiens
ctccttattttgtat

SEQ ID NO: 396154 - DNA, 16 bp, Homo sapiens
ctccttcactctgaca

SEQ ID NO: 396155 - DNA, 17 bp, Homo sapiens
ctccttcactctgacag

SEQ ID NO: 396156 - DNA, 13 bp, Homo sapiens
ctccttcatgctt

SEQ ID NO: 396157 - DNA, 14 bp, Homo sapiens
ctccttcatgcttt

SEQ ID NO: 396158 - DNA, 16 bp, Homo sapiens
ctccttcatgcttttc

SEQ ID NO: 396159 - DNA, 14 bp, Homo sapiens
ctccttccaactgc

SEQ ID NO: 396160 - DNA, 18 bp, Homo sapiens
ctccttccaactgctgcc

SEQ ID NO: 396161 - DNA, 19 bp, Homo sapiens
ctccttccaactgctgccc

SEQ ID NO: 396162 - DNA, 18 bp, Homo sapiens
ctccttcccactgtcctt

SEQ ID NO: 396163 - DNA, 20 bp, Homo sapiens
ctccttcccactgtcctttc

SEQ ID NO: 396164 - DNA, 15 bp, Homo sapiens
ctccttcccccagcc

SEQ ID NO: 396165 - DNA, 18 bp, Homo sapiens
ctccttcccccagcccaa

SEQ ID NO: 396166 - DNA, 17 bp, Homo sapiens
ctccttccctggtccag

SEQ ID NO: 396167 - DNA, 20 bp, Homo sapiens
ctccttccctggtccagatt

SEQ ID NO: 396168 - DNA, 19 bp, Homo sapiens
ctccttcgtgtctctccca

SEQ ID NO: 396169 - DNA, 20 bp, Homo sapiens
ctccttcgtgtctctcccac

SEQ ID NO: 396170 - DNA, 13 bp, Homo sapiens
ctccttctcccct

SEQ ID NO: 396171 - DNA, 20 bp, Homo sapiens
ctccttctcccctccagacc

SEQ ID NO: 396172 - DNA, 13 bp, Homo sapiens
ctccttctccctt

SEQ ID NO: 396173 - DNA, 16 bp, Homo sapiens
ctccttcttgccctga

SEQ ID NO: 396174 - DNA, 13 bp, Homo sapiens
ctccttgaataag

SEQ ID NO: 396175 - DNA, 14 bp, Homo sapiens
ctccttgccacccc

SEQ ID NO: 396176 - DNA, 17 bp, Homo sapiens
ctccttgccaccccccg

SEQ ID NO: 396177 - DNA, 18 bp, Homo sapiens
ctccttgccgctgggaga

SEQ ID NO: 396178 - DNA, 19 bp, Homo sapiens
ctccttgccgctgggagag

SEQ ID NO: 396179 - DNA, 20 bp, Homo sapiens
ctccttgccgctgggagagc

SEQ ID NO: 396180 - DNA, 21 bp, Homo sapiens
ctccttggatttgcatttttg

SEQ ID NO: 396181 - DNA, 12 bp, Homo sapiens
ctccttggccta

SEQ ID NO: 396182 - DNA, 15 bp, Homo sapiens
ctccttgggctcctg

SEQ ID NO: 396183 - DNA, 16 bp, Homo sapiens
ctccttgggctcctgg

SEQ ID NO: 396184 - DNA, 22 bp, Homo sapiens
ctccttgggctcctggctgcca

SEQ ID NO: 396185 - DNA, 23 bp, Homo sapiens
ctccttgtttgcctttaggcagg

SEQ ID NO: 396186 - DNA, 12 bp, Homo sapiens
ctcctttcccac

SEQ ID NO: 396187 - DNA, 14 bp, Homo sapiens
ctcctttcccacag

SEQ ID NO: 396188 - DNA, 15 bp, Homo sapiens
ctcctttcccacagt

SEQ ID NO: 396189 - DNA, 21 bp, Homo sapiens
ctcctttcctgcatctttcat

SEQ ID NO: 396190 - DNA, 19 bp, Homo sapiens
ctcctttctccagccagca

SEQ ID NO: 396191 - DNA, 19 bp, Homo sapiens
ctcctttctttttcttctt

SEQ ID NO: 396192 - DNA, 20 bp, Homo sapiens
ctcctttctttttcttcttc

SEQ ID NO: 396193 - DNA, 21 bp, Homo sapiens
ctcctttgtcttttttttcat

SEQ ID NO: 396194 - DNA, 15 bp, Homo sapiens
ctccttttctgtgaa

SEQ ID NO: 396195 - DNA, 15 bp, Homo sapiens
ctccttttgtcccca

SEQ ID NO: 396196 - DNA, 20 bp, Homo sapiens
ctccttttgtccccagggcc

SEQ ID NO: 396197 - DNA, 16 bp, Homo sapiens
ctcctttttctacctt

SEQ ID NO: 396198 - DNA, 16 bp, Homo sapiens
ctcgaaccaaggcagc

SEQ ID NO: 396199 - DNA, 14 bp, Homo sapiens
gggtttgggcagtg

SEQ ID NO: 396200 - DNA, 13 bp, Homo sapiens
gggttttatcagt

SEQ ID NO: 396201 - DNA, 20 bp, Homo sapiens
ggtaaaaagagaaggcaagc

SEQ ID NO: 396202 - DNA, 16 bp, Homo sapiens
ggtaaatatatgtttt

SEQ ID NO: 396203 - DNA, 11 bp, Homo sapiens
ggtaaattatt

SEQ ID NO: 396204 - DNA, 12 bp, Homo sapiens
ggtaactaagaa

SEQ ID NO: 396205 - DNA, 15 bp, Homo sapiens
ggtaactaagaagtg

SEQ ID NO: 396206 - DNA, 20 bp, Homo sapiens
ggtaactgccagccttggag

SEQ ID NO: 396207 - DNA, 12 bp, Homo sapiens
ggtaagagggag

SEQ ID NO: 396208 - DNA, 16 bp, Homo sapiens
ggtaataggaagaaca

SEQ ID NO: 396209 - DNA, 12 bp, Homo sapiens
ggtacagtttgg

SEQ ID NO: 396210 - DNA, 18 bp, Homo sapiens
ggtaccaggccacccact

SEQ ID NO: 396211 - DNA, 15 bp, Homo sapiens
ggtaccctggcagag

SEQ ID NO: 396212 - DNA, 19 bp, Homo sapiens
ggtaccctggcagagaaga

SEQ ID NO: 396213 - DNA, 15 bp, Homo sapiens
ggtactaaggagaat

SEQ ID NO: 396214 - DNA, 12 bp, Homo sapiens
ggtactctccta

SEQ ID NO: 396215 - DNA, 16 bp, Homo sapiens
ggtactcttgatgtga

SEQ ID NO: 396216 - DNA, 18 bp, Homo sapiens
ggtactggggctgagggc

SEQ ID NO: 396217 - DNA, 15 bp, Homo sapiens
ggtacttcctcctga

SEQ ID NO: 396218 - DNA, 21 bp, Homo sapiens
ggtactttattcttgctgggc

SEQ ID NO: 396219 - DNA, 19 bp, Homo sapiens
ggtagaccaggatttctaa

SEQ ID NO: 396220 - DNA, 17 bp, Homo sapiens
ggtagagcaaaggagac

SEQ ID NO: 396221 - DNA, 23 bp, Homo sapiens
ggtagagcaaaggagacaaagca

SEQ ID NO: 396222 - DNA, 21 bp, Homo sapiens
ggtagagctgatccagagcac

SEQ ID NO: 396223 - DNA, 23 bp, Homo sapiens
ggtagagctgatccagagcacag

SEQ ID NO: 396224 - DNA, 22 bp, Homo sapiens
ggtagagtttatttttttgatg

SEQ ID NO: 396225 - DNA, 23 bp, Homo sapiens
ggtagatgatttctagcaggcag

SEQ ID NO: 396226 - DNA, 23 bp, Homo sapiens
ggtagccaccaccggggcactgg

SEQ ID NO: 396227 - DNA, 15 bp, Homo sapiens
ggtagccctggccag

SEQ ID NO: 396228 - DNA, 19 bp, Homo sapiens
ggtagcgagctgctctgct

SEQ ID NO: 396229 - DNA, 15 bp, Homo sapiens
ggtagctctgagccc

SEQ ID NO: 396230 - DNA, 14 bp, Homo sapiens
ggtagcttttccct

SEQ ID NO: 396231 - DNA, 22 bp, Homo sapiens
ggtaggaaagcaccgcagcatg

SEQ ID NO: 396232 - DNA, 16 bp, Homo sapiens
ggtaggcccttgtcct

SEQ ID NO: 396233 - DNA, 19 bp, Homo sapiens
ggtaggcccttgtcctgcc

SEQ ID NO: 396234 - DNA, 20 bp, Homo sapiens
ggtaggcccttgtcctgcca

SEQ ID NO: 396235 - DNA, 21 bp, Homo sapiens
ggtaggcccttgtcctgccag

SEQ ID NO: 396236 - DNA, 16 bp, Homo sapiens
ggtaggctacttttca

SEQ ID NO: 396237 - DNA, 15 bp, Homo sapiens
ggtaggtgctggcct

SEQ ID NO: 396238 - DNA, 16 bp, Homo sapiens
ggtaggtgctggcctc

SEQ ID NO: 396239 - DNA, 22 bp, Homo sapiens
ggtagtactcctgcaaaatttt

SEQ ID NO: 396240 - DNA, 13 bp, Homo sapiens
ggtcttgatctcc

SEQ ID NO: 396241 - DNA, 18 bp, Homo sapiens
ggtctttctaatgtagct

SEQ ID NO: 396242 - DNA, 23 bp, Homo sapiens
ggtctttgaaatatgcatgtact

SEQ ID NO: 396243 - DNA, 22 bp, Homo sapiens
ggtcttttacatacagtgatat

SEQ ID NO: 396244 - DNA, 17 bp, Homo sapiens
ggtgaaaagtatggcag

SEQ ID NO: 396245 - DNA, 15 bp, Homo sapiens
ggtgaaacacacaca

SEQ ID NO: 396246 - DNA, 16 bp, Homo sapiens
ggtgaaggctctcacc

SEQ ID NO: 396247 - DNA, 15 bp, Homo sapiens
ggtgaagtgtggctg

SEQ ID NO: 396248 - DNA, 14 bp, Homo sapiens
ggtgaatgtcttcc

SEQ ID NO: 396249 - DNA, 15 bp, Homo sapiens
ggtgacagagtgagt

SEQ ID NO: 396250 - DNA, 20 bp, Homo sapiens
ggtgacatcccaggaggggc

SEQ ID NO: 396251 - DNA, 19 bp, Homo sapiens
ggtgaccccatctctgctg

SEQ ID NO: 396252 - DNA, 18 bp, Homo sapiens
ggtgacgcctgccctccc

SEQ ID NO: 396253 - DNA, 23 bp, Homo sapiens
ggtgacggtcctttaggcagcct

SEQ ID NO: 396254 - DNA, 14 bp, Homo sapiens
ggtgagaccacctc

SEQ ID NO: 396255 - DNA, 16 bp, Homo sapiens
ggtgagatcacagcct

SEQ ID NO: 396256 - DNA, 18 bp, Homo sapiens
ggtgagatcacagcctcc

SEQ ID NO: 396257 - DNA, 15 bp, Homo sapiens
ggtgagcagggccct

SEQ ID NO: 396258 - DNA, 12 bp, Homo sapiens
ggtgagccagtg

SEQ ID NO: 396259 - DNA, 15 bp, Homo sapiens
ggtgaggaccactcc

SEQ ID NO: 396260 - DNA, 13 bp, Homo sapiens
ggtgaggaggagg

SEQ ID NO: 396261 - DNA, 13 bp, Homo sapiens
ggtgaggcccagc

SEQ ID NO: 396262 - DNA, 14 bp, Homo sapiens
ggtgaggcccagcc

SEQ ID NO: 396263 - DNA, 15 bp, Homo sapiens
ggtgaggcccagcct

SEQ ID NO: 396264 - DNA, 18 bp, Homo sapiens
ggtgaggcgtgggatcca

SEQ ID NO: 396265 - DNA, 19 bp, Homo sapiens
ggtgaggcgttctcctgct

SEQ ID NO: 396266 - DNA, 20 bp, Homo sapiens
ggtgaggcgttctcctgctt

SEQ ID NO: 396267 - DNA, 21 bp, Homo sapiens
ggtgaggcgttctcctgcttg

SEQ ID NO: 396268 - DNA, 17 bp, Homo sapiens
ggtgaggggccactggg

SEQ ID NO: 396269 - DNA, 19 bp, Homo sapiens
ggtgagttttaaagaagtc

SEQ ID NO: 396270 - DNA, 14 bp, Homo sapiens
ggtgataagtggaa

SEQ ID NO: 396271 - DNA, 15 bp, Homo sapiens
ggtgatatccattct

SEQ ID NO: 396272 - DNA, 19 bp, Homo sapiens
ggtgatcaattaaatgtag

SEQ ID NO: 396273 - DNA, 14 bp, Homo sapiens
ggtgatccacctgc

SEQ ID NO: 396274 - DNA, 17 bp, Homo sapiens
ggtgatctgggattagg

SEQ ID NO: 396275 - DNA, 12 bp, Homo sapiens
ggtgatgcaagt

SEQ ID NO: 396276 - DNA, 19 bp, Homo sapiens
ggtgatgtaaaacagaata

SEQ ID NO: 396277 - DNA, 14 bp, Homo sapiens
ggtgattaaatatt

SEQ ID NO: 396278 - DNA, 21 bp, Homo sapiens
ggtgatttcttgctaagctcc

SEQ ID NO: 396279 - DNA, 18 bp, Homo sapiens
ggtgcaaagattgcctct

SEQ ID NO: 396280 - DNA, 20 bp, Homo sapiens
ggtgcacccactcaccaggg

SEQ ID NO: 396281 - DNA, 17 bp, Homo sapiens
ggtgcactggccccacc

SEQ ID NO: 396282 - DNA, 16 bp, Homo sapiens
ggtgcagccccaggac

SEQ ID NO: 396283 - DNA, 20 bp, Homo sapiens
ggtgcagccccaggaccaag

SEQ ID NO: 396284 - DNA, 15 bp, Homo sapiens
ggtgcagccttcccc

SEQ ID NO: 396285 - DNA, 21 bp, Homo sapiens
ggtgcagccttcccctccctg

SEQ ID NO: 396286 - DNA, 22 bp, Homo sapiens
ggtgcagcggtggaaggagcct

SEQ ID NO: 396287 - DNA, 18 bp, Homo sapiens
ggtgcagtaaccatttaa

SEQ ID NO: 396288 - DNA, 18 bp, Homo sapiens
ggtgccaaccacctctgg

SEQ ID NO: 396289 - DNA, 23 bp, Homo sapiens
ggtgccaaccacctctggccctg

SEQ ID NO: 396290 - DNA, 15 bp, Homo sapiens
ggtgccactccctga

SEQ ID NO: 396291 - DNA, 19 bp, Homo sapiens
ggtgccactccctgagctt

SEQ ID NO: 396292 - DNA, 14 bp, Homo sapiens
ggtgccagccttcc

SEQ ID NO: 396293 - DNA, 15 bp, Homo sapiens
ggtgccattcccagc

SEQ ID NO: 396294 - DNA, 13 bp, Homo sapiens
ggtgccccacagc

SEQ ID NO: 396295 - DNA, 15 bp, Homo sapiens
ggtgccccacagcta

SEQ ID NO: 396296 - DNA, 18 bp, Homo sapiens
ggtgccccctggggggca

SEQ ID NO: 396297 - DNA, 21 bp, Homo sapiens
ggtgccccgtggtacattcac

SEQ ID NO: 396298 - DNA, 13 bp, Homo sapiens
ggtgccctgtggg

SEQ ID NO: 396299 - DNA, 21 bp, Homo sapiens
ggtgcctcccacacttgctgg

SEQ ID NO: 396300 - DNA, 12 bp, Homo sapiens
ggtgcctgagcc

SEQ ID NO: 396301 - DNA, 14 bp, Homo sapiens
ggtgcctgaggtct

SEQ ID NO: 396302 - DNA, 15 bp, Homo sapiens
ggtgcctgctctcct

SEQ ID NO: 396303 - DNA, 16 bp, Homo sapiens
ggtgcgctcacctgca

SEQ ID NO: 396304 - DNA, 13 bp, Homo sapiens
ggtgcgctgtgct

SEQ ID NO: 396305 - DNA, 19 bp, Homo sapiens
ggtgcgctgtgctccagca

SEQ ID NO: 396306 - DNA, 15 bp, Homo sapiens
ggtgcggaccggagc

SEQ ID NO: 396307 - DNA, 16 bp, Homo sapiens
ggtgcgtgaccggccc

SEQ ID NO: 396308 - DNA, 12 bp, Homo sapiens
ggtgcgtggctg

SEQ ID NO: 396309 - DNA, 13 bp, Homo sapiens
ggtgcgtgtggcc

SEQ ID NO: 396310 - DNA, 22 bp, Homo sapiens
ggtgcgtgtggccctgtgggag

SEQ ID NO: 396311 - DNA, 15 bp, Homo sapiens
ggtgctagggtgcct

SEQ ID NO: 396312 - DNA, 23 bp, Homo sapiens
ggtgctagtgggccctctctctg

SEQ ID NO: 396313 - DNA, 12 bp, Homo sapiens
ggtgctcaaaga

SEQ ID NO: 396314 - DNA, 12 bp, Homo sapiens
ggtgctctggcg

SEQ ID NO: 396315 - DNA, 13 bp, Homo sapiens
ggtgctgagaagc

SEQ ID NO: 396316 - DNA, 14 bp, Homo sapiens
ggtgctgcttccct

SEQ ID NO: 396317 - DNA, 16 bp, Homo sapiens
ggtgctgctttgcttc

SEQ ID NO: 396318 - DNA, 18 bp, Homo sapiens
ggtgctggaggcagactc

SEQ ID NO: 396319 - DNA, 18 bp, Homo sapiens
ggtgcttaagcagaagca

SEQ ID NO: 396320 - DNA, 20 bp, Homo sapiens
ggtgcttaagcagaagcatt

SEQ ID NO: 396321 - DNA, 13 bp, Homo sapiens
ggtgcttgggctt

SEQ ID NO: 396322 - DNA, 13 bp, Homo sapiens
ggtggaaaatgga

SEQ ID NO: 396323 - DNA, 14 bp, Homo sapiens
ggtggaacaggagg

SEQ ID NO: 396324 - DNA, 16 bp, Homo sapiens
ggtggaaggagcctgc

SEQ ID NO: 396325 - DNA, 20 bp, Homo sapiens
ggtggaaggagcctgcggct

SEQ ID NO: 396326 - DNA, 15 bp, Homo sapiens
ggtggacgagggagt

SEQ ID NO: 396327 - DNA, 19 bp, Homo sapiens
ggtggcacacgcctgtaat

SEQ ID NO: 396328 - DNA, 17 bp, Homo sapiens
ggtggcatcccagtggc

SEQ ID NO: 396329 - DNA, 15 bp, Homo sapiens
ggtggcatggaagag

SEQ ID NO: 396330 - DNA, 21 bp, Homo sapiens
ggtggcatggaagagggaggg

SEQ ID NO: 396331 - DNA, 20 bp, Homo sapiens
ggtggccactccagacccct

SEQ ID NO: 396332 - DNA, 21 bp, Homo sapiens
ggtggccactccagacccctg

SEQ ID NO: 396333 - DNA, 21 bp, Homo sapiens
ggtggccaggcctgccagccc

SEQ ID NO: 396334 - DNA, 23 bp, Homo sapiens
ggtggccaggcctgccagcccct

SEQ ID NO: 396335 - DNA, 22 bp, Homo sapiens
ggtggccccacctgagccccca

SEQ ID NO: 396336 - DNA, 17 bp, Homo sapiens
ggtggcccgacagcctg

SEQ ID NO: 396337 - DNA, 14 bp, Homo sapiens
ggtggccctgggga

SEQ ID NO: 396338 - DNA, 16 bp, Homo sapiens
ggtggccgggggtggg

SEQ ID NO: 396339 - DNA, 19 bp, Homo sapiens
ggtggcctaagagttgagc

SEQ ID NO: 396340 - DNA, 17 bp, Homo sapiens
ggtggcgctttctcctg

SEQ ID NO: 396341 - DNA, 22 bp, Homo sapiens
ctctatatctttaaataaatgt

SEQ ID NO: 396342 - DNA, 17 bp, Homo sapiens
ctctatctgggcctggg

SEQ ID NO: 396343 - DNA, 22 bp, Homo sapiens
ctctatcttgcatctacctgct

SEQ ID NO: 396344 - DNA, 23 bp, Homo sapiens
ctctattagactttagaaataaa

SEQ ID NO: 396345 - DNA, 24 bp, Homo sapiens
ctctattagactttagaaataaat

SEQ ID NO: 396346 - DNA, 21 bp, Homo sapiens
ctctattgtagcatttcttga

SEQ ID NO: 396347 - DNA, 13 bp, Homo sapiens
ctctatttctcta

SEQ ID NO: 396348 - DNA, 14 bp, Homo sapiens
ctctattttaaagt

SEQ ID NO: 396349 - DNA, 15 bp, Homo sapiens
ctctattttgtgatg

SEQ ID NO: 396350 - DNA, 19 bp, Homo sapiens
ctctcaaatagctgggctt

SEQ ID NO: 396351 - DNA, 14 bp, Homo sapiens
ctctcaatatataa

SEQ ID NO: 396352 - DNA, 18 bp, Homo sapiens
ctctcacctacttcctcc

SEQ ID NO: 396353 - DNA, 13 bp, Homo sapiens
ctctcactcccca

SEQ ID NO: 396354 - DNA, 12 bp, Homo sapiens
ctctcactttgg

SEQ ID NO: 396355 - DNA, 22 bp, Homo sapiens
ctctcagagactcccaggagtt

SEQ ID NO: 396356 - DNA, 13 bp, Homo sapiens
ctctcagatccct

SEQ ID NO: 396357 - DNA, 18 bp, Homo sapiens
ctctcagatccctcggtc

SEQ ID NO: 396358 - DNA, 17 bp, Homo sapiens
ctctcagcttctaattt

SEQ ID NO: 396359 - DNA, 16 bp, Homo sapiens
ctctcaggagcacagg

SEQ ID NO: 396360 - DNA, 19 bp, Homo sapiens
ctctcaggagcacaggcag

SEQ ID NO: 396361 - DNA, 20 bp, Homo sapiens
ctctcaggagcacaggcagc

SEQ ID NO: 396362 - DNA, 19 bp, Homo sapiens
ctctcaggcatgcctgtgt

SEQ ID NO: 396363 - DNA, 21 bp, Homo sapiens
ctctcaggcatgcctgtgtga

SEQ ID NO: 396364 - DNA, 15 bp, Homo sapiens
ctctcatgtttccct

SEQ ID NO: 396365 - DNA, 15 bp, Homo sapiens
ctctccaaaccactt

SEQ ID NO: 396366 - DNA, 16 bp, Homo sapiens
ctctccaaaccacttt

SEQ ID NO: 396367 - DNA, 18 bp, Homo sapiens
ctctccaaaggggctgct

SEQ ID NO: 396368 - DNA, 22 bp, Homo sapiens
ctctccaagtctctctgtgaat

SEQ ID NO: 396369 - DNA, 13 bp, Homo sapiens
ctctccacaccca

SEQ ID NO: 396370 - DNA, 15 bp, Homo sapiens
ctctccacacccatg

SEQ ID NO: 396371 - DNA, 16 bp, Homo sapiens
ggtggtcttggagagg

SEQ ID NO: 396372 - DNA, 23 bp, Homo sapiens
ggtggtgctgggactgagccagt

SEQ ID NO: 396373 - DNA, 13 bp, Homo sapiens
ggtggtgtctcac

SEQ ID NO: 396374 - DNA, 13 bp, Homo sapiens
ggtggttggaggc

SEQ ID NO: 396375 - DNA, 16 bp, Homo sapiens
ggtggttggaggcctg

SEQ ID NO: 396376 - DNA, 17 bp, Homo sapiens
ggtggtttcagaaaggg

SEQ ID NO: 396377 - DNA, 14 bp, Homo sapiens
ggtgtagctgtcct

SEQ ID NO: 396378 - DNA, 18 bp, Homo sapiens
ggtgtagctgtcctctca

SEQ ID NO: 396379 - DNA, 19 bp, Homo sapiens
ggtgtatatcatgaagcct

SEQ ID NO: 396380 - DNA, 18 bp, Homo sapiens
ggtgtcacagaggcagtg

SEQ ID NO: 396381 - DNA, 13 bp, Homo sapiens
ggtgtcaccctgc

SEQ ID NO: 396382 - DNA, 20 bp, Homo sapiens
ggtgtcaccctgcagagcta

SEQ ID NO: 396383 - DNA, 23 bp, Homo sapiens
ggtgtccccaacgtcccctccgc

SEQ ID NO: 396384 - DNA, 15 bp, Homo sapiens
ggtgtccccttcccc

SEQ ID NO: 396385 - DNA, 17 bp, Homo sapiens
ggtgtccccttcccctg

SEQ ID NO: 396386 - DNA, 19 bp, Homo sapiens
ggtgtccccttcccctgct

SEQ ID NO: 396387 - DNA, 21 bp, Homo sapiens
ggtgtccccttcccctgctga

SEQ ID NO: 396388 - DNA, 17 bp, Homo sapiens
ggtgtccttcttcctca

SEQ ID NO: 396389 - DNA, 16 bp, Homo sapiens
ggtgtctagaggcaac

SEQ ID NO: 396390 - DNA, 14 bp, Homo sapiens
ggtgtgagatggtg

SEQ ID NO: 396391 - DNA, 16 bp, Homo sapiens
ggtgtgcatgccacgc

SEQ ID NO: 396392 - DNA, 17 bp, Homo sapiens
ggtgtgcatgccacgcc

SEQ ID NO: 396393 - DNA, 12 bp, Homo sapiens
ggtgtgccctgg

SEQ ID NO: 396394 - DNA, 14 bp, Homo sapiens
ggtgtgccctggct

SEQ ID NO: 396395 - DNA, 13 bp, Homo sapiens
ggtgtgctacaga

SEQ ID NO: 396396 - DNA, 15 bp, Homo sapiens
ggtgtggagtggagg

SEQ ID NO: 396397 - DNA, 21 bp, Homo sapiens
ggtgtggagtggaggggtcag

SEQ ID NO: 396398 - DNA, 18 bp, Homo sapiens
ggtgtgttccaactgccc

SEQ ID NO: 396399 - DNA, 19 bp, Homo sapiens
ggtgtgttccaactgcccc

SEQ ID NO: 396400 - DNA, 21 bp, Homo sapiens
ggtgtgttcgtggagccacag

SEQ ID NO: 396401 - DNA, 20 bp, Homo sapiens
ggtgtgttttgtcttcaact

SEQ ID NO: 396402 - DNA, 14 bp, Homo sapiens
ggtgttgggagccc

SEQ ID NO: 396403 - DNA, 17 bp, Homo sapiens
ggtgtttcaaaagtgga

SEQ ID NO: 396404 - DNA, 12 bp, Homo sapiens
ggttaacagtaa

SEQ ID NO: 396405 - DNA, 17 bp, Homo sapiens
ggttaagccatatgaca

SEQ ID NO: 396406 - DNA, 18 bp, Homo sapiens
ggttacagtgcagacagg

SEQ ID NO: 396407 - DNA, 19 bp, Homo sapiens
ggttaccgagtatctgtaa

SEQ ID NO: 396408 - DNA, 23 bp, Homo sapiens
ggttaccttggcgtgtgtccctg

SEQ ID NO: 396409 - DNA, 17 bp, Homo sapiens
ggttactaagatgaaat

SEQ ID NO: 396410 - DNA, 16 bp, Homo sapiens
ggttagcaatatttat

SEQ ID NO: 396411 - DNA, 16 bp, Homo sapiens
ggttaggatttaacag

SEQ ID NO: 396412 - DNA, 13 bp, Homo sapiens
ggttatctgcctg

SEQ ID NO: 396413 - DNA, 16 bp, Homo sapiens
ggttatctgcctggcc

SEQ ID NO: 396414 - DNA, 18 bp, Homo sapiens
ggttatctgcctggcctg

SEQ ID NO: 396415 - DNA, 15 bp, Homo sapiens
ggttatgtcagcagc

SEQ ID NO: 396416 - DNA, 20 bp, Homo sapiens
ggttatgtcagcagctctga

SEQ ID NO: 396417 - DNA, 19 bp, Homo sapiens
ggttattagcaaggctggg

SEQ ID NO: 396418 - DNA, 19 bp, Homo sapiens
ggttcagaaatgctgcctg

SEQ ID NO: 396419 - DNA, 17 bp, Homo sapiens
ggttcagacccctgcct

SEQ ID NO: 396420 - DNA, 18 bp, Homo sapiens
ggttcagggaactgcttg

SEQ ID NO: 396421 - DNA, 16 bp, Homo sapiens
ggttcaggtcagggct

SEQ ID NO: 396422 - DNA, 14 bp, Homo sapiens
ggttcatcagtgtt

SEQ ID NO: 396423 - DNA, 19 bp, Homo sapiens
ggttcattattggaattaa

SEQ ID NO: 396424 - DNA, 18 bp, Homo sapiens
ggttccaatcctggctct

SEQ ID NO: 396425 - DNA, 12 bp, Homo sapiens
ggttccactgga

SEQ ID NO: 396426 - DNA, 18 bp, Homo sapiens
ggttccatccaccacctt

SEQ ID NO: 396427 - DNA, 23 bp, Homo sapiens
ggttcccattttcgctttcctct

SEQ ID NO: 396428 - DNA, 13 bp, Homo sapiens
ggttcccccagga

SEQ ID NO: 396429 - DNA, 14 bp, Homo sapiens
ggttccctctttcc

SEQ ID NO: 396430 - DNA, 20 bp, Homo sapiens
ggttccctgcctaggagctg

SEQ ID NO: 396431 - DNA, 17 bp, Homo sapiens
ggttccctttccttcca

SEQ ID NO: 396432 - DNA, 21 bp, Homo sapiens
ggttccggaatcctgtcctca

SEQ ID NO: 396433 - DNA, 13 bp, Homo sapiens
ggttcctcatggc

SEQ ID NO: 396434 - DNA, 12 bp, Homo sapiens
ggttcctccagc

SEQ ID NO: 396435 - DNA, 13 bp, Homo sapiens
ggttcctccagca

SEQ ID NO: 396436 - DNA, 15 bp, Homo sapiens
ggttccttccctggg

SEQ ID NO: 396437 - DNA, 18 bp, Homo sapiens
ggttctacaatctattta

SEQ ID NO: 396438 - DNA, 17 bp, Homo sapiens
ggttctagacgcccctc

SEQ ID NO: 396439 - DNA, 19 bp, Homo sapiens
ggttctagacgcccctccc

SEQ ID NO: 396440 - DNA, 13 bp, Homo sapiens
ggttctcagagcc

SEQ ID NO: 396441 - DNA, 17 bp, Homo sapiens
ggttctcagagccaagt

SEQ ID NO: 396442 - DNA, 12 bp, Homo sapiens
ggttctggctgc

SEQ ID NO: 396443 - DNA, 11 bp, Homo sapiens
ggttctgtatt

SEQ ID NO: 396444 - DNA, 15 bp, Homo sapiens
ggttcttaaaagcat

SEQ ID NO: 396445 - DNA, 17 bp, Homo sapiens
ggttcttggtagagatt

SEQ ID NO: 396446 - DNA, 11 bp, Homo sapiens
ggttgacccta

SEQ ID NO: 396447 - DNA, 13 bp, Homo sapiens
ggttgagaaatga

SEQ ID NO: 396448 - DNA, 17 bp, Homo sapiens
ggttgagtgagccggga

SEQ ID NO: 396449 - DNA, 13 bp, Homo sapiens
ggttgcagctgct

SEQ ID NO: 396450 - DNA, 15 bp, Homo sapiens
ggttgccagtcctgc

SEQ ID NO: 396451 - DNA, 17 bp, Homo sapiens
ggttggccggctggccg

SEQ ID NO: 396452 - DNA, 15 bp, Homo sapiens
ggttggctgggccca

SEQ ID NO: 396453 - DNA, 20 bp, Homo sapiens
ggttgggacaatggcaatag

SEQ ID NO: 396454 - DNA, 14 bp, Homo sapiens
ggttgggctctgcg

SEQ ID NO: 396455 - DNA, 16 bp, Homo sapiens
ggttgggggctcctgt

SEQ ID NO: 396456 - DNA, 19 bp, Homo sapiens
ggttgtacatagtggtcat

SEQ ID NO: 396457 - DNA, 13 bp, Homo sapiens
ggttgtatttcta

SEQ ID NO: 396458 - DNA, 15 bp, Homo sapiens
ggttgtgaaaacagc

SEQ ID NO: 396459 - DNA, 23 bp, Homo sapiens
ggttgtgtagggagatggagaaa

SEQ ID NO: 396460 - DNA, 21 bp, Homo sapiens
ggttgttgccaggttgcagct

SEQ ID NO: 396461 - DNA, 13 bp, Homo sapiens
ggttgtttctctg

SEQ ID NO: 396462 - DNA, 17 bp, Homo sapiens
ggtttaactcagatcac

SEQ ID NO: 396463 - DNA, 23 bp, Homo sapiens
ggtttaactcagatcactactgc

SEQ ID NO: 396464 - DNA, 16 bp, Homo sapiens
ggtttacaacaaacac

SEQ ID NO: 396465 - DNA, 14 bp, Homo sapiens
ggtttactgctgtc

SEQ ID NO: 396466 - DNA, 19 bp, Homo sapiens
ggtttcaccatgttggcca

SEQ ID NO: 396467 - DNA, 15 bp, Homo sapiens
ggtttcagaaagggc

SEQ ID NO: 396468 - DNA, 13 bp, Homo sapiens
ggtttcagaagct

SEQ ID NO: 396469 - DNA, 14 bp, Homo sapiens
ggtttcagaagctg

SEQ ID NO: 396470 - DNA, 12 bp, Homo sapiens
ggtttctctgtg

SEQ ID NO: 396471 - DNA, 14 bp, Homo sapiens
ggtttctctgtgct

SEQ ID NO: 396472 - DNA, 14 bp, Homo sapiens
ggtttctgtttgaa

SEQ ID NO: 396473 - DNA, 21 bp, Homo sapiens
ggtttcttgtttaccaaagaa

SEQ ID NO: 396474 - DNA, 12 bp, Homo sapiens
ggtttgaaagcc

SEQ ID NO: 396475 - DNA, 16 bp, Homo sapiens
ggtttgcctgagggcg

SEQ ID NO: 396476 - DNA, 14 bp, Homo sapiens
ggtttggcgggcca

SEQ ID NO: 396477 - DNA, 17 bp, Homo sapiens
ggtttggcgggccaagg

SEQ ID NO: 396478 - DNA, 19 bp, Homo sapiens
ggtttggcgggccaaggac

SEQ ID NO: 396479 - DNA, 14 bp, Homo sapiens
ggtttgggcagtgg

SEQ ID NO: 396480 - DNA, 16 bp, Homo sapiens
ggtttgggcagtggag

SEQ ID NO: 396481 - DNA, 19 bp, Homo sapiens
ctctgaacttcagctagag

SEQ ID NO: 396482 - DNA, 17 bp, Homo sapiens
ctctgaagcatgtttca

SEQ ID NO: 396483 - DNA, 24 bp, Homo sapiens
ctctgaagtcccttcctgtcctgc

SEQ ID NO: 396484 - DNA, 18 bp, Homo sapiens
ctctgaagttggacagca

SEQ ID NO: 396485 - DNA, 21 bp, Homo sapiens
ctctgaatctctcaaaatgtg

SEQ ID NO: 396486 - DNA, 16 bp, Homo sapiens
ctctgacagcagcctg

SEQ ID NO: 396487 - DNA, 19 bp, Homo sapiens
ctctgacagcagcctgtga

SEQ ID NO: 396488 - DNA, 20 bp, Homo sapiens
ctctgacagcagcctgtgag

SEQ ID NO: 396489 - DNA, 13 bp, Homo sapiens
ctctgacagtatt

SEQ ID NO: 396490 - DNA, 14 bp, Homo sapiens
ctctgactctgagt

SEQ ID NO: 396491 - DNA, 20 bp, Homo sapiens
ctctgagcaactgtgcagca

SEQ ID NO: 396492 - DNA, 19 bp, Homo sapiens
ctctgagcagcctctgcca

SEQ ID NO: 396493 - DNA, 15 bp, Homo sapiens
ctctgagcagtgggg

SEQ ID NO: 396494 - DNA, 12 bp, Homo sapiens
ctctgagccagg

SEQ ID NO: 396495 - DNA, 11 bp, Homo sapiens
ctctgagccca

SEQ ID NO: 396496 - DNA, 14 bp, Homo sapiens
ctctgagcccaggc

SEQ ID NO: 396497 - DNA, 15 bp, Homo sapiens
ctctgagcccaggcc

SEQ ID NO: 396498 - DNA, 20 bp, Homo sapiens
ctctgagccccctgtgccca

SEQ ID NO: 396499 - DNA, 11 bp, Homo sapiens
ctctgagccct

SEQ ID NO: 396500 - DNA, 12 bp, Homo sapiens
ctctgagctgtt

SEQ ID NO: 396501 - DNA, 13 bp, Homo sapiens
ctctgagctttgt

SEQ ID NO: 396502 - DNA, 19 bp, Homo sapiens
ctctgaggactctggaccc

SEQ ID NO: 396503 - DNA, 17 bp, Homo sapiens
ctctgagtttaccattt

SEQ ID NO: 396504 - DNA, 22 bp, Homo sapiens
ctctgatatacaattagagata

SEQ ID NO: 396505 - DNA, 20 bp, Homo sapiens
ctctgattatcaggtactgg

SEQ ID NO: 396506 - DNA, 23 bp, Homo sapiens
ctctgattttttactggctgtgt

SEQ ID NO: 396507 - DNA, 13 bp, Homo sapiens
ctctgcaactgaa

SEQ ID NO: 396508 - DNA, 20 bp, Homo sapiens
ctctgcaagcccactggcca

SEQ ID NO: 396509 - DNA, 10 bp, Homo sapiens
ctctgcacag

SEQ ID NO: 396510 - DNA, 15 bp, Homo sapiens
ctctgcacagatgga

SEQ ID NO: 396511 - DNA, 20 bp, Homo sapiens
ctctgcactactgacatgtg

SEQ ID NO: 396512 - DNA, 22 bp, Homo sapiens
ctctgcactactgacatgtggg

SEQ ID NO: 396513 - DNA, 13 bp, Homo sapiens
ctctgcactccat

SEQ ID NO: 396514 - DNA, 20 bp, Homo sapiens
ctctgcactccatggccacc

SEQ ID NO: 396515 - DNA, 22 bp, Homo sapiens
ctctgcactccatggccacccc

SEQ ID NO: 396516 - DNA, 23 bp, Homo sapiens
ctctgcactccatggccaccccg

SEQ ID NO: 396517 - DNA, 14 bp, Homo sapiens
ctctgcagcctgag

SEQ ID NO: 396518 - DNA, 18 bp, Homo sapiens
ctctgcagcctgagctcc

SEQ ID NO: 396519 - DNA, 12 bp, Homo sapiens
ctctgcagctga

SEQ ID NO: 396520 - DNA, 16 bp, Homo sapiens
ctctgcagctgacctc

SEQ ID NO: 396521 - DNA, 16 bp, Homo sapiens
ctctgcagtgccttgg

SEQ ID NO: 396522 - DNA, 14 bp, Homo sapiens
ctctgcagtgtcca

SEQ ID NO: 396523 - DNA, 14 bp, Homo sapiens
ctctgcattctagt

SEQ ID NO: 396524 - DNA, 12 bp, Homo sapiens
ctctgccaccca

SEQ ID NO: 396525 - DNA, 19 bp, Homo sapiens
ctctgccagctccacaggg

SEQ ID NO: 396526 - DNA, 14 bp, Homo sapiens
ctctgccatcagcc

SEQ ID NO: 396527 - DNA, 16 bp, Homo sapiens
ctctgccatcagcccc

SEQ ID NO: 396528 - DNA, 21 bp, Homo sapiens
ctctgccatcagcccctgctg

SEQ ID NO: 396529 - DNA, 13 bp, Homo sapiens
ctctgcccagagc

SEQ ID NO: 396530 - DNA, 18 bp, Homo sapiens
ctctgcccagcttgggcc

SEQ ID NO: 396531 - DNA, 15 bp, Homo sapiens
ctctgccccaagccc

SEQ ID NO: 396532 - DNA, 21 bp, Homo sapiens
ctctgcccccagctgctcctc

SEQ ID NO: 396533 - DNA, 20 bp, Homo sapiens
ctctgcccccgcgggttcta

SEQ ID NO: 396534 - DNA, 17 bp, Homo sapiens
ctctgccccctcccccg

SEQ ID NO: 396535 - DNA, 20 bp, Homo sapiens
ctctgccccctcccccgcag

SEQ ID NO: 396536 - DNA, 21 bp, Homo sapiens
ctctgccccctcccccgcaga

SEQ ID NO: 396537 - DNA, 19 bp, Homo sapiens
ctctgccccgtttcttgcc

SEQ ID NO: 396538 - DNA, 18 bp, Homo sapiens
ctctgcccctccgtcccc

SEQ ID NO: 396539 - DNA, 19 bp, Homo sapiens
ctctgccccttctgtttcc

SEQ ID NO: 396540 - DNA, 21 bp, Homo sapiens
ctctgccccttgggcatccac

SEQ ID NO: 396541 - DNA, 17 bp, Homo sapiens
ctctgccctgcctccct

SEQ ID NO: 396542 - DNA, 19 bp, Homo sapiens
ctctgcccttcctttccct

SEQ ID NO: 396543 - DNA, 23 bp, Homo sapiens
ctctgcccttcctttccctgggg

SEQ ID NO: 396544 - DNA, 23 bp, Homo sapiens
ctctgccgaccgcctgcttcaca

SEQ ID NO: 396545 - DNA, 14 bp, Homo sapiens
ctctgccggctctt

SEQ ID NO: 396546 - DNA, 22 bp, Homo sapiens
ctctgccggctctttccttgct

SEQ ID NO: 396547 - DNA, 20 bp, Homo sapiens
ctctgccggtcccccatgcc

SEQ ID NO: 396548 - DNA, 16 bp, Homo sapiens
ctctgcctccaggagg

SEQ ID NO: 396549 - DNA, 16 bp, Homo sapiens
ctctgcctcccaggtt

SEQ ID NO: 396550 - DNA, 18 bp, Homo sapiens
ctctgcctgtccctctca

SEQ ID NO: 396551 - DNA, 13 bp, Homo sapiens
ctctgccttccag

SEQ ID NO: 396552 - DNA, 14 bp, Homo sapiens
ctctgccttccagg

SEQ ID NO: 396553 - DNA, 19 bp, Homo sapiens
ctctgcgagcaacagtgcc

SEQ ID NO: 396554 - DNA, 18 bp, Homo sapiens
ctctgcggatagcatttg

SEQ ID NO: 396555 - DNA, 12 bp, Homo sapiens
ctctgctccacc

SEQ ID NO: 396556 - DNA, 13 bp, Homo sapiens
ctctgctccacca

SEQ ID NO: 396557 - DNA, 14 bp, Homo sapiens
ctctgctccaccac

SEQ ID NO: 396558 - DNA, 13 bp, Homo sapiens
ctctgctcccagc

SEQ ID NO: 396559 - DNA, 14 bp, Homo sapiens
ctctgctcccagcc

SEQ ID NO: 396560 - DNA, 16 bp, Homo sapiens
ctctgctcccagcccc

SEQ ID NO: 396561 - DNA, 19 bp, Homo sapiens
ctctgctcctcacccccac

SEQ ID NO: 396562 - DNA, 22 bp, Homo sapiens
ctctgctcctggagcctttgaa

SEQ ID NO: 396563 - DNA, 13 bp, Homo sapiens
ctctgctctagcc

SEQ ID NO: 396564 - DNA, 14 bp, Homo sapiens
ctctgctctagcca

SEQ ID NO: 396565 - DNA, 16 bp, Homo sapiens
ctctgctctagccagg

SEQ ID NO: 396566 - DNA, 13 bp, Homo sapiens
ctctgctctgcac

SEQ ID NO: 396567 - DNA, 12 bp, Homo sapiens
ctctgctgaaca

SEQ ID NO: 396568 - DNA, 16 bp, Homo sapiens
ctctgctgacttctga

SEQ ID NO: 396569 - DNA, 12 bp, Homo sapiens
ctctgctgccca

SEQ ID NO: 396570 - DNA, 13 bp, Homo sapiens
ctctgctgcccac

SEQ ID NO: 396571 - DNA, 23 bp, Homo sapiens
ctctgctgcctgcccgcacagca

SEQ ID NO: 396572 - DNA, 15 bp, Homo sapiens
ctctgctgctcatgg

SEQ ID NO: 396573 - DNA, 16 bp, Homo sapiens
ctctgctgcttctggg

SEQ ID NO: 396574 - DNA, 14 bp, Homo sapiens
ctctgctggcccag

SEQ ID NO: 396575 - DNA, 20 bp, Homo sapiens
ctctgctggccgggcacagc

SEQ ID NO: 396576 - DNA, 22 bp, Homo sapiens
ctctgcttactaatgtgcccca

SEQ ID NO: 396577 - DNA, 16 bp, Homo sapiens
ctctgcttcagtccac

SEQ ID NO: 396578 - DNA, 17 bp, Homo sapiens
ctctgcttggctgtccc

SEQ ID NO: 396579 - DNA, 24 bp, Homo sapiens
ctctgctttgactgagcagactgg

SEQ ID NO: 396580 - DNA, 12 bp, Homo sapiens
ctctggaaaaat

SEQ ID NO: 396581 - DNA, 18 bp, Homo sapiens
ctctggaaaactcaggat

SEQ ID NO: 396582 - DNA, 16 bp, Homo sapiens
ctctggaagcctgctg

SEQ ID NO: 396583 - DNA, 17 bp, Homo sapiens
ctctggaagcctgctga

SEQ ID NO: 396584 - DNA, 21 bp, Homo sapiens
ctctggaagcctgctgatttc

SEQ ID NO: 396585 - DNA, 14 bp, Homo sapiens
ctctggaccccagg

SEQ ID NO: 396586 - DNA, 18 bp, Homo sapiens
ctctggacctctcttgtg

SEQ ID NO: 396587 - DNA, 16 bp, Homo sapiens
ctctggactggctaga

SEQ ID NO: 396588 - DNA, 14 bp, Homo sapiens
ctctggagccacct

SEQ ID NO: 396589 - DNA, 13 bp, Homo sapiens
ctctggaggcctc

SEQ ID NO: 396590 - DNA, 15 bp, Homo sapiens
ctctggatcctgcac

SEQ ID NO: 396591 - DNA, 21 bp, Homo sapiens
ctctggcactccagaacaaac

SEQ ID NO: 396592 - DNA, 23 bp, Homo sapiens
ctctggcaggtggccagggctcc

SEQ ID NO: 396593 - DNA, 16 bp, Homo sapiens
ctctggccaaatatgc

SEQ ID NO: 396594 - DNA, 18 bp, Homo sapiens
ctctggccacaatcctcc

SEQ ID NO: 396595 - DNA, 14 bp, Homo sapiens
ctctggccaccctg

SEQ ID NO: 396596 - DNA, 22 bp, Homo sapiens
ctctggccaccctggcccgccc

SEQ ID NO: 396597 - DNA, 10 bp, Homo sapiens
ctctggccag

SEQ ID NO: 396598 - DNA, 19 bp, Homo sapiens
ctctggccaggatggaggg

SEQ ID NO: 396599 - DNA, 11 bp, Homo sapiens
ctctggccctg

SEQ ID NO: 396600 - DNA, 20 bp, Homo sapiens
ctctggcggcttcctgtcca

SEQ ID NO: 396601 - DNA, 14 bp, Homo sapiens
ctctggcgtgtggg

SEQ ID NO: 396602 - DNA, 14 bp, Homo sapiens
ctctggctagaggc

SEQ ID NO: 396603 - DNA, 21 bp, Homo sapiens
ctctggctagaggccagcccc

SEQ ID NO: 396604 - DNA, 22 bp, Homo sapiens
ctctggctccgaaaaactttgt

SEQ ID NO: 396605 - DNA, 16 bp, Homo sapiens
ctctggctggagagga

SEQ ID NO: 396606 - DNA, 20 bp, Homo sapiens
ctctgggactctcctcctcc

SEQ ID NO: 396607 - DNA, 15 bp, Homo sapiens
ctctgggcaggacct

SEQ ID NO: 396608 - DNA, 12 bp, Homo sapiens
ctctgggcccag

SEQ ID NO: 396609 - DNA, 20 bp, Homo sapiens
ctctgggcccagagagaggc

SEQ ID NO: 396610 - DNA, 14 bp, Homo sapiens
ctctgggcccaggg

SEQ ID NO: 396611 - DNA, 21 bp, Homo sapiens
ctctgggcctttgtttccttg

SEQ ID NO: 396612 - DNA, 15 bp, Homo sapiens
ctctgggctcagggc

SEQ ID NO: 396613 - DNA, 16 bp, Homo sapiens
ctctgggctcagggct

SEQ ID NO: 396614 - DNA, 22 bp, Homo sapiens
ctctgggctcagggctggagtg

SEQ ID NO: 396615 - DNA, 15 bp, Homo sapiens
ctctgggctgagcct

SEQ ID NO: 396616 - DNA, 18 bp, Homo sapiens
ggtttgggcagtggagag

SEQ ID NO: 396617 - DNA, 20 bp, Homo sapiens
ggtttgggccccattcagaa

SEQ ID NO: 396618 - DNA, 18 bp, Homo sapiens
ggttttcccctccctggg

SEQ ID NO: 396619 - DNA, 19 bp, Homo sapiens
ggttttcgaagctcagccc

SEQ ID NO: 396620 - DNA, 12 bp, Homo sapiens
ggttttctgttt

SEQ ID NO: 396621 - DNA, 9 bp, Homo sapiens
ggttttttt

SEQ ID NO: 396622 - DNA, 23 bp, Homo sapiens
gtaaaaagactactggcctctgt

SEQ ID NO: 396623 - DNA, 21 bp, Homo sapiens
gtaaaacagatttgttcattc

SEQ ID NO: 396624 - DNA, 13 bp, Homo sapiens
gtaaaactgaggc

SEQ ID NO: 396625 - DNA, 15 bp, Homo sapiens
gtaaaactgaggcac

SEQ ID NO: 396626 - DNA, 12 bp, Homo sapiens
gtaaaactgtga

SEQ ID NO: 396627 - DNA, 18 bp, Homo sapiens
gtaaaactttattttata

SEQ ID NO: 396628 - DNA, 22 bp, Homo sapiens
gtaaaagagccaagttcaaaga

SEQ ID NO: 396629 - DNA, 20 bp, Homo sapiens
gtaaaagcaacatcagcttg

SEQ ID NO: 396630 - DNA, 14 bp, Homo sapiens
gtaaaatcttcagc

SEQ ID NO: 396631 - DNA, 19 bp, Homo sapiens
gtaaaatcttcagctggtg

SEQ ID NO: 396632 - DNA, 20 bp, Homo sapiens
gtaaaatcttgtcatgtgta

SEQ ID NO: 396633 - DNA, 13 bp, Homo sapiens
gtaaaatggaaaa

SEQ ID NO: 396634 - DNA, 17 bp, Homo sapiens
ctctgtagtttatggca

SEQ ID NO: 396635 - DNA, 18 bp, Homo sapiens
ctctgtagtttatggcag

SEQ ID NO: 396636 - DNA, 17 bp, Homo sapiens
ctctgtcatcactccct

SEQ ID NO: 396637 - DNA, 21 bp, Homo sapiens
ctctgtcatcactccctggat

SEQ ID NO: 396638 - DNA, 17 bp, Homo sapiens
ctctgtccaattccaga

SEQ ID NO: 396639 - DNA, 15 bp, Homo sapiens
ctctgtccaggccac

SEQ ID NO: 396640 - DNA, 22 bp, Homo sapiens
ctctgtccaggccactgtggcc

SEQ ID NO: 396641 - DNA, 23 bp, Homo sapiens
ctctgtccaggccactgtggcca

SEQ ID NO: 396642 - DNA, 24 bp, Homo sapiens
ctctgtccaggccactgtggccag

SEQ ID NO: 396643 - DNA, 23 bp, Homo sapiens
ctctgtccagggcttcagatatt

SEQ ID NO: 396644 - DNA, 21 bp, Homo sapiens
ctctgtcccggttcaccttgc

SEQ ID NO: 396645 - DNA, 15 bp, Homo sapiens
ctctgtctaccatct

SEQ ID NO: 396646 - DNA, 22 bp, Homo sapiens
ctctgtctaccatctccctcga

SEQ ID NO: 396647 - DNA, 22 bp, Homo sapiens
ctctgtctgagtaagaaacaga

SEQ ID NO: 396648 - DNA, 21 bp, Homo sapiens
ctctgtctggctgtacgtctg

SEQ ID NO: 396649 - DNA, 20 bp, Homo sapiens
ctctgtctttttccttcctg

SEQ ID NO: 396650 - DNA, 22 bp, Homo sapiens
ctctgtctttttccttcctgag

SEQ ID NO: 396651 - DNA, 18 bp, Homo sapiens
ctctgtgaacgatttaga

SEQ ID NO: 396652 - DNA, 21 bp, Homo sapiens
ctctgtgaacgatttagaaag

SEQ ID NO: 396653 - DNA, 23 bp, Homo sapiens
ctctgtgaacgatttagaaagaa

SEQ ID NO: 396654 - DNA, 17 bp, Homo sapiens
ctctgtgaatacaatta

SEQ ID NO: 396655 - DNA, 19 bp, Homo sapiens
ctctgtgaatacaattaaa

SEQ ID NO: 396656 - DNA, 20 bp, Homo sapiens
ctctgtgaatacaattaaag

SEQ ID NO: 396657 - DNA, 22 bp, Homo sapiens
ctctgtgaatacaattaaaggt

SEQ ID NO: 396658 - DNA, 14 bp, Homo sapiens
ctctgtgcaggtgc

SEQ ID NO: 396659 - DNA, 15 bp, Homo sapiens
ctctgtgcaggtgct

SEQ ID NO: 396660 - DNA, 16 bp, Homo sapiens
ctctgtgcaggtgctg

SEQ ID NO: 396661 - DNA, 23 bp, Homo sapiens
ctctgtgcaggtgctgccttgag

SEQ ID NO: 396662 - DNA, 13 bp, Homo sapiens
ctctgtgcctggg

SEQ ID NO: 396663 - DNA, 14 bp, Homo sapiens
ctctgtgctccctc

SEQ ID NO: 396664 - DNA, 15 bp, Homo sapiens
ctctgtgctctgaat

SEQ ID NO: 396665 - DNA, 13 bp, Homo sapiens
ctctgtggcctgt

SEQ ID NO: 396666 - DNA, 17 bp, Homo sapiens
ctctgtggcctgtgtcc

SEQ ID NO: 396667 - DNA, 23 bp, Homo sapiens
ctctgtggcctgtgtccagcagc

SEQ ID NO: 396668 - DNA, 15 bp, Homo sapiens
ctctgtggggccaca

SEQ ID NO: 396669 - DNA, 19 bp, Homo sapiens
ctctgttcagatgtgcatt

SEQ ID NO: 396670 - DNA, 16 bp, Homo sapiens
ctctgttccaagtgtg

SEQ ID NO: 396671 - DNA, 22 bp, Homo sapiens
ctctgttccaagtgtgtgtgca

SEQ ID NO: 396672 - DNA, 16 bp, Homo sapiens
ctctgttcccccaccc

SEQ ID NO: 396673 - DNA, 21 bp, Homo sapiens
ctctgttcccccaccctccat

SEQ ID NO: 396674 - DNA, 15 bp, Homo sapiens
ctctgttcctggctc

SEQ ID NO: 396675 - DNA, 17 bp, Homo sapiens
ctctgttctggtggccc

SEQ ID NO: 396676 - DNA, 19 bp, Homo sapiens
ctctgttctggtggcccca

SEQ ID NO: 396677 - DNA, 20 bp, Homo sapiens
ctctgttctggtggccccag

SEQ ID NO: 396678 - DNA, 20 bp, Homo sapiens
ctctgttgcccaggctggag

SEQ ID NO: 396679 - DNA, 13 bp, Homo sapiens
ctctgttgcctcc

SEQ ID NO: 396680 - DNA, 18 bp, Homo sapiens
ctctgttgcctcctctct

SEQ ID NO: 396681 - DNA, 23 bp, Homo sapiens
ctctgttgcctcctctctccctg

SEQ ID NO: 396682 - DNA, 12 bp, Homo sapiens
ctctgttgtcct

SEQ ID NO: 396683 - DNA, 22 bp, Homo sapiens
ctctgtttcccctcagaacacc

SEQ ID NO: 396684 - DNA, 20 bp, Homo sapiens
ctcttaagggggccttggaa

SEQ ID NO: 396685 - DNA, 13 bp, Homo sapiens
ctcttaccccgtc

SEQ ID NO: 396686 - DNA, 16 bp, Homo sapiens
ctcttacccttctgtg

SEQ ID NO: 396687 - DNA, 19 bp, Homo sapiens
ctcttacccttctgtgccc

SEQ ID NO: 396688 - DNA, 14 bp, Homo sapiens
ctcttacttgccaa

SEQ ID NO: 396689 - DNA, 13 bp, Homo sapiens
ctcttagaaatac

SEQ ID NO: 396690 - DNA, 18 bp, Homo sapiens
ctcttagctttctcaggg

SEQ ID NO: 396691 - DNA, 15 bp, Homo sapiens
ctcttaggagtactt

SEQ ID NO: 396692 - DNA, 19 bp, Homo sapiens
ctcttaggagtactttcct

SEQ ID NO: 396693 - DNA, 16 bp, Homo sapiens
ctcttaggtcccggga

SEQ ID NO: 396694 - DNA, 21 bp, Homo sapiens
ctcttagtcctccctgctcag

SEQ ID NO: 396695 - DNA, 22 bp, Homo sapiens
ctcttagtttttaaaaaggcct

SEQ ID NO: 396696 - DNA, 22 bp, Homo sapiens
ctcttagtttttacttgtttaa

SEQ ID NO: 396697 - DNA, 20 bp, Homo sapiens
ctcttatagaatatttatta

SEQ ID NO: 396698 - DNA, 22 bp, Homo sapiens
ctcttatagaatatttattacc

SEQ ID NO: 396699 - DNA, 16 bp, Homo sapiens
ctcttattgttcctct

SEQ ID NO: 396700 - DNA, 17 bp, Homo sapiens
ctcttcaactgaccagc

SEQ ID NO: 396701 - DNA, 12 bp, Homo sapiens
ctcttcaaggcc

SEQ ID NO: 396702 - DNA, 16 bp, Homo sapiens
ctcttcaatctctgga

SEQ ID NO: 396703 - DNA, 14 bp, Homo sapiens
ctcttcaccaggaa

SEQ ID NO: 396704 - DNA, 16 bp, Homo sapiens
ctcttcaccaggaaga

SEQ ID NO: 396705 - DNA, 16 bp, Homo sapiens
ctcttcaccccggcag

SEQ ID NO: 396706 - DNA, 18 bp, Homo sapiens
ctcttcaccccggcaggc

SEQ ID NO: 396707 - DNA, 19 bp, Homo sapiens
ctcttcaccccggcaggcc

SEQ ID NO: 396708 - DNA, 21 bp, Homo sapiens
ctcttcaccccggcaggccct

SEQ ID NO: 396709 - DNA, 22 bp, Homo sapiens
ctcttcaccccggcaggccctg

SEQ ID NO: 396710 - DNA, 14 bp, Homo sapiens
ctcttcaccttggt

SEQ ID NO: 396711 - DNA, 11 bp, Homo sapiens
ctcttcagaaa

SEQ ID NO: 396712 - DNA, 21 bp, Homo sapiens
ctcttcagaaagtgtgcttta

SEQ ID NO: 396713 - DNA, 22 bp, Homo sapiens
ctcttcagcctcattcactgtc

SEQ ID NO: 396714 - DNA, 16 bp, Homo sapiens
ctcttcaggcctccct

SEQ ID NO: 396715 - DNA, 17 bp, Homo sapiens
ctcttcaggcctccctc

SEQ ID NO: 396716 - DNA, 22 bp, Homo sapiens
ctcttcaggttcttagtgtcac

SEQ ID NO: 396717 - DNA, 16 bp, Homo sapiens
ctcttcattcccactg

SEQ ID NO: 396718 - DNA, 17 bp, Homo sapiens
ctcttcattcccactgc

SEQ ID NO: 396719 - DNA, 21 bp, Homo sapiens
ctcttcattcccactgcactt

SEQ ID NO: 396720 - DNA, 14 bp, Homo sapiens
ctcttcccagcaca

SEQ ID NO: 396721 - DNA, 13 bp, Homo sapiens
ctcttcccatgac

SEQ ID NO: 396722 - DNA, 16 bp, Homo sapiens
ctcttcccatgactgc

SEQ ID NO: 396723 - DNA, 21 bp, Homo sapiens
ctcttccccagaaaggagact

SEQ ID NO: 396724 - DNA, 16 bp, Homo sapiens
ctcttccccctctccc

SEQ ID NO: 396725 - DNA, 17 bp, Homo sapiens
ctcttccccctctccca

SEQ ID NO: 396726 - DNA, 19 bp, Homo sapiens
ctcttccccctctcccagt

SEQ ID NO: 396727 - DNA, 20 bp, Homo sapiens
ctcttccccctctcccagtt

SEQ ID NO: 396728 - DNA, 15 bp, Homo sapiens
ctcttcccccttccc

SEQ ID NO: 396729 - DNA, 16 bp, Homo sapiens
ctcttcccccttcccc

SEQ ID NO: 396730 - DNA, 18 bp, Homo sapiens
ctcttccctctcgctccc

SEQ ID NO: 396731 - DNA, 21 bp, Homo sapiens
ctcttcccttagcctctccca

SEQ ID NO: 396732 - DNA, 18 bp, Homo sapiens
ctcttccgggagctggtg

SEQ ID NO: 396733 - DNA, 19 bp, Homo sapiens
ctcttccgggagctggtga

SEQ ID NO: 396734 - DNA, 21 bp, Homo sapiens
ctcttccgggagctggtgaca

SEQ ID NO: 396735 - DNA, 19 bp, Homo sapiens
ctcttcctacccaaccact

SEQ ID NO: 396736 - DNA, 15 bp, Homo sapiens
ctcttcctccctccc

SEQ ID NO: 396737 - DNA, 13 bp, Homo sapiens
ctcttcctggacc

SEQ ID NO: 396738 - DNA, 15 bp, Homo sapiens
ctcttcctggagccc

SEQ ID NO: 396739 - DNA, 20 bp, Homo sapiens
ctcttcctggagccccagaa

SEQ ID NO: 396740 - DNA, 23 bp, Homo sapiens
ctcttccttctctactcatgcca

SEQ ID NO: 396741 - DNA, 15 bp, Homo sapiens
ctcttctatcctgca

SEQ ID NO: 396742 - DNA, 20 bp, Homo sapiens
ctcttctcagctccactctg

SEQ ID NO: 396743 - DNA, 15 bp, Homo sapiens
ctcttctccactgga

SEQ ID NO: 396744 - DNA, 17 bp, Homo sapiens
ctcttctccactggatg

SEQ ID NO: 396745 - DNA, 19 bp, Homo sapiens
ctcttctccactggatgga

SEQ ID NO: 396746 - DNA, 16 bp, Homo sapiens
ctcttctcctttcaca

SEQ ID NO: 396747 - DNA, 20 bp, Homo sapiens
ctcttctctgggcccagaga

SEQ ID NO: 396748 - DNA, 12 bp, Homo sapiens
ctcttctgctcc

SEQ ID NO: 396749 - DNA, 20 bp, Homo sapiens
ctcttctgcttaggagagac

SEQ ID NO: 396750 - DNA, 14 bp, Homo sapiens
ctcttctgggcaga

SEQ ID NO: 396751 - DNA, 15 bp, Homo sapiens
ctcttctgggcagag

SEQ ID NO: 396752 - DNA, 17 bp, Homo sapiens
ctcttctgggcagagcc

SEQ ID NO: 396753 - DNA, 13 bp, Homo sapiens
gtaattgtgaaaa

SEQ ID NO: 396754 - DNA, 14 bp, Homo sapiens
gtaatttgtatctg

SEQ ID NO: 396755 - DNA, 21 bp, Homo sapiens
gtaatttgtatctgaaggaga

SEQ ID NO: 396756 - DNA, 16 bp, Homo sapiens
gtaatttttttctagt

SEQ ID NO: 396757 - DNA, 23 bp, Homo sapiens
gtacaaaaattgttcaacctaaa

SEQ ID NO: 396758 - DNA, 21 bp, Homo sapiens
gtacaaagatacttgatgcac

SEQ ID NO: 396759 - DNA, 17 bp, Homo sapiens
gtacaaagtaaaaataa

SEQ ID NO: 396760 - DNA, 15 bp, Homo sapiens
gtacaaagtagagaa

SEQ ID NO: 396761 - DNA, 22 bp, Homo sapiens
gtacaaattataaaaagccact

SEQ ID NO: 396762 - DNA, 16 bp, Homo sapiens
gtacaagttttgtata

SEQ ID NO: 396763 - DNA, 23 bp, Homo sapiens
ctcttgagggtcattttcctttc

SEQ ID NO: 396764 - DNA, 14 bp, Homo sapiens
ctcttgatgtgaag

SEQ ID NO: 396765 - DNA, 14 bp, Homo sapiens
ctcttgcagagaag

SEQ ID NO: 396766 - DNA, 15 bp, Homo sapiens
ctcttgcagagaagc

SEQ ID NO: 396767 - DNA, 16 bp, Homo sapiens
ctcttgccactgcctc

SEQ ID NO: 396768 - DNA, 19 bp, Homo sapiens
ctcttgccactgcctcttc

SEQ ID NO: 396769 - DNA, 13 bp, Homo sapiens
ctcttgcccccca

SEQ ID NO: 396770 - DNA, 20 bp, Homo sapiens
ctcttgccgaggagccaggc

SEQ ID NO: 396771 - DNA, 18 bp, Homo sapiens
ctcttgctacctgtgagc

SEQ ID NO: 396772 - DNA, 22 bp, Homo sapiens
ctcttgctatataaataaagca

SEQ ID NO: 396773 - DNA, 16 bp, Homo sapiens
ctcttgctattggaat

SEQ ID NO: 396774 - DNA, 19 bp, Homo sapiens
ctcttgctcaaaaatctgt

SEQ ID NO: 396775 - DNA, 14 bp, Homo sapiens
ctcttgctcactcc

SEQ ID NO: 396776 - DNA, 13 bp, Homo sapiens
ctcttgctctttc

SEQ ID NO: 396777 - DNA, 23 bp, Homo sapiens
ctcttgggaactccactctcctt

SEQ ID NO: 396778 - DNA, 19 bp, Homo sapiens
ctcttgggttcaagtgatt

SEQ ID NO: 396779 - DNA, 12 bp, Homo sapiens
ctcttggtctct

SEQ ID NO: 396780 - DNA, 15 bp, Homo sapiens
ctcttggtctctttc

SEQ ID NO: 396781 - DNA, 23 bp, Homo sapiens
ctcttgtacagttaactctccca

SEQ ID NO: 396782 - DNA, 23 bp, Homo sapiens
ctcttgtattgctccattttctt

SEQ ID NO: 396783 - DNA, 13 bp, Homo sapiens
ctcttgtcatttt

SEQ ID NO: 396784 - DNA, 18 bp, Homo sapiens
ctcttgtccctttcccta

SEQ ID NO: 396785 - DNA, 13 bp, Homo sapiens
ctcttgtgctgag

SEQ ID NO: 396786 - DNA, 15 bp, Homo sapiens
ctcttgttgcccagg

SEQ ID NO: 396787 - DNA, 22 bp, Homo sapiens
ctcttgtttggagggatcattt

SEQ ID NO: 396788 - DNA, 19 bp, Homo sapiens
ctctttaagttttgattaa

SEQ ID NO: 396789 - DNA, 17 bp, Homo sapiens
ctctttatgactgtttt

SEQ ID NO: 396790 - DNA, 11 bp, Homo sapiens
ctctttcaaag

SEQ ID NO: 396791 - DNA, 22 bp, Homo sapiens
ctctttcagagaggtctcaggt

SEQ ID NO: 396792 - DNA, 18 bp, Homo sapiens
ctctttcctctaactcat

SEQ ID NO: 396793 - DNA, 13 bp, Homo sapiens
ctctttcctgtgc

SEQ ID NO: 396794 - DNA, 16 bp, Homo sapiens
ctctttctatgcccgt

SEQ ID NO: 396795 - DNA, 17 bp, Homo sapiens
ctctttctattgtttct

SEQ ID NO: 396796 - DNA, 13 bp, Homo sapiens
ctctttctctctg

SEQ ID NO: 396797 - DNA, 14 bp, Homo sapiens
ctctttctctctgt

SEQ ID NO: 396798 - DNA, 18 bp, Homo sapiens
ctctttctctctgtgtgg

SEQ ID NO: 396799 - DNA, 21 bp, Homo sapiens
ctctttctctctttccatctc

SEQ ID NO: 396800 - DNA, 15 bp, Homo sapiens
ctctttctctgccag

SEQ ID NO: 396801 - DNA, 13 bp, Homo sapiens
ctctttcttccac

SEQ ID NO: 396802 - DNA, 20 bp, Homo sapiens
ctctttcttctctctttgtc

SEQ ID NO: 396803 - DNA, 13 bp, Homo sapiens
ctctttcttcttt

SEQ ID NO: 396804 - DNA, 14 bp, Homo sapiens
ctctttctttccaa

SEQ ID NO: 396805 - DNA, 18 bp, Homo sapiens
ctctttgaaaattcttgt

SEQ ID NO: 396806 - DNA, 23 bp, Homo sapiens
ctctttgacaattcctagataaa

SEQ ID NO: 396807 - DNA, 12 bp, Homo sapiens
ctctttgctgtt

SEQ ID NO: 396808 - DNA, 18 bp, Homo sapiens
ctctttgggcctggctcc

SEQ ID NO: 396809 - DNA, 18 bp, Homo sapiens
ctctttgggtttcttgtt

SEQ ID NO: 396810 - DNA, 19 bp, Homo sapiens
ctctttgtaaggacttgtg

SEQ ID NO: 396811 - DNA, 14 bp, Homo sapiens
ctctttgtggcagt

SEQ ID NO: 396812 - DNA, 20 bp, Homo sapiens
ctctttgtgtttttgttgtt

SEQ ID NO: 396813 - DNA, 19 bp, Homo sapiens
ctcttttacccaataagat

SEQ ID NO: 396814 - DNA, 14 bp, Homo sapiens
ctcttttctctgtg

SEQ ID NO: 396815 - DNA, 15 bp, Homo sapiens
ctcttttctgcatca

SEQ ID NO: 396816 - DNA, 21 bp, Homo sapiens
ctctttttacttggaaataat

SEQ ID NO: 396817 - DNA, 18 bp, Homo sapiens
ctctttttctaaagtgtt

SEQ ID NO: 396818 - DNA, 17 bp, Homo sapiens
ctctttttcttgtaaac

SEQ ID NO: 396819 - DNA, 16 bp, Homo sapiens
ctctttttggaggtgc

SEQ ID NO: 396820 - DNA, 15 bp, Homo sapiens
ctctttttttaaaaa

SEQ ID NO: 396821 - DNA, 16 bp, Homo sapiens
ctctttttttggccca

SEQ ID NO: 396822 - DNA, 18 bp, Homo sapiens
ctctttttttggcccagg

SEQ ID NO: 396823 - DNA, 19 bp, Homo sapiens
ctctttttttggcccaggc

SEQ ID NO: 396824 - DNA, 23 bp, Homo sapiens
ctcttttttttttttttttagat

SEQ ID NO: 396825 - DNA, 14 bp, Homo sapiens
ctgaaaaaaagttt

SEQ ID NO: 396826 - DNA, 15 bp, Homo sapiens
ctgaaaaaaagttta

SEQ ID NO: 396827 - DNA, 13 bp, Homo sapiens
ctgaaaaatggga

SEQ ID NO: 396828 - DNA, 20 bp, Homo sapiens
ctgaaaacatttcaaagctg

SEQ ID NO: 396829 - DNA, 16 bp, Homo sapiens
ctgaaaacggccctct

SEQ ID NO: 396830 - DNA, 17 bp, Homo sapiens
ctgaaaacggccctctt

SEQ ID NO: 396831 - DNA, 13 bp, Homo sapiens
ctgaaaactgttt

SEQ ID NO: 396832 - DNA, 21 bp, Homo sapiens
ctgaaaagcaattgccctgta

SEQ ID NO: 396833 - DNA, 22 bp, Homo sapiens
ctgaaaatatttttttctagct

SEQ ID NO: 396834 - DNA, 23 bp, Homo sapiens
ctgaaaatatttttttctagcta

SEQ ID NO: 396835 - DNA, 20 bp, Homo sapiens
ctgaaaatcgagtttttcct

SEQ ID NO: 396836 - DNA, 15 bp, Homo sapiens
ctgaaaatctaatat

SEQ ID NO: 396837 - DNA, 17 bp, Homo sapiens
ctgaaaatctaatatta

SEQ ID NO: 396838 - DNA, 15 bp, Homo sapiens
ctgaaaatgtaaatt

SEQ ID NO: 396839 - DNA, 13 bp, Homo sapiens
ctgaaaatgttag

SEQ ID NO: 396840 - DNA, 22 bp, Homo sapiens
ctgaaaattccagaaaggatat

SEQ ID NO: 396841 - DNA, 21 bp, Homo sapiens
ctgaaacattcacacagggct

SEQ ID NO: 396842 - DNA, 14 bp, Homo sapiens
ctgaaacttcccaa

SEQ ID NO: 396843 - DNA, 15 bp, Homo sapiens
ctgaaagaaacagtt

SEQ ID NO: 396844 - DNA, 12 bp, Homo sapiens
ctgaaagaagaa

SEQ ID NO: 396845 - DNA, 19 bp, Homo sapiens
ctgaaagaagaacagctgt

SEQ ID NO: 396846 - DNA, 11 bp, Homo sapiens
ctgaaagacaa

SEQ ID NO: 396847 - DNA, 12 bp, Homo sapiens
ctgaaagagcat

SEQ ID NO: 396848 - DNA, 22 bp, Homo sapiens
ctgaaagagcattattcctggt

SEQ ID NO: 396849 - DNA, 23 bp, Homo sapiens
ctgaaagagcattattcctggtc

SEQ ID NO: 396850 - DNA, 12 bp, Homo sapiens
ctgaaaggaaaa

SEQ ID NO: 396851 - DNA, 17 bp, Homo sapiens
ctgaaaggaaaagtctt

SEQ ID NO: 396852 - DNA, 11 bp, Homo sapiens
ctgaaagtgtt

SEQ ID NO: 396853 - DNA, 13 bp, Homo sapiens
ctgaaataaaact

SEQ ID NO: 396854 - DNA, 18 bp, Homo sapiens
ctgaaatacctttgcctg

SEQ ID NO: 396855 - DNA, 19 bp, Homo sapiens
ctgaaatacctttgcctgg

SEQ ID NO: 396856 - DNA, 18 bp, Homo sapiens
ctgaaatcaattaaaagt

SEQ ID NO: 396857 - DNA, 19 bp, Homo sapiens
ctgaaatgaaacaaataat

SEQ ID NO: 396858 - DNA, 20 bp, Homo sapiens
ctgaaattatgtcaaatgga

SEQ ID NO: 396859 - DNA, 11 bp, Homo sapiens
ctgaacaaaaa

SEQ ID NO: 396860 - DNA, 19 bp, Homo sapiens
ctgaacacttttgttgtaa

SEQ ID NO: 396861 - DNA, 12 bp, Homo sapiens
ctgaacagtgga

SEQ ID NO: 396862 - DNA, 15 bp, Homo sapiens
ctgaaccccatgggc

SEQ ID NO: 396863 - DNA, 16 bp, Homo sapiens
ctgaaccccatgggct

SEQ ID NO: 396864 - DNA, 17 bp, Homo sapiens
ctgaaccccatgggctt

SEQ ID NO: 396865 - DNA, 20 bp, Homo sapiens
ctgaaccccatgggcttgga

SEQ ID NO: 396866 - DNA, 15 bp, Homo sapiens
ctgaaccccctccag

SEQ ID NO: 396867 - DNA, 20 bp, Homo sapiens
ctgaacccttgtgcttggtg

SEQ ID NO: 396868 - DNA, 12 bp, Homo sapiens
ctgaacctttgt

SEQ ID NO: 396869 - DNA, 16 bp, Homo sapiens
ctgaacgacaaagcat

SEQ ID NO: 396870 - DNA, 17 bp, Homo sapiens
ctgaactcgcttctctg

SEQ ID NO: 396871 - DNA, 13 bp, Homo sapiens
ctgaactctcaaa

SEQ ID NO: 396872 - DNA, 18 bp, Homo sapiens
ctgaactctgcaactgaa

SEQ ID NO: 396873 - DNA, 20 bp, Homo sapiens
ctgaactttgtttccagaaa

SEQ ID NO: 396874 - DNA, 15 bp, Homo sapiens
ctgaagaaaatgaag

SEQ ID NO: 396875 - DNA, 22 bp, Homo sapiens
ctgaagagcgctcctctgcctt

SEQ ID NO: 396876 - DNA, 20 bp, Homo sapiens
ctgaagagctattatataaa

SEQ ID NO: 396877 - DNA, 20 bp, Homo sapiens
ctgaagcaaataccaaagca

SEQ ID NO: 396878 - DNA, 18 bp, Homo sapiens
ctgaagcacgtgagagac

SEQ ID NO: 396879 - DNA, 12 bp, Homo sapiens
ctgaagccgcca

SEQ ID NO: 396880 - DNA, 17 bp, Homo sapiens
ctgaagcctctgccctg

SEQ ID NO: 396881 - DNA, 13 bp, Homo sapiens
ctgaagcctgcag

SEQ ID NO: 396882 - DNA, 15 bp, Homo sapiens
ctgaagcctgcagga

SEQ ID NO: 396883 - DNA, 14 bp, Homo sapiens
ctgaagcttattaa

SEQ ID NO: 396884 - DNA, 21 bp, Homo sapiens
ctgaagcttattaatgctaag

SEQ ID NO: 396885 - DNA, 16 bp, Homo sapiens
ctgaaggaatagccag

SEQ ID NO: 396886 - DNA, 21 bp, Homo sapiens
ctgaaggaatagccagagagg

SEQ ID NO: 396887 - DNA, 15 bp, Homo sapiens
ctgaaggagaggagt

SEQ ID NO: 396888 - DNA, 21 bp, Homo sapiens
ctgaaggagattttccttcct

SEQ ID NO: 396889 - DNA, 16 bp, Homo sapiens
ctgaaggcaacctgga

SEQ ID NO: 396890 - DNA, 14 bp, Homo sapiens
ctgaaggggcacac

SEQ ID NO: 396891 - DNA, 19 bp, Homo sapiens
ctgaagggtgacatcccag

SEQ ID NO: 396892 - DNA, 14 bp, Homo sapiens
gtagagagccgggc

SEQ ID NO: 396893 - DNA, 11 bp, Homo sapiens
gtagagaggac

SEQ ID NO: 396894 - DNA, 14 bp, Homo sapiens
ctgactgtcctaca

SEQ ID NO: 396895 - DNA, 18 bp, Homo sapiens
ctgacttctaatatcatt

SEQ ID NO: 396896 - DNA, 13 bp, Homo sapiens
ctgacttgcttta

SEQ ID NO: 396897 - DNA, 17 bp, Homo sapiens
ctgacttttacagcttt

SEQ ID NO: 396898 - DNA, 22 bp, Homo sapiens
ctgacttttacagcttttctct

SEQ ID NO: 396899 - DNA, 17 bp, Homo sapiens
ctgactttttcccccca

SEQ ID NO: 396900 - DNA, 11 bp, Homo sapiens
gtatcccacct

SEQ ID NO: 396901 - DNA, 23 bp, Homo sapiens
gtatcccacctccagcccacagt

SEQ ID NO: 396902 - DNA, 18 bp, Homo sapiens
gtatcccagacccctctc

SEQ ID NO: 396903 - DNA, 20 bp, Homo sapiens
gtatcccccccctgtatagt

SEQ ID NO: 396904 - DNA, 19 bp, Homo sapiens
gtatccttaaccaccgcat

SEQ ID NO: 396905 - DNA, 15 bp, Homo sapiens
gtatcggagacagtg

SEQ ID NO: 396906 - DNA, 15 bp, Homo sapiens
gtatctaaaaaataa

SEQ ID NO: 396907 - DNA, 16 bp, Homo sapiens
gtatctaaaaaataac

SEQ ID NO: 396908 - DNA, 19 bp, Homo sapiens
gtatctaaatgaaaagaga

SEQ ID NO: 396909 - DNA, 13 bp, Homo sapiens
gtatctagtgcag

SEQ ID NO: 396910 - DNA, 17 bp, Homo sapiens
gtatctctgaagcatgt

SEQ ID NO: 396911 - DNA, 14 bp, Homo sapiens
gtatctgaaggaga

SEQ ID NO: 396912 - DNA, 12 bp, Homo sapiens
gtatctgagcag

SEQ ID NO: 396913 - DNA, 21 bp, Homo sapiens
gtatctgctgcctctgaaaat

SEQ ID NO: 396914 - DNA, 17 bp, Homo sapiens
gtatctggtatctgcat

SEQ ID NO: 396915 - DNA, 18 bp, Homo sapiens
gtatctgtaacccttgaa

SEQ ID NO: 396916 - DNA, 20 bp, Homo sapiens
gtatcttacctgtaaagtct

SEQ ID NO: 396917 - DNA, 17 bp, Homo sapiens
gtatctttaaagacttg

SEQ ID NO: 396918 - DNA, 16 bp, Homo sapiens
gtatctttaaatataa

SEQ ID NO: 396919 - DNA, 22 bp, Homo sapiens
gtatctttgggtctttgataaa

SEQ ID NO: 396920 - DNA, 16 bp, Homo sapiens
gtatcttttttcaaaa

SEQ ID NO: 396921 - DNA, 21 bp, Homo sapiens
gtatgaaaatccttttaacca

SEQ ID NO: 396922 - DNA, 16 bp, Homo sapiens
gtatgaacttgaggac

SEQ ID NO: 396923 - DNA, 22 bp, Homo sapiens
gtatgaacttgaggacacatgt

SEQ ID NO: 396924 - DNA, 18 bp, Homo sapiens
gtatgactaaagagagaa

SEQ ID NO: 396925 - DNA, 21 bp, Homo sapiens
gtatgagtcaatgtgcagtgt

SEQ ID NO: 396926 - DNA, 18 bp, Homo sapiens
gtatgatgtattagtaga

SEQ ID NO: 396927 - DNA, 16 bp, Homo sapiens
gtatgatgtgttgtga

SEQ ID NO: 396928 - DNA, 17 bp, Homo sapiens
gtatgcaagaagaatat

SEQ ID NO: 396929 - DNA, 20 bp, Homo sapiens
gtatgcaagtgggagatgaa

SEQ ID NO: 396930 - DNA, 17 bp, Homo sapiens
gtatgggtttctcccag

SEQ ID NO: 396931 - DNA, 20 bp, Homo sapiens
gtatgtaaacattcatattt

SEQ ID NO: 396932 - DNA, 15 bp, Homo sapiens
gtatgtacagttcat

SEQ ID NO: 396933 - DNA, 11 bp, Homo sapiens
gtatgtatttc

SEQ ID NO: 396934 - DNA, 22 bp, Homo sapiens
gtatgtctctttaagttttgat

SEQ ID NO: 396935 - DNA, 23 bp, Homo sapiens
gtatgtgaaagtgtaaaatagaa

SEQ ID NO: 396936 - DNA, 14 bp, Homo sapiens
gtatgtgccattta

SEQ ID NO: 396937 - DNA, 13 bp, Homo sapiens
gtatgtgtagtgt

SEQ ID NO: 396938 - DNA, 18 bp, Homo sapiens
gtatgtgtagtgtgtttg

SEQ ID NO: 396939 - DNA, 18 bp, Homo sapiens
gtatgtgtctagcaaagc

SEQ ID NO: 396940 - DNA, 20 bp, Homo sapiens
gtatgtgtggtttataatct

SEQ ID NO: 396941 - DNA, 18 bp, Homo sapiens
gtatgttaagctctttat

SEQ ID NO: 396942 - DNA, 16 bp, Homo sapiens
gtatgttttagcatgt

SEQ ID NO: 396943 - DNA, 18 bp, Homo sapiens
gtattaaactctcctttg

SEQ ID NO: 396944 - DNA, 13 bp, Homo sapiens
gtattacactgta

SEQ ID NO: 396945 - DNA, 18 bp, Homo sapiens
gtattacatctaatgctt

SEQ ID NO: 396946 - DNA, 13 bp, Homo sapiens
gtattcagagcca

SEQ ID NO: 396947 - DNA, 17 bp, Homo sapiens
gtattcatacagcacta

SEQ ID NO: 396948 - DNA, 20 bp, Homo sapiens
gtattccaccttaaattaaa

SEQ ID NO: 396949 - DNA, 19 bp, Homo sapiens
gtattccttggcccagcag

SEQ ID NO: 396950 - DNA, 22 bp, Homo sapiens
gtattctcagagcatgtgtcag

SEQ ID NO: 396951 - DNA, 19 bp, Homo sapiens
gtattctctgtccagggct

SEQ ID NO: 396952 - DNA, 20 bp, Homo sapiens
gtattctctgtccagggctt

SEQ ID NO: 396953 - DNA, 14 bp, Homo sapiens
gtattgaaaacttc

SEQ ID NO: 396954 - DNA, 20 bp, Homo sapiens
gtattgattgaaaaaagaga

SEQ ID NO: 396955 - DNA, 19 bp, Homo sapiens
gtattgccacctctggcca

SEQ ID NO: 396956 - DNA, 19 bp, Homo sapiens
gtattgccatcgggtgcca

SEQ ID NO: 396957 - DNA, 22 bp, Homo sapiens
gtattgccatcgggtgccaaat

SEQ ID NO: 396958 - DNA, 20 bp, Homo sapiens
gtattggggttattttctgg

SEQ ID NO: 396959 - DNA, 14 bp, Homo sapiens
gtattgttcccagt

SEQ ID NO: 396960 - DNA, 20 bp, Homo sapiens
gtattgttcttgtaaaactg

SEQ ID NO: 396961 - DNA, 22 bp, Homo sapiens
gtatttaatgatttttgtgtat

SEQ ID NO: 396962 - DNA, 14 bp, Homo sapiens
gtatttactgtact

SEQ ID NO: 396963 - DNA, 15 bp, Homo sapiens
gtatttatatattta

SEQ ID NO: 396964 - DNA, 16 bp, Homo sapiens
gtatttatatatttat

SEQ ID NO: 396965 - DNA, 18 bp, Homo sapiens
gtatttattttcctcccc

SEQ ID NO: 396966 - DNA, 19 bp, Homo sapiens
gtatttattttcctcccca

SEQ ID NO: 396967 - DNA, 20 bp, Homo sapiens
gtatttattttcctccccag

SEQ ID NO: 396968 - DNA, 23 bp, Homo sapiens
gtatttattttcctccccagcag

SEQ ID NO: 396969 - DNA, 22 bp, Homo sapiens
gtatttccaacaaacttactgt

SEQ ID NO: 396970 - DNA, 11 bp, Homo sapiens
gtatttctgta

SEQ ID NO: 396971 - DNA, 9 bp, Homo sapiens
gtatttctt

SEQ ID NO: 396972 - DNA, 12 bp, Homo sapiens
gtatttctttta

SEQ ID NO: 396973 - DNA, 22 bp, Homo sapiens
gtatttcttttatatataaaat

SEQ ID NO: 396974 - DNA, 23 bp, Homo sapiens
gtatttcttttatatataaaata

SEQ ID NO: 396975 - DNA, 15 bp, Homo sapiens
gtatttgagacattc

SEQ ID NO: 396976 - DNA, 17 bp, Homo sapiens
gtatttgagacattcca

SEQ ID NO: 396977 - DNA, 16 bp, Homo sapiens
gtatttgagagaatct

SEQ ID NO: 396978 - DNA, 21 bp, Homo sapiens
gtatttgagagttctaaattt

SEQ ID NO: 396979 - DNA, 17 bp, Homo sapiens
gtattttactttgtgca

SEQ ID NO: 396980 - DNA, 19 bp, Homo sapiens
gtattttaggcagggattt

SEQ ID NO: 396981 - DNA, 15 bp, Homo sapiens
gtattttcaggaagg

SEQ ID NO: 396982 - DNA, 18 bp, Homo sapiens
gtattttcgggattcttt

SEQ ID NO: 396983 - DNA, 19 bp, Homo sapiens
gtattttcgggattctttg

SEQ ID NO: 396984 - DNA, 18 bp, Homo sapiens
gtattttcgtgcatttgt

SEQ ID NO: 396985 - DNA, 19 bp, Homo sapiens
gtattttcttcccatttgt

SEQ ID NO: 396986 - DNA, 22 bp, Homo sapiens
gtattttcttcccatttgtaat

SEQ ID NO: 396987 - DNA, 23 bp, Homo sapiens
gtattttcttcccatttgtaatg

SEQ ID NO: 396988 - DNA, 22 bp, Homo sapiens
gtattttcttttatatctgtaa

SEQ ID NO: 396989 - DNA, 18 bp, Homo sapiens
gtattttgaaaacactta

SEQ ID NO: 396990 - DNA, 14 bp, Homo sapiens
gtattttggagaaa

SEQ ID NO: 396991 - DNA, 19 bp, Homo sapiens
gtattttgtacaaagtaaa

SEQ ID NO: 396992 - DNA, 21 bp, Homo sapiens
gtattttgtgttcctctttgc

SEQ ID NO: 396993 - DNA, 13 bp, Homo sapiens
gtatttttagaga

SEQ ID NO: 396994 - DNA, 11 bp, Homo sapiens
gtatttttagt

SEQ ID NO: 396995 - DNA, 13 bp, Homo sapiens
gtcaaaagcctgg

SEQ ID NO: 396996 - DNA, 12 bp, Homo sapiens
gtcaaacaagtt

SEQ ID NO: 396997 - DNA, 14 bp, Homo sapiens
gtcaaacagtgtgg

SEQ ID NO: 396998 - DNA, 22 bp, Homo sapiens
gtcaaacagtgtggcttaaaca

SEQ ID NO: 396999 - DNA, 22 bp, Homo sapiens
gtcaaagacgctgagtgggagc

SEQ ID NO: 397000 - DNA, 18 bp, Homo sapiens
gtcaacagcaaagcttgg

SEQ ID NO: 397001 - DNA, 14 bp, Homo sapiens
gtcaaccaggaaca

SEQ ID NO: 397002 - DNA, 17 bp, Homo sapiens
gtcaaccttgtgtgagt

SEQ ID NO: 397003 - DNA, 21 bp, Homo sapiens
gtcaaccttgtgtgagtgtga

SEQ ID NO: 397004 - DNA, 13 bp, Homo sapiens
gtcaactccaagg

SEQ ID NO: 397005 - DNA, 16 bp, Homo sapiens
gtcaactccaaggcaa

SEQ ID NO: 397006 - DNA, 20 bp, Homo sapiens
gtcaactccaaggcaaatgt

SEQ ID NO: 397007 - DNA, 23 bp, Homo sapiens
gtcaactccaaggcaaatgtcca

SEQ ID NO: 397008 - DNA, 15 bp, Homo sapiens
gtcaactccaggact

SEQ ID NO: 397009 - DNA, 19 bp, Homo sapiens
gtcaactgctgttttatgt

SEQ ID NO: 397010 - DNA, 17 bp, Homo sapiens
gtcaacttctggctcct

SEQ ID NO: 397011 - DNA, 15 bp, Homo sapiens
gtcaactttcatttg

SEQ ID NO: 397012 - DNA, 14 bp, Homo sapiens
gtcaagcccaggag

SEQ ID NO: 397013 - DNA, 21 bp, Homo sapiens
gtcaaggcctgtccctggcca

SEQ ID NO: 397014 - DNA, 15 bp, Homo sapiens
gtcaaggtgctgttg

SEQ ID NO: 397015 - DNA, 15 bp, Homo sapiens
gtcaagtgtgcctgc

SEQ ID NO: 397016 - DNA, 22 bp, Homo sapiens
gtcaagttccgtctcctctcca

SEQ ID NO: 397017 - DNA, 22 bp, Homo sapiens
gtcaataattgtggagaggaga

SEQ ID NO: 397018 - DNA, 16 bp, Homo sapiens
gtcaatatatagagac

SEQ ID NO: 397019 - DNA, 16 bp, Homo sapiens
gtcaatattaaataca

SEQ ID NO: 397020 - DNA, 17 bp, Homo sapiens
gtcaatattaaatacag

SEQ ID NO: 397021 - DNA, 22 bp, Homo sapiens
gtcaatattaaatacagacact

SEQ ID NO: 397022 - DNA, 21 bp, Homo sapiens
gtcaatgaaatatttgcttat

SEQ ID NO: 397023 - DNA, 17 bp, Homo sapiens
gtcatctccatcagctg

SEQ ID NO: 397024 - DNA, 13 bp, Homo sapiens
gtcatctgggcca

SEQ ID NO: 397025 - DNA, 12 bp, Homo sapiens
gtcatctgtcag

SEQ ID NO: 397026 - DNA, 20 bp, Homo sapiens
gtcatctgtcagcttcccaa

SEQ ID NO: 397027 - DNA, 12 bp, Homo sapiens
gtcatcttccct

SEQ ID NO: 397028 - DNA, 20 bp, Homo sapiens
gtcatgaattcatactctgt

SEQ ID NO: 397029 - DNA, 14 bp, Homo sapiens
gtcatgatgtctgc

SEQ ID NO: 397030 - DNA, 15 bp, Homo sapiens
gtcatgatgtctgca

SEQ ID NO: 397031 - DNA, 16 bp, Homo sapiens
gtcatgatgtctgcaa

SEQ ID NO: 397032 - DNA, 16 bp, Homo sapiens
gtcatgcggtttccaa

SEQ ID NO: 397033 - DNA, 15 bp, Homo sapiens
gtcatgcgtccactt

SEQ ID NO: 397034 - DNA, 16 bp, Homo sapiens
gtcatgcgtgttgaat

SEQ ID NO: 397035 - DNA, 20 bp, Homo sapiens
gtcatggaaaatgtcctgtg

SEQ ID NO: 397036 - DNA, 15 bp, Homo sapiens
gtcatgggaacgcag

SEQ ID NO: 397037 - DNA, 17 bp, Homo sapiens
gtcatggtgatgcaagt

SEQ ID NO: 397038 - DNA, 15 bp, Homo sapiens
gtcattatgtagaaa

SEQ ID NO: 397039 - DNA, 19 bp, Homo sapiens
gtcattatttgataacatt

SEQ ID NO: 397040 - DNA, 18 bp, Homo sapiens
gtcattcctaatgcatta

SEQ ID NO: 397041 - DNA, 13 bp, Homo sapiens
ctgaggcacgagc

SEQ ID NO: 397042 - DNA, 20 bp, Homo sapiens
ctgaggcagaacctggtggc

SEQ ID NO: 397043 - DNA, 13 bp, Homo sapiens
ctgaggcaggaga

SEQ ID NO: 397044 - DNA, 19 bp, Homo sapiens
ctgaggccattccctgtag

SEQ ID NO: 397045 - DNA, 11 bp, Homo sapiens
ctgaggcccag

SEQ ID NO: 397046 - DNA, 14 bp, Homo sapiens
ctgaggcccagaga

SEQ ID NO: 397047 - DNA, 12 bp, Homo sapiens
ctgaggcccagc

SEQ ID NO: 397048 - DNA, 17 bp, Homo sapiens
ctgaggcccagcagagc

SEQ ID NO: 397049 - DNA, 13 bp, Homo sapiens
ctgaggccccagg

SEQ ID NO: 397050 - DNA, 18 bp, Homo sapiens
ctgaggccccaggcccta

SEQ ID NO: 397051 - DNA, 14 bp, Homo sapiens
ctgaggcctcatcc

SEQ ID NO: 397052 - DNA, 20 bp, Homo sapiens
ctgaggcctggactttcctg

SEQ ID NO: 397053 - DNA, 22 bp, Homo sapiens
ctgaggcgctcgctcccatgca

SEQ ID NO: 397054 - DNA, 17 bp, Homo sapiens
ctgaggcgggagaatca

SEQ ID NO: 397055 - DNA, 19 bp, Homo sapiens
ctgaggcttagagagagga

SEQ ID NO: 397056 - DNA, 20 bp, Homo sapiens
ctgaggcttagagagaggag

SEQ ID NO: 397057 - DNA, 20 bp, Homo sapiens
ctgaggcttgggcccagtag

SEQ ID NO: 397058 - DNA, 16 bp, Homo sapiens
ctgagggaagcccacc

SEQ ID NO: 397059 - DNA, 12 bp, Homo sapiens
ctgagggaccaa

SEQ ID NO: 397060 - DNA, 19 bp, Homo sapiens
ctgagggaccaactgggcc

SEQ ID NO: 397061 - DNA, 20 bp, Homo sapiens
ctgagggaccaactgggccc

SEQ ID NO: 397062 - DNA, 22 bp, Homo sapiens
ctgagggcactctctgccagct

SEQ ID NO: 397063 - DNA, 19 bp, Homo sapiens
ctgagggcagggttctaga

SEQ ID NO: 397064 - DNA, 21 bp, Homo sapiens
ctgagggcattaaaaatagta

SEQ ID NO: 397065 - DNA, 13 bp, Homo sapiens
ctgagggccacac

SEQ ID NO: 397066 - DNA, 20 bp, Homo sapiens
ctgagggcccctctgcccag

SEQ ID NO: 397067 - DNA, 14 bp, Homo sapiens
ctgagggcctggtc

SEQ ID NO: 397068 - DNA, 16 bp, Homo sapiens
ctgagggcctggtcac

SEQ ID NO: 397069 - DNA, 22 bp, Homo sapiens
ctgaggggcaacgaagaaaaaa

SEQ ID NO: 397070 - DNA, 16 bp, Homo sapiens
ctgaggggcatctgcc

SEQ ID NO: 397071 - DNA, 20 bp, Homo sapiens
ctgagggtggagactaagcc

SEQ ID NO: 397072 - DNA, 14 bp, Homo sapiens
ctgagggtttccac

SEQ ID NO: 397073 - DNA, 16 bp, Homo sapiens
ctgaggtctcttgagg

SEQ ID NO: 397074 - DNA, 19 bp, Homo sapiens
ctgaggtgaaagggagcta

SEQ ID NO: 397075 - DNA, 14 bp, Homo sapiens
ctgaggtgggcaga

SEQ ID NO: 397076 - DNA, 21 bp, Homo sapiens
ctgagtaccttctacaggccc

SEQ ID NO: 397077 - DNA, 14 bp, Homo sapiens
ctgagtactcaggc

SEQ ID NO: 397078 - DNA, 19 bp, Homo sapiens
ctgagtagctggattacag

SEQ ID NO: 397079 - DNA, 15 bp, Homo sapiens
ctgagtcacctcctc

SEQ ID NO: 397080 - DNA, 18 bp, Homo sapiens
ctgagtcacctcctccac

SEQ ID NO: 397081 - DNA, 23 bp, Homo sapiens
ctgagtcacctcctccactcact

SEQ ID NO: 397082 - DNA, 19 bp, Homo sapiens
ctgagtcagggcccagagg

SEQ ID NO: 397083 - DNA, 12 bp, Homo sapiens
ctgagtccccac

SEQ ID NO: 397084 - DNA, 14 bp, Homo sapiens
ctgagtcggcccca

SEQ ID NO: 397085 - DNA, 21 bp, Homo sapiens
ctgagtcggccccacatggga

SEQ ID NO: 397086 - DNA, 14 bp, Homo sapiens
ctgagtcggctggg

SEQ ID NO: 397087 - DNA, 19 bp, Homo sapiens
ctgagtcggctgggcaggg

SEQ ID NO: 397088 - DNA, 20 bp, Homo sapiens
ctgagtcggctgggcagggc

SEQ ID NO: 397089 - DNA, 21 bp, Homo sapiens
ctgagtcggctgggcagggcc

SEQ ID NO: 397090 - DNA, 22 bp, Homo sapiens
ctgagtcggctgggcagggccg

SEQ ID NO: 397091 - DNA, 15 bp, Homo sapiens
ctgagtctcctgtgc

SEQ ID NO: 397092 - DNA, 16 bp, Homo sapiens
ctgagtctcctgtgcc

SEQ ID NO: 397093 - DNA, 17 bp, Homo sapiens
ctgagtctgctatattt

SEQ ID NO: 397094 - DNA, 22 bp, Homo sapiens
ctgagtctgctatattttcatg

SEQ ID NO: 397095 - DNA, 23 bp, Homo sapiens
ctgagtctgtgaataaagccaca

SEQ ID NO: 397096 - DNA, 21 bp, Homo sapiens
ctgagtgaatgagtaaataaa

SEQ ID NO: 397097 - DNA, 22 bp, Homo sapiens
ctgagtgcagaggctgagcagg

SEQ ID NO: 397098 - DNA, 18 bp, Homo sapiens
ctgagtggaatgcaggga

SEQ ID NO: 397099 - DNA, 17 bp, Homo sapiens
ctgagtggtccacattc

SEQ ID NO: 397100 - DNA, 23 bp, Homo sapiens
ctgagtggtccacattctgctgc

SEQ ID NO: 397101 - DNA, 19 bp, Homo sapiens
ctgagtggtgaggggccac

SEQ ID NO: 397102 - DNA, 23 bp, Homo sapiens
ctgagtggtgaggggccactggg

SEQ ID NO: 397103 - DNA, 15 bp, Homo sapiens
ctgagtggtgttttt

SEQ ID NO: 397104 - DNA, 17 bp, Homo sapiens
ctgagtggtgttttttt

SEQ ID NO: 397105 - DNA, 22 bp, Homo sapiens
ctgagttacttgtctgaggcct

SEQ ID NO: 397106 - DNA, 23 bp, Homo sapiens
ctgagttacttgtctgaggcctc

SEQ ID NO: 397107 - DNA, 22 bp, Homo sapiens
ctgagttctcatccacagaggc

SEQ ID NO: 397108 - DNA, 16 bp, Homo sapiens
ctgagttgaggggctt

SEQ ID NO: 397109 - DNA, 20 bp, Homo sapiens
ctgagttgaggggcttccct

SEQ ID NO: 397110 - DNA, 17 bp, Homo sapiens
ctgagtttaccatttgt

SEQ ID NO: 397111 - DNA, 23 bp, Homo sapiens
ctgagtttaccatttgtaataaa

SEQ ID NO: 397112 - DNA, 15 bp, Homo sapiens
ctgataaagaaacct

SEQ ID NO: 397113 - DNA, 20 bp, Homo sapiens
ctgataactagatggtgctg

SEQ ID NO: 397114 - DNA, 21 bp, Homo sapiens
ctgataactagatggtgctga

SEQ ID NO: 397115 - DNA, 21 bp, Homo sapiens
ctgataatatgtttgaggtta

SEQ ID NO: 397116 - DNA, 13 bp, Homo sapiens
ctgatacagcctt

SEQ ID NO: 397117 - DNA, 14 bp, Homo sapiens
ctgatacagcctta

SEQ ID NO: 397118 - DNA, 12 bp, Homo sapiens
ctgatactgggt

SEQ ID NO: 397119 - DNA, 21 bp, Homo sapiens
ctgatagctacccacagagca

SEQ ID NO: 397120 - DNA, 22 bp, Homo sapiens
ctgatagctacccacagagcaa

SEQ ID NO: 397121 - DNA, 17 bp, Homo sapiens
ctgatagtcacctgctg

SEQ ID NO: 397122 - DNA, 19 bp, Homo sapiens
ctgatatacaattagagat

SEQ ID NO: 397123 - DNA, 21 bp, Homo sapiens
ctgatatcacgggcccgctca

SEQ ID NO: 397124 - DNA, 23 bp, Homo sapiens
ctgatattaatttatcagattgc

SEQ ID NO: 397125 - DNA, 19 bp, Homo sapiens
ctgatattccatgaatgta

SEQ ID NO: 397126 - DNA, 18 bp, Homo sapiens
ctgatcacccccctgctt

SEQ ID NO: 397127 - DNA, 19 bp, Homo sapiens
ctgatcacccccctgctta

SEQ ID NO: 397128 - DNA, 20 bp, Homo sapiens
ctgatcactatgcattttaa

SEQ ID NO: 397129 - DNA, 12 bp, Homo sapiens
ctgatcatgcat

SEQ ID NO: 397130 - DNA, 15 bp, Homo sapiens
ctgatcatgcattgt

SEQ ID NO: 397131 - DNA, 17 bp, Homo sapiens
ctgatcatgcattgttg

SEQ ID NO: 397132 - DNA, 20 bp, Homo sapiens
ctgatcatttgcagctgctg

SEQ ID NO: 397133 - DNA, 15 bp, Homo sapiens
ctgatcccactccta

SEQ ID NO: 397134 - DNA, 16 bp, Homo sapiens
ctgatcccactcctag

SEQ ID NO: 397135 - DNA, 21 bp, Homo sapiens
ctgatcccataaagaaagtga

SEQ ID NO: 397136 - DNA, 21 bp, Homo sapiens
ctgatcctgaacaagaaagag

SEQ ID NO: 397137 - DNA, 21 bp, Homo sapiens
ctgatctctactaccacaagg

SEQ ID NO: 397138 - DNA, 23 bp, Homo sapiens
ctgatctctactaccacaaggaa

SEQ ID NO: 397139 - DNA, 21 bp, Homo sapiens
ctgatgaaactcacaaatgat

SEQ ID NO: 397140 - DNA, 21 bp, Homo sapiens
ctgatgaactcttaatcaaat

SEQ ID NO: 397141 - DNA, 14 bp, Homo sapiens
ctgatgacactgag

SEQ ID NO: 397142 - DNA, 15 bp, Homo sapiens
ctgatgacactgaga

SEQ ID NO: 397143 - DNA, 18 bp, Homo sapiens
ctgatgagacaacacaca

SEQ ID NO: 397144 - DNA, 20 bp, Homo sapiens
ctgatgatcaaaacctgtgc

SEQ ID NO: 397145 - DNA, 15 bp, Homo sapiens
ctgatgatggaaggg

SEQ ID NO: 397146 - DNA, 22 bp, Homo sapiens
ctgatgatgtctcttgtagaag

SEQ ID NO: 397147 - DNA, 15 bp, Homo sapiens
ctgatgccccttccc

SEQ ID NO: 397148 - DNA, 19 bp, Homo sapiens
ctgatgccccttccccaag

SEQ ID NO: 397149 - DNA, 12 bp, Homo sapiens
ctgatgctccct

SEQ ID NO: 397150 - DNA, 15 bp, Homo sapiens
ctgatgctccctccc

SEQ ID NO: 397151 - DNA, 17 bp, Homo sapiens
ctgatgctccctcccct

SEQ ID NO: 397152 - DNA, 15 bp, Homo sapiens
ctgcagcagagcctg

SEQ ID NO: 397153 - DNA, 14 bp, Homo sapiens
ctgcagcaggcaga

SEQ ID NO: 397154 - DNA, 15 bp, Homo sapiens
ctgcagcaggcagag

SEQ ID NO: 397155 - DNA, 11 bp, Homo sapiens
ctgcagcatga

SEQ ID NO: 397156 - DNA, 20 bp, Homo sapiens
ctgcagcccacagaggacag

SEQ ID NO: 397157 - DNA, 22 bp, Homo sapiens
ctgcagcccacagaggacagtg

SEQ ID NO: 397158 - DNA, 13 bp, Homo sapiens
ctgcagcccagaa

SEQ ID NO: 397159 - DNA, 22 bp, Homo sapiens
ctgcagcccagaacgggcctcc

SEQ ID NO: 397160 - DNA, 13 bp, Homo sapiens
ctgcagcccttgg

SEQ ID NO: 397161 - DNA, 20 bp, Homo sapiens
ctgcagcccttgggcagttc

SEQ ID NO: 397162 - DNA, 18 bp, Homo sapiens
ctgcagcctcctcctgac

SEQ ID NO: 397163 - DNA, 22 bp, Homo sapiens
ctgcagcctcgaactcctgggc

SEQ ID NO: 397164 - DNA, 16 bp, Homo sapiens
ctgcagcctgagctcc

SEQ ID NO: 397165 - DNA, 17 bp, Homo sapiens
ctgcagcctgagctcca

SEQ ID NO: 397166 - DNA, 11 bp, Homo sapiens
ctgcagcctgg

SEQ ID NO: 397167 - DNA, 15 bp, Homo sapiens
ctgcagcctggaggc

SEQ ID NO: 397168 - DNA, 20 bp, Homo sapiens
ctgcagcctttgcctccccg

SEQ ID NO: 397169 - DNA, 12 bp, Homo sapiens
ctgcagctgacc

SEQ ID NO: 397170 - DNA, 13 bp, Homo sapiens
ctgcagctgacct

SEQ ID NO: 397171 - DNA, 14 bp, Homo sapiens
ctgcagctgacctc

SEQ ID NO: 397172 - DNA, 20 bp, Homo sapiens
ctgcagctgcaccagcaggt

SEQ ID NO: 397173 - DNA, 16 bp, Homo sapiens
ctgcagctgggcccca

SEQ ID NO: 397174 - DNA, 17 bp, Homo sapiens
ctgcagctgttttagtt

SEQ ID NO: 397175 - DNA, 14 bp, Homo sapiens
ctgcagctttacat

SEQ ID NO: 397176 - DNA, 22 bp, Homo sapiens
ctgcaggaacgagcactggcca

SEQ ID NO: 397177 - DNA, 14 bp, Homo sapiens
ctgcaggaggcctg

SEQ ID NO: 397178 - DNA, 16 bp, Homo sapiens
ctgcaggaggcctggg

SEQ ID NO: 397179 - DNA, 20 bp, Homo sapiens
ctgcaggatgattgtacaga

SEQ ID NO: 397180 - DNA, 12 bp, Homo sapiens
ctgcaggccacc

SEQ ID NO: 397181 - DNA, 14 bp, Homo sapiens
ctgcaggccaccag

SEQ ID NO: 397182 - DNA, 17 bp, Homo sapiens
gtcccggttcaccttgc

SEQ ID NO: 397183 - DNA, 22 bp, Homo sapiens
gtccctaattctcttcgctgtg

SEQ ID NO: 397184 - DNA, 22 bp, Homo sapiens
gtccctaccactgagcccttgc

SEQ ID NO: 397185 - DNA, 19 bp, Homo sapiens
gtccctcccccgcttcctc

SEQ ID NO: 397186 - DNA, 16 bp, Homo sapiens
gtccctccctcctggc

SEQ ID NO: 397187 - DNA, 20 bp, Homo sapiens
gtccctccctcctggctcac

SEQ ID NO: 397188 - DNA, 18 bp, Homo sapiens
gtccctctcactccccag

SEQ ID NO: 397189 - DNA, 13 bp, Homo sapiens
gtccctctcaggc

SEQ ID NO: 397190 - DNA, 16 bp, Homo sapiens
gtccctctcaggcatg

SEQ ID NO: 397191 - DNA, 14 bp, Homo sapiens
gtccctctctctgg

SEQ ID NO: 397192 - DNA, 18 bp, Homo sapiens
gtccctctgccttgcaca

SEQ ID NO: 397193 - DNA, 17 bp, Homo sapiens
gtccctgacttcccagc

SEQ ID NO: 397194 - DNA, 19 bp, Homo sapiens
gtccctgagcagtctactt

SEQ ID NO: 397195 - DNA, 24 bp, Homo sapiens
gtccctgccacactcagtccccca

SEQ ID NO: 397196 - DNA, 12 bp, Homo sapiens
gtccctgccccg

SEQ ID NO: 397197 - DNA, 17 bp, Homo sapiens
gtccctgccccgccccc

SEQ ID NO: 397198 - DNA, 21 bp, Homo sapiens
gtccctgccccgccccccaga

SEQ ID NO: 397199 - DNA, 19 bp, Homo sapiens
gtccctggaccagcctcct

SEQ ID NO: 397200 - DNA, 13 bp, Homo sapiens
gtccctggagctg

SEQ ID NO: 397201 - DNA, 14 bp, Homo sapiens
gtccctggagctgt

SEQ ID NO: 397202 - DNA, 16 bp, Homo sapiens
gtccctggtccctcgt

SEQ ID NO: 397203 - DNA, 14 bp, Homo sapiens
gtccctgtccctgc

SEQ ID NO: 397204 - DNA, 15 bp, Homo sapiens
gtccctgtccctgcc

SEQ ID NO: 397205 - DNA, 17 bp, Homo sapiens
gtccctgtccctgcccc

SEQ ID NO: 397206 - DNA, 13 bp, Homo sapiens
gtcccttccccct

SEQ ID NO: 397207 - DNA, 12 bp, Homo sapiens
gtcccttcccct

SEQ ID NO: 397208 - DNA, 13 bp, Homo sapiens
gtcccttcccctc

SEQ ID NO: 397209 - DNA, 15 bp, Homo sapiens
gtcccttcctgtcct

SEQ ID NO: 397210 - DNA, 19 bp, Homo sapiens
gtcccttctcttaatttaa

SEQ ID NO: 397211 - DNA, 22 bp, Homo sapiens
gtcccttcttccctaatcagct

SEQ ID NO: 397212 - DNA, 14 bp, Homo sapiens
gtcccttgcctcaa

SEQ ID NO: 397213 - DNA, 16 bp, Homo sapiens
gtccctttccctacct

SEQ ID NO: 397214 - DNA, 15 bp, Homo sapiens
gtccctttcttggcc

SEQ ID NO: 397215 - DNA, 17 bp, Homo sapiens
gtccgcaccagctgctc

SEQ ID NO: 397216 - DNA, 16 bp, Homo sapiens
gtccgcccgcccaccc

SEQ ID NO: 397217 - DNA, 14 bp, Homo sapiens
gtccgccttaatct

SEQ ID NO: 397218 - DNA, 14 bp, Homo sapiens
gtcctacccgcccg

SEQ ID NO: 397219 - DNA, 15 bp, Homo sapiens
gtcctacggagggac

SEQ ID NO: 397220 - DNA, 22 bp, Homo sapiens
gtcctagtgtctattccctgga

SEQ ID NO: 397221 - DNA, 20 bp, Homo sapiens
gtcctcaaagaagtggttct

SEQ ID NO: 397222 - DNA, 13 bp, Homo sapiens
gtcctcacagcct

SEQ ID NO: 397223 - DNA, 16 bp, Homo sapiens
gtcctcacagcctctc

SEQ ID NO: 397224 - DNA, 18 bp, Homo sapiens
gtcctcacagcctctccc

SEQ ID NO: 397225 - DNA, 20 bp, Homo sapiens
gtcctcacagcctctccctt

SEQ ID NO: 397226 - DNA, 22 bp, Homo sapiens
gtcctcacatgcccgctgtccc

SEQ ID NO: 397227 - DNA, 21 bp, Homo sapiens
gtcctcacttgggggaaaaaa

SEQ ID NO: 397228 - DNA, 13 bp, Homo sapiens
gtcctcagcttct

SEQ ID NO: 397229 - DNA, 17 bp, Homo sapiens
gtcctcagcttcttaat

SEQ ID NO: 397230 - DNA, 20 bp, Homo sapiens
gtcctccaccacaagagctc

SEQ ID NO: 397231 - DNA, 19 bp, Homo sapiens
gtcctccagaagcctctgg

SEQ ID NO: 397232 - DNA, 17 bp, Homo sapiens
gtcctccagaccaccag

SEQ ID NO: 397233 - DNA, 14 bp, Homo sapiens
gtcctccccttggg

SEQ ID NO: 397234 - DNA, 21 bp, Homo sapiens
gtcctcccgggccctcccttg

SEQ ID NO: 397235 - DNA, 22 bp, Homo sapiens
gtcctcccgggccctcccttgg

SEQ ID NO: 397236 - DNA, 19 bp, Homo sapiens
gtcctccctcctgcaggct

SEQ ID NO: 397237 - DNA, 20 bp, Homo sapiens
gtcctccctcctgcaggctg

SEQ ID NO: 397238 - DNA, 14 bp, Homo sapiens
gtcctccctgctca

SEQ ID NO: 397239 - DNA, 20 bp, Homo sapiens
gtcctcgaattctcagacga

SEQ ID NO: 397240 - DNA, 22 bp, Homo sapiens
gtcctcgtggcggggcagcagg

SEQ ID NO: 397241 - DNA, 15 bp, Homo sapiens
gtcctctcagaactc

SEQ ID NO: 397242 - DNA, 17 bp, Homo sapiens
gtcctctcagaactcct

SEQ ID NO: 397243 - DNA, 16 bp, Homo sapiens
gtcctctttcagaaaa

SEQ ID NO: 397244 - DNA, 20 bp, Homo sapiens
gtcctctttcagaaaacaga

SEQ ID NO: 397245 - DNA, 23 bp, Homo sapiens
gtcctctttcagaaaacagaaaa

SEQ ID NO: 397246 - DNA, 13 bp, Homo sapiens
gtcctgaggcaga

SEQ ID NO: 397247 - DNA, 16 bp, Homo sapiens
gtcctgaggctggggc

SEQ ID NO: 397248 - DNA, 17 bp, Homo sapiens
gtcctgattctccctgg

SEQ ID NO: 397249 - DNA, 13 bp, Homo sapiens
gtcctgcagagct

SEQ ID NO: 397250 - DNA, 16 bp, Homo sapiens
gtcctgcagaggacca

SEQ ID NO: 397251 - DNA, 21 bp, Homo sapiens
gtcctgcagaggaccacagtg

SEQ ID NO: 397252 - DNA, 17 bp, Homo sapiens
gtcctgccacctggggc

SEQ ID NO: 397253 - DNA, 12 bp, Homo sapiens
gtcctgccagct

SEQ ID NO: 397254 - DNA, 14 bp, Homo sapiens
gtcctgccagctgc

SEQ ID NO: 397255 - DNA, 15 bp, Homo sapiens
gtcctgccagctgcc

SEQ ID NO: 397256 - DNA, 20 bp, Homo sapiens
gtcctgcctggccaggcaga

SEQ ID NO: 397257 - DNA, 21 bp, Homo sapiens
gtcctgctatttcccaagctg

SEQ ID NO: 397258 - DNA, 13 bp, Homo sapiens
gtcctgctcacgt

SEQ ID NO: 397259 - DNA, 22 bp, Homo sapiens
gtcctgctctctacccagccca

SEQ ID NO: 397260 - DNA, 12 bp, Homo sapiens
gtcctgctgctc

SEQ ID NO: 397261 - DNA, 20 bp, Homo sapiens
gtcctgctgctcgggaaggc

SEQ ID NO: 397262 - DNA, 11 bp, Homo sapiens
gtcctgctgtg

SEQ ID NO: 397263 - DNA, 13 bp, Homo sapiens
gtcctggaatgaa

SEQ ID NO: 397264 - DNA, 19 bp, Homo sapiens
gtcctggcagggcaggcag

SEQ ID NO: 397265 - DNA, 23 bp, Homo sapiens
gtcctggcagggcaggcagagct

SEQ ID NO: 397266 - DNA, 23 bp, Homo sapiens
gtcctgggcgccctggaagccgg

SEQ ID NO: 397267 - DNA, 20 bp, Homo sapiens
gtcctggggaggctgagact

SEQ ID NO: 397268 - DNA, 12 bp, Homo sapiens
gtcctggggtgg

SEQ ID NO: 397269 - DNA, 23 bp, Homo sapiens
gtcctggggtggttggaggcctg

SEQ ID NO: 397270 - DNA, 16 bp, Homo sapiens
gtcctggtacagcagg

SEQ ID NO: 397271 - DNA, 16 bp, Homo sapiens
gtcctgtcccagaggt

SEQ ID NO: 397272 - DNA, 17 bp, Homo sapiens
gtcctgtctcccctctg

SEQ ID NO: 397273 - DNA, 15 bp, Homo sapiens
gtcctgtgaatttct

SEQ ID NO: 397274 - DNA, 14 bp, Homo sapiens
gtcctgtgctttct

SEQ ID NO: 397275 - DNA, 19 bp, Homo sapiens
gtcctgtgtcatctgtcag

SEQ ID NO: 397276 - DNA, 18 bp, Homo sapiens
gtccttagaatactgtat

SEQ ID NO: 397277 - DNA, 22 bp, Homo sapiens
gtccttcagtgagcccctcccc

SEQ ID NO: 397278 - DNA, 21 bp, Homo sapiens
gtccttcattccgttaggaat

SEQ ID NO: 397279 - DNA, 20 bp, Homo sapiens
gtccttcccacggccactgc

SEQ ID NO: 397280 - DNA, 19 bp, Homo sapiens
gtccttctctcacctccta

SEQ ID NO: 397281 - DNA, 15 bp, Homo sapiens
gtccttctgacccca

SEQ ID NO: 397282 - DNA, 12 bp, Homo sapiens
gtccttgaaaca

SEQ ID NO: 397283 - DNA, 16 bp, Homo sapiens
gtcctttaggcagcct

SEQ ID NO: 397284 - DNA, 14 bp, Homo sapiens
gtcctttccctcca

SEQ ID NO: 397285 - DNA, 12 bp, Homo sapiens
gtcctttccctg

SEQ ID NO: 397286 - DNA, 13 bp, Homo sapiens
gtcctttctccag

SEQ ID NO: 397287 - DNA, 14 bp, Homo sapiens
gtcctttctccagg

SEQ ID NO: 397288 - DNA, 16 bp, Homo sapiens
gtcctttctcctgata

SEQ ID NO: 397289 - DNA, 21 bp, Homo sapiens
gtcctttgagaaagaaataat

SEQ ID NO: 397290 - DNA, 17 bp, Homo sapiens
gtcgaattaatagcttt

SEQ ID NO: 397291 - DNA, 17 bp, Homo sapiens
gtcgcaggatccgctgc

SEQ ID NO: 397292 - DNA, 19 bp, Homo sapiens
gtcgcaggatccgctgcca

SEQ ID NO: 397293 - DNA, 16 bp, Homo sapiens
gtcgccctctgtgcct

SEQ ID NO: 397294 - DNA, 18 bp, Homo sapiens
gtcgccctctgtgcctaa

SEQ ID NO: 397295 - DNA, 14 bp, Homo sapiens
gtcggaagcctgtc

SEQ ID NO: 397296 - DNA, 15 bp, Homo sapiens
gtcggaagcctgtcc

SEQ ID NO: 397297 - DNA, 16 bp, Homo sapiens
gtcggactgcccccag

SEQ ID NO: 397298 - DNA, 15 bp, Homo sapiens
gtcggagtagaaatt

SEQ ID NO: 397299 - DNA, 19 bp, Homo sapiens
gtcggatctagccatggct

SEQ ID NO: 397300 - DNA, 14 bp, Homo sapiens
gtcggccctgccca

SEQ ID NO: 397301 - DNA, 11 bp, Homo sapiens
gtcggctgggc

SEQ ID NO: 397302 - DNA, 21 bp, Homo sapiens
gtcgggaaattctgctgcttg

SEQ ID NO: 397303 - DNA, 21 bp, Homo sapiens
gtcggggagggggaggcggga

SEQ ID NO: 397304 - DNA, 18 bp, Homo sapiens
gtcgggggaggagcaccc

SEQ ID NO: 397305 - DNA, 15 bp, Homo sapiens
gtcgtggcagataat

SEQ ID NO: 397306 - DNA, 23 bp, Homo sapiens
gtcgtggcagataatcagcctct

SEQ ID NO: 397307 - DNA, 23 bp, Homo sapiens
gtcgtggtggagaatctgagggc

SEQ ID NO: 397308 - DNA, 23 bp, Homo sapiens
gtcgttcccttgtgtctgttgct

SEQ ID NO: 397309 - DNA, 13 bp, Homo sapiens
gtcgtttgaccac

SEQ ID NO: 397310 - DNA, 16 bp, Homo sapiens
gtctaaagtttacagt

SEQ ID NO: 397311 - DNA, 23 bp, Homo sapiens
gtctaaatatttccttaaactgt

SEQ ID NO: 397312 - DNA, 22 bp, Homo sapiens
gtctaactttagaagtgcattt

SEQ ID NO: 397313 - DNA, 21 bp, Homo sapiens
gtctaagatagtaacaatgaa

SEQ ID NO: 397314 - DNA, 14 bp, Homo sapiens
gtctacatgtgcca

SEQ ID NO: 397315 - DNA, 18 bp, Homo sapiens
gtctacttctgtgtctgt

SEQ ID NO: 397316 - DNA, 15 bp, Homo sapiens
ctgcaggccaccagc

SEQ ID NO: 397317 - DNA, 16 bp, Homo sapiens
ctgcaggccccagcca

SEQ ID NO: 397318 - DNA, 17 bp, Homo sapiens
ctgcaggccccagccaa

SEQ ID NO: 397319 - DNA, 18 bp, Homo sapiens
ctgcaggccccagccaag

SEQ ID NO: 397320 - DNA, 22 bp, Homo sapiens
ctgcaggccccagccaagtgcc

SEQ ID NO: 397321 - DNA, 20 bp, Homo sapiens
ctgcaggcggtatccagagg

SEQ ID NO: 397322 - DNA, 21 bp, Homo sapiens
ctgcaggcggtatccagaggt

SEQ ID NO: 397323 - DNA, 10 bp, Homo sapiens
ctgcaggctg

SEQ ID NO: 397324 - DNA, 14 bp, Homo sapiens
ctgcaggctggctg

SEQ ID NO: 397325 - DNA, 16 bp, Homo sapiens
ctgcagggcagcctgt

SEQ ID NO: 397326 - DNA, 23 bp, Homo sapiens
ctgcagggcagcctgtgggagaa

SEQ ID NO: 397327 - DNA, 16 bp, Homo sapiens
ctgcagggtagggggc

SEQ ID NO: 397328 - DNA, 16 bp, Homo sapiens
ctgcagggtggtgctg

SEQ ID NO: 397329 - DNA, 19 bp, Homo sapiens
ctgcagggtggtgctggga

SEQ ID NO: 397330 - DNA, 22 bp, Homo sapiens
ctgcagggtggtgctgggactg

SEQ ID NO: 397331 - DNA, 23 bp, Homo sapiens
ctgcagggtggtgctgggactga

SEQ ID NO: 397332 - DNA, 16 bp, Homo sapiens
ctgcaggtacttcctc

SEQ ID NO: 397333 - DNA, 16 bp, Homo sapiens
ctgcaggttggacccc

SEQ ID NO: 397334 - DNA, 19 bp, Homo sapiens
ctgcaggttggaccccaga

SEQ ID NO: 397335 - DNA, 21 bp, Homo sapiens
ctgcaggttggaccccagaga

SEQ ID NO: 397336 - DNA, 20 bp, Homo sapiens
ctgcagtcacccctgtctgc

SEQ ID NO: 397337 - DNA, 18 bp, Homo sapiens
ctgcagtgtccagaagcg

SEQ ID NO: 397338 - DNA, 18 bp, Homo sapiens
ctgcagttgaagagcctg

SEQ ID NO: 397339 - DNA, 21 bp, Homo sapiens
ctgcagtttgagacaggagac

SEQ ID NO: 397340 - DNA, 24 bp, Homo sapiens
ctgcagtttttcaggagcgcaaga

SEQ ID NO: 397341 - DNA, 14 bp, Homo sapiens
ctgcatagacaaag

SEQ ID NO: 397342 - DNA, 17 bp, Homo sapiens
ctgcatagacaaaggcc

SEQ ID NO: 397343 - DNA, 19 bp, Homo sapiens
ctgcatagacaaaggcctt

SEQ ID NO: 397344 - DNA, 19 bp, Homo sapiens
ctgcatagctctattttaa

SEQ ID NO: 397345 - DNA, 20 bp, Homo sapiens
ctgcatcaagatgtgacatg

SEQ ID NO: 397346 - DNA, 18 bp, Homo sapiens
ctgcatcagcctctggcc

SEQ ID NO: 397347 - DNA, 15 bp, Homo sapiens
ctgcatccaggcctg

SEQ ID NO: 397348 - DNA, 14 bp, Homo sapiens
ctgcatccctccac

SEQ ID NO: 397349 - DNA, 18 bp, Homo sapiens
ctgcatccctccacccca

SEQ ID NO: 397350 - DNA, 20 bp, Homo sapiens
ctgcatcccttggcccctct

SEQ ID NO: 397351 - DNA, 21 bp, Homo sapiens
ctgcatcccttggcccctctc

SEQ ID NO: 397352 - DNA, 23 bp, Homo sapiens
ctgcatcccttggcccctctctg

SEQ ID NO: 397353 - DNA, 21 bp, Homo sapiens
ctgcatcctactcctacctgg

SEQ ID NO: 397354 - DNA, 12 bp, Homo sapiens
ctgcatcctcag

SEQ ID NO: 397355 - DNA, 13 bp, Homo sapiens
ctgcatcctcagc

SEQ ID NO: 397356 - DNA, 16 bp, Homo sapiens
ctgcatcctcagcccc

SEQ ID NO: 397357 - DNA, 19 bp, Homo sapiens
ctgcatctttcatagttct

SEQ ID NO: 397358 - DNA, 20 bp, Homo sapiens
ctgcatctttcatagttctg

SEQ ID NO: 397359 - DNA, 21 bp, Homo sapiens
ctgcatctttcatagttctgt

SEQ ID NO: 397360 - DNA, 11 bp, Homo sapiens
ctgcatgcaga

SEQ ID NO: 397361 - DNA, 15 bp, Homo sapiens
ctgcatgcagaaagg

SEQ ID NO: 397362 - DNA, 14 bp, Homo sapiens
ctgcatgcagcaac

SEQ ID NO: 397363 - DNA, 18 bp, Homo sapiens
ctgcatgcagcaacaccc

SEQ ID NO: 397364 - DNA, 21 bp, Homo sapiens
ctgcatgcagcaacacccaag

SEQ ID NO: 397365 - DNA, 15 bp, Homo sapiens
ctgcatgcgacagcg

SEQ ID NO: 397366 - DNA, 18 bp, Homo sapiens
ctgcatgcgggcttcctc

SEQ ID NO: 397367 - DNA, 12 bp, Homo sapiens
ctgcatgctgct

SEQ ID NO: 397368 - DNA, 17 bp, Homo sapiens
ctgcatgcttagagcat

SEQ ID NO: 397369 - DNA, 12 bp, Homo sapiens
ctgcatggacct

SEQ ID NO: 397370 - DNA, 22 bp, Homo sapiens
ctgcatggacctaacattcgat

SEQ ID NO: 397371 - DNA, 16 bp, Homo sapiens
ctgcatggacgcctgg

SEQ ID NO: 397372 - DNA, 24 bp, Homo sapiens
ctgcatggacgcctggctccaggc

SEQ ID NO: 397373 - DNA, 15 bp, Homo sapiens
ctgcatggcagaagc

SEQ ID NO: 397374 - DNA, 15 bp, Homo sapiens
ctgcatggtaattta

SEQ ID NO: 397375 - DNA, 19 bp, Homo sapiens
ctgcatggtaatttatagt

SEQ ID NO: 397376 - DNA, 20 bp, Homo sapiens
ctgcatggtaatttatagtt

SEQ ID NO: 397377 - DNA, 20 bp, Homo sapiens
ctgcatgtaaaatcttcagc

SEQ ID NO: 397378 - DNA, 21 bp, Homo sapiens
ctgcatgtaaaatcttcagct

SEQ ID NO: 397379 - DNA, 23 bp, Homo sapiens
ctgcatgtaaaatcttcagctgg

SEQ ID NO: 397380 - DNA, 17 bp, Homo sapiens
ctgcattcgcagcagct

SEQ ID NO: 397381 - DNA, 19 bp, Homo sapiens
ctgcattgttattgtggaa

SEQ ID NO: 397382 - DNA, 17 bp, Homo sapiens
ctgcatttataaatgtg

SEQ ID NO: 397383 - DNA, 19 bp, Homo sapiens
ctgcatttataaatgtgtg

SEQ ID NO: 397384 - DNA, 20 bp, Homo sapiens
ctgcatttataaatgtgtgg

SEQ ID NO: 397385 - DNA, 21 bp, Homo sapiens
ctgcatttataaatgtgtggt

SEQ ID NO: 397386 - DNA, 13 bp, Homo sapiens
ctgcatttgtgaa

SEQ ID NO: 397387 - DNA, 15 bp, Homo sapiens
ctgcatttgtgaaat

SEQ ID NO: 397388 - DNA, 17 bp, Homo sapiens
ctgcatttgtgaaatga

SEQ ID NO: 397389 - DNA, 17 bp, Homo sapiens
ctgcattttcaccccac

SEQ ID NO: 397390 - DNA, 14 bp, Homo sapiens
ctgcattttctcag

SEQ ID NO: 397391 - DNA, 17 bp, Homo sapiens
ctgcattttctgggttc

SEQ ID NO: 397392 - DNA, 21 bp, Homo sapiens
ctgccaaagggaaatatcatt

SEQ ID NO: 397393 - DNA, 19 bp, Homo sapiens
ctgccaactttccagactt

SEQ ID NO: 397394 - DNA, 15 bp, Homo sapiens
ctgccaacttttagt

SEQ ID NO: 397395 - DNA, 17 bp, Homo sapiens
ctgccaagaactctggg

SEQ ID NO: 397396 - DNA, 15 bp, Homo sapiens
ctgccaagcctggag

SEQ ID NO: 397397 - DNA, 21 bp, Homo sapiens
ctgccaaggccagagtggcct

SEQ ID NO: 397398 - DNA, 22 bp, Homo sapiens
ctgccaaggccagagtggcctg

SEQ ID NO: 397399 - DNA, 19 bp, Homo sapiens
ctgccaatgccacagccaa

SEQ ID NO: 397400 - DNA, 20 bp, Homo sapiens
ctgccaatgccacagccaag

SEQ ID NO: 397401 - DNA, 13 bp, Homo sapiens
ctgccacactctg

SEQ ID NO: 397402 - DNA, 15 bp, Homo sapiens
ctgccacactctgac

SEQ ID NO: 397403 - DNA, 18 bp, Homo sapiens
ctgccacactctgacgca

SEQ ID NO: 397404 - DNA, 13 bp, Homo sapiens
ctgccacacttca

SEQ ID NO: 397405 - DNA, 18 bp, Homo sapiens
ctgccaccacgtctgcca

SEQ ID NO: 397406 - DNA, 19 bp, Homo sapiens
ctgccaccacgtctgccag

SEQ ID NO: 397407 - DNA, 22 bp, Homo sapiens
ctgccaccacgtctgccaggcc

SEQ ID NO: 397408 - DNA, 12 bp, Homo sapiens
ctgccacccact

SEQ ID NO: 397409 - DNA, 16 bp, Homo sapiens
ctgccacccactcagg

SEQ ID NO: 397410 - DNA, 19 bp, Homo sapiens
ctgccaccctacctgttca

SEQ ID NO: 397411 - DNA, 14 bp, Homo sapiens
ctgccacctcctgc

SEQ ID NO: 397412 - DNA, 15 bp, Homo sapiens
ctgccacctgctgct

SEQ ID NO: 397413 - DNA, 20 bp, Homo sapiens
gtcttgtgactagtgctgaa

SEQ ID NO: 397414 - DNA, 21 bp, Homo sapiens
gtcttgtgactagtgctgaag

SEQ ID NO: 397415 - DNA, 17 bp, Homo sapiens
gtctttaggcagcagct

SEQ ID NO: 397416 - DNA, 23 bp, Homo sapiens
gtctttagggagacccaataaag

SEQ ID NO: 397417 - DNA, 17 bp, Homo sapiens
gtctttatgatttcatg

SEQ ID NO: 397418 - DNA, 21 bp, Homo sapiens
gtctttcaggaccttttgaag

SEQ ID NO: 397419 - DNA, 21 bp, Homo sapiens
gtctttctaatgtagctattt

SEQ ID NO: 397420 - DNA, 13 bp, Homo sapiens
gtctttctggaga

SEQ ID NO: 397421 - DNA, 13 bp, Homo sapiens
gtctttctttgct

SEQ ID NO: 397422 - DNA, 16 bp, Homo sapiens
gtctttctttgctgct

SEQ ID NO: 397423 - DNA, 13 bp, Homo sapiens
gtctttgataaag

SEQ ID NO: 397424 - DNA, 17 bp, Homo sapiens
gtctttgctcagtggat

SEQ ID NO: 397425 - DNA, 22 bp, Homo sapiens
gtctttgggggattcaaatgca

SEQ ID NO: 397426 - DNA, 23 bp, Homo sapiens
gtctttgggggattcaaatgcat

SEQ ID NO: 397427 - DNA, 21 bp, Homo sapiens
gtctttggttcctcatggctg

SEQ ID NO: 397428 - DNA, 23 bp, Homo sapiens
gtctttggttcctcatggctgtt

SEQ ID NO: 397429 - DNA, 22 bp, Homo sapiens
gtcttttcccctcattgcattt

SEQ ID NO: 397430 - DNA, 14 bp, Homo sapiens
gtcttttcttggcg

SEQ ID NO: 397431 - DNA, 22 bp, Homo sapiens
gtcttttcttggcgttcctgcc

SEQ ID NO: 397432 - DNA, 14 bp, Homo sapiens
gtcttttgacatgt

SEQ ID NO: 397433 - DNA, 20 bp, Homo sapiens
gtcttttgttctctcttggt

SEQ ID NO: 397434 - DNA, 12 bp, Homo sapiens
gtctttttcctt

SEQ ID NO: 397435 - DNA, 13 bp, Homo sapiens
gtctttttttact

SEQ ID NO: 397436 - DNA, 17 bp, Homo sapiens
gtcttttttttcatcct

SEQ ID NO: 397437 - DNA, 18 bp, Homo sapiens
gtcttttttttcatcctt

SEQ ID NO: 397438 - DNA, 19 bp, Homo sapiens
gtgaaaacatatttgtgaa

SEQ ID NO: 397439 - DNA, 15 bp, Homo sapiens
gtgaaaagtaaaaca

SEQ ID NO: 397440 - DNA, 14 bp, Homo sapiens
gtgaaaatgtactg

SEQ ID NO: 397441 - DNA, 20 bp, Homo sapiens
gtgaaaattacacccatgca

SEQ ID NO: 397442 - DNA, 17 bp, Homo sapiens
gtgaaacacaccaggct

SEQ ID NO: 397443 - DNA, 21 bp, Homo sapiens
gtgaaacacaccaggctgtgg

SEQ ID NO: 397444 - DNA, 17 bp, Homo sapiens
gtgaaacagtgtggatg

SEQ ID NO: 397445 - DNA, 15 bp, Homo sapiens
gtgaaacggatgagg

SEQ ID NO: 397446 - DNA, 21 bp, Homo sapiens
gtgaaagagagtaccatgctg

SEQ ID NO: 397447 - DNA, 17 bp, Homo sapiens
gtgaaagtacatttgga

SEQ ID NO: 397448 - DNA, 23 bp, Homo sapiens
gtgaaagtatgtgatatctgaac

SEQ ID NO: 397449 - DNA, 13 bp, Homo sapiens
gtgaaatgtgcaa

SEQ ID NO: 397450 - DNA, 20 bp, Homo sapiens
gtgaaatttacatcatttct

SEQ ID NO: 397451 - DNA, 20 bp, Homo sapiens
gtgaaatttgttaatatata

SEQ ID NO: 397452 - DNA, 21 bp, Homo sapiens
gtgaacaactatttataaact

SEQ ID NO: 397453 - DNA, 13 bp, Homo sapiens
gtgaaccaactgc

SEQ ID NO: 397454 - DNA, 16 bp, Homo sapiens
gtgaacctaccttcat

SEQ ID NO: 397455 - DNA, 24 bp, Homo sapiens
gtgaacgtgggagttcagctgctt

SEQ ID NO: 397456 - DNA, 20 bp, Homo sapiens
gtgaactaagttttttactt

SEQ ID NO: 397457 - DNA, 13 bp, Homo sapiens
gtgaagaaatgga

SEQ ID NO: 397458 - DNA, 15 bp, Homo sapiens
gtgaagaaatggaat

SEQ ID NO: 397459 - DNA, 23 bp, Homo sapiens
gtgaagacactacagaggattct

SEQ ID NO: 397460 - DNA, 16 bp, Homo sapiens
ctgccatgatagctgg

SEQ ID NO: 397461 - DNA, 23 bp, Homo sapiens
ctgccatgatagctggggcttca

SEQ ID NO: 397462 - DNA, 15 bp, Homo sapiens
ctgccatgccactgc

SEQ ID NO: 397463 - DNA, 16 bp, Homo sapiens
ctgccatgccactgcc

SEQ ID NO: 397464 - DNA, 19 bp, Homo sapiens
ctgccatgccactgccagg

SEQ ID NO: 397465 - DNA, 24 bp, Homo sapiens
ctgccatgccactgccaggcacct

SEQ ID NO: 397466 - DNA, 15 bp, Homo sapiens
ctgccatttcccttc

SEQ ID NO: 397467 - DNA, 17 bp, Homo sapiens
ctgcccaagggcctccc

SEQ ID NO: 397468 - DNA, 12 bp, Homo sapiens
ctgcccacccgt

SEQ ID NO: 397469 - DNA, 14 bp, Homo sapiens
ctgcccaccctggg

SEQ ID NO: 397470 - DNA, 17 bp, Homo sapiens
ctgcccaccctgggcct

SEQ ID NO: 397471 - DNA, 23 bp, Homo sapiens
ctgcccaccctgggcctcccgtc

SEQ ID NO: 397472 - DNA, 22 bp, Homo sapiens
ctgcccaccgaccccctttcta

SEQ ID NO: 397473 - DNA, 17 bp, Homo sapiens
ctgcccacgctcctgcc

SEQ ID NO: 397474 - DNA, 13 bp, Homo sapiens
ctgcccacggcca

SEQ ID NO: 397475 - DNA, 16 bp, Homo sapiens
ctgcccacggccaccc

SEQ ID NO: 397476 - DNA, 17 bp, Homo sapiens
ctgcccacggccaccca

SEQ ID NO: 397477 - DNA, 15 bp, Homo sapiens
ctgcccacttcccct

SEQ ID NO: 397478 - DNA, 17 bp, Homo sapiens
ctgcccagagctgggtg

SEQ ID NO: 397479 - DNA, 19 bp, Homo sapiens
ctgcccagatgccctttgg

SEQ ID NO: 397480 - DNA, 21 bp, Homo sapiens
ctgcccagccctcccagctgg

SEQ ID NO: 397481 - DNA, 12 bp, Homo sapiens
ctgcccagctct

SEQ ID NO: 397482 - DNA, 13 bp, Homo sapiens
ctgcccagctctg

SEQ ID NO: 397483 - DNA, 14 bp, Homo sapiens
ctgcccagctctga

SEQ ID NO: 397484 - DNA, 14 bp, Homo sapiens
ctgcccagcttggg

SEQ ID NO: 397485 - DNA, 17 bp, Homo sapiens
ctgcccagcttgggccc

SEQ ID NO: 397486 - DNA, 19 bp, Homo sapiens
ctgcccagcttgggcccag

SEQ ID NO: 397487 - DNA, 21 bp, Homo sapiens
ctgcccagcttgggcccagct

SEQ ID NO: 397488 - DNA, 21 bp, Homo sapiens
ctgcccaggcagtctttgctc

SEQ ID NO: 397489 - DNA, 18 bp, Homo sapiens
ctgcccaggccggccagc

SEQ ID NO: 397490 - DNA, 17 bp, Homo sapiens
ctgcccaggcctgcctg

SEQ ID NO: 397491 - DNA, 14 bp, Homo sapiens
ctgcccaggctctg

SEQ ID NO: 397492 - DNA, 20 bp, Homo sapiens
ctgcccaggctctgctgact

SEQ ID NO: 397493 - DNA, 22 bp, Homo sapiens
ctgcccagggtcagtgtatcta

SEQ ID NO: 397494 - DNA, 21 bp, Homo sapiens
ctgcccagtgttgtttgtaaa

SEQ ID NO: 397495 - DNA, 14 bp, Homo sapiens
ctgcccagttagcc

SEQ ID NO: 397496 - DNA, 17 bp, Homo sapiens
ctgccccaacctgctga

SEQ ID NO: 397497 - DNA, 18 bp, Homo sapiens
ctgccccaagcagccagc

SEQ ID NO: 397498 - DNA, 21 bp, Homo sapiens
ctgccccaagcagccagccag

SEQ ID NO: 397499 - DNA, 13 bp, Homo sapiens
ctgccccaagccc

SEQ ID NO: 397500 - DNA, 23 bp, Homo sapiens
ctgccccaagcccccaaccccgc

SEQ ID NO: 397501 - DNA, 19 bp, Homo sapiens
ctgccccaatcgggtccag

SEQ ID NO: 397502 - DNA, 23 bp, Homo sapiens
ctgccccaatcgggtccagagac

SEQ ID NO: 397503 - DNA, 21 bp, Homo sapiens
ctgccccacacggactcccgg

SEQ ID NO: 397504 - DNA, 22 bp, Homo sapiens
ctgccccacacggactcccggg

SEQ ID NO: 397505 - DNA, 17 bp, Homo sapiens
ctgccccacaggccaca

SEQ ID NO: 397506 - DNA, 17 bp, Homo sapiens
ctgccccacccctccat

SEQ ID NO: 397507 - DNA, 12 bp, Homo sapiens
ctgccccaccct

SEQ ID NO: 397508 - DNA, 13 bp, Homo sapiens
ctgccccagctgg

SEQ ID NO: 397509 - DNA, 17 bp, Homo sapiens
ctgccccagctgggctg

SEQ ID NO: 397510 - DNA, 18 bp, Homo sapiens
ctgccccagctgggctgt

SEQ ID NO: 397511 - DNA, 13 bp, Homo sapiens
ctgcccccactgt

SEQ ID NO: 397512 - DNA, 15 bp, Homo sapiens
ctgcccccagaaagc

SEQ ID NO: 397513 - DNA, 23 bp, Homo sapiens
ctgcccccagaaagcctcctgcc

SEQ ID NO: 397514 - DNA, 13 bp, Homo sapiens
ctgcccccagctg

SEQ ID NO: 397515 - DNA, 21 bp, Homo sapiens
ctgcccccagctgctcctcgc

SEQ ID NO: 397516 - DNA, 21 bp, Homo sapiens
ctgcccccatctccccaggcc

SEQ ID NO: 397517 - DNA, 22 bp, Homo sapiens
ctgcccccatctccccaggcct

SEQ ID NO: 397518 - DNA, 23 bp, Homo sapiens
ctgcccccatctccccaggcctc

SEQ ID NO: 397519 - DNA, 14 bp, Homo sapiens
ctgccccccttccc

SEQ ID NO: 397520 - DNA, 17 bp, Homo sapiens
ctgcccccgccctgctg

SEQ ID NO: 397521 - DNA, 20 bp, Homo sapiens
ctgcccccgcgggttctaga

SEQ ID NO: 397522 - DNA, 21 bp, Homo sapiens
ctgcccccgcgggttctagac

SEQ ID NO: 397523 - DNA, 17 bp, Homo sapiens
ctgcccccgctctgcca

SEQ ID NO: 397524 - DNA, 17 bp, Homo sapiens
ctgcccccgttccagct

SEQ ID NO: 397525 - DNA, 14 bp, Homo sapiens
ctgccccctccccc

SEQ ID NO: 397526 - DNA, 15 bp, Homo sapiens
ctgccccctcccccg

SEQ ID NO: 397527 - DNA, 18 bp, Homo sapiens
ctgccccctcccccgcag

SEQ ID NO: 397528 - DNA, 23 bp, Homo sapiens
ctgccccctcccccgcagacaga

SEQ ID NO: 397529 - DNA, 17 bp, Homo sapiens
ctgccccctccccttca

SEQ ID NO: 397530 - DNA, 12 bp, Homo sapiens
ctgccccctgcc

SEQ ID NO: 397531 - DNA, 13 bp, Homo sapiens
ctgccccctgcca

SEQ ID NO: 397532 - DNA, 14 bp, Homo sapiens
ctgccccctgccag

SEQ ID NO: 397533 - DNA, 16 bp, Homo sapiens
ctgcccccttctccca

SEQ ID NO: 397534 - DNA, 18 bp, Homo sapiens
ctgcccccttctcccaca

SEQ ID NO: 397535 - DNA, 22 bp, Homo sapiens
ctgcccccttctcccacactgc

SEQ ID NO: 397536 - DNA, 11 bp, Homo sapiens
ctgccccgccc

SEQ ID NO: 397537 - DNA, 17 bp, Homo sapiens
ctgccccgccccccaga

SEQ ID NO: 397538 - DNA, 19 bp, Homo sapiens
ctgccccgtcaccatctca

SEQ ID NO: 397539 - DNA, 16 bp, Homo sapiens
ctgccccgtcccctgg

SEQ ID NO: 397540 - DNA, 20 bp, Homo sapiens
ctgccccgtcccctgggcca

SEQ ID NO: 397541 - DNA, 22 bp, Homo sapiens
ctgccccgtctcatgaggggcc

SEQ ID NO: 397542 - DNA, 22 bp, Homo sapiens
gtgcatgagaatgtcatttgct

SEQ ID NO: 397543 - DNA, 19 bp, Homo sapiens
gtgcatgcaaaccaggagc

SEQ ID NO: 397544 - DNA, 16 bp, Homo sapiens
gtgcatggccacagcc

SEQ ID NO: 397545 - DNA, 13 bp, Homo sapiens
gtgcatggctcct

SEQ ID NO: 397546 - DNA, 18 bp, Homo sapiens
gtgcatgtgtgtgctcag

SEQ ID NO: 397547 - DNA, 16 bp, Homo sapiens
gtgcattacagagagg

SEQ ID NO: 397548 - DNA, 22 bp, Homo sapiens
gtgcatttcacctgtgacaaag

SEQ ID NO: 397549 - DNA, 23 bp, Homo sapiens
gtgcatttgtgagccaaagagaa

SEQ ID NO: 397550 - DNA, 18 bp, Homo sapiens
gtgcatttgtgtctgcct

SEQ ID NO: 397551 - DNA, 18 bp, Homo sapiens
gtgcatttttgtgaaatg

SEQ ID NO: 397552 - DNA, 22 bp, Homo sapiens
gtgcatttttgtgaaatgaaaa

SEQ ID NO: 397553 - DNA, 16 bp, Homo sapiens
gtgccaaccacctctg

SEQ ID NO: 397554 - DNA, 14 bp, Homo sapiens
gtgccaagcagagg

SEQ ID NO: 397555 - DNA, 19 bp, Homo sapiens
gtgccaatatgtattgtaa

SEQ ID NO: 397556 - DNA, 21 bp, Homo sapiens
gtgccaatatgtattgtaaac

SEQ ID NO: 397557 - DNA, 12 bp, Homo sapiens
gtgccaccaccc

SEQ ID NO: 397558 - DNA, 18 bp, Homo sapiens
gtgccacccaccagggcg

SEQ ID NO: 397559 - DNA, 19 bp, Homo sapiens
gtgccaccctctgcagggc

SEQ ID NO: 397560 - DNA, 21 bp, Homo sapiens
gtgccaccctctgcagggcag

SEQ ID NO: 397561 - DNA, 22 bp, Homo sapiens
gtgccaccctctgcagggcagc

SEQ ID NO: 397562 - DNA, 22 bp, Homo sapiens
gtgccacctatgcctgtggtga

SEQ ID NO: 397563 - DNA, 17 bp, Homo sapiens
gtgccactccctgagct

SEQ ID NO: 397564 - DNA, 17 bp, Homo sapiens
gtgccactgcccgagct

SEQ ID NO: 397565 - DNA, 18 bp, Homo sapiens
gtgccactgcccgagctg

SEQ ID NO: 397566 - DNA, 22 bp, Homo sapiens
gtgccacttcttaaaggcctgg

SEQ ID NO: 397567 - DNA, 20 bp, Homo sapiens
gtgccagaaacagtgggagc

SEQ ID NO: 397568 - DNA, 19 bp, Homo sapiens
gtgccagaaagagagaacc

SEQ ID NO: 397569 - DNA, 22 bp, Homo sapiens
gtgccagccgtgatgctcaggc

SEQ ID NO: 397570 - DNA, 18 bp, Homo sapiens
gtgccagccttcctctgc

SEQ ID NO: 397571 - DNA, 15 bp, Homo sapiens
gtgccaggagcaatg

SEQ ID NO: 397572 - DNA, 22 bp, Homo sapiens
gtgccatacatgttattgtttt

SEQ ID NO: 397573 - DNA, 23 bp, Homo sapiens
gtgccatctgtacatattactgt

SEQ ID NO: 397574 - DNA, 14 bp, Homo sapiens
gtgccattcccagc

SEQ ID NO: 397575 - DNA, 22 bp, Homo sapiens
gtgccattgtactccagcctgg

SEQ ID NO: 397576 - DNA, 11 bp, Homo sapiens
gtgcccaaagt

SEQ ID NO: 397577 - DNA, 15 bp, Homo sapiens
gtgcccaaagtgggg

SEQ ID NO: 397578 - DNA, 23 bp, Homo sapiens
gtgcccaagaatagatgctgact

SEQ ID NO: 397579 - DNA, 14 bp, Homo sapiens
gtgcccacagcccg

SEQ ID NO: 397580 - DNA, 16 bp, Homo sapiens
gtgcccacccagggcc

SEQ ID NO: 397581 - DNA, 17 bp, Homo sapiens
gtgcccacccagggccc

SEQ ID NO: 397582 - DNA, 21 bp, Homo sapiens
gtgcccagatcgttctgccac

SEQ ID NO: 397583 - DNA, 14 bp, Homo sapiens
gtgcccagtcttga

SEQ ID NO: 397584 - DNA, 15 bp, Homo sapiens
gtgcccagtcttgag

SEQ ID NO: 397585 - DNA, 17 bp, Homo sapiens
gtgcccagttaatcttg

SEQ ID NO: 397586 - DNA, 22 bp, Homo sapiens
gtgcccatcatctctgcctttg

SEQ ID NO: 397587 - DNA, 12 bp, Homo sapiens
gtgccccaagag

SEQ ID NO: 397588 - DNA, 13 bp, Homo sapiens
gtgccccaagagg

SEQ ID NO: 397589 - DNA, 14 bp, Homo sapiens
gtgccccacagcta

SEQ ID NO: 397590 - DNA, 14 bp, Homo sapiens
gtgccccacctgcc

SEQ ID NO: 397591 - DNA, 21 bp, Homo sapiens
gtgccccatgcctgtccagcc

SEQ ID NO: 397592 - DNA, 16 bp, Homo sapiens
gtgccccgcctccccg

SEQ ID NO: 397593 - DNA, 17 bp, Homo sapiens
gtgccccgcctccccga

SEQ ID NO: 397594 - DNA, 19 bp, Homo sapiens
gtgcccctcccatggccca

SEQ ID NO: 397595 - DNA, 22 bp, Homo sapiens
gtgcccctcccatggcccagca

SEQ ID NO: 397596 - DNA, 13 bp, Homo sapiens
gtgcccctgctgc

SEQ ID NO: 397597 - DNA, 20 bp, Homo sapiens
gtgcccctgctgcctcccca

SEQ ID NO: 397598 - DNA, 14 bp, Homo sapiens
gtgcccgtgtcggt

SEQ ID NO: 397599 - DNA, 18 bp, Homo sapiens
gtgccctccactgccctc

SEQ ID NO: 397600 - DNA, 20 bp, Homo sapiens
gtgccctccactgccctctg

SEQ ID NO: 397601 - DNA, 21 bp, Homo sapiens
gtgccggcggcagccccactt

SEQ ID NO: 397602 - DNA, 13 bp, Homo sapiens
gtgccggctgtgg

SEQ ID NO: 397603 - DNA, 14 bp, Homo sapiens
gtgccggctgtgga

SEQ ID NO: 397604 - DNA, 23 bp, Homo sapiens
gtgccgtagggagtacctgctgc

SEQ ID NO: 397605 - DNA, 14 bp, Homo sapiens
gtgccgtgagcagg

SEQ ID NO: 397606 - DNA, 14 bp, Homo sapiens
ctgcgcccttcccc

SEQ ID NO: 397607 - DNA, 18 bp, Homo sapiens
ctgcgcccttgtgccctg

SEQ ID NO: 397608 - DNA, 15 bp, Homo sapiens
ctgcgcctgcccgcc

SEQ ID NO: 397609 - DNA, 16 bp, Homo sapiens
ctgcgcggatgtagca

SEQ ID NO: 397610 - DNA, 14 bp, Homo sapiens
ctgcgctcctctgc

SEQ ID NO: 397611 - DNA, 19 bp, Homo sapiens
ctgcgctcctctgcagcct

SEQ ID NO: 397612 - DNA, 21 bp, Homo sapiens
ctgcgctcctctgcagcctga

SEQ ID NO: 397613 - DNA, 14 bp, Homo sapiens
ctgcggcatcagat

SEQ ID NO: 397614 - DNA, 13 bp, Homo sapiens
ctgcggctgctgg

SEQ ID NO: 397615 - DNA, 15 bp, Homo sapiens
ctgcggctgctggca

SEQ ID NO: 397616 - DNA, 17 bp, Homo sapiens
ctgcgggcccagctgag

SEQ ID NO: 397617 - DNA, 18 bp, Homo sapiens
ctgcgggcccagctgagt

SEQ ID NO: 397618 - DNA, 15 bp, Homo sapiens
ctgcgggtctgaagg

SEQ ID NO: 397619 - DNA, 21 bp, Homo sapiens
ctgcgggtgggtatcccacct

SEQ ID NO: 397620 - DNA, 16 bp, Homo sapiens
ctgcggtgaggcaggg

SEQ ID NO: 397621 - DNA, 14 bp, Homo sapiens
ctgcgtcatggctc

SEQ ID NO: 397622 - DNA, 17 bp, Homo sapiens
ctgcgtcatggctcaag

SEQ ID NO: 397623 - DNA, 20 bp, Homo sapiens
ctgcgtctgacatcctgacc

SEQ ID NO: 397624 - DNA, 14 bp, Homo sapiens
ctgcgtggcctggg

SEQ ID NO: 397625 - DNA, 15 bp, Homo sapiens
ctgcgtggcctgggg

SEQ ID NO: 397626 - DNA, 16 bp, Homo sapiens
ctgcgtggcctggggc

SEQ ID NO: 397627 - DNA, 14 bp, Homo sapiens
ctgcgttggagcca

SEQ ID NO: 397628 - DNA, 16 bp, Homo sapiens
ctgcgttggagccact

SEQ ID NO: 397629 - DNA, 19 bp, Homo sapiens
ctgcgttggagccactcct

SEQ ID NO: 397630 - DNA, 16 bp, Homo sapiens
ctgctaataaaaccca

SEQ ID NO: 397631 - DNA, 18 bp, Homo sapiens
ctgctaataaatgaccag

SEQ ID NO: 397632 - DNA, 14 bp, Homo sapiens
ctgctaatcttcag

SEQ ID NO: 397633 - DNA, 23 bp, Homo sapiens
ctgctacaaatactcttaggaag

SEQ ID NO: 397634 - DNA, 15 bp, Homo sapiens
ctgctacagagcaga

SEQ ID NO: 397635 - DNA, 21 bp, Homo sapiens
ctgctacccagaaccttttta

SEQ ID NO: 397636 - DNA, 19 bp, Homo sapiens
ctgctaccgccctgggctg

SEQ ID NO: 397637 - DNA, 16 bp, Homo sapiens
ctgctactacccgagc

SEQ ID NO: 397638 - DNA, 17 bp, Homo sapiens
ctgctactacccgagcc

SEQ ID NO: 397639 - DNA, 19 bp, Homo sapiens
ctgctactacccgagccca

SEQ ID NO: 397640 - DNA, 16 bp, Homo sapiens
ctgctagagcaacccc

SEQ ID NO: 397641 - DNA, 21 bp, Homo sapiens
ctgctaggtagaggcatttgt

SEQ ID NO: 397642 - DNA, 22 bp, Homo sapiens
ctgctaggtagaggcatttgtc

SEQ ID NO: 397643 - DNA, 23 bp, Homo sapiens
ctgctaggtagaggcatttgtct

SEQ ID NO: 397644 - DNA, 20 bp, Homo sapiens
ctgctaggtgggccagcccc

SEQ ID NO: 397645 - DNA, 23 bp, Homo sapiens
ctgctaggtgggccagcccctcc

SEQ ID NO: 397646 - DNA, 14 bp, Homo sapiens
ctgctagtacctgt

SEQ ID NO: 397647 - DNA, 15 bp, Homo sapiens
ctgctagtacctgta

SEQ ID NO: 397648 - DNA, 17 bp, Homo sapiens
ctgctatattttcatga

SEQ ID NO: 397649 - DNA, 13 bp, Homo sapiens
ctgctatccagcc

SEQ ID NO: 397650 - DNA, 14 bp, Homo sapiens
ctgctatccagccg

SEQ ID NO: 397651 - DNA, 15 bp, Homo sapiens
ctgctatgtctgtga

SEQ ID NO: 397652 - DNA, 24 bp, Homo sapiens
ctgctatttcccaagctggagtgc

SEQ ID NO: 397653 - DNA, 22 bp, Homo sapiens
ctgctcaatgaaaccttcctct

SEQ ID NO: 397654 - DNA, 13 bp, Homo sapiens
ctgctcacattcc

SEQ ID NO: 397655 - DNA, 17 bp, Homo sapiens
ctgctcacgtctgtgag

SEQ ID NO: 397656 - DNA, 15 bp, Homo sapiens
ctgctcagctggccg

SEQ ID NO: 397657 - DNA, 18 bp, Homo sapiens
ctgctcaggcctcacctg

SEQ ID NO: 397658 - DNA, 21 bp, Homo sapiens
ctgctcaggcctcacctggct

SEQ ID NO: 397659 - DNA, 17 bp, Homo sapiens
ctgctccacagaaaccc

SEQ ID NO: 397660 - DNA, 20 bp, Homo sapiens
ctgctccacagaaaccctgt

SEQ ID NO: 397661 - DNA, 13 bp, Homo sapiens
ctgctccaccaca

SEQ ID NO: 397662 - DNA, 13 bp, Homo sapiens
ctgctccaccctt

SEQ ID NO: 397663 - DNA, 17 bp, Homo sapiens
ctgctccacccttggcc

SEQ ID NO: 397664 - DNA, 20 bp, Homo sapiens
ctgctccacccttggcctgt

SEQ ID NO: 397665 - DNA, 16 bp, Homo sapiens
ctgctccacgaagcct

SEQ ID NO: 397666 - DNA, 12 bp, Homo sapiens
ctgctccatgca

SEQ ID NO: 397667 - DNA, 17 bp, Homo sapiens
ctgctccatgcagatct

SEQ ID NO: 397668 - DNA, 21 bp, Homo sapiens
ctgctccatttataaccccag

SEQ ID NO: 397669 - DNA, 22 bp, Homo sapiens
ctgctccatttataaccccagc

SEQ ID NO: 397670 - DNA, 17 bp, Homo sapiens
ctgctcccagatgcctt

SEQ ID NO: 397671 - DNA, 22 bp, Homo sapiens
ctgctcccagcagccctaagga

SEQ ID NO: 397672 - DNA, 19 bp, Homo sapiens
ctgggaagatgctggcccc

SEQ ID NO: 397673 - DNA, 17 bp, Homo sapiens
ctgggaagcattacttt

SEQ ID NO: 397674 - DNA, 22 bp, Homo sapiens
ctgggaagctgtactcagagca

SEQ ID NO: 397675 - DNA, 18 bp, Homo sapiens
ctgggaagcttgagcctc

SEQ ID NO: 397676 - DNA, 23 bp, Homo sapiens
ctgggaagcttgagcctccccca

SEQ ID NO: 397677 - DNA, 23 bp, Homo sapiens
ctgggaaggagggagctgctcag

SEQ ID NO: 397678 - DNA, 20 bp, Homo sapiens
ctgggaagggagagttcttt

SEQ ID NO: 397679 - DNA, 18 bp, Homo sapiens
ctgggaatgtattattct

SEQ ID NO: 397680 - DNA, 16 bp, Homo sapiens
ctgggacacagaccgg

SEQ ID NO: 397681 - DNA, 12 bp, Homo sapiens
ctgggacccagc

SEQ ID NO: 397682 - DNA, 13 bp, Homo sapiens
ctgggacccagct

SEQ ID NO: 397683 - DNA, 17 bp, Homo sapiens
ctgggacccagctactc

SEQ ID NO: 397684 - DNA, 23 bp, Homo sapiens
ctgggacccagctactctgtcca

SEQ ID NO: 397685 - DNA, 21 bp, Homo sapiens
ctgggaccccccccccccccg

SEQ ID NO: 397686 - DNA, 22 bp, Homo sapiens
ctgggaccccccccccccccgc

SEQ ID NO: 397687 - DNA, 18 bp, Homo sapiens
ctgggacccctcccaacc

SEQ ID NO: 397688 - DNA, 16 bp, Homo sapiens
ctgggaccctcggggc

SEQ ID NO: 397689 - DNA, 23 bp, Homo sapiens
ctgggaccctcggggcaggaagt

SEQ ID NO: 397690 - DNA, 13 bp, Homo sapiens
ctgggactcccag

SEQ ID NO: 397691 - DNA, 14 bp, Homo sapiens
ctgggactcccagt

SEQ ID NO: 397692 - DNA, 13 bp, Homo sapiens
ctgggactgagcc

SEQ ID NO: 397693 - DNA, 15 bp, Homo sapiens
ctgggactgagccag

SEQ ID NO: 397694 - DNA, 17 bp, Homo sapiens
ctgggacttccttgctc

SEQ ID NO: 397695 - DNA, 21 bp, Homo sapiens
ctgggacttccttgctctccc

SEQ ID NO: 397696 - DNA, 12 bp, Homo sapiens
ctgggacttgaa

SEQ ID NO: 397697 - DNA, 16 bp, Homo sapiens
ctgggagaaaagccag

SEQ ID NO: 397698 - DNA, 13 bp, Homo sapiens
ctgggagaactaa

SEQ ID NO: 397699 - DNA, 23 bp, Homo sapiens
ctgggagaactaacagaggagaa

SEQ ID NO: 397700 - DNA, 17 bp, Homo sapiens
ctgggagagccaaggcc

SEQ ID NO: 397701 - DNA, 23 bp, Homo sapiens
ctgggagagccaaggcctatgcc

SEQ ID NO: 397702 - DNA, 24 bp, Homo sapiens
ctgggagaggcagagtgccccacc

SEQ ID NO: 397703 - DNA, 17 bp, Homo sapiens
ctgggagagtgaggtca

SEQ ID NO: 397704 - DNA, 16 bp, Homo sapiens
ctgggagatgctggga

SEQ ID NO: 397705 - DNA, 14 bp, Homo sapiens
ctgggagcagaaca

SEQ ID NO: 397706 - DNA, 22 bp, Homo sapiens
ctgggagccacttctccccaga

SEQ ID NO: 397707 - DNA, 14 bp, Homo sapiens
ctgggaggcaggtc

SEQ ID NO: 397708 - DNA, 14 bp, Homo sapiens
ctgggagggcaagg

SEQ ID NO: 397709 - DNA, 19 bp, Homo sapiens
ctgggagggggcccttcca

SEQ ID NO: 397710 - DNA, 13 bp, Homo sapiens
ctgggagggtggt

SEQ ID NO: 397711 - DNA, 19 bp, Homo sapiens
ctgggagggtggttcctgt

SEQ ID NO: 397712 - DNA, 18 bp, Homo sapiens
ctgggagtcagagccctg

SEQ ID NO: 397713 - DNA, 19 bp, Homo sapiens
ctgggagtcagagccctgg

SEQ ID NO: 397714 - DNA, 14 bp, Homo sapiens
ctgggagtgttctg

SEQ ID NO: 397715 - DNA, 15 bp, Homo sapiens
ctgggatcagtgggg

SEQ ID NO: 397716 - DNA, 23 bp, Homo sapiens
ctgggatggggcatgtggccaag

SEQ ID NO: 397717 - DNA, 14 bp, Homo sapiens
ctgggattcatggc

SEQ ID NO: 397718 - DNA, 21 bp, Homo sapiens
ctgggattctactttaagcac

SEQ ID NO: 397719 - DNA, 23 bp, Homo sapiens
ctgggattctactttaagcacta

SEQ ID NO: 397720 - DNA, 22 bp, Homo sapiens
ctgggatttcttcgctgctcta

SEQ ID NO: 397721 - DNA, 16 bp, Homo sapiens
ctgggatttgaaccag

SEQ ID NO: 397722 - DNA, 22 bp, Homo sapiens
ctgggcaaagccacaaggctgg

SEQ ID NO: 397723 - DNA, 18 bp, Homo sapiens
ctgggcaagtgaggcaag

SEQ ID NO: 397724 - DNA, 17 bp, Homo sapiens
ctgggcacccacctcca

SEQ ID NO: 397725 - DNA, 20 bp, Homo sapiens
ctgggcacctggggagtggg

SEQ ID NO: 397726 - DNA, 13 bp, Homo sapiens
ctgggcagagcct

SEQ ID NO: 397727 - DNA, 14 bp, Homo sapiens
ctgggcagagcctg

SEQ ID NO: 397728 - DNA, 14 bp, Homo sapiens
ctgggcagagggga

SEQ ID NO: 397729 - DNA, 17 bp, Homo sapiens
ctgggcagccaggctgc

SEQ ID NO: 397730 - DNA, 18 bp, Homo sapiens
ctgggcagcccagagaga

SEQ ID NO: 397731 - DNA, 21 bp, Homo sapiens
ctgggcagctgttagagtcca

SEQ ID NO: 397732 - DNA, 17 bp, Homo sapiens
ctgggcagggccgcagg

SEQ ID NO: 397733 - DNA, 17 bp, Homo sapiens
ctgggcaggtcctgggg

SEQ ID NO: 397734 - DNA, 22 bp, Homo sapiens
ctgggcaggtcctggggaggct

SEQ ID NO: 397735 - DNA, 23 bp, Homo sapiens
ctgggcaggtcctggggaggctg

SEQ ID NO: 397736 - DNA, 13 bp, Homo sapiens
ctgggcagtgccc

SEQ ID NO: 397737 - DNA, 21 bp, Homo sapiens
ctgggcatccccagccccctg

SEQ ID NO: 397738 - DNA, 22 bp, Homo sapiens
ctgggcatggtaccagccctgg

SEQ ID NO: 397739 - DNA, 21 bp, Homo sapiens
ctgggcatgtttgtctgtgtg

SEQ ID NO: 397740 - DNA, 15 bp, Homo sapiens
ctgggccacccttca

SEQ ID NO: 397741 - DNA, 14 bp, Homo sapiens
ctgggccactggca

SEQ ID NO: 397742 - DNA, 16 bp, Homo sapiens
ctgggccactggcatc

SEQ ID NO: 397743 - DNA, 23 bp, Homo sapiens
ctgggccactggcatctctggag

SEQ ID NO: 397744 - DNA, 18 bp, Homo sapiens
ctgggccagaagtcctcc

SEQ ID NO: 397745 - DNA, 13 bp, Homo sapiens
ctgggccagggtc

SEQ ID NO: 397746 - DNA, 14 bp, Homo sapiens
ctgggccagtggct

SEQ ID NO: 397747 - DNA, 14 bp, Homo sapiens
ctgggcccagaagg

SEQ ID NO: 397748 - DNA, 14 bp, Homo sapiens
ctgggcccagaggc

SEQ ID NO: 397749 - DNA, 20 bp, Homo sapiens
ctgggcccagaggcacagcc

SEQ ID NO: 397750 - DNA, 16 bp, Homo sapiens
ctgggcccaggcagca

SEQ ID NO: 397751 - DNA, 14 bp, Homo sapiens
ctgggccccaccta

SEQ ID NO: 397752 - DNA, 15 bp, Homo sapiens
ctgggccccacctac

SEQ ID NO: 397753 - DNA, 17 bp, Homo sapiens
ctgggccccatgctctg

SEQ ID NO: 397754 - DNA, 21 bp, Homo sapiens
ctgggccccatgctctgcccc

SEQ ID NO: 397755 - DNA, 19 bp, Homo sapiens
ctgggccccattctccctc

SEQ ID NO: 397756 - DNA, 16 bp, Homo sapiens
ctgggcccctccctac

SEQ ID NO: 397757 - DNA, 20 bp, Homo sapiens
ctgggcccgggcaggccagc

SEQ ID NO: 397758 - DNA, 15 bp, Homo sapiens
ctgggccctaggcat

SEQ ID NO: 397759 - DNA, 23 bp, Homo sapiens
ctgggccctaggcatactctcca

SEQ ID NO: 397760 - DNA, 18 bp, Homo sapiens
ctgggccctgcaggaggc

SEQ ID NO: 397761 - DNA, 19 bp, Homo sapiens
ctgggccctgcaggaggcc

SEQ ID NO: 397762 - DNA, 22 bp, Homo sapiens
ctgggccctgcaggaggcctgg

SEQ ID NO: 397763 - DNA, 14 bp, Homo sapiens
ctgggccctggttc

SEQ ID NO: 397764 - DNA, 15 bp, Homo sapiens
ctgggccctggttcc

SEQ ID NO: 397765 - DNA, 20 bp, Homo sapiens
ctgggccctggttcccccag

SEQ ID NO: 397766 - DNA, 18 bp, Homo sapiens
ctgggcctcccttgggct

SEQ ID NO: 397767 - DNA, 19 bp, Homo sapiens
ctgggcctcccttgggctg

SEQ ID NO: 397768 - DNA, 23 bp, Homo sapiens
ctgggcctcctctaacaggggct

SEQ ID NO: 397769 - DNA, 19 bp, Homo sapiens
gttaatgtactctttggct

SEQ ID NO: 397770 - DNA, 22 bp, Homo sapiens
gttaattaaagtaaaattattc

SEQ ID NO: 397771 - DNA, 19 bp, Homo sapiens
gttaattccaattatatga

SEQ ID NO: 397772 - DNA, 19 bp, Homo sapiens
gttaattgattaaactgta

SEQ ID NO: 397773 - DNA, 9 bp, Homo sapiens
gttaattta

SEQ ID NO: 397774 - DNA, 22 bp, Homo sapiens
gttacaccctttcttgacaaaa

SEQ ID NO: 397775 - DNA, 13 bp, Homo sapiens
gttacagctcccc

SEQ ID NO: 397776 - DNA, 16 bp, Homo sapiens
gttacaggtgtactat

SEQ ID NO: 397777 - DNA, 17 bp, Homo sapiens
gttacagtgcagacagg

SEQ ID NO: 397778 - DNA, 14 bp, Homo sapiens
gttacatagaaagt

SEQ ID NO: 397779 - DNA, 14 bp, Homo sapiens
gttacattaatgtt

SEQ ID NO: 397780 - DNA, 16 bp, Homo sapiens
gttacattaatgttaa

SEQ ID NO: 397781 - DNA, 15 bp, Homo sapiens
gttaccgagtatctg

SEQ ID NO: 397782 - DNA, 17 bp, Homo sapiens
gttaccgagtatctgta

SEQ ID NO: 397783 - DNA, 18 bp, Homo sapiens
gttaccgagtatctgtaa

SEQ ID NO: 397784 - DNA, 10 bp, Homo sapiens
gttacctaat

SEQ ID NO: 397785 - DNA, 17 bp, Homo sapiens
gttacctaggttaacaa

SEQ ID NO: 397786 - DNA, 15 bp, Homo sapiens
gttacctcctataaa

SEQ ID NO: 397787 - DNA, 17 bp, Homo sapiens
gttacctcctataaact

SEQ ID NO: 397788 - DNA, 23 bp, Homo sapiens
gttacctttctaggtcaaggcct

SEQ ID NO: 397789 - DNA, 21 bp, Homo sapiens
gttacggcagtcacactgctg

SEQ ID NO: 397790 - DNA, 16 bp, Homo sapiens
gttactaatatgccta

SEQ ID NO: 397791 - DNA, 17 bp, Homo sapiens
gttactgaaatgagcct

SEQ ID NO: 397792 - DNA, 18 bp, Homo sapiens
gttactgatcatgcattg

SEQ ID NO: 397793 - DNA, 13 bp, Homo sapiens
gttactggtttca

SEQ ID NO: 397794 - DNA, 17 bp, Homo sapiens
gttactgtctgtagtgt

SEQ ID NO: 397795 - DNA, 19 bp, Homo sapiens
gttactgtctgtagtgttt

SEQ ID NO: 397796 - DNA, 13 bp, Homo sapiens
gttacttcctatc

SEQ ID NO: 397797 - DNA, 15 bp, Homo sapiens
gttagaatgaggagg

SEQ ID NO: 397798 - DNA, 14 bp, Homo sapiens
gttagatgctacta

SEQ ID NO: 397799 - DNA, 18 bp, Homo sapiens
gttagcccggccaaggac

SEQ ID NO: 397800 - DNA, 23 bp, Homo sapiens
gttagcccggccaaggacactga

SEQ ID NO: 397801 - DNA, 21 bp, Homo sapiens
gttagctcagccccagcccag

SEQ ID NO: 397802 - DNA, 22 bp, Homo sapiens
ctgggctgttttagtgccaggc

SEQ ID NO: 397803 - DNA, 13 bp, Homo sapiens
ctgggcttaagtt

SEQ ID NO: 397804 - DNA, 20 bp, Homo sapiens
ctgggcttggggcttcctaa

SEQ ID NO: 397805 - DNA, 20 bp, Homo sapiens
ctgggctttgattccatctc

SEQ ID NO: 397806 - DNA, 21 bp, Homo sapiens
ctgggctttgattccatctcc

SEQ ID NO: 397807 - DNA, 16 bp, Homo sapiens
ctggggaagaggcctt

SEQ ID NO: 397808 - DNA, 19 bp, Homo sapiens
ctggggaagaggccttggg

SEQ ID NO: 397809 - DNA, 15 bp, Homo sapiens
ctggggaaggaccaa

SEQ ID NO: 397810 - DNA, 15 bp, Homo sapiens
ctggggaccaggagc

SEQ ID NO: 397811 - DNA, 16 bp, Homo sapiens
ctggggaccaggagct

SEQ ID NO: 397812 - DNA, 19 bp, Homo sapiens
ctggggacgccaaggaggt

SEQ ID NO: 397813 - DNA, 14 bp, Homo sapiens
ctggggactctgct

SEQ ID NO: 397814 - DNA, 15 bp, Homo sapiens
ctggggagaccgagt

SEQ ID NO: 397815 - DNA, 15 bp, Homo sapiens
ctggggaggctgaga

SEQ ID NO: 397816 - DNA, 20 bp, Homo sapiens
ctggggaggctgagactgca

SEQ ID NO: 397817 - DNA, 12 bp, Homo sapiens
ctggggagggag

SEQ ID NO: 397818 - DNA, 14 bp, Homo sapiens
ctggggagggagag

SEQ ID NO: 397819 - DNA, 12 bp, Homo sapiens
ctggggagtccc

SEQ ID NO: 397820 - DNA, 17 bp, Homo sapiens
ctggggagtgagcttgg

SEQ ID NO: 397821 - DNA, 13 bp, Homo sapiens
ctggggagtgctg

SEQ ID NO: 397822 - DNA, 17 bp, Homo sapiens
ctggggagtgggacaga

SEQ ID NO: 397823 - DNA, 21 bp, Homo sapiens
ctggggatggagaatgccagc

SEQ ID NO: 397824 - DNA, 20 bp, Homo sapiens
ctggggatgtaaccaagctg

SEQ ID NO: 397825 - DNA, 17 bp, Homo sapiens
ctggggcagaggggcag

SEQ ID NO: 397826 - DNA, 21 bp, Homo sapiens
ctggggcagaggggcagccgc

SEQ ID NO: 397827 - DNA, 22 bp, Homo sapiens
ctggggcagaggggcagccgct

SEQ ID NO: 397828 - DNA, 24 bp, Homo sapiens
ctggggcagaggggcagccgctag

SEQ ID NO: 397829 - DNA, 20 bp, Homo sapiens
ctggggcatgtgtgcctgtg

SEQ ID NO: 397830 - DNA, 16 bp, Homo sapiens
ctggggccgaaagaac

SEQ ID NO: 397831 - DNA, 22 bp, Homo sapiens
ctggggccgaggggccagggtg

SEQ ID NO: 397832 - DNA, 19 bp, Homo sapiens
ctggggcctggacctgcct

SEQ ID NO: 397833 - DNA, 13 bp, Homo sapiens
ctggggcctggcc

SEQ ID NO: 397834 - DNA, 22 bp, Homo sapiens
ctggggctcccttcatctccag

SEQ ID NO: 397835 - DNA, 13 bp, Homo sapiens
ctggggctggcac

SEQ ID NO: 397836 - DNA, 12 bp, Homo sapiens
ctggggctgggc

SEQ ID NO: 397837 - DNA, 13 bp, Homo sapiens
ctggggctgggcc

SEQ ID NO: 397838 - DNA, 18 bp, Homo sapiens
ctggggcttcaccagtct

SEQ ID NO: 397839 - DNA, 15 bp, Homo sapiens
ctggggcttctcctg

SEQ ID NO: 397840 - DNA, 16 bp, Homo sapiens
ctggggcttctcctga

SEQ ID NO: 397841 - DNA, 15 bp, Homo sapiens
ctgggggactgggag

SEQ ID NO: 397842 - DNA, 17 bp, Homo sapiens
ctgggggactgggagtc

SEQ ID NO: 397843 - DNA, 12 bp, Homo sapiens
ctgggggcagga

SEQ ID NO: 397844 - DNA, 19 bp, Homo sapiens
ctgggggcaggagggccct

SEQ ID NO: 397845 - DNA, 12 bp, Homo sapiens
ctgggggcagtg

SEQ ID NO: 397846 - DNA, 17 bp, Homo sapiens
ctgggggccatgagctc

SEQ ID NO: 397847 - DNA, 22 bp, Homo sapiens
ctgggggccatgagctccagac

SEQ ID NO: 397848 - DNA, 14 bp, Homo sapiens
ctgggggcctcact

SEQ ID NO: 397849 - DNA, 16 bp, Homo sapiens
ctgggggcctcactcc

SEQ ID NO: 397850 - DNA, 15 bp, Homo sapiens
ctgggggcctctgcc

SEQ ID NO: 397851 - DNA, 18 bp, Homo sapiens
ctgggggcctctgcctcc

SEQ ID NO: 397852 - DNA, 21 bp, Homo sapiens
ctggggggaaggcgatgtggt

SEQ ID NO: 397853 - DNA, 14 bp, Homo sapiens
ctggggggcacagc

SEQ ID NO: 397854 - DNA, 16 bp, Homo sapiens
ctggggggcacagcca

SEQ ID NO: 397855 - DNA, 19 bp, Homo sapiens
ctggggggctgtcctgagc

SEQ ID NO: 397856 - DNA, 16 bp, Homo sapiens
ctgggggtcaggaggc

SEQ ID NO: 397857 - DNA, 19 bp, Homo sapiens
ctggggtacacagtgagag

SEQ ID NO: 397858 - DNA, 14 bp, Homo sapiens
ctggggtaccacat

SEQ ID NO: 397859 - DNA, 15 bp, Homo sapiens
ctggggtccccactc

SEQ ID NO: 397860 - DNA, 22 bp, Homo sapiens
ctggggtccccactccctgtcc

SEQ ID NO: 397861 - DNA, 20 bp, Homo sapiens
ctggggtgatgttttacttt

SEQ ID NO: 397862 - DNA, 19 bp, Homo sapiens
ctggggtgccctccactgc

SEQ ID NO: 397863 - DNA, 21 bp, Homo sapiens
ctggggtgccctccactgccc

SEQ ID NO: 397864 - DNA, 21 bp, Homo sapiens
ctggggtggcgtctgcctagg

SEQ ID NO: 397865 - DNA, 15 bp, Homo sapiens
ctggggtggggcttg

SEQ ID NO: 397866 - DNA, 21 bp, Homo sapiens
ctggggtgggtttagcaggct

SEQ ID NO: 397867 - DNA, 20 bp, Homo sapiens
ctggggtggttggaggcctg

SEQ ID NO: 397868 - DNA, 21 bp, Homo sapiens
ctggggtttccacacaggccc

SEQ ID NO: 397869 - DNA, 15 bp, Homo sapiens
ctggggtttttttca

SEQ ID NO: 397870 - DNA, 16 bp, Homo sapiens
ctgggtacgagggatg

SEQ ID NO: 397871 - DNA, 20 bp, Homo sapiens
ctgggtaggtgttgaaaatg

SEQ ID NO: 397872 - DNA, 19 bp, Homo sapiens
ctgggtcaccttcctgggc

SEQ ID NO: 397873 - DNA, 16 bp, Homo sapiens
ctgggtcagcttgaat

SEQ ID NO: 397874 - DNA, 19 bp, Homo sapiens
ctgggtcggccctgcccaa

SEQ ID NO: 397875 - DNA, 15 bp, Homo sapiens
ctgggtctcactcct

SEQ ID NO: 397876 - DNA, 23 bp, Homo sapiens
ctgggtgacagagcgagactctg

SEQ ID NO: 397877 - DNA, 24 bp, Homo sapiens
ctgggtgagaatcctgcctctccc

SEQ ID NO: 397878 - DNA, 13 bp, Homo sapiens
ctgggtgatttct

SEQ ID NO: 397879 - DNA, 16 bp, Homo sapiens
ctgggtgcccacagcc

SEQ ID NO: 397880 - DNA, 14 bp, Homo sapiens
ctgggtgcctccca

SEQ ID NO: 397881 - DNA, 11 bp, Homo sapiens
ctgggtggcct

SEQ ID NO: 397882 - DNA, 13 bp, Homo sapiens
ctgggtgggccca

SEQ ID NO: 397883 - DNA, 14 bp, Homo sapiens
ctgggtgggcccag

SEQ ID NO: 397884 - DNA, 16 bp, Homo sapiens
ctgggtggggtgagga

SEQ ID NO: 397885 - DNA, 13 bp, Homo sapiens
ctgggtggtcagc

SEQ ID NO: 397886 - DNA, 20 bp, Homo sapiens
ctgggtgtgtgagtgggagg

SEQ ID NO: 397887 - DNA, 21 bp, Homo sapiens
ctgggttcagaaatgctgcct

SEQ ID NO: 397888 - DNA, 23 bp, Homo sapiens
ctgggttcagaaatgctgcctgc

SEQ ID NO: 397889 - DNA, 16 bp, Homo sapiens
ctgggttccctttcct

SEQ ID NO: 397890 - DNA, 21 bp, Homo sapiens
ctgggttccctttccttccat

SEQ ID NO: 397891 - DNA, 18 bp, Homo sapiens
ctgggttctcttcattcc

SEQ ID NO: 397892 - DNA, 19 bp, Homo sapiens
ctgggttctcttcattccc

SEQ ID NO: 397893 - DNA, 22 bp, Homo sapiens
ctgggtttacaacaaacactgt

SEQ ID NO: 397894 - DNA, 19 bp, Homo sapiens
ctgggtttccacacagcct

SEQ ID NO: 397895 - DNA, 19 bp, Homo sapiens
ctggtaaactatttgtctt

SEQ ID NO: 397896 - DNA, 12 bp, Homo sapiens
ctggtaagcaaa

SEQ ID NO: 397897 - DNA, 14 bp, Homo sapiens
ctggtagagatgga

SEQ ID NO: 397898 - DNA, 16 bp, Homo sapiens
ctggtagcatgacctt

SEQ ID NO: 397899 - DNA, 18 bp, Homo sapiens
ctggtagcatgacctttt

SEQ ID NO: 397900 - DNA, 23 bp, Homo sapiens
ctggtagcatgaccttttggcct

SEQ ID NO: 397901 - DNA, 23 bp, Homo sapiens
ctggtaggaagaggtaccacagg

SEQ ID NO: 397902 - DNA, 20 bp, Homo sapiens
ctggtaggaatagcatgtca

SEQ ID NO: 397903 - DNA, 17 bp, Homo sapiens
ctggtaggttctgtctg

SEQ ID NO: 397904 - DNA, 23 bp, Homo sapiens
ctggtatgaacttgaggacacat

SEQ ID NO: 397905 - DNA, 13 bp, Homo sapiens
ctggtattctctc

SEQ ID NO: 397906 - DNA, 18 bp, Homo sapiens
ctggtattctctctatgc

SEQ ID NO: 397907 - DNA, 19 bp, Homo sapiens
ctggtcaacccgctgcttc

SEQ ID NO: 397908 - DNA, 21 bp, Homo sapiens
ctggtcaacccgctgcttcca

SEQ ID NO: 397909 - DNA, 20 bp, Homo sapiens
ctggtcaacttgagcatgtt

SEQ ID NO: 397910 - DNA, 19 bp, Homo sapiens
ctggtcaagccccctttga

SEQ ID NO: 397911 - DNA, 16 bp, Homo sapiens
ctggtcacccccaccc

SEQ ID NO: 397912 - DNA, 15 bp, Homo sapiens
ctggtcagcagagcc

SEQ ID NO: 397913 - DNA, 19 bp, Homo sapiens
ctggtcatcagtattgtgt

SEQ ID NO: 397914 - DNA, 20 bp, Homo sapiens
ctggtccaggcatgggtccc

SEQ ID NO: 397915 - DNA, 13 bp, Homo sapiens
gttgattctttca

SEQ ID NO: 397916 - DNA, 13 bp, Homo sapiens
gttgcaaccactg

SEQ ID NO: 397917 - DNA, 19 bp, Homo sapiens
gttgcacagtccctcctgt

SEQ ID NO: 397918 - DNA, 14 bp, Homo sapiens
gttgcaccattctt

SEQ ID NO: 397919 - DNA, 15 bp, Homo sapiens
gttgcactgaaaacc

SEQ ID NO: 397920 - DNA, 23 bp, Homo sapiens
gttgcagccctgctgctgcctgc

SEQ ID NO: 397921 - DNA, 11 bp, Homo sapiens
gttgcatggta

SEQ ID NO: 397922 - DNA, 14 bp, Homo sapiens
gttgccaaagctgg

SEQ ID NO: 397923 - DNA, 13 bp, Homo sapiens
gttgccaagctgg

SEQ ID NO: 397924 - DNA, 13 bp, Homo sapiens
gttgccacaggac

SEQ ID NO: 397925 - DNA, 14 bp, Homo sapiens
gttgccacaggaca

SEQ ID NO: 397926 - DNA, 16 bp, Homo sapiens
gttgccacaggacaca

SEQ ID NO: 397927 - DNA, 17 bp, Homo sapiens
gttgccaggttgcagct

SEQ ID NO: 397928 - DNA, 18 bp, Homo sapiens
gttgccaggttgcagctg

SEQ ID NO: 397929 - DNA, 20 bp, Homo sapiens
gttgccaggttgcagctgct

SEQ ID NO: 397930 - DNA, 15 bp, Homo sapiens
gttgcccaggctgga

SEQ ID NO: 397931 - DNA, 22 bp, Homo sapiens
gttgccgtgagccaagatcacg

SEQ ID NO: 397932 - DNA, 14 bp, Homo sapiens
ctgtagggaactct

SEQ ID NO: 397933 - DNA, 21 bp, Homo sapiens
ctgtagggctggacctatgtc

SEQ ID NO: 397934 - DNA, 14 bp, Homo sapiens
ctgtaggttgctta

SEQ ID NO: 397935 - DNA, 22 bp, Homo sapiens
ctgtaggttgcttaaaagggac

SEQ ID NO: 397936 - DNA, 13 bp, Homo sapiens
ctgtagtcacttt

SEQ ID NO: 397937 - DNA, 18 bp, Homo sapiens
ctgtagtcccagctactt

SEQ ID NO: 397938 - DNA, 21 bp, Homo sapiens
ctgtagtgcccctcccatggc

SEQ ID NO: 397939 - DNA, 24 bp, Homo sapiens
ctgtagtgcccctcccatggccca

SEQ ID NO: 397940 - DNA, 17 bp, Homo sapiens
ctgtagtgttttgtgga

SEQ ID NO: 397941 - DNA, 13 bp, Homo sapiens
ctgtagttaggaa

SEQ ID NO: 397942 - DNA, 22 bp, Homo sapiens
ctgtagttaggaaataaaacct

SEQ ID NO: 397943 - DNA, 21 bp, Homo sapiens
ctgtagtttatggcagaaggg

SEQ ID NO: 397944 - DNA, 23 bp, Homo sapiens
ctgtagtttatggcagaagggaa

SEQ ID NO: 397945 - DNA, 21 bp, Homo sapiens
ctgtataaaatgcaaaataaa

SEQ ID NO: 397946 - DNA, 17 bp, Homo sapiens
ctgtatacaaacaggtg

SEQ ID NO: 397947 - DNA, 14 bp, Homo sapiens
ctgtatagcaacct

SEQ ID NO: 397948 - DNA, 24 bp, Homo sapiens
ctgtatagcaacctatttgactgc

SEQ ID NO: 397949 - DNA, 14 bp, Homo sapiens
ctgtatatgttgta

SEQ ID NO: 397950 - DNA, 19 bp, Homo sapiens
ctgtatcaacccagaaaca

SEQ ID NO: 397951 - DNA, 19 bp, Homo sapiens
ctgtatgatttaggcttct

SEQ ID NO: 397952 - DNA, 9 bp, Homo sapiens
ctgtatgtc

SEQ ID NO: 397953 - DNA, 16 bp, Homo sapiens
ctgtatgtctgcctaa

SEQ ID NO: 397954 - DNA, 17 bp, Homo sapiens
ctgtatgtcttataaga

SEQ ID NO: 397955 - DNA, 16 bp, Homo sapiens
ctgtattcgtgcattt

SEQ ID NO: 397956 - DNA, 21 bp, Homo sapiens
ctgtattctgcaacagcctgt

SEQ ID NO: 397957 - DNA, 21 bp, Homo sapiens
ctgtattgtgctgattgtgga

SEQ ID NO: 397958 - DNA, 19 bp, Homo sapiens
ctgtattgttacagctgaa

SEQ ID NO: 397959 - DNA, 17 bp, Homo sapiens
ctgtatttatgtgtgag

SEQ ID NO: 397960 - DNA, 15 bp, Homo sapiens
ctgtatttctgtgga

SEQ ID NO: 397961 - DNA, 17 bp, Homo sapiens
ctgtattttcaggaagg

SEQ ID NO: 397962 - DNA, 19 bp, Homo sapiens
ctgtcaagattaagttata

SEQ ID NO: 397963 - DNA, 16 bp, Homo sapiens
ctgtcaattacaggaa

SEQ ID NO: 397964 - DNA, 19 bp, Homo sapiens
ctgtcaccacatcttgtct

SEQ ID NO: 397965 - DNA, 21 bp, Homo sapiens
ctgtcaccacatcttgtcttt

SEQ ID NO: 397966 - DNA, 16 bp, Homo sapiens
ctgtcaccgccatgca

SEQ ID NO: 397967 - DNA, 18 bp, Homo sapiens
ctgtcacgctctggtgca

SEQ ID NO: 397968 - DNA, 12 bp, Homo sapiens
ctgtcactactg

SEQ ID NO: 397969 - DNA, 13 bp, Homo sapiens
ctgtcactactgg

SEQ ID NO: 397970 - DNA, 13 bp, Homo sapiens
ctgtcactcagct

SEQ ID NO: 397971 - DNA, 15 bp, Homo sapiens
ctgtcactcagctga

SEQ ID NO: 397972 - DNA, 17 bp, Homo sapiens
ctgtcactcagctgaga

SEQ ID NO: 397973 - DNA, 20 bp, Homo sapiens
ctgtcagaccttcttccaca

SEQ ID NO: 397974 - DNA, 15 bp, Homo sapiens
ctgtcagagccgcca

SEQ ID NO: 397975 - DNA, 12 bp, Homo sapiens
ctgtcagaggct

SEQ ID NO: 397976 - DNA, 14 bp, Homo sapiens
ctgtcagctgagct

SEQ ID NO: 397977 - DNA, 15 bp, Homo sapiens
ctgtcagcttcccaa

SEQ ID NO: 397978 - DNA, 19 bp, Homo sapiens
ctgtcagcttcccaacaat

SEQ ID NO: 397979 - DNA, 20 bp, Homo sapiens
ctgtcagcttcccaacaata

SEQ ID NO: 397980 - DNA, 22 bp, Homo sapiens
ctgtcaggcagtagcagctgtg

SEQ ID NO: 397981 - DNA, 16 bp, Homo sapiens
ctgtcagtatgacatt

SEQ ID NO: 397982 - DNA, 15 bp, Homo sapiens
ctgtcagtgcagccc

SEQ ID NO: 397983 - DNA, 15 bp, Homo sapiens
ctgtcatgaacatgt

SEQ ID NO: 397984 - DNA, 18 bp, Homo sapiens
ctgtccaaaggaggctgg

SEQ ID NO: 397985 - DNA, 22 bp, Homo sapiens
ctgtccaaaggaggctggcagg

SEQ ID NO: 397986 - DNA, 19 bp, Homo sapiens
ctgtccaagtgtttcttgt

SEQ ID NO: 397987 - DNA, 19 bp, Homo sapiens
ctgtccacctgtgctgctg

SEQ ID NO: 397988 - DNA, 17 bp, Homo sapiens
ctgtccaggcactgctg

SEQ ID NO: 397989 - DNA, 19 bp, Homo sapiens
ctgtccaggcactgctgcc

SEQ ID NO: 397990 - DNA, 21 bp, Homo sapiens
ctgtccaggcactgctgccca

SEQ ID NO: 397991 - DNA, 12 bp, Homo sapiens
ctgtccaggcca

SEQ ID NO: 397992 - DNA, 13 bp, Homo sapiens
ctgtccaggccac

SEQ ID NO: 397993 - DNA, 15 bp, Homo sapiens
ctgtccaggccactg

SEQ ID NO: 397994 - DNA, 20 bp, Homo sapiens
ctgtccaggccactgtggcc

SEQ ID NO: 397995 - DNA, 16 bp, Homo sapiens
ctgtccagggcttcag

SEQ ID NO: 397996 - DNA, 17 bp, Homo sapiens
ctgtccagggcttcaga

SEQ ID NO: 397997 - DNA, 18 bp, Homo sapiens
ctgtccagggcttcagat

SEQ ID NO: 397998 - DNA, 20 bp, Homo sapiens
ctgtccatctgtctgtccta

SEQ ID NO: 397999 - DNA, 21 bp, Homo sapiens
ctgtcccacaaaatatttcta

SEQ ID NO: 398000 - DNA, 19 bp, Homo sapiens
ctgtcccaccaactctgca

SEQ ID NO: 398001 - DNA, 13 bp, Homo sapiens
ctgtcccacctca

SEQ ID NO: 398002 - DNA, 12 bp, Homo sapiens
ctgtcccactgg

SEQ ID NO: 398003 - DNA, 13 bp, Homo sapiens
ctgtcccactggg

SEQ ID NO: 398004 - DNA, 11 bp, Homo sapiens
ctgtcccagag

SEQ ID NO: 398005 - DNA, 13 bp, Homo sapiens
ctgtcccagagct

SEQ ID NO: 398006 - DNA, 23 bp, Homo sapiens
ctgtcccagaggttatctgcctg

SEQ ID NO: 398007 - DNA, 15 bp, Homo sapiens
ctgtcccattctaga

SEQ ID NO: 398008 - DNA, 19 bp, Homo sapiens
ctgtccccagccctgtcct

SEQ ID NO: 398009 - DNA, 23 bp, Homo sapiens
ctgtccccagccctgtcctggtt

SEQ ID NO: 398010 - DNA, 17 bp, Homo sapiens
ctgtccccctacccacc

SEQ ID NO: 398011 - DNA, 18 bp, Homo sapiens
ctgtccccctacccaccg

SEQ ID NO: 398012 - DNA, 20 bp, Homo sapiens
ctgtccccctcccctcccag

SEQ ID NO: 398013 - DNA, 23 bp, Homo sapiens
ctgtccccctcccctcccagtcc

SEQ ID NO: 398014 - DNA, 23 bp, Homo sapiens
ctgtccccgagccgagctctcct

SEQ ID NO: 398015 - DNA, 16 bp, Homo sapiens
ctgtccccttccaggg

SEQ ID NO: 398016 - DNA, 15 bp, Homo sapiens
ctgtcccgccttcct

SEQ ID NO: 398017 - DNA, 19 bp, Homo sapiens
ctgtcccggttcaccttgc

SEQ ID NO: 398018 - DNA, 13 bp, Homo sapiens
ctgtccctaccac

SEQ ID NO: 398019 - DNA, 18 bp, Homo sapiens
ctgtccctgccccgcccc

SEQ ID NO: 398020 - DNA, 19 bp, Homo sapiens
ctgtcccttcccccataag

SEQ ID NO: 398021 - DNA, 20 bp, Homo sapiens
ctgtcccttgcctcaatgcc

SEQ ID NO: 398022 - DNA, 16 bp, Homo sapiens
ctgtccgcctctgccc

SEQ ID NO: 398023 - DNA, 18 bp, Homo sapiens
ctgtccgcctctgcccgc

SEQ ID NO: 398024 - DNA, 20 bp, Homo sapiens
ctgtccgcctctgcccgcag

SEQ ID NO: 398025 - DNA, 15 bp, Homo sapiens
ctgtcctacccgccc

SEQ ID NO: 398026 - DNA, 15 bp, Homo sapiens
ctgtcctaggtgacc

SEQ ID NO: 398027 - DNA, 15 bp, Homo sapiens
ctgtcctccagaggg

SEQ ID NO: 398028 - DNA, 22 bp, Homo sapiens
ctgtcctctcagaactcctgtg

SEQ ID NO: 398029 - DNA, 16 bp, Homo sapiens
ctgtcctctttcagaa

SEQ ID NO: 398030 - DNA, 20 bp, Homo sapiens
ctgtcctctttcagaaaaca

SEQ ID NO: 398031 - DNA, 12 bp, Homo sapiens
ctgtcctgagcc

SEQ ID NO: 398032 - DNA, 13 bp, Homo sapiens
ctgtcctgagccc

SEQ ID NO: 398033 - DNA, 18 bp, Homo sapiens
ctgtcctgagccccctgc

SEQ ID NO: 398034 - DNA, 21 bp, Homo sapiens
ctgtcctgagccccctgcacc

SEQ ID NO: 398035 - DNA, 21 bp, Homo sapiens
ctgtcctgcagtagaaggtgc

SEQ ID NO: 398036 - DNA, 11 bp, Homo sapiens
ctgtcctgggc

SEQ ID NO: 398037 - DNA, 12 bp, Homo sapiens
ctgtcctgggcg

SEQ ID NO: 398038 - DNA, 13 bp, Homo sapiens
ctgtcctgggcgc

SEQ ID NO: 398039 - DNA, 22 bp, Homo sapiens
ctgtcctgggcgccctggaagc

SEQ ID NO: 398040 - DNA, 14 bp, Homo sapiens
ctgtcctggtacag

SEQ ID NO: 398041 - DNA, 20 bp, Homo sapiens
ctgtcctggtacagcagggt

SEQ ID NO: 398042 - DNA, 17 bp, Homo sapiens
ctgtccttagactcctt

SEQ ID NO: 398043 - DNA, 16 bp, Homo sapiens
ctgtccttcagatgga

SEQ ID NO: 398044 - DNA, 17 bp, Homo sapiens
ctgtccttcagatggaa

SEQ ID NO: 398045 - DNA, 19 bp, Homo sapiens
ctgtccttcccacggccac

SEQ ID NO: 398046 - DNA, 23 bp, Homo sapiens
ctgtccttcccacggccactgca

SEQ ID NO: 398047 - DNA, 14 bp, Homo sapiens
ctgtcggagaggct

SEQ ID NO: 398048 - DNA, 20 bp, Homo sapiens
ctgtcgtccccctccagtgc

SEQ ID NO: 398049 - DNA, 12 bp, Homo sapiens
ctgtcgtgccag

SEQ ID NO: 398050 - DNA, 15 bp, Homo sapiens
ctgtcgtgccagtcc

SEQ ID NO: 398051 - DNA, 19 bp, Homo sapiens
ctgtcgtgccagtcctggg

SEQ ID NO: 398052 - DNA, 22 bp, Homo sapiens
ctgtcgttctccacccaccagt

SEQ ID NO: 398053 - DNA, 19 bp, Homo sapiens
ctgtctaacctacgacccc

SEQ ID NO: 398054 - DNA, 14 bp, Homo sapiens
ctgtctaagaataa

SEQ ID NO: 398055 - DNA, 22 bp, Homo sapiens
ctgtctaatgaaacctgtgtct

SEQ ID NO: 398056 - DNA, 17 bp, Homo sapiens
ctgtctaccatctccct

SEQ ID NO: 398057 - DNA, 15 bp, Homo sapiens
ctgtctactgtggtg

SEQ ID NO: 398058 - DNA, 16 bp, Homo sapiens
ctgtctactgtggtga

SEQ ID NO: 398059 - DNA, 18 bp, Homo sapiens
ctgtctcaagagggcact

SEQ ID NO: 398060 - DNA, 19 bp, Homo sapiens
ctgtctcaagagggcactg

SEQ ID NO: 398061 - DNA, 21 bp, Homo sapiens
ctgtctcaagagggcactggt

SEQ ID NO: 398062 - DNA, 23 bp, Homo sapiens
taaagaactccttattttgtatt

SEQ ID NO: 398063 - DNA, 18 bp, Homo sapiens
taaagaagacacacagcc

SEQ ID NO: 398064 - DNA, 14 bp, Homo sapiens
taaagacataggaa

SEQ ID NO: 398065 - DNA, 18 bp, Homo sapiens
taaagaccatttagtcct

SEQ ID NO: 398066 - DNA, 20 bp, Homo sapiens
taaagacttaagattaaatt

SEQ ID NO: 398067 - DNA, 18 bp, Homo sapiens
taaagacttgatgaataa

SEQ ID NO: 398068 - DNA, 23 bp, Homo sapiens
taaagacttgatgaataaacact

SEQ ID NO: 398069 - DNA, 17 bp, Homo sapiens
taaagagacaaatagta

SEQ ID NO: 398070 - DNA, 13 bp, Homo sapiens
taaagagaggtta

SEQ ID NO: 398071 - DNA, 19 bp, Homo sapiens
taaagagctaggaaagagt

SEQ ID NO: 398072 - DNA, 22 bp, Homo sapiens
taaagaggaagccttgcccagc

SEQ ID NO: 398073 - DNA, 23 bp, Homo sapiens
taaagaggcgtcttgtattttct

SEQ ID NO: 398074 - DNA, 20 bp, Homo sapiens
taaagaggtggggtgaagct

SEQ ID NO: 398075 - DNA, 19 bp, Homo sapiens
ctgtgcctccccccagacc

SEQ ID NO: 398076 - DNA, 12 bp, Homo sapiens
ctgtgcctctgc

SEQ ID NO: 398077 - DNA, 14 bp, Homo sapiens
ctgtgcctctgcct

SEQ ID NO: 398078 - DNA, 16 bp, Homo sapiens
ctgtgcctctgcctgt

SEQ ID NO: 398079 - DNA, 11 bp, Homo sapiens
ctgtgcctgct

SEQ ID NO: 398080 - DNA, 13 bp, Homo sapiens
ctgtgcctgctag

SEQ ID NO: 398081 - DNA, 16 bp, Homo sapiens
ctgtgcctgctagagc

SEQ ID NO: 398082 - DNA, 18 bp, Homo sapiens
ctgtgcctggagctcctg

SEQ ID NO: 398083 - DNA, 21 bp, Homo sapiens
ctgtgcctttgagtttcctca

SEQ ID NO: 398084 - DNA, 15 bp, Homo sapiens
ctgtgctaagttgtc

SEQ ID NO: 398085 - DNA, 17 bp, Homo sapiens
ctgtgctaagttgtctt

SEQ ID NO: 398086 - DNA, 15 bp, Homo sapiens
ctgtgctacagagaa

SEQ ID NO: 398087 - DNA, 19 bp, Homo sapiens
ctgtgctacagagaaaatc

SEQ ID NO: 398088 - DNA, 14 bp, Homo sapiens
ctgtgctacctcta

SEQ ID NO: 398089 - DNA, 19 bp, Homo sapiens
ctgtgctacctctaacacc

SEQ ID NO: 398090 - DNA, 21 bp, Homo sapiens
ctgtgctacctctaacaccac

SEQ ID NO: 398091 - DNA, 20 bp, Homo sapiens
ctgtgctagttttacagatt

SEQ ID NO: 398092 - DNA, 14 bp, Homo sapiens
ctgtgctcacccat

SEQ ID NO: 398093 - DNA, 21 bp, Homo sapiens
ctgtgctcatcggagactgcc

SEQ ID NO: 398094 - DNA, 20 bp, Homo sapiens
ctgtgctccagcagtgctgg

SEQ ID NO: 398095 - DNA, 20 bp, Homo sapiens
ctgtgctcctaaaggcagca

SEQ ID NO: 398096 - DNA, 22 bp, Homo sapiens
ctgtgctcttttggtggggagc

SEQ ID NO: 398097 - DNA, 14 bp, Homo sapiens
ctgtgctgcatgcg

SEQ ID NO: 398098 - DNA, 20 bp, Homo sapiens
ctgtgctgctgttactgtta

SEQ ID NO: 398099 - DNA, 16 bp, Homo sapiens
ctgtgctgtgcctgct

SEQ ID NO: 398100 - DNA, 15 bp, Homo sapiens
ctgtgcttgctccta

SEQ ID NO: 398101 - DNA, 19 bp, Homo sapiens
ctgtgcttgctcctaagca

SEQ ID NO: 398102 - DNA, 18 bp, Homo sapiens
ctgtgctttctgcatgct

SEQ ID NO: 398103 - DNA, 17 bp, Homo sapiens
ctgtggagagtgagaat

SEQ ID NO: 398104 - DNA, 22 bp, Homo sapiens
ctgtggagagtgagaataattg

SEQ ID NO: 398105 - DNA, 14 bp, Homo sapiens
ctgtggaggcctga

SEQ ID NO: 398106 - DNA, 15 bp, Homo sapiens
ctgtggaggcctgat

SEQ ID NO: 398107 - DNA, 14 bp, Homo sapiens
ctgtggaggtggct

SEQ ID NO: 398108 - DNA, 20 bp, Homo sapiens
ctgtggatacccttaccctt

SEQ ID NO: 398109 - DNA, 22 bp, Homo sapiens
ctgtggattttgtggcttcaat

SEQ ID NO: 398110 - DNA, 16 bp, Homo sapiens
ctgtggcagaaaagag

SEQ ID NO: 398111 - DNA, 23 bp, Homo sapiens
ctgtggcaggccagctgtggttt

SEQ ID NO: 398112 - DNA, 17 bp, Homo sapiens
ctgtggcattgttgatg

SEQ ID NO: 398113 - DNA, 13 bp, Homo sapiens
ctgtggccagagc

SEQ ID NO: 398114 - DNA, 18 bp, Homo sapiens
ctgtggccagagcacctc

SEQ ID NO: 398115 - DNA, 15 bp, Homo sapiens
ctgtggccagagctg

SEQ ID NO: 398116 - DNA, 17 bp, Homo sapiens
ctgtggccagagctgga

SEQ ID NO: 398117 - DNA, 19 bp, Homo sapiens
ctgtggccagagctggaag

SEQ ID NO: 398118 - DNA, 20 bp, Homo sapiens
ctgtggccagagctggaagg

SEQ ID NO: 398119 - DNA, 19 bp, Homo sapiens
ctgtggcccctccttctcc

SEQ ID NO: 398120 - DNA, 22 bp, Homo sapiens
ctgtggcccctccttctcccct

SEQ ID NO: 398121 - DNA, 15 bp, Homo sapiens
ctgtggccgtctcct

SEQ ID NO: 398122 - DNA, 15 bp, Homo sapiens
ctgtggcctcaggag

SEQ ID NO: 398123 - DNA, 20 bp, Homo sapiens
ctgtggcctgtgtccagcag

SEQ ID NO: 398124 - DNA, 14 bp, Homo sapiens
ctgtggccttgccc

SEQ ID NO: 398125 - DNA, 21 bp, Homo sapiens
ctgtggctgggtggtcagcag

SEQ ID NO: 398126 - DNA, 19 bp, Homo sapiens
ctgtgggactggcccaccc

SEQ ID NO: 398127 - DNA, 21 bp, Homo sapiens
ctgtgggactggcccacccct

SEQ ID NO: 398128 - DNA, 16 bp, Homo sapiens
ctgtgggagaagggac

SEQ ID NO: 398129 - DNA, 22 bp, Homo sapiens
ctgtgggagaagggacagcggg

SEQ ID NO: 398130 - DNA, 13 bp, Homo sapiens
ctgtggggagctg

SEQ ID NO: 398131 - DNA, 15 bp, Homo sapiens
ctgtggggagctggt

SEQ ID NO: 398132 - DNA, 18 bp, Homo sapiens
ctgtggggatttctccca

SEQ ID NO: 398133 - DNA, 14 bp, Homo sapiens
ctgtggggcaagcc

SEQ ID NO: 398134 - DNA, 20 bp, Homo sapiens
ctgtgggtattcaccaccct

SEQ ID NO: 398135 - DNA, 12 bp, Homo sapiens
ctgtgggtgggg

SEQ ID NO: 398136 - DNA, 21 bp, Homo sapiens
ctgtggtaccctggcagagaa

SEQ ID NO: 398137 - DNA, 17 bp, Homo sapiens
ctgtggtgaagtgtggc

SEQ ID NO: 398138 - DNA, 20 bp, Homo sapiens
ctgtggtgaagtgtggctgg

SEQ ID NO: 398139 - DNA, 21 bp, Homo sapiens
ctgtggtgaagtgtggctggt

SEQ ID NO: 398140 - DNA, 22 bp, Homo sapiens
ctgtggtgaagtgtggctggtg

SEQ ID NO: 398141 - DNA, 16 bp, Homo sapiens
ctgtggtgacaggccc

SEQ ID NO: 398142 - DNA, 19 bp, Homo sapiens
ctgtggtgaggttgggcag

SEQ ID NO: 398143 - DNA, 15 bp, Homo sapiens
ctgtggttcctgggg

SEQ ID NO: 398144 - DNA, 18 bp, Homo sapiens
ctgtggttttcccctccc

SEQ ID NO: 398145 - DNA, 19 bp, Homo sapiens
ctgtggttttcccctccct

SEQ ID NO: 398146 - DNA, 23 bp, Homo sapiens
ctgtggttttcccctccctgggt

SEQ ID NO: 398147 - DNA, 21 bp, Homo sapiens
ctgtggttttcttttgccatg

SEQ ID NO: 398148 - DNA, 22 bp, Homo sapiens
ctgtggttttcttttgccatga

SEQ ID NO: 398149 - DNA, 18 bp, Homo sapiens
ctgtgtaaatatttttcc

SEQ ID NO: 398150 - DNA, 19 bp, Homo sapiens
ctgtgtaaatatttttccc

SEQ ID NO: 398151 - DNA, 23 bp, Homo sapiens
ctgtgtaaatatttttccctccg

SEQ ID NO: 398152 - DNA, 22 bp, Homo sapiens
ctgtgtaaccagcagtcacagg

SEQ ID NO: 398153 - DNA, 16 bp, Homo sapiens
ctgtgtaatctctgat

SEQ ID NO: 398154 - DNA, 18 bp, Homo sapiens
ctgtgtaatctctgatta

SEQ ID NO: 398155 - DNA, 13 bp, Homo sapiens
ctgtgtagctggg

SEQ ID NO: 398156 - DNA, 16 bp, Homo sapiens
ctgtgtataaaaaaga

SEQ ID NO: 398157 - DNA, 14 bp, Homo sapiens
ctgtgtatgtacat

SEQ ID NO: 398158 - DNA, 14 bp, Homo sapiens
ctgtgtatttctgt

SEQ ID NO: 398159 - DNA, 18 bp, Homo sapiens
ctgtgtatttctgtagaa

SEQ ID NO: 398160 - DNA, 16 bp, Homo sapiens
ctgtgtcataccacaa

SEQ ID NO: 398161 - DNA, 14 bp, Homo sapiens
ctgtgtcatggtga

SEQ ID NO: 398162 - DNA, 21 bp, Homo sapiens
ctgtgtcatggtgatgcaagt

SEQ ID NO: 398163 - DNA, 23 bp, Homo sapiens
ctgtgtccagagacatgggcctc

SEQ ID NO: 398164 - DNA, 19 bp, Homo sapiens
ctgtgtcccctgacctgtc

SEQ ID NO: 398165 - DNA, 20 bp, Homo sapiens
ctgtgtcccctgacctgtcc

SEQ ID NO: 398166 - DNA, 15 bp, Homo sapiens
ctgtgtccctctctc

SEQ ID NO: 398167 - DNA, 20 bp, Homo sapiens
ctgtgtccgctctctcatgt

SEQ ID NO: 398168 - DNA, 21 bp, Homo sapiens
ctgtgtccgctctctcatgtg

SEQ ID NO: 398169 - DNA, 19 bp, Homo sapiens
ctgtgtctggtccacacac

SEQ ID NO: 398170 - DNA, 14 bp, Homo sapiens
ctgtgtgaagaaat

SEQ ID NO: 398171 - DNA, 19 bp, Homo sapiens
ctgtgtgacatcagtggca

SEQ ID NO: 398172 - DNA, 15 bp, Homo sapiens
ctgtgtgatgaactt

SEQ ID NO: 398173 - DNA, 19 bp, Homo sapiens
ctgtgtgatgaactttctc

SEQ ID NO: 398174 - DNA, 18 bp, Homo sapiens
ctgtgtgcagtctctctt

SEQ ID NO: 398175 - DNA, 21 bp, Homo sapiens
ctgtgtgctgtggttcctggg

SEQ ID NO: 398176 - DNA, 18 bp, Homo sapiens
ctgtgtggactgtgatgc

SEQ ID NO: 398177 - DNA, 17 bp, Homo sapiens
ctgtgtggcaaacattt

SEQ ID NO: 398178 - DNA, 21 bp, Homo sapiens
ctgtgtggcaaacatttaaaa

SEQ ID NO: 398179 - DNA, 22 bp, Homo sapiens
ctgtgtggcaaacatttaaaaa

SEQ ID NO: 398180 - DNA, 14 bp, Homo sapiens
ctgtgtgggagggc

SEQ ID NO: 398181 - DNA, 15 bp, Homo sapiens
ctgtgtgggatactt

SEQ ID NO: 398182 - DNA, 16 bp, Homo sapiens
ctgtgtggggagggtg

SEQ ID NO: 398183 - DNA, 13 bp, Homo sapiens
ctgtgtgtacctg

SEQ ID NO: 398184 - DNA, 16 bp, Homo sapiens
ctgtgtgtagccagga

SEQ ID NO: 398185 - DNA, 17 bp, Homo sapiens
ctgtgtgtagccaggaa

SEQ ID NO: 398186 - DNA, 17 bp, Homo sapiens
ctgtgtgttcttttgat

SEQ ID NO: 398187 - DNA, 21 bp, Homo sapiens
ctgtgtgttgccacaggacac

SEQ ID NO: 398188 - DNA, 14 bp, Homo sapiens
ctgtgttcacactg

SEQ ID NO: 398189 - DNA, 12 bp, Homo sapiens
ctgtgttcctgg

SEQ ID NO: 398190 - DNA, 17 bp, Homo sapiens
ctgtgttctatgcaaag

SEQ ID NO: 398191 - DNA, 12 bp, Homo sapiens
aaatattttcca

SEQ ID NO: 398192 - DNA, 20 bp, Homo sapiens
aaatattttgataataaatt

SEQ ID NO: 398193 - DNA, 14 bp, Homo sapiens
aaatatttttagta

SEQ ID NO: 398194 - DNA, 18 bp, Homo sapiens
aaatatttttttctagct

SEQ ID NO: 398195 - DNA, 23 bp, Homo sapiens
aaatatttttttctagctataac

SEQ ID NO: 398196 - DNA, 11 bp, Homo sapiens
aaatcaatttt

SEQ ID NO: 398197 - DNA, 13 bp, Homo sapiens
aaatcaatttttt

SEQ ID NO: 398198 - DNA, 20 bp, Homo sapiens
aaatcacagaaaaaaatggt

SEQ ID NO: 398199 - DNA, 22 bp, Homo sapiens
aaatcaccttttctaaaaagtc

SEQ ID NO: 398200 - DNA, 13 bp, Homo sapiens
aaatcagacacaa

SEQ ID NO: 398201 - DNA, 23 bp, Homo sapiens
aaatcagagcagtgattctctct

SEQ ID NO: 398202 - DNA, 13 bp, Homo sapiens
aaatcagttttgt

SEQ ID NO: 398203 - DNA, 15 bp, Homo sapiens
aaatcagttttgtgt

SEQ ID NO: 398204 - DNA, 14 bp, Homo sapiens
aaatcatgttttga

SEQ ID NO: 398205 - DNA, 17 bp, Homo sapiens
aaatcatgttttgatga

SEQ ID NO: 398206 - DNA, 19 bp, Homo sapiens
aaatcattgtgtgtcttca

SEQ ID NO: 398207 - DNA, 12 bp, Homo sapiens
aaatcatttcag

SEQ ID NO: 398208 - DNA, 20 bp, Homo sapiens
aaatcatttcagtatcatct

SEQ ID NO: 398209 - DNA, 14 bp, Homo sapiens
aaatcatttcatgt

SEQ ID NO: 398210 - DNA, 19 bp, Homo sapiens
aaatccataccccctgccc

SEQ ID NO: 398211 - DNA, 17 bp, Homo sapiens
aaatcctagacttgaaa

SEQ ID NO: 398212 - DNA, 19 bp, Homo sapiens
aaatcctagacttgaaagt

SEQ ID NO: 398213 - DNA, 13 bp, Homo sapiens
aaatctaatctct

SEQ ID NO: 398214 - DNA, 17 bp, Homo sapiens
aaatctaatctcttatt

SEQ ID NO: 398215 - DNA, 21 bp, Homo sapiens
aaatctactcttaaatataca

SEQ ID NO: 398216 - DNA, 17 bp, Homo sapiens
aaatctactgagccacg

SEQ ID NO: 398217 - DNA, 19 bp, Homo sapiens
ctgttagctttttaaaaca

SEQ ID NO: 398218 - DNA, 21 bp, Homo sapiens
ctgttagctttttaaaacatt

SEQ ID NO: 398219 - DNA, 16 bp, Homo sapiens
ctgttatctgtcttta

SEQ ID NO: 398220 - DNA, 14 bp, Homo sapiens
ctgttatcttgtgt

SEQ ID NO: 398221 - DNA, 17 bp, Homo sapiens
ctgttatcttgtgtatg

SEQ ID NO: 398222 - DNA, 23 bp, Homo sapiens
ctgttcaaagtactaaaactaga

SEQ ID NO: 398223 - DNA, 14 bp, Homo sapiens
ctgttcagatgtgc

SEQ ID NO: 398224 - DNA, 15 bp, Homo sapiens
ctgttcagatgtgca

SEQ ID NO: 398225 - DNA, 20 bp, Homo sapiens
ctgttcagtgtcccgggccc

SEQ ID NO: 398226 - DNA, 14 bp, Homo sapiens
ctgttcattgtaag

SEQ ID NO: 398227 - DNA, 13 bp, Homo sapiens
ctgttcatttcca

SEQ ID NO: 398228 - DNA, 13 bp, Homo sapiens
ctgttccaagtgt

SEQ ID NO: 398229 - DNA, 15 bp, Homo sapiens
ctgttccaagtgtgt

SEQ ID NO: 398230 - DNA, 20 bp, Homo sapiens
ctgttccaagtgtgtgtgca

SEQ ID NO: 398231 - DNA, 12 bp, Homo sapiens
ctgttcccctca

SEQ ID NO: 398232 - DNA, 14 bp, Homo sapiens
ctgttccctccaag

SEQ ID NO: 398233 - DNA, 17 bp, Homo sapiens
ctgttccctccaaggtc

SEQ ID NO: 398234 - DNA, 19 bp, Homo sapiens
ctgttccctctgctcctgg

SEQ ID NO: 398235 - DNA, 13 bp, Homo sapiens
ctgttccctgctg

SEQ ID NO: 398236 - DNA, 13 bp, Homo sapiens
ctgttcccttgca

SEQ ID NO: 398237 - DNA, 21 bp, Homo sapiens
ctgttcctctcttttcctgtt

SEQ ID NO: 398238 - DNA, 11 bp, Homo sapiens
ctgttcctgcc

SEQ ID NO: 398239 - DNA, 18 bp, Homo sapiens
ctgttcctgccttctctt

SEQ ID NO: 398240 - DNA, 17 bp, Homo sapiens
ctgttctcagagctcca

SEQ ID NO: 398241 - DNA, 22 bp, Homo sapiens
ctgttctcagagctccacagaa

SEQ ID NO: 398242 - DNA, 17 bp, Homo sapiens
ctgttctgccccctcag

SEQ ID NO: 398243 - DNA, 14 bp, Homo sapiens
ctgttctgtgtctg

SEQ ID NO: 398244 - DNA, 19 bp, Homo sapiens
ctgttctgtgtctgctgta

SEQ ID NO: 398245 - DNA, 18 bp, Homo sapiens
ctgttctttaagactttt

SEQ ID NO: 398246 - DNA, 12 bp, Homo sapiens
ctgttgaaaatt

SEQ ID NO: 398247 - DNA, 21 bp, Homo sapiens
ctgttgaaaattattttaaac

SEQ ID NO: 398248 - DNA, 22 bp, Homo sapiens
ctgttgaaaattattttaaaca

SEQ ID NO: 398249 - DNA, 23 bp, Homo sapiens
ctgttgacatccaagcttccttt

SEQ ID NO: 398250 - DNA, 22 bp, Homo sapiens
ctgttgacgttgatctcctggt

SEQ ID NO: 398251 - DNA, 20 bp, Homo sapiens
ctgttgagctgttttccctg

SEQ ID NO: 398252 - DNA, 15 bp, Homo sapiens
ctgttgagtatttgc

SEQ ID NO: 398253 - DNA, 16 bp, Homo sapiens
ctgttgagttggacac

SEQ ID NO: 398254 - DNA, 21 bp, Homo sapiens
ctgttgcaggtgtccgggggt

SEQ ID NO: 398255 - DNA, 17 bp, Homo sapiens
ctgttgcatttactttt

SEQ ID NO: 398256 - DNA, 23 bp, Homo sapiens
ctgttgccacactttcactgggg

SEQ ID NO: 398257 - DNA, 13 bp, Homo sapiens
ctgttgccagaga

SEQ ID NO: 398258 - DNA, 13 bp, Homo sapiens
ctgttgcccaggc

SEQ ID NO: 398259 - DNA, 20 bp, Homo sapiens
ctgttgccctttctgtacca

SEQ ID NO: 398260 - DNA, 12 bp, Homo sapiens
ctgttgcctcct

SEQ ID NO: 398261 - DNA, 19 bp, Homo sapiens
ctgttgcctcctctctccc

SEQ ID NO: 398262 - DNA, 20 bp, Homo sapiens
ctgttgcctcctctctccct

SEQ ID NO: 398263 - DNA, 22 bp, Homo sapiens
ctgttgcctcctctctccctgc

SEQ ID NO: 398264 - DNA, 23 bp, Homo sapiens
ctgttgcctcctctctccctgcc

SEQ ID NO: 398265 - DNA, 11 bp, Homo sapiens
ctgttgctcaa

SEQ ID NO: 398266 - DNA, 21 bp, Homo sapiens
ctgttgctcaaatctattcag

SEQ ID NO: 398267 - DNA, 16 bp, Homo sapiens
ctgttgctgaagtcat

SEQ ID NO: 398268 - DNA, 12 bp, Homo sapiens
ctgttgcttttt

SEQ ID NO: 398269 - DNA, 23 bp, Homo sapiens
ctgttggaaattgggtgtgccct

SEQ ID NO: 398270 - DNA, 15 bp, Homo sapiens
ctgttggctgctgcc

SEQ ID NO: 398271 - DNA, 18 bp, Homo sapiens
ctgttggttagctggaca

SEQ ID NO: 398272 - DNA, 21 bp, Homo sapiens
ctgttgtacgtaaagcttaaa

SEQ ID NO: 398273 - DNA, 16 bp, Homo sapiens
ctgttgtcattgcttt

SEQ ID NO: 398274 - DNA, 17 bp, Homo sapiens
ctgttgtcattgcttta

SEQ ID NO: 398275 - DNA, 18 bp, Homo sapiens
ctgttgtcattgctttac

SEQ ID NO: 398276 - DNA, 23 bp, Homo sapiens
ctgttgtgcagtgtgcctgtcac

SEQ ID NO: 398277 - DNA, 15 bp, Homo sapiens
ctgttgttcagaagt

SEQ ID NO: 398278 - DNA, 13 bp, Homo sapiens
ctgttgttgttaa

SEQ ID NO: 398279 - DNA, 23 bp, Homo sapiens
ctgttgttgttaatgaaaatgtc

SEQ ID NO: 398280 - DNA, 9 bp, Homo sapiens
ctgttgttt

SEQ ID NO: 398281 - DNA, 23 bp, Homo sapiens
ctgtttaactccctagttaccca

SEQ ID NO: 398282 - DNA, 19 bp, Homo sapiens
ctgtttaccctccctgtcc

SEQ ID NO: 398283 - DNA, 22 bp, Homo sapiens
ctgtttaccctccctgtcccct

SEQ ID NO: 398284 - DNA, 22 bp, Homo sapiens
ctgtttagtttgttaattgatt

SEQ ID NO: 398285 - DNA, 22 bp, Homo sapiens
ctgtttatggcctcagctgcct

SEQ ID NO: 398286 - DNA, 19 bp, Homo sapiens
ctgtttcaatgacctgtat

SEQ ID NO: 398287 - DNA, 17 bp, Homo sapiens
ctgtttccaggtcagaa

SEQ ID NO: 398288 - DNA, 15 bp, Homo sapiens
ctgtttcccctcaga

SEQ ID NO: 398289 - DNA, 20 bp, Homo sapiens
ctgtttctaatttgctgctg

SEQ ID NO: 398290 - DNA, 16 bp, Homo sapiens
ctgtttctgcagccct

SEQ ID NO: 398291 - DNA, 17 bp, Homo sapiens
ctgtttctgcagccctt

SEQ ID NO: 398292 - DNA, 11 bp, Homo sapiens
ctgtttgaatt

SEQ ID NO: 398293 - DNA, 12 bp, Homo sapiens
ctgtttgcctat

SEQ ID NO: 398294 - DNA, 18 bp, Homo sapiens
ctgtttggcttataaaca

SEQ ID NO: 398295 - DNA, 19 bp, Homo sapiens
ctgtttgggaggctggagt

SEQ ID NO: 398296 - DNA, 11 bp, Homo sapiens
ctgtttgtcat

SEQ ID NO: 398297 - DNA, 17 bp, Homo sapiens
ctgttttactgctttta

SEQ ID NO: 398298 - DNA, 16 bp, Homo sapiens
ctgttttagtgccagg

SEQ ID NO: 398299 - DNA, 20 bp, Homo sapiens
ctgttttattgagttctgaa

SEQ ID NO: 398300 - DNA, 20 bp, Homo sapiens
ctgttttctgtgcactgtag

SEQ ID NO: 398301 - DNA, 22 bp, Homo sapiens
ctgttttgcctgaagttggagt

SEQ ID NO: 398302 - DNA, 22 bp, Homo sapiens
ctgttttgtcctttgagaaaga

SEQ ID NO: 398303 - DNA, 22 bp, Homo sapiens
ctgttttgttttgttttttaaa

SEQ ID NO: 398304 - DNA, 16 bp, Homo sapiens
ctgtttttaagctgtt

SEQ ID NO: 398305 - DNA, 23 bp, Homo sapiens
ctgtttttaagctgtttccatag

SEQ ID NO: 398306 - DNA, 12 bp, Homo sapiens
ctgtttttctca

SEQ ID NO: 398307 - DNA, 16 bp, Homo sapiens
ctgtttttctcaaata

SEQ ID NO: 398308 - DNA, 18 bp, Homo sapiens
ctgtttttctcaaataaa

SEQ ID NO: 398309 - DNA, 22 bp, Homo sapiens
ctgtttttgaagaagggaaatt

SEQ ID NO: 398310 - DNA, 14 bp, Homo sapiens
ctgtttttgtagtg

SEQ ID NO: 398311 - DNA, 18 bp, Homo sapiens
ctgttttttcctgagctt

SEQ ID NO: 398312 - DNA, 22 bp, Homo sapiens
cttaaaaaaaaaaaaaaaagac

SEQ ID NO: 398313 - DNA, 15 bp, Homo sapiens
cttaaaaaaaactca

SEQ ID NO: 398314 - DNA, 15 bp, Homo sapiens
cttaaaaaaaggaaa

SEQ ID NO: 398315 - DNA, 16 bp, Homo sapiens
cttaaaaaaaggaaaa

SEQ ID NO: 398316 - DNA, 18 bp, Homo sapiens
cttaaaaagtctgcatta

SEQ ID NO: 398317 - DNA, 13 bp, Homo sapiens
cttaaaaatatgt

SEQ ID NO: 398318 - DNA, 18 bp, Homo sapiens
cttaaaaatgtaaatatt

SEQ ID NO: 398319 - DNA, 12 bp, Homo sapiens
cttaaaactagg

SEQ ID NO: 398320 - DNA, 17 bp, Homo sapiens
cttaaaataaacagttg

SEQ ID NO: 398321 - DNA, 17 bp, Homo sapiens
taacagggccttgctaa

SEQ ID NO: 398322 - DNA, 19 bp, Homo sapiens
taacagggtaaattattca

SEQ ID NO: 398323 - DNA, 15 bp, Homo sapiens
taacaggttttcttc

SEQ ID NO: 398324 - DNA, 21 bp, Homo sapiens
taacagtacctgtgcctgaga

SEQ ID NO: 398325 - DNA, 20 bp, Homo sapiens
taacagttggtgattttaga

SEQ ID NO: 398326 - DNA, 15 bp, Homo sapiens
taacagttttccatg

SEQ ID NO: 398327 - DNA, 21 bp, Homo sapiens
taacataaaatctgtgaatta

SEQ ID NO: 398328 - DNA, 15 bp, Homo sapiens
taacataacaacctt

SEQ ID NO: 398329 - DNA, 17 bp, Homo sapiens
taacatataaattaata

SEQ ID NO: 398330 - DNA, 16 bp, Homo sapiens
taacatatattgttat

SEQ ID NO: 398331 - DNA, 20 bp, Homo sapiens
taacatatgtacataaattg

SEQ ID NO: 398332 - DNA, 17 bp, Homo sapiens
taacatattcttgcttt

SEQ ID NO: 398333 - DNA, 22 bp, Homo sapiens
taacatattcttgctttcacaa

SEQ ID NO: 398334 - DNA, 13 bp, Homo sapiens
taacatatttact

SEQ ID NO: 398335 - DNA, 22 bp, Homo sapiens
taacatatttactaagccacaa

SEQ ID NO: 398336 - DNA, 23 bp, Homo sapiens
taacatatttcttgagtaattta

SEQ ID NO: 398337 - DNA, 19 bp, Homo sapiens
taacatcactatccatgca

SEQ ID NO: 398338 - DNA, 21 bp, Homo sapiens
taacatcactatccatgcacc

SEQ ID NO: 398339 - DNA, 17 bp, Homo sapiens
taacatctctttcatct

SEQ ID NO: 398340 - DNA, 13 bp, Homo sapiens
taacatctgaaaa

SEQ ID NO: 398341 - DNA, 14 bp, Homo sapiens
taacatctgaaaag

SEQ ID NO: 398342 - DNA, 17 bp, Homo sapiens
taacatctgaaaagaaa

SEQ ID NO: 398343 - DNA, 20 bp, Homo sapiens
taacatgaaaaacacggcag

SEQ ID NO: 398344 - DNA, 23 bp, Homo sapiens
taacatgaaaaacacggcagctg

SEQ ID NO: 398345 - DNA, 14 bp, Homo sapiens
taacatggaagtac

SEQ ID NO: 398346 - DNA, 23 bp, Homo sapiens
taacattaagtattccttggccc

SEQ ID NO: 398347 - DNA, 16 bp, Homo sapiens
taacattactgccttc

SEQ ID NO: 398348 - DNA, 16 bp, Homo sapiens
taacattcatgagatt

SEQ ID NO: 398349 - DNA, 21 bp, Homo sapiens
taacattcctcatgaatgtaa

SEQ ID NO: 398350 - DNA, 23 bp, Homo sapiens
taacattcgatctcattcagtat

SEQ ID NO: 398351 - DNA, 15 bp, Homo sapiens
taacattctatttca

SEQ ID NO: 398352 - DNA, 16 bp, Homo sapiens
taacattgaccaagaa

SEQ ID NO: 398353 - DNA, 21 bp, Homo sapiens
taacattgaccaagaactgca

SEQ ID NO: 398354 - DNA, 22 bp, Homo sapiens
taacattgaccaagaactgcat

SEQ ID NO: 398355 - DNA, 17 bp, Homo sapiens
taacattgtaaatgata

SEQ ID NO: 398356 - DNA, 21 bp, Homo sapiens
taacatttgctgaatatgcaa

SEQ ID NO: 398357 - DNA, 11 bp, Homo sapiens
taacattttgt

SEQ ID NO: 398358 - DNA, 15 bp, Homo sapiens
taaccacaaggtcca

SEQ ID NO: 398359 - DNA, 20 bp, Homo sapiens
taaccaccatttcccctgtg

SEQ ID NO: 398360 - DNA, 17 bp, Homo sapiens
taaccacctctctgtct

SEQ ID NO: 398361 - DNA, 18 bp, Homo sapiens
taaccacctctctgtctt

SEQ ID NO: 398362 - DNA, 20 bp, Homo sapiens
taaccacgtctgtcttcaca

SEQ ID NO: 398363 - DNA, 12 bp, Homo sapiens
taaccactgctt

SEQ ID NO: 398364 - DNA, 19 bp, Homo sapiens
taaccagcagtcacaggtc

SEQ ID NO: 398365 - DNA, 22 bp, Homo sapiens
taaccatcagttactggtttca

SEQ ID NO: 398366 - DNA, 14 bp, Homo sapiens
taaccatccccaac

SEQ ID NO: 398367 - DNA, 17 bp, Homo sapiens
taaccatccccaactcc

SEQ ID NO: 398368 - DNA, 19 bp, Homo sapiens
taaccccaaaatgaagatt

SEQ ID NO: 398369 - DNA, 14 bp, Homo sapiens
taaccccagcctga

SEQ ID NO: 398370 - DNA, 17 bp, Homo sapiens
taacctagaagtatttt

SEQ ID NO: 398371 - DNA, 18 bp, Homo sapiens
taacctagaagtattttt

SEQ ID NO: 398372 - DNA, 23 bp, Homo sapiens
taacctatttttttctctattct

SEQ ID NO: 398373 - DNA, 23 bp, Homo sapiens
taacctcagcatttactttgttt

SEQ ID NO: 398374 - DNA, 19 bp, Homo sapiens
taacctcagctctgggaga

SEQ ID NO: 398375 - DNA, 19 bp, Homo sapiens
taacctcagtgtcatttat

SEQ ID NO: 398376 - DNA, 14 bp, Homo sapiens
taacctctgcacta

SEQ ID NO: 398377 - DNA, 16 bp, Homo sapiens
taacctgcaaaatctg

SEQ ID NO: 398378 - DNA, 16 bp, Homo sapiens
taacctgcatgcagca

SEQ ID NO: 398379 - DNA, 17 bp, Homo sapiens
taacctgcatgcagcaa

SEQ ID NO: 398380 - DNA, 12 bp, Homo sapiens
taacctggagac

SEQ ID NO: 398381 - DNA, 14 bp, Homo sapiens
taacctggagacag

SEQ ID NO: 398382 - DNA, 15 bp, Homo sapiens
taacctggagacagt

SEQ ID NO: 398383 - DNA, 18 bp, Homo sapiens
taacctggtgctggatat

SEQ ID NO: 398384 - DNA, 23 bp, Homo sapiens
taacgacttcagggcagggctct

SEQ ID NO: 398385 - DNA, 16 bp, Homo sapiens
taacgcaggagagaga

SEQ ID NO: 398386 - DNA, 23 bp, Homo sapiens
taacgcaggagagagagagagaa

SEQ ID NO: 398387 - DNA, 20 bp, Homo sapiens
taacgccctatttttgcaat

SEQ ID NO: 398388 - DNA, 15 bp, Homo sapiens
taacgcgtcttcctg

SEQ ID NO: 398389 - DNA, 17 bp, Homo sapiens
taacgcgtcttcctgag

SEQ ID NO: 398390 - DNA, 12 bp, Homo sapiens
taacggctccag

SEQ ID NO: 398391 - DNA, 15 bp, Homo sapiens
taacggctccaggat

SEQ ID NO: 398392 - DNA, 19 bp, Homo sapiens
taacgtatgtatttcattg

SEQ ID NO: 398393 - DNA, 23 bp, Homo sapiens
taacgtatgtatttcattgctgt

SEQ ID NO: 398394 - DNA, 14 bp, Homo sapiens
taactaagaagtgg

SEQ ID NO: 398395 - DNA, 23 bp, Homo sapiens
taactaatctattgggttcatta

SEQ ID NO: 398396 - DNA, 23 bp, Homo sapiens
taactaatttgaatgtggttact

SEQ ID NO: 398397 - DNA, 12 bp, Homo sapiens
taactacattta

SEQ ID NO: 398398 - DNA, 14 bp, Homo sapiens
taactacatttatg

SEQ ID NO: 398399 - DNA, 15 bp, Homo sapiens
taactactgtgttcc

SEQ ID NO: 398400 - DNA, 15 bp, Homo sapiens
taactagaatttatt

SEQ ID NO: 398401 - DNA, 15 bp, Homo sapiens
taactagatctcctg

SEQ ID NO: 398402 - DNA, 16 bp, Homo sapiens
taactagatctcctgt

SEQ ID NO: 398403 - DNA, 20 bp, Homo sapiens
taactagatggtgctgagaa

SEQ ID NO: 398404 - DNA, 21 bp, Homo sapiens
taactagatggtgctgagaag

SEQ ID NO: 398405 - DNA, 17 bp, Homo sapiens
taactatatttgctttt

SEQ ID NO: 398406 - DNA, 18 bp, Homo sapiens
taactatatttgcttttt

SEQ ID NO: 398407 - DNA, 21 bp, Homo sapiens
taactcagatcactactgcag

SEQ ID NO: 398408 - DNA, 19 bp, Homo sapiens
taactcatacctttaaagg

SEQ ID NO: 398409 - DNA, 16 bp, Homo sapiens
taactcatcataaaat

SEQ ID NO: 398410 - DNA, 17 bp, Homo sapiens
taactcatcataaaata

SEQ ID NO: 398411 - DNA, 14 bp, Homo sapiens
taactcatggcagg

SEQ ID NO: 398412 - DNA, 23 bp, Homo sapiens
taactccctagttacccacccta

SEQ ID NO: 398413 - DNA, 16 bp, Homo sapiens
taactccgtttccaaa

SEQ ID NO: 398414 - DNA, 22 bp, Homo sapiens
taactctaattcccattttgca

SEQ ID NO: 398415 - DNA, 16 bp, Homo sapiens
taactcttgtctattt

SEQ ID NO: 398416 - DNA, 16 bp, Homo sapiens
taactgaaaatgtaaa

SEQ ID NO: 398417 - DNA, 18 bp, Homo sapiens
taactgaaaatgtaaatt

SEQ ID NO: 398418 - DNA, 12 bp, Homo sapiens
taactgaagcaa

SEQ ID NO: 398419 - DNA, 17 bp, Homo sapiens
taactgaccctcccttc

SEQ ID NO: 398420 - DNA, 21 bp, Homo sapiens
taactgactattcttgatgta

SEQ ID NO: 398421 - DNA, 14 bp, Homo sapiens
taactgcatataga

SEQ ID NO: 398422 - DNA, 16 bp, Homo sapiens
taactgcatttttaga

SEQ ID NO: 398423 - DNA, 23 bp, Homo sapiens
taactgcccttttaaatggcatg

SEQ ID NO: 398424 - DNA, 17 bp, Homo sapiens
taactgctcttttacta

SEQ ID NO: 398425 - DNA, 13 bp, Homo sapiens
taactgctgagcc

SEQ ID NO: 398426 - DNA, 14 bp, Homo sapiens
taactgctgagcca

SEQ ID NO: 398427 - DNA, 16 bp, Homo sapiens
taactgctgagccact

SEQ ID NO: 398428 - DNA, 17 bp, Homo sapiens
taactgctgagccactc

SEQ ID NO: 398429 - DNA, 11 bp, Homo sapiens
taactggcccc

SEQ ID NO: 398430 - DNA, 16 bp, Homo sapiens
taactggccccaggcg

SEQ ID NO: 398431 - DNA, 14 bp, Homo sapiens
taactgggttcaaa

SEQ ID NO: 398432 - DNA, 16 bp, Homo sapiens
taactgtgtgaagaaa

SEQ ID NO: 398433 - DNA, 18 bp, Homo sapiens
taactgtgtgaagaaatg

SEQ ID NO: 398434 - DNA, 19 bp, Homo sapiens
taacttaaaaatgtaaata

SEQ ID NO: 398435 - DNA, 13 bp, Homo sapiens
taacttaattata

SEQ ID NO: 398436 - DNA, 13 bp, Homo sapiens
taacttagtattt

SEQ ID NO: 398437 - DNA, 22 bp, Homo sapiens
taacttatctagaaagaaaaga

SEQ ID NO: 398438 - DNA, 22 bp, Homo sapiens
taacttattgcctgggcagtgc

SEQ ID NO: 398439 - DNA, 13 bp, Homo sapiens
taacttcagagaa

SEQ ID NO: 398440 - DNA, 16 bp, Homo sapiens
taacttcagagaagtc

SEQ ID NO: 398441 - DNA, 18 bp, Homo sapiens
taacttcagagaagtcag

SEQ ID NO: 398442 - DNA, 23 bp, Homo sapiens
taacttctgatagcgttggaatt

SEQ ID NO: 398443 - DNA, 22 bp, Homo sapiens
taacttgagagtagatggtttg

SEQ ID NO: 398444 - DNA, 22 bp, Homo sapiens
taacttgagggtaataaactta

SEQ ID NO: 398445 - DNA, 15 bp, Homo sapiens
taacttgagttttat

SEQ ID NO: 398446 - DNA, 14 bp, Homo sapiens
taacttgatcttgt

SEQ ID NO: 398447 - DNA, 15 bp, Homo sapiens
taacttgcgcagaaa

SEQ ID NO: 398448 - DNA, 19 bp, Homo sapiens
taacttgctgtgaaatgac

SEQ ID NO: 398449 - DNA, 22 bp, Homo sapiens
taactttaattctctttcaaag

SEQ ID NO: 398450 - DNA, 22 bp, Homo sapiens
taactttagaagtgcatttctg

SEQ ID NO: 398451 - DNA, 18 bp, Homo sapiens
cttcgactcaggatccag

SEQ ID NO: 398452 - DNA, 19 bp, Homo sapiens
cttcgagggttccaggctg

SEQ ID NO: 398453 - DNA, 22 bp, Homo sapiens
cttcgagggttccaggctgtgt

SEQ ID NO: 398454 - DNA, 15 bp, Homo sapiens
cttcgctattcccag

SEQ ID NO: 398455 - DNA, 16 bp, Homo sapiens
cttcgctattcccagg

SEQ ID NO: 398456 - DNA, 19 bp, Homo sapiens
cttcgctattcccaggcag

SEQ ID NO: 398457 - DNA, 21 bp, Homo sapiens
cttcgctgctctagctggcag

SEQ ID NO: 398458 - DNA, 18 bp, Homo sapiens
cttcggagggcccctgcg

SEQ ID NO: 398459 - DNA, 22 bp, Homo sapiens
cttcggagggcccctgcgtggg

SEQ ID NO: 398460 - DNA, 13 bp, Homo sapiens
cttcggaggtggc

SEQ ID NO: 398461 - DNA, 13 bp, Homo sapiens
cttcggcctgctt

SEQ ID NO: 398462 - DNA, 15 bp, Homo sapiens
cttcgggaagagagg

SEQ ID NO: 398463 - DNA, 16 bp, Homo sapiens
cttcgtacagttcttc

SEQ ID NO: 398464 - DNA, 18 bp, Homo sapiens
cttcgtccttttggttta

SEQ ID NO: 398465 - DNA, 17 bp, Homo sapiens
cttcgtgcccccccttc

SEQ ID NO: 398466 - DNA, 12 bp, Homo sapiens
cttcgtgctgga

SEQ ID NO: 398467 - DNA, 17 bp, Homo sapiens
cttcgtgctggaggaac

SEQ ID NO: 398468 - DNA, 16 bp, Homo sapiens
cttcgtgtctctccca

SEQ ID NO: 398469 - DNA, 17 bp, Homo sapiens
cttcgtgtctctcccac

SEQ ID NO: 398470 - DNA, 22 bp, Homo sapiens
cttcgtgtctctcccaccccgg

SEQ ID NO: 398471 - DNA, 17 bp, Homo sapiens
cttcgttaactgtgtat

SEQ ID NO: 398472 - DNA, 13 bp, Homo sapiens
cttctaaatcata

SEQ ID NO: 398473 - DNA, 20 bp, Homo sapiens
cttctaaatcataatcatcc

SEQ ID NO: 398474 - DNA, 13 bp, Homo sapiens
cttctaaatgcat

SEQ ID NO: 398475 - DNA, 15 bp, Homo sapiens
cttctaactaaacta

SEQ ID NO: 398476 - DNA, 15 bp, Homo sapiens
cttctaagatgccag

SEQ ID NO: 398477 - DNA, 12 bp, Homo sapiens
cttctaatatat

SEQ ID NO: 398478 - DNA, 15 bp, Homo sapiens
cttctaattgccatg

SEQ ID NO: 398479 - DNA, 20 bp, Homo sapiens
cttctacaaccagagccccc

SEQ ID NO: 398480 - DNA, 17 bp, Homo sapiens
cttctacctcttccagg

SEQ ID NO: 398481 - DNA, 19 bp, Homo sapiens
cttctacctcttccaggaa

SEQ ID NO: 398482 - DNA, 18 bp, Homo sapiens
cttctacctgcaggactc

SEQ ID NO: 398483 - DNA, 22 bp, Homo sapiens
cttctacctgcaggactcgggc

SEQ ID NO: 398484 - DNA, 19 bp, Homo sapiens
cttctactttttccttcct

SEQ ID NO: 398485 - DNA, 23 bp, Homo sapiens
cttctagaattataagtcacaaa

SEQ ID NO: 398486 - DNA, 18 bp, Homo sapiens
cttctagagtaattatct

SEQ ID NO: 398487 - DNA, 20 bp, Homo sapiens
cttctagagtaattatctgt

SEQ ID NO: 398488 - DNA, 14 bp, Homo sapiens
cttctagctcggaa

SEQ ID NO: 398489 - DNA, 16 bp, Homo sapiens
cttctaggaggatgct

SEQ ID NO: 398490 - DNA, 21 bp, Homo sapiens
cttctaggaggatgctgtgcc

SEQ ID NO: 398491 - DNA, 16 bp, Homo sapiens
cttctagttgctcttg

SEQ ID NO: 398492 - DNA, 17 bp, Homo sapiens
cttctatgatcagaact

SEQ ID NO: 398493 - DNA, 20 bp, Homo sapiens
cttctcaaatgctactcagt

SEQ ID NO: 398494 - DNA, 17 bp, Homo sapiens
cttctcaagcactgaca

SEQ ID NO: 398495 - DNA, 18 bp, Homo sapiens
cttctcaaggacacattt

SEQ ID NO: 398496 - DNA, 16 bp, Homo sapiens
cttctcagctccactc

SEQ ID NO: 398497 - DNA, 20 bp, Homo sapiens
cttctcagctccactctgaa

SEQ ID NO: 398498 - DNA, 15 bp, Homo sapiens
cttctcatagcatta

SEQ ID NO: 398499 - DNA, 13 bp, Homo sapiens
cttctccccaatc

SEQ ID NO: 398500 - DNA, 19 bp, Homo sapiens
cttctccccgcagcccgcc

SEQ ID NO: 398501 - DNA, 12 bp, Homo sapiens
cttctcccctcc

SEQ ID NO: 398502 - DNA, 17 bp, Homo sapiens
cttctcccctccagacc

SEQ ID NO: 398503 - DNA, 20 bp, Homo sapiens
cttctcccctccagacccct

SEQ ID NO: 398504 - DNA, 14 bp, Homo sapiens
cttctcccctgcac

SEQ ID NO: 398505 - DNA, 17 bp, Homo sapiens
cttctcccctgcactgt

SEQ ID NO: 398506 - DNA, 16 bp, Homo sapiens
taagatgtgtcttcaa

SEQ ID NO: 398507 - DNA, 16 bp, Homo sapiens
taagattatctgggga

SEQ ID NO: 398508 - DNA, 14 bp, Homo sapiens
taagattcatattt

SEQ ID NO: 398509 - DNA, 21 bp, Homo sapiens
taagattccagagagtggctc

SEQ ID NO: 398510 - DNA, 14 bp, Homo sapiens
taagattcttggta

SEQ ID NO: 398511 - DNA, 17 bp, Homo sapiens
taagattgcaaggaagg

SEQ ID NO: 398512 - DNA, 22 bp, Homo sapiens
taagattgcaaggaaggaaaca

SEQ ID NO: 398513 - DNA, 15 bp, Homo sapiens
taagattgtacatat

SEQ ID NO: 398514 - DNA, 16 bp, Homo sapiens
taagattgtacatatg

SEQ ID NO: 398515 - DNA, 22 bp, Homo sapiens
taagatttaattgtaattgtct

SEQ ID NO: 398516 - DNA, 12 bp, Homo sapiens
taagattttaca

SEQ ID NO: 398517 - DNA, 23 bp, Homo sapiens
taagattttattttcaagcaaat

SEQ ID NO: 398518 - DNA, 21 bp, Homo sapiens
taagcaacatgaattaagaac

SEQ ID NO: 398519 - DNA, 12 bp, Homo sapiens
taagcacctggg

SEQ ID NO: 398520 - DNA, 18 bp, Homo sapiens
taagcacctgggctgagg

SEQ ID NO: 398521 - DNA, 17 bp, Homo sapiens
taagcactacataaact

SEQ ID NO: 398522 - DNA, 17 bp, Homo sapiens
taagcactttgaaaata

SEQ ID NO: 398523 - DNA, 20 bp, Homo sapiens
taagcactttgaaaatattt

SEQ ID NO: 398524 - DNA, 23 bp, Homo sapiens
taagcactttgaaaatatttcta

SEQ ID NO: 398525 - DNA, 14 bp, Homo sapiens
taagcagaggtgga

SEQ ID NO: 398526 - DNA, 15 bp, Homo sapiens
taagcagagttcttt

SEQ ID NO: 398527 - DNA, 22 bp, Homo sapiens
taagcagatggaatgctgtgtt

SEQ ID NO: 398528 - DNA, 16 bp, Homo sapiens
taagcagcctttctgt

SEQ ID NO: 398529 - DNA, 18 bp, Homo sapiens
taagcagcctttctgtgg

SEQ ID NO: 398530 - DNA, 15 bp, Homo sapiens
taagcagtaaaaact

SEQ ID NO: 398531 - DNA, 15 bp, Homo sapiens
taagcattctgagct

SEQ ID NO: 398532 - DNA, 21 bp, Homo sapiens
taagcattctgagctgggctt

SEQ ID NO: 398533 - DNA, 12 bp, Homo sapiens
taagcattgttt

SEQ ID NO: 398534 - DNA, 21 bp, Homo sapiens
taagccaagaagtgaggcctg

SEQ ID NO: 398535 - DNA, 14 bp, Homo sapiens
taagccaagggcct

SEQ ID NO: 398536 - DNA, 18 bp, Homo sapiens
taagccaataaataatat

SEQ ID NO: 398537 - DNA, 16 bp, Homo sapiens
taagccacaagaaatt

SEQ ID NO: 398538 - DNA, 22 bp, Homo sapiens
taagccacaagaaatttgattt

SEQ ID NO: 398539 - DNA, 17 bp, Homo sapiens
taagccactggtatctg

SEQ ID NO: 398540 - DNA, 19 bp, Homo sapiens
taagccagttttcattttg

SEQ ID NO: 398541 - DNA, 20 bp, Homo sapiens
taagccatcatcagcttaat

SEQ ID NO: 398542 - DNA, 20 bp, Homo sapiens
taagccctcgaaccaaggca

SEQ ID NO: 398543 - DNA, 21 bp, Homo sapiens
taagccctcgaaccaaggcag

SEQ ID NO: 398544 - DNA, 22 bp, Homo sapiens
taagccctcgaaccaaggcagc

SEQ ID NO: 398545 - DNA, 20 bp, Homo sapiens
taagccctgtcgagacactt

SEQ ID NO: 398546 - DNA, 17 bp, Homo sapiens
taagcctccatttagtt

SEQ ID NO: 398547 - DNA, 19 bp, Homo sapiens
taagcctccatttagttct

SEQ ID NO: 398548 - DNA, 13 bp, Homo sapiens
taagcctgatgat

SEQ ID NO: 398549 - DNA, 22 bp, Homo sapiens
taagcgaagtctttgccttctc

SEQ ID NO: 398550 - DNA, 23 bp, Homo sapiens
taagcgaagtctttgccttctct

SEQ ID NO: 398551 - DNA, 21 bp, Homo sapiens
taagctaaagaggctgaaaga

SEQ ID NO: 398552 - DNA, 22 bp, Homo sapiens
taagctcaaatgtatatttaac

SEQ ID NO: 398553 - DNA, 17 bp, Homo sapiens
taagctctttgaaacaa

SEQ ID NO: 398554 - DNA, 16 bp, Homo sapiens
taagctgctctattgt

SEQ ID NO: 398555 - DNA, 12 bp, Homo sapiens
taagctgtaaaa

SEQ ID NO: 398556 - DNA, 13 bp, Homo sapiens
taagctgtaaaaa

SEQ ID NO: 398557 - DNA, 15 bp, Homo sapiens
taagctgtaaaaaga

SEQ ID NO: 398558 - DNA, 16 bp, Homo sapiens
taagcttaaaataagt

SEQ ID NO: 398559 - DNA, 19 bp, Homo sapiens
taagcttaaaataagtgaa

SEQ ID NO: 398560 - DNA, 16 bp, Homo sapiens
taagctttctcctttg

SEQ ID NO: 398561 - DNA, 19 bp, Homo sapiens
taaggaaatatcataatgt

SEQ ID NO: 398562 - DNA, 13 bp, Homo sapiens
taaggaagaaaaa

SEQ ID NO: 398563 - DNA, 18 bp, Homo sapiens
taaggacaaaaatgaact

SEQ ID NO: 398564 - DNA, 10 bp, Homo sapiens
taaggactgc

SEQ ID NO: 398565 - DNA, 13 bp, Homo sapiens
taaggactgcatg

SEQ ID NO: 398566 - DNA, 16 bp, Homo sapiens
taaggacttgtgcctc

SEQ ID NO: 398567 - DNA, 16 bp, Homo sapiens
taaggagaggagagca

SEQ ID NO: 398568 - DNA, 14 bp, Homo sapiens
taaggatagccttt

SEQ ID NO: 398569 - DNA, 17 bp, Homo sapiens
taaggatagcctttgta

SEQ ID NO: 398570 - DNA, 18 bp, Homo sapiens
taaggatagcctttgtag

SEQ ID NO: 398571 - DNA, 15 bp, Homo sapiens
taaggatgagcagca

SEQ ID NO: 398572 - DNA, 18 bp, Homo sapiens
taaggcagctctgtcgtg

SEQ ID NO: 398573 - DNA, 24 bp, Homo sapiens
taaggcatgctcccagcatttgtc

SEQ ID NO: 398574 - DNA, 18 bp, Homo sapiens
taaggccaaggcctcagg

SEQ ID NO: 398575 - DNA, 14 bp, Homo sapiens
taaggccttggtgc

SEQ ID NO: 398576 - DNA, 17 bp, Homo sapiens
taaggctccttcatgtg

SEQ ID NO: 398577 - DNA, 12 bp, Homo sapiens
taagggactgtg

SEQ ID NO: 398578 - DNA, 16 bp, Homo sapiens
taagggccgccggacc

SEQ ID NO: 398579 - DNA, 22 bp, Homo sapiens
taagggctggtctctgctgaag

SEQ ID NO: 398580 - DNA, 20 bp, Homo sapiens
taaggtacggtgagactctg

SEQ ID NO: 398581 - DNA, 19 bp, Homo sapiens
cttgcccagactacagggc

SEQ ID NO: 398582 - DNA, 19 bp, Homo sapiens
cttgcccagggtgcagtgt

SEQ ID NO: 398583 - DNA, 22 bp, Homo sapiens
cttgcccccatccctcggaccc

SEQ ID NO: 398584 - DNA, 14 bp, Homo sapiens
cttgccccccaccc

SEQ ID NO: 398585 - DNA, 17 bp, Homo sapiens
cttgcccgccagcctca

SEQ ID NO: 398586 - DNA, 15 bp, Homo sapiens
cttgccctagatgag

SEQ ID NO: 398587 - DNA, 13 bp, Homo sapiens
cttgccctgagct

SEQ ID NO: 398588 - DNA, 15 bp, Homo sapiens
cttgccgagagaggc

SEQ ID NO: 398589 - DNA, 16 bp, Homo sapiens
cttgccgagagaggcg

SEQ ID NO: 398590 - DNA, 14 bp, Homo sapiens
cttgccgagcctaa

SEQ ID NO: 398591 - DNA, 20 bp, Homo sapiens
cttgccgaggagccaggcaa

SEQ ID NO: 398592 - DNA, 18 bp, Homo sapiens
cttgccgctgggagagcc

SEQ ID NO: 398593 - DNA, 19 bp, Homo sapiens
cttgccgctgggagagcca

SEQ ID NO: 398594 - DNA, 18 bp, Homo sapiens
cttgcctaggccaaatgc

SEQ ID NO: 398595 - DNA, 19 bp, Homo sapiens
cttgcctagggcctggtcc

SEQ ID NO: 398596 - DNA, 21 bp, Homo sapiens
cttgcctccatggtgcctctg

SEQ ID NO: 398597 - DNA, 15 bp, Homo sapiens
cttgcctcccctcct

SEQ ID NO: 398598 - DNA, 12 bp, Homo sapiens
cttgccttcccc

SEQ ID NO: 398599 - DNA, 19 bp, Homo sapiens
cttgccttcttcacccagc

SEQ ID NO: 398600 - DNA, 15 bp, Homo sapiens
cttgcggcaccgccc

SEQ ID NO: 398601 - DNA, 18 bp, Homo sapiens
cttgcggcaccgcccacc

SEQ ID NO: 398602 - DNA, 13 bp, Homo sapiens
cttgcgtcctgca

SEQ ID NO: 398603 - DNA, 14 bp, Homo sapiens
cttgcgtcctgcag

SEQ ID NO: 398604 - DNA, 16 bp, Homo sapiens
cttgctacctgtgagc

SEQ ID NO: 398605 - DNA, 14 bp, Homo sapiens
cttgctcaataaag

SEQ ID NO: 398606 - DNA, 15 bp, Homo sapiens
cttgctcactcccta

SEQ ID NO: 398607 - DNA, 22 bp, Homo sapiens
cttgctcagacgagacacccta

SEQ ID NO: 398608 - DNA, 16 bp, Homo sapiens
cttgctcagagctagg

SEQ ID NO: 398609 - DNA, 16 bp, Homo sapiens
cttgctcagtgcctcc

SEQ ID NO: 398610 - DNA, 21 bp, Homo sapiens
cttgctcagtgcctcctggcc

SEQ ID NO: 398611 - DNA, 20 bp, Homo sapiens
cttgctctttctactctgaa

SEQ ID NO: 398612 - DNA, 20 bp, Homo sapiens
cttgctgatggcttgacatg

SEQ ID NO: 398613 - DNA, 12 bp, Homo sapiens
cttgctgcaccc

SEQ ID NO: 398614 - DNA, 17 bp, Homo sapiens
cttgctgcagtgtccag

SEQ ID NO: 398615 - DNA, 10 bp, Homo sapiens
cttgctgcca

SEQ ID NO: 398616 - DNA, 16 bp, Homo sapiens
cttgctgccctaggct

SEQ ID NO: 398617 - DNA, 23 bp, Homo sapiens
cttgctgccctaggctccgtcag

SEQ ID NO: 398618 - DNA, 16 bp, Homo sapiens
cttgctggattaatgt

SEQ ID NO: 398619 - DNA, 15 bp, Homo sapiens
cttgctgggtccagg

SEQ ID NO: 398620 - DNA, 17 bp, Homo sapiens
cttgctgtagagacttc

SEQ ID NO: 398621 - DNA, 18 bp, Homo sapiens
cttgctgtagagacttcc

SEQ ID NO: 398622 - DNA, 20 bp, Homo sapiens
cttgcttcaaccccatgaga

SEQ ID NO: 398623 - DNA, 14 bp, Homo sapiens
cttgcttcttgtgt

SEQ ID NO: 398624 - DNA, 19 bp, Homo sapiens
cttgcttcttgtgtttgaa

SEQ ID NO: 398625 - DNA, 14 bp, Homo sapiens
cttgcttgtaaaaa

SEQ ID NO: 398626 - DNA, 16 bp, Homo sapiens
cttgctttcacaaata

SEQ ID NO: 398627 - DNA, 17 bp, Homo sapiens
cttgctttcacaaatat

SEQ ID NO: 398628 - DNA, 21 bp, Homo sapiens
cttgctttgggctttgcaggc

SEQ ID NO: 398629 - DNA, 15 bp, Homo sapiens
cttggaaatattaaa

SEQ ID NO: 398630 - DNA, 16 bp, Homo sapiens
cttggaaatcattgtg

SEQ ID NO: 398631 - DNA, 16 bp, Homo sapiens
cttggaaatgggagac

SEQ ID NO: 398632 - DNA, 12 bp, Homo sapiens
cttggaatgaat

SEQ ID NO: 398633 - DNA, 22 bp, Homo sapiens
cttggacctcgtgctttaagtg

SEQ ID NO: 398634 - DNA, 23 bp, Homo sapiens
cttggacggggacacggcctctg

SEQ ID NO: 398635 - DNA, 20 bp, Homo sapiens
cttggactacctataaatgg

SEQ ID NO: 398636 - DNA, 22 bp, Homo sapiens
cttggactccctccccacccca

SEQ ID NO: 398637 - DNA, 23 bp, Homo sapiens
cttggactccctccccaccccaa

SEQ ID NO: 398638 - DNA, 15 bp, Homo sapiens
cttggactcttgctc

SEQ ID NO: 398639 - DNA, 13 bp, Homo sapiens
cttggacttcctg

SEQ ID NO: 398640 - DNA, 18 bp, Homo sapiens
cttggacttcctggggcc

SEQ ID NO: 398641 - DNA, 13 bp, Homo sapiens
cttggacttgagg

SEQ ID NO: 398642 - DNA, 14 bp, Homo sapiens
cttggagagcagct

SEQ ID NO: 398643 - DNA, 15 bp, Homo sapiens
cttggagagcagctg

SEQ ID NO: 398644 - DNA, 15 bp, Homo sapiens
cttggagagctcagg

SEQ ID NO: 398645 - DNA, 23 bp, Homo sapiens
cttggagagctcaggatggctca

SEQ ID NO: 398646 - DNA, 11 bp, Homo sapiens
cttggagagga

SEQ ID NO: 398647 - DNA, 13 bp, Homo sapiens
cttggagaggagg

SEQ ID NO: 398648 - DNA, 15 bp, Homo sapiens
taataaagtattcca

SEQ ID NO: 398649 - DNA, 18 bp, Homo sapiens
taataaatacacaatgaa

SEQ ID NO: 398650 - DNA, 15 bp, Homo sapiens
taataaatatactat

SEQ ID NO: 398651 - DNA, 12 bp, Homo sapiens
taataaatgacc

SEQ ID NO: 398652 - DNA, 13 bp, Homo sapiens
taataaatgacca

SEQ ID NO: 398653 - DNA, 17 bp, Homo sapiens
taataaatgaccagttt

SEQ ID NO: 398654 - DNA, 12 bp, Homo sapiens
taataaatggga

SEQ ID NO: 398655 - DNA, 17 bp, Homo sapiens
taataaatgggaaatgt

SEQ ID NO: 398656 - DNA, 18 bp, Homo sapiens
taataaatgggaaatgtc

SEQ ID NO: 398657 - DNA, 19 bp, Homo sapiens
taataaatgtacattaatt

SEQ ID NO: 398658 - DNA, 18 bp, Homo sapiens
taataaatgttatttaag

SEQ ID NO: 398659 - DNA, 13 bp, Homo sapiens
taataaattgaaa

SEQ ID NO: 398660 - DNA, 16 bp, Homo sapiens
taataaattgcatgct

SEQ ID NO: 398661 - DNA, 23 bp, Homo sapiens
taataaattgcatgctgctttaa

SEQ ID NO: 398662 - DNA, 16 bp, Homo sapiens
taataactagatctcc

SEQ ID NO: 398663 - DNA, 13 bp, Homo sapiens
taataactttgct

SEQ ID NO: 398664 - DNA, 18 bp, Homo sapiens
taataagctaaagaggct

SEQ ID NO: 398665 - DNA, 12 bp, Homo sapiens
taatacaacaat

SEQ ID NO: 398666 - DNA, 20 bp, Homo sapiens
taatacactaatagtaagat

SEQ ID NO: 398667 - DNA, 22 bp, Homo sapiens
taatacactaattcctttctat

SEQ ID NO: 398668 - DNA, 22 bp, Homo sapiens
taatacagatgtatcatgattg

SEQ ID NO: 398669 - DNA, 18 bp, Homo sapiens
taatacatctttatcatt

SEQ ID NO: 398670 - DNA, 23 bp, Homo sapiens
taatacatctttatcattaaaca

SEQ ID NO: 398671 - DNA, 23 bp, Homo sapiens
taatacccaaaccctaaacctct

SEQ ID NO: 398672 - DNA, 12 bp, Homo sapiens
taatactgaatt

SEQ ID NO: 398673 - DNA, 21 bp, Homo sapiens
taatactggttatcctgtgct

SEQ ID NO: 398674 - DNA, 16 bp, Homo sapiens
taatagaaaactgaaa

SEQ ID NO: 398675 - DNA, 15 bp, Homo sapiens
taatagaaatgcata

SEQ ID NO: 398676 - DNA, 22 bp, Homo sapiens
taatagaagtccatgagttgag

SEQ ID NO: 398677 - DNA, 13 bp, Homo sapiens
taatagaatttcc

SEQ ID NO: 398678 - DNA, 12 bp, Homo sapiens
taatagagcaaa

SEQ ID NO: 398679 - DNA, 21 bp, Homo sapiens
taatagagcaaaattgatgtg

SEQ ID NO: 398680 - DNA, 15 bp, Homo sapiens
taatagcctcacctt

SEQ ID NO: 398681 - DNA, 14 bp, Homo sapiens
taatagctgaacct

SEQ ID NO: 398682 - DNA, 18 bp, Homo sapiens
taatagcttttattgtat

SEQ ID NO: 398683 - DNA, 15 bp, Homo sapiens
taataggaagaacag

SEQ ID NO: 398684 - DNA, 14 bp, Homo sapiens
taatagtactattg

SEQ ID NO: 398685 - DNA, 13 bp, Homo sapiens
taatataaatgaa

SEQ ID NO: 398686 - DNA, 14 bp, Homo sapiens
taatataaatgaat

SEQ ID NO: 398687 - DNA, 21 bp, Homo sapiens
taatataaatgaatgaaatat

SEQ ID NO: 398688 - DNA, 22 bp, Homo sapiens
taatataactgccttaaaactt

SEQ ID NO: 398689 - DNA, 19 bp, Homo sapiens
taatatactaaccatttct

SEQ ID NO: 398690 - DNA, 21 bp, Homo sapiens
taatatactcagggattcctt

SEQ ID NO: 398691 - DNA, 16 bp, Homo sapiens
taatatactgcatatc

SEQ ID NO: 398692 - DNA, 16 bp, Homo sapiens
taatatagggtttgtt

SEQ ID NO: 398693 - DNA, 23 bp, Homo sapiens
taatatagggtttgtttgctgct

SEQ ID NO: 398694 - DNA, 14 bp, Homo sapiens
taatatattgaaca

SEQ ID NO: 398695 - DNA, 12 bp, Homo sapiens
taatatattgct

SEQ ID NO: 398696 - DNA, 14 bp, Homo sapiens
taatatcattttat

SEQ ID NO: 398697 - DNA, 15 bp, Homo sapiens
taatatcattttatt

SEQ ID NO: 398698 - DNA, 19 bp, Homo sapiens
taatatcattttattcaca

SEQ ID NO: 398699 - DNA, 18 bp, Homo sapiens
taatatcttgaagaatat

SEQ ID NO: 398700 - DNA, 12 bp, Homo sapiens
taatatctttaa

SEQ ID NO: 398701 - DNA, 17 bp, Homo sapiens
taatatgatctgtggag

SEQ ID NO: 398702 - DNA, 10 bp, Homo sapiens
taatatgcat

SEQ ID NO: 398703 - DNA, 13 bp, Homo sapiens
taatatgcatctt

SEQ ID NO: 398704 - DNA, 15 bp, Homo sapiens
taatatggcaaaaat

SEQ ID NO: 398705 - DNA, 18 bp, Homo sapiens
taatatgggcattgtagt

SEQ ID NO: 398706 - DNA, 20 bp, Homo sapiens
taatatgggcattgtagtta

SEQ ID NO: 398707 - DNA, 14 bp, Homo sapiens
taatattaaaaata

SEQ ID NO: 398708 - DNA, 14 bp, Homo sapiens
taatattaatttat

SEQ ID NO: 398709 - DNA, 22 bp, Homo sapiens
taatattactgtttatttctgt

SEQ ID NO: 398710 - DNA, 11 bp, Homo sapiens
taatattatta

SEQ ID NO: 398711 - DNA, 17 bp, Homo sapiens
taatattctctgatgtt

SEQ ID NO: 398712 - DNA, 19 bp, Homo sapiens
taatattgagaaagaaact

SEQ ID NO: 398713 - DNA, 20 bp, Homo sapiens
tactgaagtcttttctgtca

SEQ ID NO: 398714 - DNA, 11 bp, Homo sapiens
tactgagccac

SEQ ID NO: 398715 - DNA, 14 bp, Homo sapiens
tactgagcttctct

SEQ ID NO: 398716 - DNA, 17 bp, Homo sapiens
tactgagcttctctgtg

SEQ ID NO: 398717 - DNA, 20 bp, Homo sapiens
tactgagtatgtggaaggca

SEQ ID NO: 398718 - DNA, 17 bp, Homo sapiens
tactgagttctcatcca

SEQ ID NO: 398719 - DNA, 16 bp, Homo sapiens
tactgatcttaccttt

SEQ ID NO: 398720 - DNA, 14 bp, Homo sapiens
tactgattgaatgt

SEQ ID NO: 398721 - DNA, 21 bp, Homo sapiens
tactgatttcctttggagctt

SEQ ID NO: 398722 - DNA, 15 bp, Homo sapiens
tactgatttttgtga

SEQ ID NO: 398723 - DNA, 15 bp, Homo sapiens
tactgcaaaaagtac

SEQ ID NO: 398724 - DNA, 17 bp, Homo sapiens
tactgcagaatacagta

SEQ ID NO: 398725 - DNA, 22 bp, Homo sapiens
tactgcagcctttgcctccccg

SEQ ID NO: 398726 - DNA, 15 bp, Homo sapiens
tactgcagctttaca

SEQ ID NO: 398727 - DNA, 19 bp, Homo sapiens
tactgcagctttacatgca

SEQ ID NO: 398728 - DNA, 11 bp, Homo sapiens
tactgccaaag

SEQ ID NO: 398729 - DNA, 22 bp, Homo sapiens
tactgcccggggcagctgccag

SEQ ID NO: 398730 - DNA, 23 bp, Homo sapiens
tactgccctccagctctttcctc

SEQ ID NO: 398731 - DNA, 19 bp, Homo sapiens
tactgctgatgctgaaata

SEQ ID NO: 398732 - DNA, 21 bp, Homo sapiens
tactgctgatgctgaaataaa

SEQ ID NO: 398733 - DNA, 23 bp, Homo sapiens
tactgctgatgctgaaataaact

SEQ ID NO: 398734 - DNA, 17 bp, Homo sapiens
tactgctttcaacttaa

SEQ ID NO: 398735 - DNA, 21 bp, Homo sapiens
tactgctttcaacttaaatca

SEQ ID NO: 398736 - DNA, 23 bp, Homo sapiens
tactggaagttttgcatttatgg

SEQ ID NO: 398737 - DNA, 22 bp, Homo sapiens
tactggaccaaaaaaataaagc

SEQ ID NO: 398738 - DNA, 16 bp, Homo sapiens
tactggagaaaatgga

SEQ ID NO: 398739 - DNA, 19 bp, Homo sapiens
tactggagtggaaggtcta

SEQ ID NO: 398740 - DNA, 23 bp, Homo sapiens
tactggagtggaaggtctattgg

SEQ ID NO: 398741 - DNA, 11 bp, Homo sapiens
tactggcagct

SEQ ID NO: 398742 - DNA, 14 bp, Homo sapiens
tactggcagctcct

SEQ ID NO: 398743 - DNA, 19 bp, Homo sapiens
tactggcagctcctctcct

SEQ ID NO: 398744 - DNA, 10 bp, Homo sapiens
tactggctgt

SEQ ID NO: 398745 - DNA, 17 bp, Homo sapiens
tactgggttaatggcta

SEQ ID NO: 398746 - DNA, 13 bp, Homo sapiens
tactggttatagt

SEQ ID NO: 398747 - DNA, 23 bp, Homo sapiens
tactggttatagttgatatgtaa

SEQ ID NO: 398748 - DNA, 21 bp, Homo sapiens
tactggttatcctgtgctaca

SEQ ID NO: 398749 - DNA, 15 bp, Homo sapiens
tactgtcaataaaca

SEQ ID NO: 398750 - DNA, 15 bp, Homo sapiens
tactgtcagagaata

SEQ ID NO: 398751 - DNA, 16 bp, Homo sapiens
tactgtcggtgtcccc

SEQ ID NO: 398752 - DNA, 14 bp, Homo sapiens
tactgtctccttcc

SEQ ID NO: 398753 - DNA, 16 bp, Homo sapiens
tactgtctccttccca

SEQ ID NO: 398754 - DNA, 21 bp, Homo sapiens
tactgtctccttcccactgtc

SEQ ID NO: 398755 - DNA, 22 bp, Homo sapiens
tactgtctccttcccactgtcc

SEQ ID NO: 398756 - DNA, 15 bp, Homo sapiens
tactgtggaggtggc

SEQ ID NO: 398757 - DNA, 18 bp, Homo sapiens
tactgttaaccatttaag

SEQ ID NO: 398758 - DNA, 12 bp, Homo sapiens
tactgttcatgg

SEQ ID NO: 398759 - DNA, 21 bp, Homo sapiens
tactgttgcatttacttttaa

SEQ ID NO: 398760 - DNA, 19 bp, Homo sapiens
tactgtttgtaatatacag

SEQ ID NO: 398761 - DNA, 14 bp, Homo sapiens
tactgttttgtgcg

SEQ ID NO: 398762 - DNA, 21 bp, Homo sapiens
tactgttttgtgcggtgtgtc

SEQ ID NO: 398763 - DNA, 14 bp, Homo sapiens
tacttaaacaaaaa

SEQ ID NO: 398764 - DNA, 22 bp, Homo sapiens
tacttaaacaaaaactttccat

SEQ ID NO: 398765 - DNA, 15 bp, Homo sapiens
tacttaaacagcttt

SEQ ID NO: 398766 - DNA, 21 bp, Homo sapiens
tacttaaatagcatctgctct

SEQ ID NO: 398767 - DNA, 12 bp, Homo sapiens
tacttaactgtg

SEQ ID NO: 398768 - DNA, 17 bp, Homo sapiens
tacttaatactgaattt

SEQ ID NO: 398769 - DNA, 13 bp, Homo sapiens
tacttaatatact

SEQ ID NO: 398770 - DNA, 15 bp, Homo sapiens
tacttaatatactca

SEQ ID NO: 398771 - DNA, 18 bp, Homo sapiens
tacttaattcctttctca

SEQ ID NO: 398772 - DNA, 16 bp, Homo sapiens
tacttacctaaacaga

SEQ ID NO: 398773 - DNA, 22 bp, Homo sapiens
tacttacctaaacagatataaa

SEQ ID NO: 398774 - DNA, 15 bp, Homo sapiens
tacttacggttttaa

SEQ ID NO: 398775 - DNA, 21 bp, Homo sapiens
tacttacggttttaaatgtgt

SEQ ID NO: 398776 - DNA, 15 bp, Homo sapiens
tacttacttagagat

SEQ ID NO: 398777 - DNA, 15 bp, Homo sapiens
tacttaggaaatact

SEQ ID NO: 398778 - DNA, 13 bp, Homo sapiens
tacttagtggtat

SEQ ID NO: 398779 - DNA, 21 bp, Homo sapiens
tacttatatttccctaaaata

SEQ ID NO: 398780 - DNA, 17 bp, Homo sapiens
tacttatgcacatttgt

SEQ ID NO: 398781 - DNA, 21 bp, Homo sapiens
tacttatttaaaaatgcatga

SEQ ID NO: 398782 - DNA, 16 bp, Homo sapiens
tacttcaaaagccata

SEQ ID NO: 398783 - DNA, 21 bp, Homo sapiens
tacttcaaaagccataacttg

SEQ ID NO: 398784 - DNA, 15 bp, Homo sapiens
tacttcagtcttgga

SEQ ID NO: 398785 - DNA, 24 bp, Homo sapiens
tacttcataagatattctttacaa

SEQ ID NO: 398786 - DNA, 14 bp, Homo sapiens
tacttcctggattt

SEQ ID NO: 398787 - DNA, 17 bp, Homo sapiens
tacttcctggattttct

SEQ ID NO: 398788 - DNA, 23 bp, Homo sapiens
tacttcctgtgacttcagctctg

SEQ ID NO: 398789 - DNA, 12 bp, Homo sapiens
tacttctgtgtc

SEQ ID NO: 398790 - DNA, 16 bp, Homo sapiens
tacttctttttcatta

SEQ ID NO: 398791 - DNA, 20 bp, Homo sapiens
tacttgaaatctaggattat

SEQ ID NO: 398792 - DNA, 12 bp, Homo sapiens
tacttgaatttc

SEQ ID NO: 398793 - DNA, 14 bp, Homo sapiens
tacttgacctccta

SEQ ID NO: 398794 - DNA, 20 bp, Homo sapiens
tacttgaggatcatatgaat

SEQ ID NO: 398795 - DNA, 20 bp, Homo sapiens
tacttgagggaccaatatta

SEQ ID NO: 398796 - DNA, 14 bp, Homo sapiens
tacttgatgcactt

SEQ ID NO: 398797 - DNA, 19 bp, Homo sapiens
tacttgctcaataaaggtc

SEQ ID NO: 398798 - DNA, 19 bp, Homo sapiens
tacttgggaagctgaggcg

SEQ ID NO: 398799 - DNA, 23 bp, Homo sapiens
tacttgggagacctgtaatcata

SEQ ID NO: 398800 - DNA, 14 bp, Homo sapiens
tacttgggagcctg

SEQ ID NO: 398801 - DNA, 22 bp, Homo sapiens
tacttgggagcctgaggcagga

SEQ ID NO: 398802 - DNA, 12 bp, Homo sapiens
tacttgggaggc

SEQ ID NO: 398803 - DNA, 19 bp, Homo sapiens
tacttgggaggccgaggca

SEQ ID NO: 398804 - DNA, 18 bp, Homo sapiens
tacttggtgaggaggagg

SEQ ID NO: 398805 - DNA, 16 bp, Homo sapiens
tacttgtctgaggcct

SEQ ID NO: 398806 - DNA, 20 bp, Homo sapiens
tacttgttcatttctgtctc

SEQ ID NO: 398807 - DNA, 20 bp, Homo sapiens
tactttaaatcctaccaaag

SEQ ID NO: 398808 - DNA, 17 bp, Homo sapiens
tactttatattttctat

SEQ ID NO: 398809 - DNA, 11 bp, Homo sapiens
tactttattct

SEQ ID NO: 398810 - DNA, 18 bp, Homo sapiens
tactttgtcccctcacct

SEQ ID NO: 398811 - DNA, 15 bp, Homo sapiens
tactttgtgtctttt

SEQ ID NO: 398812 - DNA, 16 bp, Homo sapiens
tactttgtttcttttg

SEQ ID NO: 398813 - DNA, 18 bp, Homo sapiens
tactttgtttttccatgt

SEQ ID NO: 398814 - DNA, 11 bp, Homo sapiens
tacttttaacg

SEQ ID NO: 398815 - DNA, 17 bp, Homo sapiens
tacttttacttgttcat

SEQ ID NO: 398816 - DNA, 21 bp, Homo sapiens
tacttttacttgttcatttct

SEQ ID NO: 398817 - DNA, 19 bp, Homo sapiens
tacttttatttgcaacatt

SEQ ID NO: 398818 - DNA, 18 bp, Homo sapiens
tacttttcagtttttaac

SEQ ID NO: 398819 - DNA, 20 bp, Homo sapiens
tactttttaaaaggtatttt

SEQ ID NO: 398820 - DNA, 13 bp, Homo sapiens
tactttttcctgg

SEQ ID NO: 398821 - DNA, 16 bp, Homo sapiens
tactttttccttcctg

SEQ ID NO: 398822 - DNA, 22 bp, Homo sapiens
gaaaagaccctgagactccaga

SEQ ID NO: 398823 - DNA, 12 bp, Homo sapiens
gaaaagactgac

SEQ ID NO: 398824 - DNA, 14 bp, Homo sapiens
gaaaagagaagaaa

SEQ ID NO: 398825 - DNA, 13 bp, Homo sapiens
gaaaagataaaga

SEQ ID NO: 398826 - DNA, 22 bp, Homo sapiens
gaaaagatacgactttattttc

SEQ ID NO: 398827 - DNA, 18 bp, Homo sapiens
gaaaagataggtttgagt

SEQ ID NO: 398828 - DNA, 14 bp, Homo sapiens
gaaaagatttaagc

SEQ ID NO: 398829 - DNA, 19 bp, Homo sapiens
gaaaagcagacgcagcagc

SEQ ID NO: 398830 - DNA, 12 bp, Homo sapiens
gaaaagccaagc

SEQ ID NO: 398831 - DNA, 12 bp, Homo sapiens
gaaaagccagat

SEQ ID NO: 398832 - DNA, 22 bp, Homo sapiens
gaaaagccagatgacagggagc

SEQ ID NO: 398833 - DNA, 17 bp, Homo sapiens
gaaaaggaatgcaagag

SEQ ID NO: 398834 - DNA, 18 bp, Homo sapiens
gaaaagggaacaggaaaa

SEQ ID NO: 398835 - DNA, 14 bp, Homo sapiens
gaaaagggagaaaa

SEQ ID NO: 398836 - DNA, 14 bp, Homo sapiens
gaaaagtacattta

SEQ ID NO: 398837 - DNA, 21 bp, Homo sapiens
gaaaagtatggcagtgggaga

SEQ ID NO: 398838 - DNA, 19 bp, Homo sapiens
gaaaagtggcaagaccaaa

SEQ ID NO: 398839 - DNA, 13 bp, Homo sapiens
gaaaataaaataa

SEQ ID NO: 398840 - DNA, 15 bp, Homo sapiens
gaaaataaaataaac

SEQ ID NO: 398841 - DNA, 11 bp, Homo sapiens
gaaaataaagt

SEQ ID NO: 398842 - DNA, 12 bp, Homo sapiens
gaaaataacaga

SEQ ID NO: 398843 - DNA, 18 bp, Homo sapiens
gaaaatagagatgagctt

SEQ ID NO: 398844 - DNA, 22 bp, Homo sapiens
tagatacttttgataatagata

SEQ ID NO: 398845 - DNA, 21 bp, Homo sapiens
tagatagctgactcattcttt

SEQ ID NO: 398846 - DNA, 14 bp, Homo sapiens
tagatataactgta

SEQ ID NO: 398847 - DNA, 18 bp, Homo sapiens
tagatcaaggcaaaaata

SEQ ID NO: 398848 - DNA, 22 bp, Homo sapiens
tagatcctctgatatacaatta

SEQ ID NO: 398849 - DNA, 13 bp, Homo sapiens
tagatcctgcacc

SEQ ID NO: 398850 - DNA, 15 bp, Homo sapiens
tagatcgcttgagcc

SEQ ID NO: 398851 - DNA, 19 bp, Homo sapiens
tagatcgcttgagcccagg

SEQ ID NO: 398852 - DNA, 21 bp, Homo sapiens
tagatctgatggtgagctggg

SEQ ID NO: 398853 - DNA, 15 bp, Homo sapiens
tagatgaactcaact

SEQ ID NO: 398854 - DNA, 20 bp, Homo sapiens
tagatgagaattcagctgcc

SEQ ID NO: 398855 - DNA, 21 bp, Homo sapiens
tagatgagattgttttatcat

SEQ ID NO: 398856 - DNA, 23 bp, Homo sapiens
tagatgagcccagccctgttctg

SEQ ID NO: 398857 - DNA, 15 bp, Homo sapiens
tagatgagtcctgtt

SEQ ID NO: 398858 - DNA, 19 bp, Homo sapiens
tagatgcaagatatttata

SEQ ID NO: 398859 - DNA, 15 bp, Homo sapiens
tagatgccctgctag

SEQ ID NO: 398860 - DNA, 16 bp, Homo sapiens
tagatgctgaatatct

SEQ ID NO: 398861 - DNA, 14 bp, Homo sapiens
tagatgctgactgt

SEQ ID NO: 398862 - DNA, 15 bp, Homo sapiens
tagatggtgaaattt

SEQ ID NO: 398863 - DNA, 12 bp, Homo sapiens
tagatgtagcat

SEQ ID NO: 398864 - DNA, 19 bp, Homo sapiens
tagatgtagcattgttcca

SEQ ID NO: 398865 - DNA, 21 bp, Homo sapiens
tagatgtctttaggcagcagc

SEQ ID NO: 398866 - DNA, 14 bp, Homo sapiens
tagatgtgaaaaag

SEQ ID NO: 398867 - DNA, 19 bp, Homo sapiens
tagatgtttaacaaatcta

SEQ ID NO: 398868 - DNA, 12 bp, Homo sapiens
tagattcacctg

SEQ ID NO: 398869 - DNA, 22 bp, Homo sapiens
tagattcacctgtaaaacttta

SEQ ID NO: 398870 - DNA, 17 bp, Homo sapiens
tagattcctacttaaac

SEQ ID NO: 398871 - DNA, 19 bp, Homo sapiens
tagattcctacttaaacaa

SEQ ID NO: 398872 - DNA, 21 bp, Homo sapiens
tagattcctacttaaacaaaa

SEQ ID NO: 398873 - DNA, 21 bp, Homo sapiens
tagattcctcttgcctctctc

SEQ ID NO: 398874 - DNA, 15 bp, Homo sapiens
tagattctccaaatg

SEQ ID NO: 398875 - DNA, 14 bp, Homo sapiens
tagatttgttttgt

SEQ ID NO: 398876 - DNA, 23 bp, Homo sapiens
tagcaaaacgcatggagtgtgta

SEQ ID NO: 398877 - DNA, 14 bp, Homo sapiens
tagcaatatttata

SEQ ID NO: 398878 - DNA, 13 bp, Homo sapiens
tagcacaaaaaaa

SEQ ID NO: 398879 - DNA, 21 bp, Homo sapiens
tagcacatcatggcagtggga

SEQ ID NO: 398880 - DNA, 18 bp, Homo sapiens
tagcactcacatgctgga

SEQ ID NO: 398881 - DNA, 21 bp, Homo sapiens
tagcactggtttgtttctcaa

SEQ ID NO: 398882 - DNA, 15 bp, Homo sapiens
tagcagagtcattgt

SEQ ID NO: 398883 - DNA, 18 bp, Homo sapiens
tagcagattttaattttg

SEQ ID NO: 398884 - DNA, 17 bp, Homo sapiens
tagcagctcaggcgcag

SEQ ID NO: 398885 - DNA, 20 bp, Homo sapiens
tagcagttctgcaaatagaa

SEQ ID NO: 398886 - DNA, 21 bp, Homo sapiens
tagcagttgaggccaggctag

SEQ ID NO: 398887 - DNA, 15 bp, Homo sapiens
tagcatacatttata

SEQ ID NO: 398888 - DNA, 16 bp, Homo sapiens
tagcatactgatgaga

SEQ ID NO: 398889 - DNA, 12 bp, Homo sapiens
tagcataggcta

SEQ ID NO: 398890 - DNA, 14 bp, Homo sapiens
tagcatataaatgt

SEQ ID NO: 398891 - DNA, 15 bp, Homo sapiens
tagcatataaatgtt

SEQ ID NO: 398892 - DNA, 21 bp, Homo sapiens
tagcatataaatgtttatatt

SEQ ID NO: 398893 - DNA, 16 bp, Homo sapiens
tagcatcccatctcag

SEQ ID NO: 398894 - DNA, 14 bp, Homo sapiens
tagcatcctgatta

SEQ ID NO: 398895 - DNA, 23 bp, Homo sapiens
tagcatcctgattattgaatgtt

SEQ ID NO: 398896 - DNA, 14 bp, Homo sapiens
tagcatctgagaag

SEQ ID NO: 398897 - DNA, 18 bp, Homo sapiens
tagcatgacaagccccag

SEQ ID NO: 398898 - DNA, 21 bp, Homo sapiens
tagcatgacaagccccaggca

SEQ ID NO: 398899 - DNA, 17 bp, Homo sapiens
tagcatgcacaaagtgt

SEQ ID NO: 398900 - DNA, 17 bp, Homo sapiens
tagcatggactctgggt

SEQ ID NO: 398901 - DNA, 22 bp, Homo sapiens
tagcatgtgtttggttctgggg

SEQ ID NO: 398902 - DNA, 20 bp, Homo sapiens
tagcatgttgagccaggcct

SEQ ID NO: 398903 - DNA, 15 bp, Homo sapiens
tagcatgttgtagat

SEQ ID NO: 398904 - DNA, 13 bp, Homo sapiens
tagcattaaaaat

SEQ ID NO: 398905 - DNA, 16 bp, Homo sapiens
tagcattaactaatct

SEQ ID NO: 398906 - DNA, 15 bp, Homo sapiens
tagcattgaaataat

SEQ ID NO: 398907 - DNA, 13 bp, Homo sapiens
tagcattgttcca

SEQ ID NO: 398908 - DNA, 13 bp, Homo sapiens
tagcatttcttga

SEQ ID NO: 398909 - DNA, 16 bp, Homo sapiens
tagccaaacccttgtc

SEQ ID NO: 398910 - DNA, 23 bp, Homo sapiens
tagccaacccaactgacttctgc

SEQ ID NO: 398911 - DNA, 23 bp, Homo sapiens
tagccaccaccggggcactggct

SEQ ID NO: 398912 - DNA, 18 bp, Homo sapiens
tagccactctctgcccac

SEQ ID NO: 398913 - DNA, 11 bp, Homo sapiens
tagccactggc

SEQ ID NO: 398914 - DNA, 15 bp, Homo sapiens
tagccagagaggagc

SEQ ID NO: 398915 - DNA, 11 bp, Homo sapiens
tagccaggcct

SEQ ID NO: 398916 - DNA, 12 bp, Homo sapiens
tagccaggcctc

SEQ ID NO: 398917 - DNA, 17 bp, Homo sapiens
tagccaggcctcccgca

SEQ ID NO: 398918 - DNA, 12 bp, Homo sapiens
tagccagtgact

SEQ ID NO: 398919 - DNA, 18 bp, Homo sapiens
tagccatggctcaggcaa

SEQ ID NO: 398920 - DNA, 15 bp, Homo sapiens
tagccatggctggca

SEQ ID NO: 398921 - DNA, 15 bp, Homo sapiens
tagccatttgcccca

SEQ ID NO: 398922 - DNA, 21 bp, Homo sapiens
tagccattttgtaactgccta

SEQ ID NO: 398923 - DNA, 20 bp, Homo sapiens
tagccccaagaaggctgggg

SEQ ID NO: 398924 - DNA, 22 bp, Homo sapiens
tagccccaagaaggctggggct

SEQ ID NO: 398925 - DNA, 16 bp, Homo sapiens
tagcccggatgcccac

SEQ ID NO: 398926 - DNA, 21 bp, Homo sapiens
tagcccggatgcccacccctg

SEQ ID NO: 398927 - DNA, 16 bp, Homo sapiens
tagccctccccctcaa

SEQ ID NO: 398928 - DNA, 15 bp, Homo sapiens
tagccctctttctct

SEQ ID NO: 398929 - DNA, 20 bp, Homo sapiens
tagccctctttctctctgtg

SEQ ID NO: 398930 - DNA, 18 bp, Homo sapiens
tagccctggccagaggct

SEQ ID NO: 398931 - DNA, 17 bp, Homo sapiens
tagccctttccccactc

SEQ ID NO: 398932 - DNA, 15 bp, Homo sapiens
tagccctttctgtgt

SEQ ID NO: 398933 - DNA, 15 bp, Homo sapiens
tagccgtccatggca

SEQ ID NO: 398934 - DNA, 17 bp, Homo sapiens
tagccgtccatggcacc

SEQ ID NO: 398935 - DNA, 20 bp, Homo sapiens
tagccgtccatggcaccagc

SEQ ID NO: 398936 - DNA, 13 bp, Homo sapiens
tagcctccctgaa

SEQ ID NO: 398937 - DNA, 20 bp, Homo sapiens
tagcctccgtttatgggcct

SEQ ID NO: 398938 - DNA, 21 bp, Homo sapiens
tagcctccgtttatgggcctt

SEQ ID NO: 398939 - DNA, 15 bp, Homo sapiens
tagcctctcccaccc

SEQ ID NO: 398940 - DNA, 19 bp, Homo sapiens
tagcctctttgtgtttttg

SEQ ID NO: 398941 - DNA, 14 bp, Homo sapiens
tagcctggcttggg

SEQ ID NO: 398942 - DNA, 13 bp, Homo sapiens
tagcctgggccag

SEQ ID NO: 398943 - DNA, 17 bp, Homo sapiens
tagccttgctgtagaga

SEQ ID NO: 398944 - DNA, 14 bp, Homo sapiens
tagccttgtgccct

SEQ ID NO: 398945 - DNA, 16 bp, Homo sapiens
tagccttgtgccctgc

SEQ ID NO: 398946 - DNA, 12 bp, Homo sapiens
tagcctttgtag

SEQ ID NO: 398947 - DNA, 14 bp, Homo sapiens
tagccttttgtaac

SEQ ID NO: 398948 - DNA, 17 bp, Homo sapiens
tagcgagctgctctgct

SEQ ID NO: 398949 - DNA, 20 bp, Homo sapiens
tagcggaaaagttgtcttaa

SEQ ID NO: 398950 - DNA, 15 bp, Homo sapiens
tagcgtcctgaggaa

SEQ ID NO: 398951 - DNA, 21 bp, Homo sapiens
tagcgttctggactctgcccc

SEQ ID NO: 398952 - DNA, 23 bp, Homo sapiens
tagctaacattttaaataaaaga

SEQ ID NO: 398953 - DNA, 19 bp, Homo sapiens
tagctaatgtaataactgt

SEQ ID NO: 398954 - DNA, 15 bp, Homo sapiens
tagctacaggaagca

SEQ ID NO: 398955 - DNA, 19 bp, Homo sapiens
tagctagtttaaaattatt

SEQ ID NO: 398956 - DNA, 20 bp, Homo sapiens
tagctataacaactctattt

SEQ ID NO: 398957 - DNA, 15 bp, Homo sapiens
tagctatatccatgt

SEQ ID NO: 398958 - DNA, 15 bp, Homo sapiens
tagctatcagaagac

SEQ ID NO: 398959 - DNA, 17 bp, Homo sapiens
tagctattaagatactt

SEQ ID NO: 398960 - DNA, 13 bp, Homo sapiens
tagctattactgt

SEQ ID NO: 398961 - DNA, 15 bp, Homo sapiens
tagctattctttgac

SEQ ID NO: 398962 - DNA, 17 bp, Homo sapiens
tagctcagccccagccc

SEQ ID NO: 398963 - DNA, 19 bp, Homo sapiens
tagctcagccccagcccag

SEQ ID NO: 398964 - DNA, 23 bp, Homo sapiens
tagctcccgagctactctcttgc

SEQ ID NO: 398965 - DNA, 14 bp, Homo sapiens
tagctccctcctcc

SEQ ID NO: 398966 - DNA, 22 bp, Homo sapiens
tagctccttcatgcttttctca

SEQ ID NO: 398967 - DNA, 23 bp, Homo sapiens
gaacagctatgggagccccaggg

SEQ ID NO: 398968 - DNA, 18 bp, Homo sapiens
gaacagctcctcctcttg

SEQ ID NO: 398969 - DNA, 15 bp, Homo sapiens
gaacagctgtaatct

SEQ ID NO: 398970 - DNA, 16 bp, Homo sapiens
gaacagctgttcctgt

SEQ ID NO: 398971 - DNA, 17 bp, Homo sapiens
gaacagctgttcctgtg

SEQ ID NO: 398972 - DNA, 19 bp, Homo sapiens
gaacaggaggaactggtcc

SEQ ID NO: 398973 - DNA, 21 bp, Homo sapiens
gaacaggaggaactggtccag

SEQ ID NO: 398974 - DNA, 16 bp, Homo sapiens
gaagaaaaaaaataac

SEQ ID NO: 398975 - DNA, 19 bp, Homo sapiens
gaagaaaacatatatttta

SEQ ID NO: 398976 - DNA, 16 bp, Homo sapiens
gaagaaaatgagatgg

SEQ ID NO: 398977 - DNA, 15 bp, Homo sapiens
gaagaaagaagcact

SEQ ID NO: 398978 - DNA, 17 bp, Homo sapiens
gaagaaagaagcactct

SEQ ID NO: 398979 - DNA, 12 bp, Homo sapiens
gaagaaagcaaa

SEQ ID NO: 398980 - DNA, 23 bp, Homo sapiens
gaagaaattatttaatatgcatc

SEQ ID NO: 398981 - DNA, 19 bp, Homo sapiens
gaagaacacagcatgtgcc

SEQ ID NO: 398982 - DNA, 22 bp, Homo sapiens
gaagaacacagcatgtgccaag

SEQ ID NO: 398983 - DNA, 23 bp, Homo sapiens
gaagaacacagcatgtgccaaga

SEQ ID NO: 398984 - DNA, 13 bp, Homo sapiens
gaagaacagcaga

SEQ ID NO: 398985 - DNA, 13 bp, Homo sapiens
gaagaaccatctt

SEQ ID NO: 398986 - DNA, 22 bp, Homo sapiens
gaagaagaccagtcacagccat

SEQ ID NO: 398987 - DNA, 16 bp, Homo sapiens
gaagaaggcccgggag

SEQ ID NO: 398988 - DNA, 18 bp, Homo sapiens
gaagaaggcccgggagga

SEQ ID NO: 398989 - DNA, 14 bp, Homo sapiens
gaagaagggaaatt

SEQ ID NO: 398990 - DNA, 15 bp, Homo sapiens
gaagaagtatatttt

SEQ ID NO: 398991 - DNA, 13 bp, Homo sapiens
gaagaatataaat

SEQ ID NO: 398992 - DNA, 14 bp, Homo sapiens
gaagaatattcagg

SEQ ID NO: 398993 - DNA, 17 bp, Homo sapiens
gaagaatattcaggact

SEQ ID NO: 398994 - DNA, 13 bp, Homo sapiens
gaagaatggccat

SEQ ID NO: 398995 - DNA, 13 bp, Homo sapiens
gaagaattatttt

SEQ ID NO: 398996 - DNA, 16 bp, Homo sapiens
gaagaatttgttcttg

SEQ ID NO: 398997 - DNA, 16 bp, Homo sapiens
gaagacatatcatgtg

SEQ ID NO: 398998 - DNA, 18 bp, Homo sapiens
gaagacatgaaccaagtg

SEQ ID NO: 398999 - DNA, 14 bp, Homo sapiens
gaagaccagtcaca

SEQ ID NO: 399000 - DNA, 23 bp, Homo sapiens
gaagaccagtcacagccatttca

SEQ ID NO: 399001 - DNA, 14 bp, Homo sapiens
gaagaccccaccca

SEQ ID NO: 399002 - DNA, 18 bp, Homo sapiens
gaagaccccacccaagct

SEQ ID NO: 399003 - DNA, 16 bp, Homo sapiens
gaagaccttctgaaga

SEQ ID NO: 399004 - DNA, 13 bp, Homo sapiens
gaagactggagac

SEQ ID NO: 399005 - DNA, 20 bp, Homo sapiens
gaagacttagatctgagccc

SEQ ID NO: 399006 - DNA, 16 bp, Homo sapiens
gaagacttctagcaga

SEQ ID NO: 399007 - DNA, 15 bp, Homo sapiens
gaagacttggcccag

SEQ ID NO: 399008 - DNA, 20 bp, Homo sapiens
gaagacttttctttcagcca

SEQ ID NO: 399009 - DNA, 12 bp, Homo sapiens
gaagagaaacca

SEQ ID NO: 399010 - DNA, 12 bp, Homo sapiens
gaagagagcctg

SEQ ID NO: 399011 - DNA, 13 bp, Homo sapiens
gaagagaggagtt

SEQ ID NO: 399012 - DNA, 15 bp, Homo sapiens
gaagagaggagttca

SEQ ID NO: 399013 - DNA, 19 bp, Homo sapiens
gaagagaggagttcaatga

SEQ ID NO: 399014 - DNA, 19 bp, Homo sapiens
gaagagaggcacctgctgg

SEQ ID NO: 399015 - DNA, 23 bp, Homo sapiens
gaagagaggcacctgctggaaac

SEQ ID NO: 399016 - DNA, 17 bp, Homo sapiens
gaagagcgctcctctgc

SEQ ID NO: 399017 - DNA, 18 bp, Homo sapiens
gaagagcgctcctctgcc

SEQ ID NO: 399018 - DNA, 17 bp, Homo sapiens
gaagagctgagtactca

SEQ ID NO: 399019 - DNA, 15 bp, Homo sapiens
gaagaggagccctca

SEQ ID NO: 399020 - DNA, 21 bp, Homo sapiens
gaagagggaatggatggggag

SEQ ID NO: 399021 - DNA, 13 bp, Homo sapiens
gaagagggagaag

SEQ ID NO: 399022 - DNA, 20 bp, Homo sapiens
gaagagggagaagcatgaaa

SEQ ID NO: 399023 - DNA, 19 bp, Homo sapiens
gaagagggagaaggagagg

SEQ ID NO: 399024 - DNA, 21 bp, Homo sapiens
gaagagggctgagctgagctt

SEQ ID NO: 399025 - DNA, 17 bp, Homo sapiens
gaagaggggaggggcct

SEQ ID NO: 399026 - DNA, 21 bp, Homo sapiens
gaagaggggaggggcctaggg

SEQ ID NO: 399027 - DNA, 21 bp, Homo sapiens
gaagaggttctcagcaagtgt

SEQ ID NO: 399028 - DNA, 22 bp, Homo sapiens
gaagaggttctcagcaagtgta

SEQ ID NO: 399029 - DNA, 14 bp, Homo sapiens
gaagagtatggatt

SEQ ID NO: 399030 - DNA, 17 bp, Homo sapiens
gaagataggctctgcac

SEQ ID NO: 399031 - DNA, 20 bp, Homo sapiens
gaagatctgcctcccctgtg

SEQ ID NO: 399032 - DNA, 17 bp, Homo sapiens
gaagatcttgagagctg

SEQ ID NO: 399033 - DNA, 20 bp, Homo sapiens
gaagatcttgagagctgctg

SEQ ID NO: 399034 - DNA, 12 bp, Homo sapiens
gaagatgccctc

SEQ ID NO: 399035 - DNA, 17 bp, Homo sapiens
gaagatgctggccccaa

SEQ ID NO: 399036 - DNA, 18 bp, Homo sapiens
gaagatggactctgaaaa

SEQ ID NO: 399037 - DNA, 18 bp, Homo sapiens
gaagatgtattcagagcc

SEQ ID NO: 399038 - DNA, 15 bp, Homo sapiens
gaagattctaaaaca

SEQ ID NO: 399039 - DNA, 22 bp, Homo sapiens
gaagatttgatgctggagaggt

SEQ ID NO: 399040 - DNA, 19 bp, Homo sapiens
gaagcaaataccaaagcag

SEQ ID NO: 399041 - DNA, 18 bp, Homo sapiens
gaagcaagacgtcctgga

SEQ ID NO: 399042 - DNA, 21 bp, Homo sapiens
gaagcaagacgtcctggaatg

SEQ ID NO: 399043 - DNA, 14 bp, Homo sapiens
gaagcaaggccagc

SEQ ID NO: 399044 - DNA, 15 bp, Homo sapiens
gaagcaattatttaa

SEQ ID NO: 399045 - DNA, 19 bp, Homo sapiens
gaagcaattatttaaagaa

SEQ ID NO: 399046 - DNA, 21 bp, Homo sapiens
gaagcaattatttaaagaaag

SEQ ID NO: 399047 - DNA, 22 bp, Homo sapiens
gaagcaattatttaaagaaagt

SEQ ID NO: 399048 - DNA, 21 bp, Homo sapiens
gaagcacaagaagtgggagtg

SEQ ID NO: 399049 - DNA, 20 bp, Homo sapiens
gaagcacaagttcctggttt

SEQ ID NO: 399050 - DNA, 18 bp, Homo sapiens
gaagcacaggccagggga

SEQ ID NO: 399051 - DNA, 22 bp, Homo sapiens
gaagcacaggccaggggatctg

SEQ ID NO: 399052 - DNA, 13 bp, Homo sapiens
gaagcaccccacc

SEQ ID NO: 399053 - DNA, 21 bp, Homo sapiens
gaagcaccccatgccaaagct

SEQ ID NO: 399054 - DNA, 20 bp, Homo sapiens
gaagcacctactatgtgctg

SEQ ID NO: 399055 - DNA, 20 bp, Homo sapiens
gaagcacctatgaaagcaac

SEQ ID NO: 399056 - DNA, 17 bp, Homo sapiens
gaagcactctgctggcg

SEQ ID NO: 399057 - DNA, 16 bp, Homo sapiens
gaagcagggagagttg

SEQ ID NO: 399058 - DNA, 15 bp, Homo sapiens
gaagcagtcttgctc

SEQ ID NO: 399059 - DNA, 16 bp, Homo sapiens
gaagcagtgcctcgag

SEQ ID NO: 399060 - DNA, 19 bp, Homo sapiens
gaagcagtgcctcgaggca

SEQ ID NO: 399061 - DNA, 17 bp, Homo sapiens
gaagcagtgccttccat

SEQ ID NO: 399062 - DNA, 22 bp, Homo sapiens
gaagcagtgtcgccgtccctct

SEQ ID NO: 399063 - DNA, 19 bp, Homo sapiens
gaagcatgctttgctgcta

SEQ ID NO: 399064 - DNA, 13 bp, Homo sapiens
gaagcatgtttca

SEQ ID NO: 399065 - DNA, 15 bp, Homo sapiens
gaagccaagacagtg

SEQ ID NO: 399066 - DNA, 17 bp, Homo sapiens
gaagccacgtgctggag

SEQ ID NO: 399067 - DNA, 20 bp, Homo sapiens
gaagccatattcacacctca

SEQ ID NO: 399068 - DNA, 18 bp, Homo sapiens
gaagccatcacttctccc

SEQ ID NO: 399069 - DNA, 11 bp, Homo sapiens
gaagcccaccc

SEQ ID NO: 399070 - DNA, 12 bp, Homo sapiens
gaagcccacccg

SEQ ID NO: 399071 - DNA, 14 bp, Homo sapiens
gaagcccacccgcc

SEQ ID NO: 399072 - DNA, 15 bp, Homo sapiens
gaagcccacccgccc

SEQ ID NO: 399073 - DNA, 16 bp, Homo sapiens
gaagcccacccgcccc

SEQ ID NO: 399074 - DNA, 23 bp, Homo sapiens
gaagcccacccgccccagagact

SEQ ID NO: 399075 - DNA, 16 bp, Homo sapiens
gaagccccgctcaggt

SEQ ID NO: 399076 - DNA, 20 bp, Homo sapiens
gaagccccgctcaggtagcc

SEQ ID NO: 399077 - DNA, 17 bp, Homo sapiens
gaagccctccaaaagca

SEQ ID NO: 399078 - DNA, 21 bp, Homo sapiens
gaagccctttgcctgtagagc

SEQ ID NO: 399079 - DNA, 19 bp, Homo sapiens
gaagccgcaccaccagcca

SEQ ID NO: 399080 - DNA, 16 bp, Homo sapiens
gaagccgccaggaccg

SEQ ID NO: 399081 - DNA, 15 bp, Homo sapiens
gaagccggcggccca

SEQ ID NO: 399082 - DNA, 20 bp, Homo sapiens
gaagccgtctgactccagag

SEQ ID NO: 399083 - DNA, 23 bp, Homo sapiens
gaagccgtctgactccagagtct

SEQ ID NO: 399084 - DNA, 24 bp, Homo sapiens
gaagccgtctgactccagagtctg

SEQ ID NO: 399085 - DNA, 16 bp, Homo sapiens
gaagcctattgtaaat

SEQ ID NO: 399086 - DNA, 21 bp, Homo sapiens
gaagcctccaagcctgcctcc

SEQ ID NO: 399087 - DNA, 12 bp, Homo sapiens
gaagcctctcat

SEQ ID NO: 399088 - DNA, 15 bp, Homo sapiens
gaagcctctgccctg

SEQ ID NO: 399089 - DNA, 14 bp, Homo sapiens
gaagcctctggcta

SEQ ID NO: 399090 - DNA, 12 bp, Homo sapiens
gaagcctgctga

SEQ ID NO: 399091 - DNA, 12 bp, Homo sapiens
gaagccttgctg

SEQ ID NO: 399092 - DNA, 13 bp, Homo sapiens
gaagcgaacatct

SEQ ID NO: 399093 - DNA, 17 bp, Homo sapiens
gaagcgaacatcttcat

SEQ ID NO: 399094 - DNA, 16 bp, Homo sapiens
gaagcgagcactgacc

SEQ ID NO: 399095 - DNA, 20 bp, Homo sapiens
gaagctatttcctttgcgca

SEQ ID NO: 399096 - DNA, 15 bp, Homo sapiens
gaagctcaaggctgc

SEQ ID NO: 399097 - DNA, 21 bp, Homo sapiens
gaagctcagcccacccccctc

SEQ ID NO: 399098 - DNA, 19 bp, Homo sapiens
gaagctcagtttggctgta

SEQ ID NO: 399099 - DNA, 12 bp, Homo sapiens
gaagctcctggt

SEQ ID NO: 399100 - DNA, 19 bp, Homo sapiens
gaagctggagtgctgcttg

SEQ ID NO: 399101 - DNA, 22 bp, Homo sapiens
gaagctggcaggagacactggt

SEQ ID NO: 399102 - DNA, 17 bp, Homo sapiens
gaagctggccgagggtc

SEQ ID NO: 399103 - DNA, 22 bp, Homo sapiens
gaagctgggactcattcacatt

SEQ ID NO: 399104 - DNA, 15 bp, Homo sapiens
aacaaaagcaagact

SEQ ID NO: 399105 - DNA, 13 bp, Homo sapiens
aacaaaaggcttt

SEQ ID NO: 399106 - DNA, 21 bp, Homo sapiens
aacaaaatatttatttgtttt

SEQ ID NO: 399107 - DNA, 21 bp, Homo sapiens
aacaaaatccttgccttcaaa

SEQ ID NO: 399108 - DNA, 13 bp, Homo sapiens
aacaaaatctgaa

SEQ ID NO: 399109 - DNA, 19 bp, Homo sapiens
aacaaaatttgtttgaaat

SEQ ID NO: 399110 - DNA, 16 bp, Homo sapiens
aacaaacaacctgcca

SEQ ID NO: 399111 - DNA, 21 bp, Homo sapiens
aacaaacctctatatgttgct

SEQ ID NO: 399112 - DNA, 17 bp, Homo sapiens
aacaaactctactaatt

SEQ ID NO: 399113 - DNA, 15 bp, Homo sapiens
aacaaagcacagtgt

SEQ ID NO: 399114 - DNA, 17 bp, Homo sapiens
aacaaagcacagtgtta

SEQ ID NO: 399115 - DNA, 15 bp, Homo sapiens
aacaaagcatgctca

SEQ ID NO: 399116 - DNA, 16 bp, Homo sapiens
aacaaagcatgctcag

SEQ ID NO: 399117 - DNA, 21 bp, Homo sapiens
aacaaagcatgctcagtattg

SEQ ID NO: 399118 - DNA, 17 bp, Homo sapiens
aacaaaggatttgaaaa

SEQ ID NO: 399119 - DNA, 23 bp, Homo sapiens
aacaaatatgattctcctctccc

SEQ ID NO: 399120 - DNA, 13 bp, Homo sapiens
aacaacaaagcat

SEQ ID NO: 399121 - DNA, 22 bp, Homo sapiens
gaagttttcttttactatcttt

SEQ ID NO: 399122 - DNA, 14 bp, Homo sapiens
gaataaaaaccctg

SEQ ID NO: 399123 - DNA, 16 bp, Homo sapiens
gaataaaaactttgct

SEQ ID NO: 399124 - DNA, 13 bp, Homo sapiens
gaataaaaattaa

SEQ ID NO: 399125 - DNA, 12 bp, Homo sapiens
gaataaaagtgc

SEQ ID NO: 399126 - DNA, 14 bp, Homo sapiens
gaataaagacacct

SEQ ID NO: 399127 - DNA, 19 bp, Homo sapiens
gaataaagacttcatgttc

SEQ ID NO: 399128 - DNA, 17 bp, Homo sapiens
gaataaataaagaagaa

SEQ ID NO: 399129 - DNA, 14 bp, Homo sapiens
gaataaatttggga

SEQ ID NO: 399130 - DNA, 12 bp, Homo sapiens
gaataacactgc

SEQ ID NO: 399131 - DNA, 12 bp, Homo sapiens
gaataacttgaa

SEQ ID NO: 399132 - DNA, 23 bp, Homo sapiens
gaataagaaaacaatcacactca

SEQ ID NO: 399133 - DNA, 21 bp, Homo sapiens
gaataataaatacacaatgaa

SEQ ID NO: 399134 - DNA, 19 bp, Homo sapiens
gaataatatgctgccaaat

SEQ ID NO: 399135 - DNA, 22 bp, Homo sapiens
gaataatgacgtattgtgaaat

SEQ ID NO: 399136 - DNA, 17 bp, Homo sapiens
gaataatggaattatgt

SEQ ID NO: 399137 - DNA, 14 bp, Homo sapiens
gaataatgtagtgc

SEQ ID NO: 399138 - DNA, 13 bp, Homo sapiens
gaataatgtgtta

SEQ ID NO: 399139 - DNA, 20 bp, Homo sapiens
gaataattatttatttaata

SEQ ID NO: 399140 - DNA, 13 bp, Homo sapiens
gaataattgtgta

SEQ ID NO: 399141 - DNA, 16 bp, Homo sapiens
gaataattgtgtacaa

SEQ ID NO: 399142 - DNA, 21 bp, Homo sapiens
gaataattgtgtacaaagtag

SEQ ID NO: 399143 - DNA, 14 bp, Homo sapiens
gaatacaattaaag

SEQ ID NO: 399144 - DNA, 15 bp, Homo sapiens
gaatacaattaaagg

SEQ ID NO: 399145 - DNA, 16 bp, Homo sapiens
gaatacaattaaaggt

SEQ ID NO: 399146 - DNA, 20 bp, Homo sapiens
gaatactgttaaaggaaaaa

SEQ ID NO: 399147 - DNA, 15 bp, Homo sapiens
gaatactttttaaaa

SEQ ID NO: 399148 - DNA, 17 bp, Homo sapiens
gaatagtacatgcagaa

SEQ ID NO: 399149 - DNA, 17 bp, Homo sapiens
gaatagtctctgggttt

SEQ ID NO: 399150 - DNA, 11 bp, Homo sapiens
gaatataaatg

SEQ ID NO: 399151 - DNA, 19 bp, Homo sapiens
gaatataagcttaaaataa

SEQ ID NO: 399152 - DNA, 14 bp, Homo sapiens
gaatatacatagtc

SEQ ID NO: 399153 - DNA, 14 bp, Homo sapiens
gaatatactgtctt

SEQ ID NO: 399154 - DNA, 18 bp, Homo sapiens
gaatatactgtcttgtct

SEQ ID NO: 399155 - DNA, 15 bp, Homo sapiens
gaatatcatatgtat

SEQ ID NO: 399156 - DNA, 15 bp, Homo sapiens
gaatatgacggaaga

SEQ ID NO: 399157 - DNA, 19 bp, Homo sapiens
gaatatgacggaagaacat

SEQ ID NO: 399158 - DNA, 13 bp, Homo sapiens
gaatatggaacat

SEQ ID NO: 399159 - DNA, 23 bp, Homo sapiens
gaatattaagaaacaatttaaat

SEQ ID NO: 399160 - DNA, 13 bp, Homo sapiens
gaatattaatccc

SEQ ID NO: 399161 - DNA, 18 bp, Homo sapiens
gaatattataaaaatatc

SEQ ID NO: 399162 - DNA, 11 bp, Homo sapiens
gaatattcagg

SEQ ID NO: 399163 - DNA, 10 bp, Homo sapiens
gaatatttat

SEQ ID NO: 399164 - DNA, 13 bp, Homo sapiens
gaatatttataac

SEQ ID NO: 399165 - DNA, 15 bp, Homo sapiens
gaatatttataacag

SEQ ID NO: 399166 - DNA, 18 bp, Homo sapiens
gaatatttatatttcact

SEQ ID NO: 399167 - DNA, 12 bp, Homo sapiens
gaatatttatta

SEQ ID NO: 399168 - DNA, 15 bp, Homo sapiens
gaatatttattacct

SEQ ID NO: 399169 - DNA, 17 bp, Homo sapiens
gaatatttattacctct

SEQ ID NO: 399170 - DNA, 19 bp, Homo sapiens
gaatcaacagtgaacagct

SEQ ID NO: 399171 - DNA, 17 bp, Homo sapiens
gaatcaatctggcttct

SEQ ID NO: 399172 - DNA, 23 bp, Homo sapiens
gaatcaatctggcttctgcatta

SEQ ID NO: 399173 - DNA, 18 bp, Homo sapiens
gaatcacctaattaattt

SEQ ID NO: 399174 - DNA, 22 bp, Homo sapiens
gaatcagctatgcaaatcagtc

SEQ ID NO: 399175 - DNA, 14 bp, Homo sapiens
gaatccaaagtgga

SEQ ID NO: 399176 - DNA, 20 bp, Homo sapiens
gaatccaagcctaaaattaa

SEQ ID NO: 399177 - DNA, 15 bp, Homo sapiens
gaatccacccatcct

SEQ ID NO: 399178 - DNA, 15 bp, Homo sapiens
gaatccagaaggaag

SEQ ID NO: 399179 - DNA, 22 bp, Homo sapiens
gaatccagctccctagactgca

SEQ ID NO: 399180 - DNA, 14 bp, Homo sapiens
gaatccagtgcttc

SEQ ID NO: 399181 - DNA, 22 bp, Homo sapiens
gaatcccacttatcaaatcatt

SEQ ID NO: 399182 - DNA, 17 bp, Homo sapiens
gaatcccagaggtggga

SEQ ID NO: 399183 - DNA, 16 bp, Homo sapiens
gaatcccctccctgtc

SEQ ID NO: 399184 - DNA, 13 bp, Homo sapiens
gaatcccctcgct

SEQ ID NO: 399185 - DNA, 19 bp, Homo sapiens
gaatcctgccacacatgct

SEQ ID NO: 399186 - DNA, 18 bp, Homo sapiens
gaatcgacctcactgtca

SEQ ID NO: 399187 - DNA, 16 bp, Homo sapiens
gaatcgaggaaccaga

SEQ ID NO: 399188 - DNA, 19 bp, Homo sapiens
gaatcgcttgaacctggga

SEQ ID NO: 399189 - DNA, 21 bp, Homo sapiens
gaatcggtgctgtcagccctg

SEQ ID NO: 399190 - DNA, 16 bp, Homo sapiens
gaatcgtttcatgtaa

SEQ ID NO: 399191 - DNA, 19 bp, Homo sapiens
gaatctacagaacaaagaa

SEQ ID NO: 399192 - DNA, 22 bp, Homo sapiens
gaatctcaatgacctgttgatt

SEQ ID NO: 399193 - DNA, 19 bp, Homo sapiens
gaatctcccctcctcacag

SEQ ID NO: 399194 - DNA, 12 bp, Homo sapiens
gaatctgagggc

SEQ ID NO: 399195 - DNA, 22 bp, Homo sapiens
gaatctgagggcactctctgcc

SEQ ID NO: 399196 - DNA, 19 bp, Homo sapiens
gaatctgcctgtggccttg

SEQ ID NO: 399197 - DNA, 16 bp, Homo sapiens
gaatctgccttccagc

SEQ ID NO: 399198 - DNA, 21 bp, Homo sapiens
gaatctgccttccagcccaga

SEQ ID NO: 399199 - DNA, 20 bp, Homo sapiens
gaatctgctgcatagctcta

SEQ ID NO: 399200 - DNA, 21 bp, Homo sapiens
gaatctgctgttgccatagcc

SEQ ID NO: 399201 - DNA, 20 bp, Homo sapiens
gaatctgtagaggagcctgg

SEQ ID NO: 399202 - DNA, 23 bp, Homo sapiens
gaatctgtagaggagcctggagt

SEQ ID NO: 399203 - DNA, 13 bp, Homo sapiens
gaatctgtgcagt

SEQ ID NO: 399204 - DNA, 20 bp, Homo sapiens
gaatctgtgcagtcatcaac

SEQ ID NO: 399205 - DNA, 23 bp, Homo sapiens
gaatctgtgcagtcatcaacaaa

SEQ ID NO: 399206 - DNA, 18 bp, Homo sapiens
gaatcttatggtggaaga

SEQ ID NO: 399207 - DNA, 11 bp, Homo sapiens
gaatcttgatt

SEQ ID NO: 399208 - DNA, 15 bp, Homo sapiens
gaatgaaaaatttaa

SEQ ID NO: 399209 - DNA, 13 bp, Homo sapiens
gaatgaagcatgt

SEQ ID NO: 399210 - DNA, 15 bp, Homo sapiens
gaatgaagcatgtag

SEQ ID NO: 399211 - DNA, 16 bp, Homo sapiens
gaatgaagcatgtagc

SEQ ID NO: 399212 - DNA, 17 bp, Homo sapiens
gaatgagaaagaaaagg

SEQ ID NO: 399213 - DNA, 13 bp, Homo sapiens
gaatgagagagtg

SEQ ID NO: 399214 - DNA, 18 bp, Homo sapiens
gaatgagagagtgtggaa

SEQ ID NO: 399215 - DNA, 12 bp, Homo sapiens
gaatgagctggg

SEQ ID NO: 399216 - DNA, 14 bp, Homo sapiens
gaatgaggaggaag

SEQ ID NO: 399217 - DNA, 15 bp, Homo sapiens
gaatgagtaaataaa

SEQ ID NO: 399218 - DNA, 13 bp, Homo sapiens
gaatgatgaagct

SEQ ID NO: 399219 - DNA, 14 bp, Homo sapiens
gaatgatgccatga

SEQ ID NO: 399220 - DNA, 22 bp, Homo sapiens
gaatgattccctcttgctattg

SEQ ID NO: 399221 - DNA, 15 bp, Homo sapiens
gaatgattttgacat

SEQ ID NO: 399222 - DNA, 14 bp, Homo sapiens
gaatgcagtgggtg

SEQ ID NO: 399223 - DNA, 16 bp, Homo sapiens
gaatgccagcccaaag

SEQ ID NO: 399224 - DNA, 21 bp, Homo sapiens
gaatgcgctcttcaccaggaa

SEQ ID NO: 399225 - DNA, 23 bp, Homo sapiens
gaatgcggcaagaaggaattgac

SEQ ID NO: 399226 - DNA, 15 bp, Homo sapiens
gaatgcggttcaggg

SEQ ID NO: 399227 - DNA, 15 bp, Homo sapiens
gaatgctcaatgtgc

SEQ ID NO: 399228 - DNA, 17 bp, Homo sapiens
gaatgctcaatgtgctg

SEQ ID NO: 399229 - DNA, 11 bp, Homo sapiens
gaatgctcccc

SEQ ID NO: 399230 - DNA, 22 bp, Homo sapiens
gaatgctcccccatcctcccct

SEQ ID NO: 399231 - DNA, 15 bp, Homo sapiens
gaatgctctgtgcca

SEQ ID NO: 399232 - DNA, 23 bp, Homo sapiens
gaatgctgcccagggtcagtgta

SEQ ID NO: 399233 - DNA, 13 bp, Homo sapiens
gaatgctgtagaa

SEQ ID NO: 399234 - DNA, 15 bp, Homo sapiens
gaatgctgtatatgt

SEQ ID NO: 399235 - DNA, 18 bp, Homo sapiens
aaccagaatgattttgac

SEQ ID NO: 399236 - DNA, 11 bp, Homo sapiens
aaccagagccc

SEQ ID NO: 399237 - DNA, 13 bp, Homo sapiens
aaccagagccccc

SEQ ID NO: 399238 - DNA, 19 bp, Homo sapiens
aaccagcaagtcccagaca

SEQ ID NO: 399239 - DNA, 17 bp, Homo sapiens
aaccagcactcccaggg

SEQ ID NO: 399240 - DNA, 20 bp, Homo sapiens
aaccagcactcccagggccc

SEQ ID NO: 399241 - DNA, 16 bp, Homo sapiens
aaccaggactctgccc

SEQ ID NO: 399242 - DNA, 22 bp, Homo sapiens
aaccaggattttgtgttttttc

SEQ ID NO: 399243 - DNA, 22 bp, Homo sapiens
aaccaggccccagcctccaggc

SEQ ID NO: 399244 - DNA, 19 bp, Homo sapiens
aaccagggaagctgtccct

SEQ ID NO: 399245 - DNA, 21 bp, Homo sapiens
aaccagggagcccctttgatg

SEQ ID NO: 399246 - DNA, 17 bp, Homo sapiens
aaccagggcaccaagcc

SEQ ID NO: 399247 - DNA, 14 bp, Homo sapiens
aaccagtctgaagt

SEQ ID NO: 399248 - DNA, 15 bp, Homo sapiens
aaccagtctgaagtt

SEQ ID NO: 399249 - DNA, 21 bp, Homo sapiens
aaccagtctgaagtttcattt

SEQ ID NO: 399250 - DNA, 22 bp, Homo sapiens
aaccagtctgaagtttcattta

SEQ ID NO: 399251 - DNA, 16 bp, Homo sapiens
aaccataaaataaata

SEQ ID NO: 399252 - DNA, 16 bp, Homo sapiens
aaccatccccaactcc

SEQ ID NO: 399253 - DNA, 18 bp, Homo sapiens
aaccatgaggtaaaagag

SEQ ID NO: 399254 - DNA, 23 bp, Homo sapiens
aaccattgatgagcactcctgat

SEQ ID NO: 399255 - DNA, 15 bp, Homo sapiens
aaccattgcttcact

SEQ ID NO: 399256 - DNA, 16 bp, Homo sapiens
aaccattgcttcacta

SEQ ID NO: 399257 - DNA, 13 bp, Homo sapiens
aacccaaaagatt

SEQ ID NO: 399258 - DNA, 19 bp, Homo sapiens
aacccaactgacttctgct

SEQ ID NO: 399259 - DNA, 20 bp, Homo sapiens
aacccaactgacttctgcta

SEQ ID NO: 399260 - DNA, 18 bp, Homo sapiens
aacccacaagctgcctct

SEQ ID NO: 399261 - DNA, 22 bp, Homo sapiens
aacccaccttgttggagcctgc

SEQ ID NO: 399262 - DNA, 22 bp, Homo sapiens
aacccagcgttcttcaggagat

SEQ ID NO: 399263 - DNA, 24 bp, Homo sapiens
aacccagcgttcttcaggagatga

SEQ ID NO: 399264 - DNA, 16 bp, Homo sapiens
aacccaggacgcttct

SEQ ID NO: 399265 - DNA, 19 bp, Homo sapiens
aacccaggacgcttctgaa

SEQ ID NO: 399266 - DNA, 21 bp, Homo sapiens
aacccaggccacaaatgtgtc

SEQ ID NO: 399267 - DNA, 14 bp, Homo sapiens
gacacataaaagta

SEQ ID NO: 399268 - DNA, 15 bp, Homo sapiens
gacacataatttgaa

SEQ ID NO: 399269 - DNA, 13 bp, Homo sapiens
gacacatcccggc

SEQ ID NO: 399270 - DNA, 16 bp, Homo sapiens
gacacatcccggcctc

SEQ ID NO: 399271 - DNA, 23 bp, Homo sapiens
gacacatgctctcaatatataat

SEQ ID NO: 399272 - DNA, 14 bp, Homo sapiens
gacaccagccctgc

SEQ ID NO: 399273 - DNA, 13 bp, Homo sapiens
gacaccatcccct

SEQ ID NO: 399274 - DNA, 21 bp, Homo sapiens
gacacccaccccctctttgtg

SEQ ID NO: 399275 - DNA, 15 bp, Homo sapiens
gacacccattttcac

SEQ ID NO: 399276 - DNA, 19 bp, Homo sapiens
gacacccctgctctaccca

SEQ ID NO: 399277 - DNA, 19 bp, Homo sapiens
gacaccctaactcttgctc

SEQ ID NO: 399278 - DNA, 22 bp, Homo sapiens
gacaccctaactcttgctcact

SEQ ID NO: 399279 - DNA, 24 bp, Homo sapiens
gacaccctaactcttgctcactcc

SEQ ID NO: 399280 - DNA, 22 bp, Homo sapiens
gacaccctacacaaaatacagc

SEQ ID NO: 399281 - DNA, 17 bp, Homo sapiens
gacaccgtttgtccccc

SEQ ID NO: 399282 - DNA, 17 bp, Homo sapiens
gacacctactgagtggc

SEQ ID NO: 399283 - DNA, 13 bp, Homo sapiens
gacacctcagagc

SEQ ID NO: 399284 - DNA, 9 bp, Homo sapiens
gacacctgc

SEQ ID NO: 399285 - DNA, 13 bp, Homo sapiens
gacacctgccctg

SEQ ID NO: 399286 - DNA, 19 bp, Homo sapiens
gacacctggagactgtccc

SEQ ID NO: 399287 - DNA, 18 bp, Homo sapiens
gacacggcctctggggag

SEQ ID NO: 399288 - DNA, 17 bp, Homo sapiens
gacacgggcagcctggc

SEQ ID NO: 399289 - DNA, 20 bp, Homo sapiens
gacacgggcagcctggctcc

SEQ ID NO: 399290 - DNA, 18 bp, Homo sapiens
gacactaagttatagtat

SEQ ID NO: 399291 - DNA, 20 bp, Homo sapiens
gacactaagttatagtatat

SEQ ID NO: 399292 - DNA, 21 bp, Homo sapiens
gacactagtagagcaaagact

SEQ ID NO: 399293 - DNA, 20 bp, Homo sapiens
gacactatagtttaaaacac

SEQ ID NO: 399294 - DNA, 21 bp, Homo sapiens
gacactctagtgacttcctgg

SEQ ID NO: 399295 - DNA, 15 bp, Homo sapiens
gacactgaaggcaaa

SEQ ID NO: 399296 - DNA, 19 bp, Homo sapiens
gacactgaaggcaaatctc

SEQ ID NO: 399297 - DNA, 18 bp, Homo sapiens
gacactgatgggtcctgc

SEQ ID NO: 399298 - DNA, 19 bp, Homo sapiens
gacactgatgggtcctgct

SEQ ID NO: 399299 - DNA, 21 bp, Homo sapiens
gacactgatgggtcctgctgc

SEQ ID NO: 399300 - DNA, 19 bp, Homo sapiens
gacactgctgcaccagagt

SEQ ID NO: 399301 - DNA, 20 bp, Homo sapiens
gacactgctgcaccagagtg

SEQ ID NO: 399302 - DNA, 14 bp, Homo sapiens
gacactggtctcag

SEQ ID NO: 399303 - DNA, 20 bp, Homo sapiens
gacactgtgcccagcccgga

SEQ ID NO: 399304 - DNA, 23 bp, Homo sapiens
gacactgtgcccagcccggacct

SEQ ID NO: 399305 - DNA, 23 bp, Homo sapiens
gacactgtggaaagctttgaaca

SEQ ID NO: 399306 - DNA, 16 bp, Homo sapiens
gacactgttaatagta

SEQ ID NO: 399307 - DNA, 15 bp, Homo sapiens
gacacttcagagagc

SEQ ID NO: 399308 - DNA, 18 bp, Homo sapiens
gacacttcagagagctgg

SEQ ID NO: 399309 - DNA, 20 bp, Homo sapiens
gacacttcagagagctggta

SEQ ID NO: 399310 - DNA, 22 bp, Homo sapiens
gacacttgccttcttcacccag

SEQ ID NO: 399311 - DNA, 20 bp, Homo sapiens
gacagaaaaaaaaatgtttt

SEQ ID NO: 399312 - DNA, 22 bp, Homo sapiens
gacagaaaaaaaaatgttttat

SEQ ID NO: 399313 - DNA, 17 bp, Homo sapiens
gacagaagcaggctgga

SEQ ID NO: 399314 - DNA, 23 bp, Homo sapiens
gacagaagcttgtggggtacatg

SEQ ID NO: 399315 - DNA, 16 bp, Homo sapiens
gacagaaggccttgaa

SEQ ID NO: 399316 - DNA, 18 bp, Homo sapiens
gacagacatctctgcacc

SEQ ID NO: 399317 - DNA, 18 bp, Homo sapiens
gacagacggacgggacag

SEQ ID NO: 399318 - DNA, 17 bp, Homo sapiens
gacagagaaggcagcag

SEQ ID NO: 399319 - DNA, 21 bp, Homo sapiens
gacagagagttctggtgagat

SEQ ID NO: 399320 - DNA, 16 bp, Homo sapiens
gacagagcccagcatc

SEQ ID NO: 399321 - DNA, 12 bp, Homo sapiens
gacagagggaga

SEQ ID NO: 399322 - DNA, 15 bp, Homo sapiens
gacagagggagaagg

SEQ ID NO: 399323 - DNA, 16 bp, Homo sapiens
gacagagggagaaggg

SEQ ID NO: 399324 - DNA, 15 bp, Homo sapiens
gacagagtctcgctc

SEQ ID NO: 399325 - DNA, 15 bp, Homo sapiens
gacagagtctgggtg

SEQ ID NO: 399326 - DNA, 16 bp, Homo sapiens
gacagatcctccattt

SEQ ID NO: 399327 - DNA, 13 bp, Homo sapiens
gacagatcttgag

SEQ ID NO: 399328 - DNA, 15 bp, Homo sapiens
gacagatcttgagca

SEQ ID NO: 399329 - DNA, 16 bp, Homo sapiens
gacagatgaaaggaga

SEQ ID NO: 399330 - DNA, 14 bp, Homo sapiens
gacagatgccccag

SEQ ID NO: 399331 - DNA, 22 bp, Homo sapiens
gacagcaaaaccattgcttcac

SEQ ID NO: 399332 - DNA, 22 bp, Homo sapiens
gacagcaacggggaggccaagt

SEQ ID NO: 399333 - DNA, 12 bp, Homo sapiens
gacagcaagttt

SEQ ID NO: 399334 - DNA, 14 bp, Homo sapiens
gacagcagcctgtg

SEQ ID NO: 399335 - DNA, 19 bp, Homo sapiens
gacagcatgccccttggct

SEQ ID NO: 399336 - DNA, 21 bp, Homo sapiens
gacagcatggtgcatgccgct

SEQ ID NO: 399337 - DNA, 13 bp, Homo sapiens
gacagccagagct

SEQ ID NO: 399338 - DNA, 16 bp, Homo sapiens
gacagccagagctggg

SEQ ID NO: 399339 - DNA, 17 bp, Homo sapiens
gacagcccactgagaag

SEQ ID NO: 399340 - DNA, 18 bp, Homo sapiens
gacagccggatcttggag

SEQ ID NO: 399341 - DNA, 18 bp, Homo sapiens
gacagccttgggcctttc

SEQ ID NO: 399342 - DNA, 19 bp, Homo sapiens
gacagccttgggcctttca

SEQ ID NO: 399343 - DNA, 18 bp, Homo sapiens
gacagcgggtaaaaagag

SEQ ID NO: 399344 - DNA, 21 bp, Homo sapiens
gacagcgggtaaaaagagaag

SEQ ID NO: 399345 - DNA, 21 bp, Homo sapiens
gacagcgtccggggtggtgga

SEQ ID NO: 399346 - DNA, 22 bp, Homo sapiens
gacagctactaacctggagaca

SEQ ID NO: 399347 - DNA, 15 bp, Homo sapiens
gacagctaggctgag

SEQ ID NO: 399348 - DNA, 17 bp, Homo sapiens
gacagctgcaggtgccc

SEQ ID NO: 399349 - DNA, 18 bp, Homo sapiens
gacagctgcaggtgccca

SEQ ID NO: 399350 - DNA, 14 bp, Homo sapiens
gacagctttcctgg

SEQ ID NO: 399351 - DNA, 15 bp, Homo sapiens
gacagctttcctggg

SEQ ID NO: 399352 - DNA, 17 bp, Homo sapiens
gacaggaaagggaaggc

SEQ ID NO: 399353 - DNA, 15 bp, Homo sapiens
gacaggaacacccag

SEQ ID NO: 399354 - DNA, 21 bp, Homo sapiens
gacaggaacacccagccccag

SEQ ID NO: 399355 - DNA, 19 bp, Homo sapiens
gacaggaagcacagcaggt

SEQ ID NO: 399356 - DNA, 20 bp, Homo sapiens
gacaggacgggcttgggctt

SEQ ID NO: 399357 - DNA, 14 bp, Homo sapiens
gacaggaggaggag

SEQ ID NO: 399358 - DNA, 23 bp, Homo sapiens
gacaggaggaggagatggccata

SEQ ID NO: 399359 - DNA, 18 bp, Homo sapiens
gacaggcagggagggctt

SEQ ID NO: 399360 - DNA, 19 bp, Homo sapiens
gacaggccctccctgtctc

SEQ ID NO: 399361 - DNA, 15 bp, Homo sapiens
gacaggcgcctgcca

SEQ ID NO: 399362 - DNA, 14 bp, Homo sapiens
gacagggaaaatat

SEQ ID NO: 399363 - DNA, 18 bp, Homo sapiens
gacaggggcatctctggg

SEQ ID NO: 399364 - DNA, 16 bp, Homo sapiens
aaccttgtttgtttta

SEQ ID NO: 399365 - DNA, 13 bp, Homo sapiens
aacctttatccct

SEQ ID NO: 399366 - DNA, 14 bp, Homo sapiens
aacctttcaaattt

SEQ ID NO: 399367 - DNA, 19 bp, Homo sapiens
aacctttcagctggcagag

SEQ ID NO: 399368 - DNA, 17 bp, Homo sapiens
aacctttgtgtaataaa

SEQ ID NO: 399369 - DNA, 20 bp, Homo sapiens
aacctttttttttgaaacag

SEQ ID NO: 399370 - DNA, 16 bp, Homo sapiens
aacgaaacacagaact

SEQ ID NO: 399371 - DNA, 12 bp, Homo sapiens
aacgaaacattt

SEQ ID NO: 399372 - DNA, 16 bp, Homo sapiens
aacgaacatggcatgt

SEQ ID NO: 399373 - DNA, 14 bp, Homo sapiens
aacgaagaaaaaaa

SEQ ID NO: 399374 - DNA, 15 bp, Homo sapiens
aacgagcactggcca

SEQ ID NO: 399375 - DNA, 13 bp, Homo sapiens
aacgatttagaaa

SEQ ID NO: 399376 - DNA, 18 bp, Homo sapiens
aacgcagatgatccatga

SEQ ID NO: 399377 - DNA, 11 bp, Homo sapiens
aacgcagccct

SEQ ID NO: 399378 - DNA, 11 bp, Homo sapiens
aacgcagcctc

SEQ ID NO: 399379 - DNA, 13 bp, Homo sapiens
aacgcaggagaga

SEQ ID NO: 399380 - DNA, 15 bp, Homo sapiens
aacgcaggagagaga

SEQ ID NO: 399381 - DNA, 17 bp, Homo sapiens
aacgcattaagaggttt

SEQ ID NO: 399382 - DNA, 13 bp, Homo sapiens
aacgccagtctcc

SEQ ID NO: 399383 - DNA, 22 bp, Homo sapiens
aacgccccagataccagcccct

SEQ ID NO: 399384 - DNA, 22 bp, Homo sapiens
aacgcctcttttccctctctag

SEQ ID NO: 399385 - DNA, 20 bp, Homo sapiens
aacggggtggacgagggagt

SEQ ID NO: 399386 - DNA, 20 bp, Homo sapiens
aacgggtctgtgggactggc

SEQ ID NO: 399387 - DNA, 22 bp, Homo sapiens
aacgtacttaactgtgtgaaga

SEQ ID NO: 399388 - DNA, 18 bp, Homo sapiens
aacgtatcacctttccca

SEQ ID NO: 399389 - DNA, 12 bp, Homo sapiens
aacgtcattcag

SEQ ID NO: 399390 - DNA, 20 bp, Homo sapiens
aacgtgatgatcagctgttt

SEQ ID NO: 399391 - DNA, 21 bp, Homo sapiens
aacgtgcgtgtctctgccatg

SEQ ID NO: 399392 - DNA, 20 bp, Homo sapiens
aacgtgtttaattaaatttc

SEQ ID NO: 399393 - DNA, 14 bp, Homo sapiens
aacgttgctcccca

SEQ ID NO: 399394 - DNA, 18 bp, Homo sapiens
aacgtttcagtaataaaa

SEQ ID NO: 399395 - DNA, 20 bp, Homo sapiens
aactaaaattcaacaaatga

SEQ ID NO: 399396 - DNA, 23 bp, Homo sapiens
aactaagaaatatgcacaatagc

SEQ ID NO: 399397 - DNA, 16 bp, Homo sapiens
aactaagaagtggtgt

SEQ ID NO: 399398 - DNA, 21 bp, Homo sapiens
aactaagcaagtatatttatt

SEQ ID NO: 399399 - DNA, 13 bp, Homo sapiens
aactaagccctcg

SEQ ID NO: 399400 - DNA, 20 bp, Homo sapiens
aactaaggtacggtgagact

SEQ ID NO: 399401 - DNA, 16 bp, Homo sapiens
aactaagttttgtgtg

SEQ ID NO: 399402 - DNA, 20 bp, Homo sapiens
aactaagttttgtgtgtata

SEQ ID NO: 399403 - DNA, 13 bp, Homo sapiens
aactaatcaagag

SEQ ID NO: 399404 - DNA, 16 bp, Homo sapiens
aactaatcaagagtga

SEQ ID NO: 399405 - DNA, 21 bp, Homo sapiens
aactaatcaagagtgagtgaa

SEQ ID NO: 399406 - DNA, 19 bp, Homo sapiens
aactaatttgaatgtggtt

SEQ ID NO: 399407 - DNA, 14 bp, Homo sapiens
aactaattttgtac

SEQ ID NO: 399408 - DNA, 21 bp, Homo sapiens
gacccggagctaacactggcc

SEQ ID NO: 399409 - DNA, 22 bp, Homo sapiens
gacccggagctaacactggccc

SEQ ID NO: 399410 - DNA, 23 bp, Homo sapiens
gacccggaggccacatgagtccc

SEQ ID NO: 399411 - DNA, 18 bp, Homo sapiens
gacccgggaccacagctg

SEQ ID NO: 399412 - DNA, 14 bp, Homo sapiens
gacccggggcagct

SEQ ID NO: 399413 - DNA, 16 bp, Homo sapiens
gacccggggcagctgg

SEQ ID NO: 399414 - DNA, 17 bp, Homo sapiens
gacccggggcagctggc

SEQ ID NO: 399415 - DNA, 16 bp, Homo sapiens
gacccgttccatatcc

SEQ ID NO: 399416 - DNA, 19 bp, Homo sapiens
gaccctcactgctggggag

SEQ ID NO: 399417 - DNA, 12 bp, Homo sapiens
gaccctccccca

SEQ ID NO: 399418 - DNA, 15 bp, Homo sapiens
gaccctcccccacca

SEQ ID NO: 399419 - DNA, 21 bp, Homo sapiens
gaccctcctccactccacctc

SEQ ID NO: 399420 - DNA, 16 bp, Homo sapiens
gaccctctccacccca

SEQ ID NO: 399421 - DNA, 15 bp, Homo sapiens
gaccctcttctctgg

SEQ ID NO: 399422 - DNA, 16 bp, Homo sapiens
gaccctcttctctggg

SEQ ID NO: 399423 - DNA, 13 bp, Homo sapiens
gaccctgagactc

SEQ ID NO: 399424 - DNA, 19 bp, Homo sapiens
gaccctgccaactttccag

SEQ ID NO: 399425 - DNA, 20 bp, Homo sapiens
gaccctgccaactttccaga

SEQ ID NO: 399426 - DNA, 23 bp, Homo sapiens
gaccctgccaactttccagactt

SEQ ID NO: 399427 - DNA, 16 bp, Homo sapiens
gaccctgcctgagccc

SEQ ID NO: 399428 - DNA, 21 bp, Homo sapiens
gaccctgcctgagcccaggag

SEQ ID NO: 399429 - DNA, 21 bp, Homo sapiens
gaccctggaattcagcaccct

SEQ ID NO: 399430 - DNA, 22 bp, Homo sapiens
gaccctggaattcagcaccctg

SEQ ID NO: 399431 - DNA, 23 bp, Homo sapiens
gaccctggagcccggcagtgcac

SEQ ID NO: 399432 - DNA, 18 bp, Homo sapiens
gacccttctactttttcc

SEQ ID NO: 399433 - DNA, 23 bp, Homo sapiens
gacccttctactttttccttcct

SEQ ID NO: 399434 - DNA, 24 bp, Homo sapiens
gacccttctactttttccttcctg

SEQ ID NO: 399435 - DNA, 23 bp, Homo sapiens
gaccctttagccaaacccttgtc

SEQ ID NO: 399436 - DNA, 16 bp, Homo sapiens
gaccgagtgtggagct

SEQ ID NO: 399437 - DNA, 21 bp, Homo sapiens
gaccgagtgtggagctgcttc

SEQ ID NO: 399438 - DNA, 22 bp, Homo sapiens
gaccgagtgtggagctgcttcc

SEQ ID NO: 399439 - DNA, 16 bp, Homo sapiens
gaccgcagagggaagc

SEQ ID NO: 399440 - DNA, 15 bp, Homo sapiens
gaccgcatcctccag

SEQ ID NO: 399441 - DNA, 20 bp, Homo sapiens
gaccgccagatggggcctct

SEQ ID NO: 399442 - DNA, 22 bp, Homo sapiens
gaccgccagatggggcctctgt

SEQ ID NO: 399443 - DNA, 17 bp, Homo sapiens
gaccgccagattctccc

SEQ ID NO: 399444 - DNA, 20 bp, Homo sapiens
gaccgcgtagagagccgggc

SEQ ID NO: 399445 - DNA, 18 bp, Homo sapiens
gaccggaattgagaggtg

SEQ ID NO: 399446 - DNA, 19 bp, Homo sapiens
gaccggagcggctgaggac

SEQ ID NO: 399447 - DNA, 21 bp, Homo sapiens
gaccggaggcaaaaggcagtg

SEQ ID NO: 399448 - DNA, 11 bp, Homo sapiens
gaccggcccgc

SEQ ID NO: 399449 - DNA, 15 bp, Homo sapiens
gaccggcccgccacc

SEQ ID NO: 399450 - DNA, 16 bp, Homo sapiens
gaccggcccgccacct

SEQ ID NO: 399451 - DNA, 14 bp, Homo sapiens
gaccgggagcctgc

SEQ ID NO: 399452 - DNA, 14 bp, Homo sapiens
gaccgggtgggcct

SEQ ID NO: 399453 - DNA, 15 bp, Homo sapiens
gaccgggtgggcctg

SEQ ID NO: 399454 - DNA, 16 bp, Homo sapiens
gaccgggtgggcctgg

SEQ ID NO: 399455 - DNA, 18 bp, Homo sapiens
gaccgggtgggcctggcc

SEQ ID NO: 399456 - DNA, 21 bp, Homo sapiens
gaccgtgatttggaagagagg

SEQ ID NO: 399457 - DNA, 21 bp, Homo sapiens
gaccgtgccattgtactccag

SEQ ID NO: 399458 - DNA, 19 bp, Homo sapiens
gacctaaatccattttcta

SEQ ID NO: 399459 - DNA, 17 bp, Homo sapiens
gacctaacattcgatct

SEQ ID NO: 399460 - DNA, 19 bp, Homo sapiens
gacctaatatcattttatt

SEQ ID NO: 399461 - DNA, 21 bp, Homo sapiens
gacctaatatcattttattca

SEQ ID NO: 399462 - DNA, 22 bp, Homo sapiens
gacctaatatcattttattcac

SEQ ID NO: 399463 - DNA, 22 bp, Homo sapiens
gacctaatgctccttgttccta

SEQ ID NO: 399464 - DNA, 14 bp, Homo sapiens
gacctatgataaat

SEQ ID NO: 399465 - DNA, 21 bp, Homo sapiens
gacctatgtcctaaggacaca

SEQ ID NO: 399466 - DNA, 16 bp, Homo sapiens
gacctcactgtgacct

SEQ ID NO: 399467 - DNA, 18 bp, Homo sapiens
gacctcagagtccaggcc

SEQ ID NO: 399468 - DNA, 16 bp, Homo sapiens
gacctcagctgcacat

SEQ ID NO: 399469 - DNA, 23 bp, Homo sapiens
gacctcagctgcacattcctggc

SEQ ID NO: 399470 - DNA, 14 bp, Homo sapiens
gacctcccctcttc

SEQ ID NO: 399471 - DNA, 21 bp, Homo sapiens
gacctccctccctccccagtg

SEQ ID NO: 399472 - DNA, 20 bp, Homo sapiens
gacctccctgtctctacaaa

SEQ ID NO: 399473 - DNA, 17 bp, Homo sapiens
gacctccctgtgagaga

SEQ ID NO: 399474 - DNA, 14 bp, Homo sapiens
gacctcctggactg

SEQ ID NO: 399475 - DNA, 19 bp, Homo sapiens
gacctcctggactgtagga

SEQ ID NO: 399476 - DNA, 16 bp, Homo sapiens
gacctccttagaaaag

SEQ ID NO: 399477 - DNA, 17 bp, Homo sapiens
gacctccttagaaaaga

SEQ ID NO: 399478 - DNA, 18 bp, Homo sapiens
gacctcgtgctttaagtg

SEQ ID NO: 399479 - DNA, 13 bp, Homo sapiens
gacctctcttgtg

SEQ ID NO: 399480 - DNA, 14 bp, Homo sapiens
gacctctgatccct

SEQ ID NO: 399481 - DNA, 10 bp, Homo sapiens
gacctctggg

SEQ ID NO: 399482 - DNA, 12 bp, Homo sapiens
gacctctgttgt

SEQ ID NO: 399483 - DNA, 22 bp, Homo sapiens
gacctgaagagcgctcctctgc

SEQ ID NO: 399484 - DNA, 22 bp, Homo sapiens
gacctgaagggtgacatcccag

SEQ ID NO: 399485 - DNA, 15 bp, Homo sapiens
gacctgactcaggca

SEQ ID NO: 399486 - DNA, 16 bp, Homo sapiens
gacctgagctccccac

SEQ ID NO: 399487 - DNA, 18 bp, Homo sapiens
gacctgagctccccacca

SEQ ID NO: 399488 - DNA, 14 bp, Homo sapiens
gacctgattttcaa

SEQ ID NO: 399489 - DNA, 17 bp, Homo sapiens
gacctgcccctgccgcc

SEQ ID NO: 399490 - DNA, 23 bp, Homo sapiens
gacctgcctcctgcctgcccctc

SEQ ID NO: 399491 - DNA, 18 bp, Homo sapiens
gacctgctccgccaggaa

SEQ ID NO: 399492 - DNA, 15 bp, Homo sapiens
gacctggcacagaaa

SEQ ID NO: 399493 - DNA, 18 bp, Homo sapiens
gacctggcactggatgca

SEQ ID NO: 399494 - DNA, 23 bp, Homo sapiens
gactctaaatgcagttttaagaa

SEQ ID NO: 399495 - DNA, 16 bp, Homo sapiens
gactctacactgtgaa

SEQ ID NO: 399496 - DNA, 12 bp, Homo sapiens
gactctcaggga

SEQ ID NO: 399497 - DNA, 14 bp, Homo sapiens
gactctcctcctcc

SEQ ID NO: 399498 - DNA, 16 bp, Homo sapiens
gactctcctcctcccc

SEQ ID NO: 399499 - DNA, 20 bp, Homo sapiens
gactctcctcctcccctcct

SEQ ID NO: 399500 - DNA, 20 bp, Homo sapiens
gactctctcctctctctccc

SEQ ID NO: 399501 - DNA, 23 bp, Homo sapiens
gactctctcctctctctccctcc

SEQ ID NO: 399502 - DNA, 12 bp, Homo sapiens
gactctctttct

SEQ ID NO: 399503 - DNA, 20 bp, Homo sapiens
gactctgaaaaacattccag

SEQ ID NO: 399504 - DNA, 12 bp, Homo sapiens
gactctgcccca

SEQ ID NO: 399505 - DNA, 16 bp, Homo sapiens
gactctgcctcctctt

SEQ ID NO: 399506 - DNA, 17 bp, Homo sapiens
gactctgccttccaggc

SEQ ID NO: 399507 - DNA, 14 bp, Homo sapiens
gactctgcttggct

SEQ ID NO: 399508 - DNA, 17 bp, Homo sapiens
gactctgcttggctgtc

SEQ ID NO: 399509 - DNA, 17 bp, Homo sapiens
gactctgtaacatcact

SEQ ID NO: 399510 - DNA, 17 bp, Homo sapiens
gactctgtggggccaca

SEQ ID NO: 399511 - DNA, 16 bp, Homo sapiens
gactcttcctgcaaag

SEQ ID NO: 399512 - DNA, 22 bp, Homo sapiens
gactcttgagccctcctggaat

SEQ ID NO: 399513 - DNA, 12 bp, Homo sapiens
gactcttgctct

SEQ ID NO: 399514 - DNA, 17 bp, Homo sapiens
gactcttttgccattaa

SEQ ID NO: 399515 - DNA, 21 bp, Homo sapiens
gactgaaagaagaacagctgt

SEQ ID NO: 399516 - DNA, 14 bp, Homo sapiens
gactgaaagcagca

SEQ ID NO: 399517 - DNA, 15 bp, Homo sapiens
gactgaaagcagcag

SEQ ID NO: 399518 - DNA, 16 bp, Homo sapiens
gactgaaagcagcagc

SEQ ID NO: 399519 - DNA, 16 bp, Homo sapiens
gactgaaatggcttct

SEQ ID NO: 399520 - DNA, 23 bp, Homo sapiens
gactgaaggggcacaccactgcc

SEQ ID NO: 399521 - DNA, 14 bp, Homo sapiens
gactgacctgcccc

SEQ ID NO: 399522 - DNA, 19 bp, Homo sapiens
gactgaccttgatgtcttg

SEQ ID NO: 399523 - DNA, 19 bp, Homo sapiens
gactgactcacattgcctt

SEQ ID NO: 399524 - DNA, 14 bp, Homo sapiens
gactgagcagactg

SEQ ID NO: 399525 - DNA, 12 bp, Homo sapiens
gactgagccagt

SEQ ID NO: 399526 - DNA, 18 bp, Homo sapiens
gactgagggcctggtcac

SEQ ID NO: 399527 - DNA, 17 bp, Homo sapiens
gactgatgtcatcttga

SEQ ID NO: 399528 - DNA, 19 bp, Homo sapiens
gactgatgtcatcttgagc

SEQ ID NO: 399529 - DNA, 20 bp, Homo sapiens
gactgatgttaggctgggcc

SEQ ID NO: 399530 - DNA, 23 bp, Homo sapiens
gactgatgttaggctgggcccag

SEQ ID NO: 399531 - DNA, 17 bp, Homo sapiens
gactgcacccagctcca

SEQ ID NO: 399532 - DNA, 20 bp, Homo sapiens
gactgcacccagctccaggg

SEQ ID NO: 399533 - DNA, 21 bp, Homo sapiens
gactgcacccagctccagggg

SEQ ID NO: 399534 - DNA, 21 bp, Homo sapiens
gactgcaggttggaccccaga

SEQ ID NO: 399535 - DNA, 17 bp, Homo sapiens
gactgcatggtaattta

SEQ ID NO: 399536 - DNA, 18 bp, Homo sapiens
gactgcatggtaatttat

SEQ ID NO: 399537 - DNA, 20 bp, Homo sapiens
gactgcattttactgtacag

SEQ ID NO: 399538 - DNA, 20 bp, Homo sapiens
gactgccagtccccctgccc

SEQ ID NO: 399539 - DNA, 10 bp, Homo sapiens
gactgcccac

SEQ ID NO: 399540 - DNA, 20 bp, Homo sapiens
gactgcccaccctgggcctc

SEQ ID NO: 399541 - DNA, 22 bp, Homo sapiens
gactgcccccagaaagcctcct

SEQ ID NO: 399542 - DNA, 19 bp, Homo sapiens
gactgccccgtgcagactg

SEQ ID NO: 399543 - DNA, 21 bp, Homo sapiens
gactgccccgtgcagactgga

SEQ ID NO: 399544 - DNA, 17 bp, Homo sapiens
gactgccccttgcttct

SEQ ID NO: 399545 - DNA, 19 bp, Homo sapiens
gactgccgaccgaggctgg

SEQ ID NO: 399546 - DNA, 23 bp, Homo sapiens
gactgccgaccgaggctggagct

SEQ ID NO: 399547 - DNA, 10 bp, Homo sapiens
gactgcctcc

SEQ ID NO: 399548 - DNA, 15 bp, Homo sapiens
tagttgtaatgtgta

SEQ ID NO: 399549 - DNA, 19 bp, Homo sapiens
tagtttacaatattatgtt

SEQ ID NO: 399550 - DNA, 20 bp, Homo sapiens
tagtttacagaaaaatcttg

SEQ ID NO: 399551 - DNA, 18 bp, Homo sapiens
tagtttagtgtggttttc

SEQ ID NO: 399552 - DNA, 15 bp, Homo sapiens
tagtttattggaagt

SEQ ID NO: 399553 - DNA, 11 bp, Homo sapiens
tagtttcaagc

SEQ ID NO: 399554 - DNA, 15 bp, Homo sapiens
tagtttcagaagtac

SEQ ID NO: 399555 - DNA, 21 bp, Homo sapiens
tagtttcaggcaaggcagctc

SEQ ID NO: 399556 - DNA, 14 bp, Homo sapiens
tagtttcagtaaat

SEQ ID NO: 399557 - DNA, 19 bp, Homo sapiens
tagtttgtaccatttatga

SEQ ID NO: 399558 - DNA, 19 bp, Homo sapiens
tagtttgttaattgattaa

SEQ ID NO: 399559 - DNA, 14 bp, Homo sapiens
tagttttaaactca

SEQ ID NO: 399560 - DNA, 15 bp, Homo sapiens
tagttttagacctca

SEQ ID NO: 399561 - DNA, 23 bp, Homo sapiens
tagttttagacctcatctccaag

SEQ ID NO: 399562 - DNA, 13 bp, Homo sapiens
tagttttgtcaaa

SEQ ID NO: 399563 - DNA, 13 bp, Homo sapiens
tagttttgttcca

SEQ ID NO: 399564 - DNA, 20 bp, Homo sapiens
tagttttgttccaacagtta

SEQ ID NO: 399565 - DNA, 15 bp, Homo sapiens
tagtttttgctgaag

SEQ ID NO: 399566 - DNA, 20 bp, Homo sapiens
tataaaaaaattgtaaatgt

SEQ ID NO: 399567 - DNA, 21 bp, Homo sapiens
tataaaaaagaaaacttgtgt

SEQ ID NO: 399568 - DNA, 16 bp, Homo sapiens
tataaaagacaaaact

SEQ ID NO: 399569 - DNA, 12 bp, Homo sapiens
tataaaagcctt

SEQ ID NO: 399570 - DNA, 20 bp, Homo sapiens
tataaaataaatatactaat

SEQ ID NO: 399571 - DNA, 13 bp, Homo sapiens
tataaaatgaggg

SEQ ID NO: 399572 - DNA, 23 bp, Homo sapiens
tataaaatgcaaaataaatgttt

SEQ ID NO: 399573 - DNA, 15 bp, Homo sapiens
tataaaatgtattca

SEQ ID NO: 399574 - DNA, 19 bp, Homo sapiens
tataaacactgtattgtaa

SEQ ID NO: 399575 - DNA, 23 bp, Homo sapiens
tataaacattaaaagaagactgg

SEQ ID NO: 399576 - DNA, 16 bp, Homo sapiens
tataaactagatctcc

SEQ ID NO: 399577 - DNA, 19 bp, Homo sapiens
tataaactatcagtttgtc

SEQ ID NO: 399578 - DNA, 18 bp, Homo sapiens
tataaactgtgagataaa

SEQ ID NO: 399579 - DNA, 19 bp, Homo sapiens
tataaagatttttgttaag

SEQ ID NO: 399580 - DNA, 22 bp, Homo sapiens
tataaagcgatatacagatgaa

SEQ ID NO: 399581 - DNA, 13 bp, Homo sapiens
tataaataaagca

SEQ ID NO: 399582 - DNA, 20 bp, Homo sapiens
tataaataaataaaaatatt

SEQ ID NO: 399583 - DNA, 13 bp, Homo sapiens
tataaataataaa

SEQ ID NO: 399584 - DNA, 19 bp, Homo sapiens
tataaataataaagaactc

SEQ ID NO: 399585 - DNA, 20 bp, Homo sapiens
tataaatatattgtatattt

SEQ ID NO: 399586 - DNA, 12 bp, Homo sapiens
tataaatatcta

SEQ ID NO: 399587 - DNA, 14 bp, Homo sapiens
tataaatctgatca

SEQ ID NO: 399588 - DNA, 21 bp, Homo sapiens
tataaatgaagtttatacagt

SEQ ID NO: 399589 - DNA, 14 bp, Homo sapiens
tataaatgaatgaa

SEQ ID NO: 399590 - DNA, 16 bp, Homo sapiens
tataaatgaatgaaat

SEQ ID NO: 399591 - DNA, 22 bp, Homo sapiens
tataaatgaatgaaatataaac

SEQ ID NO: 399592 - DNA, 13 bp, Homo sapiens
tataaatgagcaa

SEQ ID NO: 399593 - DNA, 12 bp, Homo sapiens
tataaatggact

SEQ ID NO: 399594 - DNA, 17 bp, Homo sapiens
tataaatggacttgctt

SEQ ID NO: 399595 - DNA, 20 bp, Homo sapiens
tataaatggtgagaattaaa

SEQ ID NO: 399596 - DNA, 14 bp, Homo sapiens
tataaatgtaaaaa

SEQ ID NO: 399597 - DNA, 19 bp, Homo sapiens
tataaatgtactacatttg

SEQ ID NO: 399598 - DNA, 14 bp, Homo sapiens
tataaatgtcctaa

SEQ ID NO: 399599 - DNA, 17 bp, Homo sapiens
tataaatgtttatattg

SEQ ID NO: 399600 - DNA, 13 bp, Homo sapiens
tataaattaaata

SEQ ID NO: 399601 - DNA, 14 bp, Homo sapiens
tataaattaaatat

SEQ ID NO: 399602 - DNA, 20 bp, Homo sapiens
tataaattaaatatatgtat

SEQ ID NO: 399603 - DNA, 16 bp, Homo sapiens
tataaattaagaagag

SEQ ID NO: 399604 - DNA, 17 bp, Homo sapiens
tataaattaagaagagt

SEQ ID NO: 399605 - DNA, 18 bp, Homo sapiens
tataaattaagactttaa

SEQ ID NO: 399606 - DNA, 13 bp, Homo sapiens
tataaattaatac

SEQ ID NO: 399607 - DNA, 20 bp, Homo sapiens
tataaattaatacataagtt

SEQ ID NO: 399608 - DNA, 15 bp, Homo sapiens
tataaatttgtgtaa

SEQ ID NO: 399609 - DNA, 17 bp, Homo sapiens
tataacaaactatgtaa

SEQ ID NO: 399610 - DNA, 14 bp, Homo sapiens
tataacagatcctt

SEQ ID NO: 399611 - DNA, 14 bp, Homo sapiens
tataacagcaaata

SEQ ID NO: 399612 - DNA, 17 bp, Homo sapiens
tataacatatgtacata

SEQ ID NO: 399613 - DNA, 17 bp, Homo sapiens
tataacattgtaaatga

SEQ ID NO: 399614 - DNA, 22 bp, Homo sapiens
tataaccatcagttactggttt

SEQ ID NO: 399615 - DNA, 12 bp, Homo sapiens
tataaccccacc

SEQ ID NO: 399616 - DNA, 14 bp, Homo sapiens
tataaccccagcct

SEQ ID NO: 399617 - DNA, 17 bp, Homo sapiens
tataacccctgcctgga

SEQ ID NO: 399618 - DNA, 11 bp, Homo sapiens
tataactcatg

SEQ ID NO: 399619 - DNA, 20 bp, Homo sapiens
tataactgccttaaaacttt

SEQ ID NO: 399620 - DNA, 13 bp, Homo sapiens
tataactgtacaa

SEQ ID NO: 399621 - DNA, 19 bp, Homo sapiens
tataagcattgaaattata

SEQ ID NO: 399622 - DNA, 16 bp, Homo sapiens
tataagcccactgtta

SEQ ID NO: 399623 - DNA, 16 bp, Homo sapiens
tataagctgtttagtt

SEQ ID NO: 399624 - DNA, 17 bp, Homo sapiens
tataagctgtttagttt

SEQ ID NO: 399625 - DNA, 16 bp, Homo sapiens
aacttttataaattaa

SEQ ID NO: 399626 - DNA, 18 bp, Homo sapiens
aacttttataaattaaat

SEQ ID NO: 399627 - DNA, 19 bp, Homo sapiens
aacttttataaattaaata

SEQ ID NO: 399628 - DNA, 22 bp, Homo sapiens
aacttttataaattaaatatat

SEQ ID NO: 399629 - DNA, 15 bp, Homo sapiens
aacttttcccctgtc

SEQ ID NO: 399630 - DNA, 18 bp, Homo sapiens
aacttttcccctgtcctg

SEQ ID NO: 399631 - DNA, 16 bp, Homo sapiens
aactttttcaatggtt

SEQ ID NO: 399632 - DNA, 20 bp, Homo sapiens
aagaaaaaaaataacacaga

SEQ ID NO: 399633 - DNA, 14 bp, Homo sapiens
aagaaaaaaataat

SEQ ID NO: 399634 - DNA, 21 bp, Homo sapiens
aagaaaaaaatagttttacat

SEQ ID NO: 399635 - DNA, 18 bp, Homo sapiens
aagaaaaacaaaatgtta

SEQ ID NO: 399636 - DNA, 13 bp, Homo sapiens
aagaaaaacatgt

SEQ ID NO: 399637 - DNA, 14 bp, Homo sapiens
aagaaaaacatgtc

SEQ ID NO: 399638 - DNA, 17 bp, Homo sapiens
aagaaaaaccacagata

SEQ ID NO: 399639 - DNA, 16 bp, Homo sapiens
aagaaaacacacaaaa

SEQ ID NO: 399640 - DNA, 21 bp, Homo sapiens
aagaaaacacacaaaagatta

SEQ ID NO: 399641 - DNA, 18 bp, Homo sapiens
aagaaaacatatatttta

SEQ ID NO: 399642 - DNA, 17 bp, Homo sapiens
aagaaaacattccagat

SEQ ID NO: 399643 - DNA, 15 bp, Homo sapiens
aagaaaagataaaga

SEQ ID NO: 399644 - DNA, 18 bp, Homo sapiens
aagaaaaggaatgcaaga

SEQ ID NO: 399645 - DNA, 15 bp, Homo sapiens
aagaaaagtgggcca

SEQ ID NO: 399646 - DNA, 17 bp, Homo sapiens
aagaaaatacaataaac

SEQ ID NO: 399647 - DNA, 23 bp, Homo sapiens
aagaaaatcagatggagcatgaa

SEQ ID NO: 399648 - DNA, 16 bp, Homo sapiens
aagaaaatgaagggat

SEQ ID NO: 399649 - DNA, 12 bp, Homo sapiens
aagaaaatgaat

SEQ ID NO: 399650 - DNA, 21 bp, Homo sapiens
aagaaacccttccacgtgtat

SEQ ID NO: 399651 - DNA, 17 bp, Homo sapiens
aagaaagagaaagtact

SEQ ID NO: 399652 - DNA, 15 bp, Homo sapiens
aagaaagcaaaaaat

SEQ ID NO: 399653 - DNA, 19 bp, Homo sapiens
aagaaagcaaaaaataaaa

SEQ ID NO: 399654 - DNA, 20 bp, Homo sapiens
aagaaagcaaaaaataaaat

SEQ ID NO: 399655 - DNA, 19 bp, Homo sapiens
aagaaagctatatatgaat

SEQ ID NO: 399656 - DNA, 17 bp, Homo sapiens
aagaaagctggtaaact

SEQ ID NO: 399657 - DNA, 17 bp, Homo sapiens
aagaaagggttctgtaa

SEQ ID NO: 399658 - DNA, 17 bp, Homo sapiens
aagaaagtaaaaagaac

SEQ ID NO: 399659 - DNA, 22 bp, Homo sapiens
aagaaagtcagacctgtttctt

SEQ ID NO: 399660 - DNA, 15 bp, Homo sapiens
aagaaagtttcccca

SEQ ID NO: 399661 - DNA, 19 bp, Homo sapiens
aagaaatcgccttatgaga

SEQ ID NO: 399662 - DNA, 16 bp, Homo sapiens
aagaaatgctaatgta

SEQ ID NO: 399663 - DNA, 16 bp, Homo sapiens
aagaaattgcctcctt

SEQ ID NO: 399664 - DNA, 21 bp, Homo sapiens
aagaacacaaagcggggggag

SEQ ID NO: 399665 - DNA, 17 bp, Homo sapiens
aagaacacagcatgtgc

SEQ ID NO: 399666 - DNA, 19 bp, Homo sapiens
aagaacaccctatattttg

SEQ ID NO: 399667 - DNA, 15 bp, Homo sapiens
aagaacagtacattt

SEQ ID NO: 399668 - DNA, 12 bp, Homo sapiens
aagaacatagaa

SEQ ID NO: 399669 - DNA, 12 bp, Homo sapiens
aagaacatcaag

SEQ ID NO: 399670 - DNA, 16 bp, Homo sapiens
aagaacccccctcccc

SEQ ID NO: 399671 - DNA, 17 bp, Homo sapiens
aagaacccccctcccca

SEQ ID NO: 399672 - DNA, 13 bp, Homo sapiens
aagaactccttat

SEQ ID NO: 399673 - DNA, 19 bp, Homo sapiens
aagaactgaaaacataaaa

SEQ ID NO: 399674 - DNA, 13 bp, Homo sapiens
aagaactgcccca

SEQ ID NO: 399675 - DNA, 23 bp, Homo sapiens
aagaactgccccatctcctccca

SEQ ID NO: 399676 - DNA, 18 bp, Homo sapiens
aagaactttgcacacttc

SEQ ID NO: 399677 - DNA, 21 bp, Homo sapiens
aagaagaaagtctatgcttag

SEQ ID NO: 399678 - DNA, 12 bp, Homo sapiens
aagaagacatga

SEQ ID NO: 399679 - DNA, 14 bp, Homo sapiens
aagaagattctaaa

SEQ ID NO: 399680 - DNA, 14 bp, Homo sapiens
aagaagcaaatttt

SEQ ID NO: 399681 - DNA, 11 bp, Homo sapiens
aagaagccctc

SEQ ID NO: 399682 - DNA, 19 bp, Homo sapiens
aagaagctaaaatgaaaaa

SEQ ID NO: 399683 - DNA, 20 bp, Homo sapiens
aagaaggcccgggaggagga

SEQ ID NO: 399684 - DNA, 19 bp, Homo sapiens
aagaagggaaattcacact

SEQ ID NO: 399685 - DNA, 23 bp, Homo sapiens
aagaaggggctcgagtgcccctg

SEQ ID NO: 399686 - DNA, 13 bp, Homo sapiens
tatagtgtaaaat

SEQ ID NO: 399687 - DNA, 18 bp, Homo sapiens
tatagttaggatagcatt

SEQ ID NO: 399688 - DNA, 15 bp, Homo sapiens
tatagtttgtacatg

SEQ ID NO: 399689 - DNA, 13 bp, Homo sapiens
tatagttttacac

SEQ ID NO: 399690 - DNA, 12 bp, Homo sapiens
tatataaaacaa

SEQ ID NO: 399691 - DNA, 18 bp, Homo sapiens
tatataaaataaatatac

SEQ ID NO: 399692 - DNA, 14 bp, Homo sapiens
tatataaaatgtat

SEQ ID NO: 399693 - DNA, 21 bp, Homo sapiens
tatataaaatgtattcaagca

SEQ ID NO: 399694 - DNA, 16 bp, Homo sapiens
tatataaataaagcaa

SEQ ID NO: 399695 - DNA, 17 bp, Homo sapiens
tatataaataaagcaaa

SEQ ID NO: 399696 - DNA, 13 bp, Homo sapiens
tatataaatggtg

SEQ ID NO: 399697 - DNA, 12 bp, Homo sapiens
tatataagctgt

SEQ ID NO: 399698 - DNA, 20 bp, Homo sapiens
tatataataaatgggaaatg

SEQ ID NO: 399699 - DNA, 20 bp, Homo sapiens
tatataatacttaaaaatat

SEQ ID NO: 399700 - DNA, 21 bp, Homo sapiens
tatataatacttaaaaatatg

SEQ ID NO: 399701 - DNA, 20 bp, Homo sapiens
tatataatggtttactgctg

SEQ ID NO: 399702 - DNA, 21 bp, Homo sapiens
tatataatggtttactgctgt

SEQ ID NO: 399703 - DNA, 14 bp, Homo sapiens
tatataattatgtt

SEQ ID NO: 399704 - DNA, 22 bp, Homo sapiens
tatataatttttttatgttttg

SEQ ID NO: 399705 - DNA, 17 bp, Homo sapiens
tatatacatgtatagtg

SEQ ID NO: 399706 - DNA, 13 bp, Homo sapiens
tatatagagatgt

SEQ ID NO: 399707 - DNA, 14 bp, Homo sapiens
tatatagcttgaaa

SEQ ID NO: 399708 - DNA, 17 bp, Homo sapiens
tatatagtacctttgct

SEQ ID NO: 399709 - DNA, 12 bp, Homo sapiens
tatatataaaat

SEQ ID NO: 399710 - DNA, 14 bp, Homo sapiens
tatatataatactt

SEQ ID NO: 399711 - DNA, 13 bp, Homo sapiens
tatatatacataa

SEQ ID NO: 399712 - DNA, 19 bp, Homo sapiens
tatatatacataacagggt

SEQ ID NO: 399713 - DNA, 13 bp, Homo sapiens
tatatatgctact

SEQ ID NO: 399714 - DNA, 11 bp, Homo sapiens
tatatatgtac

SEQ ID NO: 399715 - DNA, 17 bp, Homo sapiens
tatatatgtgtgtttaa

SEQ ID NO: 399716 - DNA, 10 bp, Homo sapiens
tatatattat

SEQ ID NO: 399717 - DNA, 20 bp, Homo sapiens
tatatatttatcatatttaa

SEQ ID NO: 399718 - DNA, 15 bp, Homo sapiens
tatatatttgaaaga

SEQ ID NO: 399719 - DNA, 22 bp, Homo sapiens
tatatatttttggttgtcaata

SEQ ID NO: 399720 - DNA, 21 bp, Homo sapiens
tatatcaaggatgttctggct

SEQ ID NO: 399721 - DNA, 18 bp, Homo sapiens
tatatcagaaaagggaag

SEQ ID NO: 399722 - DNA, 15 bp, Homo sapiens
tatatcagactgctt

SEQ ID NO: 399723 - DNA, 13 bp, Homo sapiens
tatatcagcagac

SEQ ID NO: 399724 - DNA, 19 bp, Homo sapiens
tatatccatgtactgtagt

SEQ ID NO: 399725 - DNA, 21 bp, Homo sapiens
tatatctatctatatatacat

SEQ ID NO: 399726 - DNA, 18 bp, Homo sapiens
tatatctttaaataaatg

SEQ ID NO: 399727 - DNA, 14 bp, Homo sapiens
tatatctttgcact

SEQ ID NO: 399728 - DNA, 19 bp, Homo sapiens
tatatgaacttaacatgct

SEQ ID NO: 399729 - DNA, 20 bp, Homo sapiens
tatatgacttcttgttcatg

SEQ ID NO: 399730 - DNA, 15 bp, Homo sapiens
tatatgatatgcatg

SEQ ID NO: 399731 - DNA, 21 bp, Homo sapiens
tatatgatatgcatgtagcat

SEQ ID NO: 399732 - DNA, 18 bp, Homo sapiens
tatatgcacccctggaac

SEQ ID NO: 399733 - DNA, 23 bp, Homo sapiens
tatatgctacttttacttgttca

SEQ ID NO: 399734 - DNA, 18 bp, Homo sapiens
tatatgctgaattgaaca

SEQ ID NO: 399735 - DNA, 16 bp, Homo sapiens
tatatggcccagcctt

SEQ ID NO: 399736 - DNA, 11 bp, Homo sapiens
tatatgtatgt

SEQ ID NO: 399737 - DNA, 13 bp, Homo sapiens
tatatgtgtgtgt

SEQ ID NO: 399738 - DNA, 19 bp, Homo sapiens
tatatgtgtgtttaaataa

SEQ ID NO: 399739 - DNA, 22 bp, Homo sapiens
tatatgtgtgtttaaataaagt

SEQ ID NO: 399740 - DNA, 23 bp, Homo sapiens
tatatgtgtgtttaaataaagta

SEQ ID NO: 399741 - DNA, 22 bp, Homo sapiens
tatatgttatggcttattgtgt

SEQ ID NO: 399742 - DNA, 12 bp, Homo sapiens
tatatgttttaa

SEQ ID NO: 399743 - DNA, 11 bp, Homo sapiens
tatatgttttg

SEQ ID NO: 399744 - DNA, 17 bp, Homo sapiens
tatattaaaaatataaa

SEQ ID NO: 399745 - DNA, 18 bp, Homo sapiens
tatattaccagcaagaat

SEQ ID NO: 399746 - DNA, 15 bp, Homo sapiens
tatattacttttgta

SEQ ID NO: 399747 - DNA, 18 bp, Homo sapiens
tatattacttttgtaaat

SEQ ID NO: 399748 - DNA, 23 bp, Homo sapiens
tatattaggcctgtgtgtaagct

SEQ ID NO: 399749 - DNA, 15 bp, Homo sapiens
tatattataagattt

SEQ ID NO: 399750 - DNA, 14 bp, Homo sapiens
tatattataagttg

SEQ ID NO: 399751 - DNA, 17 bp, Homo sapiens
tatattcagagatgtac

SEQ ID NO: 399752 - DNA, 16 bp, Homo sapiens
tatattcatacctgtt

SEQ ID NO: 399753 - DNA, 14 bp, Homo sapiens
tatattcatatatt

SEQ ID NO: 399754 - DNA, 13 bp, Homo sapiens
tatattctaaatt

SEQ ID NO: 399755 - DNA, 11 bp, Homo sapiens
tatattctttc

SEQ ID NO: 399756 - DNA, 16 bp, Homo sapiens
tattacttttgtaaat

SEQ ID NO: 399757 - DNA, 15 bp, Homo sapiens
tattactttttaaaa

SEQ ID NO: 399758 - DNA, 16 bp, Homo sapiens
tattagagtgccctta

SEQ ID NO: 399759 - DNA, 21 bp, Homo sapiens
tattagattgctgaattaagg

SEQ ID NO: 399760 - DNA, 19 bp, Homo sapiens
tattagccagtcattgtaa

SEQ ID NO: 399761 - DNA, 14 bp, Homo sapiens
tattagctgtaaat

SEQ ID NO: 399762 - DNA, 23 bp, Homo sapiens
tattagttccctgtctcttgaaa

SEQ ID NO: 399763 - DNA, 17 bp, Homo sapiens
tattataataatgttct

SEQ ID NO: 399764 - DNA, 18 bp, Homo sapiens
tattatactaagaaaaga

SEQ ID NO: 399765 - DNA, 12 bp, Homo sapiens
tattatgtagct

SEQ ID NO: 399766 - DNA, 15 bp, Homo sapiens
tattattagattctc

SEQ ID NO: 399767 - DNA, 18 bp, Homo sapiens
tattattcaccatgtaaa

SEQ ID NO: 399768 - DNA, 22 bp, Homo sapiens
tattattcaccatgtaaaacaa

SEQ ID NO: 399769 - DNA, 21 bp, Homo sapiens
tattattcagaattatacaga

SEQ ID NO: 399770 - DNA, 15 bp, Homo sapiens
tattattctgcagca

SEQ ID NO: 399771 - DNA, 16 bp, Homo sapiens
tattatttcaatgtga

SEQ ID NO: 399772 - DNA, 17 bp, Homo sapiens
tattattttaaaaattg

SEQ ID NO: 399773 - DNA, 13 bp, Homo sapiens
tattattttaata

SEQ ID NO: 399774 - DNA, 18 bp, Homo sapiens
tattattttaatatttat

SEQ ID NO: 399775 - DNA, 16 bp, Homo sapiens
tattcaaacacacagt

SEQ ID NO: 399776 - DNA, 20 bp, Homo sapiens
tattcaactaatacatggtt

SEQ ID NO: 399777 - DNA, 16 bp, Homo sapiens
tattcaagaaagatat

SEQ ID NO: 399778 - DNA, 19 bp, Homo sapiens
tattcaagcaaacatcaaa

SEQ ID NO: 399779 - DNA, 20 bp, Homo sapiens
tattcaagcaaacatcaaat

SEQ ID NO: 399780 - DNA, 22 bp, Homo sapiens
tattcacagtgaacataactgt

SEQ ID NO: 399781 - DNA, 16 bp, Homo sapiens
tattcacatatgtctt

SEQ ID NO: 399782 - DNA, 11 bp, Homo sapiens
tattcaccacc

SEQ ID NO: 399783 - DNA, 20 bp, Homo sapiens
tattcaccatgtaaaacaaa

SEQ ID NO: 399784 - DNA, 20 bp, Homo sapiens
tattcagaatcaaacctttt

SEQ ID NO: 399785 - DNA, 14 bp, Homo sapiens
tattcagagatgta

SEQ ID NO: 399786 - DNA, 13 bp, Homo sapiens
tattcaggacccc

SEQ ID NO: 399787 - DNA, 24 bp, Homo sapiens
tattcaggaccccatctgctgagc

SEQ ID NO: 399788 - DNA, 12 bp, Homo sapiens
tattcaggactt

SEQ ID NO: 399789 - DNA, 14 bp, Homo sapiens
tattcaggagttgg

SEQ ID NO: 399790 - DNA, 20 bp, Homo sapiens
tattcaggagttggaatgtt

SEQ ID NO: 399791 - DNA, 12 bp, Homo sapiens
tattcagtcctg

SEQ ID NO: 399792 - DNA, 18 bp, Homo sapiens
tattcagttaagaaaaaa

SEQ ID NO: 399793 - DNA, 14 bp, Homo sapiens
tattcatacctgtt

SEQ ID NO: 399794 - DNA, 23 bp, Homo sapiens
tattcatcaaataaaccttgttt

SEQ ID NO: 399795 - DNA, 14 bp, Homo sapiens
tattcatctgcaat

SEQ ID NO: 399796 - DNA, 16 bp, Homo sapiens
tattcatgctttctcc

SEQ ID NO: 399797 - DNA, 18 bp, Homo sapiens
tattcatgctttctcctt

SEQ ID NO: 399798 - DNA, 15 bp, Homo sapiens
tattccaccttaaat

SEQ ID NO: 399799 - DNA, 22 bp, Homo sapiens
tattccaccttaaattaaacaa

SEQ ID NO: 399800 - DNA, 19 bp, Homo sapiens
tattccatccatatacttt

SEQ ID NO: 399801 - DNA, 16 bp, Homo sapiens
tattccatgaatgtat

SEQ ID NO: 399802 - DNA, 17 bp, Homo sapiens
tattccatgaatgtatc

SEQ ID NO: 399803 - DNA, 23 bp, Homo sapiens
tattccatgaatgtatcaggaaa

SEQ ID NO: 399804 - DNA, 22 bp, Homo sapiens
tattccatttttactaaagcag

SEQ ID NO: 399805 - DNA, 11 bp, Homo sapiens
tattcccaggc

SEQ ID NO: 399806 - DNA, 23 bp, Homo sapiens
tattcccatggtagactgtgaca

SEQ ID NO: 399807 - DNA, 16 bp, Homo sapiens
tattccctgaattgtt

SEQ ID NO: 399808 - DNA, 13 bp, Homo sapiens
tattccctggaga

SEQ ID NO: 399809 - DNA, 20 bp, Homo sapiens
tattcctgcatttgtgaaat

SEQ ID NO: 399810 - DNA, 21 bp, Homo sapiens
tattcctgcatttgtgaaatg

SEQ ID NO: 399811 - DNA, 13 bp, Homo sapiens
tattcctgccttt

SEQ ID NO: 399812 - DNA, 21 bp, Homo sapiens
tattccttctggcctttcctc

SEQ ID NO: 399813 - DNA, 17 bp, Homo sapiens
tattccttggcccagca

SEQ ID NO: 399814 - DNA, 19 bp, Homo sapiens
tattccttggcccagcagc

SEQ ID NO: 399815 - DNA, 21 bp, Homo sapiens
tattcctttgggcctctgctt

SEQ ID NO: 399816 - DNA, 22 bp, Homo sapiens
tattctaagccagttttcattt

SEQ ID NO: 399817 - DNA, 23 bp, Homo sapiens
tattctacatatgataggcagca

SEQ ID NO: 399818 - DNA, 19 bp, Homo sapiens
tattctagctaatgtaata

SEQ ID NO: 399819 - DNA, 21 bp, Homo sapiens
tattctagtcaactgctgttt

SEQ ID NO: 399820 - DNA, 18 bp, Homo sapiens
tattctatgtaaaaatat

SEQ ID NO: 399821 - DNA, 14 bp, Homo sapiens
tattctctgatgtt

SEQ ID NO: 399822 - DNA, 15 bp, Homo sapiens
tattctgagccttga

SEQ ID NO: 399823 - DNA, 18 bp, Homo sapiens
tattctgcaacagcctgt

SEQ ID NO: 399824 - DNA, 19 bp, Homo sapiens
tattctgcaacagcctgtt

SEQ ID NO: 399825 - DNA, 20 bp, Homo sapiens
tattctggatatcgtcattt

SEQ ID NO: 399826 - DNA, 21 bp, Homo sapiens
tattctggctgataaaagata

SEQ ID NO: 399827 - DNA, 20 bp, Homo sapiens
tattctgggctcctggaacc

SEQ ID NO: 399828 - DNA, 21 bp, Homo sapiens
tattctgtggattctatattt

SEQ ID NO: 399829 - DNA, 19 bp, Homo sapiens
tattcttaagcactttgaa

SEQ ID NO: 399830 - DNA, 16 bp, Homo sapiens
tattcttgtccacatt

SEQ ID NO: 399831 - DNA, 22 bp, Homo sapiens
tattctttaattgttgctttta

SEQ ID NO: 399832 - DNA, 12 bp, Homo sapiens
tattctttacaa

SEQ ID NO: 399833 - DNA, 13 bp, Homo sapiens
tattctttacaaa

SEQ ID NO: 399834 - DNA, 20 bp, Homo sapiens
tattctttacaaaatgaatg

SEQ ID NO: 399835 - DNA, 15 bp, Homo sapiens
tattctttccatgca

SEQ ID NO: 399836 - DNA, 13 bp, Homo sapiens
gactgcctccctc

SEQ ID NO: 399837 - DNA, 13 bp, Homo sapiens
gactgcctctgcc

SEQ ID NO: 399838 - DNA, 14 bp, Homo sapiens
gactgcctctgcca

SEQ ID NO: 399839 - DNA, 14 bp, Homo sapiens
gactgctgctcccc

SEQ ID NO: 399840 - DNA, 19 bp, Homo sapiens
gactgctgctccccacccc

SEQ ID NO: 399841 - DNA, 19 bp, Homo sapiens
gactgcttcacggactctt

SEQ ID NO: 399842 - DNA, 20 bp, Homo sapiens
gactgcttcacggactcttt

SEQ ID NO: 399843 - DNA, 16 bp, Homo sapiens
gactggagacaatgca

SEQ ID NO: 399844 - DNA, 20 bp, Homo sapiens
gactggagaccgcttcaccc

SEQ ID NO: 399845 - DNA, 20 bp, Homo sapiens
gactggaggaccacactcaa

SEQ ID NO: 399846 - DNA, 18 bp, Homo sapiens
gactggaggtgggcatgc

SEQ ID NO: 399847 - DNA, 17 bp, Homo sapiens
gactggagtcagatgag

SEQ ID NO: 399848 - DNA, 20 bp, Homo sapiens
gactggagtgaggcttccag

SEQ ID NO: 399849 - DNA, 23 bp, Homo sapiens
gactggagtgaggcttccaggct

SEQ ID NO: 399850 - DNA, 15 bp, Homo sapiens
gactggatactgccc

SEQ ID NO: 399851 - DNA, 22 bp, Homo sapiens
gactggatactgcccggggcag

SEQ ID NO: 399852 - DNA, 14 bp, Homo sapiens
gactggcaagagct

SEQ ID NO: 399853 - DNA, 13 bp, Homo sapiens
gactggccagagg

SEQ ID NO: 399854 - DNA, 18 bp, Homo sapiens
gactggccatgcaagtgg

SEQ ID NO: 399855 - DNA, 17 bp, Homo sapiens
gactggcccacccctct

SEQ ID NO: 399856 - DNA, 22 bp, Homo sapiens
gactggcccacccctcttcccc

SEQ ID NO: 399857 - DNA, 19 bp, Homo sapiens
gactggcccttgcccaact

SEQ ID NO: 399858 - DNA, 17 bp, Homo sapiens
gactggctagagtcctc

SEQ ID NO: 399859 - DNA, 23 bp, Homo sapiens
gactggctagagtcctcactccc

SEQ ID NO: 399860 - DNA, 12 bp, Homo sapiens
gactggctgcac

SEQ ID NO: 399861 - DNA, 16 bp, Homo sapiens
gactggcttggccaca

SEQ ID NO: 399862 - DNA, 17 bp, Homo sapiens
gactgggagccacttct

SEQ ID NO: 399863 - DNA, 19 bp, Homo sapiens
gactgggagccacttctcc

SEQ ID NO: 399864 - DNA, 15 bp, Homo sapiens
gactgggagggccca

SEQ ID NO: 399865 - DNA, 15 bp, Homo sapiens
gactgggagtcagag

SEQ ID NO: 399866 - DNA, 12 bp, Homo sapiens
gactgggcctcc

SEQ ID NO: 399867 - DNA, 22 bp, Homo sapiens
gactgggcctcccttgggctgg

SEQ ID NO: 399868 - DNA, 17 bp, Homo sapiens
gactgggggactgggag

SEQ ID NO: 399869 - DNA, 18 bp, Homo sapiens
gactgggggactgggagt

SEQ ID NO: 399870 - DNA, 17 bp, Homo sapiens
gactgggggcctctgcc

SEQ ID NO: 399871 - DNA, 22 bp, Homo sapiens
gactgggggcctctgcctccag

SEQ ID NO: 399872 - DNA, 23 bp, Homo sapiens
gactgggggtgccaaccacctct

SEQ ID NO: 399873 - DNA, 14 bp, Homo sapiens
gactggggtaggaa

SEQ ID NO: 399874 - DNA, 17 bp, Homo sapiens
gactggtgagcagactg

SEQ ID NO: 399875 - DNA, 14 bp, Homo sapiens
gactgtaagatgtt

SEQ ID NO: 399876 - DNA, 22 bp, Homo sapiens
gactgtaagatgttgttttagg

SEQ ID NO: 399877 - DNA, 12 bp, Homo sapiens
gactgtacctgt

SEQ ID NO: 399878 - DNA, 20 bp, Homo sapiens
gactgtacctgtaggaaaca

SEQ ID NO: 399879 - DNA, 17 bp, Homo sapiens
gactgtactcctcccag

SEQ ID NO: 399880 - DNA, 20 bp, Homo sapiens
gactgtagattgcttctgta

SEQ ID NO: 399881 - DNA, 18 bp, Homo sapiens
gactgtataggtagatcc

SEQ ID NO: 399882 - DNA, 18 bp, Homo sapiens
gactgtattatacatggg

SEQ ID NO: 399883 - DNA, 22 bp, Homo sapiens
gactgtcaagtacaagcaagac

SEQ ID NO: 399884 - DNA, 14 bp, Homo sapiens
gactgtcagctgag

SEQ ID NO: 399885 - DNA, 20 bp, Homo sapiens
gactgtcatgtggcttggtt

SEQ ID NO: 399886 - DNA, 19 bp, Homo sapiens
gagaatggctttggtctct

SEQ ID NO: 399887 - DNA, 15 bp, Homo sapiens
gagaattcagctgcc

SEQ ID NO: 399888 - DNA, 13 bp, Homo sapiens
gagaattctaaga

SEQ ID NO: 399889 - DNA, 18 bp, Homo sapiens
gagaattgcttgaaccca

SEQ ID NO: 399890 - DNA, 11 bp, Homo sapiens
gagacaaaaat

SEQ ID NO: 399891 - DNA, 19 bp, Homo sapiens
gagacaaagcaggagtgga

SEQ ID NO: 399892 - DNA, 15 bp, Homo sapiens
gagacaagccctggc

SEQ ID NO: 399893 - DNA, 21 bp, Homo sapiens
gagacaatgcagatgccagag

SEQ ID NO: 399894 - DNA, 23 bp, Homo sapiens
gagacaatgcagatgccagagca

SEQ ID NO: 399895 - DNA, 17 bp, Homo sapiens
gagacacagggcatcca

SEQ ID NO: 399896 - DNA, 13 bp, Homo sapiens
gagacacctcaga

SEQ ID NO: 399897 - DNA, 19 bp, Homo sapiens
gagacacgtgtggcgggca

SEQ ID NO: 399898 - DNA, 19 bp, Homo sapiens
gagacactggtctcagagg

SEQ ID NO: 399899 - DNA, 14 bp, Homo sapiens
gagacagggtcctg

SEQ ID NO: 399900 - DNA, 22 bp, Homo sapiens
gagacagtgttttgccatgttg

SEQ ID NO: 399901 - DNA, 22 bp, Homo sapiens
gagacagttgggtgagaacaac

SEQ ID NO: 399902 - DNA, 19 bp, Homo sapiens
gagacataaccactgcttc

SEQ ID NO: 399903 - DNA, 17 bp, Homo sapiens
gagaccaagtcctggct

SEQ ID NO: 399904 - DNA, 18 bp, Homo sapiens
gagaccaagtcctggcta

SEQ ID NO: 399905 - DNA, 14 bp, Homo sapiens
gagaccagcctttc

SEQ ID NO: 399906 - DNA, 16 bp, Homo sapiens
gagaccagcctttctt

SEQ ID NO: 399907 - DNA, 15 bp, Homo sapiens
gagaccatcctggcc

SEQ ID NO: 399908 - DNA, 17 bp, Homo sapiens
gagaccatcctggcccc

SEQ ID NO: 399909 - DNA, 18 bp, Homo sapiens
gagaccatcctggcccct

SEQ ID NO: 399910 - DNA, 12 bp, Homo sapiens
gagacccccaca

SEQ ID NO: 399911 - DNA, 15 bp, Homo sapiens
gagacccccacacct

SEQ ID NO: 399912 - DNA, 13 bp, Homo sapiens
gagaccctggaat

SEQ ID NO: 399913 - DNA, 15 bp, Homo sapiens
gagaccctgggagag

SEQ ID NO: 399914 - DNA, 18 bp, Homo sapiens
gagaccctgggagagtga

SEQ ID NO: 399915 - DNA, 17 bp, Homo sapiens
gagacccttgcattaga

SEQ ID NO: 399916 - DNA, 15 bp, Homo sapiens
gagaccgagtgaacc

SEQ ID NO: 399917 - DNA, 20 bp, Homo sapiens
gagaccgagtgtggagctgc

SEQ ID NO: 399918 - DNA, 21 bp, Homo sapiens
gagaccgagtgtggagctgct

SEQ ID NO: 399919 - DNA, 13 bp, Homo sapiens
gagaccgcagagg

SEQ ID NO: 399920 - DNA, 19 bp, Homo sapiens
gagaccgcttcacccctgc

SEQ ID NO: 399921 - DNA, 20 bp, Homo sapiens
gagaccgtcgggggctgagg

SEQ ID NO: 399922 - DNA, 16 bp, Homo sapiens
gagaccgtgagcgccc

SEQ ID NO: 399923 - DNA, 18 bp, Homo sapiens
gagacctcatcaggatga

SEQ ID NO: 399924 - DNA, 20 bp, Homo sapiens
gagacctctcaacagatctg

SEQ ID NO: 399925 - DNA, 13 bp, Homo sapiens
gagacctgaggca

SEQ ID NO: 399926 - DNA, 19 bp, Homo sapiens
gagacctggcactggatgc

SEQ ID NO: 399927 - DNA, 22 bp, Homo sapiens
gagacggatggaaggagagagg

SEQ ID NO: 399928 - DNA, 16 bp, Homo sapiens
gagacggcagccccat

SEQ ID NO: 399929 - DNA, 19 bp, Homo sapiens
gagacggcagccccatcct

SEQ ID NO: 399930 - DNA, 19 bp, Homo sapiens
gagacgggcatcgcaggag

SEQ ID NO: 399931 - DNA, 18 bp, Homo sapiens
gagacgtccaccctgcag

SEQ ID NO: 399932 - DNA, 20 bp, Homo sapiens
gagacgtccaccctgcagcc

SEQ ID NO: 399933 - DNA, 15 bp, Homo sapiens
gagactaagccctgt

SEQ ID NO: 399934 - DNA, 16 bp, Homo sapiens
gagactagacaaataa

SEQ ID NO: 399935 - DNA, 17 bp, Homo sapiens
gagactagacaaataac

SEQ ID NO: 399936 - DNA, 16 bp, Homo sapiens
gagactagattgcctt

SEQ ID NO: 399937 - DNA, 14 bp, Homo sapiens
gagactagggaagg

SEQ ID NO: 399938 - DNA, 13 bp, Homo sapiens
gagactatgtgtc

SEQ ID NO: 399939 - DNA, 15 bp, Homo sapiens
gagactatgtgtcat

SEQ ID NO: 399940 - DNA, 13 bp, Homo sapiens
gagactatttaaa

SEQ ID NO: 399941 - DNA, 21 bp, Homo sapiens
gagactccagaatctgctgtt

SEQ ID NO: 399942 - DNA, 18 bp, Homo sapiens
gagactgaaagcagcagc

SEQ ID NO: 399943 - DNA, 17 bp, Homo sapiens
gagactgagaggcagaa

SEQ ID NO: 399944 - DNA, 22 bp, Homo sapiens
gagactgaggcttagagagagg

SEQ ID NO: 399945 - DNA, 15 bp, Homo sapiens
gagactgcagaggag

SEQ ID NO: 399946 - DNA, 12 bp, Homo sapiens
gagactgcccac

SEQ ID NO: 399947 - DNA, 21 bp, Homo sapiens
gagactgcccaccctgggcct

SEQ ID NO: 399948 - DNA, 13 bp, Homo sapiens
gagactgccccac

SEQ ID NO: 399949 - DNA, 21 bp, Homo sapiens
gagactgccccacggccctgt

SEQ ID NO: 399950 - DNA, 12 bp, Homo sapiens
gagactggcagc

SEQ ID NO: 399951 - DNA, 13 bp, Homo sapiens
gagactggcagcc

SEQ ID NO: 399952 - DNA, 18 bp, Homo sapiens
gagactggccagaggcag

SEQ ID NO: 399953 - DNA, 13 bp, Homo sapiens
gagactgggaaga

SEQ ID NO: 399954 - DNA, 23 bp, Homo sapiens
gagactggtcctgtgtgcagtga

SEQ ID NO: 399955 - DNA, 19 bp, Homo sapiens
gagactgtcggagaggctg

SEQ ID NO: 399956 - DNA, 21 bp, Homo sapiens
gagactgtgaggcggcagctg

SEQ ID NO: 399957 - DNA, 22 bp, Homo sapiens
gagactgtgaggcggcagctgg

SEQ ID NO: 399958 - DNA, 20 bp, Homo sapiens
gagacttccaaacctgacag

SEQ ID NO: 399959 - DNA, 18 bp, Homo sapiens
gagacttctaaatcataa

SEQ ID NO: 399960 - DNA, 21 bp, Homo sapiens
gagacttctaggaggatgctg

SEQ ID NO: 399961 - DNA, 12 bp, Homo sapiens
gagagaaaaaga

SEQ ID NO: 399962 - DNA, 18 bp, Homo sapiens
gagagaaaaagtgcccct

SEQ ID NO: 399963 - DNA, 16 bp, Homo sapiens
gagagaaagaatgaga

SEQ ID NO: 399964 - DNA, 15 bp, Homo sapiens
gagagaacagggatg

SEQ ID NO: 399965 - DNA, 12 bp, Homo sapiens
gagagaagggga

SEQ ID NO: 399966 - DNA, 16 bp, Homo sapiens
gagagaaggggaggag

SEQ ID NO: 399967 - DNA, 17 bp, Homo sapiens
gagagaaggggaggagg

SEQ ID NO: 399968 - DNA, 13 bp, Homo sapiens
gagagaagtgccc

SEQ ID NO: 399969 - DNA, 21 bp, Homo sapiens
gagagaatgagagagtgtgga

SEQ ID NO: 399970 - DNA, 17 bp, Homo sapiens
gagagacaagaagcaaa

SEQ ID NO: 399971 - DNA, 15 bp, Homo sapiens
gagagaccctcactg

SEQ ID NO: 399972 - DNA, 22 bp, Homo sapiens
gagagaccctcactgctgggga

SEQ ID NO: 399973 - DNA, 20 bp, Homo sapiens
gagagaccctcgcaaaatga

SEQ ID NO: 399974 - DNA, 18 bp, Homo sapiens
gagagactgaaagcagca

SEQ ID NO: 399975 - DNA, 21 bp, Homo sapiens
gagagactggccagaggcagc

SEQ ID NO: 399976 - DNA, 12 bp, Homo sapiens
gagagagaaaga

SEQ ID NO: 399977 - DNA, 13 bp, Homo sapiens
gagagagagaaag

SEQ ID NO: 399978 - DNA, 19 bp, Homo sapiens
tattttcagtatactgtgt

SEQ ID NO: 399979 - DNA, 17 bp, Homo sapiens
tattttcagtattttgg

SEQ ID NO: 399980 - DNA, 12 bp, Homo sapiens
tattttcctccc

SEQ ID NO: 399981 - DNA, 16 bp, Homo sapiens
tattttcctccccagc

SEQ ID NO: 399982 - DNA, 13 bp, Homo sapiens
tattttcctgtct

SEQ ID NO: 399983 - DNA, 13 bp, Homo sapiens
tattttcgtgcat

SEQ ID NO: 399984 - DNA, 20 bp, Homo sapiens
tattttcgtgcatttgtgag

SEQ ID NO: 399985 - DNA, 18 bp, Homo sapiens
tattttctatatttgtaa

SEQ ID NO: 399986 - DNA, 20 bp, Homo sapiens
tattttctggtagatagaaa

SEQ ID NO: 399987 - DNA, 18 bp, Homo sapiens
tattttcttacagtattt

SEQ ID NO: 399988 - DNA, 22 bp, Homo sapiens
tattttcttcccatttgtaatg

SEQ ID NO: 399989 - DNA, 22 bp, Homo sapiens
tattttcttttatatctgtaaa

SEQ ID NO: 399990 - DNA, 16 bp, Homo sapiens
tattttgaaaacactt

SEQ ID NO: 399991 - DNA, 17 bp, Homo sapiens
tattttgaaaacactta

SEQ ID NO: 399992 - DNA, 17 bp, Homo sapiens
tattttgaatgtcacaa

SEQ ID NO: 399993 - DNA, 21 bp, Homo sapiens
tattttgcacgaattttaaaa

SEQ ID NO: 399994 - DNA, 21 bp, Homo sapiens
tattttgtacaaagtaaaaat

SEQ ID NO: 399995 - DNA, 15 bp, Homo sapiens
tattttgttactgtc

SEQ ID NO: 399996 - DNA, 17 bp, Homo sapiens
tattttgttactgtctg

SEQ ID NO: 399997 - DNA, 17 bp, Homo sapiens
tatttttaaattctgct

SEQ ID NO: 399998 - DNA, 13 bp, Homo sapiens
tatttttagagat

SEQ ID NO: 399999 - DNA, 18 bp, Homo sapiens
tatttttatttatttttg

SEQ ID NO: 400000 - DNA, 11 bp, Homo sapiens
tatttttcata

SEQ ID NO: 400001 - DNA, 17 bp, Homo sapiens
tatttttccctgtttgc

SEQ ID NO: 400002 - DNA, 21 bp, Homo sapiens
tatttttccctgtttgcctat

SEQ ID NO: 400003 - DNA, 22 bp, Homo sapiens
tatttttccctgtttgcctata

SEQ ID NO: 400004 - DNA, 14 bp, Homo sapiens
tatttttctaaggt

SEQ ID NO: 400005 - DNA, 13 bp, Homo sapiens
tatttttgaataa

SEQ ID NO: 400006 - DNA, 13 bp, Homo sapiens
tatttttggactt

SEQ ID NO: 400007 - DNA, 17 bp, Homo sapiens
tatttttgtactgtgct

SEQ ID NO: 400008 - DNA, 23 bp, Homo sapiens
tatttttgttaatcatcttctct

SEQ ID NO: 400009 - DNA, 19 bp, Homo sapiens
tatttttgttgtgttctgt

SEQ ID NO: 400010 - DNA, 18 bp, Homo sapiens
tatttttgtttgttttgt

SEQ ID NO: 400011 - DNA, 15 bp, Homo sapiens
tattttttaagtatt

SEQ ID NO: 400012 - DNA, 15 bp, Homo sapiens
tattttttaagttca

SEQ ID NO: 400013 - DNA, 16 bp, Homo sapiens
tattttttaatgtgag

SEQ ID NO: 400014 - DNA, 12 bp, Homo sapiens
tattttttaatt

SEQ ID NO: 400015 - DNA, 21 bp, Homo sapiens
tattttttatttctaagtatt

SEQ ID NO: 400016 - DNA, 15 bp, Homo sapiens
tatttttttgttgct

SEQ ID NO: 400017 - DNA, 23 bp, Homo sapiens
tcaagaagtcagagaaaacactt

SEQ ID NO: 400018 - DNA, 17 bp, Homo sapiens
tcaagactcaatgtgga

SEQ ID NO: 400019 - DNA, 12 bp, Homo sapiens
tcaagactgaaa

SEQ ID NO: 400020 - DNA, 19 bp, Homo sapiens
tcaagatcttcaaccatga

SEQ ID NO: 400021 - DNA, 20 bp, Homo sapiens
tcaagattatattataataa

SEQ ID NO: 400022 - DNA, 22 bp, Homo sapiens
tcaagattcccggctggacttt

SEQ ID NO: 400023 - DNA, 19 bp, Homo sapiens
tcaagattttgaatgcttc

SEQ ID NO: 400024 - DNA, 12 bp, Homo sapiens
tcaagcaaacat

SEQ ID NO: 400025 - DNA, 14 bp, Homo sapiens
tcaagcaaacatca

SEQ ID NO: 400026 - DNA, 22 bp, Homo sapiens
tcaagcaaacatcaaataaatt

SEQ ID NO: 400027 - DNA, 23 bp, Homo sapiens
tcaagcaaatatttatgacctca

SEQ ID NO: 400028 - DNA, 18 bp, Homo sapiens
tcaagcaaggaagcagag

SEQ ID NO: 400029 - DNA, 18 bp, Homo sapiens
tcaagcaatcctcctgag

SEQ ID NO: 400030 - DNA, 18 bp, Homo sapiens
tcaagcactaaaaagtgg

SEQ ID NO: 400031 - DNA, 13 bp, Homo sapiens
tcaagcagagacc

SEQ ID NO: 400032 - DNA, 18 bp, Homo sapiens
tcaagcaggtttcttgct

SEQ ID NO: 400033 - DNA, 19 bp, Homo sapiens
tcaagcaggtttcttgctt

SEQ ID NO: 400034 - DNA, 19 bp, Homo sapiens
tcaagcagtctacccacct

SEQ ID NO: 400035 - DNA, 20 bp, Homo sapiens
tcaagcagtctacccacctc

SEQ ID NO: 400036 - DNA, 23 bp, Homo sapiens
tcaagctaataaaatatcattca

SEQ ID NO: 400037 - DNA, 19 bp, Homo sapiens
tcaagctgtcccctctgtc

SEQ ID NO: 400038 - DNA, 18 bp, Homo sapiens
tcaagcttgtgtacttga

SEQ ID NO: 400039 - DNA, 17 bp, Homo sapiens
tcaagctttcaaatcct

SEQ ID NO: 400040 - DNA, 14 bp, Homo sapiens
tcaagctttccgag

SEQ ID NO: 400041 - DNA, 18 bp, Homo sapiens
tcaaggacttgaaagcat

SEQ ID NO: 400042 - DNA, 17 bp, Homo sapiens
tcaaggagatataaaat

SEQ ID NO: 400043 - DNA, 18 bp, Homo sapiens
tcaaggagatataaaatc

SEQ ID NO: 400044 - DNA, 12 bp, Homo sapiens
tcaaggccgtgt

SEQ ID NO: 400045 - DNA, 14 bp, Homo sapiens
tcaaggctgcctgg

SEQ ID NO: 400046 - DNA, 13 bp, Homo sapiens
tcaagggaagaaa

SEQ ID NO: 400047 - DNA, 20 bp, Homo sapiens
tcaagggactgggggtgcca

SEQ ID NO: 400048 - DNA, 16 bp, Homo sapiens
tcaaggtgctgttgtc

SEQ ID NO: 400049 - DNA, 20 bp, Homo sapiens
tcaaggtggccaaattattt

SEQ ID NO: 400050 - DNA, 16 bp, Homo sapiens
tcaagtaagaagacat

SEQ ID NO: 400051 - DNA, 23 bp, Homo sapiens
tcaagtaagaagacatgaaccaa

SEQ ID NO: 400052 - DNA, 15 bp, Homo sapiens
tcaagtaattgtgaa

SEQ ID NO: 400053 - DNA, 16 bp, Homo sapiens
tcaagtatataaagtt

SEQ ID NO: 400054 - DNA, 22 bp, Homo sapiens
tcaagtatttattattgaagat

SEQ ID NO: 400055 - DNA, 15 bp, Homo sapiens
tcaagtcacctcctt

SEQ ID NO: 400056 - DNA, 23 bp, Homo sapiens
tcaagtcatgatggagacttcag

SEQ ID NO: 400057 - DNA, 14 bp, Homo sapiens
tcaagtctctgctg

SEQ ID NO: 400058 - DNA, 12 bp, Homo sapiens
tcaagtctgtga

SEQ ID NO: 400059 - DNA, 14 bp, Homo sapiens
tcaagtctgtgaaa

SEQ ID NO: 400060 - DNA, 17 bp, Homo sapiens
tcaagtctgtgcctgga

SEQ ID NO: 400061 - DNA, 16 bp, Homo sapiens
tcaagtgagtggcatg

SEQ ID NO: 400062 - DNA, 18 bp, Homo sapiens
tcaagtgagtggcatgtg

SEQ ID NO: 400063 - DNA, 19 bp, Homo sapiens
tcaagtgattctcctgcct

SEQ ID NO: 400064 - DNA, 11 bp, Homo sapiens
tcaagttcaat

SEQ ID NO: 400065 - DNA, 21 bp, Homo sapiens
tcaagttgggagcctgaaata

SEQ ID NO: 400066 - DNA, 13 bp, Homo sapiens
tcaagttgtgctt

SEQ ID NO: 400067 - DNA, 14 bp, Homo sapiens
tcaataaaatgtga

SEQ ID NO: 400068 - DNA, 18 bp, Homo sapiens
tcaataaaatgtgatttt

SEQ ID NO: 400069 - DNA, 12 bp, Homo sapiens
tcaataaactta

SEQ ID NO: 400070 - DNA, 22 bp, Homo sapiens
tcaataaatactttaacttcca

SEQ ID NO: 400071 - DNA, 22 bp, Homo sapiens
tcaataaatagatgagtcctgt

SEQ ID NO: 400072 - DNA, 23 bp, Homo sapiens
tcaataaatagatgagtcctgtt

SEQ ID NO: 400073 - DNA, 15 bp, Homo sapiens
tcaataactattgct

SEQ ID NO: 400074 - DNA, 16 bp, Homo sapiens
tcaataactattgctg

SEQ ID NO: 400075 - DNA, 20 bp, Homo sapiens
tcaataattgtggagaggag

SEQ ID NO: 400076 - DNA, 22 bp, Homo sapiens
tcaataattgtggagaggagag

SEQ ID NO: 400077 - DNA, 14 bp, Homo sapiens
tcaatacccttggc

SEQ ID NO: 400078 - DNA, 18 bp, Homo sapiens
tcaatacccttggcactg

SEQ ID NO: 400079 - DNA, 20 bp, Homo sapiens
tcaatacccttggcactgat

SEQ ID NO: 400080 - DNA, 18 bp, Homo sapiens
tcaatacttgaatatgga

SEQ ID NO: 400081 - DNA, 22 bp, Homo sapiens
tcaatagaaagtcatctttgag

SEQ ID NO: 400082 - DNA, 18 bp, Homo sapiens
tcaatatccaaaccaaat

SEQ ID NO: 400083 - DNA, 16 bp, Homo sapiens
tcaatattaaatacag

SEQ ID NO: 400084 - DNA, 19 bp, Homo sapiens
tcaatatttaagagattaa

SEQ ID NO: 400085 - DNA, 11 bp, Homo sapiens
tcaatatttat

SEQ ID NO: 400086 - DNA, 12 bp, Homo sapiens
tcaatatttatt

SEQ ID NO: 400087 - DNA, 13 bp, Homo sapiens
tcaatatttatta

SEQ ID NO: 400088 - DNA, 16 bp, Homo sapiens
tcaatcaacctgcact

SEQ ID NO: 400089 - DNA, 16 bp, Homo sapiens
tcaatcatctgtgtga

SEQ ID NO: 400090 - DNA, 13 bp, Homo sapiens
tcaatccacagta

SEQ ID NO: 400091 - DNA, 17 bp, Homo sapiens
tcaatccacagtattgt

SEQ ID NO: 400092 - DNA, 18 bp, Homo sapiens
tcaatccaggatgttatt

SEQ ID NO: 400093 - DNA, 15 bp, Homo sapiens
tcaatcccaattctg

SEQ ID NO: 400094 - DNA, 21 bp, Homo sapiens
tcaatctaggcgaggcgaagc

SEQ ID NO: 400095 - DNA, 11 bp, Homo sapiens
tcaatctctgg

SEQ ID NO: 400096 - DNA, 20 bp, Homo sapiens
tcaatctctggaaaaataag

SEQ ID NO: 400097 - DNA, 12 bp, Homo sapiens
tcaatctctgtt

SEQ ID NO: 400098 - DNA, 17 bp, Homo sapiens
tcaatctggcttctgca

SEQ ID NO: 400099 - DNA, 20 bp, Homo sapiens
tcaatctggcttctgcatta

SEQ ID NO: 400100 - DNA, 22 bp, Homo sapiens
tcaatctgtgaagcctttatct

SEQ ID NO: 400101 - DNA, 23 bp, Homo sapiens
tcaatgaaatatttgcttattta

SEQ ID NO: 400102 - DNA, 15 bp, Homo sapiens
tcaatgatctaggtt

SEQ ID NO: 400103 - DNA, 21 bp, Homo sapiens
tcaatgcattgtcttgtggag

SEQ ID NO: 400104 - DNA, 12 bp, Homo sapiens
tcaatgccctgc

SEQ ID NO: 400105 - DNA, 13 bp, Homo sapiens
tcaatgcttttct

SEQ ID NO: 400106 - DNA, 19 bp, Homo sapiens
tcaatgcttttctagcaac

SEQ ID NO: 400107 - DNA, 18 bp, Homo sapiens
tcaatggcgcagtgcctc

SEQ ID NO: 400108 - DNA, 14 bp, Homo sapiens
tcaatgggcaatga

SEQ ID NO: 400109 - DNA, 15 bp, Homo sapiens
tcaatgtgattctaa

SEQ ID NO: 400110 - DNA, 17 bp, Homo sapiens
tcaatgtgattctaatg

SEQ ID NO: 400111 - DNA, 21 bp, Homo sapiens
tcaatgtgattctaatgtctt

SEQ ID NO: 400112 - DNA, 11 bp, Homo sapiens
tcaattaataa

SEQ ID NO: 400113 - DNA, 18 bp, Homo sapiens
tcaattacaggaagtact

SEQ ID NO: 400114 - DNA, 16 bp, Homo sapiens
tcaattattacattta

SEQ ID NO: 400115 - DNA, 12 bp, Homo sapiens
tcaattcatcta

SEQ ID NO: 400116 - DNA, 16 bp, Homo sapiens
tcaattcctctgggaa

SEQ ID NO: 400117 - DNA, 19 bp, Homo sapiens
tcaattgcagatgccaaaa

SEQ ID NO: 400118 - DNA, 17 bp, Homo sapiens
tcaattgtgtctgtggt

SEQ ID NO: 400119 - DNA, 18 bp, Homo sapiens
gagcaactctccactcca

SEQ ID NO: 400120 - DNA, 19 bp, Homo sapiens
gagcaactctccactccat

SEQ ID NO: 400121 - DNA, 18 bp, Homo sapiens
gagcaagaaaaaagtaca

SEQ ID NO: 400122 - DNA, 14 bp, Homo sapiens
gagcaagccttcct

SEQ ID NO: 400123 - DNA, 20 bp, Homo sapiens
gagcaaggacattgccccaa

SEQ ID NO: 400124 - DNA, 18 bp, Homo sapiens
gagcacaaaagcctctca

SEQ ID NO: 400125 - DNA, 15 bp, Homo sapiens
gagcacaggcagctg

SEQ ID NO: 400126 - DNA, 14 bp, Homo sapiens
gagcaccaggtgtt

SEQ ID NO: 400127 - DNA, 13 bp, Homo sapiens
gagcacccccagc

SEQ ID NO: 400128 - DNA, 20 bp, Homo sapiens
gagcacccccagcctccccc

SEQ ID NO: 400129 - DNA, 22 bp, Homo sapiens
gagcacccccagcctcccccag

SEQ ID NO: 400130 - DNA, 22 bp, Homo sapiens
gagcacctcaggaccctcccca

SEQ ID NO: 400131 - DNA, 17 bp, Homo sapiens
gagcaccttcctcactt

SEQ ID NO: 400132 - DNA, 19 bp, Homo sapiens
gagcacgtggagatagtgc

SEQ ID NO: 400133 - DNA, 22 bp, Homo sapiens
gagcacgtggagatagtgccag

SEQ ID NO: 400134 - DNA, 17 bp, Homo sapiens
gagcactcctgattttt

SEQ ID NO: 400135 - DNA, 16 bp, Homo sapiens
gagcactggccagaga

SEQ ID NO: 400136 - DNA, 19 bp, Homo sapiens
gagcagactggtgagcaga

SEQ ID NO: 400137 - DNA, 23 bp, Homo sapiens
gagcagactggtgagcagactgg

SEQ ID NO: 400138 - DNA, 15 bp, Homo sapiens
gagcagactggtggg

SEQ ID NO: 400139 - DNA, 12 bp, Homo sapiens
gagcagagaagg

SEQ ID NO: 400140 - DNA, 21 bp, Homo sapiens
gagcagagacactaacgactt

SEQ ID NO: 400141 - DNA, 24 bp, Homo sapiens
gagcagagacatgactcagcctgt

SEQ ID NO: 400142 - DNA, 20 bp, Homo sapiens
gagcagagacggcagcccca

SEQ ID NO: 400143 - DNA, 16 bp, Homo sapiens
gagcagagtctgggcc

SEQ ID NO: 400144 - DNA, 17 bp, Homo sapiens
gagcagagtctgggcct

SEQ ID NO: 400145 - DNA, 20 bp, Homo sapiens
gagcagagtctgggcctctg

SEQ ID NO: 400146 - DNA, 15 bp, Homo sapiens
gagcagcctccaaga

SEQ ID NO: 400147 - DNA, 20 bp, Homo sapiens
tcaccctgtgaccctctcac

SEQ ID NO: 400148 - DNA, 19 bp, Homo sapiens
tcacccttggtagagttta

SEQ ID NO: 400149 - DNA, 22 bp, Homo sapiens
tcaccctttgctgtgaggctgt

SEQ ID NO: 400150 - DNA, 21 bp, Homo sapiens
tcaccgccatgcaactccatg

SEQ ID NO: 400151 - DNA, 21 bp, Homo sapiens
tcacctaatgtttatgagcca

SEQ ID NO: 400152 - DNA, 17 bp, Homo sapiens
tcacctacttcctcctc

SEQ ID NO: 400153 - DNA, 16 bp, Homo sapiens
tcacctcaggacccca

SEQ ID NO: 400154 - DNA, 13 bp, Homo sapiens
tcacctcccctcc

SEQ ID NO: 400155 - DNA, 14 bp, Homo sapiens
tcacctcctccact

SEQ ID NO: 400156 - DNA, 16 bp, Homo sapiens
tcacctcctccactca

SEQ ID NO: 400157 - DNA, 20 bp, Homo sapiens
tcacctcctccactcactcc

SEQ ID NO: 400158 - DNA, 15 bp, Homo sapiens
tcacctctagcctta

SEQ ID NO: 400159 - DNA, 15 bp, Homo sapiens
tcacctgacctctga

SEQ ID NO: 400160 - DNA, 14 bp, Homo sapiens
tcacctgcaagccc

SEQ ID NO: 400161 - DNA, 20 bp, Homo sapiens
tcacctgcaagccccagggc

SEQ ID NO: 400162 - DNA, 21 bp, Homo sapiens
tcacctgcaagccccagggcc

SEQ ID NO: 400163 - DNA, 12 bp, Homo sapiens
tcacctgcagcc

SEQ ID NO: 400164 - DNA, 15 bp, Homo sapiens
tcacctgctggcccc

SEQ ID NO: 400165 - DNA, 16 bp, Homo sapiens
tcacctgctggcccct

SEQ ID NO: 400166 - DNA, 19 bp, Homo sapiens
tcacctgctggcccctcac

SEQ ID NO: 400167 - DNA, 13 bp, Homo sapiens
tcacctgctggtt

SEQ ID NO: 400168 - DNA, 22 bp, Homo sapiens
tcacctgctggttgttgccagg

SEQ ID NO: 400169 - DNA, 23 bp, Homo sapiens
tcacctggcttcccaggaccctg

SEQ ID NO: 400170 - DNA, 17 bp, Homo sapiens
tcacctgggcacctggg

SEQ ID NO: 400171 - DNA, 17 bp, Homo sapiens
tcacctgggcctttcct

SEQ ID NO: 400172 - DNA, 21 bp, Homo sapiens
tcacctgggcctttcctgtgc

SEQ ID NO: 400173 - DNA, 22 bp, Homo sapiens
tcacctgggcctttcctgtgcc

SEQ ID NO: 400174 - DNA, 16 bp, Homo sapiens
tcacctgtaaaacttt

SEQ ID NO: 400175 - DNA, 18 bp, Homo sapiens
tcacctgtgctacctcta

SEQ ID NO: 400176 - DNA, 18 bp, Homo sapiens
tcacctgtttttaagctg

SEQ ID NO: 400177 - DNA, 21 bp, Homo sapiens
tcacctgtttttaagctgttt

SEQ ID NO: 400178 - DNA, 15 bp, Homo sapiens
tcaccttcctgggca

SEQ ID NO: 400179 - DNA, 20 bp, Homo sapiens
tcaccttctgttttagagtt

SEQ ID NO: 400180 - DNA, 18 bp, Homo sapiens
tcaccttgcaacacacag

SEQ ID NO: 400181 - DNA, 19 bp, Homo sapiens
tcaccttgcaacacacaga

SEQ ID NO: 400182 - DNA, 21 bp, Homo sapiens
tcaccttgcaacacacagaca

SEQ ID NO: 400183 - DNA, 21 bp, Homo sapiens
tcaccttgccgagagaggcgc

SEQ ID NO: 400184 - DNA, 15 bp, Homo sapiens
tcacctttcccagat

SEQ ID NO: 400185 - DNA, 22 bp, Homo sapiens
tcaccttttctaaaaagtcaat

SEQ ID NO: 400186 - DNA, 21 bp, Homo sapiens
tcacctttttgacttttccaa

SEQ ID NO: 400187 - DNA, 13 bp, Homo sapiens
tcacgactcttcc

SEQ ID NO: 400188 - DNA, 20 bp, Homo sapiens
tcacgccattctcctgcctc

SEQ ID NO: 400189 - DNA, 23 bp, Homo sapiens
tcacgccattctcctgcctcagc

SEQ ID NO: 400190 - DNA, 23 bp, Homo sapiens
tcacgcctgtaatcccagcactt

SEQ ID NO: 400191 - DNA, 21 bp, Homo sapiens
tcacgctcccccgcagtcccc

SEQ ID NO: 400192 - DNA, 15 bp, Homo sapiens
tcacgctctccatca

SEQ ID NO: 400193 - DNA, 17 bp, Homo sapiens
tcacgctctggtgcagt

SEQ ID NO: 400194 - DNA, 14 bp, Homo sapiens
tcacgctggcttcc

SEQ ID NO: 400195 - DNA, 19 bp, Homo sapiens
tcacggggttggctgttcc

SEQ ID NO: 400196 - DNA, 22 bp, Homo sapiens
tcacgtaagatacaagtttcag

SEQ ID NO: 400197 - DNA, 14 bp, Homo sapiens
tcacgtcactgcca

SEQ ID NO: 400198 - DNA, 14 bp, Homo sapiens
tcacgtctgtgagt

SEQ ID NO: 400199 - DNA, 16 bp, Homo sapiens
tcacgtctgtgagtct

SEQ ID NO: 400200 - DNA, 22 bp, Homo sapiens
tcacgtctgtgagtctgtcctt

SEQ ID NO: 400201 - DNA, 12 bp, Homo sapiens
tcactacaaaaa

SEQ ID NO: 400202 - DNA, 16 bp, Homo sapiens
tcactacaaaaataca

SEQ ID NO: 400203 - DNA, 19 bp, Homo sapiens
tcactacagcatcaataga

SEQ ID NO: 400204 - DNA, 23 bp, Homo sapiens
tcactacagcatcaatagaaagt

SEQ ID NO: 400205 - DNA, 22 bp, Homo sapiens
tcactacccatcggtgtccatt

SEQ ID NO: 400206 - DNA, 21 bp, Homo sapiens
tcactaccctcctgtaaaata

SEQ ID NO: 400207 - DNA, 19 bp, Homo sapiens
tcactactcacagtctctt

SEQ ID NO: 400208 - DNA, 22 bp, Homo sapiens
tcactactcacagtctctttaa

SEQ ID NO: 400209 - DNA, 15 bp, Homo sapiens
tcactactggtctgt

SEQ ID NO: 400210 - DNA, 21 bp, Homo sapiens
tcactagagacaaatctttaa

SEQ ID NO: 400211 - DNA, 13 bp, Homo sapiens
tcactataaatgg

SEQ ID NO: 400212 - DNA, 15 bp, Homo sapiens
tcactatgcatttta

SEQ ID NO: 400213 - DNA, 17 bp, Homo sapiens
tcactatgtttctcaga

SEQ ID NO: 400214 - DNA, 22 bp, Homo sapiens
tcactattcttaagcactttga

SEQ ID NO: 400215 - DNA, 18 bp, Homo sapiens
tcactatttttatttata

SEQ ID NO: 400216 - DNA, 20 bp, Homo sapiens
tcactcatttacgtaaaaag

SEQ ID NO: 400217 - DNA, 13 bp, Homo sapiens
tcactccactccc

SEQ ID NO: 400218 - DNA, 14 bp, Homo sapiens
tcactccactcccc

SEQ ID NO: 400219 - DNA, 14 bp, Homo sapiens
tcactcccagtcca

SEQ ID NO: 400220 - DNA, 20 bp, Homo sapiens
tcactccctttgtggacttt

SEQ ID NO: 400221 - DNA, 18 bp, Homo sapiens
tcactcctaggagagcca

SEQ ID NO: 400222 - DNA, 12 bp, Homo sapiens
tcactcctgggg

SEQ ID NO: 400223 - DNA, 15 bp, Homo sapiens
tcactcgcccccggg

SEQ ID NO: 400224 - DNA, 14 bp, Homo sapiens
tcactcggctgtgg

SEQ ID NO: 400225 - DNA, 23 bp, Homo sapiens
tcactcggctttggctcgggact

SEQ ID NO: 400226 - DNA, 20 bp, Homo sapiens
tcactctacttagcatgtcc

SEQ ID NO: 400227 - DNA, 13 bp, Homo sapiens
tcactctcagtgc

SEQ ID NO: 400228 - DNA, 21 bp, Homo sapiens
tcactctgccagggcagtgct

SEQ ID NO: 400229 - DNA, 22 bp, Homo sapiens
tcactctgcctctaaggccaag

SEQ ID NO: 400230 - DNA, 14 bp, Homo sapiens
tcactcttatgaaa

SEQ ID NO: 400231 - DNA, 23 bp, Homo sapiens
tcactctttcttctctctttgtc

SEQ ID NO: 400232 - DNA, 19 bp, Homo sapiens
tcactgaagtgaatacatg

SEQ ID NO: 400233 - DNA, 22 bp, Homo sapiens
tcactgaataatggaattatgt

SEQ ID NO: 400234 - DNA, 21 bp, Homo sapiens
tcactgagggggagctgtctt

SEQ ID NO: 400235 - DNA, 17 bp, Homo sapiens
tcactgcaacctctgcc

SEQ ID NO: 400236 - DNA, 21 bp, Homo sapiens
tcactgcaacctctgcctccc

SEQ ID NO: 400237 - DNA, 17 bp, Homo sapiens
tcactgcaacttctgcc

SEQ ID NO: 400238 - DNA, 21 bp, Homo sapiens
tcactgcaagctccaactccc

SEQ ID NO: 400239 - DNA, 18 bp, Homo sapiens
tcactgcaattttgtgta

SEQ ID NO: 400240 - DNA, 15 bp, Homo sapiens
tcactgccatgatag

SEQ ID NO: 400241 - DNA, 12 bp, Homo sapiens
tcactgcccgca

SEQ ID NO: 400242 - DNA, 20 bp, Homo sapiens
tcactgcccgcacaccctca

SEQ ID NO: 400243 - DNA, 22 bp, Homo sapiens
tcactgccctccctcggcccca

SEQ ID NO: 400244 - DNA, 17 bp, Homo sapiens
tcactgcctatacccct

SEQ ID NO: 400245 - DNA, 17 bp, Homo sapiens
tcactgctcccccgtgt

SEQ ID NO: 400246 - DNA, 12 bp, Homo sapiens
tcactgctgctc

SEQ ID NO: 400247 - DNA, 15 bp, Homo sapiens
tcactgctgctcctc

SEQ ID NO: 400248 - DNA, 21 bp, Homo sapiens
tcactgctgctcctctttccc

SEQ ID NO: 400249 - DNA, 14 bp, Homo sapiens
tcactgctggctgc

SEQ ID NO: 400250 - DNA, 18 bp, Homo sapiens
tcactgctggctgcctta

SEQ ID NO: 400251 - DNA, 18 bp, Homo sapiens
tcactgctggggagtccc

SEQ ID NO: 400252 - DNA, 21 bp, Homo sapiens
tcactgctgtccctcctgagg

SEQ ID NO: 400253 - DNA, 17 bp, Homo sapiens
tcactggaacctccctg

SEQ ID NO: 400254 - DNA, 21 bp, Homo sapiens
tcactggaacctccctgggcc

SEQ ID NO: 400255 - DNA, 22 bp, Homo sapiens
tcactggaacctccctgggcct

SEQ ID NO: 400256 - DNA, 19 bp, Homo sapiens
tcactggagttacattaat

SEQ ID NO: 400257 - DNA, 21 bp, Homo sapiens
tcactggagttacattaatgt

SEQ ID NO: 400258 - DNA, 22 bp, Homo sapiens
tcactggagttacattaatgtt

SEQ ID NO: 400259 - DNA, 13 bp, Homo sapiens
tcactggctgggg

SEQ ID NO: 400260 - DNA, 18 bp, Homo sapiens
tcactgggtggggtgagg

SEQ ID NO: 400261 - DNA, 20 bp, Homo sapiens
tcactgggtggggtgaggac

SEQ ID NO: 400262 - DNA, 21 bp, Homo sapiens
tcactgtcttttgattcttga

SEQ ID NO: 400263 - DNA, 17 bp, Homo sapiens
tcactgtggtcctatgc

SEQ ID NO: 400264 - DNA, 23 bp, Homo sapiens
gaggaaaaccaagccgtggcttc

SEQ ID NO: 400265 - DNA, 14 bp, Homo sapiens
gaggaaaagccagt

SEQ ID NO: 400266 - DNA, 18 bp, Homo sapiens
gaggaaataatgggaaag

SEQ ID NO: 400267 - DNA, 16 bp, Homo sapiens
gaggaactccttggcc

SEQ ID NO: 400268 - DNA, 23 bp, Homo sapiens
gaggaactccttggcctagccca

SEQ ID NO: 400269 - DNA, 13 bp, Homo sapiens
gaggaactggtcc

SEQ ID NO: 400270 - DNA, 14 bp, Homo sapiens
gaggaactggtcca

SEQ ID NO: 400271 - DNA, 20 bp, Homo sapiens
gaggaactggtccaggccag

SEQ ID NO: 400272 - DNA, 17 bp, Homo sapiens
gaggaacttgctgctgt

SEQ ID NO: 400273 - DNA, 16 bp, Homo sapiens
gaggaagccacgtgct

SEQ ID NO: 400274 - DNA, 16 bp, Homo sapiens
gaggaaggagagaagg

SEQ ID NO: 400275 - DNA, 16 bp, Homo sapiens
gaggaaggatgcaaag

SEQ ID NO: 400276 - DNA, 14 bp, Homo sapiens
tcagccaaatgtaa

SEQ ID NO: 400277 - DNA, 17 bp, Homo sapiens
tcagccagctgcccaca

SEQ ID NO: 400278 - DNA, 14 bp, Homo sapiens
tcagccagcttggt

SEQ ID NO: 400279 - DNA, 16 bp, Homo sapiens
tcagccattcactgcc

SEQ ID NO: 400280 - DNA, 18 bp, Homo sapiens
tcagccattcctgttctc

SEQ ID NO: 400281 - DNA, 13 bp, Homo sapiens
tcagcccaccccc

SEQ ID NO: 400282 - DNA, 16 bp, Homo sapiens
tcagcccaggtcccag

SEQ ID NO: 400283 - DNA, 16 bp, Homo sapiens
tcagcccatatttcat

SEQ ID NO: 400284 - DNA, 12 bp, Homo sapiens
tcagccccagcc

SEQ ID NO: 400285 - DNA, 18 bp, Homo sapiens
tcagccccagggccctgc

SEQ ID NO: 400286 - DNA, 19 bp, Homo sapiens
tcagccccagggccctgct

SEQ ID NO: 400287 - DNA, 21 bp, Homo sapiens
tcagccccagggccctgctca

SEQ ID NO: 400288 - DNA, 23 bp, Homo sapiens
tcagccccagggccctgctcagg

SEQ ID NO: 400289 - DNA, 11 bp, Homo sapiens
tcagcccctct

SEQ ID NO: 400290 - DNA, 17 bp, Homo sapiens
tcagcccgaatgcctgt

SEQ ID NO: 400291 - DNA, 13 bp, Homo sapiens
tcagccctgaggt

SEQ ID NO: 400292 - DNA, 15 bp, Homo sapiens
tcagccctgctgtca

SEQ ID NO: 400293 - DNA, 21 bp, Homo sapiens
tcagcccttgcccccatccct

SEQ ID NO: 400294 - DNA, 18 bp, Homo sapiens
tcagccgagccgggcctg

SEQ ID NO: 400295 - DNA, 21 bp, Homo sapiens
tcagccgagccgggcctgggg

SEQ ID NO: 400296 - DNA, 15 bp, Homo sapiens
tcagcctcctgagcc

SEQ ID NO: 400297 - DNA, 19 bp, Homo sapiens
tcagcctcctgagcctgtg

SEQ ID NO: 400298 - DNA, 21 bp, Homo sapiens
tcagcctcctgagtagctgga

SEQ ID NO: 400299 - DNA, 20 bp, Homo sapiens
tcagcctcctgtgtagctgg

SEQ ID NO: 400300 - DNA, 14 bp, Homo sapiens
tcagcctgcttctt

SEQ ID NO: 400301 - DNA, 18 bp, Homo sapiens
tcagcgctgcccacacca

SEQ ID NO: 400302 - DNA, 18 bp, Homo sapiens
tcagcgggcgctgctggg

SEQ ID NO: 400303 - DNA, 15 bp, Homo sapiens
tcagctactaatgat

SEQ ID NO: 400304 - DNA, 20 bp, Homo sapiens
tcagctactaatgatgtttt

SEQ ID NO: 400305 - DNA, 22 bp, Homo sapiens
tcagctatgcaaatcagtctca

SEQ ID NO: 400306 - DNA, 19 bp, Homo sapiens
tcagctatttactgccaaa

SEQ ID NO: 400307 - DNA, 14 bp, Homo sapiens
tcagctccactctg

SEQ ID NO: 400308 - DNA, 18 bp, Homo sapiens
tcagctctctgggacctc

SEQ ID NO: 400309 - DNA, 11 bp, Homo sapiens
tcagctctggc

SEQ ID NO: 400310 - DNA, 12 bp, Homo sapiens
tcagctctggcc

SEQ ID NO: 400311 - DNA, 13 bp, Homo sapiens
tcagctctggcca

SEQ ID NO: 400312 - DNA, 14 bp, Homo sapiens
tcagctctggccac

SEQ ID NO: 400313 - DNA, 20 bp, Homo sapiens
tcagctctggctcacagact

SEQ ID NO: 400314 - DNA, 18 bp, Homo sapiens
tcagctgacacataattt

SEQ ID NO: 400315 - DNA, 22 bp, Homo sapiens
tcagctgagcttgagctcccct

SEQ ID NO: 400316 - DNA, 17 bp, Homo sapiens
tcagctgcagttgaaga

SEQ ID NO: 400317 - DNA, 12 bp, Homo sapiens
tcagctgccccc

SEQ ID NO: 400318 - DNA, 12 bp, Homo sapiens
tcagctgcttct

SEQ ID NO: 400319 - DNA, 23 bp, Homo sapiens
tcagctggcggaacctggctgcg

SEQ ID NO: 400320 - DNA, 22 bp, Homo sapiens
tcagctggtggatggtgacttt

SEQ ID NO: 400321 - DNA, 23 bp, Homo sapiens
tcagctggtggatggtgactttt

SEQ ID NO: 400322 - DNA, 16 bp, Homo sapiens
tcagctgtagaaaggt

SEQ ID NO: 400323 - DNA, 12 bp, Homo sapiens
tcagctgtgaac

SEQ ID NO: 400324 - DNA, 15 bp, Homo sapiens
tcagctgtttgtcat

SEQ ID NO: 400325 - DNA, 13 bp, Homo sapiens
tcagcttcccaac

SEQ ID NO: 400326 - DNA, 12 bp, Homo sapiens
tcagcttctgtt

SEQ ID NO: 400327 - DNA, 15 bp, Homo sapiens
tcagcttgctgccct

SEQ ID NO: 400328 - DNA, 17 bp, Homo sapiens
tcagcttggttcctgcc

SEQ ID NO: 400329 - DNA, 16 bp, Homo sapiens
tcagcttgtttctata

SEQ ID NO: 400330 - DNA, 21 bp, Homo sapiens
tcagcttgtttctatactgtt

SEQ ID NO: 400331 - DNA, 17 bp, Homo sapiens
tcagctttccctggctc

SEQ ID NO: 400332 - DNA, 22 bp, Homo sapiens
tcagctttccctggctcaggga

SEQ ID NO: 400333 - DNA, 23 bp, Homo sapiens
tcagctttgactttatctcctgc

SEQ ID NO: 400334 - DNA, 22 bp, Homo sapiens
tcagctttgccttccacgctgt

SEQ ID NO: 400335 - DNA, 17 bp, Homo sapiens
tcagcttttaataaaat

SEQ ID NO: 400336 - DNA, 16 bp, Homo sapiens
tcagcttttgttctag

SEQ ID NO: 400337 - DNA, 17 bp, Homo sapiens
tcagcttttgttctaga

SEQ ID NO: 400338 - DNA, 18 bp, Homo sapiens
tcagcttttgttctagac

SEQ ID NO: 400339 - DNA, 19 bp, Homo sapiens
tcagcttttgttctagact

SEQ ID NO: 400340 - DNA, 18 bp, Homo sapiens
tcaggaaatatatatgtg

SEQ ID NO: 400341 - DNA, 20 bp, Homo sapiens
tcaggaaatatatatgtgtg

SEQ ID NO: 400342 - DNA, 13 bp, Homo sapiens
tcaggaacctgga

SEQ ID NO: 400343 - DNA, 15 bp, Homo sapiens
tcaggaacctggacc

SEQ ID NO: 400344 - DNA, 23 bp, Homo sapiens
tcaggaacctggaccaaagctga

SEQ ID NO: 400345 - DNA, 20 bp, Homo sapiens
tcaggaagcctcctgctgag

SEQ ID NO: 400346 - DNA, 17 bp, Homo sapiens
tcaggaagggagaggag

SEQ ID NO: 400347 - DNA, 19 bp, Homo sapiens
tcaggacagctgcttctgt

SEQ ID NO: 400348 - DNA, 17 bp, Homo sapiens
tcaggaccaaagaacac

SEQ ID NO: 400349 - DNA, 23 bp, Homo sapiens
tcaggacccaggccctccatggg

SEQ ID NO: 400350 - DNA, 23 bp, Homo sapiens
tcaggaccccagagggaccagct

SEQ ID NO: 400351 - DNA, 21 bp, Homo sapiens
tcaggaccccatctgctgagc

SEQ ID NO: 400352 - DNA, 22 bp, Homo sapiens
tcaggactaccgttaccaagag

SEQ ID NO: 400353 - DNA, 14 bp, Homo sapiens
tcaggactcctctc

SEQ ID NO: 400354 - DNA, 20 bp, Homo sapiens
tcaggacttaacggctccag

SEQ ID NO: 400355 - DNA, 21 bp, Homo sapiens
tcaggagaaggcctgcccccc

SEQ ID NO: 400356 - DNA, 20 bp, Homo sapiens
tcaggagagccctctgctgc

SEQ ID NO: 400357 - DNA, 22 bp, Homo sapiens
tcaggagagtagaacagataat

SEQ ID NO: 400358 - DNA, 18 bp, Homo sapiens
tcaggagagtgcagatct

SEQ ID NO: 400359 - DNA, 14 bp, Homo sapiens
tcaggagccagcag

SEQ ID NO: 400360 - DNA, 23 bp, Homo sapiens
tcaggaggagacagtcaggaagc

SEQ ID NO: 400361 - DNA, 13 bp, Homo sapiens
tcaggaggagggc

SEQ ID NO: 400362 - DNA, 23 bp, Homo sapiens
tcaggaggagggcgcatgtgtgt

SEQ ID NO: 400363 - DNA, 13 bp, Homo sapiens
tcaggaggcagtg

SEQ ID NO: 400364 - DNA, 19 bp, Homo sapiens
tcaggaggcagtggcttgg

SEQ ID NO: 400365 - DNA, 20 bp, Homo sapiens
tcaggaggcagtggcttgga

SEQ ID NO: 400366 - DNA, 13 bp, Homo sapiens
tcaggaggctgga

SEQ ID NO: 400367 - DNA, 18 bp, Homo sapiens
tcaggaggtactgtgagg

SEQ ID NO: 400368 - DNA, 15 bp, Homo sapiens
tcaggatacatgtgc

SEQ ID NO: 400369 - DNA, 16 bp, Homo sapiens
tcaggatacatgtgcc

SEQ ID NO: 400370 - DNA, 20 bp, Homo sapiens
tcaggatcaaaccccgacca

SEQ ID NO: 400371 - DNA, 23 bp, Homo sapiens
tcaggatctcttagcattttaat

SEQ ID NO: 400372 - DNA, 15 bp, Homo sapiens
tcaggatgaacccag

SEQ ID NO: 400373 - DNA, 20 bp, Homo sapiens
tcaggatgcacggtttctgt

SEQ ID NO: 400374 - DNA, 20 bp, Homo sapiens
tcaggatttaaaaactggaa

SEQ ID NO: 400375 - DNA, 21 bp, Homo sapiens
tcaggatttaaaaactggaac

SEQ ID NO: 400376 - DNA, 20 bp, Homo sapiens
tcaggatttggtttttctct

SEQ ID NO: 400377 - DNA, 22 bp, Homo sapiens
tcaggatttggtttttctcttt

SEQ ID NO: 400378 - DNA, 18 bp, Homo sapiens
tcaggattttaaattaca

SEQ ID NO: 400379 - DNA, 16 bp, Homo sapiens
tcaggattttagtgct

SEQ ID NO: 400380 - DNA, 24 bp, Homo sapiens
tcaggcaagcccctcagcccttgc

SEQ ID NO: 400381 - DNA, 17 bp, Homo sapiens
tcaggcacatgtgttca

SEQ ID NO: 400382 - DNA, 16 bp, Homo sapiens
tcaggcactggtggca

SEQ ID NO: 400383 - DNA, 13 bp, Homo sapiens
tcaggcaggaagg

SEQ ID NO: 400384 - DNA, 21 bp, Homo sapiens
tcaggcaggaagggcaggaag

SEQ ID NO: 400385 - DNA, 19 bp, Homo sapiens
tcaggcagtagcagctgtg

SEQ ID NO: 400386 - DNA, 21 bp, Homo sapiens
tcaggcagtagcagctgtgtt

SEQ ID NO: 400387 - DNA, 16 bp, Homo sapiens
tcaggcagtaggcatt

SEQ ID NO: 400388 - DNA, 17 bp, Homo sapiens
tcaggcataggcctggg

SEQ ID NO: 400389 - DNA, 17 bp, Homo sapiens
tcaggccacctgccccc

SEQ ID NO: 400390 - DNA, 13 bp, Homo sapiens
tcaggccacttga

SEQ ID NO: 400391 - DNA, 13 bp, Homo sapiens
tcaggcccacatt

SEQ ID NO: 400392 - DNA, 19 bp, Homo sapiens
tcaggcccacattgcccac

SEQ ID NO: 400393 - DNA, 23 bp, Homo sapiens
tcaggccccaacctgaaggagga

SEQ ID NO: 400394 - DNA, 20 bp, Homo sapiens
tcaggcctcacctggcttcc

SEQ ID NO: 400395 - DNA, 22 bp, Homo sapiens
tcaggcctcacctggcttccca

SEQ ID NO: 400396 - DNA, 13 bp, Homo sapiens
tcaggcctgccaa

SEQ ID NO: 400397 - DNA, 20 bp, Homo sapiens
tcaggcgatccacctgtctc

SEQ ID NO: 400398 - DNA, 15 bp, Homo sapiens
tcaggctccattagg

SEQ ID NO: 400399 - DNA, 15 bp, Homo sapiens
tcaggctctgaatct

SEQ ID NO: 400400 - DNA, 21 bp, Homo sapiens
tcaggctctgaatctctcaaa

SEQ ID NO: 400401 - DNA, 17 bp, Homo sapiens
tcaggctgctggaggaa

SEQ ID NO: 400402 - DNA, 18 bp, Homo sapiens
tcaggcttggaatgaatt

SEQ ID NO: 400403 - DNA, 17 bp, Homo sapiens
tcagggaactgcttgcc

SEQ ID NO: 400404 - DNA, 15 bp, Homo sapiens
tcagggacagcagcc

SEQ ID NO: 400405 - DNA, 16 bp, Homo sapiens
tcagggacagcagcct

SEQ ID NO: 400406 - DNA, 11 bp, Homo sapiens
tcagggcaggg

SEQ ID NO: 400407 - DNA, 20 bp, Homo sapiens
tcagggcccacctcctccag

SEQ ID NO: 400408 - DNA, 16 bp, Homo sapiens
gaggtagcgagctgct

SEQ ID NO: 400409 - DNA, 21 bp, Homo sapiens
gaggtaggcgggaaaggatgg

SEQ ID NO: 400410 - DNA, 24 bp, Homo sapiens
gaggtcaagcccaggaggactgcc

SEQ ID NO: 400411 - DNA, 15 bp, Homo sapiens
gaggtcccaggaagt

SEQ ID NO: 400412 - DNA, 14 bp, Homo sapiens
gaggtcccctgagg

SEQ ID NO: 400413 - DNA, 22 bp, Homo sapiens
gaggtcgtataatttagtccct

SEQ ID NO: 400414 - DNA, 16 bp, Homo sapiens
gaggtctctgccggct

SEQ ID NO: 400415 - DNA, 21 bp, Homo sapiens
gaggtctgtacgttacctctt

SEQ ID NO: 400416 - DNA, 16 bp, Homo sapiens
gaggtgaaagggagct

SEQ ID NO: 400417 - DNA, 16 bp, Homo sapiens
gaggtgagaccacctc

SEQ ID NO: 400418 - DNA, 17 bp, Homo sapiens
gaggtgagggaggcctg

SEQ ID NO: 400419 - DNA, 15 bp, Homo sapiens
gaggtgataggcaag

SEQ ID NO: 400420 - DNA, 16 bp, Homo sapiens
gaggtgataggcaagg

SEQ ID NO: 400421 - DNA, 19 bp, Homo sapiens
gaggtgcctgagagcagaa

SEQ ID NO: 400422 - DNA, 11 bp, Homo sapiens
gaggtggctgg

SEQ ID NO: 400423 - DNA, 20 bp, Homo sapiens
gaggtgggaggcccctggtg

SEQ ID NO: 400424 - DNA, 17 bp, Homo sapiens
gaggtgggatcctccct

SEQ ID NO: 400425 - DNA, 11 bp, Homo sapiens
gaggtgggcat

SEQ ID NO: 400426 - DNA, 19 bp, Homo sapiens
gaggtgggcatgccaccct

SEQ ID NO: 400427 - DNA, 16 bp, Homo sapiens
gaggtgggggatgctg

SEQ ID NO: 400428 - DNA, 21 bp, Homo sapiens
gaggtgggggtctggcctagt

SEQ ID NO: 400429 - DNA, 19 bp, Homo sapiens
gaggtggtagctctgagcc

SEQ ID NO: 400430 - DNA, 13 bp, Homo sapiens
gaggtggtctgaa

SEQ ID NO: 400431 - DNA, 17 bp, Homo sapiens
gaggtggtctgaatgtt

SEQ ID NO: 400432 - DNA, 20 bp, Homo sapiens
gaggtggtctgaatgttctg

SEQ ID NO: 400433 - DNA, 20 bp, Homo sapiens
gaggtgtatggagagaaaac

SEQ ID NO: 400434 - DNA, 15 bp, Homo sapiens
gaggtgtcaccctgc

SEQ ID NO: 400435 - DNA, 20 bp, Homo sapiens
gaggtgtcaccctgcagagc

SEQ ID NO: 400436 - DNA, 22 bp, Homo sapiens
gaggtgtcaccctgcagagcta

SEQ ID NO: 400437 - DNA, 14 bp, Homo sapiens
gaggtgtggagtgg

SEQ ID NO: 400438 - DNA, 21 bp, Homo sapiens
gaggtgtttaaagagaggtta

SEQ ID NO: 400439 - DNA, 13 bp, Homo sapiens
gaggttaaaatat

SEQ ID NO: 400440 - DNA, 14 bp, Homo sapiens
gaggttaaggtggg

SEQ ID NO: 400441 - DNA, 17 bp, Homo sapiens
gaggttaggaacccggc

SEQ ID NO: 400442 - DNA, 19 bp, Homo sapiens
gaggttatctgcctggcct

SEQ ID NO: 400443 - DNA, 20 bp, Homo sapiens
gaggttatctgcctggcctg

SEQ ID NO: 400444 - DNA, 22 bp, Homo sapiens
gaggttatctgcctggcctggc

SEQ ID NO: 400445 - DNA, 18 bp, Homo sapiens
gaggttattttccgccag

SEQ ID NO: 400446 - DNA, 13 bp, Homo sapiens
gaggttctcagag

SEQ ID NO: 400447 - DNA, 14 bp, Homo sapiens
gaggttctcagagc

SEQ ID NO: 400448 - DNA, 12 bp, Homo sapiens
gaggttctcagc

SEQ ID NO: 400449 - DNA, 13 bp, Homo sapiens
gaggttgagtgag

SEQ ID NO: 400450 - DNA, 13 bp, Homo sapiens
gaggttgcagtga

SEQ ID NO: 400451 - DNA, 15 bp, Homo sapiens
gaggttgggaggcca

SEQ ID NO: 400452 - DNA, 17 bp, Homo sapiens
gaggttgggaggccatt

SEQ ID NO: 400453 - DNA, 20 bp, Homo sapiens
gagtaaaaattcatataaag

SEQ ID NO: 400454 - DNA, 23 bp, Homo sapiens
gagtaaaaattcatataaagtgc

SEQ ID NO: 400455 - DNA, 14 bp, Homo sapiens
gagtaagctgcttt

SEQ ID NO: 400456 - DNA, 14 bp, Homo sapiens
gagtaattatctgt

SEQ ID NO: 400457 - DNA, 21 bp, Homo sapiens
gagtaccaaatccacaagcca

SEQ ID NO: 400458 - DNA, 22 bp, Homo sapiens
gagtacccccctgagagcatgt

SEQ ID NO: 400459 - DNA, 18 bp, Homo sapiens
gagtacctgctgccccag

SEQ ID NO: 400460 - DNA, 22 bp, Homo sapiens
gagtacctgctgccccagctga

SEQ ID NO: 400461 - DNA, 19 bp, Homo sapiens
gagtaccttctacaggccc

SEQ ID NO: 400462 - DNA, 15 bp, Homo sapiens
gagtactatatttac

SEQ ID NO: 400463 - DNA, 16 bp, Homo sapiens
gagtactatatttaca

SEQ ID NO: 400464 - DNA, 19 bp, Homo sapiens
gagtagaaattgttcctga

SEQ ID NO: 400465 - DNA, 18 bp, Homo sapiens
gagtagacccctggctgg

SEQ ID NO: 400466 - DNA, 19 bp, Homo sapiens
gagtagagcatgacttatt

SEQ ID NO: 400467 - DNA, 18 bp, Homo sapiens
gagtagcacccccagcca

SEQ ID NO: 400468 - DNA, 12 bp, Homo sapiens
gagtagctggat

SEQ ID NO: 400469 - DNA, 21 bp, Homo sapiens
gagtaggcggcgatttttgta

SEQ ID NO: 400470 - DNA, 17 bp, Homo sapiens
gagtagggtagaaggaa

SEQ ID NO: 400471 - DNA, 17 bp, Homo sapiens
gagtagggttgccagtc

SEQ ID NO: 400472 - DNA, 19 bp, Homo sapiens
gagtagggttgccagtcct

SEQ ID NO: 400473 - DNA, 20 bp, Homo sapiens
gagtagttgatgttgcattt

SEQ ID NO: 400474 - DNA, 21 bp, Homo sapiens
gagtagttgatgttgcatttt

SEQ ID NO: 400475 - DNA, 15 bp, Homo sapiens
gagtatatatgtaca

SEQ ID NO: 400476 - DNA, 16 bp, Homo sapiens
gagtatcaaaggcaga

SEQ ID NO: 400477 - DNA, 22 bp, Homo sapiens
gagtatcaaaggcagaaaggag

SEQ ID NO: 400478 - DNA, 19 bp, Homo sapiens
gagtattctatgtaaaaat

SEQ ID NO: 400479 - DNA, 14 bp, Homo sapiens
gagtcaaaacactt

SEQ ID NO: 400480 - DNA, 20 bp, Homo sapiens
gagtcaaaagcctgggtgag

SEQ ID NO: 400481 - DNA, 18 bp, Homo sapiens
gagtcaagtgtgcctgct

SEQ ID NO: 400482 - DNA, 14 bp, Homo sapiens
gagtcacctcctcc

SEQ ID NO: 400483 - DNA, 16 bp, Homo sapiens
gagtcacctgcaagcc

SEQ ID NO: 400484 - DNA, 17 bp, Homo sapiens
gagtcacctgcaagccc

SEQ ID NO: 400485 - DNA, 21 bp, Homo sapiens
gagtcactggaacactaatga

SEQ ID NO: 400486 - DNA, 20 bp, Homo sapiens
gagtcagagccctggctggg

SEQ ID NO: 400487 - DNA, 12 bp, Homo sapiens
gagtcagatgag

SEQ ID NO: 400488 - DNA, 19 bp, Homo sapiens
gagtcaggcttctcttgct

SEQ ID NO: 400489 - DNA, 14 bp, Homo sapiens
gagtcagggagccc

SEQ ID NO: 400490 - DNA, 16 bp, Homo sapiens
gagtcagggcccagag

SEQ ID NO: 400491 - DNA, 22 bp, Homo sapiens
gagtcagggcccagaggctgag

SEQ ID NO: 400492 - DNA, 15 bp, Homo sapiens
gagtcatcaaaaaga

SEQ ID NO: 400493 - DNA, 11 bp, Homo sapiens
gagtcatcatg

SEQ ID NO: 400494 - DNA, 14 bp, Homo sapiens
gagtcattgttaca

SEQ ID NO: 400495 - DNA, 15 bp, Homo sapiens
gagtccaaaatcatt

SEQ ID NO: 400496 - DNA, 18 bp, Homo sapiens
gagtccaaaatcattccc

SEQ ID NO: 400497 - DNA, 16 bp, Homo sapiens
gagtccaatttaagga

SEQ ID NO: 400498 - DNA, 16 bp, Homo sapiens
gagtccactttcctct

SEQ ID NO: 400499 - DNA, 17 bp, Homo sapiens
gagtccactttcctctc

SEQ ID NO: 400500 - DNA, 21 bp, Homo sapiens
gagtccactttcctctctctc

SEQ ID NO: 400501 - DNA, 21 bp, Homo sapiens
gagtccagacctgggccctgg

SEQ ID NO: 400502 - DNA, 17 bp, Homo sapiens
gagtccaggagccccag

SEQ ID NO: 400503 - DNA, 14 bp, Homo sapiens
gagtccaggcccca

SEQ ID NO: 400504 - DNA, 12 bp, Homo sapiens
gagtccagggaa

SEQ ID NO: 400505 - DNA, 18 bp, Homo sapiens
gagtccattatttgagtt

SEQ ID NO: 400506 - DNA, 19 bp, Homo sapiens
gagtccattgcaaaaggtt

SEQ ID NO: 400507 - DNA, 22 bp, Homo sapiens
gagtcccctactcccctgatcc

SEQ ID NO: 400508 - DNA, 22 bp, Homo sapiens
gagtcccttccaggccatcaga

SEQ ID NO: 400509 - DNA, 14 bp, Homo sapiens
gagtccggaggcag

SEQ ID NO: 400510 - DNA, 15 bp, Homo sapiens
gagtccggaggcagc

SEQ ID NO: 400511 - DNA, 17 bp, Homo sapiens
gagtcctcactcccagt

SEQ ID NO: 400512 - DNA, 20 bp, Homo sapiens
gagtcctgttctcagagctc

SEQ ID NO: 400513 - DNA, 18 bp, Homo sapiens
gagtccttaaacagggca

SEQ ID NO: 400514 - DNA, 23 bp, Homo sapiens
gagtcctttcttttgaaatgcca

SEQ ID NO: 400515 - DNA, 12 bp, Homo sapiens
gagtcggctggg

SEQ ID NO: 400516 - DNA, 19 bp, Homo sapiens
gagtcgtcatcacttttca

SEQ ID NO: 400517 - DNA, 14 bp, Homo sapiens
gagtctcgctctgt

SEQ ID NO: 400518 - DNA, 14 bp, Homo sapiens
gagtctctgccacc

SEQ ID NO: 400519 - DNA, 16 bp, Homo sapiens
gagtctctgccaccca

SEQ ID NO: 400520 - DNA, 15 bp, Homo sapiens
gagtctcttctccac

SEQ ID NO: 400521 - DNA, 17 bp, Homo sapiens
gagtctgaaggagagga

SEQ ID NO: 400522 - DNA, 18 bp, Homo sapiens
gagtctgaaggagaggag

SEQ ID NO: 400523 - DNA, 20 bp, Homo sapiens
gagtctgaaggagaggagtg

SEQ ID NO: 400524 - DNA, 16 bp, Homo sapiens
gagtctgacaggaaga

SEQ ID NO: 400525 - DNA, 12 bp, Homo sapiens
gagtctgagccc

SEQ ID NO: 400526 - DNA, 21 bp, Homo sapiens
gagtctgctatattttcatga

SEQ ID NO: 400527 - DNA, 19 bp, Homo sapiens
gagtctggagaccaggact

SEQ ID NO: 400528 - DNA, 20 bp, Homo sapiens
gagtctggcaaacatgtgca

SEQ ID NO: 400529 - DNA, 22 bp, Homo sapiens
gagtctggcaaacatgtgcaac

SEQ ID NO: 400530 - DNA, 15 bp, Homo sapiens
gagtcttaattttct

SEQ ID NO: 400531 - DNA, 19 bp, Homo sapiens
gagtcttcacatttagaat

SEQ ID NO: 400532 - DNA, 22 bp, Homo sapiens
gagtctttgtaatgcttgtaca

SEQ ID NO: 400533 - DNA, 19 bp, Homo sapiens
gagtgaatgagtaaataaa

SEQ ID NO: 400534 - DNA, 22 bp, Homo sapiens
gagtgagaaatttttttccaga

SEQ ID NO: 400535 - DNA, 16 bp, Homo sapiens
tcatgtgggtgagcca

SEQ ID NO: 400536 - DNA, 18 bp, Homo sapiens
tcatgttaatcctagctg

SEQ ID NO: 400537 - DNA, 15 bp, Homo sapiens
tcatgttgaagtcaa

SEQ ID NO: 400538 - DNA, 22 bp, Homo sapiens
tcatgttttaaaagtttgtcct

SEQ ID NO: 400539 - DNA, 21 bp, Homo sapiens
tcatgttttgatgagaaaaaa

SEQ ID NO: 400540 - DNA, 14 bp, Homo sapiens
tcatgttttgtgac

SEQ ID NO: 400541 - DNA, 20 bp, Homo sapiens
tcattaaaagttttatgtac

SEQ ID NO: 400542 - DNA, 22 bp, Homo sapiens
tcattaaaatagattatcccac

SEQ ID NO: 400543 - DNA, 13 bp, Homo sapiens
tcattaaagaaaa

SEQ ID NO: 400544 - DNA, 24 bp, Homo sapiens
tcattaaatggtgatttcttgcta

SEQ ID NO: 400545 - DNA, 15 bp, Homo sapiens
tcattaaatgtttgt

SEQ ID NO: 400546 - DNA, 16 bp, Homo sapiens
tcattaaatgtttgtt

SEQ ID NO: 400547 - DNA, 22 bp, Homo sapiens
tcattaaatgtttgttgaataa

SEQ ID NO: 400548 - DNA, 13 bp, Homo sapiens
tcattataaacgt

SEQ ID NO: 400549 - DNA, 14 bp, Homo sapiens
tcattatgtagaaa

SEQ ID NO: 400550 - DNA, 16 bp, Homo sapiens
tcattatgtagaaata

SEQ ID NO: 400551 - DNA, 21 bp, Homo sapiens
tcattattggaattaacctgg

SEQ ID NO: 400552 - DNA, 14 bp, Homo sapiens
tcattattggaggg

SEQ ID NO: 400553 - DNA, 16 bp, Homo sapiens
gatagatttggaatag

SEQ ID NO: 400554 - DNA, 20 bp, Homo sapiens
gatagcaagtcccatcagcc

SEQ ID NO: 400555 - DNA, 22 bp, Homo sapiens
gatagcactggtttgtttctca

SEQ ID NO: 400556 - DNA, 23 bp, Homo sapiens
gatagcatatattcatacctgtt

SEQ ID NO: 400557 - DNA, 15 bp, Homo sapiens
gatagcctttgtagg

SEQ ID NO: 400558 - DNA, 15 bp, Homo sapiens
gatagcgttggaatt

SEQ ID NO: 400559 - DNA, 23 bp, Homo sapiens
gatagcgttggaattaaaacaat

SEQ ID NO: 400560 - DNA, 16 bp, Homo sapiens
gatagctaacatttta

SEQ ID NO: 400561 - DNA, 16 bp, Homo sapiens
gatagctattaagata

SEQ ID NO: 400562 - DNA, 14 bp, Homo sapiens
gatagctccttcat

SEQ ID NO: 400563 - DNA, 23 bp, Homo sapiens
gatagctgactcattcttttgga

SEQ ID NO: 400564 - DNA, 16 bp, Homo sapiens
gatagctggggcttca

SEQ ID NO: 400565 - DNA, 18 bp, Homo sapiens
gataggcaaggatgaaag

SEQ ID NO: 400566 - DNA, 15 bp, Homo sapiens
gataggcccaaggtc

SEQ ID NO: 400567 - DNA, 18 bp, Homo sapiens
gatagtagcatacattta

SEQ ID NO: 400568 - DNA, 22 bp, Homo sapiens
gatagtctttcagttaaggaga

SEQ ID NO: 400569 - DNA, 17 bp, Homo sapiens
gatagtgcttcttgtaa

SEQ ID NO: 400570 - DNA, 17 bp, Homo sapiens
gatagtgttttgtactt

SEQ ID NO: 400571 - DNA, 23 bp, Homo sapiens
gatataataaatatatatttatc

SEQ ID NO: 400572 - DNA, 20 bp, Homo sapiens
gatatacaattagagatatt

SEQ ID NO: 400573 - DNA, 16 bp, Homo sapiens
gatatacagatgaaaa

SEQ ID NO: 400574 - DNA, 23 bp, Homo sapiens
gatataggtcagtgaggcccagg

SEQ ID NO: 400575 - DNA, 11 bp, Homo sapiens
gatatataaac

SEQ ID NO: 400576 - DNA, 13 bp, Homo sapiens
gatatatatcata

SEQ ID NO: 400577 - DNA, 15 bp, Homo sapiens
gatatcacgggcccg

SEQ ID NO: 400578 - DNA, 18 bp, Homo sapiens
gatatcactaataaagtc

SEQ ID NO: 400579 - DNA, 14 bp, Homo sapiens
gatatcgtcatttt

SEQ ID NO: 400580 - DNA, 15 bp, Homo sapiens
gatatgaaaaataaa

SEQ ID NO: 400581 - DNA, 17 bp, Homo sapiens
gatatgaaaaataaata

SEQ ID NO: 400582 - DNA, 23 bp, Homo sapiens
gatatgaacagggcccaggcctg

SEQ ID NO: 400583 - DNA, 21 bp, Homo sapiens
gatatgagagggatgcagtgc

SEQ ID NO: 400584 - DNA, 14 bp, Homo sapiens
gatatgcagaagga

SEQ ID NO: 400585 - DNA, 22 bp, Homo sapiens
gatatgcatgtagcatataaat

SEQ ID NO: 400586 - DNA, 15 bp, Homo sapiens
gatatggagccctgt

SEQ ID NO: 400587 - DNA, 14 bp, Homo sapiens
gatatgggctttct

SEQ ID NO: 400588 - DNA, 21 bp, Homo sapiens
gatatgtgtaaatgttatgac

SEQ ID NO: 400589 - DNA, 22 bp, Homo sapiens
gatatgtgtaaatgttatgact

SEQ ID NO: 400590 - DNA, 22 bp, Homo sapiens
gatattaatttatcagattgct

SEQ ID NO: 400591 - DNA, 21 bp, Homo sapiens
gatattccatgaatgtatcag

SEQ ID NO: 400592 - DNA, 20 bp, Homo sapiens
gatattccccccacttaaga

SEQ ID NO: 400593 - DNA, 20 bp, Homo sapiens
gatattctttacaaactgaa

SEQ ID NO: 400594 - DNA, 19 bp, Homo sapiens
gatattggttctatttatt

SEQ ID NO: 400595 - DNA, 18 bp, Homo sapiens
gatattgttataaataaa

SEQ ID NO: 400596 - DNA, 15 bp, Homo sapiens
gatatttaagaaaat

SEQ ID NO: 400597 - DNA, 13 bp, Homo sapiens
gatatttatatat

SEQ ID NO: 400598 - DNA, 16 bp, Homo sapiens
gatatttatatatatt

SEQ ID NO: 400599 - DNA, 14 bp, Homo sapiens
gatatttcttgctt

SEQ ID NO: 400600 - DNA, 16 bp, Homo sapiens
gatatttcttgctttc

SEQ ID NO: 400601 - DNA, 20 bp, Homo sapiens
gatatttgctggagtgctgg

SEQ ID NO: 400602 - DNA, 22 bp, Homo sapiens
gatatttgctggagtgctggct

SEQ ID NO: 400603 - DNA, 19 bp, Homo sapiens
gatattttcaaattgtatc

SEQ ID NO: 400604 - DNA, 19 bp, Homo sapiens
gatattttcaacgcagccc

SEQ ID NO: 400605 - DNA, 14 bp, Homo sapiens
gatattttgcacga

SEQ ID NO: 400606 - DNA, 22 bp, Homo sapiens
gatcaaaccccgaccacctgcc

SEQ ID NO: 400607 - DNA, 20 bp, Homo sapiens
gatcaaagctaggaaaggca

SEQ ID NO: 400608 - DNA, 23 bp, Homo sapiens
gatcaagtcggatctagtccagc

SEQ ID NO: 400609 - DNA, 21 bp, Homo sapiens
gatcaataaaatgtgattttt

SEQ ID NO: 400610 - DNA, 16 bp, Homo sapiens
gatcaattaaatgtag

SEQ ID NO: 400611 - DNA, 16 bp, Homo sapiens
gatcacaaggtcagga

SEQ ID NO: 400612 - DNA, 14 bp, Homo sapiens
gatcacagatgtgc

SEQ ID NO: 400613 - DNA, 17 bp, Homo sapiens
gatcacagatgtgccca

SEQ ID NO: 400614 - DNA, 19 bp, Homo sapiens
gatcacagcctccagggcc

SEQ ID NO: 400615 - DNA, 14 bp, Homo sapiens
gatcaccagcccgg

SEQ ID NO: 400616 - DNA, 14 bp, Homo sapiens
gatcactactgcag

SEQ ID NO: 400617 - DNA, 18 bp, Homo sapiens
gatcacttgagcccagga

SEQ ID NO: 400618 - DNA, 14 bp, Homo sapiens
gatcactttctgaa

SEQ ID NO: 400619 - DNA, 11 bp, Homo sapiens
gatcagaacag

SEQ ID NO: 400620 - DNA, 14 bp, Homo sapiens
gatcagatctgaca

SEQ ID NO: 400621 - DNA, 19 bp, Homo sapiens
gatcagcaaaccggggcct

SEQ ID NO: 400622 - DNA, 11 bp, Homo sapiens
gatcagcctcc

SEQ ID NO: 400623 - DNA, 17 bp, Homo sapiens
gatcagctgtttgtcat

SEQ ID NO: 400624 - DNA, 18 bp, Homo sapiens
gatcagctgtttgtcata

SEQ ID NO: 400625 - DNA, 15 bp, Homo sapiens
gatcagttttcctag

SEQ ID NO: 400626 - DNA, 13 bp, Homo sapiens
gatcatgaaaagt

SEQ ID NO: 400627 - DNA, 15 bp, Homo sapiens
gatcatgcattgttg

SEQ ID NO: 400628 - DNA, 17 bp, Homo sapiens
gatcatttgcagctgct

SEQ ID NO: 400629 - DNA, 18 bp, Homo sapiens
gatcatttgcagctgctg

SEQ ID NO: 400630 - DNA, 19 bp, Homo sapiens
gatcatttgcagctgctgg

SEQ ID NO: 400631 - DNA, 15 bp, Homo sapiens
gatcattttcccccc

SEQ ID NO: 400632 - DNA, 15 bp, Homo sapiens
gatccaaatgctgtg

SEQ ID NO: 400633 - DNA, 19 bp, Homo sapiens
gatccaaatgctgtgcaaa

SEQ ID NO: 400634 - DNA, 17 bp, Homo sapiens
gatccacccacctcagc

SEQ ID NO: 400635 - DNA, 19 bp, Homo sapiens
gatccacccacctcagcct

SEQ ID NO: 400636 - DNA, 14 bp, Homo sapiens
gatccagagagaag

SEQ ID NO: 400637 - DNA, 15 bp, Homo sapiens
gatccagagagaagc

SEQ ID NO: 400638 - DNA, 16 bp, Homo sapiens
gatccagagagaagca

SEQ ID NO: 400639 - DNA, 23 bp, Homo sapiens
gatccagagagaagcaccccacc

SEQ ID NO: 400640 - DNA, 22 bp, Homo sapiens
gatccatgagtttgccctggtt

SEQ ID NO: 400641 - DNA, 22 bp, Homo sapiens
gatcccaagtcaaacagtgtgg

SEQ ID NO: 400642 - DNA, 22 bp, Homo sapiens
gatcccactcctaggacatgtt

SEQ ID NO: 400643 - DNA, 13 bp, Homo sapiens
gatccccgccacc

SEQ ID NO: 400644 - DNA, 20 bp, Homo sapiens
gatcccctttggttttacta

SEQ ID NO: 400645 - DNA, 18 bp, Homo sapiens
gatccctcggtcagcacc

SEQ ID NO: 400646 - DNA, 14 bp, Homo sapiens
gatccctgtgttgt

SEQ ID NO: 400647 - DNA, 13 bp, Homo sapiens
gatccgcatgtgt

SEQ ID NO: 400648 - DNA, 16 bp, Homo sapiens
gatccgcatgtgtctg

SEQ ID NO: 400649 - DNA, 21 bp, Homo sapiens
gatccgcctacctcagcctcc

SEQ ID NO: 400650 - DNA, 13 bp, Homo sapiens
gatccgctgccac

SEQ ID NO: 400651 - DNA, 14 bp, Homo sapiens
gatcctctattttg

SEQ ID NO: 400652 - DNA, 20 bp, Homo sapiens
gatcctctattttgtgatga

SEQ ID NO: 400653 - DNA, 18 bp, Homo sapiens
gatcctgaacaagaaaga

SEQ ID NO: 400654 - DNA, 16 bp, Homo sapiens
gatcctgcaccccagc

SEQ ID NO: 400655 - DNA, 22 bp, Homo sapiens
gatcctgcaggaacgagcactg

SEQ ID NO: 400656 - DNA, 11 bp, Homo sapiens
gatcctggagc

SEQ ID NO: 400657 - DNA, 18 bp, Homo sapiens
gatcctgtaatcacaact

SEQ ID NO: 400658 - DNA, 19 bp, Homo sapiens
gatcctgtgtggagaggga

SEQ ID NO: 400659 - DNA, 20 bp, Homo sapiens
gatcctgtgtggagagggaa

SEQ ID NO: 400660 - DNA, 14 bp, Homo sapiens
gatcgcacaaggac

SEQ ID NO: 400661 - DNA, 20 bp, Homo sapiens
gatcgcacaaggacatttgg

SEQ ID NO: 400662 - DNA, 23 bp, Homo sapiens
gatcgcatcattgcactctagcc

SEQ ID NO: 400663 - DNA, 15 bp, Homo sapiens
gatcgcttgagccca

SEQ ID NO: 400664 - DNA, 20 bp, Homo sapiens
gatcgcttgagcccaggagt

SEQ ID NO: 400665 - DNA, 19 bp, Homo sapiens
tccactctagttctagatg

SEQ ID NO: 400666 - DNA, 17 bp, Homo sapiens
tccactgcctctgcctt

SEQ ID NO: 400667 - DNA, 18 bp, Homo sapiens
tccactgcctctgcctta

SEQ ID NO: 400668 - DNA, 14 bp, Homo sapiens
tccactggcctgcc

SEQ ID NO: 400669 - DNA, 19 bp, Homo sapiens
tccactgtcactgtttctc

SEQ ID NO: 400670 - DNA, 22 bp, Homo sapiens
tccactgtcactgtttctctgc

SEQ ID NO: 400671 - DNA, 14 bp, Homo sapiens
tccactgtgtccag

SEQ ID NO: 400672 - DNA, 18 bp, Homo sapiens
tccacttctggtcccctg

SEQ ID NO: 400673 - DNA, 20 bp, Homo sapiens
tccacttctggtcccctgtg

SEQ ID NO: 400674 - DNA, 14 bp, Homo sapiens
tccactttcctctc

SEQ ID NO: 400675 - DNA, 16 bp, Homo sapiens
tccactttcctctctc

SEQ ID NO: 400676 - DNA, 18 bp, Homo sapiens
tccactttcctctctctc

SEQ ID NO: 400677 - DNA, 16 bp, Homo sapiens
tccactttgttcttta

SEQ ID NO: 400678 - DNA, 21 bp, Homo sapiens
tccactttgttggcccttcca

SEQ ID NO: 400679 - DNA, 16 bp, Homo sapiens
tccagaaagcaggagc

SEQ ID NO: 400680 - DNA, 23 bp, Homo sapiens
tccagaaaggatatttaagaaaa

SEQ ID NO: 400681 - DNA, 20 bp, Homo sapiens
tccagaaattcttcaatttg

SEQ ID NO: 400682 - DNA, 21 bp, Homo sapiens
tccagaacaaaagataaaact

SEQ ID NO: 400683 - DNA, 22 bp, Homo sapiens
tccagaacagccctcggcctcc

SEQ ID NO: 400684 - DNA, 23 bp, Homo sapiens
tccagaacagccctcggcctccg

SEQ ID NO: 400685 - DNA, 20 bp, Homo sapiens
tccagaacgtctctcaccta

SEQ ID NO: 400686 - DNA, 22 bp, Homo sapiens
tccagaacgtctctcacctaga

SEQ ID NO: 400687 - DNA, 23 bp, Homo sapiens
tccagaagaaattatttaatatg

SEQ ID NO: 400688 - DNA, 21 bp, Homo sapiens
tccagaagaatattcaggact

SEQ ID NO: 400689 - DNA, 22 bp, Homo sapiens
tccagaagaatattcaggactt

SEQ ID NO: 400690 - DNA, 21 bp, Homo sapiens
tccagaagcggcctgtgcgtt

SEQ ID NO: 400691 - DNA, 16 bp, Homo sapiens
tccagaaggccacagg

SEQ ID NO: 400692 - DNA, 23 bp, Homo sapiens
tccagaaggggtttggtctggga

SEQ ID NO: 400693 - DNA, 14 bp, Homo sapiens
tccagaatatctgg

SEQ ID NO: 400694 - DNA, 18 bp, Homo sapiens
tccagaatctgctgttgc

SEQ ID NO: 400695 - DNA, 19 bp, Homo sapiens
tccagaatctgctgttgcc

SEQ ID NO: 400696 - DNA, 20 bp, Homo sapiens
tccagaatttcccaaagcag

SEQ ID NO: 400697 - DNA, 20 bp, Homo sapiens
tccagacagagtggatctgg

SEQ ID NO: 400698 - DNA, 23 bp, Homo sapiens
gatggaggttctcagagccaagt

SEQ ID NO: 400699 - DNA, 18 bp, Homo sapiens
gatggataacctatatga

SEQ ID NO: 400700 - DNA, 15 bp, Homo sapiens
gatggatctgctcca

SEQ ID NO: 400701 - DNA, 18 bp, Homo sapiens
gatggatctgctccatgc

SEQ ID NO: 400702 - DNA, 14 bp, Homo sapiens
gatggattctcaga

SEQ ID NO: 400703 - DNA, 23 bp, Homo sapiens
gatggcacctgtggccagagcac

SEQ ID NO: 400704 - DNA, 22 bp, Homo sapiens
gatggcagcctcagggcttcct

SEQ ID NO: 400705 - DNA, 23 bp, Homo sapiens
gatggcagcctcagggcttcctt

SEQ ID NO: 400706 - DNA, 13 bp, Homo sapiens
gatggcattactc

SEQ ID NO: 400707 - DNA, 18 bp, Homo sapiens
gatggccaagggggtgga

SEQ ID NO: 400708 - DNA, 13 bp, Homo sapiens
gatggccatgctc

SEQ ID NO: 400709 - DNA, 14 bp, Homo sapiens
gatggccgggctgc

SEQ ID NO: 400710 - DNA, 22 bp, Homo sapiens
gatggcgcgggaggcaccagct

SEQ ID NO: 400711 - DNA, 15 bp, Homo sapiens
gatggcgtgtcccct

SEQ ID NO: 400712 - DNA, 17 bp, Homo sapiens
gatggctgtgcctctgc

SEQ ID NO: 400713 - DNA, 20 bp, Homo sapiens
gatggcttccgtgagacaca

SEQ ID NO: 400714 - DNA, 21 bp, Homo sapiens
gatggcttccgtgagacacaa

SEQ ID NO: 400715 - DNA, 17 bp, Homo sapiens
gatggcttgacatgtgc

SEQ ID NO: 400716 - DNA, 19 bp, Homo sapiens
gatgggaacactggtgggc

SEQ ID NO: 400717 - DNA, 14 bp, Homo sapiens
gatgggactgggag

SEQ ID NO: 400718 - DNA, 15 bp, Homo sapiens
gatgggactgggagg

SEQ ID NO: 400719 - DNA, 17 bp, Homo sapiens
gatgggagtctccctcc

SEQ ID NO: 400720 - DNA, 19 bp, Homo sapiens
gatgggagtgggcacctca

SEQ ID NO: 400721 - DNA, 15 bp, Homo sapiens
gatgggcacttgaga

SEQ ID NO: 400722 - DNA, 17 bp, Homo sapiens
gatgggcatggggtggg

SEQ ID NO: 400723 - DNA, 22 bp, Homo sapiens
gatgggcattgggctgacacct

SEQ ID NO: 400724 - DNA, 13 bp, Homo sapiens
gatggggcccaca

SEQ ID NO: 400725 - DNA, 14 bp, Homo sapiens
gatgggtcctgctg

SEQ ID NO: 400726 - DNA, 22 bp, Homo sapiens
gatgggttctaattttggatgg

SEQ ID NO: 400727 - DNA, 15 bp, Homo sapiens
gatggtcagctccct

SEQ ID NO: 400728 - DNA, 16 bp, Homo sapiens
gatggtcccaggaagc

SEQ ID NO: 400729 - DNA, 17 bp, Homo sapiens
gatggtgaatattacat

SEQ ID NO: 400730 - DNA, 14 bp, Homo sapiens
gatggtgagctggg

SEQ ID NO: 400731 - DNA, 16 bp, Homo sapiens
gatggtgctgagaagc

SEQ ID NO: 400732 - DNA, 12 bp, Homo sapiens
gatgtaaaacag

SEQ ID NO: 400733 - DNA, 14 bp, Homo sapiens
gatgtaaaatcttg

SEQ ID NO: 400734 - DNA, 15 bp, Homo sapiens
gatgtaaaatcttgt

SEQ ID NO: 400735 - DNA, 17 bp, Homo sapiens
gatgtaagaagcccgat

SEQ ID NO: 400736 - DNA, 17 bp, Homo sapiens
gatgtacaggcagatga

SEQ ID NO: 400737 - DNA, 18 bp, Homo sapiens
gatgtacagtctgtcatg

SEQ ID NO: 400738 - DNA, 15 bp, Homo sapiens
gatgtacttaagagt

SEQ ID NO: 400739 - DNA, 18 bp, Homo sapiens
gatgtatccatgggggca

SEQ ID NO: 400740 - DNA, 19 bp, Homo sapiens
gatgtattaacctacctgt

SEQ ID NO: 400741 - DNA, 17 bp, Homo sapiens
gatgtattatgcaaagt

SEQ ID NO: 400742 - DNA, 14 bp, Homo sapiens
gatgtcaaccttgt

SEQ ID NO: 400743 - DNA, 20 bp, Homo sapiens
gatgtcaaccttgtgtgagt

SEQ ID NO: 400744 - DNA, 23 bp, Homo sapiens
gatgtcaatgctatggactgcac

SEQ ID NO: 400745 - DNA, 22 bp, Homo sapiens
gatgtcagccgagccgggcctg

SEQ ID NO: 400746 - DNA, 11 bp, Homo sapiens
gatgtcagcct

SEQ ID NO: 400747 - DNA, 18 bp, Homo sapiens
gatgtcccaacttgtaaa

SEQ ID NO: 400748 - DNA, 19 bp, Homo sapiens
gatgtcccccaggggccca

SEQ ID NO: 400749 - DNA, 17 bp, Homo sapiens
gatgtcccctgtcccac

SEQ ID NO: 400750 - DNA, 22 bp, Homo sapiens
gatgtcccctgtcccaccaact

SEQ ID NO: 400751 - DNA, 20 bp, Homo sapiens
gatgtccctttcttggccag

SEQ ID NO: 400752 - DNA, 23 bp, Homo sapiens
gatgtcgatgctcactgcttctg

SEQ ID NO: 400753 - DNA, 15 bp, Homo sapiens
gatgtcgttcatttt

SEQ ID NO: 400754 - DNA, 15 bp, Homo sapiens
gatgtctaaaagatt

SEQ ID NO: 400755 - DNA, 20 bp, Homo sapiens
gatgtctaaaagattcttta

SEQ ID NO: 400756 - DNA, 21 bp, Homo sapiens
gatgtctagataacattcatg

SEQ ID NO: 400757 - DNA, 17 bp, Homo sapiens
gatgtctcttgtagaag

SEQ ID NO: 400758 - DNA, 22 bp, Homo sapiens
gatgtctgagagaccatctcct

SEQ ID NO: 400759 - DNA, 21 bp, Homo sapiens
gatgtcttcgtacagttcttc

SEQ ID NO: 400760 - DNA, 16 bp, Homo sapiens
gatgtcttctgcctgt

SEQ ID NO: 400761 - DNA, 15 bp, Homo sapiens
gatgtcttgagagcg

SEQ ID NO: 400762 - DNA, 12 bp, Homo sapiens
gatgtctttgtt

SEQ ID NO: 400763 - DNA, 16 bp, Homo sapiens
gatgtctttgttaaga

SEQ ID NO: 400764 - DNA, 12 bp, Homo sapiens
gatgtgcttctg

SEQ ID NO: 400765 - DNA, 17 bp, Homo sapiens
gatgtgtcttcaatttg

SEQ ID NO: 400766 - DNA, 13 bp, Homo sapiens
gatgtgtggggca

SEQ ID NO: 400767 - DNA, 16 bp, Homo sapiens
gatgtgtggggcatgg

SEQ ID NO: 400768 - DNA, 12 bp, Homo sapiens
gatgttaaaaca

SEQ ID NO: 400769 - DNA, 17 bp, Homo sapiens
gatgttcagcactgtcc

SEQ ID NO: 400770 - DNA, 14 bp, Homo sapiens
gatgttgttcctgg

SEQ ID NO: 400771 - DNA, 14 bp, Homo sapiens
gatgtttaacaaat

SEQ ID NO: 400772 - DNA, 20 bp, Homo sapiens
gatgtttaacaaatctaatc

SEQ ID NO: 400773 - DNA, 15 bp, Homo sapiens
gatgtttagtagctg

SEQ ID NO: 400774 - DNA, 17 bp, Homo sapiens
gatgtttagtagctgat

SEQ ID NO: 400775 - DNA, 13 bp, Homo sapiens
gatgtttgtgctg

SEQ ID NO: 400776 - DNA, 16 bp, Homo sapiens
gatgtttgtggcctca

SEQ ID NO: 400777 - DNA, 17 bp, Homo sapiens
gatgtttgtggcctcag

SEQ ID NO: 400778 - DNA, 18 bp, Homo sapiens
gatgtttttaaaagtttc

SEQ ID NO: 400779 - DNA, 20 bp, Homo sapiens
gatgtttttaaaagtttcaa

SEQ ID NO: 400780 - DNA, 21 bp, Homo sapiens
gatgtttttaaaagtttcaat

SEQ ID NO: 400781 - DNA, 22 bp, Homo sapiens
gatgtttttaaaagtttcaatg

SEQ ID NO: 400782 - DNA, 15 bp, Homo sapiens
gattaaaagcacaag

SEQ ID NO: 400783 - DNA, 19 bp, Homo sapiens
gattaaacacctgacacat

SEQ ID NO: 400784 - DNA, 12 bp, Homo sapiens
gattaaactgta

SEQ ID NO: 400785 - DNA, 13 bp, Homo sapiens
gattaaactgtat

SEQ ID NO: 400786 - DNA, 14 bp, Homo sapiens
gattaaatatttaa

SEQ ID NO: 400787 - DNA, 12 bp, Homo sapiens
gattaaatggca

SEQ ID NO: 400788 - DNA, 18 bp, Homo sapiens
gattaaccccttctttca

SEQ ID NO: 400789 - DNA, 14 bp, Homo sapiens
gattaacctctgca

SEQ ID NO: 400790 - DNA, 16 bp, Homo sapiens
gattaactgtgaataa

SEQ ID NO: 400791 - DNA, 20 bp, Homo sapiens
gattaagttataccagcaaa

SEQ ID NO: 400792 - DNA, 22 bp, Homo sapiens
gattaagttataccagcaaaag

SEQ ID NO: 400793 - DNA, 15 bp, Homo sapiens
gattaagttcctatc

SEQ ID NO: 400794 - DNA, 17 bp, Homo sapiens
gattaagttcgaggtgg

SEQ ID NO: 400795 - DNA, 21 bp, Homo sapiens
gcctctgcctccaggagggca

SEQ ID NO: 400796 - DNA, 19 bp, Homo sapiens
gcctctgccttagaggagc

SEQ ID NO: 400797 - DNA, 19 bp, Homo sapiens
gcctctggaggcctctggg

SEQ ID NO: 400798 - DNA, 19 bp, Homo sapiens
gcctctggctagaggccag

SEQ ID NO: 400799 - DNA, 13 bp, Homo sapiens
gcctctggctgcc

SEQ ID NO: 400800 - DNA, 14 bp, Homo sapiens
gcctctggctgcct

SEQ ID NO: 400801 - DNA, 15 bp, Homo sapiens
gcctctggctgcctg

SEQ ID NO: 400802 - DNA, 19 bp, Homo sapiens
gcctctggctgcctggccc

SEQ ID NO: 400803 - DNA, 15 bp, Homo sapiens
gcctctggggagacc

SEQ ID NO: 400804 - DNA, 18 bp, Homo sapiens
gcctctgtcctggctgtg

SEQ ID NO: 400805 - DNA, 20 bp, Homo sapiens
gcctctgtcctggctgtgca

SEQ ID NO: 400806 - DNA, 14 bp, Homo sapiens
gcctcttaaaaatt

SEQ ID NO: 400807 - DNA, 20 bp, Homo sapiens
gcctcttaaagctgcctgta

SEQ ID NO: 400808 - DNA, 23 bp, Homo sapiens
gcctcttaaagctgcctgtagtt

SEQ ID NO: 400809 - DNA, 12 bp, Homo sapiens
gcctcttcctcc

SEQ ID NO: 400810 - DNA, 22 bp, Homo sapiens
gcctcttctgaagatggaaggc

SEQ ID NO: 400811 - DNA, 19 bp, Homo sapiens
gcctcttgagcagtggctg

SEQ ID NO: 400812 - DNA, 21 bp, Homo sapiens
gcctcttgagcagtggctggt

SEQ ID NO: 400813 - DNA, 14 bp, Homo sapiens
gcctcttgctggtg

SEQ ID NO: 400814 - DNA, 16 bp, Homo sapiens
gcctcttgctggtgca

SEQ ID NO: 400815 - DNA, 14 bp, Homo sapiens
gcctcttgggagac

SEQ ID NO: 400816 - DNA, 17 bp, Homo sapiens
gcctctttaacagcttt

SEQ ID NO: 400817 - DNA, 22 bp, Homo sapiens
gcctctttgtgtttttgttgtt

SEQ ID NO: 400818 - DNA, 12 bp, Homo sapiens
gcctcttttctc

SEQ ID NO: 400819 - DNA, 15 bp, Homo sapiens
gcctgaaaaatggga

SEQ ID NO: 400820 - DNA, 19 bp, Homo sapiens
gcctgaaacagccatgtcc

SEQ ID NO: 400821 - DNA, 20 bp, Homo sapiens
gcctgaaatgtttccaggca

SEQ ID NO: 400822 - DNA, 21 bp, Homo sapiens
gcctgaaatgtttccaggcat

SEQ ID NO: 400823 - DNA, 22 bp, Homo sapiens
gcctgaaatgtttccaggcatg

SEQ ID NO: 400824 - DNA, 20 bp, Homo sapiens
gcctgacacaggggacactg

SEQ ID NO: 400825 - DNA, 21 bp, Homo sapiens
gcctgacactgagccccacct

SEQ ID NO: 400826 - DNA, 22 bp, Homo sapiens
gcctgaccccttgctcccttca

SEQ ID NO: 400827 - DNA, 19 bp, Homo sapiens
gcctgacctcaagcaacca

SEQ ID NO: 400828 - DNA, 17 bp, Homo sapiens
gcctgacctgagactgt

SEQ ID NO: 400829 - DNA, 17 bp, Homo sapiens
gcctgacctggcacaga

SEQ ID NO: 400830 - DNA, 22 bp, Homo sapiens
gcctgacttttacagcttttct

SEQ ID NO: 400831 - DNA, 15 bp, Homo sapiens
gcctgagagcagaat

SEQ ID NO: 400832 - DNA, 13 bp, Homo sapiens
gcctgagagtatt

SEQ ID NO: 400833 - DNA, 12 bp, Homo sapiens
gcctgagccaca

SEQ ID NO: 400834 - DNA, 20 bp, Homo sapiens
gcctgagccacagtggggcc

SEQ ID NO: 400835 - DNA, 16 bp, Homo sapiens
gcctgagctccaccct

SEQ ID NO: 400836 - DNA, 20 bp, Homo sapiens
gcctgagctccaccctcccc

SEQ ID NO: 400837 - DNA, 18 bp, Homo sapiens
gcctgagctggggccaca

SEQ ID NO: 400838 - DNA, 18 bp, Homo sapiens
gcctgaggatgagctgga

SEQ ID NO: 400839 - DNA, 16 bp, Homo sapiens
gcctgaggcaggagaa

SEQ ID NO: 400840 - DNA, 13 bp, Homo sapiens
gcctgaggccttc

SEQ ID NO: 400841 - DNA, 16 bp, Homo sapiens
gcctgagggcccctct

SEQ ID NO: 400842 - DNA, 18 bp, Homo sapiens
gcctgagggcccctctgc

SEQ ID NO: 400843 - DNA, 19 bp, Homo sapiens
gcctgagggcccctctgcc

SEQ ID NO: 400844 - DNA, 15 bp, Homo sapiens
gcctgagggtggaga

SEQ ID NO: 400845 - DNA, 18 bp, Homo sapiens
gcctgaggtctgtacgtt

SEQ ID NO: 400846 - DNA, 12 bp, Homo sapiens
gcctgagtcagg

SEQ ID NO: 400847 - DNA, 20 bp, Homo sapiens
gcctgagtcagggcccagag

SEQ ID NO: 400848 - DNA, 16 bp, Homo sapiens
gcctgagtctcctgtg

SEQ ID NO: 400849 - DNA, 19 bp, Homo sapiens
gcctgagtggtgaggggcc

SEQ ID NO: 400850 - DNA, 15 bp, Homo sapiens
gcctgagttgagggg

SEQ ID NO: 400851 - DNA, 16 bp, Homo sapiens
gcctgatgctccctcc

SEQ ID NO: 400852 - DNA, 20 bp, Homo sapiens
gcctgatgctccctcccctg

SEQ ID NO: 400853 - DNA, 13 bp, Homo sapiens
gcctgatgctgcc

SEQ ID NO: 400854 - DNA, 14 bp, Homo sapiens
gcctgatgctgccc

SEQ ID NO: 400855 - DNA, 16 bp, Homo sapiens
gcctgatgctgccccg

SEQ ID NO: 400856 - DNA, 17 bp, Homo sapiens
gcctgatgctgccccgt

SEQ ID NO: 400857 - DNA, 17 bp, Homo sapiens
gcctgatggccaagggg

SEQ ID NO: 400858 - DNA, 15 bp, Homo sapiens
gcctgattggggcct

SEQ ID NO: 400859 - DNA, 16 bp, Homo sapiens
gcctgattggggcctc

SEQ ID NO: 400860 - DNA, 12 bp, Homo sapiens
gcctgcacacac

SEQ ID NO: 400861 - DNA, 15 bp, Homo sapiens
gcctgcacacacctg

SEQ ID NO: 400862 - DNA, 17 bp, Homo sapiens
gcctgcacacacctgcc

SEQ ID NO: 400863 - DNA, 12 bp, Homo sapiens
gcctgcaccagg

SEQ ID NO: 400864 - DNA, 21 bp, Homo sapiens
gcctgcaccaggagacagaca

SEQ ID NO: 400865 - DNA, 22 bp, Homo sapiens
gcctgcacctgcgcctggctct

SEQ ID NO: 400866 - DNA, 12 bp, Homo sapiens
gcctgcagccca

SEQ ID NO: 400867 - DNA, 15 bp, Homo sapiens
gcctgcagcccagaa

SEQ ID NO: 400868 - DNA, 15 bp, Homo sapiens
gcctgcaggccccag

SEQ ID NO: 400869 - DNA, 20 bp, Homo sapiens
gcctgcaggccccagccaag

SEQ ID NO: 400870 - DNA, 19 bp, Homo sapiens
gcctgcagggtggtgctgg

SEQ ID NO: 400871 - DNA, 18 bp, Homo sapiens
gcctgcattcgcagcagc

SEQ ID NO: 400872 - DNA, 18 bp, Homo sapiens
gcctgccaatgccacagc

SEQ ID NO: 400873 - DNA, 22 bp, Homo sapiens
gcctgccaatgccacagccaag

SEQ ID NO: 400874 - DNA, 20 bp, Homo sapiens
cctgcaactcaaggactttg

SEQ ID NO: 400875 - DNA, 14 bp, Homo sapiens
cctgcaagaacaag

SEQ ID NO: 400876 - DNA, 14 bp, Homo sapiens
cctgcaagagtggg

SEQ ID NO: 400877 - DNA, 22 bp, Homo sapiens
cctgcaagagtgggctttccag

SEQ ID NO: 400878 - DNA, 14 bp, Homo sapiens
cctgcaagccccag

SEQ ID NO: 400879 - DNA, 16 bp, Homo sapiens
cctgcaagccccaggg

SEQ ID NO: 400880 - DNA, 19 bp, Homo sapiens
cctgcaagccccagggcct

SEQ ID NO: 400881 - DNA, 20 bp, Homo sapiens
cctgcaagccccagggcctg

SEQ ID NO: 400882 - DNA, 16 bp, Homo sapiens
cctgcaaggcccacag

SEQ ID NO: 400883 - DNA, 18 bp, Homo sapiens
cctgcaagggcgtggtgg

SEQ ID NO: 400884 - DNA, 15 bp, Homo sapiens
cctgcaatctccagg

SEQ ID NO: 400885 - DNA, 16 bp, Homo sapiens
cctgcaatctccaggg

SEQ ID NO: 400886 - DNA, 17 bp, Homo sapiens
cctgcaatctccagggc

SEQ ID NO: 400887 - DNA, 19 bp, Homo sapiens
cctgcaatgtatcccttct

SEQ ID NO: 400888 - DNA, 20 bp, Homo sapiens
cctgcacaaagcccttccat

SEQ ID NO: 400889 - DNA, 22 bp, Homo sapiens
cctgcacaaagcccttccatgt

SEQ ID NO: 400890 - DNA, 15 bp, Homo sapiens
cctgcacacacctgc

SEQ ID NO: 400891 - DNA, 19 bp, Homo sapiens
cctgcacacacctgcctgc

SEQ ID NO: 400892 - DNA, 18 bp, Homo sapiens
cctgcaccagcccttccc

SEQ ID NO: 400893 - DNA, 21 bp, Homo sapiens
cctgcaccagcccttccctgc

SEQ ID NO: 400894 - DNA, 12 bp, Homo sapiens
cctgcaccagga

SEQ ID NO: 400895 - DNA, 14 bp, Homo sapiens
cctgcacccacccc

SEQ ID NO: 400896 - DNA, 20 bp, Homo sapiens
cctgcacccacccctgccca

SEQ ID NO: 400897 - DNA, 12 bp, Homo sapiens
cctgcaccccag

SEQ ID NO: 400898 - DNA, 13 bp, Homo sapiens
cctgcaccccagc

SEQ ID NO: 400899 - DNA, 12 bp, Homo sapiens
cctgcaccctgg

SEQ ID NO: 400900 - DNA, 20 bp, Homo sapiens
cctgcacctgcgcctggctc

SEQ ID NO: 400901 - DNA, 14 bp, Homo sapiens
cctgcacctgtgca

SEQ ID NO: 400902 - DNA, 18 bp, Homo sapiens
cctgcaccttgggcacgg

SEQ ID NO: 400903 - DNA, 13 bp, Homo sapiens
cctgcactcacag

SEQ ID NO: 400904 - DNA, 11 bp, Homo sapiens
cctgcactgta

SEQ ID NO: 400905 - DNA, 16 bp, Homo sapiens
cctgcacttcatatct

SEQ ID NO: 400906 - DNA, 15 bp, Homo sapiens
cctgcagagctatgg

SEQ ID NO: 400907 - DNA, 13 bp, Homo sapiens
cctgcagagctgg

SEQ ID NO: 400908 - DNA, 21 bp, Homo sapiens
cctgcagaggaccacagtggg

SEQ ID NO: 400909 - DNA, 22 bp, Homo sapiens
cctgcagaggaccacagtgggt

SEQ ID NO: 400910 - DNA, 14 bp, Homo sapiens
cctgcagcagagcc

SEQ ID NO: 400911 - DNA, 15 bp, Homo sapiens
cctgcagcagagcct

SEQ ID NO: 400912 - DNA, 15 bp, Homo sapiens
cctgcagcccagaac

SEQ ID NO: 400913 - DNA, 15 bp, Homo sapiens
cctgcagcctcctcc

SEQ ID NO: 400914 - DNA, 18 bp, Homo sapiens
cctgcaggaacgagcact

SEQ ID NO: 400915 - DNA, 19 bp, Homo sapiens
cctgcaggaacgagcactg

SEQ ID NO: 400916 - DNA, 15 bp, Homo sapiens
cctgcaggaggcctg

SEQ ID NO: 400917 - DNA, 20 bp, Homo sapiens
cctgcaggaggcctgggagg

SEQ ID NO: 400918 - DNA, 18 bp, Homo sapiens
cctgcaggccccagccaa

SEQ ID NO: 400919 - DNA, 23 bp, Homo sapiens
cctgcaggccccagccaagtgcc

SEQ ID NO: 400920 - DNA, 12 bp, Homo sapiens
cctgcaggctgg

SEQ ID NO: 400921 - DNA, 13 bp, Homo sapiens
cctgcaggctggc

SEQ ID NO: 400922 - DNA, 23 bp, Homo sapiens
cctgcaggggagggtccaatctc

SEQ ID NO: 400923 - DNA, 22 bp, Homo sapiens
cctgcagggtggtgctgggact

SEQ ID NO: 400924 - DNA, 14 bp, Homo sapiens
cctgcagttcctga

SEQ ID NO: 400925 - DNA, 22 bp, Homo sapiens
cctgcatatctctagtccctgt

SEQ ID NO: 400926 - DNA, 17 bp, Homo sapiens
cctgcatcagcctctgg

SEQ ID NO: 400927 - DNA, 20 bp, Homo sapiens
cctgcatcagcctctggcca

SEQ ID NO: 400928 - DNA, 21 bp, Homo sapiens
cctgcatcccttggcccctct

SEQ ID NO: 400929 - DNA, 22 bp, Homo sapiens
cctgcatctttcatagttctgt

SEQ ID NO: 400930 - DNA, 16 bp, Homo sapiens
cctgcatgcagcaaca

SEQ ID NO: 400931 - DNA, 18 bp, Homo sapiens
cctgcattcgcagcagct

SEQ ID NO: 400932 - DNA, 19 bp, Homo sapiens
cctgcatttttaaaggaca

SEQ ID NO: 400933 - DNA, 12 bp, Homo sapiens
cctgccaactcc

SEQ ID NO: 400934 - DNA, 18 bp, Homo sapiens
cctgccaactccatgacc

SEQ ID NO: 400935 - DNA, 22 bp, Homo sapiens
cctgccaactccatgaccaggc

SEQ ID NO: 400936 - DNA, 14 bp, Homo sapiens
cctgccaagaactc

SEQ ID NO: 400937 - DNA, 18 bp, Homo sapiens
cctgccaagaactctggg

SEQ ID NO: 400938 - DNA, 14 bp, Homo sapiens
cctgccaagcctgg

SEQ ID NO: 400939 - DNA, 16 bp, Homo sapiens
cctgccaagcctggag

SEQ ID NO: 400940 - DNA, 22 bp, Homo sapiens
cctgccaagcctggagcccctg

SEQ ID NO: 400941 - DNA, 21 bp, Homo sapiens
cctgccaagtggtttctatga

SEQ ID NO: 400942 - DNA, 16 bp, Homo sapiens
cctgccaatgccacag

SEQ ID NO: 400943 - DNA, 21 bp, Homo sapiens
cctgccaatgccacagccaag

SEQ ID NO: 400944 - DNA, 17 bp, Homo sapiens
cctgccacaatgtgata

SEQ ID NO: 400945 - DNA, 15 bp, Homo sapiens
cctgccacactcagt

SEQ ID NO: 400946 - DNA, 20 bp, Homo sapiens
cctgccacactcagtccccc

SEQ ID NO: 400947 - DNA, 16 bp, Homo sapiens
cctgccacctccctga

SEQ ID NO: 400948 - DNA, 16 bp, Homo sapiens
cctgccacctcctgcc

SEQ ID NO: 400949 - DNA, 16 bp, Homo sapiens
cctgccacctgctgct

SEQ ID NO: 400950 - DNA, 14 bp, Homo sapiens
cctgccacctgtct

SEQ ID NO: 400951 - DNA, 15 bp, Homo sapiens
cctgccacctgtctg

SEQ ID NO: 400952 - DNA, 16 bp, Homo sapiens
cctgccacctgtctgt

SEQ ID NO: 400953 - DNA, 17 bp, Homo sapiens
cctgccactctctggga

SEQ ID NO: 400954 - DNA, 21 bp, Homo sapiens
cctgccactctctgggactct

SEQ ID NO: 400955 - DNA, 22 bp, Homo sapiens
cctgccactctctgggactctc

SEQ ID NO: 400956 - DNA, 19 bp, Homo sapiens
cctgccagacggcacccac

SEQ ID NO: 400957 - DNA, 11 bp, Homo sapiens
cctgccagcaa

SEQ ID NO: 400958 - DNA, 12 bp, Homo sapiens
cctgccagctgc

SEQ ID NO: 400959 - DNA, 18 bp, Homo sapiens
cctgccaggagcagcctc

SEQ ID NO: 400960 - DNA, 11 bp, Homo sapiens
cctgccaggct

SEQ ID NO: 400961 - DNA, 16 bp, Homo sapiens
cctgccaggctgtcag

SEQ ID NO: 400962 - DNA, 17 bp, Homo sapiens
cctgccaggctgtcagc

SEQ ID NO: 400963 - DNA, 12 bp, Homo sapiens
cctgccagggcc

SEQ ID NO: 400964 - DNA, 20 bp, Homo sapiens
cctgccagtgaagtccttca

SEQ ID NO: 400965 - DNA, 21 bp, Homo sapiens
cctgccagtgaagtccttcag

SEQ ID NO: 400966 - DNA, 23 bp, Homo sapiens
cctgcccaagggcctcccaccag

SEQ ID NO: 400967 - DNA, 21 bp, Homo sapiens
cctgcccaatgctttgggagg

SEQ ID NO: 400968 - DNA, 19 bp, Homo sapiens
cctgcccacttagccgtcc

SEQ ID NO: 400969 - DNA, 12 bp, Homo sapiens
cctgcccagctc

SEQ ID NO: 400970 - DNA, 21 bp, Homo sapiens
cctgcccaggcagtctttgct

SEQ ID NO: 400971 - DNA, 23 bp, Homo sapiens
cctgcccaggccggccagcctca

SEQ ID NO: 400972 - DNA, 13 bp, Homo sapiens
cctgcccagtgtt

SEQ ID NO: 400973 - DNA, 20 bp, Homo sapiens
cctgcccagttagcccggcc

SEQ ID NO: 400974 - DNA, 16 bp, Homo sapiens
cctgccccaaaattat

SEQ ID NO: 400975 - DNA, 18 bp, Homo sapiens
cctgccccacacaggcct

SEQ ID NO: 400976 - DNA, 22 bp, Homo sapiens
cctgccccacacaggcctggcc

SEQ ID NO: 400977 - DNA, 23 bp, Homo sapiens
cctgccccacacaggcctggccc

SEQ ID NO: 400978 - DNA, 15 bp, Homo sapiens
cctgccccagctggg

SEQ ID NO: 400979 - DNA, 18 bp, Homo sapiens
cctgccccaggcctgaaa

SEQ ID NO: 400980 - DNA, 22 bp, Homo sapiens
cctgcccccatctccccaggcc

SEQ ID NO: 400981 - DNA, 19 bp, Homo sapiens
cctgccccccttcccaccc

SEQ ID NO: 400982 - DNA, 18 bp, Homo sapiens
cctgcccccgtcccacct

SEQ ID NO: 400983 - DNA, 21 bp, Homo sapiens
cctgcccccgtcccacctcgc

SEQ ID NO: 400984 - DNA, 13 bp, Homo sapiens
cctgccccctgcc

SEQ ID NO: 400985 - DNA, 20 bp, Homo sapiens
cctgcccccttctcccacac

SEQ ID NO: 400986 - DNA, 17 bp, Homo sapiens
cctgccccgccccccag

SEQ ID NO: 400987 - DNA, 21 bp, Homo sapiens
cctgccccgccccccagagcc

SEQ ID NO: 400988 - DNA, 22 bp, Homo sapiens
cctgccccgccccccagagcca

SEQ ID NO: 400989 - DNA, 22 bp, Homo sapiens
cctgccccgtcaccatctcagg

SEQ ID NO: 400990 - DNA, 21 bp, Homo sapiens
cctgccccgtcccctgggcca

SEQ ID NO: 400991 - DNA, 23 bp, Homo sapiens
cctgccccgtcccctgggccacc

SEQ ID NO: 400992 - DNA, 22 bp, Homo sapiens
cctgccccgtcggactgccccc

SEQ ID NO: 400993 - DNA, 14 bp, Homo sapiens
cctgcccctccctt

SEQ ID NO: 400994 - DNA, 18 bp, Homo sapiens
cctgcccctcccttcaac

SEQ ID NO: 400995 - DNA, 16 bp, Homo sapiens
cctgcccctcctgtac

SEQ ID NO: 400996 - DNA, 15 bp, Homo sapiens
cctgcccctctcccg

SEQ ID NO: 400997 - DNA, 11 bp, Homo sapiens
cctgcccctgc

SEQ ID NO: 400998 - DNA, 19 bp, Homo sapiens
cctgcccctgcccgagagc

SEQ ID NO: 400999 - DNA, 20 bp, Homo sapiens
cctgccccttctacactctc

SEQ ID NO: 401000 - DNA, 23 bp, Homo sapiens
cctgccccttctacactctcctg

SEQ ID NO: 401001 - DNA, 16 bp, Homo sapiens
cctgcccgcacagcag

SEQ ID NO: 401002 - DNA, 16 bp, Homo sapiens
cctgcccgctgcaatg

SEQ ID NO: 401003 - DNA, 13 bp, Homo sapiens
cctgccctcacgc

SEQ ID NO: 401004 - DNA, 15 bp, Homo sapiens
cctgccctcactcca

SEQ ID NO: 401005 - DNA, 15 bp, Homo sapiens
cctgccctccccaga

SEQ ID NO: 401006 - DNA, 16 bp, Homo sapiens
cctgccctccccagag

SEQ ID NO: 401007 - DNA, 13 bp, Homo sapiens
cctgccctccccc

SEQ ID NO: 401008 - DNA, 15 bp, Homo sapiens
gcctgccactctctg

SEQ ID NO: 401009 - DNA, 16 bp, Homo sapiens
gcctgccactctctgg

SEQ ID NO: 401010 - DNA, 18 bp, Homo sapiens
gcctgccactctctggga

SEQ ID NO: 401011 - DNA, 17 bp, Homo sapiens
gcctgcccctctcccgc

SEQ ID NO: 401012 - DNA, 14 bp, Homo sapiens
gcctgcccgcacag

SEQ ID NO: 401013 - DNA, 17 bp, Homo sapiens
gcctgcccgcccgccgg

SEQ ID NO: 401014 - DNA, 15 bp, Homo sapiens
gcctgccctcccatg

SEQ ID NO: 401015 - DNA, 15 bp, Homo sapiens
gcctgccctccccag

SEQ ID NO: 401016 - DNA, 17 bp, Homo sapiens
gcctgccctccccagag

SEQ ID NO: 401017 - DNA, 18 bp, Homo sapiens
gcctgccctccccagagc

SEQ ID NO: 401018 - DNA, 19 bp, Homo sapiens
gcctgccctccccagagca

SEQ ID NO: 401019 - DNA, 21 bp, Homo sapiens
gcctgccgtgcatggctcctg

SEQ ID NO: 401020 - DNA, 19 bp, Homo sapiens
gcctgcctccggccctgcc

SEQ ID NO: 401021 - DNA, 13 bp, Homo sapiens
gcctgcctgggaa

SEQ ID NO: 401022 - DNA, 14 bp, Homo sapiens
gcctgcctgtctgt

SEQ ID NO: 401023 - DNA, 16 bp, Homo sapiens
gcctgccttctgggca

SEQ ID NO: 401024 - DNA, 15 bp, Homo sapiens
gcctgcgcctgcacc

SEQ ID NO: 401025 - DNA, 15 bp, Homo sapiens
gcctgcgctcctctg

SEQ ID NO: 401026 - DNA, 16 bp, Homo sapiens
gcctgcgctcctctgc

SEQ ID NO: 401027 - DNA, 17 bp, Homo sapiens
gcctgcgctcctctgca

SEQ ID NO: 401028 - DNA, 22 bp, Homo sapiens
gcctgcgctcctctgcagcctg

SEQ ID NO: 401029 - DNA, 23 bp, Homo sapiens
gcctgcgctcctctgcagcctga

SEQ ID NO: 401030 - DNA, 15 bp, Homo sapiens
gcctgcgtggcctgg

SEQ ID NO: 401031 - DNA, 16 bp, Homo sapiens
gcctgcgtggcctggg

SEQ ID NO: 401032 - DNA, 16 bp, Homo sapiens
gcctgctatccagccg

SEQ ID NO: 401033 - DNA, 18 bp, Homo sapiens
gcctgctatccagccgca

SEQ ID NO: 401034 - DNA, 15 bp, Homo sapiens
gcctgctcccagcag

SEQ ID NO: 401035 - DNA, 22 bp, Homo sapiens
gcctgctcccagcagccctaag

SEQ ID NO: 401036 - DNA, 15 bp, Homo sapiens
gcctgctctgcagcc

SEQ ID NO: 401037 - DNA, 20 bp, Homo sapiens
gcctgctctgcagcccacag

SEQ ID NO: 401038 - DNA, 17 bp, Homo sapiens
gcctgctgagagccccc

SEQ ID NO: 401039 - DNA, 10 bp, Homo sapiens
gcctgctgca

SEQ ID NO: 401040 - DNA, 13 bp, Homo sapiens
gcctgctgggaac

SEQ ID NO: 401041 - DNA, 23 bp, Homo sapiens
gcctgctgggaaccccgcagccc

SEQ ID NO: 401042 - DNA, 12 bp, Homo sapiens
gcctgcttcaca

SEQ ID NO: 401043 - DNA, 14 bp, Homo sapiens
gcctgcttcacacc

SEQ ID NO: 401044 - DNA, 16 bp, Homo sapiens
gcctgcttcacacccc

SEQ ID NO: 401045 - DNA, 19 bp, Homo sapiens
gcctgcttcacacccctca

SEQ ID NO: 401046 - DNA, 22 bp, Homo sapiens
gcctgcttcacacccctcagcg

SEQ ID NO: 401047 - DNA, 22 bp, Homo sapiens
gcctgcttcccacctccctgcc

SEQ ID NO: 401048 - DNA, 18 bp, Homo sapiens
gcctgcttttccaggatc

SEQ ID NO: 401049 - DNA, 19 bp, Homo sapiens
gcctgcttttccaggatcc

SEQ ID NO: 401050 - DNA, 22 bp, Homo sapiens
gcctgcttttccaggatcctgc

SEQ ID NO: 401051 - DNA, 23 bp, Homo sapiens
gcctgcttttccaggatcctgca

SEQ ID NO: 401052 - DNA, 19 bp, Homo sapiens
gcctggaaccagggaggag

SEQ ID NO: 401053 - DNA, 20 bp, Homo sapiens
gcctggaaccagggaggaga

SEQ ID NO: 401054 - DNA, 14 bp, Homo sapiens
gcctggacaaaccc

SEQ ID NO: 401055 - DNA, 16 bp, Homo sapiens
gcctggacctgcctcc

SEQ ID NO: 401056 - DNA, 12 bp, Homo sapiens
cctccagctgtt

SEQ ID NO: 401057 - DNA, 12 bp, Homo sapiens
cctccagcttct

SEQ ID NO: 401058 - DNA, 21 bp, Homo sapiens
cctccagcttctggtactctc

SEQ ID NO: 401059 - DNA, 10 bp, Homo sapiens
cctccaggca

SEQ ID NO: 401060 - DNA, 23 bp, Homo sapiens
cctccaggcaggacgagactcct

SEQ ID NO: 401061 - DNA, 15 bp, Homo sapiens
cctccaggctggggc

SEQ ID NO: 401062 - DNA, 17 bp, Homo sapiens
cctccagggggcctgca

SEQ ID NO: 401063 - DNA, 23 bp, Homo sapiens
cctccagggggcctgcaggcccc

SEQ ID NO: 401064 - DNA, 16 bp, Homo sapiens
cctccagtctgttctc

SEQ ID NO: 401065 - DNA, 22 bp, Homo sapiens
cctccagtgcttggctgcccca

SEQ ID NO: 401066 - DNA, 16 bp, Homo sapiens
cctccagttctgatga

SEQ ID NO: 401067 - DNA, 15 bp, Homo sapiens
cctccatcctgccag

SEQ ID NO: 401068 - DNA, 14 bp, Homo sapiens
cctccatctgggga

SEQ ID NO: 401069 - DNA, 22 bp, Homo sapiens
cctctcagttctctcccttcct

SEQ ID NO: 401070 - DNA, 23 bp, Homo sapiens
cctctcatcagcccaggtcccag

SEQ ID NO: 401071 - DNA, 23 bp, Homo sapiens
cctctcatcagtgtcctcttgct

SEQ ID NO: 401072 - DNA, 20 bp, Homo sapiens
cctctcatccaggtcctttc

SEQ ID NO: 401073 - DNA, 16 bp, Homo sapiens
cctctcatgtttccct

SEQ ID NO: 401074 - DNA, 21 bp, Homo sapiens
cctctccaagtctctctgtga

SEQ ID NO: 401075 - DNA, 16 bp, Homo sapiens
cctctccacacccatg

SEQ ID NO: 401076 - DNA, 22 bp, Homo sapiens
cctctccacacccatgactgcc

SEQ ID NO: 401077 - DNA, 17 bp, Homo sapiens
cctctccaccctccggc

SEQ ID NO: 401078 - DNA, 15 bp, Homo sapiens
cctctccactccatg

SEQ ID NO: 401079 - DNA, 13 bp, Homo sapiens
cctctccactgcc

SEQ ID NO: 401080 - DNA, 14 bp, Homo sapiens
cctctccactgcct

SEQ ID NO: 401081 - DNA, 15 bp, Homo sapiens
cctctcccaagtcca

SEQ ID NO: 401082 - DNA, 23 bp, Homo sapiens
cctctcccacccggccacagctg

SEQ ID NO: 401083 - DNA, 13 bp, Homo sapiens
cctctcccagttg

SEQ ID NO: 401084 - DNA, 15 bp, Homo sapiens
cctctcccagttgtc

SEQ ID NO: 401085 - DNA, 13 bp, Homo sapiens
cctctcccatgca

SEQ ID NO: 401086 - DNA, 15 bp, Homo sapiens
cctctccccaaccct

SEQ ID NO: 401087 - DNA, 22 bp, Homo sapiens
cctctccccaagacttggtgtc

SEQ ID NO: 401088 - DNA, 22 bp, Homo sapiens
cctctcccgccagactgttaga

SEQ ID NO: 401089 - DNA, 17 bp, Homo sapiens
cctctccctcaacaagg

SEQ ID NO: 401090 - DNA, 10 bp, Homo sapiens
cctctccctg

SEQ ID NO: 401091 - DNA, 12 bp, Homo sapiens
cctctccctggg

SEQ ID NO: 401092 - DNA, 13 bp, Homo sapiens
cctctccctgttg

SEQ ID NO: 401093 - DNA, 21 bp, Homo sapiens
cctctcctatgtggcagctgg

SEQ ID NO: 401094 - DNA, 12 bp, Homo sapiens
cctctcctcgtc

SEQ ID NO: 401095 - DNA, 20 bp, Homo sapiens
cctctcctcgtccggcctgc

SEQ ID NO: 401096 - DNA, 23 bp, Homo sapiens
cctctcctcgtccggcctgcagc

SEQ ID NO: 401097 - DNA, 12 bp, Homo sapiens
cctctcctgaag

SEQ ID NO: 401098 - DNA, 15 bp, Homo sapiens
cctctcctgcatccc

SEQ ID NO: 401099 - DNA, 14 bp, Homo sapiens
cctctcctgtagcc

SEQ ID NO: 401100 - DNA, 21 bp, Homo sapiens
cctctcgccccatccctgctt

SEQ ID NO: 401101 - DNA, 14 bp, Homo sapiens
cctctcgctcccct

SEQ ID NO: 401102 - DNA, 16 bp, Homo sapiens
cctctcggctggaaga

SEQ ID NO: 401103 - DNA, 13 bp, Homo sapiens
cctctctccctgc

SEQ ID NO: 401104 - DNA, 17 bp, Homo sapiens
cctctctccctgcctca

SEQ ID NO: 401105 - DNA, 21 bp, Homo sapiens
cctctctccctgcctcacatc

SEQ ID NO: 401106 - DNA, 14 bp, Homo sapiens
cctctctcctttgc

SEQ ID NO: 401107 - DNA, 20 bp, Homo sapiens
cctctctctcacctacttcc

SEQ ID NO: 401108 - DNA, 13 bp, Homo sapiens
cctctctctccct

SEQ ID NO: 401109 - DNA, 17 bp, Homo sapiens
cctctctctccctccac

SEQ ID NO: 401110 - DNA, 22 bp, Homo sapiens
cctctctctctctctctctgtt

SEQ ID NO: 401111 - DNA, 22 bp, Homo sapiens
cctctctctgctcctcaccccc

SEQ ID NO: 401112 - DNA, 12 bp, Homo sapiens
cctctctctggg

SEQ ID NO: 401113 - DNA, 21 bp, Homo sapiens
cctctctcttctgctccaccc

SEQ ID NO: 401114 - DNA, 22 bp, Homo sapiens
cctctctcttctgctccaccct

SEQ ID NO: 401115 - DNA, 13 bp, Homo sapiens
cctctctgcacct

SEQ ID NO: 401116 - DNA, 21 bp, Homo sapiens
cctctctggccactctgctct

SEQ ID NO: 401117 - DNA, 23 bp, Homo sapiens
cctctctgtagtttatggcagaa

SEQ ID NO: 401118 - DNA, 18 bp, Homo sapiens
cctctctgtttaccctcc

SEQ ID NO: 401119 - DNA, 21 bp, Homo sapiens
cctctctgtttaccctccctg

SEQ ID NO: 401120 - DNA, 16 bp, Homo sapiens
cctctcttaccccgtc

SEQ ID NO: 401121 - DNA, 20 bp, Homo sapiens
cctctcttatagaatattta

SEQ ID NO: 401122 - DNA, 20 bp, Homo sapiens
cctctcttccgggagctggt

SEQ ID NO: 401123 - DNA, 18 bp, Homo sapiens
cctctctttcaattgcag

SEQ ID NO: 401124 - DNA, 18 bp, Homo sapiens
cctctgaaatttcccaca

SEQ ID NO: 401125 - DNA, 21 bp, Homo sapiens
cctctgaaatttcccacaccc

SEQ ID NO: 401126 - DNA, 17 bp, Homo sapiens
cctctgaactgctgctg

SEQ ID NO: 401127 - DNA, 19 bp, Homo sapiens
cctctgaactgctgctggt

SEQ ID NO: 401128 - DNA, 20 bp, Homo sapiens
cctctgaagttggacagcaa

SEQ ID NO: 401129 - DNA, 18 bp, Homo sapiens
cctctgacagcagcctgt

SEQ ID NO: 401130 - DNA, 21 bp, Homo sapiens
cctctgacagcagcctgtgag

SEQ ID NO: 401131 - DNA, 21 bp, Homo sapiens
cctctgactcccaaagagctg

SEQ ID NO: 401132 - DNA, 24 bp, Homo sapiens
cctctgactctgagtccactgctc

SEQ ID NO: 401133 - DNA, 19 bp, Homo sapiens
cctctgagcaactgtgcag

SEQ ID NO: 401134 - DNA, 21 bp, Homo sapiens
cctctgagcaactgtgcagca

SEQ ID NO: 401135 - DNA, 15 bp, Homo sapiens
cctctgagcagcctc

SEQ ID NO: 401136 - DNA, 23 bp, Homo sapiens
cctctgagcagcctctgccaggc

SEQ ID NO: 401137 - DNA, 13 bp, Homo sapiens
cctctgagccagg

SEQ ID NO: 401138 - DNA, 18 bp, Homo sapiens
cctctgagccaggagcct

SEQ ID NO: 401139 - DNA, 14 bp, Homo sapiens
cctctgatacctca

SEQ ID NO: 401140 - DNA, 21 bp, Homo sapiens
cctctgcactactgacatgtg

SEQ ID NO: 401141 - DNA, 15 bp, Homo sapiens
cctctgcagcctgag

SEQ ID NO: 401142 - DNA, 22 bp, Homo sapiens
cctctgcagcctgagctccacc

SEQ ID NO: 401143 - DNA, 23 bp, Homo sapiens
cctctgcagcctgagctccaccc

SEQ ID NO: 401144 - DNA, 19 bp, Homo sapiens
cctctgcagctgacctctg

SEQ ID NO: 401145 - DNA, 15 bp, Homo sapiens
cctctgcagggcagc

SEQ ID NO: 401146 - DNA, 20 bp, Homo sapiens
cctctgcagggcagcctgtg

SEQ ID NO: 401147 - DNA, 17 bp, Homo sapiens
cctctgcccagcttggg

SEQ ID NO: 401148 - DNA, 18 bp, Homo sapiens
cctctgcccagcttgggc

SEQ ID NO: 401149 - DNA, 20 bp, Homo sapiens
cctctgcccagcttgggccc

SEQ ID NO: 401150 - DNA, 17 bp, Homo sapiens
cctctgccccaagcagc

SEQ ID NO: 401151 - DNA, 19 bp, Homo sapiens
cctctgccccaagcagcca

SEQ ID NO: 401152 - DNA, 20 bp, Homo sapiens
cctctgccccaagcagccag

SEQ ID NO: 401153 - DNA, 11 bp, Homo sapiens
cctctgccccc

SEQ ID NO: 401154 - DNA, 15 bp, Homo sapiens
cctctgccccctccc

SEQ ID NO: 401155 - DNA, 21 bp, Homo sapiens
cctctgccccctcccccgcag

SEQ ID NO: 401156 - DNA, 14 bp, Homo sapiens
cctctgcccgcaga

SEQ ID NO: 401157 - DNA, 15 bp, Homo sapiens
cctctgcccgcagag

SEQ ID NO: 401158 - DNA, 16 bp, Homo sapiens
cctctgcccgcagagc

SEQ ID NO: 401159 - DNA, 17 bp, Homo sapiens
cctctgcccttcctttc

SEQ ID NO: 401160 - DNA, 20 bp, Homo sapiens
cctctgccgaccgcctgctt

SEQ ID NO: 401161 - DNA, 15 bp, Homo sapiens
cctctgcctcccagg

SEQ ID NO: 401162 - DNA, 17 bp, Homo sapiens
cctctgcctgtccctct

SEQ ID NO: 401163 - DNA, 12 bp, Homo sapiens
cctctgccttgg

SEQ ID NO: 401164 - DNA, 14 bp, Homo sapiens
cctctgccttggac

SEQ ID NO: 401165 - DNA, 21 bp, Homo sapiens
cctctgcggggaggacccggg

SEQ ID NO: 401166 - DNA, 16 bp, Homo sapiens
cctctgctccgtgtgt

SEQ ID NO: 401167 - DNA, 19 bp, Homo sapiens
cctctgctgcccacggcca

SEQ ID NO: 401168 - DNA, 21 bp, Homo sapiens
cctctgctgcccacggccacc

SEQ ID NO: 401169 - DNA, 21 bp, Homo sapiens
cctctgctggccgggcacagc

SEQ ID NO: 401170 - DNA, 18 bp, Homo sapiens
cctctgctgtcctgcagt

SEQ ID NO: 401171 - DNA, 20 bp, Homo sapiens
cctctgctgtcctgcagtag

SEQ ID NO: 401172 - DNA, 12 bp, Homo sapiens
cctctggccaga

SEQ ID NO: 401173 - DNA, 12 bp, Homo sapiens
cctctggctaga

SEQ ID NO: 401174 - DNA, 22 bp, Homo sapiens
cctctggctagaggccagcccc

SEQ ID NO: 401175 - DNA, 14 bp, Homo sapiens
cctctggctgcctg

SEQ ID NO: 401176 - DNA, 16 bp, Homo sapiens
cctctgggcaggacct

SEQ ID NO: 401177 - DNA, 17 bp, Homo sapiens
cctctgggccctgcagg

SEQ ID NO: 401178 - DNA, 23 bp, Homo sapiens
cctctgggccctgcaggaggcct

SEQ ID NO: 401179 - DNA, 17 bp, Homo sapiens
cctctgggcctcctcta

SEQ ID NO: 401180 - DNA, 20 bp, Homo sapiens
cctctgggtgagtggctgac

SEQ ID NO: 401181 - DNA, 21 bp, Homo sapiens
cctctggtaaacattcctcca

SEQ ID NO: 401182 - DNA, 22 bp, Homo sapiens
cctctggtaaacattcctccag

SEQ ID NO: 401183 - DNA, 16 bp, Homo sapiens
cctctggtccttctga

SEQ ID NO: 401184 - DNA, 16 bp, Homo sapiens
cctctggtctgggtgc

SEQ ID NO: 401185 - DNA, 21 bp, Homo sapiens
cctctgtagctccctcctccc

SEQ ID NO: 401186 - DNA, 22 bp, Homo sapiens
cctctgtcagtttgtgaagtga

SEQ ID NO: 401187 - DNA, 15 bp, Homo sapiens
cctctgtcatcactc

SEQ ID NO: 401188 - DNA, 19 bp, Homo sapiens
cctctgtcatcactccctg

SEQ ID NO: 401189 - DNA, 14 bp, Homo sapiens
cctctgtccccgag

SEQ ID NO: 401190 - DNA, 19 bp, Homo sapiens
cctctgtcctggctgtgca

SEQ ID NO: 401191 - DNA, 16 bp, Homo sapiens
cctctgtgcctaataa

SEQ ID NO: 401192 - DNA, 20 bp, Homo sapiens
cctctgtgctccctcggtca

SEQ ID NO: 401193 - DNA, 23 bp, Homo sapiens
cctctgttacatcctgctacact

SEQ ID NO: 401194 - DNA, 18 bp, Homo sapiens
cctctgttctggtggccc

SEQ ID NO: 401195 - DNA, 18 bp, Homo sapiens
cctcttaccgtagcctcc

SEQ ID NO: 401196 - DNA, 19 bp, Homo sapiens
cctcttaccgtagcctccg

SEQ ID NO: 401197 - DNA, 21 bp, Homo sapiens
cctcttcaccccggcaggccc

SEQ ID NO: 401198 - DNA, 15 bp, Homo sapiens
cctagagcatctgtc

SEQ ID NO: 401199 - DNA, 21 bp, Homo sapiens
cctagagcatctgtcccactg

SEQ ID NO: 401200 - DNA, 22 bp, Homo sapiens
cctagagcatctgtcccactgg

SEQ ID NO: 401201 - DNA, 18 bp, Homo sapiens
cctagaggcgagccaggc

SEQ ID NO: 401202 - DNA, 16 bp, Homo sapiens
cctagaggtgggcagc

SEQ ID NO: 401203 - DNA, 20 bp, Homo sapiens
cctagaggtgggcagctggg

SEQ ID NO: 401204 - DNA, 22 bp, Homo sapiens
cctagaggtgggcagctgggcc

SEQ ID NO: 401205 - DNA, 23 bp, Homo sapiens
cctagaggtgggcagctgggccc

SEQ ID NO: 401206 - DNA, 23 bp, Homo sapiens
cctagatggcagtcactgaattc

SEQ ID NO: 401207 - DNA, 20 bp, Homo sapiens
cctagcacaaggagtgcccg

SEQ ID NO: 401208 - DNA, 18 bp, Homo sapiens
cctagcagatatgtatta

SEQ ID NO: 401209 - DNA, 14 bp, Homo sapiens
cctagcccaccctg

SEQ ID NO: 401210 - DNA, 11 bp, Homo sapiens
cctagctgtgt

SEQ ID NO: 401211 - DNA, 19 bp, Homo sapiens
cctagcttatctccctgct

SEQ ID NO: 401212 - DNA, 20 bp, Homo sapiens
cctagcttatctccctgctt

SEQ ID NO: 401213 - DNA, 18 bp, Homo sapiens
cctagctttttcctggaa

SEQ ID NO: 401214 - DNA, 19 bp, Homo sapiens
cctagctttttcctggaaa

SEQ ID NO: 401215 - DNA, 23 bp, Homo sapiens
cctaggacatgttcccttctcct

SEQ ID NO: 401216 - DNA, 19 bp, Homo sapiens
cctaggactcaggcctgcc

SEQ ID NO: 401217 - DNA, 13 bp, Homo sapiens
cctaggagagcca

SEQ ID NO: 401218 - DNA, 15 bp, Homo sapiens
cctaggagagccaac

SEQ ID NO: 401219 - DNA, 14 bp, Homo sapiens
cctaggagctggct

SEQ ID NO: 401220 - DNA, 16 bp, Homo sapiens
cctaggagctggctgg

SEQ ID NO: 401221 - DNA, 20 bp, Homo sapiens
cctaggagctggctggcagg

SEQ ID NO: 401222 - DNA, 21 bp, Homo sapiens
cctaggagctggctggcaggt

SEQ ID NO: 401223 - DNA, 14 bp, Homo sapiens
cttttcccctgtcc

SEQ ID NO: 401224 - DNA, 14 bp, Homo sapiens
cttttcccttcttt

SEQ ID NO: 401225 - DNA, 15 bp, Homo sapiens
cttttcccttgcttc

SEQ ID NO: 401226 - DNA, 16 bp, Homo sapiens
cttttcctatttgttt

SEQ ID NO: 401227 - DNA, 13 bp, Homo sapiens
cttttcctccctt

SEQ ID NO: 401228 - DNA, 22 bp, Homo sapiens
cttttcctgggccttctcagct

SEQ ID NO: 401229 - DNA, 21 bp, Homo sapiens
cttttccttcagagtgaatca

SEQ ID NO: 401230 - DNA, 14 bp, Homo sapiens
cttttcctttcttt

SEQ ID NO: 401231 - DNA, 16 bp, Homo sapiens
cttttcgccgtggctg

SEQ ID NO: 401232 - DNA, 17 bp, Homo sapiens
cttttctatggagcaaa

SEQ ID NO: 401233 - DNA, 14 bp, Homo sapiens
cttttctcatggta

SEQ ID NO: 401234 - DNA, 15 bp, Homo sapiens
cttttctccatgagt

SEQ ID NO: 401235 - DNA, 18 bp, Homo sapiens
cttttctggaatgtaatc

SEQ ID NO: 401236 - DNA, 15 bp, Homo sapiens
cttttctggctcctg

SEQ ID NO: 401237 - DNA, 15 bp, Homo sapiens
cttttctgtcaccaa

SEQ ID NO: 401238 - DNA, 20 bp, Homo sapiens
cttttctgtgaagccctttg

SEQ ID NO: 401239 - DNA, 13 bp, Homo sapiens
cttttcttgccag

SEQ ID NO: 401240 - DNA, 16 bp, Homo sapiens
cttttcttgccagctc

SEQ ID NO: 401241 - DNA, 14 bp, Homo sapiens
cttttcttggacac

SEQ ID NO: 401242 - DNA, 16 bp, Homo sapiens
cttttctttcagccaa

SEQ ID NO: 401243 - DNA, 13 bp, Homo sapiens
cttttctttttcc

SEQ ID NO: 401244 - DNA, 20 bp, Homo sapiens
cttttgaaagtttgttctgc

SEQ ID NO: 401245 - DNA, 21 bp, Homo sapiens
cttttgaactgttagatgctg

SEQ ID NO: 401246 - DNA, 21 bp, Homo sapiens
cttttgaagaacaaaaggctt

SEQ ID NO: 401247 - DNA, 22 bp, Homo sapiens
cttttgaagaacaaaaggcttt

SEQ ID NO: 401248 - DNA, 20 bp, Homo sapiens
cttttgaagtagtttgtata

SEQ ID NO: 401249 - DNA, 16 bp, Homo sapiens
cttttgaatcaatctg

SEQ ID NO: 401250 - DNA, 17 bp, Homo sapiens
cttttgacacagttgtt

SEQ ID NO: 401251 - DNA, 17 bp, Homo sapiens
cttttgaccccttcctg

SEQ ID NO: 401252 - DNA, 21 bp, Homo sapiens
cttttgaccccttcctgtctg

SEQ ID NO: 401253 - DNA, 16 bp, Homo sapiens
cttttgaggcttctcc

SEQ ID NO: 401254 - DNA, 17 bp, Homo sapiens
cttttgaggcttctgtt

SEQ ID NO: 401255 - DNA, 23 bp, Homo sapiens
cttttgataaaatgttccttttg

SEQ ID NO: 401256 - DNA, 13 bp, Homo sapiens
cttttgatacatt

SEQ ID NO: 401257 - DNA, 23 bp, Homo sapiens
cttttgatacatttatcttctgt

SEQ ID NO: 401258 - DNA, 12 bp, Homo sapiens
cttttgcacata

SEQ ID NO: 401259 - DNA, 11 bp, Homo sapiens
cttttgctaaa

SEQ ID NO: 401260 - DNA, 16 bp, Homo sapiens
cttttggacaaggaag

SEQ ID NO: 401261 - DNA, 17 bp, Homo sapiens
cttttgggtttctgccc

SEQ ID NO: 401262 - DNA, 12 bp, Homo sapiens
cttttgtaaata

SEQ ID NO: 401263 - DNA, 15 bp, Homo sapiens
cttttgtaaatattc

SEQ ID NO: 401264 - DNA, 16 bp, Homo sapiens
cttttgtaaatattct

SEQ ID NO: 401265 - DNA, 22 bp, Homo sapiens
cttttgtagatggcactttagt

SEQ ID NO: 401266 - DNA, 14 bp, Homo sapiens
cttttgtatcctcc

SEQ ID NO: 401267 - DNA, 15 bp, Homo sapiens
cttttgtccccaggg

SEQ ID NO: 401268 - DNA, 20 bp, Homo sapiens
cttttgtgggtttctctgtg

SEQ ID NO: 401269 - DNA, 14 bp, Homo sapiens
cttttgtgtattct

SEQ ID NO: 401270 - DNA, 15 bp, Homo sapiens
cttttgttctagact

SEQ ID NO: 401271 - DNA, 12 bp, Homo sapiens
cttttgttctct

SEQ ID NO: 401272 - DNA, 23 bp, Homo sapiens
cttttgttctctcttggtctctt

SEQ ID NO: 401273 - DNA, 14 bp, Homo sapiens
cttttgttgtgact

SEQ ID NO: 401274 - DNA, 22 bp, Homo sapiens
ctttttaaaaggtattttgaat

SEQ ID NO: 401275 - DNA, 15 bp, Homo sapiens
ctttttaaaatataa

SEQ ID NO: 401276 - DNA, 16 bp, Homo sapiens
ctttttaaaatataag

SEQ ID NO: 401277 - DNA, 20 bp, Homo sapiens
ctttttaaaatgttggtgca

SEQ ID NO: 401278 - DNA, 14 bp, Homo sapiens
ctttttaaacagtg

SEQ ID NO: 401279 - DNA, 15 bp, Homo sapiens
ctttttaaacagtgt

SEQ ID NO: 401280 - DNA, 23 bp, Homo sapiens
ctttttaaagcttttgatgtggt

SEQ ID NO: 401281 - DNA, 20 bp, Homo sapiens
ctttttaacaaatgttttca

SEQ ID NO: 401282 - DNA, 16 bp, Homo sapiens
ctttttaacctgcaaa

SEQ ID NO: 401283 - DNA, 18 bp, Homo sapiens
ctttttacagttacttcc

SEQ ID NO: 401284 - DNA, 19 bp, Homo sapiens
ctttttactccccttgagc

SEQ ID NO: 401285 - DNA, 14 bp, Homo sapiens
ctttttagccagtg

SEQ ID NO: 401286 - DNA, 23 bp, Homo sapiens
ctttttaggccacctccaaggac

SEQ ID NO: 401287 - DNA, 22 bp, Homo sapiens
ctttttatattttatactgcac

SEQ ID NO: 401288 - DNA, 19 bp, Homo sapiens
ctttttcaaaactagttct

SEQ ID NO: 401289 - DNA, 23 bp, Homo sapiens
ctttttcaatggttgggacaatg

SEQ ID NO: 401290 - DNA, 21 bp, Homo sapiens
ctttttcagagttgctttaaa

SEQ ID NO: 401291 - DNA, 12 bp, Homo sapiens
ctttttcccagc

SEQ ID NO: 401292 - DNA, 15 bp, Homo sapiens
ctttttccttcctga

SEQ ID NO: 401293 - DNA, 16 bp, Homo sapiens
ctttttccttcctgag

SEQ ID NO: 401294 - DNA, 19 bp, Homo sapiens
ctttttccttcctgagaaa

SEQ ID NO: 401295 - DNA, 22 bp, Homo sapiens
ctttttccttcctgccctgtac

SEQ ID NO: 401296 - DNA, 11 bp, Homo sapiens
ctttttccttt

SEQ ID NO: 401297 - DNA, 12 bp, Homo sapiens
ctttttccttta

SEQ ID NO: 401298 - DNA, 13 bp, Homo sapiens
ctttttctccacc

SEQ ID NO: 401299 - DNA, 21 bp, Homo sapiens
ctttttctcgagtccaaaatc

SEQ ID NO: 401300 - DNA, 15 bp, Homo sapiens
ctttttcttcttccc

SEQ ID NO: 401301 - DNA, 22 bp, Homo sapiens
ctttttcttgtaaacctggagg

SEQ ID NO: 401302 - DNA, 18 bp, Homo sapiens
ctttttcttttctatgga

SEQ ID NO: 401303 - DNA, 12 bp, Homo sapiens
ctttttgcagct

SEQ ID NO: 401304 - DNA, 14 bp, Homo sapiens
ctttttgcagcttt

SEQ ID NO: 401305 - DNA, 17 bp, Homo sapiens
ctttttgggagagactt

SEQ ID NO: 401306 - DNA, 16 bp, Homo sapiens
ctttttgtaaatactg

SEQ ID NO: 401307 - DNA, 18 bp, Homo sapiens
ctttttgtaaatactgct

SEQ ID NO: 401308 - DNA, 17 bp, Homo sapiens
cttttttagctctctta

SEQ ID NO: 401309 - DNA, 14 bp, Homo sapiens
cttttttaggcttc

SEQ ID NO: 401310 - DNA, 16 bp, Homo sapiens
cttttttatcatttct

SEQ ID NO: 401311 - DNA, 12 bp, Homo sapiens
cttttttcctgt

SEQ ID NO: 401312 - DNA, 12 bp, Homo sapiens
cttttttcttcc

SEQ ID NO: 401313 - DNA, 21 bp, Homo sapiens
cttttttcttccccctccatg

SEQ ID NO: 401314 - DNA, 20 bp, Homo sapiens
cttttttggaaactgttggt

SEQ ID NO: 401315 - DNA, 10 bp, Homo sapiens
cttttttgtc

SEQ ID NO: 401316 - DNA, 20 bp, Homo sapiens
ctttttttaaaaataaatct

SEQ ID NO: 401317 - DNA, 15 bp, Homo sapiens
ctttttttttctctt

SEQ ID NO: 401318 - DNA, 17 bp, Homo sapiens
ctttttttttctctttc

SEQ ID NO: 401319 - DNA, 18 bp, Homo sapiens
ctttttttttctctttct

SEQ ID NO: 401320 - DNA, 17 bp, Homo sapiens
ctttttttttgaaacag

SEQ ID NO: 401321 - DNA, 21 bp, Homo sapiens
ctttttttttttttttaaaga

SEQ ID NO: 401322 - DNA, 17 bp, Homo sapiens
gaaaaaaaaaaaagaaa

SEQ ID NO: 401323 - DNA, 19 bp, Homo sapiens
gaaaaaaaaaaaagaaaag

SEQ ID NO: 401324 - DNA, 17 bp, Homo sapiens
gaaaaaaaaaacaaaaa

SEQ ID NO: 401325 - DNA, 13 bp, Homo sapiens
gaaaaaaaaatca

SEQ ID NO: 401326 - DNA, 20 bp, Homo sapiens
gaaaaaaaaattatttgcct

SEQ ID NO: 401327 - DNA, 20 bp, Homo sapiens
gaaaaaaaatgttctttggg

SEQ ID NO: 401328 - DNA, 14 bp, Homo sapiens
gaaaaaaactttta

SEQ ID NO: 401329 - DNA, 16 bp, Homo sapiens
gaaaaaaatagtttta

SEQ ID NO: 401330 - DNA, 12 bp, Homo sapiens
gaaaaaaatata

SEQ ID NO: 401331 - DNA, 15 bp, Homo sapiens
gaaaaaaatatattt

SEQ ID NO: 401332 - DNA, 16 bp, Homo sapiens
gaaaaaaatgatctat

SEQ ID NO: 401333 - DNA, 16 bp, Homo sapiens
gaaaaacaagtttgct

SEQ ID NO: 401334 - DNA, 14 bp, Homo sapiens
gaaaaacatgtcat

SEQ ID NO: 401335 - DNA, 15 bp, Homo sapiens
gaaaaacatgtcatg

SEQ ID NO: 401336 - DNA, 17 bp, Homo sapiens
gaaaaacatgtcatgta

SEQ ID NO: 401337 - DNA, 15 bp, Homo sapiens
gaaaaaccaatgatt

SEQ ID NO: 401338 - DNA, 18 bp, Homo sapiens
gaaaaaccaatgattcat

SEQ ID NO: 401339 - DNA, 16 bp, Homo sapiens
gaaaaaccacagatac

SEQ ID NO: 401340 - DNA, 13 bp, Homo sapiens
gaaaaagagagag

SEQ ID NO: 401341 - DNA, 19 bp, Homo sapiens
gaaaaagttaaacattgaa

SEQ ID NO: 401342 - DNA, 21 bp, Homo sapiens
gaaaaatatgttgagtgttca

SEQ ID NO: 401343 - DNA, 21 bp, Homo sapiens
gaaaaatcttgtgctagaata

SEQ ID NO: 401344 - DNA, 20 bp, Homo sapiens
gaaaaatgcccttaaatcat

SEQ ID NO: 401345 - DNA, 16 bp, Homo sapiens
gaaaaattacagcttc

SEQ ID NO: 401346 - DNA, 18 bp, Homo sapiens
gaaaaatttaagcattgt

SEQ ID NO: 401347 - DNA, 19 bp, Homo sapiens
gaaaacaatctgcccaccg

SEQ ID NO: 401348 - DNA, 16 bp, Homo sapiens
gaaaacaattgttctg

SEQ ID NO: 401349 - DNA, 22 bp, Homo sapiens
gaaaacaattgttctgggtgat

SEQ ID NO: 401350 - DNA, 24 bp, Homo sapiens
gaaaacaatttgcataatactaat

SEQ ID NO: 401351 - DNA, 20 bp, Homo sapiens
gaaaacaccaagagtacagg

SEQ ID NO: 401352 - DNA, 21 bp, Homo sapiens
gaaaacactttcctggataaa

SEQ ID NO: 401353 - DNA, 22 bp, Homo sapiens
gaaaacataaaaagttaaaaaa

SEQ ID NO: 401354 - DNA, 18 bp, Homo sapiens
gacaatgtggaattacat

SEQ ID NO: 401355 - DNA, 13 bp, Homo sapiens
gacaatttcaaaa

SEQ ID NO: 401356 - DNA, 14 bp, Homo sapiens
gacaatttcaaaat

SEQ ID NO: 401357 - DNA, 17 bp, Homo sapiens
gacaatttcaaaatgca

SEQ ID NO: 401358 - DNA, 19 bp, Homo sapiens
gacaatttcaaaatgcatg

SEQ ID NO: 401359 - DNA, 12 bp, Homo sapiens
gacacacacaca

SEQ ID NO: 401360 - DNA, 22 bp, Homo sapiens
gacacacacacgcacgcacaca

SEQ ID NO: 401361 - DNA, 23 bp, Homo sapiens
gacacacacacgcacgcacacac

SEQ ID NO: 401362 - DNA, 11 bp, Homo sapiens
gacacacagcc

SEQ ID NO: 401363 - DNA, 17 bp, Homo sapiens
gacacacagcctttctg

SEQ ID NO: 401364 - DNA, 20 bp, Homo sapiens
gacacacggggcacccagcc

SEQ ID NO: 401365 - DNA, 22 bp, Homo sapiens
gacacactcaccatttaatcat

SEQ ID NO: 401366 - DNA, 18 bp, Homo sapiens
gacacagatggcacctgt

SEQ ID NO: 401367 - DNA, 15 bp, Homo sapiens
gacacagcagcttca

SEQ ID NO: 401368 - DNA, 19 bp, Homo sapiens
gacacagcagcttcaccag

SEQ ID NO: 401369 - DNA, 22 bp, Homo sapiens
gacacagcagcttcaccagagc

SEQ ID NO: 401370 - DNA, 16 bp, Homo sapiens
gacacagtattgactt

SEQ ID NO: 401371 - DNA, 15 bp, Homo sapiens
gacacataaatctgt

SEQ ID NO: 401372 - DNA, 19 bp, Homo sapiens
gacacatgctgttggcctc

SEQ ID NO: 401373 - DNA, 21 bp, Homo sapiens
gacacatgctgttggcctcaa

SEQ ID NO: 401374 - DNA, 18 bp, Homo sapiens
gacaccagccctgctgct

SEQ ID NO: 401375 - DNA, 22 bp, Homo sapiens
gacacccaccccctctttgtgt

SEQ ID NO: 401376 - DNA, 18 bp, Homo sapiens
gacacccctcgcccccat

SEQ ID NO: 401377 - DNA, 18 bp, Homo sapiens
gacacccctgctctaccc

SEQ ID NO: 401378 - DNA, 20 bp, Homo sapiens
gacaccctaactcttgctca

SEQ ID NO: 401379 - DNA, 15 bp, Homo sapiens
gacacctaccatgct

SEQ ID NO: 401380 - DNA, 19 bp, Homo sapiens
gacacctaccatgctgctt

SEQ ID NO: 401381 - DNA, 17 bp, Homo sapiens
gacacctcccttcgtgt

SEQ ID NO: 401382 - DNA, 15 bp, Homo sapiens
gacacctgccctgcc

SEQ ID NO: 401383 - DNA, 16 bp, Homo sapiens
gacacctgccctgccc

SEQ ID NO: 401384 - DNA, 15 bp, Homo sapiens
gacacggcctctggg

SEQ ID NO: 401385 - DNA, 14 bp, Homo sapiens
gacacgtccacccc

SEQ ID NO: 401386 - DNA, 13 bp, Homo sapiens
gacacgtgttttt

SEQ ID NO: 401387 - DNA, 16 bp, Homo sapiens
gacacgtgtttttgta

SEQ ID NO: 401388 - DNA, 15 bp, Homo sapiens
gacactaacgacttc

SEQ ID NO: 401389 - DNA, 18 bp, Homo sapiens
gacactacagaggattct

SEQ ID NO: 401390 - DNA, 23 bp, Homo sapiens
gacactatagtttaaaacacatt

SEQ ID NO: 401391 - DNA, 18 bp, Homo sapiens
gacactcattaccgtctg

SEQ ID NO: 401392 - DNA, 21 bp, Homo sapiens
gacactcgcttgccgggcctg

SEQ ID NO: 401393 - DNA, 23 bp, Homo sapiens
gacactgatgggtcctgctgctc

SEQ ID NO: 401394 - DNA, 12 bp, Homo sapiens
gacactgctgca

SEQ ID NO: 401395 - DNA, 14 bp, Homo sapiens
gacactgctgcacc

SEQ ID NO: 401396 - DNA, 15 bp, Homo sapiens
gacactgctgcacca

SEQ ID NO: 401397 - DNA, 20 bp, Homo sapiens
gacactgtggaaagctttga

SEQ ID NO: 401398 - DNA, 21 bp, Homo sapiens
gacactgtggaaagctttgaa

SEQ ID NO: 401399 - DNA, 17 bp, Homo sapiens
gacacttaattctgttc

SEQ ID NO: 401400 - DNA, 19 bp, Homo sapiens
gacacttaattctgttctg

SEQ ID NO: 401401 - DNA, 23 bp, Homo sapiens
gacacttcagagagctggtagtt

SEQ ID NO: 401402 - DNA, 15 bp, Homo sapiens
gacacttgccttctt

SEQ ID NO: 401403 - DNA, 23 bp, Homo sapiens
gacacttgccttcttcacccagc

SEQ ID NO: 401404 - DNA, 20 bp, Homo sapiens
gacactttgccaaggctctc

SEQ ID NO: 401405 - DNA, 18 bp, Homo sapiens
gacagaaaacctcaaggg

SEQ ID NO: 401406 - DNA, 15 bp, Homo sapiens
gacagaagcaggctg

SEQ ID NO: 401407 - DNA, 17 bp, Homo sapiens
gacagaaggcaaagttt

SEQ ID NO: 401408 - DNA, 14 bp, Homo sapiens
gacagacagacaga

SEQ ID NO: 401409 - DNA, 12 bp, Homo sapiens
gacagacagacg

SEQ ID NO: 401410 - DNA, 18 bp, Homo sapiens
gacagagaggacgtgggc

SEQ ID NO: 401411 - DNA, 18 bp, Homo sapiens
gacagagcccagcatccc

SEQ ID NO: 401412 - DNA, 20 bp, Homo sapiens
gacagagggaaacacagcag

SEQ ID NO: 401413 - DNA, 18 bp, Homo sapiens
gacagagtggatctggag

SEQ ID NO: 401414 - DNA, 15 bp, Homo sapiens
gacagagttcaggga

SEQ ID NO: 401415 - DNA, 19 bp, Homo sapiens
gacagatgaatgccgtgga

SEQ ID NO: 401416 - DNA, 20 bp, Homo sapiens
gacagatgaatgccgtggat

SEQ ID NO: 401417 - DNA, 20 bp, Homo sapiens
gacagatgccccagagctgt

SEQ ID NO: 401418 - DNA, 17 bp, Homo sapiens
gacagatgtcagccgag

SEQ ID NO: 401419 - DNA, 16 bp, Homo sapiens
gacagcaaaaccattg

SEQ ID NO: 401420 - DNA, 19 bp, Homo sapiens
gacagcaaaaccattgctt

SEQ ID NO: 401421 - DNA, 19 bp, Homo sapiens
gacagcagcctccctgtca

SEQ ID NO: 401422 - DNA, 13 bp, Homo sapiens
gacagcagcctgt

SEQ ID NO: 401423 - DNA, 22 bp, Homo sapiens
gacagcagtatcacaggccaga

SEQ ID NO: 401424 - DNA, 13 bp, Homo sapiens
gacagcatgcccc

SEQ ID NO: 401425 - DNA, 20 bp, Homo sapiens
gacagcatgccccttggctg

SEQ ID NO: 401426 - DNA, 22 bp, Homo sapiens
gacagcatgccccttggctgga

SEQ ID NO: 401427 - DNA, 13 bp, Homo sapiens
gacagcatggtgc

SEQ ID NO: 401428 - DNA, 22 bp, Homo sapiens
gacagcatggtgcatgccgctg

SEQ ID NO: 401429 - DNA, 19 bp, Homo sapiens
gacagccggatcttggaga

SEQ ID NO: 401430 - DNA, 11 bp, Homo sapiens
gacagcctccc

SEQ ID NO: 401431 - DNA, 12 bp, Homo sapiens
gacagcctggca

SEQ ID NO: 401432 - DNA, 19 bp, Homo sapiens
gacagcctggcacagggca

SEQ ID NO: 401433 - DNA, 21 bp, Homo sapiens
gacagccttgggcctttcagt

SEQ ID NO: 401434 - DNA, 13 bp, Homo sapiens
gacagcggcccgg

SEQ ID NO: 401435 - DNA, 18 bp, Homo sapiens
gacagcggcccggcccac

SEQ ID NO: 401436 - DNA, 22 bp, Homo sapiens
gacagcggcccggcccacgcag

SEQ ID NO: 401437 - DNA, 19 bp, Homo sapiens
gacagcgggtaaaaagaga

SEQ ID NO: 401438 - DNA, 22 bp, Homo sapiens
gacagcgggtaaaaagagaagg

SEQ ID NO: 401439 - DNA, 21 bp, Homo sapiens
gacagctactaacctggagac

SEQ ID NO: 401440 - DNA, 18 bp, Homo sapiens
gacagctaggctgagatg

SEQ ID NO: 401441 - DNA, 15 bp, Homo sapiens
gacagctgcaggtgc

SEQ ID NO: 401442 - DNA, 18 bp, Homo sapiens
gacagctgcttctgtgca

SEQ ID NO: 401443 - DNA, 13 bp, Homo sapiens
gacagctgttcca

SEQ ID NO: 401444 - DNA, 18 bp, Homo sapiens
gacagctgttccacaggg

SEQ ID NO: 401445 - DNA, 19 bp, Homo sapiens
gacaggaacacccagcccc

SEQ ID NO: 401446 - DNA, 17 bp, Homo sapiens
gacaggaagactggaga

SEQ ID NO: 401447 - DNA, 18 bp, Homo sapiens
gacaggaagactggagac

SEQ ID NO: 401448 - DNA, 19 bp, Homo sapiens
gacaggaagactggagact

SEQ ID NO: 401449 - DNA, 16 bp, Homo sapiens
gacaggacagcatggt

SEQ ID NO: 401450 - DNA, 13 bp, Homo sapiens
gacaggcagacac

SEQ ID NO: 401451 - DNA, 15 bp, Homo sapiens
gacaggcagggaggg

SEQ ID NO: 401452 - DNA, 20 bp, Homo sapiens
gacaggccatgtgagccacc

SEQ ID NO: 401453 - DNA, 17 bp, Homo sapiens
gacaggctcttagcagc

SEQ ID NO: 401454 - DNA, 15 bp, Homo sapiens
gacagggaaaatata

SEQ ID NO: 401455 - DNA, 22 bp, Homo sapiens
gacagggcatggccaggtggcc

SEQ ID NO: 401456 - DNA, 16 bp, Homo sapiens
gacagtattgccacct

SEQ ID NO: 401457 - DNA, 15 bp, Homo sapiens
gacagtgatctccat

SEQ ID NO: 401458 - DNA, 15 bp, Homo sapiens
gacagtgccttctct

SEQ ID NO: 401459 - DNA, 16 bp, Homo sapiens
gacagtgctgacccca

SEQ ID NO: 401460 - DNA, 19 bp, Homo sapiens
gacagtgctgaccccagga

SEQ ID NO: 401461 - DNA, 22 bp, Homo sapiens
gacagtggcagcaaaggaagac

SEQ ID NO: 401462 - DNA, 14 bp, Homo sapiens
gacagtggctctcc

SEQ ID NO: 401463 - DNA, 23 bp, Homo sapiens
gacagtgggggtgcctggtgcgc

SEQ ID NO: 401464 - DNA, 21 bp, Homo sapiens
gacagttactcttcagtttta

SEQ ID NO: 401465 - DNA, 24 bp, Homo sapiens
gacagttggcagagaaggcctctt

SEQ ID NO: 401466 - DNA, 20 bp, Homo sapiens
ccacttagccgtccatggca

SEQ ID NO: 401467 - DNA, 21 bp, Homo sapiens
ccacttagccgtccatggcac

SEQ ID NO: 401468 - DNA, 22 bp, Homo sapiens
ccacttagccgtccatggcacc

SEQ ID NO: 401469 - DNA, 16 bp, Homo sapiens
ccacttatgctgctgt

SEQ ID NO: 401470 - DNA, 20 bp, Homo sapiens
ccacttatgctgctgtgaat

SEQ ID NO: 401471 - DNA, 17 bp, Homo sapiens
ccacttatttccatgga

SEQ ID NO: 401472 - DNA, 19 bp, Homo sapiens
ccacttcacccccaacttc

SEQ ID NO: 401473 - DNA, 18 bp, Homo sapiens
ccacttccattgtattgt

SEQ ID NO: 401474 - DNA, 11 bp, Homo sapiens
ccacttctccc

SEQ ID NO: 401475 - DNA, 17 bp, Homo sapiens
ccacttctggtcccctg

SEQ ID NO: 401476 - DNA, 19 bp, Homo sapiens
ccacttctggtcccctgtg

SEQ ID NO: 401477 - DNA, 14 bp, Homo sapiens
ccacttgacattcc

SEQ ID NO: 401478 - DNA, 13 bp, Homo sapiens
ccacttgcactgt

SEQ ID NO: 401479 - DNA, 15 bp, Homo sapiens
ccactttcctctctc

SEQ ID NO: 401480 - DNA, 16 bp, Homo sapiens
ccactttcctctctct

SEQ ID NO: 401481 - DNA, 17 bp, Homo sapiens
ccactttcctctctctc

SEQ ID NO: 401482 - DNA, 23 bp, Homo sapiens
ccactttccttttctattccttc

SEQ ID NO: 401483 - DNA, 20 bp, Homo sapiens
ccactttgcagacctgggac

SEQ ID NO: 401484 - DNA, 13 bp, Homo sapiens
ccactttggggaa

SEQ ID NO: 401485 - DNA, 20 bp, Homo sapiens
ccactttgttggcccttcca

SEQ ID NO: 401486 - DNA, 14 bp, Homo sapiens
ccactttttgcagc

SEQ ID NO: 401487 - DNA, 16 bp, Homo sapiens
ccactttttgcagctt

SEQ ID NO: 401488 - DNA, 15 bp, Homo sapiens
ccagaaagaaaatga

SEQ ID NO: 401489 - DNA, 16 bp, Homo sapiens
ccagaaagaaaatgaa

SEQ ID NO: 401490 - DNA, 20 bp, Homo sapiens
ccagaaagcctcctgccccc

SEQ ID NO: 401491 - DNA, 15 bp, Homo sapiens
ccagaaaggatattt

SEQ ID NO: 401492 - DNA, 16 bp, Homo sapiens
ccagaaaggatattta

SEQ ID NO: 401493 - DNA, 20 bp, Homo sapiens
ccagaaaggatatttaagaa

SEQ ID NO: 401494 - DNA, 19 bp, Homo sapiens
ccagaaatgccgctgtgtc

SEQ ID NO: 401495 - DNA, 20 bp, Homo sapiens
ccagaaatgccgctgtgtcc

SEQ ID NO: 401496 - DNA, 15 bp, Homo sapiens
ccagaaattcttcaa

SEQ ID NO: 401497 - DNA, 20 bp, Homo sapiens
ccagaacagccctcggcctc

SEQ ID NO: 401498 - DNA, 15 bp, Homo sapiens
ccagaaccacactgt

SEQ ID NO: 401499 - DNA, 18 bp, Homo sapiens
ccagaacgcaccccactg

SEQ ID NO: 401500 - DNA, 23 bp, Homo sapiens
ccagaacgcaccccactgggaga

SEQ ID NO: 401501 - DNA, 14 bp, Homo sapiens
ccagaacgggcctc

SEQ ID NO: 401502 - DNA, 18 bp, Homo sapiens
ccagaacgggcctccccg

SEQ ID NO: 401503 - DNA, 21 bp, Homo sapiens
ccagaactgcccccactgtcc

SEQ ID NO: 401504 - DNA, 17 bp, Homo sapiens
ccagaagaatattcagg

SEQ ID NO: 401505 - DNA, 18 bp, Homo sapiens
ccagaagaatattcagga

SEQ ID NO: 401506 - DNA, 16 bp, Homo sapiens
ccagaagatgccctcc

SEQ ID NO: 401507 - DNA, 22 bp, Homo sapiens
ccagaagatgtattcagagcca

SEQ ID NO: 401508 - DNA, 15 bp, Homo sapiens
ccagaagcctctggc

SEQ ID NO: 401509 - DNA, 16 bp, Homo sapiens
ccagaagcctctggct

SEQ ID NO: 401510 - DNA, 20 bp, Homo sapiens
ccagaaggaacccggtccca

SEQ ID NO: 401511 - DNA, 21 bp, Homo sapiens
ccagaaggagggcagagccat

SEQ ID NO: 401512 - DNA, 22 bp, Homo sapiens
ccagaaggccacaggccactgc

SEQ ID NO: 401513 - DNA, 21 bp, Homo sapiens
ccagaagtttctacattctct

SEQ ID NO: 401514 - DNA, 14 bp, Homo sapiens
ccagaatctgctgt

SEQ ID NO: 401515 - DNA, 15 bp, Homo sapiens
ccagaatggaaaaaa

SEQ ID NO: 401516 - DNA, 17 bp, Homo sapiens
ccagaatgtaagaaaac

SEQ ID NO: 401517 - DNA, 18 bp, Homo sapiens
ccagaatttcccaaagca

SEQ ID NO: 401518 - DNA, 19 bp, Homo sapiens
ccagacagacatctctgca

SEQ ID NO: 401519 - DNA, 14 bp, Homo sapiens
ccagacccagggca

SEQ ID NO: 401520 - DNA, 9 bp, Homo sapiens
ccagacccc

SEQ ID NO: 401521 - DNA, 15 bp, Homo sapiens
ccagaccccagggca

SEQ ID NO: 401522 - DNA, 17 bp, Homo sapiens
ccagaccccatccagcc

SEQ ID NO: 401523 - DNA, 19 bp, Homo sapiens
ccagaccccatccagccag

SEQ ID NO: 401524 - DNA, 12 bp, Homo sapiens
ccagaccccgcc

SEQ ID NO: 401525 - DNA, 12 bp, Homo sapiens
ccagacccctac

SEQ ID NO: 401526 - DNA, 17 bp, Homo sapiens
ccagacccctctggcca

SEQ ID NO: 401527 - DNA, 22 bp, Homo sapiens
ccagacccctctggccaggatg

SEQ ID NO: 401528 - DNA, 24 bp, Homo sapiens
ccagacccctctggccaggatgga

SEQ ID NO: 401529 - DNA, 14 bp, Homo sapiens
ccagacccctggct

SEQ ID NO: 401530 - DNA, 15 bp, Homo sapiens
ccagacccctggctt

SEQ ID NO: 401531 - DNA, 18 bp, Homo sapiens
ccagacccctggcttttc

SEQ ID NO: 401532 - DNA, 14 bp, Homo sapiens
ccagaccctgcctg

SEQ ID NO: 401533 - DNA, 17 bp, Homo sapiens
ccagaccctgcctgagc

SEQ ID NO: 401534 - DNA, 21 bp, Homo sapiens
ccagacctgggccctggttcc

SEQ ID NO: 401535 - DNA, 13 bp, Homo sapiens
ccagacctgttct

SEQ ID NO: 401536 - DNA, 14 bp, Homo sapiens
ccagacctgttctg

SEQ ID NO: 401537 - DNA, 16 bp, Homo sapiens
ccagacggcacccacc

SEQ ID NO: 401538 - DNA, 14 bp, Homo sapiens
ccagactacagggc

SEQ ID NO: 401539 - DNA, 15 bp, Homo sapiens
ccagactcagagacc

SEQ ID NO: 401540 - DNA, 15 bp, Homo sapiens
ccagactcaggttcc

SEQ ID NO: 401541 - DNA, 16 bp, Homo sapiens
ccagactcgagagggc

SEQ ID NO: 401542 - DNA, 18 bp, Homo sapiens
ccagactcgagagggctg

SEQ ID NO: 401543 - DNA, 20 bp, Homo sapiens
ccagactcgagagggctgag

SEQ ID NO: 401544 - DNA, 13 bp, Homo sapiens
ccagactctgccc

SEQ ID NO: 401545 - DNA, 13 bp, Homo sapiens
ccagactggctgc

SEQ ID NO: 401546 - DNA, 14 bp, Homo sapiens
ccagactggctgca

SEQ ID NO: 401547 - DNA, 17 bp, Homo sapiens
ccagactggctgcacag

SEQ ID NO: 401548 - DNA, 19 bp, Homo sapiens
ccagactggctgcacagcc

SEQ ID NO: 401549 - DNA, 20 bp, Homo sapiens
ccagactggctgcacagccc

SEQ ID NO: 401550 - DNA, 15 bp, Homo sapiens
ccagactgttagaaa

SEQ ID NO: 401551 - DNA, 22 bp, Homo sapiens
ccagacttcgctattcccaggc

SEQ ID NO: 401552 - DNA, 24 bp, Homo sapiens
ccagacttcgctattcccaggcag

SEQ ID NO: 401553 - DNA, 13 bp, Homo sapiens
ccagacttgtttc

SEQ ID NO: 401554 - DNA, 15 bp, Homo sapiens
ccagacttgtttcct

SEQ ID NO: 401555 - DNA, 16 bp, Homo sapiens
ccagacttgtttcctg

SEQ ID NO: 401556 - DNA, 18 bp, Homo sapiens
ccagacttgtttcctgtg

SEQ ID NO: 401557 - DNA, 21 bp, Homo sapiens
ccagagaacaatcactattct

SEQ ID NO: 401558 - DNA, 23 bp, Homo sapiens
ccagagaagcatcggagggaatt

SEQ ID NO: 401559 - DNA, 22 bp, Homo sapiens
ccagagactgcccaccctgggc

SEQ ID NO: 401560 - DNA, 15 bp, Homo sapiens
ccagagagaaaaaga

SEQ ID NO: 401561 - DNA, 19 bp, Homo sapiens
ccagagagaaaaagagaga

SEQ ID NO: 401562 - DNA, 19 bp, Homo sapiens
ccagagagaagcaccccac

SEQ ID NO: 401563 - DNA, 18 bp, Homo sapiens
ccagagagaccctgccaa

SEQ ID NO: 401564 - DNA, 23 bp, Homo sapiens
ccagagagagaagtgcccctgct

SEQ ID NO: 401565 - DNA, 21 bp, Homo sapiens
ccagagagaggcgtcctggtg

SEQ ID NO: 401566 - DNA, 19 bp, Homo sapiens
ccagagaggagcacctgaa

SEQ ID NO: 401567 - DNA, 18 bp, Homo sapiens
ccagagagggcccagctg

SEQ ID NO: 401568 - DNA, 20 bp, Homo sapiens
ccagagagggcccagctgta

SEQ ID NO: 401569 - DNA, 23 bp, Homo sapiens
ccagagagggcccagctgtagcc

SEQ ID NO: 401570 - DNA, 15 bp, Homo sapiens
ccagagagtggctcc

SEQ ID NO: 401571 - DNA, 18 bp, Homo sapiens
ccagagagtggctcctcc

SEQ ID NO: 401572 - DNA, 16 bp, Homo sapiens
ccagagatgggactgg

SEQ ID NO: 401573 - DNA, 15 bp, Homo sapiens
ccagagcacctcagg

SEQ ID NO: 401574 - DNA, 13 bp, Homo sapiens
ccagagcagacca

SEQ ID NO: 401575 - DNA, 14 bp, Homo sapiens
ccagagcaggaggc

SEQ ID NO: 401576 - DNA, 23 bp, Homo sapiens
ccagagcaggaggcccctggccc

SEQ ID NO: 401577 - DNA, 18 bp, Homo sapiens
ccagagcatttccaacac

SEQ ID NO: 401578 - DNA, 20 bp, Homo sapiens
ccagagcatttccaacacca

SEQ ID NO: 401579 - DNA, 15 bp, Homo sapiens
ccagagccagcctgg

SEQ ID NO: 401580 - DNA, 17 bp, Homo sapiens
ccagagccagcctggga

SEQ ID NO: 401581 - DNA, 20 bp, Homo sapiens
ccagagccagcctgggactc

SEQ ID NO: 401582 - DNA, 13 bp, Homo sapiens
ccagagccagggc

SEQ ID NO: 401583 - DNA, 18 bp, Homo sapiens
ccagagccagggctgtcc

SEQ ID NO: 401584 - DNA, 21 bp, Homo sapiens
ccagagccagggctgtcctta

SEQ ID NO: 401585 - DNA, 13 bp, Homo sapiens
ccagagccatgga

SEQ ID NO: 401586 - DNA, 10 bp, Homo sapiens
ccagagcccc

SEQ ID NO: 401587 - DNA, 23 bp, Homo sapiens
ccagagccccccacaatgatgat

SEQ ID NO: 401588 - DNA, 20 bp, Homo sapiens
ccagagcccttcactgccat

SEQ ID NO: 401589 - DNA, 21 bp, Homo sapiens
ccagagcccttcactgccatg

SEQ ID NO: 401590 - DNA, 15 bp, Homo sapiens
ccagagccttaataa

SEQ ID NO: 401591 - DNA, 22 bp, Homo sapiens
ccagagctcatttcggggtcag

SEQ ID NO: 401592 - DNA, 15 bp, Homo sapiens
ccagagctcccagga

SEQ ID NO: 401593 - DNA, 17 bp, Homo sapiens
ccagagctcccaggacg

SEQ ID NO: 401594 - DNA, 20 bp, Homo sapiens
ccagagctggaaggcagggc

SEQ ID NO: 401595 - DNA, 21 bp, Homo sapiens
ccagagctggaaggcagggca

SEQ ID NO: 401596 - DNA, 22 bp, Homo sapiens
ccagagctggaaggcagggcag

SEQ ID NO: 401597 - DNA, 15 bp, Homo sapiens
ccagagctgggtgag

SEQ ID NO: 401598 - DNA, 18 bp, Homo sapiens
ccagagcttattggccac

SEQ ID NO: 401599 - DNA, 19 bp, Homo sapiens
ccagagcttcagggctggg

SEQ ID NO: 401600 - DNA, 16 bp, Homo sapiens
gagggcagtacctggg

SEQ ID NO: 401601 - DNA, 17 bp, Homo sapiens
gagggcagtacctggga

SEQ ID NO: 401602 - DNA, 15 bp, Homo sapiens
gagggcatataaatt

SEQ ID NO: 401603 - DNA, 18 bp, Homo sapiens
gagggcccagctgtagcc

SEQ ID NO: 401604 - DNA, 12 bp, Homo sapiens
gagggcccctct

SEQ ID NO: 401605 - DNA, 16 bp, Homo sapiens
gagggcccctctgccc

SEQ ID NO: 401606 - DNA, 14 bp, Homo sapiens
gagggcctcagaga

SEQ ID NO: 401607 - DNA, 17 bp, Homo sapiens
gagggcggccagggaca

SEQ ID NO: 401608 - DNA, 15 bp, Homo sapiens
gagggctgagagggc

SEQ ID NO: 401609 - DNA, 13 bp, Homo sapiens
gagggctgagccc

SEQ ID NO: 401610 - DNA, 17 bp, Homo sapiens
gagggctgagcccctcc

SEQ ID NO: 401611 - DNA, 20 bp, Homo sapiens
gagggctgagcccctcctct

SEQ ID NO: 401612 - DNA, 21 bp, Homo sapiens
gagggctgagcccctcctctc

SEQ ID NO: 401613 - DNA, 13 bp, Homo sapiens
gagggctgtggct

SEQ ID NO: 401614 - DNA, 19 bp, Homo sapiens
gaggggaagctgcagcttg

SEQ ID NO: 401615 - DNA, 13 bp, Homo sapiens
gaggggacttgga

SEQ ID NO: 401616 - DNA, 18 bp, Homo sapiens
gaggggcaacgaagaaaa

SEQ ID NO: 401617 - DNA, 23 bp, Homo sapiens
gaggggcaactgatgaacacagg

SEQ ID NO: 401618 - DNA, 15 bp, Homo sapiens
gaggggccactgggc

SEQ ID NO: 401619 - DNA, 20 bp, Homo sapiens
gaggggccactgggccccat

SEQ ID NO: 401620 - DNA, 12 bp, Homo sapiens
gaggggccaggc

SEQ ID NO: 401621 - DNA, 13 bp, Homo sapiens
gaggggcctaggg

SEQ ID NO: 401622 - DNA, 12 bp, Homo sapiens
gaggggcctggc

SEQ ID NO: 401623 - DNA, 13 bp, Homo sapiens
gaggggcctggca

SEQ ID NO: 401624 - DNA, 19 bp, Homo sapiens
gaggggcctggcctgggtg

SEQ ID NO: 401625 - DNA, 21 bp, Homo sapiens
gaggggcggcaggagggaggt

SEQ ID NO: 401626 - DNA, 16 bp, Homo sapiens
gagggggcgctcagga

SEQ ID NO: 401627 - DNA, 21 bp, Homo sapiens
gagggggctatagctacagga

SEQ ID NO: 401628 - DNA, 22 bp, Homo sapiens
gagggggtcatttcagagccct

SEQ ID NO: 401629 - DNA, 20 bp, Homo sapiens
gagggggttacaaactgcaa

SEQ ID NO: 401630 - DNA, 17 bp, Homo sapiens
gaggggtcagctctggc

SEQ ID NO: 401631 - DNA, 23 bp, Homo sapiens
gaggggtgagacagtgggggtgc

SEQ ID NO: 401632 - DNA, 14 bp, Homo sapiens
gagggtccctaggt

SEQ ID NO: 401633 - DNA, 20 bp, Homo sapiens
gagggttccaggctgtgtgt

SEQ ID NO: 401634 - DNA, 21 bp, Homo sapiens
gagggttcctcttaggtcaga

SEQ ID NO: 401635 - DNA, 15 bp, Homo sapiens
gagggttgctatttg

SEQ ID NO: 401636 - DNA, 19 bp, Homo sapiens
gaggtaccacaggaagccg

SEQ ID NO: 401637 - DNA, 14 bp, Homo sapiens
gaggtagagtttga

SEQ ID NO: 401638 - DNA, 21 bp, Homo sapiens
gaggtagcgagctgctctgct

SEQ ID NO: 401639 - DNA, 15 bp, Homo sapiens
gaggtcaagcccagg

SEQ ID NO: 401640 - DNA, 20 bp, Homo sapiens
gaggtcaagcccaggaggac

SEQ ID NO: 401641 - DNA, 19 bp, Homo sapiens
gaggtcatcccggggccat

SEQ ID NO: 401642 - DNA, 22 bp, Homo sapiens
gaggtcgaccccaaagcccctt

SEQ ID NO: 401643 - DNA, 18 bp, Homo sapiens
gaggtctcttgagggagc

SEQ ID NO: 401644 - DNA, 14 bp, Homo sapiens
gaggtctgaaatgg

SEQ ID NO: 401645 - DNA, 18 bp, Homo sapiens
gaggtcttttgacatgtg

SEQ ID NO: 401646 - DNA, 15 bp, Homo sapiens
gaggtgaaagggagc

SEQ ID NO: 401647 - DNA, 18 bp, Homo sapiens
gaggtgagggaggcctga

SEQ ID NO: 401648 - DNA, 22 bp, Homo sapiens
gaggtgcctgagagcagaatga

SEQ ID NO: 401649 - DNA, 16 bp, Homo sapiens
gaggtgctgctttgct

SEQ ID NO: 401650 - DNA, 20 bp, Homo sapiens
gaggtgcttaagcagaagca

SEQ ID NO: 401651 - DNA, 22 bp, Homo sapiens
gaggtgcttaagcagaagcatt

SEQ ID NO: 401652 - DNA, 18 bp, Homo sapiens
gaggtggccaggcctgcc

SEQ ID NO: 401653 - DNA, 19 bp, Homo sapiens
gaggtggccaggcctgcca

SEQ ID NO: 401654 - DNA, 20 bp, Homo sapiens
gaggtggctctggaatgaca

SEQ ID NO: 401655 - DNA, 14 bp, Homo sapiens
gaggtgggcagctg

SEQ ID NO: 401656 - DNA, 16 bp, Homo sapiens
gaggtgggcagctggg

SEQ ID NO: 401657 - DNA, 19 bp, Homo sapiens
gaggtggggaagagagcct

SEQ ID NO: 401658 - DNA, 21 bp, Homo sapiens
gaggtggggaagagagcctgc

SEQ ID NO: 401659 - DNA, 23 bp, Homo sapiens
gaggtggggaagagagcctgccc

SEQ ID NO: 401660 - DNA, 17 bp, Homo sapiens
gaggtgggggatgctga

SEQ ID NO: 401661 - DNA, 14 bp, Homo sapiens
gaggtgggggtctg

SEQ ID NO: 401662 - DNA, 20 bp, Homo sapiens
gaggtggtagctctgagccc

SEQ ID NO: 401663 - DNA, 16 bp, Homo sapiens
gaggtggtctgaatgt

SEQ ID NO: 401664 - DNA, 17 bp, Homo sapiens
gaggtggtgccttctca

SEQ ID NO: 401665 - DNA, 21 bp, Homo sapiens
gaggtgtcaccctgcagagct

SEQ ID NO: 401666 - DNA, 17 bp, Homo sapiens
gaggtgtctcctaccct

SEQ ID NO: 401667 - DNA, 14 bp, Homo sapiens
gaggtgtttaaaga

SEQ ID NO: 401668 - DNA, 15 bp, Homo sapiens
gaggttaaaatataa

SEQ ID NO: 401669 - DNA, 22 bp, Homo sapiens
gaggttataggtcactcctggg

SEQ ID NO: 401670 - DNA, 13 bp, Homo sapiens
gaggttatctgcc

SEQ ID NO: 401671 - DNA, 16 bp, Homo sapiens
gaggttatctgcctgg

SEQ ID NO: 401672 - DNA, 17 bp, Homo sapiens
gaggttatctgcctggc

SEQ ID NO: 401673 - DNA, 18 bp, Homo sapiens
gaggttatctgcctggcc

SEQ ID NO: 401674 - DNA, 21 bp, Homo sapiens
gaggttatctgcctggcctgg

SEQ ID NO: 401675 - DNA, 17 bp, Homo sapiens
gaggttgaggatgcact

SEQ ID NO: 401676 - DNA, 20 bp, Homo sapiens
gaggttgatcagatctgaca

SEQ ID NO: 401677 - DNA, 14 bp, Homo sapiens
gaggttggtgactg

SEQ ID NO: 401678 - DNA, 16 bp, Homo sapiens
gagtaaaaattcatat

SEQ ID NO: 401679 - DNA, 19 bp, Homo sapiens
gagtaaagataaaaggata

SEQ ID NO: 401680 - DNA, 15 bp, Homo sapiens
gagtaagctgctttt

SEQ ID NO: 401681 - DNA, 20 bp, Homo sapiens
gagtaatgcagacatttaca

SEQ ID NO: 401682 - DNA, 15 bp, Homo sapiens
gagtaattttctgat

SEQ ID NO: 401683 - DNA, 17 bp, Homo sapiens
gagtacaaagacaggga

SEQ ID NO: 401684 - DNA, 18 bp, Homo sapiens
gagtacatggaagaagta

SEQ ID NO: 401685 - DNA, 20 bp, Homo sapiens
gagtacatggaagaagtata

SEQ ID NO: 401686 - DNA, 17 bp, Homo sapiens
gagtacctgctgcccca

SEQ ID NO: 401687 - DNA, 11 bp, Homo sapiens
gagtatatatg

SEQ ID NO: 401688 - DNA, 12 bp, Homo sapiens
gagtatctgtaa

SEQ ID NO: 401689 - DNA, 19 bp, Homo sapiens
gagtatgcaagaagaatat

SEQ ID NO: 401690 - DNA, 22 bp, Homo sapiens
gagtatgcaagaagaatataaa

SEQ ID NO: 401691 - DNA, 16 bp, Homo sapiens
gagtatgtagtggctt

SEQ ID NO: 401692 - DNA, 20 bp, Homo sapiens
gagtatttaggcagattgaa

SEQ ID NO: 401693 - DNA, 13 bp, Homo sapiens
gagtatttgctgt

SEQ ID NO: 401694 - DNA, 17 bp, Homo sapiens
gagtcaaaacacttgta

SEQ ID NO: 401695 - DNA, 20 bp, Homo sapiens
gagtcaaaacacttgtaatt

SEQ ID NO: 401696 - DNA, 15 bp, Homo sapiens
gagtcaaaagcctgg

SEQ ID NO: 401697 - DNA, 23 bp, Homo sapiens
gagtcacctcctccactcactcc

SEQ ID NO: 401698 - DNA, 14 bp, Homo sapiens
gagtcaccttccag

SEQ ID NO: 401699 - DNA, 15 bp, Homo sapiens
gagtcaccttccagg

SEQ ID NO: 401700 - DNA, 14 bp, Homo sapiens
gagtcactggaaca

SEQ ID NO: 401701 - DNA, 18 bp, Homo sapiens
gagtcagggagccctggg

SEQ ID NO: 401702 - DNA, 19 bp, Homo sapiens
gagtcagggagccctgggg

SEQ ID NO: 401703 - DNA, 17 bp, Homo sapiens
gagtcagggcccagagg

SEQ ID NO: 401704 - DNA, 19 bp, Homo sapiens
gagtcagtcttcacttgca

SEQ ID NO: 401705 - DNA, 14 bp, Homo sapiens
gagtcatgcgtgtt

SEQ ID NO: 401706 - DNA, 20 bp, Homo sapiens
gagtccaacgtggggcagca

SEQ ID NO: 401707 - DNA, 15 bp, Homo sapiens
gagtccactgctcca

SEQ ID NO: 401708 - DNA, 14 bp, Homo sapiens
gagtccactttcct

SEQ ID NO: 401709 - DNA, 18 bp, Homo sapiens
gagtccagacctgggccc

SEQ ID NO: 401710 - DNA, 20 bp, Homo sapiens
gagtccagacctgggccctg

SEQ ID NO: 401711 - DNA, 13 bp, Homo sapiens
gagtccagctccc

SEQ ID NO: 401712 - DNA, 15 bp, Homo sapiens
gagtccagctccccc

SEQ ID NO: 401713 - DNA, 16 bp, Homo sapiens
gagtccagctcccccc

SEQ ID NO: 401714 - DNA, 18 bp, Homo sapiens
gagtccaggagccccagc

SEQ ID NO: 401715 - DNA, 19 bp, Homo sapiens
gagtccaggagccccagcc

SEQ ID NO: 401716 - DNA, 20 bp, Homo sapiens
gagtccaggagccccagcca

SEQ ID NO: 401717 - DNA, 21 bp, Homo sapiens
gagtccaggagccccagccag

SEQ ID NO: 401718 - DNA, 23 bp, Homo sapiens
gagtccaggagccccagccagcc

SEQ ID NO: 401719 - DNA, 13 bp, Homo sapiens
gagtccaggcccc

SEQ ID NO: 401720 - DNA, 14 bp, Homo sapiens
gagtccattgcaaa

SEQ ID NO: 401721 - DNA, 14 bp, Homo sapiens
gagtcccagtggga

SEQ ID NO: 401722 - DNA, 15 bp, Homo sapiens
gagtccccacctgcg

SEQ ID NO: 401723 - DNA, 20 bp, Homo sapiens
gagtcccccctcccacctcc

SEQ ID NO: 401724 - DNA, 21 bp, Homo sapiens
gagtccccgtgtgccccaaga

SEQ ID NO: 401725 - DNA, 17 bp, Homo sapiens
gagtccggaggcagcag

SEQ ID NO: 401726 - DNA, 18 bp, Homo sapiens
gagtcctgaggcagaacc

SEQ ID NO: 401727 - DNA, 11 bp, Homo sapiens
gagtcctgtta

SEQ ID NO: 401728 - DNA, 18 bp, Homo sapiens
gagtcctgttctcagagc

SEQ ID NO: 401729 - DNA, 12 bp, Homo sapiens
gagtcggcccca

SEQ ID NO: 401730 - DNA, 15 bp, Homo sapiens
gcagccgtgccttca

SEQ ID NO: 401731 - DNA, 17 bp, Homo sapiens
gcagccgtgccttcagc

SEQ ID NO: 401732 - DNA, 19 bp, Homo sapiens
gcagcctagtaggagctga

SEQ ID NO: 401733 - DNA, 20 bp, Homo sapiens
gcagcctatgggggctctcg

SEQ ID NO: 401734 - DNA, 14 bp, Homo sapiens
gcagcctccagagc

SEQ ID NO: 401735 - DNA, 15 bp, Homo sapiens
gcagcctccagagcc

SEQ ID NO: 401736 - DNA, 21 bp, Homo sapiens
gcagcctccagagccagcctg

SEQ ID NO: 401737 - DNA, 18 bp, Homo sapiens
gcagcctcctcctgacca

SEQ ID NO: 401738 - DNA, 15 bp, Homo sapiens
gcagcctctctgcta

SEQ ID NO: 401739 - DNA, 14 bp, Homo sapiens
gcagcctctgaagt

SEQ ID NO: 401740 - DNA, 11 bp, Homo sapiens
gcagcctctgc

SEQ ID NO: 401741 - DNA, 17 bp, Homo sapiens
gcagcctctgccaggcc

SEQ ID NO: 401742 - DNA, 13 bp, Homo sapiens
gcagcctctgtcc

SEQ ID NO: 401743 - DNA, 23 bp, Homo sapiens
gcagcctctgtcctggctgtgca

SEQ ID NO: 401744 - DNA, 13 bp, Homo sapiens
gcagcctgagctc

SEQ ID NO: 401745 - DNA, 16 bp, Homo sapiens
gcagcctgagctccac

SEQ ID NO: 401746 - DNA, 21 bp, Homo sapiens
gcagcctgagctccaccctcc

SEQ ID NO: 401747 - DNA, 23 bp, Homo sapiens
gcagcctgcttcccacctccctg

SEQ ID NO: 401748 - DNA, 13 bp, Homo sapiens
gcagcctggaggc

SEQ ID NO: 401749 - DNA, 19 bp, Homo sapiens
gcagcctggctcccaggac

SEQ ID NO: 401750 - DNA, 17 bp, Homo sapiens
gcagcctggttccctct

SEQ ID NO: 401751 - DNA, 18 bp, Homo sapiens
gcagcctgtgagggagtg

SEQ ID NO: 401752 - DNA, 22 bp, Homo sapiens
gcagcctgtgagggagtgcaga

SEQ ID NO: 401753 - DNA, 22 bp, Homo sapiens
gcagcctgtggcatctttgcct

SEQ ID NO: 401754 - DNA, 16 bp, Homo sapiens
gcagcctgtgggagaa

SEQ ID NO: 401755 - DNA, 15 bp, Homo sapiens
gcagccttcccctcc

SEQ ID NO: 401756 - DNA, 18 bp, Homo sapiens
gcagccttcccctccctg

SEQ ID NO: 401757 - DNA, 13 bp, Homo sapiens
gcagcctttctgt

SEQ ID NO: 401758 - DNA, 14 bp, Homo sapiens
gcagcctttctgtg

SEQ ID NO: 401759 - DNA, 17 bp, Homo sapiens
gcagcctttgcctcccc

SEQ ID NO: 401760 - DNA, 19 bp, Homo sapiens
gcagcgccacccagtggaa

SEQ ID NO: 401761 - DNA, 12 bp, Homo sapiens
gcagcgcctccc

SEQ ID NO: 401762 - DNA, 14 bp, Homo sapiens
gcagcgcctcctgg

SEQ ID NO: 401763 - DNA, 15 bp, Homo sapiens
gcagctaaggggcag

SEQ ID NO: 401764 - DNA, 17 bp, Homo sapiens
gcagctagactggagtg

SEQ ID NO: 401765 - DNA, 13 bp, Homo sapiens
gcagctcacccct

SEQ ID NO: 401766 - DNA, 16 bp, Homo sapiens
gcagctcacccctggg

SEQ ID NO: 401767 - DNA, 20 bp, Homo sapiens
gcagctcacccctgggcagg

SEQ ID NO: 401768 - DNA, 21 bp, Homo sapiens
gcagctcacccctgggcaggc

SEQ ID NO: 401769 - DNA, 22 bp, Homo sapiens
gcagctcacccctgggcaggcg

SEQ ID NO: 401770 - DNA, 20 bp, Homo sapiens
gcagctcccaggtttagaga

SEQ ID NO: 401771 - DNA, 12 bp, Homo sapiens
gcagctccccag

SEQ ID NO: 401772 - DNA, 13 bp, Homo sapiens
gcagctccccagg

SEQ ID NO: 401773 - DNA, 13 bp, Homo sapiens
cccgctcccacag

SEQ ID NO: 401774 - DNA, 15 bp, Homo sapiens
cccgctgctgctgct

SEQ ID NO: 401775 - DNA, 20 bp, Homo sapiens
cccgctgtcagccattcctg

SEQ ID NO: 401776 - DNA, 17 bp, Homo sapiens
cccgcttattctcctcc

SEQ ID NO: 401777 - DNA, 15 bp, Homo sapiens
cccggacgctggctc

SEQ ID NO: 401778 - DNA, 22 bp, Homo sapiens
cccggagcacagccctgggagg

SEQ ID NO: 401779 - DNA, 21 bp, Homo sapiens
cccggagctaacactggcccc

SEQ ID NO: 401780 - DNA, 16 bp, Homo sapiens
cccggaggcgcccacc

SEQ ID NO: 401781 - DNA, 18 bp, Homo sapiens
cccggaggggcctggcag

SEQ ID NO: 401782 - DNA, 14 bp, Homo sapiens
cccggatctccagg

SEQ ID NO: 401783 - DNA, 20 bp, Homo sapiens
cccggatctccaggcccagc

SEQ ID NO: 401784 - DNA, 22 bp, Homo sapiens
cccggatctccaggcccagcct

SEQ ID NO: 401785 - DNA, 22 bp, Homo sapiens
cccggcacagagtcgatgctca

SEQ ID NO: 401786 - DNA, 12 bp, Homo sapiens
cccggcagcccc

SEQ ID NO: 401787 - DNA, 22 bp, Homo sapiens
cccggcagccccccagtgtccc

SEQ ID NO: 401788 - DNA, 14 bp, Homo sapiens
cccggcaggccctg

SEQ ID NO: 401789 - DNA, 19 bp, Homo sapiens
cccggcccacgcagagccc

SEQ ID NO: 401790 - DNA, 15 bp, Homo sapiens
cccggcccctaccag

SEQ ID NO: 401791 - DNA, 21 bp, Homo sapiens
cccggccgccccgccccagag

SEQ ID NO: 401792 - DNA, 19 bp, Homo sapiens
cccggcctccactccccca

SEQ ID NO: 401793 - DNA, 21 bp, Homo sapiens
cccggcctccaggctggggcc

SEQ ID NO: 401794 - DNA, 17 bp, Homo sapiens
cccggcctgctcccagc

SEQ ID NO: 401795 - DNA, 21 bp, Homo sapiens
cccggcctgctcccagcagcc

SEQ ID NO: 401796 - DNA, 18 bp, Homo sapiens
cccggctccccctgccag

SEQ ID NO: 401797 - DNA, 23 bp, Homo sapiens
cccggctgggtcggccctgccca

SEQ ID NO: 401798 - DNA, 15 bp, Homo sapiens
cccgggaaaggccgg

SEQ ID NO: 401799 - DNA, 20 bp, Homo sapiens
cccgggaccacagctgctgg

SEQ ID NO: 401800 - DNA, 22 bp, Homo sapiens
cccgggacccccggcctccagg

SEQ ID NO: 401801 - DNA, 23 bp, Homo sapiens
cccgggacgcaggggttgcagtg

SEQ ID NO: 401802 - DNA, 14 bp, Homo sapiens
cccgggcaggccag

SEQ ID NO: 401803 - DNA, 12 bp, Homo sapiens
cccgggcagggc

SEQ ID NO: 401804 - DNA, 13 bp, Homo sapiens
cccgggcagggct

SEQ ID NO: 401805 - DNA, 21 bp, Homo sapiens
cccgggcagggctcccacaga

SEQ ID NO: 401806 - DNA, 22 bp, Homo sapiens
cccgggccacgccccagcccga

SEQ ID NO: 401807 - DNA, 12 bp, Homo sapiens
cccgggcccaga

SEQ ID NO: 401808 - DNA, 14 bp, Homo sapiens
cccgggcccagagg

SEQ ID NO: 401809 - DNA, 18 bp, Homo sapiens
cccgggccctcccttgga

SEQ ID NO: 401810 - DNA, 17 bp, Homo sapiens
cccgggctctctgctgt

SEQ ID NO: 401811 - DNA, 15 bp, Homo sapiens
cccgggctctggcca

SEQ ID NO: 401812 - DNA, 16 bp, Homo sapiens
cccgggctctggccac

SEQ ID NO: 401813 - DNA, 17 bp, Homo sapiens
cccgggctctggccacc

SEQ ID NO: 401814 - DNA, 20 bp, Homo sapiens
cccgggctctggccaccctg

SEQ ID NO: 401815 - DNA, 16 bp, Homo sapiens
cccggggaactggttt

SEQ ID NO: 401816 - DNA, 13 bp, Homo sapiens
cccggggcagctg

SEQ ID NO: 401817 - DNA, 14 bp, Homo sapiens
cccggggcagctgg

SEQ ID NO: 401818 - DNA, 20 bp, Homo sapiens
cccggggcagctggcaggag

SEQ ID NO: 401819 - DNA, 21 bp, Homo sapiens
cccggggcatggacagggcca

SEQ ID NO: 401820 - DNA, 12 bp, Homo sapiens
cccggggctggc

SEQ ID NO: 401821 - DNA, 20 bp, Homo sapiens
cccgggtttggcgggccaag

SEQ ID NO: 401822 - DNA, 22 bp, Homo sapiens
cccgggtttggcgggccaagga

SEQ ID NO: 401823 - DNA, 15 bp, Homo sapiens
cccggtcccaggccg

SEQ ID NO: 401824 - DNA, 22 bp, Homo sapiens
cccggtcccaggccgcatggcc

SEQ ID NO: 401825 - DNA, 20 bp, Homo sapiens
cccgtagccactctctgccc

SEQ ID NO: 401826 - DNA, 15 bp, Homo sapiens
cccgtaggcagcctc

SEQ ID NO: 401827 - DNA, 19 bp, Homo sapiens
cccgtaggcagcctctctg

SEQ ID NO: 401828 - DNA, 13 bp, Homo sapiens
cccgtctcctgcc

SEQ ID NO: 401829 - DNA, 15 bp, Homo sapiens
cccgtgaagcagtgc

SEQ ID NO: 401830 - DNA, 18 bp, Homo sapiens
cccgtgcagactggaggg

SEQ ID NO: 401831 - DNA, 11 bp, Homo sapiens
cccgtgcagta

SEQ ID NO: 401832 - DNA, 18 bp, Homo sapiens
cccgtgcagtacaggcaa

SEQ ID NO: 401833 - DNA, 19 bp, Homo sapiens
cccgtgccaaatcctgggc

SEQ ID NO: 401834 - DNA, 19 bp, Homo sapiens
cccgtgccaggagcaatgg

SEQ ID NO: 401835 - DNA, 22 bp, Homo sapiens
cccgtgcgcagccgcgctctgc

SEQ ID NO: 401836 - DNA, 14 bp, Homo sapiens
cccgtgctggaaga

SEQ ID NO: 401837 - DNA, 18 bp, Homo sapiens
cccgtgtggccccttcac

SEQ ID NO: 401838 - DNA, 16 bp, Homo sapiens
cccgttaatttaaagc

SEQ ID NO: 401839 - DNA, 22 bp, Homo sapiens
cccgttaatttaaagctgtttc

SEQ ID NO: 401840 - DNA, 16 bp, Homo sapiens
cccgttacagctcccc

SEQ ID NO: 401841 - DNA, 16 bp, Homo sapiens
cccgttccctgtcaga

SEQ ID NO: 401842 - DNA, 17 bp, Homo sapiens
cccgtttccaagcctgg

SEQ ID NO: 401843 - DNA, 13 bp, Homo sapiens
ccctaaagccctc

SEQ ID NO: 401844 - DNA, 22 bp, Homo sapiens
ccctaactcttgctcactccct

SEQ ID NO: 401845 - DNA, 23 bp, Homo sapiens
ccctaactgagctgccagtgggg

SEQ ID NO: 401846 - DNA, 16 bp, Homo sapiens
ccctaagaattcccag

SEQ ID NO: 401847 - DNA, 18 bp, Homo sapiens
ccctaagaattcccagat

SEQ ID NO: 401848 - DNA, 13 bp, Homo sapiens
ccctaagtgccca

SEQ ID NO: 401849 - DNA, 21 bp, Homo sapiens
ccctaagttcctatttcattt

SEQ ID NO: 401850 - DNA, 20 bp, Homo sapiens
ccctaattctcttcgctgtg

SEQ ID NO: 401851 - DNA, 19 bp, Homo sapiens
ccctaattcttattttata

SEQ ID NO: 401852 - DNA, 21 bp, Homo sapiens
ccctaattcttattttataat

SEQ ID NO: 401853 - DNA, 15 bp, Homo sapiens
ccctacagcctgcac

SEQ ID NO: 401854 - DNA, 23 bp, Homo sapiens
ccctacagcctgcacacacctgc

SEQ ID NO: 401855 - DNA, 15 bp, Homo sapiens
ccctacatgcatgtt

SEQ ID NO: 401856 - DNA, 14 bp, Homo sapiens
ccctaccctcttct

SEQ ID NO: 401857 - DNA, 18 bp, Homo sapiens
ccctaccgatggtcccag

SEQ ID NO: 401858 - DNA, 16 bp, Homo sapiens
ccctacctcaggcagg

SEQ ID NO: 401859 - DNA, 22 bp, Homo sapiens
ccctacctgattggtgcaaccc

SEQ ID NO: 401860 - DNA, 18 bp, Homo sapiens
ccctccttcttgccctga

SEQ ID NO: 401861 - DNA, 14 bp, Homo sapiens
ccctccttgccacc

SEQ ID NO: 401862 - DNA, 12 bp, Homo sapiens
ccctccttgccg

SEQ ID NO: 401863 - DNA, 22 bp, Homo sapiens
ccctccttgccgctgggagagc

SEQ ID NO: 401864 - DNA, 13 bp, Homo sapiens
ccctcctttccca

SEQ ID NO: 401865 - DNA, 20 bp, Homo sapiens
ccctcctttcccaacacttc

SEQ ID NO: 401866 - DNA, 17 bp, Homo sapiens
ccctcgaaccaaggcag

SEQ ID NO: 401867 - DNA, 19 bp, Homo sapiens
ccctcgaaccaaggcagcc

SEQ ID NO: 401868 - DNA, 22 bp, Homo sapiens
ccctcgaaccaaggcagcctcc

SEQ ID NO: 401869 - DNA, 21 bp, Homo sapiens
ccctcgcatccgcctctgagc

SEQ ID NO: 401870 - DNA, 24 bp, Homo sapiens
ccctcgcatccgcctctgagccag

SEQ ID NO: 401871 - DNA, 14 bp, Homo sapiens
ccctcgctgctgct

SEQ ID NO: 401872 - DNA, 22 bp, Homo sapiens
ccctcggaagccgtctgactcc

SEQ ID NO: 401873 - DNA, 16 bp, Homo sapiens
ccctcggagcctgtgt

SEQ ID NO: 401874 - DNA, 17 bp, Homo sapiens
ccctcggagcctgtgtt

SEQ ID NO: 401875 - DNA, 20 bp, Homo sapiens
ccctcggcattcacacacag

SEQ ID NO: 401876 - DNA, 23 bp, Homo sapiens
ccctcggcattcacacacagcct

SEQ ID NO: 401877 - DNA, 22 bp, Homo sapiens
ccctcggcctccgaggctcccc

SEQ ID NO: 401878 - DNA, 18 bp, Homo sapiens
ccctcggcctctactttg

SEQ ID NO: 401879 - DNA, 16 bp, Homo sapiens
ccctcggggcaggaag

SEQ ID NO: 401880 - DNA, 21 bp, Homo sapiens
ccctcggggcaggaagtccct

SEQ ID NO: 401881 - DNA, 23 bp, Homo sapiens
ccctcggggcaggaagtccctga

SEQ ID NO: 401882 - DNA, 23 bp, Homo sapiens
ccctcggtcacctgtgctacctc

SEQ ID NO: 401883 - DNA, 15 bp, Homo sapiens
ccctcgtccacaggg

SEQ ID NO: 401884 - DNA, 14 bp, Homo sapiens
ccctcgtcctgtcc

SEQ ID NO: 401885 - DNA, 14 bp, Homo sapiens
ccctcgtctccctg

SEQ ID NO: 401886 - DNA, 20 bp, Homo sapiens
ccctcgtctccctggccacc

SEQ ID NO: 401887 - DNA, 16 bp, Homo sapiens
ccctcgtggacacctg

SEQ ID NO: 401888 - DNA, 22 bp, Homo sapiens
ccctcgtggacacctgccctgc

SEQ ID NO: 401889 - DNA, 16 bp, Homo sapiens
ccctctcactccccag

SEQ ID NO: 401890 - DNA, 21 bp, Homo sapiens
ccctctcactccccagcccca

SEQ ID NO: 401891 - DNA, 21 bp, Homo sapiens
ccctctcatccaggtcctttc

SEQ ID NO: 401892 - DNA, 22 bp, Homo sapiens
ccctctcctatgtggcagctgg

SEQ ID NO: 401893 - DNA, 20 bp, Homo sapiens
ccctctcctgagcctgtctc

SEQ ID NO: 401894 - DNA, 21 bp, Homo sapiens
ccctctcctgagcctgtctct

SEQ ID NO: 401895 - DNA, 18 bp, Homo sapiens
ccctctcctgcatccctc

SEQ ID NO: 401896 - DNA, 12 bp, Homo sapiens
ccctctcctgcc

SEQ ID NO: 401897 - DNA, 22 bp, Homo sapiens
ccctctcgccccatccctgctt

SEQ ID NO: 401898 - DNA, 14 bp, Homo sapiens
ccctctctctgggc

SEQ ID NO: 401899 - DNA, 19 bp, Homo sapiens
ccctctctcttctgctcca

SEQ ID NO: 401900 - DNA, 22 bp, Homo sapiens
ccctctctcttctgctccaccc

SEQ ID NO: 401901 - DNA, 22 bp, Homo sapiens
ccctctctgtttaccctccctg

SEQ ID NO: 401902 - DNA, 17 bp, Homo sapiens
ccctctcttccgggagc

SEQ ID NO: 401903 - DNA, 21 bp, Homo sapiens
ccctctcttccgggagctggt

SEQ ID NO: 401904 - DNA, 13 bp, Homo sapiens
ccctctgcccagc

SEQ ID NO: 401905 - DNA, 16 bp, Homo sapiens
ccctctgcccagcttg

SEQ ID NO: 401906 - DNA, 18 bp, Homo sapiens
ccctctgcccagcttggg

SEQ ID NO: 401907 - DNA, 22 bp, Homo sapiens
ccctctgccccaagcagccagc

SEQ ID NO: 401908 - DNA, 20 bp, Homo sapiens
ccctctgccgaccgcctgct

SEQ ID NO: 401909 - DNA, 15 bp, Homo sapiens
ccctctgctccacag

SEQ ID NO: 401910 - DNA, 14 bp, Homo sapiens
ccctctgctctcat

SEQ ID NO: 401911 - DNA, 13 bp, Homo sapiens
ccctctgctgctt

SEQ ID NO: 401912 - DNA, 14 bp, Homo sapiens
ccctctgctggccg

SEQ ID NO: 401913 - DNA, 18 bp, Homo sapiens
gcaggttctctcctgtga

SEQ ID NO: 401914 - DNA, 18 bp, Homo sapiens
gcagtaatgatatttatt

SEQ ID NO: 401915 - DNA, 14 bp, Homo sapiens
gcagtacagagtgc

SEQ ID NO: 401916 - DNA, 17 bp, Homo sapiens
gcagtaccatcccactg

SEQ ID NO: 401917 - DNA, 16 bp, Homo sapiens
gcagtacctataaagt

SEQ ID NO: 401918 - DNA, 23 bp, Homo sapiens
gcagtacctataaagtaaagcta

SEQ ID NO: 401919 - DNA, 14 bp, Homo sapiens
gcagtacctgggaa

SEQ ID NO: 401920 - DNA, 21 bp, Homo sapiens
gcagtagaaataatatgcatt

SEQ ID NO: 401921 - DNA, 20 bp, Homo sapiens
gcagtagagtcatctccatc

SEQ ID NO: 401922 - DNA, 15 bp, Homo sapiens
gcagtagcagctgtg

SEQ ID NO: 401923 - DNA, 16 bp, Homo sapiens
gcagtatcacaggcca

SEQ ID NO: 401924 - DNA, 17 bp, Homo sapiens
gcagtatgaatgatgtt

SEQ ID NO: 401925 - DNA, 18 bp, Homo sapiens
gcagtcacactgctggga

SEQ ID NO: 401926 - DNA, 20 bp, Homo sapiens
gcagtcacactgctgggaag

SEQ ID NO: 401927 - DNA, 20 bp, Homo sapiens
gcagtcacaggtcttttctt

SEQ ID NO: 401928 - DNA, 15 bp, Homo sapiens
gcagtcatcaacaaa

SEQ ID NO: 401929 - DNA, 14 bp, Homo sapiens
gcagtccagagctt

SEQ ID NO: 401930 - DNA, 13 bp, Homo sapiens
gcagtccccagcc

SEQ ID NO: 401931 - DNA, 15 bp, Homo sapiens
gcagtccccagccct

SEQ ID NO: 401932 - DNA, 17 bp, Homo sapiens
gcagtccccagcccttc

SEQ ID NO: 401933 - DNA, 19 bp, Homo sapiens
gcagtccccagcccttctg

SEQ ID NO: 401934 - DNA, 16 bp, Homo sapiens
gcagtcctggtggggc

SEQ ID NO: 401935 - DNA, 21 bp, Homo sapiens
gcagtcgcaggatccgctgcc

SEQ ID NO: 401936 - DNA, 22 bp, Homo sapiens
gcagtcgcaggatccgctgcca

SEQ ID NO: 401937 - DNA, 16 bp, Homo sapiens
gcagtctacttctgtg

SEQ ID NO: 401938 - DNA, 20 bp, Homo sapiens
gcagtctacttctgtgtctg

SEQ ID NO: 401939 - DNA, 22 bp, Homo sapiens
gcagtctacttctgtgtctgtc

SEQ ID NO: 401940 - DNA, 18 bp, Homo sapiens
gcagtctgaacccttgtg

SEQ ID NO: 401941 - DNA, 19 bp, Homo sapiens
gcagtctttgctcagtgga

SEQ ID NO: 401942 - DNA, 18 bp, Homo sapiens
gcagtctttttctacagc

SEQ ID NO: 401943 - DNA, 12 bp, Homo sapiens
gcagtgaaactt

SEQ ID NO: 401944 - DNA, 16 bp, Homo sapiens
gcagtgaaacttgtgc

SEQ ID NO: 401945 - DNA, 21 bp, Homo sapiens
gcagtgaacacactcagcagc

SEQ ID NO: 401946 - DNA, 23 bp, Homo sapiens
gcagtgaacacactcagcagccc

SEQ ID NO: 401947 - DNA, 14 bp, Homo sapiens
gcagtgaattgtga

SEQ ID NO: 401948 - DNA, 13 bp, Homo sapiens
gcagtgcatgtga

SEQ ID NO: 401949 - DNA, 18 bp, Homo sapiens
gcagtgcccagtgatggc

SEQ ID NO: 401950 - DNA, 13 bp, Homo sapiens
gcagtgcctctgg

SEQ ID NO: 401951 - DNA, 23 bp, Homo sapiens
gcagtgccttggggaatttcctc

SEQ ID NO: 401952 - DNA, 22 bp, Homo sapiens
gcagtgcgcgtgcacgtggaga

SEQ ID NO: 401953 - DNA, 19 bp, Homo sapiens
gcagtgctagtgagctggg

SEQ ID NO: 401954 - DNA, 22 bp, Homo sapiens
gcagtgctagtgagctgggcat

SEQ ID NO: 401955 - DNA, 16 bp, Homo sapiens
gcagtggactgtgtcc

SEQ ID NO: 401956 - DNA, 13 bp, Homo sapiens
gcagtggagaggg

SEQ ID NO: 401957 - DNA, 15 bp, Homo sapiens
gcagtggagagggac

SEQ ID NO: 401958 - DNA, 21 bp, Homo sapiens
gcagtggccccatccagcatg

SEQ ID NO: 401959 - DNA, 19 bp, Homo sapiens
gcagtgtccattatctgct

SEQ ID NO: 401960 - DNA, 11 bp, Homo sapiens
gcagtgtcttc

SEQ ID NO: 401961 - DNA, 14 bp, Homo sapiens
gcagtgtcttccat

SEQ ID NO: 401962 - DNA, 14 bp, Homo sapiens
gcagtgtgagtgtg

SEQ ID NO: 401963 - DNA, 16 bp, Homo sapiens
gcagtgtgtctcctgc

SEQ ID NO: 401964 - DNA, 20 bp, Homo sapiens
gcagtgtgtctcctgcatgc

SEQ ID NO: 401965 - DNA, 19 bp, Homo sapiens
gcagtgttcctcaccaata

SEQ ID NO: 401966 - DNA, 13 bp, Homo sapiens
gcagtgtttgtat

SEQ ID NO: 401967 - DNA, 23 bp, Homo sapiens
gcagttaagccccctcctcaccc

SEQ ID NO: 401968 - DNA, 19 bp, Homo sapiens
gcagttcagcaccacccta

SEQ ID NO: 401969 - DNA, 15 bp, Homo sapiens
gcagttctcactcct

SEQ ID NO: 401970 - DNA, 11 bp, Homo sapiens
gcagttctgca

SEQ ID NO: 401971 - DNA, 20 bp, Homo sapiens
gcagttgacatccaaatcta

SEQ ID NO: 401972 - DNA, 22 bp, Homo sapiens
gcagttggccagagagcctggt

SEQ ID NO: 401973 - DNA, 13 bp, Homo sapiens
gcagttgtgtcag

SEQ ID NO: 401974 - DNA, 16 bp, Homo sapiens
gcataagtggacccag

SEQ ID NO: 401975 - DNA, 18 bp, Homo sapiens
gcataataagctaaagag

SEQ ID NO: 401976 - DNA, 20 bp, Homo sapiens
gcataatactaatttattgc

SEQ ID NO: 401977 - DNA, 19 bp, Homo sapiens
gcatacaaaaatatattaa

SEQ ID NO: 401978 - DNA, 19 bp, Homo sapiens
gcatactgatgagacaaca

SEQ ID NO: 401979 - DNA, 15 bp, Homo sapiens
gcatagccctcctga

SEQ ID NO: 401980 - DNA, 12 bp, Homo sapiens
gcataggcctgg

SEQ ID NO: 401981 - DNA, 22 bp, Homo sapiens
gcataggcctgggtgctggctg

SEQ ID NO: 401982 - DNA, 20 bp, Homo sapiens
gcatagtattccattgtgtg

SEQ ID NO: 401983 - DNA, 16 bp, Homo sapiens
gcatataaatgtttat

SEQ ID NO: 401984 - DNA, 20 bp, Homo sapiens
gcatataattttcacttctg

SEQ ID NO: 401985 - DNA, 21 bp, Homo sapiens
gcatataattttcacttctgt

SEQ ID NO: 401986 - DNA, 16 bp, Homo sapiens
gcatatcctgagccat

SEQ ID NO: 401987 - DNA, 20 bp, Homo sapiens
gcatatcctggtgtctagtt

SEQ ID NO: 401988 - DNA, 19 bp, Homo sapiens
gcatatctctagtccctgt

SEQ ID NO: 401989 - DNA, 14 bp, Homo sapiens
gcatgtgggggaag

SEQ ID NO: 401990 - DNA, 21 bp, Homo sapiens
gcatgtgtatttccagtgcaa

SEQ ID NO: 401991 - DNA, 18 bp, Homo sapiens
gcatgtgtcagagtgttg

SEQ ID NO: 401992 - DNA, 20 bp, Homo sapiens
gcatgtgtcctttcaagggg

SEQ ID NO: 401993 - DNA, 15 bp, Homo sapiens
gcatgtgtctgtatt

SEQ ID NO: 401994 - DNA, 16 bp, Homo sapiens
gcatgtgtctgtattc

SEQ ID NO: 401995 - DNA, 15 bp, Homo sapiens
gcatgtgtgcctgtg

SEQ ID NO: 401996 - DNA, 20 bp, Homo sapiens
gcatgtgtgcctgtggcaga

SEQ ID NO: 401997 - DNA, 11 bp, Homo sapiens
gcatgtgtgtg

SEQ ID NO: 401998 - DNA, 14 bp, Homo sapiens
gcatgtgtgtgctc

SEQ ID NO: 401999 - DNA, 23 bp, Homo sapiens
gcatgttgggataaatagctaaa

SEQ ID NO: 402000 - DNA, 20 bp, Homo sapiens
gcatgtttcatgttttgtga

SEQ ID NO: 402001 - DNA, 21 bp, Homo sapiens
gcatgtttgtctgtgtgctgt

SEQ ID NO: 402002 - DNA, 20 bp, Homo sapiens
gcatgttttatgtgcactca

SEQ ID NO: 402003 - DNA, 13 bp, Homo sapiens
gcattaaaaataa

SEQ ID NO: 402004 - DNA, 13 bp, Homo sapiens
gcattaaaactta

SEQ ID NO: 402005 - DNA, 18 bp, Homo sapiens
gcattaactaatctattg

SEQ ID NO: 402006 - DNA, 14 bp, Homo sapiens
gcattaagaggttt

SEQ ID NO: 402007 - DNA, 14 bp, Homo sapiens
gcattacagagagg

SEQ ID NO: 402008 - DNA, 13 bp, Homo sapiens
gcattacattcct

SEQ ID NO: 402009 - DNA, 15 bp, Homo sapiens
gcattactattaact

SEQ ID NO: 402010 - DNA, 15 bp, Homo sapiens
gcattatataccatt

SEQ ID NO: 402011 - DNA, 19 bp, Homo sapiens
gcattatataccatttatc

SEQ ID NO: 402012 - DNA, 17 bp, Homo sapiens
gcattatctctttctct

SEQ ID NO: 402013 - DNA, 15 bp, Homo sapiens
gcattattgcattat

SEQ ID NO: 402014 - DNA, 22 bp, Homo sapiens
gcattcaaaatagttctatttc

SEQ ID NO: 402015 - DNA, 24 bp, Homo sapiens
gcattcaaaatagttctatttcta

SEQ ID NO: 402016 - DNA, 23 bp, Homo sapiens
gcattcacaaggtgactgggatg

SEQ ID NO: 402017 - DNA, 13 bp, Homo sapiens
gcattcacacaca

SEQ ID NO: 402018 - DNA, 17 bp, Homo sapiens
gcattcacacacagcct

SEQ ID NO: 402019 - DNA, 20 bp, Homo sapiens
gcattcacacacagcctggc

SEQ ID NO: 402020 - DNA, 13 bp, Homo sapiens
gcattccttagca

SEQ ID NO: 402021 - DNA, 16 bp, Homo sapiens
gcattctacacctgga

SEQ ID NO: 402022 - DNA, 13 bp, Homo sapiens
gcattctagtact

SEQ ID NO: 402023 - DNA, 15 bp, Homo sapiens
gcattctcactccta

SEQ ID NO: 402024 - DNA, 17 bp, Homo sapiens
gcattctgcctgcctgg

SEQ ID NO: 402025 - DNA, 21 bp, Homo sapiens
gcattcttgtcacaataaatg

SEQ ID NO: 402026 - DNA, 18 bp, Homo sapiens
gcattgaaataataatat

SEQ ID NO: 402027 - DNA, 14 bp, Homo sapiens
gcattgcactaaaa

SEQ ID NO: 402028 - DNA, 20 bp, Homo sapiens
gcattgcactaaaagtgatg

SEQ ID NO: 402029 - DNA, 13 bp, Homo sapiens
gcattgctttcgt

SEQ ID NO: 402030 - DNA, 16 bp, Homo sapiens
gcattgcttttggaca

SEQ ID NO: 402031 - DNA, 21 bp, Homo sapiens
gcattggaaaccctatttccc

SEQ ID NO: 402032 - DNA, 11 bp, Homo sapiens
gcattgttcca

SEQ ID NO: 402033 - DNA, 23 bp, Homo sapiens
gcattgttgaggtggtctgaatg

SEQ ID NO: 402034 - DNA, 23 bp, Homo sapiens
gcattgttgatgctcacatatga

SEQ ID NO: 402035 - DNA, 17 bp, Homo sapiens
gcattgtttgcttattg

SEQ ID NO: 402036 - DNA, 22 bp, Homo sapiens
gcattgtttgcttattgttcca

SEQ ID NO: 402037 - DNA, 16 bp, Homo sapiens
gcatttataaatgtgt

SEQ ID NO: 402038 - DNA, 20 bp, Homo sapiens
gcatttcttgatgttgctta

SEQ ID NO: 402039 - DNA, 21 bp, Homo sapiens
gcatttcttgatgttgcttag

SEQ ID NO: 402040 - DNA, 20 bp, Homo sapiens
gcatttgctgaataacaaca

SEQ ID NO: 402041 - DNA, 17 bp, Homo sapiens
gcatttgtaaatattaa

SEQ ID NO: 402042 - DNA, 18 bp, Homo sapiens
gcatttgtcaatgacagt

SEQ ID NO: 402043 - DNA, 16 bp, Homo sapiens
gcatttgtcttagaga

SEQ ID NO: 402044 - DNA, 12 bp, Homo sapiens
gcattttctcag

SEQ ID NO: 402045 - DNA, 14 bp, Homo sapiens
gcattttctcaggc

SEQ ID NO: 402046 - DNA, 16 bp, Homo sapiens
gcatttttagctcctt

SEQ ID NO: 402047 - DNA, 15 bp, Homo sapiens
gcatttttgtatttt

SEQ ID NO: 402048 - DNA, 18 bp, Homo sapiens
gcatttttgtgaaatgaa

SEQ ID NO: 402049 - DNA, 21 bp, Homo sapiens
gcatttttgtgaaatgaaaac

SEQ ID NO: 402050 - DNA, 16 bp, Homo sapiens
gcattttttaaaacaa

SEQ ID NO: 402051 - DNA, 18 bp, Homo sapiens
gcattttttaaaacaaga

SEQ ID NO: 402052 - DNA, 20 bp, Homo sapiens
gccaaagctagggtggccct

SEQ ID NO: 402053 - DNA, 19 bp, Homo sapiens
gccaaagggaaatatcatt

SEQ ID NO: 402054 - DNA, 14 bp, Homo sapiens
ccctggagcccggc

SEQ ID NO: 402055 - DNA, 18 bp, Homo sapiens
ccctggagcccggcagtg

SEQ ID NO: 402056 - DNA, 18 bp, Homo sapiens
ccctggagcctccactgc

SEQ ID NO: 402057 - DNA, 12 bp, Homo sapiens
ccctggagctgt

SEQ ID NO: 402058 - DNA, 14 bp, Homo sapiens
ccctggagctgtcc

SEQ ID NO: 402059 - DNA, 17 bp, Homo sapiens
ccctggatgggcattgg

SEQ ID NO: 402060 - DNA, 22 bp, Homo sapiens
ccctggatgggcattgggctga

SEQ ID NO: 402061 - DNA, 18 bp, Homo sapiens
ccctggatgtcccctgtc

SEQ ID NO: 402062 - DNA, 17 bp, Homo sapiens
ccctggcagagaagaga

SEQ ID NO: 402063 - DNA, 21 bp, Homo sapiens
ccctggcccagcggcccctcc

SEQ ID NO: 402064 - DNA, 16 bp, Homo sapiens
ccctggcccgcccctc

SEQ ID NO: 402065 - DNA, 20 bp, Homo sapiens
ccctggcccgcccctcgctg

SEQ ID NO: 402066 - DNA, 15 bp, Homo sapiens
ccctggcctgttctg

SEQ ID NO: 402067 - DNA, 12 bp, Homo sapiens
ccctggctcagg

SEQ ID NO: 402068 - DNA, 14 bp, Homo sapiens
ccctggctcaggga

SEQ ID NO: 402069 - DNA, 14 bp, Homo sapiens
ccctggctcccaag

SEQ ID NO: 402070 - DNA, 15 bp, Homo sapiens
ccctggctcccaagg

SEQ ID NO: 402071 - DNA, 23 bp, Homo sapiens
ccctggctcccatgaccatactg

SEQ ID NO: 402072 - DNA, 16 bp, Homo sapiens
ccctggctggggactt

SEQ ID NO: 402073 - DNA, 17 bp, Homo sapiens
ccctggctggggacttg

SEQ ID NO: 402074 - DNA, 11 bp, Homo sapiens
ccctggctggt

SEQ ID NO: 402075 - DNA, 18 bp, Homo sapiens
ccctggcttttcactgct

SEQ ID NO: 402076 - DNA, 22 bp, Homo sapiens
ccctggcttttcactgctggct

SEQ ID NO: 402077 - DNA, 16 bp, Homo sapiens
ccctgggaaggctaag

SEQ ID NO: 402078 - DNA, 14 bp, Homo sapiens
ccctgggacccccc

SEQ ID NO: 402079 - DNA, 14 bp, Homo sapiens
ccctgggagagtga

SEQ ID NO: 402080 - DNA, 23 bp, Homo sapiens
ccctgggagagtgaggtcatccc

SEQ ID NO: 402081 - DNA, 22 bp, Homo sapiens
ccctgggcaggcggtccccatc

SEQ ID NO: 402082 - DNA, 16 bp, Homo sapiens
ccctgggccacccttc

SEQ ID NO: 402083 - DNA, 17 bp, Homo sapiens
ccctgggccagcccagg

SEQ ID NO: 402084 - DNA, 15 bp, Homo sapiens
ccctgggcctgtctc

SEQ ID NO: 402085 - DNA, 15 bp, Homo sapiens
ccctgggctggactg

SEQ ID NO: 402086 - DNA, 17 bp, Homo sapiens
ccctgggctggactgga

SEQ ID NO: 402087 - DNA, 13 bp, Homo sapiens
ccctggggaaata

SEQ ID NO: 402088 - DNA, 20 bp, Homo sapiens
ccctggggaagaggccttgg

SEQ ID NO: 402089 - DNA, 19 bp, Homo sapiens
ccctggggatatgcaaccc

SEQ ID NO: 402090 - DNA, 15 bp, Homo sapiens
ccctggggcctagac

SEQ ID NO: 402091 - DNA, 13 bp, Homo sapiens
ccctggggcctgg

SEQ ID NO: 402092 - DNA, 14 bp, Homo sapiens
ccctggggcctgga

SEQ ID NO: 402093 - DNA, 21 bp, Homo sapiens
ccctggggcctggacctgcct

SEQ ID NO: 402094 - DNA, 21 bp, Homo sapiens
ccctggggcttctcctgaccc

SEQ ID NO: 402095 - DNA, 18 bp, Homo sapiens
ccctggggggcacagcca

SEQ ID NO: 402096 - DNA, 17 bp, Homo sapiens
ccctgggggtcccagga

SEQ ID NO: 402097 - DNA, 21 bp, Homo sapiens
ccctgggggtcccaggatccc

SEQ ID NO: 402098 - DNA, 18 bp, Homo sapiens
ccctggggtctctgagca

SEQ ID NO: 402099 - DNA, 22 bp, Homo sapiens
ccctggggtggcgtctgcctag

SEQ ID NO: 402100 - DNA, 23 bp, Homo sapiens
ccctggggtggcgtctgcctagg

SEQ ID NO: 402101 - DNA, 14 bp, Homo sapiens
ccctgggtgccatt

SEQ ID NO: 402102 - DNA, 22 bp, Homo sapiens
ccctgggttcagaaatgctgcc

SEQ ID NO: 402103 - DNA, 14 bp, Homo sapiens
ccctggtctcctcc

SEQ ID NO: 402104 - DNA, 17 bp, Homo sapiens
ccctggtgctgccacac

SEQ ID NO: 402105 - DNA, 18 bp, Homo sapiens
ccctggttcccccaggac

SEQ ID NO: 402106 - DNA, 20 bp, Homo sapiens
ccctggttcccccaggaccc

SEQ ID NO: 402107 - DNA, 18 bp, Homo sapiens
ccctggttctccatcccc

SEQ ID NO: 402108 - DNA, 16 bp, Homo sapiens
ccctgtacccagccac

SEQ ID NO: 402109 - DNA, 20 bp, Homo sapiens
ccctgtacctctctctgctc

SEQ ID NO: 402110 - DNA, 13 bp, Homo sapiens
ccctgtcactcag

SEQ ID NO: 402111 - DNA, 15 bp, Homo sapiens
ccctgtcactcagct

SEQ ID NO: 402112 - DNA, 17 bp, Homo sapiens
ccctgtcagaggctaag

SEQ ID NO: 402113 - DNA, 21 bp, Homo sapiens
ccctgtcagtgcagcccgtgt

SEQ ID NO: 402114 - DNA, 22 bp, Homo sapiens
ccctgtcagtgcagcccgtgtg

SEQ ID NO: 402115 - DNA, 16 bp, Homo sapiens
ccctgtccatccccag

SEQ ID NO: 402116 - DNA, 17 bp, Homo sapiens
ccctgtccatccccagt

SEQ ID NO: 402117 - DNA, 15 bp, Homo sapiens
ccctgtcccaccaac

SEQ ID NO: 402118 - DNA, 20 bp, Homo sapiens
ccctgtcccaccaactctgc

SEQ ID NO: 402119 - DNA, 14 bp, Homo sapiens
ccctttcttggcca

SEQ ID NO: 402120 - DNA, 15 bp, Homo sapiens
ccctttcttggccag

SEQ ID NO: 402121 - DNA, 21 bp, Homo sapiens
ccctttgacttcagctgcctg

SEQ ID NO: 402122 - DNA, 20 bp, Homo sapiens
ccctttgcaggcccagcaga

SEQ ID NO: 402123 - DNA, 24 bp, Homo sapiens
ccctttggagaacgccagtctccc

SEQ ID NO: 402124 - DNA, 21 bp, Homo sapiens
ccctttgtggactttatttaa

SEQ ID NO: 402125 - DNA, 16 bp, Homo sapiens
cccttttaaatggcat

SEQ ID NO: 402126 - DNA, 23 bp, Homo sapiens
cccttttagtggtggtgtctcac

SEQ ID NO: 402127 - DNA, 12 bp, Homo sapiens
cccttttcctgg

SEQ ID NO: 402128 - DNA, 15 bp, Homo sapiens
cccttttgcctggct

SEQ ID NO: 402129 - DNA, 16 bp, Homo sapiens
cccttttgcctggctg

SEQ ID NO: 402130 - DNA, 14 bp, Homo sapiens
cccttttggccccc

SEQ ID NO: 402131 - DNA, 22 bp, Homo sapiens
cccttttggcccccgagctggg

SEQ ID NO: 402132 - DNA, 21 bp, Homo sapiens
cccttttgtgggtttctctgt

SEQ ID NO: 402133 - DNA, 16 bp, Homo sapiens
ccctttttactcccct

SEQ ID NO: 402134 - DNA, 17 bp, Homo sapiens
cccttttttgtccccca

SEQ ID NO: 402135 - DNA, 18 bp, Homo sapiens
cccttttttgtcccccaa

SEQ ID NO: 402136 - DNA, 19 bp, Homo sapiens
cccttttttgtcccccaac

SEQ ID NO: 402137 - DNA, 24 bp, Homo sapiens
ccgaaacaggctactctcctcggc

SEQ ID NO: 402138 - DNA, 15 bp, Homo sapiens
ccgaaccccccactc

SEQ ID NO: 402139 - DNA, 18 bp, Homo sapiens
ccgaaccccccactccct

SEQ ID NO: 402140 - DNA, 23 bp, Homo sapiens
ccgaagaccttctgaagatctca

SEQ ID NO: 402141 - DNA, 13 bp, Homo sapiens
ccgaagccatcac

SEQ ID NO: 402142 - DNA, 17 bp, Homo sapiens
ccgaagccatcacttct

SEQ ID NO: 402143 - DNA, 21 bp, Homo sapiens
ccgaagccatcacttctcccc

SEQ ID NO: 402144 - DNA, 16 bp, Homo sapiens
ccgaatcccctccctg

SEQ ID NO: 402145 - DNA, 13 bp, Homo sapiens
ccgaatgcctgtc

SEQ ID NO: 402146 - DNA, 15 bp, Homo sapiens
ccgacaaccgatgct

SEQ ID NO: 402147 - DNA, 20 bp, Homo sapiens
ccgacaaccgatgctccagc

SEQ ID NO: 402148 - DNA, 17 bp, Homo sapiens
ccgacacgctccctccc

SEQ ID NO: 402149 - DNA, 14 bp, Homo sapiens
ccgacactgctgca

SEQ ID NO: 402150 - DNA, 17 bp, Homo sapiens
ccgacactgctgcacca

SEQ ID NO: 402151 - DNA, 15 bp, Homo sapiens
ccgacagcctggcac

SEQ ID NO: 402152 - DNA, 15 bp, Homo sapiens
ccgaccccctttcta

SEQ ID NO: 402153 - DNA, 15 bp, Homo sapiens
ccgaccgcctgcttc

SEQ ID NO: 402154 - DNA, 23 bp, Homo sapiens
ccgaccgcctgcttcacacccct

SEQ ID NO: 402155 - DNA, 21 bp, Homo sapiens
ccgacgccacagcccagccac

SEQ ID NO: 402156 - DNA, 15 bp, Homo sapiens
ccgactagcaggcat

SEQ ID NO: 402157 - DNA, 13 bp, Homo sapiens
ccgactcaggtcc

SEQ ID NO: 402158 - DNA, 17 bp, Homo sapiens
ccgagaccgcagaggga

SEQ ID NO: 402159 - DNA, 22 bp, Homo sapiens
ccgagagctcttagtttttaaa

SEQ ID NO: 402160 - DNA, 19 bp, Homo sapiens
ccgagatcggggtggcaga

SEQ ID NO: 402161 - DNA, 20 bp, Homo sapiens
ccgagatgtgacccaccagt

SEQ ID NO: 402162 - DNA, 21 bp, Homo sapiens
ccgagatgtgacccaccagtg

SEQ ID NO: 402163 - DNA, 18 bp, Homo sapiens
ccgagcaaagtctaaagt

SEQ ID NO: 402164 - DNA, 20 bp, Homo sapiens
ccgagcaaagtctaaagttt

SEQ ID NO: 402165 - DNA, 18 bp, Homo sapiens
ccgagcccagctacattc

SEQ ID NO: 402166 - DNA, 21 bp, Homo sapiens
ccgagcccagctacattcctc

SEQ ID NO: 402167 - DNA, 16 bp, Homo sapiens
ccgagccccctgtcct

SEQ ID NO: 402168 - DNA, 17 bp, Homo sapiens
ccgagccccctgtcctt

SEQ ID NO: 402169 - DNA, 13 bp, Homo sapiens
ccgagccgagctc

SEQ ID NO: 402170 - DNA, 19 bp, Homo sapiens
ccgagccgagctctcctgg

SEQ ID NO: 402171 - DNA, 19 bp, Homo sapiens
ccgagccgggcctggggct

SEQ ID NO: 402172 - DNA, 18 bp, Homo sapiens
ccgagcgcgtgccttccc

SEQ ID NO: 402173 - DNA, 22 bp, Homo sapiens
ccgagcgcgtgccttccccgtg

SEQ ID NO: 402174 - DNA, 21 bp, Homo sapiens
ccgagctactctcttgccagc

SEQ ID NO: 402175 - DNA, 22 bp, Homo sapiens
ccgagctactctcttgccagca

SEQ ID NO: 402176 - DNA, 20 bp, Homo sapiens
ccgagctcgtgtatcctggg

SEQ ID NO: 402177 - DNA, 16 bp, Homo sapiens
ccgagctctcctgggc

SEQ ID NO: 402178 - DNA, 21 bp, Homo sapiens
ccgagctctcctgggccaggg

SEQ ID NO: 402179 - DNA, 13 bp, Homo sapiens
ccgagctctgtcc

SEQ ID NO: 402180 - DNA, 18 bp, Homo sapiens
ccgagctgggggccatga

SEQ ID NO: 402181 - DNA, 14 bp, Homo sapiens
ccgaggcagcaaca

SEQ ID NO: 402182 - DNA, 15 bp, Homo sapiens
ccgaggcaggggctg

SEQ ID NO: 402183 - DNA, 21 bp, Homo sapiens
ccgaggcaggggctgggcaga

SEQ ID NO: 402184 - DNA, 21 bp, Homo sapiens
ccgagggatgtccttggggag

SEQ ID NO: 402185 - DNA, 16 bp, Homo sapiens
ccgagggtcctggctc

SEQ ID NO: 402186 - DNA, 18 bp, Homo sapiens
ccgagtctcttctccact

SEQ ID NO: 402187 - DNA, 16 bp, Homo sapiens
ccgagtgaacctacct

SEQ ID NO: 402188 - DNA, 13 bp, Homo sapiens
ccgagtgccccag

SEQ ID NO: 402189 - DNA, 22 bp, Homo sapiens
ccgagtggatagatgccctgct

SEQ ID NO: 402190 - DNA, 22 bp, Homo sapiens
ccgagtggtctcctctcagctt

SEQ ID NO: 402191 - DNA, 16 bp, Homo sapiens
ccgagtgtggagctgc

SEQ ID NO: 402192 - DNA, 15 bp, Homo sapiens
ccgatattctccctg

SEQ ID NO: 402193 - DNA, 17 bp, Homo sapiens
ccgatggagcccccaga

SEQ ID NO: 402194 - DNA, 19 bp, Homo sapiens
ccgatgggagtctccctcc

SEQ ID NO: 402195 - DNA, 17 bp, Homo sapiens
ccgatggggcccacatt

SEQ ID NO: 402196 - DNA, 22 bp, Homo sapiens
ccgcaaatccataccccctgcc

SEQ ID NO: 402197 - DNA, 12 bp, Homo sapiens
ccgcaaggagca

SEQ ID NO: 402198 - DNA, 21 bp, Homo sapiens
ccgcaatgtgcccccagacgc

SEQ ID NO: 402199 - DNA, 22 bp, Homo sapiens
ccgcacagcagcctgcttccca

SEQ ID NO: 402200 - DNA, 14 bp, Homo sapiens
ccgcaccagctgct

SEQ ID NO: 402201 - DNA, 15 bp, Homo sapiens
ccgcaccagctgctc

SEQ ID NO: 402202 - DNA, 15 bp, Homo sapiens
ccgcacccccaccct

SEQ ID NO: 402203 - DNA, 14 bp, Homo sapiens
ccgcactaggggat

SEQ ID NO: 402204 - DNA, 15 bp, Homo sapiens
ccgcagcaccagcct

SEQ ID NO: 402205 - DNA, 18 bp, Homo sapiens
ccgcagcaccagcctgag

SEQ ID NO: 402206 - DNA, 21 bp, Homo sapiens
ccgcagcaccagcctgagcca

SEQ ID NO: 402207 - DNA, 18 bp, Homo sapiens
ccgcagcccgcctgccgt

SEQ ID NO: 402208 - DNA, 21 bp, Homo sapiens
ccgcagggcgctccggcagag

SEQ ID NO: 402209 - DNA, 13 bp, Homo sapiens
ccgcatcctccag

SEQ ID NO: 402210 - DNA, 14 bp, Homo sapiens
ccgcatctgctcat

SEQ ID NO: 402211 - DNA, 20 bp, Homo sapiens
ccgcatgcagcagcttgctg

SEQ ID NO: 402212 - DNA, 16 bp, Homo sapiens
ccgcatgctgcctgcc

SEQ ID NO: 402213 - DNA, 18 bp, Homo sapiens
ccgcatggcccctccagg

SEQ ID NO: 402214 - DNA, 20 bp, Homo sapiens
ccgcatgtctgcatggcaga

SEQ ID NO: 402215 - DNA, 12 bp, Homo sapiens
ccgcatgtgtct

SEQ ID NO: 402216 - DNA, 13 bp, Homo sapiens
ccgcatgtgtctg

SEQ ID NO: 402217 - DNA, 19 bp, Homo sapiens
ccgcatgtgtctgtattca

SEQ ID NO: 402218 - DNA, 23 bp, Homo sapiens
ccgccacctatctcgtgggagag

SEQ ID NO: 402219 - DNA, 16 bp, Homo sapiens
ccgccagatggggcct

SEQ ID NO: 402220 - DNA, 18 bp, Homo sapiens
ccgccagccagtggccga

SEQ ID NO: 402221 - DNA, 20 bp, Homo sapiens
ccgccatgcaactccatgcc

SEQ ID NO: 402222 - DNA, 15 bp, Homo sapiens
ccgccattgccacca

SEQ ID NO: 402223 - DNA, 19 bp, Homo sapiens
ccgccattgccaccaggag

SEQ ID NO: 402224 - DNA, 18 bp, Homo sapiens
ccgcccaccccgctgcct

SEQ ID NO: 402225 - DNA, 20 bp, Homo sapiens
ccgcccacctctgctgccca

SEQ ID NO: 402226 - DNA, 11 bp, Homo sapiens
ccgcccacctg

SEQ ID NO: 402227 - DNA, 16 bp, Homo sapiens
ccgcccagacaccaca

SEQ ID NO: 402228 - DNA, 19 bp, Homo sapiens
ccgcccagacaccacagac

SEQ ID NO: 402229 - DNA, 13 bp, Homo sapiens
ccgccccacattc

SEQ ID NO: 402230 - DNA, 13 bp, Homo sapiens
ccgccccagagac

SEQ ID NO: 402231 - DNA, 15 bp, Homo sapiens
ccgccccagagactg

SEQ ID NO: 402232 - DNA, 22 bp, Homo sapiens
ccgccccagagactgcccaccc

SEQ ID NO: 402233 - DNA, 17 bp, Homo sapiens
ccgccccagagctccga

SEQ ID NO: 402234 - DNA, 14 bp, Homo sapiens
ccgccccagcccct

SEQ ID NO: 402235 - DNA, 17 bp, Homo sapiens
ccgccccagccccttct

SEQ ID NO: 402236 - DNA, 15 bp, Homo sapiens
ccgccccagcctctg

SEQ ID NO: 402237 - DNA, 20 bp, Homo sapiens
ccgccccccagagccagggc

SEQ ID NO: 402238 - DNA, 22 bp, Homo sapiens
ccgccccggggactcgcagcac

SEQ ID NO: 402239 - DNA, 21 bp, Homo sapiens
ccgcccctcgctgctgctact

SEQ ID NO: 402240 - DNA, 15 bp, Homo sapiens
ccgcccgccctcctc

SEQ ID NO: 402241 - DNA, 11 bp, Homo sapiens
ccgccctcctc

SEQ ID NO: 402242 - DNA, 14 bp, Homo sapiens
ccgccctcctctgc

SEQ ID NO: 402243 - DNA, 15 bp, Homo sapiens
ccgccctcctctgcc

SEQ ID NO: 402244 - DNA, 12 bp, Homo sapiens
ccgccctgctgt

SEQ ID NO: 402245 - DNA, 14 bp, Homo sapiens
ccgccctgggctgg

SEQ ID NO: 402246 - DNA, 17 bp, Homo sapiens
ccgccctgggctggact

SEQ ID NO: 402247 - DNA, 19 bp, Homo sapiens
ccgccctgggctggactgg

SEQ ID NO: 402248 - DNA, 21 bp, Homo sapiens
ccgccggaccgcgtagagagc

SEQ ID NO: 402249 - DNA, 21 bp, Homo sapiens
gaccctgggagagtgaggtca

SEQ ID NO: 402250 - DNA, 16 bp, Homo sapiens
gaccctgggtcacctt

SEQ ID NO: 402251 - DNA, 22 bp, Homo sapiens
gaccctgggtcaccttcctggg

SEQ ID NO: 402252 - DNA, 16 bp, Homo sapiens
gacccttcagggccag

SEQ ID NO: 402253 - DNA, 19 bp, Homo sapiens
gacccttctgtctgtaaga

SEQ ID NO: 402254 - DNA, 21 bp, Homo sapiens
gacccttgaagatgtagcttc

SEQ ID NO: 402255 - DNA, 13 bp, Homo sapiens
gaccgcagaggga

SEQ ID NO: 402256 - DNA, 16 bp, Homo sapiens
gaccgcatcctccagg

SEQ ID NO: 402257 - DNA, 23 bp, Homo sapiens
gaccgcctgcttcacacccctca

SEQ ID NO: 402258 - DNA, 17 bp, Homo sapiens
gaccggaagctcctggt

SEQ ID NO: 402259 - DNA, 18 bp, Homo sapiens
gaccggagcggctgagga

SEQ ID NO: 402260 - DNA, 17 bp, Homo sapiens
gaccggcccgccacctt

SEQ ID NO: 402261 - DNA, 12 bp, Homo sapiens
gaccggggtcct

SEQ ID NO: 402262 - DNA, 18 bp, Homo sapiens
gaccggggtcctgaggct

SEQ ID NO: 402263 - DNA, 20 bp, Homo sapiens
gaccggggtcctgaggctgg

SEQ ID NO: 402264 - DNA, 19 bp, Homo sapiens
gaccgggtgggcctggcct

SEQ ID NO: 402265 - DNA, 20 bp, Homo sapiens
gaccgggtgggcctggcctg

SEQ ID NO: 402266 - DNA, 16 bp, Homo sapiens
gaccgtactctcacat

SEQ ID NO: 402267 - DNA, 16 bp, Homo sapiens
gaccgtgtcccaagga

SEQ ID NO: 402268 - DNA, 20 bp, Homo sapiens
gaccgtgtcccaaggagctg

SEQ ID NO: 402269 - DNA, 18 bp, Homo sapiens
gaccgttttcatcctggc

SEQ ID NO: 402270 - DNA, 22 bp, Homo sapiens
gaccgttttcatcctggcctcc

SEQ ID NO: 402271 - DNA, 18 bp, Homo sapiens
gacctaaatccattttct

SEQ ID NO: 402272 - DNA, 20 bp, Homo sapiens
gacctaaatccattttctaa

SEQ ID NO: 402273 - DNA, 13 bp, Homo sapiens
gacctaaattcgt

SEQ ID NO: 402274 - DNA, 13 bp, Homo sapiens
gacctaatatcat

SEQ ID NO: 402275 - DNA, 18 bp, Homo sapiens
gacctaatatcattttat

SEQ ID NO: 402276 - DNA, 14 bp, Homo sapiens
gacctacagggaac

SEQ ID NO: 402277 - DNA, 15 bp, Homo sapiens
gacctacagggaact

SEQ ID NO: 402278 - DNA, 14 bp, Homo sapiens
gacctacattccct

SEQ ID NO: 402279 - DNA, 17 bp, Homo sapiens
gacctacattccctctc

SEQ ID NO: 402280 - DNA, 17 bp, Homo sapiens
gacctaccaccccactg

SEQ ID NO: 402281 - DNA, 21 bp, Homo sapiens
gacctagggaggaccttatct

SEQ ID NO: 402282 - DNA, 22 bp, Homo sapiens
gacctatgtacttaatccttta

SEQ ID NO: 402283 - DNA, 14 bp, Homo sapiens
gacctatgtttgct

SEQ ID NO: 402284 - DNA, 14 bp, Homo sapiens
gacctcaagcaacc

SEQ ID NO: 402285 - DNA, 17 bp, Homo sapiens
gacctcagctgcacatt

SEQ ID NO: 402286 - DNA, 15 bp, Homo sapiens
gacctcatctccaag

SEQ ID NO: 402287 - DNA, 16 bp, Homo sapiens
gacctccctgtgagag

SEQ ID NO: 402288 - DNA, 20 bp, Homo sapiens
gacctcctggactgtaggac

SEQ ID NO: 402289 - DNA, 16 bp, Homo sapiens
gacctcgtttgggagt

SEQ ID NO: 402290 - DNA, 21 bp, Homo sapiens
gacctctactttccaggctag

SEQ ID NO: 402291 - DNA, 17 bp, Homo sapiens
gacctctgaagagctga

SEQ ID NO: 402292 - DNA, 20 bp, Homo sapiens
gacctctgaagagctgagta

SEQ ID NO: 402293 - DNA, 21 bp, Homo sapiens
gacctgaagggtgacatccca

SEQ ID NO: 402294 - DNA, 21 bp, Homo sapiens
gacctgaatgcttctgagagc

SEQ ID NO: 402295 - DNA, 16 bp, Homo sapiens
gacctgagtcggcccc

SEQ ID NO: 402296 - DNA, 22 bp, Homo sapiens
gacctgatcattacatggctgt

SEQ ID NO: 402297 - DNA, 20 bp, Homo sapiens
gacctgcccccgctctgcca

SEQ ID NO: 402298 - DNA, 16 bp, Homo sapiens
gacctgcccctgccgc

SEQ ID NO: 402299 - DNA, 16 bp, Homo sapiens
gacctgcctcctgcct

SEQ ID NO: 402300 - DNA, 20 bp, Homo sapiens
gacctgcctcctgcctgccc

SEQ ID NO: 402301 - DNA, 18 bp, Homo sapiens
gacctgctaagtgtggaa

SEQ ID NO: 402302 - DNA, 16 bp, Homo sapiens
gacctgctccgccagg

SEQ ID NO: 402303 - DNA, 20 bp, Homo sapiens
gacctgctccgccaggaaag

SEQ ID NO: 402304 - DNA, 13 bp, Homo sapiens
gacctgctgctcc

SEQ ID NO: 402305 - DNA, 17 bp, Homo sapiens
gacctggaaccagagcc

SEQ ID NO: 402306 - DNA, 16 bp, Homo sapiens
gacctggaagagctgg

SEQ ID NO: 402307 - DNA, 18 bp, Homo sapiens
gacctggaagagctgggt

SEQ ID NO: 402308 - DNA, 16 bp, Homo sapiens
gacctgggccctggtt

SEQ ID NO: 402309 - DNA, 23 bp, Homo sapiens
gacctgggctcttggccgtggca

SEQ ID NO: 402310 - DNA, 20 bp, Homo sapiens
gacctggggtggggaggcag

SEQ ID NO: 402311 - DNA, 10 bp, Homo sapiens
gacctgtcca

SEQ ID NO: 402312 - DNA, 12 bp, Homo sapiens
gacctgtgacca

SEQ ID NO: 402313 - DNA, 19 bp, Homo sapiens
gacctgtgctagttttaca

SEQ ID NO: 402314 - DNA, 21 bp, Homo sapiens
gacctgtggggatttctccca

SEQ ID NO: 402315 - DNA, 14 bp, Homo sapiens
gaccttacaaccac

SEQ ID NO: 402316 - DNA, 16 bp, Homo sapiens
gaccttacaaccacat

SEQ ID NO: 402317 - DNA, 21 bp, Homo sapiens
gaccttagaaatcattgtaga

SEQ ID NO: 402318 - DNA, 12 bp, Homo sapiens
gaccttagcgtt

SEQ ID NO: 402319 - DNA, 14 bp, Homo sapiens
gaccttatctgtgc

SEQ ID NO: 402320 - DNA, 22 bp, Homo sapiens
gaccttatctgtgcgtgaaaca

SEQ ID NO: 402321 - DNA, 14 bp, Homo sapiens
gaccttcaccaagc

SEQ ID NO: 402322 - DNA, 18 bp, Homo sapiens
gaccttcctctggggctc

SEQ ID NO: 402323 - DNA, 21 bp, Homo sapiens
gaccttcctctggggctctag

SEQ ID NO: 402324 - DNA, 19 bp, Homo sapiens
gaccttctagaattataag

SEQ ID NO: 402325 - DNA, 13 bp, Homo sapiens
gaccttctgaaga

SEQ ID NO: 402326 - DNA, 18 bp, Homo sapiens
gaccttctgaagatctca

SEQ ID NO: 402327 - DNA, 17 bp, Homo sapiens
gaccttgaactcctggg

SEQ ID NO: 402328 - DNA, 15 bp, Homo sapiens
gacctttatttatta

SEQ ID NO: 402329 - DNA, 21 bp, Homo sapiens
gacctttatttattaaacttc

SEQ ID NO: 402330 - DNA, 21 bp, Homo sapiens
gacgacaagtgctgaacagtg

SEQ ID NO: 402331 - DNA, 14 bp, Homo sapiens
gacgagactcctcg

SEQ ID NO: 402332 - DNA, 15 bp, Homo sapiens
gacgaggcaggggct

SEQ ID NO: 402333 - DNA, 14 bp, Homo sapiens
gacgaggctgggcc

SEQ ID NO: 402334 - DNA, 12 bp, Homo sapiens
gacgcagcagct

SEQ ID NO: 402335 - DNA, 22 bp, Homo sapiens
gacgcagcagctgggacccctc

SEQ ID NO: 402336 - DNA, 17 bp, Homo sapiens
gacgcagggagaccctg

SEQ ID NO: 402337 - DNA, 20 bp, Homo sapiens
gacgcagggagaccctggga

SEQ ID NO: 402338 - DNA, 21 bp, Homo sapiens
gacgcagggagaccctgggag

SEQ ID NO: 402339 - DNA, 15 bp, Homo sapiens
gacgccaataataaa

SEQ ID NO: 402340 - DNA, 15 bp, Homo sapiens
gacgccacagcccag

SEQ ID NO: 402341 - DNA, 16 bp, Homo sapiens
gacgccacctggcggc

SEQ ID NO: 402342 - DNA, 11 bp, Homo sapiens
gacgccctgcg

SEQ ID NO: 402343 - DNA, 22 bp, Homo sapiens
gacgcctgccctccccagagca

SEQ ID NO: 402344 - DNA, 17 bp, Homo sapiens
gacgcctggctccaggc

SEQ ID NO: 402345 - DNA, 19 bp, Homo sapiens
gacgcctggctccaggctc

SEQ ID NO: 402346 - DNA, 20 bp, Homo sapiens
gacgctcccctgagaggttt

SEQ ID NO: 402347 - DNA, 18 bp, Homo sapiens
gacgctggtagagatgga

SEQ ID NO: 402348 - DNA, 20 bp, Homo sapiens
gacgctggtagagatggagg

SEQ ID NO: 402349 - DNA, 21 bp, Homo sapiens
gacgctggtagagatggagga

SEQ ID NO: 402350 - DNA, 13 bp, Homo sapiens
ccagtgctgccat

SEQ ID NO: 402351 - DNA, 16 bp, Homo sapiens
ccagtgctgccatgcc

SEQ ID NO: 402352 - DNA, 21 bp, Homo sapiens
ccagtgctgccatgccactgc

SEQ ID NO: 402353 - DNA, 15 bp, Homo sapiens
ccagtgcttccacag

SEQ ID NO: 402354 - DNA, 14 bp, Homo sapiens
ccagtgcttggctg

SEQ ID NO: 402355 - DNA, 22 bp, Homo sapiens
ccagtggaacagcgggagacct

SEQ ID NO: 402356 - DNA, 14 bp, Homo sapiens
ccagtggacagagg

SEQ ID NO: 402357 - DNA, 22 bp, Homo sapiens
ccagtggccgaaccccccactc

SEQ ID NO: 402358 - DNA, 16 bp, Homo sapiens
ccagtggcctcaaccc

SEQ ID NO: 402359 - DNA, 17 bp, Homo sapiens
ccagtggcctcaaccct

SEQ ID NO: 402360 - DNA, 24 bp, Homo sapiens
ccagtggcctcaaccctccctcag

SEQ ID NO: 402361 - DNA, 13 bp, Homo sapiens
ccagtggctgggg

SEQ ID NO: 402362 - DNA, 10 bp, Homo sapiens
ccagtgggct

SEQ ID NO: 402363 - DNA, 12 bp, Homo sapiens
ccagtgggctgt

SEQ ID NO: 402364 - DNA, 13 bp, Homo sapiens
ccagtggggtccc

SEQ ID NO: 402365 - DNA, 14 bp, Homo sapiens
ccagtggggtcccc

SEQ ID NO: 402366 - DNA, 20 bp, Homo sapiens
ccagtggggtcccccctgag

SEQ ID NO: 402367 - DNA, 23 bp, Homo sapiens
ccagtggggtcccccctgagtgg

SEQ ID NO: 402368 - DNA, 15 bp, Homo sapiens
ccagtgtactgcttt

SEQ ID NO: 402369 - DNA, 16 bp, Homo sapiens
ccagtgtactgctttc

SEQ ID NO: 402370 - DNA, 19 bp, Homo sapiens
ccagtgttagtgggaagag

SEQ ID NO: 402371 - DNA, 23 bp, Homo sapiens
ccagtgttagtgggaagagctgg

SEQ ID NO: 402372 - DNA, 24 bp, Homo sapiens
ccagtgttagtgggaagagctggg

SEQ ID NO: 402373 - DNA, 19 bp, Homo sapiens
ccagttaatcttgctttct

SEQ ID NO: 402374 - DNA, 12 bp, Homo sapiens
ccagttactgtt

SEQ ID NO: 402375 - DNA, 18 bp, Homo sapiens
ccagttctgaataacttg

SEQ ID NO: 402376 - DNA, 20 bp, Homo sapiens
ccagttgcacttggcctctg

SEQ ID NO: 402377 - DNA, 23 bp, Homo sapiens
ccagttggactgtggcctcagga

SEQ ID NO: 402378 - DNA, 14 bp, Homo sapiens
ccagttggggctgc

SEQ ID NO: 402379 - DNA, 22 bp, Homo sapiens
ccagttttttgccactgcaaac

SEQ ID NO: 402380 - DNA, 18 bp, Homo sapiens
ccataaaccaataaaaca

SEQ ID NO: 402381 - DNA, 20 bp, Homo sapiens
ccataatagttagccctcag

SEQ ID NO: 402382 - DNA, 19 bp, Homo sapiens
ccataatgtataaagaaca

SEQ ID NO: 402383 - DNA, 20 bp, Homo sapiens
ccataattatgacagttata

SEQ ID NO: 402384 - DNA, 16 bp, Homo sapiens
ccataccccctgcccc

SEQ ID NO: 402385 - DNA, 16 bp, Homo sapiens
ccatactctgtctccc

SEQ ID NO: 402386 - DNA, 17 bp, Homo sapiens
ccatactctgtctccct

SEQ ID NO: 402387 - DNA, 22 bp, Homo sapiens
ccatagaaaacaatctgcccac

SEQ ID NO: 402388 - DNA, 12 bp, Homo sapiens
ccatagacacag

SEQ ID NO: 402389 - DNA, 13 bp, Homo sapiens
ccatagagtttaa

SEQ ID NO: 402390 - DNA, 16 bp, Homo sapiens
ccatagagtttaacac

SEQ ID NO: 402391 - DNA, 17 bp, Homo sapiens
ccatagagtttaacaca

SEQ ID NO: 402392 - DNA, 14 bp, Homo sapiens
ccatagatcttctg

SEQ ID NO: 402393 - DNA, 15 bp, Homo sapiens
ccatagatcttctga

SEQ ID NO: 402394 - DNA, 12 bp, Homo sapiens
ccataggagagg

SEQ ID NO: 402395 - DNA, 12 bp, Homo sapiens
ccatatataaat

SEQ ID NO: 402396 - DNA, 15 bp, Homo sapiens
gactgtatttctgtg

SEQ ID NO: 402397 - DNA, 16 bp, Homo sapiens
gactgtatttctgtgg

SEQ ID NO: 402398 - DNA, 21 bp, Homo sapiens
gactgtctcaagagggcactg

SEQ ID NO: 402399 - DNA, 18 bp, Homo sapiens
gactgtcttcaaccctgc

SEQ ID NO: 402400 - DNA, 19 bp, Homo sapiens
gactgtcttcaaccctgcc

SEQ ID NO: 402401 - DNA, 20 bp, Homo sapiens
gactgtgaaagtatgtgata

SEQ ID NO: 402402 - DNA, 17 bp, Homo sapiens
gactgtgaccaccttct

SEQ ID NO: 402403 - DNA, 23 bp, Homo sapiens
gactgtgagcgagcctggcaggt

SEQ ID NO: 402404 - DNA, 17 bp, Homo sapiens
gactgtgaggcggcagc

SEQ ID NO: 402405 - DNA, 20 bp, Homo sapiens
gactgtgaggcggcagctgg

SEQ ID NO: 402406 - DNA, 23 bp, Homo sapiens
gactgtgaggcggcagctggggc

SEQ ID NO: 402407 - DNA, 12 bp, Homo sapiens
gactgtgattta

SEQ ID NO: 402408 - DNA, 21 bp, Homo sapiens
gactgtgatttatttggagtg

SEQ ID NO: 402409 - DNA, 15 bp, Homo sapiens
gactgtggcctcagg

SEQ ID NO: 402410 - DNA, 22 bp, Homo sapiens
gactgtgtattctagttttgtc

SEQ ID NO: 402411 - DNA, 21 bp, Homo sapiens
gactgtgtgttgccacaggac

SEQ ID NO: 402412 - DNA, 12 bp, Homo sapiens
gactgtgtttaa

SEQ ID NO: 402413 - DNA, 22 bp, Homo sapiens
gactgttagaaaatggacactg

SEQ ID NO: 402414 - DNA, 16 bp, Homo sapiens
gactgttccctccaag

SEQ ID NO: 402415 - DNA, 14 bp, Homo sapiens
gactgttttttcct

SEQ ID NO: 402416 - DNA, 19 bp, Homo sapiens
gacttaaaatattcctgca

SEQ ID NO: 402417 - DNA, 22 bp, Homo sapiens
gacttaagacaaatgggactga

SEQ ID NO: 402418 - DNA, 19 bp, Homo sapiens
gacttaagcacacttgaca

SEQ ID NO: 402419 - DNA, 19 bp, Homo sapiens
gacttaatcatatcaactt

SEQ ID NO: 402420 - DNA, 14 bp, Homo sapiens
gacttaatctttgc

SEQ ID NO: 402421 - DNA, 17 bp, Homo sapiens
gacttaatctttgctga

SEQ ID NO: 402422 - DNA, 14 bp, Homo sapiens
gacttagatctgag

SEQ ID NO: 402423 - DNA, 20 bp, Homo sapiens
gacttatatatttgaaagaa

SEQ ID NO: 402424 - DNA, 13 bp, Homo sapiens
gacttatgggccc

SEQ ID NO: 402425 - DNA, 15 bp, Homo sapiens
gacttattacaattt

SEQ ID NO: 402426 - DNA, 17 bp, Homo sapiens
gacttatttcttcaaat

SEQ ID NO: 402427 - DNA, 15 bp, Homo sapiens
gacttattttctctg

SEQ ID NO: 402428 - DNA, 15 bp, Homo sapiens
gacttcagactctct

SEQ ID NO: 402429 - DNA, 16 bp, Homo sapiens
gacttcagcaggggtg

SEQ ID NO: 402430 - DNA, 15 bp, Homo sapiens
gacttcagctgcctg

SEQ ID NO: 402431 - DNA, 17 bp, Homo sapiens
gacttcaggttgttctg

SEQ ID NO: 402432 - DNA, 16 bp, Homo sapiens
gacttcatttttccta

SEQ ID NO: 402433 - DNA, 15 bp, Homo sapiens
gacttcccagctggc

SEQ ID NO: 402434 - DNA, 16 bp, Homo sapiens
gacttcccagctggca

SEQ ID NO: 402435 - DNA, 22 bp, Homo sapiens
gacttcccagctggcagcgcct

SEQ ID NO: 402436 - DNA, 23 bp, Homo sapiens
gacttcccagctggcagcgcctc

SEQ ID NO: 402437 - DNA, 12 bp, Homo sapiens
gacttccccatc

SEQ ID NO: 402438 - DNA, 14 bp, Homo sapiens
gacttccccatccc

SEQ ID NO: 402439 - DNA, 15 bp, Homo sapiens
gacttccccatcccg

SEQ ID NO: 402440 - DNA, 21 bp, Homo sapiens
gacttcctgctacagtagctg

SEQ ID NO: 402441 - DNA, 15 bp, Homo sapiens
gacttcctggggccc

SEQ ID NO: 402442 - DNA, 16 bp, Homo sapiens
gacttccttgctctcc

SEQ ID NO: 402443 - DNA, 14 bp, Homo sapiens
gacttcgaaaacag

SEQ ID NO: 402444 - DNA, 16 bp, Homo sapiens
gacttcgctattccca

SEQ ID NO: 402445 - DNA, 14 bp, Homo sapiens
gacttctaaatcat

SEQ ID NO: 402446 - DNA, 19 bp, Homo sapiens
gacttctaggaggatgctg

SEQ ID NO: 402447 - DNA, 20 bp, Homo sapiens
gacttctaggaggatgctgt

SEQ ID NO: 402448 - DNA, 21 bp, Homo sapiens
gacttctaggaggatgctgtg

SEQ ID NO: 402449 - DNA, 19 bp, Homo sapiens
gacttctatcctgttaaca

SEQ ID NO: 402450 - DNA, 11 bp, Homo sapiens
gacttctgcta

SEQ ID NO: 402451 - DNA, 14 bp, Homo sapiens
gacttctggaaggc

SEQ ID NO: 402452 - DNA, 17 bp, Homo sapiens
gacttctggaaggctgg

SEQ ID NO: 402453 - DNA, 21 bp, Homo sapiens
gacttctggttgtatttctat

SEQ ID NO: 402454 - DNA, 15 bp, Homo sapiens
gacttcttgttcatg

SEQ ID NO: 402455 - DNA, 15 bp, Homo sapiens
gacttgaatgtacaa

SEQ ID NO: 402456 - DNA, 21 bp, Homo sapiens
gacttgaattcaaagcatgtc

SEQ ID NO: 402457 - DNA, 17 bp, Homo sapiens
gacttgatgaataaaca

SEQ ID NO: 402458 - DNA, 20 bp, Homo sapiens
gacttgctgttttgttctgt

SEQ ID NO: 402459 - DNA, 22 bp, Homo sapiens
gacttgctgttttgttctgtgg

SEQ ID NO: 402460 - DNA, 18 bp, Homo sapiens
gacttggccgcttcccta

SEQ ID NO: 402461 - DNA, 20 bp, Homo sapiens
gacttgggagagggagcaag

SEQ ID NO: 402462 - DNA, 21 bp, Homo sapiens
gacttgggagagggagcaagc

SEQ ID NO: 402463 - DNA, 17 bp, Homo sapiens
gacttgtaggaatctgc

SEQ ID NO: 402464 - DNA, 20 bp, Homo sapiens
gacttgtaggaatctgcctt

SEQ ID NO: 402465 - DNA, 23 bp, Homo sapiens
gacttgtaggaatctgccttcca

SEQ ID NO: 402466 - DNA, 19 bp, Homo sapiens
gacttgtagggatgccttt

SEQ ID NO: 402467 - DNA, 21 bp, Homo sapiens
gacttgtgcctcttgggagac

SEQ ID NO: 402468 - DNA, 13 bp, Homo sapiens
gacttgtttcctg

SEQ ID NO: 402469 - DNA, 20 bp, Homo sapiens
gacttgtttcctgtgcccat

SEQ ID NO: 402470 - DNA, 15 bp, Homo sapiens
gacttgtttctttct

SEQ ID NO: 402471 - DNA, 16 bp, Homo sapiens
gacttgtttctttctg

SEQ ID NO: 402472 - DNA, 17 bp, Homo sapiens
gactttatctcctgctc

SEQ ID NO: 402473 - DNA, 18 bp, Homo sapiens
gactttatttaatttcat

SEQ ID NO: 402474 - DNA, 20 bp, Homo sapiens
gactttatttaatttcataa

SEQ ID NO: 402475 - DNA, 22 bp, Homo sapiens
gactttatttaatttcataaat

SEQ ID NO: 402476 - DNA, 21 bp, Homo sapiens
gactttcaaaattaaatctgt

SEQ ID NO: 402477 - DNA, 13 bp, Homo sapiens
gactttccacccc

SEQ ID NO: 402478 - DNA, 15 bp, Homo sapiens
gactttccaccccct

SEQ ID NO: 402479 - DNA, 16 bp, Homo sapiens
gactttccaccccctc

SEQ ID NO: 402480 - DNA, 13 bp, Homo sapiens
gagacggcagccc

SEQ ID NO: 402481 - DNA, 15 bp, Homo sapiens
gagacggcagcccca

SEQ ID NO: 402482 - DNA, 13 bp, Homo sapiens
gagacgggcatcg

SEQ ID NO: 402483 - DNA, 22 bp, Homo sapiens
gagacggtcatgcaagaaagca

SEQ ID NO: 402484 - DNA, 16 bp, Homo sapiens
gagactagggaaggga

SEQ ID NO: 402485 - DNA, 13 bp, Homo sapiens
gagactcagacag

SEQ ID NO: 402486 - DNA, 15 bp, Homo sapiens
gagactcagagggag

SEQ ID NO: 402487 - DNA, 14 bp, Homo sapiens
gagactcaggccca

SEQ ID NO: 402488 - DNA, 15 bp, Homo sapiens
gagactcaggcccac

SEQ ID NO: 402489 - DNA, 23 bp, Homo sapiens
gagactccagaatctgctgttgc

SEQ ID NO: 402490 - DNA, 14 bp, Homo sapiens
gagactcccaggag

SEQ ID NO: 402491 - DNA, 16 bp, Homo sapiens
gagactcccaggagtt

SEQ ID NO: 402492 - DNA, 14 bp, Homo sapiens
gagactcctcgggc

SEQ ID NO: 402493 - DNA, 17 bp, Homo sapiens
gagactcctgccctgtt

SEQ ID NO: 402494 - DNA, 15 bp, Homo sapiens
gagactgaaagcagc

SEQ ID NO: 402495 - DNA, 13 bp, Homo sapiens
gagactgcccacc

SEQ ID NO: 402496 - DNA, 16 bp, Homo sapiens
gagactgcccaccctg

SEQ ID NO: 402497 - DNA, 16 bp, Homo sapiens
gagactggcaagagct

SEQ ID NO: 402498 - DNA, 16 bp, Homo sapiens
gagactggcagccagg

SEQ ID NO: 402499 - DNA, 16 bp, Homo sapiens
gagactggccagaggc

SEQ ID NO: 402500 - DNA, 16 bp, Homo sapiens
gagactgggagccact

SEQ ID NO: 402501 - DNA, 15 bp, Homo sapiens
gagactgggatggga

SEQ ID NO: 402502 - DNA, 20 bp, Homo sapiens
gagactgggtgaaagtgact

SEQ ID NO: 402503 - DNA, 13 bp, Homo sapiens
gagactgtagatt

SEQ ID NO: 402504 - DNA, 23 bp, Homo sapiens
gagactgtctcaagagggcactg

SEQ ID NO: 402505 - DNA, 14 bp, Homo sapiens
gagacttcctctgg

SEQ ID NO: 402506 - DNA, 14 bp, Homo sapiens
gagacttgtagttt

SEQ ID NO: 402507 - DNA, 13 bp, Homo sapiens
gagacttgtatga

SEQ ID NO: 402508 - DNA, 20 bp, Homo sapiens
gagagaaaacttatttgagt

SEQ ID NO: 402509 - DNA, 14 bp, Homo sapiens
gagagaaagaatga

SEQ ID NO: 402510 - DNA, 15 bp, Homo sapiens
gagagaaggggagga

SEQ ID NO: 402511 - DNA, 15 bp, Homo sapiens
gagagaatcagacct

SEQ ID NO: 402512 - DNA, 23 bp, Homo sapiens
gagagaccctcactgctggggag

SEQ ID NO: 402513 - DNA, 15 bp, Homo sapiens
gagagacctcatcag

SEQ ID NO: 402514 - DNA, 14 bp, Homo sapiens
gagagactggccag

SEQ ID NO: 402515 - DNA, 17 bp, Homo sapiens
gagagactggccagagg

SEQ ID NO: 402516 - DNA, 12 bp, Homo sapiens
gagagacttgtt

SEQ ID NO: 402517 - DNA, 20 bp, Homo sapiens
gagagacttgttttggatgc

SEQ ID NO: 402518 - DNA, 23 bp, Homo sapiens
gagagagaagtgcccctgctgcc

SEQ ID NO: 402519 - DNA, 15 bp, Homo sapiens
gagagagaatcagac

SEQ ID NO: 402520 - DNA, 14 bp, Homo sapiens
gagagagagaaaga

SEQ ID NO: 402521 - DNA, 16 bp, Homo sapiens
gagagagagagaaaga

SEQ ID NO: 402522 - DNA, 13 bp, Homo sapiens
gagagagccttgg

SEQ ID NO: 402523 - DNA, 21 bp, Homo sapiens
gagagagcttcctgtttctaa

SEQ ID NO: 402524 - DNA, 16 bp, Homo sapiens
gagagaggcgtcctgg

SEQ ID NO: 402525 - DNA, 20 bp, Homo sapiens
gagagagtcttccaggtact

SEQ ID NO: 402526 - DNA, 14 bp, Homo sapiens
gagagagtgagaga

SEQ ID NO: 402527 - DNA, 14 bp, Homo sapiens
gagagagtgtggaa

SEQ ID NO: 402528 - DNA, 13 bp, Homo sapiens
gagagcacaaaga

SEQ ID NO: 402529 - DNA, 14 bp, Homo sapiens
gagagcacaaagat

SEQ ID NO: 402530 - DNA, 13 bp, Homo sapiens
gagagcacttgaa

SEQ ID NO: 402531 - DNA, 23 bp, Homo sapiens
gagagcaggctggcagctctcca

SEQ ID NO: 402532 - DNA, 21 bp, Homo sapiens
gagagccaacctcggcttgtg

SEQ ID NO: 402533 - DNA, 20 bp, Homo sapiens
gagagccaaggcctatgcca

SEQ ID NO: 402534 - DNA, 22 bp, Homo sapiens
gagagccaaggcctatgccacc

SEQ ID NO: 402535 - DNA, 16 bp, Homo sapiens
gagagcccaggcctgc

SEQ ID NO: 402536 - DNA, 20 bp, Homo sapiens
gagagccttaatggatgctc

SEQ ID NO: 402537 - DNA, 15 bp, Homo sapiens
gagagcgccacccgc

SEQ ID NO: 402538 - DNA, 18 bp, Homo sapiens
ccatgcctgagggtggag

SEQ ID NO: 402539 - DNA, 22 bp, Homo sapiens
ccatgcctgcccccctcatctc

SEQ ID NO: 402540 - DNA, 14 bp, Homo sapiens
ccatgcctgtccag

SEQ ID NO: 402541 - DNA, 18 bp, Homo sapiens
ccatgcggccggcctggg

SEQ ID NO: 402542 - DNA, 22 bp, Homo sapiens
ccatgctcaacccccctcccag

SEQ ID NO: 402543 - DNA, 23 bp, Homo sapiens
ccatgctcaacccccctcccaga

SEQ ID NO: 402544 - DNA, 16 bp, Homo sapiens
ccatgctcctcacctg

SEQ ID NO: 402545 - DNA, 15 bp, Homo sapiens
ccatgctcctcactg

SEQ ID NO: 402546 - DNA, 23 bp, Homo sapiens
ccatgctctgccccaagccccca

SEQ ID NO: 402547 - DNA, 15 bp, Homo sapiens
ccatgctgccttcag

SEQ ID NO: 402548 - DNA, 18 bp, Homo sapiens
ccatgctgccttcaggga

SEQ ID NO: 402549 - DNA, 20 bp, Homo sapiens
ccatgctggcggcgcagagg

SEQ ID NO: 402550 - DNA, 16 bp, Homo sapiens
ccatggaagctggcag

SEQ ID NO: 402551 - DNA, 20 bp, Homo sapiens
ccatggaggcacacagctgc

SEQ ID NO: 402552 - DNA, 23 bp, Homo sapiens
ccatggcaattttgtaaattgac

SEQ ID NO: 402553 - DNA, 14 bp, Homo sapiens
ccatggcaccagcc

SEQ ID NO: 402554 - DNA, 15 bp, Homo sapiens
ccatggcaccagccc

SEQ ID NO: 402555 - DNA, 18 bp, Homo sapiens
ccatggcagcatggagag

SEQ ID NO: 402556 - DNA, 17 bp, Homo sapiens
ccatggcaggaaggcgg

SEQ ID NO: 402557 - DNA, 13 bp, Homo sapiens
ccatggcccagca

SEQ ID NO: 402558 - DNA, 14 bp, Homo sapiens
ccatggcccagcag

SEQ ID NO: 402559 - DNA, 17 bp, Homo sapiens
ccatggcccagcagctt

SEQ ID NO: 402560 - DNA, 18 bp, Homo sapiens
ccatggcccagcagcttg

SEQ ID NO: 402561 - DNA, 22 bp, Homo sapiens
ccatggcccagcagcttggctg

SEQ ID NO: 402562 - DNA, 13 bp, Homo sapiens
ccatggccccagc

SEQ ID NO: 402563 - DNA, 14 bp, Homo sapiens
ccatggccccagct

SEQ ID NO: 402564 - DNA, 15 bp, Homo sapiens
ccatggccccagctg

SEQ ID NO: 402565 - DNA, 16 bp, Homo sapiens
ccatggccccagctgg

SEQ ID NO: 402566 - DNA, 13 bp, Homo sapiens
ccatggccctgcc

SEQ ID NO: 402567 - DNA, 16 bp, Homo sapiens
ccatggctcaggcaag

SEQ ID NO: 402568 - DNA, 15 bp, Homo sapiens
ccatggctggcagag

SEQ ID NO: 402569 - DNA, 21 bp, Homo sapiens
ccatggctttcatcctgtgtc

SEQ ID NO: 402570 - DNA, 22 bp, Homo sapiens
ccatggctttcatcctgtgtcc

SEQ ID NO: 402571 - DNA, 20 bp, Homo sapiens
ccatgggcctgctgcgtcag

SEQ ID NO: 402572 - DNA, 23 bp, Homo sapiens
ccatgggcctgctgcgtcagacc

SEQ ID NO: 402573 - DNA, 12 bp, Homo sapiens
ccatgggcctgg

SEQ ID NO: 402574 - DNA, 15 bp, Homo sapiens
ccatgggcctgggcc

SEQ ID NO: 402575 - DNA, 17 bp, Homo sapiens
ccatgggcctgggcctg

SEQ ID NO: 402576 - DNA, 19 bp, Homo sapiens
ccatgggcctgggcctgct

SEQ ID NO: 402577 - DNA, 14 bp, Homo sapiens
ccatgggggcccct

SEQ ID NO: 402578 - DNA, 18 bp, Homo sapiens
ccatggtagactgtgaca

SEQ ID NO: 402579 - DNA, 22 bp, Homo sapiens
ccatggtgcagtgaagaaaatg

SEQ ID NO: 402580 - DNA, 16 bp, Homo sapiens
ccatggtgcctctgga

SEQ ID NO: 402581 - DNA, 23 bp, Homo sapiens
ccatggtgggagagactgtgagg

SEQ ID NO: 402582 - DNA, 16 bp, Homo sapiens
ccatgtaaaacaaaaa

SEQ ID NO: 402583 - DNA, 17 bp, Homo sapiens
ccatgtaaaacaaaaaa

SEQ ID NO: 402584 - DNA, 14 bp, Homo sapiens
ccatgtaaatacca

SEQ ID NO: 402585 - DNA, 16 bp, Homo sapiens
ccatgtacatgaagaa

SEQ ID NO: 402586 - DNA, 19 bp, Homo sapiens
ccatgtaccagtgtactgc

SEQ ID NO: 402587 - DNA, 19 bp, Homo sapiens
ccatgtagaagagggagaa

SEQ ID NO: 402588 - DNA, 14 bp, Homo sapiens
ccatgtagacccct

SEQ ID NO: 402589 - DNA, 23 bp, Homo sapiens
ccatgtatagctagctatttcta

SEQ ID NO: 402590 - DNA, 13 bp, Homo sapiens
ccatgtcactgtg

SEQ ID NO: 402591 - DNA, 19 bp, Homo sapiens
ccatgtccaagtccaacct

SEQ ID NO: 402592 - DNA, 15 bp, Homo sapiens
ccatgtccaatggag

SEQ ID NO: 402593 - DNA, 16 bp, Homo sapiens
ccatgtcgcctctgca

SEQ ID NO: 402594 - DNA, 19 bp, Homo sapiens
ccatgtcgcctctgcattc

SEQ ID NO: 402595 - DNA, 14 bp, Homo sapiens
ccatgtcgcttttg

SEQ ID NO: 402596 - DNA, 13 bp, Homo sapiens
ccatgtgagccac

SEQ ID NO: 402597 - DNA, 17 bp, Homo sapiens
ccatgtgagccaccgct

SEQ ID NO: 402598 - DNA, 20 bp, Homo sapiens
ccatgtgccatctgtacata

SEQ ID NO: 402599 - DNA, 18 bp, Homo sapiens
ccatgtgcctgcaccagg

SEQ ID NO: 402600 - DNA, 21 bp, Homo sapiens
ccatgtgcctgtcacgctctg

SEQ ID NO: 402601 - DNA, 23 bp, Homo sapiens
ccatgtggcagaagtgctctttg

SEQ ID NO: 402602 - DNA, 22 bp, Homo sapiens
ccatgtggccccaggtgccacc

SEQ ID NO: 402603 - DNA, 20 bp, Homo sapiens
ccatgtggccttgagcaagt

SEQ ID NO: 402604 - DNA, 14 bp, Homo sapiens
ccatgtggctgaag

SEQ ID NO: 402605 - DNA, 18 bp, Homo sapiens
ccatgtgggtgaccaggt

SEQ ID NO: 402606 - DNA, 18 bp, Homo sapiens
ccatgtgtgagtgtgtgc

SEQ ID NO: 402607 - DNA, 19 bp, Homo sapiens
ccatgtgttttgcttttat

SEQ ID NO: 402608 - DNA, 20 bp, Homo sapiens
ccatgttagccgggatggtc

SEQ ID NO: 402609 - DNA, 22 bp, Homo sapiens
ccatgttcacaccgctgcactc

SEQ ID NO: 402610 - DNA, 18 bp, Homo sapiens
ccatgttggccaggctgg

SEQ ID NO: 402611 - DNA, 18 bp, Homo sapiens
gagattgccccagagccc

SEQ ID NO: 402612 - DNA, 19 bp, Homo sapiens
gagattgcctcaaaattgt

SEQ ID NO: 402613 - DNA, 18 bp, Homo sapiens
gagatttcttgttgctca

SEQ ID NO: 402614 - DNA, 14 bp, Homo sapiens
gagatttgccagca

SEQ ID NO: 402615 - DNA, 17 bp, Homo sapiens
gagatttgtatttatat

SEQ ID NO: 402616 - DNA, 21 bp, Homo sapiens
gagatttgtatttatattaga

SEQ ID NO: 402617 - DNA, 19 bp, Homo sapiens
gagcaaaaatgccaggcag

SEQ ID NO: 402618 - DNA, 17 bp, Homo sapiens
gagcaaaacaaagctga

SEQ ID NO: 402619 - DNA, 15 bp, Homo sapiens
gagcaaaaggcagct

SEQ ID NO: 402620 - DNA, 24 bp, Homo sapiens
gagcaaaaggcagctcacccctgg

SEQ ID NO: 402621 - DNA, 14 bp, Homo sapiens
gagcaaaataagga

SEQ ID NO: 402622 - DNA, 19 bp, Homo sapiens
gagcaaaataaggaagagg

SEQ ID NO: 402623 - DNA, 15 bp, Homo sapiens
gagcaaacctgcccc

SEQ ID NO: 402624 - DNA, 20 bp, Homo sapiens
gagcaaagatggcttccgtg

SEQ ID NO: 402625 - DNA, 16 bp, Homo sapiens
gagcaaagtctaaagt

SEQ ID NO: 402626 - DNA, 14 bp, Homo sapiens
gagcaacccctgta

SEQ ID NO: 402627 - DNA, 16 bp, Homo sapiens
gagcaactctccactc

SEQ ID NO: 402628 - DNA, 19 bp, Homo sapiens
gagcaactgtgcagcaccc

SEQ ID NO: 402629 - DNA, 15 bp, Homo sapiens
gagcaagacagagac

SEQ ID NO: 402630 - DNA, 14 bp, Homo sapiens
gagcaagactctgt

SEQ ID NO: 402631 - DNA, 20 bp, Homo sapiens
gagcaagccggcaagcgagc

SEQ ID NO: 402632 - DNA, 20 bp, Homo sapiens
gagcaaggacaacctgcccc

SEQ ID NO: 402633 - DNA, 12 bp, Homo sapiens
gagcaaggacat

SEQ ID NO: 402634 - DNA, 17 bp, Homo sapiens
gagcaaggacattgccc

SEQ ID NO: 402635 - DNA, 21 bp, Homo sapiens
gagcaaggacattgccccaag

SEQ ID NO: 402636 - DNA, 21 bp, Homo sapiens
gagcaatgggactggagtcag

SEQ ID NO: 402637 - DNA, 22 bp, Homo sapiens
gagcaatgggactggagtcaga

SEQ ID NO: 402638 - DNA, 21 bp, Homo sapiens
gagcacaagaagtttcttcag

SEQ ID NO: 402639 - DNA, 17 bp, Homo sapiens
gagcacagatctgtttc

SEQ ID NO: 402640 - DNA, 13 bp, Homo sapiens
gagcacagccctg

SEQ ID NO: 402641 - DNA, 14 bp, Homo sapiens
gagcacagccctgg

SEQ ID NO: 402642 - DNA, 13 bp, Homo sapiens
gagcacaggcagc

SEQ ID NO: 402643 - DNA, 17 bp, Homo sapiens
gagcaccacggggtcgg

SEQ ID NO: 402644 - DNA, 21 bp, Homo sapiens
gagcaccagatgacacataaa

SEQ ID NO: 402645 - DNA, 12 bp, Homo sapiens
gagcacccccag

SEQ ID NO: 402646 - DNA, 14 bp, Homo sapiens
gagcacccccagcc

SEQ ID NO: 402647 - DNA, 16 bp, Homo sapiens
gagcacccccagcctc

SEQ ID NO: 402648 - DNA, 18 bp, Homo sapiens
gagcacccccagcctccc

SEQ ID NO: 402649 - DNA, 19 bp, Homo sapiens
gagcacccccagcctcccc

SEQ ID NO: 402650 - DNA, 13 bp, Homo sapiens
gagcaccctctcc

SEQ ID NO: 402651 - DNA, 11 bp, Homo sapiens
gagcacctcag

SEQ ID NO: 402652 - DNA, 13 bp, Homo sapiens
gagcacctcagga

SEQ ID NO: 402653 - DNA, 18 bp, Homo sapiens
gagcacctcaggaccctc

SEQ ID NO: 402654 - DNA, 20 bp, Homo sapiens
gagcacctgaaccccatggg

SEQ ID NO: 402655 - DNA, 23 bp, Homo sapiens
gagcacctgaaccccatgggctt

SEQ ID NO: 402656 - DNA, 19 bp, Homo sapiens
gagcacgggcaaagaaaac

SEQ ID NO: 402657 - DNA, 20 bp, Homo sapiens
gagcacgggcaaagaaaaca

SEQ ID NO: 402658 - DNA, 15 bp, Homo sapiens
gagcactggccagag

SEQ ID NO: 402659 - DNA, 18 bp, Homo sapiens
gagcactggccagagagg

SEQ ID NO: 402660 - DNA, 22 bp, Homo sapiens
gagcactggccagagagggccc

SEQ ID NO: 402661 - DNA, 23 bp, Homo sapiens
gagcactggccagagagggccca

SEQ ID NO: 402662 - DNA, 18 bp, Homo sapiens
gagcacttcacacagaca

SEQ ID NO: 402663 - DNA, 16 bp, Homo sapiens
gagcacttgcgtcctg

SEQ ID NO: 402664 - DNA, 20 bp, Homo sapiens
gagcacttgcgtcctgcaga

SEQ ID NO: 402665 - DNA, 11 bp, Homo sapiens
gagcagagacg

SEQ ID NO: 402666 - DNA, 14 bp, Homo sapiens
gagcagcagctgag

SEQ ID NO: 402667 - DNA, 23 bp, Homo sapiens
gagcagcagctgaggccccaggg

SEQ ID NO: 402668 - DNA, 16 bp, Homo sapiens
gagcagcctccactgt

SEQ ID NO: 402669 - DNA, 18 bp, Homo sapiens
gagcagcctctgccaggc

SEQ ID NO: 402670 - DNA, 22 bp, Homo sapiens
gagcagcctctgccaggcctgt

SEQ ID NO: 402671 - DNA, 15 bp, Homo sapiens
gagcagcctgatggc

SEQ ID NO: 402672 - DNA, 16 bp, Homo sapiens
gagcagcctgatggcc

SEQ ID NO: 402673 - DNA, 19 bp, Homo sapiens
gagcagcctgatggccaag

SEQ ID NO: 402674 - DNA, 13 bp, Homo sapiens
gagcagcctgtgg

SEQ ID NO: 402675 - DNA, 13 bp, Homo sapiens
gagcagctcccca

SEQ ID NO: 402676 - DNA, 21 bp, Homo sapiens
ccattttgtctggctgtggcc

SEQ ID NO: 402677 - DNA, 23 bp, Homo sapiens
ccatttttactaaagcagtgttt

SEQ ID NO: 402678 - DNA, 14 bp, Homo sapiens
ccatttttcccagg

SEQ ID NO: 402679 - DNA, 16 bp, Homo sapiens
ccatttttcccaggac

SEQ ID NO: 402680 - DNA, 22 bp, Homo sapiens
cccaaacattaatcaccaaagt

SEQ ID NO: 402681 - DNA, 23 bp, Homo sapiens
cccaaacattaatcaccaaagta

SEQ ID NO: 402682 - DNA, 14 bp, Homo sapiens
cccaaaccccagcc

SEQ ID NO: 402683 - DNA, 15 bp, Homo sapiens
cccaaaccccagccc

SEQ ID NO: 402684 - DNA, 18 bp, Homo sapiens
cccaaaccctgcttctgc

SEQ ID NO: 402685 - DNA, 18 bp, Homo sapiens
cccaaactcccaggacct

SEQ ID NO: 402686 - DNA, 21 bp, Homo sapiens
cccaaagaatgtttatagcaa

SEQ ID NO: 402687 - DNA, 12 bp, Homo sapiens
cccaaagagctg

SEQ ID NO: 402688 - DNA, 15 bp, Homo sapiens
cccaaagagctgcct

SEQ ID NO: 402689 - DNA, 12 bp, Homo sapiens
cccaaagcccag

SEQ ID NO: 402690 - DNA, 18 bp, Homo sapiens
cccaaagtattcttcttt

SEQ ID NO: 402691 - DNA, 16 bp, Homo sapiens
cccaaagtctgtgtga

SEQ ID NO: 402692 - DNA, 19 bp, Homo sapiens
cccaaatctactgagccac

SEQ ID NO: 402693 - DNA, 18 bp, Homo sapiens
cccaaatcttcctctgga

SEQ ID NO: 402694 - DNA, 21 bp, Homo sapiens
cccaaatggctagaacgtgtt

SEQ ID NO: 402695 - DNA, 17 bp, Homo sapiens
cccaaattgccttcagc

SEQ ID NO: 402696 - DNA, 15 bp, Homo sapiens
cccaacagaggcctc

SEQ ID NO: 402697 - DNA, 15 bp, Homo sapiens
cccaacagccttagc

SEQ ID NO: 402698 - DNA, 21 bp, Homo sapiens
cccaacagccttagctgccag

SEQ ID NO: 402699 - DNA, 18 bp, Homo sapiens
cccaacccccacctcccg

SEQ ID NO: 402700 - DNA, 20 bp, Homo sapiens
cccaaccccgcggtgctctg

SEQ ID NO: 402701 - DNA, 22 bp, Homo sapiens
cccaaccccgcggtgctctggc

SEQ ID NO: 402702 - DNA, 22 bp, Homo sapiens
cccaaccggggagcccccgccc

SEQ ID NO: 402703 - DNA, 13 bp, Homo sapiens
cccaacctcaatg

SEQ ID NO: 402704 - DNA, 15 bp, Homo sapiens
cccaacctcaatgcc

SEQ ID NO: 402705 - DNA, 19 bp, Homo sapiens
cccaacctcaatgccctgc

SEQ ID NO: 402706 - DNA, 12 bp, Homo sapiens
cccaacctcaga

SEQ ID NO: 402707 - DNA, 14 bp, Homo sapiens
cccaacctgctctc

SEQ ID NO: 402708 - DNA, 21 bp, Homo sapiens
cccaacctgctctcctcttgc

SEQ ID NO: 402709 - DNA, 16 bp, Homo sapiens
cccaacgaaaagcaca

SEQ ID NO: 402710 - DNA, 19 bp, Homo sapiens
cccaacgaaaagcacatcc

SEQ ID NO: 402711 - DNA, 23 bp, Homo sapiens
cccaactactattgtagagtggt

SEQ ID NO: 402712 - DNA, 15 bp, Homo sapiens
cccaactcactgtgc

SEQ ID NO: 402713 - DNA, 18 bp, Homo sapiens
cccaactccaggggcacc

SEQ ID NO: 402714 - DNA, 12 bp, Homo sapiens
cccaactcccag

SEQ ID NO: 402715 - DNA, 13 bp, Homo sapiens
cccaactcccagc

SEQ ID NO: 402716 - DNA, 16 bp, Homo sapiens
cccaactctccccagt

SEQ ID NO: 402717 - DNA, 23 bp, Homo sapiens
cccaactctccccagtgcctgcc

SEQ ID NO: 402718 - DNA, 14 bp, Homo sapiens
cccaactctggcct

SEQ ID NO: 402719 - DNA, 19 bp, Homo sapiens
cccaactgacttctgctag

SEQ ID NO: 402720 - DNA, 15 bp, Homo sapiens
cccaacttaagttta

SEQ ID NO: 402721 - DNA, 22 bp, Homo sapiens
cccaagaacagcaggcccacct

SEQ ID NO: 402722 - DNA, 23 bp, Homo sapiens
cccaagaacagcaggcccaccta

SEQ ID NO: 402723 - DNA, 21 bp, Homo sapiens
cccaagaatagatgctgactg

SEQ ID NO: 402724 - DNA, 15 bp, Homo sapiens
cccaagaatgggagg

SEQ ID NO: 402725 - DNA, 18 bp, Homo sapiens
cccaagacagatgcccca

SEQ ID NO: 402726 - DNA, 22 bp, Homo sapiens
cccaagacttggtgtcctttcc

SEQ ID NO: 402727 - DNA, 16 bp, Homo sapiens
cccaagagcagagtct

SEQ ID NO: 402728 - DNA, 17 bp, Homo sapiens
cccaagagcagagtctg

SEQ ID NO: 402729 - DNA, 22 bp, Homo sapiens
cccaagagcagagtctgggcct

SEQ ID NO: 402730 - DNA, 23 bp, Homo sapiens
cccaagagcagagtctgggcctc

SEQ ID NO: 402731 - DNA, 14 bp, Homo sapiens
cccaagaggctagc

SEQ ID NO: 402732 - DNA, 20 bp, Homo sapiens
cccaagaggctagccccagg

SEQ ID NO: 402733 - DNA, 16 bp, Homo sapiens
cccaagagtggtggca

SEQ ID NO: 402734 - DNA, 19 bp, Homo sapiens
cccaagatgagctgcagcc

SEQ ID NO: 402735 - DNA, 15 bp, Homo sapiens
cccaagcagccagcc

SEQ ID NO: 402736 - DNA, 20 bp, Homo sapiens
cccaagcgttcctggccttc

SEQ ID NO: 402737 - DNA, 22 bp, Homo sapiens
cccaagcgttcctggccttctg

SEQ ID NO: 402738 - DNA, 11 bp, Homo sapiens
cccaagctgga

SEQ ID NO: 402739 - DNA, 20 bp, Homo sapiens
cccaagcttaatagccctcc

SEQ ID NO: 402740 - DNA, 23 bp, Homo sapiens
cccaaggagctgatttccaggcc

SEQ ID NO: 402741 - DNA, 21 bp, Homo sapiens
gagcccagaagctcaaggctg

SEQ ID NO: 402742 - DNA, 16 bp, Homo sapiens
gagcccagacctcccc

SEQ ID NO: 402743 - DNA, 21 bp, Homo sapiens
gagcccagacctcccctcttc

SEQ ID NO: 402744 - DNA, 18 bp, Homo sapiens
gagcccagccctgttctg

SEQ ID NO: 402745 - DNA, 12 bp, Homo sapiens
gagcccaggaag

SEQ ID NO: 402746 - DNA, 23 bp, Homo sapiens
gagcccaggcctggcctcggggc

SEQ ID NO: 402747 - DNA, 14 bp, Homo sapiens
gagccccactcccg

SEQ ID NO: 402748 - DNA, 16 bp, Homo sapiens
gagccccagccagccc

SEQ ID NO: 402749 - DNA, 17 bp, Homo sapiens
gagccccagccagccct

SEQ ID NO: 402750 - DNA, 20 bp, Homo sapiens
gagcccccaccttgatccca

SEQ ID NO: 402751 - DNA, 22 bp, Homo sapiens
gagcccccagatagagctgggt

SEQ ID NO: 402752 - DNA, 13 bp, Homo sapiens
gagccccctgcac

SEQ ID NO: 402753 - DNA, 15 bp, Homo sapiens
gagccccctgtgccc

SEQ ID NO: 402754 - DNA, 17 bp, Homo sapiens
gagccccctgtgcccac

SEQ ID NO: 402755 - DNA, 21 bp, Homo sapiens
gagccccctgtgcccacccag

SEQ ID NO: 402756 - DNA, 18 bp, Homo sapiens
gagcccctatcctgcacc

SEQ ID NO: 402757 - DNA, 17 bp, Homo sapiens
gagcccctccccagcca

SEQ ID NO: 402758 - DNA, 12 bp, Homo sapiens
gagcccctcctc

SEQ ID NO: 402759 - DNA, 22 bp, Homo sapiens
gagcccctcctctcctcgtccg

SEQ ID NO: 402760 - DNA, 19 bp, Homo sapiens
gagcccctcctctgagcag

SEQ ID NO: 402761 - DNA, 17 bp, Homo sapiens
gagcccgatattctccc

SEQ ID NO: 402762 - DNA, 15 bp, Homo sapiens
gagcccgcccacctg

SEQ ID NO: 402763 - DNA, 21 bp, Homo sapiens
gagccctcctggaatggagct

SEQ ID NO: 402764 - DNA, 23 bp, Homo sapiens
gagccctcctggaatggagctgt

SEQ ID NO: 402765 - DNA, 18 bp, Homo sapiens
gagccctccttcttgccc

SEQ ID NO: 402766 - DNA, 22 bp, Homo sapiens
gagccctccttcttgccctgag

SEQ ID NO: 402767 - DNA, 13 bp, Homo sapiens
gagccctgccctc

SEQ ID NO: 402768 - DNA, 23 bp, Homo sapiens
gagcccttagccttgctgtagag

SEQ ID NO: 402769 - DNA, 18 bp, Homo sapiens
gagcccttcactgccatg

SEQ ID NO: 402770 - DNA, 19 bp, Homo sapiens
gagcccttcactgccatga

SEQ ID NO: 402771 - DNA, 17 bp, Homo sapiens
gagcccttgcacaggcc

SEQ ID NO: 402772 - DNA, 15 bp, Homo sapiens
gagccgagctctcct

SEQ ID NO: 402773 - DNA, 22 bp, Homo sapiens
gagccgagctctcctgggccag

SEQ ID NO: 402774 - DNA, 17 bp, Homo sapiens
gagccgcctctggttcc

SEQ ID NO: 402775 - DNA, 23 bp, Homo sapiens
gagccgcctctggttccactcag

SEQ ID NO: 402776 - DNA, 14 bp, Homo sapiens
gagccgggccgcag

SEQ ID NO: 402777 - DNA, 14 bp, Homo sapiens
gagcctactgtctc

SEQ ID NO: 402778 - DNA, 16 bp, Homo sapiens
gagcctcccccaaagc

SEQ ID NO: 402779 - DNA, 22 bp, Homo sapiens
gagcctcgcccctccagtgttg

SEQ ID NO: 402780 - DNA, 21 bp, Homo sapiens
gagcctctccttgccccagtc

SEQ ID NO: 402781 - DNA, 14 bp, Homo sapiens
gagcctctgcagac

SEQ ID NO: 402782 - DNA, 16 bp, Homo sapiens
gagcctgagccttaga

SEQ ID NO: 402783 - DNA, 15 bp, Homo sapiens
gagcctgaggcagga

SEQ ID NO: 402784 - DNA, 15 bp, Homo sapiens
gagcctgagtcaggg

SEQ ID NO: 402785 - DNA, 21 bp, Homo sapiens
gagcctgagtcagggcccaga

SEQ ID NO: 402786 - DNA, 22 bp, Homo sapiens
gagcctgagtcagggcccagag

SEQ ID NO: 402787 - DNA, 15 bp, Homo sapiens
gagcctgcagggtgg

SEQ ID NO: 402788 - DNA, 20 bp, Homo sapiens
gagcctgcagggtggtgctg

SEQ ID NO: 402789 - DNA, 14 bp, Homo sapiens
gagcctgcatctgt

SEQ ID NO: 402790 - DNA, 20 bp, Homo sapiens
gagcctgccccagctgggct

SEQ ID NO: 402791 - DNA, 19 bp, Homo sapiens
gagcctgcggcctgctgga

SEQ ID NO: 402792 - DNA, 18 bp, Homo sapiens
gagcctgcgtggcctggg

SEQ ID NO: 402793 - DNA, 13 bp, Homo sapiens
gagcctgtctctc

SEQ ID NO: 402794 - DNA, 16 bp, Homo sapiens
gagccttgctgccaag

SEQ ID NO: 402795 - DNA, 18 bp, Homo sapiens
gagcctttggtgaataac

SEQ ID NO: 402796 - DNA, 14 bp, Homo sapiens
gagcgccacccgcc

SEQ ID NO: 402797 - DNA, 22 bp, Homo sapiens
gagcgccacccgcccgcccccg

SEQ ID NO: 402798 - DNA, 16 bp, Homo sapiens
gagcgcgtgccttccc

SEQ ID NO: 402799 - DNA, 15 bp, Homo sapiens
gagcgctcctctgcc

SEQ ID NO: 402800 - DNA, 20 bp, Homo sapiens
gagcgctcctctgccttgga

SEQ ID NO: 402801 - DNA, 14 bp, Homo sapiens
gagcgctggcctct

SEQ ID NO: 402802 - DNA, 18 bp, Homo sapiens
gagcggagaaaggaaggg

SEQ ID NO: 402803 - DNA, 21 bp, Homo sapiens
gagcggagaaaggaagggctg

SEQ ID NO: 402804 - DNA, 13 bp, Homo sapiens
gagcggagcccga

SEQ ID NO: 402805 - DNA, 17 bp, Homo sapiens
gagcggccgcctgtcct

SEQ ID NO: 402806 - DNA, 17 bp, Homo sapiens
gagcgggacctgtggct

SEQ ID NO: 402807 - DNA, 21 bp, Homo sapiens
gagcgtgtagcgtcctgagga

SEQ ID NO: 402808 - DNA, 15 bp, Homo sapiens
gagcgtttgctgtgc

SEQ ID NO: 402809 - DNA, 15 bp, Homo sapiens
gagctaacactggcc

SEQ ID NO: 402810 - DNA, 17 bp, Homo sapiens
gagctactctcttgcca

SEQ ID NO: 402811 - DNA, 21 bp, Homo sapiens
gagctactctcttgccagcat

SEQ ID NO: 402812 - DNA, 15 bp, Homo sapiens
gagctaggaaagagt

SEQ ID NO: 402813 - DNA, 12 bp, Homo sapiens
cccaccccacac

SEQ ID NO: 402814 - DNA, 14 bp, Homo sapiens
cccaccccacactt

SEQ ID NO: 402815 - DNA, 19 bp, Homo sapiens
cccacccccaaagacctgc

SEQ ID NO: 402816 - DNA, 20 bp, Homo sapiens
cccacccccaaagacctgcc

SEQ ID NO: 402817 - DNA, 19 bp, Homo sapiens
cccacccccttctctgctc

SEQ ID NO: 402818 - DNA, 18 bp, Homo sapiens
cccacccctaagtgccca

SEQ ID NO: 402819 - DNA, 19 bp, Homo sapiens
cccacccctacagcctgca

SEQ ID NO: 402820 - DNA, 15 bp, Homo sapiens
cccacccctcttccc

SEQ ID NO: 402821 - DNA, 14 bp, Homo sapiens
cccacccctgccca

SEQ ID NO: 402822 - DNA, 21 bp, Homo sapiens
cccacccctgctgccgccact

SEQ ID NO: 402823 - DNA, 17 bp, Homo sapiens
cccacccgccccagaga

SEQ ID NO: 402824 - DNA, 23 bp, Homo sapiens
cccacccgccccagagactgccc

SEQ ID NO: 402825 - DNA, 17 bp, Homo sapiens
cccacccggccacagct

SEQ ID NO: 402826 - DNA, 20 bp, Homo sapiens
cccacccggccacagctgct

SEQ ID NO: 402827 - DNA, 21 bp, Homo sapiens
cccacccggccacagctgctg

SEQ ID NO: 402828 - DNA, 22 bp, Homo sapiens
cccacccgtcttcaatctctgt

SEQ ID NO: 402829 - DNA, 17 bp, Homo sapiens
cccacccgttaatttaa

SEQ ID NO: 402830 - DNA, 22 bp, Homo sapiens
cccaccctaatttgcccttcag

SEQ ID NO: 402831 - DNA, 18 bp, Homo sapiens
cccaccctccatgctcct

SEQ ID NO: 402832 - DNA, 20 bp, Homo sapiens
cccaccctcccctctcctga

SEQ ID NO: 402833 - DNA, 12 bp, Homo sapiens
cccaccctgggc

SEQ ID NO: 402834 - DNA, 18 bp, Homo sapiens
cccaccctgggcctcccg

SEQ ID NO: 402835 - DNA, 13 bp, Homo sapiens
cccacccttctcc

SEQ ID NO: 402836 - DNA, 22 bp, Homo sapiens
cccacccttctcccctgccccg

SEQ ID NO: 402837 - DNA, 14 bp, Homo sapiens
cccaccgaccccct

SEQ ID NO: 402838 - DNA, 19 bp, Homo sapiens
cccaccgaccccctttcta

SEQ ID NO: 402839 - DNA, 18 bp, Homo sapiens
cccaccgaggttcccagg

SEQ ID NO: 402840 - DNA, 15 bp, Homo sapiens
cccaccgatggagcc

SEQ ID NO: 402841 - DNA, 20 bp, Homo sapiens
cccacctaccttcaaagctg

SEQ ID NO: 402842 - DNA, 18 bp, Homo sapiens
cccacctacttgtgactg

SEQ ID NO: 402843 - DNA, 12 bp, Homo sapiens
cccacctcagcc

SEQ ID NO: 402844 - DNA, 14 bp, Homo sapiens
cccacctcagcctc

SEQ ID NO: 402845 - DNA, 17 bp, Homo sapiens
cccacctcagcctcctg

SEQ ID NO: 402846 - DNA, 16 bp, Homo sapiens
cccacctcatgcctgg

SEQ ID NO: 402847 - DNA, 23 bp, Homo sapiens
cccacctcatgcctggcccccct

SEQ ID NO: 402848 - DNA, 20 bp, Homo sapiens
cccacctccacccagcccct

SEQ ID NO: 402849 - DNA, 14 bp, Homo sapiens
cccacctccacccc

SEQ ID NO: 402850 - DNA, 14 bp, Homo sapiens
cccacctcccggtg

SEQ ID NO: 402851 - DNA, 15 bp, Homo sapiens
cccacctcccggtgt

SEQ ID NO: 402852 - DNA, 13 bp, Homo sapiens
cccacctccctgc

SEQ ID NO: 402853 - DNA, 13 bp, Homo sapiens
cccacctctgagg

SEQ ID NO: 402854 - DNA, 14 bp, Homo sapiens
cccacctctgagga

SEQ ID NO: 402855 - DNA, 15 bp, Homo sapiens
cccacctctgaggac

SEQ ID NO: 402856 - DNA, 14 bp, Homo sapiens
cccacctctgctgc

SEQ ID NO: 402857 - DNA, 21 bp, Homo sapiens
cccacctctgctgcccacggc

SEQ ID NO: 402858 - DNA, 16 bp, Homo sapiens
cccacctcttttccta

SEQ ID NO: 402859 - DNA, 19 bp, Homo sapiens
cccacctgaaagcctgtct

SEQ ID NO: 402860 - DNA, 21 bp, Homo sapiens
cccacctgaaagcctgtctct

SEQ ID NO: 402861 - DNA, 22 bp, Homo sapiens
cccacctgaaagcctgtctctt

SEQ ID NO: 402862 - DNA, 17 bp, Homo sapiens
cccacctgacaatggca

SEQ ID NO: 402863 - DNA, 12 bp, Homo sapiens
cccacctgagct

SEQ ID NO: 402864 - DNA, 15 bp, Homo sapiens
cccacctgagctttg

SEQ ID NO: 402865 - DNA, 19 bp, Homo sapiens
cccacctgcatcagcctct

SEQ ID NO: 402866 - DNA, 21 bp, Homo sapiens
cccacctgcatcagcctctgg

SEQ ID NO: 402867 - DNA, 12 bp, Homo sapiens
cccacctgccca

SEQ ID NO: 402868 - DNA, 22 bp, Homo sapiens
cccacctgggccctaggcatac

SEQ ID NO: 402869 - DNA, 16 bp, Homo sapiens
cccaccttgccaagct

SEQ ID NO: 402870 - DNA, 18 bp, Homo sapiens
cccaccttgttggagcct

SEQ ID NO: 402871 - DNA, 21 bp, Homo sapiens
gagctggatttgggagctctg

SEQ ID NO: 402872 - DNA, 14 bp, Homo sapiens
gagctggctggcag

SEQ ID NO: 402873 - DNA, 15 bp, Homo sapiens
gagctggctggcagg

SEQ ID NO: 402874 - DNA, 14 bp, Homo sapiens
gagctggggccaca

SEQ ID NO: 402875 - DNA, 19 bp, Homo sapiens
gagctgggggccatgagct

SEQ ID NO: 402876 - DNA, 14 bp, Homo sapiens
gagctggggggaag

SEQ ID NO: 402877 - DNA, 20 bp, Homo sapiens
gagctgggtaccaggccacc

SEQ ID NO: 402878 - DNA, 18 bp, Homo sapiens
gagctggtgacagccttg

SEQ ID NO: 402879 - DNA, 14 bp, Homo sapiens
gagctggtgcatta

SEQ ID NO: 402880 - DNA, 17 bp, Homo sapiens
gagctggtgcattacag

SEQ ID NO: 402881 - DNA, 21 bp, Homo sapiens
gagctggtgcccggagattgg

SEQ ID NO: 402882 - DNA, 14 bp, Homo sapiens
gagctggtgtctga

SEQ ID NO: 402883 - DNA, 21 bp, Homo sapiens
gagctgtataactgtgcagag

SEQ ID NO: 402884 - DNA, 14 bp, Homo sapiens
gagctgtcaggcag

SEQ ID NO: 402885 - DNA, 13 bp, Homo sapiens
gagctgtcttgtc

SEQ ID NO: 402886 - DNA, 19 bp, Homo sapiens
gagctgtgttttgtctgag

SEQ ID NO: 402887 - DNA, 13 bp, Homo sapiens
gagctgttatctt

SEQ ID NO: 402888 - DNA, 17 bp, Homo sapiens
gagctgtttatggcctc

SEQ ID NO: 402889 - DNA, 22 bp, Homo sapiens
gagctgtttatggcctcagctg

SEQ ID NO: 402890 - DNA, 14 bp, Homo sapiens
gagctgttttggat

SEQ ID NO: 402891 - DNA, 13 bp, Homo sapiens
gagcttacctccc

SEQ ID NO: 402892 - DNA, 16 bp, Homo sapiens
gagcttattggccact

SEQ ID NO: 402893 - DNA, 17 bp, Homo sapiens
gagcttattggccactg

SEQ ID NO: 402894 - DNA, 20 bp, Homo sapiens
gagcttcaagtctgtgcctg

SEQ ID NO: 402895 - DNA, 15 bp, Homo sapiens
gagcttcctgtttct

SEQ ID NO: 402896 - DNA, 19 bp, Homo sapiens
gagcttcggttctccagaa

SEQ ID NO: 402897 - DNA, 20 bp, Homo sapiens
gagcttcggttctccagaat

SEQ ID NO: 402898 - DNA, 16 bp, Homo sapiens
gagcttgagctcccct

SEQ ID NO: 402899 - DNA, 19 bp, Homo sapiens
gagcttgattctaaagggg

SEQ ID NO: 402900 - DNA, 16 bp, Homo sapiens
gagcttgtacatattg

SEQ ID NO: 402901 - DNA, 21 bp, Homo sapiens
gagctttccggggaggagcct

SEQ ID NO: 402902 - DNA, 23 bp, Homo sapiens
gagctttctgtccttttggcact

SEQ ID NO: 402903 - DNA, 21 bp, Homo sapiens
gagctttgcagccaaggtgct

SEQ ID NO: 402904 - DNA, 14 bp, Homo sapiens
gagctttggacaca

SEQ ID NO: 402905 - DNA, 23 bp, Homo sapiens
gagctttggggacagttggcaga

SEQ ID NO: 402906 - DNA, 14 bp, Homo sapiens
gagctttgttactg

SEQ ID NO: 402907 - DNA, 20 bp, Homo sapiens
gaggaaaaccaagccgtggc

SEQ ID NO: 402908 - DNA, 20 bp, Homo sapiens
gaggaaactcacctgctggc

SEQ ID NO: 402909 - DNA, 16 bp, Homo sapiens
gaggaaattaaataat

SEQ ID NO: 402910 - DNA, 14 bp, Homo sapiens
gaggaacaaggcaa

SEQ ID NO: 402911 - DNA, 14 bp, Homo sapiens
gaggaaccagagcc

SEQ ID NO: 402912 - DNA, 15 bp, Homo sapiens
gaggaaccagagcca

SEQ ID NO: 402913 - DNA, 19 bp, Homo sapiens
gaggaacgtggttcagaga

SEQ ID NO: 402914 - DNA, 17 bp, Homo sapiens
gaggaactggtccaggc

SEQ ID NO: 402915 - DNA, 19 bp, Homo sapiens
gaggaactggtccaggcca

SEQ ID NO: 402916 - DNA, 12 bp, Homo sapiens
gaggaagcagaa

SEQ ID NO: 402917 - DNA, 15 bp, Homo sapiens
gaggaagccttgccc

SEQ ID NO: 402918 - DNA, 21 bp, Homo sapiens
gaggaagctccagtcctgctc

SEQ ID NO: 402919 - DNA, 14 bp, Homo sapiens
gaggaaggagagaa

SEQ ID NO: 402920 - DNA, 17 bp, Homo sapiens
gaggaaggatgcaaagt

SEQ ID NO: 402921 - DNA, 21 bp, Homo sapiens
gaggaagggactggtccaggc

SEQ ID NO: 402922 - DNA, 14 bp, Homo sapiens
gaggaagtggtgtt

SEQ ID NO: 402923 - DNA, 23 bp, Homo sapiens
gaggaatatgacggaagaacata

SEQ ID NO: 402924 - DNA, 13 bp, Homo sapiens
gaggaatttctga

SEQ ID NO: 402925 - DNA, 15 bp, Homo sapiens
gaggacaggagaggg

SEQ ID NO: 402926 - DNA, 14 bp, Homo sapiens
gaggacagggaggg

SEQ ID NO: 402927 - DNA, 13 bp, Homo sapiens
gaggacagtgctg

SEQ ID NO: 402928 - DNA, 14 bp, Homo sapiens
gaggacagtgctga

SEQ ID NO: 402929 - DNA, 19 bp, Homo sapiens
gaggacagtgctgacccca

SEQ ID NO: 402930 - DNA, 13 bp, Homo sapiens
gaggaccaaagat

SEQ ID NO: 402931 - DNA, 13 bp, Homo sapiens
gaggaccactcct

SEQ ID NO: 402932 - DNA, 23 bp, Homo sapiens
gaggacccgggaccacagctgct

SEQ ID NO: 402933 - DNA, 15 bp, Homo sapiens
gaggacctctgggct

SEQ ID NO: 402934 - DNA, 14 bp, Homo sapiens
gaggacctgggggg

SEQ ID NO: 402935 - DNA, 22 bp, Homo sapiens
gaggacgagcgattgaggtgta

SEQ ID NO: 402936 - DNA, 16 bp, Homo sapiens
gaggacggagttcaga

SEQ ID NO: 402937 - DNA, 18 bp, Homo sapiens
gaggacggagttcagagg

SEQ ID NO: 402938 - DNA, 21 bp, Homo sapiens
gaggacggagttcagagggtg

SEQ ID NO: 402939 - DNA, 15 bp, Homo sapiens
gaggacgtgggcggc

SEQ ID NO: 402940 - DNA, 16 bp, Homo sapiens
gaggacgtgggcggca

SEQ ID NO: 402941 - DNA, 18 bp, Homo sapiens
gaggacgtgggcggcaga

SEQ ID NO: 402942 - DNA, 20 bp, Homo sapiens
gaggacgtgggcggcagaga

SEQ ID NO: 402943 - DNA, 13 bp, Homo sapiens
gaggactccctcc

SEQ ID NO: 402944 - DNA, 23 bp, Homo sapiens
gaggactttgattgcacattgtt

SEQ ID NO: 402945 - DNA, 18 bp, Homo sapiens
gaggagaaaggtgaaaca

SEQ ID NO: 402946 - DNA, 17 bp, Homo sapiens
gaggagactcaggccca

SEQ ID NO: 402947 - DNA, 18 bp, Homo sapiens
gaggagactcaggcccac

SEQ ID NO: 402948 - DNA, 13 bp, Homo sapiens
gaggagagacggt

SEQ ID NO: 402949 - DNA, 20 bp, Homo sapiens
gaggagagtggttgttgcca

SEQ ID NO: 402950 - DNA, 16 bp, Homo sapiens
gaggagattgctctgg

SEQ ID NO: 402951 - DNA, 18 bp, Homo sapiens
cccagagcttattggcca

SEQ ID NO: 402952 - DNA, 20 bp, Homo sapiens
cccagagcttattggccact

SEQ ID NO: 402953 - DNA, 21 bp, Homo sapiens
cccagagcttattggccactg

SEQ ID NO: 402954 - DNA, 22 bp, Homo sapiens
cccagaggagctgggagccggg

SEQ ID NO: 402955 - DNA, 13 bp, Homo sapiens
cccagaggaggca

SEQ ID NO: 402956 - DNA, 16 bp, Homo sapiens
cccagaggcacagccg

SEQ ID NO: 402957 - DNA, 20 bp, Homo sapiens
cccagaggctcctggagcca

SEQ ID NO: 402958 - DNA, 23 bp, Homo sapiens
cccagaggtgggatcctccctca

SEQ ID NO: 402959 - DNA, 21 bp, Homo sapiens
cccagaggtggggaagagagc

SEQ ID NO: 402960 - DNA, 23 bp, Homo sapiens
cccagaggtggggaagagagcct

SEQ ID NO: 402961 - DNA, 18 bp, Homo sapiens
cccagaggttatctgcct

SEQ ID NO: 402962 - DNA, 21 bp, Homo sapiens
cccagaggttatctgcctggc

SEQ ID NO: 402963 - DNA, 22 bp, Homo sapiens
cccagaggttatctgcctggcc

SEQ ID NO: 402964 - DNA, 13 bp, Homo sapiens
cccagagtagccc

SEQ ID NO: 402965 - DNA, 14 bp, Homo sapiens
cccagagtagccca

SEQ ID NO: 402966 - DNA, 21 bp, Homo sapiens
cccagagtgactgacggctgt

SEQ ID NO: 402967 - DNA, 15 bp, Homo sapiens
cccagatagagctgg

SEQ ID NO: 402968 - DNA, 23 bp, Homo sapiens
cccagatagagctgggtggcctg

SEQ ID NO: 402969 - DNA, 16 bp, Homo sapiens
cccagatcccagaagg

SEQ ID NO: 402970 - DNA, 13 bp, Homo sapiens
cccagatctgcct

SEQ ID NO: 402971 - DNA, 14 bp, Homo sapiens
cccagatctgcctg

SEQ ID NO: 402972 - DNA, 16 bp, Homo sapiens
cccagatctgcctggg

SEQ ID NO: 402973 - DNA, 21 bp, Homo sapiens
cccagatctgcctgggcctgt

SEQ ID NO: 402974 - DNA, 20 bp, Homo sapiens
cccagatctggtcccttgca

SEQ ID NO: 402975 - DNA, 21 bp, Homo sapiens
cccagatgcctcctctgtcct

SEQ ID NO: 402976 - DNA, 21 bp, Homo sapiens
cccagcaaccctcctatcacc

SEQ ID NO: 402977 - DNA, 15 bp, Homo sapiens
cccagcaaggcacag

SEQ ID NO: 402978 - DNA, 20 bp, Homo sapiens
cccagcaaggcacaggctcc

SEQ ID NO: 402979 - DNA, 15 bp, Homo sapiens
cccagcacctgccag

SEQ ID NO: 402980 - DNA, 17 bp, Homo sapiens
cccagcacctgccaggg

SEQ ID NO: 402981 - DNA, 21 bp, Homo sapiens
cccagcacctgccagggcccg

SEQ ID NO: 402982 - DNA, 12 bp, Homo sapiens
cccagcactttg

SEQ ID NO: 402983 - DNA, 21 bp, Homo sapiens
cccagcactttgggaggccta

SEQ ID NO: 402984 - DNA, 20 bp, Homo sapiens
cccagcagagccgttcctgg

SEQ ID NO: 402985 - DNA, 18 bp, Homo sapiens
cccagcagcccaagctta

SEQ ID NO: 402986 - DNA, 17 bp, Homo sapiens
cccagcagccctaagga

SEQ ID NO: 402987 - DNA, 14 bp, Homo sapiens
cccagcagcctccc

SEQ ID NO: 402988 - DNA, 15 bp, Homo sapiens
cccagcagcggccca

SEQ ID NO: 402989 - DNA, 17 bp, Homo sapiens
cccagcagcggcccaga

SEQ ID NO: 402990 - DNA, 20 bp, Homo sapiens
cccagcagcttggctgagcc

SEQ ID NO: 402991 - DNA, 21 bp, Homo sapiens
cccagcagcttggctgagccc

SEQ ID NO: 402992 - DNA, 15 bp, Homo sapiens
cccagcaggtgggga

SEQ ID NO: 402993 - DNA, 16 bp, Homo sapiens
cccagcaggtggggag

SEQ ID NO: 402994 - DNA, 20 bp, Homo sapiens
cccagcattccagctctgcc

SEQ ID NO: 402995 - DNA, 21 bp, Homo sapiens
cccagcattccagctctgccc

SEQ ID NO: 402996 - DNA, 20 bp, Homo sapiens
cccagccaccaccactgtcc

SEQ ID NO: 402997 - DNA, 14 bp, Homo sapiens
cccagccacccgga

SEQ ID NO: 402998 - DNA, 23 bp, Homo sapiens
cccagccacccggatctccaggc

SEQ ID NO: 402999 - DNA, 13 bp, Homo sapiens
cccagccagcagg

SEQ ID NO: 403000 - DNA, 17 bp, Homo sapiens
cccagccaggaggggct

SEQ ID NO: 403001 - DNA, 20 bp, Homo sapiens
ctttgaaatatgcatgtact

SEQ ID NO: 403002 - DNA, 22 bp, Homo sapiens
ctttgaacacatctcttagtcc

SEQ ID NO: 403003 - DNA, 17 bp, Homo sapiens
ctttgaataaaaatgca

SEQ ID NO: 403004 - DNA, 13 bp, Homo sapiens
ctttgaatgcttt

SEQ ID NO: 403005 - DNA, 16 bp, Homo sapiens
ctttgaatgctttttg

SEQ ID NO: 403006 - DNA, 13 bp, Homo sapiens
ctttgacatgaaa

SEQ ID NO: 403007 - DNA, 21 bp, Homo sapiens
ctttgacgagtcaccttccag

SEQ ID NO: 403008 - DNA, 21 bp, Homo sapiens
ctttgactcttttgccattaa

SEQ ID NO: 403009 - DNA, 21 bp, Homo sapiens
ctttgactgatgctgagattc

SEQ ID NO: 403010 - DNA, 22 bp, Homo sapiens
ctttgacttcagctgcctgaaa

SEQ ID NO: 403011 - DNA, 17 bp, Homo sapiens
ctttgactttatctcct

SEQ ID NO: 403012 - DNA, 16 bp, Homo sapiens
ctttgagaaagaaata

SEQ ID NO: 403013 - DNA, 18 bp, Homo sapiens
ctttgagaaaggattaag

SEQ ID NO: 403014 - DNA, 21 bp, Homo sapiens
ctttgagaaaggattaagata

SEQ ID NO: 403015 - DNA, 21 bp, Homo sapiens
ctttgagataatttaaccctg

SEQ ID NO: 403016 - DNA, 19 bp, Homo sapiens
ctttgaggaggaagcagaa

SEQ ID NO: 403017 - DNA, 13 bp, Homo sapiens
ctttgagggactg

SEQ ID NO: 403018 - DNA, 12 bp, Homo sapiens
ctttgaggtcta

SEQ ID NO: 403019 - DNA, 23 bp, Homo sapiens
ctttgaggttattttccgccaga

SEQ ID NO: 403020 - DNA, 21 bp, Homo sapiens
ctttgagtgtcaggctctgaa

SEQ ID NO: 403021 - DNA, 17 bp, Homo sapiens
ctttgagtttcctcagg

SEQ ID NO: 403022 - DNA, 19 bp, Homo sapiens
ctttgagtttcctcaggct

SEQ ID NO: 403023 - DNA, 16 bp, Homo sapiens
ctttgatgtgtttttg

SEQ ID NO: 403024 - DNA, 17 bp, Homo sapiens
ctttgatgtgtttttgt

SEQ ID NO: 403025 - DNA, 21 bp, Homo sapiens
ctttgattgcacattgttgtt

SEQ ID NO: 403026 - DNA, 17 bp, Homo sapiens
ctttgatttacagtgcc

SEQ ID NO: 403027 - DNA, 21 bp, Homo sapiens
ctttgcaacaataataaatgt

SEQ ID NO: 403028 - DNA, 15 bp, Homo sapiens
ctttgcaacagcact

SEQ ID NO: 403029 - DNA, 13 bp, Homo sapiens
ctttgcaagctta

SEQ ID NO: 403030 - DNA, 13 bp, Homo sapiens
ctttgcacacttc

SEQ ID NO: 403031 - DNA, 16 bp, Homo sapiens
ctttgcacacttcaaa

SEQ ID NO: 403032 - DNA, 17 bp, Homo sapiens
ctttgcaccgtggtcag

SEQ ID NO: 403033 - DNA, 14 bp, Homo sapiens
ctttgcactgaggg

SEQ ID NO: 403034 - DNA, 16 bp, Homo sapiens
ctttgcagacctggga

SEQ ID NO: 403035 - DNA, 18 bp, Homo sapiens
ctttgcaggctctgggct

SEQ ID NO: 403036 - DNA, 19 bp, Homo sapiens
ctttgcaggctctgggctc

SEQ ID NO: 403037 - DNA, 20 bp, Homo sapiens
ctttgcaggctctgggctca

SEQ ID NO: 403038 - DNA, 23 bp, Homo sapiens
ctttgcaggctctgggctcaggg

SEQ ID NO: 403039 - DNA, 14 bp, Homo sapiens
ctttattaaatatt

SEQ ID NO: 403040 - DNA, 15 bp, Homo sapiens
ctttattaacctcag

SEQ ID NO: 403041 - DNA, 19 bp, Homo sapiens
ctttattaacctcagcatt

SEQ ID NO: 403042 - DNA, 18 bp, Homo sapiens
ctttattccttcatttca

SEQ ID NO: 403043 - DNA, 11 bp, Homo sapiens
ctttattcttt

SEQ ID NO: 403044 - DNA, 21 bp, Homo sapiens
ctttattctttaattgttgct

SEQ ID NO: 403045 - DNA, 18 bp, Homo sapiens
ctttatttattaaacttc

SEQ ID NO: 403046 - DNA, 23 bp, Homo sapiens
ctttattttatataataaagtat

SEQ ID NO: 403047 - DNA, 14 bp, Homo sapiens
ctttattttattat

SEQ ID NO: 403048 - DNA, 17 bp, Homo sapiens
ctttattttattattca

SEQ ID NO: 403049 - DNA, 18 bp, Homo sapiens
ctttattttctggtagat

SEQ ID NO: 403050 - DNA, 23 bp, Homo sapiens
ctttattttttaagtatttatat

SEQ ID NO: 403051 - DNA, 19 bp, Homo sapiens
ctttcaaaattaaatctgt

SEQ ID NO: 403052 - DNA, 17 bp, Homo sapiens
ctttcaacttaaatcac

SEQ ID NO: 403053 - DNA, 19 bp, Homo sapiens
ctttcaacttaaatcactg

SEQ ID NO: 403054 - DNA, 17 bp, Homo sapiens
ctttcaagatcttcaac

SEQ ID NO: 403055 - DNA, 22 bp, Homo sapiens
ctttcaatatttatttccagag

SEQ ID NO: 403056 - DNA, 15 bp, Homo sapiens
ctttcaatccacagt

SEQ ID NO: 403057 - DNA, 23 bp, Homo sapiens
ctttcaatccacagtattgttct

SEQ ID NO: 403058 - DNA, 17 bp, Homo sapiens
ctttcacagtaccatct

SEQ ID NO: 403059 - DNA, 19 bp, Homo sapiens
ctttcacagtaccatctga

SEQ ID NO: 403060 - DNA, 15 bp, Homo sapiens
ctttcacccttttct

SEQ ID NO: 403061 - DNA, 15 bp, Homo sapiens
ctttcactgaagtga

SEQ ID NO: 403062 - DNA, 13 bp, Homo sapiens
ctttcactgggga

SEQ ID NO: 403063 - DNA, 14 bp, Homo sapiens
ctttcagaaaacag

SEQ ID NO: 403064 - DNA, 23 bp, Homo sapiens
ctttcagaaaacagaaaaaaaac

SEQ ID NO: 403065 - DNA, 21 bp, Homo sapiens
ctttcagaactgctaccatga

SEQ ID NO: 403066 - DNA, 15 bp, Homo sapiens
ctttcagaatacaat

SEQ ID NO: 403067 - DNA, 18 bp, Homo sapiens
ctttcagagccagtgaag

SEQ ID NO: 403068 - DNA, 12 bp, Homo sapiens
ctttcagatgtc

SEQ ID NO: 403069 - DNA, 15 bp, Homo sapiens
ctttcagatgtcttc

SEQ ID NO: 403070 - DNA, 17 bp, Homo sapiens
ctttcagatgtcttctg

SEQ ID NO: 403071 - DNA, 19 bp, Homo sapiens
ctttcagatgtcttctgcc

SEQ ID NO: 403072 - DNA, 21 bp, Homo sapiens
ctttcagcattaggcttttaa

SEQ ID NO: 403073 - DNA, 20 bp, Homo sapiens
ctttcagccaagaattctta

SEQ ID NO: 403074 - DNA, 17 bp, Homo sapiens
ctttcagcctgcttctt

SEQ ID NO: 403075 - DNA, 17 bp, Homo sapiens
ctttcagctggcagagt

SEQ ID NO: 403076 - DNA, 23 bp, Homo sapiens
ctttcaggaagttgctgagaaat

SEQ ID NO: 403077 - DNA, 21 bp, Homo sapiens
ctttcagtattaaactctcct

SEQ ID NO: 403078 - DNA, 15 bp, Homo sapiens
ctttcatagttctgt

SEQ ID NO: 403079 - DNA, 16 bp, Homo sapiens
ctttcatagttctgtt

SEQ ID NO: 403080 - DNA, 21 bp, Homo sapiens
ctttcatagttctgttaaata

SEQ ID NO: 403081 - DNA, 23 bp, Homo sapiens
ctttcatagttctgttaaatatt

SEQ ID NO: 403082 - DNA, 15 bp, Homo sapiens
ctttcatcctcagca

SEQ ID NO: 403083 - DNA, 22 bp, Homo sapiens
ctttcatgaccactgggcctgc

SEQ ID NO: 403084 - DNA, 13 bp, Homo sapiens
ctttcatttgaaa

SEQ ID NO: 403085 - DNA, 16 bp, Homo sapiens
ctttccaccccctccc

SEQ ID NO: 403086 - DNA, 17 bp, Homo sapiens
ctttccaccccctccct

SEQ ID NO: 403087 - DNA, 22 bp, Homo sapiens
ctttccaccccctccctggcct

SEQ ID NO: 403088 - DNA, 22 bp, Homo sapiens
ctttccaccctattccctaact

SEQ ID NO: 403089 - DNA, 12 bp, Homo sapiens
ctttccactccc

SEQ ID NO: 403090 - DNA, 21 bp, Homo sapiens
ctttccactttgttggccctt

SEQ ID NO: 403091 - DNA, 14 bp, Homo sapiens
ctttccaggaaggc

SEQ ID NO: 403092 - DNA, 18 bp, Homo sapiens
ctttccagggtctttact

SEQ ID NO: 403093 - DNA, 14 bp, Homo sapiens
ctttccatgacagt

SEQ ID NO: 403094 - DNA, 12 bp, Homo sapiens
ctttccattttg

SEQ ID NO: 403095 - DNA, 19 bp, Homo sapiens
ctttcccaaaatgtgcctc

SEQ ID NO: 403096 - DNA, 16 bp, Homo sapiens
ctttcccatcacccct

SEQ ID NO: 403097 - DNA, 23 bp, Homo sapiens
ctttcccatcaccccttccccat

SEQ ID NO: 403098 - DNA, 15 bp, Homo sapiens
ctttccccagaggct

SEQ ID NO: 403099 - DNA, 17 bp, Homo sapiens
ctttccccatactctgt

SEQ ID NO: 403100 - DNA, 18 bp, Homo sapiens
ctttccccatactctgtc

SEQ ID NO: 403101 - DNA, 18 bp, Homo sapiens
ctttcccctcctttgtct

SEQ ID NO: 403102 - DNA, 17 bp, Homo sapiens
ctttccctgcatccctt

SEQ ID NO: 403103 - DNA, 13 bp, Homo sapiens
ctttccctggagt

SEQ ID NO: 403104 - DNA, 13 bp, Homo sapiens
ctttccctggctc

SEQ ID NO: 403105 - DNA, 14 bp, Homo sapiens
ctttcccttccagt

SEQ ID NO: 403106 - DNA, 15 bp, Homo sapiens
ctttcccttccagtt

SEQ ID NO: 403107 - DNA, 15 bp, Homo sapiens
ctttccggggaggag

SEQ ID NO: 403108 - DNA, 19 bp, Homo sapiens
ctttccggggaggagcctt

SEQ ID NO: 403109 - DNA, 23 bp, Homo sapiens
ctttccggggaggagccttggag

SEQ ID NO: 403110 - DNA, 13 bp, Homo sapiens
ctttcctcccttc

SEQ ID NO: 403111 - DNA, 16 bp, Homo sapiens
ctttcctcccttctga

SEQ ID NO: 403112 - DNA, 14 bp, Homo sapiens
ctttcctctctctc

SEQ ID NO: 403113 - DNA, 12 bp, Homo sapiens
ctttcctctctg

SEQ ID NO: 403114 - DNA, 22 bp, Homo sapiens
ctttcctgatggtacaggaaag

SEQ ID NO: 403115 - DNA, 21 bp, Homo sapiens
ctttcctgcatctttcatagt

SEQ ID NO: 403116 - DNA, 12 bp, Homo sapiens
ctttcctgcccc

SEQ ID NO: 403117 - DNA, 20 bp, Homo sapiens
ctttcctgcccttttcctgg

SEQ ID NO: 403118 - DNA, 21 bp, Homo sapiens
ctttcctggagagtctcactc

SEQ ID NO: 403119 - DNA, 22 bp, Homo sapiens
ctttccttagacccgccaggtc

SEQ ID NO: 403120 - DNA, 13 bp, Homo sapiens
ctttccttgcctt

SEQ ID NO: 403121 - DNA, 15 bp, Homo sapiens
ctttccttgctcaac

SEQ ID NO: 403122 - DNA, 18 bp, Homo sapiens
ctttcctttgctctggat

SEQ ID NO: 403123 - DNA, 20 bp, Homo sapiens
ctttcgttggttgtttctct

SEQ ID NO: 403124 - DNA, 20 bp, Homo sapiens
ctttctaaggatagcctttg

SEQ ID NO: 403125 - DNA, 21 bp, Homo sapiens
ctttctaaggatagcctttgt

SEQ ID NO: 403126 - DNA, 21 bp, Homo sapiens
ctttctaattaaaaaaataat

SEQ ID NO: 403127 - DNA, 19 bp, Homo sapiens
ctttctacatgactgggcc

SEQ ID NO: 403128 - DNA, 22 bp, Homo sapiens
ctttctacatgactgggcctcc

SEQ ID NO: 403129 - DNA, 23 bp, Homo sapiens
ctttctagctgttgagctgtttt

SEQ ID NO: 403130 - DNA, 13 bp, Homo sapiens
ctttctatgtaga

SEQ ID NO: 403131 - DNA, 22 bp, Homo sapiens
ctttctccaaaggcactgaccc

SEQ ID NO: 403132 - DNA, 15 bp, Homo sapiens
ctttctccagccagc

SEQ ID NO: 403133 - DNA, 22 bp, Homo sapiens
ctttctcccccgacactgctgc

SEQ ID NO: 403134 - DNA, 20 bp, Homo sapiens
ctttctccggggtctgtgct

SEQ ID NO: 403135 - DNA, 15 bp, Homo sapiens
ctttctcctgtgccc

SEQ ID NO: 403136 - DNA, 14 bp, Homo sapiens
ctttctcctgtggt

SEQ ID NO: 403137 - DNA, 21 bp, Homo sapiens
ctttctcctgtggtttgctcc

SEQ ID NO: 403138 - DNA, 21 bp, Homo sapiens
ctttctctcagccttacattt

SEQ ID NO: 403139 - DNA, 22 bp, Homo sapiens
ctttctctcagccttacatttg

SEQ ID NO: 403140 - DNA, 12 bp, Homo sapiens
ctttctctctgt

SEQ ID NO: 403141 - DNA, 20 bp, Homo sapiens
ctttctctctgtgtggcaaa

SEQ ID NO: 403142 - DNA, 18 bp, Homo sapiens
ctttctctgccagtgaca

SEQ ID NO: 403143 - DNA, 12 bp, Homo sapiens
ctttctctgctt

SEQ ID NO: 403144 - DNA, 16 bp, Homo sapiens
ctttctctgcttcagc

SEQ ID NO: 403145 - DNA, 11 bp, Homo sapiens
ctttctctttc

SEQ ID NO: 403146 - DNA, 13 bp, Homo sapiens
ctttctgaaataa

SEQ ID NO: 403147 - DNA, 22 bp, Homo sapiens
ctttctgactgcaacttctgtc

SEQ ID NO: 403148 - DNA, 15 bp, Homo sapiens
ctttctgcagttttt

SEQ ID NO: 403149 - DNA, 16 bp, Homo sapiens
ctttctgcttgtgtta

SEQ ID NO: 403150 - DNA, 17 bp, Homo sapiens
ctttctgtaccatttat

SEQ ID NO: 403151 - DNA, 21 bp, Homo sapiens
ctttctgtatcaagcccctgt

SEQ ID NO: 403152 - DNA, 16 bp, Homo sapiens
ctttctgtctctctct

SEQ ID NO: 403153 - DNA, 12 bp, Homo sapiens
ctttctgtgtgc

SEQ ID NO: 403154 - DNA, 15 bp, Homo sapiens
ctttctgtgtgcacc

SEQ ID NO: 403155 - DNA, 21 bp, Homo sapiens
ctttcttccactaccctccct

SEQ ID NO: 403156 - DNA, 18 bp, Homo sapiens
ctttcttccatcagctct

SEQ ID NO: 403157 - DNA, 15 bp, Homo sapiens
ctttcttcctccagt

SEQ ID NO: 403158 - DNA, 14 bp, Homo sapiens
ctttcttcctctgc

SEQ ID NO: 403159 - DNA, 20 bp, Homo sapiens
ctttcttgacaaaacctaac

SEQ ID NO: 403160 - DNA, 17 bp, Homo sapiens
ctttcttgagcaccagg

SEQ ID NO: 403161 - DNA, 15 bp, Homo sapiens
ctttcttgcttcaaa

SEQ ID NO: 403162 - DNA, 13 bp, Homo sapiens
ctttcttggccag

SEQ ID NO: 403163 - DNA, 14 bp, Homo sapiens
ctttctttaatagt

SEQ ID NO: 403164 - DNA, 15 bp, Homo sapiens
ctttctttacctgag

SEQ ID NO: 403165 - DNA, 11 bp, Homo sapiens
ctttctttcca

SEQ ID NO: 403166 - DNA, 12 bp, Homo sapiens
ctttctttccaa

SEQ ID NO: 403167 - DNA, 21 bp, Homo sapiens
ctttctttgctgctgtggaaa

SEQ ID NO: 403168 - DNA, 18 bp, Homo sapiens
ctttctttgtttggctgg

SEQ ID NO: 403169 - DNA, 17 bp, Homo sapiens
ctttcttttttctctga

SEQ ID NO: 403170 - DNA, 19 bp, Homo sapiens
ctttcttttttttcttggt

SEQ ID NO: 403171 - DNA, 20 bp, Homo sapiens
ctttgaaaatatttctatgt

SEQ ID NO: 403172 - DNA, 19 bp, Homo sapiens
ctttgaaatagtctgtgtg

SEQ ID NO: 403173 - DNA, 18 bp, Homo sapiens
ctgtatcggagacagtga

SEQ ID NO: 403174 - DNA, 21 bp, Homo sapiens
ctgtatctaaaaaataactgt

SEQ ID NO: 403175 - DNA, 23 bp, Homo sapiens
ctgtatggcacttattatgaggc

SEQ ID NO: 403176 - DNA, 22 bp, Homo sapiens
ctgtatgtcttataagaaaaca

SEQ ID NO: 403177 - DNA, 18 bp, Homo sapiens
ctgtatgtgtctttatca

SEQ ID NO: 403178 - DNA, 23 bp, Homo sapiens
ctgtattgtaagtggaaaatgca

SEQ ID NO: 403179 - DNA, 23 bp, Homo sapiens
ctgtatttgtatctctgaagcat

SEQ ID NO: 403180 - DNA, 11 bp, Homo sapiens
ctgtattttct

SEQ ID NO: 403181 - DNA, 16 bp, Homo sapiens
ctgtattttgccagac

SEQ ID NO: 403182 - DNA, 20 bp, Homo sapiens
ctgtattttttttttccatt

SEQ ID NO: 403183 - DNA, 14 bp, Homo sapiens
ctgtcaagttaaca

SEQ ID NO: 403184 - DNA, 20 bp, Homo sapiens
ctgtcaagttaacaaggaat

SEQ ID NO: 403185 - DNA, 21 bp, Homo sapiens
ctgtcaagttaacaaggaatg

SEQ ID NO: 403186 - DNA, 22 bp, Homo sapiens
ctgtcaagttaacaaggaatgc

SEQ ID NO: 403187 - DNA, 15 bp, Homo sapiens
ctgtcaattacagga

SEQ ID NO: 403188 - DNA, 18 bp, Homo sapiens
ctgtcaattacaggaagt

SEQ ID NO: 403189 - DNA, 23 bp, Homo sapiens
ctgtcaattacaggaagtactgg

SEQ ID NO: 403190 - DNA, 13 bp, Homo sapiens
ctgtcaccaaatt

SEQ ID NO: 403191 - DNA, 20 bp, Homo sapiens
ctgtcaccacatcttgtctt

SEQ ID NO: 403192 - DNA, 15 bp, Homo sapiens
ctgtcaccgccatgc

SEQ ID NO: 403193 - DNA, 12 bp, Homo sapiens
ctgtcactttgc

SEQ ID NO: 403194 - DNA, 14 bp, Homo sapiens
ctgtcactttgctc

SEQ ID NO: 403195 - DNA, 15 bp, Homo sapiens
ctgtcactttgctct

SEQ ID NO: 403196 - DNA, 14 bp, Homo sapiens
ctgtcagagccgcc

SEQ ID NO: 403197 - DNA, 20 bp, Homo sapiens
ctgtcagataatcggtgcag

SEQ ID NO: 403198 - DNA, 23 bp, Homo sapiens
ctgtcagcgcctcaagggtaggg

SEQ ID NO: 403199 - DNA, 20 bp, Homo sapiens
ctgtcagggccttggcccag

SEQ ID NO: 403200 - DNA, 18 bp, Homo sapiens
ctgtcagtgcagcccgtg

SEQ ID NO: 403201 - DNA, 15 bp, Homo sapiens
ctgtcatcactccct

SEQ ID NO: 403202 - DNA, 19 bp, Homo sapiens
ctgtcatgaacatgttcct

SEQ ID NO: 403203 - DNA, 15 bp, Homo sapiens
ctgtcattgtccatg

SEQ ID NO: 403204 - DNA, 17 bp, Homo sapiens
ctgtccaagtgtttctt

SEQ ID NO: 403205 - DNA, 18 bp, Homo sapiens
ctgtccaattccagagct

SEQ ID NO: 403206 - DNA, 23 bp, Homo sapiens
ctgtccaccctcatttctgccag

SEQ ID NO: 403207 - DNA, 15 bp, Homo sapiens
ctgtccacctgtgct

SEQ ID NO: 403208 - DNA, 17 bp, Homo sapiens
ctgtccacctgtgctgc

SEQ ID NO: 403209 - DNA, 14 bp, Homo sapiens
ctgtccactctcgg

SEQ ID NO: 403210 - DNA, 15 bp, Homo sapiens
ctgtccacttctagc

SEQ ID NO: 403211 - DNA, 17 bp, Homo sapiens
ctgtccagcctgggcag

SEQ ID NO: 403212 - DNA, 18 bp, Homo sapiens
ctgtccagcctgggcagc

SEQ ID NO: 403213 - DNA, 18 bp, Homo sapiens
ctgtccaggcactgctgc

SEQ ID NO: 403214 - DNA, 20 bp, Homo sapiens
ctgtccaggcactgctgccc

SEQ ID NO: 403215 - DNA, 22 bp, Homo sapiens
ctgtccaggcactgctgcccag

SEQ ID NO: 403216 - DNA, 23 bp, Homo sapiens
ctgtccaggcactgctgcccagc

SEQ ID NO: 403217 - DNA, 17 bp, Homo sapiens
ctgtccaggccactgtg

SEQ ID NO: 403218 - DNA, 22 bp, Homo sapiens
ctgtccaggccactgtggccag

SEQ ID NO: 403219 - DNA, 15 bp, Homo sapiens
ctgtccagggcttca

SEQ ID NO: 403220 - DNA, 12 bp, Homo sapiens
ctgtccaggtga

SEQ ID NO: 403221 - DNA, 13 bp, Homo sapiens
ctgtccatcccca

SEQ ID NO: 403222 - DNA, 15 bp, Homo sapiens
ctgtccatccccagt

SEQ ID NO: 403223 - DNA, 12 bp, Homo sapiens
ctgtccatctgt

SEQ ID NO: 403224 - DNA, 20 bp, Homo sapiens
ctgtcccaccaactctgcac

SEQ ID NO: 403225 - DNA, 11 bp, Homo sapiens
ctgtcccactg

SEQ ID NO: 403226 - DNA, 23 bp, Homo sapiens
ctgtcccagagcttattggccac

SEQ ID NO: 403227 - DNA, 13 bp, Homo sapiens
ctgtcccagaggt

SEQ ID NO: 403228 - DNA, 22 bp, Homo sapiens
ctgtcccagaggttatctgcct

SEQ ID NO: 403229 - DNA, 22 bp, Homo sapiens
ctgtcccaggggtctccctgag

SEQ ID NO: 403230 - DNA, 15 bp, Homo sapiens
ctgtccccagccctg

SEQ ID NO: 403231 - DNA, 17 bp, Homo sapiens
ctgtccccagccctgtc

SEQ ID NO: 403232 - DNA, 20 bp, Homo sapiens
ctgtccccagccctgtcctg

SEQ ID NO: 403233 - DNA, 17 bp, Homo sapiens
ctgtcccccacgtggac

SEQ ID NO: 403234 - DNA, 22 bp, Homo sapiens
ctgtccccctcccctcccagtc

SEQ ID NO: 403235 - DNA, 18 bp, Homo sapiens
ctgtccccgagccgagct

SEQ ID NO: 403236 - DNA, 17 bp, Homo sapiens
ctgtcccctccatctgg

SEQ ID NO: 403237 - DNA, 15 bp, Homo sapiens
ctgtcccctctgtca

SEQ ID NO: 403238 - DNA, 16 bp, Homo sapiens
ctgtcccggttcacct

SEQ ID NO: 403239 - DNA, 18 bp, Homo sapiens
ctgtcccggttcaccttg

SEQ ID NO: 403240 - DNA, 17 bp, Homo sapiens
ctgtccctaggtcagct

SEQ ID NO: 403241 - DNA, 13 bp, Homo sapiens
ctgtccctcactg

SEQ ID NO: 403242 - DNA, 12 bp, Homo sapiens
ctgtccctgccc

SEQ ID NO: 403243 - DNA, 17 bp, Homo sapiens
ctgtccctgccccgccc

SEQ ID NO: 403244 - DNA, 22 bp, Homo sapiens
ctgtccctgccccgccccccag

SEQ ID NO: 403245 - DNA, 23 bp, Homo sapiens
ctgtccctgccccgccccccaga

SEQ ID NO: 403246 - DNA, 18 bp, Homo sapiens
ctgtccctggccatctct

SEQ ID NO: 403247 - DNA, 18 bp, Homo sapiens
ctgtccctgtccccctcc

SEQ ID NO: 403248 - DNA, 17 bp, Homo sapiens
ctgtccctgtccctgcc

SEQ ID NO: 403249 - DNA, 18 bp, Homo sapiens
ctgtccctgtccctgccc

SEQ ID NO: 403250 - DNA, 20 bp, Homo sapiens
ctgtcccttacgtgagtcct

SEQ ID NO: 403251 - DNA, 22 bp, Homo sapiens
ctgtcccttacgtgagtcctgg

SEQ ID NO: 403252 - DNA, 16 bp, Homo sapiens
ctgtcccttctcttaa

SEQ ID NO: 403253 - DNA, 21 bp, Homo sapiens
ctgtcccttgcctcaatgcca

SEQ ID NO: 403254 - DNA, 14 bp, Homo sapiens
ctgtccgcctctgc

SEQ ID NO: 403255 - DNA, 19 bp, Homo sapiens
ctgtcctcaggtgaataac

SEQ ID NO: 403256 - DNA, 21 bp, Homo sapiens
ctgtcctctttcagaaaacag

SEQ ID NO: 403257 - DNA, 14 bp, Homo sapiens
ctgtcctgagcccc

SEQ ID NO: 403258 - DNA, 19 bp, Homo sapiens
ctgtcctgagccccctgca

SEQ ID NO: 403259 - DNA, 20 bp, Homo sapiens
ctgtcctgagccccctgcac

SEQ ID NO: 403260 - DNA, 22 bp, Homo sapiens
ctgtcctgagccccctgcaccc

SEQ ID NO: 403261 - DNA, 21 bp, Homo sapiens
ctgtcctgatggtcagctccc

SEQ ID NO: 403262 - DNA, 13 bp, Homo sapiens
ctgtcctgctcac

SEQ ID NO: 403263 - DNA, 22 bp, Homo sapiens
ctgtcctggcttttatttaaag

SEQ ID NO: 403264 - DNA, 21 bp, Homo sapiens
ctgtcctgggcgccctggaag

SEQ ID NO: 403265 - DNA, 14 bp, Homo sapiens
ctgtcctgtacatt

SEQ ID NO: 403266 - DNA, 20 bp, Homo sapiens
ctgtccttagactccttctc

SEQ ID NO: 403267 - DNA, 21 bp, Homo sapiens
ctgtccttagactccttctcc

SEQ ID NO: 403268 - DNA, 15 bp, Homo sapiens
ctgtccttccttcca

SEQ ID NO: 403269 - DNA, 15 bp, Homo sapiens
ctgtccttctctcac

SEQ ID NO: 403270 - DNA, 22 bp, Homo sapiens
ctgtcctttccagtggcctggc

SEQ ID NO: 403271 - DNA, 13 bp, Homo sapiens
ctgtcctttctcc

SEQ ID NO: 403272 - DNA, 16 bp, Homo sapiens
ctgtcctttctccagg

SEQ ID NO: 403273 - DNA, 17 bp, Homo sapiens
ctgtcctttctccaggc

SEQ ID NO: 403274 - DNA, 14 bp, Homo sapiens
ctgtcgagacactt

SEQ ID NO: 403275 - DNA, 18 bp, Homo sapiens
ctgtcgagacacttgcct

SEQ ID NO: 403276 - DNA, 15 bp, Homo sapiens
ctgtcggagaggctg

SEQ ID NO: 403277 - DNA, 23 bp, Homo sapiens
ctgtcggagaggctgtctggggc

SEQ ID NO: 403278 - DNA, 16 bp, Homo sapiens
ctgtcggtgtcccctt

SEQ ID NO: 403279 - DNA, 13 bp, Homo sapiens
ctgtctacaaata

SEQ ID NO: 403280 - DNA, 13 bp, Homo sapiens
ctgtctaccatct

SEQ ID NO: 403281 - DNA, 13 bp, Homo sapiens
ctgtctactgtgg

SEQ ID NO: 403282 - DNA, 20 bp, Homo sapiens
ctgtctactgtggtgatctg

SEQ ID NO: 403283 - DNA, 21 bp, Homo sapiens
catgaatacgtaaactgcgta

SEQ ID NO: 403284 - DNA, 14 bp, Homo sapiens
catgaatgtaaatt

SEQ ID NO: 403285 - DNA, 17 bp, Homo sapiens
catgaatgtatcaggaa

SEQ ID NO: 403286 - DNA, 18 bp, Homo sapiens
catgaattagaagaaaat

SEQ ID NO: 403287 - DNA, 14 bp, Homo sapiens
catgaattcatact

SEQ ID NO: 403288 - DNA, 13 bp, Homo sapiens
catgaatttaatg

SEQ ID NO: 403289 - DNA, 17 bp, Homo sapiens
catgaatttctgccata

SEQ ID NO: 403290 - DNA, 19 bp, Homo sapiens
catgacaactttgccagct

SEQ ID NO: 403291 - DNA, 14 bp, Homo sapiens
catgacaagcccca

SEQ ID NO: 403292 - DNA, 12 bp, Homo sapiens
catgacatgtta

SEQ ID NO: 403293 - DNA, 19 bp, Homo sapiens
catgacatttgtcctgcag

SEQ ID NO: 403294 - DNA, 20 bp, Homo sapiens
catgacatttgtcctgcaga

SEQ ID NO: 403295 - DNA, 22 bp, Homo sapiens
catgaccactgggcctgctagt

SEQ ID NO: 403296 - DNA, 16 bp, Homo sapiens
catgaccaggccacca

SEQ ID NO: 403297 - DNA, 14 bp, Homo sapiens
catgaccctggagc

SEQ ID NO: 403298 - DNA, 16 bp, Homo sapiens
catgaccctggagccc

SEQ ID NO: 403299 - DNA, 16 bp, Homo sapiens
catgacctgtgaccag

SEQ ID NO: 403300 - DNA, 18 bp, Homo sapiens
catgacctgtgaccagca

SEQ ID NO: 403301 - DNA, 21 bp, Homo sapiens
catgactagagacgcaccttg

SEQ ID NO: 403302 - DNA, 23 bp, Homo sapiens
catgactgagtctggcaaacatg

SEQ ID NO: 403303 - DNA, 14 bp, Homo sapiens
ctggaccagatgct

SEQ ID NO: 403304 - DNA, 15 bp, Homo sapiens
ctggaccagatgctg

SEQ ID NO: 403305 - DNA, 15 bp, Homo sapiens
ctggaccccaggcca

SEQ ID NO: 403306 - DNA, 20 bp, Homo sapiens
ctggacctatgtcctaagga

SEQ ID NO: 403307 - DNA, 16 bp, Homo sapiens
ctggacctctcttgtg

SEQ ID NO: 403308 - DNA, 12 bp, Homo sapiens
ctggacctgagt

SEQ ID NO: 403309 - DNA, 17 bp, Homo sapiens
ctggacctgcctcctgc

SEQ ID NO: 403310 - DNA, 23 bp, Homo sapiens
ctggactgaagcctgcaggagtt

SEQ ID NO: 403311 - DNA, 20 bp, Homo sapiens
ctggactgcaatatcaacaa

SEQ ID NO: 403312 - DNA, 16 bp, Homo sapiens
ctggactggaggtggg

SEQ ID NO: 403313 - DNA, 19 bp, Homo sapiens
ctggactggaggtgggcat

SEQ ID NO: 403314 - DNA, 13 bp, Homo sapiens
ctggactggccct

SEQ ID NO: 403315 - DNA, 16 bp, Homo sapiens
ctggactggcccttgc

SEQ ID NO: 403316 - DNA, 19 bp, Homo sapiens
ctggactggcccttgccca

SEQ ID NO: 403317 - DNA, 22 bp, Homo sapiens
ctggactggcccttgcccaact

SEQ ID NO: 403318 - DNA, 21 bp, Homo sapiens
ctggactggtggcccctgcct

SEQ ID NO: 403319 - DNA, 23 bp, Homo sapiens
ctggactgtaggactatataaag

SEQ ID NO: 403320 - DNA, 13 bp, Homo sapiens
ctggactttcctg

SEQ ID NO: 403321 - DNA, 19 bp, Homo sapiens
ctggacttttgcagcttcc

SEQ ID NO: 403322 - DNA, 20 bp, Homo sapiens
ctggacttttgcagcttcct

SEQ ID NO: 403323 - DNA, 22 bp, Homo sapiens
ctggacttttgcagcttccttc

SEQ ID NO: 403324 - DNA, 21 bp, Homo sapiens
ctggagaaaatggacgtgtta

SEQ ID NO: 403325 - DNA, 13 bp, Homo sapiens
ctggagaaaggat

SEQ ID NO: 403326 - DNA, 14 bp, Homo sapiens
ctggagaactagag

SEQ ID NO: 403327 - DNA, 15 bp, Homo sapiens
ctggagaactagaga

SEQ ID NO: 403328 - DNA, 20 bp, Homo sapiens
ctggagacaatgcagatgcc

SEQ ID NO: 403329 - DNA, 18 bp, Homo sapiens
ctggagacagtaacattt

SEQ ID NO: 403330 - DNA, 18 bp, Homo sapiens
ctggagaccaggactctg

SEQ ID NO: 403331 - DNA, 21 bp, Homo sapiens
ctggagaggttataggtcact

SEQ ID NO: 403332 - DNA, 23 bp, Homo sapiens
ctggagagtagacatccccctcc

SEQ ID NO: 403333 - DNA, 20 bp, Homo sapiens
ctggagcagcagctgaggcc

SEQ ID NO: 403334 - DNA, 15 bp, Homo sapiens
ctggagccacctgtc

SEQ ID NO: 403335 - DNA, 16 bp, Homo sapiens
ctggagccacctgtcc

SEQ ID NO: 403336 - DNA, 20 bp, Homo sapiens
ctggagccacctgtcccacc

SEQ ID NO: 403337 - DNA, 23 bp, Homo sapiens
ctggagccacctgtcccacctca

SEQ ID NO: 403338 - DNA, 17 bp, Homo sapiens
ctggagccagcagggct

SEQ ID NO: 403339 - DNA, 19 bp, Homo sapiens
ctggagcccctatcctgca

SEQ ID NO: 403340 - DNA, 16 bp, Homo sapiens
ctggagcccctgtgtg

SEQ ID NO: 403341 - DNA, 16 bp, Homo sapiens
ctggagcccctgtgtt

SEQ ID NO: 403342 - DNA, 19 bp, Homo sapiens
ctggagcccggcagtgcac

SEQ ID NO: 403343 - DNA, 23 bp, Homo sapiens
ctggagcctccactgcctctgga

SEQ ID NO: 403344 - DNA, 18 bp, Homo sapiens
ctggagcctgagtcaggg

SEQ ID NO: 403345 - DNA, 19 bp, Homo sapiens
ctggagcctgagtcagggc

SEQ ID NO: 403346 - DNA, 13 bp, Homo sapiens
ctggagctcctgg

SEQ ID NO: 403347 - DNA, 17 bp, Homo sapiens
ctggaggaaaactgaga

SEQ ID NO: 403348 - DNA, 19 bp, Homo sapiens
ctggaggaagccagtgggg

SEQ ID NO: 403349 - DNA, 20 bp, Homo sapiens
ctggaggccaccaagctgct

SEQ ID NO: 403350 - DNA, 22 bp, Homo sapiens
cagtgcaatggtataaatttca

SEQ ID NO: 403351 - DNA, 18 bp, Homo sapiens
cagtgcaccccctaaaga

SEQ ID NO: 403352 - DNA, 15 bp, Homo sapiens
cagtgcactcgagcc

SEQ ID NO: 403353 - DNA, 21 bp, Homo sapiens
cagtgcagacaggccatgtga

SEQ ID NO: 403354 - DNA, 22 bp, Homo sapiens
cagtgcagcccgtgtggcccct

SEQ ID NO: 403355 - DNA, 15 bp, Homo sapiens
cagtgcatctcagcc

SEQ ID NO: 403356 - DNA, 17 bp, Homo sapiens
cagtgcatctcagccca

SEQ ID NO: 403357 - DNA, 16 bp, Homo sapiens
cagtgcatgctgtccc

SEQ ID NO: 403358 - DNA, 23 bp, Homo sapiens
cagtgcatgctgtcccttacgtg

SEQ ID NO: 403359 - DNA, 19 bp, Homo sapiens
cagtgcatgtgaagcatgc

SEQ ID NO: 403360 - DNA, 22 bp, Homo sapiens
cagtgcatgtgaagcatgcttt

SEQ ID NO: 403361 - DNA, 19 bp, Homo sapiens
cagtgccacctatgcctgt

SEQ ID NO: 403362 - DNA, 20 bp, Homo sapiens
cagtgccacttgacattcct

SEQ ID NO: 403363 - DNA, 20 bp, Homo sapiens
cagtgcccagtgatggcatt

SEQ ID NO: 403364 - DNA, 17 bp, Homo sapiens
cagtgcctcgaggcacc

SEQ ID NO: 403365 - DNA, 14 bp, Homo sapiens
cagtgcctgggaat

SEQ ID NO: 403366 - DNA, 14 bp, Homo sapiens
cagtgcctgtctgg

SEQ ID NO: 403367 - DNA, 17 bp, Homo sapiens
cagtgcctgtctggagc

SEQ ID NO: 403368 - DNA, 14 bp, Homo sapiens
cagtgccttccata

SEQ ID NO: 403369 - DNA, 11 bp, Homo sapiens
cagtgccttct

SEQ ID NO: 403370 - DNA, 12 bp, Homo sapiens
cagtgccttctc

SEQ ID NO: 403371 - DNA, 14 bp, Homo sapiens
cagtgccttgggga

SEQ ID NO: 403372 - DNA, 21 bp, Homo sapiens
cagtgccttggggaatttcct

SEQ ID NO: 403373 - DNA, 14 bp, Homo sapiens
cagtgcctttcccc

SEQ ID NO: 403374 - DNA, 16 bp, Homo sapiens
cagtgctagtgagctg

SEQ ID NO: 403375 - DNA, 15 bp, Homo sapiens
cagtgctgccatgcc

SEQ ID NO: 403376 - DNA, 20 bp, Homo sapiens
cagtgctgccatgccactgc

SEQ ID NO: 403377 - DNA, 22 bp, Homo sapiens
cagtgctgccatgccactgcca

SEQ ID NO: 403378 - DNA, 23 bp, Homo sapiens
cagtgctgccatgccactgccag

SEQ ID NO: 403379 - DNA, 11 bp, Homo sapiens
cagtgctgctt

SEQ ID NO: 403380 - DNA, 12 bp, Homo sapiens
cagtgctgggcc

SEQ ID NO: 403381 - DNA, 14 bp, Homo sapiens
cagtgctgggccca

SEQ ID NO: 403382 - DNA, 15 bp, Homo sapiens
cagtgctgggcccag

SEQ ID NO: 403383 - DNA, 16 bp, Homo sapiens
cagtgctgggcccagc

SEQ ID NO: 403384 - DNA, 13 bp, Homo sapiens
cagtgcttggctg

SEQ ID NO: 403385 - DNA, 20 bp, Homo sapiens
cagtggactttccaccccct

SEQ ID NO: 403386 - DNA, 21 bp, Homo sapiens
cagtggactttccaccccctc

SEQ ID NO: 403387 - DNA, 13 bp, Homo sapiens
cagtggagagggg

SEQ ID NO: 403388 - DNA, 19 bp, Homo sapiens
cagtggagaggggacttgg

SEQ ID NO: 403389 - DNA, 21 bp, Homo sapiens
cagtggagaggggacttggat

SEQ ID NO: 403390 - DNA, 15 bp, Homo sapiens
cagtggaggaagagg

SEQ ID NO: 403391 - DNA, 18 bp, Homo sapiens
cagtggatcatgaaaagt

SEQ ID NO: 403392 - DNA, 16 bp, Homo sapiens
cagtggcagcaaagga

SEQ ID NO: 403393 - DNA, 22 bp, Homo sapiens
cagtggcagcaacaaaggattt

SEQ ID NO: 403394 - DNA, 15 bp, Homo sapiens
cagtggcatggctcc

SEQ ID NO: 403395 - DNA, 19 bp, Homo sapiens
cagtggcatggctccagtc

SEQ ID NO: 403396 - DNA, 13 bp, Homo sapiens
cagtggccaggca

SEQ ID NO: 403397 - DNA, 18 bp, Homo sapiens
cagtggccccatccagca

SEQ ID NO: 403398 - DNA, 20 bp, Homo sapiens
cagtggccccatccagcatg

SEQ ID NO: 403399 - DNA, 21 bp, Homo sapiens
cagtggccccatccagcatgt

SEQ ID NO: 403400 - DNA, 23 bp, Homo sapiens
cagtggccccatccagcatgtgt

SEQ ID NO: 403401 - DNA, 18 bp, Homo sapiens
cagtggccgaacccccca

SEQ ID NO: 403402 - DNA, 19 bp, Homo sapiens
cagtggcctcaaccctccc

SEQ ID NO: 403403 - DNA, 20 bp, Homo sapiens
cagtggcctcaaccctccct

SEQ ID NO: 403404 - DNA, 23 bp, Homo sapiens
cagtggcctcaaccctccctcag

SEQ ID NO: 403405 - DNA, 16 bp, Homo sapiens
cagtggctcctataat

SEQ ID NO: 403406 - DNA, 13 bp, Homo sapiens
cagtggctctttt

SEQ ID NO: 403407 - DNA, 14 bp, Homo sapiens
cagtggctgggtgg

SEQ ID NO: 403408 - DNA, 22 bp, Homo sapiens
cagtggctgggtgggcccagaa

SEQ ID NO: 403409 - DNA, 23 bp, Homo sapiens
cagtggcttttgccccagaaagg

SEQ ID NO: 403410 - DNA, 19 bp, Homo sapiens
cagtgggacagggcatggc

SEQ ID NO: 403411 - DNA, 15 bp, Homo sapiens
cagtgggagccctga

SEQ ID NO: 403412 - DNA, 21 bp, Homo sapiens
cagtgggaggtgagaccacct

SEQ ID NO: 403413 - DNA, 22 bp, Homo sapiens
cagtgggattatcgagcatgtt

SEQ ID NO: 403414 - DNA, 20 bp, Homo sapiens
cagtgggccggccccaggct

SEQ ID NO: 403415 - DNA, 14 bp, Homo sapiens
cagtggggaaaaaa

SEQ ID NO: 403416 - DNA, 22 bp, Homo sapiens
cagtggggcccatggccccagc

SEQ ID NO: 403417 - DNA, 22 bp, Homo sapiens
cagtggggccccaaagcccagc

SEQ ID NO: 403418 - DNA, 23 bp, Homo sapiens
cagtggggccccaaagcccagcc

SEQ ID NO: 403419 - DNA, 14 bp, Homo sapiens
cagtggggctgggg

SEQ ID NO: 403420 - DNA, 16 bp, Homo sapiens
cagtgggggtgcctgg

SEQ ID NO: 403421 - DNA, 20 bp, Homo sapiens
cagtggggtcccccctgagt

SEQ ID NO: 403422 - DNA, 21 bp, Homo sapiens
cagtggggtcccccctgagtg

SEQ ID NO: 403423 - DNA, 22 bp, Homo sapiens
cagtggggtcccccctgagtgg

SEQ ID NO: 403424 - DNA, 22 bp, Homo sapiens
cagtggggtcgtgaggcaagat

SEQ ID NO: 403425 - DNA, 16 bp, Homo sapiens
cagtgggtggcacctc

SEQ ID NO: 403426 - DNA, 19 bp, Homo sapiens
cagtgggtggcacctcctg

SEQ ID NO: 403427 - DNA, 18 bp, Homo sapiens
cagtgggtggggctgtac

SEQ ID NO: 403428 - DNA, 23 bp, Homo sapiens
cagtgggtggggctgtacacacc

SEQ ID NO: 403429 - DNA, 14 bp, Homo sapiens
cagtggtgatgcct

SEQ ID NO: 403430 - DNA, 22 bp, Homo sapiens
cagtggttctacaatctattta

SEQ ID NO: 403431 - DNA, 15 bp, Homo sapiens
cagtgtactgctttc

SEQ ID NO: 403432 - DNA, 16 bp, Homo sapiens
ctggcattgtccctgt

SEQ ID NO: 403433 - DNA, 18 bp, Homo sapiens
ctggcatttttagctcct

SEQ ID NO: 403434 - DNA, 20 bp, Homo sapiens
ctggccaaagtcagtaggag

SEQ ID NO: 403435 - DNA, 22 bp, Homo sapiens
ctggccaaagtcagtaggagag

SEQ ID NO: 403436 - DNA, 13 bp, Homo sapiens
ctggccaaatatg

SEQ ID NO: 403437 - DNA, 17 bp, Homo sapiens
ctggccaaatatgcact

SEQ ID NO: 403438 - DNA, 23 bp, Homo sapiens
ctggccaacatcgtgaaaccctg

SEQ ID NO: 403439 - DNA, 22 bp, Homo sapiens
ctggccacaatcctccccacca

SEQ ID NO: 403440 - DNA, 17 bp, Homo sapiens
ctggccagagagggccc

SEQ ID NO: 403441 - DNA, 21 bp, Homo sapiens
ctggccagagagggcccagct

SEQ ID NO: 403442 - DNA, 22 bp, Homo sapiens
ctggccagagagggcccagctg

SEQ ID NO: 403443 - DNA, 12 bp, Homo sapiens
ctggccagaggc

SEQ ID NO: 403444 - DNA, 14 bp, Homo sapiens
ctggccagaggcag

SEQ ID NO: 403445 - DNA, 15 bp, Homo sapiens
ctggccagaggcagc

SEQ ID NO: 403446 - DNA, 13 bp, Homo sapiens
ctggccagcctgg

SEQ ID NO: 403447 - DNA, 15 bp, Homo sapiens
ctggccagcctgggg

SEQ ID NO: 403448 - DNA, 21 bp, Homo sapiens
ctggccagcctggggcctggc

SEQ ID NO: 403449 - DNA, 22 bp, Homo sapiens
ctggccagcctggggcctggca

SEQ ID NO: 403450 - DNA, 12 bp, Homo sapiens
ctggccaggagc

SEQ ID NO: 403451 - DNA, 15 bp, Homo sapiens
ctggccaggagctct

SEQ ID NO: 403452 - DNA, 21 bp, Homo sapiens
ctggccaggcagatctgtgcc

SEQ ID NO: 403453 - DNA, 22 bp, Homo sapiens
ctggccaggcagatctgtgccc

SEQ ID NO: 403454 - DNA, 13 bp, Homo sapiens
ctggccagtgtca

SEQ ID NO: 403455 - DNA, 15 bp, Homo sapiens
ctggccagtgtcatt

SEQ ID NO: 403456 - DNA, 18 bp, Homo sapiens
ctggccagtgtcatttta

SEQ ID NO: 403457 - DNA, 22 bp, Homo sapiens
ctggccatctctgaacttcagc

SEQ ID NO: 403458 - DNA, 14 bp, Homo sapiens
ctggccatgcaagt

SEQ ID NO: 403459 - DNA, 16 bp, Homo sapiens
ctggcccacccctctt

SEQ ID NO: 403460 - DNA, 19 bp, Homo sapiens
ctggcccacccctcttccc

SEQ ID NO: 403461 - DNA, 22 bp, Homo sapiens
ctggcccacccctcttccccct

SEQ ID NO: 403462 - DNA, 17 bp, Homo sapiens
ctggcccagagctggaa

SEQ ID NO: 403463 - DNA, 17 bp, Homo sapiens
ctggcccagccaaaccc

SEQ ID NO: 403464 - DNA, 12 bp, Homo sapiens
ctggcccagcgg

SEQ ID NO: 403465 - DNA, 13 bp, Homo sapiens
ctggcccagcggc

SEQ ID NO: 403466 - DNA, 18 bp, Homo sapiens
ctggcccagcggcccctc

SEQ ID NO: 403467 - DNA, 19 bp, Homo sapiens
ctggcccagcggcccctcc

SEQ ID NO: 403468 - DNA, 18 bp, Homo sapiens
ctggcccatctcagcctc

SEQ ID NO: 403469 - DNA, 19 bp, Homo sapiens
ctggcccatctcagcctcc

SEQ ID NO: 403470 - DNA, 12 bp, Homo sapiens
ctggccccaggc

SEQ ID NO: 403471 - DNA, 15 bp, Homo sapiens
ctggccccaggcgga

SEQ ID NO: 403472 - DNA, 15 bp, Homo sapiens
ctggcccccagctgt

SEQ ID NO: 403473 - DNA, 18 bp, Homo sapiens
ctggcccccctccaggca

SEQ ID NO: 403474 - DNA, 22 bp, Homo sapiens
ctggccccgggctctggccacc

SEQ ID NO: 403475 - DNA, 12 bp, Homo sapiens
ctggcccctcac

SEQ ID NO: 403476 - DNA, 15 bp, Homo sapiens
ctggcccctcacctg

SEQ ID NO: 403477 - DNA, 22 bp, Homo sapiens
ctggcccctcacctgggcacct

SEQ ID NO: 403478 - DNA, 18 bp, Homo sapiens
ctggcccctcccacatcc

SEQ ID NO: 403479 - DNA, 19 bp, Homo sapiens
ctggcccgcccctcgctgc

SEQ ID NO: 403480 - DNA, 23 bp, Homo sapiens
ctggcccgcccctcgctgctgct

SEQ ID NO: 403481 - DNA, 16 bp, Homo sapiens
ctggccctctgtgttg

SEQ ID NO: 403482 - DNA, 13 bp, Homo sapiens
ctggccctgccct

SEQ ID NO: 403483 - DNA, 19 bp, Homo sapiens
ctggccctgccctccccca

SEQ ID NO: 403484 - DNA, 14 bp, Homo sapiens
ctggccctgttgtg

SEQ ID NO: 403485 - DNA, 15 bp, Homo sapiens
ctggccctgttgtgg

SEQ ID NO: 403486 - DNA, 21 bp, Homo sapiens
ctggcccttgcccaactccca

SEQ ID NO: 403487 - DNA, 14 bp, Homo sapiens
ctgctgtccctcct

SEQ ID NO: 403488 - DNA, 20 bp, Homo sapiens
ctgctgtccctcctgaggtc

SEQ ID NO: 403489 - DNA, 16 bp, Homo sapiens
ctgctgtcctgcagta

SEQ ID NO: 403490 - DNA, 13 bp, Homo sapiens
ctgctgtgaattt

SEQ ID NO: 403491 - DNA, 19 bp, Homo sapiens
ctgctgtgctctggggatt

SEQ ID NO: 403492 - DNA, 14 bp, Homo sapiens
ctgctgtggcatca

SEQ ID NO: 403493 - DNA, 12 bp, Homo sapiens
ctgctgttttat

SEQ ID NO: 403494 - DNA, 16 bp, Homo sapiens
ctgctgttttatgtca

SEQ ID NO: 403495 - DNA, 20 bp, Homo sapiens
ctgcttacaattccctgctg

SEQ ID NO: 403496 - DNA, 16 bp, Homo sapiens
ctgcttaccaaaacat

SEQ ID NO: 403497 - DNA, 19 bp, Homo sapiens
ctgcttagaacccttctgc

SEQ ID NO: 403498 - DNA, 23 bp, Homo sapiens
ctgcttagaacccttctgctttc

SEQ ID NO: 403499 - DNA, 16 bp, Homo sapiens
ctgcttagtgtccctt

SEQ ID NO: 403500 - DNA, 16 bp, Homo sapiens
ctgcttcacacccctc

SEQ ID NO: 403501 - DNA, 18 bp, Homo sapiens
ctgcttcacacccctcag

SEQ ID NO: 403502 - DNA, 15 bp, Homo sapiens
ctgcttcacatccac

SEQ ID NO: 403503 - DNA, 22 bp, Homo sapiens
ctgcttcacggactctttgctg

SEQ ID NO: 403504 - DNA, 15 bp, Homo sapiens
ctgcttcagcttgct

SEQ ID NO: 403505 - DNA, 12 bp, Homo sapiens
ctgcttcagtgg

SEQ ID NO: 403506 - DNA, 13 bp, Homo sapiens
ctgcttcatatct

SEQ ID NO: 403507 - DNA, 18 bp, Homo sapiens
ctgcttcatatctctccc

SEQ ID NO: 403508 - DNA, 12 bp, Homo sapiens
ctgcttccaggt

SEQ ID NO: 403509 - DNA, 13 bp, Homo sapiens
ctgcttccatggc

SEQ ID NO: 403510 - DNA, 19 bp, Homo sapiens
ctgcttccatggcttcctg

SEQ ID NO: 403511 - DNA, 21 bp, Homo sapiens
ctgcttccatggcttcctgag

SEQ ID NO: 403512 - DNA, 19 bp, Homo sapiens
ctgcttcccaaactcccag

SEQ ID NO: 403513 - DNA, 22 bp, Homo sapiens
ctgcttcccaaactcccaggac

SEQ ID NO: 403514 - DNA, 21 bp, Homo sapiens
ctgcttcccacctccctgccc

SEQ ID NO: 403515 - DNA, 14 bp, Homo sapiens
ctgcttccctctgc

SEQ ID NO: 403516 - DNA, 10 bp, Homo sapiens
ctgcttccta

SEQ ID NO: 403517 - DNA, 20 bp, Homo sapiens
ctgcttctccacctccccca

SEQ ID NO: 403518 - DNA, 18 bp, Homo sapiens
ctgcttctcggaggccag

SEQ ID NO: 403519 - DNA, 19 bp, Homo sapiens
ctgcttctcggaggccagg

SEQ ID NO: 403520 - DNA, 14 bp, Homo sapiens
ctgcttctgctgcc

SEQ ID NO: 403521 - DNA, 16 bp, Homo sapiens
ctgcttctgctgccct

SEQ ID NO: 403522 - DNA, 14 bp, Homo sapiens
ctgcttctgggcct

SEQ ID NO: 403523 - DNA, 14 bp, Homo sapiens
ctgcttctggggga

SEQ ID NO: 403524 - DNA, 16 bp, Homo sapiens
ctgcttcttaacccca

SEQ ID NO: 403525 - DNA, 15 bp, Homo sapiens
ctgcttcttccccag

SEQ ID NO: 403526 - DNA, 17 bp, Homo sapiens
ctctttaacagctttct

SEQ ID NO: 403527 - DNA, 15 bp, Homo sapiens
ctctttaacttctcg

SEQ ID NO: 403528 - DNA, 16 bp, Homo sapiens
ctctttaagttttgat

SEQ ID NO: 403529 - DNA, 17 bp, Homo sapiens
ctctttaagttttgatt

SEQ ID NO: 403530 - DNA, 21 bp, Homo sapiens
ctctttcaattgcagatgcca

SEQ ID NO: 403531 - DNA, 12 bp, Homo sapiens
ctctttcagaga

SEQ ID NO: 403532 - DNA, 20 bp, Homo sapiens
ctctttctacatgactgggc

SEQ ID NO: 403533 - DNA, 22 bp, Homo sapiens
ctctttctacatgactgggcct

SEQ ID NO: 403534 - DNA, 15 bp, Homo sapiens
ctctttctcattctt

SEQ ID NO: 403535 - DNA, 17 bp, Homo sapiens
ctctttctcattcttgc

SEQ ID NO: 403536 - DNA, 15 bp, Homo sapiens
ctctttctctccttt

SEQ ID NO: 403537 - DNA, 15 bp, Homo sapiens
ctctttctctctgtg

SEQ ID NO: 403538 - DNA, 17 bp, Homo sapiens
ctctttctctctgtgtg

SEQ ID NO: 403539 - DNA, 14 bp, Homo sapiens
ctctttctctcttt

SEQ ID NO: 403540 - DNA, 13 bp, Homo sapiens
ctctttctctgcc

SEQ ID NO: 403541 - DNA, 17 bp, Homo sapiens
ctctttctggcctgcct

SEQ ID NO: 403542 - DNA, 20 bp, Homo sapiens
ctctttcttccactaccctc

SEQ ID NO: 403543 - DNA, 12 bp, Homo sapiens
ctctttctttcc

SEQ ID NO: 403544 - DNA, 13 bp, Homo sapiens
ctctttgaaacaa

SEQ ID NO: 403545 - DNA, 22 bp, Homo sapiens
ctctttgaaatagtctgtgtga

SEQ ID NO: 403546 - DNA, 17 bp, Homo sapiens
ctctttggaacaacagc

SEQ ID NO: 403547 - DNA, 17 bp, Homo sapiens
ctctttggtgccagctg

SEQ ID NO: 403548 - DNA, 21 bp, Homo sapiens
ctctttgtcccggataggcta

SEQ ID NO: 403549 - DNA, 20 bp, Homo sapiens
ctctttgtggcagaagtgtt

SEQ ID NO: 403550 - DNA, 15 bp, Homo sapiens
ctctttgtgtttttg

SEQ ID NO: 403551 - DNA, 20 bp, Homo sapiens
ctctttgttctaaagatgga

SEQ ID NO: 403552 - DNA, 16 bp, Homo sapiens
ctcttttaaatcagat

SEQ ID NO: 403553 - DNA, 15 bp, Homo sapiens
ctcttttccctctct

SEQ ID NO: 403554 - DNA, 17 bp, Homo sapiens
ctcttttccctctctag

SEQ ID NO: 403555 - DNA, 14 bp, Homo sapiens
ctcttttggccttg

SEQ ID NO: 403556 - DNA, 11 bp, Homo sapiens
ctctttttaag

SEQ ID NO: 403557 - DNA, 22 bp, Homo sapiens
ctctttttcccaactttggaaa

SEQ ID NO: 403558 - DNA, 18 bp, Homo sapiens
ctgacactgacatttcac

SEQ ID NO: 403559 - DNA, 14 bp, Homo sapiens
ctgacactgagccc

SEQ ID NO: 403560 - DNA, 16 bp, Homo sapiens
ctgacactgagcccca

SEQ ID NO: 403561 - DNA, 14 bp, Homo sapiens
ctgacagaaggact

SEQ ID NO: 403562 - DNA, 17 bp, Homo sapiens
ctgacagagcaggtctg

SEQ ID NO: 403563 - DNA, 17 bp, Homo sapiens
ctgacagcagcctgtga

SEQ ID NO: 403564 - DNA, 17 bp, Homo sapiens
ctgacagcctcccaccc

SEQ ID NO: 403565 - DNA, 11 bp, Homo sapiens
ctgacaggaag

SEQ ID NO: 403566 - DNA, 12 bp, Homo sapiens
ctgacaggaaga

SEQ ID NO: 403567 - DNA, 13 bp, Homo sapiens
ctgacaggaagac

SEQ ID NO: 403568 - DNA, 22 bp, Homo sapiens
ctgacaggaagactggagactg

SEQ ID NO: 403569 - DNA, 21 bp, Homo sapiens
ctgacataaacccatctgtaa

SEQ ID NO: 403570 - DNA, 22 bp, Homo sapiens
ctgacataaacccatctgtaat

SEQ ID NO: 403571 - DNA, 15 bp, Homo sapiens
ctgacatcctgacct

SEQ ID NO: 403572 - DNA, 16 bp, Homo sapiens
ctgacatgattccttc

SEQ ID NO: 403573 - DNA, 18 bp, Homo sapiens
ctgacatggagttcccgt

SEQ ID NO: 403574 - DNA, 23 bp, Homo sapiens
ctgacattaacagttttccatga

SEQ ID NO: 403575 - DNA, 12 bp, Homo sapiens
ctgacatttcac

SEQ ID NO: 403576 - DNA, 17 bp, Homo sapiens
ctgacatttcacttcct

SEQ ID NO: 403577 - DNA, 22 bp, Homo sapiens
ctgaccaacattcaaaagcaca

SEQ ID NO: 403578 - DNA, 16 bp, Homo sapiens
ctgaccacactgtatc

SEQ ID NO: 403579 - DNA, 16 bp, Homo sapiens
ctgaccacacttcctg

SEQ ID NO: 403580 - DNA, 17 bp, Homo sapiens
ctgaccacacttcctgt

SEQ ID NO: 403581 - DNA, 18 bp, Homo sapiens
ctgaccacacttcctgtc

SEQ ID NO: 403582 - DNA, 19 bp, Homo sapiens
ctgaccacacttcctgtcc

SEQ ID NO: 403583 - DNA, 15 bp, Homo sapiens
ctgaccatccactct

SEQ ID NO: 403584 - DNA, 16 bp, Homo sapiens
ctgaccatccactcta

SEQ ID NO: 403585 - DNA, 18 bp, Homo sapiens
ctgaccatcccatgagca

SEQ ID NO: 403586 - DNA, 19 bp, Homo sapiens
ctgaccatcccatgagcag

SEQ ID NO: 403587 - DNA, 21 bp, Homo sapiens
ctgacccagattcccttccgg

SEQ ID NO: 403588 - DNA, 12 bp, Homo sapiens
ctgaccccactt

SEQ ID NO: 403589 - DNA, 18 bp, Homo sapiens
ctgaccctgcagagatgc

SEQ ID NO: 403590 - DNA, 21 bp, Homo sapiens
ctgaccctgtgatgcctgaca

SEQ ID NO: 403591 - DNA, 20 bp, Homo sapiens
ctgacctcaagcaaccatga

SEQ ID NO: 403592 - DNA, 11 bp, Homo sapiens
ctgacctcagc

SEQ ID NO: 403593 - DNA, 17 bp, Homo sapiens
ctgacctcccactttgg

SEQ ID NO: 403594 - DNA, 18 bp, Homo sapiens
ctgacctccctctaattt

SEQ ID NO: 403595 - DNA, 19 bp, Homo sapiens
ctgacctctgaagagctga

SEQ ID NO: 403596 - DNA, 13 bp, Homo sapiens
ctgacctgccccc

SEQ ID NO: 403597 - DNA, 23 bp, Homo sapiens
ctgacctgcccccgctctgccat

SEQ ID NO: 403598 - DNA, 19 bp, Homo sapiens
ctgacctgctccgccagga

SEQ ID NO: 403599 - DNA, 12 bp, Homo sapiens
ctgacctgtcca

SEQ ID NO: 403600 - DNA, 20 bp, Homo sapiens
ctgaccttagcgttctggac

SEQ ID NO: 403601 - DNA, 16 bp, Homo sapiens
ctgaccttcacaggga

SEQ ID NO: 403602 - DNA, 22 bp, Homo sapiens
ctgaccttggaggaatgacaat

SEQ ID NO: 403603 - DNA, 20 bp, Homo sapiens
ctgacgaggctgggccaagc

SEQ ID NO: 403604 - DNA, 21 bp, Homo sapiens
ctgacgcaaaaccactttcct

SEQ ID NO: 403605 - DNA, 15 bp, Homo sapiens
ctgacgccaataata

SEQ ID NO: 403606 - DNA, 13 bp, Homo sapiens
ctgacgccctgcg

SEQ ID NO: 403607 - DNA, 13 bp, Homo sapiens
ctgacggccctgc

SEQ ID NO: 403608 - DNA, 16 bp, Homo sapiens
ctgacggccctgcaat

SEQ ID NO: 403609 - DNA, 14 bp, Homo sapiens
ctgacggcgccccc

SEQ ID NO: 403610 - DNA, 20 bp, Homo sapiens
ctgacggcgcccccagtgtg

SEQ ID NO: 403611 - DNA, 20 bp, Homo sapiens
ctgacggctgtgtatttctg

SEQ ID NO: 403612 - DNA, 22 bp, Homo sapiens
ctgacgtagctgcaaaggacag

SEQ ID NO: 403613 - DNA, 19 bp, Homo sapiens
ctgacgtttgacaccaggg

SEQ ID NO: 403614 - DNA, 23 bp, Homo sapiens
ctgacgtttgacaccagggccag

SEQ ID NO: 403615 - DNA, 14 bp, Homo sapiens
ctgactaaccattg

SEQ ID NO: 403616 - DNA, 16 bp, Homo sapiens
ctgactaaccattgat

SEQ ID NO: 403617 - DNA, 21 bp, Homo sapiens
ctgactattcttgatgtaaaa

SEQ ID NO: 403618 - DNA, 22 bp, Homo sapiens
ctgactattcttgatgtaaaat

SEQ ID NO: 403619 - DNA, 21 bp, Homo sapiens
ctgactcacattgccttgagc

SEQ ID NO: 403620 - DNA, 14 bp, Homo sapiens
ctgactccagagtc

SEQ ID NO: 403621 - DNA, 18 bp, Homo sapiens
ctgactcccaaagagctg

SEQ ID NO: 403622 - DNA, 22 bp, Homo sapiens
ctgactgatcctgaacaagaaa

SEQ ID NO: 403623 - DNA, 18 bp, Homo sapiens
ctgactgcaacttctgtc

SEQ ID NO: 403624 - DNA, 22 bp, Homo sapiens
ctgactggccccagggactctt

SEQ ID NO: 403625 - DNA, 11 bp, Homo sapiens
ctgactgggaa

SEQ ID NO: 403626 - DNA, 19 bp, Homo sapiens
ctgactgggaaggacataa

SEQ ID NO: 403627 - DNA, 19 bp, Homo sapiens
ctgactgggggcctctgcc

SEQ ID NO: 403628 - DNA, 17 bp, Homo sapiens
ctgacttcccagctggc

SEQ ID NO: 403629 - DNA, 19 bp, Homo sapiens
ctgacttcccagctggcag

SEQ ID NO: 403630 - DNA, 17 bp, Homo sapiens
ctgacttctgctaggta

SEQ ID NO: 403631 - DNA, 21 bp, Homo sapiens
ctgacttctgctaggtagagg

SEQ ID NO: 403632 - DNA, 12 bp, Homo sapiens
ctgacttgcttt

SEQ ID NO: 403633 - DNA, 14 bp, Homo sapiens
ctgactttctcccc

SEQ ID NO: 403634 - DNA, 21 bp, Homo sapiens
ctgacttttaatgtcatttgt

SEQ ID NO: 403635 - DNA, 16 bp, Homo sapiens
ctgactttttcccccc

SEQ ID NO: 403636 - DNA, 22 bp, Homo sapiens
ctgagaaaacgaaactgctcta

SEQ ID NO: 403637 - DNA, 19 bp, Homo sapiens
ctgagaaacgtccatctct

SEQ ID NO: 403638 - DNA, 18 bp, Homo sapiens
ctgagaaagcccacctgg

SEQ ID NO: 403639 - DNA, 19 bp, Homo sapiens
ctgagaaatggggtggaat

SEQ ID NO: 403640 - DNA, 21 bp, Homo sapiens
ctgagaagaggagccctcatc

SEQ ID NO: 403641 - DNA, 17 bp, Homo sapiens
ctgagaagattgtgaat

SEQ ID NO: 403642 - DNA, 15 bp, Homo sapiens
ctgagaagcctcatg

SEQ ID NO: 403643 - DNA, 21 bp, Homo sapiens
ctgagaaggcgaggagagtgg

SEQ ID NO: 403644 - DNA, 19 bp, Homo sapiens
ctgagaatttaatttttaa

SEQ ID NO: 403645 - DNA, 20 bp, Homo sapiens
ctgagaatttaatttttaaa

SEQ ID NO: 403646 - DNA, 22 bp, Homo sapiens
ctgagaccagttgggagcactg

SEQ ID NO: 403647 - DNA, 16 bp, Homo sapiens
ctgagacggatggaag

SEQ ID NO: 403648 - DNA, 21 bp, Homo sapiens
ctgagacgggcatcgcaggag

SEQ ID NO: 403649 - DNA, 22 bp, Homo sapiens
ctgagacgggcatcgcaggagt

SEQ ID NO: 403650 - DNA, 17 bp, Homo sapiens
ctgagactccagaatct

SEQ ID NO: 403651 - DNA, 20 bp, Homo sapiens
ctgagactccagaatctgct

SEQ ID NO: 403652 - DNA, 21 bp, Homo sapiens
ctgagactccagaatctgctg

SEQ ID NO: 403653 - DNA, 15 bp, Homo sapiens
ctgagactgcagagg

SEQ ID NO: 403654 - DNA, 18 bp, Homo sapiens
ctgagagacttttaatca

SEQ ID NO: 403655 - DNA, 13 bp, Homo sapiens
ctgagagcatgtg

SEQ ID NO: 403656 - DNA, 20 bp, Homo sapiens
ctgagagcatgtgggggaag

SEQ ID NO: 403657 - DNA, 16 bp, Homo sapiens
ctgagagccccagctg

SEQ ID NO: 403658 - DNA, 17 bp, Homo sapiens
ctgagagccccagctga

SEQ ID NO: 403659 - DNA, 14 bp, Homo sapiens
ctgagagctcacag

SEQ ID NO: 403660 - DNA, 17 bp, Homo sapiens
ctgagagggctgtggct

SEQ ID NO: 403661 - DNA, 19 bp, Homo sapiens
ctgagagggctgtggctgg

SEQ ID NO: 403662 - DNA, 21 bp, Homo sapiens
ctgagagggctgtggctgggt

SEQ ID NO: 403663 - DNA, 23 bp, Homo sapiens
ctgagagggctgtggctgggtgg

SEQ ID NO: 403664 - DNA, 13 bp, Homo sapiens
ctgcacctgtgca

SEQ ID NO: 403665 - DNA, 11 bp, Homo sapiens
ctgcaccttgg

SEQ ID NO: 403666 - DNA, 18 bp, Homo sapiens
cagtacctgggaaaggac

SEQ ID NO: 403667 - DNA, 16 bp, Homo sapiens
cagtacctttgtcaca

SEQ ID NO: 403668 - DNA, 17 bp, Homo sapiens
cagtacctttgtcacaa

SEQ ID NO: 403669 - DNA, 12 bp, Homo sapiens
cagtactgggaa

SEQ ID NO: 403670 - DNA, 20 bp, Homo sapiens
cagtacttgagggaccaata

SEQ ID NO: 403671 - DNA, 17 bp, Homo sapiens
cagtacttgctcaataa

SEQ ID NO: 403672 - DNA, 21 bp, Homo sapiens
cagtactttatgaaaaaaata

SEQ ID NO: 403673 - DNA, 19 bp, Homo sapiens
cagtagaaataatatgcat

SEQ ID NO: 403674 - DNA, 15 bp, Homo sapiens
cagtagagagtgccc

SEQ ID NO: 403675 - DNA, 24 bp, Homo sapiens
cagtagagtagggtagaaggaaag

SEQ ID NO: 403676 - DNA, 21 bp, Homo sapiens
cagtagcatactgatgagaca

SEQ ID NO: 403677 - DNA, 19 bp, Homo sapiens
cagtagccattttgtaact

SEQ ID NO: 403678 - DNA, 22 bp, Homo sapiens
cagtagctgccaaaaagaacac

SEQ ID NO: 403679 - DNA, 13 bp, Homo sapiens
cagtagctgtggg

SEQ ID NO: 403680 - DNA, 19 bp, Homo sapiens
cagtagctgtggggagctg

SEQ ID NO: 403681 - DNA, 15 bp, Homo sapiens
cagtaggttggcagt

SEQ ID NO: 403682 - DNA, 18 bp, Homo sapiens
cagtagtcacctctgggc

SEQ ID NO: 403683 - DNA, 15 bp, Homo sapiens
cagtataaaagacaa

SEQ ID NO: 403684 - DNA, 18 bp, Homo sapiens
cagtataaaattacagtg

SEQ ID NO: 403685 - DNA, 22 bp, Homo sapiens
cagtataaaattacagtggatt

SEQ ID NO: 403686 - DNA, 15 bp, Homo sapiens
cagtatactgtgtgg

SEQ ID NO: 403687 - DNA, 13 bp, Homo sapiens
ctgcctgcctggg

SEQ ID NO: 403688 - DNA, 14 bp, Homo sapiens
ctgcctgcctgtct

SEQ ID NO: 403689 - DNA, 17 bp, Homo sapiens
ctgcctgcgaaacccag

SEQ ID NO: 403690 - DNA, 12 bp, Homo sapiens
ctgcctgctcct

SEQ ID NO: 403691 - DNA, 16 bp, Homo sapiens
ctgcctgctccttggc

SEQ ID NO: 403692 - DNA, 15 bp, Homo sapiens
ctgcctgctctgcag

SEQ ID NO: 403693 - DNA, 16 bp, Homo sapiens
ctgcctgctctgcagc

SEQ ID NO: 403694 - DNA, 22 bp, Homo sapiens
ctgcctgctctgcagcccacag

SEQ ID NO: 403695 - DNA, 12 bp, Homo sapiens
ctgcctggactt

SEQ ID NO: 403696 - DNA, 16 bp, Homo sapiens
ctgcctggagaaagga

SEQ ID NO: 403697 - DNA, 12 bp, Homo sapiens
ctgcctggccag

SEQ ID NO: 403698 - DNA, 13 bp, Homo sapiens
ctgcctggcccag

SEQ ID NO: 403699 - DNA, 14 bp, Homo sapiens
ctgcctggccccca

SEQ ID NO: 403700 - DNA, 20 bp, Homo sapiens
ctgcctggcccccagctgtg

SEQ ID NO: 403701 - DNA, 13 bp, Homo sapiens
ctgcctggcctgg

SEQ ID NO: 403702 - DNA, 15 bp, Homo sapiens
ctgcctggcgggcag

SEQ ID NO: 403703 - DNA, 22 bp, Homo sapiens
ctgcctggcgggcagcccctgc

SEQ ID NO: 403704 - DNA, 20 bp, Homo sapiens
ctgcctgggaacggggtgga

SEQ ID NO: 403705 - DNA, 18 bp, Homo sapiens
ctgcctgggcctgtgcag

SEQ ID NO: 403706 - DNA, 24 bp, Homo sapiens
ctgcctgggcctgtgcagcagccc

SEQ ID NO: 403707 - DNA, 22 bp, Homo sapiens
ctgcctgggttccaatcctggc

SEQ ID NO: 403708 - DNA, 15 bp, Homo sapiens
ctgcctggtatgagt

SEQ ID NO: 403709 - DNA, 19 bp, Homo sapiens
ctgcctgtaacttgagagt

SEQ ID NO: 403710 - DNA, 13 bp, Homo sapiens
ctgcctgtagtta

SEQ ID NO: 403711 - DNA, 20 bp, Homo sapiens
ctgcctgtagttaggaaata

SEQ ID NO: 403712 - DNA, 14 bp, Homo sapiens
ctgcctgtattttc

SEQ ID NO: 403713 - DNA, 20 bp, Homo sapiens
ctgcctgtccctctcaggca

SEQ ID NO: 403714 - DNA, 15 bp, Homo sapiens
ctgcctgtctgtctc

SEQ ID NO: 403715 - DNA, 13 bp, Homo sapiens
ctgcctgtgcatg

SEQ ID NO: 403716 - DNA, 18 bp, Homo sapiens
ctgcctgtgcatgacctg

SEQ ID NO: 403717 - DNA, 23 bp, Homo sapiens
ctgcctgtggccttgcccgccag

SEQ ID NO: 403718 - DNA, 13 bp, Homo sapiens
ctgcctgtgtgct

SEQ ID NO: 403719 - DNA, 22 bp, Homo sapiens
ctgcctgttataactctgcact

SEQ ID NO: 403720 - DNA, 15 bp, Homo sapiens
ctgcctgttcccatt

SEQ ID NO: 403721 - DNA, 13 bp, Homo sapiens
ctgcctgttcctt

SEQ ID NO: 403722 - DNA, 18 bp, Homo sapiens
ctgccttaaccttctggg

SEQ ID NO: 403723 - DNA, 23 bp, Homo sapiens
ctgccttagaggagcccacggct

SEQ ID NO: 403724 - DNA, 15 bp, Homo sapiens
ctgccttcagggaga

SEQ ID NO: 403725 - DNA, 19 bp, Homo sapiens
ctgccttcagtatcaaggc

SEQ ID NO: 403726 - DNA, 15 bp, Homo sapiens
ctgccttccagccca

SEQ ID NO: 403727 - DNA, 20 bp, Homo sapiens
ctgccttcgttaactgtgta

SEQ ID NO: 403728 - DNA, 11 bp, Homo sapiens
ctgccttctct

SEQ ID NO: 403729 - DNA, 21 bp, Homo sapiens
ctgccttgatggagaaggaaa

SEQ ID NO: 403730 - DNA, 21 bp, Homo sapiens
ctgccttgctgcacctgaggc

SEQ ID NO: 403731 - DNA, 13 bp, Homo sapiens
ctgccttggacac

SEQ ID NO: 403732 - DNA, 21 bp, Homo sapiens
ctgccttggacaccatcccct

SEQ ID NO: 403733 - DNA, 22 bp, Homo sapiens
ctgcctttcttccatcagctct

SEQ ID NO: 403734 - DNA, 11 bp, Homo sapiens
ctgcctttgtt

SEQ ID NO: 403735 - DNA, 18 bp, Homo sapiens
ctgccttttctcattctg

SEQ ID NO: 403736 - DNA, 17 bp, Homo sapiens
ctgcgaaacccagcgtt

SEQ ID NO: 403737 - DNA, 22 bp, Homo sapiens
ctgcgaaacccagcgttcttca

SEQ ID NO: 403738 - DNA, 14 bp, Homo sapiens
ctgcgaactgtgca

SEQ ID NO: 403739 - DNA, 14 bp, Homo sapiens
ctgcgagcaacagt

SEQ ID NO: 403740 - DNA, 20 bp, Homo sapiens
ctgcgagctccttgggtcct

SEQ ID NO: 403741 - DNA, 13 bp, Homo sapiens
ctgcgcaggccct

SEQ ID NO: 403742 - DNA, 17 bp, Homo sapiens
ctgcgcaggccctccgc

SEQ ID NO: 403743 - DNA, 16 bp, Homo sapiens
ctgcgccctccctccc

SEQ ID NO: 403744 - DNA, 13 bp, Homo sapiens
ctgcgcccttccc

SEQ ID NO: 403745 - DNA, 14 bp, Homo sapiens
ctgcgcctgcccgc

SEQ ID NO: 403746 - DNA, 13 bp, Homo sapiens
ctgcgcctggctc

SEQ ID NO: 403747 - DNA, 14 bp, Homo sapiens
ctgcgcctggctct

SEQ ID NO: 403748 - DNA, 18 bp, Homo sapiens
ctgcgcctggctctgtca

SEQ ID NO: 403749 - DNA, 15 bp, Homo sapiens
ctgcgctcctctgca

SEQ ID NO: 403750 - DNA, 16 bp, Homo sapiens
ctgcgctcctctgcag

SEQ ID NO: 403751 - DNA, 14 bp, Homo sapiens
ctgcggactccatg

SEQ ID NO: 403752 - DNA, 17 bp, Homo sapiens
ctgcggagctgcatgga

SEQ ID NO: 403753 - DNA, 20 bp, Homo sapiens
ctgcggatagcatttggtag

SEQ ID NO: 403754 - DNA, 12 bp, Homo sapiens
ctgcggctgctg

SEQ ID NO: 403755 - DNA, 14 bp, Homo sapiens
ctgcggctgctggc

SEQ ID NO: 403756 - DNA, 16 bp, Homo sapiens
ctgcgggtctgaagga

SEQ ID NO: 403757 - DNA, 23 bp, Homo sapiens
ctgcgggtgggtatcccacctcc

SEQ ID NO: 403758 - DNA, 14 bp, Homo sapiens
ctgcggtgggcagc

SEQ ID NO: 403759 - DNA, 15 bp, Homo sapiens
ctgcggtgggcagcc

SEQ ID NO: 403760 - DNA, 17 bp, Homo sapiens
ctgcggtgggcagccat

SEQ ID NO: 403761 - DNA, 22 bp, Homo sapiens
ctgcggtttgttggatcttcaa

SEQ ID NO: 403762 - DNA, 20 bp, Homo sapiens
ctgcgtcagaccagtactgg

SEQ ID NO: 403763 - DNA, 18 bp, Homo sapiens
ctgcgtcatggctcaagg

SEQ ID NO: 403764 - DNA, 18 bp, Homo sapiens
ctgcgtcctgacgccctg

SEQ ID NO: 403765 - DNA, 23 bp, Homo sapiens
ctgcgtgtgatttgtctctgagc

SEQ ID NO: 403766 - DNA, 15 bp, Homo sapiens
ctgcgttggagccac

SEQ ID NO: 403767 - DNA, 21 bp, Homo sapiens
ctgcgttggagccactcctgt

SEQ ID NO: 403768 - DNA, 14 bp, Homo sapiens
ctgctaaatgactt

SEQ ID NO: 403769 - DNA, 17 bp, Homo sapiens
ctgctaaggctcctcct

SEQ ID NO: 403770 - DNA, 13 bp, Homo sapiens
ctgctaataaatg

SEQ ID NO: 403771 - DNA, 21 bp, Homo sapiens
ctgctaataaatgaccagttt

SEQ ID NO: 403772 - DNA, 23 bp, Homo sapiens
ctgctaataaatgaccagtttac

SEQ ID NO: 403773 - DNA, 23 bp, Homo sapiens
ctgctaatcatgtgggtgagcca

SEQ ID NO: 403774 - DNA, 18 bp, Homo sapiens
ctgctaatcttcagggca

SEQ ID NO: 403775 - DNA, 20 bp, Homo sapiens
ctgctaccgccctgggctgg

SEQ ID NO: 403776 - DNA, 16 bp, Homo sapiens
ctgctactccactgac

SEQ ID NO: 403777 - DNA, 19 bp, Homo sapiens
ctgctactccactgacctg

SEQ ID NO: 403778 - DNA, 20 bp, Homo sapiens
ctgctactccactgacctgg

SEQ ID NO: 403779 - DNA, 23 bp, Homo sapiens
ctgctactccactgacctggaag

SEQ ID NO: 403780 - DNA, 13 bp, Homo sapiens
ctgctagagcaac

SEQ ID NO: 403781 - DNA, 23 bp, Homo sapiens
ctgctagagcaacccctgtaccc

SEQ ID NO: 403782 - DNA, 16 bp, Homo sapiens
ctgctaggtgggccag

SEQ ID NO: 403783 - DNA, 22 bp, Homo sapiens
ctgctaggtgggccagcccctc

SEQ ID NO: 403784 - DNA, 20 bp, Homo sapiens
ctgctatatgccttaagcca

SEQ ID NO: 403785 - DNA, 17 bp, Homo sapiens
ctgctatattaggcctg

SEQ ID NO: 403786 - DNA, 18 bp, Homo sapiens
ctgctatgtctgtgatgt

SEQ ID NO: 403787 - DNA, 13 bp, Homo sapiens
ctgctatttccca

SEQ ID NO: 403788 - DNA, 17 bp, Homo sapiens
ctgctatttcccaagct

SEQ ID NO: 403789 - DNA, 23 bp, Homo sapiens
ctgctatttcccaagctggagtg

SEQ ID NO: 403790 - DNA, 14 bp, Homo sapiens
ctgctcacattccc

SEQ ID NO: 403791 - DNA, 18 bp, Homo sapiens
ctgctcacattccctctc

SEQ ID NO: 403792 - DNA, 19 bp, Homo sapiens
ctgctcacattccctctca

SEQ ID NO: 403793 - DNA, 13 bp, Homo sapiens
ctgctcagctggc

SEQ ID NO: 403794 - DNA, 16 bp, Homo sapiens
ctgctcagctggccgg

SEQ ID NO: 403795 - DNA, 16 bp, Homo sapiens
ctgctcaggcctcacc

SEQ ID NO: 403796 - DNA, 14 bp, Homo sapiens
cagtgaacataact

SEQ ID NO: 403797 - DNA, 22 bp, Homo sapiens
cagtgaagcccaggaggacctg

SEQ ID NO: 403798 - DNA, 19 bp, Homo sapiens
cagtgaatcttatggtgga

SEQ ID NO: 403799 - DNA, 12 bp, Homo sapiens
cagtgaattctt

SEQ ID NO: 403800 - DNA, 18 bp, Homo sapiens
cagtgacacttcagagag

SEQ ID NO: 403801 - DNA, 19 bp, Homo sapiens
cagtgacacttcagagagc

SEQ ID NO: 403802 - DNA, 16 bp, Homo sapiens
cagtgacagagttcac

SEQ ID NO: 403803 - DNA, 13 bp, Homo sapiens
cagtgactccagg

SEQ ID NO: 403804 - DNA, 17 bp, Homo sapiens
cagtgactccaggagag

SEQ ID NO: 403805 - DNA, 21 bp, Homo sapiens
cagtgactccaggagaggagc

SEQ ID NO: 403806 - DNA, 13 bp, Homo sapiens
cagtgactggcag

SEQ ID NO: 403807 - DNA, 14 bp, Homo sapiens
cagtgactggcagg

SEQ ID NO: 403808 - DNA, 23 bp, Homo sapiens
cagtgagacagccggatcttgga

SEQ ID NO: 403809 - DNA, 18 bp, Homo sapiens
cagtgagagtactcactt

SEQ ID NO: 403810 - DNA, 21 bp, Homo sapiens
cagtgagagtactcacttttc

SEQ ID NO: 403811 - DNA, 13 bp, Homo sapiens
cagtgagcccctc

SEQ ID NO: 403812 - DNA, 14 bp, Homo sapiens
cagtgagcccctcc

SEQ ID NO: 403813 - DNA, 17 bp, Homo sapiens
cagtgagcccctcccca

SEQ ID NO: 403814 - DNA, 14 bp, Homo sapiens
cagtgagctcagga

SEQ ID NO: 403815 - DNA, 15 bp, Homo sapiens
cagtgaggagggtgg

SEQ ID NO: 403816 - DNA, 21 bp, Homo sapiens
cagtgaggagggtggaggaag

SEQ ID NO: 403817 - DNA, 13 bp, Homo sapiens
cagtgaggcccag

SEQ ID NO: 403818 - DNA, 21 bp, Homo sapiens
cagtgaggcccagggagaggc

SEQ ID NO: 403819 - DNA, 15 bp, Homo sapiens
cagtgatctccatat

SEQ ID NO: 403820 - DNA, 12 bp, Homo sapiens
cagtgatggcat

SEQ ID NO: 403821 - DNA, 18 bp, Homo sapiens
cagtgatggcattactct

SEQ ID NO: 403822 - DNA, 22 bp, Homo sapiens
cagtgatggcgcgggaggcacc

SEQ ID NO: 403823 - DNA, 14 bp, Homo sapiens
cagtgatgggagta

SEQ ID NO: 403824 - DNA, 21 bp, Homo sapiens
cagtgatgggagtaagagcaa

SEQ ID NO: 403825 - DNA, 16 bp, Homo sapiens
cagtgatttacatgct

SEQ ID NO: 403826 - DNA, 21 bp, Homo sapiens
ctgagccacagtggggcccat

SEQ ID NO: 403827 - DNA, 17 bp, Homo sapiens
ctgagccacggaccgca

SEQ ID NO: 403828 - DNA, 17 bp, Homo sapiens
ctgagccactcgcagtc

SEQ ID NO: 403829 - DNA, 16 bp, Homo sapiens
ctgagccaggagcctc

SEQ ID NO: 403830 - DNA, 11 bp, Homo sapiens
ctgagcccagg

SEQ ID NO: 403831 - DNA, 13 bp, Homo sapiens
ctgagcccaggag

SEQ ID NO: 403832 - DNA, 15 bp, Homo sapiens
ctgagcccaggccgt

SEQ ID NO: 403833 - DNA, 16 bp, Homo sapiens
ctgagcccaggccgtt

SEQ ID NO: 403834 - DNA, 15 bp, Homo sapiens
ctgagccccacctct

SEQ ID NO: 403835 - DNA, 23 bp, Homo sapiens
ctgagccccacctctccaagtct

SEQ ID NO: 403836 - DNA, 20 bp, Homo sapiens
ctgagcccccacctgcctga

SEQ ID NO: 403837 - DNA, 22 bp, Homo sapiens
ctgagcccccggctagtaccct

SEQ ID NO: 403838 - DNA, 15 bp, Homo sapiens
ctgagccccctgcac

SEQ ID NO: 403839 - DNA, 14 bp, Homo sapiens
ctgagccccctgtg

SEQ ID NO: 403840 - DNA, 16 bp, Homo sapiens
ctgagccccctgtgcc

SEQ ID NO: 403841 - DNA, 20 bp, Homo sapiens
ctgagccccctgtgcccacc

SEQ ID NO: 403842 - DNA, 14 bp, Homo sapiens
ctgagcccctaccc

SEQ ID NO: 403843 - DNA, 13 bp, Homo sapiens
ctgagcccctcct

SEQ ID NO: 403844 - DNA, 15 bp, Homo sapiens
ctgagcccctcctct

SEQ ID NO: 403845 - DNA, 18 bp, Homo sapiens
ctgagccctccctcttcc

SEQ ID NO: 403846 - DNA, 22 bp, Homo sapiens
ctgagccctccttcttgccctg

SEQ ID NO: 403847 - DNA, 21 bp, Homo sapiens
ctgagcccttgcacaggccac

SEQ ID NO: 403848 - DNA, 17 bp, Homo sapiens
ctgagcctacagatgaa

SEQ ID NO: 403849 - DNA, 18 bp, Homo sapiens
ctgagcctacagatgaac

SEQ ID NO: 403850 - DNA, 16 bp, Homo sapiens
ctgagcctactgtctc

SEQ ID NO: 403851 - DNA, 18 bp, Homo sapiens
ctgagcctactgtctcct

SEQ ID NO: 403852 - DNA, 21 bp, Homo sapiens
ctgagcctactgtctccttcc

SEQ ID NO: 403853 - DNA, 17 bp, Homo sapiens
ctgagcctgaggccttc

SEQ ID NO: 403854 - DNA, 17 bp, Homo sapiens
ctgagcgattattatct

SEQ ID NO: 403855 - DNA, 22 bp, Homo sapiens
ctgagcgggtctagtggaaaga

SEQ ID NO: 403856 - DNA, 19 bp, Homo sapiens
ctgagctataacatttgct

SEQ ID NO: 403857 - DNA, 17 bp, Homo sapiens
ctgagctcctctgggca

SEQ ID NO: 403858 - DNA, 20 bp, Homo sapiens
ctgagctcctctgggcagga

SEQ ID NO: 403859 - DNA, 23 bp, Homo sapiens
ctgagctcctctgggcaggacct

SEQ ID NO: 403860 - DNA, 13 bp, Homo sapiens
ctgagctctgacc

SEQ ID NO: 403861 - DNA, 14 bp, Homo sapiens
ctgagctctgacct

SEQ ID NO: 403862 - DNA, 13 bp, Homo sapiens
ctgagctgccagt

SEQ ID NO: 403863 - DNA, 13 bp, Homo sapiens
ctgagctggaaag

SEQ ID NO: 403864 - DNA, 12 bp, Homo sapiens
ctgagctgggct

SEQ ID NO: 403865 - DNA, 13 bp, Homo sapiens
ctgagctggggcc

SEQ ID NO: 403866 - DNA, 15 bp, Homo sapiens
ctgagctggggccac

SEQ ID NO: 403867 - DNA, 22 bp, Homo sapiens
ctgagctgtgttttgtctgagc

SEQ ID NO: 403868 - DNA, 17 bp, Homo sapiens
ctgagcttagccttgtg

SEQ ID NO: 403869 - DNA, 20 bp, Homo sapiens
ctgagcttagccttgtgccc

SEQ ID NO: 403870 - DNA, 22 bp, Homo sapiens
ctgagcttagccttgtgccctg

SEQ ID NO: 403871 - DNA, 24 bp, Homo sapiens
ctgagcttagccttgtgccctgcc

SEQ ID NO: 403872 - DNA, 20 bp, Homo sapiens
ctgagcttcggttctccaga

SEQ ID NO: 403873 - DNA, 21 bp, Homo sapiens
ctgagcttcggttctccagaa

SEQ ID NO: 403874 - DNA, 15 bp, Homo sapiens
ctgagcttctctgtg

SEQ ID NO: 403875 - DNA, 16 bp, Homo sapiens
ctgagcttgagctccc

SEQ ID NO: 403876 - DNA, 20 bp, Homo sapiens
ctgagcttgagctcccctgg

SEQ ID NO: 403877 - DNA, 18 bp, Homo sapiens
ctgagcttggccagaagg

SEQ ID NO: 403878 - DNA, 19 bp, Homo sapiens
ctgagctttccggggagga

SEQ ID NO: 403879 - DNA, 20 bp, Homo sapiens
ctgagctttccggggaggag

SEQ ID NO: 403880 - DNA, 23 bp, Homo sapiens
ctgagctttccggggaggagcct

SEQ ID NO: 403881 - DNA, 23 bp, Homo sapiens
ctgagctttggacacacacagct

SEQ ID NO: 403882 - DNA, 22 bp, Homo sapiens
ctgagctttggacgcacacagc

SEQ ID NO: 403883 - DNA, 21 bp, Homo sapiens
ctgagctttggggacagttgg

SEQ ID NO: 403884 - DNA, 18 bp, Homo sapiens
ctgagcttttcatggaag

SEQ ID NO: 403885 - DNA, 20 bp, Homo sapiens
ctgagcttttcatggaagtg

SEQ ID NO: 403886 - DNA, 22 bp, Homo sapiens
ctgaggaaggaggggaagctgc

SEQ ID NO: 403887 - DNA, 23 bp, Homo sapiens
ctgaggacaggggcatctctggg

SEQ ID NO: 403888 - DNA, 15 bp, Homo sapiens
ctgaggacggggcag

SEQ ID NO: 403889 - DNA, 17 bp, Homo sapiens
ctgaggacggggcagag

SEQ ID NO: 403890 - DNA, 19 bp, Homo sapiens
ctgaggacggggcagagct

SEQ ID NO: 403891 - DNA, 21 bp, Homo sapiens
ctgaggacggggcagagctga

SEQ ID NO: 403892 - DNA, 22 bp, Homo sapiens
ctgaggacggggcagagctgag

SEQ ID NO: 403893 - DNA, 20 bp, Homo sapiens
ctgaggactccctccatgtg

SEQ ID NO: 403894 - DNA, 14 bp, Homo sapiens
ctgaggactctgga

SEQ ID NO: 403895 - DNA, 15 bp, Homo sapiens
ctgaggactctggac

SEQ ID NO: 403896 - DNA, 15 bp, Homo sapiens
ctgaggatgagacag

SEQ ID NO: 403897 - DNA, 16 bp, Homo sapiens
ctgaggatgagctgga

SEQ ID NO: 403898 - DNA, 12 bp, Homo sapiens
ctgaggcaagag

SEQ ID NO: 403899 - DNA, 21 bp, Homo sapiens
ctgaggcagaacctggtggct

SEQ ID NO: 403900 - DNA, 12 bp, Homo sapiens
ctgaggcaggag

SEQ ID NO: 403901 - DNA, 21 bp, Homo sapiens
ctgaggccaggacgtctgggg

SEQ ID NO: 403902 - DNA, 21 bp, Homo sapiens
ctgaggccattccctgtagga

SEQ ID NO: 403903 - DNA, 19 bp, Homo sapiens
ctgaggcccagcagagccg

SEQ ID NO: 403904 - DNA, 22 bp, Homo sapiens
ctgaggcccagcagagccgttc

SEQ ID NO: 403905 - DNA, 11 bp, Homo sapiens
ctgaggcctca

SEQ ID NO: 403906 - DNA, 12 bp, Homo sapiens
ctgaggcctgga

SEQ ID NO: 403907 - DNA, 19 bp, Homo sapiens
ctgaggcctggactttcct

SEQ ID NO: 403908 - DNA, 22 bp, Homo sapiens
ctgaggctctgacccagtgaga

SEQ ID NO: 403909 - DNA, 23 bp, Homo sapiens
ctgaggctctgacccagtgagat

SEQ ID NO: 403910 - DNA, 14 bp, Homo sapiens
ctgaggctggggct

SEQ ID NO: 403911 - DNA, 17 bp, Homo sapiens
ctgaggcttgggcccag

SEQ ID NO: 403912 - DNA, 23 bp, Homo sapiens
ctgagggaagcccacccgcccca

SEQ ID NO: 403913 - DNA, 16 bp, Homo sapiens
ctgagggaccaactgg

SEQ ID NO: 403914 - DNA, 20 bp, Homo sapiens
ctgagggaccttggagagct

SEQ ID NO: 403915 - DNA, 23 bp, Homo sapiens
ctgagggaccttggagagctcag

SEQ ID NO: 403916 - DNA, 14 bp, Homo sapiens
ctgagggccacact

SEQ ID NO: 403917 - DNA, 18 bp, Homo sapiens
ctgagggcccctctgccc

SEQ ID NO: 403918 - DNA, 22 bp, Homo sapiens
ctgagggcccctctgcccagct

SEQ ID NO: 403919 - DNA, 16 bp, Homo sapiens
ctgagggcgaggggag

SEQ ID NO: 403920 - DNA, 18 bp, Homo sapiens
ctgagggctaattctggg

SEQ ID NO: 403921 - DNA, 21 bp, Homo sapiens
ctgaggggcaacgaagaaaaa

SEQ ID NO: 403922 - DNA, 17 bp, Homo sapiens
ctgaggggcatctgccc

SEQ ID NO: 403923 - DNA, 15 bp, Homo sapiens
ctgagggtggagact

SEQ ID NO: 403924 - DNA, 22 bp, Homo sapiens
ctgagggtgttagtacctagtg

SEQ ID NO: 403925 - DNA, 19 bp, Homo sapiens
ctgaggtctcttgagggag

SEQ ID NO: 403926 - DNA, 15 bp, Homo sapiens
ctgaggtctggattg

SEQ ID NO: 403927 - DNA, 20 bp, Homo sapiens
ctgagtagctggattacagg

SEQ ID NO: 403928 - DNA, 17 bp, Homo sapiens
ctgagtcacctcctcca

SEQ ID NO: 403929 - DNA, 20 bp, Homo sapiens
ctgagtcagggcccagaggc

SEQ ID NO: 403930 - DNA, 23 bp, Homo sapiens
ctgagtcagggcccagaggctga

SEQ ID NO: 403931 - DNA, 12 bp, Homo sapiens
ctgagtcatcaa

SEQ ID NO: 403932 - DNA, 17 bp, Homo sapiens
ctgagtccactgctcca

SEQ ID NO: 403933 - DNA, 18 bp, Homo sapiens
ctgagtccactgctccat

SEQ ID NO: 403934 - DNA, 15 bp, Homo sapiens
ctgagtcctgttctt

SEQ ID NO: 403935 - DNA, 15 bp, Homo sapiens
ctgagtccttaaaca

SEQ ID NO: 403936 - DNA, 20 bp, Homo sapiens
ctgagtcggccccacatggg

SEQ ID NO: 403937 - DNA, 17 bp, Homo sapiens
ctgagtcggctgggcag

SEQ ID NO: 403938 - DNA, 18 bp, Homo sapiens
ctgagtcggctgggcagg

SEQ ID NO: 403939 - DNA, 22 bp, Homo sapiens
ctgagtctggcaaacatgtgca

SEQ ID NO: 403940 - DNA, 16 bp, Homo sapiens
caggccccctgcatct

SEQ ID NO: 403941 - DNA, 14 bp, Homo sapiens
caggcccctgagga

SEQ ID NO: 403942 - DNA, 17 bp, Homo sapiens
caggcccctgaggactg

SEQ ID NO: 403943 - DNA, 20 bp, Homo sapiens
caggcccgagatgtgaccca

SEQ ID NO: 403944 - DNA, 21 bp, Homo sapiens
caggccctagaccctccccca

SEQ ID NO: 403945 - DNA, 14 bp, Homo sapiens
caggccctccatgg

SEQ ID NO: 403946 - DNA, 16 bp, Homo sapiens
caggccctccatgggc

SEQ ID NO: 403947 - DNA, 17 bp, Homo sapiens
caggccctccatgggct

SEQ ID NO: 403948 - DNA, 21 bp, Homo sapiens
caggccctccatgggctagtg

SEQ ID NO: 403949 - DNA, 15 bp, Homo sapiens
caggccctccctgtc

SEQ ID NO: 403950 - DNA, 16 bp, Homo sapiens
caggccctccctgtct

SEQ ID NO: 403951 - DNA, 15 bp, Homo sapiens
caggccctcctgctg

SEQ ID NO: 403952 - DNA, 17 bp, Homo sapiens
caggccctcctgctggc

SEQ ID NO: 403953 - DNA, 22 bp, Homo sapiens
caggccgcatggcccctccagg

SEQ ID NO: 403954 - DNA, 14 bp, Homo sapiens
caggccgccccagc

SEQ ID NO: 403955 - DNA, 16 bp, Homo sapiens
caggccgccccagcct

SEQ ID NO: 403956 - DNA, 18 bp, Homo sapiens
caggccgccccagcctct

SEQ ID NO: 403957 - DNA, 13 bp, Homo sapiens
caggccggccagc

SEQ ID NO: 403958 - DNA, 19 bp, Homo sapiens
caggccggggtggagcatg

SEQ ID NO: 403959 - DNA, 23 bp, Homo sapiens
caggccgttccccttggcttcct

SEQ ID NO: 403960 - DNA, 16 bp, Homo sapiens
caggcctcacctggct

SEQ ID NO: 403961 - DNA, 17 bp, Homo sapiens
caggcctcacctggctt

SEQ ID NO: 403962 - DNA, 14 bp, Homo sapiens
caggcctccagcct

SEQ ID NO: 403963 - DNA, 12 bp, Homo sapiens
caggcctccctc

SEQ ID NO: 403964 - DNA, 15 bp, Homo sapiens
caggcctccctctct

SEQ ID NO: 403965 - DNA, 17 bp, Homo sapiens
caggcctccctctctct

SEQ ID NO: 403966 - DNA, 22 bp, Homo sapiens
caggcctgaaagaggctgaggc

SEQ ID NO: 403967 - DNA, 13 bp, Homo sapiens
caggcctgccaat

SEQ ID NO: 403968 - DNA, 17 bp, Homo sapiens
caggcctgccaatgcca

SEQ ID NO: 403969 - DNA, 20 bp, Homo sapiens
caggcctgccaatgccacag

SEQ ID NO: 403970 - DNA, 12 bp, Homo sapiens
caggcctggagc

SEQ ID NO: 403971 - DNA, 17 bp, Homo sapiens
caggcctggcaagtggg

SEQ ID NO: 403972 - DNA, 20 bp, Homo sapiens
caggcctggcaagtgggtga

SEQ ID NO: 403973 - DNA, 12 bp, Homo sapiens
caggcctggccc

SEQ ID NO: 403974 - DNA, 21 bp, Homo sapiens
caggcctggcccagccagcag

SEQ ID NO: 403975 - DNA, 22 bp, Homo sapiens
caggcctggcccagccagcagg

SEQ ID NO: 403976 - DNA, 18 bp, Homo sapiens
caggcctgggacccagct

SEQ ID NO: 403977 - DNA, 14 bp, Homo sapiens
caggcctgggtctg

SEQ ID NO: 403978 - DNA, 18 bp, Homo sapiens
caggcctgggtctgtgtc

SEQ ID NO: 403979 - DNA, 16 bp, Homo sapiens
caggcctgttgctttt

SEQ ID NO: 403980 - DNA, 12 bp, Homo sapiens
caggccttctga

SEQ ID NO: 403981 - DNA, 17 bp, Homo sapiens
caggcctttcaggaagg

SEQ ID NO: 403982 - DNA, 12 bp, Homo sapiens
caggcctttcct

SEQ ID NO: 403983 - DNA, 19 bp, Homo sapiens
caggcgatccacctgtctc

SEQ ID NO: 403984 - DNA, 14 bp, Homo sapiens
caggcgcagcccta

SEQ ID NO: 403985 - DNA, 15 bp, Homo sapiens
caggcgcagccctag

SEQ ID NO: 403986 - DNA, 15 bp, Homo sapiens
caggcgccccttccc

SEQ ID NO: 403987 - DNA, 21 bp, Homo sapiens
caggcgcgcaccgcccaaccc

SEQ ID NO: 403988 - DNA, 13 bp, Homo sapiens
caggcggaggggc

SEQ ID NO: 403989 - DNA, 17 bp, Homo sapiens
caggcggaggggcttgg

SEQ ID NO: 403990 - DNA, 23 bp, Homo sapiens
caggcggaggggcttggagcaga

SEQ ID NO: 403991 - DNA, 19 bp, Homo sapiens
caggcggtatccagaggtg

SEQ ID NO: 403992 - DNA, 21 bp, Homo sapiens
caggcggtccccatccccacc

SEQ ID NO: 403993 - DNA, 17 bp, Homo sapiens
caggcgtagggccaggg

SEQ ID NO: 403994 - DNA, 17 bp, Homo sapiens
caggcgttggtgccact

SEQ ID NO: 403995 - DNA, 20 bp, Homo sapiens
caggcgttggtgccacttct

SEQ ID NO: 403996 - DNA, 14 bp, Homo sapiens
caggctactctcct

SEQ ID NO: 403997 - DNA, 16 bp, Homo sapiens
caggctactctcctcg

SEQ ID NO: 403998 - DNA, 20 bp, Homo sapiens
caggctagaatggaaaactg

SEQ ID NO: 403999 - DNA, 23 bp, Homo sapiens
caggctagtccggacccacctca

SEQ ID NO: 404000 - DNA, 15 bp, Homo sapiens
caggctcaagcactt

SEQ ID NO: 404001 - DNA, 15 bp, Homo sapiens
caggctcacaactgt

SEQ ID NO: 404002 - DNA, 13 bp, Homo sapiens
caggctccaggct

SEQ ID NO: 404003 - DNA, 14 bp, Homo sapiens
caggctccaggctg

SEQ ID NO: 404004 - DNA, 15 bp, Homo sapiens
caggctccaggctga

SEQ ID NO: 404005 - DNA, 22 bp, Homo sapiens
caggctccaggctgactggggg

SEQ ID NO: 404006 - DNA, 13 bp, Homo sapiens
caggctcctctcc

SEQ ID NO: 404007 - DNA, 20 bp, Homo sapiens
caggctcgggctccccagcc

SEQ ID NO: 404008 - DNA, 12 bp, Homo sapiens
caggctctccct

SEQ ID NO: 404009 - DNA, 14 bp, Homo sapiens
caggctctgctgac

SEQ ID NO: 404010 - DNA, 17 bp, Homo sapiens
caggctctgctgacttc

SEQ ID NO: 404011 - DNA, 12 bp, Homo sapiens
caggctctgggc

SEQ ID NO: 404012 - DNA, 13 bp, Homo sapiens
caggctctgggct

SEQ ID NO: 404013 - DNA, 16 bp, Homo sapiens
caggctctgggctcag

SEQ ID NO: 404014 - DNA, 18 bp, Homo sapiens
caggctctgggctcaggg

SEQ ID NO: 404015 - DNA, 20 bp, Homo sapiens
caggctctgggctcagggct

SEQ ID NO: 404016 - DNA, 23 bp, Homo sapiens
caggctctgggctcagggctgga

SEQ ID NO: 404017 - DNA, 12 bp, Homo sapiens
caggctcttagc

SEQ ID NO: 404018 - DNA, 14 bp, Homo sapiens
caggctcttcctgg

SEQ ID NO: 404019 - DNA, 18 bp, Homo sapiens
caggctcttcctggacct

SEQ ID NO: 404020 - DNA, 22 bp, Homo sapiens
caggctcttcctggacctgagt

SEQ ID NO: 404021 - DNA, 15 bp, Homo sapiens
caggctcttctcctt

SEQ ID NO: 404022 - DNA, 22 bp, Homo sapiens
caggctcttctcctttcacaac

SEQ ID NO: 404023 - DNA, 19 bp, Homo sapiens
caggctgaattacagtgaa

SEQ ID NO: 404024 - DNA, 13 bp, Homo sapiens
caggctgcactgc

SEQ ID NO: 404025 - DNA, 14 bp, Homo sapiens
caggctgcactgca

SEQ ID NO: 404026 - DNA, 15 bp, Homo sapiens
caggctgcactgcag

SEQ ID NO: 404027 - DNA, 17 bp, Homo sapiens
caggctgcagcaggcag

SEQ ID NO: 404028 - DNA, 18 bp, Homo sapiens
caggctgcagcaggcaga

SEQ ID NO: 404029 - DNA, 20 bp, Homo sapiens
caggctgcagcaggcagagg

SEQ ID NO: 404030 - DNA, 23 bp, Homo sapiens
caggctgcagcaggcagaggaga

SEQ ID NO: 404031 - DNA, 13 bp, Homo sapiens
caggctgcgcctg

SEQ ID NO: 404032 - DNA, 16 bp, Homo sapiens
caggctgcgcctgccc

SEQ ID NO: 404033 - DNA, 17 bp, Homo sapiens
caggctgcgcctgcccg

SEQ ID NO: 404034 - DNA, 20 bp, Homo sapiens
caggctgcgcctgcccgccc

SEQ ID NO: 404035 - DNA, 18 bp, Homo sapiens
caggctgcggtgggcagc

SEQ ID NO: 404036 - DNA, 21 bp, Homo sapiens
caggctgcggtgggcagccat

SEQ ID NO: 404037 - DNA, 16 bp, Homo sapiens
caggctgctggaggaa

SEQ ID NO: 404038 - DNA, 15 bp, Homo sapiens
caggctgcttgggat

SEQ ID NO: 404039 - DNA, 20 bp, Homo sapiens
caggctggcagctctccagt

SEQ ID NO: 404040 - DNA, 22 bp, Homo sapiens
caggctgggcacggctccgagg

SEQ ID NO: 404041 - DNA, 12 bp, Homo sapiens
caggctggggcc

SEQ ID NO: 404042 - DNA, 13 bp, Homo sapiens
caggctggtctca

SEQ ID NO: 404043 - DNA, 22 bp, Homo sapiens
caggctggtcttgaactcctga

SEQ ID NO: 404044 - DNA, 18 bp, Homo sapiens
caggctggttcttgggct

SEQ ID NO: 404045 - DNA, 15 bp, Homo sapiens
caggctgtcagcgcc

SEQ ID NO: 404046 - DNA, 21 bp, Homo sapiens
caggctgtcagcgcctcaagg

SEQ ID NO: 404047 - DNA, 17 bp, Homo sapiens
caggctgtgggcctcaa

SEQ ID NO: 404048 - DNA, 21 bp, Homo sapiens
caggctgtgtgtggggcccaa

SEQ ID NO: 404049 - DNA, 24 bp, Homo sapiens
caggctgtgtgtggggcccaagca

SEQ ID NO: 404050 - DNA, 18 bp, Homo sapiens
caggctgtttttgggtgc

SEQ ID NO: 404051 - DNA, 17 bp, Homo sapiens
caggcttggcaaagaag

SEQ ID NO: 404052 - DNA, 17 bp, Homo sapiens
caggcttgggctccatt

SEQ ID NO: 404053 - DNA, 21 bp, Homo sapiens
caggctttgggaacactggcc

SEQ ID NO: 404054 - DNA, 21 bp, Homo sapiens
caggcttttttccagactcta

SEQ ID NO: 404055 - DNA, 14 bp, Homo sapiens
cagggaaaatatag

SEQ ID NO: 404056 - DNA, 15 bp, Homo sapiens
cagggaaagctccac

SEQ ID NO: 404057 - DNA, 20 bp, Homo sapiens
cagggaactgcttgcccagg

SEQ ID NO: 404058 - DNA, 18 bp, Homo sapiens
cagggaactgggaagatg

SEQ ID NO: 404059 - DNA, 17 bp, Homo sapiens
cagggaagctggccgag

SEQ ID NO: 404060 - DNA, 16 bp, Homo sapiens
cagggaatagtgggat

SEQ ID NO: 404061 - DNA, 22 bp, Homo sapiens
cagggaatccagctccctagac

SEQ ID NO: 404062 - DNA, 19 bp, Homo sapiens
cagggacacaaagaggaat

SEQ ID NO: 404063 - DNA, 14 bp, Homo sapiens
cagggacagcagcc

SEQ ID NO: 404064 - DNA, 15 bp, Homo sapiens
cagggactgtacctg

SEQ ID NO: 404065 - DNA, 13 bp, Homo sapiens
cagggagaccctg

SEQ ID NO: 404066 - DNA, 18 bp, Homo sapiens
cagggagaccctgggaga

SEQ ID NO: 404067 - DNA, 19 bp, Homo sapiens
cagggagaccctgggagag

SEQ ID NO: 404068 - DNA, 15 bp, Homo sapiens
cagggagcaagacag

SEQ ID NO: 404069 - DNA, 20 bp, Homo sapiens
cagggagggcttggggctgc

SEQ ID NO: 404070 - DNA, 14 bp, Homo sapiens
cagggaggggaggc

SEQ ID NO: 404071 - DNA, 17 bp, Homo sapiens
cagggaggggaggcaga

SEQ ID NO: 404072 - DNA, 22 bp, Homo sapiens
cagggaggggctgagtctggct

SEQ ID NO: 404073 - DNA, 17 bp, Homo sapiens
cagggaggtcaggccct

SEQ ID NO: 404074 - DNA, 20 bp, Homo sapiens
cagggaggtcaggccctgga

SEQ ID NO: 404075 - DNA, 13 bp, Homo sapiens
ctgagtctggcta

SEQ ID NO: 404076 - DNA, 16 bp, Homo sapiens
ctgagtctggctaggg

SEQ ID NO: 404077 - DNA, 22 bp, Homo sapiens
ctgagtctgtgaataaagccac

SEQ ID NO: 404078 - DNA, 23 bp, Homo sapiens
ctgagtgaatgagtaaataaact

SEQ ID NO: 404079 - DNA, 14 bp, Homo sapiens
ctgagtgcagaggc

SEQ ID NO: 404080 - DNA, 23 bp, Homo sapiens
ctgagtggaatgcagggaagagg

SEQ ID NO: 404081 - DNA, 18 bp, Homo sapiens
ctgagtgggctgggccct

SEQ ID NO: 404082 - DNA, 22 bp, Homo sapiens
ctgagtggtgaggggccactgg

SEQ ID NO: 404083 - DNA, 21 bp, Homo sapiens
ctgagttgaggggcttccctc

SEQ ID NO: 404084 - DNA, 15 bp, Homo sapiens
ctgagtttaccattt

SEQ ID NO: 404085 - DNA, 21 bp, Homo sapiens
ctgagtttaccatttgtaata

SEQ ID NO: 404086 - DNA, 22 bp, Homo sapiens
ctgagtttgaacacagatcatt

SEQ ID NO: 404087 - DNA, 17 bp, Homo sapiens
ctgataacttggggagg

SEQ ID NO: 404088 - DNA, 19 bp, Homo sapiens
ctgataacttggggaggca

SEQ ID NO: 404089 - DNA, 20 bp, Homo sapiens
ctgataacttggggaggcaa

SEQ ID NO: 404090 - DNA, 20 bp, Homo sapiens
ctgataagggagagggaaat

SEQ ID NO: 404091 - DNA, 14 bp, Homo sapiens
ctgataatgtattg

SEQ ID NO: 404092 - DNA, 21 bp, Homo sapiens
ctgatacttatttataacatt

SEQ ID NO: 404093 - DNA, 18 bp, Homo sapiens
ctgatagatatccttggc

SEQ ID NO: 404094 - DNA, 23 bp, Homo sapiens
ctgatagcgttggaattaaaaca

SEQ ID NO: 404095 - DNA, 18 bp, Homo sapiens
ctgatagtcacctgctgg

SEQ ID NO: 404096 - DNA, 20 bp, Homo sapiens
ctgatatcacgggcccgctc

SEQ ID NO: 404097 - DNA, 19 bp, Homo sapiens
ctgatatctgtttgcttct

SEQ ID NO: 404098 - DNA, 19 bp, Homo sapiens
ctgatattgccgcactagg

SEQ ID NO: 404099 - DNA, 17 bp, Homo sapiens
ctgatcatttgcagctg

SEQ ID NO: 404100 - DNA, 19 bp, Homo sapiens
ctgatcatttgcagctgct

SEQ ID NO: 404101 - DNA, 13 bp, Homo sapiens
ctgatccagagca

SEQ ID NO: 404102 - DNA, 15 bp, Homo sapiens
ctgatccagagcaca

SEQ ID NO: 404103 - DNA, 19 bp, Homo sapiens
ctgatcccctttggtttta

SEQ ID NO: 404104 - DNA, 22 bp, Homo sapiens
ctgatcccctttggttttacta

SEQ ID NO: 404105 - DNA, 15 bp, Homo sapiens
ctgatcgtgctaaat

SEQ ID NO: 404106 - DNA, 19 bp, Homo sapiens
ctgatcgtgctaaattttc

SEQ ID NO: 404107 - DNA, 21 bp, Homo sapiens
ctgatcgtgctaaattttcag

SEQ ID NO: 404108 - DNA, 14 bp, Homo sapiens
ctgatctctcgtga

SEQ ID NO: 404109 - DNA, 18 bp, Homo sapiens
ctgatctctcgtgattga

SEQ ID NO: 404110 - DNA, 19 bp, Homo sapiens
ctgatcttacctttatgag

SEQ ID NO: 404111 - DNA, 16 bp, Homo sapiens
ctgatgagacaacaca

SEQ ID NO: 404112 - DNA, 13 bp, Homo sapiens
ctgatgatgtctc

SEQ ID NO: 404113 - DNA, 21 bp, Homo sapiens
ctgatgatgtctcttgtagaa

SEQ ID NO: 404114 - DNA, 19 bp, Homo sapiens
ctgatgctccctcccctgc

SEQ ID NO: 404115 - DNA, 21 bp, Homo sapiens
ctgatgctccctcccctgccc

SEQ ID NO: 404116 - DNA, 24 bp, Homo sapiens
ctgatgctccctcccctgccctgg

SEQ ID NO: 404117 - DNA, 14 bp, Homo sapiens
ctgatgctgaaata

SEQ ID NO: 404118 - DNA, 15 bp, Homo sapiens
ctgatgctgaaataa

SEQ ID NO: 404119 - DNA, 15 bp, Homo sapiens
ctgatggagaggaga

SEQ ID NO: 404120 - DNA, 15 bp, Homo sapiens
ctgatggccaagagc

SEQ ID NO: 404121 - DNA, 20 bp, Homo sapiens
ctgatggccaagggggtgga

SEQ ID NO: 404122 - DNA, 21 bp, Homo sapiens
ctgatggccaagggggtggac

SEQ ID NO: 404123 - DNA, 14 bp, Homo sapiens
ctgatggcttgaca

SEQ ID NO: 404124 - DNA, 20 bp, Homo sapiens
ctgatggcttgacatgtgca

SEQ ID NO: 404125 - DNA, 21 bp, Homo sapiens
ctgatggcttgacatgtgcaa

SEQ ID NO: 404126 - DNA, 22 bp, Homo sapiens
ctgatggcttgacatgtgcaat

SEQ ID NO: 404127 - DNA, 15 bp, Homo sapiens
ctgatgggtcctgct

SEQ ID NO: 404128 - DNA, 16 bp, Homo sapiens
ctgatgggtcctgctg

SEQ ID NO: 404129 - DNA, 14 bp, Homo sapiens
ctgatggtcagctc

SEQ ID NO: 404130 - DNA, 16 bp, Homo sapiens
ctgatggtcagctccc

SEQ ID NO: 404131 - DNA, 19 bp, Homo sapiens
ctgatggtgagctgggaag

SEQ ID NO: 404132 - DNA, 12 bp, Homo sapiens
ctgatgtcatct

SEQ ID NO: 404133 - DNA, 15 bp, Homo sapiens
ctgatgttaggctgg

SEQ ID NO: 404134 - DNA, 13 bp, Homo sapiens
ctgatgttttgat

SEQ ID NO: 404135 - DNA, 18 bp, Homo sapiens
ctgatgttttgtattttg

SEQ ID NO: 404136 - DNA, 23 bp, Homo sapiens
ctgattactgtcaataaacagct

SEQ ID NO: 404137 - DNA, 12 bp, Homo sapiens
ctgattatcagg

SEQ ID NO: 404138 - DNA, 15 bp, Homo sapiens
ctgattattgaatgt

SEQ ID NO: 404139 - DNA, 20 bp, Homo sapiens
ctgattcaataaaatgcact

SEQ ID NO: 404140 - DNA, 14 bp, Homo sapiens
ctgattcccagagc

SEQ ID NO: 404141 - DNA, 16 bp, Homo sapiens
ctgattcccagagcag

SEQ ID NO: 404142 - DNA, 17 bp, Homo sapiens
ctgattcccagagcaga

SEQ ID NO: 404143 - DNA, 21 bp, Homo sapiens
ctgattctatgcctgtatttc

SEQ ID NO: 404144 - DNA, 15 bp, Homo sapiens
ctgattggacatttt

SEQ ID NO: 404145 - DNA, 17 bp, Homo sapiens
ctgattggtgcaaccct

SEQ ID NO: 404146 - DNA, 18 bp, Homo sapiens
ctgatttacaagactaac

SEQ ID NO: 404147 - DNA, 15 bp, Homo sapiens
ctgatttcaaggtcc

SEQ ID NO: 404148 - DNA, 22 bp, Homo sapiens
ctgatttcaaggtccgagctct

SEQ ID NO: 404149 - DNA, 13 bp, Homo sapiens
ctgatttcccttt

SEQ ID NO: 404150 - DNA, 13 bp, Homo sapiens
ctgatttgctgtt

SEQ ID NO: 404151 - DNA, 12 bp, Homo sapiens
ctgattttaaca

SEQ ID NO: 404152 - DNA, 14 bp, Homo sapiens
ctgattttaacaat

SEQ ID NO: 404153 - DNA, 17 bp, Homo sapiens
ctgattttaacaataac

SEQ ID NO: 404154 - DNA, 18 bp, Homo sapiens
ctgattttgtagttaatt

SEQ ID NO: 404155 - DNA, 23 bp, Homo sapiens
ctgattttttactggctgtgtga

SEQ ID NO: 404156 - DNA, 24 bp, Homo sapiens
ctgattttttactggctgtgtgac

SEQ ID NO: 404157 - DNA, 14 bp, Homo sapiens
ctgcaaaattacct

SEQ ID NO: 404158 - DNA, 13 bp, Homo sapiens
ctgcaaaatttta

SEQ ID NO: 404159 - DNA, 15 bp, Homo sapiens
ctgcaaacaataaac

SEQ ID NO: 404160 - DNA, 23 bp, Homo sapiens
ctgcaaacatggggttggctggg

SEQ ID NO: 404161 - DNA, 20 bp, Homo sapiens
ctgcaaacattgtacatcca

SEQ ID NO: 404162 - DNA, 16 bp, Homo sapiens
ctgcaaactcactgct

SEQ ID NO: 404163 - DNA, 22 bp, Homo sapiens
ctgcaaagagttatatgacttc

SEQ ID NO: 404164 - DNA, 23 bp, Homo sapiens
ctgcaaaggacagatccagggac

SEQ ID NO: 404165 - DNA, 19 bp, Homo sapiens
ctgcaaagggaactgaaga

SEQ ID NO: 404166 - DNA, 14 bp, Homo sapiens
ctgcaaatagtttc

SEQ ID NO: 404167 - DNA, 20 bp, Homo sapiens
ctgcaaatagtttcaaatga

SEQ ID NO: 404168 - DNA, 18 bp, Homo sapiens
ctgcaaattgtagcccag

SEQ ID NO: 404169 - DNA, 15 bp, Homo sapiens
ctgcaactagccaag

SEQ ID NO: 404170 - DNA, 23 bp, Homo sapiens
ctgcaactcaaggactttgcagc

SEQ ID NO: 404171 - DNA, 15 bp, Homo sapiens
ctgcaagccccaggg

SEQ ID NO: 404172 - DNA, 16 bp, Homo sapiens
ctgcaagccccagggc

SEQ ID NO: 404173 - DNA, 17 bp, Homo sapiens
ctgcaagccccagggcc

SEQ ID NO: 404174 - DNA, 19 bp, Homo sapiens
ctgcaagccccagggcctg

SEQ ID NO: 404175 - DNA, 13 bp, Homo sapiens
ctgcaaggcccac

SEQ ID NO: 404176 - DNA, 18 bp, Homo sapiens
ctgcaaggcccacaggag

SEQ ID NO: 404177 - DNA, 22 bp, Homo sapiens
ctgcaagtgagcaaacctgccc

SEQ ID NO: 404178 - DNA, 12 bp, Homo sapiens
ctgcaatagaga

SEQ ID NO: 404179 - DNA, 16 bp, Homo sapiens
ctgcaatagagactgt

SEQ ID NO: 404180 - DNA, 17 bp, Homo sapiens
ctgcaatctccagggct

SEQ ID NO: 404181 - DNA, 14 bp, Homo sapiens
ctgcaatctgggtg

SEQ ID NO: 404182 - DNA, 14 bp, Homo sapiens
ctgcaatgcctaga

SEQ ID NO: 404183 - DNA, 20 bp, Homo sapiens
ctgcaatgtatcccttctca

SEQ ID NO: 404184 - DNA, 17 bp, Homo sapiens
ctgcaatgtttttgtgt

SEQ ID NO: 404185 - DNA, 18 bp, Homo sapiens
ctgcaatgtttttgtgta

SEQ ID NO: 404186 - DNA, 18 bp, Homo sapiens
ctgcaatttcatatgctg

SEQ ID NO: 404187 - DNA, 20 bp, Homo sapiens
ctgcaatttcatatgctgta

SEQ ID NO: 404188 - DNA, 13 bp, Homo sapiens
ctgcacaaagccc

SEQ ID NO: 404189 - DNA, 18 bp, Homo sapiens
ctgcacaaagcccttcca

SEQ ID NO: 404190 - DNA, 20 bp, Homo sapiens
ctgcacaaagcccttccatg

SEQ ID NO: 404191 - DNA, 22 bp, Homo sapiens
ctgcacaagccagggtgtgtct

SEQ ID NO: 404192 - DNA, 14 bp, Homo sapiens
ctgcacacacagct

SEQ ID NO: 404193 - DNA, 14 bp, Homo sapiens
ctgcacacacctgc

SEQ ID NO: 404194 - DNA, 15 bp, Homo sapiens
ctgcacacacctgcc

SEQ ID NO: 404195 - DNA, 20 bp, Homo sapiens
ctgcacagatggatttgcct

SEQ ID NO: 404196 - DNA, 17 bp, Homo sapiens
ctgcacattcctggccc

SEQ ID NO: 404197 - DNA, 21 bp, Homo sapiens
ctgcacattcctggccccggg

SEQ ID NO: 404198 - DNA, 20 bp, Homo sapiens
ctgcaccaacctcactgccc

SEQ ID NO: 404199 - DNA, 15 bp, Homo sapiens
ctgcacccacccctg

SEQ ID NO: 404200 - DNA, 12 bp, Homo sapiens
ctgcacccagct

SEQ ID NO: 404201 - DNA, 16 bp, Homo sapiens
ctgcaccccagcattc

SEQ ID NO: 404202 - DNA, 12 bp, Homo sapiens
ctgcaccctgga

SEQ ID NO: 404203 - DNA, 19 bp, Homo sapiens
ctgcacccttgtacagtgt

SEQ ID NO: 404204 - DNA, 22 bp, Homo sapiens
ctgcaccgacgcctgcccccgt

SEQ ID NO: 404205 - DNA, 11 bp, Homo sapiens
ctgcacctcct

SEQ ID NO: 404206 - DNA, 17 bp, Homo sapiens
ctgcacctgaggcccag

SEQ ID NO: 404207 - DNA, 18 bp, Homo sapiens
ctgcacctgaggcccagc

SEQ ID NO: 404208 - DNA, 17 bp, Homo sapiens
ctccttttgtccccagg

SEQ ID NO: 404209 - DNA, 19 bp, Homo sapiens
ctccttttgtccccagggc

SEQ ID NO: 404210 - DNA, 21 bp, Homo sapiens
ctccttttgtccccagggccc

SEQ ID NO: 404211 - DNA, 17 bp, Homo sapiens
ctcctttttctaccttt

SEQ ID NO: 404212 - DNA, 15 bp, Homo sapiens
ctcgaaaagagcact

SEQ ID NO: 404213 - DNA, 15 bp, Homo sapiens
ctcgaaccaaggcag

SEQ ID NO: 404214 - DNA, 19 bp, Homo sapiens
ctcgaaccaaggcagcctc

SEQ ID NO: 404215 - DNA, 20 bp, Homo sapiens
ctcgaaccaaggcagcctcc

SEQ ID NO: 404216 - DNA, 13 bp, Homo sapiens
ctcgaactcctga

SEQ ID NO: 404217 - DNA, 15 bp, Homo sapiens
ctcgaactcctgggc

SEQ ID NO: 404218 - DNA, 17 bp, Homo sapiens
ctcgaactcctgggctc

SEQ ID NO: 404219 - DNA, 16 bp, Homo sapiens
ctcgactctgctgctc

SEQ ID NO: 404220 - DNA, 14 bp, Homo sapiens
ctcgagaccatcct

SEQ ID NO: 404221 - DNA, 20 bp, Homo sapiens
ctcgagaccatcctggcccc

SEQ ID NO: 404222 - DNA, 19 bp, Homo sapiens
ctcgagagggctgagcccc

SEQ ID NO: 404223 - DNA, 17 bp, Homo sapiens
ctcgagcagtcctgcct

SEQ ID NO: 404224 - DNA, 15 bp, Homo sapiens
ctcgagccccctgga

SEQ ID NO: 404225 - DNA, 23 bp, Homo sapiens
ctcgagccccctggatgtcccct

SEQ ID NO: 404226 - DNA, 22 bp, Homo sapiens
ctcgagcctgggtgacagggca

SEQ ID NO: 404227 - DNA, 18 bp, Homo sapiens
ctcgaggcaccggcgctg

SEQ ID NO: 404228 - DNA, 19 bp, Homo sapiens
ctcgagtgcccctgcaggg

SEQ ID NO: 404229 - DNA, 12 bp, Homo sapiens
ctcgatgcactg

SEQ ID NO: 404230 - DNA, 15 bp, Homo sapiens
ctcgatgcactgacc

SEQ ID NO: 404231 - DNA, 16 bp, Homo sapiens
ctcgatgcactgacct

SEQ ID NO: 404232 - DNA, 22 bp, Homo sapiens
ctcgcatttgtcaatgacagtt

SEQ ID NO: 404233 - DNA, 13 bp, Homo sapiens
ctcgccccatccc

SEQ ID NO: 404234 - DNA, 18 bp, Homo sapiens
ctcgcccctccagtgttg

SEQ ID NO: 404235 - DNA, 12 bp, Homo sapiens
ctcgcccgccca

SEQ ID NO: 404236 - DNA, 15 bp, Homo sapiens
ctcgcccgcccactg

SEQ ID NO: 404237 - DNA, 21 bp, Homo sapiens
ctcgcccgcccactgtcctgg

SEQ ID NO: 404238 - DNA, 14 bp, Homo sapiens
ctcgctctcctaag

SEQ ID NO: 404239 - DNA, 12 bp, Homo sapiens
ctcgctgtgcca

SEQ ID NO: 404240 - DNA, 13 bp, Homo sapiens
ctcgctgtgccac

SEQ ID NO: 404241 - DNA, 15 bp, Homo sapiens
ctcgctgtgccacca

SEQ ID NO: 404242 - DNA, 14 bp, Homo sapiens
ctcgcttagctgaa

SEQ ID NO: 404243 - DNA, 15 bp, Homo sapiens
ctcgcttcataggca

SEQ ID NO: 404244 - DNA, 23 bp, Homo sapiens
ctcgcttgccgggcctgggcctc

SEQ ID NO: 404245 - DNA, 17 bp, Homo sapiens
ctcggaagccgtctgac

SEQ ID NO: 404246 - DNA, 13 bp, Homo sapiens
ctcggacccacca

SEQ ID NO: 404247 - DNA, 14 bp, Homo sapiens
ctcggacccacccc

SEQ ID NO: 404248 - DNA, 15 bp, Homo sapiens
ctcggacccacccca

SEQ ID NO: 404249 - DNA, 15 bp, Homo sapiens
ctcggaggccaggcc

SEQ ID NO: 404250 - DNA, 17 bp, Homo sapiens
ctcggagggattcccct

SEQ ID NO: 404251 - DNA, 19 bp, Homo sapiens
ctcggcattcacacacagc

SEQ ID NO: 404252 - DNA, 20 bp, Homo sapiens
ctcggcattcacacacagcc

SEQ ID NO: 404253 - DNA, 23 bp, Homo sapiens
ctcggcattcacacacagcctgg

SEQ ID NO: 404254 - DNA, 24 bp, Homo sapiens
ctcggcattcacacacagcctggc

SEQ ID NO: 404255 - DNA, 14 bp, Homo sapiens
ctcggccagagctc

SEQ ID NO: 404256 - DNA, 19 bp, Homo sapiens
ctcggccagagctcccagg

SEQ ID NO: 404257 - DNA, 20 bp, Homo sapiens
ctcggccagagctcccagga

SEQ ID NO: 404258 - DNA, 22 bp, Homo sapiens
ctcggccagagctcccaggacg

SEQ ID NO: 404259 - DNA, 16 bp, Homo sapiens
ctcggccccacccacc

SEQ ID NO: 404260 - DNA, 16 bp, Homo sapiens
ctcggccccctccatc

SEQ ID NO: 404261 - DNA, 21 bp, Homo sapiens
ctcggcctccgaggctccccg

SEQ ID NO: 404262 - DNA, 23 bp, Homo sapiens
ctcggcgtgctccttttctcttt

SEQ ID NO: 404263 - DNA, 13 bp, Homo sapiens
ctcggctggaaga

SEQ ID NO: 404264 - DNA, 16 bp, Homo sapiens
ctcggctggaagaaca

SEQ ID NO: 404265 - DNA, 22 bp, Homo sapiens
ctcggctgtgtggggagggtgg

SEQ ID NO: 404266 - DNA, 22 bp, Homo sapiens
ctcggctttggctcgggacttc

SEQ ID NO: 404267 - DNA, 23 bp, Homo sapiens
ctcgggaaggcctgagggaagcc

SEQ ID NO: 404268 - DNA, 21 bp, Homo sapiens
ctcgggacctcgtttgggagt

SEQ ID NO: 404269 - DNA, 15 bp, Homo sapiens
ctcgggcaagggccg

SEQ ID NO: 404270 - DNA, 22 bp, Homo sapiens
ctcgggctaagtccagctctcc

SEQ ID NO: 404271 - DNA, 21 bp, Homo sapiens
ctcggggcccttggggcctgg

SEQ ID NO: 404272 - DNA, 24 bp, Homo sapiens
ctcggggcccttggggcctggctt

SEQ ID NO: 404273 - DNA, 14 bp, Homo sapiens
ctcggtcagcaccg

SEQ ID NO: 404274 - DNA, 23 bp, Homo sapiens
ctcggtgtgtggccgcctggcag

SEQ ID NO: 404275 - DNA, 15 bp, Homo sapiens
ctcgtagatgctgcc

SEQ ID NO: 404276 - DNA, 18 bp, Homo sapiens
ctcgtagatgctgcctag

SEQ ID NO: 404277 - DNA, 15 bp, Homo sapiens
ctcgtccacaggggc

SEQ ID NO: 404278 - DNA, 16 bp, Homo sapiens
ctcgtccacaggggca

SEQ ID NO: 404279 - DNA, 21 bp, Homo sapiens
ctcgtccacaggggcaggcct

SEQ ID NO: 404280 - DNA, 23 bp, Homo sapiens
ctcgtccacaggggcaggcctgg

SEQ ID NO: 404281 - DNA, 14 bp, Homo sapiens
ctcgtccggcctgc

SEQ ID NO: 404282 - DNA, 22 bp, Homo sapiens
ctcgtccggcctgcagcccaga

SEQ ID NO: 404283 - DNA, 13 bp, Homo sapiens
ctcgtcctgtccc

SEQ ID NO: 404284 - DNA, 15 bp, Homo sapiens
ctcgtcctgtcccag

SEQ ID NO: 404285 - DNA, 14 bp, Homo sapiens
ctcgtcttcctctc

SEQ ID NO: 404286 - DNA, 15 bp, Homo sapiens
ctcgtgacccagtgg

SEQ ID NO: 404287 - DNA, 12 bp, Homo sapiens
ctcgtgctttaa

SEQ ID NO: 404288 - DNA, 15 bp, Homo sapiens
ctcgtgctttaagtg

SEQ ID NO: 404289 - DNA, 12 bp, Homo sapiens
ctcgtggacacc

SEQ ID NO: 404290 - DNA, 14 bp, Homo sapiens
ctcgtggacacctg

SEQ ID NO: 404291 - DNA, 16 bp, Homo sapiens
ctcgtggacacctgcc

SEQ ID NO: 404292 - DNA, 17 bp, Homo sapiens
ctcgtggacacctgccc

SEQ ID NO: 404293 - DNA, 11 bp, Homo sapiens
ctcgtggcctt

SEQ ID NO: 404294 - DNA, 15 bp, Homo sapiens
ctcgtggcggggcag

SEQ ID NO: 404295 - DNA, 18 bp, Homo sapiens
ctcgtggcggggcagcag

SEQ ID NO: 404296 - DNA, 15 bp, Homo sapiens
ctcgtgggagagcca

SEQ ID NO: 404297 - DNA, 13 bp, Homo sapiens
ctcgtgggctctg

SEQ ID NO: 404298 - DNA, 20 bp, Homo sapiens
ctcgtggtagaagccagtac

SEQ ID NO: 404299 - DNA, 20 bp, Homo sapiens
ctcgtggttattagcaaggc

SEQ ID NO: 404300 - DNA, 18 bp, Homo sapiens
ctcgttgacatgcacagt

SEQ ID NO: 404301 - DNA, 22 bp, Homo sapiens
ctctaaaagggggctattccct

SEQ ID NO: 404302 - DNA, 15 bp, Homo sapiens
ctctaaaattctagt

SEQ ID NO: 404303 - DNA, 22 bp, Homo sapiens
ctctaaatgaggggcctcaggt

SEQ ID NO: 404304 - DNA, 21 bp, Homo sapiens
ctctaaatgcagttttaagaa

SEQ ID NO: 404305 - DNA, 16 bp, Homo sapiens
ctctaacaccacactg

SEQ ID NO: 404306 - DNA, 20 bp, Homo sapiens
ctctaacaccacactgacca

SEQ ID NO: 404307 - DNA, 21 bp, Homo sapiens
ctctaacaccacactgaccac

SEQ ID NO: 404308 - DNA, 16 bp, Homo sapiens
ctctaacagctcagga

SEQ ID NO: 404309 - DNA, 14 bp, Homo sapiens
ctctaacaggggct

SEQ ID NO: 404310 - DNA, 21 bp, Homo sapiens
ctctaacttattttatttcca

SEQ ID NO: 404311 - DNA, 22 bp, Homo sapiens
ctctaagaaatggctttccaca

SEQ ID NO: 404312 - DNA, 22 bp, Homo sapiens
ctctaagtgtaaaaaaaagtct

SEQ ID NO: 404313 - DNA, 18 bp, Homo sapiens
ctctaatgctcacgctcc

SEQ ID NO: 404314 - DNA, 11 bp, Homo sapiens
ctctaatttcc

SEQ ID NO: 404315 - DNA, 23 bp, Homo sapiens
ctctacaactgagtccttaaaca

SEQ ID NO: 404316 - DNA, 17 bp, Homo sapiens
ctctacacaacatgtat

SEQ ID NO: 404317 - DNA, 14 bp, Homo sapiens
ctctacactgtgaa

SEQ ID NO: 404318 - DNA, 21 bp, Homo sapiens
ctctacagctaatcagcattc

SEQ ID NO: 404319 - DNA, 19 bp, Homo sapiens
ctctacccactatgcacag

SEQ ID NO: 404320 - DNA, 12 bp, Homo sapiens
ctctacccagcc

SEQ ID NO: 404321 - DNA, 19 bp, Homo sapiens
ctctacccagcccatcttg

SEQ ID NO: 404322 - DNA, 16 bp, Homo sapiens
ctctacccatgagcct

SEQ ID NO: 404323 - DNA, 18 bp, Homo sapiens
ctctacccatgagcctgc

SEQ ID NO: 404324 - DNA, 18 bp, Homo sapiens
ctctaccctcccaccccc

SEQ ID NO: 404325 - DNA, 16 bp, Homo sapiens
ctctactaaaaatgca

SEQ ID NO: 404326 - DNA, 16 bp, Homo sapiens
ctctactcatgccaga

SEQ ID NO: 404327 - DNA, 17 bp, Homo sapiens
ctctactcatgccagat

SEQ ID NO: 404328 - DNA, 15 bp, Homo sapiens
ctctacttaatgaga

SEQ ID NO: 404329 - DNA, 17 bp, Homo sapiens
ctctacttagcatgtcc

SEQ ID NO: 404330 - DNA, 13 bp, Homo sapiens
ctctactttccag

SEQ ID NO: 404331 - DNA, 23 bp, Homo sapiens
ctctagaattttaagtgctttgt

SEQ ID NO: 404332 - DNA, 18 bp, Homo sapiens
ctctagacaaccctgcaa

SEQ ID NO: 404333 - DNA, 13 bp, Homo sapiens
ctctagagcaggg

SEQ ID NO: 404334 - DNA, 19 bp, Homo sapiens
ctctagccaaatggtttaa

SEQ ID NO: 404335 - DNA, 13 bp, Homo sapiens
ctctagccaggag

SEQ ID NO: 404336 - DNA, 15 bp, Homo sapiens
ctctagccaggagtc

SEQ ID NO: 404337 - DNA, 21 bp, Homo sapiens
ctctagccaggagtctgtgct

SEQ ID NO: 404338 - DNA, 14 bp, Homo sapiens
ctctctgccagctc

SEQ ID NO: 404339 - DNA, 14 bp, Homo sapiens
ctctctgctcctca

SEQ ID NO: 404340 - DNA, 22 bp, Homo sapiens
ctctctgctcctcacccccacc

SEQ ID NO: 404341 - DNA, 17 bp, Homo sapiens
ctctctggccttttcct

SEQ ID NO: 404342 - DNA, 17 bp, Homo sapiens
ctctctgggacctcctt

SEQ ID NO: 404343 - DNA, 16 bp, Homo sapiens
ctctctgggactctcc

SEQ ID NO: 404344 - DNA, 15 bp, Homo sapiens
ctctctgggcccagg

SEQ ID NO: 404345 - DNA, 13 bp, Homo sapiens
ctctctgggcctt

SEQ ID NO: 404346 - DNA, 11 bp, Homo sapiens
ctctctgtctt

SEQ ID NO: 404347 - DNA, 21 bp, Homo sapiens
ctctctgtctttttccttcct

SEQ ID NO: 404348 - DNA, 17 bp, Homo sapiens
ctctctgtgaatacaat

SEQ ID NO: 404349 - DNA, 13 bp, Homo sapiens
ctctctgtgtggc

SEQ ID NO: 404350 - DNA, 16 bp, Homo sapiens
ctctctgtgtggcaaa

SEQ ID NO: 404351 - DNA, 13 bp, Homo sapiens
ctctctgttccaa

SEQ ID NO: 404352 - DNA, 18 bp, Homo sapiens
ctctctgttccaagtgtg

SEQ ID NO: 404353 - DNA, 19 bp, Homo sapiens
ctctctgttccaagtgtgt

SEQ ID NO: 404354 - DNA, 12 bp, Homo sapiens
ctctctgtttac

SEQ ID NO: 404355 - DNA, 22 bp, Homo sapiens
ctctctgtttaccctccctgtc

SEQ ID NO: 404356 - DNA, 19 bp, Homo sapiens
ctctcttacccttctgtgc

SEQ ID NO: 404357 - DNA, 22 bp, Homo sapiens
ctctcttacccttctgtgccca

SEQ ID NO: 404358 - DNA, 23 bp, Homo sapiens
ctctcttatagaatatttattac

SEQ ID NO: 404359 - DNA, 18 bp, Homo sapiens
ctctcttcaatctctgga

SEQ ID NO: 404360 - DNA, 16 bp, Homo sapiens
ctctcttccgggagct

SEQ ID NO: 404361 - DNA, 17 bp, Homo sapiens
ctctcttctgctccacc

SEQ ID NO: 404362 - DNA, 13 bp, Homo sapiens
ctctcttcttact

SEQ ID NO: 404363 - DNA, 15 bp, Homo sapiens
ctctcttcttactgt

SEQ ID NO: 404364 - DNA, 16 bp, Homo sapiens
ctctcttgattgattt

SEQ ID NO: 404365 - DNA, 18 bp, Homo sapiens
ctctcttgattgattttt

SEQ ID NO: 404366 - DNA, 14 bp, Homo sapiens
ctctcttgccagca

SEQ ID NO: 404367 - DNA, 20 bp, Homo sapiens
ctctcttgccgaggagccag

SEQ ID NO: 404368 - DNA, 19 bp, Homo sapiens
ctctcttggtctctttctt

SEQ ID NO: 404369 - DNA, 13 bp, Homo sapiens
ctctcttgtccaa

SEQ ID NO: 404370 - DNA, 18 bp, Homo sapiens
ctctctttttggaggtgc

SEQ ID NO: 404371 - DNA, 19 bp, Homo sapiens
ctctctttttggaggtgct

SEQ ID NO: 404372 - DNA, 17 bp, Homo sapiens
ctctgaaaacggccctc

SEQ ID NO: 404373 - DNA, 15 bp, Homo sapiens
ctctgaaaatatttt

SEQ ID NO: 404374 - DNA, 22 bp, Homo sapiens
ctctgaaaatatttttttctag

SEQ ID NO: 404375 - DNA, 20 bp, Homo sapiens
ctctgaaatttcccacaccc

SEQ ID NO: 404376 - DNA, 17 bp, Homo sapiens
ctctgaactgctgctgg

SEQ ID NO: 404377 - DNA, 19 bp, Homo sapiens
ctctgaaggacccttcaga

SEQ ID NO: 404378 - DNA, 16 bp, Homo sapiens
ctctgaatctctcaaa

SEQ ID NO: 404379 - DNA, 20 bp, Homo sapiens
ctctgaatctctcaaaatgt

SEQ ID NO: 404380 - DNA, 17 bp, Homo sapiens
ctctgacagcagcctgt

SEQ ID NO: 404381 - DNA, 21 bp, Homo sapiens
ctctgacagcagcctgtgagg

SEQ ID NO: 404382 - DNA, 17 bp, Homo sapiens
ctctgacataaacccat

SEQ ID NO: 404383 - DNA, 18 bp, Homo sapiens
ctctgacataaacccatc

SEQ ID NO: 404384 - DNA, 22 bp, Homo sapiens
ctctgacccaagtggggcctcc

SEQ ID NO: 404385 - DNA, 23 bp, Homo sapiens
ctctgacccaagtggggcctcct

SEQ ID NO: 404386 - DNA, 16 bp, Homo sapiens
ctctgacccagtgaga

SEQ ID NO: 404387 - DNA, 13 bp, Homo sapiens
ctctgactcccaa

SEQ ID NO: 404388 - DNA, 23 bp, Homo sapiens
ctctgactcccaaagagctgcct

SEQ ID NO: 404389 - DNA, 13 bp, Homo sapiens
ctctgactctgag

SEQ ID NO: 404390 - DNA, 23 bp, Homo sapiens
ctctgagaaggggaggacctctg

SEQ ID NO: 404391 - DNA, 15 bp, Homo sapiens
ctctgagcagcctct

SEQ ID NO: 404392 - DNA, 18 bp, Homo sapiens
ctctgagcagtggggagc

SEQ ID NO: 404393 - DNA, 13 bp, Homo sapiens
ctctgagccagga

SEQ ID NO: 404394 - DNA, 23 bp, Homo sapiens
ctctgagccaggagcctcctgac

SEQ ID NO: 404395 - DNA, 17 bp, Homo sapiens
ctctgagcccaggccgt

SEQ ID NO: 404396 - DNA, 17 bp, Homo sapiens
ctctgagccccctgtgc

SEQ ID NO: 404397 - DNA, 13 bp, Homo sapiens
ctctgagcccctg

SEQ ID NO: 404398 - DNA, 16 bp, Homo sapiens
ctctgagctgttatct

SEQ ID NO: 404399 - DNA, 19 bp, Homo sapiens
ctctgagctgttatcttgt

SEQ ID NO: 404400 - DNA, 20 bp, Homo sapiens
ctctgagctttgttactgaa

SEQ ID NO: 404401 - DNA, 19 bp, Homo sapiens
ctctgaggcaaccccctcg

SEQ ID NO: 404402 - DNA, 17 bp, Homo sapiens
ctctgagtccactgctc

SEQ ID NO: 404403 - DNA, 19 bp, Homo sapiens
ctctgagtccactgctcca

SEQ ID NO: 404404 - DNA, 20 bp, Homo sapiens
ctctgagtttaccatttgta

SEQ ID NO: 404405 - DNA, 21 bp, Homo sapiens
ctctgagtttaccatttgtaa

SEQ ID NO: 404406 - DNA, 22 bp, Homo sapiens
ctctgagtttaccatttgtaat

SEQ ID NO: 404407 - DNA, 23 bp, Homo sapiens
ctctgataaaagggcaaatctgc

SEQ ID NO: 404408 - DNA, 20 bp, Homo sapiens
ctctgatattccatgaatgt

SEQ ID NO: 404409 - DNA, 17 bp, Homo sapiens
ctctgatcaaagcacct

SEQ ID NO: 404410 - DNA, 13 bp, Homo sapiens
ctctgatcttgtg

SEQ ID NO: 404411 - DNA, 14 bp, Homo sapiens
ctctgatgtttggg

SEQ ID NO: 404412 - DNA, 18 bp, Homo sapiens
ctctgattttttactggc

SEQ ID NO: 404413 - DNA, 13 bp, Homo sapiens
ctctgcactactc

SEQ ID NO: 404414 - DNA, 15 bp, Homo sapiens
ctctgcactactcct

SEQ ID NO: 404415 - DNA, 20 bp, Homo sapiens
ctctgcactactcctctgca

SEQ ID NO: 404416 - DNA, 23 bp, Homo sapiens
ctctgcactactcctctgcagtg

SEQ ID NO: 404417 - DNA, 14 bp, Homo sapiens
ctctgcactccatg

SEQ ID NO: 404418 - DNA, 17 bp, Homo sapiens
ctctgcagcaatattct

SEQ ID NO: 404419 - DNA, 11 bp, Homo sapiens
ctctgcagccc

SEQ ID NO: 404420 - DNA, 15 bp, Homo sapiens
ctctgcagcccacag

SEQ ID NO: 404421 - DNA, 20 bp, Homo sapiens
ctctgcagcccacagaggac

SEQ ID NO: 404422 - DNA, 12 bp, Homo sapiens
ctctgcagcctg

SEQ ID NO: 404423 - DNA, 16 bp, Homo sapiens
ctctgcagcctgagct

SEQ ID NO: 404424 - DNA, 13 bp, Homo sapiens
ctctgcagggcag

SEQ ID NO: 404425 - DNA, 18 bp, Homo sapiens
ctctgcagggcagcctgt

SEQ ID NO: 404426 - DNA, 20 bp, Homo sapiens
ctctgcatagacaaaggcct

SEQ ID NO: 404427 - DNA, 13 bp, Homo sapiens
ctctgcatgtgtg

SEQ ID NO: 404428 - DNA, 15 bp, Homo sapiens
ctctgccacccactc

SEQ ID NO: 404429 - DNA, 17 bp, Homo sapiens
ctctgccacccactcag

SEQ ID NO: 404430 - DNA, 20 bp, Homo sapiens
ctctgccacccactcaggat

SEQ ID NO: 404431 - DNA, 22 bp, Homo sapiens
ctctgccagctccacagggtgg

SEQ ID NO: 404432 - DNA, 17 bp, Homo sapiens
ctctgccatcagcccct

SEQ ID NO: 404433 - DNA, 19 bp, Homo sapiens
ctctgcccagagctgggtg

SEQ ID NO: 404434 - DNA, 15 bp, Homo sapiens
ctctgcccagcttgg

SEQ ID NO: 404435 - DNA, 14 bp, Homo sapiens
ctctgccccaagca

SEQ ID NO: 404436 - DNA, 18 bp, Homo sapiens
ctctgccccaagcagcca

SEQ ID NO: 404437 - DNA, 20 bp, Homo sapiens
ctctgccccaagcagccagc

SEQ ID NO: 404438 - DNA, 14 bp, Homo sapiens
ctctgccccaagcc

SEQ ID NO: 404439 - DNA, 12 bp, Homo sapiens
ctctgccccaat

SEQ ID NO: 404440 - DNA, 21 bp, Homo sapiens
ctctgccccaatcgggtccag

SEQ ID NO: 404441 - DNA, 23 bp, Homo sapiens
ctctgccccaatcgggtccagag

SEQ ID NO: 404442 - DNA, 17 bp, Homo sapiens
ctctgcccccagctgct

SEQ ID NO: 404443 - DNA, 18 bp, Homo sapiens
ctctgcccccagctgctc

SEQ ID NO: 404444 - DNA, 19 bp, Homo sapiens
ctctgcccccagctgctcc

SEQ ID NO: 404445 - DNA, 22 bp, Homo sapiens
ctctgcccccgcgggttctaga

SEQ ID NO: 404446 - DNA, 23 bp, Homo sapiens
ctctgcccctccgtccccagggt

SEQ ID NO: 404447 - DNA, 20 bp, Homo sapiens
ctctgccccttctgtttcca

SEQ ID NO: 404448 - DNA, 18 bp, Homo sapiens
ctctgccctgcctccctt

SEQ ID NO: 404449 - DNA, 19 bp, Homo sapiens
ctctgccgaccgcctgctt

SEQ ID NO: 404450 - DNA, 22 bp, Homo sapiens
ctctgccgaccgcctgcttcac

SEQ ID NO: 404451 - DNA, 14 bp, Homo sapiens
ctctgcctccagga

SEQ ID NO: 404452 - DNA, 15 bp, Homo sapiens
ctctgcctccaggag

SEQ ID NO: 404453 - DNA, 19 bp, Homo sapiens
ctctgcctccaggagggca

SEQ ID NO: 404454 - DNA, 23 bp, Homo sapiens
ctctgcctccaggagggcatcag

SEQ ID NO: 404455 - DNA, 14 bp, Homo sapiens
ctctgcctcccagg

SEQ ID NO: 404456 - DNA, 15 bp, Homo sapiens
ctctgcctcccaggt

SEQ ID NO: 404457 - DNA, 16 bp, Homo sapiens
ctctgcctcctcttca

SEQ ID NO: 404458 - DNA, 19 bp, Homo sapiens
ctctgcctctaaggccaag

SEQ ID NO: 404459 - DNA, 20 bp, Homo sapiens
ctctgcctctaaggccaagg

SEQ ID NO: 404460 - DNA, 23 bp, Homo sapiens
ctctgcctctaaggccaaggcct

SEQ ID NO: 404461 - DNA, 20 bp, Homo sapiens
ctctgcctgtccctctcagg

SEQ ID NO: 404462 - DNA, 17 bp, Homo sapiens
ctctgccttccaggcgt

SEQ ID NO: 404463 - DNA, 16 bp, Homo sapiens
ctctgccttgcacaaa

SEQ ID NO: 404464 - DNA, 13 bp, Homo sapiens
ctctgccttggac

SEQ ID NO: 404465 - DNA, 22 bp, Homo sapiens
ctctgcgagcaacagtgccccc

SEQ ID NO: 404466 - DNA, 23 bp, Homo sapiens
ctctgcggggaggacccgggacc

SEQ ID NO: 404467 - DNA, 20 bp, Homo sapiens
ctctgcgtcccactgagtct

SEQ ID NO: 404468 - DNA, 20 bp, Homo sapiens
caggattgtacgtgggagag

SEQ ID NO: 404469 - DNA, 21 bp, Homo sapiens
caggattgtacgtgggagagg

SEQ ID NO: 404470 - DNA, 22 bp, Homo sapiens
caggattgtacgtgggagaggc

SEQ ID NO: 404471 - DNA, 21 bp, Homo sapiens
caggattgtctggggccgagg

SEQ ID NO: 404472 - DNA, 22 bp, Homo sapiens
caggattttaacaaaagcaaga

SEQ ID NO: 404473 - DNA, 21 bp, Homo sapiens
caggattttgtattgccatcg

SEQ ID NO: 404474 - DNA, 21 bp, Homo sapiens
caggcaaaaaagggacagcat

SEQ ID NO: 404475 - DNA, 21 bp, Homo sapiens
caggcaaaacacgcaagggca

SEQ ID NO: 404476 - DNA, 14 bp, Homo sapiens
caggcaaagaggtg

SEQ ID NO: 404477 - DNA, 23 bp, Homo sapiens
caggcaaagaggtgctgctttgc

SEQ ID NO: 404478 - DNA, 23 bp, Homo sapiens
caggcaacattacaaacaaagga

SEQ ID NO: 404479 - DNA, 21 bp, Homo sapiens
caggcaacgtgcgtgtctctg

SEQ ID NO: 404480 - DNA, 17 bp, Homo sapiens
caggcaacttcagtcct

SEQ ID NO: 404481 - DNA, 22 bp, Homo sapiens
caggcaacttcagtcctgggag

SEQ ID NO: 404482 - DNA, 16 bp, Homo sapiens
caggcaagcccctcag

SEQ ID NO: 404483 - DNA, 20 bp, Homo sapiens
caggcaagcccctcagccct

SEQ ID NO: 404484 - DNA, 22 bp, Homo sapiens
caggcaagcccctcagcccttg

SEQ ID NO: 404485 - DNA, 24 bp, Homo sapiens
caggcaagcccctcagcccttgcc

SEQ ID NO: 404486 - DNA, 22 bp, Homo sapiens
caggcaatggcctaaacttcag

SEQ ID NO: 404487 - DNA, 13 bp, Homo sapiens
caggcaccgagaa

SEQ ID NO: 404488 - DNA, 12 bp, Homo sapiens
caggcacctggc

SEQ ID NO: 404489 - DNA, 14 bp, Homo sapiens
caggcacctgggct

SEQ ID NO: 404490 - DNA, 15 bp, Homo sapiens
caggcacggaggctc

SEQ ID NO: 404491 - DNA, 16 bp, Homo sapiens
caggcacggaggctcg

SEQ ID NO: 404492 - DNA, 16 bp, Homo sapiens
caggcactgccttctc

SEQ ID NO: 404493 - DNA, 17 bp, Homo sapiens
caggcactgccttctcc

SEQ ID NO: 404494 - DNA, 21 bp, Homo sapiens
caggcactgccttctcctctc

SEQ ID NO: 404495 - DNA, 17 bp, Homo sapiens
caggcactgctgcccag

SEQ ID NO: 404496 - DNA, 14 bp, Homo sapiens
caggcagaaaactg

SEQ ID NO: 404497 - DNA, 17 bp, Homo sapiens
caggcagacacatgctg

SEQ ID NO: 404498 - DNA, 21 bp, Homo sapiens
caggcagagacaataaaacat

SEQ ID NO: 404499 - DNA, 22 bp, Homo sapiens
caggcagagctcagcacagcct

SEQ ID NO: 404500 - DNA, 22 bp, Homo sapiens
caggcagatctgtgccccatgc

SEQ ID NO: 404501 - DNA, 17 bp, Homo sapiens
caggcagcacctggagc

SEQ ID NO: 404502 - DNA, 13 bp, Homo sapiens
caggcagccttga

SEQ ID NO: 404503 - DNA, 17 bp, Homo sapiens
caggcagccttgaccac

SEQ ID NO: 404504 - DNA, 12 bp, Homo sapiens
caggcagcgatg

SEQ ID NO: 404505 - DNA, 15 bp, Homo sapiens
caggcagctggatga

SEQ ID NO: 404506 - DNA, 22 bp, Homo sapiens
caggcaggacgagactcctcgg

SEQ ID NO: 404507 - DNA, 15 bp, Homo sapiens
caggcaggcacctgg

SEQ ID NO: 404508 - DNA, 22 bp, Homo sapiens
caggcagggagggaaacccggg

SEQ ID NO: 404509 - DNA, 20 bp, Homo sapiens
caggcagtagcagctgtgtt

SEQ ID NO: 404510 - DNA, 15 bp, Homo sapiens
caggcagtgcatgtg

SEQ ID NO: 404511 - DNA, 14 bp, Homo sapiens
caggcataggcctg

SEQ ID NO: 404512 - DNA, 16 bp, Homo sapiens
caggcataggcctggg

SEQ ID NO: 404513 - DNA, 19 bp, Homo sapiens
caggcataggcctgggtgc

SEQ ID NO: 404514 - DNA, 22 bp, Homo sapiens
caggcatcattccaccatggct

SEQ ID NO: 404515 - DNA, 12 bp, Homo sapiens
caggcatcctcc

SEQ ID NO: 404516 - DNA, 21 bp, Homo sapiens
caggcatctgtaagaagtaga

SEQ ID NO: 404517 - DNA, 16 bp, Homo sapiens
caggcatgaccctgga

SEQ ID NO: 404518 - DNA, 14 bp, Homo sapiens
caggcatgcctgtg

SEQ ID NO: 404519 - DNA, 14 bp, Homo sapiens
caggcatgctggcc

SEQ ID NO: 404520 - DNA, 24 bp, Homo sapiens
caggcatgctggctcccagggcca

SEQ ID NO: 404521 - DNA, 21 bp, Homo sapiens
caggcatggcccagcctggag

SEQ ID NO: 404522 - DNA, 22 bp, Homo sapiens
caggcatggcccagcctggagc

SEQ ID NO: 404523 - DNA, 18 bp, Homo sapiens
caggccacacgctgccca

SEQ ID NO: 404524 - DNA, 19 bp, Homo sapiens
caggccacacgctgcccag

SEQ ID NO: 404525 - DNA, 14 bp, Homo sapiens
caggccaccagctg

SEQ ID NO: 404526 - DNA, 18 bp, Homo sapiens
caggccaccagctgctgg

SEQ ID NO: 404527 - DNA, 18 bp, Homo sapiens
caggccacccactgtggg

SEQ ID NO: 404528 - DNA, 17 bp, Homo sapiens
caggccacggcagccta

SEQ ID NO: 404529 - DNA, 14 bp, Homo sapiens
caggccactgacct

SEQ ID NO: 404530 - DNA, 16 bp, Homo sapiens
caggccactgacctcc

SEQ ID NO: 404531 - DNA, 12 bp, Homo sapiens
caggccactgtg

SEQ ID NO: 404532 - DNA, 14 bp, Homo sapiens
caggccactgtggc

SEQ ID NO: 404533 - DNA, 15 bp, Homo sapiens
caggccactgtggcc

SEQ ID NO: 404534 - DNA, 17 bp, Homo sapiens
caggccactgtggccag

SEQ ID NO: 404535 - DNA, 21 bp, Homo sapiens
caggccactgtggccagagct

SEQ ID NO: 404536 - DNA, 16 bp, Homo sapiens
caggccacttgctcag

SEQ ID NO: 404537 - DNA, 17 bp, Homo sapiens
caggccagcgaggcgag

SEQ ID NO: 404538 - DNA, 14 bp, Homo sapiens
caggccagcgtgga

SEQ ID NO: 404539 - DNA, 23 bp, Homo sapiens
caggccagcttcgtgctggagga

SEQ ID NO: 404540 - DNA, 12 bp, Homo sapiens
caggccaggtcc

SEQ ID NO: 404541 - DNA, 13 bp, Homo sapiens
caggccaggtccc

SEQ ID NO: 404542 - DNA, 16 bp, Homo sapiens
caggccagtggacaga

SEQ ID NO: 404543 - DNA, 15 bp, Homo sapiens
caggccataccaggt

SEQ ID NO: 404544 - DNA, 11 bp, Homo sapiens
caggccatggc

SEQ ID NO: 404545 - DNA, 12 bp, Homo sapiens
caggcccaccta

SEQ ID NO: 404546 - DNA, 16 bp, Homo sapiens
caggcccagcctggcc

SEQ ID NO: 404547 - DNA, 21 bp, Homo sapiens
caggcccagtccactggggag

SEQ ID NO: 404548 - DNA, 19 bp, Homo sapiens
caggcccatctcaggtgcc

SEQ ID NO: 404549 - DNA, 24 bp, Homo sapiens
caggcccatctcaggtgccactcc

SEQ ID NO: 404550 - DNA, 18 bp, Homo sapiens
caggcccatgccctccgt

SEQ ID NO: 404551 - DNA, 22 bp, Homo sapiens
caggccccaaaaccacagccct

SEQ ID NO: 404552 - DNA, 23 bp, Homo sapiens
caggccccaaaaccacagccctg

SEQ ID NO: 404553 - DNA, 14 bp, Homo sapiens
caggccccagccaa

SEQ ID NO: 404554 - DNA, 18 bp, Homo sapiens
caggccccagccaagtgc

SEQ ID NO: 404555 - DNA, 21 bp, Homo sapiens
caggccccagccaagtgcctt

SEQ ID NO: 404556 - DNA, 23 bp, Homo sapiens
caggccccagccaagtgccttcc

SEQ ID NO: 404557 - DNA, 18 bp, Homo sapiens
ctctgtcatcactccctg

SEQ ID NO: 404558 - DNA, 20 bp, Homo sapiens
ctctgtcatcactccctgga

SEQ ID NO: 404559 - DNA, 18 bp, Homo sapiens
ctctgtccaattccagag

SEQ ID NO: 404560 - DNA, 14 bp, Homo sapiens
ctctgtccaggcca

SEQ ID NO: 404561 - DNA, 16 bp, Homo sapiens
ctctgtccaggccact

SEQ ID NO: 404562 - DNA, 17 bp, Homo sapiens
ctctgtccaggccactg

SEQ ID NO: 404563 - DNA, 16 bp, Homo sapiens
ctctgtccagggcttc

SEQ ID NO: 404564 - DNA, 19 bp, Homo sapiens
ctctgtccagggcttcaga

SEQ ID NO: 404565 - DNA, 14 bp, Homo sapiens
ctctgtcctctgtc

SEQ ID NO: 404566 - DNA, 19 bp, Homo sapiens
ctctgtcctctgtcagtca

SEQ ID NO: 404567 - DNA, 20 bp, Homo sapiens
ctctgtcctctgtcagtcat

SEQ ID NO: 404568 - DNA, 16 bp, Homo sapiens
ctctgtctaccatctc

SEQ ID NO: 404569 - DNA, 18 bp, Homo sapiens
ctctgtcttctctccact

SEQ ID NO: 404570 - DNA, 15 bp, Homo sapiens
ctctgtctttttcct

SEQ ID NO: 404571 - DNA, 14 bp, Homo sapiens
ctctgtgaatacaa

SEQ ID NO: 404572 - DNA, 18 bp, Homo sapiens
ctctgtgaatacaattaa

SEQ ID NO: 404573 - DNA, 21 bp, Homo sapiens
ctctgtgactcgcttagctga

SEQ ID NO: 404574 - DNA, 13 bp, Homo sapiens
ctctgtgcaggtg

SEQ ID NO: 404575 - DNA, 17 bp, Homo sapiens
ctctgtgcctgggatca

SEQ ID NO: 404576 - DNA, 16 bp, Homo sapiens
ctctgtgctcacccat

SEQ ID NO: 404577 - DNA, 13 bp, Homo sapiens
ctctgtgctccct

SEQ ID NO: 404578 - DNA, 13 bp, Homo sapiens
ctctgtgctctga

SEQ ID NO: 404579 - DNA, 10 bp, Homo sapiens
ctctgtggcc

SEQ ID NO: 404580 - DNA, 18 bp, Homo sapiens
ctctgtggcctgtgtcca

SEQ ID NO: 404581 - DNA, 17 bp, Homo sapiens
ctctgttacatcctgct

SEQ ID NO: 404582 - DNA, 20 bp, Homo sapiens
ctctgttcagatgtgcattt

SEQ ID NO: 404583 - DNA, 19 bp, Homo sapiens
ctctgttccaagtgtgtgt

SEQ ID NO: 404584 - DNA, 14 bp, Homo sapiens
ctctgttgcctcct

SEQ ID NO: 404585 - DNA, 19 bp, Homo sapiens
ctctgttgcctcctctctc

SEQ ID NO: 404586 - DNA, 20 bp, Homo sapiens
ctctgttgcctcctctctcc

SEQ ID NO: 404587 - DNA, 17 bp, Homo sapiens
ctctgttgtcctcccct

SEQ ID NO: 404588 - DNA, 20 bp, Homo sapiens
ctctgttgtcctccccttgg

SEQ ID NO: 404589 - DNA, 22 bp, Homo sapiens
ctctgttgtcctccccttgggc

SEQ ID NO: 404590 - DNA, 22 bp, Homo sapiens
ctctgttgtgttcgttcttgtt

SEQ ID NO: 404591 - DNA, 17 bp, Homo sapiens
ctctgtttaccctccct

SEQ ID NO: 404592 - DNA, 18 bp, Homo sapiens
ctctgtttaccctccctg

SEQ ID NO: 404593 - DNA, 20 bp, Homo sapiens
ctctgtttaccctccctgtc

SEQ ID NO: 404594 - DNA, 22 bp, Homo sapiens
ctcttaaaaattatctttaaaa

SEQ ID NO: 404595 - DNA, 20 bp, Homo sapiens
ctcttaaagctgcctgtagt

SEQ ID NO: 404596 - DNA, 17 bp, Homo sapiens
ctcttaacaatttctgt

SEQ ID NO: 404597 - DNA, 12 bp, Homo sapiens
aggccaggccct

SEQ ID NO: 404598 - DNA, 15 bp, Homo sapiens
aggccaggccctcct

SEQ ID NO: 404599 - DNA, 18 bp, Homo sapiens
aggccaggccctcctgct

SEQ ID NO: 404600 - DNA, 15 bp, Homo sapiens
aggccaggggatctg

SEQ ID NO: 404601 - DNA, 15 bp, Homo sapiens
aggccagtggacaga

SEQ ID NO: 404602 - DNA, 14 bp, Homo sapiens
aggccatctgtaaa

SEQ ID NO: 404603 - DNA, 18 bp, Homo sapiens
aggccatctgtaaatatc

SEQ ID NO: 404604 - DNA, 21 bp, Homo sapiens
aggccatctgtaaatatccca

SEQ ID NO: 404605 - DNA, 22 bp, Homo sapiens
aggccatgatgtcgttcatttt

SEQ ID NO: 404606 - DNA, 13 bp, Homo sapiens
aggccatggccaa

SEQ ID NO: 404607 - DNA, 18 bp, Homo sapiens
aggccatgggggcccctc

SEQ ID NO: 404608 - DNA, 12 bp, Homo sapiens
aggccatgtgaa

SEQ ID NO: 404609 - DNA, 13 bp, Homo sapiens
aggccattccctg

SEQ ID NO: 404610 - DNA, 14 bp, Homo sapiens
aggccattccctgt

SEQ ID NO: 404611 - DNA, 17 bp, Homo sapiens
aggcccaaggtcccctc

SEQ ID NO: 404612 - DNA, 18 bp, Homo sapiens
aggcccaaggtcccctcc

SEQ ID NO: 404613 - DNA, 19 bp, Homo sapiens
aggcccaaggtcccctcca

SEQ ID NO: 404614 - DNA, 12 bp, Homo sapiens
aggcccacagga

SEQ ID NO: 404615 - DNA, 15 bp, Homo sapiens
aggcccagagagctg

SEQ ID NO: 404616 - DNA, 15 bp, Homo sapiens
aggcccagcctggcc

SEQ ID NO: 404617 - DNA, 13 bp, Homo sapiens
aggcccagcctgt

SEQ ID NO: 404618 - DNA, 17 bp, Homo sapiens
aggcccagcctgtcctg

SEQ ID NO: 404619 - DNA, 21 bp, Homo sapiens
aggccccaaaaccacagccct

SEQ ID NO: 404620 - DNA, 23 bp, Homo sapiens
aggccccaaaaccacagccctgt

SEQ ID NO: 404621 - DNA, 23 bp, Homo sapiens
aggccccagccaagtgccttccg

SEQ ID NO: 404622 - DNA, 22 bp, Homo sapiens
catggccaaggggccagctgcc

SEQ ID NO: 404623 - DNA, 17 bp, Homo sapiens
catggccacagccacct

SEQ ID NO: 404624 - DNA, 22 bp, Homo sapiens
catggccacttgggtcttccct

SEQ ID NO: 404625 - DNA, 15 bp, Homo sapiens
catggccaggtggcc

SEQ ID NO: 404626 - DNA, 14 bp, Homo sapiens
catggcccagcagc

SEQ ID NO: 404627 - DNA, 18 bp, Homo sapiens
catggcccagcagcttgg

SEQ ID NO: 404628 - DNA, 19 bp, Homo sapiens
catggcccagcagcttggc

SEQ ID NO: 404629 - DNA, 18 bp, Homo sapiens
catggcccagcctggagc

SEQ ID NO: 404630 - DNA, 23 bp, Homo sapiens
catggcccatcactcggctgtgg

SEQ ID NO: 404631 - DNA, 18 bp, Homo sapiens
catggccccagctggctg

SEQ ID NO: 404632 - DNA, 14 bp, Homo sapiens
catggcccctccag

SEQ ID NO: 404633 - DNA, 18 bp, Homo sapiens
catggcccctccaggaac

SEQ ID NO: 404634 - DNA, 21 bp, Homo sapiens
catggccgggccctctgtagc

SEQ ID NO: 404635 - DNA, 14 bp, Homo sapiens
catggcctcccagc

SEQ ID NO: 404636 - DNA, 15 bp, Homo sapiens
catggcctcccagcc

SEQ ID NO: 404637 - DNA, 17 bp, Homo sapiens
catggcgtaatgggcct

SEQ ID NO: 404638 - DNA, 17 bp, Homo sapiens
catggctaagcttaaaa

SEQ ID NO: 404639 - DNA, 16 bp, Homo sapiens
catggctcaaggattc

SEQ ID NO: 404640 - DNA, 12 bp, Homo sapiens
catggctcaggc

SEQ ID NO: 404641 - DNA, 21 bp, Homo sapiens
catggctgttatctgtcttta

SEQ ID NO: 404642 - DNA, 20 bp, Homo sapiens
catggcttaatgtttattcc

SEQ ID NO: 404643 - DNA, 17 bp, Homo sapiens
catggctttcatcctgt

SEQ ID NO: 404644 - DNA, 18 bp, Homo sapiens
catggctttcatcctgtg

SEQ ID NO: 404645 - DNA, 21 bp, Homo sapiens
catggctttcatcctgtgtcc

SEQ ID NO: 404646 - DNA, 16 bp, Homo sapiens
catgggaacgcagcct

SEQ ID NO: 404647 - DNA, 14 bp, Homo sapiens
catgggaatgaatg

SEQ ID NO: 404648 - DNA, 17 bp, Homo sapiens
catgggcacctcatgga

SEQ ID NO: 404649 - DNA, 13 bp, Homo sapiens
catgggccctctg

SEQ ID NO: 404650 - DNA, 12 bp, Homo sapiens
catgggcctccc

SEQ ID NO: 404651 - DNA, 14 bp, Homo sapiens
catgggcctcccac

SEQ ID NO: 404652 - DNA, 10 bp, Homo sapiens
catgggcctg

SEQ ID NO: 404653 - DNA, 22 bp, Homo sapiens
catgggcctgctgcgtcagacc

SEQ ID NO: 404654 - DNA, 11 bp, Homo sapiens
catgggcctgg

SEQ ID NO: 404655 - DNA, 22 bp, Homo sapiens
catgggctagtgtgagtggcag

SEQ ID NO: 404656 - DNA, 21 bp, Homo sapiens
catggggatcagagtctggcc

SEQ ID NO: 404657 - DNA, 16 bp, Homo sapiens
catgggggaggctctg

SEQ ID NO: 404658 - DNA, 17 bp, Homo sapiens
catgggggaggctctga

SEQ ID NO: 404659 - DNA, 18 bp, Homo sapiens
catgggggaggctctgaa

SEQ ID NO: 404660 - DNA, 20 bp, Homo sapiens
catgggggaggctctgaaga

SEQ ID NO: 404661 - DNA, 14 bp, Homo sapiens
catgggggcagggc

SEQ ID NO: 404662 - DNA, 13 bp, Homo sapiens
catggggtgggcc

SEQ ID NO: 404663 - DNA, 19 bp, Homo sapiens
catggggtgggcctctggt

SEQ ID NO: 404664 - DNA, 16 bp, Homo sapiens
catgggtagcttctga

SEQ ID NO: 404665 - DNA, 19 bp, Homo sapiens
catgggtagcttctgacct

SEQ ID NO: 404666 - DNA, 22 bp, Homo sapiens
catgggtagcttctgacctcag

SEQ ID NO: 404667 - DNA, 14 bp, Homo sapiens
catgggtcccttcc

SEQ ID NO: 404668 - DNA, 19 bp, Homo sapiens
catgggtgaagggagagcc

SEQ ID NO: 404669 - DNA, 13 bp, Homo sapiens
catgggtggaggg

SEQ ID NO: 404670 - DNA, 13 bp, Homo sapiens
catggtaatgtaa

SEQ ID NO: 404671 - DNA, 16 bp, Homo sapiens
catggtatttgagaca

SEQ ID NO: 404672 - DNA, 22 bp, Homo sapiens
catggtccatttcatgtgatct

SEQ ID NO: 404673 - DNA, 21 bp, Homo sapiens
catggtgaaaatgtactgaga

SEQ ID NO: 404674 - DNA, 21 bp, Homo sapiens
catggtgaggcttaacaatgt

SEQ ID NO: 404675 - DNA, 15 bp, Homo sapiens
catggtgatgcaagt

SEQ ID NO: 404676 - DNA, 14 bp, Homo sapiens
catggtgctagtgg

SEQ ID NO: 404677 - DNA, 19 bp, Homo sapiens
catggtggcacgtgcctgt

SEQ ID NO: 404678 - DNA, 19 bp, Homo sapiens
catggtgggttcaggggac

SEQ ID NO: 404679 - DNA, 16 bp, Homo sapiens
catggttgagaaatga

SEQ ID NO: 404680 - DNA, 16 bp, Homo sapiens
catgtaaaacaaaaaa

SEQ ID NO: 404681 - DNA, 19 bp, Homo sapiens
catgtaaaacaaaaaacaa

SEQ ID NO: 404682 - DNA, 14 bp, Homo sapiens
catgtaaaatcttc

SEQ ID NO: 404683 - DNA, 21 bp, Homo sapiens
catgtaaaatcttcagctggt

SEQ ID NO: 404684 - DNA, 20 bp, Homo sapiens
catgtaaggtcttcttgtgt

SEQ ID NO: 404685 - DNA, 21 bp, Homo sapiens
catgtaataaaaagtatatgt

SEQ ID NO: 404686 - DNA, 22 bp, Homo sapiens
catgtaataaaaagtatatgtt

SEQ ID NO: 404687 - DNA, 21 bp, Homo sapiens
catgtaatggtatcttaaagt

SEQ ID NO: 404688 - DNA, 20 bp, Homo sapiens
catgtaccagtgtactgctt

SEQ ID NO: 404689 - DNA, 23 bp, Homo sapiens
catgtaccagtgtactgctttca

SEQ ID NO: 404690 - DNA, 15 bp, Homo sapiens
catgtaccatcaata

SEQ ID NO: 404691 - DNA, 19 bp, Homo sapiens
catgtactgagccttgtaa

SEQ ID NO: 404692 - DNA, 23 bp, Homo sapiens
catgtactgagccttgtaattct

SEQ ID NO: 404693 - DNA, 21 bp, Homo sapiens
catgtactgctagtacctgta

SEQ ID NO: 404694 - DNA, 24 bp, Homo sapiens
catgtactgctagtacctgtaagc

SEQ ID NO: 404695 - DNA, 19 bp, Homo sapiens
catgtagaagagggagaag

SEQ ID NO: 404696 - DNA, 17 bp, Homo sapiens
catgtagcatataaatg

SEQ ID NO: 404697 - DNA, 20 bp, Homo sapiens
catgtagcatataaatgttt

SEQ ID NO: 404698 - DNA, 21 bp, Homo sapiens
catgtagcatataaatgttta

SEQ ID NO: 404699 - DNA, 23 bp, Homo sapiens
catgtataaatgaagtttataca

SEQ ID NO: 404700 - DNA, 12 bp, Homo sapiens
catgtatactta

SEQ ID NO: 404701 - DNA, 15 bp, Homo sapiens
catgtatagctagct

SEQ ID NO: 404702 - DNA, 15 bp, Homo sapiens
catgtatagtgagtg

SEQ ID NO: 404703 - DNA, 21 bp, Homo sapiens
catgtatgtggatacagtcat

SEQ ID NO: 404704 - DNA, 19 bp, Homo sapiens
catgtattcactaaaataa

SEQ ID NO: 404705 - DNA, 14 bp, Homo sapiens
catgtattggcctg

SEQ ID NO: 404706 - DNA, 19 bp, Homo sapiens
catgtattggcctggaggt

SEQ ID NO: 404707 - DNA, 21 bp, Homo sapiens
catgtcatgtaggttgtctaa

SEQ ID NO: 404708 - DNA, 22 bp, Homo sapiens
catgtccaagtccaacctgcct

SEQ ID NO: 404709 - DNA, 24 bp, Homo sapiens
catgtccaagtccaacctgcctgt

SEQ ID NO: 404710 - DNA, 15 bp, Homo sapiens
catgtccaagttctt

SEQ ID NO: 404711 - DNA, 20 bp, Homo sapiens
catgtccaagttcttcacct

SEQ ID NO: 404712 - DNA, 20 bp, Homo sapiens
catgtcgcctctgcattcag

SEQ ID NO: 404713 - DNA, 17 bp, Homo sapiens
catgtcggagtagaaat

SEQ ID NO: 404714 - DNA, 18 bp, Homo sapiens
catgtctacaaaagcaaa

SEQ ID NO: 404715 - DNA, 21 bp, Homo sapiens
atatccaagtaccaatgctgt

SEQ ID NO: 404716 - DNA, 22 bp, Homo sapiens
atatccaagtaccaatgctgtt

SEQ ID NO: 404717 - DNA, 23 bp, Homo sapiens
atatccaagtaccaatgctgttg

SEQ ID NO: 404718 - DNA, 16 bp, Homo sapiens
atatccataacctcta

SEQ ID NO: 404719 - DNA, 15 bp, Homo sapiens
atatccatgtactgt

SEQ ID NO: 404720 - DNA, 11 bp, Homo sapiens
atatcccagag

SEQ ID NO: 404721 - DNA, 13 bp, Homo sapiens
atatcgtcatttt

SEQ ID NO: 404722 - DNA, 15 bp, Homo sapiens
atatctagatttcta

SEQ ID NO: 404723 - DNA, 16 bp, Homo sapiens
atatctagatttctag

SEQ ID NO: 404724 - DNA, 17 bp, Homo sapiens
atatctagatttctaga

SEQ ID NO: 404725 - DNA, 21 bp, Homo sapiens
atatctatgactgtgtttaat

SEQ ID NO: 404726 - DNA, 23 bp, Homo sapiens
atatctcaatgtgcaataacttg

SEQ ID NO: 404727 - DNA, 12 bp, Homo sapiens
atatctctccct

SEQ ID NO: 404728 - DNA, 13 bp, Homo sapiens
atatctctccctt

SEQ ID NO: 404729 - DNA, 16 bp, Homo sapiens
atatctctcccttctt

SEQ ID NO: 404730 - DNA, 13 bp, Homo sapiens
atatctgcttcag

SEQ ID NO: 404731 - DNA, 16 bp, Homo sapiens
atatctgcttcagtgg

SEQ ID NO: 404732 - DNA, 15 bp, Homo sapiens
atatctgttagatgc

SEQ ID NO: 404733 - DNA, 19 bp, Homo sapiens
atatctgttagatgctact

SEQ ID NO: 404734 - DNA, 15 bp, Homo sapiens
atatctgttcacttt

SEQ ID NO: 404735 - DNA, 16 bp, Homo sapiens
atatctgttttactgc

SEQ ID NO: 404736 - DNA, 18 bp, Homo sapiens
atatctttaaataaatgt

SEQ ID NO: 404737 - DNA, 13 bp, Homo sapiens
atatctttgcact

SEQ ID NO: 404738 - DNA, 16 bp, Homo sapiens
atatgaaaactaagtt

SEQ ID NO: 404739 - DNA, 23 bp, Homo sapiens
atatgaaaatacaacttaaataa

SEQ ID NO: 404740 - DNA, 14 bp, Homo sapiens
atatgaacttaaca

SEQ ID NO: 404741 - DNA, 18 bp, Homo sapiens
atatgaagtaagttctga

SEQ ID NO: 404742 - DNA, 21 bp, Homo sapiens
atatgaagtaagttctgaaaa

SEQ ID NO: 404743 - DNA, 19 bp, Homo sapiens
atatgaatgcttgtaatag

SEQ ID NO: 404744 - DNA, 17 bp, Homo sapiens
atatgaatttaaatata

SEQ ID NO: 404745 - DNA, 18 bp, Homo sapiens
atatgacaatttcaaaat

SEQ ID NO: 404746 - DNA, 23 bp, Homo sapiens
atatgacctaaatccattttcta

SEQ ID NO: 404747 - DNA, 19 bp, Homo sapiens
atatgagaaatataaaaat

SEQ ID NO: 404748 - DNA, 22 bp, Homo sapiens
atatgagaaatataaaaataat

SEQ ID NO: 404749 - DNA, 21 bp, Homo sapiens
atatgaggggactgcatgcaa

SEQ ID NO: 404750 - DNA, 12 bp, Homo sapiens
atatgatatata

SEQ ID NO: 404751 - DNA, 16 bp, Homo sapiens
cgcgctctgcccctcc

SEQ ID NO: 404752 - DNA, 21 bp, Homo sapiens
cgcgctggaatccagaaggaa

SEQ ID NO: 404753 - DNA, 15 bp, Homo sapiens
cgcggctgggagcct

SEQ ID NO: 404754 - DNA, 12 bp, Homo sapiens
cgcgggagagag

SEQ ID NO: 404755 - DNA, 15 bp, Homo sapiens
cgcgggaggcaccag

SEQ ID NO: 404756 - DNA, 15 bp, Homo sapiens
cgcgggcggccaggc

SEQ ID NO: 404757 - DNA, 13 bp, Homo sapiens
cgcggtgctctgg

SEQ ID NO: 404758 - DNA, 16 bp, Homo sapiens
cgcggtgctctggcgg

SEQ ID NO: 404759 - DNA, 14 bp, Homo sapiens
cgcggttcaggtca

SEQ ID NO: 404760 - DNA, 13 bp, Homo sapiens
cgcgtagagagcc

SEQ ID NO: 404761 - DNA, 13 bp, Homo sapiens
cgcgtctgcccca

SEQ ID NO: 404762 - DNA, 13 bp, Homo sapiens
cgcgtcttcctga

SEQ ID NO: 404763 - DNA, 15 bp, Homo sapiens
cgcgtgattgaccct

SEQ ID NO: 404764 - DNA, 18 bp, Homo sapiens
cgcgtgcccccagcgtgg

SEQ ID NO: 404765 - DNA, 13 bp, Homo sapiens
cgcgtgttctgaa

SEQ ID NO: 404766 - DNA, 23 bp, Homo sapiens
cgctagatgggcatggggtgggc

SEQ ID NO: 404767 - DNA, 15 bp, Homo sapiens
cgctaggagagactg

SEQ ID NO: 404768 - DNA, 20 bp, Homo sapiens
cgctaggagagactgaaagc

SEQ ID NO: 404769 - DNA, 15 bp, Homo sapiens
cgctatccacagaac

SEQ ID NO: 404770 - DNA, 13 bp, Homo sapiens
cgctattacaaat

SEQ ID NO: 404771 - DNA, 20 bp, Homo sapiens
cgctcaacctctcagatccc

SEQ ID NO: 404772 - DNA, 13 bp, Homo sapiens
cgctcaccctcct

SEQ ID NO: 404773 - DNA, 16 bp, Homo sapiens
cgctcacctgcagccc

SEQ ID NO: 404774 - DNA, 13 bp, Homo sapiens
cgctcaggaccca

SEQ ID NO: 404775 - DNA, 15 bp, Homo sapiens
cgctcaggacccagg

SEQ ID NO: 404776 - DNA, 17 bp, Homo sapiens
cgctcaggacccaggcc

SEQ ID NO: 404777 - DNA, 18 bp, Homo sapiens
cgctcatgggcccctctg

SEQ ID NO: 404778 - DNA, 19 bp, Homo sapiens
cgctcccccgcagtcccca

SEQ ID NO: 404779 - DNA, 13 bp, Homo sapiens
cgctcccctctgc

SEQ ID NO: 404780 - DNA, 16 bp, Homo sapiens
cgctcccctttcccat

SEQ ID NO: 404781 - DNA, 17 bp, Homo sapiens
cgctccctgtcgcctgc

SEQ ID NO: 404782 - DNA, 16 bp, Homo sapiens
cgctccggcagaggca

SEQ ID NO: 404783 - DNA, 23 bp, Homo sapiens
cgctccgggtgcgtgaccggccc

SEQ ID NO: 404784 - DNA, 12 bp, Homo sapiens
cgctcctctgca

SEQ ID NO: 404785 - DNA, 15 bp, Homo sapiens
cgctcctctgcagcc

SEQ ID NO: 404786 - DNA, 16 bp, Homo sapiens
cgctcctctgcagcct

SEQ ID NO: 404787 - DNA, 17 bp, Homo sapiens
cgctcctctgcagcctg

SEQ ID NO: 404788 - DNA, 20 bp, Homo sapiens
cgctcctctgcagcctgagc

SEQ ID NO: 404789 - DNA, 19 bp, Homo sapiens
cgctctccatcataggctg

SEQ ID NO: 404790 - DNA, 14 bp, Homo sapiens
cgctctctgtctgg

SEQ ID NO: 404791 - DNA, 14 bp, Homo sapiens
cgctctcttccaga

SEQ ID NO: 404792 - DNA, 15 bp, Homo sapiens
cgctctgccatcagc

SEQ ID NO: 404793 - DNA, 17 bp, Homo sapiens
cgctctgccatcagccc

SEQ ID NO: 404794 - DNA, 12 bp, Homo sapiens
cgctctgcccct

SEQ ID NO: 404795 - DNA, 20 bp, Homo sapiens
cgctctgcccctccgtcccc

SEQ ID NO: 404796 - DNA, 23 bp, Homo sapiens
cgctctgcccctccgtccccagg

SEQ ID NO: 404797 - DNA, 12 bp, Homo sapiens
cgctctggacat

SEQ ID NO: 404798 - DNA, 22 bp, Homo sapiens
cgctctgttgcccaggctggag

SEQ ID NO: 404799 - DNA, 17 bp, Homo sapiens
cgctcttcaccaggaag

SEQ ID NO: 404800 - DNA, 23 bp, Homo sapiens
cgctcttcaccaggaagaaggcc

SEQ ID NO: 404801 - DNA, 22 bp, Homo sapiens
cgctgagggcagggttctagaa

SEQ ID NO: 404802 - DNA, 21 bp, Homo sapiens
cgctgccaccacgtctgccag

SEQ ID NO: 404803 - DNA, 15 bp, Homo sapiens
cgctgcccacaccac

SEQ ID NO: 404804 - DNA, 12 bp, Homo sapiens
cgctgcccagcc

SEQ ID NO: 404805 - DNA, 15 bp, Homo sapiens
cgctgcccagccctc

SEQ ID NO: 404806 - DNA, 23 bp, Homo sapiens
cgctgcccagccctcccagctgg

SEQ ID NO: 404807 - DNA, 14 bp, Homo sapiens
cgctgcccaggctc

SEQ ID NO: 404808 - DNA, 15 bp, Homo sapiens
cgctgcccaggctct

SEQ ID NO: 404809 - DNA, 19 bp, Homo sapiens
cgctgcccaggctctgctg

SEQ ID NO: 404810 - DNA, 19 bp, Homo sapiens
cgctgcctggcgggcagcc

SEQ ID NO: 404811 - DNA, 15 bp, Homo sapiens
cgctgcgggcccagc

SEQ ID NO: 404812 - DNA, 18 bp, Homo sapiens
cgctgcgggcccagctga

SEQ ID NO: 404813 - DNA, 14 bp, Homo sapiens
cgctgctctagctg

SEQ ID NO: 404814 - DNA, 17 bp, Homo sapiens
cgctgctctagctggca

SEQ ID NO: 404815 - DNA, 13 bp, Homo sapiens
cgctgctgctttc

SEQ ID NO: 404816 - DNA, 14 bp, Homo sapiens
cgctgctgtgctct

SEQ ID NO: 404817 - DNA, 13 bp, Homo sapiens
cgctgcttccagg

SEQ ID NO: 404818 - DNA, 13 bp, Homo sapiens
cgctggctcccca

SEQ ID NO: 404819 - DNA, 16 bp, Homo sapiens
cgctggctccccaaag

SEQ ID NO: 404820 - DNA, 14 bp, Homo sapiens
cgctggctgggggc

SEQ ID NO: 404821 - DNA, 17 bp, Homo sapiens
cgctgggagaaaagcca

SEQ ID NO: 404822 - DNA, 14 bp, Homo sapiens
cgctgggctgagcc

SEQ ID NO: 404823 - DNA, 15 bp, Homo sapiens
cgctgggctgagccc

SEQ ID NO: 404824 - DNA, 17 bp, Homo sapiens
cgctgggctgagcccct

SEQ ID NO: 404825 - DNA, 15 bp, Homo sapiens
cgctggtagagatgg

SEQ ID NO: 404826 - DNA, 21 bp, Homo sapiens
cgctgtcacccagcaaggcac

SEQ ID NO: 404827 - DNA, 10 bp, Homo sapiens
cgctgtgctc

SEQ ID NO: 404828 - DNA, 14 bp, Homo sapiens
cgcttcacccctgc

SEQ ID NO: 404829 - DNA, 15 bp, Homo sapiens
cgcttcacccctgca

SEQ ID NO: 404830 - DNA, 12 bp, Homo sapiens
cgcttgagccca

SEQ ID NO: 404831 - DNA, 13 bp, Homo sapiens
cgcttgagcccag

SEQ ID NO: 404832 - DNA, 17 bp, Homo sapiens
cgcttgagcccaggagt

SEQ ID NO: 404833 - DNA, 16 bp, Homo sapiens
cgcttggctccatgct

SEQ ID NO: 404834 - DNA, 16 bp, Homo sapiens
cgctttctagctgttg

SEQ ID NO: 404835 - DNA, 16 bp, Homo sapiens
cgctttctcctgtgcc

SEQ ID NO: 404836 - DNA, 13 bp, Homo sapiens
cggaaacagaact

SEQ ID NO: 404837 - DNA, 16 bp, Homo sapiens
cggaaagactgaaaga

SEQ ID NO: 404838 - DNA, 20 bp, Homo sapiens
cggaaatacactacaaatgt

SEQ ID NO: 404839 - DNA, 16 bp, Homo sapiens
cggaactgcatgctgc

SEQ ID NO: 404840 - DNA, 13 bp, Homo sapiens
cggaagcctgtcc

SEQ ID NO: 404841 - DNA, 17 bp, Homo sapiens
cggaagtggtggggact

SEQ ID NO: 404842 - DNA, 17 bp, Homo sapiens
cggaatcctgtcctcag

SEQ ID NO: 404843 - DNA, 18 bp, Homo sapiens
cggaatcctgtcctcagc

SEQ ID NO: 404844 - DNA, 15 bp, Homo sapiens
cggaccggagcggct

SEQ ID NO: 404845 - DNA, 20 bp, Homo sapiens
cggaccggagcggctgagga

SEQ ID NO: 404846 - DNA, 14 bp, Homo sapiens
cggacgctggctcc

SEQ ID NO: 404847 - DNA, 16 bp, Homo sapiens
cggacgggacagcggc

SEQ ID NO: 404848 - DNA, 19 bp, Homo sapiens
cggacgttggttctgcact

SEQ ID NO: 404849 - DNA, 16 bp, Homo sapiens
cggacgtttccatcag

SEQ ID NO: 404850 - DNA, 16 bp, Homo sapiens
cggactccatggccct

SEQ ID NO: 404851 - DNA, 19 bp, Homo sapiens
cggactcccgggccacgcc

SEQ ID NO: 404852 - DNA, 22 bp, Homo sapiens
cggactcccgggccacgcccca

SEQ ID NO: 404853 - DNA, 15 bp, Homo sapiens
cggactgcccccaga

SEQ ID NO: 404854 - DNA, 15 bp, Homo sapiens
cggagaaaggaaggg

SEQ ID NO: 404855 - DNA, 15 bp, Homo sapiens
cggagaacatctgcc

SEQ ID NO: 404856 - DNA, 14 bp, Homo sapiens
cggagacgggaccg

SEQ ID NO: 404857 - DNA, 21 bp, Homo sapiens
cggagacgtgatgaagggagg

SEQ ID NO: 404858 - DNA, 16 bp, Homo sapiens
cggagagaaaaaagaa

SEQ ID NO: 404859 - DNA, 16 bp, Homo sapiens
cggagaggctgtctgg

SEQ ID NO: 404860 - DNA, 21 bp, Homo sapiens
cggagagggagtcagtcttca

SEQ ID NO: 404861 - DNA, 16 bp, Homo sapiens
cggagcacagccctgg

SEQ ID NO: 404862 - DNA, 21 bp, Homo sapiens
cggagcacagccctgggaggg

SEQ ID NO: 404863 - DNA, 13 bp, Homo sapiens
cggagcggctgag

SEQ ID NO: 404864 - DNA, 16 bp, Homo sapiens
cggagcggctgaggac

SEQ ID NO: 404865 - DNA, 17 bp, Homo sapiens
cggagctaacactggcc

SEQ ID NO: 404866 - DNA, 21 bp, Homo sapiens
cggagctgcatggacgcctgg

SEQ ID NO: 404867 - DNA, 21 bp, Homo sapiens
cggaggccatgggggcccctc

SEQ ID NO: 404868 - DNA, 12 bp, Homo sapiens
cggaggcgccca

SEQ ID NO: 404869 - DNA, 15 bp, Homo sapiens
cggaggcttgggacc

SEQ ID NO: 404870 - DNA, 18 bp, Homo sapiens
cggaggcttgtcagagct

SEQ ID NO: 404871 - DNA, 20 bp, Homo sapiens
cggaggcttgtcagagctgg

SEQ ID NO: 404872 - DNA, 21 bp, Homo sapiens
cggaggcttgtcagagctggg

SEQ ID NO: 404873 - DNA, 22 bp, Homo sapiens
cggagggaccaggtgtctagag

SEQ ID NO: 404874 - DNA, 15 bp, Homo sapiens
cggaggggcctggca

SEQ ID NO: 404875 - DNA, 16 bp, Homo sapiens
cggaggggcctggcag

SEQ ID NO: 404876 - DNA, 18 bp, Homo sapiens
cggaggggcctggcagcc

SEQ ID NO: 404877 - DNA, 19 bp, Homo sapiens
cggaggggcttggagcaga

SEQ ID NO: 404878 - DNA, 21 bp, Homo sapiens
cggagtagaaattgttcctga

SEQ ID NO: 404879 - DNA, 13 bp, Homo sapiens
cggataggctaat

SEQ ID NO: 404880 - DNA, 19 bp, Homo sapiens
cggatcacaaggtcaggag

SEQ ID NO: 404881 - DNA, 17 bp, Homo sapiens
cggatctagccatggct

SEQ ID NO: 404882 - DNA, 16 bp, Homo sapiens
cggatctccaggccca

SEQ ID NO: 404883 - DNA, 20 bp, Homo sapiens
cgggagctggtgacagcctt

SEQ ID NO: 404884 - DNA, 17 bp, Homo sapiens
cgggaggcaccagctct

SEQ ID NO: 404885 - DNA, 19 bp, Homo sapiens
cgggaggcaccagctctgt

SEQ ID NO: 404886 - DNA, 20 bp, Homo sapiens
cgggaggccacgggggaggc

SEQ ID NO: 404887 - DNA, 22 bp, Homo sapiens
cgggaggccacgggggaggccg

SEQ ID NO: 404888 - DNA, 14 bp, Homo sapiens
cgggcacagctgtg

SEQ ID NO: 404889 - DNA, 15 bp, Homo sapiens
cgggcagcccctgct

SEQ ID NO: 404890 - DNA, 14 bp, Homo sapiens
cgggcagcctggct

SEQ ID NO: 404891 - DNA, 23 bp, Homo sapiens
cgggcagcctggctcccaggaca

SEQ ID NO: 404892 - DNA, 17 bp, Homo sapiens
cgggcagggctcccaca

SEQ ID NO: 404893 - DNA, 22 bp, Homo sapiens
cgggcaggggagccagggtaga

SEQ ID NO: 404894 - DNA, 22 bp, Homo sapiens
cgggcagtgacgtgagtgggga

SEQ ID NO: 404895 - DNA, 15 bp, Homo sapiens
cgggcatcgcaggag

SEQ ID NO: 404896 - DNA, 12 bp, Homo sapiens
cgggcattttga

SEQ ID NO: 404897 - DNA, 14 bp, Homo sapiens
cgggccaaggactg

SEQ ID NO: 404898 - DNA, 15 bp, Homo sapiens
cgggcccagaggagc

SEQ ID NO: 404899 - DNA, 18 bp, Homo sapiens
cgggcccgctcaacctct

SEQ ID NO: 404900 - DNA, 18 bp, Homo sapiens
cgggcccgttgaggatga

SEQ ID NO: 404901 - DNA, 22 bp, Homo sapiens
cgggcccgttgaggatgaggcc

SEQ ID NO: 404902 - DNA, 17 bp, Homo sapiens
cgggccctctgccgacc

SEQ ID NO: 404903 - DNA, 15 bp, Homo sapiens
cgggccctctgtagc

SEQ ID NO: 404904 - DNA, 16 bp, Homo sapiens
cgggccctctgtagct

SEQ ID NO: 404905 - DNA, 18 bp, Homo sapiens
cgggccctctgtagctcc

SEQ ID NO: 404906 - DNA, 15 bp, Homo sapiens
cgggccgcctcctcc

SEQ ID NO: 404907 - DNA, 19 bp, Homo sapiens
cgggccgcctcctccagac

SEQ ID NO: 404908 - DNA, 21 bp, Homo sapiens
cgggcctggactgtcctaggt

SEQ ID NO: 404909 - DNA, 16 bp, Homo sapiens
cgggcctggagaacta

SEQ ID NO: 404910 - DNA, 18 bp, Homo sapiens
cgggcgcctgcgctcctc

SEQ ID NO: 404911 - DNA, 13 bp, Homo sapiens
cgggcgctgctgg

SEQ ID NO: 404912 - DNA, 13 bp, Homo sapiens
cgggcggccaggc

SEQ ID NO: 404913 - DNA, 17 bp, Homo sapiens
cgggctaagtccagctc

SEQ ID NO: 404914 - DNA, 19 bp, Homo sapiens
cgggctaagtccagctctc

SEQ ID NO: 404915 - DNA, 14 bp, Homo sapiens
cgggctcagctctg

SEQ ID NO: 404916 - DNA, 14 bp, Homo sapiens
cgggctctctgctg

SEQ ID NO: 404917 - DNA, 15 bp, Homo sapiens
cgggctctctgctgt

SEQ ID NO: 404918 - DNA, 23 bp, Homo sapiens
cgggctctggccaccctggcccg

SEQ ID NO: 404919 - DNA, 16 bp, Homo sapiens
cgggctggcctgtgcc

SEQ ID NO: 404920 - DNA, 16 bp, Homo sapiens
cgggctgggagctctg

SEQ ID NO: 404921 - DNA, 14 bp, Homo sapiens
cgggctgggcagct

SEQ ID NO: 404922 - DNA, 16 bp, Homo sapiens
cgggctgggcagctgt

SEQ ID NO: 404923 - DNA, 14 bp, Homo sapiens
cggggacacggcct

SEQ ID NO: 404924 - DNA, 13 bp, Homo sapiens
cggggaccctgcc

SEQ ID NO: 404925 - DNA, 16 bp, Homo sapiens
cggggagcccccgccc

SEQ ID NO: 404926 - DNA, 15 bp, Homo sapiens
cggggaggagccttg

SEQ ID NO: 404927 - DNA, 19 bp, Homo sapiens
cggggaggccaagtgcagg

SEQ ID NO: 404928 - DNA, 23 bp, Homo sapiens
cggggagtttccgcggcggcttc

SEQ ID NO: 404929 - DNA, 16 bp, Homo sapiens
cggggcactggctgct

SEQ ID NO: 404930 - DNA, 15 bp, Homo sapiens
cggggcagagctgag

SEQ ID NO: 404931 - DNA, 14 bp, Homo sapiens
cggggcagctgcca

SEQ ID NO: 404932 - DNA, 13 bp, Homo sapiens
cggggccagaggc

SEQ ID NO: 404933 - DNA, 22 bp, Homo sapiens
cggggcccttggggcctggctt

SEQ ID NO: 404934 - DNA, 17 bp, Homo sapiens
cggggcctccaacccat

SEQ ID NO: 404935 - DNA, 15 bp, Homo sapiens
cggggcctgcctagc

SEQ ID NO: 404936 - DNA, 16 bp, Homo sapiens
cggggcctgcctagca

SEQ ID NO: 404937 - DNA, 12 bp, Homo sapiens
cggggctggcaa

SEQ ID NO: 404938 - DNA, 16 bp, Homo sapiens
cggggctggcaagcag

SEQ ID NO: 404939 - DNA, 19 bp, Homo sapiens
cggggctggcaagcaggga

SEQ ID NO: 404940 - DNA, 12 bp, Homo sapiens
cggggctggccc

SEQ ID NO: 404941 - DNA, 17 bp, Homo sapiens
cggggctggccctgccc

SEQ ID NO: 404942 - DNA, 20 bp, Homo sapiens
cggggctggccctgccctcc

SEQ ID NO: 404943 - DNA, 14 bp, Homo sapiens
cgggggagcctgga

SEQ ID NO: 404944 - DNA, 15 bp, Homo sapiens
cgggggagcctggag

SEQ ID NO: 404945 - DNA, 19 bp, Homo sapiens
cgggggagcctggagcccc

SEQ ID NO: 404946 - DNA, 18 bp, Homo sapiens
cgggggaggagcaccccc

SEQ ID NO: 404947 - DNA, 23 bp, Homo sapiens
cgggggaggagcacccccagcct

SEQ ID NO: 404948 - DNA, 20 bp, Homo sapiens
cgggggaggccgaggcaggg

SEQ ID NO: 404949 - DNA, 15 bp, Homo sapiens
cgggggatcctggag

SEQ ID NO: 404950 - DNA, 15 bp, Homo sapiens
cgggggcagagaggg

SEQ ID NO: 404951 - DNA, 15 bp, Homo sapiens
cgggggcctagtggc

SEQ ID NO: 404952 - DNA, 19 bp, Homo sapiens
cgggggctaactggcccca

SEQ ID NO: 404953 - DNA, 15 bp, Homo sapiens
cggggtcgggggagg

SEQ ID NO: 404954 - DNA, 18 bp, Homo sapiens
cggggtcgggggaggagc

SEQ ID NO: 404955 - DNA, 17 bp, Homo sapiens
cggggtctgtgctgtgc

SEQ ID NO: 404956 - DNA, 19 bp, Homo sapiens
cggggtctgtgctgtgcct

SEQ ID NO: 404957 - DNA, 22 bp, Homo sapiens
cggggtctgtgctgtgcctgct

SEQ ID NO: 404958 - DNA, 22 bp, Homo sapiens
cggggtggtggacagggccccc

SEQ ID NO: 404959 - DNA, 17 bp, Homo sapiens
cgggtaaaaagagaagg

SEQ ID NO: 404960 - DNA, 11 bp, Homo sapiens
cgggtgcctgt

SEQ ID NO: 404961 - DNA, 12 bp, Homo sapiens
cgggttctagac

SEQ ID NO: 404962 - DNA, 13 bp, Homo sapiens
cgggttctagacg

SEQ ID NO: 404963 - DNA, 19 bp, Homo sapiens
cgggttctagacgcccctc

SEQ ID NO: 404964 - DNA, 21 bp, Homo sapiens
cgggttctagacgcccctccc

SEQ ID NO: 404965 - DNA, 15 bp, Homo sapiens
cgggttctcctgatt

SEQ ID NO: 404966 - DNA, 16 bp, Homo sapiens
cgggttggaggcctca

SEQ ID NO: 404967 - DNA, 22 bp, Homo sapiens
cgggttggaggcctcaccctgc

SEQ ID NO: 404968 - DNA, 20 bp, Homo sapiens
cggtacttggtaagagggag

SEQ ID NO: 404969 - DNA, 21 bp, Homo sapiens
cggtcaataattgtggagagg

SEQ ID NO: 404970 - DNA, 15 bp, Homo sapiens
cactctgctttgcat

SEQ ID NO: 404971 - DNA, 14 bp, Homo sapiens
cactcttaaagcaa

SEQ ID NO: 404972 - DNA, 15 bp, Homo sapiens
cactcttatgaaatg

SEQ ID NO: 404973 - DNA, 16 bp, Homo sapiens
cactcttatgaaatgg

SEQ ID NO: 404974 - DNA, 13 bp, Homo sapiens
cactcttgactca

SEQ ID NO: 404975 - DNA, 11 bp, Homo sapiens
cactcttggct

SEQ ID NO: 404976 - DNA, 12 bp, Homo sapiens
cactgaaaacat

SEQ ID NO: 404977 - DNA, 22 bp, Homo sapiens
cactgaaaacatttcaaagctg

SEQ ID NO: 404978 - DNA, 21 bp, Homo sapiens
cactgaaggctttcagggcct

SEQ ID NO: 404979 - DNA, 16 bp, Homo sapiens
cactgaagtgaataca

SEQ ID NO: 404980 - DNA, 23 bp, Homo sapiens
cactgaagttgtctgaaggtaat

SEQ ID NO: 404981 - DNA, 14 bp, Homo sapiens
cactgaatatttat

SEQ ID NO: 404982 - DNA, 23 bp, Homo sapiens
cactgaatctcccctcctcacag

SEQ ID NO: 404983 - DNA, 17 bp, Homo sapiens
cactgaattccattttt

SEQ ID NO: 404984 - DNA, 16 bp, Homo sapiens
cactgacagcctccca

SEQ ID NO: 404985 - DNA, 21 bp, Homo sapiens
cactgacctgctccgccagga

SEQ ID NO: 404986 - DNA, 22 bp, Homo sapiens
cactgacctgctccgccaggaa

SEQ ID NO: 404987 - DNA, 17 bp, Homo sapiens
cactgagaagattgtga

SEQ ID NO: 404988 - DNA, 19 bp, Homo sapiens
cactgagaagattgtgaat

SEQ ID NO: 404989 - DNA, 14 bp, Homo sapiens
cactgagccccacc

SEQ ID NO: 404990 - DNA, 19 bp, Homo sapiens
cactgagcccttgcacagg

SEQ ID NO: 404991 - DNA, 10 bp, Homo sapiens
cactgagggc

SEQ ID NO: 404992 - DNA, 13 bp, Homo sapiens
cactgagggtctg

SEQ ID NO: 404993 - DNA, 17 bp, Homo sapiens
cactgagggtctggtgc

SEQ ID NO: 404994 - DNA, 16 bp, Homo sapiens
cactgagtctcattcc

SEQ ID NO: 404995 - DNA, 20 bp, Homo sapiens
cactgagtctcattcctctg

SEQ ID NO: 404996 - DNA, 21 bp, Homo sapiens
cactgagtctcattcctctgt

SEQ ID NO: 404997 - DNA, 19 bp, Homo sapiens
cactgatatcacgggcccg

SEQ ID NO: 404998 - DNA, 19 bp, Homo sapiens
cactgatgggtcctgctgc

SEQ ID NO: 404999 - DNA, 20 bp, Homo sapiens
cactgatgggtcctgctgct

SEQ ID NO: 405000 - DNA, 13 bp, Homo sapiens
cactgatttcaca

SEQ ID NO: 405001 - DNA, 14 bp, Homo sapiens
cactgcaaatactt

SEQ ID NO: 405002 - DNA, 18 bp, Homo sapiens
cactgcacagtgcatctc

SEQ ID NO: 405003 - DNA, 15 bp, Homo sapiens
cactgcactccagcc

SEQ ID NO: 405004 - DNA, 17 bp, Homo sapiens
cactgcagatttctcac

SEQ ID NO: 405005 - DNA, 20 bp, Homo sapiens
cactgcagatttctcacctg

SEQ ID NO: 405006 - DNA, 22 bp, Homo sapiens
cactgcagcctcgaactcctgg

SEQ ID NO: 405007 - DNA, 13 bp, Homo sapiens
cactgcagcctct

SEQ ID NO: 405008 - DNA, 23 bp, Homo sapiens
cactgcagcctctgcctcccagg

SEQ ID NO: 405009 - DNA, 13 bp, Homo sapiens
cactgcagtgatg

SEQ ID NO: 405010 - DNA, 14 bp, Homo sapiens
cactgccagagcta

SEQ ID NO: 405011 - DNA, 19 bp, Homo sapiens
cactgccaggcacctggcc

SEQ ID NO: 405012 - DNA, 11 bp, Homo sapiens
cactgccatga

SEQ ID NO: 405013 - DNA, 21 bp, Homo sapiens
cactgccatgatagctggggc

SEQ ID NO: 405014 - DNA, 13 bp, Homo sapiens
cgtacagttcttc

SEQ ID NO: 405015 - DNA, 15 bp, Homo sapiens
cgtacataataagtt

SEQ ID NO: 405016 - DNA, 14 bp, Homo sapiens
cgtactcctcagac

SEQ ID NO: 405017 - DNA, 23 bp, Homo sapiens
cgtacttaactgtgtgaagaaat

SEQ ID NO: 405018 - DNA, 12 bp, Homo sapiens
cgtagcttttta

SEQ ID NO: 405019 - DNA, 15 bp, Homo sapiens
cgtagggccagggct

SEQ ID NO: 405020 - DNA, 22 bp, Homo sapiens
cgtataaggaaatccagcccca

SEQ ID NO: 405021 - DNA, 22 bp, Homo sapiens
cgtatatgtctcaggtccctgc

SEQ ID NO: 405022 - DNA, 18 bp, Homo sapiens
cgtatatttcattgaata

SEQ ID NO: 405023 - DNA, 17 bp, Homo sapiens
cgtatgtatttcattgc

SEQ ID NO: 405024 - DNA, 17 bp, Homo sapiens
cgtattgcaaataagac

SEQ ID NO: 405025 - DNA, 20 bp, Homo sapiens
cgtattgtgaaatttgttaa

SEQ ID NO: 405026 - DNA, 18 bp, Homo sapiens
cgtcaccatctcaggcca

SEQ ID NO: 405027 - DNA, 16 bp, Homo sapiens
cgtcacccttatttat

SEQ ID NO: 405028 - DNA, 21 bp, Homo sapiens
cgtcacccttggtagagttta

SEQ ID NO: 405029 - DNA, 17 bp, Homo sapiens
cgtcactccattctcag

SEQ ID NO: 405030 - DNA, 19 bp, Homo sapiens
cgtcagcgggcgctgctgg

SEQ ID NO: 405031 - DNA, 20 bp, Homo sapiens
cgtcaggaggtgcctgagag

SEQ ID NO: 405032 - DNA, 13 bp, Homo sapiens
cgtcatcttccct

SEQ ID NO: 405033 - DNA, 17 bp, Homo sapiens
cgtcatcttccctttcc

SEQ ID NO: 405034 - DNA, 20 bp, Homo sapiens
cgtcatggcttaatgtttat

SEQ ID NO: 405035 - DNA, 15 bp, Homo sapiens
cgtccacaggggcag

SEQ ID NO: 405036 - DNA, 13 bp, Homo sapiens
cgtccacccaggc

SEQ ID NO: 405037 - DNA, 16 bp, Homo sapiens
cgtccacccaggctgc

SEQ ID NO: 405038 - DNA, 18 bp, Homo sapiens
cgtccactacgctcctgt

SEQ ID NO: 405039 - DNA, 20 bp, Homo sapiens
cgtccactttcccttcccct

SEQ ID NO: 405040 - DNA, 21 bp, Homo sapiens
cgtccagccgccattgccacc

SEQ ID NO: 405041 - DNA, 12 bp, Homo sapiens
cgtccatctctc

SEQ ID NO: 405042 - DNA, 17 bp, Homo sapiens
cgtccccctccagtgct

SEQ ID NO: 405043 - DNA, 13 bp, Homo sapiens
cgtcccctccgcc

SEQ ID NO: 405044 - DNA, 14 bp, Homo sapiens
cgtcccctccgccg

SEQ ID NO: 405045 - DNA, 14 bp, Homo sapiens
cgtcccctgcctca

SEQ ID NO: 405046 - DNA, 16 bp, Homo sapiens
cgtcccctgggccacc

SEQ ID NO: 405047 - DNA, 21 bp, Homo sapiens
cgtcccctgggccacccttca

SEQ ID NO: 405048 - DNA, 17 bp, Homo sapiens
cgtcccgcgttcaagac

SEQ ID NO: 405049 - DNA, 16 bp, Homo sapiens
cgtccctttccctgca

SEQ ID NO: 405050 - DNA, 16 bp, Homo sapiens
cgtccggcctgcagcc

SEQ ID NO: 405051 - DNA, 17 bp, Homo sapiens
cgtccggcctgcagccc

SEQ ID NO: 405052 - DNA, 17 bp, Homo sapiens
cgtcctgacgccctgcg

SEQ ID NO: 405053 - DNA, 20 bp, Homo sapiens
cgtcctgacgccctgcgttg

SEQ ID NO: 405054 - DNA, 23 bp, Homo sapiens
cgtcctgacggcgcccccagtgt

SEQ ID NO: 405055 - DNA, 14 bp, Homo sapiens
cgtcctgaggaata

SEQ ID NO: 405056 - DNA, 15 bp, Homo sapiens
cgtcctgcagtgtga

SEQ ID NO: 405057 - DNA, 18 bp, Homo sapiens
cgtcctggaatgaagcat

SEQ ID NO: 405058 - DNA, 14 bp, Homo sapiens
cgtcctggactctg

SEQ ID NO: 405059 - DNA, 15 bp, Homo sapiens
cgtcctggcagggca

SEQ ID NO: 405060 - DNA, 23 bp, Homo sapiens
cgtcctggggtggttggaggcct

SEQ ID NO: 405061 - DNA, 14 bp, Homo sapiens
cgtcggaatggtaa

SEQ ID NO: 405062 - DNA, 19 bp, Homo sapiens
cgtcggactgcccccagaa

SEQ ID NO: 405063 - DNA, 23 bp, Homo sapiens
cgtctcaaaaaaaaaaaaatgca

SEQ ID NO: 405064 - DNA, 21 bp, Homo sapiens
cgtctcccttggccacggcct

SEQ ID NO: 405065 - DNA, 13 bp, Homo sapiens
cgtctctgtcccg

SEQ ID NO: 405066 - DNA, 15 bp, Homo sapiens
cgtctgaccctctcc

SEQ ID NO: 405067 - DNA, 16 bp, Homo sapiens
cgtctgactccagagt

SEQ ID NO: 405068 - DNA, 18 bp, Homo sapiens
cgtctgactccagagtct

SEQ ID NO: 405069 - DNA, 13 bp, Homo sapiens
cgtctgagcggcc

SEQ ID NO: 405070 - DNA, 13 bp, Homo sapiens
cgtctgccaggcc

SEQ ID NO: 405071 - DNA, 14 bp, Homo sapiens
cgtctgccaggccc

SEQ ID NO: 405072 - DNA, 11 bp, Homo sapiens
cgtctgcccct

SEQ ID NO: 405073 - DNA, 22 bp, Homo sapiens
cgtctgccccttgaccccacac

SEQ ID NO: 405074 - DNA, 19 bp, Homo sapiens
cgtctgcgattttatctgt

SEQ ID NO: 405075 - DNA, 23 bp, Homo sapiens
cgtctgcgattttatctgttaac

SEQ ID NO: 405076 - DNA, 17 bp, Homo sapiens
cgtcttcaagaacttct

SEQ ID NO: 405077 - DNA, 19 bp, Homo sapiens
cgtcttcaatctctgttct

SEQ ID NO: 405078 - DNA, 12 bp, Homo sapiens
cgtcttgtattt

SEQ ID NO: 405079 - DNA, 20 bp, Homo sapiens
cgtctttggttcctcatggc

SEQ ID NO: 405080 - DNA, 18 bp, Homo sapiens
cgtgaaagaattattttt

SEQ ID NO: 405081 - DNA, 13 bp, Homo sapiens
cgtgaagcagtgc

SEQ ID NO: 405082 - DNA, 16 bp, Homo sapiens
cgtgaagcagtgcctc

SEQ ID NO: 405083 - DNA, 21 bp, Homo sapiens
cgtgaataagttgattctgtc

SEQ ID NO: 405084 - DNA, 22 bp, Homo sapiens
cgtgaccaattgccctgccagg

SEQ ID NO: 405085 - DNA, 12 bp, Homo sapiens
cgtgacccagtg

SEQ ID NO: 405086 - DNA, 16 bp, Homo sapiens
cgtgacccttcagggc

SEQ ID NO: 405087 - DNA, 17 bp, Homo sapiens
cgtgacccttcagggcc

SEQ ID NO: 405088 - DNA, 18 bp, Homo sapiens
cgtgacccttcagggcca

SEQ ID NO: 405089 - DNA, 20 bp, Homo sapiens
cgtgacccttcagggccaga

SEQ ID NO: 405090 - DNA, 18 bp, Homo sapiens
cgtgacggacatccaggc

SEQ ID NO: 405091 - DNA, 19 bp, Homo sapiens
cgtgacttcagactctctc

SEQ ID NO: 405092 - DNA, 12 bp, Homo sapiens
cgtgagacacaa

SEQ ID NO: 405093 - DNA, 14 bp, Homo sapiens
cgtgagacacaaga

SEQ ID NO: 405094 - DNA, 14 bp, Homo sapiens
cgtgagagcccaat

SEQ ID NO: 405095 - DNA, 19 bp, Homo sapiens
cgtgagagcccaatcactg

SEQ ID NO: 405096 - DNA, 23 bp, Homo sapiens
cgtgagcgccccgcccccacccc

SEQ ID NO: 405097 - DNA, 16 bp, Homo sapiens
cgtgagtcctggcatg

SEQ ID NO: 405098 - DNA, 18 bp, Homo sapiens
cgtgagtcctggcatggg

SEQ ID NO: 405099 - DNA, 19 bp, Homo sapiens
cgtgagtgaaccatcatta

SEQ ID NO: 405100 - DNA, 15 bp, Homo sapiens
cgtgagtgcagaccc

SEQ ID NO: 405101 - DNA, 13 bp, Homo sapiens
cgtgatagaagaa

SEQ ID NO: 405102 - DNA, 22 bp, Homo sapiens
cgtgatagaagaaaagcactgg

SEQ ID NO: 405103 - DNA, 20 bp, Homo sapiens
cgtgatccatccatctccag

SEQ ID NO: 405104 - DNA, 13 bp, Homo sapiens
cgtgattctgttc

SEQ ID NO: 405105 - DNA, 16 bp, Homo sapiens
cgtgattgacccttta

SEQ ID NO: 405106 - DNA, 20 bp, Homo sapiens
cgtgatttggaagagaggca

SEQ ID NO: 405107 - DNA, 21 bp, Homo sapiens
cgtgatttggaagagaggcac

SEQ ID NO: 405108 - DNA, 19 bp, Homo sapiens
cgtgcacggggccagcatc

SEQ ID NO: 405109 - DNA, 16 bp, Homo sapiens
cacttaaactttgtca

SEQ ID NO: 405110 - DNA, 13 bp, Homo sapiens
cacttaacctgct

SEQ ID NO: 405111 - DNA, 21 bp, Homo sapiens
cacttaagactgtgtattcta

SEQ ID NO: 405112 - DNA, 11 bp, Homo sapiens
cacttaatctt

SEQ ID NO: 405113 - DNA, 17 bp, Homo sapiens
cacttaatcttctctct

SEQ ID NO: 405114 - DNA, 19 bp, Homo sapiens
cacttagaaattgcatttc

SEQ ID NO: 405115 - DNA, 24 bp, Homo sapiens
cacttagaaattgcatttcctgac

SEQ ID NO: 405116 - DNA, 15 bp, Homo sapiens
cacttagctatcaga

SEQ ID NO: 405117 - DNA, 13 bp, Homo sapiens
cacttatgctgct

SEQ ID NO: 405118 - DNA, 14 bp, Homo sapiens
cacttatgctgctg

SEQ ID NO: 405119 - DNA, 15 bp, Homo sapiens
cacttatgctgctgt

SEQ ID NO: 405120 - DNA, 17 bp, Homo sapiens
cacttatgctgctgtga

SEQ ID NO: 405121 - DNA, 20 bp, Homo sapiens
cacttatgctgctgtgaatt

SEQ ID NO: 405122 - DNA, 22 bp, Homo sapiens
cacttattatgaggctattaaa

SEQ ID NO: 405123 - DNA, 13 bp, Homo sapiens
cacttattgcttt

SEQ ID NO: 405124 - DNA, 14 bp, Homo sapiens
cacttattgctttg

SEQ ID NO: 405125 - DNA, 14 bp, Homo sapiens
cacttatttcataa

SEQ ID NO: 405126 - DNA, 13 bp, Homo sapiens
cacttatttccat

SEQ ID NO: 405127 - DNA, 15 bp, Homo sapiens
cacttatttctaaat

SEQ ID NO: 405128 - DNA, 20 bp, Homo sapiens
cacttcaaatcagagcagtg

SEQ ID NO: 405129 - DNA, 16 bp, Homo sapiens
cacttcacccccaact

SEQ ID NO: 405130 - DNA, 14 bp, Homo sapiens
cacttcaggctctt

SEQ ID NO: 405131 - DNA, 16 bp, Homo sapiens
cacttcaggctcttct

SEQ ID NO: 405132 - DNA, 22 bp, Homo sapiens
cacttcagggttctcctctccc

SEQ ID NO: 405133 - DNA, 18 bp, Homo sapiens
cacttccatacagctcta

SEQ ID NO: 405134 - DNA, 16 bp, Homo sapiens
cacttcccatttgtgt

SEQ ID NO: 405135 - DNA, 23 bp, Homo sapiens
cacttcctacaagagcagcctgt

SEQ ID NO: 405136 - DNA, 14 bp, Homo sapiens
cacttcctcgctct

SEQ ID NO: 405137 - DNA, 21 bp, Homo sapiens
cacttcgcgtgccctcgctgc

SEQ ID NO: 405138 - DNA, 19 bp, Homo sapiens
cacttctatttatttatta

SEQ ID NO: 405139 - DNA, 12 bp, Homo sapiens
cacttctccccg

SEQ ID NO: 405140 - DNA, 12 bp, Homo sapiens
cacttctgctgt

SEQ ID NO: 405141 - DNA, 13 bp, Homo sapiens
cacttctggtccc

SEQ ID NO: 405142 - DNA, 19 bp, Homo sapiens
cacttctggtcccctgtgg

SEQ ID NO: 405143 - DNA, 22 bp, Homo sapiens
cacttctggtcccctgtggtga

SEQ ID NO: 405144 - DNA, 21 bp, Homo sapiens
cacttcttaaaggcctggaac

SEQ ID NO: 405145 - DNA, 17 bp, Homo sapiens
cgtggatctgggcacaa

SEQ ID NO: 405146 - DNA, 17 bp, Homo sapiens
cgtggattgcacgtggc

SEQ ID NO: 405147 - DNA, 19 bp, Homo sapiens
cgtggccaacgtggacctg

SEQ ID NO: 405148 - DNA, 18 bp, Homo sapiens
cgtggccccgccctcagg

SEQ ID NO: 405149 - DNA, 19 bp, Homo sapiens
cgtggccccgtgaactcac

SEQ ID NO: 405150 - DNA, 15 bp, Homo sapiens
cgtggcctcttgagc

SEQ ID NO: 405151 - DNA, 16 bp, Homo sapiens
cgtggcctcttgagca

SEQ ID NO: 405152 - DNA, 15 bp, Homo sapiens
cgtggcctggggctg

SEQ ID NO: 405153 - DNA, 21 bp, Homo sapiens
cgtggccttccccttttgcct

SEQ ID NO: 405154 - DNA, 19 bp, Homo sapiens
cgtggctgcggcacccttg

SEQ ID NO: 405155 - DNA, 12 bp, Homo sapiens
cgtggctgtggc

SEQ ID NO: 405156 - DNA, 17 bp, Homo sapiens
cgtggctgtggcacaga

SEQ ID NO: 405157 - DNA, 18 bp, Homo sapiens
cgtggcttcccgctcagc

SEQ ID NO: 405158 - DNA, 17 bp, Homo sapiens
cgtgggacgtggtcagg

SEQ ID NO: 405159 - DNA, 15 bp, Homo sapiens
cgtgggagaggcaga

SEQ ID NO: 405160 - DNA, 15 bp, Homo sapiens
cgtgggatccagaga

SEQ ID NO: 405161 - DNA, 17 bp, Homo sapiens
cgtgggcggcagagagg

SEQ ID NO: 405162 - DNA, 11 bp, Homo sapiens
cgtgggctctg

SEQ ID NO: 405163 - DNA, 18 bp, Homo sapiens
cgtgggctctggctccct

SEQ ID NO: 405164 - DNA, 20 bp, Homo sapiens
cgtggggcagcacagagagg

SEQ ID NO: 405165 - DNA, 19 bp, Homo sapiens
cgtggggctaacgggcgcc

SEQ ID NO: 405166 - DNA, 15 bp, Homo sapiens
cgtgggtacccaggc

SEQ ID NO: 405167 - DNA, 19 bp, Homo sapiens
cgtgggtacccaggctggt

SEQ ID NO: 405168 - DNA, 15 bp, Homo sapiens
cgtggtagaagccag

SEQ ID NO: 405169 - DNA, 18 bp, Homo sapiens
cgtggtggagaatctgag

SEQ ID NO: 405170 - DNA, 15 bp, Homo sapiens
cgtggtgtgaggccc

SEQ ID NO: 405171 - DNA, 14 bp, Homo sapiens
cgtgtaacttgtgc

SEQ ID NO: 405172 - DNA, 16 bp, Homo sapiens
cgtgtaatattctctg

SEQ ID NO: 405173 - DNA, 14 bp, Homo sapiens
cgtgtagcgtcctg

SEQ ID NO: 405174 - DNA, 15 bp, Homo sapiens
cgtgtatagtgccta

SEQ ID NO: 405175 - DNA, 23 bp, Homo sapiens
cgtgtatagtgcctaaaattgta

SEQ ID NO: 405176 - DNA, 15 bp, Homo sapiens
cgtgtatcctggggc

SEQ ID NO: 405177 - DNA, 16 bp, Homo sapiens
cgtgtattttcattac

SEQ ID NO: 405178 - DNA, 22 bp, Homo sapiens
cgtgtccaggagaccttccaca

SEQ ID NO: 405179 - DNA, 13 bp, Homo sapiens
cgtgtctctccca

SEQ ID NO: 405180 - DNA, 18 bp, Homo sapiens
cgtgtgaagccacggaag

SEQ ID NO: 405181 - DNA, 18 bp, Homo sapiens
cgtgtggccctgtgggag

SEQ ID NO: 405182 - DNA, 23 bp, Homo sapiens
cgtgtggccctgtgggagtccac

SEQ ID NO: 405183 - DNA, 16 bp, Homo sapiens
cgtgtgtccctgtggt

SEQ ID NO: 405184 - DNA, 19 bp, Homo sapiens
cgtgttatgactccagaat

SEQ ID NO: 405185 - DNA, 11 bp, Homo sapiens
cgttaacattg

SEQ ID NO: 405186 - DNA, 20 bp, Homo sapiens
cgttaacctttttgtaaata

SEQ ID NO: 405187 - DNA, 11 bp, Homo sapiens
cgttaatttaa

SEQ ID NO: 405188 - DNA, 14 bp, Homo sapiens
cgttacagctcccc

SEQ ID NO: 405189 - DNA, 21 bp, Homo sapiens
cgttactagcagtcacttgat

SEQ ID NO: 405190 - DNA, 14 bp, Homo sapiens
cgttagtgggcagg

SEQ ID NO: 405191 - DNA, 15 bp, Homo sapiens
cgttattgttgactt

SEQ ID NO: 405192 - DNA, 15 bp, Homo sapiens
cgttcacccctccac

SEQ ID NO: 405193 - DNA, 20 bp, Homo sapiens
cgttcacccctccacccttg

SEQ ID NO: 405194 - DNA, 14 bp, Homo sapiens
cgttcatctgagga

SEQ ID NO: 405195 - DNA, 19 bp, Homo sapiens
cgttcccactgccctgggc

SEQ ID NO: 405196 - DNA, 17 bp, Homo sapiens
cgttcctgccaggctct

SEQ ID NO: 405197 - DNA, 19 bp, Homo sapiens
cgttcctgggactgtcaga

SEQ ID NO: 405198 - DNA, 12 bp, Homo sapiens
cgttctctgcct

SEQ ID NO: 405199 - DNA, 18 bp, Homo sapiens
cgttctcttctctcttca

SEQ ID NO: 405200 - DNA, 15 bp, Homo sapiens
cgttctgccacttgc

SEQ ID NO: 405201 - DNA, 18 bp, Homo sapiens
cgttctgctggcctggat

SEQ ID NO: 405202 - DNA, 17 bp, Homo sapiens
cgttctggactctgccc

SEQ ID NO: 405203 - DNA, 13 bp, Homo sapiens
cgttcttgttctg

SEQ ID NO: 405204 - DNA, 13 bp, Homo sapiens
cgttgacgtgacc

SEQ ID NO: 405205 - DNA, 16 bp, Homo sapiens
cgttgacgtgaccaat

SEQ ID NO: 405206 - DNA, 16 bp, Homo sapiens
cgttgaggccgcatct

SEQ ID NO: 405207 - DNA, 16 bp, Homo sapiens
cgttgccgggcctgga

SEQ ID NO: 405208 - DNA, 15 bp, Homo sapiens
cgttgctttttcact

SEQ ID NO: 405209 - DNA, 17 bp, Homo sapiens
cgttggaattaaaacaa

SEQ ID NO: 405210 - DNA, 13 bp, Homo sapiens
cgttggagccact

SEQ ID NO: 405211 - DNA, 15 bp, Homo sapiens
cgttggttctgcact

SEQ ID NO: 405212 - DNA, 17 bp, Homo sapiens
cgttggttgtttctctg

SEQ ID NO: 405213 - DNA, 13 bp, Homo sapiens
cgttgtgggcagg

SEQ ID NO: 405214 - DNA, 21 bp, Homo sapiens
cgtttagtttctagaggcctc

SEQ ID NO: 405215 - DNA, 18 bp, Homo sapiens
cgtttcagtaataaaaca

SEQ ID NO: 405216 - DNA, 21 bp, Homo sapiens
cgtttgatagtgcttcttgta

SEQ ID NO: 405217 - DNA, 22 bp, Homo sapiens
cgtttgatttcttcctgcagag

SEQ ID NO: 405218 - DNA, 14 bp, Homo sapiens
cgtttgctgtgcca

SEQ ID NO: 405219 - DNA, 15 bp, Homo sapiens
cgtttgctgtgccag

SEQ ID NO: 405220 - DNA, 19 bp, Homo sapiens
cgtttgctgtgccaggagg

SEQ ID NO: 405221 - DNA, 13 bp, Homo sapiens
cgtttgtttgttt

SEQ ID NO: 405222 - DNA, 16 bp, Homo sapiens
cgtttgtttgttttgt

SEQ ID NO: 405223 - DNA, 16 bp, Homo sapiens
ctaaaaaataactgtg

SEQ ID NO: 405224 - DNA, 18 bp, Homo sapiens
ctaaaaaataactgtgca

SEQ ID NO: 405225 - DNA, 15 bp, Homo sapiens
ctaaaaacattttaa

SEQ ID NO: 405226 - DNA, 23 bp, Homo sapiens
ctaaaaagaactcaaaaggagaa

SEQ ID NO: 405227 - DNA, 15 bp, Homo sapiens
ctaaaaagtggctaa

SEQ ID NO: 405228 - DNA, 14 bp, Homo sapiens
ctaaaaataaaatg

SEQ ID NO: 405229 - DNA, 16 bp, Homo sapiens
ctaaaaataaaatgat

SEQ ID NO: 405230 - DNA, 18 bp, Homo sapiens
ctaaaaataaaatgatgt

SEQ ID NO: 405231 - DNA, 18 bp, Homo sapiens
ctaaaaatagtggccaga

SEQ ID NO: 405232 - DNA, 22 bp, Homo sapiens
ctaaaactatggttcccaataa

SEQ ID NO: 405233 - DNA, 14 bp, Homo sapiens
ctaaaagacatttg

SEQ ID NO: 405234 - DNA, 17 bp, Homo sapiens
ctaaaagacatttgtta

SEQ ID NO: 405235 - DNA, 14 bp, Homo sapiens
ctaaaagagaaggg

SEQ ID NO: 405236 - DNA, 16 bp, Homo sapiens
ctaaaagattctttaa

SEQ ID NO: 405237 - DNA, 15 bp, Homo sapiens
ctaaaagccacccca

SEQ ID NO: 405238 - DNA, 22 bp, Homo sapiens
ctaaaagtgatgtgatttatgc

SEQ ID NO: 405239 - DNA, 20 bp, Homo sapiens
ctaaaagttaagtgtcattt

SEQ ID NO: 405240 - DNA, 23 bp, Homo sapiens
ctaaaagttaagtgtcatttctt

SEQ ID NO: 405241 - DNA, 17 bp, Homo sapiens
ctaaaatactcaccaaa

SEQ ID NO: 405242 - DNA, 23 bp, Homo sapiens
ctaaaatgattttatctgtgaat

SEQ ID NO: 405243 - DNA, 17 bp, Homo sapiens
ctaaaattaagaagtac

SEQ ID NO: 405244 - DNA, 17 bp, Homo sapiens
ctaaaattcaacaaatg

SEQ ID NO: 405245 - DNA, 18 bp, Homo sapiens
ctaaaattcaacaaatga

SEQ ID NO: 405246 - DNA, 19 bp, Homo sapiens
ctaaaattcaacaaatgat

SEQ ID NO: 405247 - DNA, 22 bp, Homo sapiens
ctaaaattctagtctctgattt

SEQ ID NO: 405248 - DNA, 22 bp, Homo sapiens
cacggccacccacccttctccc

SEQ ID NO: 405249 - DNA, 15 bp, Homo sapiens
cacggccactgcagt

SEQ ID NO: 405250 - DNA, 19 bp, Homo sapiens
cacggccactgcagtcacc

SEQ ID NO: 405251 - DNA, 13 bp, Homo sapiens
cacggccgtccct

SEQ ID NO: 405252 - DNA, 16 bp, Homo sapiens
cacggccgtccctgac

SEQ ID NO: 405253 - DNA, 16 bp, Homo sapiens
cacggcctctggggag

SEQ ID NO: 405254 - DNA, 19 bp, Homo sapiens
cacggcctctggggagacc

SEQ ID NO: 405255 - DNA, 17 bp, Homo sapiens
cacggcctgggagggtg

SEQ ID NO: 405256 - DNA, 16 bp, Homo sapiens
cacggctaagaggctg

SEQ ID NO: 405257 - DNA, 20 bp, Homo sapiens
cacggctccgagggcggcca

SEQ ID NO: 405258 - DNA, 21 bp, Homo sapiens
cacggctccgagggcggccag

SEQ ID NO: 405259 - DNA, 20 bp, Homo sapiens
cacggctgcctgacactgag

SEQ ID NO: 405260 - DNA, 22 bp, Homo sapiens
cacgggagagcgccacccgccc

SEQ ID NO: 405261 - DNA, 12 bp, Homo sapiens
cacgggcagcct

SEQ ID NO: 405262 - DNA, 14 bp, Homo sapiens
cacgggcagcctgg

SEQ ID NO: 405263 - DNA, 14 bp, Homo sapiens
cacgggcccgctca

SEQ ID NO: 405264 - DNA, 13 bp, Homo sapiens
cacggggcaccca

SEQ ID NO: 405265 - DNA, 19 bp, Homo sapiens
cacggggtcgggggaggag

SEQ ID NO: 405266 - DNA, 21 bp, Homo sapiens
cacggggttggctgttccaga

SEQ ID NO: 405267 - DNA, 19 bp, Homo sapiens
cacggtcctttgagtgtca

SEQ ID NO: 405268 - DNA, 14 bp, Homo sapiens
cacggtgcgtggct

SEQ ID NO: 405269 - DNA, 16 bp, Homo sapiens
cacggtttctgttctg

SEQ ID NO: 405270 - DNA, 15 bp, Homo sapiens
cacgtacaaaatcca

SEQ ID NO: 405271 - DNA, 20 bp, Homo sapiens
cacgtagtagggtcaggcca

SEQ ID NO: 405272 - DNA, 18 bp, Homo sapiens
cacgtatagtcctagctg

SEQ ID NO: 405273 - DNA, 14 bp, Homo sapiens
cacgtcactgccag

SEQ ID NO: 405274 - DNA, 15 bp, Homo sapiens
cacgtccccctgggg

SEQ ID NO: 405275 - DNA, 20 bp, Homo sapiens
cacgtccccctggggcttct

SEQ ID NO: 405276 - DNA, 16 bp, Homo sapiens
cacgtcctcgaattct

SEQ ID NO: 405277 - DNA, 16 bp, Homo sapiens
cacgtctgaccctctc

SEQ ID NO: 405278 - DNA, 17 bp, Homo sapiens
cacgtctgaccctctcc

SEQ ID NO: 405279 - DNA, 12 bp, Homo sapiens
cacgtctgccag

SEQ ID NO: 405280 - DNA, 16 bp, Homo sapiens
cacgtctgccaggccc

SEQ ID NO: 405281 - DNA, 18 bp, Homo sapiens
cacgtctggccaggcact

SEQ ID NO: 405282 - DNA, 14 bp, Homo sapiens
cacgtctgtcttca

SEQ ID NO: 405283 - DNA, 20 bp, Homo sapiens
cacgtgagagaatctgcctg

SEQ ID NO: 405284 - DNA, 14 bp, Homo sapiens
cacgtgctggagag

SEQ ID NO: 405285 - DNA, 15 bp, Homo sapiens
cacgtgctggagagt

SEQ ID NO: 405286 - DNA, 17 bp, Homo sapiens
cacgtggagatagtgcc

SEQ ID NO: 405287 - DNA, 18 bp, Homo sapiens
cacgtggcctcttgagca

SEQ ID NO: 405288 - DNA, 20 bp, Homo sapiens
cacgtggctagggttccact

SEQ ID NO: 405289 - DNA, 16 bp, Homo sapiens
cacgtgtgatgtatgt

SEQ ID NO: 405290 - DNA, 11 bp, Homo sapiens
cacgtgtgtga

SEQ ID NO: 405291 - DNA, 16 bp, Homo sapiens
cacgtgtgtgactcag

SEQ ID NO: 405292 - DNA, 21 bp, Homo sapiens
cacgttaaaaattaaaagaag

SEQ ID NO: 405293 - DNA, 16 bp, Homo sapiens
cacgttgcctctactt

SEQ ID NO: 405294 - DNA, 15 bp, Homo sapiens
cactaaaaagtggct

SEQ ID NO: 405295 - DNA, 21 bp, Homo sapiens
cactaaaagtgatgtgattta

SEQ ID NO: 405296 - DNA, 17 bp, Homo sapiens
cactaaacagactattt

SEQ ID NO: 405297 - DNA, 18 bp, Homo sapiens
cactaagctttctccttt

SEQ ID NO: 405298 - DNA, 22 bp, Homo sapiens
cactaagttatagtatatctgg

SEQ ID NO: 405299 - DNA, 21 bp, Homo sapiens
cactaatactggttatcctgt

SEQ ID NO: 405300 - DNA, 15 bp, Homo sapiens
cactacacgcaccca

SEQ ID NO: 405301 - DNA, 18 bp, Homo sapiens
cactacagagcagctccc

SEQ ID NO: 405302 - DNA, 20 bp, Homo sapiens
cactacagagcagctcccca

SEQ ID NO: 405303 - DNA, 22 bp, Homo sapiens
cactacagagcagctccccagg

SEQ ID NO: 405304 - DNA, 16 bp, Homo sapiens
cactacagaggattct

SEQ ID NO: 405305 - DNA, 22 bp, Homo sapiens
cactacaggtgaaggctctcac

SEQ ID NO: 405306 - DNA, 14 bp, Homo sapiens
cactacataaactg

SEQ ID NO: 405307 - DNA, 21 bp, Homo sapiens
cactacatgcagcccatgccc

SEQ ID NO: 405308 - DNA, 20 bp, Homo sapiens
cactaccgggggctctgagc

SEQ ID NO: 405309 - DNA, 19 bp, Homo sapiens
cactaccttctgacctccc

SEQ ID NO: 405310 - DNA, 20 bp, Homo sapiens
cactaccttctgacctcccc

SEQ ID NO: 405311 - DNA, 19 bp, Homo sapiens
cactacgctcctgtctcca

SEQ ID NO: 405312 - DNA, 16 bp, Homo sapiens
aggtcctgctgtggaa

SEQ ID NO: 405313 - DNA, 16 bp, Homo sapiens
aggtcctttccttctc

SEQ ID NO: 405314 - DNA, 17 bp, Homo sapiens
aggtcggaggcttggga

SEQ ID NO: 405315 - DNA, 14 bp, Homo sapiens
aggtcgggctcagc

SEQ ID NO: 405316 - DNA, 13 bp, Homo sapiens
aggtctccacccc

SEQ ID NO: 405317 - DNA, 15 bp, Homo sapiens
aggtctcctcagggt

SEQ ID NO: 405318 - DNA, 19 bp, Homo sapiens
aggtctccttactctgagc

SEQ ID NO: 405319 - DNA, 20 bp, Homo sapiens
aggtctccttactctgagcc

SEQ ID NO: 405320 - DNA, 22 bp, Homo sapiens
aggtctccttactctgagccca

SEQ ID NO: 405321 - DNA, 23 bp, Homo sapiens
aggtctccttactctgagcccag

SEQ ID NO: 405322 - DNA, 24 bp, Homo sapiens
aggtctccttactctgagcccagg

SEQ ID NO: 405323 - DNA, 15 bp, Homo sapiens
aggtctctgccggct

SEQ ID NO: 405324 - DNA, 20 bp, Homo sapiens
aggtctgacacgtctgccta

SEQ ID NO: 405325 - DNA, 15 bp, Homo sapiens
aggtctgcaggccac

SEQ ID NO: 405326 - DNA, 20 bp, Homo sapiens
aggtctgcattttctcaggc

SEQ ID NO: 405327 - DNA, 21 bp, Homo sapiens
aggtctgcattttctcaggca

SEQ ID NO: 405328 - DNA, 16 bp, Homo sapiens
aggtctgggagaggca

SEQ ID NO: 405329 - DNA, 21 bp, Homo sapiens
aggtctgggagtgttctgttt

SEQ ID NO: 405330 - DNA, 16 bp, Homo sapiens
aggtcttgacctgaac

SEQ ID NO: 405331 - DNA, 23 bp, Homo sapiens
aggtcttgacctgaactctgcaa

SEQ ID NO: 405332 - DNA, 18 bp, Homo sapiens
aggtcttgagtttcattt

SEQ ID NO: 405333 - DNA, 21 bp, Homo sapiens
aggtcttgagtttcatttttc

SEQ ID NO: 405334 - DNA, 21 bp, Homo sapiens
aggtctttgaaatatgcatgt

SEQ ID NO: 405335 - DNA, 18 bp, Homo sapiens
aggtcttttgacatgtgg

SEQ ID NO: 405336 - DNA, 21 bp, Homo sapiens
aggtcttttgacatgtggaaa

SEQ ID NO: 405337 - DNA, 13 bp, Homo sapiens
aggtgaaacacac

SEQ ID NO: 405338 - DNA, 22 bp, Homo sapiens
aggtgaaacacacacacattct

SEQ ID NO: 405339 - DNA, 14 bp, Homo sapiens
aggtgaaagggagc

SEQ ID NO: 405340 - DNA, 22 bp, Homo sapiens
aggtgaccccatctctgctgct

SEQ ID NO: 405341 - DNA, 21 bp, Homo sapiens
aggtgacccttctgtctgtaa

SEQ ID NO: 405342 - DNA, 13 bp, Homo sapiens
aggtgaccgccca

SEQ ID NO: 405343 - DNA, 17 bp, Homo sapiens
aggtgaccgcccagctc

SEQ ID NO: 405344 - DNA, 18 bp, Homo sapiens
aggtgagaaaaggggcat

SEQ ID NO: 405345 - DNA, 15 bp, Homo sapiens
aggtgagaccacctc

SEQ ID NO: 405346 - DNA, 19 bp, Homo sapiens
aggtgagatcacagcctcc

SEQ ID NO: 405347 - DNA, 22 bp, Homo sapiens
aggtgagatcacagcctccagg

SEQ ID NO: 405348 - DNA, 16 bp, Homo sapiens
aggtgagggaggcctg

SEQ ID NO: 405349 - DNA, 16 bp, Homo sapiens
aggtgataggcaagga

SEQ ID NO: 405350 - DNA, 18 bp, Homo sapiens
aggtgatatccattcttt

SEQ ID NO: 405351 - DNA, 21 bp, Homo sapiens
aggtgatccacctgcctcggc

SEQ ID NO: 405352 - DNA, 17 bp, Homo sapiens
aggtgatgtttccagct

SEQ ID NO: 405353 - DNA, 19 bp, Homo sapiens
aggtgatgtttccagctgc

SEQ ID NO: 405354 - DNA, 23 bp, Homo sapiens
aggtgatgtttccagctgccaag

SEQ ID NO: 405355 - DNA, 14 bp, Homo sapiens
aggtgcacattttc

SEQ ID NO: 405356 - DNA, 15 bp, Homo sapiens
aggtgccactccctg

SEQ ID NO: 405357 - DNA, 12 bp, Homo sapiens
aggtgcccagga

SEQ ID NO: 405358 - DNA, 18 bp, Homo sapiens
aggtgcccagtcttgagt

SEQ ID NO: 405359 - DNA, 19 bp, Homo sapiens
aggtgccctgtgggagagc

SEQ ID NO: 405360 - DNA, 18 bp, Homo sapiens
aggtgccgtgagcaggct

SEQ ID NO: 405361 - DNA, 16 bp, Homo sapiens
aggtgcctgagagcag

SEQ ID NO: 405362 - DNA, 21 bp, Homo sapiens
aggtgcctgagagcagaatga

SEQ ID NO: 405363 - DNA, 18 bp, Homo sapiens
aggtgctagggtgcctgc

SEQ ID NO: 405364 - DNA, 16 bp, Homo sapiens
aggtgctcaaagatgt

SEQ ID NO: 405365 - DNA, 21 bp, Homo sapiens
aggtgctctcctggcacccag

SEQ ID NO: 405366 - DNA, 12 bp, Homo sapiens
aggtgctgagct

SEQ ID NO: 405367 - DNA, 13 bp, Homo sapiens
aggtgctgagctt

SEQ ID NO: 405368 - DNA, 23 bp, Homo sapiens
aggtgctgagcttagccttgtgc

SEQ ID NO: 405369 - DNA, 13 bp, Homo sapiens
aggtgctgccttg

SEQ ID NO: 405370 - DNA, 14 bp, Homo sapiens
aggtgctgctttgc

SEQ ID NO: 405371 - DNA, 15 bp, Homo sapiens
aggtgctgctttgct

SEQ ID NO: 405372 - DNA, 16 bp, Homo sapiens
aggtgctgctttgctt

SEQ ID NO: 405373 - DNA, 12 bp, Homo sapiens
aggtgctgggag

SEQ ID NO: 405374 - DNA, 15 bp, Homo sapiens
aggtgctgggaggga

SEQ ID NO: 405375 - DNA, 23 bp, Homo sapiens
aggtgctgttgtcattgctttac

SEQ ID NO: 405376 - DNA, 20 bp, Homo sapiens
aggtgcttaagcagaagcat

SEQ ID NO: 405377 - DNA, 23 bp, Homo sapiens
aggtgcttattctcaaagcagga

SEQ ID NO: 405378 - DNA, 15 bp, Homo sapiens
aggtggaacaggagg

SEQ ID NO: 405379 - DNA, 10 bp, Homo sapiens
aggtggaact

SEQ ID NO: 405380 - DNA, 22 bp, Homo sapiens
aggtggccaggcctgccagccc

SEQ ID NO: 405381 - DNA, 14 bp, Homo sapiens
aggtggccagggct

SEQ ID NO: 405382 - DNA, 17 bp, Homo sapiens
aggtggcctaaggctgc

SEQ ID NO: 405383 - DNA, 17 bp, Homo sapiens
aggtgggatcctccctc

SEQ ID NO: 405384 - DNA, 17 bp, Homo sapiens
aggtgggattacaggtg

SEQ ID NO: 405385 - DNA, 14 bp, Homo sapiens
aggtgggcagatca

SEQ ID NO: 405386 - DNA, 22 bp, Homo sapiens
aggtgggccacacccaggaagg

SEQ ID NO: 405387 - DNA, 16 bp, Homo sapiens
aggtgggccagcccct

SEQ ID NO: 405388 - DNA, 18 bp, Homo sapiens
aggtgggccagcccctcc

SEQ ID NO: 405389 - DNA, 21 bp, Homo sapiens
aggtgggccagcccctcccac

SEQ ID NO: 405390 - DNA, 19 bp, Homo sapiens
aggtgggccttgctacctc

SEQ ID NO: 405391 - DNA, 23 bp, Homo sapiens
aggtggggaagagagcctgcccg

SEQ ID NO: 405392 - DNA, 11 bp, Homo sapiens
aggtggggagg

SEQ ID NO: 405393 - DNA, 16 bp, Homo sapiens
aggtgggggagcctgg

SEQ ID NO: 405394 - DNA, 17 bp, Homo sapiens
aggtgggggagcctgga

SEQ ID NO: 405395 - DNA, 19 bp, Homo sapiens
aggtgggggagcctggagc

SEQ ID NO: 405396 - DNA, 20 bp, Homo sapiens
aggtgggggttggctgggta

SEQ ID NO: 405397 - DNA, 16 bp, Homo sapiens
aggtggggtgaagctg

SEQ ID NO: 405398 - DNA, 20 bp, Homo sapiens
aggtggggtgaagctgggga

SEQ ID NO: 405399 - DNA, 19 bp, Homo sapiens
aggtgggtcaactccaagg

SEQ ID NO: 405400 - DNA, 13 bp, Homo sapiens
aggtgggtccagg

SEQ ID NO: 405401 - DNA, 19 bp, Homo sapiens
aggtgggtccaggaaggca

SEQ ID NO: 405402 - DNA, 23 bp, Homo sapiens
aggtgggtccaggaaggcagctg

SEQ ID NO: 405403 - DNA, 19 bp, Homo sapiens
aggtgggtgagcgggtggg

SEQ ID NO: 405404 - DNA, 16 bp, Homo sapiens
aggtggtagctctgag

SEQ ID NO: 405405 - DNA, 18 bp, Homo sapiens
aggtggtctgaatgttct

SEQ ID NO: 405406 - DNA, 19 bp, Homo sapiens
aggtggtctgaatgttctg

SEQ ID NO: 405407 - DNA, 21 bp, Homo sapiens
aggtggtctgaatgttctgac

SEQ ID NO: 405408 - DNA, 23 bp, Homo sapiens
aggtggtctgaatgttctgacat

SEQ ID NO: 405409 - DNA, 16 bp, Homo sapiens
cagacccctctggcca

SEQ ID NO: 405410 - DNA, 21 bp, Homo sapiens
cagacccctctggccaggatg

SEQ ID NO: 405411 - DNA, 13 bp, Homo sapiens
cagacccctggct

SEQ ID NO: 405412 - DNA, 16 bp, Homo sapiens
cagacccctggctttt

SEQ ID NO: 405413 - DNA, 18 bp, Homo sapiens
cagacccctggcttttca

SEQ ID NO: 405414 - DNA, 21 bp, Homo sapiens
cagacccctggcttttcactg

SEQ ID NO: 405415 - DNA, 16 bp, Homo sapiens
cagaccccttggccag

SEQ ID NO: 405416 - DNA, 13 bp, Homo sapiens
cagaccctgcctg

SEQ ID NO: 405417 - DNA, 15 bp, Homo sapiens
cagaccctgcctgag

SEQ ID NO: 405418 - DNA, 19 bp, Homo sapiens
cagaccctgcctgagccca

SEQ ID NO: 405419 - DNA, 17 bp, Homo sapiens
cagaccgatccttccca

SEQ ID NO: 405420 - DNA, 13 bp, Homo sapiens
cagaccggccgca

SEQ ID NO: 405421 - DNA, 17 bp, Homo sapiens
cagacctaatatcattt

SEQ ID NO: 405422 - DNA, 16 bp, Homo sapiens
cagacctaatgctcct

SEQ ID NO: 405423 - DNA, 14 bp, Homo sapiens
cagacctctgatcc

SEQ ID NO: 405424 - DNA, 16 bp, Homo sapiens
cagacctctgatccct

SEQ ID NO: 405425 - DNA, 22 bp, Homo sapiens
cagacctgaatgcttctgagag

SEQ ID NO: 405426 - DNA, 17 bp, Homo sapiens
cagacctgagctcccca

SEQ ID NO: 405427 - DNA, 22 bp, Homo sapiens
cagacctgagctccccaccacc

SEQ ID NO: 405428 - DNA, 13 bp, Homo sapiens
cagacctgggact

SEQ ID NO: 405429 - DNA, 14 bp, Homo sapiens
cagacctgggactt

SEQ ID NO: 405430 - DNA, 16 bp, Homo sapiens
cagacctgggccctgg

SEQ ID NO: 405431 - DNA, 19 bp, Homo sapiens
cagacctgggccctggttc

SEQ ID NO: 405432 - DNA, 13 bp, Homo sapiens
cagacctgtcttc

SEQ ID NO: 405433 - DNA, 14 bp, Homo sapiens
cagacctgtcttcc

SEQ ID NO: 405434 - DNA, 15 bp, Homo sapiens
cagacctgttctgac

SEQ ID NO: 405435 - DNA, 14 bp, Homo sapiens
cagacgaggacact

SEQ ID NO: 405436 - DNA, 17 bp, Homo sapiens
cagacgcacgtgggtct

SEQ ID NO: 405437 - DNA, 20 bp, Homo sapiens
cagacgcagcagctgggacc

SEQ ID NO: 405438 - DNA, 16 bp, Homo sapiens
cagacggcacccaccc

SEQ ID NO: 405439 - DNA, 19 bp, Homo sapiens
cagacggcccgccgtgcct

SEQ ID NO: 405440 - DNA, 18 bp, Homo sapiens
cagactatttaacttgag

SEQ ID NO: 405441 - DNA, 19 bp, Homo sapiens
cagactatttaacttgagg

SEQ ID NO: 405442 - DNA, 14 bp, Homo sapiens
ctaaagtttacagt

SEQ ID NO: 405443 - DNA, 18 bp, Homo sapiens
ctaaagtttacagtaaat

SEQ ID NO: 405444 - DNA, 21 bp, Homo sapiens
ctaaagtttacagtaaataaa

SEQ ID NO: 405445 - DNA, 20 bp, Homo sapiens
ctaaataaacacatagattc

SEQ ID NO: 405446 - DNA, 16 bp, Homo sapiens
ctaaataacacagata

SEQ ID NO: 405447 - DNA, 18 bp, Homo sapiens
ctaaataatatcctgaat

SEQ ID NO: 405448 - DNA, 20 bp, Homo sapiens
ctaaatagatttttagattc

SEQ ID NO: 405449 - DNA, 21 bp, Homo sapiens
ctaaatattggtttgttattc

SEQ ID NO: 405450 - DNA, 23 bp, Homo sapiens
ctaaatattggtttgttattctt

SEQ ID NO: 405451 - DNA, 13 bp, Homo sapiens
ctaaatatttcct

SEQ ID NO: 405452 - DNA, 15 bp, Homo sapiens
ctaaatatttcctta

SEQ ID NO: 405453 - DNA, 22 bp, Homo sapiens
ctaaatatttccttaaactgtg

SEQ ID NO: 405454 - DNA, 17 bp, Homo sapiens
ctaaatccattttctaa

SEQ ID NO: 405455 - DNA, 15 bp, Homo sapiens
ctaaatctctaatat

SEQ ID NO: 405456 - DNA, 18 bp, Homo sapiens
ctaaatctgtaagctctt

SEQ ID NO: 405457 - DNA, 16 bp, Homo sapiens
ctaaatgaaaagagaa

SEQ ID NO: 405458 - DNA, 14 bp, Homo sapiens
ctaaatgaatgttt

SEQ ID NO: 405459 - DNA, 22 bp, Homo sapiens
ctaaatgcatatcctgagccat

SEQ ID NO: 405460 - DNA, 13 bp, Homo sapiens
ctaaattaacttc

SEQ ID NO: 405461 - DNA, 17 bp, Homo sapiens
ctaaattgtatacattt

SEQ ID NO: 405462 - DNA, 19 bp, Homo sapiens
ctaaatttacgtatatttc

SEQ ID NO: 405463 - DNA, 21 bp, Homo sapiens
ctaaatttacgtatatttcat

SEQ ID NO: 405464 - DNA, 14 bp, Homo sapiens
ctaaatttctcagt

SEQ ID NO: 405465 - DNA, 23 bp, Homo sapiens
ctaaatttctcagtttttgctga

SEQ ID NO: 405466 - DNA, 16 bp, Homo sapiens
ctaaattttctgaaac

SEQ ID NO: 405467 - DNA, 16 bp, Homo sapiens
ctaacaaactgaaaaa

SEQ ID NO: 405468 - DNA, 14 bp, Homo sapiens
ctaacacagcatgt

SEQ ID NO: 405469 - DNA, 17 bp, Homo sapiens
ctaacacattatcggga

SEQ ID NO: 405470 - DNA, 15 bp, Homo sapiens
ctaacaccacactga

SEQ ID NO: 405471 - DNA, 17 bp, Homo sapiens
ctaacaccacactgacc

SEQ ID NO: 405472 - DNA, 18 bp, Homo sapiens
ctaacaccacactgacca

SEQ ID NO: 405473 - DNA, 13 bp, Homo sapiens
ctaacaccagcgt

SEQ ID NO: 405474 - DNA, 14 bp, Homo sapiens
ctaacactggcccc

SEQ ID NO: 405475 - DNA, 17 bp, Homo sapiens
ctaacagatcagaacat

SEQ ID NO: 405476 - DNA, 17 bp, Homo sapiens
ctaacagctcaggatct

SEQ ID NO: 405477 - DNA, 15 bp, Homo sapiens
ctaacaggggctggt

SEQ ID NO: 405478 - DNA, 20 bp, Homo sapiens
ctaacaggggctggtgggca

SEQ ID NO: 405479 - DNA, 16 bp, Homo sapiens
ctaacataaaatctgt

SEQ ID NO: 405480 - DNA, 22 bp, Homo sapiens
ctaacatataatgttgttattt

SEQ ID NO: 405481 - DNA, 23 bp, Homo sapiens
ctaacatataatgttgttattta

SEQ ID NO: 405482 - DNA, 15 bp, Homo sapiens
ctaacatcccaataa

SEQ ID NO: 405483 - DNA, 22 bp, Homo sapiens
ctaacatcccaataaagtcctc

SEQ ID NO: 405484 - DNA, 18 bp, Homo sapiens
ctaacattttaaataaaa

SEQ ID NO: 405485 - DNA, 21 bp, Homo sapiens
ctaaccacgtctgtcttcaca

SEQ ID NO: 405486 - DNA, 15 bp, Homo sapiens
ctaaccatccccaac

SEQ ID NO: 405487 - DNA, 16 bp, Homo sapiens
ctaaccatccccaact

SEQ ID NO: 405488 - DNA, 21 bp, Homo sapiens
ctaaccatccccaactccatg

SEQ ID NO: 405489 - DNA, 13 bp, Homo sapiens
ctaaccatttctt

SEQ ID NO: 405490 - DNA, 13 bp, Homo sapiens
ctaacctggagac

SEQ ID NO: 405491 - DNA, 16 bp, Homo sapiens
ctaacgtgctgtcagc

SEQ ID NO: 405492 - DNA, 16 bp, Homo sapiens
ctaactcttgctcact

SEQ ID NO: 405493 - DNA, 20 bp, Homo sapiens
ctaactgctacaaatactct

SEQ ID NO: 405494 - DNA, 14 bp, Homo sapiens
ctaactggccccag

SEQ ID NO: 405495 - DNA, 15 bp, Homo sapiens
ctaactggccccagg

SEQ ID NO: 405496 - DNA, 16 bp, Homo sapiens
ctaactggccccaggc

SEQ ID NO: 405497 - DNA, 14 bp, Homo sapiens
ctaactgtatgtgt

SEQ ID NO: 405498 - DNA, 15 bp, Homo sapiens
ctaacttattgcctg

SEQ ID NO: 405499 - DNA, 20 bp, Homo sapiens
ctaactttagaagtgcattt

SEQ ID NO: 405500 - DNA, 14 bp, Homo sapiens
ctaactttcttgct

SEQ ID NO: 405501 - DNA, 13 bp, Homo sapiens
ctaacttttgtgt

SEQ ID NO: 405502 - DNA, 23 bp, Homo sapiens
ctaagaaaagatacgactttatt

SEQ ID NO: 405503 - DNA, 13 bp, Homo sapiens
ctaagaaaataga

SEQ ID NO: 405504 - DNA, 20 bp, Homo sapiens
ctaagaagatgttttgaaat

SEQ ID NO: 405505 - DNA, 13 bp, Homo sapiens
ctaagaataaata

SEQ ID NO: 405506 - DNA, 22 bp, Homo sapiens
ctaagaataaataaagaagaaa

SEQ ID NO: 405507 - DNA, 13 bp, Homo sapiens
ctaagaataatga

SEQ ID NO: 405508 - DNA, 21 bp, Homo sapiens
ctaagacattcaccaacaaca

SEQ ID NO: 405509 - DNA, 22 bp, Homo sapiens
ctaagactgtgacaactgtcta

SEQ ID NO: 405510 - DNA, 20 bp, Homo sapiens
ctaagagccatttaggggcc

SEQ ID NO: 405511 - DNA, 14 bp, Homo sapiens
ctaagaggctgctg

SEQ ID NO: 405512 - DNA, 20 bp, Homo sapiens
ctaagagtgtcactgagctg

SEQ ID NO: 405513 - DNA, 18 bp, Homo sapiens
ctaagagttgagctctcg

SEQ ID NO: 405514 - DNA, 21 bp, Homo sapiens
ctaagagttgagctctcggaa

SEQ ID NO: 405515 - DNA, 17 bp, Homo sapiens
ctaagataattaaatga

SEQ ID NO: 405516 - DNA, 16 bp, Homo sapiens
ctaagatagtaacaat

SEQ ID NO: 405517 - DNA, 12 bp, Homo sapiens
ctaagatgaaat

SEQ ID NO: 405518 - DNA, 22 bp, Homo sapiens
ctaagatgtattaacctacctg

SEQ ID NO: 405519 - DNA, 15 bp, Homo sapiens
ctaagattgtacata

SEQ ID NO: 405520 - DNA, 15 bp, Homo sapiens
ctaagcaatttcttg

SEQ ID NO: 405521 - DNA, 14 bp, Homo sapiens
ctaagccaagggcc

SEQ ID NO: 405522 - DNA, 12 bp, Homo sapiens
ctaagccctgtc

SEQ ID NO: 405523 - DNA, 21 bp, Homo sapiens
ctaagccctgtcgagacactt

SEQ ID NO: 405524 - DNA, 13 bp, Homo sapiens
ctaagcctgttgc

SEQ ID NO: 405525 - DNA, 15 bp, Homo sapiens
ctaagctcaaatgta

SEQ ID NO: 405526 - DNA, 19 bp, Homo sapiens
ctaagctcaaatgtatatt

SEQ ID NO: 405527 - DNA, 15 bp, Homo sapiens
ctaagcttatttcta

SEQ ID NO: 405528 - DNA, 15 bp, Homo sapiens
ctaagctttctcctt

SEQ ID NO: 405529 - DNA, 16 bp, Homo sapiens
ctaagctttctccttt

SEQ ID NO: 405530 - DNA, 12 bp, Homo sapiens
ctaaggacacac

SEQ ID NO: 405531 - DNA, 12 bp, Homo sapiens
ctaaggatctct

SEQ ID NO: 405532 - DNA, 22 bp, Homo sapiens
ctaaggcatgctcccagcattt

SEQ ID NO: 405533 - DNA, 17 bp, Homo sapiens
ctaaggccaaggcctca

SEQ ID NO: 405534 - DNA, 19 bp, Homo sapiens
ctaaggcctcttgctggtg

SEQ ID NO: 405535 - DNA, 20 bp, Homo sapiens
ctaaggcctcttgctggtgc

SEQ ID NO: 405536 - DNA, 15 bp, Homo sapiens
ctaaggctcctcctt

SEQ ID NO: 405537 - DNA, 14 bp, Homo sapiens
ctaaggctgctgta

SEQ ID NO: 405538 - DNA, 17 bp, Homo sapiens
ctaaggggcaggaatca

SEQ ID NO: 405539 - DNA, 17 bp, Homo sapiens
ctaagtatttaaatgtt

SEQ ID NO: 405540 - DNA, 19 bp, Homo sapiens
ctaagtatttaaatgttct

SEQ ID NO: 405541 - DNA, 15 bp, Homo sapiens
ctaagtccctgcccc

SEQ ID NO: 405542 - DNA, 14 bp, Homo sapiens
ctaagtgaaaaggt

SEQ ID NO: 405543 - DNA, 14 bp, Homo sapiens
ctaagtgactacca

SEQ ID NO: 405544 - DNA, 15 bp, Homo sapiens
ctaagtgcccaaagt

SEQ ID NO: 405545 - DNA, 22 bp, Homo sapiens
ctaagtgcccaaagtggggagg

SEQ ID NO: 405546 - DNA, 21 bp, Homo sapiens
ctaagtggattggctttgtgc

SEQ ID NO: 405547 - DNA, 17 bp, Homo sapiens
ctaagtgttgacttttt

SEQ ID NO: 405548 - DNA, 16 bp, Homo sapiens
ctaagttatagtatat

SEQ ID NO: 405549 - DNA, 15 bp, Homo sapiens
ctaagttcagttctg

SEQ ID NO: 405550 - DNA, 20 bp, Homo sapiens
ctaagttcatgtttgtaaat

SEQ ID NO: 405551 - DNA, 16 bp, Homo sapiens
ctaagttttgtcatca

SEQ ID NO: 405552 - DNA, 19 bp, Homo sapiens
ctaagttttgtgtgtatat

SEQ ID NO: 405553 - DNA, 16 bp, Homo sapiens
ctaataaaaaggttta

SEQ ID NO: 405554 - DNA, 15 bp, Homo sapiens
cagaacgggcctccc

SEQ ID NO: 405555 - DNA, 14 bp, Homo sapiens
cagaacgggttctc

SEQ ID NO: 405556 - DNA, 16 bp, Homo sapiens
cagaacgtagtgagcc

SEQ ID NO: 405557 - DNA, 14 bp, Homo sapiens
cagaacgtctctca

SEQ ID NO: 405558 - DNA, 16 bp, Homo sapiens
cagaactcgatgcact

SEQ ID NO: 405559 - DNA, 17 bp, Homo sapiens
cagaactcgatgcactg

SEQ ID NO: 405560 - DNA, 21 bp, Homo sapiens
cagaactcgatgcactgacct

SEQ ID NO: 405561 - DNA, 22 bp, Homo sapiens
cagaactcgatgcactgacctg

SEQ ID NO: 405562 - DNA, 13 bp, Homo sapiens
cagaactctcaga

SEQ ID NO: 405563 - DNA, 14 bp, Homo sapiens
cagaactctcagac

SEQ ID NO: 405564 - DNA, 22 bp, Homo sapiens
cagaactctctgtcttctctcc

SEQ ID NO: 405565 - DNA, 23 bp, Homo sapiens
cagaactgagctcctctgggcag

SEQ ID NO: 405566 - DNA, 24 bp, Homo sapiens
cagaactgagctcctctgggcagg

SEQ ID NO: 405567 - DNA, 16 bp, Homo sapiens
cagaactgcccccact

SEQ ID NO: 405568 - DNA, 18 bp, Homo sapiens
cagaactgcccccactgt

SEQ ID NO: 405569 - DNA, 13 bp, Homo sapiens
cagaactgcttta

SEQ ID NO: 405570 - DNA, 16 bp, Homo sapiens
cagaactgggaaaaca

SEQ ID NO: 405571 - DNA, 17 bp, Homo sapiens
cagaacttgtaactaaa

SEQ ID NO: 405572 - DNA, 17 bp, Homo sapiens
cagaagaatattcagga

SEQ ID NO: 405573 - DNA, 20 bp, Homo sapiens
cagaagaatattcaggactt

SEQ ID NO: 405574 - DNA, 16 bp, Homo sapiens
cagaagacacgtgttt

SEQ ID NO: 405575 - DNA, 22 bp, Homo sapiens
cagaagacacgtgtttttgtat

SEQ ID NO: 405576 - DNA, 20 bp, Homo sapiens
cagaagacctccctgtgaga

SEQ ID NO: 405577 - DNA, 21 bp, Homo sapiens
cagaagacctccctgtgagag

SEQ ID NO: 405578 - DNA, 15 bp, Homo sapiens
cagaagataacttga

SEQ ID NO: 405579 - DNA, 22 bp, Homo sapiens
cagaagataacttgagcaccgt

SEQ ID NO: 405580 - DNA, 14 bp, Homo sapiens
cagaagatagagat

SEQ ID NO: 405581 - DNA, 22 bp, Homo sapiens
cagaagatagagattcccctgg

SEQ ID NO: 405582 - DNA, 14 bp, Homo sapiens
cagaagatgtattc

SEQ ID NO: 405583 - DNA, 22 bp, Homo sapiens
cagaagatgtattcagagccac

SEQ ID NO: 405584 - DNA, 15 bp, Homo sapiens
cagaagcaggctgga

SEQ ID NO: 405585 - DNA, 16 bp, Homo sapiens
cagaagcaggctggag

SEQ ID NO: 405586 - DNA, 16 bp, Homo sapiens
cagaagcctattgtaa

SEQ ID NO: 405587 - DNA, 17 bp, Homo sapiens
cagaagcctattgtaaa

SEQ ID NO: 405588 - DNA, 22 bp, Homo sapiens
cagaagcctattgtaaatacaa

SEQ ID NO: 405589 - DNA, 22 bp, Homo sapiens
cagaagcctccaagcctgcctc

SEQ ID NO: 405590 - DNA, 15 bp, Homo sapiens
cagaagcctctggct

SEQ ID NO: 405591 - DNA, 19 bp, Homo sapiens
cagaagcctctggctagag

SEQ ID NO: 405592 - DNA, 18 bp, Homo sapiens
cagaagcggcctgtgcgt

SEQ ID NO: 405593 - DNA, 16 bp, Homo sapiens
cagaagcgtctccctt

SEQ ID NO: 405594 - DNA, 19 bp, Homo sapiens
cagaagctcaaggctgcag

SEQ ID NO: 405595 - DNA, 15 bp, Homo sapiens
cagaagctgcagctg

SEQ ID NO: 405596 - DNA, 21 bp, Homo sapiens
cagaagctgcagctggtctgt

SEQ ID NO: 405597 - DNA, 15 bp, Homo sapiens
cagaaggaacccggt

SEQ ID NO: 405598 - DNA, 20 bp, Homo sapiens
cagaaggaacccggtcccag

SEQ ID NO: 405599 - DNA, 23 bp, Homo sapiens
cagaaggaacccggtcccaggcc

SEQ ID NO: 405600 - DNA, 17 bp, Homo sapiens
cagaaggagggcagagc

SEQ ID NO: 405601 - DNA, 19 bp, Homo sapiens
cagaaggagggcagagcca

SEQ ID NO: 405602 - DNA, 18 bp, Homo sapiens
cagaaggcaaagtttcca

SEQ ID NO: 405603 - DNA, 14 bp, Homo sapiens
cagaaggccacagg

SEQ ID NO: 405604 - DNA, 13 bp, Homo sapiens
cagaagggaaaca

SEQ ID NO: 405605 - DNA, 16 bp, Homo sapiens
cagaagggaaacagtc

SEQ ID NO: 405606 - DNA, 14 bp, Homo sapiens
cagaagggggccat

SEQ ID NO: 405607 - DNA, 16 bp, Homo sapiens
cagaagggggccatga

SEQ ID NO: 405608 - DNA, 22 bp, Homo sapiens
cagaaggggtttggtctgggac

SEQ ID NO: 405609 - DNA, 23 bp, Homo sapiens
cagaaggtgggggttggctgggt

SEQ ID NO: 405610 - DNA, 16 bp, Homo sapiens
cagaaggttgtgatga

SEQ ID NO: 405611 - DNA, 20 bp, Homo sapiens
cagaagtactggcatcacac

SEQ ID NO: 405612 - DNA, 22 bp, Homo sapiens
cagaagtcactcaattgttttt

SEQ ID NO: 405613 - DNA, 24 bp, Homo sapiens
cagaagtcctccctcctgcaggct

SEQ ID NO: 405614 - DNA, 17 bp, Homo sapiens
cagaagtgaaaaagact

SEQ ID NO: 405615 - DNA, 13 bp, Homo sapiens
cagaagtggagct

SEQ ID NO: 405616 - DNA, 17 bp, Homo sapiens
cagaagttgttagtgat

SEQ ID NO: 405617 - DNA, 16 bp, Homo sapiens
cagaatacaagccact

SEQ ID NO: 405618 - DNA, 22 bp, Homo sapiens
cagaatactgttaaaggaaaaa

SEQ ID NO: 405619 - DNA, 12 bp, Homo sapiens
cagaatatctgg

SEQ ID NO: 405620 - DNA, 15 bp, Homo sapiens
cagaatcattgctta

SEQ ID NO: 405621 - DNA, 20 bp, Homo sapiens
cagaatcattgcttatgaca

SEQ ID NO: 405622 - DNA, 14 bp, Homo sapiens
cagaatcctcagtt

SEQ ID NO: 405623 - DNA, 20 bp, Homo sapiens
cagaatctgctgttgccata

SEQ ID NO: 405624 - DNA, 21 bp, Homo sapiens
cagaatctgctgttgccatag

SEQ ID NO: 405625 - DNA, 17 bp, Homo sapiens
cagaatgccatattttt

SEQ ID NO: 405626 - DNA, 15 bp, Homo sapiens
cagaatgctcttcta

SEQ ID NO: 405627 - DNA, 20 bp, Homo sapiens
cagaatggtgggctccagag

SEQ ID NO: 405628 - DNA, 20 bp, Homo sapiens
cagaatgtaagaaaacaaaa

SEQ ID NO: 405629 - DNA, 20 bp, Homo sapiens
cagaattatacagacctaat

SEQ ID NO: 405630 - DNA, 22 bp, Homo sapiens
cagaattattcatagctgtata

SEQ ID NO: 405631 - DNA, 19 bp, Homo sapiens
cagaatttcccaaagcagt

SEQ ID NO: 405632 - DNA, 22 bp, Homo sapiens
cagaatttctttgtcattcaag

SEQ ID NO: 405633 - DNA, 19 bp, Homo sapiens
cagaatttggaagctagaa

SEQ ID NO: 405634 - DNA, 14 bp, Homo sapiens
cagacaaaaagaac

SEQ ID NO: 405635 - DNA, 16 bp, Homo sapiens
cagacaacaaacctgt

SEQ ID NO: 405636 - DNA, 17 bp, Homo sapiens
cagacaacacgttacta

SEQ ID NO: 405637 - DNA, 23 bp, Homo sapiens
cagacaagcaacaggttttataa

SEQ ID NO: 405638 - DNA, 17 bp, Homo sapiens
cagacaaggagagcgga

SEQ ID NO: 405639 - DNA, 22 bp, Homo sapiens
cagacaaggagagcggaggagg

SEQ ID NO: 405640 - DNA, 16 bp, Homo sapiens
cagacaaggtagccct

SEQ ID NO: 405641 - DNA, 20 bp, Homo sapiens
cagacaatttatccaaagca

SEQ ID NO: 405642 - DNA, 17 bp, Homo sapiens
cagacacacaacatcaa

SEQ ID NO: 405643 - DNA, 18 bp, Homo sapiens
cagacacacaacatcaag

SEQ ID NO: 405644 - DNA, 14 bp, Homo sapiens
cagacacacacaca

SEQ ID NO: 405645 - DNA, 15 bp, Homo sapiens
cagacacacacacac

SEQ ID NO: 405646 - DNA, 21 bp, Homo sapiens
cagacacacacacacacacaa

SEQ ID NO: 405647 - DNA, 23 bp, Homo sapiens
cagacacacggggcacccagccc

SEQ ID NO: 405648 - DNA, 14 bp, Homo sapiens
cagacaccacagac

SEQ ID NO: 405649 - DNA, 14 bp, Homo sapiens
cagacactttggaa

SEQ ID NO: 405650 - DNA, 14 bp, Homo sapiens
cagacagacacaca

SEQ ID NO: 405651 - DNA, 14 bp, Homo sapiens
cagacagacagacg

SEQ ID NO: 405652 - DNA, 19 bp, Homo sapiens
cagacagacatctctgcac

SEQ ID NO: 405653 - DNA, 12 bp, Homo sapiens
cagacagagtgg

SEQ ID NO: 405654 - DNA, 13 bp, Homo sapiens
cagacagagtgga

SEQ ID NO: 405655 - DNA, 15 bp, Homo sapiens
cagacagcaagggct

SEQ ID NO: 405656 - DNA, 23 bp, Homo sapiens
cagacaggaaagggaaggcccca

SEQ ID NO: 405657 - DNA, 21 bp, Homo sapiens
cagacaggccatgtgagccac

SEQ ID NO: 405658 - DNA, 13 bp, Homo sapiens
cagacaggccctc

SEQ ID NO: 405659 - DNA, 15 bp, Homo sapiens
cagacaggccctccc

SEQ ID NO: 405660 - DNA, 20 bp, Homo sapiens
cagacaggccctccctgtct

SEQ ID NO: 405661 - DNA, 18 bp, Homo sapiens
cagacaggctcttagcag

SEQ ID NO: 405662 - DNA, 15 bp, Homo sapiens
cagacagggtggggc

SEQ ID NO: 405663 - DNA, 22 bp, Homo sapiens
cagacatccatgtttgtaaaac

SEQ ID NO: 405664 - DNA, 23 bp, Homo sapiens
cagacatccatgtttgtaaaact

SEQ ID NO: 405665 - DNA, 19 bp, Homo sapiens
cagacatctcctcacccca

SEQ ID NO: 405666 - DNA, 20 bp, Homo sapiens
cagacatctcctcaccccag

SEQ ID NO: 405667 - DNA, 17 bp, Homo sapiens
cagacatctctgcaccc

SEQ ID NO: 405668 - DNA, 16 bp, Homo sapiens
cagacatttacatgtt

SEQ ID NO: 405669 - DNA, 16 bp, Homo sapiens
cagaccaaaataatac

SEQ ID NO: 405670 - DNA, 15 bp, Homo sapiens
cagaccaactctctc

SEQ ID NO: 405671 - DNA, 18 bp, Homo sapiens
cagaccaactctctcctg

SEQ ID NO: 405672 - DNA, 12 bp, Homo sapiens
cagaccagagct

SEQ ID NO: 405673 - DNA, 17 bp, Homo sapiens
cagaccagtactgggaa

SEQ ID NO: 405674 - DNA, 19 bp, Homo sapiens
cagacccagggcagtgtgg

SEQ ID NO: 405675 - DNA, 21 bp, Homo sapiens
cagaccccatccagccagggg

SEQ ID NO: 405676 - DNA, 13 bp, Homo sapiens
cagacccccaccc

SEQ ID NO: 405677 - DNA, 23 bp, Homo sapiens
cagacccccaccccttccccact

SEQ ID NO: 405678 - DNA, 12 bp, Homo sapiens
cagaccccgccc

SEQ ID NO: 405679 - DNA, 13 bp, Homo sapiens
cagaccccgcccc

SEQ ID NO: 405680 - DNA, 15 bp, Homo sapiens
cagaccccgcccctg

SEQ ID NO: 405681 - DNA, 18 bp, Homo sapiens
cagacccctaccctttcc

SEQ ID NO: 405682 - DNA, 17 bp, Homo sapiens
cagacccctctggccag

SEQ ID NO: 405683 - DNA, 12 bp, Homo sapiens
cagacccctgcc

SEQ ID NO: 405684 - DNA, 14 bp, Homo sapiens
cagacccctgcctg

SEQ ID NO: 405685 - DNA, 13 bp, Homo sapiens
cagaccccttggc

SEQ ID NO: 405686 - DNA, 22 bp, Homo sapiens
cagacccttgaagatgtagctt

SEQ ID NO: 405687 - DNA, 13 bp, Homo sapiens
ctaataaaatatc

SEQ ID NO: 405688 - DNA, 21 bp, Homo sapiens
ctaataaaatatcattcagca

SEQ ID NO: 405689 - DNA, 23 bp, Homo sapiens
ctaataaaatatcattcagcaac

SEQ ID NO: 405690 - DNA, 21 bp, Homo sapiens
ctaataaatatactatgaaat

SEQ ID NO: 405691 - DNA, 12 bp, Homo sapiens
ctaataaatgac

SEQ ID NO: 405692 - DNA, 13 bp, Homo sapiens
ctaataaatgacc

SEQ ID NO: 405693 - DNA, 14 bp, Homo sapiens
ctaataaatgacca

SEQ ID NO: 405694 - DNA, 16 bp, Homo sapiens
ctaataaatgaccagt

SEQ ID NO: 405695 - DNA, 13 bp, Homo sapiens
ctaatagaactca

SEQ ID NO: 405696 - DNA, 23 bp, Homo sapiens
ctaatagcgggttactttcacat

SEQ ID NO: 405697 - DNA, 15 bp, Homo sapiens
ctaatatatttttat

SEQ ID NO: 405698 - DNA, 14 bp, Homo sapiens
ctaatatcatttta

SEQ ID NO: 405699 - DNA, 15 bp, Homo sapiens
ctaatatcattttat

SEQ ID NO: 405700 - DNA, 14 bp, Homo sapiens
ctaatattaaaaat

SEQ ID NO: 405701 - DNA, 22 bp, Homo sapiens
ctaatcaagagtgagtgaacaa

SEQ ID NO: 405702 - DNA, 20 bp, Homo sapiens
ctaatcagcattctcactcc

SEQ ID NO: 405703 - DNA, 20 bp, Homo sapiens
ctaatcagggaggtcatttt

SEQ ID NO: 405704 - DNA, 16 bp, Homo sapiens
ctaatccccttctccc

SEQ ID NO: 405705 - DNA, 16 bp, Homo sapiens
ctaatccttaaaagca

SEQ ID NO: 405706 - DNA, 17 bp, Homo sapiens
ctaatccttaaaagcat

SEQ ID NO: 405707 - DNA, 17 bp, Homo sapiens
ctaatctattgggttca

SEQ ID NO: 405708 - DNA, 21 bp, Homo sapiens
ctaatctattgggttcattat

SEQ ID NO: 405709 - DNA, 16 bp, Homo sapiens
ctaatctcttattcta

SEQ ID NO: 405710 - DNA, 14 bp, Homo sapiens
ctaatctgtagggc

SEQ ID NO: 405711 - DNA, 15 bp, Homo sapiens
ctaatgaaattgtga

SEQ ID NO: 405712 - DNA, 20 bp, Homo sapiens
ctaatgaatgcaaaaagata

SEQ ID NO: 405713 - DNA, 12 bp, Homo sapiens
ctaatgaatttt

SEQ ID NO: 405714 - DNA, 14 bp, Homo sapiens
ctaatgaattttaa

SEQ ID NO: 405715 - DNA, 12 bp, Homo sapiens
ctaatgatgttt

SEQ ID NO: 405716 - DNA, 18 bp, Homo sapiens
ctaatgctccttgttcct

SEQ ID NO: 405717 - DNA, 13 bp, Homo sapiens
ctaatgctgcaca

SEQ ID NO: 405718 - DNA, 22 bp, Homo sapiens
ctaatgctgcacaccagttact

SEQ ID NO: 405719 - DNA, 21 bp, Homo sapiens
ctaatgcttgccaagaaatcg

SEQ ID NO: 405720 - DNA, 17 bp, Homo sapiens
ctaatgcttgtttatga

SEQ ID NO: 405721 - DNA, 19 bp, Homo sapiens
ctaatgtaataactgtgaa

SEQ ID NO: 405722 - DNA, 19 bp, Homo sapiens
ctaatgtaatcatttatct

SEQ ID NO: 405723 - DNA, 15 bp, Homo sapiens
ctaatgtagctattt

SEQ ID NO: 405724 - DNA, 16 bp, Homo sapiens
ctaatgtaggactgta

SEQ ID NO: 405725 - DNA, 17 bp, Homo sapiens
ctaatgttagaattgat

SEQ ID NO: 405726 - DNA, 22 bp, Homo sapiens
ctaatgttagaattgatttcca

SEQ ID NO: 405727 - DNA, 15 bp, Homo sapiens
ctaattcaatttatg

SEQ ID NO: 405728 - DNA, 20 bp, Homo sapiens
ctaattcatacctccctcct

SEQ ID NO: 405729 - DNA, 21 bp, Homo sapiens
ctaattcccattttgcaaaat

SEQ ID NO: 405730 - DNA, 13 bp, Homo sapiens
ctaattctgggaa

SEQ ID NO: 405731 - DNA, 15 bp, Homo sapiens
ctaattctgggaagg

SEQ ID NO: 405732 - DNA, 13 bp, Homo sapiens
ctaattgccatgt

SEQ ID NO: 405733 - DNA, 17 bp, Homo sapiens
ctaattggtcattccta

SEQ ID NO: 405734 - DNA, 12 bp, Homo sapiens
ctaatttacaag

SEQ ID NO: 405735 - DNA, 21 bp, Homo sapiens
ctaatttcaaaaatataactt

SEQ ID NO: 405736 - DNA, 22 bp, Homo sapiens
ctaattttctcaaaagcattta

SEQ ID NO: 405737 - DNA, 15 bp, Homo sapiens
ctaattttgtacgta

SEQ ID NO: 405738 - DNA, 23 bp, Homo sapiens
ctaattttgtacgtatgaatgat

SEQ ID NO: 405739 - DNA, 17 bp, Homo sapiens
ctaatttttagatattc

SEQ ID NO: 405740 - DNA, 13 bp, Homo sapiens
ctaatttttgtat

SEQ ID NO: 405741 - DNA, 15 bp, Homo sapiens
ctaatttttgtattt

SEQ ID NO: 405742 - DNA, 14 bp, Homo sapiens
ctaatttttttgta

SEQ ID NO: 405743 - DNA, 20 bp, Homo sapiens
ctacaaaacctgatgttaaa

SEQ ID NO: 405744 - DNA, 20 bp, Homo sapiens
ctacaaaagcaaagtgaagt

SEQ ID NO: 405745 - DNA, 13 bp, Homo sapiens
ctacaaccagagc

SEQ ID NO: 405746 - DNA, 22 bp, Homo sapiens
ctacaaccagagccccccacaa

SEQ ID NO: 405747 - DNA, 15 bp, Homo sapiens
ctacaaccaggtctt

SEQ ID NO: 405748 - DNA, 16 bp, Homo sapiens
ctacaacctccacctt

SEQ ID NO: 405749 - DNA, 21 bp, Homo sapiens
ctacaacctccaccttccagg

SEQ ID NO: 405750 - DNA, 14 bp, Homo sapiens
ctacaactgagtcc

SEQ ID NO: 405751 - DNA, 16 bp, Homo sapiens
ctacaacttcagcagt

SEQ ID NO: 405752 - DNA, 20 bp, Homo sapiens
ctacaagagcagcctgtggc

SEQ ID NO: 405753 - DNA, 15 bp, Homo sapiens
ctacaagatttagaa

SEQ ID NO: 405754 - DNA, 12 bp, Homo sapiens
ctacaatatata

SEQ ID NO: 405755 - DNA, 15 bp, Homo sapiens
ctacacaacatgtat

SEQ ID NO: 405756 - DNA, 14 bp, Homo sapiens
ctacacacacacac

SEQ ID NO: 405757 - DNA, 15 bp, Homo sapiens
ctacacacacacaca

SEQ ID NO: 405758 - DNA, 15 bp, Homo sapiens
ctacacctctgggcc

SEQ ID NO: 405759 - DNA, 11 bp, Homo sapiens
ctacacctgga

SEQ ID NO: 405760 - DNA, 15 bp, Homo sapiens
ctacactctcctggg

SEQ ID NO: 405761 - DNA, 21 bp, Homo sapiens
ctacactctcctgggcccctc

SEQ ID NO: 405762 - DNA, 23 bp, Homo sapiens
ctacactctcctgggcccctccc

SEQ ID NO: 405763 - DNA, 15 bp, Homo sapiens
ctacacttacaagta

SEQ ID NO: 405764 - DNA, 23 bp, Homo sapiens
ctacagaaagcaaatcagacaca

SEQ ID NO: 405765 - DNA, 14 bp, Homo sapiens
ctacagaacaaaga

SEQ ID NO: 405766 - DNA, 16 bp, Homo sapiens
ctacagaacaaagaac

SEQ ID NO: 405767 - DNA, 17 bp, Homo sapiens
ctacagaataatgtgtt

SEQ ID NO: 405768 - DNA, 17 bp, Homo sapiens
ctacagacattaaataa

SEQ ID NO: 405769 - DNA, 19 bp, Homo sapiens
ctacagacattaaataatc

SEQ ID NO: 405770 - DNA, 22 bp, Homo sapiens
ctacagagcagctccccaggag

SEQ ID NO: 405771 - DNA, 14 bp, Homo sapiens
ctacagaggattct

SEQ ID NO: 405772 - DNA, 18 bp, Homo sapiens
ctacagagtctgacagga

SEQ ID NO: 405773 - DNA, 21 bp, Homo sapiens
ctacagagtctgacaggaaga

SEQ ID NO: 405774 - DNA, 21 bp, Homo sapiens
ctacagataatttattttgta

SEQ ID NO: 405775 - DNA, 15 bp, Homo sapiens
ctacagcctgcacac

SEQ ID NO: 405776 - DNA, 16 bp, Homo sapiens
ctacagcctgcacaca

SEQ ID NO: 405777 - DNA, 20 bp, Homo sapiens
ctacagcctgcacacacctg

SEQ ID NO: 405778 - DNA, 20 bp, Homo sapiens
ctacaggaagcaccccatgc

SEQ ID NO: 405779 - DNA, 14 bp, Homo sapiens
ctacaggcctttca

SEQ ID NO: 405780 - DNA, 16 bp, Homo sapiens
ctacaggcgctccagg

SEQ ID NO: 405781 - DNA, 22 bp, Homo sapiens
ctacagtagctgtggggagctg

SEQ ID NO: 405782 - DNA, 12 bp, Homo sapiens
ctacagtatata

SEQ ID NO: 405783 - DNA, 17 bp, Homo sapiens
ctacataaactgacttt

SEQ ID NO: 405784 - DNA, 17 bp, Homo sapiens
ctacatgcagcccatgc

SEQ ID NO: 405785 - DNA, 21 bp, Homo sapiens
ctacatgcagcccatgcccac

SEQ ID NO: 405786 - DNA, 16 bp, Homo sapiens
ctacatgcatgtttta

SEQ ID NO: 405787 - DNA, 16 bp, Homo sapiens
ctacatgtgggagctt

SEQ ID NO: 405788 - DNA, 17 bp, Homo sapiens
ctacatgtgggagcttt

SEQ ID NO: 405789 - DNA, 15 bp, Homo sapiens
ctacattccctctcc

SEQ ID NO: 405790 - DNA, 11 bp, Homo sapiens
ctacattcctc

SEQ ID NO: 405791 - DNA, 23 bp, Homo sapiens
ctacattgtaatctgctttgtta

SEQ ID NO: 405792 - DNA, 13 bp, Homo sapiens
ctacatttgcatg

SEQ ID NO: 405793 - DNA, 15 bp, Homo sapiens
ctacatttgcatgcc

SEQ ID NO: 405794 - DNA, 16 bp, Homo sapiens
ctaccaaatgtgtaat

SEQ ID NO: 405795 - DNA, 13 bp, Homo sapiens
ctaccaatgcatg

SEQ ID NO: 405796 - DNA, 14 bp, Homo sapiens
ctaccaatgcatgc

SEQ ID NO: 405797 - DNA, 15 bp, Homo sapiens
ctaccaatgcatgca

SEQ ID NO: 405798 - DNA, 14 bp, Homo sapiens
ctaccaccccactg

SEQ ID NO: 405799 - DNA, 18 bp, Homo sapiens
ctaccactgagcccttgc

SEQ ID NO: 405800 - DNA, 19 bp, Homo sapiens
ctaccacttatttctaaat

SEQ ID NO: 405801 - DNA, 10 bp, Homo sapiens
ctaccaggaa

SEQ ID NO: 405802 - DNA, 23 bp, Homo sapiens
ctaccagtcgccctctgtgccta

SEQ ID NO: 405803 - DNA, 17 bp, Homo sapiens
ctaccatgaagtgaaaa

SEQ ID NO: 405804 - DNA, 13 bp, Homo sapiens
ctaccatgctgct

SEQ ID NO: 405805 - DNA, 15 bp, Homo sapiens
ctacccaaccactca

SEQ ID NO: 405806 - DNA, 16 bp, Homo sapiens
ctacccaaccactcaa

SEQ ID NO: 405807 - DNA, 20 bp, Homo sapiens
ctacccacagggcctgactt

SEQ ID NO: 405808 - DNA, 23 bp, Homo sapiens
ctacccaccgatggagcccccag

SEQ ID NO: 405809 - DNA, 17 bp, Homo sapiens
ctacccactatgcacag

SEQ ID NO: 405810 - DNA, 20 bp, Homo sapiens
ctacccatgttgggaaaaac

SEQ ID NO: 405811 - DNA, 17 bp, Homo sapiens
ctaccccctaagagcca

SEQ ID NO: 405812 - DNA, 18 bp, Homo sapiens
ctacccccttgtctgctg

SEQ ID NO: 405813 - DNA, 15 bp, Homo sapiens
ctacccctgctccca

SEQ ID NO: 405814 - DNA, 14 bp, Homo sapiens
ctacccctgtcctg

SEQ ID NO: 405815 - DNA, 15 bp, Homo sapiens
ctacccgagcccagc

SEQ ID NO: 405816 - DNA, 16 bp, Homo sapiens
ctacccgggcctgacc

SEQ ID NO: 405817 - DNA, 14 bp, Homo sapiens
ctaccctcaaagta

SEQ ID NO: 405818 - DNA, 13 bp, Homo sapiens
ctaccctcccacc

SEQ ID NO: 405819 - DNA, 15 bp, Homo sapiens
ctaccctcccaccag

SEQ ID NO: 405820 - DNA, 14 bp, Homo sapiens
ctaccctcccccag

SEQ ID NO: 405821 - DNA, 13 bp, Homo sapiens
ctaccctccctcg

SEQ ID NO: 405822 - DNA, 19 bp, Homo sapiens
ctaccctggtaggaaagca

SEQ ID NO: 405823 - DNA, 21 bp, Homo sapiens
cagaccggccgcatgtctgca

SEQ ID NO: 405824 - DNA, 18 bp, Homo sapiens
cagacctaatgctccttg

SEQ ID NO: 405825 - DNA, 20 bp, Homo sapiens
cagacctcactgctttgtag

SEQ ID NO: 405826 - DNA, 17 bp, Homo sapiens
cagacctcccctcttcc

SEQ ID NO: 405827 - DNA, 18 bp, Homo sapiens
cagacctctgatccctcg

SEQ ID NO: 405828 - DNA, 14 bp, Homo sapiens
cagacctgggccct

SEQ ID NO: 405829 - DNA, 17 bp, Homo sapiens
cagacctgggccctggt

SEQ ID NO: 405830 - DNA, 18 bp, Homo sapiens
cagacctgggccctggtt

SEQ ID NO: 405831 - DNA, 16 bp, Homo sapiens
cagacctgtcttccaa

SEQ ID NO: 405832 - DNA, 22 bp, Homo sapiens
cagacgacacctggagactgtc

SEQ ID NO: 405833 - DNA, 13 bp, Homo sapiens
cagacgagacacc

SEQ ID NO: 405834 - DNA, 15 bp, Homo sapiens
cagacgagacaccct

SEQ ID NO: 405835 - DNA, 14 bp, Homo sapiens
cagacgcagcagct

SEQ ID NO: 405836 - DNA, 17 bp, Homo sapiens
cagacggacgggacagc

SEQ ID NO: 405837 - DNA, 15 bp, Homo sapiens
cagacggcacccacc

SEQ ID NO: 405838 - DNA, 17 bp, Homo sapiens
cagacgggctgagagga

SEQ ID NO: 405839 - DNA, 15 bp, Homo sapiens
cagacgtccctccac

SEQ ID NO: 405840 - DNA, 16 bp, Homo sapiens
cagactcatacagaag

SEQ ID NO: 405841 - DNA, 14 bp, Homo sapiens
cagactcctcagat

SEQ ID NO: 405842 - DNA, 21 bp, Homo sapiens
cagactcgagagggctgagcc

SEQ ID NO: 405843 - DNA, 22 bp, Homo sapiens
cagactcgagagggctgagccc

SEQ ID NO: 405844 - DNA, 22 bp, Homo sapiens
cagactctctcctctctctccc

SEQ ID NO: 405845 - DNA, 15 bp, Homo sapiens
cagactgcaggttgg

SEQ ID NO: 405846 - DNA, 21 bp, Homo sapiens
cagactgcaggttggacccca

SEQ ID NO: 405847 - DNA, 13 bp, Homo sapiens
cagactggctgca

SEQ ID NO: 405848 - DNA, 14 bp, Homo sapiens
cagactggctgcac

SEQ ID NO: 405849 - DNA, 17 bp, Homo sapiens
cagactggctgcacagc

SEQ ID NO: 405850 - DNA, 15 bp, Homo sapiens
cagactggtgagcag

SEQ ID NO: 405851 - DNA, 17 bp, Homo sapiens
cagactggtgagcagac

SEQ ID NO: 405852 - DNA, 23 bp, Homo sapiens
cagactgtaagatgttgttttag

SEQ ID NO: 405853 - DNA, 18 bp, Homo sapiens
cagacttaccaggaagca

SEQ ID NO: 405854 - DNA, 22 bp, Homo sapiens
cagacttccaccatgtgcatca

SEQ ID NO: 405855 - DNA, 19 bp, Homo sapiens
cagacttcgctattcccag

SEQ ID NO: 405856 - DNA, 20 bp, Homo sapiens
cagacttcgctattcccagg

SEQ ID NO: 405857 - DNA, 23 bp, Homo sapiens
cagacttcgctattcccaggcag

SEQ ID NO: 405858 - DNA, 14 bp, Homo sapiens
cagacttctggaag

SEQ ID NO: 405859 - DNA, 21 bp, Homo sapiens
cagacttctggaaggctggct

SEQ ID NO: 405860 - DNA, 22 bp, Homo sapiens
cagacttctggaaggctggctg

SEQ ID NO: 405861 - DNA, 23 bp, Homo sapiens
cagacttctggaaggctggctga

SEQ ID NO: 405862 - DNA, 13 bp, Homo sapiens
cagacttgagaac

SEQ ID NO: 405863 - DNA, 15 bp, Homo sapiens
cagacttgtttcctg

SEQ ID NO: 405864 - DNA, 20 bp, Homo sapiens
cagacttgtttcctgtgccc

SEQ ID NO: 405865 - DNA, 20 bp, Homo sapiens
cagactttctacacctgttg

SEQ ID NO: 405866 - DNA, 20 bp, Homo sapiens
cagactttgcttcccattgt

SEQ ID NO: 405867 - DNA, 13 bp, Homo sapiens
cagagaaaacact

SEQ ID NO: 405868 - DNA, 23 bp, Homo sapiens
cagagaaaacactttcctggata

SEQ ID NO: 405869 - DNA, 19 bp, Homo sapiens
cagagaaaatcaaagcagt

SEQ ID NO: 405870 - DNA, 22 bp, Homo sapiens
cagagaagagaccaagcttgtt

SEQ ID NO: 405871 - DNA, 15 bp, Homo sapiens
cagagaaggcagcag

SEQ ID NO: 405872 - DNA, 16 bp, Homo sapiens
cagagaaggcagcagg

SEQ ID NO: 405873 - DNA, 14 bp, Homo sapiens
cagagaaggcctct

SEQ ID NO: 405874 - DNA, 21 bp, Homo sapiens
cagagaaggcctcttgtgctc

SEQ ID NO: 405875 - DNA, 22 bp, Homo sapiens
cagagaaggcctcttgtgctca

SEQ ID NO: 405876 - DNA, 16 bp, Homo sapiens
cagagaagtcagttgg

SEQ ID NO: 405877 - DNA, 11 bp, Homo sapiens
cagagaatata

SEQ ID NO: 405878 - DNA, 13 bp, Homo sapiens
cagagacaaggag

SEQ ID NO: 405879 - DNA, 20 bp, Homo sapiens
cagagacaaggagggcacag

SEQ ID NO: 405880 - DNA, 22 bp, Homo sapiens
cagagacaggaagtcttcaggg

SEQ ID NO: 405881 - DNA, 14 bp, Homo sapiens
cagagaccacacca

SEQ ID NO: 405882 - DNA, 16 bp, Homo sapiens
cagagaccacaccact

SEQ ID NO: 405883 - DNA, 17 bp, Homo sapiens
cagagaccgtgagcgcc

SEQ ID NO: 405884 - DNA, 17 bp, Homo sapiens
cagagacgcaggaatgg

SEQ ID NO: 405885 - DNA, 18 bp, Homo sapiens
cagagacgcaggaatgga

SEQ ID NO: 405886 - DNA, 14 bp, Homo sapiens
cagagacggcagcc

SEQ ID NO: 405887 - DNA, 16 bp, Homo sapiens
cagagacggcagcccc

SEQ ID NO: 405888 - DNA, 18 bp, Homo sapiens
cagagacggcagccccat

SEQ ID NO: 405889 - DNA, 18 bp, Homo sapiens
cagagactcccaggagtt

SEQ ID NO: 405890 - DNA, 16 bp, Homo sapiens
cagagactgcccaccc

SEQ ID NO: 405891 - DNA, 18 bp, Homo sapiens
cagagactgcccaccctg

SEQ ID NO: 405892 - DNA, 13 bp, Homo sapiens
cagagactggcag

SEQ ID NO: 405893 - DNA, 15 bp, Homo sapiens
cagagactggcagcc

SEQ ID NO: 405894 - DNA, 18 bp, Homo sapiens
cagagactggcagccagg

SEQ ID NO: 405895 - DNA, 19 bp, Homo sapiens
cagagactggcagccaggg

SEQ ID NO: 405896 - DNA, 12 bp, Homo sapiens
cagagacttcta

SEQ ID NO: 405897 - DNA, 12 bp, Homo sapiens
cagagagaaaaa

SEQ ID NO: 405898 - DNA, 13 bp, Homo sapiens
cagagagaaaaag

SEQ ID NO: 405899 - DNA, 16 bp, Homo sapiens
cagagagaaaaagaga

SEQ ID NO: 405900 - DNA, 16 bp, Homo sapiens
cagagagaatggcttt

SEQ ID NO: 405901 - DNA, 17 bp, Homo sapiens
cagagagacagacttga

SEQ ID NO: 405902 - DNA, 16 bp, Homo sapiens
cagagagaccctgcca

SEQ ID NO: 405903 - DNA, 19 bp, Homo sapiens
cagagagagaagtgcccct

SEQ ID NO: 405904 - DNA, 20 bp, Homo sapiens
cagagagagaagtgcccctg

SEQ ID NO: 405905 - DNA, 21 bp, Homo sapiens
cagagagagaagtgcccctgc

SEQ ID NO: 405906 - DNA, 22 bp, Homo sapiens
cagagagagaagtgcccctgct

SEQ ID NO: 405907 - DNA, 23 bp, Homo sapiens
cagagagagaagtgcccctgctg

SEQ ID NO: 405908 - DNA, 20 bp, Homo sapiens
cagagagaggcgtcctggtg

SEQ ID NO: 405909 - DNA, 19 bp, Homo sapiens
cagagagcctggtgctgct

SEQ ID NO: 405910 - DNA, 19 bp, Homo sapiens
cagagagctggtagttagt

SEQ ID NO: 405911 - DNA, 22 bp, Homo sapiens
cagagaggagaaacacatcttc

SEQ ID NO: 405912 - DNA, 16 bp, Homo sapiens
cagagaggagcacctg

SEQ ID NO: 405913 - DNA, 17 bp, Homo sapiens
cagagagggcccagctg

SEQ ID NO: 405914 - DNA, 20 bp, Homo sapiens
cagagagggcccagctgtag

SEQ ID NO: 405915 - DNA, 21 bp, Homo sapiens
cagagaggtcaagcccaggag

SEQ ID NO: 405916 - DNA, 13 bp, Homo sapiens
cagagagtggctc

SEQ ID NO: 405917 - DNA, 12 bp, Homo sapiens
cagagagttctg

SEQ ID NO: 405918 - DNA, 20 bp, Homo sapiens
cagagataaaccaataaatc

SEQ ID NO: 405919 - DNA, 15 bp, Homo sapiens
cagagatgggactgg

SEQ ID NO: 405920 - DNA, 22 bp, Homo sapiens
cagagatggtaatctacagctc

SEQ ID NO: 405921 - DNA, 14 bp, Homo sapiens
cagagatgtaccat

SEQ ID NO: 405922 - DNA, 16 bp, Homo sapiens
cagagattcccaagcc

SEQ ID NO: 405923 - DNA, 19 bp, Homo sapiens
cagagcaaatgagggaggg

SEQ ID NO: 405924 - DNA, 20 bp, Homo sapiens
cagagcaagactctgtctca

SEQ ID NO: 405925 - DNA, 19 bp, Homo sapiens
cagagcacctcaggaccct

SEQ ID NO: 405926 - DNA, 20 bp, Homo sapiens
cagagcactgggttgcaggg

SEQ ID NO: 405927 - DNA, 11 bp, Homo sapiens
cagagcagcct

SEQ ID NO: 405928 - DNA, 22 bp, Homo sapiens
cagagcagcctctgtcctggct

SEQ ID NO: 405929 - DNA, 18 bp, Homo sapiens
cagagcagctccccagga

SEQ ID NO: 405930 - DNA, 18 bp, Homo sapiens
cagagcaggaaatgagag

SEQ ID NO: 405931 - DNA, 15 bp, Homo sapiens
cagagcaggaggccc

SEQ ID NO: 405932 - DNA, 17 bp, Homo sapiens
cagagcaggtctgcagg

SEQ ID NO: 405933 - DNA, 21 bp, Homo sapiens
cagagcaggtctgcaggccac

SEQ ID NO: 405934 - DNA, 22 bp, Homo sapiens
cagagcaggtctgcaggccacc

SEQ ID NO: 405935 - DNA, 20 bp, Homo sapiens
cagagcagtgattctctctt

SEQ ID NO: 405936 - DNA, 18 bp, Homo sapiens
cagagcatgtgtcagagt

SEQ ID NO: 405937 - DNA, 11 bp, Homo sapiens
cagagccaagt

SEQ ID NO: 405938 - DNA, 13 bp, Homo sapiens
cagagccagcctg

SEQ ID NO: 405939 - DNA, 14 bp, Homo sapiens
cagagccagcctgg

SEQ ID NO: 405940 - DNA, 10 bp, Homo sapiens
cagagccagg

SEQ ID NO: 405941 - DNA, 13 bp, Homo sapiens
cagagccagggct

SEQ ID NO: 405942 - DNA, 18 bp, Homo sapiens
cagagccagggctgtcct

SEQ ID NO: 405943 - DNA, 19 bp, Homo sapiens
cagagccagggctgtcctt

SEQ ID NO: 405944 - DNA, 20 bp, Homo sapiens
cagagccagggctgtcctta

SEQ ID NO: 405945 - DNA, 11 bp, Homo sapiens
cagagccagtg

SEQ ID NO: 405946 - DNA, 13 bp, Homo sapiens
cagagccagtgaa

SEQ ID NO: 405947 - DNA, 14 bp, Homo sapiens
cagagccagtgaag

SEQ ID NO: 405948 - DNA, 14 bp, Homo sapiens
cagagccatgggcc

SEQ ID NO: 405949 - DNA, 16 bp, Homo sapiens
cagagccatgggcctg

SEQ ID NO: 405950 - DNA, 18 bp, Homo sapiens
cagagccatgggcctggg

SEQ ID NO: 405951 - DNA, 19 bp, Homo sapiens
cagagccatgggcctgggc

SEQ ID NO: 405952 - DNA, 23 bp, Homo sapiens
cagagccatgggcctgggcctgc

SEQ ID NO: 405953 - DNA, 15 bp, Homo sapiens
cagagccccccacaa

SEQ ID NO: 405954 - DNA, 14 bp, Homo sapiens
cagagccccggagc

SEQ ID NO: 405955 - DNA, 16 bp, Homo sapiens
cagagcccgcccacct

SEQ ID NO: 405956 - DNA, 22 bp, Homo sapiens
cagagcccgcccacctgggccc

SEQ ID NO: 405957 - DNA, 15 bp, Homo sapiens
ctacccttgccaagg

SEQ ID NO: 405958 - DNA, 17 bp, Homo sapiens
ctacccttgccaaggcc

SEQ ID NO: 405959 - DNA, 19 bp, Homo sapiens
ctaccgagtctcttctcca

SEQ ID NO: 405960 - DNA, 21 bp, Homo sapiens
ctaccgagtctcttctccact

SEQ ID NO: 405961 - DNA, 16 bp, Homo sapiens
ctaccgatggtcccag

SEQ ID NO: 405962 - DNA, 15 bp, Homo sapiens
ctaccgccctgggct

SEQ ID NO: 405963 - DNA, 20 bp, Homo sapiens
ctaccgccctgggctggact

SEQ ID NO: 405964 - DNA, 19 bp, Homo sapiens
ctaccgggttctcctgatt

SEQ ID NO: 405965 - DNA, 23 bp, Homo sapiens
ctacctcaggcaggaagggcagg

SEQ ID NO: 405966 - DNA, 17 bp, Homo sapiens
ctacctctaacaccaca

SEQ ID NO: 405967 - DNA, 18 bp, Homo sapiens
ctacctctccagcctcag

SEQ ID NO: 405968 - DNA, 23 bp, Homo sapiens
ctacctcttttgagactttgccc

SEQ ID NO: 405969 - DNA, 22 bp, Homo sapiens
ctacctgaacacttattgcttt

SEQ ID NO: 405970 - DNA, 15 bp, Homo sapiens
ctacctgcaggactc

SEQ ID NO: 405971 - DNA, 14 bp, Homo sapiens
ctacctgtaacttt

SEQ ID NO: 405972 - DNA, 17 bp, Homo sapiens
ctacctgtgaatcatat

SEQ ID NO: 405973 - DNA, 14 bp, Homo sapiens
ctacctgtgagcat

SEQ ID NO: 405974 - DNA, 21 bp, Homo sapiens
ctacctgttcagtgtcccggg

SEQ ID NO: 405975 - DNA, 15 bp, Homo sapiens
ctaccttcaaagctg

SEQ ID NO: 405976 - DNA, 18 bp, Homo sapiens
ctaccttcatttcaggag

SEQ ID NO: 405977 - DNA, 16 bp, Homo sapiens
ctaccttctgacctcc

SEQ ID NO: 405978 - DNA, 22 bp, Homo sapiens
ctaccttgaggtcttttgacat

SEQ ID NO: 405979 - DNA, 21 bp, Homo sapiens
ctacctttggcttaattccaa

SEQ ID NO: 405980 - DNA, 20 bp, Homo sapiens
ctacctttttttctctccta

SEQ ID NO: 405981 - DNA, 20 bp, Homo sapiens
ctacggagggtgggctctga

SEQ ID NO: 405982 - DNA, 22 bp, Homo sapiens
ctacggttccctgcctaggagc

SEQ ID NO: 405983 - DNA, 14 bp, Homo sapiens
ctacgtataaatat

SEQ ID NO: 405984 - DNA, 14 bp, Homo sapiens
ctactaaaaatgca

SEQ ID NO: 405985 - DNA, 14 bp, Homo sapiens
ctactaacatccca

SEQ ID NO: 405986 - DNA, 16 bp, Homo sapiens
ctactaacatcccaat

SEQ ID NO: 405987 - DNA, 17 bp, Homo sapiens
ctactaacatcccaata

SEQ ID NO: 405988 - DNA, 16 bp, Homo sapiens
ctactaagaaaataga

SEQ ID NO: 405989 - DNA, 14 bp, Homo sapiens
ctactaatgatgtt

SEQ ID NO: 405990 - DNA, 14 bp, Homo sapiens
ctactaatttttag

SEQ ID NO: 405991 - DNA, 16 bp, Homo sapiens
ctactacatcgccctc

SEQ ID NO: 405992 - DNA, 15 bp, Homo sapiens
ctactacccgagccc

SEQ ID NO: 405993 - DNA, 14 bp, Homo sapiens
ctactactctgtct

SEQ ID NO: 405994 - DNA, 18 bp, Homo sapiens
ctactcacagtctcttta

SEQ ID NO: 405995 - DNA, 18 bp, Homo sapiens
ctactcaggagactgagt

SEQ ID NO: 405996 - DNA, 14 bp, Homo sapiens
ctactcatgccaga

SEQ ID NO: 405997 - DNA, 17 bp, Homo sapiens
ctactcctacctggtca

SEQ ID NO: 405998 - DNA, 14 bp, Homo sapiens
ctactcctctgcag

SEQ ID NO: 405999 - DNA, 15 bp, Homo sapiens
ctactcctctgcagt

SEQ ID NO: 406000 - DNA, 15 bp, Homo sapiens
ctactcgagttacag

SEQ ID NO: 406001 - DNA, 12 bp, Homo sapiens
ctactctcctca

SEQ ID NO: 406002 - DNA, 17 bp, Homo sapiens
ctactctcctcatctct

SEQ ID NO: 406003 - DNA, 13 bp, Homo sapiens
ctactctgtccag

SEQ ID NO: 406004 - DNA, 15 bp, Homo sapiens
ctactctgtccaggc

SEQ ID NO: 406005 - DNA, 19 bp, Homo sapiens
ctactctgtccaggccact

SEQ ID NO: 406006 - DNA, 13 bp, Homo sapiens
ctactcttaaata

SEQ ID NO: 406007 - DNA, 18 bp, Homo sapiens
ctactcttaaatatacaa

SEQ ID NO: 406008 - DNA, 21 bp, Homo sapiens
ctactctttgttttctttcct

SEQ ID NO: 406009 - DNA, 17 bp, Homo sapiens
ctactgaactgttacct

SEQ ID NO: 406010 - DNA, 15 bp, Homo sapiens
ctactgacatgtggg

SEQ ID NO: 406011 - DNA, 20 bp, Homo sapiens
ctactgacatgtggggccag

SEQ ID NO: 406012 - DNA, 14 bp, Homo sapiens
ctactgcagcttta

SEQ ID NO: 406013 - DNA, 17 bp, Homo sapiens
ctactggacttgaatgg

SEQ ID NO: 406014 - DNA, 23 bp, Homo sapiens
ctactggataaacttgcttcaga

SEQ ID NO: 406015 - DNA, 15 bp, Homo sapiens
ctactggcagctcct

SEQ ID NO: 406016 - DNA, 22 bp, Homo sapiens
ctactggcagctcctctccttg

SEQ ID NO: 406017 - DNA, 18 bp, Homo sapiens
ctactggcctctgtgcca

SEQ ID NO: 406018 - DNA, 15 bp, Homo sapiens
ctactggtaggaaga

SEQ ID NO: 406019 - DNA, 19 bp, Homo sapiens
ctactggtctgtactcctt

SEQ ID NO: 406020 - DNA, 20 bp, Homo sapiens
ctactggtttgtatgatgta

SEQ ID NO: 406021 - DNA, 14 bp, Homo sapiens
ctactgtctccttc

SEQ ID NO: 406022 - DNA, 18 bp, Homo sapiens
ctactgtctccttcccac

SEQ ID NO: 406023 - DNA, 22 bp, Homo sapiens
ctactgtctccttcccactgtc

SEQ ID NO: 406024 - DNA, 13 bp, Homo sapiens
ctactgtgttcct

SEQ ID NO: 406025 - DNA, 15 bp, Homo sapiens
ctactgtgttcctgg

SEQ ID NO: 406026 - DNA, 20 bp, Homo sapiens
ctactgtgttcctggcaata

SEQ ID NO: 406027 - DNA, 22 bp, Homo sapiens
ctacttagcatgtccctaccga

SEQ ID NO: 406028 - DNA, 12 bp, Homo sapiens
ctacttcagctt

SEQ ID NO: 406029 - DNA, 16 bp, Homo sapiens
ctacttcatagctcct

SEQ ID NO: 406030 - DNA, 12 bp, Homo sapiens
ctacttgggagg

SEQ ID NO: 406031 - DNA, 15 bp, Homo sapiens
ctacttgtttaacat

SEQ ID NO: 406032 - DNA, 13 bp, Homo sapiens
ctactttaaatcc

SEQ ID NO: 406033 - DNA, 20 bp, Homo sapiens
ctactttaaatcctaccaaa

SEQ ID NO: 406034 - DNA, 21 bp, Homo sapiens
ctactttaaatcctaccaaag

SEQ ID NO: 406035 - DNA, 22 bp, Homo sapiens
ctactttaaatcctaccaaagt

SEQ ID NO: 406036 - DNA, 15 bp, Homo sapiens
ctactttaagcacta

SEQ ID NO: 406037 - DNA, 14 bp, Homo sapiens
ctactttgtcccct

SEQ ID NO: 406038 - DNA, 18 bp, Homo sapiens
ctacttttacttgttcat

SEQ ID NO: 406039 - DNA, 12 bp, Homo sapiens
ctactttttcct

SEQ ID NO: 406040 - DNA, 15 bp, Homo sapiens
ctactttttccttcc

SEQ ID NO: 406041 - DNA, 16 bp, Homo sapiens
ctactttttccttcct

SEQ ID NO: 406042 - DNA, 22 bp, Homo sapiens
ctactttttccttcctgccctg

SEQ ID NO: 406043 - DNA, 13 bp, Homo sapiens
ctagaaaaaacat

SEQ ID NO: 406044 - DNA, 15 bp, Homo sapiens
ctagaaagccatatt

SEQ ID NO: 406045 - DNA, 16 bp, Homo sapiens
ctagaaagccatattc

SEQ ID NO: 406046 - DNA, 23 bp, Homo sapiens
ctagaaagtgaataaaaattaag

SEQ ID NO: 406047 - DNA, 20 bp, Homo sapiens
ctagaaagtggcagagccag

SEQ ID NO: 406048 - DNA, 22 bp, Homo sapiens
ctagaaagtggcagagccagga

SEQ ID NO: 406049 - DNA, 13 bp, Homo sapiens
ctagaaatatgat

SEQ ID NO: 406050 - DNA, 20 bp, Homo sapiens
ctagaagaaagtaaaaagaa

SEQ ID NO: 406051 - DNA, 21 bp, Homo sapiens
ctagaagaaagtaaaaagaac

SEQ ID NO: 406052 - DNA, 12 bp, Homo sapiens
ctagaatacttt

SEQ ID NO: 406053 - DNA, 14 bp, Homo sapiens
ctagaatacttttt

SEQ ID NO: 406054 - DNA, 22 bp, Homo sapiens
ctagaatcagcctaggggtcag

SEQ ID NO: 406055 - DNA, 23 bp, Homo sapiens
ctagaatttattcaattcctctg

SEQ ID NO: 406056 - DNA, 19 bp, Homo sapiens
ctagaattttaagtgcttt

SEQ ID NO: 406057 - DNA, 18 bp, Homo sapiens
ctagacaaaggcccagaa

SEQ ID NO: 406058 - DNA, 15 bp, Homo sapiens
ctagacaaccctgca

SEQ ID NO: 406059 - DNA, 16 bp, Homo sapiens
ctagacaaccctgcaa

SEQ ID NO: 406060 - DNA, 16 bp, Homo sapiens
ctagacaaggttgctg

SEQ ID NO: 406061 - DNA, 11 bp, Homo sapiens
ctagacactga

SEQ ID NO: 406062 - DNA, 19 bp, Homo sapiens
ctagacactgaaggcaaat

SEQ ID NO: 406063 - DNA, 17 bp, Homo sapiens
ctagacagtattgccac

SEQ ID NO: 406064 - DNA, 15 bp, Homo sapiens
ctagactaggagacc

SEQ ID NO: 406065 - DNA, 17 bp, Homo sapiens
ctagactaggagaccag

SEQ ID NO: 406066 - DNA, 16 bp, Homo sapiens
ctagacttcccaacag

SEQ ID NO: 406067 - DNA, 20 bp, Homo sapiens
ctagacttcccaacagcctt

SEQ ID NO: 406068 - DNA, 21 bp, Homo sapiens
ctagacttcccaacagcctta

SEQ ID NO: 406069 - DNA, 13 bp, Homo sapiens
ctagacttcccca

SEQ ID NO: 406070 - DNA, 23 bp, Homo sapiens
ctagacttgaaagttttccagta

SEQ ID NO: 406071 - DNA, 13 bp, Homo sapiens
ctagactttctgt

SEQ ID NO: 406072 - DNA, 14 bp, Homo sapiens
ctagactttctgtt

SEQ ID NO: 406073 - DNA, 15 bp, Homo sapiens
ctagagacaaatctt

SEQ ID NO: 406074 - DNA, 18 bp, Homo sapiens
ctagagacgcaccttgct

SEQ ID NO: 406075 - DNA, 13 bp, Homo sapiens
ctagagaggggcc

SEQ ID NO: 406076 - DNA, 19 bp, Homo sapiens
ctagagaggggcctctggc

SEQ ID NO: 406077 - DNA, 23 bp, Homo sapiens
ctagagaggggcctctggctgcc

SEQ ID NO: 406078 - DNA, 20 bp, Homo sapiens
ctagagattcttagctcttg

SEQ ID NO: 406079 - DNA, 22 bp, Homo sapiens
ctagagattcttagctcttggg

SEQ ID NO: 406080 - DNA, 21 bp, Homo sapiens
ctagagcaacccctgtaccca

SEQ ID NO: 406081 - DNA, 23 bp, Homo sapiens
ctagagcaacccctgtacccagc

SEQ ID NO: 406082 - DNA, 18 bp, Homo sapiens
ctagagcatctgtcccac

SEQ ID NO: 406083 - DNA, 13 bp, Homo sapiens
ctagagcattctg

SEQ ID NO: 406084 - DNA, 16 bp, Homo sapiens
ctagagctaacagaca

SEQ ID NO: 406085 - DNA, 23 bp, Homo sapiens
ctagaggcaacagtgttctgagc

SEQ ID NO: 406086 - DNA, 22 bp, Homo sapiens
ctagaggcctgaggatgagctg

SEQ ID NO: 406087 - DNA, 15 bp, Homo sapiens
ctagaggcgagccag

SEQ ID NO: 406088 - DNA, 24 bp, Homo sapiens
ctagaggctattcctaggcctcag

SEQ ID NO: 406089 - DNA, 22 bp, Homo sapiens
ctagaggcttgcataataagct

SEQ ID NO: 406090 - DNA, 14 bp, Homo sapiens
ctagaggtgggcag

SEQ ID NO: 406091 - DNA, 22 bp, Homo sapiens
cagagccctgccctgcaccctt

SEQ ID NO: 406092 - DNA, 14 bp, Homo sapiens
cagagccctggctg

SEQ ID NO: 406093 - DNA, 19 bp, Homo sapiens
cagagccctggctgggttc

SEQ ID NO: 406094 - DNA, 17 bp, Homo sapiens
cagagcccttcactgcc

SEQ ID NO: 406095 - DNA, 20 bp, Homo sapiens
cagagcccttcactgccatg

SEQ ID NO: 406096 - DNA, 17 bp, Homo sapiens
cagagccgttcctggga

SEQ ID NO: 406097 - DNA, 22 bp, Homo sapiens
cagagcctggtagagactaggg

SEQ ID NO: 406098 - DNA, 13 bp, Homo sapiens
cagagcctgtccc

SEQ ID NO: 406099 - DNA, 15 bp, Homo sapiens
cagagcgcccctccc

SEQ ID NO: 406100 - DNA, 17 bp, Homo sapiens
cagagcgtccttccccc

SEQ ID NO: 406101 - DNA, 22 bp, Homo sapiens
cagagcgtccttccccctgtag

SEQ ID NO: 406102 - DNA, 23 bp, Homo sapiens
cagagcgtccttccccctgtaga

SEQ ID NO: 406103 - DNA, 16 bp, Homo sapiens
cagagctatggtgagg

SEQ ID NO: 406104 - DNA, 12 bp, Homo sapiens
cagagctcagag

SEQ ID NO: 406105 - DNA, 18 bp, Homo sapiens
cagagctcagcacagcct

SEQ ID NO: 406106 - DNA, 15 bp, Homo sapiens
cagagctccacagaa

SEQ ID NO: 406107 - DNA, 16 bp, Homo sapiens
cagagctccacagaag

SEQ ID NO: 406108 - DNA, 14 bp, Homo sapiens
cagagctcccagga

SEQ ID NO: 406109 - DNA, 17 bp, Homo sapiens
cagagctcccaggacgc

SEQ ID NO: 406110 - DNA, 19 bp, Homo sapiens
cagagctctggagccacct

SEQ ID NO: 406111 - DNA, 22 bp, Homo sapiens
cagagctcttcaagctgtcccc

SEQ ID NO: 406112 - DNA, 18 bp, Homo sapiens
cagagctgagtcggctgg

SEQ ID NO: 406113 - DNA, 23 bp, Homo sapiens
cagagctgagtcggctgggcagg

SEQ ID NO: 406114 - DNA, 16 bp, Homo sapiens
cagagctggaaggcag

SEQ ID NO: 406115 - DNA, 20 bp, Homo sapiens
cagagctggaaggcagggca

SEQ ID NO: 406116 - DNA, 23 bp, Homo sapiens
cagagctggaccagtggtgcctt

SEQ ID NO: 406117 - DNA, 16 bp, Homo sapiens
cagagctggggggaag

SEQ ID NO: 406118 - DNA, 13 bp, Homo sapiens
cagagctgggtga

SEQ ID NO: 406119 - DNA, 17 bp, Homo sapiens
cagagctgggtggggac

SEQ ID NO: 406120 - DNA, 19 bp, Homo sapiens
cagagctgtctggtgatca

SEQ ID NO: 406121 - DNA, 17 bp, Homo sapiens
cagagcttattggccac

SEQ ID NO: 406122 - DNA, 19 bp, Homo sapiens
cagagcttattggccactg

SEQ ID NO: 406123 - DNA, 21 bp, Homo sapiens
cagagcttattggccactggg

SEQ ID NO: 406124 - DNA, 24 bp, Homo sapiens
cagaggaaaaacagaggatgctga

SEQ ID NO: 406125 - DNA, 13 bp, Homo sapiens
cagaggacagatc

SEQ ID NO: 406126 - DNA, 23 bp, Homo sapiens
cagaggacagatcaatggcgcag

SEQ ID NO: 406127 - DNA, 12 bp, Homo sapiens
cagaggaccaca

SEQ ID NO: 406128 - DNA, 15 bp, Homo sapiens
cagaggaccacagtg

SEQ ID NO: 406129 - DNA, 18 bp, Homo sapiens
cagaggaccacagtgggt

SEQ ID NO: 406130 - DNA, 21 bp, Homo sapiens
cagaggaccacagtgggtggc

SEQ ID NO: 406131 - DNA, 16 bp, Homo sapiens
cagaggagagacggtg

SEQ ID NO: 406132 - DNA, 17 bp, Homo sapiens
cagaggagagtaccccc

SEQ ID NO: 406133 - DNA, 23 bp, Homo sapiens
cagaggagagtacccccctgaga

SEQ ID NO: 406134 - DNA, 23 bp, Homo sapiens
cagaggagagtcccagagcagga

SEQ ID NO: 406135 - DNA, 20 bp, Homo sapiens
cagaggagccacctgggctg

SEQ ID NO: 406136 - DNA, 21 bp, Homo sapiens
cagaggagccacctgggctgg

SEQ ID NO: 406137 - DNA, 23 bp, Homo sapiens
cagaggagccacctgggctggga

SEQ ID NO: 406138 - DNA, 22 bp, Homo sapiens
cagaggagggatagagacgcag

SEQ ID NO: 406139 - DNA, 22 bp, Homo sapiens
cagaggagtctgggaaggggcg

SEQ ID NO: 406140 - DNA, 16 bp, Homo sapiens
cagaggcacagccggg

SEQ ID NO: 406141 - DNA, 13 bp, Homo sapiens
cagaggcacctca

SEQ ID NO: 406142 - DNA, 13 bp, Homo sapiens
cagaggcagaacc

SEQ ID NO: 406143 - DNA, 15 bp, Homo sapiens
cagaggcagcaggag

SEQ ID NO: 406144 - DNA, 15 bp, Homo sapiens
cagaggcagggccct

SEQ ID NO: 406145 - DNA, 15 bp, Homo sapiens
cagaggcagtggcag

SEQ ID NO: 406146 - DNA, 23 bp, Homo sapiens
cagaggcctcccccagccaggac

SEQ ID NO: 406147 - DNA, 15 bp, Homo sapiens
cagaggctcctggag

SEQ ID NO: 406148 - DNA, 17 bp, Homo sapiens
cagaggctcctggagcc

SEQ ID NO: 406149 - DNA, 19 bp, Homo sapiens
cagaggctcctggagccag

SEQ ID NO: 406150 - DNA, 15 bp, Homo sapiens
cagaggctgagcagg

SEQ ID NO: 406151 - DNA, 14 bp, Homo sapiens
cagaggctggcctc

SEQ ID NO: 406152 - DNA, 16 bp, Homo sapiens
cagaggctggcctcag

SEQ ID NO: 406153 - DNA, 15 bp, Homo sapiens
cagagggagaaggga

SEQ ID NO: 406154 - DNA, 16 bp, Homo sapiens
cagagggagaagggag

SEQ ID NO: 406155 - DNA, 17 bp, Homo sapiens
cagagggagaagggaga

SEQ ID NO: 406156 - DNA, 22 bp, Homo sapiens
cagagggagaagggagaacagg

SEQ ID NO: 406157 - DNA, 22 bp, Homo sapiens
cagagggaggaatcgaggaacc

SEQ ID NO: 406158 - DNA, 12 bp, Homo sapiens
cagaggggacag

SEQ ID NO: 406159 - DNA, 14 bp, Homo sapiens
cagaggggagagga

SEQ ID NO: 406160 - DNA, 17 bp, Homo sapiens
cagaggggagaggaagc

SEQ ID NO: 406161 - DNA, 20 bp, Homo sapiens
cagaggggcggggccaggat

SEQ ID NO: 406162 - DNA, 21 bp, Homo sapiens
cagaggggcggggccaggatg

SEQ ID NO: 406163 - DNA, 20 bp, Homo sapiens
cagaggtggctctggaatga

SEQ ID NO: 406164 - DNA, 14 bp, Homo sapiens
cagaggtggggaag

SEQ ID NO: 406165 - DNA, 19 bp, Homo sapiens
cagaggttatctgcctggc

SEQ ID NO: 406166 - DNA, 20 bp, Homo sapiens
cagaggttatctgcctggcc

SEQ ID NO: 406167 - DNA, 23 bp, Homo sapiens
cagaggttatctgcctggcctgg

SEQ ID NO: 406168 - DNA, 21 bp, Homo sapiens
cagaggttctttgagggactg

SEQ ID NO: 406169 - DNA, 16 bp, Homo sapiens
cagaggtttctagggt

SEQ ID NO: 406170 - DNA, 21 bp, Homo sapiens
cagagtagcccaggtcactgt

SEQ ID NO: 406171 - DNA, 16 bp, Homo sapiens
cagagtaggtgggtct

SEQ ID NO: 406172 - DNA, 17 bp, Homo sapiens
cagagtatatatgtaca

SEQ ID NO: 406173 - DNA, 22 bp, Homo sapiens
cagagtcagccattcctgttct

SEQ ID NO: 406174 - DNA, 16 bp, Homo sapiens
cagagtccaatttaag

SEQ ID NO: 406175 - DNA, 17 bp, Homo sapiens
cagagtccaatttaagg

SEQ ID NO: 406176 - DNA, 23 bp, Homo sapiens
cagagtctcgctctgttgcccag

SEQ ID NO: 406177 - DNA, 17 bp, Homo sapiens
cagagtctgacaggaag

SEQ ID NO: 406178 - DNA, 22 bp, Homo sapiens
cagagtctgacaggaagactgg

SEQ ID NO: 406179 - DNA, 12 bp, Homo sapiens
cagagtctgagc

SEQ ID NO: 406180 - DNA, 14 bp, Homo sapiens
cagagtctgagccc

SEQ ID NO: 406181 - DNA, 18 bp, Homo sapiens
cagagtctggcctgccag

SEQ ID NO: 406182 - DNA, 24 bp, Homo sapiens
cagagtctggcctgccaggctcct

SEQ ID NO: 406183 - DNA, 16 bp, Homo sapiens
cagagtctgggcctct

SEQ ID NO: 406184 - DNA, 24 bp, Homo sapiens
cagagtctgggcctctgactctga

SEQ ID NO: 406185 - DNA, 12 bp, Homo sapiens
cagagtgcccca

SEQ ID NO: 406186 - DNA, 17 bp, Homo sapiens
cagagtgccccacctgc

SEQ ID NO: 406187 - DNA, 18 bp, Homo sapiens
cagagtgccccacctgcc

SEQ ID NO: 406188 - DNA, 19 bp, Homo sapiens
cagagtgccccacctgcca

SEQ ID NO: 406189 - DNA, 20 bp, Homo sapiens
cagagtgccccacctgccac

SEQ ID NO: 406190 - DNA, 12 bp, Homo sapiens
cagagtggactc

SEQ ID NO: 406191 - DNA, 20 bp, Homo sapiens
cagagtggccaatccctgtg

SEQ ID NO: 406192 - DNA, 15 bp, Homo sapiens
cagagtggcctggcc

SEQ ID NO: 406193 - DNA, 15 bp, Homo sapiens
cagagtggtctttct

SEQ ID NO: 406194 - DNA, 12 bp, Homo sapiens
cagagttcacta

SEQ ID NO: 406195 - DNA, 15 bp, Homo sapiens
cagagttcagggagg

SEQ ID NO: 406196 - DNA, 12 bp, Homo sapiens
cagagttctttg

SEQ ID NO: 406197 - DNA, 16 bp, Homo sapiens
cagagttctttgcaag

SEQ ID NO: 406198 - DNA, 14 bp, Homo sapiens
cagataaggaaact

SEQ ID NO: 406199 - DNA, 14 bp, Homo sapiens
cagataatcagtgt

SEQ ID NO: 406200 - DNA, 17 bp, Homo sapiens
cagataatcggtgcagc

SEQ ID NO: 406201 - DNA, 20 bp, Homo sapiens
cagatacacaagtgagggct

SEQ ID NO: 406202 - DNA, 17 bp, Homo sapiens
cagataccttgaaagga

SEQ ID NO: 406203 - DNA, 18 bp, Homo sapiens
cagataccttgaaaggaa

SEQ ID NO: 406204 - DNA, 15 bp, Homo sapiens
cagatactgaaacat

SEQ ID NO: 406205 - DNA, 13 bp, Homo sapiens
cagatagagctgg

SEQ ID NO: 406206 - DNA, 13 bp, Homo sapiens
cagatagtcccag

SEQ ID NO: 406207 - DNA, 20 bp, Homo sapiens
cagatataaatggctggttt

SEQ ID NO: 406208 - DNA, 22 bp, Homo sapiens
cagatatttatatttttatttt

SEQ ID NO: 406209 - DNA, 18 bp, Homo sapiens
cagatcaatggcgcagtg

SEQ ID NO: 406210 - DNA, 21 bp, Homo sapiens
cagatcaccagcccggcctgc

SEQ ID NO: 406211 - DNA, 16 bp, Homo sapiens
cagatcactactgcag

SEQ ID NO: 406212 - DNA, 23 bp, Homo sapiens
cagatcagaacatgaaatgccct

SEQ ID NO: 406213 - DNA, 23 bp, Homo sapiens
cagatccagactgtaagatgttg

SEQ ID NO: 406214 - DNA, 13 bp, Homo sapiens
cagatccatcggt

SEQ ID NO: 406215 - DNA, 22 bp, Homo sapiens
cagatcccagaaggacctcctg

SEQ ID NO: 406216 - DNA, 17 bp, Homo sapiens
cagatcccatccatcag

SEQ ID NO: 406217 - DNA, 22 bp, Homo sapiens
cagatcccatccatcagctccc

SEQ ID NO: 406218 - DNA, 14 bp, Homo sapiens
cagatccctcggtc

SEQ ID NO: 406219 - DNA, 16 bp, Homo sapiens
cagatccgcatgtgtc

SEQ ID NO: 406220 - DNA, 19 bp, Homo sapiens
cagatccgcatgtgtctgt

SEQ ID NO: 406221 - DNA, 21 bp, Homo sapiens
cagatccgcatgtgtctgtat

SEQ ID NO: 406222 - DNA, 20 bp, Homo sapiens
cagatcctccatttttgttg

SEQ ID NO: 406223 - DNA, 12 bp, Homo sapiens
cagatcctgctg

SEQ ID NO: 406224 - DNA, 15 bp, Homo sapiens
ctagaggtgggcagc

SEQ ID NO: 406225 - DNA, 17 bp, Homo sapiens
ctagaggtgggcagctg

SEQ ID NO: 406226 - DNA, 18 bp, Homo sapiens
ctagagtaattatctgtg

SEQ ID NO: 406227 - DNA, 17 bp, Homo sapiens
ctagagtagagtggagg

SEQ ID NO: 406228 - DNA, 16 bp, Homo sapiens
ctagataaaaagatgg

SEQ ID NO: 406229 - DNA, 23 bp, Homo sapiens
ctagataaaaagatggcctttgc

SEQ ID NO: 406230 - DNA, 17 bp, Homo sapiens
ctagataacttaaataa

SEQ ID NO: 406231 - DNA, 23 bp, Homo sapiens
ctagataacttaaataatttaag

SEQ ID NO: 406232 - DNA, 16 bp, Homo sapiens
ctagatatgagaaata

SEQ ID NO: 406233 - DNA, 18 bp, Homo sapiens
ctagatcaattaattctt

SEQ ID NO: 406234 - DNA, 21 bp, Homo sapiens
ctagatctcctgtaattttgt

SEQ ID NO: 406235 - DNA, 16 bp, Homo sapiens
ctagatcttacatctg

SEQ ID NO: 406236 - DNA, 16 bp, Homo sapiens
ctagatggcagtcact

SEQ ID NO: 406237 - DNA, 16 bp, Homo sapiens
ctagatgtttaacaaa

SEQ ID NO: 406238 - DNA, 19 bp, Homo sapiens
ctagatttctagaaaagct

SEQ ID NO: 406239 - DNA, 21 bp, Homo sapiens
ctagatttctagaaaagcttc

SEQ ID NO: 406240 - DNA, 22 bp, Homo sapiens
ctagatttctagaaaagcttcc

SEQ ID NO: 406241 - DNA, 13 bp, Homo sapiens
ctagcaagaagat

SEQ ID NO: 406242 - DNA, 21 bp, Homo sapiens
ctagcaagaagattctaaaac

SEQ ID NO: 406243 - DNA, 20 bp, Homo sapiens
ctagcacaaggagtgcccgc

SEQ ID NO: 406244 - DNA, 14 bp, Homo sapiens
ctagcacagctgtg

SEQ ID NO: 406245 - DNA, 18 bp, Homo sapiens
ctagcagagcgtctggca

SEQ ID NO: 406246 - DNA, 17 bp, Homo sapiens
ctagcagggaacactaa

SEQ ID NO: 406247 - DNA, 22 bp, Homo sapiens
ctagcagtgatgaaaatgaatc

SEQ ID NO: 406248 - DNA, 13 bp, Homo sapiens
ctagcatccctga

SEQ ID NO: 406249 - DNA, 15 bp, Homo sapiens
ctagccaaagagctc

SEQ ID NO: 406250 - DNA, 22 bp, Homo sapiens
ctagccaacccaactgacttct

SEQ ID NO: 406251 - DNA, 23 bp, Homo sapiens
ctagccaaggctagttcctttca

SEQ ID NO: 406252 - DNA, 20 bp, Homo sapiens
ctagccagagaatagatcag

SEQ ID NO: 406253 - DNA, 12 bp, Homo sapiens
ctagccaggagt

SEQ ID NO: 406254 - DNA, 20 bp, Homo sapiens
ctagccaggagtctgtgctc

SEQ ID NO: 406255 - DNA, 13 bp, Homo sapiens
ctagccaggcctc

SEQ ID NO: 406256 - DNA, 14 bp, Homo sapiens
ctagccaggcctcc

SEQ ID NO: 406257 - DNA, 15 bp, Homo sapiens
ctagccaggcctccc

SEQ ID NO: 406258 - DNA, 23 bp, Homo sapiens
ctagccaggcctcccgcatgctg

SEQ ID NO: 406259 - DNA, 14 bp, Homo sapiens
ctagcccaccctgc

SEQ ID NO: 406260 - DNA, 17 bp, Homo sapiens
ctagcccaccctgctgc

SEQ ID NO: 406261 - DNA, 21 bp, Homo sapiens
ctagcccaccctgctgccttc

SEQ ID NO: 406262 - DNA, 13 bp, Homo sapiens
ctagcccagtccc

SEQ ID NO: 406263 - DNA, 22 bp, Homo sapiens
ctagcccagtccctggagctgt

SEQ ID NO: 406264 - DNA, 18 bp, Homo sapiens
ctagccctctttctctct

SEQ ID NO: 406265 - DNA, 19 bp, Homo sapiens
ctagccctctttctctctg

SEQ ID NO: 406266 - DNA, 20 bp, Homo sapiens
ctagccctctttctctctgt

SEQ ID NO: 406267 - DNA, 21 bp, Homo sapiens
ctagccctctttctctctgtg

SEQ ID NO: 406268 - DNA, 15 bp, Homo sapiens
ctagcctgggccaga

SEQ ID NO: 406269 - DNA, 17 bp, Homo sapiens
ctagcctgggccagaga

SEQ ID NO: 406270 - DNA, 19 bp, Homo sapiens
ctagcgagccgcctctggt

SEQ ID NO: 406271 - DNA, 16 bp, Homo sapiens
ctagcgctctcttcca

SEQ ID NO: 406272 - DNA, 21 bp, Homo sapiens
ctagctagaaatatgatttta

SEQ ID NO: 406273 - DNA, 13 bp, Homo sapiens
ctagctatttcta

SEQ ID NO: 406274 - DNA, 12 bp, Homo sapiens
ctagctggcagg

SEQ ID NO: 406275 - DNA, 13 bp, Homo sapiens
ctagctggcagga

SEQ ID NO: 406276 - DNA, 18 bp, Homo sapiens
ctaggaaaggcagaaaca

SEQ ID NO: 406277 - DNA, 22 bp, Homo sapiens
ctaggacatgttcccttctcct

SEQ ID NO: 406278 - DNA, 16 bp, Homo sapiens
ctaggactcaggcctg

SEQ ID NO: 406279 - DNA, 12 bp, Homo sapiens
ctaggactgagg

SEQ ID NO: 406280 - DNA, 17 bp, Homo sapiens
ctaggactttagggatc

SEQ ID NO: 406281 - DNA, 12 bp, Homo sapiens
ctaggagctggg

SEQ ID NO: 406282 - DNA, 19 bp, Homo sapiens
ctaggaggatgctgtgcct

SEQ ID NO: 406283 - DNA, 23 bp, Homo sapiens
ctaggataatttttaaaagagga

SEQ ID NO: 406284 - DNA, 15 bp, Homo sapiens
ctaggatagcttcat

SEQ ID NO: 406285 - DNA, 14 bp, Homo sapiens
ctaggattcctccc

SEQ ID NO: 406286 - DNA, 23 bp, Homo sapiens
ctaggattcctcccccagagcca

SEQ ID NO: 406287 - DNA, 23 bp, Homo sapiens
ctaggcagttagagatgcctccc

SEQ ID NO: 406288 - DNA, 19 bp, Homo sapiens
ctaggcatctcctctcccc

SEQ ID NO: 406289 - DNA, 20 bp, Homo sapiens
ctaggccaaatgcacaagct

SEQ ID NO: 406290 - DNA, 22 bp, Homo sapiens
ctaggccaaatgcacaagctca

SEQ ID NO: 406291 - DNA, 22 bp, Homo sapiens
ctaggcccccaaattgccttca

SEQ ID NO: 406292 - DNA, 17 bp, Homo sapiens
ctaggccggccagctcc

SEQ ID NO: 406293 - DNA, 20 bp, Homo sapiens
ctaggcgaggcgaagctgag

SEQ ID NO: 406294 - DNA, 21 bp, Homo sapiens
ctaggcgaggcgaagctgagc

SEQ ID NO: 406295 - DNA, 22 bp, Homo sapiens
ctaggcgcggttcaggtcaggg

SEQ ID NO: 406296 - DNA, 16 bp, Homo sapiens
ctaggctgagatgcac

SEQ ID NO: 406297 - DNA, 17 bp, Homo sapiens
ctaggctgggtgcccac

SEQ ID NO: 406298 - DNA, 18 bp, Homo sapiens
ctaggctgggtgcccaca

SEQ ID NO: 406299 - DNA, 21 bp, Homo sapiens
ctaggctgggtgcccacagcc

SEQ ID NO: 406300 - DNA, 20 bp, Homo sapiens
ctagggaagaaagcagaaca

SEQ ID NO: 406301 - DNA, 16 bp, Homo sapiens
ctagggaaggccacct

SEQ ID NO: 406302 - DNA, 20 bp, Homo sapiens
ctagggaaggccacctgcag

SEQ ID NO: 406303 - DNA, 10 bp, Homo sapiens
ctagggagcc

SEQ ID NO: 406304 - DNA, 14 bp, Homo sapiens
ctagggaggacctt

SEQ ID NO: 406305 - DNA, 17 bp, Homo sapiens
ctaggggagaagagccc

SEQ ID NO: 406306 - DNA, 20 bp, Homo sapiens
ctaggggagaagagccctgg

SEQ ID NO: 406307 - DNA, 15 bp, Homo sapiens
ctaggggtcactgta

SEQ ID NO: 406308 - DNA, 16 bp, Homo sapiens
ctaggggtcaggctcc

SEQ ID NO: 406309 - DNA, 21 bp, Homo sapiens
ctaggggtcagggaccaagga

SEQ ID NO: 406310 - DNA, 23 bp, Homo sapiens
ctaggggtgcgctcacctgcagc

SEQ ID NO: 406311 - DNA, 16 bp, Homo sapiens
ctagggtcttgggggt

SEQ ID NO: 406312 - DNA, 15 bp, Homo sapiens
ctagggttgctggag

SEQ ID NO: 406313 - DNA, 15 bp, Homo sapiens
ctagggttttggcct

SEQ ID NO: 406314 - DNA, 19 bp, Homo sapiens
ctagggttttggcctgcct

SEQ ID NO: 406315 - DNA, 16 bp, Homo sapiens
ctaggtcaaggcctgt

SEQ ID NO: 406316 - DNA, 20 bp, Homo sapiens
ctaggtcaaggcctgtccct

SEQ ID NO: 406317 - DNA, 17 bp, Homo sapiens
ctaggtcagcttgctgc

SEQ ID NO: 406318 - DNA, 15 bp, Homo sapiens
ctaggtctccacccc

SEQ ID NO: 406319 - DNA, 17 bp, Homo sapiens
ctaggtctccacccctc

SEQ ID NO: 406320 - DNA, 21 bp, Homo sapiens
ctaggtgggccagcccctccc

SEQ ID NO: 406321 - DNA, 22 bp, Homo sapiens
ctaggtgggtcaactccaaggc

SEQ ID NO: 406322 - DNA, 16 bp, Homo sapiens
ctaggtgtccccaacg

SEQ ID NO: 406323 - DNA, 16 bp, Homo sapiens
ctaggttgtttttaaa

SEQ ID NO: 406324 - DNA, 15 bp, Homo sapiens
ctaggtttaactcag

SEQ ID NO: 406325 - DNA, 20 bp, Homo sapiens
ctaggtttaactcagatcac

SEQ ID NO: 406326 - DNA, 19 bp, Homo sapiens
ctagtaccctatagagagg

SEQ ID NO: 406327 - DNA, 13 bp, Homo sapiens
ctagtactattac

SEQ ID NO: 406328 - DNA, 13 bp, Homo sapiens
ctagtactattat

SEQ ID NO: 406329 - DNA, 16 bp, Homo sapiens
ctagtactctctgctc

SEQ ID NO: 406330 - DNA, 19 bp, Homo sapiens
ctagtactctctgctctag

SEQ ID NO: 406331 - DNA, 11 bp, Homo sapiens
ctagtactgta

SEQ ID NO: 406332 - DNA, 15 bp, Homo sapiens
ctagtagagcaaaga

SEQ ID NO: 406333 - DNA, 14 bp, Homo sapiens
ctagtaggagctga

SEQ ID NO: 406334 - DNA, 16 bp, Homo sapiens
ctagtcaataaacctg

SEQ ID NO: 406335 - DNA, 21 bp, Homo sapiens
ctagtccccctgttttctgtt

SEQ ID NO: 406336 - DNA, 14 bp, Homo sapiens
ctagtcccttcccc

SEQ ID NO: 406337 - DNA, 17 bp, Homo sapiens
ctagtcccttcccctcc

SEQ ID NO: 406338 - DNA, 21 bp, Homo sapiens
ctagtcccttcccctccctgg

SEQ ID NO: 406339 - DNA, 15 bp, Homo sapiens
ctagtctcctttgca

SEQ ID NO: 406340 - DNA, 19 bp, Homo sapiens
ctagtctcctttgcactga

SEQ ID NO: 406341 - DNA, 21 bp, Homo sapiens
ctagtctcctttgcactgagg

SEQ ID NO: 406342 - DNA, 17 bp, Homo sapiens
ctagtctctgatttgca

SEQ ID NO: 406343 - DNA, 22 bp, Homo sapiens
ctagtgaattttttaaatgaaa

SEQ ID NO: 406344 - DNA, 14 bp, Homo sapiens
ctagtgacttcctg

SEQ ID NO: 406345 - DNA, 18 bp, Homo sapiens
ctagtgacttcctggtga

SEQ ID NO: 406346 - DNA, 19 bp, Homo sapiens
ctagtgacttgtgtcccat

SEQ ID NO: 406347 - DNA, 22 bp, Homo sapiens
ctagtgagcaaaatatgcccct

SEQ ID NO: 406348 - DNA, 23 bp, Homo sapiens
ctagtgatgtagaaagatacact

SEQ ID NO: 406349 - DNA, 12 bp, Homo sapiens
ctagtgctgaag

SEQ ID NO: 406350 - DNA, 15 bp, Homo sapiens
ctagtgctgaagctt

SEQ ID NO: 406351 - DNA, 17 bp, Homo sapiens
ctagtgctgaagcttat

SEQ ID NO: 406352 - DNA, 15 bp, Homo sapiens
ctagtggcttcaaaa

SEQ ID NO: 406353 - DNA, 14 bp, Homo sapiens
ctagtggcttcagc

SEQ ID NO: 406354 - DNA, 19 bp, Homo sapiens
ctagtggcttcagcccctg

SEQ ID NO: 406355 - DNA, 16 bp, Homo sapiens
ctagtgggagcccagc

SEQ ID NO: 406356 - DNA, 17 bp, Homo sapiens
ctagtgggagcccagca

SEQ ID NO: 406357 - DNA, 15 bp, Homo sapiens
cagatcctgctgccg

SEQ ID NO: 406358 - DNA, 21 bp, Homo sapiens
cagatcgttctgccacttgca

SEQ ID NO: 406359 - DNA, 14 bp, Homo sapiens
cagatctagccagg

SEQ ID NO: 406360 - DNA, 15 bp, Homo sapiens
cagatctagccaggc

SEQ ID NO: 406361 - DNA, 22 bp, Homo sapiens
cagatctagccaggcctcccgc

SEQ ID NO: 406362 - DNA, 14 bp, Homo sapiens
cagatctgaacaca

SEQ ID NO: 406363 - DNA, 12 bp, Homo sapiens
cagatctgcctg

SEQ ID NO: 406364 - DNA, 13 bp, Homo sapiens
cagatctgcctgg

SEQ ID NO: 406365 - DNA, 14 bp, Homo sapiens
cagatctgcctggg

SEQ ID NO: 406366 - DNA, 15 bp, Homo sapiens
cagatctgcctgggc

SEQ ID NO: 406367 - DNA, 16 bp, Homo sapiens
cagatctgcctgggcc

SEQ ID NO: 406368 - DNA, 18 bp, Homo sapiens
cagatctgcctgggcctg

SEQ ID NO: 406369 - DNA, 19 bp, Homo sapiens
cagatctgcctgggcctgt

SEQ ID NO: 406370 - DNA, 17 bp, Homo sapiens
cagatctggtcccttgc

SEQ ID NO: 406371 - DNA, 20 bp, Homo sapiens
cagatctggtctagttaacc

SEQ ID NO: 406372 - DNA, 15 bp, Homo sapiens
cagatctgtgcccca

SEQ ID NO: 406373 - DNA, 21 bp, Homo sapiens
cagatctgtgccccatgcctg

SEQ ID NO: 406374 - DNA, 17 bp, Homo sapiens
cagatgaaaataaaata

SEQ ID NO: 406375 - DNA, 18 bp, Homo sapiens
cagatgaaaataaaataa

SEQ ID NO: 406376 - DNA, 14 bp, Homo sapiens
cagatgaaaatttg

SEQ ID NO: 406377 - DNA, 15 bp, Homo sapiens
cagatgaaaatttga

SEQ ID NO: 406378 - DNA, 18 bp, Homo sapiens
cagatgaaaggagacaat

SEQ ID NO: 406379 - DNA, 23 bp, Homo sapiens
cagatgaactctttctggcctgc

SEQ ID NO: 406380 - DNA, 16 bp, Homo sapiens
cagatgacacataaat

SEQ ID NO: 406381 - DNA, 22 bp, Homo sapiens
cagatgagaagttaagcagcct

SEQ ID NO: 406382 - DNA, 21 bp, Homo sapiens
cagatgagcaaggacattgcc

SEQ ID NO: 406383 - DNA, 23 bp, Homo sapiens
cagatgagcaaggacattgcccc

SEQ ID NO: 406384 - DNA, 14 bp, Homo sapiens
cagatgatccatga

SEQ ID NO: 406385 - DNA, 13 bp, Homo sapiens
cagatgccagagc

SEQ ID NO: 406386 - DNA, 19 bp, Homo sapiens
cagatgccatggcctgtgc

SEQ ID NO: 406387 - DNA, 15 bp, Homo sapiens
cagatgccccagagc

SEQ ID NO: 406388 - DNA, 16 bp, Homo sapiens
cagatgccccagagct

SEQ ID NO: 406389 - DNA, 18 bp, Homo sapiens
cagatgccccagagctgt

SEQ ID NO: 406390 - DNA, 11 bp, Homo sapiens
cagatgccctt

SEQ ID NO: 406391 - DNA, 18 bp, Homo sapiens
cagatgcctcctctgtcc

SEQ ID NO: 406392 - DNA, 20 bp, Homo sapiens
cagatgcctcctctgtcctc

SEQ ID NO: 406393 - DNA, 22 bp, Homo sapiens
cagatgccttctagattcactg

SEQ ID NO: 406394 - DNA, 16 bp, Homo sapiens
cagatgctactggact

SEQ ID NO: 406395 - DNA, 17 bp, Homo sapiens
cagatggaaatattttg

SEQ ID NO: 406396 - DNA, 15 bp, Homo sapiens
cagatggctgtgaaa

SEQ ID NO: 406397 - DNA, 14 bp, Homo sapiens
cagatggggcctct

SEQ ID NO: 406398 - DNA, 15 bp, Homo sapiens
cagatggggcctctg

SEQ ID NO: 406399 - DNA, 16 bp, Homo sapiens
cagatgggtattaaac

SEQ ID NO: 406400 - DNA, 23 bp, Homo sapiens
cagatgggttttgttaggggtgg

SEQ ID NO: 406401 - DNA, 20 bp, Homo sapiens
cagatgtaagaagcccgatc

SEQ ID NO: 406402 - DNA, 22 bp, Homo sapiens
cagatgtccctgaagtcttgca

SEQ ID NO: 406403 - DNA, 18 bp, Homo sapiens
cagatgtctgggaaagca

SEQ ID NO: 406404 - DNA, 16 bp, Homo sapiens
cagatgtcttctgcct

SEQ ID NO: 406405 - DNA, 15 bp, Homo sapiens
cagatgtgcccagag

SEQ ID NO: 406406 - DNA, 16 bp, Homo sapiens
cagatgtgcccagagt

SEQ ID NO: 406407 - DNA, 19 bp, Homo sapiens
cagatgtgcccagagtagc

SEQ ID NO: 406408 - DNA, 18 bp, Homo sapiens
cagatgttgttcctggct

SEQ ID NO: 406409 - DNA, 20 bp, Homo sapiens
cagatgttgttcctggctag

SEQ ID NO: 406410 - DNA, 22 bp, Homo sapiens
cagatgtttgttttcaaaatac

SEQ ID NO: 406411 - DNA, 19 bp, Homo sapiens
cagattaaacttcacctac

SEQ ID NO: 406412 - DNA, 16 bp, Homo sapiens
cagattaggacacagt

SEQ ID NO: 406413 - DNA, 21 bp, Homo sapiens
cagattatttccagttttttg

SEQ ID NO: 406414 - DNA, 17 bp, Homo sapiens
cagattcctgggcctgt

SEQ ID NO: 406415 - DNA, 19 bp, Homo sapiens
cagattcctgggcctgtcc

SEQ ID NO: 406416 - DNA, 18 bp, Homo sapiens
cagattgctacacacaca

SEQ ID NO: 406417 - DNA, 15 bp, Homo sapiens
cagattgctgcttct

SEQ ID NO: 406418 - DNA, 19 bp, Homo sapiens
cagatttgaactcttcaat

SEQ ID NO: 406419 - DNA, 13 bp, Homo sapiens
cagatttgttcat

SEQ ID NO: 406420 - DNA, 14 bp, Homo sapiens
cagatttgttcatt

SEQ ID NO: 406421 - DNA, 15 bp, Homo sapiens
cagattttaattttg

SEQ ID NO: 406422 - DNA, 18 bp, Homo sapiens
cagattttacaaaagatg

SEQ ID NO: 406423 - DNA, 19 bp, Homo sapiens
cagattttacaaaagatgt

SEQ ID NO: 406424 - DNA, 12 bp, Homo sapiens
cagattttagac

SEQ ID NO: 406425 - DNA, 13 bp, Homo sapiens
cagcaaaaccatt

SEQ ID NO: 406426 - DNA, 17 bp, Homo sapiens
cagcaaaaccattgctt

SEQ ID NO: 406427 - DNA, 17 bp, Homo sapiens
cagcaaaatatatgttt

SEQ ID NO: 406428 - DNA, 16 bp, Homo sapiens
cagcaaaccaggactc

SEQ ID NO: 406429 - DNA, 16 bp, Homo sapiens
cagcaaagttttcaga

SEQ ID NO: 406430 - DNA, 19 bp, Homo sapiens
cagcaaattcttgaataaa

SEQ ID NO: 406431 - DNA, 12 bp, Homo sapiens
cagcaacaacaa

SEQ ID NO: 406432 - DNA, 14 bp, Homo sapiens
cagcaacaacaaca

SEQ ID NO: 406433 - DNA, 14 bp, Homo sapiens
cagcaacacaatgt

SEQ ID NO: 406434 - DNA, 18 bp, Homo sapiens
cagcaacaggaccaggag

SEQ ID NO: 406435 - DNA, 19 bp, Homo sapiens
cagcaacaggaccaggagc

SEQ ID NO: 406436 - DNA, 18 bp, Homo sapiens
cagcaaccattcatcttt

SEQ ID NO: 406437 - DNA, 14 bp, Homo sapiens
cagcaaccctccta

SEQ ID NO: 406438 - DNA, 18 bp, Homo sapiens
cagcaacctgtaagactg

SEQ ID NO: 406439 - DNA, 20 bp, Homo sapiens
cagcaacttgtctttttctg

SEQ ID NO: 406440 - DNA, 14 bp, Homo sapiens
cagcaagaataaaa

SEQ ID NO: 406441 - DNA, 21 bp, Homo sapiens
cagcaagccggccccccctct

SEQ ID NO: 406442 - DNA, 14 bp, Homo sapiens
cagcaaggcaggtt

SEQ ID NO: 406443 - DNA, 22 bp, Homo sapiens
cagcaaggcaggttggatggga

SEQ ID NO: 406444 - DNA, 13 bp, Homo sapiens
cagcaagggagag

SEQ ID NO: 406445 - DNA, 12 bp, Homo sapiens
cagcaagggctt

SEQ ID NO: 406446 - DNA, 15 bp, Homo sapiens
cagcaagtgtacagt

SEQ ID NO: 406447 - DNA, 16 bp, Homo sapiens
cagcaagtgtacagta

SEQ ID NO: 406448 - DNA, 23 bp, Homo sapiens
cagcaagtgtacagtatttacct

SEQ ID NO: 406449 - DNA, 22 bp, Homo sapiens
cagcaatatattaccagcaaga

SEQ ID NO: 406450 - DNA, 15 bp, Homo sapiens
cagcaatattctgat

SEQ ID NO: 406451 - DNA, 18 bp, Homo sapiens
cagcaatgatgtccagaa

SEQ ID NO: 406452 - DNA, 20 bp, Homo sapiens
cagcaatgatgtccagaaga

SEQ ID NO: 406453 - DNA, 20 bp, Homo sapiens
cagcacaaagaaacagcctt

SEQ ID NO: 406454 - DNA, 23 bp, Homo sapiens
cagcacaattctgtccctgtccc

SEQ ID NO: 406455 - DNA, 24 bp, Homo sapiens
cagcacaattctgtccctgtccct

SEQ ID NO: 406456 - DNA, 18 bp, Homo sapiens
cagcacagactgttccct

SEQ ID NO: 406457 - DNA, 14 bp, Homo sapiens
cagcacagcctcac

SEQ ID NO: 406458 - DNA, 16 bp, Homo sapiens
cagcacagcctcaccc

SEQ ID NO: 406459 - DNA, 14 bp, Homo sapiens
cagcacaggggccc

SEQ ID NO: 406460 - DNA, 17 bp, Homo sapiens
cagcacaggggccccag

SEQ ID NO: 406461 - DNA, 20 bp, Homo sapiens
cagcacatagcactgggaac

SEQ ID NO: 406462 - DNA, 16 bp, Homo sapiens
cagcacatgcactact

SEQ ID NO: 406463 - DNA, 19 bp, Homo sapiens
cagcacatgcactactgaa

SEQ ID NO: 406464 - DNA, 22 bp, Homo sapiens
cagcacatgctggccagcctgg

SEQ ID NO: 406465 - DNA, 12 bp, Homo sapiens
cagcacatttcc

SEQ ID NO: 406466 - DNA, 15 bp, Homo sapiens
cagcacatttcctct

SEQ ID NO: 406467 - DNA, 16 bp, Homo sapiens
cagcaccagcctgagc

SEQ ID NO: 406468 - DNA, 16 bp, Homo sapiens
cagcacccccacccac

SEQ ID NO: 406469 - DNA, 18 bp, Homo sapiens
cagcacccccacccacct

SEQ ID NO: 406470 - DNA, 11 bp, Homo sapiens
cagcaccctgg

SEQ ID NO: 406471 - DNA, 14 bp, Homo sapiens
cagcaccctgggtg

SEQ ID NO: 406472 - DNA, 20 bp, Homo sapiens
cagcaccctgggtgccattc

SEQ ID NO: 406473 - DNA, 19 bp, Homo sapiens
cagcaccctttcaccccca

SEQ ID NO: 406474 - DNA, 21 bp, Homo sapiens
cagcacctcctctctgctggg

SEQ ID NO: 406475 - DNA, 13 bp, Homo sapiens
cagcacctgccag

SEQ ID NO: 406476 - DNA, 16 bp, Homo sapiens
cagcacctgccagggc

SEQ ID NO: 406477 - DNA, 21 bp, Homo sapiens
cagcacgggcacagctgctgt

SEQ ID NO: 406478 - DNA, 22 bp, Homo sapiens
cagcacgggcacagctgctgtg

SEQ ID NO: 406479 - DNA, 23 bp, Homo sapiens
cagcacgggcacagctgctgtgc

SEQ ID NO: 406480 - DNA, 15 bp, Homo sapiens
cagcacgtgcagcca

SEQ ID NO: 406481 - DNA, 15 bp, Homo sapiens
cagcactacttactt

SEQ ID NO: 406482 - DNA, 21 bp, Homo sapiens
cagcactacttacttagagat

SEQ ID NO: 406483 - DNA, 12 bp, Homo sapiens
cagcactcccag

SEQ ID NO: 406484 - DNA, 16 bp, Homo sapiens
cagcactcccagggcc

SEQ ID NO: 406485 - DNA, 14 bp, Homo sapiens
cagcactggctctc

SEQ ID NO: 406486 - DNA, 20 bp, Homo sapiens
cagcactggctctctccagg

SEQ ID NO: 406487 - DNA, 18 bp, Homo sapiens
cagcactgggaagctgga

SEQ ID NO: 406488 - DNA, 18 bp, Homo sapiens
cagcactgtcccttgcct

SEQ ID NO: 406489 - DNA, 20 bp, Homo sapiens
cagcactttagatcacttga

SEQ ID NO: 406490 - DNA, 16 bp, Homo sapiens
cagcactttgggaggc

SEQ ID NO: 406491 - DNA, 20 bp, Homo sapiens
ctagtgggccctctctctgg

SEQ ID NO: 406492 - DNA, 14 bp, Homo sapiens
ctagtggtctgatt

SEQ ID NO: 406493 - DNA, 16 bp, Homo sapiens
ctagtgtgagtggcag

SEQ ID NO: 406494 - DNA, 18 bp, Homo sapiens
ctagtgtgagtggcagcc

SEQ ID NO: 406495 - DNA, 20 bp, Homo sapiens
ctagtgtgagtggcagccat

SEQ ID NO: 406496 - DNA, 23 bp, Homo sapiens
ctagtgtgagtggcagccatgcc

SEQ ID NO: 406497 - DNA, 18 bp, Homo sapiens
ctagtgtttctgcagagg

SEQ ID NO: 406498 - DNA, 16 bp, Homo sapiens
ctagttacccacccta

SEQ ID NO: 406499 - DNA, 16 bp, Homo sapiens
ctagttagcaggaaat

SEQ ID NO: 406500 - DNA, 15 bp, Homo sapiens
ctagttatgtgagaa

SEQ ID NO: 406501 - DNA, 20 bp, Homo sapiens
ctagttcagacactttggaa

SEQ ID NO: 406502 - DNA, 22 bp, Homo sapiens
ctagttcatccaatcctcactg

SEQ ID NO: 406503 - DNA, 17 bp, Homo sapiens
ctagttccattcttggt

SEQ ID NO: 406504 - DNA, 24 bp, Homo sapiens
ctagttccctcagtgtgaagcctg

SEQ ID NO: 406505 - DNA, 12 bp, Homo sapiens
ctagttctagat

SEQ ID NO: 406506 - DNA, 14 bp, Homo sapiens
ctagtttacagaaa

SEQ ID NO: 406507 - DNA, 21 bp, Homo sapiens
ctagtttcagtaaataatgaa

SEQ ID NO: 406508 - DNA, 13 bp, Homo sapiens
ctagttttacaga

SEQ ID NO: 406509 - DNA, 14 bp, Homo sapiens
ctagttttacagat

SEQ ID NO: 406510 - DNA, 19 bp, Homo sapiens
ctagttttagacctcatct

SEQ ID NO: 406511 - DNA, 17 bp, Homo sapiens
ctagttttatgtttctt

SEQ ID NO: 406512 - DNA, 18 bp, Homo sapiens
ctagttttttttgtaaac

SEQ ID NO: 406513 - DNA, 19 bp, Homo sapiens
ctagttttttttgtaaact

SEQ ID NO: 406514 - DNA, 18 bp, Homo sapiens
ctataaacattaaaagaa

SEQ ID NO: 406515 - DNA, 20 bp, Homo sapiens
ctataaagcgatatacagat

SEQ ID NO: 406516 - DNA, 16 bp, Homo sapiens
ctataaagtaaagcta

SEQ ID NO: 406517 - DNA, 17 bp, Homo sapiens
ctataaatagtgaaaat

SEQ ID NO: 406518 - DNA, 14 bp, Homo sapiens
ctataaatatattg

SEQ ID NO: 406519 - DNA, 21 bp, Homo sapiens
ctataaatatattgtatattt

SEQ ID NO: 406520 - DNA, 23 bp, Homo sapiens
ctataaatggtgtttttttaata

SEQ ID NO: 406521 - DNA, 21 bp, Homo sapiens
ctataacagatcctttcaaaa

SEQ ID NO: 406522 - DNA, 14 bp, Homo sapiens
ctataacatgtctt

SEQ ID NO: 406523 - DNA, 12 bp, Homo sapiens
ctataacatttg

SEQ ID NO: 406524 - DNA, 19 bp, Homo sapiens
ctataacccctgcctggat

SEQ ID NO: 406525 - DNA, 22 bp, Homo sapiens
ctataagggagtaggctgtatt

SEQ ID NO: 406526 - DNA, 20 bp, Homo sapiens
ctataattccctatctttta

SEQ ID NO: 406527 - DNA, 22 bp, Homo sapiens
ctataattccctatcttttagt

SEQ ID NO: 406528 - DNA, 15 bp, Homo sapiens
ctatacattcctgag

SEQ ID NO: 406529 - DNA, 19 bp, Homo sapiens
ctataccccttacttagca

SEQ ID NO: 406530 - DNA, 23 bp, Homo sapiens
ctatactgtgtcatggtgatgca

SEQ ID NO: 406531 - DNA, 16 bp, Homo sapiens
ctatactgtttgtaat

SEQ ID NO: 406532 - DNA, 19 bp, Homo sapiens
ctatagaaatgtattttga

SEQ ID NO: 406533 - DNA, 12 bp, Homo sapiens
ctatagactcta

SEQ ID NO: 406534 - DNA, 21 bp, Homo sapiens
ctatagagaaacccctgggga

SEQ ID NO: 406535 - DNA, 19 bp, Homo sapiens
ctatagagagggggctctc

SEQ ID NO: 406536 - DNA, 13 bp, Homo sapiens
ctatagaggagga

SEQ ID NO: 406537 - DNA, 15 bp, Homo sapiens
ctatagcagggctgg

SEQ ID NO: 406538 - DNA, 16 bp, Homo sapiens
ctatagcagggctggg

SEQ ID NO: 406539 - DNA, 14 bp, Homo sapiens
ctatagccatttgc

SEQ ID NO: 406540 - DNA, 17 bp, Homo sapiens
ctataggagatgagctt

SEQ ID NO: 406541 - DNA, 18 bp, Homo sapiens
ctataggtaattaaggca

SEQ ID NO: 406542 - DNA, 19 bp, Homo sapiens
ctatagtttaaaacacatt

SEQ ID NO: 406543 - DNA, 18 bp, Homo sapiens
ctatataaaatgtattca

SEQ ID NO: 406544 - DNA, 21 bp, Homo sapiens
ctatataaagtactactgtag

SEQ ID NO: 406545 - DNA, 18 bp, Homo sapiens
ctatatatacatgtatag

SEQ ID NO: 406546 - DNA, 14 bp, Homo sapiens
ctatatccatgtac

SEQ ID NO: 406547 - DNA, 16 bp, Homo sapiens
ctatatccatgtactg

SEQ ID NO: 406548 - DNA, 14 bp, Homo sapiens
ctatatctgtttta

SEQ ID NO: 406549 - DNA, 15 bp, Homo sapiens
ctatatgaatttaaa

SEQ ID NO: 406550 - DNA, 16 bp, Homo sapiens
ctatatgaatttaaat

SEQ ID NO: 406551 - DNA, 23 bp, Homo sapiens
ctatatgaatttaaatataattc

SEQ ID NO: 406552 - DNA, 16 bp, Homo sapiens
ctatatgatttatagt

SEQ ID NO: 406553 - DNA, 15 bp, Homo sapiens
ctatatgcacccctg

SEQ ID NO: 406554 - DNA, 21 bp, Homo sapiens
ctatatgcataaacaacagta

SEQ ID NO: 406555 - DNA, 19 bp, Homo sapiens
ctatatggcaagaaagctg

SEQ ID NO: 406556 - DNA, 21 bp, Homo sapiens
ctatatgtatatctttgcact

SEQ ID NO: 406557 - DNA, 15 bp, Homo sapiens
ctatatttgtaactt

SEQ ID NO: 406558 - DNA, 19 bp, Homo sapiens
ctatatttgtaactttgca

SEQ ID NO: 406559 - DNA, 15 bp, Homo sapiens
ctatcaagtcaatca

SEQ ID NO: 406560 - DNA, 23 bp, Homo sapiens
ctatcaagtgtgctttagcttga

SEQ ID NO: 406561 - DNA, 17 bp, Homo sapiens
ctatcacctcccctcct

SEQ ID NO: 406562 - DNA, 11 bp, Homo sapiens
ctatcacctgt

SEQ ID NO: 406563 - DNA, 21 bp, Homo sapiens
ctatcagtgttcttctcaagg

SEQ ID NO: 406564 - DNA, 19 bp, Homo sapiens
ctatccaaagaacttgatt

SEQ ID NO: 406565 - DNA, 20 bp, Homo sapiens
ctatccaaagaacttgattt

SEQ ID NO: 406566 - DNA, 19 bp, Homo sapiens
ctatccaattaaaattaag

SEQ ID NO: 406567 - DNA, 20 bp, Homo sapiens
ctatccacagaacctttgtc

SEQ ID NO: 406568 - DNA, 13 bp, Homo sapiens
ctatccagccgca

SEQ ID NO: 406569 - DNA, 17 bp, Homo sapiens
ctatccagccgcaaatc

SEQ ID NO: 406570 - DNA, 18 bp, Homo sapiens
ctatccatgcaccaaact

SEQ ID NO: 406571 - DNA, 15 bp, Homo sapiens
ctatcctgcaccctc

SEQ ID NO: 406572 - DNA, 16 bp, Homo sapiens
ctatcctgcaccctct

SEQ ID NO: 406573 - DNA, 17 bp, Homo sapiens
ctatcctgcaccctctg

SEQ ID NO: 406574 - DNA, 21 bp, Homo sapiens
ctatcctggctttgcccaacc

SEQ ID NO: 406575 - DNA, 22 bp, Homo sapiens
ctatcctgttaacactgtaata

SEQ ID NO: 406576 - DNA, 19 bp, Homo sapiens
ctatccttggagagcagct

SEQ ID NO: 406577 - DNA, 22 bp, Homo sapiens
ctatccttttttattgaataac

SEQ ID NO: 406578 - DNA, 14 bp, Homo sapiens
ctatcgagtttgca

SEQ ID NO: 406579 - DNA, 18 bp, Homo sapiens
ctatcgatctggaaagag

SEQ ID NO: 406580 - DNA, 17 bp, Homo sapiens
ctatctaaccctcccat

SEQ ID NO: 406581 - DNA, 16 bp, Homo sapiens
ctatctagatagctga

SEQ ID NO: 406582 - DNA, 23 bp, Homo sapiens
ctatctatatatacatatacaca

SEQ ID NO: 406583 - DNA, 19 bp, Homo sapiens
ctatctcgctagccatata

SEQ ID NO: 406584 - DNA, 18 bp, Homo sapiens
ctatctctagagtgagaa

SEQ ID NO: 406585 - DNA, 17 bp, Homo sapiens
ctatctctcaaaacttg

SEQ ID NO: 406586 - DNA, 20 bp, Homo sapiens
ctatctgcaaatagtttcaa

SEQ ID NO: 406587 - DNA, 17 bp, Homo sapiens
ctatctgcatttataaa

SEQ ID NO: 406588 - DNA, 20 bp, Homo sapiens
ctatctggaaaaaaaaaaat

SEQ ID NO: 406589 - DNA, 22 bp, Homo sapiens
ctatctggaaaaaaaaaaatat

SEQ ID NO: 406590 - DNA, 17 bp, Homo sapiens
ctatctgggcctgggct

SEQ ID NO: 406591 - DNA, 21 bp, Homo sapiens
ctatctgggcctgggctaggg

SEQ ID NO: 406592 - DNA, 17 bp, Homo sapiens
ctatctgtatgtctgcc

SEQ ID NO: 406593 - DNA, 16 bp, Homo sapiens
ctatcttttcatttat

SEQ ID NO: 406594 - DNA, 13 bp, Homo sapiens
ctatgaactacaa

SEQ ID NO: 406595 - DNA, 18 bp, Homo sapiens
ctatgagatggccatgct

SEQ ID NO: 406596 - DNA, 22 bp, Homo sapiens
ctatgaggaataattatttatt

SEQ ID NO: 406597 - DNA, 18 bp, Homo sapiens
ctatgcaaaatgtctgtt

SEQ ID NO: 406598 - DNA, 13 bp, Homo sapiens
ctatgcacaccaa

SEQ ID NO: 406599 - DNA, 17 bp, Homo sapiens
ctatgcacaccaaattg

SEQ ID NO: 406600 - DNA, 21 bp, Homo sapiens
ctatgcacaccaaattgctga

SEQ ID NO: 406601 - DNA, 22 bp, Homo sapiens
ctatgcacaccaaattgctgag

SEQ ID NO: 406602 - DNA, 13 bp, Homo sapiens
ctatgccacctgc

SEQ ID NO: 406603 - DNA, 20 bp, Homo sapiens
ctatgccacctgcagcgtct

SEQ ID NO: 406604 - DNA, 20 bp, Homo sapiens
ctatgcccaggtaccaccct

SEQ ID NO: 406605 - DNA, 14 bp, Homo sapiens
ctatgcctgtggtg

SEQ ID NO: 406606 - DNA, 21 bp, Homo sapiens
ctatgcctgtggtgaagtgtg

SEQ ID NO: 406607 - DNA, 19 bp, Homo sapiens
ctatgctgcctaggctgac

SEQ ID NO: 406608 - DNA, 22 bp, Homo sapiens
ctatgcttctagaaagcccctc

SEQ ID NO: 406609 - DNA, 13 bp, Homo sapiens
ctatggactgcac

SEQ ID NO: 406610 - DNA, 19 bp, Homo sapiens
ctatggagggtcctcctcc

SEQ ID NO: 406611 - DNA, 14 bp, Homo sapiens
ctatgggagcccca

SEQ ID NO: 406612 - DNA, 15 bp, Homo sapiens
ctatgggagccccag

SEQ ID NO: 406613 - DNA, 18 bp, Homo sapiens
ctatggggatggtccact

SEQ ID NO: 406614 - DNA, 19 bp, Homo sapiens
ctatgggggcactgaggac

SEQ ID NO: 406615 - DNA, 23 bp, Homo sapiens
ctatgggtatcaaacagctcagg

SEQ ID NO: 406616 - DNA, 20 bp, Homo sapiens
ctatgggtggggcactcctt

SEQ ID NO: 406617 - DNA, 13 bp, Homo sapiens
ctatggtaaagat

SEQ ID NO: 406618 - DNA, 21 bp, Homo sapiens
ctatggtaaagatattattca

SEQ ID NO: 406619 - DNA, 22 bp, Homo sapiens
ctatggtaaagatattattcac

SEQ ID NO: 406620 - DNA, 14 bp, Homo sapiens
ctatggtgaggtgt

SEQ ID NO: 406621 - DNA, 18 bp, Homo sapiens
ctatggttcccaataaaa

SEQ ID NO: 406622 - DNA, 20 bp, Homo sapiens
ctatggttcccaataaaagt

SEQ ID NO: 406623 - DNA, 18 bp, Homo sapiens
ctatgtaaattattgtaa

SEQ ID NO: 406624 - DNA, 22 bp, Homo sapiens
cagcactttgggaggcctaggc

SEQ ID NO: 406625 - DNA, 18 bp, Homo sapiens
cagcagaaacccccagga

SEQ ID NO: 406626 - DNA, 18 bp, Homo sapiens
cagcagagccgttcctgg

SEQ ID NO: 406627 - DNA, 20 bp, Homo sapiens
cagcagagccgttcctggga

SEQ ID NO: 406628 - DNA, 22 bp, Homo sapiens
cagcagagttattgaatcttaa

SEQ ID NO: 406629 - DNA, 10 bp, Homo sapiens
cagcagcaca

SEQ ID NO: 406630 - DNA, 16 bp, Homo sapiens
cagcagcccaagctta

SEQ ID NO: 406631 - DNA, 12 bp, Homo sapiens
cagcagcccagc

SEQ ID NO: 406632 - DNA, 13 bp, Homo sapiens
cagcagcccagct

SEQ ID NO: 406633 - DNA, 13 bp, Homo sapiens
cagcagcccctgc

SEQ ID NO: 406634 - DNA, 23 bp, Homo sapiens
cagcagccctaaggatctctcag

SEQ ID NO: 406635 - DNA, 12 bp, Homo sapiens
cagcagcctccc

SEQ ID NO: 406636 - DNA, 24 bp, Homo sapiens
cagcagcctccctgtcactcagct

SEQ ID NO: 406637 - DNA, 17 bp, Homo sapiens
cagcagcctgtgaggga

SEQ ID NO: 406638 - DNA, 20 bp, Homo sapiens
cagcagcctgtgagggagtg

SEQ ID NO: 406639 - DNA, 17 bp, Homo sapiens
cagcagcggcccagatt

SEQ ID NO: 406640 - DNA, 14 bp, Homo sapiens
cagcagctccgcct

SEQ ID NO: 406641 - DNA, 20 bp, Homo sapiens
cagcagctccgcctggcacc

SEQ ID NO: 406642 - DNA, 18 bp, Homo sapiens
cagcagctgaagtctctt

SEQ ID NO: 406643 - DNA, 20 bp, Homo sapiens
cagcagctgaggccccaggg

SEQ ID NO: 406644 - DNA, 11 bp, Homo sapiens
cagcagctgcg

SEQ ID NO: 406645 - DNA, 17 bp, Homo sapiens
cagcagctgcgggtctg

SEQ ID NO: 406646 - DNA, 23 bp, Homo sapiens
cagcagctgcgggtctgaaggaa

SEQ ID NO: 406647 - DNA, 22 bp, Homo sapiens
cagcagctgggacccctcccaa

SEQ ID NO: 406648 - DNA, 12 bp, Homo sapiens
cagcagcttcac

SEQ ID NO: 406649 - DNA, 15 bp, Homo sapiens
cagcagcttgctgca

SEQ ID NO: 406650 - DNA, 17 bp, Homo sapiens
cagcagcttttaataca

SEQ ID NO: 406651 - DNA, 14 bp, Homo sapiens
cagcaggcagagga

SEQ ID NO: 406652 - DNA, 18 bp, Homo sapiens
cagcaggcccacctacct

SEQ ID NO: 406653 - DNA, 13 bp, Homo sapiens
cagcaggcctgtt

SEQ ID NO: 406654 - DNA, 21 bp, Homo sapiens
cagcaggcctgttgctttttt

SEQ ID NO: 406655 - DNA, 23 bp, Homo sapiens
cagcaggcggcctttgttgctca

SEQ ID NO: 406656 - DNA, 18 bp, Homo sapiens
cagcagggcgggccagga

SEQ ID NO: 406657 - DNA, 16 bp, Homo sapiens
cagcaggggcagaagg

SEQ ID NO: 406658 - DNA, 20 bp, Homo sapiens
cagcaggggcagaaggagga

SEQ ID NO: 406659 - DNA, 15 bp, Homo sapiens
cagcaggggggttgg

SEQ ID NO: 406660 - DNA, 13 bp, Homo sapiens
cagcaggggtggg

SEQ ID NO: 406661 - DNA, 20 bp, Homo sapiens
cagcagggtagtctggtttc

SEQ ID NO: 406662 - DNA, 21 bp, Homo sapiens
cagcaggtgccatcacgcttg

SEQ ID NO: 406663 - DNA, 17 bp, Homo sapiens
cagcaggtgtggtggct

SEQ ID NO: 406664 - DNA, 22 bp, Homo sapiens
cagcaggtgtggtggctcatgg

SEQ ID NO: 406665 - DNA, 18 bp, Homo sapiens
cagcaggttctctcctgt

SEQ ID NO: 406666 - DNA, 17 bp, Homo sapiens
cagcagtaccatcccac

SEQ ID NO: 406667 - DNA, 19 bp, Homo sapiens
cagcagtacctataaagta

SEQ ID NO: 406668 - DNA, 16 bp, Homo sapiens
cagcagtacttgctca

SEQ ID NO: 406669 - DNA, 21 bp, Homo sapiens
cagcagtacttgctcaataaa

SEQ ID NO: 406670 - DNA, 14 bp, Homo sapiens
cagcagtcacaggt

SEQ ID NO: 406671 - DNA, 19 bp, Homo sapiens
cagcagtgagtctcttcag

SEQ ID NO: 406672 - DNA, 21 bp, Homo sapiens
cagcagtgagtctcttcagaa

SEQ ID NO: 406673 - DNA, 11 bp, Homo sapiens
cagcagtgctg

SEQ ID NO: 406674 - DNA, 19 bp, Homo sapiens
cagcagtgctgggcccagc

SEQ ID NO: 406675 - DNA, 21 bp, Homo sapiens
cagcagtgctgggcccagccg

SEQ ID NO: 406676 - DNA, 16 bp, Homo sapiens
cagcagtgtcatcaga

SEQ ID NO: 406677 - DNA, 13 bp, Homo sapiens
cagcagttgctag

SEQ ID NO: 406678 - DNA, 21 bp, Homo sapiens
cagcagttttcttttaatttt

SEQ ID NO: 406679 - DNA, 15 bp, Homo sapiens
cagcataattcggaa

SEQ ID NO: 406680 - DNA, 15 bp, Homo sapiens
cagcatcaaaataca

SEQ ID NO: 406681 - DNA, 13 bp, Homo sapiens
cagcatccagcct

SEQ ID NO: 406682 - DNA, 14 bp, Homo sapiens
cagcatccagcctg

SEQ ID NO: 406683 - DNA, 15 bp, Homo sapiens
cagcatccagcctgt

SEQ ID NO: 406684 - DNA, 17 bp, Homo sapiens
cagcatccagcctgtgt

SEQ ID NO: 406685 - DNA, 19 bp, Homo sapiens
cagcatctactactctgtc

SEQ ID NO: 406686 - DNA, 23 bp, Homo sapiens
cagcatctgattgagtcagtgtt

SEQ ID NO: 406687 - DNA, 13 bp, Homo sapiens
cagcatgattctt

SEQ ID NO: 406688 - DNA, 23 bp, Homo sapiens
cagcatgccccttggctggatca

SEQ ID NO: 406689 - DNA, 12 bp, Homo sapiens
cagcatgtgcca

SEQ ID NO: 406690 - DNA, 19 bp, Homo sapiens
cagcatgtgccaagattct

SEQ ID NO: 406691 - DNA, 11 bp, Homo sapiens
cagcatgtgtg

SEQ ID NO: 406692 - DNA, 16 bp, Homo sapiens
cagcatgtgtgtgtct

SEQ ID NO: 406693 - DNA, 17 bp, Homo sapiens
cagcattattcctccag

SEQ ID NO: 406694 - DNA, 14 bp, Homo sapiens
cagcattcaaaata

SEQ ID NO: 406695 - DNA, 20 bp, Homo sapiens
cagcattcttgtcacaataa

SEQ ID NO: 406696 - DNA, 21 bp, Homo sapiens
cagcattcttgtcacaataaa

SEQ ID NO: 406697 - DNA, 22 bp, Homo sapiens
cagcattcttgtcacaataaat

SEQ ID NO: 406698 - DNA, 15 bp, Homo sapiens
cagcatttgtccacc

SEQ ID NO: 406699 - DNA, 16 bp, Homo sapiens
cagcatttgtccaccc

SEQ ID NO: 406700 - DNA, 15 bp, Homo sapiens
cagcattttcacatt

SEQ ID NO: 406701 - DNA, 21 bp, Homo sapiens
cagcattttcacattttgcct

SEQ ID NO: 406702 - DNA, 16 bp, Homo sapiens
cagccaaaccctgtct

SEQ ID NO: 406703 - DNA, 18 bp, Homo sapiens
cagccaaatgcagggagg

SEQ ID NO: 406704 - DNA, 22 bp, Homo sapiens
cagccaacattgccttgcattt

SEQ ID NO: 406705 - DNA, 12 bp, Homo sapiens
cagccaacccct

SEQ ID NO: 406706 - DNA, 15 bp, Homo sapiens
cagccaacccctgtg

SEQ ID NO: 406707 - DNA, 18 bp, Homo sapiens
cagccaacccctgtggag

SEQ ID NO: 406708 - DNA, 21 bp, Homo sapiens
cagccaacccctgtggagccc

SEQ ID NO: 406709 - DNA, 15 bp, Homo sapiens
cagccacatgggaaa

SEQ ID NO: 406710 - DNA, 15 bp, Homo sapiens
cagccaccaccactg

SEQ ID NO: 406711 - DNA, 16 bp, Homo sapiens
cagccaccaccactgt

SEQ ID NO: 406712 - DNA, 13 bp, Homo sapiens
cagccaccacctg

SEQ ID NO: 406713 - DNA, 14 bp, Homo sapiens
cagccaccacctgg

SEQ ID NO: 406714 - DNA, 11 bp, Homo sapiens
cagccaccccg

SEQ ID NO: 406715 - DNA, 18 bp, Homo sapiens
cagccacccggatctcca

SEQ ID NO: 406716 - DNA, 23 bp, Homo sapiens
cagccacccggatctccaggccc

SEQ ID NO: 406717 - DNA, 19 bp, Homo sapiens
cagccaccctaactgagct

SEQ ID NO: 406718 - DNA, 21 bp, Homo sapiens
cagccaccttcctgactggga

SEQ ID NO: 406719 - DNA, 12 bp, Homo sapiens
cagccagagctg

SEQ ID NO: 406720 - DNA, 20 bp, Homo sapiens
cagccagcaggttctctcct

SEQ ID NO: 406721 - DNA, 24 bp, Homo sapiens
cagccagcaggttctctcctgtga

SEQ ID NO: 406722 - DNA, 13 bp, Homo sapiens
cagccagccagtc

SEQ ID NO: 406723 - DNA, 13 bp, Homo sapiens
cagccagcccagc

SEQ ID NO: 406724 - DNA, 14 bp, Homo sapiens
cagccagcccagct

SEQ ID NO: 406725 - DNA, 17 bp, Homo sapiens
cagccagcccagctcca

SEQ ID NO: 406726 - DNA, 11 bp, Homo sapiens
cagccagccct

SEQ ID NO: 406727 - DNA, 15 bp, Homo sapiens
cagccagcccttccc

SEQ ID NO: 406728 - DNA, 20 bp, Homo sapiens
cagccagcccttcccaggcc

SEQ ID NO: 406729 - DNA, 13 bp, Homo sapiens
cagccaggagggg

SEQ ID NO: 406730 - DNA, 16 bp, Homo sapiens
cagccaggctgccaag

SEQ ID NO: 406731 - DNA, 21 bp, Homo sapiens
cagccagtcttgcctaggcca

SEQ ID NO: 406732 - DNA, 21 bp, Homo sapiens
cagccatagcttgattgctca

SEQ ID NO: 406733 - DNA, 12 bp, Homo sapiens
cagccatgcctc

SEQ ID NO: 406734 - DNA, 13 bp, Homo sapiens
cagccatgcctca

SEQ ID NO: 406735 - DNA, 14 bp, Homo sapiens
cagccatgcctcat

SEQ ID NO: 406736 - DNA, 16 bp, Homo sapiens
cagccatgcctcatgc

SEQ ID NO: 406737 - DNA, 18 bp, Homo sapiens
cagccatgcctcatgcca

SEQ ID NO: 406738 - DNA, 20 bp, Homo sapiens
cagccatgggccctctgagc

SEQ ID NO: 406739 - DNA, 15 bp, Homo sapiens
cagccatgtccaagt

SEQ ID NO: 406740 - DNA, 22 bp, Homo sapiens
cagccattcatctgggctggca

SEQ ID NO: 406741 - DNA, 22 bp, Homo sapiens
cagcccaaagctggagccaatg

SEQ ID NO: 406742 - DNA, 23 bp, Homo sapiens
cagcccaaccaggaggggtctgc

SEQ ID NO: 406743 - DNA, 21 bp, Homo sapiens
cagcccaaccgggaaaggcat

SEQ ID NO: 406744 - DNA, 13 bp, Homo sapiens
cagcccaataaag

SEQ ID NO: 406745 - DNA, 14 bp, Homo sapiens
cagcccaataaagg

SEQ ID NO: 406746 - DNA, 15 bp, Homo sapiens
cagcccacagaggac

SEQ ID NO: 406747 - DNA, 17 bp, Homo sapiens
cagcccacagtgctcag

SEQ ID NO: 406748 - DNA, 10 bp, Homo sapiens
cagcccaccc

SEQ ID NO: 406749 - DNA, 12 bp, Homo sapiens
cagcccaccccc

SEQ ID NO: 406750 - DNA, 17 bp, Homo sapiens
cagcccaccctgctcct

SEQ ID NO: 406751 - DNA, 16 bp, Homo sapiens
cagcccactgagaagt

SEQ ID NO: 406752 - DNA, 15 bp, Homo sapiens
cagcccactggatca

SEQ ID NO: 406753 - DNA, 20 bp, Homo sapiens
cagcccagagagaccctgcc

SEQ ID NO: 406754 - DNA, 22 bp, Homo sapiens
cagcccagagagaccctgccaa

SEQ ID NO: 406755 - DNA, 18 bp, Homo sapiens
cagcccagcccagctgct

SEQ ID NO: 406756 - DNA, 20 bp, Homo sapiens
cagcccagctccactcaggg

SEQ ID NO: 406757 - DNA, 22 bp, Homo sapiens
cagcccagctccactcagggct

SEQ ID NO: 406758 - DNA, 13 bp, Homo sapiens
cagcccagctgct

SEQ ID NO: 406759 - DNA, 19 bp, Homo sapiens
ctatgtaaattattgtaaa

SEQ ID NO: 406760 - DNA, 23 bp, Homo sapiens
ctatgtaaattattgtaaacttt

SEQ ID NO: 406761 - DNA, 22 bp, Homo sapiens
ctatgtaatgcttatgtgttgc

SEQ ID NO: 406762 - DNA, 19 bp, Homo sapiens
ctatgtagaactgttcatt

SEQ ID NO: 406763 - DNA, 20 bp, Homo sapiens
ctatgtattaccagcccccc

SEQ ID NO: 406764 - DNA, 20 bp, Homo sapiens
ctatgtcactaccctcctgt

SEQ ID NO: 406765 - DNA, 13 bp, Homo sapiens
ctatgtcatttct

SEQ ID NO: 406766 - DNA, 20 bp, Homo sapiens
ctatgtcctaaggacacact

SEQ ID NO: 406767 - DNA, 12 bp, Homo sapiens
ctatgtctgtga

SEQ ID NO: 406768 - DNA, 12 bp, Homo sapiens
ctatgtgacaat

SEQ ID NO: 406769 - DNA, 14 bp, Homo sapiens
ctatgtgcgagaca

SEQ ID NO: 406770 - DNA, 15 bp, Homo sapiens
ctatgtgctgggtgc

SEQ ID NO: 406771 - DNA, 13 bp, Homo sapiens
ctatgtggcagct

SEQ ID NO: 406772 - DNA, 14 bp, Homo sapiens
ctatgtggcagctg

SEQ ID NO: 406773 - DNA, 22 bp, Homo sapiens
ctatgtggcagctggggagcag

SEQ ID NO: 406774 - DNA, 21 bp, Homo sapiens
ctatgtgtcatgatttcaatg

SEQ ID NO: 406775 - DNA, 12 bp, Homo sapiens
ctatgttcccca

SEQ ID NO: 406776 - DNA, 14 bp, Homo sapiens
ctatgttccccagg

SEQ ID NO: 406777 - DNA, 12 bp, Homo sapiens
ctattaactctg

SEQ ID NO: 406778 - DNA, 13 bp, Homo sapiens
ctattaactctgc

SEQ ID NO: 406779 - DNA, 20 bp, Homo sapiens
ctattaagcagtaaaaactg

SEQ ID NO: 406780 - DNA, 17 bp, Homo sapiens
ctattaccatgagaaga

SEQ ID NO: 406781 - DNA, 23 bp, Homo sapiens
ctattactgtctggttttaacaa

SEQ ID NO: 406782 - DNA, 12 bp, Homo sapiens
ctattagacttt

SEQ ID NO: 406783 - DNA, 13 bp, Homo sapiens
ctattagagaaac

SEQ ID NO: 406784 - DNA, 20 bp, Homo sapiens
ctattagtattattaacact

SEQ ID NO: 406785 - DNA, 17 bp, Homo sapiens
ctattagtgttaactgt

SEQ ID NO: 406786 - DNA, 22 bp, Homo sapiens
ctattcaaggtggccaaattat

SEQ ID NO: 406787 - DNA, 17 bp, Homo sapiens
ctattcagacaagcaac

SEQ ID NO: 406788 - DNA, 18 bp, Homo sapiens
ctattcccactttcattc

SEQ ID NO: 406789 - DNA, 23 bp, Homo sapiens
ctattcccatcgctggaaaacag

SEQ ID NO: 406790 - DNA, 15 bp, Homo sapiens
ctattccctggaatt

SEQ ID NO: 406791 - DNA, 15 bp, Homo sapiens
ctattccctggagac

SEQ ID NO: 406792 - DNA, 17 bp, Homo sapiens
ctattccttctggcctt

SEQ ID NO: 406793 - DNA, 14 bp, Homo sapiens
ctattctattgcag

SEQ ID NO: 406794 - DNA, 22 bp, Homo sapiens
ctattctctgcaatttgtttaa

SEQ ID NO: 406795 - DNA, 13 bp, Homo sapiens
ctattctgagcct

SEQ ID NO: 406796 - DNA, 14 bp, Homo sapiens
ctattctgagcctt

SEQ ID NO: 406797 - DNA, 17 bp, Homo sapiens
ctattctgttaaaatca

SEQ ID NO: 406798 - DNA, 15 bp, Homo sapiens
ctattcttaagcact

SEQ ID NO: 406799 - DNA, 22 bp, Homo sapiens
ctattctttgaccaaactgtgg

SEQ ID NO: 406800 - DNA, 21 bp, Homo sapiens
ctattgaaagtttttaatatt

SEQ ID NO: 406801 - DNA, 15 bp, Homo sapiens
ctattgaagatacac

SEQ ID NO: 406802 - DNA, 15 bp, Homo sapiens
ctattgatgtacagt

SEQ ID NO: 406803 - DNA, 20 bp, Homo sapiens
ctattgatgtacagtctgtc

SEQ ID NO: 406804 - DNA, 21 bp, Homo sapiens
ctattgatgtacagtctgtca

SEQ ID NO: 406805 - DNA, 23 bp, Homo sapiens
ctattgatgtacagtctgtcatg

SEQ ID NO: 406806 - DNA, 13 bp, Homo sapiens
ctattgctgtaaa

SEQ ID NO: 406807 - DNA, 22 bp, Homo sapiens
ctattgctgtaaataaaaatag

SEQ ID NO: 406808 - DNA, 21 bp, Homo sapiens
ctattgtgggacttattacaa

SEQ ID NO: 406809 - DNA, 20 bp, Homo sapiens
ctattgttactctggttctt

SEQ ID NO: 406810 - DNA, 15 bp, Homo sapiens
ctatttaaaaaatga

SEQ ID NO: 406811 - DNA, 14 bp, Homo sapiens
ctatttaactgact

SEQ ID NO: 406812 - DNA, 16 bp, Homo sapiens
ctatttaagccccctc

SEQ ID NO: 406813 - DNA, 15 bp, Homo sapiens
ctatttactggaaac

SEQ ID NO: 406814 - DNA, 13 bp, Homo sapiens
ctatttagcatga

SEQ ID NO: 406815 - DNA, 11 bp, Homo sapiens
ctatttatctg

SEQ ID NO: 406816 - DNA, 14 bp, Homo sapiens
ctatttattaaaac

SEQ ID NO: 406817 - DNA, 23 bp, Homo sapiens
ctatttatttatttattgaagat

SEQ ID NO: 406818 - DNA, 18 bp, Homo sapiens
ctatttcaacttcaggaa

SEQ ID NO: 406819 - DNA, 17 bp, Homo sapiens
ctatttcccaagctgga

SEQ ID NO: 406820 - DNA, 21 bp, Homo sapiens
ctatttccccaggggaaaatg

SEQ ID NO: 406821 - DNA, 18 bp, Homo sapiens
ctatttcctttgcgcaaa

SEQ ID NO: 406822 - DNA, 12 bp, Homo sapiens
ctatttgactgc

SEQ ID NO: 406823 - DNA, 16 bp, Homo sapiens
ctatttgtgtgtatgc

SEQ ID NO: 406824 - DNA, 15 bp, Homo sapiens
ctatttgttcagaga

SEQ ID NO: 406825 - DNA, 16 bp, Homo sapiens
ctattttaaagtaaaa

SEQ ID NO: 406826 - DNA, 15 bp, Homo sapiens
ctattttgcagcagt

SEQ ID NO: 406827 - DNA, 11 bp, Homo sapiens
ctattttgtga

SEQ ID NO: 406828 - DNA, 16 bp, Homo sapiens
ctattttgtgatgatg

SEQ ID NO: 406829 - DNA, 18 bp, Homo sapiens
ctatttttatttatattt

SEQ ID NO: 406830 - DNA, 20 bp, Homo sapiens
ctatttttcttgttgcatct

SEQ ID NO: 406831 - DNA, 20 bp, Homo sapiens
ctatttttgtttttgtcttt

SEQ ID NO: 406832 - DNA, 21 bp, Homo sapiens
ctatttttgtttttgtctttt

SEQ ID NO: 406833 - DNA, 22 bp, Homo sapiens
ctatttttttaactgaaaatgt

SEQ ID NO: 406834 - DNA, 14 bp, Homo sapiens
ctatttttttctct

SEQ ID NO: 406835 - DNA, 14 bp, Homo sapiens
ctcaaaagcattta

SEQ ID NO: 406836 - DNA, 13 bp, Homo sapiens
ctcaaaaggaaac

SEQ ID NO: 406837 - DNA, 23 bp, Homo sapiens
ctcaaaaggaaaccaagtggtca

SEQ ID NO: 406838 - DNA, 13 bp, Homo sapiens
ctcaaaaggagaa

SEQ ID NO: 406839 - DNA, 12 bp, Homo sapiens
ctcaaaatgtgc

SEQ ID NO: 406840 - DNA, 22 bp, Homo sapiens
ctcaaactaaaagacatttgtt

SEQ ID NO: 406841 - DNA, 21 bp, Homo sapiens
ctcaaactcctgacctcaggt

SEQ ID NO: 406842 - DNA, 16 bp, Homo sapiens
ctcaaagatctgaatt

SEQ ID NO: 406843 - DNA, 14 bp, Homo sapiens
ctcaaagatgtact

SEQ ID NO: 406844 - DNA, 16 bp, Homo sapiens
ctcaaagcatcaaata

SEQ ID NO: 406845 - DNA, 20 bp, Homo sapiens
ctcaaagcatcaaataatac

SEQ ID NO: 406846 - DNA, 16 bp, Homo sapiens
ctcaaaggactgacct

SEQ ID NO: 406847 - DNA, 18 bp, Homo sapiens
ctcaaaggactgacctgc

SEQ ID NO: 406848 - DNA, 16 bp, Homo sapiens
ctcaaatctattcaga

SEQ ID NO: 406849 - DNA, 20 bp, Homo sapiens
ctcaaatgtatatttaactt

SEQ ID NO: 406850 - DNA, 15 bp, Homo sapiens
ctcaacaagggagag

SEQ ID NO: 406851 - DNA, 19 bp, Homo sapiens
ctcaacaagggagagacct

SEQ ID NO: 406852 - DNA, 14 bp, Homo sapiens
ctcaacagatctgt

SEQ ID NO: 406853 - DNA, 14 bp, Homo sapiens
ctcaacccccctcc

SEQ ID NO: 406854 - DNA, 16 bp, Homo sapiens
ctcaaccctccctcag

SEQ ID NO: 406855 - DNA, 18 bp, Homo sapiens
ctcaaccctccctcagcc

SEQ ID NO: 406856 - DNA, 18 bp, Homo sapiens
ctcaacctctcagatccc

SEQ ID NO: 406857 - DNA, 15 bp, Homo sapiens
ctcaacctgtaaatt

SEQ ID NO: 406858 - DNA, 22 bp, Homo sapiens
ctcaactaaagaatagtgcctc

SEQ ID NO: 406859 - DNA, 17 bp, Homo sapiens
ctcaactctacccctgc

SEQ ID NO: 406860 - DNA, 20 bp, Homo sapiens
ctcaactctacccctgctcc

SEQ ID NO: 406861 - DNA, 20 bp, Homo sapiens
ctcaagaagacatggagact

SEQ ID NO: 406862 - DNA, 22 bp, Homo sapiens
ctcaagaagacatggagactcc

SEQ ID NO: 406863 - DNA, 18 bp, Homo sapiens
ctcaagattatattataa

SEQ ID NO: 406864 - DNA, 16 bp, Homo sapiens
ctcaagcactgacact

SEQ ID NO: 406865 - DNA, 18 bp, Homo sapiens
ctcaagcacttttcctgt

SEQ ID NO: 406866 - DNA, 13 bp, Homo sapiens
ctcaagcaggttt

SEQ ID NO: 406867 - DNA, 14 bp, Homo sapiens
ctcaagccaggaga

SEQ ID NO: 406868 - DNA, 15 bp, Homo sapiens
ctcaagccaggagac

SEQ ID NO: 406869 - DNA, 18 bp, Homo sapiens
ctcaagccaggagaccct

SEQ ID NO: 406870 - DNA, 19 bp, Homo sapiens
ctcaagccaggagaccctg

SEQ ID NO: 406871 - DNA, 22 bp, Homo sapiens
ctcaagccaggagaccctgtct

SEQ ID NO: 406872 - DNA, 20 bp, Homo sapiens
ctcaagcgctatccacagaa

SEQ ID NO: 406873 - DNA, 19 bp, Homo sapiens
ctcaaggcaccgcagcctg

SEQ ID NO: 406874 - DNA, 12 bp, Homo sapiens
ctcaagtgatag

SEQ ID NO: 406875 - DNA, 13 bp, Homo sapiens
ctcaagtgatagt

SEQ ID NO: 406876 - DNA, 14 bp, Homo sapiens
ctcaataaaggtca

SEQ ID NO: 406877 - DNA, 15 bp, Homo sapiens
ctcaataaaggtcat

SEQ ID NO: 406878 - DNA, 16 bp, Homo sapiens
ctcaatatataataaa

SEQ ID NO: 406879 - DNA, 12 bp, Homo sapiens
ctcaatattaaa

SEQ ID NO: 406880 - DNA, 16 bp, Homo sapiens
ctcaatattcaataaa

SEQ ID NO: 406881 - DNA, 18 bp, Homo sapiens
ctcaatattcctgaatga

SEQ ID NO: 406882 - DNA, 13 bp, Homo sapiens
ctcaatgccctgc

SEQ ID NO: 406883 - DNA, 15 bp, Homo sapiens
ctcaatgccctgcca

SEQ ID NO: 406884 - DNA, 15 bp, Homo sapiens
ctcaatggaggtttg

SEQ ID NO: 406885 - DNA, 13 bp, Homo sapiens
ctcaatgtgaaaa

SEQ ID NO: 406886 - DNA, 11 bp, Homo sapiens
ctcaatgtgct

SEQ ID NO: 406887 - DNA, 12 bp, Homo sapiens
ctcaatgtgctg

SEQ ID NO: 406888 - DNA, 15 bp, Homo sapiens
ctcaatgtgctgttg

SEQ ID NO: 406889 - DNA, 20 bp, Homo sapiens
ctcaatgtgctgttgattct

SEQ ID NO: 406890 - DNA, 13 bp, Homo sapiens
ctcaattgttttt

SEQ ID NO: 406891 - DNA, 21 bp, Homo sapiens
ctcaattttgtatttaatgat

SEQ ID NO: 406892 - DNA, 19 bp, Homo sapiens
ctcacaactccttccatcc

SEQ ID NO: 406893 - DNA, 16 bp, Homo sapiens
ctcacaatagcgtgag

SEQ ID NO: 406894 - DNA, 21 bp, Homo sapiens
cagcccagctgctctgcccag

SEQ ID NO: 406895 - DNA, 11 bp, Homo sapiens
cagcccagctt

SEQ ID NO: 406896 - DNA, 16 bp, Homo sapiens
cagcccagcttcctgg

SEQ ID NO: 406897 - DNA, 23 bp, Homo sapiens
cagcccaggccggggtggagcat

SEQ ID NO: 406898 - DNA, 19 bp, Homo sapiens
cagcccagggttcccccag

SEQ ID NO: 406899 - DNA, 17 bp, Homo sapiens
cagcccatgcccacctg

SEQ ID NO: 406900 - DNA, 24 bp, Homo sapiens
cagcccatgcccacctgcccatca

SEQ ID NO: 406901 - DNA, 23 bp, Homo sapiens
cagccccaactccaggggcacct

SEQ ID NO: 406902 - DNA, 12 bp, Homo sapiens
cagccccaccca

SEQ ID NO: 406903 - DNA, 13 bp, Homo sapiens
cagccccacccag

SEQ ID NO: 406904 - DNA, 14 bp, Homo sapiens
cagccccacccagg

SEQ ID NO: 406905 - DNA, 22 bp, Homo sapiens
cagccccacccctaagtgccca

SEQ ID NO: 406906 - DNA, 18 bp, Homo sapiens
cagccccacttcaccccc

SEQ ID NO: 406907 - DNA, 13 bp, Homo sapiens
cagccccagccca

SEQ ID NO: 406908 - DNA, 21 bp, Homo sapiens
cagccccagcccagcccagct

SEQ ID NO: 406909 - DNA, 12 bp, Homo sapiens
cagccccaggac

SEQ ID NO: 406910 - DNA, 16 bp, Homo sapiens
cagccccaggaccaag

SEQ ID NO: 406911 - DNA, 16 bp, Homo sapiens
cagccccagggccctg

SEQ ID NO: 406912 - DNA, 21 bp, Homo sapiens
cagccccagggccctgctcag

SEQ ID NO: 406913 - DNA, 19 bp, Homo sapiens
cagccccatagaaaacaat

SEQ ID NO: 406914 - DNA, 21 bp, Homo sapiens
cagccccatcccaaacccttc

SEQ ID NO: 406915 - DNA, 22 bp, Homo sapiens
cagccccatcccaaacccttca

SEQ ID NO: 406916 - DNA, 12 bp, Homo sapiens
cagccccatcct

SEQ ID NO: 406917 - DNA, 15 bp, Homo sapiens
cagccccctggatgg

SEQ ID NO: 406918 - DNA, 14 bp, Homo sapiens
cagccccggccact

SEQ ID NO: 406919 - DNA, 19 bp, Homo sapiens
cagccccggccactccctg

SEQ ID NO: 406920 - DNA, 22 bp, Homo sapiens
cagccccggccactccctgcca

SEQ ID NO: 406921 - DNA, 22 bp, Homo sapiens
cagccccgttttggggacgtga

SEQ ID NO: 406922 - DNA, 17 bp, Homo sapiens
cagcccctcttgccccc

SEQ ID NO: 406923 - DNA, 21 bp, Homo sapiens
cagcccctcttgccccccacc

SEQ ID NO: 406924 - DNA, 22 bp, Homo sapiens
cagcccctcttgccccccaccc

SEQ ID NO: 406925 - DNA, 19 bp, Homo sapiens
cagcccctggagctcctgc

SEQ ID NO: 406926 - DNA, 12 bp, Homo sapiens
cagcccctgggg

SEQ ID NO: 406927 - DNA, 19 bp, Homo sapiens
cagcccctggtactccccc

SEQ ID NO: 406928 - DNA, 17 bp, Homo sapiens
cagccccttctcccagc

SEQ ID NO: 406929 - DNA, 18 bp, Homo sapiens
cagccccttctcccagca

SEQ ID NO: 406930 - DNA, 15 bp, Homo sapiens
cagcccgaatgcctg

SEQ ID NO: 406931 - DNA, 16 bp, Homo sapiens
cagcccgaatgcctgt

SEQ ID NO: 406932 - DNA, 23 bp, Homo sapiens
cagcccgagtggtctcctctcag

SEQ ID NO: 406933 - DNA, 12 bp, Homo sapiens
cagcccggcctg

SEQ ID NO: 406934 - DNA, 21 bp, Homo sapiens
cagcccggcgccaccatcctg

SEQ ID NO: 406935 - DNA, 23 bp, Homo sapiens
cagcccgggagatccgccctggg

SEQ ID NO: 406936 - DNA, 18 bp, Homo sapiens
cagcccgtgaagcagtgc

SEQ ID NO: 406937 - DNA, 21 bp, Homo sapiens
cagcccgtgaagcagtgcctc

SEQ ID NO: 406938 - DNA, 22 bp, Homo sapiens
cagcccgtgaagcagtgcctcg

SEQ ID NO: 406939 - DNA, 21 bp, Homo sapiens
cagcccgtgtggccccttcac

SEQ ID NO: 406940 - DNA, 19 bp, Homo sapiens
cagccctaaggatctctca

SEQ ID NO: 406941 - DNA, 16 bp, Homo sapiens
cagccctaggctaccc

SEQ ID NO: 406942 - DNA, 23 bp, Homo sapiens
cagccctaggctacccttgccaa

SEQ ID NO: 406943 - DNA, 20 bp, Homo sapiens
cagccctagtgggagcccag

SEQ ID NO: 406944 - DNA, 21 bp, Homo sapiens
cagccctagtgggagcccagc

SEQ ID NO: 406945 - DNA, 13 bp, Homo sapiens
cagccctccagag

SEQ ID NO: 406946 - DNA, 14 bp, Homo sapiens
cagccctccagagc

SEQ ID NO: 406947 - DNA, 16 bp, Homo sapiens
cagccctccctgcccc

SEQ ID NO: 406948 - DNA, 18 bp, Homo sapiens
cagccctccctgcccctc

SEQ ID NO: 406949 - DNA, 15 bp, Homo sapiens
cagccctgctgcttc

SEQ ID NO: 406950 - DNA, 19 bp, Homo sapiens
cagccctgctgcttcctaa

SEQ ID NO: 406951 - DNA, 13 bp, Homo sapiens
cagccctgctttg

SEQ ID NO: 406952 - DNA, 19 bp, Homo sapiens
cagccctgctttgggctgc

SEQ ID NO: 406953 - DNA, 20 bp, Homo sapiens
cagccctgctttgggctgcc

SEQ ID NO: 406954 - DNA, 23 bp, Homo sapiens
cagccctgctttgggctgccctg

SEQ ID NO: 406955 - DNA, 14 bp, Homo sapiens
cagccctggggctg

SEQ ID NO: 406956 - DNA, 19 bp, Homo sapiens
cagccctggggctgggccc

SEQ ID NO: 406957 - DNA, 21 bp, Homo sapiens
cagccctggttctccatcccc

SEQ ID NO: 406958 - DNA, 16 bp, Homo sapiens
cagccctgtcagtgca

SEQ ID NO: 406959 - DNA, 16 bp, Homo sapiens
cagcccttcccaggcc

SEQ ID NO: 406960 - DNA, 17 bp, Homo sapiens
cagcccttcccaggcca

SEQ ID NO: 406961 - DNA, 12 bp, Homo sapiens
cagcccttccct

SEQ ID NO: 406962 - DNA, 17 bp, Homo sapiens
cagcccttccctgcttt

SEQ ID NO: 406963 - DNA, 16 bp, Homo sapiens
cagcccttccctggcc

SEQ ID NO: 406964 - DNA, 16 bp, Homo sapiens
cagcccttcctcctga

SEQ ID NO: 406965 - DNA, 15 bp, Homo sapiens
cagcccttctgcctt

SEQ ID NO: 406966 - DNA, 16 bp, Homo sapiens
cagcccttctgccttt

SEQ ID NO: 406967 - DNA, 15 bp, Homo sapiens
cagcccttgggcagt

SEQ ID NO: 406968 - DNA, 12 bp, Homo sapiens
cagccctttcca

SEQ ID NO: 406969 - DNA, 13 bp, Homo sapiens
cagccctttccag

SEQ ID NO: 406970 - DNA, 16 bp, Homo sapiens
cagccctttccagggc

SEQ ID NO: 406971 - DNA, 21 bp, Homo sapiens
cagccgagatcggggtggcag

SEQ ID NO: 406972 - DNA, 16 bp, Homo sapiens
cagccgccggaagtgg

SEQ ID NO: 406973 - DNA, 18 bp, Homo sapiens
cagccgcgctctgcccct

SEQ ID NO: 406974 - DNA, 17 bp, Homo sapiens
cagccgctaggagagac

SEQ ID NO: 406975 - DNA, 17 bp, Homo sapiens
cagccggatcttggaga

SEQ ID NO: 406976 - DNA, 22 bp, Homo sapiens
cagccggatcttggagacaatt

SEQ ID NO: 406977 - DNA, 15 bp, Homo sapiens
cagccggcacagggt

SEQ ID NO: 406978 - DNA, 17 bp, Homo sapiens
cagccggggaagacttg

SEQ ID NO: 406979 - DNA, 19 bp, Homo sapiens
cagccggggcctgcctagc

SEQ ID NO: 406980 - DNA, 15 bp, Homo sapiens
cagccggggtggggt

SEQ ID NO: 406981 - DNA, 22 bp, Homo sapiens
cagccggggtggggtgcctgag

SEQ ID NO: 406982 - DNA, 23 bp, Homo sapiens
cagccggggtggggtgcctgagc

SEQ ID NO: 406983 - DNA, 22 bp, Homo sapiens
cagccgtcccgcgttcaagact

SEQ ID NO: 406984 - DNA, 20 bp, Homo sapiens
cagccgtgccttcagctcta

SEQ ID NO: 406985 - DNA, 19 bp, Homo sapiens
cagcctaggggtcagggac

SEQ ID NO: 406986 - DNA, 16 bp, Homo sapiens
cagcctcacccctgca

SEQ ID NO: 406987 - DNA, 11 bp, Homo sapiens
cagcctcaggg

SEQ ID NO: 406988 - DNA, 14 bp, Homo sapiens
cagcctcagggctt

SEQ ID NO: 406989 - DNA, 16 bp, Homo sapiens
cagcctcagtgccact

SEQ ID NO: 406990 - DNA, 19 bp, Homo sapiens
cagcctcagtgccacttga

SEQ ID NO: 406991 - DNA, 14 bp, Homo sapiens
cagcctccaagaaa

SEQ ID NO: 406992 - DNA, 14 bp, Homo sapiens
cagcctccaagctc

SEQ ID NO: 406993 - DNA, 20 bp, Homo sapiens
cagcctccagagccagcctg

SEQ ID NO: 406994 - DNA, 23 bp, Homo sapiens
cagcctccagagccagcctggga

SEQ ID NO: 406995 - DNA, 12 bp, Homo sapiens
cagcctccaggg

SEQ ID NO: 406996 - DNA, 18 bp, Homo sapiens
cagcctccatgctgcctc

SEQ ID NO: 406997 - DNA, 14 bp, Homo sapiens
cagcctcccacccc

SEQ ID NO: 406998 - DNA, 18 bp, Homo sapiens
cagcctcccacccccatc

SEQ ID NO: 406999 - DNA, 13 bp, Homo sapiens
cagcctcccccag

SEQ ID NO: 407000 - DNA, 14 bp, Homo sapiens
cagcctcccccagg

SEQ ID NO: 407001 - DNA, 15 bp, Homo sapiens
cagcctcccccaggc

SEQ ID NO: 407002 - DNA, 17 bp, Homo sapiens
cagcctcccccaggctg

SEQ ID NO: 407003 - DNA, 11 bp, Homo sapiens
cagcctcccct

SEQ ID NO: 407004 - DNA, 14 bp, Homo sapiens
cagcctcccctccc

SEQ ID NO: 407005 - DNA, 22 bp, Homo sapiens
cagcctcccctcccctggggac

SEQ ID NO: 407006 - DNA, 19 bp, Homo sapiens
cagcctcccgagtagctgg

SEQ ID NO: 407007 - DNA, 14 bp, Homo sapiens
cagcctccctgtca

SEQ ID NO: 407008 - DNA, 15 bp, Homo sapiens
cagcctccctgtcac

SEQ ID NO: 407009 - DNA, 16 bp, Homo sapiens
cagcctccctgtcact

SEQ ID NO: 407010 - DNA, 17 bp, Homo sapiens
cagcctccgccattcca

SEQ ID NO: 407011 - DNA, 16 bp, Homo sapiens
cagcctcctgagcctg

SEQ ID NO: 407012 - DNA, 16 bp, Homo sapiens
cagcctcctgtttgca

SEQ ID NO: 407013 - DNA, 22 bp, Homo sapiens
cagcctcgaactcctgggctca

SEQ ID NO: 407014 - DNA, 19 bp, Homo sapiens
cagcctctacagccgtccc

SEQ ID NO: 407015 - DNA, 19 bp, Homo sapiens
cagcctctcaaatagctgg

SEQ ID NO: 407016 - DNA, 20 bp, Homo sapiens
cagcctctccccgctctgga

SEQ ID NO: 407017 - DNA, 13 bp, Homo sapiens
cagcctctcccgg

SEQ ID NO: 407018 - DNA, 20 bp, Homo sapiens
cagcctctcccggctgcctg

SEQ ID NO: 407019 - DNA, 21 bp, Homo sapiens
cagcctctcccggctgcctgc

SEQ ID NO: 407020 - DNA, 22 bp, Homo sapiens
cagcctctcccggctgcctgcc

SEQ ID NO: 407021 - DNA, 12 bp, Homo sapiens
cagcctctctgc

SEQ ID NO: 407022 - DNA, 19 bp, Homo sapiens
cagcctctgagcccctggg

SEQ ID NO: 407023 - DNA, 21 bp, Homo sapiens
cagcctctgagcccctgggac

SEQ ID NO: 407024 - DNA, 13 bp, Homo sapiens
cagcctctgccag

SEQ ID NO: 407025 - DNA, 14 bp, Homo sapiens
cagcctctgcctcc

SEQ ID NO: 407026 - DNA, 15 bp, Homo sapiens
cagcctctgcctccc

SEQ ID NO: 407027 - DNA, 18 bp, Homo sapiens
cagcctctgcctcccagg

SEQ ID NO: 407028 - DNA, 13 bp, Homo sapiens
ctcacacacacag

SEQ ID NO: 407029 - DNA, 13 bp, Homo sapiens
ctcacacagctgg

SEQ ID NO: 407030 - DNA, 14 bp, Homo sapiens
ctcacacctgggcc

SEQ ID NO: 407031 - DNA, 16 bp, Homo sapiens
ctcacagagccaactc

SEQ ID NO: 407032 - DNA, 17 bp, Homo sapiens
ctcacagccaccacctg

SEQ ID NO: 407033 - DNA, 17 bp, Homo sapiens
ctcacagcctctccctt

SEQ ID NO: 407034 - DNA, 19 bp, Homo sapiens
ctcacagtctctttaatct

SEQ ID NO: 407035 - DNA, 17 bp, Homo sapiens
ctcacagtgttgcccag

SEQ ID NO: 407036 - DNA, 14 bp, Homo sapiens
ctcacatctccctt

SEQ ID NO: 407037 - DNA, 16 bp, Homo sapiens
ctcacatctttaactt

SEQ ID NO: 407038 - DNA, 23 bp, Homo sapiens
ctcacatgcccgctgtcccaggg

SEQ ID NO: 407039 - DNA, 20 bp, Homo sapiens
ctcacatgtggcaaaatatg

SEQ ID NO: 407040 - DNA, 19 bp, Homo sapiens
ctcacattccctctcatcc

SEQ ID NO: 407041 - DNA, 20 bp, Homo sapiens
ctcacattccctctcatcca

SEQ ID NO: 407042 - DNA, 14 bp, Homo sapiens
ctcaccaaaatata

SEQ ID NO: 407043 - DNA, 22 bp, Homo sapiens
ctcaccaataacttcagagaag

SEQ ID NO: 407044 - DNA, 21 bp, Homo sapiens
ctcaccagggtccgcaccagc

SEQ ID NO: 407045 - DNA, 17 bp, Homo sapiens
ctcaccattgtgaagca

SEQ ID NO: 407046 - DNA, 17 bp, Homo sapiens
ctcaccatttaatcatt

SEQ ID NO: 407047 - DNA, 22 bp, Homo sapiens
ctcaccatttaatcatttccag

SEQ ID NO: 407048 - DNA, 13 bp, Homo sapiens
ctcaccatttcat

SEQ ID NO: 407049 - DNA, 17 bp, Homo sapiens
ctcaccatttggatcct

SEQ ID NO: 407050 - DNA, 13 bp, Homo sapiens
ctcacccagaagg

SEQ ID NO: 407051 - DNA, 18 bp, Homo sapiens
ctcacccattgtctcatt

SEQ ID NO: 407052 - DNA, 12 bp, Homo sapiens
ctcaccccagtg

SEQ ID NO: 407053 - DNA, 22 bp, Homo sapiens
ctcaccccatcccacaccctgg

SEQ ID NO: 407054 - DNA, 14 bp, Homo sapiens
ctcacccccacccc

SEQ ID NO: 407055 - DNA, 16 bp, Homo sapiens
ctcacccccacccctg

SEQ ID NO: 407056 - DNA, 20 bp, Homo sapiens
ctcacccccacccctgtacc

SEQ ID NO: 407057 - DNA, 14 bp, Homo sapiens
ctcacccctgggca

SEQ ID NO: 407058 - DNA, 14 bp, Homo sapiens
ctcacccgctgccc

SEQ ID NO: 407059 - DNA, 14 bp, Homo sapiens
ctcaccctgcctta

SEQ ID NO: 407060 - DNA, 21 bp, Homo sapiens
ctcaccctgccttatcttgca

SEQ ID NO: 407061 - DNA, 23 bp, Homo sapiens
ctcaccctgcttggggcctggcg

SEQ ID NO: 407062 - DNA, 23 bp, Homo sapiens
ctcacctaatgtttatgagccag

SEQ ID NO: 407063 - DNA, 20 bp, Homo sapiens
ctcacctaccctcaaagtag

SEQ ID NO: 407064 - DNA, 17 bp, Homo sapiens
ctcacctacttcctcct

SEQ ID NO: 407065 - DNA, 15 bp, Homo sapiens
ctcacctcaggaccc

SEQ ID NO: 407066 - DNA, 13 bp, Homo sapiens
ctcacctgcagcc

SEQ ID NO: 407067 - DNA, 16 bp, Homo sapiens
ctcacctggcttccca

SEQ ID NO: 407068 - DNA, 17 bp, Homo sapiens
ctcacctggcttcccag

SEQ ID NO: 407069 - DNA, 18 bp, Homo sapiens
ctcacctggcttcccagg

SEQ ID NO: 407070 - DNA, 19 bp, Homo sapiens
ctcacctggcttcccagga

SEQ ID NO: 407071 - DNA, 20 bp, Homo sapiens
ctcacctggcttcccaggac

SEQ ID NO: 407072 - DNA, 15 bp, Homo sapiens
ctcacctgggccttt

SEQ ID NO: 407073 - DNA, 21 bp, Homo sapiens
ctcacctgggcctttcctgtg

SEQ ID NO: 407074 - DNA, 17 bp, Homo sapiens
ctcacgactcttcctgc

SEQ ID NO: 407075 - DNA, 17 bp, Homo sapiens
ctcacgctcccccgcag

SEQ ID NO: 407076 - DNA, 13 bp, Homo sapiens
ctcacgctctcca

SEQ ID NO: 407077 - DNA, 15 bp, Homo sapiens
ctcacgctctggaca

SEQ ID NO: 407078 - DNA, 15 bp, Homo sapiens
ctcacggggcctcca

SEQ ID NO: 407079 - DNA, 22 bp, Homo sapiens
ctcacggggttggctgttccag

SEQ ID NO: 407080 - DNA, 19 bp, Homo sapiens
ctcactacaacctccacct

SEQ ID NO: 407081 - DNA, 14 bp, Homo sapiens
ctcactatctctag

SEQ ID NO: 407082 - DNA, 16 bp, Homo sapiens
ctcactatgtttctca

SEQ ID NO: 407083 - DNA, 17 bp, Homo sapiens
ctcactatgtttctcag

SEQ ID NO: 407084 - DNA, 19 bp, Homo sapiens
ctcactatgtttctcagac

SEQ ID NO: 407085 - DNA, 15 bp, Homo sapiens
ctcactccactcccc

SEQ ID NO: 407086 - DNA, 19 bp, Homo sapiens
ctcactccccagccccacc

SEQ ID NO: 407087 - DNA, 13 bp, Homo sapiens
ctcactccctaaa

SEQ ID NO: 407088 - DNA, 16 bp, Homo sapiens
ctcactcctacctggt

SEQ ID NO: 407089 - DNA, 13 bp, Homo sapiens
ctcactcctgagt

SEQ ID NO: 407090 - DNA, 11 bp, Homo sapiens
ctcactcctgc

SEQ ID NO: 407091 - DNA, 11 bp, Homo sapiens
ctcactcctgt

SEQ ID NO: 407092 - DNA, 20 bp, Homo sapiens
ctcactcctgttacttacct

SEQ ID NO: 407093 - DNA, 12 bp, Homo sapiens
ctcactctgcca

SEQ ID NO: 407094 - DNA, 13 bp, Homo sapiens
ctcactctgccag

SEQ ID NO: 407095 - DNA, 19 bp, Homo sapiens
ctcactcttcctcatcctg

SEQ ID NO: 407096 - DNA, 13 bp, Homo sapiens
ctcactctttctt

SEQ ID NO: 407097 - DNA, 22 bp, Homo sapiens
ctcactgagaagattgtgaata

SEQ ID NO: 407098 - DNA, 12 bp, Homo sapiens
ctcactgcagcc

SEQ ID NO: 407099 - DNA, 20 bp, Homo sapiens
ctcactgcccgcacaccctc

SEQ ID NO: 407100 - DNA, 17 bp, Homo sapiens
ctcactgccctccctcg

SEQ ID NO: 407101 - DNA, 12 bp, Homo sapiens
ctcactgctcaa

SEQ ID NO: 407102 - DNA, 14 bp, Homo sapiens
ctcactgctcaaga

SEQ ID NO: 407103 - DNA, 16 bp, Homo sapiens
ctcactgctcaagaag

SEQ ID NO: 407104 - DNA, 20 bp, Homo sapiens
ctcactgctcaagaagacat

SEQ ID NO: 407105 - DNA, 21 bp, Homo sapiens
ctcactgctcaagaagacatg

SEQ ID NO: 407106 - DNA, 18 bp, Homo sapiens
ctcactgctggggagtcc

SEQ ID NO: 407107 - DNA, 21 bp, Homo sapiens
ctcactgcttctgctttttct

SEQ ID NO: 407108 - DNA, 14 bp, Homo sapiens
ctcactggctgggg

SEQ ID NO: 407109 - DNA, 13 bp, Homo sapiens
ctcactgggtggg

SEQ ID NO: 407110 - DNA, 12 bp, Homo sapiens
ctcactgtgctc

SEQ ID NO: 407111 - DNA, 13 bp, Homo sapiens
ctcactgtgctcc

SEQ ID NO: 407112 - DNA, 15 bp, Homo sapiens
ctcactgtgctccta

SEQ ID NO: 407113 - DNA, 20 bp, Homo sapiens
ctcactgttccctctgctcc

SEQ ID NO: 407114 - DNA, 21 bp, Homo sapiens
ctcactgttgaattttctcta

SEQ ID NO: 407115 - DNA, 20 bp, Homo sapiens
ctcacttccatacagctcta

SEQ ID NO: 407116 - DNA, 23 bp, Homo sapiens
ctcacttttcacttgtcttgctc

SEQ ID NO: 407117 - DNA, 17 bp, Homo sapiens
ctcagaaaacttctctt

SEQ ID NO: 407118 - DNA, 17 bp, Homo sapiens
ctcagaaagtcaccagg

SEQ ID NO: 407119 - DNA, 18 bp, Homo sapiens
ctcagaaagtcaccagga

SEQ ID NO: 407120 - DNA, 20 bp, Homo sapiens
ctcagaaagtcaccaggact

SEQ ID NO: 407121 - DNA, 14 bp, Homo sapiens
ctcagaacagtctg

SEQ ID NO: 407122 - DNA, 12 bp, Homo sapiens
ctcagaagatgg

SEQ ID NO: 407123 - DNA, 15 bp, Homo sapiens
ctcagaagtgaaaaa

SEQ ID NO: 407124 - DNA, 19 bp, Homo sapiens
ctcagaagtgaaaaagact

SEQ ID NO: 407125 - DNA, 13 bp, Homo sapiens
ctcagaccaactc

SEQ ID NO: 407126 - DNA, 23 bp, Homo sapiens
ctcagacgagacaccctaactct

SEQ ID NO: 407127 - DNA, 17 bp, Homo sapiens
ctcagacgggctgagag

SEQ ID NO: 407128 - DNA, 17 bp, Homo sapiens
ctcagactcatacagaa

SEQ ID NO: 407129 - DNA, 16 bp, Homo sapiens
ctcagacttaccagga

SEQ ID NO: 407130 - DNA, 21 bp, Homo sapiens
ctcagagaaatatgcagaagg

SEQ ID NO: 407131 - DNA, 16 bp, Homo sapiens
ctcagagaccgtgagc

SEQ ID NO: 407132 - DNA, 13 bp, Homo sapiens
ctcagagcagagc

SEQ ID NO: 407133 - DNA, 15 bp, Homo sapiens
ctcagagccacccct

SEQ ID NO: 407134 - DNA, 14 bp, Homo sapiens
ctcagagccctgcc

SEQ ID NO: 407135 - DNA, 19 bp, Homo sapiens
ctcagaggagtctgggaag

SEQ ID NO: 407136 - DNA, 22 bp, Homo sapiens
ctcagaggctatagctgggaac

SEQ ID NO: 407137 - DNA, 14 bp, Homo sapiens
ctcagagtccaggc

SEQ ID NO: 407138 - DNA, 18 bp, Homo sapiens
ctcagagtccaggcccca

SEQ ID NO: 407139 - DNA, 22 bp, Homo sapiens
ctcagatacacaagtgagggct

SEQ ID NO: 407140 - DNA, 14 bp, Homo sapiens
ctcagatatttata

SEQ ID NO: 407141 - DNA, 17 bp, Homo sapiens
ctcagatatttatattt

SEQ ID NO: 407142 - DNA, 20 bp, Homo sapiens
ctcagatcactactgcagtc

SEQ ID NO: 407143 - DNA, 15 bp, Homo sapiens
ctcagatccctcggt

SEQ ID NO: 407144 - DNA, 23 bp, Homo sapiens
ctcagcaaattcttgaataaact

SEQ ID NO: 407145 - DNA, 19 bp, Homo sapiens
ctcagcaagtgctgagtct

SEQ ID NO: 407146 - DNA, 12 bp, Homo sapiens
ctcagcaagtgt

SEQ ID NO: 407147 - DNA, 14 bp, Homo sapiens
ctcagcaagtgtac

SEQ ID NO: 407148 - DNA, 13 bp, Homo sapiens
ctcagcacagcct

SEQ ID NO: 407149 - DNA, 18 bp, Homo sapiens
ctcagcagttgacatcca

SEQ ID NO: 407150 - DNA, 19 bp, Homo sapiens
ctcagcatcagcgtggcag

SEQ ID NO: 407151 - DNA, 15 bp, Homo sapiens
ctcagccagctgccc

SEQ ID NO: 407152 - DNA, 19 bp, Homo sapiens
ctcagcccacatagtgatg

SEQ ID NO: 407153 - DNA, 21 bp, Homo sapiens
ctcagcccacatagtgatggt

SEQ ID NO: 407154 - DNA, 16 bp, Homo sapiens
ctcagcccacccccct

SEQ ID NO: 407155 - DNA, 19 bp, Homo sapiens
ctcagcccacccccctcat

SEQ ID NO: 407156 - DNA, 11 bp, Homo sapiens
ctcagccccag

SEQ ID NO: 407157 - DNA, 15 bp, Homo sapiens
ctcagccccagccca

SEQ ID NO: 407158 - DNA, 13 bp, Homo sapiens
ctcagccccaggg

SEQ ID NO: 407159 - DNA, 18 bp, Homo sapiens
ctcagccccagggccctg

SEQ ID NO: 407160 - DNA, 18 bp, Homo sapiens
ctcagccccggccactcc

SEQ ID NO: 407161 - DNA, 18 bp, Homo sapiens
ctcagcccctcttgcccc

SEQ ID NO: 407162 - DNA, 19 bp, Homo sapiens
ctcagccctccctgcccct

SEQ ID NO: 407163 - DNA, 15 bp, Homo sapiens
ctcagccctgaggtg

SEQ ID NO: 407164 - DNA, 23 bp, Homo sapiens
ctcagcccttgcccccatccctc

SEQ ID NO: 407165 - DNA, 15 bp, Homo sapiens
ctcagcctcctgagc

SEQ ID NO: 407166 - DNA, 22 bp, Homo sapiens
ctcagcctcctgagtagctgga

SEQ ID NO: 407167 - DNA, 22 bp, Homo sapiens
ctcagcctcctgtgtagctggg

SEQ ID NO: 407168 - DNA, 16 bp, Homo sapiens
ctcagccttacatttg

SEQ ID NO: 407169 - DNA, 18 bp, Homo sapiens
ctcagccttacatttgtg

SEQ ID NO: 407170 - DNA, 13 bp, Homo sapiens
ctcagccttccga

SEQ ID NO: 407171 - DNA, 14 bp, Homo sapiens
ctcagcgaatgaat

SEQ ID NO: 407172 - DNA, 13 bp, Homo sapiens
ctcagcgctccct

SEQ ID NO: 407173 - DNA, 16 bp, Homo sapiens
ctcagcgctgcccaca

SEQ ID NO: 407174 - DNA, 23 bp, Homo sapiens
ctcagcgtttttttgtttttaat

SEQ ID NO: 407175 - DNA, 18 bp, Homo sapiens
ctcagctattaagaaaat

SEQ ID NO: 407176 - DNA, 12 bp, Homo sapiens
ctcagctccact

SEQ ID NO: 407177 - DNA, 15 bp, Homo sapiens
ctcagctccctggaa

SEQ ID NO: 407178 - DNA, 13 bp, Homo sapiens
ctcagctctccac

SEQ ID NO: 407179 - DNA, 15 bp, Homo sapiens
ctcagctctctggga

SEQ ID NO: 407180 - DNA, 13 bp, Homo sapiens
ctcagctctggct

SEQ ID NO: 407181 - DNA, 16 bp, Homo sapiens
ctcagctctgggagag

SEQ ID NO: 407182 - DNA, 18 bp, Homo sapiens
ctcagctctgggagagga

SEQ ID NO: 407183 - DNA, 14 bp, Homo sapiens
ctcagctgacacat

SEQ ID NO: 407184 - DNA, 19 bp, Homo sapiens
ctcagctgagaaggccagc

SEQ ID NO: 407185 - DNA, 13 bp, Homo sapiens
ctcagctgcacat

SEQ ID NO: 407186 - DNA, 17 bp, Homo sapiens
ctcagctgcacattcct

SEQ ID NO: 407187 - DNA, 21 bp, Homo sapiens
ctcagctgcacattcctggcc

SEQ ID NO: 407188 - DNA, 12 bp, Homo sapiens
ctcagctgcctc

SEQ ID NO: 407189 - DNA, 18 bp, Homo sapiens
ctcagctgcctcacttcc

SEQ ID NO: 407190 - DNA, 18 bp, Homo sapiens
ctcagcttctaattttgt

SEQ ID NO: 407191 - DNA, 20 bp, Homo sapiens
ctcagcttctaattttgtgc

SEQ ID NO: 407192 - DNA, 15 bp, Homo sapiens
ctcaggaactagact

SEQ ID NO: 407193 - DNA, 17 bp, Homo sapiens
ctcaggacccaggccct

SEQ ID NO: 407194 - DNA, 15 bp, Homo sapiens
ctcaggactcctctc

SEQ ID NO: 407195 - DNA, 16 bp, Homo sapiens
ctcaggactcctctcc

SEQ ID NO: 407196 - DNA, 17 bp, Homo sapiens
ctcaggagaaggcctgc

SEQ ID NO: 407197 - DNA, 12 bp, Homo sapiens
ctcaggagcaca

SEQ ID NO: 407198 - DNA, 14 bp, Homo sapiens
ctcaggagcacagg

SEQ ID NO: 407199 - DNA, 15 bp, Homo sapiens
ctcaggagcacaggc

SEQ ID NO: 407200 - DNA, 13 bp, Homo sapiens
ctcaggcaagccc

SEQ ID NO: 407201 - DNA, 14 bp, Homo sapiens
ctcaggcaagcccc

SEQ ID NO: 407202 - DNA, 15 bp, Homo sapiens
ctcaggcaagcccct

SEQ ID NO: 407203 - DNA, 16 bp, Homo sapiens
ctcaggcaagcccctc

SEQ ID NO: 407204 - DNA, 19 bp, Homo sapiens
ctcaggcaagcccctcagc

SEQ ID NO: 407205 - DNA, 21 bp, Homo sapiens
ctcaggcaagcccctcagccc

SEQ ID NO: 407206 - DNA, 23 bp, Homo sapiens
ctcaggcaagcccctcagccctt

SEQ ID NO: 407207 - DNA, 18 bp, Homo sapiens
ctcaggcaattccttttg

SEQ ID NO: 407208 - DNA, 20 bp, Homo sapiens
ctcaggcagaggatgttctg

SEQ ID NO: 407209 - DNA, 21 bp, Homo sapiens
ctcaggcagaggatgttctgg

SEQ ID NO: 407210 - DNA, 17 bp, Homo sapiens
ctcaggcataggcctgg

SEQ ID NO: 407211 - DNA, 18 bp, Homo sapiens
ctcaggcatcattccacc

SEQ ID NO: 407212 - DNA, 23 bp, Homo sapiens
ctcaggccacctgcccccttctc

SEQ ID NO: 407213 - DNA, 16 bp, Homo sapiens
ctcaggccgggctttc

SEQ ID NO: 407214 - DNA, 20 bp, Homo sapiens
ctcaggcctcacctggcttc

SEQ ID NO: 407215 - DNA, 13 bp, Homo sapiens
ctcaggcctccca

SEQ ID NO: 407216 - DNA, 15 bp, Homo sapiens
ctcaggcctgccaat

SEQ ID NO: 407217 - DNA, 21 bp, Homo sapiens
ctcaggcgatccacctgtctc

SEQ ID NO: 407218 - DNA, 11 bp, Homo sapiens
ctcaggctccg

SEQ ID NO: 407219 - DNA, 17 bp, Homo sapiens
ctcaggctgctggagga

SEQ ID NO: 407220 - DNA, 15 bp, Homo sapiens
ctcaggcttgaaatg

SEQ ID NO: 407221 - DNA, 20 bp, Homo sapiens
ctcagggccatgcctgcccc

SEQ ID NO: 407222 - DNA, 14 bp, Homo sapiens
ctcagggcccacct

SEQ ID NO: 407223 - DNA, 15 bp, Homo sapiens
ctcagggcccacctc

SEQ ID NO: 407224 - DNA, 17 bp, Homo sapiens
ctcagggcccacctcct

SEQ ID NO: 407225 - DNA, 20 bp, Homo sapiens
ctcagggcccacctcctcca

SEQ ID NO: 407226 - DNA, 22 bp, Homo sapiens
ctcagggcccacctcctccagc

SEQ ID NO: 407227 - DNA, 11 bp, Homo sapiens
ctcagggctgg

SEQ ID NO: 407228 - DNA, 15 bp, Homo sapiens
ctcagggctggagtg

SEQ ID NO: 407229 - DNA, 16 bp, Homo sapiens
ctcagggctggagtgc

SEQ ID NO: 407230 - DNA, 22 bp, Homo sapiens
ctcagggctggagtgcgctctt

SEQ ID NO: 407231 - DNA, 14 bp, Homo sapiens
ctcagggcttcctt

SEQ ID NO: 407232 - DNA, 19 bp, Homo sapiens
ctcagggggtcagcagagt

SEQ ID NO: 407233 - DNA, 17 bp, Homo sapiens
ctcaggtagccaccacc

SEQ ID NO: 407234 - DNA, 17 bp, Homo sapiens
ctcaggtagtactggga

SEQ ID NO: 407235 - DNA, 17 bp, Homo sapiens
ctcaggtccctgcaggg

SEQ ID NO: 407236 - DNA, 20 bp, Homo sapiens
ctcaggtgccactccctgag

SEQ ID NO: 407237 - DNA, 23 bp, Homo sapiens
ctcaggtgccactccctgagctt

SEQ ID NO: 407238 - DNA, 13 bp, Homo sapiens
ctcaggtggggag

SEQ ID NO: 407239 - DNA, 22 bp, Homo sapiens
ctcaggtggtgtccttcttcct

SEQ ID NO: 407240 - DNA, 23 bp, Homo sapiens
ctcaggtggtgtccttcttcctc

SEQ ID NO: 407241 - DNA, 14 bp, Homo sapiens
ctcaggtgttgcca

SEQ ID NO: 407242 - DNA, 13 bp, Homo sapiens
ctcaggttccaaa

SEQ ID NO: 407243 - DNA, 14 bp, Homo sapiens
ctcaggttccagaa

SEQ ID NO: 407244 - DNA, 22 bp, Homo sapiens
ctcaggttgtctgaagtcactg

SEQ ID NO: 407245 - DNA, 23 bp, Homo sapiens
ctcagtattgagacactgtcaag

SEQ ID NO: 407246 - DNA, 21 bp, Homo sapiens
ctcagtcccccaccacactga

SEQ ID NO: 407247 - DNA, 22 bp, Homo sapiens
ctcagtcccccaccacactgaa

SEQ ID NO: 407248 - DNA, 22 bp, Homo sapiens
ctcagtccctccctcctggctc

SEQ ID NO: 407249 - DNA, 19 bp, Homo sapiens
ctcagtcctcaaagctttt

SEQ ID NO: 407250 - DNA, 15 bp, Homo sapiens
ctcagtctccctttc

SEQ ID NO: 407251 - DNA, 20 bp, Homo sapiens
ctcagtcttccctagggctg

SEQ ID NO: 407252 - DNA, 14 bp, Homo sapiens
ctcagtgcagcaat

SEQ ID NO: 407253 - DNA, 13 bp, Homo sapiens
ctcagtgccactt

SEQ ID NO: 407254 - DNA, 20 bp, Homo sapiens
ctcagtgccacttgacattc

SEQ ID NO: 407255 - DNA, 23 bp, Homo sapiens
ctcagtgccacttgacattcctt

SEQ ID NO: 407256 - DNA, 14 bp, Homo sapiens
ctcagtgcctcctg

SEQ ID NO: 407257 - DNA, 21 bp, Homo sapiens
ctcagtgctctcctaccccac

SEQ ID NO: 407258 - DNA, 16 bp, Homo sapiens
ctcagtggactttcca

SEQ ID NO: 407259 - DNA, 17 bp, Homo sapiens
ctcagtgtcatttatga

SEQ ID NO: 407260 - DNA, 14 bp, Homo sapiens
ctcagtgtgaagcc

SEQ ID NO: 407261 - DNA, 15 bp, Homo sapiens
ctcagtgtgaagcct

SEQ ID NO: 407262 - DNA, 14 bp, Homo sapiens
ctcagttccaatgt

SEQ ID NO: 407263 - DNA, 14 bp, Homo sapiens
ctcagttcccttgg

SEQ ID NO: 407264 - DNA, 17 bp, Homo sapiens
ctcagttcccttggcct

SEQ ID NO: 407265 - DNA, 18 bp, Homo sapiens
ctcagttcccttggcctc

SEQ ID NO: 407266 - DNA, 21 bp, Homo sapiens
cagctagactggagtgaggct

SEQ ID NO: 407267 - DNA, 14 bp, Homo sapiens
cagctaggactgag

SEQ ID NO: 407268 - DNA, 20 bp, Homo sapiens
cagctaggactgaggagtgg

SEQ ID NO: 407269 - DNA, 20 bp, Homo sapiens
cagctaggctgagatgcacc

SEQ ID NO: 407270 - DNA, 19 bp, Homo sapiens
cagctatcagtgttcttct

SEQ ID NO: 407271 - DNA, 19 bp, Homo sapiens
cagctatctagatagctga

SEQ ID NO: 407272 - DNA, 17 bp, Homo sapiens
cagctatgggagcccca

SEQ ID NO: 407273 - DNA, 14 bp, Homo sapiens
cagctattcacaca

SEQ ID NO: 407274 - DNA, 23 bp, Homo sapiens
cagctatttctcatcaattctct

SEQ ID NO: 407275 - DNA, 14 bp, Homo sapiens
cagctcacccctgg

SEQ ID NO: 407276 - DNA, 19 bp, Homo sapiens
cagctcacccctgggcagg

SEQ ID NO: 407277 - DNA, 20 bp, Homo sapiens
cagctcacccctgggcaggc

SEQ ID NO: 407278 - DNA, 21 bp, Homo sapiens
cagctcacccctgggcaggcg

SEQ ID NO: 407279 - DNA, 21 bp, Homo sapiens
cagctcactgcaagctccaac

SEQ ID NO: 407280 - DNA, 21 bp, Homo sapiens
cagctcagcagttcacttcct

SEQ ID NO: 407281 - DNA, 13 bp, Homo sapiens
cagctcagccccg

SEQ ID NO: 407282 - DNA, 17 bp, Homo sapiens
cagctcagccccggcca

SEQ ID NO: 407283 - DNA, 18 bp, Homo sapiens
cagctcagccccggccac

SEQ ID NO: 407284 - DNA, 16 bp, Homo sapiens
cagctcaggcgcagcc

SEQ ID NO: 407285 - DNA, 14 bp, Homo sapiens
cagctcaggggcag

SEQ ID NO: 407286 - DNA, 15 bp, Homo sapiens
cagctcaggggcagc

SEQ ID NO: 407287 - DNA, 20 bp, Homo sapiens
cagctcatagagtcccccct

SEQ ID NO: 407288 - DNA, 13 bp, Homo sapiens
cagctcatctcca

SEQ ID NO: 407289 - DNA, 16 bp, Homo sapiens
cagctccacagggtgg

SEQ ID NO: 407290 - DNA, 20 bp, Homo sapiens
cagctccacagggtgggatg

SEQ ID NO: 407291 - DNA, 14 bp, Homo sapiens
cagctccactcagg

SEQ ID NO: 407292 - DNA, 17 bp, Homo sapiens
cagctccactcagggct

SEQ ID NO: 407293 - DNA, 18 bp, Homo sapiens
cagctccactcagggctg

SEQ ID NO: 407294 - DNA, 23 bp, Homo sapiens
cagctccactctgaagtcccttc

SEQ ID NO: 407295 - DNA, 20 bp, Homo sapiens
cagctccaggggcccttggg

SEQ ID NO: 407296 - DNA, 16 bp, Homo sapiens
cagctcccaacagagg

SEQ ID NO: 407297 - DNA, 20 bp, Homo sapiens
cagctcccaacagaggcctc

SEQ ID NO: 407298 - DNA, 19 bp, Homo sapiens
cagctccccaggagctcag

SEQ ID NO: 407299 - DNA, 22 bp, Homo sapiens
cagctcccccgacggtgggcat

SEQ ID NO: 407300 - DNA, 20 bp, Homo sapiens
cagctccctagactgcatcc

SEQ ID NO: 407301 - DNA, 15 bp, Homo sapiens
cagctcccttctctg

SEQ ID NO: 407302 - DNA, 22 bp, Homo sapiens
ctcatctagtttgatgactaaa

SEQ ID NO: 407303 - DNA, 12 bp, Homo sapiens
ctcatctccaag

SEQ ID NO: 407304 - DNA, 20 bp, Homo sapiens
ctcatctctaacagctcagg

SEQ ID NO: 407305 - DNA, 23 bp, Homo sapiens
ctcatctctaacagctcaggatc

SEQ ID NO: 407306 - DNA, 19 bp, Homo sapiens
ctcatcttgaagggcccag

SEQ ID NO: 407307 - DNA, 12 bp, Homo sapiens
ctcatgaatgta

SEQ ID NO: 407308 - DNA, 22 bp, Homo sapiens
ctcatgaatgtaaatttgtact

SEQ ID NO: 407309 - DNA, 20 bp, Homo sapiens
ctcatgcactgcaaatactt

SEQ ID NO: 407310 - DNA, 12 bp, Homo sapiens
ctcatgccagat

SEQ ID NO: 407311 - DNA, 17 bp, Homo sapiens
ctcatgccccctttcag

SEQ ID NO: 407312 - DNA, 23 bp, Homo sapiens
ctcatgccccctttcagatgtct

SEQ ID NO: 407313 - DNA, 14 bp, Homo sapiens
ctcatgcctggccc

SEQ ID NO: 407314 - DNA, 21 bp, Homo sapiens
ctcatgcctggcccccctcca

SEQ ID NO: 407315 - DNA, 22 bp, Homo sapiens
ctcatgcctggcccccctccag

SEQ ID NO: 407316 - DNA, 14 bp, Homo sapiens
ctcatgcggcccag

SEQ ID NO: 407317 - DNA, 14 bp, Homo sapiens
ctcatgctctctat

SEQ ID NO: 407318 - DNA, 22 bp, Homo sapiens
ctcatggactccaggatcctcc

SEQ ID NO: 407319 - DNA, 20 bp, Homo sapiens
ctcatggcgtaatgggcctg

SEQ ID NO: 407320 - DNA, 21 bp, Homo sapiens
ctcatggcgtaatgggcctgc

SEQ ID NO: 407321 - DNA, 18 bp, Homo sapiens
ctcatggctgttatctgt

SEQ ID NO: 407322 - DNA, 12 bp, Homo sapiens
ctcatgggcccc

SEQ ID NO: 407323 - DNA, 20 bp, Homo sapiens
ctcatgggcccctctgactc

SEQ ID NO: 407324 - DNA, 14 bp, Homo sapiens
ctcatgtgatttac

SEQ ID NO: 407325 - DNA, 19 bp, Homo sapiens
ctcatgtgctttgtagctt

SEQ ID NO: 407326 - DNA, 12 bp, Homo sapiens
ctcatgttctca

SEQ ID NO: 407327 - DNA, 15 bp, Homo sapiens
ctcatgttctcatgt

SEQ ID NO: 407328 - DNA, 21 bp, Homo sapiens
ctcattaaatggtgatttctt

SEQ ID NO: 407329 - DNA, 18 bp, Homo sapiens
ctcattacagatttagtt

SEQ ID NO: 407330 - DNA, 21 bp, Homo sapiens
ctcattatcgccttttgacag

SEQ ID NO: 407331 - DNA, 15 bp, Homo sapiens
ctcattcactgtcct

SEQ ID NO: 407332 - DNA, 21 bp, Homo sapiens
ctcattcactgtcctggcttt

SEQ ID NO: 407333 - DNA, 17 bp, Homo sapiens
ctcattcatattcctgc

SEQ ID NO: 407334 - DNA, 13 bp, Homo sapiens
ctcattcccagta

SEQ ID NO: 407335 - DNA, 12 bp, Homo sapiens
ctcattcctctg

SEQ ID NO: 407336 - DNA, 13 bp, Homo sapiens
ctcattctagcac

SEQ ID NO: 407337 - DNA, 17 bp, Homo sapiens
ctcattctagcaccttg

SEQ ID NO: 407338 - DNA, 24 bp, Homo sapiens
ctcattgatcacagatgtgcccag

SEQ ID NO: 407339 - DNA, 19 bp, Homo sapiens
ctcatttaaaatgtaaact

SEQ ID NO: 407340 - DNA, 21 bp, Homo sapiens
ctcatttagcattgaaataat

SEQ ID NO: 407341 - DNA, 22 bp, Homo sapiens
ctcatttagcattgaaataata

SEQ ID NO: 407342 - DNA, 18 bp, Homo sapiens
ctcatttctttcaagaca

SEQ ID NO: 407343 - DNA, 11 bp, Homo sapiens
ctcatttgcat

SEQ ID NO: 407344 - DNA, 12 bp, Homo sapiens
ctcattttattc

SEQ ID NO: 407345 - DNA, 14 bp, Homo sapiens
ctcattttgtatgt

SEQ ID NO: 407346 - DNA, 21 bp, Homo sapiens
ctcattttgtatgtatgtgta

SEQ ID NO: 407347 - DNA, 15 bp, Homo sapiens
ctccaaaagcactta

SEQ ID NO: 407348 - DNA, 13 bp, Homo sapiens
ctccaaaccactt

SEQ ID NO: 407349 - DNA, 22 bp, Homo sapiens
ctccaaaccactttttgcagct

SEQ ID NO: 407350 - DNA, 13 bp, Homo sapiens
ctccaaactcctg

SEQ ID NO: 407351 - DNA, 15 bp, Homo sapiens
ctccaaactcctgcc

SEQ ID NO: 407352 - DNA, 16 bp, Homo sapiens
ctccaaaggggctgct

SEQ ID NO: 407353 - DNA, 16 bp, Homo sapiens
ctccaaagtcttgata

SEQ ID NO: 407354 - DNA, 12 bp, Homo sapiens
ctccaaatgatt

SEQ ID NO: 407355 - DNA, 13 bp, Homo sapiens
ctccaaatgctgt

SEQ ID NO: 407356 - DNA, 14 bp, Homo sapiens
ctccaagaagccct

SEQ ID NO: 407357 - DNA, 23 bp, Homo sapiens
ctccaagaagccctccttgccac

SEQ ID NO: 407358 - DNA, 21 bp, Homo sapiens
ctccaagaatacagaaaatgc

SEQ ID NO: 407359 - DNA, 15 bp, Homo sapiens
ctccaagcctgcctc

SEQ ID NO: 407360 - DNA, 17 bp, Homo sapiens
ctccaagtctctctgtg

SEQ ID NO: 407361 - DNA, 18 bp, Homo sapiens
ctccaagtctctctgtga

SEQ ID NO: 407362 - DNA, 20 bp, Homo sapiens
ctccaagtctctctgtgaat

SEQ ID NO: 407363 - DNA, 18 bp, Homo sapiens
ctccaatccacacatatt

SEQ ID NO: 407364 - DNA, 15 bp, Homo sapiens
ctccacaccagtggc

SEQ ID NO: 407365 - DNA, 15 bp, Homo sapiens
ctccacagggactgt

SEQ ID NO: 407366 - DNA, 13 bp, Homo sapiens
ctccacagtgctg

SEQ ID NO: 407367 - DNA, 14 bp, Homo sapiens
ctccacagtgctgc

SEQ ID NO: 407368 - DNA, 18 bp, Homo sapiens
ctccacatcccagcagcc

SEQ ID NO: 407369 - DNA, 20 bp, Homo sapiens
ctccacattaagtggctttt

SEQ ID NO: 407370 - DNA, 15 bp, Homo sapiens
ctccaccacaagagc

SEQ ID NO: 407371 - DNA, 13 bp, Homo sapiens
ctccaccaggaac

SEQ ID NO: 407372 - DNA, 15 bp, Homo sapiens
ctccaccaggaacct

SEQ ID NO: 407373 - DNA, 21 bp, Homo sapiens
ctccacccaaaccccttccca

SEQ ID NO: 407374 - DNA, 18 bp, Homo sapiens
ctccacccaccagtcagg

SEQ ID NO: 407375 - DNA, 12 bp, Homo sapiens
ctccacccagcc

SEQ ID NO: 407376 - DNA, 13 bp, Homo sapiens
ctccacccagccc

SEQ ID NO: 407377 - DNA, 16 bp, Homo sapiens
ctccacccagcccctg

SEQ ID NO: 407378 - DNA, 17 bp, Homo sapiens
ctccacccagcccctgg

SEQ ID NO: 407379 - DNA, 18 bp, Homo sapiens
ctccacccccaagaaacc

SEQ ID NO: 407380 - DNA, 18 bp, Homo sapiens
ctccacccccaccactct

SEQ ID NO: 407381 - DNA, 19 bp, Homo sapiens
ctccacccccgccacggcc

SEQ ID NO: 407382 - DNA, 20 bp, Homo sapiens
ctccacccccgccacggcca

SEQ ID NO: 407383 - DNA, 15 bp, Homo sapiens
ctccacccctcaagc

SEQ ID NO: 407384 - DNA, 21 bp, Homo sapiens
ctccacccctcaagccaggag

SEQ ID NO: 407385 - DNA, 22 bp, Homo sapiens
ctccacccctcaagccaggaga

SEQ ID NO: 407386 - DNA, 22 bp, Homo sapiens
ctccacccgttcccactgccct

SEQ ID NO: 407387 - DNA, 22 bp, Homo sapiens
ctccaccctccggccagcgagt

SEQ ID NO: 407388 - DNA, 15 bp, Homo sapiens
ctccacccttggcct

SEQ ID NO: 407389 - DNA, 17 bp, Homo sapiens
ctccaccggtgcctcct

SEQ ID NO: 407390 - DNA, 14 bp, Homo sapiens
ctccacctccccca

SEQ ID NO: 407391 - DNA, 17 bp, Homo sapiens
ctccacctcctctcttg

SEQ ID NO: 407392 - DNA, 14 bp, Homo sapiens
ctccacctgggaga

SEQ ID NO: 407393 - DNA, 13 bp, Homo sapiens
ctccacgccctgg

SEQ ID NO: 407394 - DNA, 14 bp, Homo sapiens
ctccacgccctggg

SEQ ID NO: 407395 - DNA, 16 bp, Homo sapiens
ctccacgccctgggga

SEQ ID NO: 407396 - DNA, 14 bp, Homo sapiens
cagctgggcaaagc

SEQ ID NO: 407397 - DNA, 15 bp, Homo sapiens
cagctgggcaaagcc

SEQ ID NO: 407398 - DNA, 16 bp, Homo sapiens
cagctgggcaaagcca

SEQ ID NO: 407399 - DNA, 13 bp, Homo sapiens
cagctgggcccca

SEQ ID NO: 407400 - DNA, 19 bp, Homo sapiens
cagctgggccccatgctct

SEQ ID NO: 407401 - DNA, 23 bp, Homo sapiens
cagctgggccccatgctctgccc

SEQ ID NO: 407402 - DNA, 16 bp, Homo sapiens
cagctgggctctgcca

SEQ ID NO: 407403 - DNA, 23 bp, Homo sapiens
cagctgggctgttggctgggggc

SEQ ID NO: 407404 - DNA, 14 bp, Homo sapiens
cagctggggagcag

SEQ ID NO: 407405 - DNA, 15 bp, Homo sapiens
cagctggggagcagc

SEQ ID NO: 407406 - DNA, 16 bp, Homo sapiens
cagctggggagcagct

SEQ ID NO: 407407 - DNA, 16 bp, Homo sapiens
cagctggggcccctcg

SEQ ID NO: 407408 - DNA, 18 bp, Homo sapiens
cagctggggggcaggggg

SEQ ID NO: 407409 - DNA, 22 bp, Homo sapiens
cagctggtggatggtgactttt

SEQ ID NO: 407410 - DNA, 21 bp, Homo sapiens
cagctgtaagaagagactggg

SEQ ID NO: 407411 - DNA, 16 bp, Homo sapiens
cagctgtactgagttc

SEQ ID NO: 407412 - DNA, 17 bp, Homo sapiens
cagctgtacttcgtctt

SEQ ID NO: 407413 - DNA, 15 bp, Homo sapiens
cagctgtagaaaggt

SEQ ID NO: 407414 - DNA, 14 bp, Homo sapiens
cagctgtagccatg

SEQ ID NO: 407415 - DNA, 15 bp, Homo sapiens
cagctgtagccatgg

SEQ ID NO: 407416 - DNA, 20 bp, Homo sapiens
cagctgtagccatggctcag

SEQ ID NO: 407417 - DNA, 20 bp, Homo sapiens
cagctgtcccctctccctgg

SEQ ID NO: 407418 - DNA, 21 bp, Homo sapiens
cagctgtcccctctccctggg

SEQ ID NO: 407419 - DNA, 22 bp, Homo sapiens
cagctgtcccctctccctgggg

SEQ ID NO: 407420 - DNA, 14 bp, Homo sapiens
cagctgtgagcttt

SEQ ID NO: 407421 - DNA, 16 bp, Homo sapiens
cagctgttactttctt

SEQ ID NO: 407422 - DNA, 22 bp, Homo sapiens
cagctgttcaacaagagtaaat

SEQ ID NO: 407423 - DNA, 14 bp, Homo sapiens
cagctgttcctgtg

SEQ ID NO: 407424 - DNA, 16 bp, Homo sapiens
cagctgttcctgtgtt

SEQ ID NO: 407425 - DNA, 23 bp, Homo sapiens
cagctgttgagcccctcctagtt

SEQ ID NO: 407426 - DNA, 15 bp, Homo sapiens
cagctgtttgtcata

SEQ ID NO: 407427 - DNA, 13 bp, Homo sapiens
cagcttcaaaaca

SEQ ID NO: 407428 - DNA, 15 bp, Homo sapiens
cagcttcaaaacaga

SEQ ID NO: 407429 - DNA, 16 bp, Homo sapiens
cagcttcaaaacagaa

SEQ ID NO: 407430 - DNA, 17 bp, Homo sapiens
cagcttcaccctgtcaa

SEQ ID NO: 407431 - DNA, 18 bp, Homo sapiens
cagcttcatgcctttgta

SEQ ID NO: 407432 - DNA, 20 bp, Homo sapiens
cagcttcatgcctttgtaag

SEQ ID NO: 407433 - DNA, 16 bp, Homo sapiens
cagcttcgtgctggag

SEQ ID NO: 407434 - DNA, 18 bp, Homo sapiens
cagcttcgtgctggagga

SEQ ID NO: 407435 - DNA, 19 bp, Homo sapiens
cagcttctggtactctcct

SEQ ID NO: 407436 - DNA, 22 bp, Homo sapiens
cagcttcttaatataactgcct

SEQ ID NO: 407437 - DNA, 18 bp, Homo sapiens
cagcttgatgctgtttct

SEQ ID NO: 407438 - DNA, 14 bp, Homo sapiens
cagcttggctgagc

SEQ ID NO: 407439 - DNA, 16 bp, Homo sapiens
cagcttggctgagccc

SEQ ID NO: 407440 - DNA, 14 bp, Homo sapiens
cagcttgggcccag

SEQ ID NO: 407441 - DNA, 21 bp, Homo sapiens
ctccagactcgagagggctga

SEQ ID NO: 407442 - DNA, 11 bp, Homo sapiens
ctccagagcca

SEQ ID NO: 407443 - DNA, 13 bp, Homo sapiens
ctccagagccagc

SEQ ID NO: 407444 - DNA, 15 bp, Homo sapiens
ctccagaggagggga

SEQ ID NO: 407445 - DNA, 21 bp, Homo sapiens
ctccagagtaggtgggtcttg

SEQ ID NO: 407446 - DNA, 23 bp, Homo sapiens
ctccagagtaggtgggtcttgga

SEQ ID NO: 407447 - DNA, 20 bp, Homo sapiens
ctccagagtctgagcccccg

SEQ ID NO: 407448 - DNA, 21 bp, Homo sapiens
ctccagatagctcatttcatt

SEQ ID NO: 407449 - DNA, 23 bp, Homo sapiens
ctccagatatgaacagggcccag

SEQ ID NO: 407450 - DNA, 11 bp, Homo sapiens
ctccagcacag

SEQ ID NO: 407451 - DNA, 13 bp, Homo sapiens
ctccagcacagac

SEQ ID NO: 407452 - DNA, 14 bp, Homo sapiens
ctccagcagtgctg

SEQ ID NO: 407453 - DNA, 15 bp, Homo sapiens
ctccagcagtgctgg

SEQ ID NO: 407454 - DNA, 17 bp, Homo sapiens
ctccagcagtgctgggc

SEQ ID NO: 407455 - DNA, 19 bp, Homo sapiens
ctccagcagtgctgggccc

SEQ ID NO: 407456 - DNA, 23 bp, Homo sapiens
ctccagcagtgctgggcccagcc

SEQ ID NO: 407457 - DNA, 17 bp, Homo sapiens
ctccagcatccagcctg

SEQ ID NO: 407458 - DNA, 20 bp, Homo sapiens
ctccagcatccagcctgtgt

SEQ ID NO: 407459 - DNA, 19 bp, Homo sapiens
ctccagccaacccctgtgg

SEQ ID NO: 407460 - DNA, 11 bp, Homo sapiens
ctccagccagc

SEQ ID NO: 407461 - DNA, 13 bp, Homo sapiens
ctccagcctcccc

SEQ ID NO: 407462 - DNA, 14 bp, Homo sapiens
ctccagcctctccc

SEQ ID NO: 407463 - DNA, 15 bp, Homo sapiens
ctccagcctctcccg

SEQ ID NO: 407464 - DNA, 20 bp, Homo sapiens
ctccagcctctcccggctgc

SEQ ID NO: 407465 - DNA, 22 bp, Homo sapiens
ctccagcctctcccggctgcct

SEQ ID NO: 407466 - DNA, 24 bp, Homo sapiens
ctccagcctctcccggctgcctgc

SEQ ID NO: 407467 - DNA, 12 bp, Homo sapiens
ctccagcctggg

SEQ ID NO: 407468 - DNA, 16 bp, Homo sapiens
ctccagcgagtacccc

SEQ ID NO: 407469 - DNA, 15 bp, Homo sapiens
ctccagctctttcct

SEQ ID NO: 407470 - DNA, 13 bp, Homo sapiens
ctccagcttctgg

SEQ ID NO: 407471 - DNA, 19 bp, Homo sapiens
ctccagcttctggtactct

SEQ ID NO: 407472 - DNA, 16 bp, Homo sapiens
ctccaggaaaactgtt

SEQ ID NO: 407473 - DNA, 21 bp, Homo sapiens
ctccaggaacattcccacata

SEQ ID NO: 407474 - DNA, 15 bp, Homo sapiens
ctccaggacttgctt

SEQ ID NO: 407475 - DNA, 16 bp, Homo sapiens
ctccaggatcctcctg

SEQ ID NO: 407476 - DNA, 17 bp, Homo sapiens
ctccaggatcctcctgg

SEQ ID NO: 407477 - DNA, 18 bp, Homo sapiens
ctccaggatcctcctgga

SEQ ID NO: 407478 - DNA, 21 bp, Homo sapiens
ctccaggatcctcctggagca

SEQ ID NO: 407479 - DNA, 22 bp, Homo sapiens
ctccaggatcctcctggagcag

SEQ ID NO: 407480 - DNA, 21 bp, Homo sapiens
ctccaggcaggacgagactcc

SEQ ID NO: 407481 - DNA, 23 bp, Homo sapiens
ctccaggcaggacgagactcctc

SEQ ID NO: 407482 - DNA, 15 bp, Homo sapiens
ctccaggcatgctgg

SEQ ID NO: 407483 - DNA, 14 bp, Homo sapiens
ctccaggccagctc

SEQ ID NO: 407484 - DNA, 19 bp, Homo sapiens
ctccaggccagctcctttt

SEQ ID NO: 407485 - DNA, 20 bp, Homo sapiens
ctccaggccagctccttttc

SEQ ID NO: 407486 - DNA, 13 bp, Homo sapiens
ctccaggcccagc

SEQ ID NO: 407487 - DNA, 15 bp, Homo sapiens
ctccaggcccagcct

SEQ ID NO: 407488 - DNA, 18 bp, Homo sapiens
ctccaggcccagcctggc

SEQ ID NO: 407489 - DNA, 19 bp, Homo sapiens
ctccaggcccagcctggcc

SEQ ID NO: 407490 - DNA, 16 bp, Homo sapiens
ctccaggcccccaact

SEQ ID NO: 407491 - DNA, 18 bp, Homo sapiens
ctccaggctggggcctgg

SEQ ID NO: 407492 - DNA, 19 bp, Homo sapiens
ctccagggagcaagacaga

SEQ ID NO: 407493 - DNA, 18 bp, Homo sapiens
ctccagggagtcccctcc

SEQ ID NO: 407494 - DNA, 16 bp, Homo sapiens
ctccagggccccccaa

SEQ ID NO: 407495 - DNA, 13 bp, Homo sapiens
ctccagggctgcc

SEQ ID NO: 407496 - DNA, 24 bp, Homo sapiens
ctccagggggcctgcaggccccag

SEQ ID NO: 407497 - DNA, 16 bp, Homo sapiens
ctccagggtcttgggc

SEQ ID NO: 407498 - DNA, 17 bp, Homo sapiens
ctccagggtcttgggct

SEQ ID NO: 407499 - DNA, 21 bp, Homo sapiens
ctccagggtcttgggctactg

SEQ ID NO: 407500 - DNA, 23 bp, Homo sapiens
ctccagggtcttgggctactggc

SEQ ID NO: 407501 - DNA, 22 bp, Homo sapiens
ctccaggtcctctacttaatga

SEQ ID NO: 407502 - DNA, 17 bp, Homo sapiens
ctccaggtgccctgtgg

SEQ ID NO: 407503 - DNA, 14 bp, Homo sapiens
ctccagtacgtccc

SEQ ID NO: 407504 - DNA, 21 bp, Homo sapiens
ctccagtacgtcccgctgctg

SEQ ID NO: 407505 - DNA, 22 bp, Homo sapiens
ctccagtacgtcccgctgctgt

SEQ ID NO: 407506 - DNA, 15 bp, Homo sapiens
ctccagtcctgctct

SEQ ID NO: 407507 - DNA, 16 bp, Homo sapiens
ctccagtcctgctctc

SEQ ID NO: 407508 - DNA, 17 bp, Homo sapiens
ctccagtcctgctctct

SEQ ID NO: 407509 - DNA, 12 bp, Homo sapiens
ctccagtctgct

SEQ ID NO: 407510 - DNA, 15 bp, Homo sapiens
ctccagtctgctgcc

SEQ ID NO: 407511 - DNA, 22 bp, Homo sapiens
ctccagtgttgcctcctcccat

SEQ ID NO: 407512 - DNA, 23 bp, Homo sapiens
ctccagtgttgcctcctcccatc

SEQ ID NO: 407513 - DNA, 21 bp, Homo sapiens
ctccagtttgcccaccacaac

SEQ ID NO: 407514 - DNA, 23 bp, Homo sapiens
ctccagttttcgtattgcaaata

SEQ ID NO: 407515 - DNA, 17 bp, Homo sapiens
ctccataattgcaaggg

SEQ ID NO: 407516 - DNA, 16 bp, Homo sapiens
ctccatacagcctcta

SEQ ID NO: 407517 - DNA, 13 bp, Homo sapiens
ctccatccccatg

SEQ ID NO: 407518 - DNA, 15 bp, Homo sapiens
ctccatcccctccct

SEQ ID NO: 407519 - DNA, 23 bp, Homo sapiens
ctccatcctgccaggagcagcct

SEQ ID NO: 407520 - DNA, 14 bp, Homo sapiens
ctccatctccactc

SEQ ID NO: 407521 - DNA, 20 bp, Homo sapiens
ctccatcttggtagttctgt

SEQ ID NO: 407522 - DNA, 14 bp, Homo sapiens
ctccatgaccaggc

SEQ ID NO: 407523 - DNA, 19 bp, Homo sapiens
ctccatgaccaggccacca

SEQ ID NO: 407524 - DNA, 15 bp, Homo sapiens
ctccatgactggctg

SEQ ID NO: 407525 - DNA, 19 bp, Homo sapiens
ctccatgcctatttactgg

SEQ ID NO: 407526 - DNA, 13 bp, Homo sapiens
ctcccctcttgag

SEQ ID NO: 407527 - DNA, 13 bp, Homo sapiens
ctcccctgcactg

SEQ ID NO: 407528 - DNA, 14 bp, Homo sapiens
ctcccctgcactgt

SEQ ID NO: 407529 - DNA, 15 bp, Homo sapiens
ctcccctgcactgta

SEQ ID NO: 407530 - DNA, 18 bp, Homo sapiens
ctcccctgcactgtaaaa

SEQ ID NO: 407531 - DNA, 19 bp, Homo sapiens
ctcccctgcactgtaaaat

SEQ ID NO: 407532 - DNA, 21 bp, Homo sapiens
ctcccctgcactgtaaaatgt

SEQ ID NO: 407533 - DNA, 14 bp, Homo sapiens
ctcccctgccattt

SEQ ID NO: 407534 - DNA, 15 bp, Homo sapiens
ctcccctgccctgct

SEQ ID NO: 407535 - DNA, 16 bp, Homo sapiens
ctcccctggagccagc

SEQ ID NO: 407536 - DNA, 14 bp, Homo sapiens
ctcccctggtctcc

SEQ ID NO: 407537 - DNA, 15 bp, Homo sapiens
ctccccttgggcggc

SEQ ID NO: 407538 - DNA, 18 bp, Homo sapiens
ctccccttgggcggctga

SEQ ID NO: 407539 - DNA, 13 bp, Homo sapiens
ctccccttttcct

SEQ ID NO: 407540 - DNA, 14 bp, Homo sapiens
ctcccgaatcctga

SEQ ID NO: 407541 - DNA, 19 bp, Homo sapiens
ctcccgcatgctgcctgcc

SEQ ID NO: 407542 - DNA, 18 bp, Homo sapiens
ctcccgccacacgctcac

SEQ ID NO: 407543 - DNA, 21 bp, Homo sapiens
ctcccgccagactgttagaaa

SEQ ID NO: 407544 - DNA, 13 bp, Homo sapiens
ctcccgccgcctc

SEQ ID NO: 407545 - DNA, 19 bp, Homo sapiens
ctcccgcctcccccgcagg

SEQ ID NO: 407546 - DNA, 20 bp, Homo sapiens
ctcccgcctgattggggcct

SEQ ID NO: 407547 - DNA, 22 bp, Homo sapiens
ctcccgcctgattggggcctca

SEQ ID NO: 407548 - DNA, 20 bp, Homo sapiens
ctcccggagagggagtcagt

SEQ ID NO: 407549 - DNA, 19 bp, Homo sapiens
ctcccggcatgggaaagcc

SEQ ID NO: 407550 - DNA, 15 bp, Homo sapiens
ctcccggctgcctgc

SEQ ID NO: 407551 - DNA, 17 bp, Homo sapiens
ctcccggctgcctgccg

SEQ ID NO: 407552 - DNA, 15 bp, Homo sapiens
ctcccggctttgcag

SEQ ID NO: 407553 - DNA, 21 bp, Homo sapiens
ctcccggctttgcagggagac

SEQ ID NO: 407554 - DNA, 19 bp, Homo sapiens
ctcccgggccacgccccag

SEQ ID NO: 407555 - DNA, 21 bp, Homo sapiens
ctcccgggttcacgccattct

SEQ ID NO: 407556 - DNA, 22 bp, Homo sapiens
ctcccgggttcacgccattctc

SEQ ID NO: 407557 - DNA, 19 bp, Homo sapiens
ctcccggtgtatgcagtgg

SEQ ID NO: 407558 - DNA, 14 bp, Homo sapiens
ctccctaaagccct

SEQ ID NO: 407559 - DNA, 15 bp, Homo sapiens
ctccctaaagccctc

SEQ ID NO: 407560 - DNA, 19 bp, Homo sapiens
ctccctaaagccctcttca

SEQ ID NO: 407561 - DNA, 18 bp, Homo sapiens
ctccctacctcaacctgt

SEQ ID NO: 407562 - DNA, 21 bp, Homo sapiens
ctccctacctcaacctgtaaa

SEQ ID NO: 407563 - DNA, 22 bp, Homo sapiens
ctccctacctcaacctgtaaat

SEQ ID NO: 407564 - DNA, 19 bp, Homo sapiens
ctccctacttccaagaaaa

SEQ ID NO: 407565 - DNA, 22 bp, Homo sapiens
ctccctagtgacccggaggcca

SEQ ID NO: 407566 - DNA, 18 bp, Homo sapiens
ctccctcagcccctcttg

SEQ ID NO: 407567 - DNA, 14 bp, Homo sapiens
ctccctcatggctc

SEQ ID NO: 407568 - DNA, 14 bp, Homo sapiens
ctccctccacacct

SEQ ID NO: 407569 - DNA, 19 bp, Homo sapiens
ctccctccacacctccacc

SEQ ID NO: 407570 - DNA, 13 bp, Homo sapiens
ctccctccactcc

SEQ ID NO: 407571 - DNA, 13 bp, Homo sapiens
ctccctccatggc

SEQ ID NO: 407572 - DNA, 16 bp, Homo sapiens
ctccctccatggcagg

SEQ ID NO: 407573 - DNA, 21 bp, Homo sapiens
ctccctccatggcaggaaggc

SEQ ID NO: 407574 - DNA, 16 bp, Homo sapiens
ctccctccatgtggcc

SEQ ID NO: 407575 - DNA, 17 bp, Homo sapiens
ctccctccccagtgttt

SEQ ID NO: 407576 - DNA, 15 bp, Homo sapiens
ctccctcccctgcca

SEQ ID NO: 407577 - DNA, 18 bp, Homo sapiens
ctccctcccctgccattt

SEQ ID NO: 407578 - DNA, 23 bp, Homo sapiens
ctccctcccctgccctggtccag

SEQ ID NO: 407579 - DNA, 15 bp, Homo sapiens
ctccctccctccaca

SEQ ID NO: 407580 - DNA, 13 bp, Homo sapiens
ctccctccctgca

SEQ ID NO: 407581 - DNA, 15 bp, Homo sapiens
ctccctccctgcagg

SEQ ID NO: 407582 - DNA, 15 bp, Homo sapiens
ctccctcctcccatc

SEQ ID NO: 407583 - DNA, 13 bp, Homo sapiens
ctccctcctgcag

SEQ ID NO: 407584 - DNA, 15 bp, Homo sapiens
ctccctcctgcaggc

SEQ ID NO: 407585 - DNA, 21 bp, Homo sapiens
ctccctcctgcaggctggctg

SEQ ID NO: 407586 - DNA, 15 bp, Homo sapiens
ctccctcctggctca

SEQ ID NO: 407587 - DNA, 19 bp, Homo sapiens
ctccctccttccttcttgc

SEQ ID NO: 407588 - DNA, 18 bp, Homo sapiens
ctccctcgaacccacact

SEQ ID NO: 407589 - DNA, 21 bp, Homo sapiens
ctccctcgaacccacactgca

SEQ ID NO: 407590 - DNA, 22 bp, Homo sapiens
ctccctcgcatccgcctctgag

SEQ ID NO: 407591 - DNA, 20 bp, Homo sapiens
ctccctcggccccacccacc

SEQ ID NO: 407592 - DNA, 14 bp, Homo sapiens
ctccctctcttccg

SEQ ID NO: 407593 - DNA, 12 bp, Homo sapiens
ctccctctgccc

SEQ ID NO: 407594 - DNA, 14 bp, Homo sapiens
ctccctctgctctc

SEQ ID NO: 407595 - DNA, 12 bp, Homo sapiens
ctccctcttccc

SEQ ID NO: 407596 - DNA, 16 bp, Homo sapiens
ctccctgaccctgcag

SEQ ID NO: 407597 - DNA, 19 bp, Homo sapiens
ctccctgaccttagcgttc

SEQ ID NO: 407598 - DNA, 14 bp, Homo sapiens
ctccctgagcctgc

SEQ ID NO: 407599 - DNA, 22 bp, Homo sapiens
ctccctgagcctgccccagctg

SEQ ID NO: 407600 - DNA, 23 bp, Homo sapiens
ctccctgagcctgccccagctgg

SEQ ID NO: 407601 - DNA, 12 bp, Homo sapiens
ctccctgagctt

SEQ ID NO: 407602 - DNA, 11 bp, Homo sapiens
ctccctgcagg

SEQ ID NO: 407603 - DNA, 13 bp, Homo sapiens
ctccctgcagggt

SEQ ID NO: 407604 - DNA, 21 bp, Homo sapiens
ctccctgccaactccatgacc

SEQ ID NO: 407605 - DNA, 14 bp, Homo sapiens
ctccctgcccaggc

SEQ ID NO: 407606 - DNA, 18 bp, Homo sapiens
ctccctgcccctcccttc

SEQ ID NO: 407607 - DNA, 20 bp, Homo sapiens
ctccctgcccctcccttcaa

SEQ ID NO: 407608 - DNA, 17 bp, Homo sapiens
ctccctgcctcacatct

SEQ ID NO: 407609 - DNA, 16 bp, Homo sapiens
ctccctgcctgctcct

SEQ ID NO: 407610 - DNA, 19 bp, Homo sapiens
ctccctgcctgctccttgg

SEQ ID NO: 407611 - DNA, 18 bp, Homo sapiens
ctccctgctcagctggcc

SEQ ID NO: 407612 - DNA, 15 bp, Homo sapiens
ctccctggcctgttc

SEQ ID NO: 407613 - DNA, 16 bp, Homo sapiens
ctccctggcctgttct

SEQ ID NO: 407614 - DNA, 19 bp, Homo sapiens
ctccctggcctgttctgtt

SEQ ID NO: 407615 - DNA, 11 bp, Homo sapiens
ctccctggctc

SEQ ID NO: 407616 - DNA, 15 bp, Homo sapiens
ctccctggctcccat

SEQ ID NO: 407617 - DNA, 13 bp, Homo sapiens
ctccctggctgtg

SEQ ID NO: 407618 - DNA, 15 bp, Homo sapiens
ctccctgggcctgtc

SEQ ID NO: 407619 - DNA, 17 bp, Homo sapiens
ctccctgggcctgtctc

SEQ ID NO: 407620 - DNA, 14 bp, Homo sapiens
ctccctgggttcag

SEQ ID NO: 407621 - DNA, 17 bp, Homo sapiens
ctccctgtataagacac

SEQ ID NO: 407622 - DNA, 21 bp, Homo sapiens
ctccctgtcactcagctgaga

SEQ ID NO: 407623 - DNA, 18 bp, Homo sapiens
ctccctgtccatccccag

SEQ ID NO: 407624 - DNA, 20 bp, Homo sapiens
ctcccttcaaccattcccca

SEQ ID NO: 407625 - DNA, 21 bp, Homo sapiens
ctcccttcaaccattccccat

SEQ ID NO: 407626 - DNA, 18 bp, Homo sapiens
ctcccttcaatcctgtca

SEQ ID NO: 407627 - DNA, 14 bp, Homo sapiens
ctcccttccacctc

SEQ ID NO: 407628 - DNA, 15 bp, Homo sapiens
ctcccttccacctca

SEQ ID NO: 407629 - DNA, 15 bp, Homo sapiens
ctcccttcccagtgg

SEQ ID NO: 407630 - DNA, 12 bp, Homo sapiens
ctcccttcccca

SEQ ID NO: 407631 - DNA, 15 bp, Homo sapiens
ctcccttcctggcct

SEQ ID NO: 407632 - DNA, 15 bp, Homo sapiens
ctcccttctttacct

SEQ ID NO: 407633 - DNA, 23 bp, Homo sapiens
ctcccttctttgcttctttttct

SEQ ID NO: 407634 - DNA, 20 bp, Homo sapiens
ctcccttgattccacttgtg

SEQ ID NO: 407635 - DNA, 16 bp, Homo sapiens
ctcccttgctcagtgc

SEQ ID NO: 407636 - DNA, 22 bp, Homo sapiens
ctcccttgctcagtgcctcctg

SEQ ID NO: 407637 - DNA, 23 bp, Homo sapiens
ctcccttgctcagtgcctcctgg

SEQ ID NO: 407638 - DNA, 18 bp, Homo sapiens
ctcccttggaaacctgcc

SEQ ID NO: 407639 - DNA, 19 bp, Homo sapiens
ctcccttggaaacctgccc

SEQ ID NO: 407640 - DNA, 22 bp, Homo sapiens
ctcccttggaaacctgccctgc

SEQ ID NO: 407641 - DNA, 18 bp, Homo sapiens
ctcccttggccacggcct

SEQ ID NO: 407642 - DNA, 20 bp, Homo sapiens
ctcccttggccacggcctgg

SEQ ID NO: 407643 - DNA, 21 bp, Homo sapiens
ctcccttggccacggcctggg

SEQ ID NO: 407644 - DNA, 23 bp, Homo sapiens
ctcccttggccacggcctgggag

SEQ ID NO: 407645 - DNA, 15 bp, Homo sapiens
ctccctttcccctct

SEQ ID NO: 407646 - DNA, 15 bp, Homo sapiens
ctccctttcccttct

SEQ ID NO: 407647 - DNA, 18 bp, Homo sapiens
ctccctttgtggacttta

SEQ ID NO: 407648 - DNA, 21 bp, Homo sapiens
ctccctttttatatcccattt

SEQ ID NO: 407649 - DNA, 23 bp, Homo sapiens
ctccgagaagctctcgagggaag

SEQ ID NO: 407650 - DNA, 13 bp, Homo sapiens
ctccgaggctccc

SEQ ID NO: 407651 - DNA, 14 bp, Homo sapiens
ctccgaggctcccc

SEQ ID NO: 407652 - DNA, 23 bp, Homo sapiens
ctccgaggctccccgcctccact

SEQ ID NO: 407653 - DNA, 15 bp, Homo sapiens
ctccgcccagcctct

SEQ ID NO: 407654 - DNA, 13 bp, Homo sapiens
ctccgcctggcac

SEQ ID NO: 407655 - DNA, 18 bp, Homo sapiens
ctccgctcccctttccca

SEQ ID NO: 407656 - DNA, 19 bp, Homo sapiens
caggaccctgggtcacctt

SEQ ID NO: 407657 - DNA, 15 bp, Homo sapiens
caggaccgccaaaga

SEQ ID NO: 407658 - DNA, 15 bp, Homo sapiens
caggacgcagggaga

SEQ ID NO: 407659 - DNA, 15 bp, Homo sapiens
caggacgcttctgaa

SEQ ID NO: 407660 - DNA, 16 bp, Homo sapiens
caggacgttaggcccg

SEQ ID NO: 407661 - DNA, 23 bp, Homo sapiens
caggacgttgctttttcactgtt

SEQ ID NO: 407662 - DNA, 12 bp, Homo sapiens
caggactctgcc

SEQ ID NO: 407663 - DNA, 21 bp, Homo sapiens
caggactctgccccttctgtt

SEQ ID NO: 407664 - DNA, 17 bp, Homo sapiens
caggactctgccttcca

SEQ ID NO: 407665 - DNA, 15 bp, Homo sapiens
caggactgtgactca

SEQ ID NO: 407666 - DNA, 19 bp, Homo sapiens
caggacttaacggctccag

SEQ ID NO: 407667 - DNA, 20 bp, Homo sapiens
caggacttaacggctccagg

SEQ ID NO: 407668 - DNA, 19 bp, Homo sapiens
caggacttaagacaaatgg

SEQ ID NO: 407669 - DNA, 23 bp, Homo sapiens
caggacttaagacaaatgggact

SEQ ID NO: 407670 - DNA, 17 bp, Homo sapiens
caggacttggggtcagg

SEQ ID NO: 407671 - DNA, 11 bp, Homo sapiens
caggagaacca

SEQ ID NO: 407672 - DNA, 13 bp, Homo sapiens
caggagacactgg

SEQ ID NO: 407673 - DNA, 16 bp, Homo sapiens
caggagacactggtct

SEQ ID NO: 407674 - DNA, 21 bp, Homo sapiens
caggagacactggtctcagag

SEQ ID NO: 407675 - DNA, 15 bp, Homo sapiens
caggagacaggaagg

SEQ ID NO: 407676 - DNA, 13 bp, Homo sapiens
caggagagagaga

SEQ ID NO: 407677 - DNA, 14 bp, Homo sapiens
caggagagagagag

SEQ ID NO: 407678 - DNA, 15 bp, Homo sapiens
caggagagagagaga

SEQ ID NO: 407679 - DNA, 20 bp, Homo sapiens
caggagagagagagagaaag

SEQ ID NO: 407680 - DNA, 23 bp, Homo sapiens
caggagagagagagagaaagaat

SEQ ID NO: 407681 - DNA, 16 bp, Homo sapiens
caggagagagccttgg

SEQ ID NO: 407682 - DNA, 19 bp, Homo sapiens
caggagagcatcaccacca

SEQ ID NO: 407683 - DNA, 18 bp, Homo sapiens
caggagagcccccaccag

SEQ ID NO: 407684 - DNA, 23 bp, Homo sapiens
caggagagcccccaccagcagca

SEQ ID NO: 407685 - DNA, 22 bp, Homo sapiens
caggagagccctctgctgcttt

SEQ ID NO: 407686 - DNA, 12 bp, Homo sapiens
caggagaggagc

SEQ ID NO: 407687 - DNA, 22 bp, Homo sapiens
caggagagtgcagatctgtgct

SEQ ID NO: 407688 - DNA, 17 bp, Homo sapiens
caggagatgatgtgatg

SEQ ID NO: 407689 - DNA, 20 bp, Homo sapiens
caggagatggaagttgcagt

SEQ ID NO: 407690 - DNA, 15 bp, Homo sapiens
caggagcaatgggac

SEQ ID NO: 407691 - DNA, 17 bp, Homo sapiens
caggagcaatgggactg

SEQ ID NO: 407692 - DNA, 19 bp, Homo sapiens
caggagcaatgggactgga

SEQ ID NO: 407693 - DNA, 22 bp, Homo sapiens
caggagcaatgggactggagtc

SEQ ID NO: 407694 - DNA, 16 bp, Homo sapiens
caggagcacaggcagc

SEQ ID NO: 407695 - DNA, 17 bp, Homo sapiens
caggagcacaggcagct

SEQ ID NO: 407696 - DNA, 18 bp, Homo sapiens
caggagcacaggcagctg

SEQ ID NO: 407697 - DNA, 12 bp, Homo sapiens
caggagcagcct

SEQ ID NO: 407698 - DNA, 13 bp, Homo sapiens
caggagcagcctc

SEQ ID NO: 407699 - DNA, 14 bp, Homo sapiens
caggagcagcctcc

SEQ ID NO: 407700 - DNA, 15 bp, Homo sapiens
caggagcagcctcca

SEQ ID NO: 407701 - DNA, 18 bp, Homo sapiens
caggagcagcctccaaga

SEQ ID NO: 407702 - DNA, 16 bp, Homo sapiens
caggagcattttgtgt

SEQ ID NO: 407703 - DNA, 18 bp, Homo sapiens
caggagcattttgtgtct

SEQ ID NO: 407704 - DNA, 19 bp, Homo sapiens
caggagcattttgtgtctt

SEQ ID NO: 407705 - DNA, 15 bp, Homo sapiens
caggagccagcaggg

SEQ ID NO: 407706 - DNA, 22 bp, Homo sapiens
caggagccagcagggcgggcca

SEQ ID NO: 407707 - DNA, 16 bp, Homo sapiens
caggagccaggtgtcc

SEQ ID NO: 407708 - DNA, 18 bp, Homo sapiens
caggagccaggtgtcctg

SEQ ID NO: 407709 - DNA, 13 bp, Homo sapiens
caggagcgcaaga

SEQ ID NO: 407710 - DNA, 16 bp, Homo sapiens
caggagcgcaagatag

SEQ ID NO: 407711 - DNA, 18 bp, Homo sapiens
caggagctcttcaggcct

SEQ ID NO: 407712 - DNA, 19 bp, Homo sapiens
caggagctcttcaggcctc

SEQ ID NO: 407713 - DNA, 20 bp, Homo sapiens
caggagctcttcaggcctcc

SEQ ID NO: 407714 - DNA, 18 bp, Homo sapiens
caggagctgagtcacctc

SEQ ID NO: 407715 - DNA, 20 bp, Homo sapiens
caggagctgagtcacctcct

SEQ ID NO: 407716 - DNA, 13 bp, Homo sapiens
caggaggacctgg

SEQ ID NO: 407717 - DNA, 19 bp, Homo sapiens
caggaggaggaaaggtagc

SEQ ID NO: 407718 - DNA, 23 bp, Homo sapiens
ctcctccaagaagccctccttgc

SEQ ID NO: 407719 - DNA, 13 bp, Homo sapiens
ctcctccacagtg

SEQ ID NO: 407720 - DNA, 16 bp, Homo sapiens
ctcctccacagtgctg

SEQ ID NO: 407721 - DNA, 14 bp, Homo sapiens
ctcctccactccac

SEQ ID NO: 407722 - DNA, 22 bp, Homo sapiens
ctcctccagactcgagagggct

SEQ ID NO: 407723 - DNA, 22 bp, Homo sapiens
ctcctccagtacgtcccgctgc

SEQ ID NO: 407724 - DNA, 23 bp, Homo sapiens
ctcctccagtacgtcccgctgct

SEQ ID NO: 407725 - DNA, 17 bp, Homo sapiens
ctcctcccaactctggc

SEQ ID NO: 407726 - DNA, 13 bp, Homo sapiens
ctcctcccatcca

SEQ ID NO: 407727 - DNA, 16 bp, Homo sapiens
ctcctcccatggcctt

SEQ ID NO: 407728 - DNA, 23 bp, Homo sapiens
ctcctccccgtagccactctctg

SEQ ID NO: 407729 - DNA, 10 bp, Homo sapiens
ctcctccctc

SEQ ID NO: 407730 - DNA, 22 bp, Homo sapiens
ctcctccctcagctctctggga

SEQ ID NO: 407731 - DNA, 17 bp, Homo sapiens
ctcctcccttccccact

SEQ ID NO: 407732 - DNA, 14 bp, Homo sapiens
ctcctcctcccctc

SEQ ID NO: 407733 - DNA, 15 bp, Homo sapiens
ctcctcctcctcctg

SEQ ID NO: 407734 - DNA, 12 bp, Homo sapiens
ctcctcctgccc

SEQ ID NO: 407735 - DNA, 20 bp, Homo sapiens
ctcctcctgttcctgccttc

SEQ ID NO: 407736 - DNA, 18 bp, Homo sapiens
ctcctccttgcccagact

SEQ ID NO: 407737 - DNA, 15 bp, Homo sapiens
ctcctcgctgtgcca

SEQ ID NO: 407738 - DNA, 16 bp, Homo sapiens
ctcctcgctgtgccac

SEQ ID NO: 407739 - DNA, 18 bp, Homo sapiens
ctcctcgctgtgccacca

SEQ ID NO: 407740 - DNA, 21 bp, Homo sapiens
ctcctcggccagagctcccag

SEQ ID NO: 407741 - DNA, 23 bp, Homo sapiens
ctcctcggccagagctcccagga

SEQ ID NO: 407742 - DNA, 19 bp, Homo sapiens
ctcctcggccccctccatc

SEQ ID NO: 407743 - DNA, 16 bp, Homo sapiens
ctcctcgggcaagggc

SEQ ID NO: 407744 - DNA, 19 bp, Homo sapiens
ctcctcgggcaagggccgt

SEQ ID NO: 407745 - DNA, 21 bp, Homo sapiens
ctcctcgggcaagggccgtgc

SEQ ID NO: 407746 - DNA, 16 bp, Homo sapiens
ctcctcggtggcattt

SEQ ID NO: 407747 - DNA, 15 bp, Homo sapiens
ctcctcgtccggcct

SEQ ID NO: 407748 - DNA, 18 bp, Homo sapiens
ctcctcgtccggcctgca

SEQ ID NO: 407749 - DNA, 19 bp, Homo sapiens
ctcctcgtccggcctgcag

SEQ ID NO: 407750 - DNA, 23 bp, Homo sapiens
ctcctcgtccggcctgcagccca

SEQ ID NO: 407751 - DNA, 13 bp, Homo sapiens
ctcctctcagctt

SEQ ID NO: 407752 - DNA, 15 bp, Homo sapiens
ctcctctcagcttct

SEQ ID NO: 407753 - DNA, 15 bp, Homo sapiens
ctcctctccagccct

SEQ ID NO: 407754 - DNA, 21 bp, Homo sapiens
ctcctctccttgggctcctgg

SEQ ID NO: 407755 - DNA, 22 bp, Homo sapiens
ctcctctccttgggctcctggc

SEQ ID NO: 407756 - DNA, 14 bp, Homo sapiens
ctcctctctccctg

SEQ ID NO: 407757 - DNA, 15 bp, Homo sapiens
ctcctctctccctgc

SEQ ID NO: 407758 - DNA, 15 bp, Homo sapiens
ctcctctctgggcct

SEQ ID NO: 407759 - DNA, 12 bp, Homo sapiens
ctcctctcttgg

SEQ ID NO: 407760 - DNA, 14 bp, Homo sapiens
ctcctctcttggac

SEQ ID NO: 407761 - DNA, 13 bp, Homo sapiens
ctcctctgcagcc

SEQ ID NO: 407762 - DNA, 15 bp, Homo sapiens
ctcctctgcagcctg

SEQ ID NO: 407763 - DNA, 18 bp, Homo sapiens
ctcctctgcagcctgagc

SEQ ID NO: 407764 - DNA, 18 bp, Homo sapiens
ctcctctgcagtgccttg

SEQ ID NO: 407765 - DNA, 11 bp, Homo sapiens
ctcctctgccc

SEQ ID NO: 407766 - DNA, 12 bp, Homo sapiens
ctcctctgcccc

SEQ ID NO: 407767 - DNA, 15 bp, Homo sapiens
ctcctctgccccctc

SEQ ID NO: 407768 - DNA, 12 bp, Homo sapiens
ctcctctgcctt

SEQ ID NO: 407769 - DNA, 13 bp, Homo sapiens
ctcctctgccttg

SEQ ID NO: 407770 - DNA, 14 bp, Homo sapiens
ctcctctgccttgg

SEQ ID NO: 407771 - DNA, 13 bp, Homo sapiens
ctcctctgggcag

SEQ ID NO: 407772 - DNA, 11 bp, Homo sapiens
ctcctctgtcc

SEQ ID NO: 407773 - DNA, 11 bp, Homo sapiens
ctcctctgtgc

SEQ ID NO: 407774 - DNA, 15 bp, Homo sapiens
ctcctctgtgctccc

SEQ ID NO: 407775 - DNA, 13 bp, Homo sapiens
ctcctctgttcag

SEQ ID NO: 407776 - DNA, 20 bp, Homo sapiens
ctcctcttaccgtagcctcc

SEQ ID NO: 407777 - DNA, 21 bp, Homo sapiens
ctcctcttaccgtagcctccg

SEQ ID NO: 407778 - DNA, 23 bp, Homo sapiens
ctcctcttcaactgaccagcctc

SEQ ID NO: 407779 - DNA, 18 bp, Homo sapiens
ctcctcttcaccccggca

SEQ ID NO: 407780 - DNA, 20 bp, Homo sapiens
ctcctcttcaccccggcagg

SEQ ID NO: 407781 - DNA, 20 bp, Homo sapiens
ctcctcttcccttagcctct

SEQ ID NO: 407782 - DNA, 23 bp, Homo sapiens
ctcctcttcccttagcctctccc

SEQ ID NO: 407783 - DNA, 15 bp, Homo sapiens
ctcctcttcctgtag

SEQ ID NO: 407784 - DNA, 12 bp, Homo sapiens
ctcctcttgcca

SEQ ID NO: 407785 - DNA, 15 bp, Homo sapiens
ctcctcttgccactg

SEQ ID NO: 407786 - DNA, 19 bp, Homo sapiens
ctcctcttgccactgcctc

SEQ ID NO: 407787 - DNA, 13 bp, Homo sapiens
tgagaaatgatga

SEQ ID NO: 407788 - DNA, 12 bp, Homo sapiens
tgagaaatgggg

SEQ ID NO: 407789 - DNA, 21 bp, Homo sapiens
tgagaacaagtcacagctgca

SEQ ID NO: 407790 - DNA, 22 bp, Homo sapiens
tgagaacaagtcacagctgcag

SEQ ID NO: 407791 - DNA, 21 bp, Homo sapiens
tgagaacatggtgtgtgtctc

SEQ ID NO: 407792 - DNA, 13 bp, Homo sapiens
tgagaactgactt

SEQ ID NO: 407793 - DNA, 17 bp, Homo sapiens
tgagaactgcttctaag

SEQ ID NO: 407794 - DNA, 19 bp, Homo sapiens
tgagaactgttctcatgga

SEQ ID NO: 407795 - DNA, 15 bp, Homo sapiens
tgagaacttttcata

SEQ ID NO: 407796 - DNA, 15 bp, Homo sapiens
tgagaagaggagccc

SEQ ID NO: 407797 - DNA, 19 bp, Homo sapiens
tgagaagccaaagccccta

SEQ ID NO: 407798 - DNA, 16 bp, Homo sapiens
tgagaagccgtgggtg

SEQ ID NO: 407799 - DNA, 17 bp, Homo sapiens
tgagaagccgtgggtgg

SEQ ID NO: 407800 - DNA, 17 bp, Homo sapiens
tgagaaggccagccctc

SEQ ID NO: 407801 - DNA, 22 bp, Homo sapiens
tgagaaggccagccctccctgg

SEQ ID NO: 407802 - DNA, 16 bp, Homo sapiens
tgagaaggcgaggaga

SEQ ID NO: 407803 - DNA, 20 bp, Homo sapiens
tgagaagtactttgtgctga

SEQ ID NO: 407804 - DNA, 22 bp, Homo sapiens
tgagaagtcaaacatttcaaag

SEQ ID NO: 407805 - DNA, 19 bp, Homo sapiens
tgagaataaaaccagctat

SEQ ID NO: 407806 - DNA, 15 bp, Homo sapiens
tgagaatcctgcctc

SEQ ID NO: 407807 - DNA, 21 bp, Homo sapiens
tgagaatctgtgcagtcatca

SEQ ID NO: 407808 - DNA, 14 bp, Homo sapiens
tgagaatgtcattt

SEQ ID NO: 407809 - DNA, 18 bp, Homo sapiens
tgagaatgtcatttgcta

SEQ ID NO: 407810 - DNA, 18 bp, Homo sapiens
tgagaattaaaataaaac

SEQ ID NO: 407811 - DNA, 20 bp, Homo sapiens
tgagaatttaatttttaaaa

SEQ ID NO: 407812 - DNA, 12 bp, Homo sapiens
tgagacaagccc

SEQ ID NO: 407813 - DNA, 16 bp, Homo sapiens
tgagacactgtcaaga

SEQ ID NO: 407814 - DNA, 14 bp, Homo sapiens
tgagacagaatctc

SEQ ID NO: 407815 - DNA, 12 bp, Homo sapiens
tgagacagcaag

SEQ ID NO: 407816 - DNA, 20 bp, Homo sapiens
tgagacagtgggggtgcctg

SEQ ID NO: 407817 - DNA, 21 bp, Homo sapiens
tgagacagtgggggtgcctgg

SEQ ID NO: 407818 - DNA, 17 bp, Homo sapiens
tgagacattacagtttg

SEQ ID NO: 407819 - DNA, 18 bp, Homo sapiens
tgagacattccaaaacga

SEQ ID NO: 407820 - DNA, 20 bp, Homo sapiens
tgagaccaagccggtgccca

SEQ ID NO: 407821 - DNA, 19 bp, Homo sapiens
tgagaccaccctgggcaac

SEQ ID NO: 407822 - DNA, 14 bp, Homo sapiens
tgagaccactgtta

SEQ ID NO: 407823 - DNA, 13 bp, Homo sapiens
tgagacccccaca

SEQ ID NO: 407824 - DNA, 15 bp, Homo sapiens
tgagacccccacacc

SEQ ID NO: 407825 - DNA, 17 bp, Homo sapiens
tgagacccccacacctc

SEQ ID NO: 407826 - DNA, 22 bp, Homo sapiens
tgagacccccacacctcagttc

SEQ ID NO: 407827 - DNA, 19 bp, Homo sapiens
tgagaccctcttctctggg

SEQ ID NO: 407828 - DNA, 18 bp, Homo sapiens
tgagacctggaaccagag

SEQ ID NO: 407829 - DNA, 23 bp, Homo sapiens
tgagacgaggcaggggctctgct

SEQ ID NO: 407830 - DNA, 23 bp, Homo sapiens
tgagacggatggaaggagagagg

SEQ ID NO: 407831 - DNA, 20 bp, Homo sapiens
tgagactataaagcagtaga

SEQ ID NO: 407832 - DNA, 21 bp, Homo sapiens
tgagactccagaatctgctgt

SEQ ID NO: 407833 - DNA, 22 bp, Homo sapiens
tgagactccagaatctgctgtt

SEQ ID NO: 407834 - DNA, 13 bp, Homo sapiens
tgagactctgagg

SEQ ID NO: 407835 - DNA, 21 bp, Homo sapiens
tgagactggatactgcccggg

SEQ ID NO: 407836 - DNA, 21 bp, Homo sapiens
tgagactgtcggagaggctgt

SEQ ID NO: 407837 - DNA, 20 bp, Homo sapiens
tgagacttgctctctggcct

SEQ ID NO: 407838 - DNA, 17 bp, Homo sapiens
tgagagaaaaagtgccc

SEQ ID NO: 407839 - DNA, 12 bp, Homo sapiens
tgagagactttt

SEQ ID NO: 407840 - DNA, 13 bp, Homo sapiens
tgagagagtgtgg

SEQ ID NO: 407841 - DNA, 19 bp, Homo sapiens
agtgggccggccccaggct

SEQ ID NO: 407842 - DNA, 15 bp, Homo sapiens
agtgggctctgagca

SEQ ID NO: 407843 - DNA, 18 bp, Homo sapiens
agtgggctgggccctctg

SEQ ID NO: 407844 - DNA, 10 bp, Homo sapiens
agtgggctgt

SEQ ID NO: 407845 - DNA, 19 bp, Homo sapiens
agtggggacgggggctgct

SEQ ID NO: 407846 - DNA, 22 bp, Homo sapiens
agtggggacgggggctgcttct

SEQ ID NO: 407847 - DNA, 20 bp, Homo sapiens
agtggggagacacctcagag

SEQ ID NO: 407848 - DNA, 12 bp, Homo sapiens
agtggggaggga

SEQ ID NO: 407849 - DNA, 14 bp, Homo sapiens
agtggggagggaca

SEQ ID NO: 407850 - DNA, 19 bp, Homo sapiens
agtggggagggacaaggga

SEQ ID NO: 407851 - DNA, 18 bp, Homo sapiens
agtggggaggggcctggc

SEQ ID NO: 407852 - DNA, 20 bp, Homo sapiens
agtggggaggggcctggcct

SEQ ID NO: 407853 - DNA, 18 bp, Homo sapiens
agtggggcccatggcccc

SEQ ID NO: 407854 - DNA, 19 bp, Homo sapiens
agtggggcccatggcccca

SEQ ID NO: 407855 - DNA, 12 bp, Homo sapiens
agtggggctggg

SEQ ID NO: 407856 - DNA, 21 bp, Homo sapiens
agtgggggagagcaggctggc

SEQ ID NO: 407857 - DNA, 20 bp, Homo sapiens
agtgggtgagaaattttagt

SEQ ID NO: 407858 - DNA, 14 bp, Homo sapiens
agtgggtggcacct

SEQ ID NO: 407859 - DNA, 20 bp, Homo sapiens
agtgggtgggacacagagac

SEQ ID NO: 407860 - DNA, 20 bp, Homo sapiens
agtggtaacaagaggagcag

SEQ ID NO: 407861 - DNA, 15 bp, Homo sapiens
agtggtacaggaagg

SEQ ID NO: 407862 - DNA, 20 bp, Homo sapiens
agtggtagagtcctaggaca

SEQ ID NO: 407863 - DNA, 12 bp, Homo sapiens
agtggtcaagga

SEQ ID NO: 407864 - DNA, 22 bp, Homo sapiens
agtggtccacattctgctgccc

SEQ ID NO: 407865 - DNA, 16 bp, Homo sapiens
agtggtctttctggag

SEQ ID NO: 407866 - DNA, 18 bp, Homo sapiens
agtggtctttctggagag

SEQ ID NO: 407867 - DNA, 20 bp, Homo sapiens
agtggtgaggggccactggg

SEQ ID NO: 407868 - DNA, 14 bp, Homo sapiens
agtggtggctctga

SEQ ID NO: 407869 - DNA, 15 bp, Homo sapiens
agtggtggctctgag

SEQ ID NO: 407870 - DNA, 16 bp, Homo sapiens
agtggtggtgtctcac

SEQ ID NO: 407871 - DNA, 17 bp, Homo sapiens
agtggtgttttaaagag

SEQ ID NO: 407872 - DNA, 21 bp, Homo sapiens
agtggttctacaatctattta

SEQ ID NO: 407873 - DNA, 22 bp, Homo sapiens
agtggtttcataggagacacat

SEQ ID NO: 407874 - DNA, 22 bp, Homo sapiens
agtggtttccacatgctctgag

SEQ ID NO: 407875 - DNA, 13 bp, Homo sapiens
agtgtaaaataag

SEQ ID NO: 407876 - DNA, 15 bp, Homo sapiens
agtgtaacagctgag

SEQ ID NO: 407877 - DNA, 17 bp, Homo sapiens
agtgtaacagctgaggt

SEQ ID NO: 407878 - DNA, 17 bp, Homo sapiens
agtgtacagaagaattt

SEQ ID NO: 407879 - DNA, 14 bp, Homo sapiens
agtgtacatcatgt

SEQ ID NO: 407880 - DNA, 17 bp, Homo sapiens
agtgtacatcatgttat

SEQ ID NO: 407881 - DNA, 16 bp, Homo sapiens
agtgtactgctttcaa

SEQ ID NO: 407882 - DNA, 22 bp, Homo sapiens
agtgtacttcataagatattct

SEQ ID NO: 407883 - DNA, 18 bp, Homo sapiens
agtgtagcccacacttga

SEQ ID NO: 407884 - DNA, 20 bp, Homo sapiens
agtgtataccacctgtacat

SEQ ID NO: 407885 - DNA, 13 bp, Homo sapiens
agtgtatctcgaa

SEQ ID NO: 407886 - DNA, 17 bp, Homo sapiens
agtgtatgcacgtgtgc

SEQ ID NO: 407887 - DNA, 21 bp, Homo sapiens
agtgtattttctgtcactgta

SEQ ID NO: 407888 - DNA, 17 bp, Homo sapiens
agtgtcaagttgtgctt

SEQ ID NO: 407889 - DNA, 19 bp, Homo sapiens
agtgtcaagttgtgcttgt

SEQ ID NO: 407890 - DNA, 20 bp, Homo sapiens
agtgtcaagttgtgcttgtt

SEQ ID NO: 407891 - DNA, 22 bp, Homo sapiens
agtgtcaagttgtgcttgttta

SEQ ID NO: 407892 - DNA, 21 bp, Homo sapiens
agtgtcacttacctagattta

SEQ ID NO: 407893 - DNA, 16 bp, Homo sapiens
agtgtcacttgactct

SEQ ID NO: 407894 - DNA, 19 bp, Homo sapiens
agtgtcacttttttcctgt

SEQ ID NO: 407895 - DNA, 21 bp, Homo sapiens
agtgtcacttttttcctgtca

SEQ ID NO: 407896 - DNA, 19 bp, Homo sapiens
agtgtcatttatgaaaaga

SEQ ID NO: 407897 - DNA, 16 bp, Homo sapiens
agtgtcatttctttta

SEQ ID NO: 407898 - DNA, 23 bp, Homo sapiens
agtgtccattatctgctgttcct

SEQ ID NO: 407899 - DNA, 16 bp, Homo sapiens
agtgtccccaggggca

SEQ ID NO: 407900 - DNA, 20 bp, Homo sapiens
agtgtcctgtgctttctgca

SEQ ID NO: 407901 - DNA, 21 bp, Homo sapiens
agtgtcctgtgctttctgcat

SEQ ID NO: 407902 - DNA, 22 bp, Homo sapiens
agtgtcctgtgctttctgcatg

SEQ ID NO: 407903 - DNA, 16 bp, Homo sapiens
agtgtcgccgtccctc

SEQ ID NO: 407904 - DNA, 20 bp, Homo sapiens
agtgtcgccgtccctctgcc

SEQ ID NO: 407905 - DNA, 17 bp, Homo sapiens
agtgtctattccctgga

SEQ ID NO: 407906 - DNA, 18 bp, Homo sapiens
agtgtctcagtccacctg

SEQ ID NO: 407907 - DNA, 22 bp, Homo sapiens
agtgtctcagtccacctgagct

SEQ ID NO: 407908 - DNA, 12 bp, Homo sapiens
agtgtctgcagt

SEQ ID NO: 407909 - DNA, 20 bp, Homo sapiens
agtgtctgctgctgcctccc

SEQ ID NO: 407910 - DNA, 13 bp, Homo sapiens
agtgtctgtccat

SEQ ID NO: 407911 - DNA, 20 bp, Homo sapiens
agtgtctgtccatctgtctg

SEQ ID NO: 407912 - DNA, 22 bp, Homo sapiens
agtgtctgtgtgcaagtgtgtg

SEQ ID NO: 407913 - DNA, 19 bp, Homo sapiens
agtgtgcaagcaaagaacc

SEQ ID NO: 407914 - DNA, 13 bp, Homo sapiens
agtgtgcacagat

SEQ ID NO: 407915 - DNA, 20 bp, Homo sapiens
agtgtgcataattttgccaa

SEQ ID NO: 407916 - DNA, 17 bp, Homo sapiens
agtgtgccaccctctgc

SEQ ID NO: 407917 - DNA, 21 bp, Homo sapiens
agtgtgccaccctctgcaggg

SEQ ID NO: 407918 - DNA, 15 bp, Homo sapiens
agtgtgcctgtcact

SEQ ID NO: 407919 - DNA, 17 bp, Homo sapiens
agtgtggactgggaagc

SEQ ID NO: 407920 - DNA, 21 bp, Homo sapiens
agtgtggagaggggtgcaccc

SEQ ID NO: 407921 - DNA, 14 bp, Homo sapiens
agtgtggctcccct

SEQ ID NO: 407922 - DNA, 16 bp, Homo sapiens
agtgtggctcccctct

SEQ ID NO: 407923 - DNA, 21 bp, Homo sapiens
agtgtggctcccctctattta

SEQ ID NO: 407924 - DNA, 13 bp, Homo sapiens
agtgtggctggtg

SEQ ID NO: 407925 - DNA, 18 bp, Homo sapiens
agtgtggcttaaacattt

SEQ ID NO: 407926 - DNA, 21 bp, Homo sapiens
agtgtgggactccaggccagc

SEQ ID NO: 407927 - DNA, 12 bp, Homo sapiens
agtgtggttttc

SEQ ID NO: 407928 - DNA, 16 bp, Homo sapiens
agtgtggttttctgtt

SEQ ID NO: 407929 - DNA, 12 bp, Homo sapiens
agtgtgtacttc

SEQ ID NO: 407930 - DNA, 19 bp, Homo sapiens
agtgtgtatgtgcgtgtgt

SEQ ID NO: 407931 - DNA, 20 bp, Homo sapiens
agtgtgtatgtgcgtgtgtg

SEQ ID NO: 407932 - DNA, 15 bp, Homo sapiens
agtgtgtctcctgca

SEQ ID NO: 407933 - DNA, 16 bp, Homo sapiens
agtgtgtgcatgtgtg

SEQ ID NO: 407934 - DNA, 21 bp, Homo sapiens
agtgtgtgggggtctgggagg

SEQ ID NO: 407935 - DNA, 13 bp, Homo sapiens
agtgtgtgtgcaa

SEQ ID NO: 407936 - DNA, 12 bp, Homo sapiens
agtgtgtgtgcg

SEQ ID NO: 407937 - DNA, 17 bp, Homo sapiens
agtgtgttctgattaga

SEQ ID NO: 407938 - DNA, 20 bp, Homo sapiens
agtgtgttttggtatgcact

SEQ ID NO: 407939 - DNA, 17 bp, Homo sapiens
agtgttagtgggaagag

SEQ ID NO: 407940 - DNA, 17 bp, Homo sapiens
agtgttataaaatctgt

SEQ ID NO: 407941 - DNA, 16 bp, Homo sapiens
agtgttatcagtcata

SEQ ID NO: 407942 - DNA, 23 bp, Homo sapiens
agtgttatcagtcataactaaat

SEQ ID NO: 407943 - DNA, 18 bp, Homo sapiens
agtgttcattttagtgac

SEQ ID NO: 407944 - DNA, 21 bp, Homo sapiens
agtgttcattttagtgactgt

SEQ ID NO: 407945 - DNA, 19 bp, Homo sapiens
agtctgaggcacctgcata

SEQ ID NO: 407946 - DNA, 20 bp, Homo sapiens
agtctgaggccccaggccct

SEQ ID NO: 407947 - DNA, 20 bp, Homo sapiens
agtctgcagctattcacaca

SEQ ID NO: 407948 - DNA, 18 bp, Homo sapiens
agtctgctgccctccatc

SEQ ID NO: 407949 - DNA, 20 bp, Homo sapiens
agtctgctgccctccatccc

SEQ ID NO: 407950 - DNA, 15 bp, Homo sapiens
agtctggagaccagg

SEQ ID NO: 407951 - DNA, 13 bp, Homo sapiens
agtctggaggggc

SEQ ID NO: 407952 - DNA, 21 bp, Homo sapiens
agtctggcaaacatgtgcaac

SEQ ID NO: 407953 - DNA, 21 bp, Homo sapiens
agtctgggaaggggcgtgtcc

SEQ ID NO: 407954 - DNA, 17 bp, Homo sapiens
agtctgggatgtagaac

SEQ ID NO: 407955 - DNA, 20 bp, Homo sapiens
agtctgggcctctgactctg

SEQ ID NO: 407956 - DNA, 14 bp, Homo sapiens
agtctgggctgccg

SEQ ID NO: 407957 - DNA, 16 bp, Homo sapiens
agtctgggctgccggg

SEQ ID NO: 407958 - DNA, 20 bp, Homo sapiens
agtctggtttctagacttgt

SEQ ID NO: 407959 - DNA, 14 bp, Homo sapiens
agtctgtcctttcc

SEQ ID NO: 407960 - DNA, 20 bp, Homo sapiens
agtctgtctactgtggtgat

SEQ ID NO: 407961 - DNA, 19 bp, Homo sapiens
agtctgtgaataaagccac

SEQ ID NO: 407962 - DNA, 21 bp, Homo sapiens
agtctgtgaataaagccacat

SEQ ID NO: 407963 - DNA, 16 bp, Homo sapiens
agtctgtgcctggagc

SEQ ID NO: 407964 - DNA, 17 bp, Homo sapiens
agtctgtgcctggagct

SEQ ID NO: 407965 - DNA, 19 bp, Homo sapiens
agtctgtgtgatgaacttt

SEQ ID NO: 407966 - DNA, 20 bp, Homo sapiens
agtctgtgtgtagccaggaa

SEQ ID NO: 407967 - DNA, 21 bp, Homo sapiens
agtctgtgtgtagccaggaag

SEQ ID NO: 407968 - DNA, 24 bp, Homo sapiens
agtcttaacaacagcttcttgctt

SEQ ID NO: 407969 - DNA, 16 bp, Homo sapiens
agtcttaattttctaa

SEQ ID NO: 407970 - DNA, 16 bp, Homo sapiens
agtcttcaagggctgc

SEQ ID NO: 407971 - DNA, 14 bp, Homo sapiens
agtcttcacattta

SEQ ID NO: 407972 - DNA, 16 bp, Homo sapiens
agtcttcactctctga

SEQ ID NO: 407973 - DNA, 21 bp, Homo sapiens
agtcttcatggtctcttccag

SEQ ID NO: 407974 - DNA, 22 bp, Homo sapiens
agtcttccagagcctaagaaaa

SEQ ID NO: 407975 - DNA, 16 bp, Homo sapiens
agtcttccatcagcag

SEQ ID NO: 407976 - DNA, 18 bp, Homo sapiens
agtcttccatcagcagtg

SEQ ID NO: 407977 - DNA, 22 bp, Homo sapiens
agtcttccctagggctgggtgt

SEQ ID NO: 407978 - DNA, 20 bp, Homo sapiens
agtcttctaccaaatgtgta

SEQ ID NO: 407979 - DNA, 18 bp, Homo sapiens
agtcttctcatagcatta

SEQ ID NO: 407980 - DNA, 16 bp, Homo sapiens
agtcttgctgtggtct

SEQ ID NO: 407981 - DNA, 17 bp, Homo sapiens
agtcttgtgactagtgc

SEQ ID NO: 407982 - DNA, 23 bp, Homo sapiens
agtcttgtgactagtgctgaagc

SEQ ID NO: 407983 - DNA, 13 bp, Homo sapiens
agtctttgtttac

SEQ ID NO: 407984 - DNA, 13 bp, Homo sapiens
agtcttttctgtc

SEQ ID NO: 407985 - DNA, 22 bp, Homo sapiens
agtctttttagtgttttgcaag

SEQ ID NO: 407986 - DNA, 19 bp, Homo sapiens
agtgaaaaagacttcaaat

SEQ ID NO: 407987 - DNA, 20 bp, Homo sapiens
agtgaaaaagacttcaaatg

SEQ ID NO: 407988 - DNA, 12 bp, Homo sapiens
agtgaaaactag

SEQ ID NO: 407989 - DNA, 15 bp, Homo sapiens
agtgaaaatgccaca

SEQ ID NO: 407990 - DNA, 22 bp, Homo sapiens
agtgaaattaggccttatgtaa

SEQ ID NO: 407991 - DNA, 19 bp, Homo sapiens
agtgaacaactatttataa

SEQ ID NO: 407992 - DNA, 14 bp, Homo sapiens
agtgaacataactg

SEQ ID NO: 407993 - DNA, 20 bp, Homo sapiens
agtgaactacgcttgctcat

SEQ ID NO: 407994 - DNA, 18 bp, Homo sapiens
agtgaatcttatggtgga

SEQ ID NO: 407995 - DNA, 13 bp, Homo sapiens
agtgaatgaaaca

SEQ ID NO: 407996 - DNA, 18 bp, Homo sapiens
agtgaatgggaaagggtg

SEQ ID NO: 407997 - DNA, 13 bp, Homo sapiens
agtgaatttgaat

SEQ ID NO: 407998 - DNA, 15 bp, Homo sapiens
agtgaatttgaatga

SEQ ID NO: 407999 - DNA, 16 bp, Homo sapiens
agtgaattttaaaatg

SEQ ID NO: 408000 - DNA, 16 bp, Homo sapiens
agtgacaaggccccag

SEQ ID NO: 408001 - DNA, 17 bp, Homo sapiens
agtgacacagcagcttc

SEQ ID NO: 408002 - DNA, 18 bp, Homo sapiens
agtgacacttcagagagc

SEQ ID NO: 408003 - DNA, 17 bp, Homo sapiens
agtgacagacaggctct

SEQ ID NO: 408004 - DNA, 20 bp, Homo sapiens
agtgacagatcctccatttt

SEQ ID NO: 408005 - DNA, 19 bp, Homo sapiens
agtgacagtggattgcatt

SEQ ID NO: 408006 - DNA, 20 bp, Homo sapiens
agtgacagtggattgcattt

SEQ ID NO: 408007 - DNA, 17 bp, Homo sapiens
agtgacatcggttcagg

SEQ ID NO: 408008 - DNA, 11 bp, Homo sapiens
agtgacccagc

SEQ ID NO: 408009 - DNA, 15 bp, Homo sapiens
agtgacccggaggcc

SEQ ID NO: 408010 - DNA, 18 bp, Homo sapiens
agtgactagtacaaatta

SEQ ID NO: 408011 - DNA, 17 bp, Homo sapiens
agtgactccaggagagg

SEQ ID NO: 408012 - DNA, 20 bp, Homo sapiens
agtgactgacggctgtgtat

SEQ ID NO: 408013 - DNA, 22 bp, Homo sapiens
agtgactgacggctgtgtattt

SEQ ID NO: 408014 - DNA, 14 bp, Homo sapiens
agtgactggcaggt

SEQ ID NO: 408015 - DNA, 22 bp, Homo sapiens
agtgactggcaggtgcagatgg

SEQ ID NO: 408016 - DNA, 23 bp, Homo sapiens
agtgactgtttggcttataaaca

SEQ ID NO: 408017 - DNA, 20 bp, Homo sapiens
agtgactttttctgagcttt

SEQ ID NO: 408018 - DNA, 14 bp, Homo sapiens
agtgagaaattttt

SEQ ID NO: 408019 - DNA, 16 bp, Homo sapiens
agtgagaagataaaaa

SEQ ID NO: 408020 - DNA, 15 bp, Homo sapiens
agtgagacaaaattt

SEQ ID NO: 408021 - DNA, 16 bp, Homo sapiens
agtgagacaaaatttt

SEQ ID NO: 408022 - DNA, 12 bp, Homo sapiens
agtgagacagaa

SEQ ID NO: 408023 - DNA, 23 bp, Homo sapiens
agtgagacctccctgtctctaca

SEQ ID NO: 408024 - DNA, 21 bp, Homo sapiens
agtgagactcctgattgctct

SEQ ID NO: 408025 - DNA, 22 bp, Homo sapiens
agtgagactcctgattgctctg

SEQ ID NO: 408026 - DNA, 14 bp, Homo sapiens
agtgagagcacaaa

SEQ ID NO: 408027 - DNA, 14 bp, Homo sapiens
agtgagatgggaag

SEQ ID NO: 408028 - DNA, 15 bp, Homo sapiens
agtgagatgggaagg

SEQ ID NO: 408029 - DNA, 19 bp, Homo sapiens
agtgagatgggaagggctt

SEQ ID NO: 408030 - DNA, 17 bp, Homo sapiens
agtgagatttgtattta

SEQ ID NO: 408031 - DNA, 17 bp, Homo sapiens
agtgagcccctccccag

SEQ ID NO: 408032 - DNA, 18 bp, Homo sapiens
agtgagcccctccccagc

SEQ ID NO: 408033 - DNA, 19 bp, Homo sapiens
agtgagcccctccccagcc

SEQ ID NO: 408034 - DNA, 20 bp, Homo sapiens
agtgagcccctccccagcca

SEQ ID NO: 408035 - DNA, 21 bp, Homo sapiens
agtgagcccctccccagccag

SEQ ID NO: 408036 - DNA, 20 bp, Homo sapiens
agtgagcgtgtagcgtcctg

SEQ ID NO: 408037 - DNA, 16 bp, Homo sapiens
agtgagctctctcaga

SEQ ID NO: 408038 - DNA, 24 bp, Homo sapiens
agtgagcttgtaattgcaccactg

SEQ ID NO: 408039 - DNA, 18 bp, Homo sapiens
agtgaggagggtggagga

SEQ ID NO: 408040 - DNA, 20 bp, Homo sapiens
agtgaggcaagagaaatgag

SEQ ID NO: 408041 - DNA, 19 bp, Homo sapiens
agtgaggcttccaggctct

SEQ ID NO: 408042 - DNA, 15 bp, Homo sapiens
agtgagtctgaattg

SEQ ID NO: 408043 - DNA, 14 bp, Homo sapiens
agtgagtggcatgt

SEQ ID NO: 408044 - DNA, 16 bp, Homo sapiens
agtgagtgtggcttag

SEQ ID NO: 408045 - DNA, 15 bp, Homo sapiens
agtgatatggcttgt

SEQ ID NO: 408046 - DNA, 23 bp, Homo sapiens
agtgatatggtactaaggagaat

SEQ ID NO: 408047 - DNA, 16 bp, Homo sapiens
agtgatcaataaaatg

SEQ ID NO: 408048 - DNA, 20 bp, Homo sapiens
agtgatgagctgaaaagtga

SEQ ID NO: 408049 - DNA, 22 bp, Homo sapiens
agtgatgatttgggggaggctt

SEQ ID NO: 408050 - DNA, 23 bp, Homo sapiens
agtgatggcgcgggaggcaccag

SEQ ID NO: 408051 - DNA, 16 bp, Homo sapiens
agtgatgtaccatgaa

SEQ ID NO: 408052 - DNA, 15 bp, Homo sapiens
agtgatgtagaaaga

SEQ ID NO: 408053 - DNA, 14 bp, Homo sapiens
agtgatgtgattta

SEQ ID NO: 408054 - DNA, 19 bp, Homo sapiens
agtgatgtgatttatgcat

SEQ ID NO: 408055 - DNA, 23 bp, Homo sapiens
agtgattgaagtatctgtacctg

SEQ ID NO: 408056 - DNA, 24 bp, Homo sapiens
agtgattgtgtctgcattgttatt

SEQ ID NO: 408057 - DNA, 16 bp, Homo sapiens
agtgatttacatgctg

SEQ ID NO: 408058 - DNA, 13 bp, Homo sapiens
agtgatttctaga

SEQ ID NO: 408059 - DNA, 17 bp, Homo sapiens
agtggctcctcccggtg

SEQ ID NO: 408060 - DNA, 17 bp, Homo sapiens
agtggctggtccagggc

SEQ ID NO: 408061 - DNA, 19 bp, Homo sapiens
agtggctggtccagggcta

SEQ ID NO: 408062 - DNA, 17 bp, Homo sapiens
agtggcttaatagtaat

SEQ ID NO: 408063 - DNA, 15 bp, Homo sapiens
agtggcttcaaaata

SEQ ID NO: 408064 - DNA, 20 bp, Homo sapiens
agtggcttcttttgaactgt

SEQ ID NO: 408065 - DNA, 13 bp, Homo sapiens
agtgggaagagct

SEQ ID NO: 408066 - DNA, 15 bp, Homo sapiens
agtgggaagagctgg

SEQ ID NO: 408067 - DNA, 20 bp, Homo sapiens
agtgggaatgcagtgggtgg

SEQ ID NO: 408068 - DNA, 17 bp, Homo sapiens
agtgggacagagtctgg

SEQ ID NO: 408069 - DNA, 15 bp, Homo sapiens
agtgggacccataga

SEQ ID NO: 408070 - DNA, 22 bp, Homo sapiens
agtgggacccatagatcttctg

SEQ ID NO: 408071 - DNA, 14 bp, Homo sapiens
agtgggagaagtgg

SEQ ID NO: 408072 - DNA, 15 bp, Homo sapiens
agtgggagaagtggc

SEQ ID NO: 408073 - DNA, 19 bp, Homo sapiens
agtgggagaagtggcccct

SEQ ID NO: 408074 - DNA, 17 bp, Homo sapiens
agtgggagaggaagcca

SEQ ID NO: 408075 - DNA, 16 bp, Homo sapiens
agtgggagatgaaaac

SEQ ID NO: 408076 - DNA, 17 bp, Homo sapiens
agtgggagatgaaaacc

SEQ ID NO: 408077 - DNA, 18 bp, Homo sapiens
agtgggagcccagcacac

SEQ ID NO: 408078 - DNA, 19 bp, Homo sapiens
agtgggaggagagggcaga

SEQ ID NO: 408079 - DNA, 22 bp, Homo sapiens
agtgggatcaaagctaggaaag

SEQ ID NO: 408080 - DNA, 18 bp, Homo sapiens
agtgggattcaggaatgg

SEQ ID NO: 408081 - DNA, 15 bp, Homo sapiens
agtgggcacctcaga

SEQ ID NO: 408082 - DNA, 15 bp, Homo sapiens
agtgggcatgtatta

SEQ ID NO: 408083 - DNA, 14 bp, Homo sapiens
agtgggccccctct

SEQ ID NO: 408084 - DNA, 18 bp, Homo sapiens
agtgggccggccccaggc

SEQ ID NO: 408085 - DNA, 14 bp, Homo sapiens
ataacttcagagaa

SEQ ID NO: 408086 - DNA, 13 bp, Homo sapiens
ataacttccttca

SEQ ID NO: 408087 - DNA, 23 bp, Homo sapiens
ataacttccttcacatctcccat

SEQ ID NO: 408088 - DNA, 15 bp, Homo sapiens
ataagaaaacatgta

SEQ ID NO: 408089 - DNA, 16 bp, Homo sapiens
ataagaaaacatgtaa

SEQ ID NO: 408090 - DNA, 19 bp, Homo sapiens
ataagaatgctggttttcc

SEQ ID NO: 408091 - DNA, 18 bp, Homo sapiens
ataagaatggttgcctta

SEQ ID NO: 408092 - DNA, 20 bp, Homo sapiens
ataagaccgtgtcccaagga

SEQ ID NO: 408093 - DNA, 17 bp, Homo sapiens
ataagactggaaaatag

SEQ ID NO: 408094 - DNA, 21 bp, Homo sapiens
ataagactggaaaatagtcct

SEQ ID NO: 408095 - DNA, 16 bp, Homo sapiens
ataagacttgtttctt

SEQ ID NO: 408096 - DNA, 19 bp, Homo sapiens
ataagacttgtttctttct

SEQ ID NO: 408097 - DNA, 18 bp, Homo sapiens
ataagagaaagaaaatga

SEQ ID NO: 408098 - DNA, 12 bp, Homo sapiens
ataagagaaatg

SEQ ID NO: 408099 - DNA, 21 bp, Homo sapiens
ataagagaaatggtagaagat

SEQ ID NO: 408100 - DNA, 17 bp, Homo sapiens
ataagatattctttaca

SEQ ID NO: 408101 - DNA, 14 bp, Homo sapiens
ataagattcatatt

SEQ ID NO: 408102 - DNA, 12 bp, Homo sapiens
ataagcaagaga

SEQ ID NO: 408103 - DNA, 16 bp, Homo sapiens
ataagcaagagagatg

SEQ ID NO: 408104 - DNA, 17 bp, Homo sapiens
ataagcaagagagatgt

SEQ ID NO: 408105 - DNA, 23 bp, Homo sapiens
ataagcatggagaacagtgattt

SEQ ID NO: 408106 - DNA, 15 bp, Homo sapiens
ataagcattgaaatt

SEQ ID NO: 408107 - DNA, 22 bp, Homo sapiens
ataagccaaaaaatgcttgctt

SEQ ID NO: 408108 - DNA, 21 bp, Homo sapiens
ataagcctccatttagttctt

SEQ ID NO: 408109 - DNA, 16 bp, Homo sapiens
ataagctgaataaagt

SEQ ID NO: 408110 - DNA, 18 bp, Homo sapiens
ataaggaaagcaataaat

SEQ ID NO: 408111 - DNA, 18 bp, Homo sapiens
ataaggaaatatcataat

SEQ ID NO: 408112 - DNA, 20 bp, Homo sapiens
ataaggaaatatcataatgt

SEQ ID NO: 408113 - DNA, 14 bp, Homo sapiens
ataaggactgcatg

SEQ ID NO: 408114 - DNA, 16 bp, Homo sapiens
ataaggcctgccctcc

SEQ ID NO: 408115 - DNA, 17 bp, Homo sapiens
ataaggcctgccctccc

SEQ ID NO: 408116 - DNA, 16 bp, Homo sapiens
ataaggccttaatatg

SEQ ID NO: 408117 - DNA, 17 bp, Homo sapiens
ataaggccttaatatgt

SEQ ID NO: 408118 - DNA, 18 bp, Homo sapiens
ataaggccttaatatgtt

SEQ ID NO: 408119 - DNA, 13 bp, Homo sapiens
ataaggtaccaag

SEQ ID NO: 408120 - DNA, 14 bp, Homo sapiens
ataagtaacatata

SEQ ID NO: 408121 - DNA, 16 bp, Homo sapiens
ataagtaacatataaa

SEQ ID NO: 408122 - DNA, 13 bp, Homo sapiens
ataagtaagtttg

SEQ ID NO: 408123 - DNA, 15 bp, Homo sapiens
ataagtatacagttc

SEQ ID NO: 408124 - DNA, 17 bp, Homo sapiens
ataagtcctaaagtgaa

SEQ ID NO: 408125 - DNA, 17 bp, Homo sapiens
ataagtggaaaaaagag

SEQ ID NO: 408126 - DNA, 19 bp, Homo sapiens
ataagttaaagagacaaat

SEQ ID NO: 408127 - DNA, 22 bp, Homo sapiens
ataagttaatattggaagtgaa

SEQ ID NO: 408128 - DNA, 19 bp, Homo sapiens
ataagttcattaaacagaa

SEQ ID NO: 408129 - DNA, 14 bp, Homo sapiens
ataataaactgtcc

SEQ ID NO: 408130 - DNA, 12 bp, Homo sapiens
ataataaagtat

SEQ ID NO: 408131 - DNA, 13 bp, Homo sapiens
ataataaagtatt

SEQ ID NO: 408132 - DNA, 23 bp, Homo sapiens
ataataaagtattccaccttaaa

SEQ ID NO: 408133 - DNA, 17 bp, Homo sapiens
ataataaattaacatta

SEQ ID NO: 408134 - DNA, 15 bp, Homo sapiens
ataataaattgaaat

SEQ ID NO: 408135 - DNA, 15 bp, Homo sapiens
ataataactagatct

SEQ ID NO: 408136 - DNA, 16 bp, Homo sapiens
ataataactagatctc

SEQ ID NO: 408137 - DNA, 18 bp, Homo sapiens
ataataaggggaagactt

SEQ ID NO: 408138 - DNA, 15 bp, Homo sapiens
ataataagtttcata

SEQ ID NO: 408139 - DNA, 14 bp, Homo sapiens
ataataatttttat

SEQ ID NO: 408140 - DNA, 22 bp, Homo sapiens
ataatacatctttatcattaaa

SEQ ID NO: 408141 - DNA, 15 bp, Homo sapiens
ataatagttaatgaa

SEQ ID NO: 408142 - DNA, 21 bp, Homo sapiens
ataatagttcaggatttggtt

SEQ ID NO: 408143 - DNA, 20 bp, Homo sapiens
ataatagtttacatgtagta

SEQ ID NO: 408144 - DNA, 14 bp, Homo sapiens
ataatataaatgaa

SEQ ID NO: 408145 - DNA, 15 bp, Homo sapiens
ataatataaatgaat

SEQ ID NO: 408146 - DNA, 17 bp, Homo sapiens
ataatataaatgaatga

SEQ ID NO: 408147 - DNA, 23 bp, Homo sapiens
ataatatcttgaagaatattgtt

SEQ ID NO: 408148 - DNA, 22 bp, Homo sapiens
ataatatgtttgaggttaaaat

SEQ ID NO: 408149 - DNA, 21 bp, Homo sapiens
ataatcatccttttttaaaaa

SEQ ID NO: 408150 - DNA, 16 bp, Homo sapiens
ataatcccagcacttt

SEQ ID NO: 408151 - DNA, 21 bp, Homo sapiens
ataatccctttacatctgtgt

SEQ ID NO: 408152 - DNA, 11 bp, Homo sapiens
ataatctcatc

SEQ ID NO: 408153 - DNA, 20 bp, Homo sapiens
ataatctgacaaagtcatga

SEQ ID NO: 408154 - DNA, 22 bp, Homo sapiens
ataatctggactcctctgtcca

SEQ ID NO: 408155 - DNA, 19 bp, Homo sapiens
ataatgacgtattgtgaaa

SEQ ID NO: 408156 - DNA, 22 bp, Homo sapiens
ataatgagtaatgcagacattt

SEQ ID NO: 408157 - DNA, 22 bp, Homo sapiens
ataatgatgatgggaattgtgt

SEQ ID NO: 408158 - DNA, 21 bp, Homo sapiens
ataatgcctttttggttttgt

SEQ ID NO: 408159 - DNA, 18 bp, Homo sapiens
ataatgcttttactaagc

SEQ ID NO: 408160 - DNA, 19 bp, Homo sapiens
ataatggcctcttaaaaat

SEQ ID NO: 408161 - DNA, 17 bp, Homo sapiens
atactggaagttttgca

SEQ ID NO: 408162 - DNA, 18 bp, Homo sapiens
atactggaagttttgcat

SEQ ID NO: 408163 - DNA, 19 bp, Homo sapiens
atactggaagttttgcatt

SEQ ID NO: 408164 - DNA, 18 bp, Homo sapiens
atactgggtacaagagcc

SEQ ID NO: 408165 - DNA, 19 bp, Homo sapiens
atactgggtacaagagcca

SEQ ID NO: 408166 - DNA, 21 bp, Homo sapiens
atactggtgcagtcattatga

SEQ ID NO: 408167 - DNA, 14 bp, Homo sapiens
atactggttatagt

SEQ ID NO: 408168 - DNA, 20 bp, Homo sapiens
atactggttatcctgtgcta

SEQ ID NO: 408169 - DNA, 22 bp, Homo sapiens
atactgtatgccggctccttca

SEQ ID NO: 408170 - DNA, 16 bp, Homo sapiens
atactgtctaagaata

SEQ ID NO: 408171 - DNA, 20 bp, Homo sapiens
atactgtctaagaataatga

SEQ ID NO: 408172 - DNA, 15 bp, Homo sapiens
atactgtgtgggata

SEQ ID NO: 408173 - DNA, 18 bp, Homo sapiens
atacttaaaaatatgtga

SEQ ID NO: 408174 - DNA, 18 bp, Homo sapiens
atacttaaaggaacacgt

SEQ ID NO: 408175 - DNA, 18 bp, Homo sapiens
atacttaatactgaattt

SEQ ID NO: 408176 - DNA, 14 bp, Homo sapiens
atacttagtggtat

SEQ ID NO: 408177 - DNA, 16 bp, Homo sapiens
atacttcaaaagccat

SEQ ID NO: 408178 - DNA, 15 bp, Homo sapiens
atacttgaatatgga

SEQ ID NO: 408179 - DNA, 16 bp, Homo sapiens
atacttgaatatggaa

SEQ ID NO: 408180 - DNA, 13 bp, Homo sapiens
atacttgatgcac

SEQ ID NO: 408181 - DNA, 18 bp, Homo sapiens
atacttgatgcacttatt

SEQ ID NO: 408182 - DNA, 14 bp, Homo sapiens
atacttgtgatttt

SEQ ID NO: 408183 - DNA, 17 bp, Homo sapiens
atacttgtggttttcaa

SEQ ID NO: 408184 - DNA, 18 bp, Homo sapiens
atacttgtggttttcaaa

SEQ ID NO: 408185 - DNA, 19 bp, Homo sapiens
atacttgtggttttcaaat

SEQ ID NO: 408186 - DNA, 15 bp, Homo sapiens
atactttctctctag

SEQ ID NO: 408187 - DNA, 16 bp, Homo sapiens
atactttgtgtctttt

SEQ ID NO: 408188 - DNA, 17 bp, Homo sapiens
atacttttgtgtattct

SEQ ID NO: 408189 - DNA, 19 bp, Homo sapiens
atacttttgtgtattctgt

SEQ ID NO: 408190 - DNA, 22 bp, Homo sapiens
atacttttgtgtattctgtgga

SEQ ID NO: 408191 - DNA, 20 bp, Homo sapiens
atagaaataaatagctatat

SEQ ID NO: 408192 - DNA, 17 bp, Homo sapiens
atagaacatattttcct

SEQ ID NO: 408193 - DNA, 14 bp, Homo sapiens
atagaagaacagca

SEQ ID NO: 408194 - DNA, 16 bp, Homo sapiens
atagaagaacagcaga

SEQ ID NO: 408195 - DNA, 14 bp, Homo sapiens
atagaagctgtagt

SEQ ID NO: 408196 - DNA, 18 bp, Homo sapiens
atagaataaaatataatt

SEQ ID NO: 408197 - DNA, 13 bp, Homo sapiens
atagaatagcatg

SEQ ID NO: 408198 - DNA, 19 bp, Homo sapiens
atagaatatttattacctc

SEQ ID NO: 408199 - DNA, 15 bp, Homo sapiens
atagaatttcctaat

SEQ ID NO: 408200 - DNA, 16 bp, Homo sapiens
atagacaaaggcctta

SEQ ID NO: 408201 - DNA, 21 bp, Homo sapiens
atagacaaaggccttaacaaa

SEQ ID NO: 408202 - DNA, 14 bp, Homo sapiens
atagacagaaacag

SEQ ID NO: 408203 - DNA, 21 bp, Homo sapiens
atagacttatatgcaggctgt

SEQ ID NO: 408204 - DNA, 14 bp, Homo sapiens
atagagactgtaga

SEQ ID NO: 408205 - DNA, 21 bp, Homo sapiens
atagagatatttaaaagacaa

SEQ ID NO: 408206 - DNA, 12 bp, Homo sapiens
atagagctttta

SEQ ID NO: 408207 - DNA, 23 bp, Homo sapiens
atagataactgctcttttactaa

SEQ ID NO: 408208 - DNA, 15 bp, Homo sapiens
atagataattatcca

SEQ ID NO: 408209 - DNA, 13 bp, Homo sapiens
atagatacttttg

SEQ ID NO: 408210 - DNA, 15 bp, Homo sapiens
atagatacttttgat

SEQ ID NO: 408211 - DNA, 14 bp, Homo sapiens
atagatataaatat

SEQ ID NO: 408212 - DNA, 16 bp, Homo sapiens
atagatcagtatttca

SEQ ID NO: 408213 - DNA, 23 bp, Homo sapiens
atagatcctctgatatacaatta

SEQ ID NO: 408214 - DNA, 21 bp, Homo sapiens
atagatctgatggtgagctgg

SEQ ID NO: 408215 - DNA, 19 bp, Homo sapiens
atagatgcaagatatttat

SEQ ID NO: 408216 - DNA, 22 bp, Homo sapiens
atagatgtccctttcttggcca

SEQ ID NO: 408217 - DNA, 18 bp, Homo sapiens
atagattcacctgtaaaa

SEQ ID NO: 408218 - DNA, 17 bp, Homo sapiens
atagatttaccctttat

SEQ ID NO: 408219 - DNA, 22 bp, Homo sapiens
atagcaagtcccatcagcctat

SEQ ID NO: 408220 - DNA, 19 bp, Homo sapiens
atagcactggtttgtttct

SEQ ID NO: 408221 - DNA, 14 bp, Homo sapiens
atagcagattttaa

SEQ ID NO: 408222 - DNA, 15 bp, Homo sapiens
atatacatgtatagt

SEQ ID NO: 408223 - DNA, 11 bp, Homo sapiens
atatacatttc

SEQ ID NO: 408224 - DNA, 14 bp, Homo sapiens
atataccatttatc

SEQ ID NO: 408225 - DNA, 14 bp, Homo sapiens
atatactaataaaa

SEQ ID NO: 408226 - DNA, 17 bp, Homo sapiens
atatactaataaaaagg

SEQ ID NO: 408227 - DNA, 19 bp, Homo sapiens
atatactaataaaaaggtt

SEQ ID NO: 408228 - DNA, 12 bp, Homo sapiens
atatactgcata

SEQ ID NO: 408229 - DNA, 18 bp, Homo sapiens
atatagacctatgataaa

SEQ ID NO: 408230 - DNA, 21 bp, Homo sapiens
atatagagacttctaaatcat

SEQ ID NO: 408231 - DNA, 21 bp, Homo sapiens
atatagctctacacaacatgt

SEQ ID NO: 408232 - DNA, 18 bp, Homo sapiens
atatagcttgaaacatag

SEQ ID NO: 408233 - DNA, 15 bp, Homo sapiens
atataggaattaaga

SEQ ID NO: 408234 - DNA, 10 bp, Homo sapiens
atatataaaa

SEQ ID NO: 408235 - DNA, 21 bp, Homo sapiens
atatataaaacaaaacaaaca

SEQ ID NO: 408236 - DNA, 11 bp, Homo sapiens
atatataaaat

SEQ ID NO: 408237 - DNA, 13 bp, Homo sapiens
atatataaaataa

SEQ ID NO: 408238 - DNA, 10 bp, Homo sapiens
atatataaat

SEQ ID NO: 408239 - DNA, 18 bp, Homo sapiens
atatataaattattactt

SEQ ID NO: 408240 - DNA, 17 bp, Homo sapiens
atatataatggtttact

SEQ ID NO: 408241 - DNA, 18 bp, Homo sapiens
atatataatggtttactg

SEQ ID NO: 408242 - DNA, 15 bp, Homo sapiens
atatatacttgtggt

SEQ ID NO: 408243 - DNA, 15 bp, Homo sapiens
atatatatgtataat

SEQ ID NO: 408244 - DNA, 14 bp, Homo sapiens
atatatatttatca

SEQ ID NO: 408245 - DNA, 15 bp, Homo sapiens
atatatatttatcat

SEQ ID NO: 408246 - DNA, 20 bp, Homo sapiens
atatatcatattggtattca

SEQ ID NO: 408247 - DNA, 16 bp, Homo sapiens
atatatcccagaaatt

SEQ ID NO: 408248 - DNA, 13 bp, Homo sapiens
atatatgatatat

SEQ ID NO: 408249 - DNA, 14 bp, Homo sapiens
atatatggatattt

SEQ ID NO: 408250 - DNA, 12 bp, Homo sapiens
atatatgtacag

SEQ ID NO: 408251 - DNA, 19 bp, Homo sapiens
atatatgtatgtaaaaatg

SEQ ID NO: 408252 - DNA, 21 bp, Homo sapiens
atatatgtgtgtttaaataaa

SEQ ID NO: 408253 - DNA, 17 bp, Homo sapiens
atatatgttttgagaaa

SEQ ID NO: 408254 - DNA, 18 bp, Homo sapiens
atatatgttttgagaaaa

SEQ ID NO: 408255 - DNA, 19 bp, Homo sapiens
atatatgttttgagaaaaa

SEQ ID NO: 408256 - DNA, 17 bp, Homo sapiens
atatattaaaaatataa

SEQ ID NO: 408257 - DNA, 18 bp, Homo sapiens
atatattaaaaatataaa

SEQ ID NO: 408258 - DNA, 22 bp, Homo sapiens
atatattaaaaatataaacaat

SEQ ID NO: 408259 - DNA, 13 bp, Homo sapiens
atatattataagt

SEQ ID NO: 408260 - DNA, 16 bp, Homo sapiens
atatattcatacctgt

SEQ ID NO: 408261 - DNA, 19 bp, Homo sapiens
atatattcatacctgttgt

SEQ ID NO: 408262 - DNA, 17 bp, Homo sapiens
atatattcttataaaaa

SEQ ID NO: 408263 - DNA, 12 bp, Homo sapiens
atatattgctgc

SEQ ID NO: 408264 - DNA, 13 bp, Homo sapiens
atatatttaagca

SEQ ID NO: 408265 - DNA, 15 bp, Homo sapiens
atatatttataactc

SEQ ID NO: 408266 - DNA, 23 bp, Homo sapiens
atatatttataactcatcataaa

SEQ ID NO: 408267 - DNA, 22 bp, Homo sapiens
atatatttgaaagaagtcaaat

SEQ ID NO: 408268 - DNA, 15 bp, Homo sapiens
atatatttttatatt

SEQ ID NO: 408269 - DNA, 17 bp, Homo sapiens
atatattttttaatttg

SEQ ID NO: 408270 - DNA, 17 bp, Homo sapiens
atatcaaggatgttctg

SEQ ID NO: 408271 - DNA, 21 bp, Homo sapiens
atatcactttggtctccattt

SEQ ID NO: 408272 - DNA, 19 bp, Homo sapiens
atatcactttgtattctct

SEQ ID NO: 408273 - DNA, 22 bp, Homo sapiens
atatcactttgtattctctgtc

SEQ ID NO: 408274 - DNA, 20 bp, Homo sapiens
atatcagacctctgatccct

SEQ ID NO: 408275 - DNA, 18 bp, Homo sapiens
atatcagagctcttaatg

SEQ ID NO: 408276 - DNA, 21 bp, Homo sapiens
atatcagagctcttaatgttg

SEQ ID NO: 408277 - DNA, 15 bp, Homo sapiens
atatcagcagacact

SEQ ID NO: 408278 - DNA, 22 bp, Homo sapiens
atatcagcctgagtctcctgtg

SEQ ID NO: 408279 - DNA, 17 bp, Homo sapiens
atatcatcaatactttt

SEQ ID NO: 408280 - DNA, 21 bp, Homo sapiens
atatcatgaagccttgctgaa

SEQ ID NO: 408281 - DNA, 13 bp, Homo sapiens
atatcattcagca

SEQ ID NO: 408282 - DNA, 23 bp, Homo sapiens
atatcatttattttttacattat

SEQ ID NO: 408283 - DNA, 17 bp, Homo sapiens
atatcatttcataaaaa

SEQ ID NO: 408284 - DNA, 15 bp, Homo sapiens
atatcattttattca

SEQ ID NO: 408285 - DNA, 17 bp, Homo sapiens
atatccaaagactgtac

SEQ ID NO: 408286 - DNA, 20 bp, Homo sapiens
atatccaaagactgtactgg

SEQ ID NO: 408287 - DNA, 20 bp, Homo sapiens
agttgctcctacccctgtcc

SEQ ID NO: 408288 - DNA, 14 bp, Homo sapiens
agttgctcctcagg

SEQ ID NO: 408289 - DNA, 21 bp, Homo sapiens
agttgctgtaagcacctgggc

SEQ ID NO: 408290 - DNA, 17 bp, Homo sapiens
agttggacacactgtaa

SEQ ID NO: 408291 - DNA, 13 bp, Homo sapiens
agttggacagtaa

SEQ ID NO: 408292 - DNA, 16 bp, Homo sapiens
agttggactctcaggg

SEQ ID NO: 408293 - DNA, 17 bp, Homo sapiens
agttggactgggttgcg

SEQ ID NO: 408294 - DNA, 15 bp, Homo sapiens
agttggactgtggcc

SEQ ID NO: 408295 - DNA, 19 bp, Homo sapiens
agttggagaaaatgaagaa

SEQ ID NO: 408296 - DNA, 20 bp, Homo sapiens
agttggagaaaatgaagaaa

SEQ ID NO: 408297 - DNA, 18 bp, Homo sapiens
agttggagtactatattt

SEQ ID NO: 408298 - DNA, 19 bp, Homo sapiens
agttggagtgagtgtggct

SEQ ID NO: 408299 - DNA, 14 bp, Homo sapiens
agttggcagagaag

SEQ ID NO: 408300 - DNA, 20 bp, Homo sapiens
agttggcagagaaggcctct

SEQ ID NO: 408301 - DNA, 16 bp, Homo sapiens
agttggccagagagcc

SEQ ID NO: 408302 - DNA, 14 bp, Homo sapiens
agttggctagaaga

SEQ ID NO: 408303 - DNA, 18 bp, Homo sapiens
agttggctagaagaaagt

SEQ ID NO: 408304 - DNA, 13 bp, Homo sapiens
agttgggagcact

SEQ ID NO: 408305 - DNA, 16 bp, Homo sapiens
agttgggagcactgga

SEQ ID NO: 408306 - DNA, 17 bp, Homo sapiens
agttgggtctgaaagga

SEQ ID NO: 408307 - DNA, 15 bp, Homo sapiens
agttgggtgagaaca

SEQ ID NO: 408308 - DNA, 19 bp, Homo sapiens
agttggttacctattgctg

SEQ ID NO: 408309 - DNA, 21 bp, Homo sapiens
agttgtaacattctatttcaa

SEQ ID NO: 408310 - DNA, 20 bp, Homo sapiens
agttgtctattctgagcctt

SEQ ID NO: 408311 - DNA, 13 bp, Homo sapiens
agttgtcttacac

SEQ ID NO: 408312 - DNA, 17 bp, Homo sapiens
agttgtctttctttgct

SEQ ID NO: 408313 - DNA, 20 bp, Homo sapiens
agttgtgaagaggggccaga

SEQ ID NO: 408314 - DNA, 17 bp, Homo sapiens
agttgtgcctttcacag

SEQ ID NO: 408315 - DNA, 21 bp, Homo sapiens
agttgtgccttttatagctat

SEQ ID NO: 408316 - DNA, 14 bp, Homo sapiens
agttgtgcttgttt

SEQ ID NO: 408317 - DNA, 19 bp, Homo sapiens
agttgttagtgatttgcta

SEQ ID NO: 408318 - DNA, 20 bp, Homo sapiens
agttgttagtgatttgctat

SEQ ID NO: 408319 - DNA, 22 bp, Homo sapiens
agttgttagtgtgtcttagtgt

SEQ ID NO: 408320 - DNA, 13 bp, Homo sapiens
agttgttggcctc

SEQ ID NO: 408321 - DNA, 17 bp, Homo sapiens
agtttaaaaaaataaca

SEQ ID NO: 408322 - DNA, 15 bp, Homo sapiens
agtttaaaacacatt

SEQ ID NO: 408323 - DNA, 14 bp, Homo sapiens
agtttaaaattatt

SEQ ID NO: 408324 - DNA, 19 bp, Homo sapiens
agtttaaataccagtactt

SEQ ID NO: 408325 - DNA, 20 bp, Homo sapiens
agtttaaataccagtacttg

SEQ ID NO: 408326 - DNA, 22 bp, Homo sapiens
agtttaacacaagtcctgtgaa

SEQ ID NO: 408327 - DNA, 21 bp, Homo sapiens
agtttacaagtgtatatcaga

SEQ ID NO: 408328 - DNA, 16 bp, Homo sapiens
atatgtggagttcatc

SEQ ID NO: 408329 - DNA, 21 bp, Homo sapiens
atatgtggagttcatcttgaa

SEQ ID NO: 408330 - DNA, 19 bp, Homo sapiens
atatgtgtaaatgttatga

SEQ ID NO: 408331 - DNA, 16 bp, Homo sapiens
atatgtgtaatatcat

SEQ ID NO: 408332 - DNA, 21 bp, Homo sapiens
atatgtgtaatatcatttcat

SEQ ID NO: 408333 - DNA, 15 bp, Homo sapiens
atatgtttggctgaa

SEQ ID NO: 408334 - DNA, 12 bp, Homo sapiens
atatgttttgag

SEQ ID NO: 408335 - DNA, 19 bp, Homo sapiens
atattaaaaatataaacaa

SEQ ID NO: 408336 - DNA, 14 bp, Homo sapiens
atattaagaaacaa

SEQ ID NO: 408337 - DNA, 14 bp, Homo sapiens
atattacattgcat

SEQ ID NO: 408338 - DNA, 16 bp, Homo sapiens
atattaccatcttaat

SEQ ID NO: 408339 - DNA, 19 bp, Homo sapiens
atattaccatcttaatctt

SEQ ID NO: 408340 - DNA, 22 bp, Homo sapiens
atattaccatcttaatctttat

SEQ ID NO: 408341 - DNA, 18 bp, Homo sapiens
atattactgttgcattta

SEQ ID NO: 408342 - DNA, 11 bp, Homo sapiens
atattacttta

SEQ ID NO: 408343 - DNA, 15 bp, Homo sapiens
atattacttttgtaa

SEQ ID NO: 408344 - DNA, 18 bp, Homo sapiens
atattacttttgtaaata

SEQ ID NO: 408345 - DNA, 20 bp, Homo sapiens
atattacttttgtaaatatt

SEQ ID NO: 408346 - DNA, 22 bp, Homo sapiens
atattacttttgtaaatattct

SEQ ID NO: 408347 - DNA, 23 bp, Homo sapiens
atattagagtgcccttaaaataa

SEQ ID NO: 408348 - DNA, 15 bp, Homo sapiens
atattaggaaaatat

SEQ ID NO: 408349 - DNA, 15 bp, Homo sapiens
atattataagttgac

SEQ ID NO: 408350 - DNA, 16 bp, Homo sapiens
atattataagttgacc

SEQ ID NO: 408351 - DNA, 14 bp, Homo sapiens
atattataataatg

SEQ ID NO: 408352 - DNA, 11 bp, Homo sapiens
atattatatat

SEQ ID NO: 408353 - DNA, 13 bp, Homo sapiens
atattatatcaga

SEQ ID NO: 408354 - DNA, 21 bp, Homo sapiens
atattatcatttctcctttaa

SEQ ID NO: 408355 - DNA, 17 bp, Homo sapiens
atattatgtgtttccat

SEQ ID NO: 408356 - DNA, 23 bp, Homo sapiens
atattattcaccatgtaaaacaa

SEQ ID NO: 408357 - DNA, 13 bp, Homo sapiens
atattcaaatcag

SEQ ID NO: 408358 - DNA, 13 bp, Homo sapiens
atattcaataaag

SEQ ID NO: 408359 - DNA, 14 bp, Homo sapiens
atattcatacctgt

SEQ ID NO: 408360 - DNA, 17 bp, Homo sapiens
atattcatacctgttgt

SEQ ID NO: 408361 - DNA, 22 bp, Homo sapiens
atattcattctttataaaccat

SEQ ID NO: 408362 - DNA, 21 bp, Homo sapiens
atattccgggtgccattccca

SEQ ID NO: 408363 - DNA, 15 bp, Homo sapiens
atattcctgaatgaa

SEQ ID NO: 408364 - DNA, 14 bp, Homo sapiens
atattcctgccttt

SEQ ID NO: 408365 - DNA, 15 bp, Homo sapiens
atattctattgtatt

SEQ ID NO: 408366 - DNA, 17 bp, Homo sapiens
atattctcattatttca

SEQ ID NO: 408367 - DNA, 18 bp, Homo sapiens
atattcttgctttcacaa

SEQ ID NO: 408368 - DNA, 22 bp, Homo sapiens
atattcttgctttcacaaatat

SEQ ID NO: 408369 - DNA, 23 bp, Homo sapiens
atattcttgctttcacaaatata

SEQ ID NO: 408370 - DNA, 15 bp, Homo sapiens
atattcttgtccaca

SEQ ID NO: 408371 - DNA, 19 bp, Homo sapiens
atattcttgtccacattct

SEQ ID NO: 408372 - DNA, 20 bp, Homo sapiens
atattcttgtccacattcta

SEQ ID NO: 408373 - DNA, 17 bp, Homo sapiens
atattgaccatgtgatt

SEQ ID NO: 408374 - DNA, 22 bp, Homo sapiens
atattgaccatgtgattatgga

SEQ ID NO: 408375 - DNA, 16 bp, Homo sapiens
atattgagatcagcat

SEQ ID NO: 408376 - DNA, 13 bp, Homo sapiens
atattgatgaaaa

SEQ ID NO: 408377 - DNA, 18 bp, Homo sapiens
atattgatgtaactgtgt

SEQ ID NO: 408378 - DNA, 20 bp, Homo sapiens
atattgccagtatataagct

SEQ ID NO: 408379 - DNA, 23 bp, Homo sapiens
atattgccagtatataagctgtt

SEQ ID NO: 408380 - DNA, 16 bp, Homo sapiens
atattgcccaaataat

SEQ ID NO: 408381 - DNA, 14 bp, Homo sapiens
atattgcttggact

SEQ ID NO: 408382 - DNA, 11 bp, Homo sapiens
atctgcattta

SEQ ID NO: 408383 - DNA, 14 bp, Homo sapiens
atctgcatttagca

SEQ ID NO: 408384 - DNA, 15 bp, Homo sapiens
atctgcatttagcac

SEQ ID NO: 408385 - DNA, 19 bp, Homo sapiens
atctgcatttataaatgtg

SEQ ID NO: 408386 - DNA, 23 bp, Homo sapiens
atctgcattttcaccccaccctt

SEQ ID NO: 408387 - DNA, 11 bp, Homo sapiens
atctgcccctc

SEQ ID NO: 408388 - DNA, 18 bp, Homo sapiens
atctgcctcccctgtgga

SEQ ID NO: 408389 - DNA, 20 bp, Homo sapiens
atctgcctcccctgtggaaa

SEQ ID NO: 408390 - DNA, 16 bp, Homo sapiens
atctgcctggcctggc

SEQ ID NO: 408391 - DNA, 11 bp, Homo sapiens
atctgcctggg

SEQ ID NO: 408392 - DNA, 16 bp, Homo sapiens
atctgcctgggcctgt

SEQ ID NO: 408393 - DNA, 21 bp, Homo sapiens
atctgcctgggcctgtgcagc

SEQ ID NO: 408394 - DNA, 23 bp, Homo sapiens
atctgcctgggcctgtgcagcag

SEQ ID NO: 408395 - DNA, 14 bp, Homo sapiens
atctgctaataaaa

SEQ ID NO: 408396 - DNA, 16 bp, Homo sapiens
atctgctccatgcaga

SEQ ID NO: 408397 - DNA, 13 bp, Homo sapiens
atctgctctgaga

SEQ ID NO: 408398 - DNA, 17 bp, Homo sapiens
atctgctgcctctgaaa

SEQ ID NO: 408399 - DNA, 20 bp, Homo sapiens
atctgctgcctctgaaaata

SEQ ID NO: 408400 - DNA, 22 bp, Homo sapiens
atctgctgttgccatagcccca

SEQ ID NO: 408401 - DNA, 12 bp, Homo sapiens
atctgcttcagt

SEQ ID NO: 408402 - DNA, 18 bp, Homo sapiens
atctgctttgttaatgaa

SEQ ID NO: 408403 - DNA, 20 bp, Homo sapiens
atctggaaaaaaaaaaatat

SEQ ID NO: 408404 - DNA, 15 bp, Homo sapiens
atctggactcctctg

SEQ ID NO: 408405 - DNA, 19 bp, Homo sapiens
atctggactcctctgtcca

SEQ ID NO: 408406 - DNA, 21 bp, Homo sapiens
atctggagtctgaaggagagg

SEQ ID NO: 408407 - DNA, 13 bp, Homo sapiens
atctggcctggcc

SEQ ID NO: 408408 - DNA, 16 bp, Homo sapiens
atctgggaactcccaa

SEQ ID NO: 408409 - DNA, 14 bp, Homo sapiens
atctgggctggcag

SEQ ID NO: 408410 - DNA, 22 bp, Homo sapiens
atctggggatggagaatgccag

SEQ ID NO: 408411 - DNA, 15 bp, Homo sapiens
atctgggtatctttc

SEQ ID NO: 408412 - DNA, 21 bp, Homo sapiens
atctgggtggtaactgccagc

SEQ ID NO: 408413 - DNA, 23 bp, Homo sapiens
atctgggtgtgtgagtgggagga

SEQ ID NO: 408414 - DNA, 15 bp, Homo sapiens
atctggtatctgcat

SEQ ID NO: 408415 - DNA, 17 bp, Homo sapiens
atctggtcccttgcagc

SEQ ID NO: 408416 - DNA, 22 bp, Homo sapiens
atctggtgcgtgtggccctgtg

SEQ ID NO: 408417 - DNA, 23 bp, Homo sapiens
atctggtgcgtgtggccctgtgg

SEQ ID NO: 408418 - DNA, 19 bp, Homo sapiens
atctggtgttcttgctaac

SEQ ID NO: 408419 - DNA, 17 bp, Homo sapiens
atctggttataattttg

SEQ ID NO: 408420 - DNA, 19 bp, Homo sapiens
atctgtaaaaaagaaaaac

SEQ ID NO: 408421 - DNA, 13 bp, Homo sapiens
atctgtaaatatc

SEQ ID NO: 408422 - DNA, 18 bp, Homo sapiens
atctgtaaatatcccaga

SEQ ID NO: 408423 - DNA, 21 bp, Homo sapiens
atctgtaaatttaactgcata

SEQ ID NO: 408424 - DNA, 16 bp, Homo sapiens
atctgtagaggagcct

SEQ ID NO: 408425 - DNA, 15 bp, Homo sapiens
atctgtagggctgga

SEQ ID NO: 408426 - DNA, 15 bp, Homo sapiens
atctgtatctctctc

SEQ ID NO: 408427 - DNA, 17 bp, Homo sapiens
atctgtcagcttcccaa

SEQ ID NO: 408428 - DNA, 18 bp, Homo sapiens
atctgtccaaaggaggct

SEQ ID NO: 408429 - DNA, 13 bp, Homo sapiens
atctgtcccactg

SEQ ID NO: 408430 - DNA, 14 bp, Homo sapiens
atctgtcccactgg

SEQ ID NO: 408431 - DNA, 16 bp, Homo sapiens
atctgtcccactggga

SEQ ID NO: 408432 - DNA, 12 bp, Homo sapiens
atctgtctagaa

SEQ ID NO: 408433 - DNA, 20 bp, Homo sapiens
atctgtctagaatcctgctt

SEQ ID NO: 408434 - DNA, 13 bp, Homo sapiens
atctgtctgagcc

SEQ ID NO: 408435 - DNA, 19 bp, Homo sapiens
atctgtctgagccctgccc

SEQ ID NO: 408436 - DNA, 18 bp, Homo sapiens
atctgtctgattctatgc

SEQ ID NO: 408437 - DNA, 14 bp, Homo sapiens
atctgtctgtccta

SEQ ID NO: 408438 - DNA, 21 bp, Homo sapiens
atctgtctttatgatttcatg

SEQ ID NO: 408439 - DNA, 21 bp, Homo sapiens
atctgtgaaatgctggcattt

SEQ ID NO: 408440 - DNA, 20 bp, Homo sapiens
atctgtgaagcctttatcta

SEQ ID NO: 408441 - DNA, 21 bp, Homo sapiens
atctgtgcccagagatgggac

SEQ ID NO: 408442 - DNA, 16 bp, Homo sapiens
atctgtgcgtgaaaca

SEQ ID NO: 408443 - DNA, 22 bp, Homo sapiens
atctgtggagaatgtacacagt

SEQ ID NO: 408444 - DNA, 13 bp, Homo sapiens
atctgtggcaagc

SEQ ID NO: 408445 - DNA, 18 bp, Homo sapiens
atctgtggcaagcaccca

SEQ ID NO: 408446 - DNA, 19 bp, Homo sapiens
atctgtgggcatggtcaaa

SEQ ID NO: 408447 - DNA, 22 bp, Homo sapiens
atctgtgggcatggtcaaaggc

SEQ ID NO: 408448 - DNA, 13 bp, Homo sapiens
atctgtgggccca

SEQ ID NO: 408449 - DNA, 13 bp, Homo sapiens
atctgtgtgaaaa

SEQ ID NO: 408450 - DNA, 22 bp, Homo sapiens
atctgttaaccaaataaaacat

SEQ ID NO: 408451 - DNA, 14 bp, Homo sapiens
atctgttctaacat

SEQ ID NO: 408452 - DNA, 16 bp, Homo sapiens
atctgttctaacatgt

SEQ ID NO: 408453 - DNA, 21 bp, Homo sapiens
atctgttgtgtacgtggagag

SEQ ID NO: 408454 - DNA, 14 bp, Homo sapiens
atctgttgtttgaa

SEQ ID NO: 408455 - DNA, 15 bp, Homo sapiens
atctgttgttttgtt

SEQ ID NO: 408456 - DNA, 14 bp, Homo sapiens
atctgttttactgc

SEQ ID NO: 408457 - DNA, 17 bp, Homo sapiens
atctgttttactgcttt

SEQ ID NO: 408458 - DNA, 20 bp, Homo sapiens
atcttaaagaaacagctttc

SEQ ID NO: 408459 - DNA, 19 bp, Homo sapiens
atcttaaagtgtgtttcta

SEQ ID NO: 408460 - DNA, 13 bp, Homo sapiens
atcttaaatctgt

SEQ ID NO: 408461 - DNA, 16 bp, Homo sapiens
atcttaaatctgtgaa

SEQ ID NO: 408462 - DNA, 23 bp, Homo sapiens
atcttaagattccattttggaaa

SEQ ID NO: 408463 - DNA, 18 bp, Homo sapiens
atcttaatctttatttta

SEQ ID NO: 408464 - DNA, 21 bp, Homo sapiens
atcttaattaagctccttcag

SEQ ID NO: 408465 - DNA, 19 bp, Homo sapiens
atcttaattttttttaatg

SEQ ID NO: 408466 - DNA, 21 bp, Homo sapiens
atcttacaacaggcttatgaa

SEQ ID NO: 408467 - DNA, 16 bp, Homo sapiens
atcttacctgtaaagt

SEQ ID NO: 408468 - DNA, 17 bp, Homo sapiens
atcttacgctatttctg

SEQ ID NO: 408469 - DNA, 21 bp, Homo sapiens
atcttagtgcctgagagtatt

SEQ ID NO: 408470 - DNA, 13 bp, Homo sapiens
atcttattcacat

SEQ ID NO: 408471 - DNA, 13 bp, Homo sapiens
atcttatttatat

SEQ ID NO: 408472 - DNA, 17 bp, Homo sapiens
atcttcaaactttcact

SEQ ID NO: 408473 - DNA, 19 bp, Homo sapiens
atcttcaactaatttttga

SEQ ID NO: 408474 - DNA, 21 bp, Homo sapiens
atcttcagctgaacacaagca

SEQ ID NO: 408475 - DNA, 20 bp, Homo sapiens
atcttcagttttatctttaa

SEQ ID NO: 408476 - DNA, 22 bp, Homo sapiens
atcttccctagagggttcctgt

SEQ ID NO: 408477 - DNA, 15 bp, Homo sapiens
atcttcctgctgctg

SEQ ID NO: 408478 - DNA, 15 bp, Homo sapiens
atcttcgttcttgtt

SEQ ID NO: 408479 - DNA, 14 bp, Homo sapiens
atcttctctcttga

SEQ ID NO: 408480 - DNA, 21 bp, Homo sapiens
atcttctctcttgattgattt

SEQ ID NO: 408481 - DNA, 17 bp, Homo sapiens
atcttctctttttccag

SEQ ID NO: 408482 - DNA, 15 bp, Homo sapiens
atcttctgtttttct

SEQ ID NO: 408483 - DNA, 21 bp, Homo sapiens
atcttctgtttttctcaaata

SEQ ID NO: 408484 - DNA, 23 bp, Homo sapiens
atcttctgtttttctcaaataaa

SEQ ID NO: 408485 - DNA, 17 bp, Homo sapiens
atcttgcatctacctgc

SEQ ID NO: 408486 - DNA, 15 bp, Homo sapiens
atcttgctgtgaaac

SEQ ID NO: 408487 - DNA, 14 bp, Homo sapiens
atcttggaaatcat

SEQ ID NO: 408488 - DNA, 15 bp, Homo sapiens
atcttttactgtgga

SEQ ID NO: 408489 - DNA, 18 bp, Homo sapiens
atcttttattttcctgtc

SEQ ID NO: 408490 - DNA, 18 bp, Homo sapiens
atcttttcatttatcaag

SEQ ID NO: 408491 - DNA, 14 bp, Homo sapiens
atcttttggctctg

SEQ ID NO: 408492 - DNA, 17 bp, Homo sapiens
atcttttggctctgaag

SEQ ID NO: 408493 - DNA, 17 bp, Homo sapiens
atctttttaaaaatgat

SEQ ID NO: 408494 - DNA, 13 bp, Homo sapiens
atctttttcctcc

SEQ ID NO: 408495 - DNA, 12 bp, Homo sapiens
atctttttctcc

SEQ ID NO: 408496 - DNA, 15 bp, Homo sapiens
atctttttgtgtgca

SEQ ID NO: 408497 - DNA, 15 bp, Homo sapiens
atcttttttaaatga

SEQ ID NO: 408498 - DNA, 14 bp, Homo sapiens
atcttttttcaaaa

SEQ ID NO: 408499 - DNA, 17 bp, Homo sapiens
atgaaaaaaagggaaaa

SEQ ID NO: 408500 - DNA, 18 bp, Homo sapiens
atgaaaaaaatgatctat

SEQ ID NO: 408501 - DNA, 21 bp, Homo sapiens
atgaaaaatagtgtgtccatg

SEQ ID NO: 408502 - DNA, 15 bp, Homo sapiens
atgaaaacattgatg

SEQ ID NO: 408503 - DNA, 14 bp, Homo sapiens
atgaaaacctgcat

SEQ ID NO: 408504 - DNA, 16 bp, Homo sapiens
atgaaaataaaataaa

SEQ ID NO: 408505 - DNA, 12 bp, Homo sapiens
atgaaaatatct

SEQ ID NO: 408506 - DNA, 15 bp, Homo sapiens
atgaaaatcctacca

SEQ ID NO: 408507 - DNA, 21 bp, Homo sapiens
atgaaaatcctaccaacctct

SEQ ID NO: 408508 - DNA, 18 bp, Homo sapiens
atgaaaatccttttaacc

SEQ ID NO: 408509 - DNA, 19 bp, Homo sapiens
atgaaaatgtcagaaacca

SEQ ID NO: 408510 - DNA, 13 bp, Homo sapiens
atgaaaatttgag

SEQ ID NO: 408511 - DNA, 16 bp, Homo sapiens
atgaaaccgtccctga

SEQ ID NO: 408512 - DNA, 14 bp, Homo sapiens
atgaaacgaatata

SEQ ID NO: 408513 - DNA, 15 bp, Homo sapiens
atgaaagacaaagaa

SEQ ID NO: 408514 - DNA, 13 bp, Homo sapiens
atgaaagcaacaa

SEQ ID NO: 408515 - DNA, 20 bp, Homo sapiens
atgaaagggaaagtcagctt

SEQ ID NO: 408516 - DNA, 16 bp, Homo sapiens
atgaaaggtttacatt

SEQ ID NO: 408517 - DNA, 19 bp, Homo sapiens
atgaaagtcttgtgactag

SEQ ID NO: 408518 - DNA, 22 bp, Homo sapiens
atgaaataaattggtgataagt

SEQ ID NO: 408519 - DNA, 20 bp, Homo sapiens
atgaaataactccttcttgt

SEQ ID NO: 408520 - DNA, 22 bp, Homo sapiens
atgaaataactccttcttgtag

SEQ ID NO: 408521 - DNA, 23 bp, Homo sapiens
atgaaatagttattttaatacct

SEQ ID NO: 408522 - DNA, 17 bp, Homo sapiens
atgaaatataaactgtg

SEQ ID NO: 408523 - DNA, 19 bp, Homo sapiens
atgaaatataaactgtgag

SEQ ID NO: 408524 - DNA, 20 bp, Homo sapiens
atgaaatataaactgtgaga

SEQ ID NO: 408525 - DNA, 13 bp, Homo sapiens
atgaaatatgcat

SEQ ID NO: 408526 - DNA, 15 bp, Homo sapiens
atgaaatatgcatct

SEQ ID NO: 408527 - DNA, 17 bp, Homo sapiens
atgaaatgactgtctaa

SEQ ID NO: 408528 - DNA, 18 bp, Homo sapiens
atgaaatgataaagatgt

SEQ ID NO: 408529 - DNA, 21 bp, Homo sapiens
atgaaatgataaagatgtcaa

SEQ ID NO: 408530 - DNA, 18 bp, Homo sapiens
atgaaattcttgaagttc

SEQ ID NO: 408531 - DNA, 11 bp, Homo sapiens
atgaacaaaat

SEQ ID NO: 408532 - DNA, 16 bp, Homo sapiens
atgaacacatggcaga

SEQ ID NO: 408533 - DNA, 22 bp, Homo sapiens
atgaacagggcccaggcctgga

SEQ ID NO: 408534 - DNA, 19 bp, Homo sapiens
atgaacatgcagttcatta

SEQ ID NO: 408535 - DNA, 15 bp, Homo sapiens
atgaacatgttcctg

SEQ ID NO: 408536 - DNA, 14 bp, Homo sapiens
atgaactcaacttt

SEQ ID NO: 408537 - DNA, 16 bp, Homo sapiens
atgaactcttaatcaa

SEQ ID NO: 408538 - DNA, 14 bp, Homo sapiens
atgaactgaagttt

SEQ ID NO: 408539 - DNA, 16 bp, Homo sapiens
atgaacttaacatgct

SEQ ID NO: 408540 - DNA, 17 bp, Homo sapiens
atgaacttgaggacaca

SEQ ID NO: 408541 - DNA, 18 bp, Homo sapiens
atgaacttgaggacacat

SEQ ID NO: 408542 - DNA, 20 bp, Homo sapiens
atgaacttgaggacacatgt

SEQ ID NO: 408543 - DNA, 18 bp, Homo sapiens
atgaactttttaacaaat

SEQ ID NO: 408544 - DNA, 19 bp, Homo sapiens
atgaagaaaagtgggccag

SEQ ID NO: 408545 - DNA, 17 bp, Homo sapiens
atgaagaaagatactaa

SEQ ID NO: 408546 - DNA, 18 bp, Homo sapiens
atgaagaacacagcatgt

SEQ ID NO: 408547 - DNA, 18 bp, Homo sapiens
atgaagataccatcagca

SEQ ID NO: 408548 - DNA, 21 bp, Homo sapiens
atgaagataccatcagcaaag

SEQ ID NO: 408549 - DNA, 19 bp, Homo sapiens
atgaagattctcctgtgct

SEQ ID NO: 408550 - DNA, 22 bp, Homo sapiens
atgaagattctcctgtgctaga

SEQ ID NO: 408551 - DNA, 21 bp, Homo sapiens
atgaaggtcatctttttcccc

SEQ ID NO: 408552 - DNA, 20 bp, Homo sapiens
atgaaggtgtgctacagaaa

SEQ ID NO: 408553 - DNA, 22 bp, Homo sapiens
atgaaggttaggatttaacagt

SEQ ID NO: 408554 - DNA, 15 bp, Homo sapiens
atgaagtttatacag

SEQ ID NO: 408555 - DNA, 16 bp, Homo sapiens
atgaagtttatacagt

SEQ ID NO: 408556 - DNA, 17 bp, Homo sapiens
atgaagtttatacagta

SEQ ID NO: 408557 - DNA, 22 bp, Homo sapiens
atgaataatttcccaattagga

SEQ ID NO: 408558 - DNA, 20 bp, Homo sapiens
atgaatcagtatgaagacac

SEQ ID NO: 408559 - DNA, 13 bp, Homo sapiens
atgaatgatatct

SEQ ID NO: 408560 - DNA, 17 bp, Homo sapiens
atgaatgatatctttga

SEQ ID NO: 408561 - DNA, 16 bp, Homo sapiens
atgaatgcagtataaa

SEQ ID NO: 408562 - DNA, 20 bp, Homo sapiens
atgaatgcagtataaaatgt

SEQ ID NO: 408563 - DNA, 12 bp, Homo sapiens
atgaatgcattg

SEQ ID NO: 408564 - DNA, 17 bp, Homo sapiens
atgaatgcattggccct

SEQ ID NO: 408565 - DNA, 16 bp, Homo sapiens
atgaatgtatcaggaa

SEQ ID NO: 408566 - DNA, 18 bp, Homo sapiens
atgaatgtcagtgtgact

SEQ ID NO: 408567 - DNA, 22 bp, Homo sapiens
atgaatgtttacactctttgta

SEQ ID NO: 408568 - DNA, 14 bp, Homo sapiens
atgaattaaatatt

SEQ ID NO: 408569 - DNA, 14 bp, Homo sapiens
atgaattagccaaa

SEQ ID NO: 408570 - DNA, 14 bp, Homo sapiens
atgaattatgataa

SEQ ID NO: 408571 - DNA, 13 bp, Homo sapiens
atgaatttaaata

SEQ ID NO: 408572 - DNA, 16 bp, Homo sapiens
atgaatttaaatataa

SEQ ID NO: 408573 - DNA, 20 bp, Homo sapiens
atgaattttaaaagcatata

SEQ ID NO: 408574 - DNA, 13 bp, Homo sapiens
atgaattttacat

SEQ ID NO: 408575 - DNA, 17 bp, Homo sapiens
atgacaacactacacgc

SEQ ID NO: 408576 - DNA, 14 bp, Homo sapiens
atgacaacagaagc

SEQ ID NO: 408577 - DNA, 18 bp, Homo sapiens
atgacaacttctaattgc

SEQ ID NO: 408578 - DNA, 16 bp, Homo sapiens
atgacaagccccaggc

SEQ ID NO: 408579 - DNA, 20 bp, Homo sapiens
atgacaagccccaggcaggc

SEQ ID NO: 408580 - DNA, 13 bp, Homo sapiens
atgacaataaatt

SEQ ID NO: 408581 - DNA, 16 bp, Homo sapiens
atgacaatttcaaaat

SEQ ID NO: 408582 - DNA, 17 bp, Homo sapiens
atgacaatttcaaaatg

SEQ ID NO: 408583 - DNA, 20 bp, Homo sapiens
atgacaatttcaaaatgcat

SEQ ID NO: 408584 - DNA, 23 bp, Homo sapiens
atgacaatttcaaaatgcatgtg

SEQ ID NO: 408585 - DNA, 19 bp, Homo sapiens
atgacactcgtataagcat

SEQ ID NO: 408586 - DNA, 22 bp, Homo sapiens
atgacactctagtgacttcctg

SEQ ID NO: 408587 - DNA, 14 bp, Homo sapiens
atgacagtagcata

SEQ ID NO: 408588 - DNA, 15 bp, Homo sapiens
atgacagtagcatac

SEQ ID NO: 408589 - DNA, 15 bp, Homo sapiens
atgacatgttatata

SEQ ID NO: 408590 - DNA, 23 bp, Homo sapiens
atgacatgttatatattttttgt

SEQ ID NO: 408591 - DNA, 21 bp, Homo sapiens
atgacatttgtcctgcagagc

SEQ ID NO: 408592 - DNA, 20 bp, Homo sapiens
atgaccaatcctatgtcatt

SEQ ID NO: 408593 - DNA, 16 bp, Homo sapiens
atgaccaatctctgtg

SEQ ID NO: 408594 - DNA, 16 bp, Homo sapiens
atgaccactgggcctg

SEQ ID NO: 408595 - DNA, 18 bp, Homo sapiens
atgaccactgggcctgct

SEQ ID NO: 408596 - DNA, 20 bp, Homo sapiens
atgaccagaagggaaacagt

SEQ ID NO: 408597 - DNA, 17 bp, Homo sapiens
atgaccaggccaccatc

SEQ ID NO: 408598 - DNA, 13 bp, Homo sapiens
atgaccagtttac

SEQ ID NO: 408599 - DNA, 20 bp, Homo sapiens
atgaccataaaattagacat

SEQ ID NO: 408600 - DNA, 15 bp, Homo sapiens
atggacccctccctt

SEQ ID NO: 408601 - DNA, 19 bp, Homo sapiens
atggacccctcccttgctc

SEQ ID NO: 408602 - DNA, 20 bp, Homo sapiens
atggaccgggtgggcctggc

SEQ ID NO: 408603 - DNA, 22 bp, Homo sapiens
atggaccgggtgggcctggcct

SEQ ID NO: 408604 - DNA, 12 bp, Homo sapiens
atggacctaaca

SEQ ID NO: 408605 - DNA, 15 bp, Homo sapiens
atggacctaacattc

SEQ ID NO: 408606 - DNA, 15 bp, Homo sapiens
atggaccttctagaa

SEQ ID NO: 408607 - DNA, 15 bp, Homo sapiens
atggacgcctggctc

SEQ ID NO: 408608 - DNA, 22 bp, Homo sapiens
atggactccaggatcctcctgg

SEQ ID NO: 408609 - DNA, 18 bp, Homo sapiens
atggactctgaaaaacat

SEQ ID NO: 408610 - DNA, 23 bp, Homo sapiens
atggacttaattatgctaacaaa

SEQ ID NO: 408611 - DNA, 18 bp, Homo sapiens
atggacttatttcttcaa

SEQ ID NO: 408612 - DNA, 19 bp, Homo sapiens
atggacttatttcttcaaa

SEQ ID NO: 408613 - DNA, 17 bp, Homo sapiens
atggacttgcttcttgt

SEQ ID NO: 408614 - DNA, 14 bp, Homo sapiens
atggagaaggaaaa

SEQ ID NO: 408615 - DNA, 15 bp, Homo sapiens
atggagaatgccagc

SEQ ID NO: 408616 - DNA, 19 bp, Homo sapiens
atggagaatgccagcccaa

SEQ ID NO: 408617 - DNA, 14 bp, Homo sapiens
atggagactcctgc

SEQ ID NO: 408618 - DNA, 18 bp, Homo sapiens
atggagactcctgccctg

SEQ ID NO: 408619 - DNA, 18 bp, Homo sapiens
atggagactgtctcaaga

SEQ ID NO: 408620 - DNA, 13 bp, Homo sapiens
atggagagaaaac

SEQ ID NO: 408621 - DNA, 21 bp, Homo sapiens
atggagccagctctgcattat

SEQ ID NO: 408622 - DNA, 16 bp, Homo sapiens
atggaggaaaaccaag

SEQ ID NO: 408623 - DNA, 17 bp, Homo sapiens
atggaggattctttccc

SEQ ID NO: 408624 - DNA, 18 bp, Homo sapiens
atggaggattctttcccc

SEQ ID NO: 408625 - DNA, 12 bp, Homo sapiens
atggaggcacac

SEQ ID NO: 408626 - DNA, 14 bp, Homo sapiens
atggaggccaagcc

SEQ ID NO: 408627 - DNA, 15 bp, Homo sapiens
atggaggccaagcct

SEQ ID NO: 408628 - DNA, 18 bp, Homo sapiens
atggaggctatgtggagt

SEQ ID NO: 408629 - DNA, 18 bp, Homo sapiens
atggaggggtggtcctga

SEQ ID NO: 408630 - DNA, 22 bp, Homo sapiens
atggaggggtggtcctgactca

SEQ ID NO: 408631 - DNA, 15 bp, Homo sapiens
atggaggttctcaga

SEQ ID NO: 408632 - DNA, 18 bp, Homo sapiens
atggaggttctcagagcc

SEQ ID NO: 408633 - DNA, 17 bp, Homo sapiens
atggagtacatggaaga

SEQ ID NO: 408634 - DNA, 22 bp, Homo sapiens
atggagtagacccctggctggt

SEQ ID NO: 408635 - DNA, 17 bp, Homo sapiens
atggagtccagacctgg

SEQ ID NO: 408636 - DNA, 20 bp, Homo sapiens
atggagtccagggaagagaa

SEQ ID NO: 408637 - DNA, 16 bp, Homo sapiens
atggagtgagcagtag

SEQ ID NO: 408638 - DNA, 23 bp, Homo sapiens
atggagtgtttgacgaagaaaca

SEQ ID NO: 408639 - DNA, 21 bp, Homo sapiens
atggagttttactcttgttgc

SEQ ID NO: 408640 - DNA, 19 bp, Homo sapiens
atggataacctatatgatt

SEQ ID NO: 408641 - DNA, 18 bp, Homo sapiens
atggatctgctccatgca

SEQ ID NO: 408642 - DNA, 13 bp, Homo sapiens
atggatgaattat

SEQ ID NO: 408643 - DNA, 15 bp, Homo sapiens
atggatgacaaagaa

SEQ ID NO: 408644 - DNA, 16 bp, Homo sapiens
atggatgtagatacag

SEQ ID NO: 408645 - DNA, 15 bp, Homo sapiens
atggatgtttcttct

SEQ ID NO: 408646 - DNA, 12 bp, Homo sapiens
atggattcactt

SEQ ID NO: 408647 - DNA, 16 bp, Homo sapiens
atggattccaaagcat

SEQ ID NO: 408648 - DNA, 17 bp, Homo sapiens
atggattccaaagcatt

SEQ ID NO: 408649 - DNA, 17 bp, Homo sapiens
atggattctcagatatt

SEQ ID NO: 408650 - DNA, 18 bp, Homo sapiens
atggattctcagatattt

SEQ ID NO: 408651 - DNA, 19 bp, Homo sapiens
atggattctcagatattta

SEQ ID NO: 408652 - DNA, 19 bp, Homo sapiens
atggatttcgtttttcttg

SEQ ID NO: 408653 - DNA, 21 bp, Homo sapiens
atggatttgcctgtgccaccc

SEQ ID NO: 408654 - DNA, 22 bp, Homo sapiens
atggatttttaaattatactgt

SEQ ID NO: 408655 - DNA, 13 bp, Homo sapiens
atggcaagagaga

SEQ ID NO: 408656 - DNA, 23 bp, Homo sapiens
atggcaagggggtgtcatctgag

SEQ ID NO: 408657 - DNA, 17 bp, Homo sapiens
atggcaccagccccctg

SEQ ID NO: 408658 - DNA, 22 bp, Homo sapiens
atggcaccagccccctggatgg

SEQ ID NO: 408659 - DNA, 20 bp, Homo sapiens
atggcagaagcgtctccctt

SEQ ID NO: 408660 - DNA, 12 bp, Homo sapiens
atggcagaaggg

SEQ ID NO: 408661 - DNA, 16 bp, Homo sapiens
atggcagcaggcctgt

SEQ ID NO: 408662 - DNA, 16 bp, Homo sapiens
atggcagcctcagggc

SEQ ID NO: 408663 - DNA, 17 bp, Homo sapiens
atggcagcctcagggct

SEQ ID NO: 408664 - DNA, 21 bp, Homo sapiens
atggcaggagaatcagcctgg

SEQ ID NO: 408665 - DNA, 19 bp, Homo sapiens
atggcaggtgatgtcctgt

SEQ ID NO: 408666 - DNA, 16 bp, Homo sapiens
atggcagtgggaccaa

SEQ ID NO: 408667 - DNA, 14 bp, Homo sapiens
atggcagtgggaga

SEQ ID NO: 408668 - DNA, 14 bp, Homo sapiens
atggcatgtgaaaa

SEQ ID NO: 408669 - DNA, 15 bp, Homo sapiens
atggcattactctgc

SEQ ID NO: 408670 - DNA, 16 bp, Homo sapiens
atggcattactctgca

SEQ ID NO: 408671 - DNA, 13 bp, Homo sapiens
atggccaagagca

SEQ ID NO: 408672 - DNA, 15 bp, Homo sapiens
atggccaaggggcca

SEQ ID NO: 408673 - DNA, 20 bp, Homo sapiens
atggccaaggggccagctgc

SEQ ID NO: 408674 - DNA, 21 bp, Homo sapiens
atggccaagggggtggacgca

SEQ ID NO: 408675 - DNA, 16 bp, Homo sapiens
atggccacagccacct

SEQ ID NO: 408676 - DNA, 17 bp, Homo sapiens
atggccacatccaacat

SEQ ID NO: 408677 - DNA, 21 bp, Homo sapiens
atggccaccccgtgccacccg

SEQ ID NO: 408678 - DNA, 14 bp, Homo sapiens
atggccccagctgg

SEQ ID NO: 408679 - DNA, 15 bp, Homo sapiens
atggcccctccattt

SEQ ID NO: 408680 - DNA, 16 bp, Homo sapiens
atggccgggctgctgc

SEQ ID NO: 408681 - DNA, 15 bp, Homo sapiens
atggcctcagctgcc

SEQ ID NO: 408682 - DNA, 19 bp, Homo sapiens
atggcctcagctgcctcac

SEQ ID NO: 408683 - DNA, 17 bp, Homo sapiens
atggcctcccagccacc

SEQ ID NO: 408684 - DNA, 19 bp, Homo sapiens
atggcctcttaaaaattat

SEQ ID NO: 408685 - DNA, 13 bp, Homo sapiens
atggcctgtgctg

SEQ ID NO: 408686 - DNA, 12 bp, Homo sapiens
atggccttccct

SEQ ID NO: 408687 - DNA, 13 bp, Homo sapiens
atggcctttgctt

SEQ ID NO: 408688 - DNA, 13 bp, Homo sapiens
atggcgcacccgg

SEQ ID NO: 408689 - DNA, 23 bp, Homo sapiens
atggcgcgggaggcaccagctct

SEQ ID NO: 408690 - DNA, 17 bp, Homo sapiens
atggcgtaatgggcctg

SEQ ID NO: 408691 - DNA, 19 bp, Homo sapiens
atggcgtaatgggcctgcc

SEQ ID NO: 408692 - DNA, 15 bp, Homo sapiens
atggctataaatata

SEQ ID NO: 408693 - DNA, 19 bp, Homo sapiens
atggctatatggcaagaaa

SEQ ID NO: 408694 - DNA, 15 bp, Homo sapiens
atggctcaaggattc

SEQ ID NO: 408695 - DNA, 16 bp, Homo sapiens
atggctcaaggattca

SEQ ID NO: 408696 - DNA, 19 bp, Homo sapiens
atggctcaggcaagcccct

SEQ ID NO: 408697 - DNA, 15 bp, Homo sapiens
atggctcatcaacaa

SEQ ID NO: 408698 - DNA, 13 bp, Homo sapiens
atggctccagtct

SEQ ID NO: 408699 - DNA, 15 bp, Homo sapiens
atggctcctgtctgg

SEQ ID NO: 408700 - DNA, 16 bp, Homo sapiens
atggctcgtgggctct

SEQ ID NO: 408701 - DNA, 22 bp, Homo sapiens
atggctctaacattactgcctt

SEQ ID NO: 408702 - DNA, 12 bp, Homo sapiens
atggctgtattt

SEQ ID NO: 408703 - DNA, 13 bp, Homo sapiens
atggctgtatttt

SEQ ID NO: 408704 - DNA, 14 bp, Homo sapiens
atggctgtgaaaat

SEQ ID NO: 408705 - DNA, 17 bp, Homo sapiens
atggctgttatctgtct

SEQ ID NO: 408706 - DNA, 15 bp, Homo sapiens
atggcttattgtgtg

SEQ ID NO: 408707 - DNA, 15 bp, Homo sapiens
atggcttgacatgtg

SEQ ID NO: 408708 - DNA, 18 bp, Homo sapiens
atggcttgtagggtgagg

SEQ ID NO: 408709 - DNA, 23 bp, Homo sapiens
atggctttatttgttttttttgt

SEQ ID NO: 408710 - DNA, 17 bp, Homo sapiens
atgggaaagccacctct

SEQ ID NO: 408711 - DNA, 18 bp, Homo sapiens
atgggaaagccacctctc

SEQ ID NO: 408712 - DNA, 23 bp, Homo sapiens
atgggaaagccacctctccctca

SEQ ID NO: 408713 - DNA, 21 bp, Homo sapiens
atgggaacaagtgtacagaag

SEQ ID NO: 408714 - DNA, 15 bp, Homo sapiens
atgggaattgtgtga

SEQ ID NO: 408715 - DNA, 21 bp, Homo sapiens
atgggactgatgtcatcttga

SEQ ID NO: 408716 - DNA, 17 bp, Homo sapiens
atgggactgggagggcc

SEQ ID NO: 408717 - DNA, 20 bp, Homo sapiens
atgggagattaaaaccagag

SEQ ID NO: 408718 - DNA, 12 bp, Homo sapiens
atgggagccaga

SEQ ID NO: 408719 - DNA, 18 bp, Homo sapiens
atgggagccagaattcac

SEQ ID NO: 408720 - DNA, 15 bp, Homo sapiens
atgggagtaagagca

SEQ ID NO: 408721 - DNA, 18 bp, Homo sapiens
atgggagtgaacatttct

SEQ ID NO: 408722 - DNA, 19 bp, Homo sapiens
atgggagtgaacatttcta

SEQ ID NO: 408723 - DNA, 14 bp, Homo sapiens
atgggagtgggcac

SEQ ID NO: 408724 - DNA, 16 bp, Homo sapiens
atgggcacctctgctg

SEQ ID NO: 408725 - DNA, 17 bp, Homo sapiens
atgggcacctctgctgt

SEQ ID NO: 408726 - DNA, 14 bp, Homo sapiens
atgggcactggaaa

SEQ ID NO: 408727 - DNA, 15 bp, Homo sapiens
atgggcagctggggg

SEQ ID NO: 408728 - DNA, 16 bp, Homo sapiens
atgggccaagccaggg

SEQ ID NO: 408729 - DNA, 14 bp, Homo sapiens
atgggcctgcccaa

SEQ ID NO: 408730 - DNA, 11 bp, Homo sapiens
atgggcctggg

SEQ ID NO: 408731 - DNA, 13 bp, Homo sapiens
atgggcctgggcc

SEQ ID NO: 408732 - DNA, 16 bp, Homo sapiens
atgggcctgggcctgc

SEQ ID NO: 408733 - DNA, 12 bp, Homo sapiens
atgggccttgct

SEQ ID NO: 408734 - DNA, 21 bp, Homo sapiens
atgggccttgctttgggcttt

SEQ ID NO: 408735 - DNA, 13 bp, Homo sapiens
atgttactgacca

SEQ ID NO: 408736 - DNA, 14 bp, Homo sapiens
atgttactgaccag

SEQ ID NO: 408737 - DNA, 18 bp, Homo sapiens
atgttactgatcatgcat

SEQ ID NO: 408738 - DNA, 22 bp, Homo sapiens
atgttactgatcatgcattgtt

SEQ ID NO: 408739 - DNA, 14 bp, Homo sapiens
atgttacttaaaca

SEQ ID NO: 408740 - DNA, 19 bp, Homo sapiens
atgttagaattgatttcca

SEQ ID NO: 408741 - DNA, 15 bp, Homo sapiens
atgttaggctgggcc

SEQ ID NO: 408742 - DNA, 14 bp, Homo sapiens
atgttatgaacatg

SEQ ID NO: 408743 - DNA, 19 bp, Homo sapiens
atgttatggcttattgtgt

SEQ ID NO: 408744 - DNA, 21 bp, Homo sapiens
atgttatggcttattgtgtga

SEQ ID NO: 408745 - DNA, 22 bp, Homo sapiens
atgttatttgttattttcagta

SEQ ID NO: 408746 - DNA, 18 bp, Homo sapiens
atgttattttctgttgaa

SEQ ID NO: 408747 - DNA, 13 bp, Homo sapiens
atgttatttttgg

SEQ ID NO: 408748 - DNA, 17 bp, Homo sapiens
atgttattttttaatta

SEQ ID NO: 408749 - DNA, 19 bp, Homo sapiens
atgttattttttaattatt

SEQ ID NO: 408750 - DNA, 20 bp, Homo sapiens
atgttattttttaattatta

SEQ ID NO: 408751 - DNA, 16 bp, Homo sapiens
atgttcagcactgtcc

SEQ ID NO: 408752 - DNA, 19 bp, Homo sapiens
atgttcagcactgtccctt

SEQ ID NO: 408753 - DNA, 21 bp, Homo sapiens
atgttcatgtgtaacttctag

SEQ ID NO: 408754 - DNA, 22 bp, Homo sapiens
atgttcattgtaatgttactga

SEQ ID NO: 408755 - DNA, 18 bp, Homo sapiens
atgttccatcctgtacaa

SEQ ID NO: 408756 - DNA, 19 bp, Homo sapiens
atgttccattcagtctgca

SEQ ID NO: 408757 - DNA, 14 bp, Homo sapiens
atgttccctgcacc

SEQ ID NO: 408758 - DNA, 17 bp, Homo sapiens
atgttccgttcatctga

SEQ ID NO: 408759 - DNA, 18 bp, Homo sapiens
atgttccgttcatctgag

SEQ ID NO: 408760 - DNA, 11 bp, Homo sapiens
atgttctatta

SEQ ID NO: 408761 - DNA, 18 bp, Homo sapiens
atgttctattaatcacct

SEQ ID NO: 408762 - DNA, 16 bp, Homo sapiens
atgttctgacattaac

SEQ ID NO: 408763 - DNA, 20 bp, Homo sapiens
atgttctgagctataacatt

SEQ ID NO: 408764 - DNA, 16 bp, Homo sapiens
atgttctggacctccc

SEQ ID NO: 408765 - DNA, 21 bp, Homo sapiens
atgttctgtgcctgtaaacat

SEQ ID NO: 408766 - DNA, 19 bp, Homo sapiens
atgttcttccagcttcaat

SEQ ID NO: 408767 - DNA, 17 bp, Homo sapiens
atgttcttggaacatgg

SEQ ID NO: 408768 - DNA, 19 bp, Homo sapiens
atgttcttgttttgttata

SEQ ID NO: 408769 - DNA, 22 bp, Homo sapiens
attacacagttcacaaacagta

SEQ ID NO: 408770 - DNA, 20 bp, Homo sapiens
attacactgtatttgtatct

SEQ ID NO: 408771 - DNA, 21 bp, Homo sapiens
attacagagaggagaaacaca

SEQ ID NO: 408772 - DNA, 22 bp, Homo sapiens
attacagagaggagaaacacat

SEQ ID NO: 408773 - DNA, 15 bp, Homo sapiens
attacagaggaagtt

SEQ ID NO: 408774 - DNA, 21 bp, Homo sapiens
attacagatgggcaaattaag

SEQ ID NO: 408775 - DNA, 17 bp, Homo sapiens
attacaggtgcccacca

SEQ ID NO: 408776 - DNA, 19 bp, Homo sapiens
attacaggtgtgtgccatc

SEQ ID NO: 408777 - DNA, 21 bp, Homo sapiens
attacagtgaaattttggtga

SEQ ID NO: 408778 - DNA, 14 bp, Homo sapiens
attacatctaatgc

SEQ ID NO: 408779 - DNA, 17 bp, Homo sapiens
attacatctttattaac

SEQ ID NO: 408780 - DNA, 21 bp, Homo sapiens
attacatctttattaacctca

SEQ ID NO: 408781 - DNA, 16 bp, Homo sapiens
attacatgtaaaacat

SEQ ID NO: 408782 - DNA, 21 bp, Homo sapiens
attacattagttaagatgtct

SEQ ID NO: 408783 - DNA, 17 bp, Homo sapiens
attacattccttgataa

SEQ ID NO: 408784 - DNA, 16 bp, Homo sapiens
attacatttatacatc

SEQ ID NO: 408785 - DNA, 18 bp, Homo sapiens
attacattttatatgtga

SEQ ID NO: 408786 - DNA, 18 bp, Homo sapiens
attaccagcaagaataaa

SEQ ID NO: 408787 - DNA, 13 bp, Homo sapiens
attaccatcttaa

SEQ ID NO: 408788 - DNA, 17 bp, Homo sapiens
attaccatcttaatctt

SEQ ID NO: 408789 - DNA, 21 bp, Homo sapiens
attactattccctttgacttc

SEQ ID NO: 408790 - DNA, 17 bp, Homo sapiens
attactctgacataaac

SEQ ID NO: 408791 - DNA, 15 bp, Homo sapiens
attactctgcactat

SEQ ID NO: 408792 - DNA, 23 bp, Homo sapiens
attactggagccatgtctacaaa

SEQ ID NO: 408793 - DNA, 16 bp, Homo sapiens
attactgtcaataaac

SEQ ID NO: 408794 - DNA, 17 bp, Homo sapiens
attactgtcaataaaca

SEQ ID NO: 408795 - DNA, 18 bp, Homo sapiens
attactgtctggttttaa

SEQ ID NO: 408796 - DNA, 20 bp, Homo sapiens
attactgtctttattcttat

SEQ ID NO: 408797 - DNA, 14 bp, Homo sapiens
attactgttgcatt

SEQ ID NO: 408798 - DNA, 20 bp, Homo sapiens
attactgttgcatttacttt

SEQ ID NO: 408799 - DNA, 16 bp, Homo sapiens
attactgtttatttct

SEQ ID NO: 408800 - DNA, 22 bp, Homo sapiens
attactttaaattatatgatat

SEQ ID NO: 408801 - DNA, 23 bp, Homo sapiens
attactttaaattatatgatatg

SEQ ID NO: 408802 - DNA, 15 bp, Homo sapiens
attactttaacatgc

SEQ ID NO: 408803 - DNA, 15 bp, Homo sapiens
attactttaatactc

SEQ ID NO: 408804 - DNA, 16 bp, Homo sapiens
attactttgtagatgt

SEQ ID NO: 408805 - DNA, 18 bp, Homo sapiens
attacttttgtaaatatt

SEQ ID NO: 408806 - DNA, 21 bp, Homo sapiens
attacttttgtaaatattctt

SEQ ID NO: 408807 - DNA, 11 bp, Homo sapiens
attagaagaaa

SEQ ID NO: 408808 - DNA, 20 bp, Homo sapiens
attagaagaaaacatatatt

SEQ ID NO: 408809 - DNA, 17 bp, Homo sapiens
attagaagccaagacag

SEQ ID NO: 408810 - DNA, 22 bp, Homo sapiens
attagacaatgtggaattacat

SEQ ID NO: 408811 - DNA, 15 bp, Homo sapiens
attagactgaattta

SEQ ID NO: 408812 - DNA, 17 bp, Homo sapiens
attagactgaatttaac

SEQ ID NO: 408813 - DNA, 23 bp, Homo sapiens
attagatatcaatgttaatgata

SEQ ID NO: 408814 - DNA, 20 bp, Homo sapiens
attagcatgaaaggtaatct

SEQ ID NO: 408815 - DNA, 14 bp, Homo sapiens
attagcctgtagct

SEQ ID NO: 408816 - DNA, 20 bp, Homo sapiens
attagctgtaaatacatgtg

SEQ ID NO: 408817 - DNA, 19 bp, Homo sapiens
attaggccttatgtaagga

SEQ ID NO: 408818 - DNA, 16 bp, Homo sapiens
attaggtttagaatca

SEQ ID NO: 408819 - DNA, 15 bp, Homo sapiens
attagtatcctgtta

SEQ ID NO: 408820 - DNA, 15 bp, Homo sapiens
attagtcctcacagc

SEQ ID NO: 408821 - DNA, 14 bp, Homo sapiens
attataaaatcttt

SEQ ID NO: 408822 - DNA, 12 bp, Homo sapiens
attataaggact

SEQ ID NO: 408823 - DNA, 17 bp, Homo sapiens
attataaggactgcatg

SEQ ID NO: 408824 - DNA, 17 bp, Homo sapiens
attataagttgaccttt

SEQ ID NO: 408825 - DNA, 20 bp, Homo sapiens
attataataatgttctctgg

SEQ ID NO: 408826 - DNA, 17 bp, Homo sapiens
attatacagacctaata

SEQ ID NO: 408827 - DNA, 20 bp, Homo sapiens
attatacagacctaatatca

SEQ ID NO: 408828 - DNA, 23 bp, Homo sapiens
attatactgtagctgatgaaact

SEQ ID NO: 408829 - DNA, 14 bp, Homo sapiens
attatatgatatgc

SEQ ID NO: 408830 - DNA, 13 bp, Homo sapiens
attatattaaaat

SEQ ID NO: 408831 - DNA, 15 bp, Homo sapiens
attatattataataa

SEQ ID NO: 408832 - DNA, 17 bp, Homo sapiens
attatattgagacaaaa

SEQ ID NO: 408833 - DNA, 15 bp, Homo sapiens
attatattgtattta

SEQ ID NO: 408834 - DNA, 13 bp, Homo sapiens
attatcaagctaa

SEQ ID NO: 408835 - DNA, 23 bp, Homo sapiens
attatcaagctaataaaatatca

SEQ ID NO: 408836 - DNA, 19 bp, Homo sapiens
attatcagtgaatataaat

SEQ ID NO: 408837 - DNA, 22 bp, Homo sapiens
attatcagtgaatataaatgta

SEQ ID NO: 408838 - DNA, 17 bp, Homo sapiens
attatcggaagcagtgc

SEQ ID NO: 408839 - DNA, 21 bp, Homo sapiens
attatcgggagcagtgtcttc

SEQ ID NO: 408840 - DNA, 19 bp, Homo sapiens
attatctaaaatctgctag

SEQ ID NO: 408841 - DNA, 17 bp, Homo sapiens
attatctaaagtgtgtt

SEQ ID NO: 408842 - DNA, 23 bp, Homo sapiens
attatctagtaggtctgcacaca

SEQ ID NO: 408843 - DNA, 15 bp, Homo sapiens
attatctatttgtat

SEQ ID NO: 408844 - DNA, 16 bp, Homo sapiens
attatctctttctctc

SEQ ID NO: 408845 - DNA, 15 bp, Homo sapiens
attatctgatccttg

SEQ ID NO: 408846 - DNA, 17 bp, Homo sapiens
attatgggtatgtgttg

SEQ ID NO: 408847 - DNA, 15 bp, Homo sapiens
attatggtgaaatta

SEQ ID NO: 408848 - DNA, 14 bp, Homo sapiens
attatgtaatgcaa

SEQ ID NO: 408849 - DNA, 14 bp, Homo sapiens
attatgtagaaata

SEQ ID NO: 408850 - DNA, 14 bp, Homo sapiens
attatgtagctgaa

SEQ ID NO: 408851 - DNA, 15 bp, Homo sapiens
attatgtcaaatgga

SEQ ID NO: 408852 - DNA, 21 bp, Homo sapiens
attatgtcaaatggatgtaat

SEQ ID NO: 408853 - DNA, 17 bp, Homo sapiens
attatgtgacaaccttt

SEQ ID NO: 408854 - DNA, 22 bp, Homo sapiens
attatgtgacaacctttgtgta

SEQ ID NO: 408855 - DNA, 24 bp, Homo sapiens
attatgtgacaacctttgtgtaat

SEQ ID NO: 408856 - DNA, 19 bp, Homo sapiens
attgtgccaatatgtattg

SEQ ID NO: 408857 - DNA, 20 bp, Homo sapiens
attgtggctcctatctgtgt

SEQ ID NO: 408858 - DNA, 18 bp, Homo sapiens
attgtgggtaacgtgaga

SEQ ID NO: 408859 - DNA, 20 bp, Homo sapiens
attgtgtacaaagtagagaa

SEQ ID NO: 408860 - DNA, 23 bp, Homo sapiens
attgtgtgaaggtaactaagaag

SEQ ID NO: 408861 - DNA, 20 bp, Homo sapiens
attgtgtggtcagtggctct

SEQ ID NO: 408862 - DNA, 19 bp, Homo sapiens
attgttacaggtgtactat

SEQ ID NO: 408863 - DNA, 17 bp, Homo sapiens
attgttataaataaaat

SEQ ID NO: 408864 - DNA, 22 bp, Homo sapiens
attgttattgtggaagatttac

SEQ ID NO: 408865 - DNA, 21 bp, Homo sapiens
attgttccaagacattgtcaa

SEQ ID NO: 408866 - DNA, 10 bp, Homo sapiens
attgttctgg

SEQ ID NO: 408867 - DNA, 20 bp, Homo sapiens
attgttcttgtaaaactgtg

SEQ ID NO: 408868 - DNA, 22 bp, Homo sapiens
attgttgtgggctttctccggg

SEQ ID NO: 408869 - DNA, 17 bp, Homo sapiens
attgtttatttatcagt

SEQ ID NO: 408870 - DNA, 19 bp, Homo sapiens
attgtttatttatcagtga

SEQ ID NO: 408871 - DNA, 20 bp, Homo sapiens
attgtttgatattgtcacct

SEQ ID NO: 408872 - DNA, 19 bp, Homo sapiens
attgtttgcttattgttcc

SEQ ID NO: 408873 - DNA, 23 bp, Homo sapiens
attgtttgcttattgttccaaga

SEQ ID NO: 408874 - DNA, 20 bp, Homo sapiens
attgtttgtctgtcttcata

SEQ ID NO: 408875 - DNA, 21 bp, Homo sapiens
attgtttgtctttaactgtca

SEQ ID NO: 408876 - DNA, 21 bp, Homo sapiens
attgttttattttggaattgg

SEQ ID NO: 408877 - DNA, 20 bp, Homo sapiens
attgttttcaacctagaaac

SEQ ID NO: 408878 - DNA, 12 bp, Homo sapiens
attgttttctgt

SEQ ID NO: 408879 - DNA, 17 bp, Homo sapiens
attgttttctgtaaata

SEQ ID NO: 408880 - DNA, 20 bp, Homo sapiens
attgttttctgtaaataacc

SEQ ID NO: 408881 - DNA, 23 bp, Homo sapiens
attgtttttatatattataagtt

SEQ ID NO: 408882 - DNA, 23 bp, Homo sapiens
attgtttttgaatttaaataaag

SEQ ID NO: 408883 - DNA, 17 bp, Homo sapiens
atttaaaaatctttcag

SEQ ID NO: 408884 - DNA, 19 bp, Homo sapiens
atttaaaaatctttcagaa

SEQ ID NO: 408885 - DNA, 12 bp, Homo sapiens
atttaaaacaaa

SEQ ID NO: 408886 - DNA, 14 bp, Homo sapiens
atttaaaacaaaca

SEQ ID NO: 408887 - DNA, 12 bp, Homo sapiens
atttaaaacatt

SEQ ID NO: 408888 - DNA, 13 bp, Homo sapiens
atttaaaacattt

SEQ ID NO: 408889 - DNA, 14 bp, Homo sapiens
atttaaaagacaaa

SEQ ID NO: 408890 - DNA, 17 bp, Homo sapiens
atttaaaagacaaacac

SEQ ID NO: 408891 - DNA, 21 bp, Homo sapiens
atttaaaatcattcaatatct

SEQ ID NO: 408892 - DNA, 13 bp, Homo sapiens
atttaaaatgatt

SEQ ID NO: 408893 - DNA, 16 bp, Homo sapiens
atttaaaatgattaga

SEQ ID NO: 408894 - DNA, 12 bp, Homo sapiens
atttaaactatt

SEQ ID NO: 408895 - DNA, 22 bp, Homo sapiens
atttaaactattcagaggaaaa

SEQ ID NO: 408896 - DNA, 12 bp, Homo sapiens
atttaaagcaca

SEQ ID NO: 408897 - DNA, 11 bp, Homo sapiens
atttaaataaa

SEQ ID NO: 408898 - DNA, 18 bp, Homo sapiens
atttaaatataattctgt

SEQ ID NO: 408899 - DNA, 23 bp, Homo sapiens
atttaaatataattctgtaaatg

SEQ ID NO: 408900 - DNA, 19 bp, Homo sapiens
atttaaattgttataactt

SEQ ID NO: 408901 - DNA, 16 bp, Homo sapiens
atttaaccctgcctct

SEQ ID NO: 408902 - DNA, 15 bp, Homo sapiens
atttaactagcactt

SEQ ID NO: 408903 - DNA, 17 bp, Homo sapiens
atttaactgcatataga

SEQ ID NO: 408904 - DNA, 13 bp, Homo sapiens
atttaactgcctt

SEQ ID NO: 408905 - DNA, 20 bp, Homo sapiens
atttaacttgagggtaataa

SEQ ID NO: 408906 - DNA, 21 bp, Homo sapiens
atttaagaaaaacaaaatgtt

SEQ ID NO: 408907 - DNA, 15 bp, Homo sapiens
atttaagaatgacag

SEQ ID NO: 408908 - DNA, 14 bp, Homo sapiens
atttaagcatgagt

SEQ ID NO: 408909 - DNA, 11 bp, Homo sapiens
atttaagcatt

SEQ ID NO: 408910 - DNA, 22 bp, Homo sapiens
atttaagtcgggaaattctgct

SEQ ID NO: 408911 - DNA, 20 bp, Homo sapiens
atttaagtggggcaaaacct

SEQ ID NO: 408912 - DNA, 22 bp, Homo sapiens
atttaataactttgctggaaaa

SEQ ID NO: 408913 - DNA, 16 bp, Homo sapiens
atttaatatactgcat

SEQ ID NO: 408914 - DNA, 16 bp, Homo sapiens
atttaatatgcatctt

SEQ ID NO: 408915 - DNA, 21 bp, Homo sapiens
atttaatcatttccagcaaaa

SEQ ID NO: 408916 - DNA, 14 bp, Homo sapiens
atttaatgtagaca

SEQ ID NO: 408917 - DNA, 13 bp, Homo sapiens
atttaattattaa

SEQ ID NO: 408918 - DNA, 20 bp, Homo sapiens
atttaattattaactacatt

SEQ ID NO: 408919 - DNA, 14 bp, Homo sapiens
atttaatttcataa

SEQ ID NO: 408920 - DNA, 15 bp, Homo sapiens
atttaatttcataaa

SEQ ID NO: 408921 - DNA, 18 bp, Homo sapiens
atttaatttttaaaagac

SEQ ID NO: 408922 - DNA, 22 bp, Homo sapiens
atttaatttttaaaagactttg

SEQ ID NO: 408923 - DNA, 22 bp, Homo sapiens
atttaattttttaactgctgca

SEQ ID NO: 408924 - DNA, 18 bp, Homo sapiens
atttacaagactaacctt

SEQ ID NO: 408925 - DNA, 16 bp, Homo sapiens
atttacagttactgcc

SEQ ID NO: 408926 - DNA, 15 bp, Homo sapiens
atttaccctttatag

SEQ ID NO: 408927 - DNA, 16 bp, Homo sapiens
atttaccctttataga

SEQ ID NO: 408928 - DNA, 17 bp, Homo sapiens
atttaccctttatagaa

SEQ ID NO: 408929 - DNA, 14 bp, Homo sapiens
atttaccttgaaca

SEQ ID NO: 408930 - DNA, 22 bp, Homo sapiens
atttactaagccacaagaaatt

SEQ ID NO: 408931 - DNA, 13 bp, Homo sapiens
atttactgagctt

SEQ ID NO: 408932 - DNA, 17 bp, Homo sapiens
atttacttcttatacat

SEQ ID NO: 408933 - DNA, 20 bp, Homo sapiens
atttacttcttatacatttg

SEQ ID NO: 408934 - DNA, 21 bp, Homo sapiens
atttacttttaccactattta

SEQ ID NO: 408935 - DNA, 17 bp, Homo sapiens
atttactttttaaacag

SEQ ID NO: 408936 - DNA, 15 bp, Homo sapiens
atttagaaatataat

SEQ ID NO: 408937 - DNA, 17 bp, Homo sapiens
atttagagatgaattaa

SEQ ID NO: 408938 - DNA, 18 bp, Homo sapiens
atttagcgtagctaagtg

SEQ ID NO: 408939 - DNA, 19 bp, Homo sapiens
atttagctgtatcaaacta

SEQ ID NO: 408940 - DNA, 12 bp, Homo sapiens
atttaggagaag

SEQ ID NO: 408941 - DNA, 14 bp, Homo sapiens
atttaggagaagtt

SEQ ID NO: 408942 - DNA, 15 bp, Homo sapiens
atttaggagaagttg

SEQ ID NO: 408943 - DNA, 22 bp, Homo sapiens
atttaggcatgagctcttggca

SEQ ID NO: 408944 - DNA, 23 bp, Homo sapiens
atttaggccagggtctcactgag

SEQ ID NO: 408945 - DNA, 17 bp, Homo sapiens
atttagggaagcaggga

SEQ ID NO: 408946 - DNA, 16 bp, Homo sapiens
atttagtatctgtaat

SEQ ID NO: 408947 - DNA, 15 bp, Homo sapiens
atttagtgaactacg

SEQ ID NO: 408948 - DNA, 14 bp, Homo sapiens
atttagttatagtt

SEQ ID NO: 408949 - DNA, 16 bp, Homo sapiens
atttagttatagtttc

SEQ ID NO: 408950 - DNA, 12 bp, Homo sapiens
atttagttcttt

SEQ ID NO: 408951 - DNA, 21 bp, Homo sapiens
atttagttgggtctgaaagga

SEQ ID NO: 408952 - DNA, 17 bp, Homo sapiens
atttataacattgtaaa

SEQ ID NO: 408953 - DNA, 18 bp, Homo sapiens
atttataactcatcataa

SEQ ID NO: 408954 - DNA, 19 bp, Homo sapiens
atttataactcatcataaa

SEQ ID NO: 408955 - DNA, 20 bp, Homo sapiens
atttataactcatcataaaa

SEQ ID NO: 408956 - DNA, 21 bp, Homo sapiens
atttataactcatcataaaat

SEQ ID NO: 408957 - DNA, 22 bp, Homo sapiens
atttataactcatcataaaata

SEQ ID NO: 408958 - DNA, 17 bp, Homo sapiens
atttatagtttatacag

SEQ ID NO: 408959 - DNA, 16 bp, Homo sapiens
atttatagtttgtaca

SEQ ID NO: 408960 - DNA, 15 bp, Homo sapiens
atttatataattatg

SEQ ID NO: 408961 - DNA, 15 bp, Homo sapiens
atttatatatgtatt

SEQ ID NO: 408962 - DNA, 17 bp, Homo sapiens
atttatatatttataac

SEQ ID NO: 408963 - DNA, 18 bp, Homo sapiens
atttatatatttataact

SEQ ID NO: 408964 - DNA, 19 bp, Homo sapiens
atttatatatttataactc

SEQ ID NO: 408965 - DNA, 20 bp, Homo sapiens
atttatatatttataactca

SEQ ID NO: 408966 - DNA, 16 bp, Homo sapiens
atttatattcatcaaa

SEQ ID NO: 408967 - DNA, 19 bp, Homo sapiens
atttatatttgtctcattt

SEQ ID NO: 408968 - DNA, 18 bp, Homo sapiens
atttatatttttatttta

SEQ ID NO: 408969 - DNA, 13 bp, Homo sapiens
atttatatttttg

SEQ ID NO: 408970 - DNA, 14 bp, Homo sapiens
atttatcacacaaa

SEQ ID NO: 408971 - DNA, 19 bp, Homo sapiens
atttatcacacaaagcaga

SEQ ID NO: 408972 - DNA, 15 bp, Homo sapiens
atttatcagattgct

SEQ ID NO: 408973 - DNA, 18 bp, Homo sapiens
atttatcagtgacagagt

SEQ ID NO: 408974 - DNA, 17 bp, Homo sapiens
atttatcatatttaata

SEQ ID NO: 408975 - DNA, 19 bp, Homo sapiens
atttatccaaagcattgca

SEQ ID NO: 408976 - DNA, 18 bp, Homo sapiens
atttatcgaaagtaaaaa

SEQ ID NO: 408977 - DNA, 17 bp, Homo sapiens
atttatctgtctgagcc

SEQ ID NO: 408978 - DNA, 21 bp, Homo sapiens
atttatcttccatatgctctt

SEQ ID NO: 408979 - DNA, 18 bp, Homo sapiens
atttatgacctcaacaaa

SEQ ID NO: 408980 - DNA, 20 bp, Homo sapiens
atttatgatataataaatat

SEQ ID NO: 408981 - DNA, 14 bp, Homo sapiens
atttatgcatgaga

SEQ ID NO: 408982 - DNA, 14 bp, Homo sapiens
atttcttgtttgtt

SEQ ID NO: 408983 - DNA, 21 bp, Homo sapiens
atttctttaatctgttgtttg

SEQ ID NO: 408984 - DNA, 22 bp, Homo sapiens
atttctttaatctgttgtttga

SEQ ID NO: 408985 - DNA, 15 bp, Homo sapiens
atttctttatttctg

SEQ ID NO: 408986 - DNA, 16 bp, Homo sapiens
atttcttttatatata

SEQ ID NO: 408987 - DNA, 18 bp, Homo sapiens
atttcttttatatataaa

SEQ ID NO: 408988 - DNA, 20 bp, Homo sapiens
atttcttttatatataaaat

SEQ ID NO: 408989 - DNA, 22 bp, Homo sapiens
atttctttttcttgcaaaacaa

SEQ ID NO: 408990 - DNA, 20 bp, Homo sapiens
atttctttttgggagagact

SEQ ID NO: 408991 - DNA, 23 bp, Homo sapiens
atttctttttgggagagacttgt

SEQ ID NO: 408992 - DNA, 20 bp, Homo sapiens
atttgaaactgctaattaca

SEQ ID NO: 408993 - DNA, 15 bp, Homo sapiens
atttgaaaggaaaaa

SEQ ID NO: 408994 - DNA, 17 bp, Homo sapiens
atttgaaaggaaaaaca

SEQ ID NO: 408995 - DNA, 10 bp, Homo sapiens
atttgaaagt

SEQ ID NO: 408996 - DNA, 22 bp, Homo sapiens
atttgaaatcaccttttctaaa

SEQ ID NO: 408997 - DNA, 22 bp, Homo sapiens
atttgaaatccaaactactttc

SEQ ID NO: 408998 - DNA, 15 bp, Homo sapiens
atttgaaatttagct

SEQ ID NO: 408999 - DNA, 17 bp, Homo sapiens
atttgaaccaaaacatt

SEQ ID NO: 409000 - DNA, 14 bp, Homo sapiens
atttgaaggtctgc

SEQ ID NO: 409001 - DNA, 15 bp, Homo sapiens
atttgaatgaaaaat

SEQ ID NO: 409002 - DNA, 19 bp, Homo sapiens
atttgaatgaaaaatttaa

SEQ ID NO: 409003 - DNA, 17 bp, Homo sapiens
atttgaatggattaaat

SEQ ID NO: 409004 - DNA, 21 bp, Homo sapiens
atttgaatggtgcagaaaaaa

SEQ ID NO: 409005 - DNA, 18 bp, Homo sapiens
atttgaatgttaagcaga

SEQ ID NO: 409006 - DNA, 20 bp, Homo sapiens
atttgacacactcaccattt

SEQ ID NO: 409007 - DNA, 22 bp, Homo sapiens
atttgaggagcagcttcagttg

SEQ ID NO: 409008 - DNA, 12 bp, Homo sapiens
atttgagtgttt

SEQ ID NO: 409009 - DNA, 19 bp, Homo sapiens
atttgagtgttttaagata

SEQ ID NO: 409010 - DNA, 13 bp, Homo sapiens
atttgagtttcct

SEQ ID NO: 409011 - DNA, 23 bp, Homo sapiens
atttgagtttcctttaaatactc

SEQ ID NO: 409012 - DNA, 16 bp, Homo sapiens
atttgatgaaagctga

SEQ ID NO: 409013 - DNA, 21 bp, Homo sapiens
atttgatgaaagctgattact

SEQ ID NO: 409014 - DNA, 14 bp, Homo sapiens
atttgatgctaaat

SEQ ID NO: 409015 - DNA, 16 bp, Homo sapiens
atttgatgctggagag

SEQ ID NO: 409016 - DNA, 14 bp, Homo sapiens
atttgatgtagttt

SEQ ID NO: 409017 - DNA, 20 bp, Homo sapiens
atttgatgtctagataacat

SEQ ID NO: 409018 - DNA, 17 bp, Homo sapiens
atttgatttctattcaa

SEQ ID NO: 409019 - DNA, 15 bp, Homo sapiens
atttgcaacatttac

SEQ ID NO: 409020 - DNA, 21 bp, Homo sapiens
atttgcaatattcctttgggc

SEQ ID NO: 409021 - DNA, 15 bp, Homo sapiens
atttgcagctgctgg

SEQ ID NO: 409022 - DNA, 14 bp, Homo sapiens
atttgcataatact

SEQ ID NO: 409023 - DNA, 18 bp, Homo sapiens
atttgcatggattttgga

SEQ ID NO: 409024 - DNA, 15 bp, Homo sapiens
atttgccaaaaacta

SEQ ID NO: 409025 - DNA, 11 bp, Homo sapiens
atttgccagca

SEQ ID NO: 409026 - DNA, 13 bp, Homo sapiens
atttgccagcaca

SEQ ID NO: 409027 - DNA, 16 bp, Homo sapiens
atttgccatgctgcta

SEQ ID NO: 409028 - DNA, 11 bp, Homo sapiens
atttgccccaa

SEQ ID NO: 409029 - DNA, 22 bp, Homo sapiens
atttgcccttcaggacccttct

SEQ ID NO: 409030 - DNA, 17 bp, Homo sapiens
atttgccgatttcctaa

SEQ ID NO: 409031 - DNA, 15 bp, Homo sapiens
atttgcctgtgccac

SEQ ID NO: 409032 - DNA, 20 bp, Homo sapiens
atttgccttaggaagtgact

SEQ ID NO: 409033 - DNA, 23 bp, Homo sapiens
atttgcctttaaaaaaaaaagtt

SEQ ID NO: 409034 - DNA, 19 bp, Homo sapiens
atttgcgtatgtaaacatt

SEQ ID NO: 409035 - DNA, 14 bp, Homo sapiens
atttgctaatgaat

SEQ ID NO: 409036 - DNA, 16 bp, Homo sapiens
atttgctaatgaattt

SEQ ID NO: 409037 - DNA, 10 bp, Homo sapiens
atttgctgaa

SEQ ID NO: 409038 - DNA, 16 bp, Homo sapiens
atttgctgaataacaa

SEQ ID NO: 409039 - DNA, 21 bp, Homo sapiens
atttgctgaataacaacaatt

SEQ ID NO: 409040 - DNA, 14 bp, Homo sapiens
atttgctgaatatg

SEQ ID NO: 409041 - DNA, 22 bp, Homo sapiens
atttgctttagagacagggact

SEQ ID NO: 409042 - DNA, 12 bp, Homo sapiens
atttgcttttca

SEQ ID NO: 409043 - DNA, 23 bp, Homo sapiens
atttgcttttcatgtagaactca

SEQ ID NO: 409044 - DNA, 16 bp, Homo sapiens
atttggaagagaggca

SEQ ID NO: 409045 - DNA, 13 bp, Homo sapiens
atttggagtggag

SEQ ID NO: 409046 - DNA, 15 bp, Homo sapiens
atttggagtggaggc

SEQ ID NO: 409047 - DNA, 21 bp, Homo sapiens
atttggggcctttcccattgg

SEQ ID NO: 409048 - DNA, 19 bp, Homo sapiens
atttggggctaagaaatag

SEQ ID NO: 409049 - DNA, 23 bp, Homo sapiens
atttggtcaagattttgaatgct

SEQ ID NO: 409050 - DNA, 17 bp, Homo sapiens
atttggtcttagcttta

SEQ ID NO: 409051 - DNA, 20 bp, Homo sapiens
atttggtcttagctttacat

SEQ ID NO: 409052 - DNA, 17 bp, Homo sapiens
atttggtttttctcttt

SEQ ID NO: 409053 - DNA, 16 bp, Homo sapiens
atttgtaacctcagct

SEQ ID NO: 409054 - DNA, 16 bp, Homo sapiens
atttgtaactttgcat

SEQ ID NO: 409055 - DNA, 18 bp, Homo sapiens
atttgtaactttgcatgt

SEQ ID NO: 409056 - DNA, 19 bp, Homo sapiens
atttgtaactttgcatgtt

SEQ ID NO: 409057 - DNA, 23 bp, Homo sapiens
atttgtaagtttatgtctaaaga

SEQ ID NO: 409058 - DNA, 16 bp, Homo sapiens
atttgtaatgtatctt

SEQ ID NO: 409059 - DNA, 15 bp, Homo sapiens
atttgtaattgctta

SEQ ID NO: 409060 - DNA, 18 bp, Homo sapiens
atttgtacagttcagttc

SEQ ID NO: 409061 - DNA, 11 bp, Homo sapiens
atttgtacatt

SEQ ID NO: 409062 - DNA, 15 bp, Homo sapiens
atttgtacattcctg

SEQ ID NO: 409063 - DNA, 21 bp, Homo sapiens
atttgtacctctaagtacata

SEQ ID NO: 409064 - DNA, 22 bp, Homo sapiens
atttgtactatttaactgacta

SEQ ID NO: 409065 - DNA, 16 bp, Homo sapiens
atttgtagggtttcta

SEQ ID NO: 409066 - DNA, 14 bp, Homo sapiens
atttgtataaaatg

SEQ ID NO: 409067 - DNA, 18 bp, Homo sapiens
atttgtatatatacataa

SEQ ID NO: 409068 - DNA, 23 bp, Homo sapiens
atttgtatctctgaagcatgttt

SEQ ID NO: 409069 - DNA, 21 bp, Homo sapiens
atttgtatttatattagagtg

SEQ ID NO: 409070 - DNA, 22 bp, Homo sapiens
atttgtcagtgtagatcaactc

SEQ ID NO: 409071 - DNA, 13 bp, Homo sapiens
atttgtccaccca

SEQ ID NO: 409072 - DNA, 15 bp, Homo sapiens
atttgtccagataat

SEQ ID NO: 409073 - DNA, 22 bp, Homo sapiens
atttgtctcattttgtatgtat

SEQ ID NO: 409074 - DNA, 15 bp, Homo sapiens
atttgtcttttgtaa

SEQ ID NO: 409075 - DNA, 19 bp, Homo sapiens
atttgtgagccaaagagaa

SEQ ID NO: 409076 - DNA, 20 bp, Homo sapiens
atttgtgagccaaagagaaa

SEQ ID NO: 409077 - DNA, 22 bp, Homo sapiens
atttgtgagccaaagagaaaag

SEQ ID NO: 409078 - DNA, 23 bp, Homo sapiens
atttgtgagccaaagagaaaaga

SEQ ID NO: 409079 - DNA, 15 bp, Homo sapiens
atttgtgatacttcc

SEQ ID NO: 409080 - DNA, 21 bp, Homo sapiens
atttgtgtagattgtgtaaat

SEQ ID NO: 409081 - DNA, 17 bp, Homo sapiens
atttgtgtctgcctgcc

SEQ ID NO: 409082 - DNA, 14 bp, Homo sapiens
atttgtgtgtgtgc

SEQ ID NO: 409083 - DNA, 13 bp, Homo sapiens
atttgttaatata

SEQ ID NO: 409084 - DNA, 16 bp, Homo sapiens
atttgttgtcatgtgt

SEQ ID NO: 409085 - DNA, 18 bp, Homo sapiens
atttgttgtcatgtgtat

SEQ ID NO: 409086 - DNA, 16 bp, Homo sapiens
atttgtttaaagaata

SEQ ID NO: 409087 - DNA, 17 bp, Homo sapiens
atttgtttaaagaataa

SEQ ID NO: 409088 - DNA, 22 bp, Homo sapiens
atttgtttaaagaataaagtcc

SEQ ID NO: 409089 - DNA, 15 bp, Homo sapiens
atttgttttcatggt

SEQ ID NO: 409090 - DNA, 21 bp, Homo sapiens
atttgttttgacggatgattg

SEQ ID NO: 409091 - DNA, 15 bp, Homo sapiens
attttaaaaaataac

SEQ ID NO: 409092 - DNA, 22 bp, Homo sapiens
attttaaaaaataacatattct

SEQ ID NO: 409093 - DNA, 14 bp, Homo sapiens
attttaaaaagtct

SEQ ID NO: 409094 - DNA, 21 bp, Homo sapiens
attttaaaaagtcttcactct

SEQ ID NO: 409095 - DNA, 22 bp, Homo sapiens
attttaaaaattggaaactgac

SEQ ID NO: 409096 - DNA, 22 bp, Homo sapiens
attttaaaagcatatataaaac

SEQ ID NO: 409097 - DNA, 20 bp, Homo sapiens
attttaaaatgtagaagaaa

SEQ ID NO: 409098 - DNA, 20 bp, Homo sapiens
attttaaataaaagtgatca

SEQ ID NO: 409099 - DNA, 22 bp, Homo sapiens
attttaaatctgaaggttctgg

SEQ ID NO: 409100 - DNA, 14 bp, Homo sapiens
attttaaattataa

SEQ ID NO: 409101 - DNA, 15 bp, Homo sapiens
attttaaattctcag

SEQ ID NO: 409102 - DNA, 18 bp, Homo sapiens
attttaacaaaagcaaga

SEQ ID NO: 409103 - DNA, 15 bp, Homo sapiens
attttaacaataact

SEQ ID NO: 409104 - DNA, 20 bp, Homo sapiens
attttaacctagatgtttaa

SEQ ID NO: 409105 - DNA, 15 bp, Homo sapiens
attttaactttatca

SEQ ID NO: 409106 - DNA, 17 bp, Homo sapiens
attttaactttatcaca

SEQ ID NO: 409107 - DNA, 14 bp, Homo sapiens
attttaagcactct

SEQ ID NO: 409108 - DNA, 22 bp, Homo sapiens
attttaagcactcttaaagcaa

SEQ ID NO: 409109 - DNA, 13 bp, Homo sapiens
attttaattatta

SEQ ID NO: 409110 - DNA, 23 bp, Homo sapiens
attttaattattattcttcataa

SEQ ID NO: 409111 - DNA, 16 bp, Homo sapiens
attttaatttgggcat

SEQ ID NO: 409112 - DNA, 16 bp, Homo sapiens
attttacaaaagatgt

SEQ ID NO: 409113 - DNA, 17 bp, Homo sapiens
attttacaaaagatgta

SEQ ID NO: 409114 - DNA, 18 bp, Homo sapiens
attttacatgtctcatat

SEQ ID NO: 409115 - DNA, 15 bp, Homo sapiens
caaagcaagggctcc

SEQ ID NO: 409116 - DNA, 18 bp, Homo sapiens
caaagcaagggctccagc

SEQ ID NO: 409117 - DNA, 13 bp, Homo sapiens
caaagcacagtgt

SEQ ID NO: 409118 - DNA, 14 bp, Homo sapiens
caaagcacagtgtt

SEQ ID NO: 409119 - DNA, 15 bp, Homo sapiens
caaagcacagtgtta

SEQ ID NO: 409120 - DNA, 19 bp, Homo sapiens
caaagcacagtgttaaatg

SEQ ID NO: 409121 - DNA, 18 bp, Homo sapiens
caaagcacattgaaagag

SEQ ID NO: 409122 - DNA, 17 bp, Homo sapiens
caaagcaccttgaatgg

SEQ ID NO: 409123 - DNA, 21 bp, Homo sapiens
caaagcacttggactcttgct

SEQ ID NO: 409124 - DNA, 12 bp, Homo sapiens
caaagcaggagt

SEQ ID NO: 409125 - DNA, 15 bp, Homo sapiens
caaagcaggagtgga

SEQ ID NO: 409126 - DNA, 17 bp, Homo sapiens
caaagcagtgcatgctg

SEQ ID NO: 409127 - DNA, 18 bp, Homo sapiens
caaagcagtgcatgctgt

SEQ ID NO: 409128 - DNA, 18 bp, Homo sapiens
caaagcatgctcagtatt

SEQ ID NO: 409129 - DNA, 19 bp, Homo sapiens
caaagcatgctcagtattg

SEQ ID NO: 409130 - DNA, 19 bp, Homo sapiens
caaagccacaaggctggcc

SEQ ID NO: 409131 - DNA, 21 bp, Homo sapiens
caaagccacaaggctggccag

SEQ ID NO: 409132 - DNA, 13 bp, Homo sapiens
caaagcccagccc

SEQ ID NO: 409133 - DNA, 19 bp, Homo sapiens
caaagcccagcccggctga

SEQ ID NO: 409134 - DNA, 18 bp, Homo sapiens
caaagcccttccatgtcg

SEQ ID NO: 409135 - DNA, 13 bp, Homo sapiens
caaagcctgggca

SEQ ID NO: 409136 - DNA, 16 bp, Homo sapiens
caaagcggggggaggg

SEQ ID NO: 409137 - DNA, 16 bp, Homo sapiens
caaagctaggaaaggc

SEQ ID NO: 409138 - DNA, 19 bp, Homo sapiens
caaagctaggaaaggcaga

SEQ ID NO: 409139 - DNA, 18 bp, Homo sapiens
caaagctgacgaggctgg

SEQ ID NO: 409140 - DNA, 19 bp, Homo sapiens
caaagctgatgacaacttc

SEQ ID NO: 409141 - DNA, 21 bp, Homo sapiens
caaagctgatttccctttttt

SEQ ID NO: 409142 - DNA, 23 bp, Homo sapiens
caaagctgatttcccttttttct

SEQ ID NO: 409143 - DNA, 17 bp, Homo sapiens
caaagctggctttttgt

SEQ ID NO: 409144 - DNA, 21 bp, Homo sapiens
caaagcttctatcccaggagg

SEQ ID NO: 409145 - DNA, 14 bp, Homo sapiens
caaagctttcctgc

SEQ ID NO: 409146 - DNA, 16 bp, Homo sapiens
caaagctttcctggag

SEQ ID NO: 409147 - DNA, 14 bp, Homo sapiens
caaagctttttgaa

SEQ ID NO: 409148 - DNA, 18 bp, Homo sapiens
caaaggaagtagcaggcc

SEQ ID NO: 409149 - DNA, 17 bp, Homo sapiens
caaaggactgacctgcc

SEQ ID NO: 409150 - DNA, 21 bp, Homo sapiens
caaaggagacaaagcaggagt

SEQ ID NO: 409151 - DNA, 20 bp, Homo sapiens
caaaggagagtcacagaaca

SEQ ID NO: 409152 - DNA, 23 bp, Homo sapiens
caaaggagggcctcagagacagc

SEQ ID NO: 409153 - DNA, 14 bp, Homo sapiens
caaaggatgaagaa

SEQ ID NO: 409154 - DNA, 21 bp, Homo sapiens
caaaggatgaagaacacagca

SEQ ID NO: 409155 - DNA, 20 bp, Homo sapiens
caaaggattttggaaaagaa

SEQ ID NO: 409156 - DNA, 15 bp, Homo sapiens
caaaggcagaaagga

SEQ ID NO: 409157 - DNA, 16 bp, Homo sapiens
caaaggcagaaaggag

SEQ ID NO: 409158 - DNA, 20 bp, Homo sapiens
caaaggcaggaggtgggtga

SEQ ID NO: 409159 - DNA, 15 bp, Homo sapiens
caaagggaaatatca

SEQ ID NO: 409160 - DNA, 18 bp, Homo sapiens
caaagggaaatatcattt

SEQ ID NO: 409161 - DNA, 18 bp, Homo sapiens
caaagggccaaatagagt

SEQ ID NO: 409162 - DNA, 15 bp, Homo sapiens
caaaggggctgctgg

SEQ ID NO: 409163 - DNA, 16 bp, Homo sapiens
caaaggggctgctggg

SEQ ID NO: 409164 - DNA, 19 bp, Homo sapiens
caaaggggctgctggggca

SEQ ID NO: 409165 - DNA, 16 bp, Homo sapiens
caaaggtgattttcct

SEQ ID NO: 409166 - DNA, 18 bp, Homo sapiens
caaaggtgattttcctgt

SEQ ID NO: 409167 - DNA, 14 bp, Homo sapiens
caaagtaaaaataa

SEQ ID NO: 409168 - DNA, 23 bp, Homo sapiens
caaagtaaaaataaactgttatg

SEQ ID NO: 409169 - DNA, 22 bp, Homo sapiens
caaagtaacctgggcttaagtt

SEQ ID NO: 409170 - DNA, 23 bp, Homo sapiens
caaagtaacctgggcttaagttt

SEQ ID NO: 409171 - DNA, 19 bp, Homo sapiens
caaagtaccaactgagcca

SEQ ID NO: 409172 - DNA, 21 bp, Homo sapiens
caaagtaccaactgagccaaa

SEQ ID NO: 409173 - DNA, 14 bp, Homo sapiens
caaagtagagaagt

SEQ ID NO: 409174 - DNA, 15 bp, Homo sapiens
caaagtagagaagta

SEQ ID NO: 409175 - DNA, 18 bp, Homo sapiens
caaagtaggtatacaaaa

SEQ ID NO: 409176 - DNA, 19 bp, Homo sapiens
caaagtcagtaggagagga

SEQ ID NO: 409177 - DNA, 16 bp, Homo sapiens
caaagtctaaagttta

SEQ ID NO: 409178 - DNA, 19 bp, Homo sapiens
caaagtctaaagtttacag

SEQ ID NO: 409179 - DNA, 21 bp, Homo sapiens
caaagtgcagcccttcctcct

SEQ ID NO: 409180 - DNA, 11 bp, Homo sapiens
caaagtgctgg

SEQ ID NO: 409181 - DNA, 15 bp, Homo sapiens
caaagtggggaggga

SEQ ID NO: 409182 - DNA, 23 bp, Homo sapiens
caaagtggtacaggaaggcttgc

SEQ ID NO: 409183 - DNA, 11 bp, Homo sapiens
caaagtgttaa

SEQ ID NO: 409184 - DNA, 21 bp, Homo sapiens
caaagtgttttctcagaacag

SEQ ID NO: 409185 - DNA, 17 bp, Homo sapiens
caaagttaacctacctg

SEQ ID NO: 409186 - DNA, 21 bp, Homo sapiens
caaagttaacctacctgtaac

SEQ ID NO: 409187 - DNA, 20 bp, Homo sapiens
caaagttccctacttcctgt

SEQ ID NO: 409188 - DNA, 15 bp, Homo sapiens
caaagttttcagatt

SEQ ID NO: 409189 - DNA, 19 bp, Homo sapiens
caaagtttttacagtgtat

SEQ ID NO: 409190 - DNA, 21 bp, Homo sapiens
caaagtttttacagtgtatct

SEQ ID NO: 409191 - DNA, 23 bp, Homo sapiens
caaataaaacataatagaatttc

SEQ ID NO: 409192 - DNA, 12 bp, Homo sapiens
caaataaaatga

SEQ ID NO: 409193 - DNA, 14 bp, Homo sapiens
caaataaaattggc

SEQ ID NO: 409194 - DNA, 18 bp, Homo sapiens
caaataaaccttgtttct

SEQ ID NO: 409195 - DNA, 13 bp, Homo sapiens
caaataagactct

SEQ ID NO: 409196 - DNA, 22 bp, Homo sapiens
caaataagtaatatctttcagt

SEQ ID NO: 409197 - DNA, 13 bp, Homo sapiens
caaataatcacat

SEQ ID NO: 409198 - DNA, 14 bp, Homo sapiens
caaatactcttagg

SEQ ID NO: 409199 - DNA, 13 bp, Homo sapiens
caaatagaaaaca

SEQ ID NO: 409200 - DNA, 11 bp, Homo sapiens
caacagaggcc

SEQ ID NO: 409201 - DNA, 15 bp, Homo sapiens
caacagcaacaacaa

SEQ ID NO: 409202 - DNA, 16 bp, Homo sapiens
caacagcaacaacaac

SEQ ID NO: 409203 - DNA, 22 bp, Homo sapiens
caacagcactggctctctccag

SEQ ID NO: 409204 - DNA, 14 bp, Homo sapiens
caacagccaagacc

SEQ ID NO: 409205 - DNA, 16 bp, Homo sapiens
caacagcttcttgctt

SEQ ID NO: 409206 - DNA, 15 bp, Homo sapiens
caacaggaccaggag

SEQ ID NO: 409207 - DNA, 17 bp, Homo sapiens
caacaggaccaggagcc

SEQ ID NO: 409208 - DNA, 22 bp, Homo sapiens
caacagtacctgaaggattatt

SEQ ID NO: 409209 - DNA, 16 bp, Homo sapiens
caacagtcagccagct

SEQ ID NO: 409210 - DNA, 13 bp, Homo sapiens
caacataaaacaa

SEQ ID NO: 409211 - DNA, 17 bp, Homo sapiens
caacataaaacaaaacc

SEQ ID NO: 409212 - DNA, 21 bp, Homo sapiens
caacataaaacaaaaccaagc

SEQ ID NO: 409213 - DNA, 15 bp, Homo sapiens
caacatcaagaaaac

SEQ ID NO: 409214 - DNA, 17 bp, Homo sapiens
caacatcaatgttcatt

SEQ ID NO: 409215 - DNA, 18 bp, Homo sapiens
caacatcaatgttcattg

SEQ ID NO: 409216 - DNA, 14 bp, Homo sapiens
caacatcagcttga

SEQ ID NO: 409217 - DNA, 19 bp, Homo sapiens
caacatctcgagccccctg

SEQ ID NO: 409218 - DNA, 15 bp, Homo sapiens
caacatctttttcct

SEQ ID NO: 409219 - DNA, 23 bp, Homo sapiens
caacatctttttcctccctttcc

SEQ ID NO: 409220 - DNA, 22 bp, Homo sapiens
caacattgccttgcatttgtac

SEQ ID NO: 409221 - DNA, 23 bp, Homo sapiens
caacatttctgccaggtttgtta

SEQ ID NO: 409222 - DNA, 12 bp, Homo sapiens
caacattttatt

SEQ ID NO: 409223 - DNA, 20 bp, Homo sapiens
caaccaagtcatgtgcattt

SEQ ID NO: 409224 - DNA, 22 bp, Homo sapiens
caaccaatgcacacagtagggc

SEQ ID NO: 409225 - DNA, 19 bp, Homo sapiens
caaccaccgctccccagcc

SEQ ID NO: 409226 - DNA, 22 bp, Homo sapiens
caaccaccgctccccagcccag

SEQ ID NO: 409227 - DNA, 22 bp, Homo sapiens
caaccactaatttgtcactgga

SEQ ID NO: 409228 - DNA, 22 bp, Homo sapiens
caaccactggtctgtagggatt

SEQ ID NO: 409229 - DNA, 19 bp, Homo sapiens
caaccactgtaaaatgaaa

SEQ ID NO: 409230 - DNA, 11 bp, Homo sapiens
caaccagagcc

SEQ ID NO: 409231 - DNA, 13 bp, Homo sapiens
caaccagagcccc

SEQ ID NO: 409232 - DNA, 21 bp, Homo sapiens
caaccagataaagaactaaat

SEQ ID NO: 409233 - DNA, 12 bp, Homo sapiens
caaccaggaaga

SEQ ID NO: 409234 - DNA, 12 bp, Homo sapiens
caaccaggaggg

SEQ ID NO: 409235 - DNA, 18 bp, Homo sapiens
caaccaggaggggtctgc

SEQ ID NO: 409236 - DNA, 20 bp, Homo sapiens
caaccaggaggggtctgcct

SEQ ID NO: 409237 - DNA, 22 bp, Homo sapiens
caaccaggcagtagatgtgctt

SEQ ID NO: 409238 - DNA, 20 bp, Homo sapiens
caaccattttttgttctgtg

SEQ ID NO: 409239 - DNA, 21 bp, Homo sapiens
caacccaactgacttctgcta

SEQ ID NO: 409240 - DNA, 22 bp, Homo sapiens
caacccaactgacttctgctag

SEQ ID NO: 409241 - DNA, 13 bp, Homo sapiens
caacccatgcatg

SEQ ID NO: 409242 - DNA, 19 bp, Homo sapiens
caacccatgcatggcctcc

SEQ ID NO: 409243 - DNA, 15 bp, Homo sapiens
caacccatgccctgc

SEQ ID NO: 409244 - DNA, 22 bp, Homo sapiens
caacccattaatcttttgtagt

SEQ ID NO: 409245 - DNA, 14 bp, Homo sapiens
caacccccacccca

SEQ ID NO: 409246 - DNA, 17 bp, Homo sapiens
caacccccacctcccgg

SEQ ID NO: 409247 - DNA, 13 bp, Homo sapiens
caacccccctccc

SEQ ID NO: 409248 - DNA, 19 bp, Homo sapiens
caaccccctcggagcctgt

SEQ ID NO: 409249 - DNA, 12 bp, Homo sapiens
caacccctgtac

SEQ ID NO: 409250 - DNA, 20 bp, Homo sapiens
caacccctgtacccagctcc

SEQ ID NO: 409251 - DNA, 21 bp, Homo sapiens
caacccctgtggagcccgcac

SEQ ID NO: 409252 - DNA, 22 bp, Homo sapiens
caacccctgtggagcccgcacc

SEQ ID NO: 409253 - DNA, 21 bp, Homo sapiens
caaccctcagagccaccccta

SEQ ID NO: 409254 - DNA, 20 bp, Homo sapiens
caaccctccctcagcccctc

SEQ ID NO: 409255 - DNA, 22 bp, Homo sapiens
caaccctcctatcacctcccct

SEQ ID NO: 409256 - DNA, 16 bp, Homo sapiens
caaccctgcccctgcc

SEQ ID NO: 409257 - DNA, 16 bp, Homo sapiens
caaccctgccctgcac

SEQ ID NO: 409258 - DNA, 15 bp, Homo sapiens
caacccttacccctt

SEQ ID NO: 409259 - DNA, 21 bp, Homo sapiens
caaccgatgctccagccaacc

SEQ ID NO: 409260 - DNA, 18 bp, Homo sapiens
caaccgcatctgctcatc

SEQ ID NO: 409261 - DNA, 17 bp, Homo sapiens
caaccgggaaaggcatc

SEQ ID NO: 409262 - DNA, 20 bp, Homo sapiens
caaccggggagcccccgccc

SEQ ID NO: 409263 - DNA, 14 bp, Homo sapiens
caacctcaatgccc

SEQ ID NO: 409264 - DNA, 16 bp, Homo sapiens
caacctcaatgccctg

SEQ ID NO: 409265 - DNA, 16 bp, Homo sapiens
caacctcactgccctc

SEQ ID NO: 409266 - DNA, 21 bp, Homo sapiens
caacctcactgccctccctcg

SEQ ID NO: 409267 - DNA, 11 bp, Homo sapiens
caacctcagca

SEQ ID NO: 409268 - DNA, 14 bp, Homo sapiens
caacctcagcaacc

SEQ ID NO: 409269 - DNA, 19 bp, Homo sapiens
caacctccaccttccaggc

SEQ ID NO: 409270 - DNA, 16 bp, Homo sapiens
caacctctcagatccc

SEQ ID NO: 409271 - DNA, 14 bp, Homo sapiens
caacctctgcctcc

SEQ ID NO: 409272 - DNA, 15 bp, Homo sapiens
caacctctttcctct

SEQ ID NO: 409273 - DNA, 19 bp, Homo sapiens
caacctgatgccccttccc

SEQ ID NO: 409274 - DNA, 23 bp, Homo sapiens
caacctgatgccccttccccaag

SEQ ID NO: 409275 - DNA, 16 bp, Homo sapiens
caacctgccacaatgt

SEQ ID NO: 409276 - DNA, 14 bp, Homo sapiens
caacctgcctgtgc

SEQ ID NO: 409277 - DNA, 18 bp, Homo sapiens
caacctgctctcctcttg

SEQ ID NO: 409278 - DNA, 16 bp, Homo sapiens
caacctgtaaattatt

SEQ ID NO: 409279 - DNA, 13 bp, Homo sapiens
caacctgtaactg

SEQ ID NO: 409280 - DNA, 15 bp, Homo sapiens
caacctgtaactgcc

SEQ ID NO: 409281 - DNA, 16 bp, Homo sapiens
caacctgtaactgccc

SEQ ID NO: 409282 - DNA, 15 bp, Homo sapiens
caacctgtaagactg

SEQ ID NO: 409283 - DNA, 20 bp, Homo sapiens
caaccttaaagcaataagtt

SEQ ID NO: 409284 - DNA, 22 bp, Homo sapiens
caaccttaaagcaataagttca

SEQ ID NO: 409285 - DNA, 19 bp, Homo sapiens
caaccttctgtggctcaca

SEQ ID NO: 409286 - DNA, 22 bp, Homo sapiens
caacctttcccatttcgtgtaa

SEQ ID NO: 409287 - DNA, 16 bp, Homo sapiens
caacctttgtgtaata

SEQ ID NO: 409288 - DNA, 18 bp, Homo sapiens
caacctttgtgtaataaa

SEQ ID NO: 409289 - DNA, 18 bp, Homo sapiens
caacgaaaagcacatcca

SEQ ID NO: 409290 - DNA, 15 bp, Homo sapiens
caacgactactttgc

SEQ ID NO: 409291 - DNA, 18 bp, Homo sapiens
caacgactactttgctac

SEQ ID NO: 409292 - DNA, 16 bp, Homo sapiens
caacgcctgccttctg

SEQ ID NO: 409293 - DNA, 17 bp, Homo sapiens
caacgggaagcaacctc

SEQ ID NO: 409294 - DNA, 15 bp, Homo sapiens
caacgggtctgtggg

SEQ ID NO: 409295 - DNA, 21 bp, Homo sapiens
caactaaagaatagtgcctca

SEQ ID NO: 409296 - DNA, 22 bp, Homo sapiens
caactaaagaatagtgcctcag

SEQ ID NO: 409297 - DNA, 23 bp, Homo sapiens
caactaaagaatagtgcctcagc

SEQ ID NO: 409298 - DNA, 12 bp, Homo sapiens
caactaaataac

SEQ ID NO: 409299 - DNA, 13 bp, Homo sapiens
caactaacaagaa

SEQ ID NO: 409300 - DNA, 14 bp, Homo sapiens
caactaacaatgcc

SEQ ID NO: 409301 - DNA, 13 bp, Homo sapiens
caactaattataa

SEQ ID NO: 409302 - DNA, 13 bp, Homo sapiens
caactagccaagg

SEQ ID NO: 409303 - DNA, 16 bp, Homo sapiens
caactagtggagagaa

SEQ ID NO: 409304 - DNA, 19 bp, Homo sapiens
caactataagcccactgtt

SEQ ID NO: 409305 - DNA, 13 bp, Homo sapiens
caactatttataa

SEQ ID NO: 409306 - DNA, 17 bp, Homo sapiens
caactcactcttatgaa

SEQ ID NO: 409307 - DNA, 20 bp, Homo sapiens
caactcactcttatgaaatg

SEQ ID NO: 409308 - DNA, 14 bp, Homo sapiens
caactcactgtgct

SEQ ID NO: 409309 - DNA, 16 bp, Homo sapiens
caactcactgtgctcc

SEQ ID NO: 409310 - DNA, 12 bp, Homo sapiens
caactccaaggc

SEQ ID NO: 409311 - DNA, 19 bp, Homo sapiens
caactccaaggcaaatgtc

SEQ ID NO: 409312 - DNA, 19 bp, Homo sapiens
caactccaggaaaactgtt

SEQ ID NO: 409313 - DNA, 18 bp, Homo sapiens
caactccaggacttgctt

SEQ ID NO: 409314 - DNA, 13 bp, Homo sapiens
caactccaggggc

SEQ ID NO: 409315 - DNA, 18 bp, Homo sapiens
caactccatgaccaggcc

SEQ ID NO: 409316 - DNA, 21 bp, Homo sapiens
caactccatggggttcgagac

SEQ ID NO: 409317 - DNA, 21 bp, Homo sapiens
caactcccagccaccaccact

SEQ ID NO: 409318 - DNA, 19 bp, Homo sapiens
caactccgcccagcctctc

SEQ ID NO: 409319 - DNA, 14 bp, Homo sapiens
caactccttcctct

SEQ ID NO: 409320 - DNA, 15 bp, Homo sapiens
caactccttcctctt

SEQ ID NO: 409321 - DNA, 20 bp, Homo sapiens
caactcgggagcattctgcc

SEQ ID NO: 409322 - DNA, 15 bp, Homo sapiens
caactctacccctgc

SEQ ID NO: 409323 - DNA, 16 bp, Homo sapiens
caactctacccctgct

SEQ ID NO: 409324 - DNA, 15 bp, Homo sapiens
caactctccactcca

SEQ ID NO: 409325 - DNA, 11 bp, Homo sapiens
caactctcccc

SEQ ID NO: 409326 - DNA, 18 bp, Homo sapiens
caactctccccagtgcct

SEQ ID NO: 409327 - DNA, 21 bp, Homo sapiens
caactctccccagtgcctgcc

SEQ ID NO: 409328 - DNA, 12 bp, Homo sapiens
caactctctcct

SEQ ID NO: 409329 - DNA, 15 bp, Homo sapiens
caactctctcctgta

SEQ ID NO: 409330 - DNA, 17 bp, Homo sapiens
caactctgcactccatg

SEQ ID NO: 409331 - DNA, 19 bp, Homo sapiens
caactctgcactccatggc

SEQ ID NO: 409332 - DNA, 16 bp, Homo sapiens
caactgaacaaaaaaa

SEQ ID NO: 409333 - DNA, 17 bp, Homo sapiens
caactgaacaaaaaaat

SEQ ID NO: 409334 - DNA, 16 bp, Homo sapiens
caactgcatccaggcc

SEQ ID NO: 409335 - DNA, 11 bp, Homo sapiens
caactgcctta

SEQ ID NO: 409336 - DNA, 22 bp, Homo sapiens
caactggactatagcagggctg

SEQ ID NO: 409337 - DNA, 18 bp, Homo sapiens
caactgttagctgggaag

SEQ ID NO: 409338 - DNA, 19 bp, Homo sapiens
caactgttgattgcaggaa

SEQ ID NO: 409339 - DNA, 15 bp, Homo sapiens
caactgtttttgaag

SEQ ID NO: 409340 - DNA, 15 bp, Homo sapiens
caacttaaaaagtct

SEQ ID NO: 409341 - DNA, 15 bp, Homo sapiens
caacttaaatcactg

SEQ ID NO: 409342 - DNA, 17 bp, Homo sapiens
caacttacatatgtctt

SEQ ID NO: 409343 - DNA, 16 bp, Homo sapiens
caacttactaaatcta

SEQ ID NO: 409344 - DNA, 16 bp, Homo sapiens
caacttcaccaccccc

SEQ ID NO: 409345 - DNA, 14 bp, Homo sapiens
caacttcagtcctg

SEQ ID NO: 409346 - DNA, 14 bp, Homo sapiens
caacttctaattgc

SEQ ID NO: 409347 - DNA, 14 bp, Homo sapiens
caacttctggctcc

SEQ ID NO: 409348 - DNA, 15 bp, Homo sapiens
caacttgaattacaa

SEQ ID NO: 409349 - DNA, 18 bp, Homo sapiens
caacttggttctgcttca

SEQ ID NO: 409350 - DNA, 23 bp, Homo sapiens
caacttgtattaaagacagaggc

SEQ ID NO: 409351 - DNA, 16 bp, Homo sapiens
caactttccaactttt

SEQ ID NO: 409352 - DNA, 14 bp, Homo sapiens
caactttccagact

SEQ ID NO: 409353 - DNA, 12 bp, Homo sapiens
caactttctgta

SEQ ID NO: 409354 - DNA, 23 bp, Homo sapiens
caactttctgtaaactcaaaact

SEQ ID NO: 409355 - DNA, 18 bp, Homo sapiens
caactttggaatttgaag

SEQ ID NO: 409356 - DNA, 18 bp, Homo sapiens
caacttttgaaatttaaa

SEQ ID NO: 409357 - DNA, 12 bp, Homo sapiens
caagaaaacata

SEQ ID NO: 409358 - DNA, 19 bp, Homo sapiens
caagaaaccaagtgggctg

SEQ ID NO: 409359 - DNA, 23 bp, Homo sapiens
caagaaacctccatcctgccagg

SEQ ID NO: 409360 - DNA, 12 bp, Homo sapiens
caagaaagaaac

SEQ ID NO: 409361 - DNA, 22 bp, Homo sapiens
caagaaagatatctatgactgt

SEQ ID NO: 409362 - DNA, 16 bp, Homo sapiens
caagaaattcattaaa

SEQ ID NO: 409363 - DNA, 17 bp, Homo sapiens
caagaaattcattaaag

SEQ ID NO: 409364 - DNA, 14 bp, Homo sapiens
caagaacagcaggc

SEQ ID NO: 409365 - DNA, 15 bp, Homo sapiens
caagaactgaaaaca

SEQ ID NO: 409366 - DNA, 17 bp, Homo sapiens
caagaactgaaaacata

SEQ ID NO: 409367 - DNA, 21 bp, Homo sapiens
caagaactgaaaacataaaaa

SEQ ID NO: 409368 - DNA, 18 bp, Homo sapiens
caagaagattctaaaaca

SEQ ID NO: 409369 - DNA, 13 bp, Homo sapiens
caagaagccctcc

SEQ ID NO: 409370 - DNA, 17 bp, Homo sapiens
caagaagccctccttgc

SEQ ID NO: 409371 - DNA, 12 bp, Homo sapiens
caagaagctgct

SEQ ID NO: 409372 - DNA, 12 bp, Homo sapiens
caagaaggctgg

SEQ ID NO: 409373 - DNA, 14 bp, Homo sapiens
caagaaggctgggg

SEQ ID NO: 409374 - DNA, 16 bp, Homo sapiens
caagaaggtgagtgct

SEQ ID NO: 409375 - DNA, 18 bp, Homo sapiens
caagaagtgaggcctggg

SEQ ID NO: 409376 - DNA, 14 bp, Homo sapiens
caagaagtgggagt

SEQ ID NO: 409377 - DNA, 22 bp, Homo sapiens
caagaagtgggagtgggagagg

SEQ ID NO: 409378 - DNA, 17 bp, Homo sapiens
caagaatacagaaaatg

SEQ ID NO: 409379 - DNA, 19 bp, Homo sapiens
caagaatggaattttctga

SEQ ID NO: 409380 - DNA, 18 bp, Homo sapiens
caagacagagacgcagga

SEQ ID NO: 409381 - DNA, 21 bp, Homo sapiens
caagacagagacgcaggaatg

SEQ ID NO: 409382 - DNA, 14 bp, Homo sapiens
caagacagtggcag

SEQ ID NO: 409383 - DNA, 15 bp, Homo sapiens
caagacagtggcagc

SEQ ID NO: 409384 - DNA, 21 bp, Homo sapiens
caagacagtggcagcaaagga

SEQ ID NO: 409385 - DNA, 14 bp, Homo sapiens
caagacataatgca

SEQ ID NO: 409386 - DNA, 11 bp, Homo sapiens
caagacattgt

SEQ ID NO: 409387 - DNA, 14 bp, Homo sapiens
caagacctgactca

SEQ ID NO: 409388 - DNA, 22 bp, Homo sapiens
caagacctgttggttagctgga

SEQ ID NO: 409389 - DNA, 15 bp, Homo sapiens
caagacgtcctggaa

SEQ ID NO: 409390 - DNA, 13 bp, Homo sapiens
caagactaacctt

SEQ ID NO: 409391 - DNA, 18 bp, Homo sapiens
caagactgttgctcaaat

SEQ ID NO: 409392 - DNA, 18 bp, Homo sapiens
caagacttgaaggtgcct

SEQ ID NO: 409393 - DNA, 12 bp, Homo sapiens
caagagaaatga

SEQ ID NO: 409394 - DNA, 19 bp, Homo sapiens
caagagaaatgaggaagaa

SEQ ID NO: 409395 - DNA, 19 bp, Homo sapiens
caagagaaggagatgtaat

SEQ ID NO: 409396 - DNA, 15 bp, Homo sapiens
caagagaattcactt

SEQ ID NO: 409397 - DNA, 16 bp, Homo sapiens
caagagcagagtctgg

SEQ ID NO: 409398 - DNA, 17 bp, Homo sapiens
caagagcagagtctggg

SEQ ID NO: 409399 - DNA, 16 bp, Homo sapiens
caagagcagcctgtgg

SEQ ID NO: 409400 - DNA, 17 bp, Homo sapiens
caagagccatgtaccag

SEQ ID NO: 409401 - DNA, 22 bp, Homo sapiens
caagagctcaggagaaggcctg

SEQ ID NO: 409402 - DNA, 13 bp, Homo sapiens
caagagctccttg

SEQ ID NO: 409403 - DNA, 17 bp, Homo sapiens
caagaggctagccccag

SEQ ID NO: 409404 - DNA, 23 bp, Homo sapiens
caagagggactgtatttctgtgg

SEQ ID NO: 409405 - DNA, 13 bp, Homo sapiens
caagagggcactg

SEQ ID NO: 409406 - DNA, 17 bp, Homo sapiens
caagagggcactggtgg

SEQ ID NO: 409407 - DNA, 14 bp, Homo sapiens
caagagtaaatatt

SEQ ID NO: 409408 - DNA, 12 bp, Homo sapiens
caagagtacagg

SEQ ID NO: 409409 - DNA, 20 bp, Homo sapiens
caagagtacaggtcttcttt

SEQ ID NO: 409410 - DNA, 20 bp, Homo sapiens
caagagtggtggcagctcaa

SEQ ID NO: 409411 - DNA, 23 bp, Homo sapiens
caagataaacacaatttcttcat

SEQ ID NO: 409412 - DNA, 15 bp, Homo sapiens
caagatacacttgta

SEQ ID NO: 409413 - DNA, 17 bp, Homo sapiens
caagatagatttggaat

SEQ ID NO: 409414 - DNA, 18 bp, Homo sapiens
caagatagatttggaata

SEQ ID NO: 409415 - DNA, 22 bp, Homo sapiens
caagatagctccttcatgcttt

SEQ ID NO: 409416 - DNA, 18 bp, Homo sapiens
caagatcacaaatagtgt

SEQ ID NO: 409417 - DNA, 21 bp, Homo sapiens
caagatgagattggcatggct

SEQ ID NO: 409418 - DNA, 21 bp, Homo sapiens
caagatgccaaggaggtccca

SEQ ID NO: 409419 - DNA, 20 bp, Homo sapiens
caagatgccatctgtgtcct

SEQ ID NO: 409420 - DNA, 20 bp, Homo sapiens
caagattcccggctggactt

SEQ ID NO: 409421 - DNA, 19 bp, Homo sapiens
caagattggaaagacagga

SEQ ID NO: 409422 - DNA, 22 bp, Homo sapiens
caagattggaaagacaggaaga

SEQ ID NO: 409423 - DNA, 15 bp, Homo sapiens
caagatttagaaaaa

SEQ ID NO: 409424 - DNA, 16 bp, Homo sapiens
caagatttagaaaaaa

SEQ ID NO: 409425 - DNA, 18 bp, Homo sapiens
caagatttccctaaaaat

SEQ ID NO: 409426 - DNA, 22 bp, Homo sapiens
caagcaagctctcttgccgagg

SEQ ID NO: 409427 - DNA, 18 bp, Homo sapiens
caagcacctagcctcgct

SEQ ID NO: 409428 - DNA, 16 bp, Homo sapiens
caagcactaaaaagtg

SEQ ID NO: 409429 - DNA, 16 bp, Homo sapiens
caagcagccagccagt

SEQ ID NO: 409430 - DNA, 17 bp, Homo sapiens
caagcagccagccagtc

SEQ ID NO: 409431 - DNA, 22 bp, Homo sapiens
caagcagccagccagtcttgcc

SEQ ID NO: 409432 - DNA, 17 bp, Homo sapiens
caagcagggaaagctcc

SEQ ID NO: 409433 - DNA, 19 bp, Homo sapiens
caagcagggaaagctccac

SEQ ID NO: 409434 - DNA, 14 bp, Homo sapiens
caagcatgccccac

SEQ ID NO: 409435 - DNA, 15 bp, Homo sapiens
caagcattccttagc

SEQ ID NO: 409436 - DNA, 15 bp, Homo sapiens
caagccaaacattct

SEQ ID NO: 409437 - DNA, 19 bp, Homo sapiens
caagccaaacattcttatt

SEQ ID NO: 409438 - DNA, 21 bp, Homo sapiens
caagccaaacattcttatttt

SEQ ID NO: 409439 - DNA, 21 bp, Homo sapiens
caagccaacttgtaaatacac

SEQ ID NO: 409440 - DNA, 18 bp, Homo sapiens
caagccacagaaatgtgt

SEQ ID NO: 409441 - DNA, 14 bp, Homo sapiens
caagccaggagacc

SEQ ID NO: 409442 - DNA, 19 bp, Homo sapiens
caagccaggagaccctgtc

SEQ ID NO: 409443 - DNA, 20 bp, Homo sapiens
caagccaggagaccctgtct

SEQ ID NO: 409444 - DNA, 19 bp, Homo sapiens
caagccagggttccagaca

SEQ ID NO: 409445 - DNA, 23 bp, Homo sapiens
caagccataaaccaataaaacaa

SEQ ID NO: 409446 - DNA, 14 bp, Homo sapiens
caagccatcacagg

SEQ ID NO: 409447 - DNA, 22 bp, Homo sapiens
caagccatcttcccgcctcagc

SEQ ID NO: 409448 - DNA, 19 bp, Homo sapiens
caagcccactggccagctc

SEQ ID NO: 409449 - DNA, 13 bp, Homo sapiens
caagccccaggca

SEQ ID NO: 409450 - DNA, 15 bp, Homo sapiens
caagccccaggcagg

SEQ ID NO: 409451 - DNA, 18 bp, Homo sapiens
caagccccaggcaggctg

SEQ ID NO: 409452 - DNA, 19 bp, Homo sapiens
caagccccagggcctgggg

SEQ ID NO: 409453 - DNA, 12 bp, Homo sapiens
caagcccctgtc

SEQ ID NO: 409454 - DNA, 22 bp, Homo sapiens
caagccctgcccctcctgtaca

SEQ ID NO: 409455 - DNA, 12 bp, Homo sapiens
caagccctggca

SEQ ID NO: 409456 - DNA, 14 bp, Homo sapiens
caagcctcttctga

SEQ ID NO: 409457 - DNA, 15 bp, Homo sapiens
caagcctcttctgaa

SEQ ID NO: 409458 - DNA, 12 bp, Homo sapiens
caagcctgcagc

SEQ ID NO: 409459 - DNA, 15 bp, Homo sapiens
caagcctgcctccca

SEQ ID NO: 409460 - DNA, 17 bp, Homo sapiens
caagtccatagctgagc

SEQ ID NO: 409461 - DNA, 21 bp, Homo sapiens
caagtccatagctgagctgga

SEQ ID NO: 409462 - DNA, 22 bp, Homo sapiens
caagtcccaccggttgcttctg

SEQ ID NO: 409463 - DNA, 23 bp, Homo sapiens
caagtcccaccggttgcttctgg

SEQ ID NO: 409464 - DNA, 18 bp, Homo sapiens
caagtcccagacaaggag

SEQ ID NO: 409465 - DNA, 14 bp, Homo sapiens
caagtcccgaggca

SEQ ID NO: 409466 - DNA, 15 bp, Homo sapiens
caagtcccgaggcag

SEQ ID NO: 409467 - DNA, 14 bp, Homo sapiens
caagtcccttgacc

SEQ ID NO: 409468 - DNA, 22 bp, Homo sapiens
caagtcccttgacctttccagc

SEQ ID NO: 409469 - DNA, 15 bp, Homo sapiens
caagtcctggctaca

SEQ ID NO: 409470 - DNA, 17 bp, Homo sapiens
caagtcctgtgaatttc

SEQ ID NO: 409471 - DNA, 23 bp, Homo sapiens
caagtccttacctcttccggaga

SEQ ID NO: 409472 - DNA, 15 bp, Homo sapiens
caagtcgccaggcag

SEQ ID NO: 409473 - DNA, 14 bp, Homo sapiens
caagtctctctgtg

SEQ ID NO: 409474 - DNA, 16 bp, Homo sapiens
caagtctctctgtgaa

SEQ ID NO: 409475 - DNA, 11 bp, Homo sapiens
caagtctgtga

SEQ ID NO: 409476 - DNA, 16 bp, Homo sapiens
caagtctgtgcctgga

SEQ ID NO: 409477 - DNA, 17 bp, Homo sapiens
caagtctgtgcctggag

SEQ ID NO: 409478 - DNA, 20 bp, Homo sapiens
caagtgagcaaacctgcccc

SEQ ID NO: 409479 - DNA, 21 bp, Homo sapiens
caagtgaggcaagagaaatga

SEQ ID NO: 409480 - DNA, 12 bp, Homo sapiens
caagtgagtggc

SEQ ID NO: 409481 - DNA, 23 bp, Homo sapiens
caagtgattgacaactgaagaga

SEQ ID NO: 409482 - DNA, 13 bp, Homo sapiens
caagtgcaggctg

SEQ ID NO: 409483 - DNA, 23 bp, Homo sapiens
caagtgccactgcccgagctggt

SEQ ID NO: 409484 - DNA, 17 bp, Homo sapiens
caagtgccttgagctgc

SEQ ID NO: 409485 - DNA, 14 bp, Homo sapiens
caagtgctgaacag

SEQ ID NO: 409486 - DNA, 16 bp, Homo sapiens
caagtggaagccactg

SEQ ID NO: 409487 - DNA, 22 bp, Homo sapiens
caagtggaagccactggaccac

SEQ ID NO: 409488 - DNA, 19 bp, Homo sapiens
caagtggaccttgagacca

SEQ ID NO: 409489 - DNA, 19 bp, Homo sapiens
caagtggcatgtgctgtga

SEQ ID NO: 409490 - DNA, 22 bp, Homo sapiens
caagtgggagatgaaaacctgc

SEQ ID NO: 409491 - DNA, 10 bp, Homo sapiens
caagtgggct

SEQ ID NO: 409492 - DNA, 19 bp, Homo sapiens
caagtgggctggtattctc

SEQ ID NO: 409493 - DNA, 23 bp, Homo sapiens
caagtgggctggtattctctcta

SEQ ID NO: 409494 - DNA, 22 bp, Homo sapiens
caagtggtttccacatgctctg

SEQ ID NO: 409495 - DNA, 12 bp, Homo sapiens
caagtgtacaga

SEQ ID NO: 409496 - DNA, 16 bp, Homo sapiens
caagtgtacagaagaa

SEQ ID NO: 409497 - DNA, 12 bp, Homo sapiens
caagtgtacagt

SEQ ID NO: 409498 - DNA, 21 bp, Homo sapiens
caagtgtagatgtagcattgt

SEQ ID NO: 409499 - DNA, 14 bp, Homo sapiens
caagtgtatatcag

SEQ ID NO: 409500 - DNA, 18 bp, Homo sapiens
caagtgtatatcagaaaa

SEQ ID NO: 409501 - DNA, 17 bp, Homo sapiens
caagtgtctcagtccac

SEQ ID NO: 409502 - DNA, 15 bp, Homo sapiens
caagtgtcttccatc

SEQ ID NO: 409503 - DNA, 21 bp, Homo sapiens
caagtgtgcctgctatccagc

SEQ ID NO: 409504 - DNA, 19 bp, Homo sapiens
caagtgtgctttagcttga

SEQ ID NO: 409505 - DNA, 19 bp, Homo sapiens
caagtgtgtgcacatgtgt

SEQ ID NO: 409506 - DNA, 22 bp, Homo sapiens
caagtgtgtgcacatgtgtgcg

SEQ ID NO: 409507 - DNA, 16 bp, Homo sapiens
caagtgtgtgcatgtg

SEQ ID NO: 409508 - DNA, 20 bp, Homo sapiens
caagtgtgtgcatgtgtgcg

SEQ ID NO: 409509 - DNA, 17 bp, Homo sapiens
caagtgtgtgtgcgtgt

SEQ ID NO: 409510 - DNA, 18 bp, Homo sapiens
caagtgtttctgttctgg

SEQ ID NO: 409511 - DNA, 18 bp, Homo sapiens
caagttaaagtgaataac

SEQ ID NO: 409512 - DNA, 15 bp, Homo sapiens
caagttaacaaggaa

SEQ ID NO: 409513 - DNA, 16 bp, Homo sapiens
caagttaacaaggaat

SEQ ID NO: 409514 - DNA, 13 bp, Homo sapiens
caagttaagattc

SEQ ID NO: 409515 - DNA, 15 bp, Homo sapiens
caagttaagattctt

SEQ ID NO: 409516 - DNA, 22 bp, Homo sapiens
caagttcaaagaaccctagcac

SEQ ID NO: 409517 - DNA, 16 bp, Homo sapiens
caagttcaagactgaa

SEQ ID NO: 409518 - DNA, 17 bp, Homo sapiens
caagttcatagtttctg

SEQ ID NO: 409519 - DNA, 17 bp, Homo sapiens
caagttccgtctcctct

SEQ ID NO: 409520 - DNA, 23 bp, Homo sapiens
caagttccgtctcctctccagcc

SEQ ID NO: 409521 - DNA, 16 bp, Homo sapiens
caagttcttcacctct

SEQ ID NO: 409522 - DNA, 19 bp, Homo sapiens
caagttcttcacctctatc

SEQ ID NO: 409523 - DNA, 17 bp, Homo sapiens
caagttgaagactttgt

SEQ ID NO: 409524 - DNA, 16 bp, Homo sapiens
caagttggctagaaga

SEQ ID NO: 409525 - DNA, 19 bp, Homo sapiens
caagttgtttcaaacagca

SEQ ID NO: 409526 - DNA, 16 bp, Homo sapiens
caagtttcagtaatag

SEQ ID NO: 409527 - DNA, 22 bp, Homo sapiens
caagtttctagctagaaatatg

SEQ ID NO: 409528 - DNA, 13 bp, Homo sapiens
caagttttgtata

SEQ ID NO: 409529 - DNA, 14 bp, Homo sapiens
caagttttgtataa

SEQ ID NO: 409530 - DNA, 15 bp, Homo sapiens
caagtttttctctca

SEQ ID NO: 409531 - DNA, 20 bp, Homo sapiens
caagtttttggtaatgatga

SEQ ID NO: 409532 - DNA, 14 bp, Homo sapiens
caataaaaatcata

SEQ ID NO: 409533 - DNA, 11 bp, Homo sapiens
caataaaagtg

SEQ ID NO: 409534 - DNA, 18 bp, Homo sapiens
caataaaagtgactctca

SEQ ID NO: 409535 - DNA, 21 bp, Homo sapiens
caataaacgaaacacagaact

SEQ ID NO: 409536 - DNA, 13 bp, Homo sapiens
caataaagcacta

SEQ ID NO: 409537 - DNA, 23 bp, Homo sapiens
caataaagctgctgagaatctag

SEQ ID NO: 409538 - DNA, 13 bp, Homo sapiens
caataaagctgga

SEQ ID NO: 409539 - DNA, 14 bp, Homo sapiens
caataaagctggac

SEQ ID NO: 409540 - DNA, 12 bp, Homo sapiens
caataaataata

SEQ ID NO: 409541 - DNA, 22 bp, Homo sapiens
caataaatagatgagtcctgtt

SEQ ID NO: 409542 - DNA, 14 bp, Homo sapiens
caataaatccacac

SEQ ID NO: 409543 - DNA, 15 bp, Homo sapiens
caataaatgtattca

SEQ ID NO: 409544 - DNA, 13 bp, Homo sapiens
caataacactgtc

SEQ ID NO: 409545 - DNA, 16 bp, Homo sapiens
caataactactgtgtt

SEQ ID NO: 409546 - DNA, 18 bp, Homo sapiens
caataactactgtgttcc

SEQ ID NO: 409547 - DNA, 19 bp, Homo sapiens
caataacttcagagaagtc

SEQ ID NO: 409548 - DNA, 21 bp, Homo sapiens
caataagagaactctcctctt

SEQ ID NO: 409549 - DNA, 17 bp, Homo sapiens
caataagcagaggtgga

SEQ ID NO: 409550 - DNA, 13 bp, Homo sapiens
caataagttcatt

SEQ ID NO: 409551 - DNA, 20 bp, Homo sapiens
caataagttcattaaacaga

SEQ ID NO: 409552 - DNA, 21 bp, Homo sapiens
caataagttcattaaacagaa

SEQ ID NO: 409553 - DNA, 21 bp, Homo sapiens
caataagtttgaacctttttt

SEQ ID NO: 409554 - DNA, 19 bp, Homo sapiens
caataataaatatttttgc

SEQ ID NO: 409555 - DNA, 12 bp, Homo sapiens
caataataaatg

SEQ ID NO: 409556 - DNA, 18 bp, Homo sapiens
caataattgtggagagga

SEQ ID NO: 409557 - DNA, 14 bp, Homo sapiens
caatacattaaaat

SEQ ID NO: 409558 - DNA, 23 bp, Homo sapiens
caataccccaagtccacctgcct

SEQ ID NO: 409559 - DNA, 22 bp, Homo sapiens
caatacccctagtatctggctg

SEQ ID NO: 409560 - DNA, 15 bp, Homo sapiens
caatactgagtgcct

SEQ ID NO: 409561 - DNA, 16 bp, Homo sapiens
caatactttgtgtctt

SEQ ID NO: 409562 - DNA, 19 bp, Homo sapiens
caatacttttgtgtattct

SEQ ID NO: 409563 - DNA, 20 bp, Homo sapiens
caatacttttgtgtattctg

SEQ ID NO: 409564 - DNA, 12 bp, Homo sapiens
caatagaactgg

SEQ ID NO: 409565 - DNA, 13 bp, Homo sapiens
caatagacagaaa

SEQ ID NO: 409566 - DNA, 22 bp, Homo sapiens
caatagagactgtagattgctt

SEQ ID NO: 409567 - DNA, 19 bp, Homo sapiens
caatagcagacagtgtttt

SEQ ID NO: 409568 - DNA, 23 bp, Homo sapiens
caatagctttaccctcaggcata

SEQ ID NO: 409569 - DNA, 15 bp, Homo sapiens
caatagggtgcagtt

SEQ ID NO: 409570 - DNA, 23 bp, Homo sapiens
caatagttgctgtccccttccag

SEQ ID NO: 409571 - DNA, 23 bp, Homo sapiens
caatataaagttctacagttaat

SEQ ID NO: 409572 - DNA, 18 bp, Homo sapiens
caatatataataaatggg

SEQ ID NO: 409573 - DNA, 19 bp, Homo sapiens
caatatataataaatggga

SEQ ID NO: 409574 - DNA, 22 bp, Homo sapiens
caatatatgatatataaacctt

SEQ ID NO: 409575 - DNA, 18 bp, Homo sapiens
caatatcattttcctggg

SEQ ID NO: 409576 - DNA, 19 bp, Homo sapiens
caatatgaggggactgcat

SEQ ID NO: 409577 - DNA, 20 bp, Homo sapiens
caatatgaggggactgcatg

SEQ ID NO: 409578 - DNA, 15 bp, Homo sapiens
caatatgcagttctg

SEQ ID NO: 409579 - DNA, 12 bp, Homo sapiens
caatatgcttta

SEQ ID NO: 409580 - DNA, 23 bp, Homo sapiens
caatatgctttacactcattttc

SEQ ID NO: 409581 - DNA, 20 bp, Homo sapiens
caatatggagaggattgctt

SEQ ID NO: 409582 - DNA, 14 bp, Homo sapiens
caatatgggaggaa

SEQ ID NO: 409583 - DNA, 18 bp, Homo sapiens
caatatggtggccctggg

SEQ ID NO: 409584 - DNA, 20 bp, Homo sapiens
caatatggtggccctgggga

SEQ ID NO: 409585 - DNA, 21 bp, Homo sapiens
caatatggtggccctggggaa

SEQ ID NO: 409586 - DNA, 22 bp, Homo sapiens
caatatgtattgtaaacatgtg

SEQ ID NO: 409587 - DNA, 14 bp, Homo sapiens
caatattaaataca

SEQ ID NO: 409588 - DNA, 15 bp, Homo sapiens
caatattaaatacag

SEQ ID NO: 409589 - DNA, 21 bp, Homo sapiens
caatattaaatacagacacta

SEQ ID NO: 409590 - DNA, 18 bp, Homo sapiens
caatattaccatcttaat

SEQ ID NO: 409591 - DNA, 13 bp, Homo sapiens
caatattataatt

SEQ ID NO: 409592 - DNA, 14 bp, Homo sapiens
caatattatactaa

SEQ ID NO: 409593 - DNA, 15 bp, Homo sapiens
caattgtcatttata

SEQ ID NO: 409594 - DNA, 17 bp, Homo sapiens
caattgtcatttataaa

SEQ ID NO: 409595 - DNA, 18 bp, Homo sapiens
caattgtgtctgtggtcc

SEQ ID NO: 409596 - DNA, 17 bp, Homo sapiens
caattgtgtggtcagtg

SEQ ID NO: 409597 - DNA, 21 bp, Homo sapiens
caattgtgttttcgtcacagg

SEQ ID NO: 409598 - DNA, 17 bp, Homo sapiens
caattgtttttgttgtg

SEQ ID NO: 409599 - DNA, 20 bp, Homo sapiens
caatttaaaatcattcaata

SEQ ID NO: 409600 - DNA, 17 bp, Homo sapiens
caatttaaattgttata

SEQ ID NO: 409601 - DNA, 12 bp, Homo sapiens
caatttaaggaa

SEQ ID NO: 409602 - DNA, 22 bp, Homo sapiens
caatttactttttaaacagtgt

SEQ ID NO: 409603 - DNA, 23 bp, Homo sapiens
caatttatccaaagcattgcaga

SEQ ID NO: 409604 - DNA, 23 bp, Homo sapiens
caatttatcttccatatgctctt

SEQ ID NO: 409605 - DNA, 14 bp, Homo sapiens
caatttattaaaat

SEQ ID NO: 409606 - DNA, 13 bp, Homo sapiens
caatttattttat

SEQ ID NO: 409607 - DNA, 14 bp, Homo sapiens
caatttattttatt

SEQ ID NO: 409608 - DNA, 12 bp, Homo sapiens
caatttcaaaat

SEQ ID NO: 409609 - DNA, 23 bp, Homo sapiens
caatttcaaaatgcatgtgattg

SEQ ID NO: 409610 - DNA, 23 bp, Homo sapiens
caatttccattcttttaaatggg

SEQ ID NO: 409611 - DNA, 12 bp, Homo sapiens
caatttctaaat

SEQ ID NO: 409612 - DNA, 22 bp, Homo sapiens
caatttctcacaatagacagaa

SEQ ID NO: 409613 - DNA, 20 bp, Homo sapiens
caatttgccttaggaagtga

SEQ ID NO: 409614 - DNA, 21 bp, Homo sapiens
caatttgccttaggaagtgac

SEQ ID NO: 409615 - DNA, 13 bp, Homo sapiens
caatttggtctta

SEQ ID NO: 409616 - DNA, 19 bp, Homo sapiens
caatttggtcttagcttta

SEQ ID NO: 409617 - DNA, 23 bp, Homo sapiens
caatttgtaattgcttacatttt

SEQ ID NO: 409618 - DNA, 14 bp, Homo sapiens
caatttgtctccta

SEQ ID NO: 409619 - DNA, 22 bp, Homo sapiens
caattttaaaaaataacatatt

SEQ ID NO: 409620 - DNA, 14 bp, Homo sapiens
caattttcatccca

SEQ ID NO: 409621 - DNA, 15 bp, Homo sapiens
caattttcatcccac

SEQ ID NO: 409622 - DNA, 16 bp, Homo sapiens
caattttctaagcaat

SEQ ID NO: 409623 - DNA, 22 bp, Homo sapiens
caattttctaagcaatttcttg

SEQ ID NO: 409624 - DNA, 20 bp, Homo sapiens
caattttctatttaaaaaat

SEQ ID NO: 409625 - DNA, 19 bp, Homo sapiens
caattttctttaaccagtc

SEQ ID NO: 409626 - DNA, 13 bp, Homo sapiens
caattttcttttt

SEQ ID NO: 409627 - DNA, 16 bp, Homo sapiens
cacaaaaagcacaagc

SEQ ID NO: 409628 - DNA, 16 bp, Homo sapiens
cacaaaagctgtgtct

SEQ ID NO: 409629 - DNA, 18 bp, Homo sapiens
cacaaaagctgtgtctct

SEQ ID NO: 409630 - DNA, 20 bp, Homo sapiens
cacaaaagctgtgtctctgt

SEQ ID NO: 409631 - DNA, 17 bp, Homo sapiens
cacaaaatgataatcaa

SEQ ID NO: 409632 - DNA, 15 bp, Homo sapiens
cacaaacacctccta

SEQ ID NO: 409633 - DNA, 14 bp, Homo sapiens
cacaaaccctgggg

SEQ ID NO: 409634 - DNA, 19 bp, Homo sapiens
cacaaagcggggggagggt

SEQ ID NO: 409635 - DNA, 18 bp, Homo sapiens
cacaaatcaaagcaaggg

SEQ ID NO: 409636 - DNA, 19 bp, Homo sapiens
cacaaatgcagacacacaa

SEQ ID NO: 409637 - DNA, 14 bp, Homo sapiens
cacaaatgtgtccc

SEQ ID NO: 409638 - DNA, 13 bp, Homo sapiens
cacaacaccagga

SEQ ID NO: 409639 - DNA, 23 bp, Homo sapiens
cacaaccaccgttacaagtatac

SEQ ID NO: 409640 - DNA, 17 bp, Homo sapiens
cacaacctctctgatct

SEQ ID NO: 409641 - DNA, 18 bp, Homo sapiens
cacaaccttctgtggctc

SEQ ID NO: 409642 - DNA, 14 bp, Homo sapiens
cacaactaacaatg

SEQ ID NO: 409643 - DNA, 18 bp, Homo sapiens
cacaactaacaatgcctt

SEQ ID NO: 409644 - DNA, 23 bp, Homo sapiens
cacaactaacaatgccttgttgt

SEQ ID NO: 409645 - DNA, 13 bp, Homo sapiens
cacaactgctgtt

SEQ ID NO: 409646 - DNA, 18 bp, Homo sapiens
cacaactgtttttgaaga

SEQ ID NO: 409647 - DNA, 14 bp, Homo sapiens
cacaagaaatttga

SEQ ID NO: 409648 - DNA, 23 bp, Homo sapiens
cacaagaagtgggagtgggagag

SEQ ID NO: 409649 - DNA, 14 bp, Homo sapiens
cacaagacccctgc

SEQ ID NO: 409650 - DNA, 15 bp, Homo sapiens
cacaagaggaagaga

SEQ ID NO: 409651 - DNA, 15 bp, Homo sapiens
cacaagatggaaaaa

SEQ ID NO: 409652 - DNA, 21 bp, Homo sapiens
cacaagatggaaaaaaaaaac

SEQ ID NO: 409653 - DNA, 19 bp, Homo sapiens
cacaagcattccttagcag

SEQ ID NO: 409654 - DNA, 23 bp, Homo sapiens
cacaagcctcttctgaagatgga

SEQ ID NO: 409655 - DNA, 13 bp, Homo sapiens
cacaagctgcctc

SEQ ID NO: 409656 - DNA, 16 bp, Homo sapiens
cacaagctgcctccct

SEQ ID NO: 409657 - DNA, 15 bp, Homo sapiens
cacaagctgcctctg

SEQ ID NO: 409658 - DNA, 15 bp, Homo sapiens
cacaaggaataaatg

SEQ ID NO: 409659 - DNA, 20 bp, Homo sapiens
cacaaggctggccagcaagg

SEQ ID NO: 409660 - DNA, 22 bp, Homo sapiens
cacaaggtccactccctgctcc

SEQ ID NO: 409661 - DNA, 15 bp, Homo sapiens
cacaagtaggagaca

SEQ ID NO: 409662 - DNA, 19 bp, Homo sapiens
cacaagttaagattcttgg

SEQ ID NO: 409663 - DNA, 12 bp, Homo sapiens
cacaatcattgg

SEQ ID NO: 409664 - DNA, 17 bp, Homo sapiens
cacaatggctgggaggg

SEQ ID NO: 409665 - DNA, 23 bp, Homo sapiens
cacaatggctgggagggggccct

SEQ ID NO: 409666 - DNA, 12 bp, Homo sapiens
cacaatgtgata

SEQ ID NO: 409667 - DNA, 16 bp, Homo sapiens
cacaattctgtccctg

SEQ ID NO: 409668 - DNA, 23 bp, Homo sapiens
cacacaaaacaacagcaacaaca

SEQ ID NO: 409669 - DNA, 21 bp, Homo sapiens
cacacaaaatgtacccagtat

SEQ ID NO: 409670 - DNA, 16 bp, Homo sapiens
cacacaaatattgctt

SEQ ID NO: 409671 - DNA, 16 bp, Homo sapiens
cactcaaattaatctt

SEQ ID NO: 409672 - DNA, 12 bp, Homo sapiens
cactcacatgct

SEQ ID NO: 409673 - DNA, 14 bp, Homo sapiens
cactcacatgctgg

SEQ ID NO: 409674 - DNA, 14 bp, Homo sapiens
cactcaccagggtc

SEQ ID NO: 409675 - DNA, 16 bp, Homo sapiens
cactcaccccctttgc

SEQ ID NO: 409676 - DNA, 13 bp, Homo sapiens
cactcactccagc

SEQ ID NO: 409677 - DNA, 12 bp, Homo sapiens
cactcagcagcc

SEQ ID NO: 409678 - DNA, 15 bp, Homo sapiens
cactcagcagccccc

SEQ ID NO: 409679 - DNA, 13 bp, Homo sapiens
cactcagctgttc

SEQ ID NO: 409680 - DNA, 16 bp, Homo sapiens
cactcagggctggccc

SEQ ID NO: 409681 - DNA, 14 bp, Homo sapiens
cactccactcccct

SEQ ID NO: 409682 - DNA, 17 bp, Homo sapiens
cactccagacccctggc

SEQ ID NO: 409683 - DNA, 15 bp, Homo sapiens
cactcccagggcccg

SEQ ID NO: 409684 - DNA, 18 bp, Homo sapiens
cactcccagggcccgagc

SEQ ID NO: 409685 - DNA, 12 bp, Homo sapiens
cactcccctcat

SEQ ID NO: 409686 - DNA, 13 bp, Homo sapiens
cactccctgagct

SEQ ID NO: 409687 - DNA, 23 bp, Homo sapiens
cactccctgccaactccatgacc

SEQ ID NO: 409688 - DNA, 13 bp, Homo sapiens
cactccctgccac

SEQ ID NO: 409689 - DNA, 23 bp, Homo sapiens
cactccctgccaccgtcacacag

SEQ ID NO: 409690 - DNA, 15 bp, Homo sapiens
cactccctgtccatc

SEQ ID NO: 409691 - DNA, 20 bp, Homo sapiens
cactccctttcccctcttcc

SEQ ID NO: 409692 - DNA, 21 bp, Homo sapiens
cactccctttgtggactttat

SEQ ID NO: 409693 - DNA, 23 bp, Homo sapiens
cactccctttgtggactttattt

SEQ ID NO: 409694 - DNA, 14 bp, Homo sapiens
cactcctaggagag

SEQ ID NO: 409695 - DNA, 22 bp, Homo sapiens
cactcctaggagagccaacctc

SEQ ID NO: 409696 - DNA, 14 bp, Homo sapiens
cactcctcctccag

SEQ ID NO: 409697 - DNA, 10 bp, Homo sapiens
cactcctggg

SEQ ID NO: 409698 - DNA, 20 bp, Homo sapiens
cactcgagaccatcctggcc

SEQ ID NO: 409699 - DNA, 15 bp, Homo sapiens
cactcgcccgcccac

SEQ ID NO: 409700 - DNA, 16 bp, Homo sapiens
cactcgcccgcccact

SEQ ID NO: 409701 - DNA, 22 bp, Homo sapiens
cactcgtgtgcatgagaatgtc

SEQ ID NO: 409702 - DNA, 16 bp, Homo sapiens
cactctaccctcccac

SEQ ID NO: 409703 - DNA, 21 bp, Homo sapiens
cactctaccctcccaccccct

SEQ ID NO: 409704 - DNA, 13 bp, Homo sapiens
cactctagcctgg

SEQ ID NO: 409705 - DNA, 23 bp, Homo sapiens
cactctagtgacttcctggtgag

SEQ ID NO: 409706 - DNA, 18 bp, Homo sapiens
cactctagttctagatga

SEQ ID NO: 409707 - DNA, 16 bp, Homo sapiens
cactctcagagactcc

SEQ ID NO: 409708 - DNA, 20 bp, Homo sapiens
cactctcagagactcccagg

SEQ ID NO: 409709 - DNA, 12 bp, Homo sapiens
cactctccccac

SEQ ID NO: 409710 - DNA, 15 bp, Homo sapiens
cactctccccacact

SEQ ID NO: 409711 - DNA, 11 bp, Homo sapiens
cactctcctgg

SEQ ID NO: 409712 - DNA, 12 bp, Homo sapiens
cactctctgcca

SEQ ID NO: 409713 - DNA, 13 bp, Homo sapiens
cactctctgccag

SEQ ID NO: 409714 - DNA, 20 bp, Homo sapiens
cactctgacgcaaaaccact

SEQ ID NO: 409715 - DNA, 13 bp, Homo sapiens
cactctgccaggg

SEQ ID NO: 409716 - DNA, 19 bp, Homo sapiens
cactctgccagggcagtgc

SEQ ID NO: 409717 - DNA, 16 bp, Homo sapiens
cactctgcctctaagg

SEQ ID NO: 409718 - DNA, 17 bp, Homo sapiens
cactctgctcccagccc

SEQ ID NO: 409719 - DNA, 22 bp, Homo sapiens
cactctgctcccagcccctacc

SEQ ID NO: 409720 - DNA, 21 bp, Homo sapiens
cactctgctttgactgagcag

SEQ ID NO: 409721 - DNA, 18 bp, Homo sapiens
cactcttcctcatcctgc

SEQ ID NO: 409722 - DNA, 22 bp, Homo sapiens
cactcttcctcatcctgcttct

SEQ ID NO: 409723 - DNA, 16 bp, Homo sapiens
cactcttcttgagcag

SEQ ID NO: 409724 - DNA, 20 bp, Homo sapiens
cactcttcttgagcagaccg

SEQ ID NO: 409725 - DNA, 23 bp, Homo sapiens
cactctttcccccaaatcttcct

SEQ ID NO: 409726 - DNA, 15 bp, Homo sapiens
cactctttctttctc

SEQ ID NO: 409727 - DNA, 15 bp, Homo sapiens
cactctttgtaagag

SEQ ID NO: 409728 - DNA, 20 bp, Homo sapiens
cactgaacctctggctagag

SEQ ID NO: 409729 - DNA, 17 bp, Homo sapiens
cactgaagctttttagt

SEQ ID NO: 409730 - DNA, 16 bp, Homo sapiens
cactgaagttgtctga

SEQ ID NO: 409731 - DNA, 15 bp, Homo sapiens
cactgaatcgtttca

SEQ ID NO: 409732 - DNA, 19 bp, Homo sapiens
cactgacatttcacttcct

SEQ ID NO: 409733 - DNA, 13 bp, Homo sapiens
cactgaccacact

SEQ ID NO: 409734 - DNA, 14 bp, Homo sapiens
cactgaccacactg

SEQ ID NO: 409735 - DNA, 20 bp, Homo sapiens
cactgacctgctccgccagg

SEQ ID NO: 409736 - DNA, 23 bp, Homo sapiens
cactgacctgctccgccaggaaa

SEQ ID NO: 409737 - DNA, 19 bp, Homo sapiens
cactgacctggaagagctg

SEQ ID NO: 409738 - DNA, 16 bp, Homo sapiens
cactgactgcagggac

SEQ ID NO: 409739 - DNA, 13 bp, Homo sapiens
cactgagcccttg

SEQ ID NO: 409740 - DNA, 20 bp, Homo sapiens
cactgagcccttgcacaggc

SEQ ID NO: 409741 - DNA, 18 bp, Homo sapiens
cactgaggcgctcgctcc

SEQ ID NO: 409742 - DNA, 18 bp, Homo sapiens
cactgatatcacgggccc

SEQ ID NO: 409743 - DNA, 19 bp, Homo sapiens
cactgatttcacaacagat

SEQ ID NO: 409744 - DNA, 21 bp, Homo sapiens
cactgatttcacaacagatca

SEQ ID NO: 409745 - DNA, 17 bp, Homo sapiens
cactgcaaaccctgctg

SEQ ID NO: 409746 - DNA, 20 bp, Homo sapiens
cactgcaaaccctgctgcct

SEQ ID NO: 409747 - DNA, 16 bp, Homo sapiens
cactgcaacttctgcc

SEQ ID NO: 409748 - DNA, 19 bp, Homo sapiens
cactgcacagtgcatctca

SEQ ID NO: 409749 - DNA, 21 bp, Homo sapiens
cactgcacagtgcatctcagc

SEQ ID NO: 409750 - DNA, 22 bp, Homo sapiens
cactgcacagtgcatctcagcc

SEQ ID NO: 409751 - DNA, 18 bp, Homo sapiens
cactgcagtcacccctgt

SEQ ID NO: 409752 - DNA, 22 bp, Homo sapiens
cactgcagtcacccctgtctgc

SEQ ID NO: 409753 - DNA, 12 bp, Homo sapiens
cactgcatccta

SEQ ID NO: 409754 - DNA, 22 bp, Homo sapiens
cactgcatttggggcctttccc

SEQ ID NO: 409755 - DNA, 12 bp, Homo sapiens
cactgccagagc

SEQ ID NO: 409756 - DNA, 19 bp, Homo sapiens
cactgccagagctacactc

SEQ ID NO: 409757 - DNA, 11 bp, Homo sapiens
cactgccaggc

SEQ ID NO: 409758 - DNA, 12 bp, Homo sapiens
cactgccaggca

SEQ ID NO: 409759 - DNA, 15 bp, Homo sapiens
cactgccaggcacct

SEQ ID NO: 409760 - DNA, 16 bp, Homo sapiens
cactgccaggcacctg

SEQ ID NO: 409761 - DNA, 17 bp, Homo sapiens
cactgccaggcacctgg

SEQ ID NO: 409762 - DNA, 18 bp, Homo sapiens
cactgccaggcacctggc

SEQ ID NO: 409763 - DNA, 21 bp, Homo sapiens
cactgccaggcacctggcctg

SEQ ID NO: 409764 - DNA, 19 bp, Homo sapiens
cactgccatggaggcacac

SEQ ID NO: 409765 - DNA, 20 bp, Homo sapiens
cactgccatttcctcctggg

SEQ ID NO: 409766 - DNA, 21 bp, Homo sapiens
cactgcccccagctcttctcc

SEQ ID NO: 409767 - DNA, 16 bp, Homo sapiens
cactgcccgagctggt

SEQ ID NO: 409768 - DNA, 18 bp, Homo sapiens
cactgcccgcacaccctc

SEQ ID NO: 409769 - DNA, 14 bp, Homo sapiens
cactgccctctcca

SEQ ID NO: 409770 - DNA, 15 bp, Homo sapiens
cactgccctctccac

SEQ ID NO: 409771 - DNA, 16 bp, Homo sapiens
cactgccctctccaca

SEQ ID NO: 409772 - DNA, 19 bp, Homo sapiens
cactgccctctccacaccc

SEQ ID NO: 409773 - DNA, 17 bp, Homo sapiens
cactgccctctgttcag

SEQ ID NO: 409774 - DNA, 14 bp, Homo sapiens
cactgccctgcctg

SEQ ID NO: 409775 - DNA, 17 bp, Homo sapiens
cactgccctgcctgccc

SEQ ID NO: 409776 - DNA, 14 bp, Homo sapiens
cactgcctctgcct

SEQ ID NO: 409777 - DNA, 15 bp, Homo sapiens
cactgcctctggaat

SEQ ID NO: 409778 - DNA, 15 bp, Homo sapiens
cactgcctgcccacc

SEQ ID NO: 409779 - DNA, 20 bp, Homo sapiens
cactgccttcgatacaccgg

SEQ ID NO: 409780 - DNA, 22 bp, Homo sapiens
cactgccttcgatacaccgggc

SEQ ID NO: 409781 - DNA, 17 bp, Homo sapiens
cactgccttctcctctc

SEQ ID NO: 409782 - DNA, 20 bp, Homo sapiens
cactgccttctcctctctgg

SEQ ID NO: 409783 - DNA, 23 bp, Homo sapiens
cactgccttctcctctctgggcc

SEQ ID NO: 409784 - DNA, 16 bp, Homo sapiens
cactgcgaactctcag

SEQ ID NO: 409785 - DNA, 13 bp, Homo sapiens
cactgctaataaa

SEQ ID NO: 409786 - DNA, 14 bp, Homo sapiens
cactgctaataaat

SEQ ID NO: 409787 - DNA, 23 bp, Homo sapiens
cactgctaataaatgaccagttt

SEQ ID NO: 409788 - DNA, 11 bp, Homo sapiens
cactgctacac

SEQ ID NO: 409789 - DNA, 15 bp, Homo sapiens
cactgctacacttct

SEQ ID NO: 409790 - DNA, 22 bp, Homo sapiens
cagactctgtgagattctaaat

SEQ ID NO: 409791 - DNA, 15 bp, Homo sapiens
cagactggctgcaca

SEQ ID NO: 409792 - DNA, 21 bp, Homo sapiens
cagactggctgcacagcccaa

SEQ ID NO: 409793 - DNA, 16 bp, Homo sapiens
cagactgtaagatgtt

SEQ ID NO: 409794 - DNA, 23 bp, Homo sapiens
cagactgttagaaaatggacact

SEQ ID NO: 409795 - DNA, 18 bp, Homo sapiens
cagactgttccctccaag

SEQ ID NO: 409796 - DNA, 21 bp, Homo sapiens
cagacttcgctattcccaggc

SEQ ID NO: 409797 - DNA, 24 bp, Homo sapiens
cagacttcgctattcccaggcagg

SEQ ID NO: 409798 - DNA, 20 bp, Homo sapiens
cagacttctggaaggctggc

SEQ ID NO: 409799 - DNA, 17 bp, Homo sapiens
cagacttgtttcctgtg

SEQ ID NO: 409800 - DNA, 19 bp, Homo sapiens
cagactttctacacctgtt

SEQ ID NO: 409801 - DNA, 22 bp, Homo sapiens
cagagaaaacactttcctggat

SEQ ID NO: 409802 - DNA, 19 bp, Homo sapiens
cagagaaatatgcagaagg

SEQ ID NO: 409803 - DNA, 12 bp, Homo sapiens
cagagaagagac

SEQ ID NO: 409804 - DNA, 14 bp, Homo sapiens
cagagaagcctcag

SEQ ID NO: 409805 - DNA, 22 bp, Homo sapiens
cagagaagcctcagtccctccc

SEQ ID NO: 409806 - DNA, 15 bp, Homo sapiens
cagagaaggaaaaga

SEQ ID NO: 409807 - DNA, 18 bp, Homo sapiens
cagagaaggcctcttgtg

SEQ ID NO: 409808 - DNA, 19 bp, Homo sapiens
cagagaaggcctcttgtgc

SEQ ID NO: 409809 - DNA, 20 bp, Homo sapiens
cagagaatagatcagtattt

SEQ ID NO: 409810 - DNA, 16 bp, Homo sapiens
cagagacagagaggac

SEQ ID NO: 409811 - DNA, 16 bp, Homo sapiens
cagagacatgggcctc

SEQ ID NO: 409812 - DNA, 14 bp, Homo sapiens
cagagacgcaggaa

SEQ ID NO: 409813 - DNA, 22 bp, Homo sapiens
cagagacggcagccccatcctt

SEQ ID NO: 409814 - DNA, 15 bp, Homo sapiens
cagagactcccagga

SEQ ID NO: 409815 - DNA, 20 bp, Homo sapiens
cagagactgcccaccctggg

SEQ ID NO: 409816 - DNA, 23 bp, Homo sapiens
cagagactgcccaccctgggcct

SEQ ID NO: 409817 - DNA, 24 bp, Homo sapiens
cagagactgcccaccctgggcctc

SEQ ID NO: 409818 - DNA, 17 bp, Homo sapiens
cagagactggcagccag

SEQ ID NO: 409819 - DNA, 21 bp, Homo sapiens
cagagactggcagccagggag

SEQ ID NO: 409820 - DNA, 21 bp, Homo sapiens
cagagacttctaggaggatgc

SEQ ID NO: 409821 - DNA, 18 bp, Homo sapiens
cagagagaaaaagagaga

SEQ ID NO: 409822 - DNA, 20 bp, Homo sapiens
cagagagaaaaagagagagc

SEQ ID NO: 409823 - DNA, 23 bp, Homo sapiens
cagagagaaaaagagagagcagg

SEQ ID NO: 409824 - DNA, 11 bp, Homo sapiens
cagagagaaac

SEQ ID NO: 409825 - DNA, 16 bp, Homo sapiens
cagagagaagcacccc

SEQ ID NO: 409826 - DNA, 19 bp, Homo sapiens
cagagagaagcaccccacc

SEQ ID NO: 409827 - DNA, 15 bp, Homo sapiens
cagagagaccctgcc

SEQ ID NO: 409828 - DNA, 17 bp, Homo sapiens
cagagagaccctgccaa

SEQ ID NO: 409829 - DNA, 24 bp, Homo sapiens
cagagagagaagtgcccctgctgc

SEQ ID NO: 409830 - DNA, 16 bp, Homo sapiens
cagagagaggcgtcct

SEQ ID NO: 409831 - DNA, 20 bp, Homo sapiens
cagagagcctggtgctgctg

SEQ ID NO: 409832 - DNA, 13 bp, Homo sapiens
cagagagctggta

SEQ ID NO: 409833 - DNA, 18 bp, Homo sapiens
cagagaggacgtgggcgg

SEQ ID NO: 409834 - DNA, 16 bp, Homo sapiens
cagagaggagaaacac

SEQ ID NO: 409835 - DNA, 17 bp, Homo sapiens
cagagaggagcacctga

SEQ ID NO: 409836 - DNA, 14 bp, Homo sapiens
cagagagggcccag

SEQ ID NO: 409837 - DNA, 16 bp, Homo sapiens
cagagagggcccagct

SEQ ID NO: 409838 - DNA, 22 bp, Homo sapiens
cagagagggggccacctcccca

SEQ ID NO: 409839 - DNA, 15 bp, Homo sapiens
cagagaggttgtgaa

SEQ ID NO: 409840 - DNA, 18 bp, Homo sapiens
caggatttaaaaactgga

SEQ ID NO: 409841 - DNA, 12 bp, Homo sapiens
caggatttctaa

SEQ ID NO: 409842 - DNA, 17 bp, Homo sapiens
caggcaaagaggtgctg

SEQ ID NO: 409843 - DNA, 19 bp, Homo sapiens
caggcaacttcagtcctgg

SEQ ID NO: 409844 - DNA, 21 bp, Homo sapiens
caggcaacttcagtcctggga

SEQ ID NO: 409845 - DNA, 17 bp, Homo sapiens
caggcaagcccctcagc

SEQ ID NO: 409846 - DNA, 18 bp, Homo sapiens
caggcaagcccctcagcc

SEQ ID NO: 409847 - DNA, 19 bp, Homo sapiens
caggcaagcccctcagccc

SEQ ID NO: 409848 - DNA, 14 bp, Homo sapiens
caggcaaggcagct

SEQ ID NO: 409849 - DNA, 17 bp, Homo sapiens
caggcaccgagaatgtt

SEQ ID NO: 409850 - DNA, 14 bp, Homo sapiens
caggcacctggcct

SEQ ID NO: 409851 - DNA, 15 bp, Homo sapiens
caggcacctggcctg

SEQ ID NO: 409852 - DNA, 16 bp, Homo sapiens
caggcacctggcctgc

SEQ ID NO: 409853 - DNA, 17 bp, Homo sapiens
caggcacctggcctgct

SEQ ID NO: 409854 - DNA, 21 bp, Homo sapiens
caggcacctggcctgctggga

SEQ ID NO: 409855 - DNA, 15 bp, Homo sapiens
caggcacctgggctt

SEQ ID NO: 409856 - DNA, 20 bp, Homo sapiens
caggcactgcgccacctgct

SEQ ID NO: 409857 - DNA, 23 bp, Homo sapiens
caggcagagacaataaaacattc

SEQ ID NO: 409858 - DNA, 17 bp, Homo sapiens
caggcagagctcagcac

SEQ ID NO: 409859 - DNA, 12 bp, Homo sapiens
caggcagaggag

SEQ ID NO: 409860 - DNA, 13 bp, Homo sapiens
caggcagaggaga

SEQ ID NO: 409861 - DNA, 14 bp, Homo sapiens
caggcagaggagag

SEQ ID NO: 409862 - DNA, 14 bp, Homo sapiens
caggcagaggatgt

SEQ ID NO: 409863 - DNA, 13 bp, Homo sapiens
caggcagatctgt

SEQ ID NO: 409864 - DNA, 17 bp, Homo sapiens
caggcagatctgtgccc

SEQ ID NO: 409865 - DNA, 19 bp, Homo sapiens
caggcagatctgtgcccca

SEQ ID NO: 409866 - DNA, 21 bp, Homo sapiens
caggcagatctgtgccccatg

SEQ ID NO: 409867 - DNA, 16 bp, Homo sapiens
caggcagcacctggag

SEQ ID NO: 409868 - DNA, 22 bp, Homo sapiens
caggcagcacctggagcccaca

SEQ ID NO: 409869 - DNA, 21 bp, Homo sapiens
caggcagcgatggtctcagaa

SEQ ID NO: 409870 - DNA, 12 bp, Homo sapiens
caggcaggaagt

SEQ ID NO: 409871 - DNA, 13 bp, Homo sapiens
caggcagggaggg

SEQ ID NO: 409872 - DNA, 14 bp, Homo sapiens
caggcagggagggc

SEQ ID NO: 409873 - DNA, 19 bp, Homo sapiens
caggcagggagtgtctgca

SEQ ID NO: 409874 - DNA, 21 bp, Homo sapiens
caggcagggagtgtctgcagt

SEQ ID NO: 409875 - DNA, 21 bp, Homo sapiens
caggcagtaggcattctttag

SEQ ID NO: 409876 - DNA, 17 bp, Homo sapiens
caggcataggcctgggt

SEQ ID NO: 409877 - DNA, 18 bp, Homo sapiens
caggcataggcctgggtg

SEQ ID NO: 409878 - DNA, 18 bp, Homo sapiens
caggcatctgtaagaagt

SEQ ID NO: 409879 - DNA, 18 bp, Homo sapiens
caggcatgaccctggagc

SEQ ID NO: 409880 - DNA, 15 bp, Homo sapiens
caggcatgcctgtgt

SEQ ID NO: 409881 - DNA, 16 bp, Homo sapiens
caggcatgcctgtgtg

SEQ ID NO: 409882 - DNA, 15 bp, Homo sapiens
caggcatgctggcct

SEQ ID NO: 409883 - DNA, 19 bp, Homo sapiens
caggcatgctggcctccca

SEQ ID NO: 409884 - DNA, 20 bp, Homo sapiens
caggcatggcccagcctgga

SEQ ID NO: 409885 - DNA, 14 bp, Homo sapiens
caggcattgcacta

SEQ ID NO: 409886 - DNA, 20 bp, Homo sapiens
caggcattgcactaaaagtg

SEQ ID NO: 409887 - DNA, 21 bp, Homo sapiens
caggcattgcactaaaagtga

SEQ ID NO: 409888 - DNA, 19 bp, Homo sapiens
caggccaaggccttctcct

SEQ ID NO: 409889 - DNA, 13 bp, Homo sapiens
caggccaccagct

SEQ ID NO: 409890 - DNA, 16 bp, Homo sapiens
caggccacccactgtg

SEQ ID NO: 409891 - DNA, 13 bp, Homo sapiens
caggccacctgcc

SEQ ID NO: 409892 - DNA, 15 bp, Homo sapiens
caggccacctgcccc

SEQ ID NO: 409893 - DNA, 16 bp, Homo sapiens
caggccacctgccccc

SEQ ID NO: 409894 - DNA, 19 bp, Homo sapiens
caggccacctgcccccttc

SEQ ID NO: 409895 - DNA, 15 bp, Homo sapiens
caggccactgacctc

SEQ ID NO: 409896 - DNA, 23 bp, Homo sapiens
caggccactgcaaaccctgctgc

SEQ ID NO: 409897 - DNA, 13 bp, Homo sapiens
caggccactgtgg

SEQ ID NO: 409898 - DNA, 16 bp, Homo sapiens
caggccactgtggcca

SEQ ID NO: 409899 - DNA, 18 bp, Homo sapiens
caggccactgtggccaga

SEQ ID NO: 409900 - DNA, 19 bp, Homo sapiens
caggccactgtggccagag

SEQ ID NO: 409901 - DNA, 23 bp, Homo sapiens
caggccactgtggccagagctgg

SEQ ID NO: 409902 - DNA, 13 bp, Homo sapiens
caggccacttgct

SEQ ID NO: 409903 - DNA, 20 bp, Homo sapiens
caggccagatgttgttcctg

SEQ ID NO: 409904 - DNA, 18 bp, Homo sapiens
caggccagctccttttct

SEQ ID NO: 409905 - DNA, 12 bp, Homo sapiens
caggccagctgt

SEQ ID NO: 409906 - DNA, 15 bp, Homo sapiens
caggccagcttcgtg

SEQ ID NO: 409907 - DNA, 21 bp, Homo sapiens
caggccagcttcgtgctggag

SEQ ID NO: 409908 - DNA, 15 bp, Homo sapiens
caggccagtggacag

SEQ ID NO: 409909 - DNA, 18 bp, Homo sapiens
caggccagtggacagagg

SEQ ID NO: 409910 - DNA, 15 bp, Homo sapiens
caggccatcagaggc

SEQ ID NO: 409911 - DNA, 12 bp, Homo sapiens
caggccatggcc

SEQ ID NO: 409912 - DNA, 23 bp, Homo sapiens
caggccatggccaaggggccagc

SEQ ID NO: 409913 - DNA, 17 bp, Homo sapiens
caggccatgtgagccac

SEQ ID NO: 409914 - DNA, 23 bp, Homo sapiens
caggcccacctaccttcaaagct

SEQ ID NO: 409915 - DNA, 15 bp, Homo sapiens
caggcccagcctggc

SEQ ID NO: 409916 - DNA, 17 bp, Homo sapiens
caggcccagcctggccc

SEQ ID NO: 409917 - DNA, 16 bp, Homo sapiens
caggcccagctggggc

SEQ ID NO: 409918 - DNA, 17 bp, Homo sapiens
caggcccagctggggcc

SEQ ID NO: 409919 - DNA, 16 bp, Homo sapiens
caggcccatctcaggt

SEQ ID NO: 409920 - DNA, 21 bp, Homo sapiens
caggcccatctcaggtgccac

SEQ ID NO: 409921 - DNA, 19 bp, Homo sapiens
caggccccaaaaccacagc

SEQ ID NO: 409922 - DNA, 15 bp, Homo sapiens
caggcccctgaggac

SEQ ID NO: 409923 - DNA, 19 bp, Homo sapiens
caggcccctgaggactgga

SEQ ID NO: 409924 - DNA, 21 bp, Homo sapiens
caggcccggcccagcctaggc

SEQ ID NO: 409925 - DNA, 17 bp, Homo sapiens
caggccctagaccctcc

SEQ ID NO: 409926 - DNA, 18 bp, Homo sapiens
caggccctccatgggcta

SEQ ID NO: 409927 - DNA, 12 bp, Homo sapiens
caggccctccgc

SEQ ID NO: 409928 - DNA, 16 bp, Homo sapiens
caggccctcctgctgg

SEQ ID NO: 409929 - DNA, 18 bp, Homo sapiens
caggccctcctgctggct

SEQ ID NO: 409930 - DNA, 13 bp, Homo sapiens
caggccctgcagt

SEQ ID NO: 409931 - DNA, 15 bp, Homo sapiens
caggccctgcagtgt

SEQ ID NO: 409932 - DNA, 17 bp, Homo sapiens
caggccctgcagtgttc

SEQ ID NO: 409933 - DNA, 15 bp, Homo sapiens
caggccctggaactc

SEQ ID NO: 409934 - DNA, 23 bp, Homo sapiens
caggcccttcctctccactgcct

SEQ ID NO: 409935 - DNA, 13 bp, Homo sapiens
caggccgcatggc

SEQ ID NO: 409936 - DNA, 21 bp, Homo sapiens
caggctctgggctcagggctg

SEQ ID NO: 409937 - DNA, 22 bp, Homo sapiens
caggctctgggctcagggctgg

SEQ ID NO: 409938 - DNA, 15 bp, Homo sapiens
caggctcttagcagc

SEQ ID NO: 409939 - DNA, 21 bp, Homo sapiens
caggctcttagcagcttccag

SEQ ID NO: 409940 - DNA, 16 bp, Homo sapiens
caggctcttcctggac

SEQ ID NO: 409941 - DNA, 17 bp, Homo sapiens
caggctcttcctggacc

SEQ ID NO: 409942 - DNA, 13 bp, Homo sapiens
caggctgactggg

SEQ ID NO: 409943 - DNA, 23 bp, Homo sapiens
caggctgactgggggcctctgcc

SEQ ID NO: 409944 - DNA, 19 bp, Homo sapiens
caggctgcaagctgcaggg

SEQ ID NO: 409945 - DNA, 20 bp, Homo sapiens
caggctgcaagctgcaggga

SEQ ID NO: 409946 - DNA, 16 bp, Homo sapiens
caggctgcactgcagt

SEQ ID NO: 409947 - DNA, 17 bp, Homo sapiens
caggctgcactgcagtg

SEQ ID NO: 409948 - DNA, 18 bp, Homo sapiens
caggctgcactgcagtga

SEQ ID NO: 409949 - DNA, 20 bp, Homo sapiens
caggctgcactgcagtgatg

SEQ ID NO: 409950 - DNA, 21 bp, Homo sapiens
caggctgcactgcagtgatgg

SEQ ID NO: 409951 - DNA, 15 bp, Homo sapiens
caggctgcagaggca

SEQ ID NO: 409952 - DNA, 13 bp, Homo sapiens
caggctgcagcag

SEQ ID NO: 409953 - DNA, 19 bp, Homo sapiens
caggctgcagcaggcagag

SEQ ID NO: 409954 - DNA, 21 bp, Homo sapiens
caggctgccaaggccagagtg

SEQ ID NO: 409955 - DNA, 22 bp, Homo sapiens
caggctgccaaggccagagtgg

SEQ ID NO: 409956 - DNA, 21 bp, Homo sapiens
caggctgcgcctgcccgcccg

SEQ ID NO: 409957 - DNA, 14 bp, Homo sapiens
caggctgctggagg

SEQ ID NO: 409958 - DNA, 14 bp, Homo sapiens
caggctggagtgca

SEQ ID NO: 409959 - DNA, 20 bp, Homo sapiens
caggctggcaccgccttctc

SEQ ID NO: 409960 - DNA, 21 bp, Homo sapiens
caggctggcaccgccttctct

SEQ ID NO: 409961 - DNA, 13 bp, Homo sapiens
caggctggcagct

SEQ ID NO: 409962 - DNA, 19 bp, Homo sapiens
caggctggcagctctccag

SEQ ID NO: 409963 - DNA, 14 bp, Homo sapiens
caggctggggcctg

SEQ ID NO: 409964 - DNA, 15 bp, Homo sapiens
caggctggggcctgg

SEQ ID NO: 409965 - DNA, 16 bp, Homo sapiens
caggctggggcctggc

SEQ ID NO: 409966 - DNA, 19 bp, Homo sapiens
caggctggggcctggccta

SEQ ID NO: 409967 - DNA, 23 bp, Homo sapiens
caggctggtctcaaactcctgac

SEQ ID NO: 409968 - DNA, 22 bp, Homo sapiens
caggctggtctcgaactcctga

SEQ ID NO: 409969 - DNA, 23 bp, Homo sapiens
caggctggtctcgaactcctgac

SEQ ID NO: 409970 - DNA, 23 bp, Homo sapiens
caggctgtaagcattctgagctg

SEQ ID NO: 409971 - DNA, 18 bp, Homo sapiens
caggctgtctcatttatt

SEQ ID NO: 409972 - DNA, 19 bp, Homo sapiens
caggctgtgcgctgacaac

SEQ ID NO: 409973 - DNA, 20 bp, Homo sapiens
caggcttcccaaaccaagtg

SEQ ID NO: 409974 - DNA, 23 bp, Homo sapiens
caggcttcccaaaccaagtgcct

SEQ ID NO: 409975 - DNA, 20 bp, Homo sapiens
caggcttccctgacttgctt

SEQ ID NO: 409976 - DNA, 19 bp, Homo sapiens
cagggaaaaagaccaaatt

SEQ ID NO: 409977 - DNA, 20 bp, Homo sapiens
cagggaactgggaagatgct

SEQ ID NO: 409978 - DNA, 21 bp, Homo sapiens
cagggaactgggaagatgctg

SEQ ID NO: 409979 - DNA, 14 bp, Homo sapiens
cagggaagagggca

SEQ ID NO: 409980 - DNA, 15 bp, Homo sapiens
cagggaagagggcag

SEQ ID NO: 409981 - DNA, 22 bp, Homo sapiens
cagggaagagggcagtacctgg

SEQ ID NO: 409982 - DNA, 13 bp, Homo sapiens
cagggaagctggc

SEQ ID NO: 409983 - DNA, 19 bp, Homo sapiens
cagggaaggggaggcagcc

SEQ ID NO: 409984 - DNA, 16 bp, Homo sapiens
cagggaatttctatct

SEQ ID NO: 409985 - DNA, 21 bp, Homo sapiens
cagggaattttcattggatgc

SEQ ID NO: 409986 - DNA, 17 bp, Homo sapiens
cagggacacgggcagcc

SEQ ID NO: 409987 - DNA, 18 bp, Homo sapiens
cagggacagcagcctccc

SEQ ID NO: 409988 - DNA, 14 bp, Homo sapiens
cagggaccaaggac

SEQ ID NO: 409989 - DNA, 19 bp, Homo sapiens
cagggaccaaggacccctc

SEQ ID NO: 409990 - DNA, 15 bp, Homo sapiens
cagggactgcagctg

SEQ ID NO: 409991 - DNA, 16 bp, Homo sapiens
cagggactgtacctgt

SEQ ID NO: 409992 - DNA, 17 bp, Homo sapiens
cagggactgtacctgta

SEQ ID NO: 409993 - DNA, 12 bp, Homo sapiens
cagggagaccag

SEQ ID NO: 409994 - DNA, 22 bp, Homo sapiens
cagggagaccaggcttcccaaa

SEQ ID NO: 409995 - DNA, 22 bp, Homo sapiens
cagggagaccctgggagagtga

SEQ ID NO: 409996 - DNA, 16 bp, Homo sapiens
cagggagaggccatga

SEQ ID NO: 409997 - DNA, 23 bp, Homo sapiens
cagggagcaactctccactccat

SEQ ID NO: 409998 - DNA, 17 bp, Homo sapiens
cagggagcaagacagag

SEQ ID NO: 409999 - DNA, 21 bp, Homo sapiens
cagggagcccggggcagagct

SEQ ID NO: 410000 - DNA, 12 bp, Homo sapiens
cagggagccctg

SEQ ID NO: 410001 - DNA, 22 bp, Homo sapiens
cagggagccctggggtttccac

SEQ ID NO: 410002 - DNA, 14 bp, Homo sapiens
cagggagctgggga

SEQ ID NO: 410003 - DNA, 12 bp, Homo sapiens
cagggaggagag

SEQ ID NO: 410004 - DNA, 15 bp, Homo sapiens
cagggaggagaggaa

SEQ ID NO: 410005 - DNA, 15 bp, Homo sapiens
caggtgcacagacgt

SEQ ID NO: 410006 - DNA, 16 bp, Homo sapiens
caggtgccaccaataa

SEQ ID NO: 410007 - DNA, 19 bp, Homo sapiens
caggtgccactccctgagc

SEQ ID NO: 410008 - DNA, 20 bp, Homo sapiens
caggtgccactccctgagct

SEQ ID NO: 410009 - DNA, 13 bp, Homo sapiens
caggtgcccacca

SEQ ID NO: 410010 - DNA, 13 bp, Homo sapiens
caggtgccctgtg

SEQ ID NO: 410011 - DNA, 15 bp, Homo sapiens
caggtgccctgtggg

SEQ ID NO: 410012 - DNA, 16 bp, Homo sapiens
caggtgctagggtgcc

SEQ ID NO: 410013 - DNA, 19 bp, Homo sapiens
caggtgctagggtgcctgc

SEQ ID NO: 410014 - DNA, 22 bp, Homo sapiens
caggtgctagggtgcctgctct

SEQ ID NO: 410015 - DNA, 14 bp, Homo sapiens
caggtgctgccttg

SEQ ID NO: 410016 - DNA, 14 bp, Homo sapiens
caggtgctggaggc

SEQ ID NO: 410017 - DNA, 18 bp, Homo sapiens
caggtgctggaggcagac

SEQ ID NO: 410018 - DNA, 17 bp, Homo sapiens
caggtggaacaggagga

SEQ ID NO: 410019 - DNA, 21 bp, Homo sapiens
caggtggaacaggaggaactg

SEQ ID NO: 410020 - DNA, 14 bp, Homo sapiens
caggtggccacagc

SEQ ID NO: 410021 - DNA, 21 bp, Homo sapiens
caggtggccactccagacccc

SEQ ID NO: 410022 - DNA, 12 bp, Homo sapiens
caggtggccagg

SEQ ID NO: 410023 - DNA, 20 bp, Homo sapiens
caggtggctcagtgccacct

SEQ ID NO: 410024 - DNA, 13 bp, Homo sapiens
caggtgggaaagc

SEQ ID NO: 410025 - DNA, 12 bp, Homo sapiens
caggtggggagg

SEQ ID NO: 410026 - DNA, 15 bp, Homo sapiens
caggtggggaggggg

SEQ ID NO: 410027 - DNA, 22 bp, Homo sapiens
caggtggggagtccagggctcc

SEQ ID NO: 410028 - DNA, 17 bp, Homo sapiens
caggtggtgtccttctt

SEQ ID NO: 410029 - DNA, 21 bp, Homo sapiens
caggtggtgtccttcttcctc

SEQ ID NO: 410030 - DNA, 21 bp, Homo sapiens
caggtgtactatggctgtatt

SEQ ID NO: 410031 - DNA, 19 bp, Homo sapiens
caggtgtccccagcccact

SEQ ID NO: 410032 - DNA, 14 bp, Homo sapiens
caggtgtcctgact

SEQ ID NO: 410033 - DNA, 19 bp, Homo sapiens
caggtgtcctgactgtcct

SEQ ID NO: 410034 - DNA, 20 bp, Homo sapiens
caggtgtcctgactgtccta

SEQ ID NO: 410035 - DNA, 21 bp, Homo sapiens
caggtgtcctgactgtcctac

SEQ ID NO: 410036 - DNA, 13 bp, Homo sapiens
caggtgtggtggc

SEQ ID NO: 410037 - DNA, 19 bp, Homo sapiens
caggtgtggtggctcatgg

SEQ ID NO: 410038 - DNA, 13 bp, Homo sapiens
caggtgttgccaa

SEQ ID NO: 410039 - DNA, 14 bp, Homo sapiens
caggtgttgccaaa

SEQ ID NO: 410040 - DNA, 19 bp, Homo sapiens
caggtgttgggacctgctg

SEQ ID NO: 410041 - DNA, 21 bp, Homo sapiens
caggtgttgggacctgctgct

SEQ ID NO: 410042 - DNA, 23 bp, Homo sapiens
caggttaccttggcgtgtgtccc

SEQ ID NO: 410043 - DNA, 12 bp, Homo sapiens
caggttccagaa

SEQ ID NO: 410044 - DNA, 14 bp, Homo sapiens
caggttccatcccg

SEQ ID NO: 410045 - DNA, 21 bp, Homo sapiens
caggttctggttagctcagcc

SEQ ID NO: 410046 - DNA, 15 bp, Homo sapiens
caggttgaggctaaa

SEQ ID NO: 410047 - DNA, 22 bp, Homo sapiens
caggttgatcagtgagctcagg

SEQ ID NO: 410048 - DNA, 17 bp, Homo sapiens
caggttgcagctgctct

SEQ ID NO: 410049 - DNA, 16 bp, Homo sapiens
caggttggaaaagaaa

SEQ ID NO: 410050 - DNA, 18 bp, Homo sapiens
caggttggaaaagaaatc

SEQ ID NO: 410051 - DNA, 22 bp, Homo sapiens
caggttggaaaagaaatcaatt

SEQ ID NO: 410052 - DNA, 15 bp, Homo sapiens
caggttggaggccct

SEQ ID NO: 410053 - DNA, 13 bp, Homo sapiens
caggtttgttaca

SEQ ID NO: 410054 - DNA, 16 bp, Homo sapiens
caggttttcctgaaga

SEQ ID NO: 410055 - DNA, 20 bp, Homo sapiens
caggttttcttctaatcata

SEQ ID NO: 410056 - DNA, 13 bp, Homo sapiens
cagtaaaaatttc

SEQ ID NO: 410057 - DNA, 20 bp, Homo sapiens
cagtaacagggccttgctaa

SEQ ID NO: 410058 - DNA, 20 bp, Homo sapiens
cagtaacgcgtcttcctgag

SEQ ID NO: 410059 - DNA, 14 bp, Homo sapiens
cagtaactaaagct

SEQ ID NO: 410060 - DNA, 19 bp, Homo sapiens
cagtaagtataacaaacta

SEQ ID NO: 410061 - DNA, 13 bp, Homo sapiens
cagtaataaaaca

SEQ ID NO: 410062 - DNA, 14 bp, Homo sapiens
cagtaataaaacat

SEQ ID NO: 410063 - DNA, 17 bp, Homo sapiens
cagtaataaaacatctt

SEQ ID NO: 410064 - DNA, 17 bp, Homo sapiens
cagtaatagctgaacct

SEQ ID NO: 410065 - DNA, 13 bp, Homo sapiens
cagtacaattctt

SEQ ID NO: 410066 - DNA, 14 bp, Homo sapiens
cagtacaattcttt

SEQ ID NO: 410067 - DNA, 17 bp, Homo sapiens
cagtacaattctttgtt

SEQ ID NO: 410068 - DNA, 20 bp, Homo sapiens
cagtacaattctttgttgct

SEQ ID NO: 410069 - DNA, 23 bp, Homo sapiens
cagtacaattctttgttgcttaa

SEQ ID NO: 410070 - DNA, 22 bp, Homo sapiens
cagtacagagaaattctgtggt

SEQ ID NO: 410071 - DNA, 12 bp, Homo sapiens
cagtaccaaaga

SEQ ID NO: 410072 - DNA, 13 bp, Homo sapiens
cagtaccatccca

SEQ ID NO: 410073 - DNA, 15 bp, Homo sapiens
cagtaccatcccact

SEQ ID NO: 410074 - DNA, 17 bp, Homo sapiens
cagtaccatcccactga

SEQ ID NO: 410075 - DNA, 13 bp, Homo sapiens
cagtacccacctg

SEQ ID NO: 410076 - DNA, 15 bp, Homo sapiens
cagtacccacctgag

SEQ ID NO: 410077 - DNA, 16 bp, Homo sapiens
cagtacccacctgagc

SEQ ID NO: 410078 - DNA, 22 bp, Homo sapiens
cagtacctataaagtaaagcta

SEQ ID NO: 410079 - DNA, 13 bp, Homo sapiens
cagtacctccaag

SEQ ID NO: 410080 - DNA, 15 bp, Homo sapiens
cagtacctccaagca

SEQ ID NO: 410081 - DNA, 21 bp, Homo sapiens
cagtacctgggaaaggaccca

SEQ ID NO: 410082 - DNA, 18 bp, Homo sapiens
cagtacgtcccgctgctg

SEQ ID NO: 410083 - DNA, 21 bp, Homo sapiens
cagtacgtcccgctgctgtgc

SEQ ID NO: 410084 - DNA, 18 bp, Homo sapiens
cagtacttgctcaataaa

SEQ ID NO: 410085 - DNA, 23 bp, Homo sapiens
cagtagaaggtcggaggcttggg

SEQ ID NO: 410086 - DNA, 19 bp, Homo sapiens
cagtagacaatccccacat

SEQ ID NO: 410087 - DNA, 23 bp, Homo sapiens
cagtagagtagggtagaaggaaa

SEQ ID NO: 410088 - DNA, 15 bp, Homo sapiens
cagtagagtcatctc

SEQ ID NO: 410089 - DNA, 18 bp, Homo sapiens
cagtagcatactgatgag

SEQ ID NO: 410090 - DNA, 19 bp, Homo sapiens
cagtagcatactgatgaga

SEQ ID NO: 410091 - DNA, 18 bp, Homo sapiens
cagtagccattttgtaac

SEQ ID NO: 410092 - DNA, 23 bp, Homo sapiens
cagtagccccaatatggtggccc

SEQ ID NO: 410093 - DNA, 15 bp, Homo sapiens
catcctccagcttct

SEQ ID NO: 410094 - DNA, 17 bp, Homo sapiens
catcctccagcttctgg

SEQ ID NO: 410095 - DNA, 11 bp, Homo sapiens
catcctccagg

SEQ ID NO: 410096 - DNA, 18 bp, Homo sapiens
catcctcccaagtaggtg

SEQ ID NO: 410097 - DNA, 12 bp, Homo sapiens
catcctcccctt

SEQ ID NO: 410098 - DNA, 15 bp, Homo sapiens
catcctccccttccc

SEQ ID NO: 410099 - DNA, 19 bp, Homo sapiens
catcctccgtccagccgcc

SEQ ID NO: 410100 - DNA, 19 bp, Homo sapiens
catcctgattattgaatgt

SEQ ID NO: 410101 - DNA, 20 bp, Homo sapiens
catcctgattattgaatgtt

SEQ ID NO: 410102 - DNA, 15 bp, Homo sapiens
catcctgccaggagc

SEQ ID NO: 410103 - DNA, 18 bp, Homo sapiens
catcctgcttctcttttc

SEQ ID NO: 410104 - DNA, 14 bp, Homo sapiens
catcctggcccctc

SEQ ID NO: 410105 - DNA, 19 bp, Homo sapiens
catcctggcccctccagac

SEQ ID NO: 410106 - DNA, 16 bp, Homo sapiens
catcctggcctccttt

SEQ ID NO: 410107 - DNA, 17 bp, Homo sapiens
catcctgtacaagtgct

SEQ ID NO: 410108 - DNA, 17 bp, Homo sapiens
catcctgtgtcccctga

SEQ ID NO: 410109 - DNA, 20 bp, Homo sapiens
catcctgttggctgctgcca

SEQ ID NO: 410110 - DNA, 11 bp, Homo sapiens
catccttaaag

SEQ ID NO: 410111 - DNA, 16 bp, Homo sapiens
catccttcccagcaga

SEQ ID NO: 410112 - DNA, 13 bp, Homo sapiens
catccttcccgca

SEQ ID NO: 410113 - DNA, 14 bp, Homo sapiens
catccttcccgcag

SEQ ID NO: 410114 - DNA, 19 bp, Homo sapiens
catccttcccgcagcacca

SEQ ID NO: 410115 - DNA, 15 bp, Homo sapiens
catccttctgccttt

SEQ ID NO: 410116 - DNA, 22 bp, Homo sapiens
catccttttttaaaaaaaagaa

SEQ ID NO: 410117 - DNA, 14 bp, Homo sapiens
catcgatatgaaaa

SEQ ID NO: 410118 - DNA, 17 bp, Homo sapiens
catcgcaggagtctctg

SEQ ID NO: 410119 - DNA, 20 bp, Homo sapiens
catcgcaggagtctctgcca

SEQ ID NO: 410120 - DNA, 21 bp, Homo sapiens
catcgcaggagtctctgccac

SEQ ID NO: 410121 - DNA, 17 bp, Homo sapiens
catgcttgatggtttat

SEQ ID NO: 410122 - DNA, 15 bp, Homo sapiens
catgctttctccttt

SEQ ID NO: 410123 - DNA, 16 bp, Homo sapiens
catgctttctcctttt

SEQ ID NO: 410124 - DNA, 17 bp, Homo sapiens
catgctttctccttttt

SEQ ID NO: 410125 - DNA, 14 bp, Homo sapiens
catgctttgctgct

SEQ ID NO: 410126 - DNA, 15 bp, Homo sapiens
catgctttgctgcta

SEQ ID NO: 410127 - DNA, 22 bp, Homo sapiens
catgctttgctgctatgaaaat

SEQ ID NO: 410128 - DNA, 16 bp, Homo sapiens
catgctttggaaattt

SEQ ID NO: 410129 - DNA, 14 bp, Homo sapiens
catgcttttctcat

SEQ ID NO: 410130 - DNA, 17 bp, Homo sapiens
catgcttttctcatggt

SEQ ID NO: 410131 - DNA, 20 bp, Homo sapiens
catggaaaatgtcctgtggt

SEQ ID NO: 410132 - DNA, 12 bp, Homo sapiens
catggaagctgg

SEQ ID NO: 410133 - DNA, 14 bp, Homo sapiens
catggaagctggca

SEQ ID NO: 410134 - DNA, 14 bp, Homo sapiens
catggaagggaaga

SEQ ID NO: 410135 - DNA, 12 bp, Homo sapiens
catggacccgga

SEQ ID NO: 410136 - DNA, 21 bp, Homo sapiens
catggacgcctggctccaggc

SEQ ID NO: 410137 - DNA, 20 bp, Homo sapiens
catggactccaggatcctcc

SEQ ID NO: 410138 - DNA, 20 bp, Homo sapiens
catggagaatctgctgcata

SEQ ID NO: 410139 - DNA, 13 bp, Homo sapiens
catggaggcacac

SEQ ID NO: 410140 - DNA, 20 bp, Homo sapiens
catggaggcacacagctgca

SEQ ID NO: 410141 - DNA, 23 bp, Homo sapiens
catggagtgagcagtagaagcct

SEQ ID NO: 410142 - DNA, 14 bp, Homo sapiens
catggagtgtgtat

SEQ ID NO: 410143 - DNA, 21 bp, Homo sapiens
catggagtgtgtattgttccc

SEQ ID NO: 410144 - DNA, 13 bp, Homo sapiens
catggatgattct

SEQ ID NO: 410145 - DNA, 14 bp, Homo sapiens
catggatgcatgcc

SEQ ID NO: 410146 - DNA, 18 bp, Homo sapiens
catggattccaaagcatt

SEQ ID NO: 410147 - DNA, 20 bp, Homo sapiens
catggattttggataaatca

SEQ ID NO: 410148 - DNA, 15 bp, Homo sapiens
catggcaataaatgg

SEQ ID NO: 410149 - DNA, 16 bp, Homo sapiens
catggcagaagcgtct

SEQ ID NO: 410150 - DNA, 19 bp, Homo sapiens
catggcagaagcgtctccc

SEQ ID NO: 410151 - DNA, 20 bp, Homo sapiens
catggcagaagcgtctccct

SEQ ID NO: 410152 - DNA, 21 bp, Homo sapiens
catggcagaagcgtctccctt

SEQ ID NO: 410153 - DNA, 23 bp, Homo sapiens
catggcagaagcgtctcccttgg

SEQ ID NO: 410154 - DNA, 20 bp, Homo sapiens
catggcagcatggagagcct

SEQ ID NO: 410155 - DNA, 14 bp, Homo sapiens
catggccacagcca

SEQ ID NO: 410156 - DNA, 15 bp, Homo sapiens
catggccacagccac

SEQ ID NO: 410157 - DNA, 21 bp, Homo sapiens
catggcccagcagcttggctg

SEQ ID NO: 410158 - DNA, 16 bp, Homo sapiens
catggcccagcctgga

SEQ ID NO: 410159 - DNA, 20 bp, Homo sapiens
catggcccagcctggagccg

SEQ ID NO: 410160 - DNA, 16 bp, Homo sapiens
catggcccctccagga

SEQ ID NO: 410161 - DNA, 19 bp, Homo sapiens
catggcccctccaggaaca

SEQ ID NO: 410162 - DNA, 17 bp, Homo sapiens
catggcccgcagtggct

SEQ ID NO: 410163 - DNA, 18 bp, Homo sapiens
catggcccttcctggact

SEQ ID NO: 410164 - DNA, 14 bp, Homo sapiens
catggccgggccct

SEQ ID NO: 410165 - DNA, 21 bp, Homo sapiens
catggccgtgtagaccctaac

SEQ ID NO: 410166 - DNA, 20 bp, Homo sapiens
catggcctattatattaaaa

SEQ ID NO: 410167 - DNA, 17 bp, Homo sapiens
catggcctcccagccac

SEQ ID NO: 410168 - DNA, 20 bp, Homo sapiens
catggcctcccagccacccg

SEQ ID NO: 410169 - DNA, 13 bp, Homo sapiens
catggcctgtgct

SEQ ID NO: 410170 - DNA, 13 bp, Homo sapiens
catggccttccct

SEQ ID NO: 410171 - DNA, 22 bp, Homo sapiens
catggcgtaatgggcctgccca

SEQ ID NO: 410172 - DNA, 20 bp, Homo sapiens
catggctaagcttaaaaaaa

SEQ ID NO: 410173 - DNA, 14 bp, Homo sapiens
catggctcactgca

SEQ ID NO: 410174 - DNA, 15 bp, Homo sapiens
catggctcactgcag

SEQ ID NO: 410175 - DNA, 16 bp, Homo sapiens
catggctcaggcaagc

SEQ ID NO: 410176 - DNA, 14 bp, Homo sapiens
catggctccagtct

SEQ ID NO: 410177 - DNA, 20 bp, Homo sapiens
catggctccagtctgctgcc

SEQ ID NO: 410178 - DNA, 22 bp, Homo sapiens
catggctccagtctgctgccct

SEQ ID NO: 410179 - DNA, 17 bp, Homo sapiens
catggctcctgtctggc

SEQ ID NO: 410180 - DNA, 14 bp, Homo sapiens
catggctggcagag

SEQ ID NO: 410181 - DNA, 23 bp, Homo sapiens
catggctgtggttcctaagcctg

SEQ ID NO: 410182 - DNA, 17 bp, Homo sapiens
catggcttaatgtttat

SEQ ID NO: 410183 - DNA, 15 bp, Homo sapiens
catggctttgtatcc

SEQ ID NO: 410184 - DNA, 18 bp, Homo sapiens
catgggaaagccacctct

SEQ ID NO: 410185 - DNA, 18 bp, Homo sapiens
catgggaatgaatgtcag

SEQ ID NO: 410186 - DNA, 15 bp, Homo sapiens
catgggactgtgcct

SEQ ID NO: 410187 - DNA, 17 bp, Homo sapiens
catgggactgtgccttt

SEQ ID NO: 410188 - DNA, 19 bp, Homo sapiens
catgggagtcagggagccc

SEQ ID NO: 410189 - DNA, 20 bp, Homo sapiens
catgggagtcagggagccct

SEQ ID NO: 410190 - DNA, 19 bp, Homo sapiens
catgggcagaagatagaga

SEQ ID NO: 410191 - DNA, 14 bp, Homo sapiens
catgggcccctctg

SEQ ID NO: 410192 - DNA, 16 bp, Homo sapiens
catgggcccctctgac

SEQ ID NO: 410193 - DNA, 19 bp, Homo sapiens
catgggcctgggcctgctt

SEQ ID NO: 410194 - DNA, 19 bp, Homo sapiens
catgggctagtgtgagtgg

SEQ ID NO: 410195 - DNA, 23 bp, Homo sapiens
catgggctagtgtgagtggcagc

SEQ ID NO: 410196 - DNA, 13 bp, Homo sapiens
catgggcttggac

SEQ ID NO: 410197 - DNA, 13 bp, Homo sapiens
catgggggaggct

SEQ ID NO: 410198 - DNA, 13 bp, Homo sapiens
catgggggcaggg

SEQ ID NO: 410199 - DNA, 15 bp, Homo sapiens
catgggggcccctcg

SEQ ID NO: 410200 - DNA, 15 bp, Homo sapiens
catgggggctccaga

SEQ ID NO: 410201 - DNA, 15 bp, Homo sapiens
catggggtgggcctc

SEQ ID NO: 410202 - DNA, 21 bp, Homo sapiens
catggggtggggtagggctga

SEQ ID NO: 410203 - DNA, 14 bp, Homo sapiens
catggggttcgaga

SEQ ID NO: 410204 - DNA, 16 bp, Homo sapiens
catggggttcgagact

SEQ ID NO: 410205 - DNA, 22 bp, Homo sapiens
catggggttggctgggcccaga

SEQ ID NO: 410206 - DNA, 23 bp, Homo sapiens
catgggtagcttctgacctcagc

SEQ ID NO: 410207 - DNA, 23 bp, Homo sapiens
catgggtcccgggttagcctggt

SEQ ID NO: 410208 - DNA, 15 bp, Homo sapiens
catgggttatgtgta

SEQ ID NO: 410209 - DNA, 23 bp, Homo sapiens
catggtaatttatagtttataca

SEQ ID NO: 410210 - DNA, 15 bp, Homo sapiens
ccacccgtggagatg

SEQ ID NO: 410211 - DNA, 21 bp, Homo sapiens
ccacccgttctgctggcctgg

SEQ ID NO: 410212 - DNA, 16 bp, Homo sapiens
ccaccctaactgagct

SEQ ID NO: 410213 - DNA, 20 bp, Homo sapiens
ccaccctaactgagctgcca

SEQ ID NO: 410214 - DNA, 21 bp, Homo sapiens
ccaccctaactgagctgccag

SEQ ID NO: 410215 - DNA, 18 bp, Homo sapiens
ccaccctaatttgccctt

SEQ ID NO: 410216 - DNA, 19 bp, Homo sapiens
ccaccctaatttgcccttc

SEQ ID NO: 410217 - DNA, 11 bp, Homo sapiens
ccaccctcaca

SEQ ID NO: 410218 - DNA, 14 bp, Homo sapiens
ccaccctcacacac

SEQ ID NO: 410219 - DNA, 15 bp, Homo sapiens
ccaccctccatgctc

SEQ ID NO: 410220 - DNA, 17 bp, Homo sapiens
ccaccctccatgctcct

SEQ ID NO: 410221 - DNA, 18 bp, Homo sapiens
ccaccctcgtggacacct

SEQ ID NO: 410222 - DNA, 20 bp, Homo sapiens
ccaccctcgtggacacctgc

SEQ ID NO: 410223 - DNA, 11 bp, Homo sapiens
ccaccctctgc

SEQ ID NO: 410224 - DNA, 12 bp, Homo sapiens
ccaccctctgca

SEQ ID NO: 410225 - DNA, 11 bp, Homo sapiens
ccaccctgagg

SEQ ID NO: 410226 - DNA, 13 bp, Homo sapiens
ccaccctggcccg

SEQ ID NO: 410227 - DNA, 20 bp, Homo sapiens
ccaccctgggatgggccacc

SEQ ID NO: 410228 - DNA, 14 bp, Homo sapiens
ccaccctgggcctc

SEQ ID NO: 410229 - DNA, 15 bp, Homo sapiens
ccaccctgggcctcc

SEQ ID NO: 410230 - DNA, 17 bp, Homo sapiens
ccaccctgggcctcccg

SEQ ID NO: 410231 - DNA, 19 bp, Homo sapiens
ccacccttcacgctggctt

SEQ ID NO: 410232 - DNA, 19 bp, Homo sapiens
ccacccttctcccctgccc

SEQ ID NO: 410233 - DNA, 12 bp, Homo sapiens
ccacccttggcc

SEQ ID NO: 410234 - DNA, 13 bp, Homo sapiens
ccacccttggcct

SEQ ID NO: 410235 - DNA, 15 bp, Homo sapiens
ccacccttggcctgt

SEQ ID NO: 410236 - DNA, 15 bp, Homo sapiens
ccaccctttgggggg

SEQ ID NO: 410237 - DNA, 15 bp, Homo sapiens
ccaccgatggagccc

SEQ ID NO: 410238 - DNA, 20 bp, Homo sapiens
ccaccgcatatgcatgccag

SEQ ID NO: 410239 - DNA, 21 bp, Homo sapiens
ccaccgcatatgcatgccagg

SEQ ID NO: 410240 - DNA, 22 bp, Homo sapiens
ccaccgcatatgcatgccaggc

SEQ ID NO: 410241 - DNA, 14 bp, Homo sapiens
ccaccgctccccag

SEQ ID NO: 410242 - DNA, 21 bp, Homo sapiens
ccaccgctccccagcccaggg

SEQ ID NO: 410243 - DNA, 19 bp, Homo sapiens
ccaccgggctgggagctct

SEQ ID NO: 410244 - DNA, 23 bp, Homo sapiens
ccaccgggctgggagctctgcag

SEQ ID NO: 410245 - DNA, 16 bp, Homo sapiens
ccaccggggcactggc

SEQ ID NO: 410246 - DNA, 20 bp, Homo sapiens
ccaccggggcactggctgct

SEQ ID NO: 410247 - DNA, 13 bp, Homo sapiens
ccaccggtgcctc

SEQ ID NO: 410248 - DNA, 21 bp, Homo sapiens
ccaccggttgcttctgggaag

SEQ ID NO: 410249 - DNA, 17 bp, Homo sapiens
ccacctacttgtgactg

SEQ ID NO: 410250 - DNA, 13 bp, Homo sapiens
ccacctcagcctc

SEQ ID NO: 410251 - DNA, 16 bp, Homo sapiens
ccacctcagcctcctg

SEQ ID NO: 410252 - DNA, 17 bp, Homo sapiens
ccacctcatgcctggcc

SEQ ID NO: 410253 - DNA, 16 bp, Homo sapiens
ccacctccacccagcc

SEQ ID NO: 410254 - DNA, 17 bp, Homo sapiens
ccacctccacccagccc

SEQ ID NO: 410255 - DNA, 16 bp, Homo sapiens
ccacctccagcccaca

SEQ ID NO: 410256 - DNA, 24 bp, Homo sapiens
ccacctccagtccccctatccttg

SEQ ID NO: 410257 - DNA, 23 bp, Homo sapiens
ccacctccccaggccgtggctgc

SEQ ID NO: 410258 - DNA, 15 bp, Homo sapiens
ccacctcccccaaac

SEQ ID NO: 410259 - DNA, 15 bp, Homo sapiens
ccacctccctgccca

SEQ ID NO: 410260 - DNA, 16 bp, Homo sapiens
ccacctccctgcccag

SEQ ID NO: 410261 - DNA, 22 bp, Homo sapiens
ccacctcgtcccgttctccatt

SEQ ID NO: 410262 - DNA, 13 bp, Homo sapiens
ccacctctcaata

SEQ ID NO: 410263 - DNA, 13 bp, Homo sapiens
ccacctctctgtc

SEQ ID NO: 410264 - DNA, 15 bp, Homo sapiens
ccacctctctgtctt

SEQ ID NO: 410265 - DNA, 17 bp, Homo sapiens
ccacctctctgtctttt

SEQ ID NO: 410266 - DNA, 13 bp, Homo sapiens
ccacctctgctgc

SEQ ID NO: 410267 - DNA, 16 bp, Homo sapiens
ccacctctgctgccca

SEQ ID NO: 410268 - DNA, 21 bp, Homo sapiens
ccacctctgctgcccacggcc

SEQ ID NO: 410269 - DNA, 23 bp, Homo sapiens
ccacctctggccaaatatgcact

SEQ ID NO: 410270 - DNA, 18 bp, Homo sapiens
ccacctgacaatggcagc

SEQ ID NO: 410271 - DNA, 21 bp, Homo sapiens
ccacctgacaatggcagctag

SEQ ID NO: 410272 - DNA, 13 bp, Homo sapiens
ccacctgcagcgt

SEQ ID NO: 410273 - DNA, 15 bp, Homo sapiens
ccacctgcatcagcc

SEQ ID NO: 410274 - DNA, 21 bp, Homo sapiens
ccacctgcatcagcctctggc

SEQ ID NO: 410275 - DNA, 15 bp, Homo sapiens
ccacctgcccagtta

SEQ ID NO: 410276 - DNA, 23 bp, Homo sapiens
ccacctgcccatcacagggttgg

SEQ ID NO: 410277 - DNA, 23 bp, Homo sapiens
ccacctgcccccttctcccacac

SEQ ID NO: 410278 - DNA, 20 bp, Homo sapiens
ccacctgcctatccatcctg

SEQ ID NO: 410279 - DNA, 21 bp, Homo sapiens
ccacctgcctatccatcctgc

SEQ ID NO: 410280 - DNA, 17 bp, Homo sapiens
ccacctgcggctcccct

SEQ ID NO: 410281 - DNA, 21 bp, Homo sapiens
ccacctgcttgtgttgggccc

SEQ ID NO: 410282 - DNA, 20 bp, Homo sapiens
ccacctggatggatctgctc

SEQ ID NO: 410283 - DNA, 13 bp, Homo sapiens
ccagctgactgtg

SEQ ID NO: 410284 - DNA, 13 bp, Homo sapiens
ccaggttgcagct

SEQ ID NO: 410285 - DNA, 16 bp, Homo sapiens
ccaggttgcagctgct

SEQ ID NO: 410286 - DNA, 17 bp, Homo sapiens
ccaggttgcagctgctc

SEQ ID NO: 410287 - DNA, 21 bp, Homo sapiens
ccaggttgcagctgctcttgc

SEQ ID NO: 410288 - DNA, 23 bp, Homo sapiens
ccagtaaaagtataacagcaaat

SEQ ID NO: 410289 - DNA, 21 bp, Homo sapiens
ccagtaacgcgtcttcctgag

SEQ ID NO: 410290 - DNA, 12 bp, Homo sapiens
ccagtacctcca

SEQ ID NO: 410291 - DNA, 15 bp, Homo sapiens
ccagtacctccaagc

SEQ ID NO: 410292 - DNA, 16 bp, Homo sapiens
ccagtacctttgtcac

SEQ ID NO: 410293 - DNA, 13 bp, Homo sapiens
ccagtagccccaa

SEQ ID NO: 410294 - DNA, 22 bp, Homo sapiens
ccagtagccccaatatggtggc

SEQ ID NO: 410295 - DNA, 22 bp, Homo sapiens
ccagtagctgccaaaaagaaca

SEQ ID NO: 410296 - DNA, 13 bp, Homo sapiens
ccagtatcgctca

SEQ ID NO: 410297 - DNA, 13 bp, Homo sapiens
ccagtatcttgaa

SEQ ID NO: 410298 - DNA, 19 bp, Homo sapiens
ccagtatcttgaagacttt

SEQ ID NO: 410299 - DNA, 22 bp, Homo sapiens
ccagtatcttgaagacttttct

SEQ ID NO: 410300 - DNA, 21 bp, Homo sapiens
ccagtattctcagagcatgtg

SEQ ID NO: 410301 - DNA, 12 bp, Homo sapiens
ccagtattcttg

SEQ ID NO: 410302 - DNA, 17 bp, Homo sapiens
ccagtcaggctgcagag

SEQ ID NO: 410303 - DNA, 21 bp, Homo sapiens
ccagtcaggctgcagaggcac

SEQ ID NO: 410304 - DNA, 14 bp, Homo sapiens
ccagtcccaggggc

SEQ ID NO: 410305 - DNA, 18 bp, Homo sapiens
ccagtccccctatccttg

SEQ ID NO: 410306 - DNA, 14 bp, Homo sapiens
ccagtccccgggaa

SEQ ID NO: 410307 - DNA, 19 bp, Homo sapiens
ccagtccccgggaaaggcc

SEQ ID NO: 410308 - DNA, 13 bp, Homo sapiens
ccagtccctggag

SEQ ID NO: 410309 - DNA, 14 bp, Homo sapiens
ccagtccctggagc

SEQ ID NO: 410310 - DNA, 16 bp, Homo sapiens
ccagtccctggagctg

SEQ ID NO: 410311 - DNA, 18 bp, Homo sapiens
ccagtcctcacatgcccg

SEQ ID NO: 410312 - DNA, 18 bp, Homo sapiens
ccagtcctccagaccacc

SEQ ID NO: 410313 - DNA, 14 bp, Homo sapiens
ccagtcctgcctgg

SEQ ID NO: 410314 - DNA, 15 bp, Homo sapiens
ccagtcctgcctggc

SEQ ID NO: 410315 - DNA, 19 bp, Homo sapiens
ccagtcctgcctggccagg

SEQ ID NO: 410316 - DNA, 13 bp, Homo sapiens
ccagtcctgctct

SEQ ID NO: 410317 - DNA, 14 bp, Homo sapiens
ccagtcctgctctc

SEQ ID NO: 410318 - DNA, 14 bp, Homo sapiens
ccagtcctggttca

SEQ ID NO: 410319 - DNA, 18 bp, Homo sapiens
ccagtcgccctctgtgcc

SEQ ID NO: 410320 - DNA, 20 bp, Homo sapiens
ccagtctccaccaggaacct

SEQ ID NO: 410321 - DNA, 21 bp, Homo sapiens
ccagtctccaccaggaacctc

SEQ ID NO: 410322 - DNA, 13 bp, Homo sapiens
ccagtctcccagg

SEQ ID NO: 410323 - DNA, 17 bp, Homo sapiens
ccagtctgaagtttcat

SEQ ID NO: 410324 - DNA, 20 bp, Homo sapiens
ccagtctgaagtttcattta

SEQ ID NO: 410325 - DNA, 16 bp, Homo sapiens
ccagtctgctgccctc

SEQ ID NO: 410326 - DNA, 17 bp, Homo sapiens
ccagtctgctgccctcc

SEQ ID NO: 410327 - DNA, 22 bp, Homo sapiens
ccagtctgctgccctccatccc

SEQ ID NO: 410328 - DNA, 16 bp, Homo sapiens
ccagtctgggctgccg

SEQ ID NO: 410329 - DNA, 18 bp, Homo sapiens
ccagtctgggctgccggg

SEQ ID NO: 410330 - DNA, 16 bp, Homo sapiens
ccagtctgtctactgt

SEQ ID NO: 410331 - DNA, 16 bp, Homo sapiens
ccagtcttgcctaggc

SEQ ID NO: 410332 - DNA, 13 bp, Homo sapiens
ccagtgaagtcct

SEQ ID NO: 410333 - DNA, 16 bp, Homo sapiens
ccagtgaattcttgaa

SEQ ID NO: 410334 - DNA, 20 bp, Homo sapiens
ccagtgaattcttgaaggaa

SEQ ID NO: 410335 - DNA, 23 bp, Homo sapiens
ccagtgaattcttgaaggaaaat

SEQ ID NO: 410336 - DNA, 24 bp, Homo sapiens
ccagtgacacttcagagagctggt

SEQ ID NO: 410337 - DNA, 19 bp, Homo sapiens
ccagtgacagacaggctct

SEQ ID NO: 410338 - DNA, 21 bp, Homo sapiens
ccagtgacagacaggctctta

SEQ ID NO: 410339 - DNA, 17 bp, Homo sapiens
ccagtgacccctgacct

SEQ ID NO: 410340 - DNA, 18 bp, Homo sapiens
ccagtgacctgctgggta

SEQ ID NO: 410341 - DNA, 22 bp, Homo sapiens
ccagtgacctgctgggtaaact

SEQ ID NO: 410342 - DNA, 13 bp, Homo sapiens
ccagtgactccag

SEQ ID NO: 410343 - DNA, 15 bp, Homo sapiens
ccagtgactccagga

SEQ ID NO: 410344 - DNA, 14 bp, Homo sapiens
ccagtgaggacctc

SEQ ID NO: 410345 - DNA, 17 bp, Homo sapiens
ccagtgatggcattact

SEQ ID NO: 410346 - DNA, 19 bp, Homo sapiens
ccagtgatggcattactct

SEQ ID NO: 410347 - DNA, 14 bp, Homo sapiens
ccagtgcaacagca

SEQ ID NO: 410348 - DNA, 16 bp, Homo sapiens
ccagtgccaaacttgg

SEQ ID NO: 410349 - DNA, 16 bp, Homo sapiens
ccagtgcctgtctgga

SEQ ID NO: 410350 - DNA, 14 bp, Homo sapiens
ccagtgctgccatg

SEQ ID NO: 410351 - DNA, 15 bp, Homo sapiens
ccagtgctgccatgc

SEQ ID NO: 410352 - DNA, 18 bp, Homo sapiens
ccagtgctgccatgccac

SEQ ID NO: 410353 - DNA, 20 bp, Homo sapiens
ccagtgctgccatgccactg

SEQ ID NO: 410354 - DNA, 16 bp, Homo sapiens
ccagtgcttggctgcc

SEQ ID NO: 410355 - DNA, 20 bp, Homo sapiens
ccagtggaacagtcaccctt

SEQ ID NO: 410356 - DNA, 18 bp, Homo sapiens
ccagtggacagagggaga

SEQ ID NO: 410357 - DNA, 20 bp, Homo sapiens
ccagtggacagagggagaag

SEQ ID NO: 410358 - DNA, 23 bp, Homo sapiens
ccagtggcctcaaccctccctca

SEQ ID NO: 410359 - DNA, 14 bp, Homo sapiens
ccagtggcctggct

SEQ ID NO: 410360 - DNA, 16 bp, Homo sapiens
ccagtggcctggctcc

SEQ ID NO: 410361 - DNA, 15 bp, Homo sapiens
ccagtgggctgtgtt

SEQ ID NO: 410362 - DNA, 16 bp, Homo sapiens
ccagtgggctgtgttg

SEQ ID NO: 410363 - DNA, 14 bp, Homo sapiens
ccagtgtactgctt

SEQ ID NO: 410364 - DNA, 17 bp, Homo sapiens
ccagtgtactgctttca

SEQ ID NO: 410365 - DNA, 18 bp, Homo sapiens
ccagtgtccccaggggca

SEQ ID NO: 410366 - DNA, 22 bp, Homo sapiens
ccagtgtctgaaccaccctgga

SEQ ID NO: 410367 - DNA, 22 bp, Homo sapiens
ccagtgttagtgggaagagctg

SEQ ID NO: 410368 - DNA, 18 bp, Homo sapiens
ccagtgttgtttgtaaat

SEQ ID NO: 410369 - DNA, 23 bp, Homo sapiens
ccagtgttgtttgtaaataagag

SEQ ID NO: 410370 - DNA, 21 bp, Homo sapiens
ccagttagcccggccaaggac

SEQ ID NO: 410371 - DNA, 23 bp, Homo sapiens
ccagttagcccggccaaggacac

SEQ ID NO: 410372 - DNA, 17 bp, Homo sapiens
ccagttatgtgaatgat

SEQ ID NO: 410373 - DNA, 19 bp, Homo sapiens
ccagttcaatctcccgctg

SEQ ID NO: 410374 - DNA, 19 bp, Homo sapiens
ccagttcaggaatttttgt

SEQ ID NO: 410375 - DNA, 14 bp, Homo sapiens
ccagttcatcccaa

SEQ ID NO: 410376 - DNA, 14 bp, Homo sapiens
ccagttgcacttgg

SEQ ID NO: 410377 - DNA, 14 bp, Homo sapiens
ccagttggactgtg

SEQ ID NO: 410378 - DNA, 21 bp, Homo sapiens
ccagttgtcccgattgtaact

SEQ ID NO: 410379 - DNA, 21 bp, Homo sapiens
ccagtttcaggtgtttagttg

SEQ ID NO: 410380 - DNA, 23 bp, Homo sapiens
ccagtttcccaaaaaccccagtg

SEQ ID NO: 410381 - DNA, 12 bp, Homo sapiens
ccagttttcatt

SEQ ID NO: 410382 - DNA, 13 bp, Homo sapiens
ccagttttcattt

SEQ ID NO: 410383 - DNA, 12 bp, Homo sapiens
ccagttttgtat

SEQ ID NO: 410384 - DNA, 13 bp, Homo sapiens
ccataaaataaat

SEQ ID NO: 410385 - DNA, 17 bp, Homo sapiens
ccataaatccagttcta

SEQ ID NO: 410386 - DNA, 12 bp, Homo sapiens
ccataacttgaa

SEQ ID NO: 410387 - DNA, 12 bp, Homo sapiens
ccataagagaaa

SEQ ID NO: 410388 - DNA, 16 bp, Homo sapiens
ccataagagaaatggt

SEQ ID NO: 410389 - DNA, 17 bp, Homo sapiens
ccataagcctccattta

SEQ ID NO: 410390 - DNA, 16 bp, Homo sapiens
ccataaggcagtggct

SEQ ID NO: 410391 - DNA, 15 bp, Homo sapiens
ccataagggactgtg

SEQ ID NO: 410392 - DNA, 19 bp, Homo sapiens
ccataatagttagccctca

SEQ ID NO: 410393 - DNA, 20 bp, Homo sapiens
ccataattttttttttcctt

SEQ ID NO: 410394 - DNA, 15 bp, Homo sapiens
ccataccccctgccc

SEQ ID NO: 410395 - DNA, 19 bp, Homo sapiens
ccataccccctgccccaga

SEQ ID NO: 410396 - DNA, 21 bp, Homo sapiens
ccataccccctgccccagaga

SEQ ID NO: 410397 - DNA, 22 bp, Homo sapiens
ccataccccctgccccagagaa

SEQ ID NO: 410398 - DNA, 18 bp, Homo sapiens
ccatactctgtctcccta

SEQ ID NO: 410399 - DNA, 18 bp, Homo sapiens
ccatagaagaacagcaga

SEQ ID NO: 410400 - DNA, 19 bp, Homo sapiens
ccatagaagaacagcagat

SEQ ID NO: 410401 - DNA, 13 bp, Homo sapiens
ccatagacacagt

SEQ ID NO: 410402 - DNA, 16 bp, Homo sapiens
ccatagatcttctgaa

SEQ ID NO: 410403 - DNA, 15 bp, Homo sapiens
ccatagcttccatga

SEQ ID NO: 410404 - DNA, 19 bp, Homo sapiens
ccatagcttgattgctcag

SEQ ID NO: 410405 - DNA, 14 bp, Homo sapiens
ccataggacatact

SEQ ID NO: 410406 - DNA, 17 bp, Homo sapiens
ccataggagcagcctta

SEQ ID NO: 410407 - DNA, 12 bp, Homo sapiens
ccatagtgctgg

SEQ ID NO: 410408 - DNA, 17 bp, Homo sapiens
ccatagtttacaatatt

SEQ ID NO: 410409 - DNA, 16 bp, Homo sapiens
ccatatataaattatt

SEQ ID NO: 410410 - DNA, 18 bp, Homo sapiens
ccatatcagacctctgat

SEQ ID NO: 410411 - DNA, 21 bp, Homo sapiens
ccatatcttaaagaaacagct

SEQ ID NO: 410412 - DNA, 19 bp, Homo sapiens
ccatatgacaatttcaaaa

SEQ ID NO: 410413 - DNA, 16 bp, Homo sapiens
ccatattcacacctca

SEQ ID NO: 410414 - DNA, 17 bp, Homo sapiens
ccatatttgtgttcagt

SEQ ID NO: 410415 - DNA, 11 bp, Homo sapiens
ccatcaataaa

SEQ ID NO: 410416 - DNA, 16 bp, Homo sapiens
ccatcacaatacagat

SEQ ID NO: 410417 - DNA, 17 bp, Homo sapiens
ccatcacaatacagata

SEQ ID NO: 410418 - DNA, 14 bp, Homo sapiens
ccatcacagccagc

SEQ ID NO: 410419 - DNA, 22 bp, Homo sapiens
ccaggccagctccttttctgtg

SEQ ID NO: 410420 - DNA, 16 bp, Homo sapiens
ccaggccatggaggca

SEQ ID NO: 410421 - DNA, 13 bp, Homo sapiens
ccaggccatggcc

SEQ ID NO: 410422 - DNA, 21 bp, Homo sapiens
ccaggcccagtccactgggga

SEQ ID NO: 410423 - DNA, 16 bp, Homo sapiens
ccaggcccatctcagg

SEQ ID NO: 410424 - DNA, 13 bp, Homo sapiens
ccaggccccagcc

SEQ ID NO: 410425 - DNA, 18 bp, Homo sapiens
ccaggccccagcctccag

SEQ ID NO: 410426 - DNA, 19 bp, Homo sapiens
ccaggcccctgaggactgg

SEQ ID NO: 410427 - DNA, 19 bp, Homo sapiens
ccaggccctagaccctccc

SEQ ID NO: 410428 - DNA, 22 bp, Homo sapiens
ccaggccctaggattcctcccc

SEQ ID NO: 410429 - DNA, 15 bp, Homo sapiens
cccacggccactgca

SEQ ID NO: 410430 - DNA, 19 bp, Homo sapiens
cccacggggcctcgggacc

SEQ ID NO: 410431 - DNA, 18 bp, Homo sapiens
cccacgtgagagaatctg

SEQ ID NO: 410432 - DNA, 20 bp, Homo sapiens
cccacgtgagagaatctgcc

SEQ ID NO: 410433 - DNA, 21 bp, Homo sapiens
cccacgtgagagaatctgcct

SEQ ID NO: 410434 - DNA, 23 bp, Homo sapiens
cccacgtgagagaatctgcctgt

SEQ ID NO: 410435 - DNA, 20 bp, Homo sapiens
cccacgtggactctgtgctc

SEQ ID NO: 410436 - DNA, 21 bp, Homo sapiens
cccacgtggactctgtgctca

SEQ ID NO: 410437 - DNA, 13 bp, Homo sapiens
cccactagccctc

SEQ ID NO: 410438 - DNA, 18 bp, Homo sapiens
cccactagccctctttct

SEQ ID NO: 410439 - DNA, 17 bp, Homo sapiens
cccactcaccagggtcc

SEQ ID NO: 410440 - DNA, 16 bp, Homo sapiens
cccactcaggattggg

SEQ ID NO: 410441 - DNA, 13 bp, Homo sapiens
cccactccctgcc

SEQ ID NO: 410442 - DNA, 15 bp, Homo sapiens
cccactccctgccac

SEQ ID NO: 410443 - DNA, 16 bp, Homo sapiens
cccactccctgtccat

SEQ ID NO: 410444 - DNA, 11 bp, Homo sapiens
cccactctccc

SEQ ID NO: 410445 - DNA, 15 bp, Homo sapiens
cccactctccccaca

SEQ ID NO: 410446 - DNA, 17 bp, Homo sapiens
cccactctgctcccagc

SEQ ID NO: 410447 - DNA, 22 bp, Homo sapiens
cccactgatctctactaccaca

SEQ ID NO: 410448 - DNA, 14 bp, Homo sapiens
cccactgcctgccc

SEQ ID NO: 410449 - DNA, 13 bp, Homo sapiens
cccactgtccttt

SEQ ID NO: 410450 - DNA, 14 bp, Homo sapiens
cccactgtcctttc

SEQ ID NO: 410451 - DNA, 19 bp, Homo sapiens
cccactgtcctttctccag

SEQ ID NO: 410452 - DNA, 20 bp, Homo sapiens
cccactgtggggcaagcctg

SEQ ID NO: 410453 - DNA, 21 bp, Homo sapiens
cccactgtggggcaagcctga

SEQ ID NO: 410454 - DNA, 22 bp, Homo sapiens
cccactgtggggcaagcctgag

SEQ ID NO: 410455 - DNA, 15 bp, Homo sapiens
cccacttatgctgct

SEQ ID NO: 410456 - DNA, 16 bp, Homo sapiens
cccacttatgctgctg

SEQ ID NO: 410457 - DNA, 14 bp, Homo sapiens
cccacttcaccccc

SEQ ID NO: 410458 - DNA, 14 bp, Homo sapiens
cccactttggggaa

SEQ ID NO: 410459 - DNA, 15 bp, Homo sapiens
cccagaaaggagact

SEQ ID NO: 410460 - DNA, 18 bp, Homo sapiens
cccagaaatgccgctgtg

SEQ ID NO: 410461 - DNA, 24 bp, Homo sapiens
cccagaaccccaactcccagccta

SEQ ID NO: 410462 - DNA, 20 bp, Homo sapiens
cccagaacgggcctccccgg

SEQ ID NO: 410463 - DNA, 19 bp, Homo sapiens
cccagaactgcccccactg

SEQ ID NO: 410464 - DNA, 23 bp, Homo sapiens
cccagaagatgtattcagagcca

SEQ ID NO: 410465 - DNA, 21 bp, Homo sapiens
cccagaaggaacccggtccca

SEQ ID NO: 410466 - DNA, 18 bp, Homo sapiens
cccagaatgtagcatctg

SEQ ID NO: 410467 - DNA, 23 bp, Homo sapiens
cccagacagacatctctgcaccc

SEQ ID NO: 410468 - DNA, 13 bp, Homo sapiens
cccagacccaggg

SEQ ID NO: 410469 - DNA, 14 bp, Homo sapiens
cccagacccagggc

SEQ ID NO: 410470 - DNA, 16 bp, Homo sapiens
cccagacccagggcag

SEQ ID NO: 410471 - DNA, 17 bp, Homo sapiens
cccagacccagggcagt

SEQ ID NO: 410472 - DNA, 14 bp, Homo sapiens
cccagaccccatcc

SEQ ID NO: 410473 - DNA, 14 bp, Homo sapiens
cccagacccctctc

SEQ ID NO: 410474 - DNA, 21 bp, Homo sapiens
cccagacccctctggccagga

SEQ ID NO: 410475 - DNA, 17 bp, Homo sapiens
cccagacttgtttcctg

SEQ ID NO: 410476 - DNA, 16 bp, Homo sapiens
cccagagactgcccac

SEQ ID NO: 410477 - DNA, 18 bp, Homo sapiens
cccagagactgcccaccc

SEQ ID NO: 410478 - DNA, 21 bp, Homo sapiens
cccagagactgcccaccctgg

SEQ ID NO: 410479 - DNA, 23 bp, Homo sapiens
cccagagactgcccaccctgggc

SEQ ID NO: 410480 - DNA, 11 bp, Homo sapiens
cccagagagaa

SEQ ID NO: 410481 - DNA, 22 bp, Homo sapiens
cccagagagaaaaagagagagc

SEQ ID NO: 410482 - DNA, 16 bp, Homo sapiens
cccagagagaccctgc

SEQ ID NO: 410483 - DNA, 23 bp, Homo sapiens
cccagagagaggcgtcctggtga

SEQ ID NO: 410484 - DNA, 17 bp, Homo sapiens
cccagagattcccaagc

SEQ ID NO: 410485 - DNA, 12 bp, Homo sapiens
cccagagcactg

SEQ ID NO: 410486 - DNA, 21 bp, Homo sapiens
cccagagcaggaggcccctgg

SEQ ID NO: 410487 - DNA, 13 bp, Homo sapiens
cccagagccaggg

SEQ ID NO: 410488 - DNA, 15 bp, Homo sapiens
cccagagccagggct

SEQ ID NO: 410489 - DNA, 16 bp, Homo sapiens
cccagagccagggctg

SEQ ID NO: 410490 - DNA, 17 bp, Homo sapiens
cccagagccagggctgt

SEQ ID NO: 410491 - DNA, 16 bp, Homo sapiens
cccagagccccactcc

SEQ ID NO: 410492 - DNA, 13 bp, Homo sapiens
cccagagctgttt

SEQ ID NO: 410493 - DNA, 19 bp, Homo sapiens
cccagagcttattggccac

SEQ ID NO: 410494 - DNA, 20 bp, Homo sapiens
cccagaggagctgggagccg

SEQ ID NO: 410495 - DNA, 10 bp, Homo sapiens
cccagaggca

SEQ ID NO: 410496 - DNA, 15 bp, Homo sapiens
cccagaggcacagcc

SEQ ID NO: 410497 - DNA, 14 bp, Homo sapiens
cccagaggctccca

SEQ ID NO: 410498 - DNA, 15 bp, Homo sapiens
cccagaggctcctgg

SEQ ID NO: 410499 - DNA, 15 bp, Homo sapiens
cccagaggctgagtt

SEQ ID NO: 410500 - DNA, 12 bp, Homo sapiens
cccagagggacc

SEQ ID NO: 410501 - DNA, 15 bp, Homo sapiens
cccagagggaccagc

SEQ ID NO: 410502 - DNA, 17 bp, Homo sapiens
cccagaggggcggggcc

SEQ ID NO: 410503 - DNA, 18 bp, Homo sapiens
cccagaggggcggggcca

SEQ ID NO: 410504 - DNA, 21 bp, Homo sapiens
cccagaggtgggatcctccct

SEQ ID NO: 410505 - DNA, 17 bp, Homo sapiens
cccagaggttatctgcc

SEQ ID NO: 410506 - DNA, 16 bp, Homo sapiens
cccagatagagctggg

SEQ ID NO: 410507 - DNA, 15 bp, Homo sapiens
cccagatagtcccag

SEQ ID NO: 410508 - DNA, 16 bp, Homo sapiens
cccagatagtcccagc

SEQ ID NO: 410509 - DNA, 23 bp, Homo sapiens
cccagatagtcccagcagcctcc

SEQ ID NO: 410510 - DNA, 15 bp, Homo sapiens
cccagatcgttctgc

SEQ ID NO: 410511 - DNA, 18 bp, Homo sapiens
cccagatcgttctgccac

SEQ ID NO: 410512 - DNA, 19 bp, Homo sapiens
cccagatcgttctgccact

SEQ ID NO: 410513 - DNA, 17 bp, Homo sapiens
cccagatctgcctgggc

SEQ ID NO: 410514 - DNA, 20 bp, Homo sapiens
cccagatctgcctgggcctg

SEQ ID NO: 410515 - DNA, 22 bp, Homo sapiens
cccagatctgcctgggcctgtg

SEQ ID NO: 410516 - DNA, 23 bp, Homo sapiens
cccagatctgcctgggcctgtgc

SEQ ID NO: 410517 - DNA, 17 bp, Homo sapiens
cccagcaaccctcctat

SEQ ID NO: 410518 - DNA, 20 bp, Homo sapiens
cccagcaagagcacaagagg

SEQ ID NO: 410519 - DNA, 23 bp, Homo sapiens
cccagcacactgcttctcggagg

SEQ ID NO: 410520 - DNA, 12 bp, Homo sapiens
cccagcacaggc

SEQ ID NO: 410521 - DNA, 21 bp, Homo sapiens
cccagcacaggcaggggtaga

SEQ ID NO: 410522 - DNA, 13 bp, Homo sapiens
cccagcacccagc

SEQ ID NO: 410523 - DNA, 15 bp, Homo sapiens
cccagcacctggcac

SEQ ID NO: 410524 - DNA, 17 bp, Homo sapiens
cccagcacctggcacac

SEQ ID NO: 410525 - DNA, 17 bp, Homo sapiens
cccagcactttgggagg

SEQ ID NO: 410526 - DNA, 20 bp, Homo sapiens
cccagcactttgggaggcct

SEQ ID NO: 410527 - DNA, 18 bp, Homo sapiens
cccagcagacatcctcat

SEQ ID NO: 410528 - DNA, 15 bp, Homo sapiens
cccagcagcccaagc

SEQ ID NO: 410529 - DNA, 18 bp, Homo sapiens
cccagcagcggcccagat

SEQ ID NO: 410530 - DNA, 16 bp, Homo sapiens
cccagcagcttggctg

SEQ ID NO: 410531 - DNA, 16 bp, Homo sapiens
cccagcatcaccagct

SEQ ID NO: 410532 - DNA, 16 bp, Homo sapiens
cccagcattccagctc

SEQ ID NO: 410533 - DNA, 17 bp, Homo sapiens
cccagcattccagctct

SEQ ID NO: 410534 - DNA, 16 bp, Homo sapiens
cccagccaagtgcctt

SEQ ID NO: 410535 - DNA, 17 bp, Homo sapiens
cccagccaccaccactg

SEQ ID NO: 410536 - DNA, 19 bp, Homo sapiens
cccagccaccaccactgtc

SEQ ID NO: 410537 - DNA, 22 bp, Homo sapiens
cccagccaccccgggctctctg

SEQ ID NO: 410538 - DNA, 21 bp, Homo sapiens
cccagccaccttcctgactgg

SEQ ID NO: 410539 - DNA, 22 bp, Homo sapiens
cccagccaccttcctgactggg

SEQ ID NO: 410540 - DNA, 12 bp, Homo sapiens
cccagccagcag

SEQ ID NO: 410541 - DNA, 12 bp, Homo sapiens
cccagccagccc

SEQ ID NO: 410542 - DNA, 13 bp, Homo sapiens
cccagccagccct

SEQ ID NO: 410543 - DNA, 19 bp, Homo sapiens
cccagccagcccttcccag

SEQ ID NO: 410544 - DNA, 16 bp, Homo sapiens
cccagccatgggccct

SEQ ID NO: 410545 - DNA, 17 bp, Homo sapiens
cccagccatgggccctc

SEQ ID NO: 410546 - DNA, 15 bp, Homo sapiens
cccagcccaataaag

SEQ ID NO: 410547 - DNA, 16 bp, Homo sapiens
cccagcccaccctgct

SEQ ID NO: 410548 - DNA, 23 bp, Homo sapiens
cccagcccaccctgctcctcctg

SEQ ID NO: 410549 - DNA, 13 bp, Homo sapiens
cccagcccatctt

SEQ ID NO: 410550 - DNA, 15 bp, Homo sapiens
cccagccccacccct

SEQ ID NO: 410551 - DNA, 21 bp, Homo sapiens
cccagccccagcgagtctgga

SEQ ID NO: 410552 - DNA, 19 bp, Homo sapiens
cccagcccctaccttgaga

SEQ ID NO: 410553 - DNA, 12 bp, Homo sapiens
cccagcccctgg

SEQ ID NO: 410554 - DNA, 16 bp, Homo sapiens
cccagccctcccagct

SEQ ID NO: 410555 - DNA, 20 bp, Homo sapiens
cccagccctgtcctggttcc

SEQ ID NO: 410556 - DNA, 17 bp, Homo sapiens
cccagcccttctgcctt

SEQ ID NO: 410557 - DNA, 20 bp, Homo sapiens
cccagcccttctgcctttct

SEQ ID NO: 410558 - DNA, 17 bp, Homo sapiens
cccagccctttccaggg

SEQ ID NO: 410559 - DNA, 16 bp, Homo sapiens
cccagccggggtgggg

SEQ ID NO: 410560 - DNA, 22 bp, Homo sapiens
cccagccggggtggggtgcctg

SEQ ID NO: 410561 - DNA, 18 bp, Homo sapiens
cccagcctcccccaggct

SEQ ID NO: 410562 - DNA, 23 bp, Homo sapiens
cccagcctcccccaggctgcgcc

SEQ ID NO: 410563 - DNA, 17 bp, Homo sapiens
cccatgataaaataagt

SEQ ID NO: 410564 - DNA, 15 bp, Homo sapiens
cccatgcatggcctc

SEQ ID NO: 410565 - DNA, 16 bp, Homo sapiens
cccatgcatggcctcc

SEQ ID NO: 410566 - DNA, 12 bp, Homo sapiens
cccatgccacca

SEQ ID NO: 410567 - DNA, 14 bp, Homo sapiens
cccatgccaccacc

SEQ ID NO: 410568 - DNA, 17 bp, Homo sapiens
cccatgccaccacccac

SEQ ID NO: 410569 - DNA, 21 bp, Homo sapiens
cccatgccctgccaagcctgg

SEQ ID NO: 410570 - DNA, 22 bp, Homo sapiens
cccatgccctgccaagcctgga

SEQ ID NO: 410571 - DNA, 13 bp, Homo sapiens
cccatgcctgtcc

SEQ ID NO: 410572 - DNA, 13 bp, Homo sapiens
cccatgcctgtct

SEQ ID NO: 410573 - DNA, 15 bp, Homo sapiens
cccatgctctgcccc

SEQ ID NO: 410574 - DNA, 17 bp, Homo sapiens
cccatgctctgccccaa

SEQ ID NO: 410575 - DNA, 19 bp, Homo sapiens
cccatgctgccttcaggga

SEQ ID NO: 410576 - DNA, 20 bp, Homo sapiens
cccatggcccagcagcttgg

SEQ ID NO: 410577 - DNA, 12 bp, Homo sapiens
cccatggcccca

SEQ ID NO: 410578 - DNA, 13 bp, Homo sapiens
cccatggccccag

SEQ ID NO: 410579 - DNA, 18 bp, Homo sapiens
cccatggccccagctggc

SEQ ID NO: 410580 - DNA, 18 bp, Homo sapiens
cccatggctcctcaccac

SEQ ID NO: 410581 - DNA, 20 bp, Homo sapiens
cccatgggatatgtggtgta

SEQ ID NO: 410582 - DNA, 19 bp, Homo sapiens
cccatgtgcctgcaccagg

SEQ ID NO: 410583 - DNA, 22 bp, Homo sapiens
cccatgtgcctgcaccaggaga

SEQ ID NO: 410584 - DNA, 16 bp, Homo sapiens
cccatgtgcctgtcac

SEQ ID NO: 410585 - DNA, 13 bp, Homo sapiens
cccatgtggctga

SEQ ID NO: 410586 - DNA, 16 bp, Homo sapiens
cccatgtggctgaaga

SEQ ID NO: 410587 - DNA, 16 bp, Homo sapiens
cccatgttgcatgcct

SEQ ID NO: 410588 - DNA, 21 bp, Homo sapiens
cccatgttgggaaaaactggc

SEQ ID NO: 410589 - DNA, 13 bp, Homo sapiens
cccattcccacca

SEQ ID NO: 410590 - DNA, 13 bp, Homo sapiens
cccattcctccct

SEQ ID NO: 410591 - DNA, 14 bp, Homo sapiens
cccattcctccctc

SEQ ID NO: 410592 - DNA, 12 bp, Homo sapiens
cccattctagat

SEQ ID NO: 410593 - DNA, 14 bp, Homo sapiens
cccattctccctcc

SEQ ID NO: 410594 - DNA, 18 bp, Homo sapiens
cccattgtgaatgttgtc

SEQ ID NO: 410595 - DNA, 17 bp, Homo sapiens
cccatttcctcttcctt

SEQ ID NO: 410596 - DNA, 15 bp, Homo sapiens
cccatttctatttat

SEQ ID NO: 410597 - DNA, 18 bp, Homo sapiens
cccatttgccatgctgct

SEQ ID NO: 410598 - DNA, 12 bp, Homo sapiens
cccatttgtaat

SEQ ID NO: 410599 - DNA, 18 bp, Homo sapiens
cccatttgtaatgtatct

SEQ ID NO: 410600 - DNA, 19 bp, Homo sapiens
cccattttgcaaaatttcc

SEQ ID NO: 410601 - DNA, 17 bp, Homo sapiens
ccccaaacatagcccct

SEQ ID NO: 410602 - DNA, 15 bp, Homo sapiens
ccccaaagcccagcc

SEQ ID NO: 410603 - DNA, 21 bp, Homo sapiens
ccccaaagctttcctgcccca

SEQ ID NO: 410604 - DNA, 15 bp, Homo sapiens
ccccaaatcttcctc

SEQ ID NO: 410605 - DNA, 18 bp, Homo sapiens
ccccaaatgttctttcct

SEQ ID NO: 410606 - DNA, 17 bp, Homo sapiens
ccccaaattgccttcag

SEQ ID NO: 410607 - DNA, 18 bp, Homo sapiens
ccccaaattgccttcagc

SEQ ID NO: 410608 - DNA, 13 bp, Homo sapiens
ccccaacccccac

SEQ ID NO: 410609 - DNA, 13 bp, Homo sapiens
ccccaaccctgcc

SEQ ID NO: 410610 - DNA, 15 bp, Homo sapiens
ccccaaccctgcccc

SEQ ID NO: 410611 - DNA, 23 bp, Homo sapiens
ccccaaccctgcccctgccccgt

SEQ ID NO: 410612 - DNA, 17 bp, Homo sapiens
ccccaacgtcccctccg

SEQ ID NO: 410613 - DNA, 18 bp, Homo sapiens
ccccaactctccccagtg

SEQ ID NO: 410614 - DNA, 21 bp, Homo sapiens
ccccaagaaacctccatcctg

SEQ ID NO: 410615 - DNA, 19 bp, Homo sapiens
ccccaagcagccagccagt

SEQ ID NO: 410616 - DNA, 13 bp, Homo sapiens
ccccaaggaagaa

SEQ ID NO: 410617 - DNA, 13 bp, Homo sapiens
ccccaaggctgcg

SEQ ID NO: 410618 - DNA, 14 bp, Homo sapiens
ccccaaggggcagt

SEQ ID NO: 410619 - DNA, 20 bp, Homo sapiens
ccccaaggttttggagtcag

SEQ ID NO: 410620 - DNA, 19 bp, Homo sapiens
ccccaatatggtggccctg

SEQ ID NO: 410621 - DNA, 21 bp, Homo sapiens
ccccaatatggtggccctggg

SEQ ID NO: 410622 - DNA, 23 bp, Homo sapiens
ccccaatatggtggccctgggga

SEQ ID NO: 410623 - DNA, 21 bp, Homo sapiens
ccccaatcacgagatcttcct

SEQ ID NO: 410624 - DNA, 21 bp, Homo sapiens
ccccaattaaacccagaacca

SEQ ID NO: 410625 - DNA, 18 bp, Homo sapiens
ccccaattactattccct

SEQ ID NO: 410626 - DNA, 22 bp, Homo sapiens
ccccaattactattccctttga

SEQ ID NO: 410627 - DNA, 14 bp, Homo sapiens
ccccacaccaggcc

SEQ ID NO: 410628 - DNA, 18 bp, Homo sapiens
ccccacaccccagcccac

SEQ ID NO: 410629 - DNA, 16 bp, Homo sapiens
ccccacacctcagttc

SEQ ID NO: 410630 - DNA, 22 bp, Homo sapiens
ccccacacgccggggctggccc

SEQ ID NO: 410631 - DNA, 22 bp, Homo sapiens
ccccacacttgttccagctctt

SEQ ID NO: 410632 - DNA, 18 bp, Homo sapiens
ccccacagctacctgaga

SEQ ID NO: 410633 - DNA, 15 bp, Homo sapiens
ccccacaggccacac

SEQ ID NO: 410634 - DNA, 12 bp, Homo sapiens
ccccacagtcct

SEQ ID NO: 410635 - DNA, 15 bp, Homo sapiens
ccccaccacactgaa

SEQ ID NO: 410636 - DNA, 16 bp, Homo sapiens
ccccaccactcttgac

SEQ ID NO: 410637 - DNA, 14 bp, Homo sapiens
ccccaccagctcgt

SEQ ID NO: 410638 - DNA, 20 bp, Homo sapiens
ccccacccaagcttggcagc

SEQ ID NO: 410639 - DNA, 16 bp, Homo sapiens
ccccacccacccctcc

SEQ ID NO: 410640 - DNA, 21 bp, Homo sapiens
ccccacccaccctctggtcct

SEQ ID NO: 410641 - DNA, 21 bp, Homo sapiens
ccccacccacctccacccagc

SEQ ID NO: 410642 - DNA, 14 bp, Homo sapiens
ccccaccccacact

SEQ ID NO: 410643 - DNA, 20 bp, Homo sapiens
ccccacccctaagtgcccaa

SEQ ID NO: 410644 - DNA, 23 bp, Homo sapiens
ccccacccctaagtgcccaaagt

SEQ ID NO: 410645 - DNA, 20 bp, Homo sapiens
ccccacccctacagcctgca

SEQ ID NO: 410646 - DNA, 23 bp, Homo sapiens
ccccacccctacagcctgcacac

SEQ ID NO: 410647 - DNA, 13 bp, Homo sapiens
ccccaccccttcc

SEQ ID NO: 410648 - DNA, 15 bp, Homo sapiens
ccccaccccttcccc

SEQ ID NO: 410649 - DNA, 18 bp, Homo sapiens
ccccaccccttccccact

SEQ ID NO: 410650 - DNA, 22 bp, Homo sapiens
ccccaccccttccccactgcct

SEQ ID NO: 410651 - DNA, 17 bp, Homo sapiens
ccccacccgttaattta

SEQ ID NO: 410652 - DNA, 18 bp, Homo sapiens
ccccaccctcccctctcc

SEQ ID NO: 410653 - DNA, 22 bp, Homo sapiens
ccccaccctcgtggacacctgc

SEQ ID NO: 410654 - DNA, 23 bp, Homo sapiens
ccccaccctcgtggacacctgcc

SEQ ID NO: 410655 - DNA, 14 bp, Homo sapiens
ccccaccctttggg

SEQ ID NO: 410656 - DNA, 14 bp, Homo sapiens
ccccacctgccact

SEQ ID NO: 410657 - DNA, 22 bp, Homo sapiens
ccccacctgccactaggctggg

SEQ ID NO: 410658 - DNA, 14 bp, Homo sapiens
ccccaccttccaag

SEQ ID NO: 410659 - DNA, 14 bp, Homo sapiens
ccccaccttgccaa

SEQ ID NO: 410660 - DNA, 19 bp, Homo sapiens
ccccaccttgccaagcttt

SEQ ID NO: 410661 - DNA, 21 bp, Homo sapiens
ccccacgagtcacctgcaagc

SEQ ID NO: 410662 - DNA, 22 bp, Homo sapiens
ccccacggggcctcgggacctc

SEQ ID NO: 410663 - DNA, 21 bp, Homo sapiens
ccccacgtggactctgtgctc

SEQ ID NO: 410664 - DNA, 19 bp, Homo sapiens
ccccacgtggcacctcctc

SEQ ID NO: 410665 - DNA, 14 bp, Homo sapiens
ccccactccctgcc

SEQ ID NO: 410666 - DNA, 15 bp, Homo sapiens
ccccactccctgcca

SEQ ID NO: 410667 - DNA, 16 bp, Homo sapiens
ccccactccctgtcca

SEQ ID NO: 410668 - DNA, 21 bp, Homo sapiens
ccccactctaggggtcaggct

SEQ ID NO: 410669 - DNA, 18 bp, Homo sapiens
ccccactctccccacact

SEQ ID NO: 410670 - DNA, 15 bp, Homo sapiens
ccccactgacagcct

SEQ ID NO: 410671 - DNA, 18 bp, Homo sapiens
ccccacttatgctgctgt

SEQ ID NO: 410672 - DNA, 20 bp, Homo sapiens
ccccacttatgctgctgtga

SEQ ID NO: 410673 - DNA, 13 bp, Homo sapiens
ccccagaccccgc

SEQ ID NO: 410674 - DNA, 19 bp, Homo sapiens
ccccagacctgagctcccc

SEQ ID NO: 410675 - DNA, 17 bp, Homo sapiens
ccccagagaagcctcag

SEQ ID NO: 410676 - DNA, 18 bp, Homo sapiens
ccccagagactgcccacc

SEQ ID NO: 410677 - DNA, 22 bp, Homo sapiens
ccccagagactgcccaccctgg

SEQ ID NO: 410678 - DNA, 13 bp, Homo sapiens
ccccagagcactg

SEQ ID NO: 410679 - DNA, 15 bp, Homo sapiens
ccccagagccactac

SEQ ID NO: 410680 - DNA, 21 bp, Homo sapiens
ccccagagccactacctttgt

SEQ ID NO: 410681 - DNA, 22 bp, Homo sapiens
ccccagagccactacctttgtc

SEQ ID NO: 410682 - DNA, 14 bp, Homo sapiens
ccccagagccaggg

SEQ ID NO: 410683 - DNA, 22 bp, Homo sapiens
ccccagagctgtttatggcctc

SEQ ID NO: 410684 - DNA, 23 bp, Homo sapiens
ccccagagctgtttatggcctca

SEQ ID NO: 410685 - DNA, 13 bp, Homo sapiens
ccccagagggacc

SEQ ID NO: 410686 - DNA, 20 bp, Homo sapiens
ccccagagggaccagctggg

SEQ ID NO: 410687 - DNA, 15 bp, Homo sapiens
ccccctacccaccga

SEQ ID NO: 410688 - DNA, 21 bp, Homo sapiens
ccccctcatctcattcaaacc

SEQ ID NO: 410689 - DNA, 14 bp, Homo sapiens
ccccctcccccgca

SEQ ID NO: 410690 - DNA, 21 bp, Homo sapiens
ccccctcccctgcccctgccc

SEQ ID NO: 410691 - DNA, 14 bp, Homo sapiens
ccccctccctggcc

SEQ ID NO: 410692 - DNA, 21 bp, Homo sapiens
ccccctctcttaccccgtccc

SEQ ID NO: 410693 - DNA, 16 bp, Homo sapiens
ccccctgagtgggctg

SEQ ID NO: 410694 - DNA, 11 bp, Homo sapiens
ccccctgcacc

SEQ ID NO: 410695 - DNA, 13 bp, Homo sapiens
ccccctgcaccca

SEQ ID NO: 410696 - DNA, 12 bp, Homo sapiens
ccccctgcccca

SEQ ID NO: 410697 - DNA, 13 bp, Homo sapiens
ccccctgccccag

SEQ ID NO: 410698 - DNA, 15 bp, Homo sapiens
ccccctgccccagag

SEQ ID NO: 410699 - DNA, 22 bp, Homo sapiens
ccccctggatgtcccctgtccc

SEQ ID NO: 410700 - DNA, 19 bp, Homo sapiens
ccccctggggcttctcctg

SEQ ID NO: 410701 - DNA, 16 bp, Homo sapiens
ccccctggggggcaca

SEQ ID NO: 410702 - DNA, 19 bp, Homo sapiens
ccccctggggggcacagcc

SEQ ID NO: 410703 - DNA, 17 bp, Homo sapiens
ccccctgtcccattcta

SEQ ID NO: 410704 - DNA, 12 bp, Homo sapiens
ccccctgtcctt

SEQ ID NO: 410705 - DNA, 21 bp, Homo sapiens
ccccctgtccttcccacggcc

SEQ ID NO: 410706 - DNA, 21 bp, Homo sapiens
ccccctgtgcccacccagggc

SEQ ID NO: 410707 - DNA, 14 bp, Homo sapiens
cccccttctcccac

SEQ ID NO: 410708 - DNA, 15 bp, Homo sapiens
cccccttctctgctc

SEQ ID NO: 410709 - DNA, 22 bp, Homo sapiens
cccccttctctgctccaccaca

SEQ ID NO: 410710 - DNA, 17 bp, Homo sapiens
ccccctttcagatgtct

SEQ ID NO: 410711 - DNA, 12 bp, Homo sapiens
ccccgagctggg

SEQ ID NO: 410712 - DNA, 16 bp, Homo sapiens
ccccgcagacagacag

SEQ ID NO: 410713 - DNA, 21 bp, Homo sapiens
ccccgcagtccccagcccttc

SEQ ID NO: 410714 - DNA, 16 bp, Homo sapiens
ccccgccccagagctc

SEQ ID NO: 410715 - DNA, 21 bp, Homo sapiens
ccccgcccccacccctacagc

SEQ ID NO: 410716 - DNA, 22 bp, Homo sapiens
ccccgcccccacccctacagcc

SEQ ID NO: 410717 - DNA, 13 bp, Homo sapiens
ccccgccccccag

SEQ ID NO: 410718 - DNA, 14 bp, Homo sapiens
ccccgccccccaga

SEQ ID NO: 410719 - DNA, 17 bp, Homo sapiens
ccccgccccccagagcc

SEQ ID NO: 410720 - DNA, 18 bp, Homo sapiens
ccccgccccccagagcca

SEQ ID NO: 410721 - DNA, 18 bp, Homo sapiens
ccccgcccgccctcctct

SEQ ID NO: 410722 - DNA, 19 bp, Homo sapiens
ccccgccttccctcactct

SEQ ID NO: 410723 - DNA, 16 bp, Homo sapiens
ccccgcggtgctctgg

SEQ ID NO: 410724 - DNA, 17 bp, Homo sapiens
ccccgcggtgctctggc

SEQ ID NO: 410725 - DNA, 16 bp, Homo sapiens
ccccgctcatgggccc

SEQ ID NO: 410726 - DNA, 23 bp, Homo sapiens
ccccgctcatgggcccctctgac

SEQ ID NO: 410727 - DNA, 12 bp, Homo sapiens
ccccgctctgcc

SEQ ID NO: 410728 - DNA, 20 bp, Homo sapiens
ccccgctgcctggcgggcag

SEQ ID NO: 410729 - DNA, 21 bp, Homo sapiens
ccccgctgcctggcgggcagc

SEQ ID NO: 410730 - DNA, 17 bp, Homo sapiens
ccccgcttcctccctct

SEQ ID NO: 410731 - DNA, 20 bp, Homo sapiens
ccccggagcaccacggggtc

SEQ ID NO: 410732 - DNA, 13 bp, Homo sapiens
ccccggaggaagc

SEQ ID NO: 410733 - DNA, 14 bp, Homo sapiens
ccccggaggaagct

SEQ ID NO: 410734 - DNA, 19 bp, Homo sapiens
ccccggaggaagcttgggg

SEQ ID NO: 410735 - DNA, 18 bp, Homo sapiens
ccccggcaggccctgcag

SEQ ID NO: 410736 - DNA, 20 bp, Homo sapiens
ccccggccactccctgccaa

SEQ ID NO: 410737 - DNA, 21 bp, Homo sapiens
ccccggccactccctgccaac

SEQ ID NO: 410738 - DNA, 18 bp, Homo sapiens
ccccggccctaccagcgc

SEQ ID NO: 410739 - DNA, 18 bp, Homo sapiens
ccccgggctctctgctgt

SEQ ID NO: 410740 - DNA, 20 bp, Homo sapiens
ccccgggctctggccaccct

SEQ ID NO: 410741 - DNA, 21 bp, Homo sapiens
ccccggggcatggacagggcc

SEQ ID NO: 410742 - DNA, 23 bp, Homo sapiens
ccccggggcatggacagggccag

SEQ ID NO: 410743 - DNA, 15 bp, Homo sapiens
ccccgggtgcctgtg

SEQ ID NO: 410744 - DNA, 16 bp, Homo sapiens
ccccgtccctttccct

SEQ ID NO: 410745 - DNA, 15 bp, Homo sapiens
ccccgtcggactgcc

SEQ ID NO: 410746 - DNA, 13 bp, Homo sapiens
ccccgtgcggccc

SEQ ID NO: 410747 - DNA, 17 bp, Homo sapiens
ccccgtgggccatggca

SEQ ID NO: 410748 - DNA, 17 bp, Homo sapiens
ccccgtgtctggatgca

SEQ ID NO: 410749 - DNA, 17 bp, Homo sapiens
cccctaagtgcccaaag

SEQ ID NO: 410750 - DNA, 19 bp, Homo sapiens
cccctaagtgcccaaagtg

SEQ ID NO: 410751 - DNA, 18 bp, Homo sapiens
cccctacagcctgcacac

SEQ ID NO: 410752 - DNA, 13 bp, Homo sapiens
cccctaccccaca

SEQ ID NO: 410753 - DNA, 22 bp, Homo sapiens
cccctaggactcaggcctgcca

SEQ ID NO: 410754 - DNA, 23 bp, Homo sapiens
cccctaggactcaggcctgccaa

SEQ ID NO: 410755 - DNA, 16 bp, Homo sapiens
cccctataccctaggt

SEQ ID NO: 410756 - DNA, 15 bp, Homo sapiens
cccctatcctctgag

SEQ ID NO: 410757 - DNA, 16 bp, Homo sapiens
cccctatcctctgagt

SEQ ID NO: 410758 - DNA, 13 bp, Homo sapiens
cccctatcctgca

SEQ ID NO: 410759 - DNA, 14 bp, Homo sapiens
cccctatcctgcac

SEQ ID NO: 410760 - DNA, 21 bp, Homo sapiens
cccctatcctgcaccctctgc

SEQ ID NO: 410761 - DNA, 12 bp, Homo sapiens
cccctatcctgt

SEQ ID NO: 410762 - DNA, 14 bp, Homo sapiens
cccctatccttggc

SEQ ID NO: 410763 - DNA, 15 bp, Homo sapiens
cccctatccttggca

SEQ ID NO: 410764 - DNA, 12 bp, Homo sapiens
cccctcaacctc

SEQ ID NO: 410765 - DNA, 11 bp, Homo sapiens
cccctcacctc

SEQ ID NO: 410766 - DNA, 15 bp, Homo sapiens
cccctcacctgggca

SEQ ID NO: 410767 - DNA, 15 bp, Homo sapiens
cccctcacctgggcc

SEQ ID NO: 410768 - DNA, 17 bp, Homo sapiens
cccctcacctgggcctt

SEQ ID NO: 410769 - DNA, 15 bp, Homo sapiens
cccctcaccttgcaa

SEQ ID NO: 410770 - DNA, 15 bp, Homo sapiens
cccctcagcccttgc

SEQ ID NO: 410771 - DNA, 17 bp, Homo sapiens
cccctcagcccttgccc

SEQ ID NO: 410772 - DNA, 11 bp, Homo sapiens
cccctccagac

SEQ ID NO: 410773 - DNA, 12 bp, Homo sapiens
cccctccagacc

SEQ ID NO: 410774 - DNA, 13 bp, Homo sapiens
cccctccagaccc

SEQ ID NO: 410775 - DNA, 14 bp, Homo sapiens
cccctccagacccc

SEQ ID NO: 410776 - DNA, 16 bp, Homo sapiens
cccctccagaccctgc

SEQ ID NO: 410777 - DNA, 16 bp, Homo sapiens
cccctccaggcatgct

SEQ ID NO: 410778 - DNA, 22 bp, Homo sapiens
cccctccagtgcttggctgccc

SEQ ID NO: 410779 - DNA, 15 bp, Homo sapiens
cccctccagtgttgc

SEQ ID NO: 410780 - DNA, 21 bp, Homo sapiens
cccctcccaagcgttcctggc

SEQ ID NO: 410781 - DNA, 16 bp, Homo sapiens
cccctcccaccacagc

SEQ ID NO: 410782 - DNA, 14 bp, Homo sapiens
cccctcccacctcc

SEQ ID NO: 410783 - DNA, 14 bp, Homo sapiens
cccctcccagacag

SEQ ID NO: 410784 - DNA, 21 bp, Homo sapiens
cccctcccagacaggccctcc

SEQ ID NO: 410785 - DNA, 22 bp, Homo sapiens
cccctcccagacaggccctccc

SEQ ID NO: 410786 - DNA, 12 bp, Homo sapiens
cccctcccatgg

SEQ ID NO: 410787 - DNA, 16 bp, Homo sapiens
cccctccccagccagc

SEQ ID NO: 410788 - DNA, 14 bp, Homo sapiens
cccctccctctgcc

SEQ ID NO: 410789 - DNA, 15 bp, Homo sapiens
cccctccctctgctc

SEQ ID NO: 410790 - DNA, 16 bp, Homo sapiens
cccctccctctgctct

SEQ ID NO: 410791 - DNA, 14 bp, Homo sapiens
cccctccctggctc

SEQ ID NO: 410792 - DNA, 15 bp, Homo sapiens
cccctcccttcaacc

SEQ ID NO: 410793 - DNA, 16 bp, Homo sapiens
cccctccgtccccagg

SEQ ID NO: 410794 - DNA, 20 bp, Homo sapiens
cccctccgtccccagggtgc

SEQ ID NO: 410795 - DNA, 23 bp, Homo sapiens
ccctcgcttcataggcagagccc

SEQ ID NO: 410796 - DNA, 17 bp, Homo sapiens
ccctcggaagccgtctg

SEQ ID NO: 410797 - DNA, 18 bp, Homo sapiens
ccctcggcattcacacac

SEQ ID NO: 410798 - DNA, 19 bp, Homo sapiens
ccctcggcattcacacaca

SEQ ID NO: 410799 - DNA, 22 bp, Homo sapiens
ccctcggcattcacacacagcc

SEQ ID NO: 410800 - DNA, 13 bp, Homo sapiens
ccctcggctaccc

SEQ ID NO: 410801 - DNA, 15 bp, Homo sapiens
ccctcggtcagcacc

SEQ ID NO: 410802 - DNA, 21 bp, Homo sapiens
ccctcggtcagcaccgtggtg

SEQ ID NO: 410803 - DNA, 23 bp, Homo sapiens
ccctcgtccacaggggcaggcct

SEQ ID NO: 410804 - DNA, 21 bp, Homo sapiens
ccctcgtcctgtcccagaggt

SEQ ID NO: 410805 - DNA, 15 bp, Homo sapiens
ccctcgtctccctgg

SEQ ID NO: 410806 - DNA, 23 bp, Homo sapiens
ccctcgtggacacctgccctgcc

SEQ ID NO: 410807 - DNA, 19 bp, Homo sapiens
ccctctaatgctcacgctc

SEQ ID NO: 410808 - DNA, 18 bp, Homo sapiens
ccctctcatccaggtcct

SEQ ID NO: 410809 - DNA, 11 bp, Homo sapiens
ccctctctctg

SEQ ID NO: 410810 - DNA, 13 bp, Homo sapiens
ccctctctctggg

SEQ ID NO: 410811 - DNA, 13 bp, Homo sapiens
ccctctctcttct

SEQ ID NO: 410812 - DNA, 15 bp, Homo sapiens
ccctctctcttctgc

SEQ ID NO: 410813 - DNA, 18 bp, Homo sapiens
ccctctctcttctgctcc

SEQ ID NO: 410814 - DNA, 23 bp, Homo sapiens
ccctctctcttctgctccaccct

SEQ ID NO: 410815 - DNA, 17 bp, Homo sapiens
ccctctctgcacctgtc

SEQ ID NO: 410816 - DNA, 12 bp, Homo sapiens
ccctctgcaggg

SEQ ID NO: 410817 - DNA, 12 bp, Homo sapiens
ccctctgcccca

SEQ ID NO: 410818 - DNA, 19 bp, Homo sapiens
ccctctgccgaccgcctgc

SEQ ID NO: 410819 - DNA, 22 bp, Homo sapiens
ccctctgccgaccgcctgcttc

SEQ ID NO: 410820 - DNA, 24 bp, Homo sapiens
ccctctgccgaccgcctgcttcac

SEQ ID NO: 410821 - DNA, 14 bp, Homo sapiens
ccctctgcctgtcc

SEQ ID NO: 410822 - DNA, 15 bp, Homo sapiens
ccctctgcctgtccc

SEQ ID NO: 410823 - DNA, 23 bp, Homo sapiens
ccctctgcctgtccctctcaggc

SEQ ID NO: 410824 - DNA, 21 bp, Homo sapiens
ccctctgctatgtctgtgatg

SEQ ID NO: 410825 - DNA, 12 bp, Homo sapiens
ccctctgctctc

SEQ ID NO: 410826 - DNA, 18 bp, Homo sapiens
ccctctgctctcatagga

SEQ ID NO: 410827 - DNA, 12 bp, Homo sapiens
ccctctggccag

SEQ ID NO: 410828 - DNA, 18 bp, Homo sapiens
ccctctggccaggatgga

SEQ ID NO: 410829 - DNA, 22 bp, Homo sapiens
ccctctggccaggatggagggg

SEQ ID NO: 410830 - DNA, 17 bp, Homo sapiens
ccctctggtccttctga

SEQ ID NO: 410831 - DNA, 13 bp, Homo sapiens
ccctctgtagctc

SEQ ID NO: 410832 - DNA, 13 bp, Homo sapiens
ccctctgtgccta

SEQ ID NO: 410833 - DNA, 14 bp, Homo sapiens
ccctctgtgcctaa

SEQ ID NO: 410834 - DNA, 15 bp, Homo sapiens
ccctctgtgcctaat

SEQ ID NO: 410835 - DNA, 19 bp, Homo sapiens
ccctctgtgcctaataaag

SEQ ID NO: 410836 - DNA, 21 bp, Homo sapiens
ccctctgtgcctaataaagtc

SEQ ID NO: 410837 - DNA, 17 bp, Homo sapiens
ccctctgttcagtaaca

SEQ ID NO: 410838 - DNA, 21 bp, Homo sapiens
ccctctgttctggtggcccca

SEQ ID NO: 410839 - DNA, 19 bp, Homo sapiens
ccctcttattgttcctctt

SEQ ID NO: 410840 - DNA, 14 bp, Homo sapiens
ccctcttccccctt

SEQ ID NO: 410841 - DNA, 15 bp, Homo sapiens
ccctcttctcagctc

SEQ ID NO: 410842 - DNA, 18 bp, Homo sapiens
ccctcttctcagctccac

SEQ ID NO: 410843 - DNA, 13 bp, Homo sapiens
ccctctttcctgt

SEQ ID NO: 410844 - DNA, 15 bp, Homo sapiens
ccctctttcctgtgc

SEQ ID NO: 410845 - DNA, 15 bp, Homo sapiens
ccctctttctctctg

SEQ ID NO: 410846 - DNA, 18 bp, Homo sapiens
ccctctttctctctgtgt

SEQ ID NO: 410847 - DNA, 19 bp, Homo sapiens
ccctctttctctctgtgtg

SEQ ID NO: 410848 - DNA, 19 bp, Homo sapiens
ccctgaaaacgaaggggcc

SEQ ID NO: 410849 - DNA, 23 bp, Homo sapiens
ccctgaaaatgtttttctgccag

SEQ ID NO: 410850 - DNA, 22 bp, Homo sapiens
ccctgaattgtttgatattgtc

SEQ ID NO: 410851 - DNA, 17 bp, Homo sapiens
ccctgacctccctctaa

SEQ ID NO: 410852 - DNA, 18 bp, Homo sapiens
ccctgaccttagcgttct

SEQ ID NO: 410853 - DNA, 15 bp, Homo sapiens
ccctgaccttggctg

SEQ ID NO: 410854 - DNA, 20 bp, Homo sapiens
ccctgaccttggctgactgg

SEQ ID NO: 410855 - DNA, 23 bp, Homo sapiens
ccctgaccttggctgactggggc

SEQ ID NO: 410856 - DNA, 20 bp, Homo sapiens
ccctgacttcccagctggca

SEQ ID NO: 410857 - DNA, 22 bp, Homo sapiens
ccctgacttcccagctggcagc

SEQ ID NO: 410858 - DNA, 14 bp, Homo sapiens
ccctgagactccag

SEQ ID NO: 410859 - DNA, 15 bp, Homo sapiens
ccctgagactccaga

SEQ ID NO: 410860 - DNA, 13 bp, Homo sapiens
ccctgagaggttt

SEQ ID NO: 410861 - DNA, 12 bp, Homo sapiens
ccctgaggactg

SEQ ID NO: 410862 - DNA, 13 bp, Homo sapiens
ccctgaggactgg

SEQ ID NO: 410863 - DNA, 13 bp, Homo sapiens
ccctgagtgaaca

SEQ ID NO: 410864 - DNA, 23 bp, Homo sapiens
ccctgagttgcaccattctttct

SEQ ID NO: 410865 - DNA, 19 bp, Homo sapiens
ccctgatgcgtctacccag

SEQ ID NO: 410866 - DNA, 20 bp, Homo sapiens
ccctgatgttcgccgtctgg

SEQ ID NO: 410867 - DNA, 16 bp, Homo sapiens
ccctgatttcttgctt

SEQ ID NO: 410868 - DNA, 15 bp, Homo sapiens
ccctgcaaaggactg

SEQ ID NO: 410869 - DNA, 10 bp, Homo sapiens
ccctgcaaat

SEQ ID NO: 410870 - DNA, 23 bp, Homo sapiens
ccctgcaaatttttttgtatttt

SEQ ID NO: 410871 - DNA, 20 bp, Homo sapiens
ccctgcaatgtatcccttct

SEQ ID NO: 410872 - DNA, 23 bp, Homo sapiens
ccctgcacaaagcccttccatgt

SEQ ID NO: 410873 - DNA, 13 bp, Homo sapiens
ccctgcacccacc

SEQ ID NO: 410874 - DNA, 14 bp, Homo sapiens
ccctgcacccaccc

SEQ ID NO: 410875 - DNA, 16 bp, Homo sapiens
ccctgcacccacccct

SEQ ID NO: 410876 - DNA, 18 bp, Homo sapiens
ccctgcacccacccctgc

SEQ ID NO: 410877 - DNA, 20 bp, Homo sapiens
ccctgcacccacccctgccc

SEQ ID NO: 410878 - DNA, 12 bp, Homo sapiens
ccctgcaccctg

SEQ ID NO: 410879 - DNA, 16 bp, Homo sapiens
ccctgcaccctggaaa

SEQ ID NO: 410880 - DNA, 14 bp, Homo sapiens
ccctgcacccttgt

SEQ ID NO: 410881 - DNA, 16 bp, Homo sapiens
ccctgcactgtaaaat

SEQ ID NO: 410882 - DNA, 19 bp, Homo sapiens
ccctgcaggaggcctggga

SEQ ID NO: 410883 - DNA, 13 bp, Homo sapiens
ccctgcaggggag

SEQ ID NO: 410884 - DNA, 13 bp, Homo sapiens
ccctgcagtgttc

SEQ ID NO: 410885 - DNA, 13 bp, Homo sapiens
ccctgcatccctt

SEQ ID NO: 410886 - DNA, 14 bp, Homo sapiens
ccctgcatcccttg

SEQ ID NO: 410887 - DNA, 16 bp, Homo sapiens
ccctgcatcccttggc

SEQ ID NO: 410888 - DNA, 22 bp, Homo sapiens
ccctgcatcccttggcccctct

SEQ ID NO: 410889 - DNA, 20 bp, Homo sapiens
ccctgccaactttccagact

SEQ ID NO: 410890 - DNA, 16 bp, Homo sapiens
ccctgccaagcctgga

SEQ ID NO: 410891 - DNA, 16 bp, Homo sapiens
ccctgccaccgtcaca

SEQ ID NO: 410892 - DNA, 11 bp, Homo sapiens
ccctgccagca

SEQ ID NO: 410893 - DNA, 18 bp, Homo sapiens
ccctgccaggctgtcagc

SEQ ID NO: 410894 - DNA, 22 bp, Homo sapiens
ccctgccagtgaagtccttcag

SEQ ID NO: 410895 - DNA, 10 bp, Homo sapiens
ccctgcccaa

SEQ ID NO: 410896 - DNA, 14 bp, Homo sapiens
ccctgcccaagggc

SEQ ID NO: 410897 - DNA, 20 bp, Homo sapiens
ccctgcccaccctctggaga

SEQ ID NO: 410898 - DNA, 12 bp, Homo sapiens
ccctgccccaca

SEQ ID NO: 410899 - DNA, 13 bp, Homo sapiens
cctcctgccccct

SEQ ID NO: 410900 - DNA, 16 bp, Homo sapiens
cctcctgccccctgcc

SEQ ID NO: 410901 - DNA, 19 bp, Homo sapiens
cctcctgccccctgccagt

SEQ ID NO: 410902 - DNA, 23 bp, Homo sapiens
cctcctgccctgtccctgtcccc

SEQ ID NO: 410903 - DNA, 14 bp, Homo sapiens
cctcctgctgagtg

SEQ ID NO: 410904 - DNA, 12 bp, Homo sapiens
cctcctgctggc

SEQ ID NO: 410905 - DNA, 23 bp, Homo sapiens
cctcctggacccagcaggggcag

SEQ ID NO: 410906 - DNA, 22 bp, Homo sapiens
cctcctggagcagcagctgagg

SEQ ID NO: 410907 - DNA, 16 bp, Homo sapiens
cctcctggccggggcc

SEQ ID NO: 410908 - DNA, 20 bp, Homo sapiens
cctcctggctcacagccacc

SEQ ID NO: 410909 - DNA, 17 bp, Homo sapiens
cctcctgggcatgtttg

SEQ ID NO: 410910 - DNA, 21 bp, Homo sapiens
cctcctgggcccaggcagcac

SEQ ID NO: 410911 - DNA, 20 bp, Homo sapiens
cctcctgtctcctctgtcag

SEQ ID NO: 410912 - DNA, 16 bp, Homo sapiens
cctcctgttgccacac

SEQ ID NO: 410913 - DNA, 17 bp, Homo sapiens
cctcctgttgccacact

SEQ ID NO: 410914 - DNA, 16 bp, Homo sapiens
cctccttagaaaagac

SEQ ID NO: 410915 - DNA, 16 bp, Homo sapiens
cctccttccacctccc

SEQ ID NO: 410916 - DNA, 19 bp, Homo sapiens
cctccttccacctccctcc

SEQ ID NO: 410917 - DNA, 16 bp, Homo sapiens
cctccttcttgccctg

SEQ ID NO: 410918 - DNA, 20 bp, Homo sapiens
cctccttcttgccctgagct

SEQ ID NO: 410919 - DNA, 13 bp, Homo sapiens
cctccttgccacc

SEQ ID NO: 410920 - DNA, 18 bp, Homo sapiens
cctccttgccaccccccg

SEQ ID NO: 410921 - DNA, 16 bp, Homo sapiens
cctcgaaccaaggcag

SEQ ID NO: 410922 - DNA, 19 bp, Homo sapiens
cctcgaaccaaggcagcct

SEQ ID NO: 410923 - DNA, 20 bp, Homo sapiens
cctcgaaccaaggcagcctc

SEQ ID NO: 410924 - DNA, 21 bp, Homo sapiens
cctcgaacccacactgcaaca

SEQ ID NO: 410925 - DNA, 14 bp, Homo sapiens
cctcgaactcctgg

SEQ ID NO: 410926 - DNA, 15 bp, Homo sapiens
cctcgaactcctggg

SEQ ID NO: 410927 - DNA, 16 bp, Homo sapiens
cctcgaactcctgggc

SEQ ID NO: 410928 - DNA, 19 bp, Homo sapiens
cctcgcggcgcagcccctg

SEQ ID NO: 410929 - DNA, 13 bp, Homo sapiens
cctcgctgctgct

SEQ ID NO: 410930 - DNA, 12 bp, Homo sapiens
cctcgctgcttc

SEQ ID NO: 410931 - DNA, 13 bp, Homo sapiens
cctcgctgtgcca

SEQ ID NO: 410932 - DNA, 16 bp, Homo sapiens
cctcgctgtgccacca

SEQ ID NO: 410933 - DNA, 17 bp, Homo sapiens
cctcgctgtgccaccac

SEQ ID NO: 410934 - DNA, 21 bp, Homo sapiens
cctcgctgtgccaccacccct

SEQ ID NO: 410935 - DNA, 18 bp, Homo sapiens
cctcgcttcataggcaga

SEQ ID NO: 410936 - DNA, 20 bp, Homo sapiens
cctcgcttcataggcagagc

SEQ ID NO: 410937 - DNA, 13 bp, Homo sapiens
cctcggagcctgt

SEQ ID NO: 410938 - DNA, 19 bp, Homo sapiens
cctcggcattcacacacag

SEQ ID NO: 410939 - DNA, 15 bp, Homo sapiens
cctcggccccaccca

SEQ ID NO: 410940 - DNA, 14 bp, Homo sapiens
cctcggcctctact

SEQ ID NO: 410941 - DNA, 19 bp, Homo sapiens
cctcggctgtgtggggagg

SEQ ID NO: 410942 - DNA, 18 bp, Homo sapiens
cctcggcttgtgggctgg

SEQ ID NO: 410943 - DNA, 15 bp, Homo sapiens
cctcgggcaagggcc

SEQ ID NO: 410944 - DNA, 16 bp, Homo sapiens
cctcgggccgcctcct

SEQ ID NO: 410945 - DNA, 17 bp, Homo sapiens
cctcgggccgcctcctc

SEQ ID NO: 410946 - DNA, 19 bp, Homo sapiens
cctcggggcaggaagtccc

SEQ ID NO: 410947 - DNA, 15 bp, Homo sapiens
cctcggtcacctgtg

SEQ ID NO: 410948 - DNA, 17 bp, Homo sapiens
cctcggtcacctgtgct

SEQ ID NO: 410949 - DNA, 22 bp, Homo sapiens
cctctcctgcccagctctgacc

SEQ ID NO: 410950 - DNA, 16 bp, Homo sapiens
cctctccttgccccag

SEQ ID NO: 410951 - DNA, 21 bp, Homo sapiens
cctctccttgccccagtcctg

SEQ ID NO: 410952 - DNA, 22 bp, Homo sapiens
cctctccttgccccagtcctgg

SEQ ID NO: 410953 - DNA, 14 bp, Homo sapiens
cctctccttgggct

SEQ ID NO: 410954 - DNA, 20 bp, Homo sapiens
cctctccttgggctcctggc

SEQ ID NO: 410955 - DNA, 22 bp, Homo sapiens
cctctccttgggctcctggctg

SEQ ID NO: 410956 - DNA, 13 bp, Homo sapiens
cctctccttttga

SEQ ID NO: 410957 - DNA, 22 bp, Homo sapiens
cctctcgccaagccatcacagg

SEQ ID NO: 410958 - DNA, 16 bp, Homo sapiens
cctctcgccccatccc

SEQ ID NO: 410959 - DNA, 19 bp, Homo sapiens
cctctcgctcccctctgcc

SEQ ID NO: 410960 - DNA, 19 bp, Homo sapiens
cctctcggtggccagcagg

SEQ ID NO: 410961 - DNA, 19 bp, Homo sapiens
cctctctcaggagtatctt

SEQ ID NO: 410962 - DNA, 16 bp, Homo sapiens
cctctctccctgcctc

SEQ ID NO: 410963 - DNA, 18 bp, Homo sapiens
cctctctccctgcctcac

SEQ ID NO: 410964 - DNA, 19 bp, Homo sapiens
cctctctccctgcctcaca

SEQ ID NO: 410965 - DNA, 20 bp, Homo sapiens
cctctctccctgcctcacat

SEQ ID NO: 410966 - DNA, 23 bp, Homo sapiens
cctctctccctgcctcacatctc

SEQ ID NO: 410967 - DNA, 18 bp, Homo sapiens
cctctctctccctccact

SEQ ID NO: 410968 - DNA, 21 bp, Homo sapiens
cctctctctccctccactcct

SEQ ID NO: 410969 - DNA, 21 bp, Homo sapiens
cctctctctgctcctcacccc

SEQ ID NO: 410970 - DNA, 13 bp, Homo sapiens
cctctctctgggc

SEQ ID NO: 410971 - DNA, 22 bp, Homo sapiens
cctctctgatcttgtgctcagc

SEQ ID NO: 410972 - DNA, 14 bp, Homo sapiens
cctctctgctgggt

SEQ ID NO: 410973 - DNA, 19 bp, Homo sapiens
cctctctgctgggtttcca

SEQ ID NO: 410974 - DNA, 19 bp, Homo sapiens
cctctctgtagtttatggc

SEQ ID NO: 410975 - DNA, 12 bp, Homo sapiens
cctctctgtctt

SEQ ID NO: 410976 - DNA, 13 bp, Homo sapiens
cctctctgtttac

SEQ ID NO: 410977 - DNA, 17 bp, Homo sapiens
cctctcttaccccgtcc

SEQ ID NO: 410978 - DNA, 18 bp, Homo sapiens
cctctcttggactccctc

SEQ ID NO: 410979 - DNA, 22 bp, Homo sapiens
cctctcttgtgagccatagaga

SEQ ID NO: 410980 - DNA, 20 bp, Homo sapiens
cctctgaaaacggccctctt

SEQ ID NO: 410981 - DNA, 11 bp, Homo sapiens
cctctgaaaat

SEQ ID NO: 410982 - DNA, 17 bp, Homo sapiens
cctctgaaaatattttt

SEQ ID NO: 410983 - DNA, 23 bp, Homo sapiens
cctctgaaaatatttttttctag

SEQ ID NO: 410984 - DNA, 14 bp, Homo sapiens
cctctgaagagctg

SEQ ID NO: 410985 - DNA, 15 bp, Homo sapiens
cctctgaagagctga

SEQ ID NO: 410986 - DNA, 22 bp, Homo sapiens
cctctgactcccaaagagctgc

SEQ ID NO: 410987 - DNA, 18 bp, Homo sapiens
cctctgactctgagtcca

SEQ ID NO: 410988 - DNA, 16 bp, Homo sapiens
cctctgagcaactgtg

SEQ ID NO: 410989 - DNA, 22 bp, Homo sapiens
cctctgagcaactgtgcagcac

SEQ ID NO: 410990 - DNA, 16 bp, Homo sapiens
cctctgagcagcctct

SEQ ID NO: 410991 - DNA, 11 bp, Homo sapiens
cctctgagcca

SEQ ID NO: 410992 - DNA, 21 bp, Homo sapiens
cctctgagccaggagcctcct

SEQ ID NO: 410993 - DNA, 21 bp, Homo sapiens
cctctgatcaaagcaccttga

SEQ ID NO: 410994 - DNA, 16 bp, Homo sapiens
cctctgattatcaggt

SEQ ID NO: 410995 - DNA, 12 bp, Homo sapiens
cctctgcagctg

SEQ ID NO: 410996 - DNA, 17 bp, Homo sapiens
cctctgcagctgacctc

SEQ ID NO: 410997 - DNA, 22 bp, Homo sapiens
cctctgcagctgacctctgttg

SEQ ID NO: 410998 - DNA, 12 bp, Homo sapiens
cctctgcaggac

SEQ ID NO: 410999 - DNA, 13 bp, Homo sapiens
cctctgcaggaca

SEQ ID NO: 411000 - DNA, 14 bp, Homo sapiens
cctctgcagggcag

SEQ ID NO: 411001 - DNA, 17 bp, Homo sapiens
cctctgcagggcagcct

SEQ ID NO: 411002 - DNA, 18 bp, Homo sapiens
cctctgcagggcagcctg

SEQ ID NO: 411003 - DNA, 11 bp, Homo sapiens
cctctgcccag

SEQ ID NO: 411004 - DNA, 14 bp, Homo sapiens
cctctgcccagctt

SEQ ID NO: 411005 - DNA, 16 bp, Homo sapiens
cctctgcccagcttgg

SEQ ID NO: 411006 - DNA, 12 bp, Homo sapiens
cctctgccccca

SEQ ID NO: 411007 - DNA, 21 bp, Homo sapiens
cctctgcccccagctgctcct

SEQ ID NO: 411008 - DNA, 19 bp, Homo sapiens
cctctgccccctcccccgc

SEQ ID NO: 411009 - DNA, 14 bp, Homo sapiens
cctctgccccgtct

SEQ ID NO: 411010 - DNA, 18 bp, Homo sapiens
cctctgcccgcagagccc

SEQ ID NO: 411011 - DNA, 16 bp, Homo sapiens
cctctgccctgcctcc

SEQ ID NO: 411012 - DNA, 22 bp, Homo sapiens
cctctgccgaccgcctgcttca

SEQ ID NO: 411013 - DNA, 18 bp, Homo sapiens
cctctgccggtcccccat

SEQ ID NO: 411014 - DNA, 22 bp, Homo sapiens
cctctgccggtcccccatgcca

SEQ ID NO: 411015 - DNA, 14 bp, Homo sapiens
cctctgcctccagg

SEQ ID NO: 411016 - DNA, 16 bp, Homo sapiens
cctctgcctccaggag

SEQ ID NO: 411017 - DNA, 17 bp, Homo sapiens
cctctgcctccaggagg

SEQ ID NO: 411018 - DNA, 15 bp, Homo sapiens
cctctgcctgtccct

SEQ ID NO: 411019 - DNA, 16 bp, Homo sapiens
cctctgcctgtccctc

SEQ ID NO: 411020 - DNA, 18 bp, Homo sapiens
cctctgcctgtccctctc

SEQ ID NO: 411021 - DNA, 19 bp, Homo sapiens
cctctgcctgtccctctca

SEQ ID NO: 411022 - DNA, 20 bp, Homo sapiens
cctctgccttagaggagccc

SEQ ID NO: 411023 - DNA, 17 bp, Homo sapiens
cctctgctatgtctgtg

SEQ ID NO: 411024 - DNA, 19 bp, Homo sapiens
cctctgctatgtctgtgat

SEQ ID NO: 411025 - DNA, 20 bp, Homo sapiens
cctctgctatgtctgtgatg

SEQ ID NO: 411026 - DNA, 11 bp, Homo sapiens
cctctgctcca

SEQ ID NO: 411027 - DNA, 22 bp, Homo sapiens
cctctgctcctggagcctttga

SEQ ID NO: 411028 - DNA, 12 bp, Homo sapiens
cctctgctctca

SEQ ID NO: 411029 - DNA, 14 bp, Homo sapiens
cctctgctctcata

SEQ ID NO: 411030 - DNA, 12 bp, Homo sapiens
cctctgctgccc

SEQ ID NO: 411031 - DNA, 13 bp, Homo sapiens
cctctgctgccca

SEQ ID NO: 411032 - DNA, 21 bp, Homo sapiens
cctctgctggcacatttcccc

SEQ ID NO: 411033 - DNA, 23 bp, Homo sapiens
cctctgctggccgggcacagctg

SEQ ID NO: 411034 - DNA, 15 bp, Homo sapiens
cctctgctgtcctgc

SEQ ID NO: 411035 - DNA, 16 bp, Homo sapiens
cctctggaattgctca

SEQ ID NO: 411036 - DNA, 18 bp, Homo sapiens
cctctggactggctagag

SEQ ID NO: 411037 - DNA, 18 bp, Homo sapiens
cctctggaggcctctggg

SEQ ID NO: 411038 - DNA, 19 bp, Homo sapiens
cctctggaggcctctgggc

SEQ ID NO: 411039 - DNA, 22 bp, Homo sapiens
cctctggaggcctctgggcctc

SEQ ID NO: 411040 - DNA, 18 bp, Homo sapiens
cctctggattgtgggaat

SEQ ID NO: 411041 - DNA, 18 bp, Homo sapiens
cctctggccaaatatgca

SEQ ID NO: 411042 - DNA, 20 bp, Homo sapiens
cctctggccaaatatgcact

SEQ ID NO: 411043 - DNA, 23 bp, Homo sapiens
cctctggccaaatatgcactttc

SEQ ID NO: 411044 - DNA, 13 bp, Homo sapiens
cctctggctagag

SEQ ID NO: 411045 - DNA, 21 bp, Homo sapiens
cgaggcgggggatcctggagc

SEQ ID NO: 411046 - DNA, 15 bp, Homo sapiens
cgaggctccccgcct

SEQ ID NO: 411047 - DNA, 20 bp, Homo sapiens
cgaggctccccgcctccact

SEQ ID NO: 411048 - DNA, 12 bp, Homo sapiens
cgaggctgcctc

SEQ ID NO: 411049 - DNA, 15 bp, Homo sapiens
cgaggctgcctctgg

SEQ ID NO: 411050 - DNA, 16 bp, Homo sapiens
cgaggctggagctggc

SEQ ID NO: 411051 - DNA, 15 bp, Homo sapiens
cgaggctgggccaag

SEQ ID NO: 411052 - DNA, 11 bp, Homo sapiens
cgagggagggg

SEQ ID NO: 411053 - DNA, 14 bp, Homo sapiens
cgagggaggggagg

SEQ ID NO: 411054 - DNA, 14 bp, Homo sapiens
cgagggcggccagg

SEQ ID NO: 411055 - DNA, 19 bp, Homo sapiens
cgagggcggccagggacag

SEQ ID NO: 411056 - DNA, 22 bp, Homo sapiens
cgagggcggcccctctgttctg

SEQ ID NO: 411057 - DNA, 18 bp, Homo sapiens
cgaggtggtagctctgag

SEQ ID NO: 411058 - DNA, 19 bp, Homo sapiens
cgagtaccccagccactcc

SEQ ID NO: 411059 - DNA, 20 bp, Homo sapiens
cgagtagctgggattacagg

SEQ ID NO: 411060 - DNA, 18 bp, Homo sapiens
cgagtatctgtaaccctt

SEQ ID NO: 411061 - DNA, 18 bp, Homo sapiens
cgagtcaccttccaggac

SEQ ID NO: 411062 - DNA, 20 bp, Homo sapiens
cgagtccaggagccccagcc

SEQ ID NO: 411063 - DNA, 17 bp, Homo sapiens
cgagtcccggagcccca

SEQ ID NO: 411064 - DNA, 15 bp, Homo sapiens
cgagtgcccctgcag

SEQ ID NO: 411065 - DNA, 17 bp, Homo sapiens
cgagtgcccctgcaggg

SEQ ID NO: 411066 - DNA, 17 bp, Homo sapiens
cgagtggatagatgccc

SEQ ID NO: 411067 - DNA, 21 bp, Homo sapiens
cgagtggatagatgccctgct

SEQ ID NO: 411068 - DNA, 22 bp, Homo sapiens
cgagtggatagatgccctgcta

SEQ ID NO: 411069 - DNA, 20 bp, Homo sapiens
cgagtggattgtaggtgcaa

SEQ ID NO: 411070 - DNA, 20 bp, Homo sapiens
cgagtgtggagctgcttcca

SEQ ID NO: 411071 - DNA, 21 bp, Homo sapiens
cgagtgtggagctgcttccag

SEQ ID NO: 411072 - DNA, 18 bp, Homo sapiens
cgagtttgcaatgtcaca

SEQ ID NO: 411073 - DNA, 20 bp, Homo sapiens
cgatacaccgggcctggaga

SEQ ID NO: 411074 - DNA, 13 bp, Homo sapiens
cgatattctccct

SEQ ID NO: 411075 - DNA, 19 bp, Homo sapiens
cgatcatggctcactgcag

SEQ ID NO: 411076 - DNA, 20 bp, Homo sapiens
cgatcatggctcactgcagc

SEQ ID NO: 411077 - DNA, 12 bp, Homo sapiens
cgatctcagctc

SEQ ID NO: 411078 - DNA, 18 bp, Homo sapiens
cgatctcagctcactgca

SEQ ID NO: 411079 - DNA, 12 bp, Homo sapiens
cgatgagctggt

SEQ ID NO: 411080 - DNA, 19 bp, Homo sapiens
cgatgcaagtgtttctgtt

SEQ ID NO: 411081 - DNA, 20 bp, Homo sapiens
cgatgcactcgcactgcaaa

SEQ ID NO: 411082 - DNA, 14 bp, Homo sapiens
cgatgcctttgctg

SEQ ID NO: 411083 - DNA, 13 bp, Homo sapiens
cgatgctcactgc

SEQ ID NO: 411084 - DNA, 19 bp, Homo sapiens
cgatgctcactgcttctgc

SEQ ID NO: 411085 - DNA, 14 bp, Homo sapiens
cgatgctccagcca

SEQ ID NO: 411086 - DNA, 18 bp, Homo sapiens
cgatgctccagccaaccc

SEQ ID NO: 411087 - DNA, 14 bp, Homo sapiens
cgatggagccccca

SEQ ID NO: 411088 - DNA, 17 bp, Homo sapiens
cgatgggagtctccctc

SEQ ID NO: 411089 - DNA, 15 bp, Homo sapiens
cgatggggcccacat

SEQ ID NO: 411090 - DNA, 18 bp, Homo sapiens
cgatgggggatgcttcat

SEQ ID NO: 411091 - DNA, 15 bp, Homo sapiens
cgattttatctgtta

SEQ ID NO: 411092 - DNA, 12 bp, Homo sapiens
cgatttttgtat

SEQ ID NO: 411093 - DNA, 20 bp, Homo sapiens
cgcaagatagatttggaata

SEQ ID NO: 411094 - DNA, 22 bp, Homo sapiens
cgcaaggatcacttgagcccag

SEQ ID NO: 411095 - DNA, 22 bp, Homo sapiens
cgcaaggcctgtgctgcatgcg

SEQ ID NO: 411096 - DNA, 18 bp, Homo sapiens
cgcaagggcatcaggcac

SEQ ID NO: 411097 - DNA, 20 bp, Homo sapiens
cgcaagggcatcaggcactg

SEQ ID NO: 411098 - DNA, 13 bp, Homo sapiens
cgcctaggcctgt

SEQ ID NO: 411099 - DNA, 15 bp, Homo sapiens
cgcctcagcctctca

SEQ ID NO: 411100 - DNA, 16 bp, Homo sapiens
cgcctcagcctctcaa

SEQ ID NO: 411101 - DNA, 15 bp, Homo sapiens
cgcctccactctagt

SEQ ID NO: 411102 - DNA, 14 bp, Homo sapiens
cgcctcccagcctg

SEQ ID NO: 411103 - DNA, 15 bp, Homo sapiens
cgcctcccccgcagg

SEQ ID NO: 411104 - DNA, 17 bp, Homo sapiens
cgcctcctccagactcg

SEQ ID NO: 411105 - DNA, 14 bp, Homo sapiens
cgcctcgcttcacg

SEQ ID NO: 411106 - DNA, 17 bp, Homo sapiens
cgcctcgggccgcctcc

SEQ ID NO: 411107 - DNA, 19 bp, Homo sapiens
cgcctcgggccgcctcctc

SEQ ID NO: 411108 - DNA, 20 bp, Homo sapiens
cgcctcgggccgcctcctcc

SEQ ID NO: 411109 - DNA, 16 bp, Homo sapiens
cgcctctgcccgcaga

SEQ ID NO: 411110 - DNA, 21 bp, Homo sapiens
cgcctctggttccactcagct

SEQ ID NO: 411111 - DNA, 16 bp, Homo sapiens
cgcctgattggggcct

SEQ ID NO: 411112 - DNA, 11 bp, Homo sapiens
cgcctgccatc

SEQ ID NO: 411113 - DNA, 13 bp, Homo sapiens
cgcctgcccgccc

SEQ ID NO: 411114 - DNA, 20 bp, Homo sapiens
cgcctgccgtgcatggctcc

SEQ ID NO: 411115 - DNA, 17 bp, Homo sapiens
cgcctgcgctcctctgc

SEQ ID NO: 411116 - DNA, 20 bp, Homo sapiens
cgcctgcgctcctctgcagc

SEQ ID NO: 411117 - DNA, 23 bp, Homo sapiens
cgcctgcgctcctctgcagcctg

SEQ ID NO: 411118 - DNA, 22 bp, Homo sapiens
cgcctgcggactccatggccct

SEQ ID NO: 411119 - DNA, 15 bp, Homo sapiens
cgcctgcttcacacc

SEQ ID NO: 411120 - DNA, 16 bp, Homo sapiens
cgcctgcttcacaccc

SEQ ID NO: 411121 - DNA, 17 bp, Homo sapiens
cgcctgcttcacacccc

SEQ ID NO: 411122 - DNA, 23 bp, Homo sapiens
cgcctgcttcacacccctcagcg

SEQ ID NO: 411123 - DNA, 13 bp, Homo sapiens
cgcctggctccag

SEQ ID NO: 411124 - DNA, 18 bp, Homo sapiens
cgcctggctccaggctcc

SEQ ID NO: 411125 - DNA, 12 bp, Homo sapiens
cgcctgtccttg

SEQ ID NO: 411126 - DNA, 23 bp, Homo sapiens
cgcctgtgcccttgctgggtcca

SEQ ID NO: 411127 - DNA, 15 bp, Homo sapiens
cgccttatttatatt

SEQ ID NO: 411128 - DNA, 14 bp, Homo sapiens
cgccttccctcact

SEQ ID NO: 411129 - DNA, 22 bp, Homo sapiens
cgccttccctcactcttcctca

SEQ ID NO: 411130 - DNA, 16 bp, Homo sapiens
cgccttcctcctccac

SEQ ID NO: 411131 - DNA, 17 bp, Homo sapiens
cgccttcctcctccaca

SEQ ID NO: 411132 - DNA, 19 bp, Homo sapiens
cgccttccttgaccttcct

SEQ ID NO: 411133 - DNA, 22 bp, Homo sapiens
cgccttgagtgacatgcggctg

SEQ ID NO: 411134 - DNA, 14 bp, Homo sapiens
cgcgaccttggccg

SEQ ID NO: 411135 - DNA, 13 bp, Homo sapiens
cgcgcaccgccca

SEQ ID NO: 411136 - DNA, 17 bp, Homo sapiens
cgcgcgtgcccccagcg

SEQ ID NO: 411137 - DNA, 14 bp, Homo sapiens
cgcgctccttgcgg

SEQ ID NO: 411138 - DNA, 13 bp, Homo sapiens
cgcgctctgcccc

SEQ ID NO: 411139 - DNA, 17 bp, Homo sapiens
cgcgctctgcccctccg

SEQ ID NO: 411140 - DNA, 11 bp, Homo sapiens
cgcgggagaga

SEQ ID NO: 411141 - DNA, 13 bp, Homo sapiens
cgcgggagagagt

SEQ ID NO: 411142 - DNA, 21 bp, Homo sapiens
cgcgggaggcaccagctctgt

SEQ ID NO: 411143 - DNA, 19 bp, Homo sapiens
cgcggggaccctgccgagg

SEQ ID NO: 411144 - DNA, 13 bp, Homo sapiens
cgcgggttctaga

SEQ ID NO: 411145 - DNA, 14 bp, Homo sapiens
cgcgggttctagac

SEQ ID NO: 411146 - DNA, 19 bp, Homo sapiens
cgcggttcaggtcagggct

SEQ ID NO: 411147 - DNA, 12 bp, Homo sapiens
cgcgtagagagc

SEQ ID NO: 411148 - DNA, 17 bp, Homo sapiens
cgcgtctgccccaccct

SEQ ID NO: 411149 - DNA, 12 bp, Homo sapiens
cgcgtcttcctg

SEQ ID NO: 411150 - DNA, 16 bp, Homo sapiens
cgcgtcttcctgagtg

SEQ ID NO: 411151 - DNA, 16 bp, Homo sapiens
cgcgtgcccccagcgt

SEQ ID NO: 411152 - DNA, 19 bp, Homo sapiens
cgcgtgccctcgctgcttc

SEQ ID NO: 411153 - DNA, 17 bp, Homo sapiens
cgcgtggtcacaggacg

SEQ ID NO: 411154 - DNA, 14 bp, Homo sapiens
cgcgtgttctgaag

SEQ ID NO: 411155 - DNA, 15 bp, Homo sapiens
cgctaaaaagaactc

SEQ ID NO: 411156 - DNA, 14 bp, Homo sapiens
cgctagaggcctga

SEQ ID NO: 411157 - DNA, 20 bp, Homo sapiens
cgctagatgggcatggggtg

SEQ ID NO: 411158 - DNA, 16 bp, Homo sapiens
cgctattcccaggcag

SEQ ID NO: 411159 - DNA, 18 bp, Homo sapiens
cgctattcccaggcaggg

SEQ ID NO: 411160 - DNA, 14 bp, Homo sapiens
cgctcactccaggt

SEQ ID NO: 411161 - DNA, 12 bp, Homo sapiens
cgctcagccctc

SEQ ID NO: 411162 - DNA, 19 bp, Homo sapiens
cgctcaggacccaggccct

SEQ ID NO: 411163 - DNA, 18 bp, Homo sapiens
cgctcaggtagccaccac

SEQ ID NO: 411164 - DNA, 19 bp, Homo sapiens
cgctcaggtagccaccacc

SEQ ID NO: 411165 - DNA, 11 bp, Homo sapiens
cgctcatcttg

SEQ ID NO: 411166 - DNA, 14 bp, Homo sapiens
cgctcccctctgcc

SEQ ID NO: 411167 - DNA, 18 bp, Homo sapiens
cgctcccctgagaggttt

SEQ ID NO: 411168 - DNA, 15 bp, Homo sapiens
cgctcccctttccca

SEQ ID NO: 411169 - DNA, 13 bp, Homo sapiens
cgctccctgtcgc

SEQ ID NO: 411170 - DNA, 17 bp, Homo sapiens
cgctccggcagaggcag

SEQ ID NO: 411171 - DNA, 19 bp, Homo sapiens
cgctccggcagaggcaggg

SEQ ID NO: 411172 - DNA, 21 bp, Homo sapiens
cgctccggcagaggcagggcc

SEQ ID NO: 411173 - DNA, 22 bp, Homo sapiens
cgctccggcagaggcagggccc

SEQ ID NO: 411174 - DNA, 24 bp, Homo sapiens
cgctccggcagaggcagggccctg

SEQ ID NO: 411175 - DNA, 17 bp, Homo sapiens
cgctcctcccctcttga

SEQ ID NO: 411176 - DNA, 13 bp, Homo sapiens
cgctcctctgcag

SEQ ID NO: 411177 - DNA, 16 bp, Homo sapiens
cgctcctctgccttgg

SEQ ID NO: 411178 - DNA, 20 bp, Homo sapiens
cgctctccatcataggctga

SEQ ID NO: 411179 - DNA, 15 bp, Homo sapiens
cgctctctcatgtgg

SEQ ID NO: 411180 - DNA, 20 bp, Homo sapiens
cgctctgccatcagcccctg

SEQ ID NO: 411181 - DNA, 22 bp, Homo sapiens
cgctctgcccctccgtccccag

SEQ ID NO: 411182 - DNA, 21 bp, Homo sapiens
cgctcttggcaggtactcagc

SEQ ID NO: 411183 - DNA, 14 bp, Homo sapiens
cgctcttggtccct

SEQ ID NO: 411184 - DNA, 14 bp, Homo sapiens
cgctgagggcaggg

SEQ ID NO: 411185 - DNA, 13 bp, Homo sapiens
cgctgcccagccc

SEQ ID NO: 411186 - DNA, 16 bp, Homo sapiens
cgggagaatcatgtga

SEQ ID NO: 411187 - DNA, 21 bp, Homo sapiens
cgggagagagtgagagagagt

SEQ ID NO: 411188 - DNA, 14 bp, Homo sapiens
cgggagagcgccac

SEQ ID NO: 411189 - DNA, 20 bp, Homo sapiens
cgggagcagtgtcttccata

SEQ ID NO: 411190 - DNA, 23 bp, Homo sapiens
cgggagcattctgcctgcctggg

SEQ ID NO: 411191 - DNA, 10 bp, Homo sapiens
cgggagctgg

SEQ ID NO: 411192 - DNA, 22 bp, Homo sapiens
cgggaggaatcttttactgtgg

SEQ ID NO: 411193 - DNA, 21 bp, Homo sapiens
cgggaggactccgggaccatt

SEQ ID NO: 411194 - DNA, 12 bp, Homo sapiens
cgggaggaggat

SEQ ID NO: 411195 - DNA, 15 bp, Homo sapiens
cgggaggcaccagct

SEQ ID NO: 411196 - DNA, 18 bp, Homo sapiens
cgggaggcaccagctctg

SEQ ID NO: 411197 - DNA, 14 bp, Homo sapiens
cgggcaaagaaaac

SEQ ID NO: 411198 - DNA, 20 bp, Homo sapiens
cgggcaagatagctccttca

SEQ ID NO: 411199 - DNA, 12 bp, Homo sapiens
cgggcaagggcc

SEQ ID NO: 411200 - DNA, 18 bp, Homo sapiens
cgggcacagctgctgtgc

SEQ ID NO: 411201 - DNA, 12 bp, Homo sapiens
cgggcagcccct

SEQ ID NO: 411202 - DNA, 16 bp, Homo sapiens
cgggcagcctggctcc

SEQ ID NO: 411203 - DNA, 15 bp, Homo sapiens
cgggcagggctccca

SEQ ID NO: 411204 - DNA, 10 bp, Homo sapiens
cgggcagggg

SEQ ID NO: 411205 - DNA, 16 bp, Homo sapiens
cgggcaggggagccag

SEQ ID NO: 411206 - DNA, 17 bp, Homo sapiens
cgggcaggggagccagg

SEQ ID NO: 411207 - DNA, 17 bp, Homo sapiens
cgggcccgctcaacctc

SEQ ID NO: 411208 - DNA, 17 bp, Homo sapiens
cgggccctcccttggaa

SEQ ID NO: 411209 - DNA, 12 bp, Homo sapiens
cgggccgcctcc

SEQ ID NO: 411210 - DNA, 16 bp, Homo sapiens
cgggccgcctcctcca

SEQ ID NO: 411211 - DNA, 20 bp, Homo sapiens
cgggccgcctcctccagact

SEQ ID NO: 411212 - DNA, 14 bp, Homo sapiens
cgggcctccccggg

SEQ ID NO: 411213 - DNA, 12 bp, Homo sapiens
cgggcctggact

SEQ ID NO: 411214 - DNA, 14 bp, Homo sapiens
cgggcctgggcctc

SEQ ID NO: 411215 - DNA, 17 bp, Homo sapiens
cgggcgtggtggcgggc

SEQ ID NO: 411216 - DNA, 15 bp, Homo sapiens
cgggctcagctctgg

SEQ ID NO: 411217 - DNA, 14 bp, Homo sapiens
cgggctctggccac

SEQ ID NO: 411218 - DNA, 15 bp, Homo sapiens
cgggctctggccacc

SEQ ID NO: 411219 - DNA, 12 bp, Homo sapiens
cgggctgctgct

SEQ ID NO: 411220 - DNA, 15 bp, Homo sapiens
cgggctgggcagctg

SEQ ID NO: 411221 - DNA, 17 bp, Homo sapiens
cgggctgggcagctgtt

SEQ ID NO: 411222 - DNA, 16 bp, Homo sapiens
cggggaccctgccgag

SEQ ID NO: 411223 - DNA, 17 bp, Homo sapiens
cggggaccctgccgagg

SEQ ID NO: 411224 - DNA, 13 bp, Homo sapiens
cggggaggccaag

SEQ ID NO: 411225 - DNA, 14 bp, Homo sapiens
cggggaggccaagt

SEQ ID NO: 411226 - DNA, 20 bp, Homo sapiens
cggggagtttccgcggcggc

SEQ ID NO: 411227 - DNA, 18 bp, Homo sapiens
cggggcaagagggaaggt

SEQ ID NO: 411228 - DNA, 17 bp, Homo sapiens
cggggcagagctcagag

SEQ ID NO: 411229 - DNA, 14 bp, Homo sapiens
cggggcagagctga

SEQ ID NO: 411230 - DNA, 12 bp, Homo sapiens
cggggcaggaag

SEQ ID NO: 411231 - DNA, 13 bp, Homo sapiens
cggggcaggaagt

SEQ ID NO: 411232 - DNA, 12 bp, Homo sapiens
cggggcatggac

SEQ ID NO: 411233 - DNA, 14 bp, Homo sapiens
cggggccagaggca

SEQ ID NO: 411234 - DNA, 14 bp, Homo sapiens
cggggccaggatgg

SEQ ID NO: 411235 - DNA, 18 bp, Homo sapiens
cggggcctcgggacctca

SEQ ID NO: 411236 - DNA, 23 bp, Homo sapiens
cggggctggccctgccctccccc

SEQ ID NO: 411237 - DNA, 15 bp, Homo sapiens
cgggggaggagcacc

SEQ ID NO: 411238 - DNA, 19 bp, Homo sapiens
cgggggaggagcaccccca

SEQ ID NO: 411239 - DNA, 18 bp, Homo sapiens
cgggggaggccgaggcag

SEQ ID NO: 411240 - DNA, 19 bp, Homo sapiens
cgggggaggccgaggcagg

SEQ ID NO: 411241 - DNA, 16 bp, Homo sapiens
cgggggatcctggagc

SEQ ID NO: 411242 - DNA, 18 bp, Homo sapiens
cgggggatcctggagccc

SEQ ID NO: 411243 - DNA, 16 bp, Homo sapiens
cgggggctaactggcc

SEQ ID NO: 411244 - DNA, 15 bp, Homo sapiens
cggggggcgagggag

SEQ ID NO: 411245 - DNA, 17 bp, Homo sapiens
cggggggcgagggaggg

SEQ ID NO: 411246 - DNA, 16 bp, Homo sapiens
cggggtcctgaggctg

SEQ ID NO: 411247 - DNA, 18 bp, Homo sapiens
cggggtcctgaggctggg

SEQ ID NO: 411248 - DNA, 21 bp, Homo sapiens
cggggtcgggggaggagcacc

SEQ ID NO: 411249 - DNA, 22 bp, Homo sapiens
cggcagctcttctgggcagagc

SEQ ID NO: 411250 - DNA, 21 bp, Homo sapiens
cggcaggtggcctaaggctgc

SEQ ID NO: 411251 - DNA, 21 bp, Homo sapiens
cggcatgccgagtgccccaga

SEQ ID NO: 411252 - DNA, 14 bp, Homo sapiens
cggcattcacacac

SEQ ID NO: 411253 - DNA, 15 bp, Homo sapiens
cggcattcacacaca

SEQ ID NO: 411254 - DNA, 17 bp, Homo sapiens
cggcattcacacacagc

SEQ ID NO: 411255 - DNA, 19 bp, Homo sapiens
cggccaaggacactgatgg

SEQ ID NO: 411256 - DNA, 14 bp, Homo sapiens
cggccacagctgct

SEQ ID NO: 411257 - DNA, 15 bp, Homo sapiens
cggccacagctgctg

SEQ ID NO: 411258 - DNA, 13 bp, Homo sapiens
cggccacccaccc

SEQ ID NO: 411259 - DNA, 16 bp, Homo sapiens
cggccacccacccttc

SEQ ID NO: 411260 - DNA, 11 bp, Homo sapiens
cggccaccctc

SEQ ID NO: 411261 - DNA, 13 bp, Homo sapiens
cggccacgctccc

SEQ ID NO: 411262 - DNA, 17 bp, Homo sapiens
cggccactgcagtcacc

SEQ ID NO: 411263 - DNA, 12 bp, Homo sapiens
cggccagagctc

SEQ ID NO: 411264 - DNA, 14 bp, Homo sapiens
cggccagagctccc

SEQ ID NO: 411265 - DNA, 15 bp, Homo sapiens
cggccagagctccca

SEQ ID NO: 411266 - DNA, 19 bp, Homo sapiens
cggccaggcacggaggctc

SEQ ID NO: 411267 - DNA, 16 bp, Homo sapiens
cggcccaagcccgact

SEQ ID NO: 411268 - DNA, 22 bp, Homo sapiens
cggcccacacccgacaccagcc

SEQ ID NO: 411269 - DNA, 17 bp, Homo sapiens
cggcccacgcagagccc

SEQ ID NO: 411270 - DNA, 21 bp, Homo sapiens
cggcccacgcagagccccgga

SEQ ID NO: 411271 - DNA, 22 bp, Homo sapiens
cggcccacgcagagccccggag

SEQ ID NO: 411272 - DNA, 20 bp, Homo sapiens
cggccccacccaccctctgg

SEQ ID NO: 411273 - DNA, 12 bp, Homo sapiens
cggccccaggct

SEQ ID NO: 411274 - DNA, 13 bp, Homo sapiens
cggccccaggctc

SEQ ID NO: 411275 - DNA, 14 bp, Homo sapiens
cggccccaggctcc

SEQ ID NO: 411276 - DNA, 23 bp, Homo sapiens
cggccccccctcttttggccttg

SEQ ID NO: 411277 - DNA, 17 bp, Homo sapiens
cggcccccgccctctgc

SEQ ID NO: 411278 - DNA, 12 bp, Homo sapiens
cgttccagctga

SEQ ID NO: 411279 - DNA, 15 bp, Homo sapiens
cgttccagctgacat

SEQ ID NO: 411280 - DNA, 18 bp, Homo sapiens
cgttccccttggcttcct

SEQ ID NO: 411281 - DNA, 21 bp, Homo sapiens
cgttccccttggcttcctccg

SEQ ID NO: 411282 - DNA, 18 bp, Homo sapiens
cgttccctgtcagaggct

SEQ ID NO: 411283 - DNA, 20 bp, Homo sapiens
cgttcccttgtgtctgttgc

SEQ ID NO: 411284 - DNA, 11 bp, Homo sapiens
cgttcctgcca

SEQ ID NO: 411285 - DNA, 15 bp, Homo sapiens
cgttctcgtgaccca

SEQ ID NO: 411286 - DNA, 19 bp, Homo sapiens
cgttctcgtgacccagtgg

SEQ ID NO: 411287 - DNA, 21 bp, Homo sapiens
cgttctcgtgacccagtggca

SEQ ID NO: 411288 - DNA, 16 bp, Homo sapiens
cgttctggactctgcc

SEQ ID NO: 411289 - DNA, 18 bp, Homo sapiens
cgttctggactctgcccc

SEQ ID NO: 411290 - DNA, 15 bp, Homo sapiens
cgttcttcaggagat

SEQ ID NO: 411291 - DNA, 19 bp, Homo sapiens
cgttcttgttctgttttgt

SEQ ID NO: 411292 - DNA, 19 bp, Homo sapiens
cgttgacaccaagaaacca

SEQ ID NO: 411293 - DNA, 18 bp, Homo sapiens
cgttgccgggcctggact

SEQ ID NO: 411294 - DNA, 19 bp, Homo sapiens
cgttgccgggcctggactg

SEQ ID NO: 411295 - DNA, 18 bp, Homo sapiens
cgttggaattaaaacaat

SEQ ID NO: 411296 - DNA, 12 bp, Homo sapiens
cgttggagccac

SEQ ID NO: 411297 - DNA, 20 bp, Homo sapiens
cgttggagccactcctgtcc

SEQ ID NO: 411298 - DNA, 14 bp, Homo sapiens
cgttggatttaaaa

SEQ ID NO: 411299 - DNA, 14 bp, Homo sapiens
cgttggttgtttct

SEQ ID NO: 411300 - DNA, 21 bp, Homo sapiens
cgttgtgtgggtttactctgt

SEQ ID NO: 411301 - DNA, 19 bp, Homo sapiens
cgtttagtttctagaggcc

SEQ ID NO: 411302 - DNA, 13 bp, Homo sapiens
cgtttattgctta

SEQ ID NO: 411303 - DNA, 18 bp, Homo sapiens
cgtttattgcttaatccc

SEQ ID NO: 411304 - DNA, 20 bp, Homo sapiens
cgtttccaggtgtttatagt

SEQ ID NO: 411305 - DNA, 11 bp, Homo sapiens
cgtttccatca

SEQ ID NO: 411306 - DNA, 11 bp, Homo sapiens
cgtttctggcc

SEQ ID NO: 411307 - DNA, 18 bp, Homo sapiens
cgtttgctgtgccaggag

SEQ ID NO: 411308 - DNA, 12 bp, Homo sapiens
cgtttgtttgtt

SEQ ID NO: 411309 - DNA, 14 bp, Homo sapiens
cgttttcatcctgg

SEQ ID NO: 411310 - DNA, 19 bp, Homo sapiens
cgttttctttgctgtgcca

SEQ ID NO: 411311 - DNA, 14 bp, Homo sapiens
cgttttgtttgaaa

SEQ ID NO: 411312 - DNA, 13 bp, Homo sapiens
ctaaaaaataact

SEQ ID NO: 411313 - DNA, 18 bp, Homo sapiens
ctaaaaacattttaaaat

SEQ ID NO: 411314 - DNA, 21 bp, Homo sapiens
ctaaaaacattttaaaatcaa

SEQ ID NO: 411315 - DNA, 20 bp, Homo sapiens
ctaaaaataaaatgcattta

SEQ ID NO: 411316 - DNA, 22 bp, Homo sapiens
ctaaaaataaaatgcatttaaa

SEQ ID NO: 411317 - DNA, 23 bp, Homo sapiens
ctaaaaataagaaattagccggg

SEQ ID NO: 411318 - DNA, 23 bp, Homo sapiens
ctaaaacattctttaacatacat

SEQ ID NO: 411319 - DNA, 16 bp, Homo sapiens
ctaaaaggaggacagg

SEQ ID NO: 411320 - DNA, 17 bp, Homo sapiens
ctaaaagtgatgtgatt

SEQ ID NO: 411321 - DNA, 18 bp, Homo sapiens
ctaaaagtgatgtgattt

SEQ ID NO: 411322 - DNA, 19 bp, Homo sapiens
ctaaaagttaagtgtcatt

SEQ ID NO: 411323 - DNA, 22 bp, Homo sapiens
ctaaaatacatttaaaacttac

SEQ ID NO: 411324 - DNA, 20 bp, Homo sapiens
ctaaaatagattaaaggaat

SEQ ID NO: 411325 - DNA, 16 bp, Homo sapiens
ctaaaattgtatgaaa

SEQ ID NO: 411326 - DNA, 17 bp, Homo sapiens
ctaaacattttgttatt

SEQ ID NO: 411327 - DNA, 13 bp, Homo sapiens
ctaaaccacaata

SEQ ID NO: 411328 - DNA, 20 bp, Homo sapiens
ctaaactgagacaatgcctt

SEQ ID NO: 411329 - DNA, 14 bp, Homo sapiens
ctaaactgttttca

SEQ ID NO: 411330 - DNA, 17 bp, Homo sapiens
ctaaagaagacacacag

SEQ ID NO: 411331 - DNA, 21 bp, Homo sapiens
ctaaagaatagtgcctcagcg

SEQ ID NO: 411332 - DNA, 18 bp, Homo sapiens
ctaaagagagaatgtaga

SEQ ID NO: 411333 - DNA, 22 bp, Homo sapiens
ctaaagagctaggaaagagttg

SEQ ID NO: 411334 - DNA, 18 bp, Homo sapiens
ctaaagaggctgaaagag

SEQ ID NO: 411335 - DNA, 15 bp, Homo sapiens
ctaaagataatatta

SEQ ID NO: 411336 - DNA, 14 bp, Homo sapiens
ctaaagcagtgttt

SEQ ID NO: 411337 - DNA, 19 bp, Homo sapiens
ctaaaggaaaaaaccatcc

SEQ ID NO: 411338 - DNA, 19 bp, Homo sapiens
ctaaaggatagatcaaagt

SEQ ID NO: 411339 - DNA, 22 bp, Homo sapiens
ctaaaggggacagatcttgagc

SEQ ID NO: 411340 - DNA, 20 bp, Homo sapiens
ctaaaggtcccaaggcaagg

SEQ ID NO: 411341 - DNA, 20 bp, Homo sapiens
ctaaagtgttggtctttcta

SEQ ID NO: 411342 - DNA, 18 bp, Homo sapiens
ctaaatagatttttagat

SEQ ID NO: 411343 - DNA, 22 bp, Homo sapiens
ctaaatagatttttagattcct

SEQ ID NO: 411344 - DNA, 21 bp, Homo sapiens
ctaaatatccaaagactgtac

SEQ ID NO: 411345 - DNA, 15 bp, Homo sapiens
ctaaatatgaaattt

SEQ ID NO: 411346 - DNA, 13 bp, Homo sapiens
ctaaatcataatc

SEQ ID NO: 411347 - DNA, 16 bp, Homo sapiens
ctaaatccattttcta

SEQ ID NO: 411348 - DNA, 22 bp, Homo sapiens
ctaaatccattttctaaactgt

SEQ ID NO: 411349 - DNA, 23 bp, Homo sapiens
ctaaatcctcactatttttttgt

SEQ ID NO: 411350 - DNA, 17 bp, Homo sapiens
ctaaatcctttactgtt

SEQ ID NO: 411351 - DNA, 23 bp, Homo sapiens
ctaaatgaaaagagaattactta

SEQ ID NO: 411352 - DNA, 16 bp, Homo sapiens
ctaaatgaatgtttac

SEQ ID NO: 411353 - DNA, 15 bp, Homo sapiens
ctaaatgattatctt

SEQ ID NO: 411354 - DNA, 17 bp, Homo sapiens
ctaaatggcaacaaaca

SEQ ID NO: 411355 - DNA, 15 bp, Homo sapiens
ctaaattaacctaaa

SEQ ID NO: 411356 - DNA, 19 bp, Homo sapiens
ctaaattgatcattcataa

SEQ ID NO: 411357 - DNA, 12 bp, Homo sapiens
ctaaatttctca

SEQ ID NO: 411358 - DNA, 15 bp, Homo sapiens
ctaaattttctgaaa

SEQ ID NO: 411359 - DNA, 12 bp, Homo sapiens
ctaaatttttac

SEQ ID NO: 411360 - DNA, 16 bp, Homo sapiens
ctaacaaaagatgaaa

SEQ ID NO: 411361 - DNA, 17 bp, Homo sapiens
ctaacaaaagatgaaag

SEQ ID NO: 411362 - DNA, 20 bp, Homo sapiens
ctaacaaaagatgaaagcag

SEQ ID NO: 411363 - DNA, 21 bp, Homo sapiens
ctaacaccagcgtttgagggg

SEQ ID NO: 411364 - DNA, 14 bp, Homo sapiens
ctaacacccagtct

SEQ ID NO: 411365 - DNA, 19 bp, Homo sapiens
ctaacactagtctgtgtgc

SEQ ID NO: 411366 - DNA, 15 bp, Homo sapiens
ctaacactggcccct

SEQ ID NO: 411367 - DNA, 17 bp, Homo sapiens
ctaacataaaatctgtg

SEQ ID NO: 411368 - DNA, 23 bp, Homo sapiens
ctaacataaaatctgtgaattaa

SEQ ID NO: 411369 - DNA, 20 bp, Homo sapiens
ctaacataaagaaacacttt

SEQ ID NO: 411370 - DNA, 12 bp, Homo sapiens
ctaacatataat

SEQ ID NO: 411371 - DNA, 21 bp, Homo sapiens
ctaacatcccaataaagtcct

SEQ ID NO: 411372 - DNA, 15 bp, Homo sapiens
ctaacatggaagtac

SEQ ID NO: 411373 - DNA, 17 bp, Homo sapiens
ctaacatggaagtacta

SEQ ID NO: 411374 - DNA, 21 bp, Homo sapiens
ctaaccagggaagctgtccct

SEQ ID NO: 411375 - DNA, 16 bp, Homo sapiens
ctaacccatgggtcca

SEQ ID NO: 411376 - DNA, 20 bp, Homo sapiens
ctaaccctcccatggcacct

SEQ ID NO: 411377 - DNA, 18 bp, Homo sapiens
ctaacctacgaccccaga

SEQ ID NO: 411378 - DNA, 13 bp, Homo sapiens
ctaacctcaaaat

SEQ ID NO: 411379 - DNA, 16 bp, Homo sapiens
ctaacctggagacagt

SEQ ID NO: 411380 - DNA, 17 bp, Homo sapiens
ctaacctggagacagta

SEQ ID NO: 411381 - DNA, 17 bp, Homo sapiens
ctaacctgggttccctt

SEQ ID NO: 411382 - DNA, 13 bp, Homo sapiens
ctaacgggcgcct

SEQ ID NO: 411383 - DNA, 14 bp, Homo sapiens
ctaactcttgctca

SEQ ID NO: 411384 - DNA, 18 bp, Homo sapiens
ctaactcttgctcactcc

SEQ ID NO: 411385 - DNA, 19 bp, Homo sapiens
ctaactcttgctcactccc

SEQ ID NO: 411386 - DNA, 12 bp, Homo sapiens
ctaactggcccc

SEQ ID NO: 411387 - DNA, 23 bp, Homo sapiens
ctaacttattgcctgggcagtgc

SEQ ID NO: 411388 - DNA, 22 bp, Homo sapiens
ctaacttattttatttccatca

SEQ ID NO: 411389 - DNA, 22 bp, Homo sapiens
ctaactttagaagtgcatttct

SEQ ID NO: 411390 - DNA, 17 bp, Homo sapiens
ctaacttttgtgtgaaa

SEQ ID NO: 411391 - DNA, 16 bp, Homo sapiens
ctaagaataaataaag

SEQ ID NO: 411392 - DNA, 23 bp, Homo sapiens
ctaagacccacaaactgcctgtt

SEQ ID NO: 411393 - DNA, 22 bp, Homo sapiens
ctaagagtgtcactgagctgtg

SEQ ID NO: 411394 - DNA, 13 bp, Homo sapiens
ctaagatgaaatt

SEQ ID NO: 411395 - DNA, 15 bp, Homo sapiens
ctaagatgaaattgc

SEQ ID NO: 411396 - DNA, 21 bp, Homo sapiens
ctaagatgagatttgccagca

SEQ ID NO: 411397 - DNA, 22 bp, Homo sapiens
ctaagatgagatttgccagcac

SEQ ID NO: 411398 - DNA, 17 bp, Homo sapiens
ctaagcagaataatgga

SEQ ID NO: 411399 - DNA, 16 bp, Homo sapiens
ctaagcagtgcttgta

SEQ ID NO: 411400 - DNA, 18 bp, Homo sapiens
ctaagcagtgcttgtaaa

SEQ ID NO: 411401 - DNA, 19 bp, Homo sapiens
ctaagcatgtgtcccagga

SEQ ID NO: 411402 - DNA, 23 bp, Homo sapiens
ctaagccactcccgccacacgct

SEQ ID NO: 411403 - DNA, 18 bp, Homo sapiens
ctaagccctcgaaccaag

SEQ ID NO: 411404 - DNA, 20 bp, Homo sapiens
ctaagccctcgaaccaaggc

SEQ ID NO: 411405 - DNA, 21 bp, Homo sapiens
ctaagccctcgaaccaaggca

SEQ ID NO: 411406 - DNA, 22 bp, Homo sapiens
ctaagccctcgaaccaaggcag

SEQ ID NO: 411407 - DNA, 11 bp, Homo sapiens
ctaagcctgtt

SEQ ID NO: 411408 - DNA, 15 bp, Homo sapiens
ctaagctctttgaga

SEQ ID NO: 411409 - DNA, 17 bp, Homo sapiens
ctaagcttaaaaaaaac

SEQ ID NO: 411410 - DNA, 14 bp, Homo sapiens
ctaagctttctcct

SEQ ID NO: 411411 - DNA, 23 bp, Homo sapiens
ctaaggaagatcactttgctctg

SEQ ID NO: 411412 - DNA, 11 bp, Homo sapiens
ctaaggacaca

SEQ ID NO: 411413 - DNA, 13 bp, Homo sapiens
ctaaggacacact

SEQ ID NO: 411414 - DNA, 15 bp, Homo sapiens
ctaaggatagccttt

SEQ ID NO: 411415 - DNA, 19 bp, Homo sapiens
ctaaggatagcctttgtag

SEQ ID NO: 411416 - DNA, 15 bp, Homo sapiens
ctaaggatctctcag

SEQ ID NO: 411417 - DNA, 17 bp, Homo sapiens
ctaaggatctctcagga

SEQ ID NO: 411418 - DNA, 23 bp, Homo sapiens
ctaaggatctctcaggagcacag

SEQ ID NO: 411419 - DNA, 21 bp, Homo sapiens
ctaaggtcagtgttataaaat

SEQ ID NO: 411420 - DNA, 14 bp, Homo sapiens
ctaagtaacctcta

SEQ ID NO: 411421 - DNA, 22 bp, Homo sapiens
ctaagtaacctctacaggcatt

SEQ ID NO: 411422 - DNA, 11 bp, Homo sapiens
ctaagtattta

SEQ ID NO: 411423 - DNA, 13 bp, Homo sapiens
ctaagtatttaaa

SEQ ID NO: 411424 - DNA, 22 bp, Homo sapiens
ctaagtcagtttcacatatttg

SEQ ID NO: 411425 - DNA, 16 bp, Homo sapiens
ctaagtccctgccccc

SEQ ID NO: 411426 - DNA, 17 bp, Homo sapiens
ctaagtccctgccccct

SEQ ID NO: 411427 - DNA, 10 bp, Homo sapiens
ctaagtgact

SEQ ID NO: 411428 - DNA, 21 bp, Homo sapiens
ctaagtgactaccacttattt

SEQ ID NO: 411429 - DNA, 11 bp, Homo sapiens
ctaagtgccca

SEQ ID NO: 411430 - DNA, 17 bp, Homo sapiens
ctaagtgcccaaagtgg

SEQ ID NO: 411431 - DNA, 21 bp, Homo sapiens
ctaagtgcccaaagtggggag

SEQ ID NO: 411432 - DNA, 16 bp, Homo sapiens
ctaagtggattggctt

SEQ ID NO: 411433 - DNA, 14 bp, Homo sapiens
ctaagtgtaaaaaa

SEQ ID NO: 411434 - DNA, 21 bp, Homo sapiens
ctaagtgtaaaaaaaagtctt

SEQ ID NO: 411435 - DNA, 20 bp, Homo sapiens
ctaagttatagtatatctgg

SEQ ID NO: 411436 - DNA, 17 bp, Homo sapiens
ctaagttatttactttt

SEQ ID NO: 411437 - DNA, 16 bp, Homo sapiens
ctaagttttgtgtgta

SEQ ID NO: 411438 - DNA, 20 bp, Homo sapiens
ctaagttttgtgtgtatata

SEQ ID NO: 411439 - DNA, 14 bp, Homo sapiens
ctaataaaaaggtt

SEQ ID NO: 411440 - DNA, 15 bp, Homo sapiens
ctaataaaatatcat

SEQ ID NO: 411441 - DNA, 18 bp, Homo sapiens
ctaataaaatatcattca

SEQ ID NO: 411442 - DNA, 14 bp, Homo sapiens
ctaatagagtactt

SEQ ID NO: 411443 - DNA, 15 bp, Homo sapiens
ctaatagagtactta

SEQ ID NO: 411444 - DNA, 11 bp, Homo sapiens
ctaatatattt

SEQ ID NO: 411445 - DNA, 16 bp, Homo sapiens
ctaatatcattttatt

SEQ ID NO: 411446 - DNA, 20 bp, Homo sapiens
ctaatatcattttattcaca

SEQ ID NO: 411447 - DNA, 13 bp, Homo sapiens
ctaatattaaaaa

SEQ ID NO: 411448 - DNA, 16 bp, Homo sapiens
ctaatattcagtcctg

SEQ ID NO: 411449 - DNA, 17 bp, Homo sapiens
ctaatcagaaattttta

SEQ ID NO: 411450 - DNA, 19 bp, Homo sapiens
ctaatcagcattctcactc

SEQ ID NO: 411451 - DNA, 21 bp, Homo sapiens
ctaatcataacatagttgaaa

SEQ ID NO: 411452 - DNA, 15 bp, Homo sapiens
ctaatccccttctcc

SEQ ID NO: 411453 - DNA, 20 bp, Homo sapiens
ctaatctattgggttcatta

SEQ ID NO: 411454 - DNA, 22 bp, Homo sapiens
ctaatcttcagggcactgctgc

SEQ ID NO: 411455 - DNA, 19 bp, Homo sapiens
ctaatgctccttgttccta

SEQ ID NO: 411456 - DNA, 11 bp, Homo sapiens
ctaatgctgca

SEQ ID NO: 411457 - DNA, 16 bp, Homo sapiens
ctaatgcttgtttatg

SEQ ID NO: 411458 - DNA, 18 bp, Homo sapiens
ctaatgtagctatttttc

SEQ ID NO: 411459 - DNA, 17 bp, Homo sapiens
ctaatgtaggactgtat

SEQ ID NO: 411460 - DNA, 18 bp, Homo sapiens
ctaatgtaggactgtata

SEQ ID NO: 411461 - DNA, 13 bp, Homo sapiens
ctaatgtcttcat

SEQ ID NO: 411462 - DNA, 21 bp, Homo sapiens
ctaatgtcttcatttcattgt

SEQ ID NO: 411463 - DNA, 22 bp, Homo sapiens
ctaatgtcttcatttcattgta

SEQ ID NO: 411464 - DNA, 18 bp, Homo sapiens
ctaatgtttatgagccag

SEQ ID NO: 411465 - DNA, 12 bp, Homo sapiens
ctatatccatgt

SEQ ID NO: 411466 - DNA, 18 bp, Homo sapiens
ctatatccatgtactgta

SEQ ID NO: 411467 - DNA, 13 bp, Homo sapiens
ctatatctgtttt

SEQ ID NO: 411468 - DNA, 15 bp, Homo sapiens
ctatatctgttttac

SEQ ID NO: 411469 - DNA, 18 bp, Homo sapiens
ctatatctgttttactgc

SEQ ID NO: 411470 - DNA, 20 bp, Homo sapiens
ctatatgaatttaaatataa

SEQ ID NO: 411471 - DNA, 19 bp, Homo sapiens
ctatatgatttatagtttg

SEQ ID NO: 411472 - DNA, 16 bp, Homo sapiens
ctatatgcacccctgg

SEQ ID NO: 411473 - DNA, 16 bp, Homo sapiens
ctatatggaattgctt

SEQ ID NO: 411474 - DNA, 10 bp, Homo sapiens
ctatatgtat

SEQ ID NO: 411475 - DNA, 11 bp, Homo sapiens
ctatatgtgcg

SEQ ID NO: 411476 - DNA, 19 bp, Homo sapiens
ctatattccgggtgccatt

SEQ ID NO: 411477 - DNA, 14 bp, Homo sapiens
ctatatttcatatt

SEQ ID NO: 411478 - DNA, 16 bp, Homo sapiens
ctatatttcatattga

SEQ ID NO: 411479 - DNA, 20 bp, Homo sapiens
ctatatttgtaactttgcat

SEQ ID NO: 411480 - DNA, 16 bp, Homo sapiens
ctatcacctcccctcc

SEQ ID NO: 411481 - DNA, 13 bp, Homo sapiens
ctatcagaagacc

SEQ ID NO: 411482 - DNA, 15 bp, Homo sapiens
ctatcagtgttcttc

SEQ ID NO: 411483 - DNA, 19 bp, Homo sapiens
ctatcagtgttcttctcaa

SEQ ID NO: 411484 - DNA, 11 bp, Homo sapiens
ctatccagccg

SEQ ID NO: 411485 - DNA, 12 bp, Homo sapiens
ctatccatcctg

SEQ ID NO: 411486 - DNA, 13 bp, Homo sapiens
ctatccatcctgc

SEQ ID NO: 411487 - DNA, 16 bp, Homo sapiens
ctatccatgcaccaaa

SEQ ID NO: 411488 - DNA, 17 bp, Homo sapiens
ctatccatgcaccaaac

SEQ ID NO: 411489 - DNA, 14 bp, Homo sapiens
ctatccccaagctg

SEQ ID NO: 411490 - DNA, 18 bp, Homo sapiens
ctatccccaggccaggtc

SEQ ID NO: 411491 - DNA, 14 bp, Homo sapiens
ctatccctcacaca

SEQ ID NO: 411492 - DNA, 21 bp, Homo sapiens
ctatcctgcaccctctgctat

SEQ ID NO: 411493 - DNA, 18 bp, Homo sapiens
ctatcctggctttgccca

SEQ ID NO: 411494 - DNA, 22 bp, Homo sapiens
ctatcctggctttgcccaacct

SEQ ID NO: 411495 - DNA, 23 bp, Homo sapiens
ctatcctgttaacactgtaatat

SEQ ID NO: 411496 - DNA, 17 bp, Homo sapiens
ctatccttggcaccaaa

SEQ ID NO: 411497 - DNA, 20 bp, Homo sapiens
ctatccttggcaccaaagat

SEQ ID NO: 411498 - DNA, 15 bp, Homo sapiens
ctatctactctcctc

SEQ ID NO: 411499 - DNA, 16 bp, Homo sapiens
ctatctactctcctca

SEQ ID NO: 411500 - DNA, 17 bp, Homo sapiens
ctatctcgtgggagagc

SEQ ID NO: 411501 - DNA, 12 bp, Homo sapiens
ctatctggaaaa

SEQ ID NO: 411502 - DNA, 14 bp, Homo sapiens
ctatctggaaaaaa

SEQ ID NO: 411503 - DNA, 15 bp, Homo sapiens
ctatctgggcctggg

SEQ ID NO: 411504 - DNA, 14 bp, Homo sapiens
ctatcttgcatcta

SEQ ID NO: 411505 - DNA, 21 bp, Homo sapiens
ctatcttgcatctacctgctc

SEQ ID NO: 411506 - DNA, 14 bp, Homo sapiens
ctatgacatttcta

SEQ ID NO: 411507 - DNA, 15 bp, Homo sapiens
ctatgactgtgttta

SEQ ID NO: 411508 - DNA, 22 bp, Homo sapiens
ctatgagaacaagtcacagctg

SEQ ID NO: 411509 - DNA, 23 bp, Homo sapiens
ctatgagaacaagtcacagctgc

SEQ ID NO: 411510 - DNA, 14 bp, Homo sapiens
ctatgataaataac

SEQ ID NO: 411511 - DNA, 14 bp, Homo sapiens
ctatgatcagaact

SEQ ID NO: 411512 - DNA, 18 bp, Homo sapiens
ctatgcacaccaaattgc

SEQ ID NO: 411513 - DNA, 17 bp, Homo sapiens
ctatgcacctataaata

SEQ ID NO: 411514 - DNA, 18 bp, Homo sapiens
ctatgcacctataaatac

SEQ ID NO: 411515 - DNA, 19 bp, Homo sapiens
ctatgcacctataaatact

SEQ ID NO: 411516 - DNA, 16 bp, Homo sapiens
ctatgccacctgcagc

SEQ ID NO: 411517 - DNA, 16 bp, Homo sapiens
ctatgcctgtggtgaa

SEQ ID NO: 411518 - DNA, 23 bp, Homo sapiens
ctatgcgcaaaactgcctgaaag

SEQ ID NO: 411519 - DNA, 15 bp, Homo sapiens
ctatgctgttcattg

SEQ ID NO: 411520 - DNA, 20 bp, Homo sapiens
ctatggaaagggtgtggctt

SEQ ID NO: 411521 - DNA, 21 bp, Homo sapiens
ctatggaaagggtgtggcttg

SEQ ID NO: 411522 - DNA, 18 bp, Homo sapiens
ctatggactgcacaaaag

SEQ ID NO: 411523 - DNA, 19 bp, Homo sapiens
ctatggagcctctgcagac

SEQ ID NO: 411524 - DNA, 17 bp, Homo sapiens
ctatggattcacttcta

SEQ ID NO: 411525 - DNA, 20 bp, Homo sapiens
ctatggattttctaaggaag

SEQ ID NO: 411526 - DNA, 16 bp, Homo sapiens
ctatggctgtattttt

SEQ ID NO: 411527 - DNA, 20 bp, Homo sapiens
ctatgggaagctctgtgtgt

SEQ ID NO: 411528 - DNA, 21 bp, Homo sapiens
ctatgggagattaaaaccaga

SEQ ID NO: 411529 - DNA, 17 bp, Homo sapiens
ctatgggagccccaggg

SEQ ID NO: 411530 - DNA, 16 bp, Homo sapiens
ctatggtaaagatatt

SEQ ID NO: 411531 - DNA, 22 bp, Homo sapiens
ctatggttcccaataaaagtga

SEQ ID NO: 411532 - DNA, 23 bp, Homo sapiens
ctatggttcccaataaaagtgac

SEQ ID NO: 411533 - DNA, 14 bp, Homo sapiens
ctatgtaaaaatat

SEQ ID NO: 411534 - DNA, 11 bp, Homo sapiens
ctatgtaaatt

SEQ ID NO: 411535 - DNA, 21 bp, Homo sapiens
ctatgtaaattattgtaaact

SEQ ID NO: 411536 - DNA, 14 bp, Homo sapiens
ctatgtagaactgt

SEQ ID NO: 411537 - DNA, 19 bp, Homo sapiens
ctatgtattaccagccccc

SEQ ID NO: 411538 - DNA, 22 bp, Homo sapiens
ctatgtcatttctactttgact

SEQ ID NO: 411539 - DNA, 15 bp, Homo sapiens
ctatgtccaacagag

SEQ ID NO: 411540 - DNA, 14 bp, Homo sapiens
ctatgtcctaagga

SEQ ID NO: 411541 - DNA, 18 bp, Homo sapiens
ctatgtcctaaggacaca

SEQ ID NO: 411542 - DNA, 22 bp, Homo sapiens
ctatgtcctaaggacacactaa

SEQ ID NO: 411543 - DNA, 17 bp, Homo sapiens
ctatgtgtcatgatttc

SEQ ID NO: 411544 - DNA, 14 bp, Homo sapiens
ctatgtgtgtgctt

SEQ ID NO: 411545 - DNA, 21 bp, Homo sapiens
ctattaagcagtaaaaactgt

SEQ ID NO: 411546 - DNA, 22 bp, Homo sapiens
ctattaagcagtaaaaactgtt

SEQ ID NO: 411547 - DNA, 16 bp, Homo sapiens
ctattacccctcattt

SEQ ID NO: 411548 - DNA, 21 bp, Homo sapiens
ctattagcttactgattaact

SEQ ID NO: 411549 - DNA, 23 bp, Homo sapiens
ctattatttttttaaagaaaact

SEQ ID NO: 411550 - DNA, 13 bp, Homo sapiens
ctattcagaataa

SEQ ID NO: 411551 - DNA, 21 bp, Homo sapiens
ctattcaggagagtagaacag

SEQ ID NO: 411552 - DNA, 15 bp, Homo sapiens
ctattcccaggcagg

SEQ ID NO: 411553 - DNA, 12 bp, Homo sapiens
ctattccctgga

SEQ ID NO: 411554 - DNA, 16 bp, Homo sapiens
ctattccctttgactt

SEQ ID NO: 411555 - DNA, 16 bp, Homo sapiens
ctattcctaggcctca

SEQ ID NO: 411556 - DNA, 23 bp, Homo sapiens
ctattccttctggcctttcctct

SEQ ID NO: 411557 - DNA, 16 bp, Homo sapiens
ctattctgagccttga

SEQ ID NO: 411558 - DNA, 17 bp, Homo sapiens
ctattcttaagcacttt

SEQ ID NO: 411559 - DNA, 14 bp, Homo sapiens
ctattcttgatgta

SEQ ID NO: 411560 - DNA, 17 bp, Homo sapiens
ctattcttgatgtaaaa

SEQ ID NO: 411561 - DNA, 18 bp, Homo sapiens
ctattcttgatgtaaaat

SEQ ID NO: 411562 - DNA, 20 bp, Homo sapiens
ctattcttgatgtaaaatct

SEQ ID NO: 411563 - DNA, 17 bp, Homo sapiens
ctattgatgtacagtct

SEQ ID NO: 411564 - DNA, 22 bp, Homo sapiens
ctattgcagatatttgatgtag

SEQ ID NO: 411565 - DNA, 18 bp, Homo sapiens
ctattgcagttatagaaa

SEQ ID NO: 411566 - DNA, 20 bp, Homo sapiens
ctattgccaggaatgtttca

SEQ ID NO: 411567 - DNA, 20 bp, Homo sapiens
ctattgctgtaaataaaaat

SEQ ID NO: 411568 - DNA, 15 bp, Homo sapiens
ctattggacagacac

SEQ ID NO: 411569 - DNA, 16 bp, Homo sapiens
ctattggacagacaca

SEQ ID NO: 411570 - DNA, 20 bp, Homo sapiens
ctattgggcacagcctaggg

SEQ ID NO: 411571 - DNA, 16 bp, Homo sapiens
ctattgggttcattat

SEQ ID NO: 411572 - DNA, 16 bp, Homo sapiens
ctattgttactctggt

SEQ ID NO: 411573 - DNA, 13 bp, Homo sapiens
ctatttaaaaaat

SEQ ID NO: 411574 - DNA, 16 bp, Homo sapiens
ctatttaaaattggca

SEQ ID NO: 411575 - DNA, 18 bp, Homo sapiens
ctatttaaaattggcacc

SEQ ID NO: 411576 - DNA, 18 bp, Homo sapiens
ctatttaaacttataaat

SEQ ID NO: 411577 - DNA, 20 bp, Homo sapiens
ctatttaaacttataaatca

SEQ ID NO: 411578 - DNA, 15 bp, Homo sapiens
ctatttaactgacta

SEQ ID NO: 411579 - DNA, 14 bp, Homo sapiens
ctatttaacttgag

SEQ ID NO: 411580 - DNA, 18 bp, Homo sapiens
ctatttagcatgacaagc

SEQ ID NO: 411581 - DNA, 13 bp, Homo sapiens
ctatttataaact

SEQ ID NO: 411582 - DNA, 22 bp, Homo sapiens
ctatttattaagttctcaatgt

SEQ ID NO: 411583 - DNA, 16 bp, Homo sapiens
ctatttcctttgcgca

SEQ ID NO: 411584 - DNA, 22 bp, Homo sapiens
ctatttcctttgcgcaaacttt

SEQ ID NO: 411585 - DNA, 19 bp, Homo sapiens
ctatttcggaaatacacta

SEQ ID NO: 411586 - DNA, 14 bp, Homo sapiens
ctatttctatctgc

SEQ ID NO: 411587 - DNA, 15 bp, Homo sapiens
ctatttctatctgca

SEQ ID NO: 411588 - DNA, 13 bp, Homo sapiens
ctatttgactgct

SEQ ID NO: 411589 - DNA, 22 bp, Homo sapiens
ctatttgtatatatacataaca

SEQ ID NO: 411590 - DNA, 23 bp, Homo sapiens
ctatttgttgtttttaacaacta

SEQ ID NO: 411591 - DNA, 21 bp, Homo sapiens
ctattttaatccttctaacta

SEQ ID NO: 411592 - DNA, 16 bp, Homo sapiens
ctattttactttgtac

SEQ ID NO: 411593 - DNA, 22 bp, Homo sapiens
ctatttttgtcttatatatatt

SEQ ID NO: 411594 - DNA, 17 bp, Homo sapiens
ctatttttttaactgaa

SEQ ID NO: 411595 - DNA, 18 bp, Homo sapiens
ctatttttttaactgaaa

SEQ ID NO: 411596 - DNA, 17 bp, Homo sapiens
ctatttttttgttgctg

SEQ ID NO: 411597 - DNA, 21 bp, Homo sapiens
ctcaaaaaaaaaaaaatgcac

SEQ ID NO: 411598 - DNA, 16 bp, Homo sapiens
ctcaaaacttaacata

SEQ ID NO: 411599 - DNA, 20 bp, Homo sapiens
ctcaaaacttaacatattta

SEQ ID NO: 411600 - DNA, 18 bp, Homo sapiens
ctcaaaaggaaaccaagt

SEQ ID NO: 411601 - DNA, 20 bp, Homo sapiens
ctcaaaaggagaactgtgct

SEQ ID NO: 411602 - DNA, 21 bp, Homo sapiens
ctcaaaaggagaactgtgctc

SEQ ID NO: 411603 - DNA, 23 bp, Homo sapiens
ctcaaaaggagaactgtgctctc

SEQ ID NO: 411604 - DNA, 15 bp, Homo sapiens
ctcaaaagtctattt

SEQ ID NO: 411605 - DNA, 14 bp, Homo sapiens
ctcaaaccctgtgg

SEQ ID NO: 411606 - DNA, 15 bp, Homo sapiens
ctcaaaccctgttta

SEQ ID NO: 411607 - DNA, 20 bp, Homo sapiens
ctcaaactaaaagacatttg

SEQ ID NO: 411608 - DNA, 14 bp, Homo sapiens
ctcaaactcctgac

SEQ ID NO: 411609 - DNA, 16 bp, Homo sapiens
ctcaaagatgtaatgt

SEQ ID NO: 411610 - DNA, 15 bp, Homo sapiens
ctcaaagatgtactg

SEQ ID NO: 411611 - DNA, 17 bp, Homo sapiens
ctcaaagatgtactgag

SEQ ID NO: 411612 - DNA, 22 bp, Homo sapiens
ctcaaagatgtactgagaggag

SEQ ID NO: 411613 - DNA, 20 bp, Homo sapiens
ctcaaagtaggtatacaaaa

SEQ ID NO: 411614 - DNA, 17 bp, Homo sapiens
ctcaaagttaacctacc

SEQ ID NO: 411615 - DNA, 18 bp, Homo sapiens
ctcaaagtttttacagtg

SEQ ID NO: 411616 - DNA, 20 bp, Homo sapiens
ctcaaagtttttacagtgta

SEQ ID NO: 411617 - DNA, 17 bp, Homo sapiens
ctcaaatagcctttctt

SEQ ID NO: 411618 - DNA, 15 bp, Homo sapiens
ctcaaatctattcag

SEQ ID NO: 411619 - DNA, 22 bp, Homo sapiens
ctcaaatgcagtatttttgttg

SEQ ID NO: 411620 - DNA, 16 bp, Homo sapiens
ctcaaattaatctttc

SEQ ID NO: 411621 - DNA, 22 bp, Homo sapiens
ctcaacaagggagagacctcat

SEQ ID NO: 411622 - DNA, 23 bp, Homo sapiens
ctcaacaagggagagacctcatc

SEQ ID NO: 411623 - DNA, 13 bp, Homo sapiens
ctcaacagatctg

SEQ ID NO: 411624 - DNA, 19 bp, Homo sapiens
ctcaacagatctgtgggcc

SEQ ID NO: 411625 - DNA, 16 bp, Homo sapiens
ctcaacatgttactga

SEQ ID NO: 411626 - DNA, 16 bp, Homo sapiens
ctcaacattgcatggt

SEQ ID NO: 411627 - DNA, 19 bp, Homo sapiens
ctcaacccccatttctatt

SEQ ID NO: 411628 - DNA, 21 bp, Homo sapiens
ctcaacccccctcccagacag

SEQ ID NO: 411629 - DNA, 20 bp, Homo sapiens
ctcaacctgtaaattatttt

SEQ ID NO: 411630 - DNA, 18 bp, Homo sapiens
ctcaacgttgctccccat

SEQ ID NO: 411631 - DNA, 16 bp, Homo sapiens
ctcaagaaattttcaa

SEQ ID NO: 411632 - DNA, 21 bp, Homo sapiens
ctcaagaagacatggagactc

SEQ ID NO: 411633 - DNA, 23 bp, Homo sapiens
ctcaagacggagatgcatggcct

SEQ ID NO: 411634 - DNA, 17 bp, Homo sapiens
ctcaagagggcactggt

SEQ ID NO: 411635 - DNA, 16 bp, Homo sapiens
ctcaagatgaaggcaa

SEQ ID NO: 411636 - DNA, 16 bp, Homo sapiens
ctcaagcaaggaagca

SEQ ID NO: 411637 - DNA, 20 bp, Homo sapiens
ctcaagcaatcctcctgagt

SEQ ID NO: 411638 - DNA, 22 bp, Homo sapiens
ctcaagcaatcctcctgagtga

SEQ ID NO: 411639 - DNA, 16 bp, Homo sapiens
ctcaagcacttttcct

SEQ ID NO: 411640 - DNA, 15 bp, Homo sapiens
ctcaagcaggtttct

SEQ ID NO: 411641 - DNA, 12 bp, Homo sapiens
ctcaagccagga

SEQ ID NO: 411642 - DNA, 10 bp, Homo sapiens
ctcaaggact

SEQ ID NO: 411643 - DNA, 15 bp, Homo sapiens
ctcaaggacttgaaa

SEQ ID NO: 411644 - DNA, 16 bp, Homo sapiens
ctcaaggactttgcag

SEQ ID NO: 411645 - DNA, 12 bp, Homo sapiens
ctcaaggattca

SEQ ID NO: 411646 - DNA, 21 bp, Homo sapiens
ctcaaggctgcagtgagccaa

SEQ ID NO: 411647 - DNA, 14 bp, Homo sapiens
ctcaagtatataaa

SEQ ID NO: 411648 - DNA, 21 bp, Homo sapiens
ctcaataaatgtgtgttgact

SEQ ID NO: 411649 - DNA, 19 bp, Homo sapiens
ctcaatattcaataaagct

SEQ ID NO: 411650 - DNA, 21 bp, Homo sapiens
ctcaatgaaaccttcctcttg

SEQ ID NO: 411651 - DNA, 17 bp, Homo sapiens
ctcaatgtgcaataact

SEQ ID NO: 411652 - DNA, 21 bp, Homo sapiens
ctcaatgtgcaataacttgtg

SEQ ID NO: 411653 - DNA, 13 bp, Homo sapiens
ctcaattttgtat

SEQ ID NO: 411654 - DNA, 13 bp, Homo sapiens
ctcacaactgttt

SEQ ID NO: 411655 - DNA, 15 bp, Homo sapiens
ctcacacacacagct

SEQ ID NO: 411656 - DNA, 19 bp, Homo sapiens
ctcacacacacagctgggc

SEQ ID NO: 411657 - DNA, 15 bp, Homo sapiens
ctcacagcacatgct

SEQ ID NO: 411658 - DNA, 19 bp, Homo sapiens
ctcacagcacatgctggcc

SEQ ID NO: 411659 - DNA, 20 bp, Homo sapiens
ctcacagcacatgctggcca

SEQ ID NO: 411660 - DNA, 21 bp, Homo sapiens
ctcacagcacatgctggccag

SEQ ID NO: 411661 - DNA, 20 bp, Homo sapiens
ctcacagcctctcccttaat

SEQ ID NO: 411662 - DNA, 20 bp, Homo sapiens
ctcacagtctctttaatctt

SEQ ID NO: 411663 - DNA, 20 bp, Homo sapiens
ctcacatagcttacaagcca

SEQ ID NO: 411664 - DNA, 13 bp, Homo sapiens
ctcacatgctgga

SEQ ID NO: 411665 - DNA, 21 bp, Homo sapiens
ctcacatgctggacaggtctg

SEQ ID NO: 411666 - DNA, 20 bp, Homo sapiens
ctcaccaaaaagctttaaaa

SEQ ID NO: 411667 - DNA, 21 bp, Homo sapiens
ctcaccaaaatatagttaatt

SEQ ID NO: 411668 - DNA, 14 bp, Homo sapiens
ctcaccaataactt

SEQ ID NO: 411669 - DNA, 23 bp, Homo sapiens
ctcaccaataacttcagagaagt

SEQ ID NO: 411670 - DNA, 12 bp, Homo sapiens
ctcaccagctca

SEQ ID NO: 411671 - DNA, 13 bp, Homo sapiens
ctcaccagctcag

SEQ ID NO: 411672 - DNA, 16 bp, Homo sapiens
ctcaccagctcagccc

SEQ ID NO: 411673 - DNA, 22 bp, Homo sapiens
ctcaccagctcagccccggcca

SEQ ID NO: 411674 - DNA, 10 bp, Homo sapiens
ctcaccaggg

SEQ ID NO: 411675 - DNA, 13 bp, Homo sapiens
ctcaccagggtcc

SEQ ID NO: 411676 - DNA, 23 bp, Homo sapiens
ctcaccagggtccgcaccagctg

SEQ ID NO: 411677 - DNA, 12 bp, Homo sapiens
ctcaccatttca

SEQ ID NO: 411678 - DNA, 13 bp, Homo sapiens
ctcacccaaaaga

SEQ ID NO: 411679 - DNA, 15 bp, Homo sapiens
ctcaccccaaggggt

SEQ ID NO: 411680 - DNA, 12 bp, Homo sapiens
ctcaccccatcc

SEQ ID NO: 411681 - DNA, 22 bp, Homo sapiens
ctcacccccaaggggcagtctg

SEQ ID NO: 411682 - DNA, 13 bp, Homo sapiens
ctcacccccaccc

SEQ ID NO: 411683 - DNA, 19 bp, Homo sapiens
ctcacccccacccctgtac

SEQ ID NO: 411684 - DNA, 20 bp, Homo sapiens
ctcaccccgttacagctccc

SEQ ID NO: 411685 - DNA, 15 bp, Homo sapiens
ctcacccctgcaggc

SEQ ID NO: 411686 - DNA, 12 bp, Homo sapiens
ctcacccctggg

SEQ ID NO: 411687 - DNA, 19 bp, Homo sapiens
ctcacccgctgcccagccc

SEQ ID NO: 411688 - DNA, 15 bp, Homo sapiens
ctcaccctgccttat

SEQ ID NO: 411689 - DNA, 20 bp, Homo sapiens
ctcaccctgcttggggcctg

SEQ ID NO: 411690 - DNA, 14 bp, Homo sapiens
ctcacctacttcct

SEQ ID NO: 411691 - DNA, 12 bp, Homo sapiens
ctcacctcagga

SEQ ID NO: 411692 - DNA, 11 bp, Homo sapiens
ctcacctcctc

SEQ ID NO: 411693 - DNA, 21 bp, Homo sapiens
ctcacctctggactggctaga

SEQ ID NO: 411694 - DNA, 22 bp, Homo sapiens
ctcacctctggactggctagag

SEQ ID NO: 411695 - DNA, 14 bp, Homo sapiens
ctcacctgcagccc

SEQ ID NO: 411696 - DNA, 15 bp, Homo sapiens
ctcacctgctggccc

SEQ ID NO: 411697 - DNA, 21 bp, Homo sapiens
ctcacctgctggcccctcacc

SEQ ID NO: 411698 - DNA, 13 bp, Homo sapiens
ctcacctggcttc

SEQ ID NO: 411699 - DNA, 21 bp, Homo sapiens
ctcacctggcttcccaggacc

SEQ ID NO: 411700 - DNA, 17 bp, Homo sapiens
ctcacctgggcctttcc

SEQ ID NO: 411701 - DNA, 22 bp, Homo sapiens
ctcacctgtctaggtctcctca

SEQ ID NO: 411702 - DNA, 21 bp, Homo sapiens
ctcaccttgcaacacacagac

SEQ ID NO: 411703 - DNA, 16 bp, Homo sapiens
ctcacgactcttcctg

SEQ ID NO: 411704 - DNA, 21 bp, Homo sapiens
ctcacggggttggctgttcca

SEQ ID NO: 411705 - DNA, 23 bp, Homo sapiens
ctcacgtctgtgagtctgtcctt

SEQ ID NO: 411706 - DNA, 21 bp, Homo sapiens
ctcacgtgtcagaagcctcca

SEQ ID NO: 411707 - DNA, 13 bp, Homo sapiens
ctcacgtgtgtga

SEQ ID NO: 411708 - DNA, 15 bp, Homo sapiens
ctcactatgtttctc

SEQ ID NO: 411709 - DNA, 21 bp, Homo sapiens
ctcactatgtttctcagactg

SEQ ID NO: 411710 - DNA, 14 bp, Homo sapiens
ctcactccactccc

SEQ ID NO: 411711 - DNA, 17 bp, Homo sapiens
ctcactccactcccctc

SEQ ID NO: 411712 - DNA, 20 bp, Homo sapiens
ctcactccccagccccaccc

SEQ ID NO: 411713 - DNA, 20 bp, Homo sapiens
ctcactcccctcctttccca

SEQ ID NO: 411714 - DNA, 19 bp, Homo sapiens
ctcactccctaaagccctc

SEQ ID NO: 411715 - DNA, 21 bp, Homo sapiens
ctcactccctttgtggacttt

SEQ ID NO: 411716 - DNA, 13 bp, Homo sapiens
ctcactcctacct

SEQ ID NO: 411717 - DNA, 13 bp, Homo sapiens
ctcactcctagga

SEQ ID NO: 411718 - DNA, 18 bp, Homo sapiens
ctcactcctaggagagcc

SEQ ID NO: 411719 - DNA, 19 bp, Homo sapiens
ctcactcctaggagagcca

SEQ ID NO: 411720 - DNA, 12 bp, Homo sapiens
ctcactcctgag

SEQ ID NO: 411721 - DNA, 12 bp, Homo sapiens
ctcactcctgtt

SEQ ID NO: 411722 - DNA, 14 bp, Homo sapiens
ctcactctgccagg

SEQ ID NO: 411723 - DNA, 15 bp, Homo sapiens
ctcactgcagcctct

SEQ ID NO: 411724 - DNA, 21 bp, Homo sapiens
ctcactgcagcctctgcctcc

SEQ ID NO: 411725 - DNA, 19 bp, Homo sapiens
ctcactgcccgcacaccct

SEQ ID NO: 411726 - DNA, 12 bp, Homo sapiens
ctcactgccctc

SEQ ID NO: 411727 - DNA, 19 bp, Homo sapiens
ctcactgctcaagaagaca

SEQ ID NO: 411728 - DNA, 20 bp, Homo sapiens
ctcactggctggggcagagg

SEQ ID NO: 411729 - DNA, 22 bp, Homo sapiens
ctcactggctggggcagagggg

SEQ ID NO: 411730 - DNA, 17 bp, Homo sapiens
ctcactggtgcatttaa

SEQ ID NO: 411731 - DNA, 21 bp, Homo sapiens
ctcactggtgcatttaaaatg

SEQ ID NO: 411732 - DNA, 14 bp, Homo sapiens
ctcactgtgctcct

SEQ ID NO: 411733 - DNA, 15 bp, Homo sapiens
ctaattaatttcagt

SEQ ID NO: 411734 - DNA, 17 bp, Homo sapiens
ctaattataatgcaaat

SEQ ID NO: 411735 - DNA, 15 bp, Homo sapiens
ctaattcaactctgt

SEQ ID NO: 411736 - DNA, 19 bp, Homo sapiens
ctaattcccattttgcaaa

SEQ ID NO: 411737 - DNA, 17 bp, Homo sapiens
ctaattctcttcgctgt

SEQ ID NO: 411738 - DNA, 18 bp, Homo sapiens
ctaattctcttcgctgtg

SEQ ID NO: 411739 - DNA, 22 bp, Homo sapiens
ctaatttattgccgtcctggac

SEQ ID NO: 411740 - DNA, 19 bp, Homo sapiens
ctaatttcaaaaatataac

SEQ ID NO: 411741 - DNA, 19 bp, Homo sapiens
ctaattttctcaaaagcat

SEQ ID NO: 411742 - DNA, 15 bp, Homo sapiens
ctaattttggatgga

SEQ ID NO: 411743 - DNA, 19 bp, Homo sapiens
ctaattttgtgctctttcc

SEQ ID NO: 411744 - DNA, 17 bp, Homo sapiens
ctaatttttaagcaaaa

SEQ ID NO: 411745 - DNA, 16 bp, Homo sapiens
ctaatttttttgtatt

SEQ ID NO: 411746 - DNA, 15 bp, Homo sapiens
ctacaaaatgtgtgc

SEQ ID NO: 411747 - DNA, 17 bp, Homo sapiens
ctacaaaatttgaaatt

SEQ ID NO: 411748 - DNA, 18 bp, Homo sapiens
ctacaaaatttgaaattt

SEQ ID NO: 411749 - DNA, 14 bp, Homo sapiens
ctacaactccagcc

SEQ ID NO: 411750 - DNA, 14 bp, Homo sapiens
ctacaacttcagca

SEQ ID NO: 411751 - DNA, 17 bp, Homo sapiens
ctacaacttcagcagta

SEQ ID NO: 411752 - DNA, 22 bp, Homo sapiens
ctacaagagcagcctgtggcat

SEQ ID NO: 411753 - DNA, 18 bp, Homo sapiens
ctacaatcctaccttttg

SEQ ID NO: 411754 - DNA, 22 bp, Homo sapiens
ctacacaacatgtatgtggata

SEQ ID NO: 411755 - DNA, 11 bp, Homo sapiens
ctacacacaca

SEQ ID NO: 411756 - DNA, 16 bp, Homo sapiens
ctacacagcatctgtt

SEQ ID NO: 411757 - DNA, 20 bp, Homo sapiens
ctacacccttggacttgagg

SEQ ID NO: 411758 - DNA, 21 bp, Homo sapiens
ctacacctctgggccctgcag

SEQ ID NO: 411759 - DNA, 21 bp, Homo sapiens
ctacactcgccttctgcttcc

SEQ ID NO: 411760 - DNA, 16 bp, Homo sapiens
ctacactctcctgggc

SEQ ID NO: 411761 - DNA, 19 bp, Homo sapiens
ctacactctcctgggcccc

SEQ ID NO: 411762 - DNA, 22 bp, Homo sapiens
ctacactgtattacataaataa

SEQ ID NO: 411763 - DNA, 16 bp, Homo sapiens
ctacacttacaagtaa

SEQ ID NO: 411764 - DNA, 13 bp, Homo sapiens
ctacagaaaataa

SEQ ID NO: 411765 - DNA, 15 bp, Homo sapiens
ctacagaacaaagaa

SEQ ID NO: 411766 - DNA, 14 bp, Homo sapiens
ctacagaataatgt

SEQ ID NO: 411767 - DNA, 15 bp, Homo sapiens
ctacagagcagctcc

SEQ ID NO: 411768 - DNA, 23 bp, Homo sapiens
ctacagagtctgacaggaagact

SEQ ID NO: 411769 - DNA, 14 bp, Homo sapiens
ctacagataattta

SEQ ID NO: 411770 - DNA, 18 bp, Homo sapiens
ctacagcctgcacacacc

SEQ ID NO: 411771 - DNA, 18 bp, Homo sapiens
ctacaggaagcaccccat

SEQ ID NO: 411772 - DNA, 19 bp, Homo sapiens
ctacaggcctttcaggaag

SEQ ID NO: 411773 - DNA, 20 bp, Homo sapiens
ctacaggcctttcaggaagg

SEQ ID NO: 411774 - DNA, 17 bp, Homo sapiens
ctacaggcgctccaggc

SEQ ID NO: 411775 - DNA, 16 bp, Homo sapiens
ctacaggggaggctga

SEQ ID NO: 411776 - DNA, 19 bp, Homo sapiens
ctacaggtattttcatcaa

SEQ ID NO: 411777 - DNA, 16 bp, Homo sapiens
ctacagtagctgtggg

SEQ ID NO: 411778 - DNA, 18 bp, Homo sapiens
ctacagtagctgtgggga

SEQ ID NO: 411779 - DNA, 18 bp, Homo sapiens
ctacagttgaacagaact

SEQ ID NO: 411780 - DNA, 17 bp, Homo sapiens
ctacatcccagcctgtg

SEQ ID NO: 411781 - DNA, 19 bp, Homo sapiens
ctacatcccagcctgtggt

SEQ ID NO: 411782 - DNA, 17 bp, Homo sapiens
ctacatcgccctccaca

SEQ ID NO: 411783 - DNA, 14 bp, Homo sapiens
ctacatgactgggc

SEQ ID NO: 411784 - DNA, 16 bp, Homo sapiens
ctacatgactgggcct

SEQ ID NO: 411785 - DNA, 14 bp, Homo sapiens
ctacatgcagccca

SEQ ID NO: 411786 - DNA, 23 bp, Homo sapiens
ctacatgcagcccatgcccacct

SEQ ID NO: 411787 - DNA, 15 bp, Homo sapiens
ctacatgcatgtttt

SEQ ID NO: 411788 - DNA, 22 bp, Homo sapiens
ctacattccctctcctgcccag

SEQ ID NO: 411789 - DNA, 23 bp, Homo sapiens
ctacattccctctcctgcccaga

SEQ ID NO: 411790 - DNA, 18 bp, Homo sapiens
ctacattcctcagctgcc

SEQ ID NO: 411791 - DNA, 19 bp, Homo sapiens
ctacattctctatttttgt

SEQ ID NO: 411792 - DNA, 15 bp, Homo sapiens
ctacattgtaatctg

SEQ ID NO: 411793 - DNA, 23 bp, Homo sapiens
ctacatttcacctactttgtaag

SEQ ID NO: 411794 - DNA, 12 bp, Homo sapiens
ctacatttgcat

SEQ ID NO: 411795 - DNA, 22 bp, Homo sapiens
ctaccaaatgttaataaagccc

SEQ ID NO: 411796 - DNA, 13 bp, Homo sapiens
ctaccaagtgacc

SEQ ID NO: 411797 - DNA, 15 bp, Homo sapiens
ctaccacaaggaaaa

SEQ ID NO: 411798 - DNA, 13 bp, Homo sapiens
ctaccacagtgtc

SEQ ID NO: 411799 - DNA, 15 bp, Homo sapiens
ctaccacagtgtctg

SEQ ID NO: 411800 - DNA, 19 bp, Homo sapiens
ctaccactgagcccttgca

SEQ ID NO: 411801 - DNA, 16 bp, Homo sapiens
ctaccacttatttcta

SEQ ID NO: 411802 - DNA, 20 bp, Homo sapiens
ctaccagcgcccgctgggct

SEQ ID NO: 411803 - DNA, 21 bp, Homo sapiens
ctaccagcgcccgctgggctg

SEQ ID NO: 411804 - DNA, 18 bp, Homo sapiens
ctaccagtcgccctctgt

SEQ ID NO: 411805 - DNA, 20 bp, Homo sapiens
ctaccagtcgccctctgtgc

SEQ ID NO: 411806 - DNA, 15 bp, Homo sapiens
ctaccagtgggcatg

SEQ ID NO: 411807 - DNA, 13 bp, Homo sapiens
ctaccatctccct

SEQ ID NO: 411808 - DNA, 21 bp, Homo sapiens
ctaccatgaagtgaaaatgcc

SEQ ID NO: 411809 - DNA, 21 bp, Homo sapiens
ctacccacagggcctgacttt

SEQ ID NO: 411810 - DNA, 17 bp, Homo sapiens
ctacccaccgatggagc

SEQ ID NO: 411811 - DNA, 12 bp, Homo sapiens
ctacccagccca

SEQ ID NO: 411812 - DNA, 15 bp, Homo sapiens
ctacccagcccatct

SEQ ID NO: 411813 - DNA, 23 bp, Homo sapiens
ctacccatcggtgtccatttata

SEQ ID NO: 411814 - DNA, 15 bp, Homo sapiens
ctacccatgagcctg

SEQ ID NO: 411815 - DNA, 12 bp, Homo sapiens
ctaccccacacc

SEQ ID NO: 411816 - DNA, 17 bp, Homo sapiens
ctaccccacaccaggcc

SEQ ID NO: 411817 - DNA, 18 bp, Homo sapiens
ctaccccccgtctcctgc

SEQ ID NO: 411818 - DNA, 23 bp, Homo sapiens
ctacccctgctcccattcctccc

SEQ ID NO: 411819 - DNA, 16 bp, Homo sapiens
ctacccctgtcctggg

SEQ ID NO: 411820 - DNA, 19 bp, Homo sapiens
ctacccgagcccagctaca

SEQ ID NO: 411821 - DNA, 20 bp, Homo sapiens
ctacccgagcccagctacat

SEQ ID NO: 411822 - DNA, 23 bp, Homo sapiens
ctacccgcccgcgtccaaccccg

SEQ ID NO: 411823 - DNA, 16 bp, Homo sapiens
ctaccctacacctctg

SEQ ID NO: 411824 - DNA, 19 bp, Homo sapiens
ctaccctacacctctgggc

SEQ ID NO: 411825 - DNA, 16 bp, Homo sapiens
ctaccctcttattgtt

SEQ ID NO: 411826 - DNA, 21 bp, Homo sapiens
ctaccctgaaacccagtaatt

SEQ ID NO: 411827 - DNA, 20 bp, Homo sapiens
ctacccttgccaaggccgcc

SEQ ID NO: 411828 - DNA, 13 bp, Homo sapiens
ctaccctttccca

SEQ ID NO: 411829 - DNA, 17 bp, Homo sapiens
ctaccgagtctcttctc

SEQ ID NO: 411830 - DNA, 22 bp, Homo sapiens
ctaccgagtctcttctccactg

SEQ ID NO: 411831 - DNA, 15 bp, Homo sapiens
ctaccgatggtccca

SEQ ID NO: 411832 - DNA, 17 bp, Homo sapiens
ctaccgatggtcccagg

SEQ ID NO: 411833 - DNA, 20 bp, Homo sapiens
ctaccgatttcagcacatgc

SEQ ID NO: 411834 - DNA, 13 bp, Homo sapiens
ctaccgccctggg

SEQ ID NO: 411835 - DNA, 14 bp, Homo sapiens
ctaccgccctgggc

SEQ ID NO: 411836 - DNA, 16 bp, Homo sapiens
ctaccgccctgggctg

SEQ ID NO: 411837 - DNA, 18 bp, Homo sapiens
ctaccgccctgggctgga

SEQ ID NO: 411838 - DNA, 22 bp, Homo sapiens
ctaccgggttctcctgatttga

SEQ ID NO: 411839 - DNA, 22 bp, Homo sapiens
ctacctcactattcaagtatta

SEQ ID NO: 411840 - DNA, 14 bp, Homo sapiens
ctacctcaggcagg

SEQ ID NO: 411841 - DNA, 14 bp, Homo sapiens
ctacctctaacacc

SEQ ID NO: 411842 - DNA, 21 bp, Homo sapiens
ctacctctaacaccacactga

SEQ ID NO: 411843 - DNA, 22 bp, Homo sapiens
ctacctcttccaggaagcacag

SEQ ID NO: 411844 - DNA, 17 bp, Homo sapiens
ctacctgaacacttatt

SEQ ID NO: 411845 - DNA, 15 bp, Homo sapiens
ctacctgatcccact

SEQ ID NO: 411846 - DNA, 20 bp, Homo sapiens
ctacctgattggtgcaaccc

SEQ ID NO: 411847 - DNA, 14 bp, Homo sapiens
ctaccttctgacct

SEQ ID NO: 411848 - DNA, 15 bp, Homo sapiens
ctaccttctgacctc

SEQ ID NO: 411849 - DNA, 21 bp, Homo sapiens
ctaccttgagaccctcttctc

SEQ ID NO: 411850 - DNA, 22 bp, Homo sapiens
ctaccttgagaccctcttctct

SEQ ID NO: 411851 - DNA, 23 bp, Homo sapiens
ctaccttgaggtcttttgacatg

SEQ ID NO: 411852 - DNA, 19 bp, Homo sapiens
ctaccttttgataaaatgt

SEQ ID NO: 411853 - DNA, 21 bp, Homo sapiens
ctaccttttgataaaatgttc

SEQ ID NO: 411854 - DNA, 20 bp, Homo sapiens
ctacgctcctgtctccaaga

SEQ ID NO: 411855 - DNA, 15 bp, Homo sapiens
ctacggagggaccag

SEQ ID NO: 411856 - DNA, 19 bp, Homo sapiens
ctacggagggtgggctctg

SEQ ID NO: 411857 - DNA, 14 bp, Homo sapiens
ctacggttatttcc

SEQ ID NO: 411858 - DNA, 15 bp, Homo sapiens
ctacggttatttcct

SEQ ID NO: 411859 - DNA, 20 bp, Homo sapiens
ctacggttatttcctgcttt

SEQ ID NO: 411860 - DNA, 23 bp, Homo sapiens
ctacgtaatctcacttaatacag

SEQ ID NO: 411861 - DNA, 13 bp, Homo sapiens
ctactaaaaatac

SEQ ID NO: 411862 - DNA, 14 bp, Homo sapiens
ctactaaagtgcct

SEQ ID NO: 411863 - DNA, 17 bp, Homo sapiens
ctactaacctggagaca

SEQ ID NO: 411864 - DNA, 21 bp, Homo sapiens
ctactacatcgccctccacat

SEQ ID NO: 411865 - DNA, 16 bp, Homo sapiens
ctactacccgagccca

SEQ ID NO: 411866 - DNA, 12 bp, Homo sapiens
ctcactgttccc

SEQ ID NO: 411867 - DNA, 21 bp, Homo sapiens
ctcactgttccctctgctcct

SEQ ID NO: 411868 - DNA, 17 bp, Homo sapiens
ctcacttataccaaagg

SEQ ID NO: 411869 - DNA, 21 bp, Homo sapiens
ctcacttataccaaagggaaa

SEQ ID NO: 411870 - DNA, 14 bp, Homo sapiens
ctcacttcaccctg

SEQ ID NO: 411871 - DNA, 14 bp, Homo sapiens
ctcacttgggggaa

SEQ ID NO: 411872 - DNA, 16 bp, Homo sapiens
ctcacttttcacttgt

SEQ ID NO: 411873 - DNA, 22 bp, Homo sapiens
ctcacttttcacttgtcttgct

SEQ ID NO: 411874 - DNA, 23 bp, Homo sapiens
ctcagaaaacttctcttctgagc

SEQ ID NO: 411875 - DNA, 15 bp, Homo sapiens
ctcagaactcctgtg

SEQ ID NO: 411876 - DNA, 15 bp, Homo sapiens
ctcagaactgttggc

SEQ ID NO: 411877 - DNA, 22 bp, Homo sapiens
ctcagaagtgaaaaagacttca

SEQ ID NO: 411878 - DNA, 12 bp, Homo sapiens
ctcagaatattg

SEQ ID NO: 411879 - DNA, 22 bp, Homo sapiens
ctcagaattattcatagctgta

SEQ ID NO: 411880 - DNA, 14 bp, Homo sapiens
ctcagacattccaa

SEQ ID NO: 411881 - DNA, 22 bp, Homo sapiens
ctcagacccttgaagatgtagc

SEQ ID NO: 411882 - DNA, 13 bp, Homo sapiens
ctcagactggtct

SEQ ID NO: 411883 - DNA, 22 bp, Homo sapiens
ctcagacttctcttattcttta

SEQ ID NO: 411884 - DNA, 17 bp, Homo sapiens
ctcagagaaggaaaaga

SEQ ID NO: 411885 - DNA, 16 bp, Homo sapiens
ctcagagactcccagg

SEQ ID NO: 411886 - DNA, 19 bp, Homo sapiens
ctcagagcagcctctgtcc

SEQ ID NO: 411887 - DNA, 15 bp, Homo sapiens
ctcagagccaagtcc

SEQ ID NO: 411888 - DNA, 16 bp, Homo sapiens
ctcagagctccacaga

SEQ ID NO: 411889 - DNA, 22 bp, Homo sapiens
ctcagaggagtctgggaagggg

SEQ ID NO: 411890 - DNA, 21 bp, Homo sapiens
ctcagagggttgttctcctag

SEQ ID NO: 411891 - DNA, 19 bp, Homo sapiens
ctcagaggtagggctgcca

SEQ ID NO: 411892 - DNA, 17 bp, Homo sapiens
ctcagatcactactgca

SEQ ID NO: 411893 - DNA, 18 bp, Homo sapiens
ctcagatcactactgcag

SEQ ID NO: 411894 - DNA, 22 bp, Homo sapiens
ctcagatccctcggtcagcacc

SEQ ID NO: 411895 - DNA, 12 bp, Homo sapiens
ctcagatctgaa

SEQ ID NO: 411896 - DNA, 15 bp, Homo sapiens
ctcagatgaaaataa

SEQ ID NO: 411897 - DNA, 20 bp, Homo sapiens
ctcagatgaaaataaaataa

SEQ ID NO: 411898 - DNA, 14 bp, Homo sapiens
ctcagatggagaca

SEQ ID NO: 411899 - DNA, 21 bp, Homo sapiens
ctcagatggagacattggatg

SEQ ID NO: 411900 - DNA, 12 bp, Homo sapiens
ctcagcacagcc

SEQ ID NO: 411901 - DNA, 20 bp, Homo sapiens
ctcagcacagcctcacccct

SEQ ID NO: 411902 - DNA, 13 bp, Homo sapiens
ctcagcagccccc

SEQ ID NO: 411903 - DNA, 14 bp, Homo sapiens
ctcagcagccccct

SEQ ID NO: 411904 - DNA, 18 bp, Homo sapiens
ctcagcagccccctgccc

SEQ ID NO: 411905 - DNA, 16 bp, Homo sapiens
ctcagcaggggagggt

SEQ ID NO: 411906 - DNA, 19 bp, Homo sapiens
ctcagcagttcacttccta

SEQ ID NO: 411907 - DNA, 17 bp, Homo sapiens
ctcagcccacccccctc

SEQ ID NO: 411908 - DNA, 18 bp, Homo sapiens
ctcagccccagcccagcc

SEQ ID NO: 411909 - DNA, 16 bp, Homo sapiens
ctcagccccagggccc

SEQ ID NO: 411910 - DNA, 17 bp, Homo sapiens
ctcagccccagggccct

SEQ ID NO: 411911 - DNA, 14 bp, Homo sapiens
ctcagccccggcca

SEQ ID NO: 411912 - DNA, 23 bp, Homo sapiens
ctcagccccggccactccctgcc

SEQ ID NO: 411913 - DNA, 20 bp, Homo sapiens
ctcagcccctagcagagcgt

SEQ ID NO: 411914 - DNA, 19 bp, Homo sapiens
ctcagcccctcttgccccc

SEQ ID NO: 411915 - DNA, 21 bp, Homo sapiens
ctcagccctagaggcgagcca

SEQ ID NO: 411916 - DNA, 22 bp, Homo sapiens
ctcagccctagaggcgagccag

SEQ ID NO: 411917 - DNA, 14 bp, Homo sapiens
ctcagccctccctg

SEQ ID NO: 411918 - DNA, 11 bp, Homo sapiens
ctcagccctga

SEQ ID NO: 411919 - DNA, 14 bp, Homo sapiens
ctcagccctgaggt

SEQ ID NO: 411920 - DNA, 18 bp, Homo sapiens
ctcagcccttgcccccat

SEQ ID NO: 411921 - DNA, 20 bp, Homo sapiens
ctcagcctcccagagtgctg

SEQ ID NO: 411922 - DNA, 20 bp, Homo sapiens
ctcagcctccggagtagctg

SEQ ID NO: 411923 - DNA, 20 bp, Homo sapiens
ctcagcctcctgagcctgtg

SEQ ID NO: 411924 - DNA, 21 bp, Homo sapiens
ctcagcctcctgagcctgtgg

SEQ ID NO: 411925 - DNA, 13 bp, Homo sapiens
ctcagccttaaga

SEQ ID NO: 411926 - DNA, 15 bp, Homo sapiens
ctcagcgctccctgt

SEQ ID NO: 411927 - DNA, 14 bp, Homo sapiens
ctcagcgctgccca

SEQ ID NO: 411928 - DNA, 15 bp, Homo sapiens
ctcagcgctgcccac

SEQ ID NO: 411929 - DNA, 14 bp, Homo sapiens
ctcagctccactct

SEQ ID NO: 411930 - DNA, 15 bp, Homo sapiens
ctcagctccactctg

SEQ ID NO: 411931 - DNA, 19 bp, Homo sapiens
ctcagctccactctgaagt

SEQ ID NO: 411932 - DNA, 16 bp, Homo sapiens
ctcagctccttggttc

SEQ ID NO: 411933 - DNA, 13 bp, Homo sapiens
ctcagctctctgg

SEQ ID NO: 411934 - DNA, 21 bp, Homo sapiens
ctcagctctctgggacctcct

SEQ ID NO: 411935 - DNA, 17 bp, Homo sapiens
ctcagctctggctcaca

SEQ ID NO: 411936 - DNA, 18 bp, Homo sapiens
ctcagctctggctcacag

SEQ ID NO: 411937 - DNA, 12 bp, Homo sapiens
ctcagctctggg

SEQ ID NO: 411938 - DNA, 14 bp, Homo sapiens
ctcagctctgggag

SEQ ID NO: 411939 - DNA, 15 bp, Homo sapiens
ctcagctgcacattc

SEQ ID NO: 411940 - DNA, 18 bp, Homo sapiens
ctcagctgcacattcctg

SEQ ID NO: 411941 - DNA, 23 bp, Homo sapiens
ctcagctgcacattcctggcccc

SEQ ID NO: 411942 - DNA, 17 bp, Homo sapiens
ctcagctgccaagcact

SEQ ID NO: 411943 - DNA, 13 bp, Homo sapiens
ctcagctggccgg

SEQ ID NO: 411944 - DNA, 14 bp, Homo sapiens
ctcagctggccggg

SEQ ID NO: 411945 - DNA, 23 bp, Homo sapiens
ctcagctggccgggttggaggcc

SEQ ID NO: 411946 - DNA, 21 bp, Homo sapiens
ctcagctggcggaacctggct

SEQ ID NO: 411947 - DNA, 23 bp, Homo sapiens
ctcagctggcggaacctggctgc

SEQ ID NO: 411948 - DNA, 22 bp, Homo sapiens
ctcagctgttcagattggacat

SEQ ID NO: 411949 - DNA, 21 bp, Homo sapiens
ctcagcttctaattttgtgct

SEQ ID NO: 411950 - DNA, 13 bp, Homo sapiens
ctcaggagaaggc

SEQ ID NO: 411951 - DNA, 23 bp, Homo sapiens
ctcaggagaaggcctgcccccct

SEQ ID NO: 411952 - DNA, 23 bp, Homo sapiens
ctcaggagagagcttcctgtttc

SEQ ID NO: 411953 - DNA, 18 bp, Homo sapiens
ctcaggagagcatcacca

SEQ ID NO: 411954 - DNA, 23 bp, Homo sapiens
ctcaggagagcatcaccaccaca

SEQ ID NO: 411955 - DNA, 13 bp, Homo sapiens
ctcaggaggaggg

SEQ ID NO: 411956 - DNA, 13 bp, Homo sapiens
ctcaggaggcagt

SEQ ID NO: 411957 - DNA, 13 bp, Homo sapiens
ctcaggatctctt

SEQ ID NO: 411958 - DNA, 16 bp, Homo sapiens
ctcaggatggctcaga

SEQ ID NO: 411959 - DNA, 19 bp, Homo sapiens
ctcaggatttaaaaactgg

SEQ ID NO: 411960 - DNA, 20 bp, Homo sapiens
ctcaggcaagcccctcagcc

SEQ ID NO: 411961 - DNA, 22 bp, Homo sapiens
ctcaggcaagcccctcagccct

SEQ ID NO: 411962 - DNA, 22 bp, Homo sapiens
ctcaggcataggcctgggtgct

SEQ ID NO: 411963 - DNA, 17 bp, Homo sapiens
ctcaggcatcattccac

SEQ ID NO: 411964 - DNA, 17 bp, Homo sapiens
ctcaggcatgcctgtgt

SEQ ID NO: 411965 - DNA, 18 bp, Homo sapiens
ctcaggcatgcctgtgtg

SEQ ID NO: 411966 - DNA, 19 bp, Homo sapiens
ctcaggccacctgccccct

SEQ ID NO: 411967 - DNA, 15 bp, Homo sapiens
ctcaggcccacattg

SEQ ID NO: 411968 - DNA, 14 bp, Homo sapiens
ctcaggcctcacct

SEQ ID NO: 411969 - DNA, 15 bp, Homo sapiens
ctcaggcctcacctg

SEQ ID NO: 411970 - DNA, 12 bp, Homo sapiens
ctcaggcctccc

SEQ ID NO: 411971 - DNA, 18 bp, Homo sapiens
ctcaggcctgccaatgcc

SEQ ID NO: 411972 - DNA, 20 bp, Homo sapiens
ctcaggcgatccacctgtct

SEQ ID NO: 411973 - DNA, 17 bp, Homo sapiens
ctcaggcgcagccctag

SEQ ID NO: 411974 - DNA, 12 bp, Homo sapiens
ctcaggctgctg

SEQ ID NO: 411975 - DNA, 14 bp, Homo sapiens
ctcaggctgctgga

SEQ ID NO: 411976 - DNA, 16 bp, Homo sapiens
ctcagggcccacctcc

SEQ ID NO: 411977 - DNA, 18 bp, Homo sapiens
ctcagggcccacctcctc

SEQ ID NO: 411978 - DNA, 14 bp, Homo sapiens
ctcagggctggccc

SEQ ID NO: 411979 - DNA, 21 bp, Homo sapiens
ctcagggtgctccctcctcag

SEQ ID NO: 411980 - DNA, 14 bp, Homo sapiens
ctcagggtgggggg

SEQ ID NO: 411981 - DNA, 17 bp, Homo sapiens
ctcagggtggggggtga

SEQ ID NO: 411982 - DNA, 15 bp, Homo sapiens
ctcaggtagccacca

SEQ ID NO: 411983 - DNA, 16 bp, Homo sapiens
ctcaggtagtactggg

SEQ ID NO: 411984 - DNA, 18 bp, Homo sapiens
ctcaggtagtactgggaa

SEQ ID NO: 411985 - DNA, 13 bp, Homo sapiens
ctcaggtgatcca

SEQ ID NO: 411986 - DNA, 16 bp, Homo sapiens
ctcaggtgatccaccc

SEQ ID NO: 411987 - DNA, 20 bp, Homo sapiens
ctcaggtgatctacctgcct

SEQ ID NO: 411988 - DNA, 19 bp, Homo sapiens
ctcaggtgccactccctga

SEQ ID NO: 411989 - DNA, 21 bp, Homo sapiens
ctcaggtgccactccctgagc

SEQ ID NO: 411990 - DNA, 18 bp, Homo sapiens
ctcaggtggggagtccag

SEQ ID NO: 411991 - DNA, 21 bp, Homo sapiens
ctcaggtggtgtccttcttcc

SEQ ID NO: 411992 - DNA, 15 bp, Homo sapiens
ctcaggttccagaac

SEQ ID NO: 411993 - DNA, 18 bp, Homo sapiens
ctcaggttccagaacagc

SEQ ID NO: 411994 - DNA, 16 bp, Homo sapiens
ctcaggttctttccat

SEQ ID NO: 411995 - DNA, 18 bp, Homo sapiens
ctcagtccctccctcctg

SEQ ID NO: 411996 - DNA, 19 bp, Homo sapiens
ctcagtccctccctcctgg

SEQ ID NO: 411997 - DNA, 23 bp, Homo sapiens
ctcagtccctccctcctggctca

SEQ ID NO: 411998 - DNA, 14 bp, Homo sapiens
ctcagtctcccttt

SEQ ID NO: 411999 - DNA, 24 bp, Homo sapiens
ctcagtctggtgctccagttccag

SEQ ID NO: 412000 - DNA, 22 bp, Homo sapiens
ctcagtctttgggggattcaaa

SEQ ID NO: 412001 - DNA, 13 bp, Homo sapiens
ctcagtgccacct

SEQ ID NO: 412002 - DNA, 20 bp, Homo sapiens
ctcagtgccacctatgcctg

SEQ ID NO: 412003 - DNA, 21 bp, Homo sapiens
ctcagtgccacctatgcctgt

SEQ ID NO: 412004 - DNA, 12 bp, Homo sapiens
ctcagtgccact

SEQ ID NO: 412005 - DNA, 13 bp, Homo sapiens
ctcagtgcctcct

SEQ ID NO: 412006 - DNA, 19 bp, Homo sapiens
ctcagtggactttccaccc

SEQ ID NO: 412007 - DNA, 18 bp, Homo sapiens
ctcagtgtattttaaatt

SEQ ID NO: 412008 - DNA, 18 bp, Homo sapiens
ctcagtgtcatttatgaa

SEQ ID NO: 412009 - DNA, 12 bp, Homo sapiens
ctcagtgtgaag

SEQ ID NO: 412010 - DNA, 16 bp, Homo sapiens
ctcagtgtgaagcctg

SEQ ID NO: 412011 - DNA, 19 bp, Homo sapiens
ctcagtgttgactgtaggc

SEQ ID NO: 412012 - DNA, 14 bp, Homo sapiens
ctcagttaaaatgt

SEQ ID NO: 412013 - DNA, 20 bp, Homo sapiens
ctcagttaaaatgtctgttt

SEQ ID NO: 412014 - DNA, 22 bp, Homo sapiens
ctcagttccatggcaattttgt

SEQ ID NO: 412015 - DNA, 16 bp, Homo sapiens
ctcagttcccttggcc

SEQ ID NO: 412016 - DNA, 21 bp, Homo sapiens
ctcagttcccttggcctcaga

SEQ ID NO: 412017 - DNA, 21 bp, Homo sapiens
ctcagttcctgcagcagagcc

SEQ ID NO: 412018 - DNA, 13 bp, Homo sapiens
ctcagttgcagcc

SEQ ID NO: 412019 - DNA, 18 bp, Homo sapiens
ctcagtttctccatcagc

SEQ ID NO: 412020 - DNA, 19 bp, Homo sapiens
ctcagtttctccatcagct

SEQ ID NO: 412021 - DNA, 22 bp, Homo sapiens
ctcagtttggctgtaatttaat

SEQ ID NO: 412022 - DNA, 17 bp, Homo sapiens
ctcagttttatcatttt

SEQ ID NO: 412023 - DNA, 13 bp, Homo sapiens
ctcataattgtca

SEQ ID NO: 412024 - DNA, 16 bp, Homo sapiens
ctcatacctttaaagg

SEQ ID NO: 412025 - DNA, 21 bp, Homo sapiens
ctcataggaaaagtacattta

SEQ ID NO: 412026 - DNA, 23 bp, Homo sapiens
ctcataggaaaagtacatttaat

SEQ ID NO: 412027 - DNA, 19 bp, Homo sapiens
ctcataggagttaggctgt

SEQ ID NO: 412028 - DNA, 19 bp, Homo sapiens
ctcatatggcccagtgtca

SEQ ID NO: 412029 - DNA, 15 bp, Homo sapiens
ctcatattcctgcag

SEQ ID NO: 412030 - DNA, 24 bp, Homo sapiens
ctcatattcctgcagcctggaggc

SEQ ID NO: 412031 - DNA, 16 bp, Homo sapiens
ctcatattttgtatat

SEQ ID NO: 412032 - DNA, 19 bp, Homo sapiens
ctcatatttttacaaataa

SEQ ID NO: 412033 - DNA, 15 bp, Homo sapiens
ctcatcagaactgaa

SEQ ID NO: 412034 - DNA, 21 bp, Homo sapiens
ctcatcaggtaaactgatgct

SEQ ID NO: 412035 - DNA, 14 bp, Homo sapiens
ctcatcataaaata

SEQ ID NO: 412036 - DNA, 18 bp, Homo sapiens
ctcatccacagaggccag

SEQ ID NO: 412037 - DNA, 23 bp, Homo sapiens
ctcatccactaggtgcccagtct

SEQ ID NO: 412038 - DNA, 20 bp, Homo sapiens
ctcatccatgcagataacag

SEQ ID NO: 412039 - DNA, 15 bp, Homo sapiens
ctcatcccaaaagct

SEQ ID NO: 412040 - DNA, 15 bp, Homo sapiens
ctcatccctcggaag

SEQ ID NO: 412041 - DNA, 12 bp, Homo sapiens
ctcatcctgctt

SEQ ID NO: 412042 - DNA, 14 bp, Homo sapiens
ctcatcctgcttct

SEQ ID NO: 412043 - DNA, 24 bp, Homo sapiens
ctcatcctttttaaatgagacttg

SEQ ID NO: 412044 - DNA, 15 bp, Homo sapiens
ctcatcggagactgc

SEQ ID NO: 412045 - DNA, 17 bp, Homo sapiens
ctcatctcagtcctcaa

SEQ ID NO: 412046 - DNA, 14 bp, Homo sapiens
ctcatctccaagga

SEQ ID NO: 412047 - DNA, 22 bp, Homo sapiens
ctcatctccaaggatcctctcc

SEQ ID NO: 412048 - DNA, 23 bp, Homo sapiens
ctcatctccaaggatcctctcca

SEQ ID NO: 412049 - DNA, 14 bp, Homo sapiens
ctcatgaatgtaaa

SEQ ID NO: 412050 - DNA, 15 bp, Homo sapiens
ctcatgatccaccca

SEQ ID NO: 412051 - DNA, 20 bp, Homo sapiens
ctcatgatccacccacctca

SEQ ID NO: 412052 - DNA, 23 bp, Homo sapiens
ctcatgatccacccacctcagcc

SEQ ID NO: 412053 - DNA, 14 bp, Homo sapiens
ctcatgccacacct

SEQ ID NO: 412054 - DNA, 13 bp, Homo sapiens
ctcatgccagcag

SEQ ID NO: 412055 - DNA, 21 bp, Homo sapiens
ctcatgcctcatcctcccaag

SEQ ID NO: 412056 - DNA, 20 bp, Homo sapiens
ctcatgcctggcccccctcc

SEQ ID NO: 412057 - DNA, 17 bp, Homo sapiens
ctcatgcggcccagcca

SEQ ID NO: 412058 - DNA, 14 bp, Homo sapiens
ctcatggactccag

SEQ ID NO: 412059 - DNA, 23 bp, Homo sapiens
ctcatggactccaggatcctcct

SEQ ID NO: 412060 - DNA, 20 bp, Homo sapiens
ctcatggatttggttatgat

SEQ ID NO: 412061 - DNA, 23 bp, Homo sapiens
ctcatggcgtaatgggcctgccc

SEQ ID NO: 412062 - DNA, 12 bp, Homo sapiens
ctcatggctgtt

SEQ ID NO: 412063 - DNA, 22 bp, Homo sapiens
ctcatggctgttatctgtcttt

SEQ ID NO: 412064 - DNA, 15 bp, Homo sapiens
ctcatgggagtcagg

SEQ ID NO: 412065 - DNA, 15 bp, Homo sapiens
ctcatgggcccctct

SEQ ID NO: 412066 - DNA, 17 bp, Homo sapiens
ctcatgtgctttgtagc

SEQ ID NO: 412067 - DNA, 21 bp, Homo sapiens
ctcatgtggggatgtttgtgc

SEQ ID NO: 412068 - DNA, 13 bp, Homo sapiens
ctcattaaaaaaa

SEQ ID NO: 412069 - DNA, 17 bp, Homo sapiens
ctcattacttttgaagt

SEQ ID NO: 412070 - DNA, 12 bp, Homo sapiens
ctcattcactgt

SEQ ID NO: 412071 - DNA, 17 bp, Homo sapiens
ctcattcagtattaaag

SEQ ID NO: 412072 - DNA, 19 bp, Homo sapiens
ctcattcagtattaaaggg

SEQ ID NO: 412073 - DNA, 19 bp, Homo sapiens
ctcattcatattcctgcct

SEQ ID NO: 412074 - DNA, 17 bp, Homo sapiens
ctcattccaacagtgag

SEQ ID NO: 412075 - DNA, 17 bp, Homo sapiens
ctcattccactgttggt

SEQ ID NO: 412076 - DNA, 20 bp, Homo sapiens
ctcattcctctgtccccgag

SEQ ID NO: 412077 - DNA, 23 bp, Homo sapiens
ctcattgatcacagatgtgccca

SEQ ID NO: 412078 - DNA, 15 bp, Homo sapiens
ctcattgtaaacaaa

SEQ ID NO: 412079 - DNA, 16 bp, Homo sapiens
ctcatttctgccagcg

SEQ ID NO: 412080 - DNA, 12 bp, Homo sapiens
ctcattttgtat

SEQ ID NO: 412081 - DNA, 20 bp, Homo sapiens
ctcattttgtatgtatgtgt

SEQ ID NO: 412082 - DNA, 23 bp, Homo sapiens
ctcatttttgccatacatcagtt

SEQ ID NO: 412083 - DNA, 12 bp, Homo sapiens
ctccaaaacaca

SEQ ID NO: 412084 - DNA, 16 bp, Homo sapiens
ctccaaaagcacttac

SEQ ID NO: 412085 - DNA, 14 bp, Homo sapiens
ctccaaactcctgc

SEQ ID NO: 412086 - DNA, 18 bp, Homo sapiens
ctccaaactcctgcctgt

SEQ ID NO: 412087 - DNA, 14 bp, Homo sapiens
ctccaaaggggctg

SEQ ID NO: 412088 - DNA, 15 bp, Homo sapiens
ctccaaatgagatct

SEQ ID NO: 412089 - DNA, 16 bp, Homo sapiens
ctccaacccaaagtat

SEQ ID NO: 412090 - DNA, 12 bp, Homo sapiens
ctccaagaaact

SEQ ID NO: 412091 - DNA, 16 bp, Homo sapiens
ctccaagaagccctcc

SEQ ID NO: 412092 - DNA, 23 bp, Homo sapiens
ctccaagcaagtagctttccaca

SEQ ID NO: 412093 - DNA, 19 bp, Homo sapiens
ctccaagcctgcctcccaa

SEQ ID NO: 412094 - DNA, 17 bp, Homo sapiens
ctccaaggatcctctcc

SEQ ID NO: 412095 - DNA, 18 bp, Homo sapiens
ctccaaggatcctctcca

SEQ ID NO: 412096 - DNA, 16 bp, Homo sapiens
ctccaaggtcctctta

SEQ ID NO: 412097 - DNA, 13 bp, Homo sapiens
ctccaagtctctc

SEQ ID NO: 412098 - DNA, 15 bp, Homo sapiens
ctccaagtctctctg

SEQ ID NO: 412099 - DNA, 16 bp, Homo sapiens
ctccaagtctctctgt

SEQ ID NO: 412100 - DNA, 21 bp, Homo sapiens
ctccaagtctctctgtgaata

SEQ ID NO: 412101 - DNA, 21 bp, Homo sapiens
ctccaatcaccctacaagatg

SEQ ID NO: 412102 - DNA, 22 bp, Homo sapiens
ctccaatcccaccaaccctcag

SEQ ID NO: 412103 - DNA, 20 bp, Homo sapiens
ctccacacccatgactgccc

SEQ ID NO: 412104 - DNA, 23 bp, Homo sapiens
ctccacacccatgactgcccctt

SEQ ID NO: 412105 - DNA, 14 bp, Homo sapiens
ctccacacctccac

SEQ ID NO: 412106 - DNA, 16 bp, Homo sapiens
ctccacacctccaccc

SEQ ID NO: 412107 - DNA, 18 bp, Homo sapiens
ctccacagaaaccctgtt

SEQ ID NO: 412108 - DNA, 23 bp, Homo sapiens
ctccacagggacacagtctggtg

SEQ ID NO: 412109 - DNA, 24 bp, Homo sapiens
ctccacagggtgggatgagcctct

SEQ ID NO: 412110 - DNA, 12 bp, Homo sapiens
ctccacagtgct

SEQ ID NO: 412111 - DNA, 16 bp, Homo sapiens
ctccacagtgctgctt

SEQ ID NO: 412112 - DNA, 14 bp, Homo sapiens
ctccaccaggaacc

SEQ ID NO: 412113 - DNA, 14 bp, Homo sapiens
ctccacccactgtc

SEQ ID NO: 412114 - DNA, 11 bp, Homo sapiens
ctccacccagc

SEQ ID NO: 412115 - DNA, 15 bp, Homo sapiens
ctccacccagcccct

SEQ ID NO: 412116 - DNA, 20 bp, Homo sapiens
ctccaccccactcacagaga

SEQ ID NO: 412117 - DNA, 15 bp, Homo sapiens
ctccaccccagtccc

SEQ ID NO: 412118 - DNA, 19 bp, Homo sapiens
ctccaccccagtccccggg

SEQ ID NO: 412119 - DNA, 20 bp, Homo sapiens
ctccaccccagtccccggga

SEQ ID NO: 412120 - DNA, 15 bp, Homo sapiens
ctccacccccaagaa

SEQ ID NO: 412121 - DNA, 16 bp, Homo sapiens
ctccaccccctcctgt

SEQ ID NO: 412122 - DNA, 13 bp, Homo sapiens
ctccacccctcaa

SEQ ID NO: 412123 - DNA, 18 bp, Homo sapiens
ctccacccctcaagccag

SEQ ID NO: 412124 - DNA, 21 bp, Homo sapiens
ctccaccctccggccagcgag

SEQ ID NO: 412125 - DNA, 14 bp, Homo sapiens
ctccacccttggcc

SEQ ID NO: 412126 - DNA, 21 bp, Homo sapiens
ctccacccttggcctgtctca

SEQ ID NO: 412127 - DNA, 18 bp, Homo sapiens
ctccaccggtgcctcctc

SEQ ID NO: 412128 - DNA, 18 bp, Homo sapiens
ccttctgtgcccagctca

SEQ ID NO: 412129 - DNA, 12 bp, Homo sapiens
ccttcttgccct

SEQ ID NO: 412130 - DNA, 13 bp, Homo sapiens
ccttcttgccctg

SEQ ID NO: 412131 - DNA, 14 bp, Homo sapiens
ccttcttgccctga

SEQ ID NO: 412132 - DNA, 15 bp, Homo sapiens
ccttcttgccctgag

SEQ ID NO: 412133 - DNA, 17 bp, Homo sapiens
ccttcttgccctgagct

SEQ ID NO: 412134 - DNA, 18 bp, Homo sapiens
ccttcttggcttctggga

SEQ ID NO: 412135 - DNA, 12 bp, Homo sapiens
ccttcttgtagt

SEQ ID NO: 412136 - DNA, 16 bp, Homo sapiens
ccttctttaccttcat

SEQ ID NO: 412137 - DNA, 15 bp, Homo sapiens
ccttctttgcagggc

SEQ ID NO: 412138 - DNA, 20 bp, Homo sapiens
ccttctttgcttctttttct

SEQ ID NO: 412139 - DNA, 17 bp, Homo sapiens
ccttcttttttgtctca

SEQ ID NO: 412140 - DNA, 18 bp, Homo sapiens
ccttgaacaatcaaggca

SEQ ID NO: 412141 - DNA, 15 bp, Homo sapiens
ccttgaacctcatta

SEQ ID NO: 412142 - DNA, 19 bp, Homo sapiens
ccttgaagaggggaggggc

SEQ ID NO: 412143 - DNA, 17 bp, Homo sapiens
ccttgaagatgtagctt

SEQ ID NO: 412144 - DNA, 15 bp, Homo sapiens
ccttgaatctgcagg

SEQ ID NO: 412145 - DNA, 19 bp, Homo sapiens
ccttgaatctgcagggagc

SEQ ID NO: 412146 - DNA, 17 bp, Homo sapiens
ccttgaccccacacgcc

SEQ ID NO: 412147 - DNA, 11 bp, Homo sapiens
ccttgagacca

SEQ ID NO: 412148 - DNA, 21 bp, Homo sapiens
ccttgagaccaagccggtgcc

SEQ ID NO: 412149 - DNA, 16 bp, Homo sapiens
ccttgagaccacaggg

SEQ ID NO: 412150 - DNA, 12 bp, Homo sapiens
ccttgagctgag

SEQ ID NO: 412151 - DNA, 19 bp, Homo sapiens
ccttgagctgcctgctctg

SEQ ID NO: 412152 - DNA, 22 bp, Homo sapiens
ccttgagctgcctgctctgcag

SEQ ID NO: 412153 - DNA, 19 bp, Homo sapiens
ccttgaggacctccacctg

SEQ ID NO: 412154 - DNA, 12 bp, Homo sapiens
ccttgaggtctt

SEQ ID NO: 412155 - DNA, 20 bp, Homo sapiens
ccttgagtagtttttatctg

SEQ ID NO: 412156 - DNA, 14 bp, Homo sapiens
ccttgatggagaag

SEQ ID NO: 412157 - DNA, 19 bp, Homo sapiens
ccttgatggagatatttac

SEQ ID NO: 412158 - DNA, 17 bp, Homo sapiens
ccttgatgttgtgttgt

SEQ ID NO: 412159 - DNA, 19 bp, Homo sapiens
ccttgattataccactgca

SEQ ID NO: 412160 - DNA, 17 bp, Homo sapiens
ccttgcacaggccactt

SEQ ID NO: 412161 - DNA, 20 bp, Homo sapiens
ccttgcactattggactttg

SEQ ID NO: 412162 - DNA, 14 bp, Homo sapiens
ccttgccaaggccg

SEQ ID NO: 412163 - DNA, 21 bp, Homo sapiens
ccttgccaatggtgtagctgt

SEQ ID NO: 412164 - DNA, 15 bp, Homo sapiens
ccttgcccaactccc

SEQ ID NO: 412165 - DNA, 19 bp, Homo sapiens
ccttgcccaactcccagcc

SEQ ID NO: 412166 - DNA, 21 bp, Homo sapiens
ccttgcccaactcccagccac

SEQ ID NO: 412167 - DNA, 22 bp, Homo sapiens
ccttgcccaactcccagccacc

SEQ ID NO: 412168 - DNA, 18 bp, Homo sapiens
ccttgcccgccagcctca

SEQ ID NO: 412169 - DNA, 13 bp, Homo sapiens
ccttgccctgggc

SEQ ID NO: 412170 - DNA, 16 bp, Homo sapiens
ccttgcctcaatgcca

SEQ ID NO: 412171 - DNA, 20 bp, Homo sapiens
ccttgcctcaatgccagtaa

SEQ ID NO: 412172 - DNA, 22 bp, Homo sapiens
ccttgcctcccctcctctcctg

SEQ ID NO: 412173 - DNA, 12 bp, Homo sapiens
ccttgcctcctg

SEQ ID NO: 412174 - DNA, 14 bp, Homo sapiens
ccttgcctcctgtg

SEQ ID NO: 412175 - DNA, 15 bp, Homo sapiens
ccttgcctcctgtgt

SEQ ID NO: 412176 - DNA, 16 bp, Homo sapiens
ccttgcctcctgtgta

SEQ ID NO: 412177 - DNA, 14 bp, Homo sapiens
ccttgctaattttc

SEQ ID NO: 412178 - DNA, 11 bp, Homo sapiens
ccttgctacct

SEQ ID NO: 412179 - DNA, 14 bp, Homo sapiens
ccttgctacctcaa

SEQ ID NO: 412180 - DNA, 23 bp, Homo sapiens
ccttgctcaaccatggctgaagg

SEQ ID NO: 412181 - DNA, 20 bp, Homo sapiens
ccttgctcagtgcctcctgg

SEQ ID NO: 412182 - DNA, 13 bp, Homo sapiens
ccttgctcccttc

SEQ ID NO: 412183 - DNA, 17 bp, Homo sapiens
ccttgctctccctcttc

SEQ ID NO: 412184 - DNA, 16 bp, Homo sapiens
ccttgctgatggcttg

SEQ ID NO: 412185 - DNA, 17 bp, Homo sapiens
ccttgctgatggcttga

SEQ ID NO: 412186 - DNA, 11 bp, Homo sapiens
ccttgctgcca

SEQ ID NO: 412187 - DNA, 13 bp, Homo sapiens
ccttgctgccaag

SEQ ID NO: 412188 - DNA, 15 bp, Homo sapiens
ctccatcctgccagg

SEQ ID NO: 412189 - DNA, 18 bp, Homo sapiens
ctccatcctgccaggagc

SEQ ID NO: 412190 - DNA, 20 bp, Homo sapiens
ctccatccttgcatcactgg

SEQ ID NO: 412191 - DNA, 13 bp, Homo sapiens
ctccatctgggga

SEQ ID NO: 412192 - DNA, 18 bp, Homo sapiens
ctccatgaccaggccacc

SEQ ID NO: 412193 - DNA, 18 bp, Homo sapiens
ctccatgactggctgtct

SEQ ID NO: 412194 - DNA, 21 bp, Homo sapiens
ctccatgactggctgtctgcc

SEQ ID NO: 412195 - DNA, 21 bp, Homo sapiens
ctccatgagacacatctcctc

SEQ ID NO: 412196 - DNA, 13 bp, Homo sapiens
ctccatgagcacc

SEQ ID NO: 412197 - DNA, 19 bp, Homo sapiens
ctccatgattccaagggcc

SEQ ID NO: 412198 - DNA, 22 bp, Homo sapiens
ctccatgattccaagggcccag

SEQ ID NO: 412199 - DNA, 17 bp, Homo sapiens
ctccatgctcctcacct

SEQ ID NO: 412200 - DNA, 19 bp, Homo sapiens
ctccatgctcctcactgcc

SEQ ID NO: 412201 - DNA, 14 bp, Homo sapiens
ctccatgctgcctc

SEQ ID NO: 412202 - DNA, 17 bp, Homo sapiens
ctccatgctgcctccag

SEQ ID NO: 412203 - DNA, 13 bp, Homo sapiens
ctccatggcagga

SEQ ID NO: 412204 - DNA, 16 bp, Homo sapiens
ctccatggccaccccg

SEQ ID NO: 412205 - DNA, 24 bp, Homo sapiens
ctccatggcccatcactcggctgt

SEQ ID NO: 412206 - DNA, 15 bp, Homo sapiens
ctccatggcccttcc

SEQ ID NO: 412207 - DNA, 15 bp, Homo sapiens
ctccatggtgcctct

SEQ ID NO: 412208 - DNA, 16 bp, Homo sapiens
ctccatggtgcctctg

SEQ ID NO: 412209 - DNA, 16 bp, Homo sapiens
ctccatgtagaagagg

SEQ ID NO: 412210 - DNA, 22 bp, Homo sapiens
ctccatgtggccccaggtgcca

SEQ ID NO: 412211 - DNA, 18 bp, Homo sapiens
ctccatttataaccccag

SEQ ID NO: 412212 - DNA, 19 bp, Homo sapiens
ctccatttataaccccagc

SEQ ID NO: 412213 - DNA, 22 bp, Homo sapiens
ctccatttataaccccagcctg

SEQ ID NO: 412214 - DNA, 23 bp, Homo sapiens
ctccatttataaccccagcctga

SEQ ID NO: 412215 - DNA, 21 bp, Homo sapiens
ctccatttcttggttttgtat

SEQ ID NO: 412216 - DNA, 14 bp, Homo sapiens
ctccattttcttgt

SEQ ID NO: 412217 - DNA, 16 bp, Homo sapiens
ctccattttcttgtca

SEQ ID NO: 412218 - DNA, 14 bp, Homo sapiens
ctcccaaagagctg

SEQ ID NO: 412219 - DNA, 22 bp, Homo sapiens
ctcccaaagtgctgggattaca

SEQ ID NO: 412220 - DNA, 19 bp, Homo sapiens
ctcccaaataaactcctta

SEQ ID NO: 412221 - DNA, 22 bp, Homo sapiens
ctcccaacccattcactacagg

SEQ ID NO: 412222 - DNA, 16 bp, Homo sapiens
ctcccaacctcaatgc

SEQ ID NO: 412223 - DNA, 22 bp, Homo sapiens
ctcccaacctcaatgccctgcc

SEQ ID NO: 412224 - DNA, 17 bp, Homo sapiens
ctcccaagaacagcagg

SEQ ID NO: 412225 - DNA, 23 bp, Homo sapiens
ctcccaagaacagcaggcccacc

SEQ ID NO: 412226 - DNA, 18 bp, Homo sapiens
ctcccaagcgttcctggc

SEQ ID NO: 412227 - DNA, 19 bp, Homo sapiens
ctcccaagcgttcctggcc

SEQ ID NO: 412228 - DNA, 20 bp, Homo sapiens
ctcccaagcgttcctggcct

SEQ ID NO: 412229 - DNA, 14 bp, Homo sapiens
ctcccaagggaggc

SEQ ID NO: 412230 - DNA, 15 bp, Homo sapiens
ctcccaataaagctg

SEQ ID NO: 412231 - DNA, 14 bp, Homo sapiens
ctcccaatcagctt

SEQ ID NO: 412232 - DNA, 19 bp, Homo sapiens
ctcccacacttgctggggc

SEQ ID NO: 412233 - DNA, 15 bp, Homo sapiens
ctcccacagagacaa

SEQ ID NO: 412234 - DNA, 16 bp, Homo sapiens
ctcccacagcttcctg

SEQ ID NO: 412235 - DNA, 15 bp, Homo sapiens
ctcccacatcccact

SEQ ID NO: 412236 - DNA, 21 bp, Homo sapiens
ctcccacatcccactggatct

SEQ ID NO: 412237 - DNA, 19 bp, Homo sapiens
ctcccacccccatctctcc

SEQ ID NO: 412238 - DNA, 16 bp, Homo sapiens
ctcccaccccggcctc

SEQ ID NO: 412239 - DNA, 20 bp, Homo sapiens
ctcccaccccggcctccact

SEQ ID NO: 412240 - DNA, 18 bp, Homo sapiens
ctcccacccggccacagc

SEQ ID NO: 412241 - DNA, 13 bp, Homo sapiens
ctcccacctccag

SEQ ID NO: 412242 - DNA, 15 bp, Homo sapiens
ctcccacctctcctt

SEQ ID NO: 412243 - DNA, 14 bp, Homo sapiens
ctcccactttgggg

SEQ ID NO: 412244 - DNA, 13 bp, Homo sapiens
ctcccagacaggc

SEQ ID NO: 412245 - DNA, 15 bp, Homo sapiens
ctcccagacaggccc

SEQ ID NO: 412246 - DNA, 16 bp, Homo sapiens
ctcccagacccagggc

SEQ ID NO: 412247 - DNA, 19 bp, Homo sapiens
ctcccagacccagggcagt

SEQ ID NO: 412248 - DNA, 21 bp, Homo sapiens
ctcccagacttgtttcctgtg

SEQ ID NO: 412249 - DNA, 17 bp, Homo sapiens
ctcccagaggctcctgg

SEQ ID NO: 412250 - DNA, 18 bp, Homo sapiens
ctcccagaggctcctgga

SEQ ID NO: 412251 - DNA, 19 bp, Homo sapiens
ctcccagaggctcctggag

SEQ ID NO: 412252 - DNA, 20 bp, Homo sapiens
ctcccagaggctcctggagc

SEQ ID NO: 412253 - DNA, 14 bp, Homo sapiens
ctcccagcatttgt

SEQ ID NO: 412254 - DNA, 15 bp, Homo sapiens
ctcccagccaccacc

SEQ ID NO: 412255 - DNA, 19 bp, Homo sapiens
ctcccagccaccaccactg

SEQ ID NO: 412256 - DNA, 20 bp, Homo sapiens
ctcccagccaccaccactgt

SEQ ID NO: 412257 - DNA, 15 bp, Homo sapiens
ctcccagccacccgg

SEQ ID NO: 412258 - DNA, 15 bp, Homo sapiens
ctcccagcctcttgc

SEQ ID NO: 412259 - DNA, 15 bp, Homo sapiens
ctcccagcctgctga

SEQ ID NO: 412260 - DNA, 15 bp, Homo sapiens
ctcccagctctagac

SEQ ID NO: 412261 - DNA, 17 bp, Homo sapiens
ctcccaggcgccccttc

SEQ ID NO: 412262 - DNA, 20 bp, Homo sapiens
ctcccagtccaaatgtcctc

SEQ ID NO: 412263 - DNA, 16 bp, Homo sapiens
ctcccagtcctccaga

SEQ ID NO: 412264 - DNA, 19 bp, Homo sapiens
ctcccagtcctccagacca

SEQ ID NO: 412265 - DNA, 20 bp, Homo sapiens
ctcccagttctctagggaag

SEQ ID NO: 412266 - DNA, 21 bp, Homo sapiens
ctcccagttctctagggaagg

SEQ ID NO: 412267 - DNA, 14 bp, Homo sapiens
ctcccatctccttc

SEQ ID NO: 412268 - DNA, 20 bp, Homo sapiens
ctcccatgcacaactctcca

SEQ ID NO: 412269 - DNA, 14 bp, Homo sapiens
ctcccatggcacct

SEQ ID NO: 412270 - DNA, 16 bp, Homo sapiens
ctcccatggcccagca

SEQ ID NO: 412271 - DNA, 17 bp, Homo sapiens
ctcccatggcccagcag

SEQ ID NO: 412272 - DNA, 16 bp, Homo sapiens
ctcccatggtccctag

SEQ ID NO: 412273 - DNA, 14 bp, Homo sapiens
ctccccaaccctgc

SEQ ID NO: 412274 - DNA, 15 bp, Homo sapiens
ctccccaaccctgcc

SEQ ID NO: 412275 - DNA, 19 bp, Homo sapiens
ctccccaaccctgcccctg

SEQ ID NO: 412276 - DNA, 13 bp, Homo sapiens
ctccccaatcacg

SEQ ID NO: 412277 - DNA, 15 bp, Homo sapiens
ctccccaatccaacc

SEQ ID NO: 412278 - DNA, 20 bp, Homo sapiens
ctccccaatccaacccatgc

SEQ ID NO: 412279 - DNA, 20 bp, Homo sapiens
ctccccaccaccccagctgc

SEQ ID NO: 412280 - DNA, 16 bp, Homo sapiens
ctccccaccagtctca

SEQ ID NO: 412281 - DNA, 13 bp, Homo sapiens
ctccccaccccaa

SEQ ID NO: 412282 - DNA, 13 bp, Homo sapiens
ctccccacccccc

SEQ ID NO: 412283 - DNA, 23 bp, Homo sapiens
ctccccacgagtcacctgcaagc

SEQ ID NO: 412284 - DNA, 20 bp, Homo sapiens
ctccccactgaaaacatttc

SEQ ID NO: 412285 - DNA, 15 bp, Homo sapiens
ctccccagagcactg

SEQ ID NO: 412286 - DNA, 16 bp, Homo sapiens
ctccccagagcactgg

SEQ ID NO: 412287 - DNA, 18 bp, Homo sapiens
cttccagagcctaagaaa

SEQ ID NO: 412288 - DNA, 19 bp, Homo sapiens
cttccagattgggggccct

SEQ ID NO: 412289 - DNA, 21 bp, Homo sapiens
cttccagcccagacccccagt

SEQ ID NO: 412290 - DNA, 15 bp, Homo sapiens
cttccagcgggccct

SEQ ID NO: 412291 - DNA, 17 bp, Homo sapiens
cttccagcgggccctct

SEQ ID NO: 412292 - DNA, 21 bp, Homo sapiens
cttccagcgggccctctgccg

SEQ ID NO: 412293 - DNA, 18 bp, Homo sapiens
cttccaggaagcacaggc

SEQ ID NO: 412294 - DNA, 19 bp, Homo sapiens
cttccaggaagcacaggcc

SEQ ID NO: 412295 - DNA, 21 bp, Homo sapiens
cttccaggaagcacaggccag

SEQ ID NO: 412296 - DNA, 23 bp, Homo sapiens
cttccaggcgtagggccagggct

SEQ ID NO: 412297 - DNA, 10 bp, Homo sapiens
cttccaggct

SEQ ID NO: 412298 - DNA, 17 bp, Homo sapiens
cttccaggctcttcctg

SEQ ID NO: 412299 - DNA, 21 bp, Homo sapiens
cttccaggctcttcctggacc

SEQ ID NO: 412300 - DNA, 23 bp, Homo sapiens
cttccaggctcttcctggacctg

SEQ ID NO: 412301 - DNA, 19 bp, Homo sapiens
cttccaggcttaagcgatt

SEQ ID NO: 412302 - DNA, 12 bp, Homo sapiens
cttccagtggga

SEQ ID NO: 412303 - DNA, 21 bp, Homo sapiens
cttccagttggactgtggcct

SEQ ID NO: 412304 - DNA, 21 bp, Homo sapiens
cttccataatctggactcctc

SEQ ID NO: 412305 - DNA, 14 bp, Homo sapiens
cttccatcagcagt

SEQ ID NO: 412306 - DNA, 15 bp, Homo sapiens
cttccatcagcagtg

SEQ ID NO: 412307 - DNA, 16 bp, Homo sapiens
cttccatccctacccc

SEQ ID NO: 412308 - DNA, 17 bp, Homo sapiens
cttccatccctaccccc

SEQ ID NO: 412309 - DNA, 19 bp, Homo sapiens
cttccatccctacccccta

SEQ ID NO: 412310 - DNA, 20 bp, Homo sapiens
cttccatgtcgcctctgcat

SEQ ID NO: 412311 - DNA, 13 bp, Homo sapiens
cttccattctttc

SEQ ID NO: 412312 - DNA, 19 bp, Homo sapiens
cttccattctttcttcctc

SEQ ID NO: 412313 - DNA, 20 bp, Homo sapiens
cttccattctttcttcctcc

SEQ ID NO: 412314 - DNA, 22 bp, Homo sapiens
cttccattctttcttcctccag

SEQ ID NO: 412315 - DNA, 16 bp, Homo sapiens
cttccatttgtgtgtg

SEQ ID NO: 412316 - DNA, 24 bp, Homo sapiens
cttccattttgccacctttcctgt

SEQ ID NO: 412317 - DNA, 19 bp, Homo sapiens
cttcccaaaccaagtgcct

SEQ ID NO: 412318 - DNA, 15 bp, Homo sapiens
cttcccaactcactg

SEQ ID NO: 412319 - DNA, 19 bp, Homo sapiens
cttcccaactcactgtgct

SEQ ID NO: 412320 - DNA, 21 bp, Homo sapiens
cttcccaactcactgtgctcc

SEQ ID NO: 412321 - DNA, 13 bp, Homo sapiens
cttcccaccccta

SEQ ID NO: 412322 - DNA, 15 bp, Homo sapiens
cttcccacctccctg

SEQ ID NO: 412323 - DNA, 16 bp, Homo sapiens
cttcccacctccctgc

SEQ ID NO: 412324 - DNA, 21 bp, Homo sapiens
cttcccacctccctgcccagg

SEQ ID NO: 412325 - DNA, 20 bp, Homo sapiens
cttcccacggccactgcagt

SEQ ID NO: 412326 - DNA, 12 bp, Homo sapiens
cttcccactgtc

SEQ ID NO: 412327 - DNA, 15 bp, Homo sapiens
cttcccactgtcctt

SEQ ID NO: 412328 - DNA, 20 bp, Homo sapiens
cttcccagctggcagcgcct

SEQ ID NO: 412329 - DNA, 21 bp, Homo sapiens
cttcccagctggcagcgcctc

SEQ ID NO: 412330 - DNA, 22 bp, Homo sapiens
cttcccagctggcagcgcctcc

SEQ ID NO: 412331 - DNA, 11 bp, Homo sapiens
cttcccaggcc

SEQ ID NO: 412332 - DNA, 14 bp, Homo sapiens
cttcccaggccagc

SEQ ID NO: 412333 - DNA, 21 bp, Homo sapiens
cttcccatgactgcacccagc

SEQ ID NO: 412334 - DNA, 16 bp, Homo sapiens
cttccccactctgctc

SEQ ID NO: 412335 - DNA, 18 bp, Homo sapiens
cttccccactctgctccc

SEQ ID NO: 412336 - DNA, 20 bp, Homo sapiens
cttccccactctgctcccag

SEQ ID NO: 412337 - DNA, 23 bp, Homo sapiens
cttccccactctgctcccagccc

SEQ ID NO: 412338 - DNA, 14 bp, Homo sapiens
cttccccactgcct

SEQ ID NO: 412339 - DNA, 22 bp, Homo sapiens
cttccccagggttctgtattgc

SEQ ID NO: 412340 - DNA, 12 bp, Homo sapiens
cttccccatccc

SEQ ID NO: 412341 - DNA, 13 bp, Homo sapiens
cttccccatcccg

SEQ ID NO: 412342 - DNA, 15 bp, Homo sapiens
cttccccctccaatc

SEQ ID NO: 412343 - DNA, 16 bp, Homo sapiens
cttccccgtgcggccc

SEQ ID NO: 412344 - DNA, 20 bp, Homo sapiens
cttcccctgaggacctttct

SEQ ID NO: 412345 - DNA, 14 bp, Homo sapiens
cttcccctgcctgg

SEQ ID NO: 412346 - DNA, 13 bp, Homo sapiens
cttcccctgctga

SEQ ID NO: 412347 - DNA, 16 bp, Homo sapiens
cttccccttttgcctg

SEQ ID NO: 412348 - DNA, 19 bp, Homo sapiens
cttccccttttgcctggct

SEQ ID NO: 412349 - DNA, 13 bp, Homo sapiens
cttcccgcagcac

SEQ ID NO: 412350 - DNA, 17 bp, Homo sapiens
cttcccgcagcaccagc

SEQ ID NO: 412351 - DNA, 15 bp, Homo sapiens
cttcccgcctcagcc

SEQ ID NO: 412352 - DNA, 20 bp, Homo sapiens
cttcccgcctcagcctctca

SEQ ID NO: 412353 - DNA, 15 bp, Homo sapiens
cttcccgctcagccc

SEQ ID NO: 412354 - DNA, 17 bp, Homo sapiens
cttcccgctcagccctc

SEQ ID NO: 412355 - DNA, 23 bp, Homo sapiens
cttcccgctcagccctccctgcc

SEQ ID NO: 412356 - DNA, 17 bp, Homo sapiens
cttccctaacttaacat

SEQ ID NO: 412357 - DNA, 20 bp, Homo sapiens
cttccctacccacagggcct

SEQ ID NO: 412358 - DNA, 16 bp, Homo sapiens
cttccctacctcaggc

SEQ ID NO: 412359 - DNA, 16 bp, Homo sapiens
cttccctagggctggg

SEQ ID NO: 412360 - DNA, 16 bp, Homo sapiens
cttccctcactcttcc

SEQ ID NO: 412361 - DNA, 22 bp, Homo sapiens
cttccctctcgctcccctctgc

SEQ ID NO: 412362 - DNA, 15 bp, Homo sapiens
cttccctctgcctgt

SEQ ID NO: 412363 - DNA, 12 bp, Homo sapiens
cttccctctgct

SEQ ID NO: 412364 - DNA, 14 bp, Homo sapiens
cttccctctgctcc

SEQ ID NO: 412365 - DNA, 15 bp, Homo sapiens
cttccctctgctcca

SEQ ID NO: 412366 - DNA, 18 bp, Homo sapiens
cttccctctgctccacag

SEQ ID NO: 412367 - DNA, 13 bp, Homo sapiens
cttccctgcttca

SEQ ID NO: 412368 - DNA, 13 bp, Homo sapiens
cttccctgggaag

SEQ ID NO: 412369 - DNA, 11 bp, Homo sapiens
cttccctgggg

SEQ ID NO: 412370 - DNA, 12 bp, Homo sapiens
cttccctggtcc

SEQ ID NO: 412371 - DNA, 18 bp, Homo sapiens
cttcccttagcctctccc

SEQ ID NO: 412372 - DNA, 16 bp, Homo sapiens
cttcccttccactgcc

SEQ ID NO: 412373 - DNA, 22 bp, Homo sapiens
cttcccttccactgcctctgcc

SEQ ID NO: 412374 - DNA, 22 bp, Homo sapiens
cttccctttgattttttgctgc

SEQ ID NO: 412375 - DNA, 14 bp, Homo sapiens
cttccgctctgagg

SEQ ID NO: 412376 - DNA, 12 bp, Homo sapiens
cttccgctgtca

SEQ ID NO: 412377 - DNA, 17 bp, Homo sapiens
cttccgggagctggtga

SEQ ID NO: 412378 - DNA, 16 bp, Homo sapiens
cttccgtgagacacaa

SEQ ID NO: 412379 - DNA, 16 bp, Homo sapiens
cttccgtgggtcatcc

SEQ ID NO: 412380 - DNA, 18 bp, Homo sapiens
cttccgtgggtcatccca

SEQ ID NO: 412381 - DNA, 19 bp, Homo sapiens
cttccgtgggtcatcccag

SEQ ID NO: 412382 - DNA, 13 bp, Homo sapiens
cttcctaacttat

SEQ ID NO: 412383 - DNA, 15 bp, Homo sapiens
cttcctaacttattg

SEQ ID NO: 412384 - DNA, 21 bp, Homo sapiens
cttcctacaagagcagcctgt

SEQ ID NO: 412385 - DNA, 23 bp, Homo sapiens
cttcctacacccttggacttgag

SEQ ID NO: 412386 - DNA, 18 bp, Homo sapiens
cttcctagagcatctgtc

SEQ ID NO: 412387 - DNA, 20 bp, Homo sapiens
cttcctagcttatctccctg

SEQ ID NO: 412388 - DNA, 21 bp, Homo sapiens
cttcctagcttatctccctgc

SEQ ID NO: 412389 - DNA, 18 bp, Homo sapiens
cttcctatgcccaggtac

SEQ ID NO: 412390 - DNA, 13 bp, Homo sapiens
cttcctcaagtct

SEQ ID NO: 412391 - DNA, 13 bp, Homo sapiens
cttcctcacttcc

SEQ ID NO: 412392 - DNA, 14 bp, Homo sapiens
cttcctccagtctg

SEQ ID NO: 412393 - DNA, 16 bp, Homo sapiens
cttcctccatggccca

SEQ ID NO: 412394 - DNA, 18 bp, Homo sapiens
cttcctccatggcccatc

SEQ ID NO: 412395 - DNA, 13 bp, Homo sapiens
cttcctccctcat

SEQ ID NO: 412396 - DNA, 21 bp, Homo sapiens
cttcctccctccctgcagggt

SEQ ID NO: 412397 - DNA, 17 bp, Homo sapiens
cttcctccgctcccctt

SEQ ID NO: 412398 - DNA, 16 bp, Homo sapiens
cttcctccgtccaccc

SEQ ID NO: 412399 - DNA, 19 bp, Homo sapiens
cttcctccgtccacccagg

SEQ ID NO: 412400 - DNA, 16 bp, Homo sapiens
cttcctcctccacagt

SEQ ID NO: 412401 - DNA, 18 bp, Homo sapiens
cttcctcctccacagtgc

SEQ ID NO: 412402 - DNA, 23 bp, Homo sapiens
cttcctcctccacagtgctgctt

SEQ ID NO: 412403 - DNA, 15 bp, Homo sapiens
cttcctcctgaagcc

SEQ ID NO: 412404 - DNA, 19 bp, Homo sapiens
cttcctcctgaagcctctg

SEQ ID NO: 412405 - DNA, 21 bp, Homo sapiens
cttcctcctgatggccaagag

SEQ ID NO: 412406 - DNA, 15 bp, Homo sapiens
cttcctctccactgc

SEQ ID NO: 412407 - DNA, 18 bp, Homo sapiens
cttcctctcggctggaag

SEQ ID NO: 412408 - DNA, 22 bp, Homo sapiens
cttcctctcggctggaagaaca

SEQ ID NO: 412409 - DNA, 14 bp, Homo sapiens
cttcctctgcagct

SEQ ID NO: 412410 - DNA, 19 bp, Homo sapiens
cttcctctgcagctgacct

SEQ ID NO: 412411 - DNA, 11 bp, Homo sapiens
cttcctctgga

SEQ ID NO: 412412 - DNA, 15 bp, Homo sapiens
cttcctctggagctt

SEQ ID NO: 412413 - DNA, 14 bp, Homo sapiens
cttcctctggggct

SEQ ID NO: 412414 - DNA, 20 bp, Homo sapiens
cttcctctggggctctaggg

SEQ ID NO: 412415 - DNA, 23 bp, Homo sapiens
cttcctgagggctaattctggga

SEQ ID NO: 412416 - DNA, 20 bp, Homo sapiens
cttcctgcagaggcccagcc

SEQ ID NO: 412417 - DNA, 19 bp, Homo sapiens
cttcctgctacagtagctg

SEQ ID NO: 412418 - DNA, 15 bp, Homo sapiens
cttcctggacctgag

SEQ ID NO: 412419 - DNA, 18 bp, Homo sapiens
cttcctggacctgagtcg

SEQ ID NO: 412420 - DNA, 20 bp, Homo sapiens
cttcctggactggcccttgc

SEQ ID NO: 412421 - DNA, 13 bp, Homo sapiens
ctttgtggggctt

SEQ ID NO: 412422 - DNA, 22 bp, Homo sapiens
ctttgtgtacttcagtcttgga

SEQ ID NO: 412423 - DNA, 15 bp, Homo sapiens
ctttgtgtgctgtgg

SEQ ID NO: 412424 - DNA, 18 bp, Homo sapiens
ctttgttaagactgctga

SEQ ID NO: 412425 - DNA, 22 bp, Homo sapiens
ctttgttactgaaatgagcctc

SEQ ID NO: 412426 - DNA, 22 bp, Homo sapiens
ctttgttatttttgtttcttcc

SEQ ID NO: 412427 - DNA, 16 bp, Homo sapiens
ctttgttcctgctttc

SEQ ID NO: 412428 - DNA, 18 bp, Homo sapiens
ctttgttcctgctttctc

SEQ ID NO: 412429 - DNA, 19 bp, Homo sapiens
ctttgttcctgctttctct

SEQ ID NO: 412430 - DNA, 15 bp, Homo sapiens
ctttgttcttgtcat

SEQ ID NO: 412431 - DNA, 18 bp, Homo sapiens
ctttgttcttgtcatcag

SEQ ID NO: 412432 - DNA, 22 bp, Homo sapiens
ctttgttgcttaatctagagct

SEQ ID NO: 412433 - DNA, 19 bp, Homo sapiens
ctttgttggcccttccagt

SEQ ID NO: 412434 - DNA, 22 bp, Homo sapiens
ctttgtttatgaagaaagatac

SEQ ID NO: 412435 - DNA, 18 bp, Homo sapiens
ctttgtttctcatccata

SEQ ID NO: 412436 - DNA, 19 bp, Homo sapiens
ctttgtttgctaatgcact

SEQ ID NO: 412437 - DNA, 19 bp, Homo sapiens
ctttgttttcccacacata

SEQ ID NO: 412438 - DNA, 19 bp, Homo sapiens
ctttgttttgatgtttgtg

SEQ ID NO: 412439 - DNA, 12 bp, Homo sapiens
ctttgtttttcc

SEQ ID NO: 412440 - DNA, 13 bp, Homo sapiens
ctttgtttttcca

SEQ ID NO: 412441 - DNA, 22 bp, Homo sapiens
ctttgtttttccatgtgttttg

SEQ ID NO: 412442 - DNA, 18 bp, Homo sapiens
cttttaacgtatgtattt

SEQ ID NO: 412443 - DNA, 19 bp, Homo sapiens
cttttaacgtatgtatttc

SEQ ID NO: 412444 - DNA, 16 bp, Homo sapiens
cttttaacttcacctt

SEQ ID NO: 412445 - DNA, 14 bp, Homo sapiens
cttttaagaaacac

SEQ ID NO: 412446 - DNA, 16 bp, Homo sapiens
cttttaatacagggta

SEQ ID NO: 412447 - DNA, 16 bp, Homo sapiens
cttttaatgatactgt

SEQ ID NO: 412448 - DNA, 24 bp, Homo sapiens
cttttaatgatactgtctaagaat

SEQ ID NO: 412449 - DNA, 11 bp, Homo sapiens
cttttaatttt

SEQ ID NO: 412450 - DNA, 15 bp, Homo sapiens
cttttacagcttttc

SEQ ID NO: 412451 - DNA, 19 bp, Homo sapiens
cttttacagcttttctctt

SEQ ID NO: 412452 - DNA, 20 bp, Homo sapiens
cttttacagcttttctcttt

SEQ ID NO: 412453 - DNA, 15 bp, Homo sapiens
cttttacatacagtg

SEQ ID NO: 412454 - DNA, 14 bp, Homo sapiens
cttttactaagaca

SEQ ID NO: 412455 - DNA, 17 bp, Homo sapiens
cttttactatcttttca

SEQ ID NO: 412456 - DNA, 20 bp, Homo sapiens
cttttactgtggaggtggct

SEQ ID NO: 412457 - DNA, 14 bp, Homo sapiens
cttttacttgttca

SEQ ID NO: 412458 - DNA, 18 bp, Homo sapiens
cttttaggccaaaaaaat

SEQ ID NO: 412459 - DNA, 16 bp, Homo sapiens
cttttagtacccacct

SEQ ID NO: 412460 - DNA, 17 bp, Homo sapiens
cttttagtacccacctg

SEQ ID NO: 412461 - DNA, 21 bp, Homo sapiens
cttttagtacccacctgagct

SEQ ID NO: 412462 - DNA, 22 bp, Homo sapiens
cttttagtcacgtgtattttca

SEQ ID NO: 412463 - DNA, 21 bp, Homo sapiens
cttttagtggtggtgtctcac

SEQ ID NO: 412464 - DNA, 11 bp, Homo sapiens
cttttatacca

SEQ ID NO: 412465 - DNA, 17 bp, Homo sapiens
cttttatatataaaata

SEQ ID NO: 412466 - DNA, 18 bp, Homo sapiens
cttttatatataaaataa

SEQ ID NO: 412467 - DNA, 19 bp, Homo sapiens
cttttatatataaaataaa

SEQ ID NO: 412468 - DNA, 23 bp, Homo sapiens
cttttatatataaaataaatata

SEQ ID NO: 412469 - DNA, 19 bp, Homo sapiens
cttttatcaataaagcact

SEQ ID NO: 412470 - DNA, 13 bp, Homo sapiens
cttttatctattt

SEQ ID NO: 412471 - DNA, 15 bp, Homo sapiens
cttttatgtttgtac

SEQ ID NO: 412472 - DNA, 22 bp, Homo sapiens
cttttattaacatatattgtta

SEQ ID NO: 412473 - DNA, 16 bp, Homo sapiens
cttttattacattagt

SEQ ID NO: 412474 - DNA, 13 bp, Homo sapiens
cttttattgtata

SEQ ID NO: 412475 - DNA, 16 bp, Homo sapiens
cttttattgtataaac

SEQ ID NO: 412476 - DNA, 13 bp, Homo sapiens
cttttattgtcag

SEQ ID NO: 412477 - DNA, 15 bp, Homo sapiens
cttttatttcagtgc

SEQ ID NO: 412478 - DNA, 16 bp, Homo sapiens
cttttattttttaagt

SEQ ID NO: 412479 - DNA, 21 bp, Homo sapiens
cttttcaagttgagaacaaaa

SEQ ID NO: 412480 - DNA, 20 bp, Homo sapiens
cttttcactgctggctgcct

SEQ ID NO: 412481 - DNA, 20 bp, Homo sapiens
cttttcagccaatttgtctc

SEQ ID NO: 412482 - DNA, 15 bp, Homo sapiens
cttttcagcttgttt

SEQ ID NO: 412483 - DNA, 17 bp, Homo sapiens
cttttcagcttgtttct

SEQ ID NO: 412484 - DNA, 22 bp, Homo sapiens
cttttcaggaggtactgtgagg

SEQ ID NO: 412485 - DNA, 21 bp, Homo sapiens
cttttcaggtttgtcatcaga

SEQ ID NO: 412486 - DNA, 15 bp, Homo sapiens
cttttcatggaagtg

SEQ ID NO: 412487 - DNA, 14 bp, Homo sapiens
cttttcatttttgc

SEQ ID NO: 412488 - DNA, 16 bp, Homo sapiens
cttttccagaaagaaa

SEQ ID NO: 412489 - DNA, 21 bp, Homo sapiens
cttttccaggatcctgcagga

SEQ ID NO: 412490 - DNA, 13 bp, Homo sapiens
cttttcccatcac

SEQ ID NO: 412491 - DNA, 19 bp, Homo sapiens
cttttcctattttcagccc

SEQ ID NO: 412492 - DNA, 23 bp, Homo sapiens
cttttcctcccttgggttctgat

SEQ ID NO: 412493 - DNA, 14 bp, Homo sapiens
cttttcctgggcct

SEQ ID NO: 412494 - DNA, 19 bp, Homo sapiens
cttttcctgggccttctca

SEQ ID NO: 412495 - DNA, 16 bp, Homo sapiens
cttttcctgttgtatt

SEQ ID NO: 412496 - DNA, 11 bp, Homo sapiens
cttttccttca

SEQ ID NO: 412497 - DNA, 14 bp, Homo sapiens
cttttctctttctc

SEQ ID NO: 412498 - DNA, 13 bp, Homo sapiens
cttttctctttgg

SEQ ID NO: 412499 - DNA, 15 bp, Homo sapiens
cttttctgcaatgtt

SEQ ID NO: 412500 - DNA, 16 bp, Homo sapiens
cttttctggctcctgt

SEQ ID NO: 412501 - DNA, 21 bp, Homo sapiens
cttttctggctcctgtgtgga

SEQ ID NO: 412502 - DNA, 18 bp, Homo sapiens
cttttctggctggggatg

SEQ ID NO: 412503 - DNA, 22 bp, Homo sapiens
cttttctgtgaagccctttgcc

SEQ ID NO: 412504 - DNA, 22 bp, Homo sapiens
cttttctgtggttgcagcctga

SEQ ID NO: 412505 - DNA, 17 bp, Homo sapiens
ctcccctccagacccct

SEQ ID NO: 412506 - DNA, 15 bp, Homo sapiens
ctcccctcccagtcc

SEQ ID NO: 412507 - DNA, 16 bp, Homo sapiens
ctcccctcctctcctg

SEQ ID NO: 412508 - DNA, 15 bp, Homo sapiens
ctcccctccttgcct

SEQ ID NO: 412509 - DNA, 20 bp, Homo sapiens
ctcccctccttgcctcctgt

SEQ ID NO: 412510 - DNA, 21 bp, Homo sapiens
ctcccctctatttagcatgac

SEQ ID NO: 412511 - DNA, 15 bp, Homo sapiens
ctcccctctcctgag

SEQ ID NO: 412512 - DNA, 20 bp, Homo sapiens
ctcccctctcgccccatccc

SEQ ID NO: 412513 - DNA, 19 bp, Homo sapiens
ctcccctcttcttgcggca

SEQ ID NO: 412514 - DNA, 14 bp, Homo sapiens
ctcccctgagaggt

SEQ ID NO: 412515 - DNA, 12 bp, Homo sapiens
ctcccctgcact

SEQ ID NO: 412516 - DNA, 16 bp, Homo sapiens
ctcccctgcactgtaa

SEQ ID NO: 412517 - DNA, 17 bp, Homo sapiens
ctcccctgcactgtaaa

SEQ ID NO: 412518 - DNA, 13 bp, Homo sapiens
ctcccctgccctc

SEQ ID NO: 412519 - DNA, 14 bp, Homo sapiens
ctcccctgccctgc

SEQ ID NO: 412520 - DNA, 14 bp, Homo sapiens
ctcccctgccctgg

SEQ ID NO: 412521 - DNA, 20 bp, Homo sapiens
ctcccctgcgcaggccctcc

SEQ ID NO: 412522 - DNA, 21 bp, Homo sapiens
ctcccctgcggagctgcatgg

SEQ ID NO: 412523 - DNA, 23 bp, Homo sapiens
ctcccctgcggagctgcatggac

SEQ ID NO: 412524 - DNA, 16 bp, Homo sapiens
ctcccctgctgaaggt

SEQ ID NO: 412525 - DNA, 13 bp, Homo sapiens
ctcccctggagcc

SEQ ID NO: 412526 - DNA, 20 bp, Homo sapiens
ctcccctgtgtagagcctgc

SEQ ID NO: 412527 - DNA, 16 bp, Homo sapiens
ctccccttgagctgag

SEQ ID NO: 412528 - DNA, 12 bp, Homo sapiens
ctccccttgggc

SEQ ID NO: 412529 - DNA, 13 bp, Homo sapiens
ctccccttgggcg

SEQ ID NO: 412530 - DNA, 14 bp, Homo sapiens
ctcccctttcccat

SEQ ID NO: 412531 - DNA, 16 bp, Homo sapiens
ctccccttttccttca

SEQ ID NO: 412532 - DNA, 13 bp, Homo sapiens
ctcccgaatcctg

SEQ ID NO: 412533 - DNA, 16 bp, Homo sapiens
ctcccgaatcctgagg

SEQ ID NO: 412534 - DNA, 16 bp, Homo sapiens
ctcccgcatgctgcct

SEQ ID NO: 412535 - DNA, 17 bp, Homo sapiens
ctcccgcattggtggct

SEQ ID NO: 412536 - DNA, 17 bp, Homo sapiens
ctcccgccacacgctca

SEQ ID NO: 412537 - DNA, 16 bp, Homo sapiens
ctcccgccgcctcggg

SEQ ID NO: 412538 - DNA, 17 bp, Homo sapiens
ctcccgccgcctcgggc

SEQ ID NO: 412539 - DNA, 13 bp, Homo sapiens
ctcccgctgctgc

SEQ ID NO: 412540 - DNA, 14 bp, Homo sapiens
ctcccgctgctgct

SEQ ID NO: 412541 - DNA, 13 bp, Homo sapiens
ctcccggctgcct

SEQ ID NO: 412542 - DNA, 16 bp, Homo sapiens
ctcccggctgcctgcc

SEQ ID NO: 412543 - DNA, 16 bp, Homo sapiens
ctcccgggccacgccc

SEQ ID NO: 412544 - DNA, 19 bp, Homo sapiens
ctcccgggccctcccttgg

SEQ ID NO: 412545 - DNA, 22 bp, Homo sapiens
ctcccgggccctcccttggaaa

SEQ ID NO: 412546 - DNA, 15 bp, Homo sapiens
ctcccggggcagggc

SEQ ID NO: 412547 - DNA, 13 bp, Homo sapiens
ctccctaccctct

SEQ ID NO: 412548 - DNA, 16 bp, Homo sapiens
ctccctaccctcttct

SEQ ID NO: 412549 - DNA, 19 bp, Homo sapiens
ctccctaccctcttctcag

SEQ ID NO: 412550 - DNA, 20 bp, Homo sapiens
ctccctacctcaacctgtaa

SEQ ID NO: 412551 - DNA, 23 bp, Homo sapiens
ctccctagtgacccggaggccac

SEQ ID NO: 412552 - DNA, 20 bp, Homo sapiens
ctccctagttacccacccta

SEQ ID NO: 412553 - DNA, 16 bp, Homo sapiens
ctccctataatgctgg

SEQ ID NO: 412554 - DNA, 20 bp, Homo sapiens
ctccctataatgctggagcg

SEQ ID NO: 412555 - DNA, 19 bp, Homo sapiens
ctccctatatgcacccctg

SEQ ID NO: 412556 - DNA, 18 bp, Homo sapiens
ctccctatccctcacaca

SEQ ID NO: 412557 - DNA, 14 bp, Homo sapiens
ctccctcagcccct

SEQ ID NO: 412558 - DNA, 15 bp, Homo sapiens
ctccctcagcccctc

SEQ ID NO: 412559 - DNA, 16 bp, Homo sapiens
ctccctcagcccctct

SEQ ID NO: 412560 - DNA, 19 bp, Homo sapiens
ctccctcatggctctggca

SEQ ID NO: 412561 - DNA, 13 bp, Homo sapiens
ctccctcattcca

SEQ ID NO: 412562 - DNA, 15 bp, Homo sapiens
ctccctccacacctc

SEQ ID NO: 412563 - DNA, 17 bp, Homo sapiens
ctccctccactcctccc

SEQ ID NO: 412564 - DNA, 18 bp, Homo sapiens
ctccctccatggcaggaa

SEQ ID NO: 412565 - DNA, 20 bp, Homo sapiens
ctccctccatggcaggaagg

SEQ ID NO: 412566 - DNA, 12 bp, Homo sapiens
ctccctccccac

SEQ ID NO: 412567 - DNA, 18 bp, Homo sapiens
ctccctccccctgcccct

SEQ ID NO: 412568 - DNA, 16 bp, Homo sapiens
ctccctcccctgccct

SEQ ID NO: 412569 - DNA, 18 bp, Homo sapiens
ctccctcccctgccctgg

SEQ ID NO: 412570 - DNA, 21 bp, Homo sapiens
ctccctcccctgccctggtcc

SEQ ID NO: 412571 - DNA, 14 bp, Homo sapiens
ctccctccctccac

SEQ ID NO: 412572 - DNA, 18 bp, Homo sapiens
ctccctccctccccagtg

SEQ ID NO: 412573 - DNA, 14 bp, Homo sapiens
ctccctccctgcag

SEQ ID NO: 412574 - DNA, 15 bp, Homo sapiens
ctccctcctcacctc

SEQ ID NO: 412575 - DNA, 18 bp, Homo sapiens
ctccctcctcacctctgg

SEQ ID NO: 412576 - DNA, 19 bp, Homo sapiens
ctccctcctcacctctgga

SEQ ID NO: 412577 - DNA, 21 bp, Homo sapiens
ctccctcctcacctctggact

SEQ ID NO: 412578 - DNA, 13 bp, Homo sapiens
ctccctcctccca

SEQ ID NO: 412579 - DNA, 12 bp, Homo sapiens
ctccctcctctg

SEQ ID NO: 412580 - DNA, 15 bp, Homo sapiens
ctccctcctctgtcc

SEQ ID NO: 412581 - DNA, 16 bp, Homo sapiens
ctccctcctgatgttt

SEQ ID NO: 412582 - DNA, 23 bp, Homo sapiens
ctccctcctgcaggctggctgtt

SEQ ID NO: 412583 - DNA, 12 bp, Homo sapiens
ctccctcctgga

SEQ ID NO: 412584 - DNA, 15 bp, Homo sapiens
ctccctcctggagca

SEQ ID NO: 412585 - DNA, 16 bp, Homo sapiens
ctccctcctggctcac

SEQ ID NO: 412586 - DNA, 20 bp, Homo sapiens
ctccctccttccttcttgct

SEQ ID NO: 412587 - DNA, 20 bp, Homo sapiens
ctccctcgaacccacactgc

SEQ ID NO: 412588 - DNA, 13 bp, Homo sapiens
ctccctcgcatcc

SEQ ID NO: 412589 - DNA, 21 bp, Homo sapiens
ctccctcgcatccgcctctga

SEQ ID NO: 412590 - DNA, 16 bp, Homo sapiens
ctccctcgctgtatga

SEQ ID NO: 412591 - DNA, 17 bp, Homo sapiens
ctccctcggtcacctgt

SEQ ID NO: 412592 - DNA, 18 bp, Homo sapiens
ctccctcggtcacctgtg

SEQ ID NO: 412593 - DNA, 19 bp, Homo sapiens
ctccctcggtcacctgtgc

SEQ ID NO: 412594 - DNA, 16 bp, Homo sapiens
ctccctctcccaggcc

SEQ ID NO: 412595 - DNA, 16 bp, Homo sapiens
ctccctctctcttctg

SEQ ID NO: 412596 - DNA, 21 bp, Homo sapiens
ctccctctcttccgggagctg

SEQ ID NO: 412597 - DNA, 22 bp, Homo sapiens
ctccctctcttccgggagctgg

SEQ ID NO: 412598 - DNA, 13 bp, Homo sapiens
ctccctctgctct

SEQ ID NO: 412599 - DNA, 17 bp, Homo sapiens
ctccctcttcccagcac

SEQ ID NO: 412600 - DNA, 14 bp, Homo sapiens
ctccctcttctcaa

SEQ ID NO: 412601 - DNA, 20 bp, Homo sapiens
ctccctcttctcaagtgcct

SEQ ID NO: 412602 - DNA, 16 bp, Homo sapiens
ctccctgacccgtcta

SEQ ID NO: 412603 - DNA, 18 bp, Homo sapiens
ctccctgaccctgcagag

SEQ ID NO: 412604 - DNA, 21 bp, Homo sapiens
ctccctgaccctgcagagatg

SEQ ID NO: 412605 - DNA, 21 bp, Homo sapiens
ctccctgaccttagcgttctg

SEQ ID NO: 412606 - DNA, 22 bp, Homo sapiens
ctccctgaccttagcgttctgg

SEQ ID NO: 412607 - DNA, 21 bp, Homo sapiens
ctccctgagcctgccccagct

SEQ ID NO: 412608 - DNA, 16 bp, Homo sapiens
ctccctgagctttggg

SEQ ID NO: 412609 - DNA, 14 bp, Homo sapiens
ctccctgccaactc

SEQ ID NO: 412610 - DNA, 20 bp, Homo sapiens
ctccctgccaccgtcacaca

SEQ ID NO: 412611 - DNA, 12 bp, Homo sapiens
ctccctgcctca

SEQ ID NO: 412612 - DNA, 16 bp, Homo sapiens
ctccctgcctcacatc

SEQ ID NO: 412613 - DNA, 13 bp, Homo sapiens
ctccctgcctgct

SEQ ID NO: 412614 - DNA, 23 bp, Homo sapiens
ctccctgctcagctggccgggtt

SEQ ID NO: 412615 - DNA, 14 bp, Homo sapiens
ctccctgctccacg

SEQ ID NO: 412616 - DNA, 17 bp, Homo sapiens
ctccctgctccacgaag

SEQ ID NO: 412617 - DNA, 19 bp, Homo sapiens
ctccctggatgtgtggggc

SEQ ID NO: 412618 - DNA, 18 bp, Homo sapiens
ctccctggctgtgagcag

SEQ ID NO: 412619 - DNA, 19 bp, Homo sapiens
ctccctggctgtgagcagc

SEQ ID NO: 412620 - DNA, 18 bp, Homo sapiens
ctccctggggaccaggag

SEQ ID NO: 412621 - DNA, 23 bp, Homo sapiens
ctccctggggatatgcaaccctt

SEQ ID NO: 412622 - DNA, 20 bp, Homo sapiens
ctccctggttttaccccagc

SEQ ID NO: 412623 - DNA, 18 bp, Homo sapiens
ctccctgtcactcagctg

SEQ ID NO: 412624 - DNA, 14 bp, Homo sapiens
ctccctgtccaccc

SEQ ID NO: 412625 - DNA, 16 bp, Homo sapiens
ctccctgtcccctcat

SEQ ID NO: 412626 - DNA, 14 bp, Homo sapiens
ctccctgtcccctg

SEQ ID NO: 412627 - DNA, 15 bp, Homo sapiens
ctccctgtctccagg

SEQ ID NO: 412628 - DNA, 19 bp, Homo sapiens
ctccctgtctccagggccc

SEQ ID NO: 412629 - DNA, 16 bp, Homo sapiens
ctccctgtgagagagt

SEQ ID NO: 412630 - DNA, 20 bp, Homo sapiens
ctccctgttatctgctagat

SEQ ID NO: 412631 - DNA, 18 bp, Homo sapiens
ctcccttcaaccattccc

SEQ ID NO: 412632 - DNA, 19 bp, Homo sapiens
ctcccttcaaccattcccc

SEQ ID NO: 412633 - DNA, 22 bp, Homo sapiens
ctcccttcaaccattccccatg

SEQ ID NO: 412634 - DNA, 19 bp, Homo sapiens
ctcccttcaatgctagaaa

SEQ ID NO: 412635 - DNA, 16 bp, Homo sapiens
ctcccttcccagtggg

SEQ ID NO: 412636 - DNA, 14 bp, Homo sapiens
ctcccttccccact

SEQ ID NO: 412637 - DNA, 18 bp, Homo sapiens
ctcccttcccctgcctgg

SEQ ID NO: 412638 - DNA, 14 bp, Homo sapiens
ctcccttcctggcc

SEQ ID NO: 412639 - DNA, 15 bp, Homo sapiens
ctcccttcgtgtgtg

SEQ ID NO: 412640 - DNA, 19 bp, Homo sapiens
cttcgcgtgccctcgctgc

SEQ ID NO: 412641 - DNA, 17 bp, Homo sapiens
cttcgctattcccaggc

SEQ ID NO: 412642 - DNA, 21 bp, Homo sapiens
cttcgctattcccaggcaggg

SEQ ID NO: 412643 - DNA, 15 bp, Homo sapiens
cttcgctgctctagc

SEQ ID NO: 412644 - DNA, 19 bp, Homo sapiens
cttcgctgctctagctggc

SEQ ID NO: 412645 - DNA, 19 bp, Homo sapiens
cttcgctgtgatgcatgag

SEQ ID NO: 412646 - DNA, 16 bp, Homo sapiens
cttcggaggtggcagc

SEQ ID NO: 412647 - DNA, 21 bp, Homo sapiens
cttcggcattggttccctttg

SEQ ID NO: 412648 - DNA, 23 bp, Homo sapiens
cttcgggaagagaggagttcaat

SEQ ID NO: 412649 - DNA, 14 bp, Homo sapiens
cttcgtgctggagg

SEQ ID NO: 412650 - DNA, 16 bp, Homo sapiens
cttcgtgctggaggaa

SEQ ID NO: 412651 - DNA, 20 bp, Homo sapiens
cttcgttaactgtgtatgta

SEQ ID NO: 412652 - DNA, 15 bp, Homo sapiens
cttctaaatgcatat

SEQ ID NO: 412653 - DNA, 14 bp, Homo sapiens
cttctaatatattt

SEQ ID NO: 412654 - DNA, 22 bp, Homo sapiens
cttctaatcataacatagttga

SEQ ID NO: 412655 - DNA, 21 bp, Homo sapiens
cttctaatccatgtgctgctg

SEQ ID NO: 412656 - DNA, 23 bp, Homo sapiens
cttctaatgttcccctaacccta

SEQ ID NO: 412657 - DNA, 18 bp, Homo sapiens
cttctaattttgtgctct

SEQ ID NO: 412658 - DNA, 22 bp, Homo sapiens
cttctaattttgtgctctttcc

SEQ ID NO: 412659 - DNA, 23 bp, Homo sapiens
cttctacaggcccggcccagcct

SEQ ID NO: 412660 - DNA, 13 bp, Homo sapiens
cttctacttttaa

SEQ ID NO: 412661 - DNA, 17 bp, Homo sapiens
cttctaggaggatgctg

SEQ ID NO: 412662 - DNA, 19 bp, Homo sapiens
cttctaggtgtggtcccat

SEQ ID NO: 412663 - DNA, 21 bp, Homo sapiens
cttctatcctgcaatttctcc

SEQ ID NO: 412664 - DNA, 15 bp, Homo sapiens
cttctatctaatcct

SEQ ID NO: 412665 - DNA, 13 bp, Homo sapiens
cttctatgatcag

SEQ ID NO: 412666 - DNA, 17 bp, Homo sapiens
cttctcaagtgccttaa

SEQ ID NO: 412667 - DNA, 15 bp, Homo sapiens
cttctcacagcacat

SEQ ID NO: 412668 - DNA, 13 bp, Homo sapiens
cttctcagctcca

SEQ ID NO: 412669 - DNA, 12 bp, Homo sapiens
cttctcagctct

SEQ ID NO: 412670 - DNA, 22 bp, Homo sapiens
cttctcatagcattaactaatc

SEQ ID NO: 412671 - DNA, 21 bp, Homo sapiens
cttctcattccaacagtgagt

SEQ ID NO: 412672 - DNA, 22 bp, Homo sapiens
cttctccacctcccccaaaccc

SEQ ID NO: 412673 - DNA, 14 bp, Homo sapiens
cttctccactggat

SEQ ID NO: 412674 - DNA, 19 bp, Homo sapiens
cttctccatggccctgcca

SEQ ID NO: 412675 - DNA, 13 bp, Homo sapiens
cttctcccagcac

SEQ ID NO: 412676 - DNA, 14 bp, Homo sapiens
cttctcccctccag

SEQ ID NO: 412677 - DNA, 16 bp, Homo sapiens
cttctcccctccagac

SEQ ID NO: 412678 - DNA, 19 bp, Homo sapiens
cttctcccctgcactgtaa

SEQ ID NO: 412679 - DNA, 20 bp, Homo sapiens
cttctccctggactctgtgg

SEQ ID NO: 412680 - DNA, 18 bp, Homo sapiens
cttctcctccccacccgc

SEQ ID NO: 412681 - DNA, 15 bp, Homo sapiens
cttctcctctctggg

SEQ ID NO: 412682 - DNA, 22 bp, Homo sapiens
cttctcctttcacaaccttctg

SEQ ID NO: 412683 - DNA, 19 bp, Homo sapiens
cttctcgtagatgctgcct

SEQ ID NO: 412684 - DNA, 15 bp, Homo sapiens
cttctcgtcttcctc

SEQ ID NO: 412685 - DNA, 16 bp, Homo sapiens
cttctcgtcttcctct

SEQ ID NO: 412686 - DNA, 16 bp, Homo sapiens
cttctctaaaacagca

SEQ ID NO: 412687 - DNA, 20 bp, Homo sapiens
cttctctactcatgccagat

SEQ ID NO: 412688 - DNA, 14 bp, Homo sapiens
cttctctcacctcc

SEQ ID NO: 412689 - DNA, 13 bp, Homo sapiens
cttctctcccaca

SEQ ID NO: 412690 - DNA, 15 bp, Homo sapiens
cttctctctttgtcc

SEQ ID NO: 412691 - DNA, 18 bp, Homo sapiens
cttctctgccaagccctc

SEQ ID NO: 412692 - DNA, 21 bp, Homo sapiens
cttctctgctccaccacatcc

SEQ ID NO: 412693 - DNA, 21 bp, Homo sapiens
cttctctgttcccttgcaggg

SEQ ID NO: 412694 - DNA, 12 bp, Homo sapiens
cttctcttaatt

SEQ ID NO: 412695 - DNA, 14 bp, Homo sapiens
cttctcttaattta

SEQ ID NO: 412696 - DNA, 15 bp, Homo sapiens
cttctcttaatttaa

SEQ ID NO: 412697 - DNA, 16 bp, Homo sapiens
cttctcttaatttaat

SEQ ID NO: 412698 - DNA, 21 bp, Homo sapiens
cttctcttacgctctctgtct

SEQ ID NO: 412699 - DNA, 20 bp, Homo sapiens
cttctcttgggaactccact

SEQ ID NO: 412700 - DNA, 23 bp, Homo sapiens
cttctcttttcctcgcagatgat

SEQ ID NO: 412701 - DNA, 15 bp, Homo sapiens
cttctgaaatgaaac

SEQ ID NO: 412702 - DNA, 23 bp, Homo sapiens
cttctgaaatgaaacaaataatc

SEQ ID NO: 412703 - DNA, 18 bp, Homo sapiens
cttctgaactttggaagc

SEQ ID NO: 412704 - DNA, 15 bp, Homo sapiens
cttctgaagatctca

SEQ ID NO: 412705 - DNA, 15 bp, Homo sapiens
cttctgaatgctgct

SEQ ID NO: 412706 - DNA, 16 bp, Homo sapiens
cttctgaatgctgcta

SEQ ID NO: 412707 - DNA, 15 bp, Homo sapiens
cttctgaccacactt

SEQ ID NO: 412708 - DNA, 17 bp, Homo sapiens
cttctgaccacacttcc

SEQ ID NO: 412709 - DNA, 19 bp, Homo sapiens
cttctgaccacacttcctg

SEQ ID NO: 412710 - DNA, 23 bp, Homo sapiens
cttctgaccacacttcctgtcca

SEQ ID NO: 412711 - DNA, 23 bp, Homo sapiens
cttctgaccccacttatgctgct

SEQ ID NO: 412712 - DNA, 13 bp, Homo sapiens
cttctgacctccc

SEQ ID NO: 412713 - DNA, 14 bp, Homo sapiens
cttctgacggccct

SEQ ID NO: 412714 - DNA, 17 bp, Homo sapiens
cttctgacggccctgca

SEQ ID NO: 412715 - DNA, 22 bp, Homo sapiens
cttctgagcagttttccaggag

SEQ ID NO: 412716 - DNA, 13 bp, Homo sapiens
cttctgagtggtg

SEQ ID NO: 412717 - DNA, 20 bp, Homo sapiens
cttctgcattactattaact

SEQ ID NO: 412718 - DNA, 18 bp, Homo sapiens
cttctgccctccctggag

SEQ ID NO: 412719 - DNA, 13 bp, Homo sapiens
cttctgctcacat

SEQ ID NO: 412720 - DNA, 18 bp, Homo sapiens
cttctgctcacattccct

SEQ ID NO: 412721 - DNA, 19 bp, Homo sapiens
cttctgctccacccttggc

SEQ ID NO: 412722 - DNA, 12 bp, Homo sapiens
cttctgctgccc

SEQ ID NO: 412723 - DNA, 15 bp, Homo sapiens
cttctgcttaggaga

SEQ ID NO: 412724 - DNA, 13 bp, Homo sapiens
cttctgctttcta

SEQ ID NO: 412725 - DNA, 13 bp, Homo sapiens
cttctgctttttc

SEQ ID NO: 412726 - DNA, 15 bp, Homo sapiens
cttctggaaggctgg

SEQ ID NO: 412727 - DNA, 18 bp, Homo sapiens
cttctggaaggctggctg

SEQ ID NO: 412728 - DNA, 15 bp, Homo sapiens
cttctggacactgag

SEQ ID NO: 412729 - DNA, 22 bp, Homo sapiens
cttctggcctttcctctctcct

SEQ ID NO: 412730 - DNA, 15 bp, Homo sapiens
cttctggctttgttc

SEQ ID NO: 412731 - DNA, 14 bp, Homo sapiens
cttctgggcagagc

SEQ ID NO: 412732 - DNA, 18 bp, Homo sapiens
cttctgggcctgatggag

SEQ ID NO: 412733 - DNA, 21 bp, Homo sapiens
cttctgggcctgatggagagg

SEQ ID NO: 412734 - DNA, 23 bp, Homo sapiens
cttctgggcctgatggagaggag

SEQ ID NO: 412735 - DNA, 18 bp, Homo sapiens
cttctggtgcatgttctt

SEQ ID NO: 412736 - DNA, 14 bp, Homo sapiens
cttctgtccccagc

SEQ ID NO: 412737 - DNA, 15 bp, Homo sapiens
cttctgtccccagcc

SEQ ID NO: 412738 - DNA, 13 bp, Homo sapiens
cttctgtctgtaa

SEQ ID NO: 412739 - DNA, 23 bp, Homo sapiens
cttctgtgcatttgtgtctgcct

SEQ ID NO: 412740 - DNA, 16 bp, Homo sapiens
cttctgtgcccagctc

SEQ ID NO: 412741 - DNA, 15 bp, Homo sapiens
cttctgtgtctgtca

SEQ ID NO: 412742 - DNA, 16 bp, Homo sapiens
cttctgtttttctcaa

SEQ ID NO: 412743 - DNA, 15 bp, Homo sapiens
cttcttaaaggcctg

SEQ ID NO: 412744 - DNA, 18 bp, Homo sapiens
cttcttaatataactgcc

SEQ ID NO: 412745 - DNA, 19 bp, Homo sapiens
cttcttatggtataataaa

SEQ ID NO: 412746 - DNA, 16 bp, Homo sapiens
cttcttcaatggcacc

SEQ ID NO: 412747 - DNA, 15 bp, Homo sapiens
cttcttcacccagct

SEQ ID NO: 412748 - DNA, 18 bp, Homo sapiens
cttcttcacccagctaat

SEQ ID NO: 412749 - DNA, 22 bp, Homo sapiens
cttcttccaatgatgcttacta

SEQ ID NO: 412750 - DNA, 14 bp, Homo sapiens
cttcttcctcaagt

SEQ ID NO: 412751 - DNA, 20 bp, Homo sapiens
cttcttcctcaagtcttgac

SEQ ID NO: 412752 - DNA, 13 bp, Homo sapiens
cttcttccttctt

SEQ ID NO: 412753 - DNA, 20 bp, Homo sapiens
cttcttcgcaaactgatgga

SEQ ID NO: 412754 - DNA, 15 bp, Homo sapiens
cttcttcggaggtgg

SEQ ID NO: 412755 - DNA, 15 bp, Homo sapiens
cttcttgagcagacc

SEQ ID NO: 412756 - DNA, 12 bp, Homo sapiens
cttcttgccctg

SEQ ID NO: 412757 - DNA, 17 bp, Homo sapiens
cttcttgccctgagctt

SEQ ID NO: 412758 - DNA, 19 bp, Homo sapiens
cttcttgcggcaccgccca

SEQ ID NO: 412759 - DNA, 16 bp, Homo sapiens
cttcttgcttgtaaaa

SEQ ID NO: 412760 - DNA, 12 bp, Homo sapiens
cttcttggcttc

SEQ ID NO: 412761 - DNA, 13 bp, Homo sapiens
cttcttggcttct

SEQ ID NO: 412762 - DNA, 13 bp, Homo sapiens
cttcttgggcccc

SEQ ID NO: 412763 - DNA, 18 bp, Homo sapiens
cttcttgggccccagacc

SEQ ID NO: 412764 - DNA, 12 bp, Homo sapiens
cttcttgtaata

SEQ ID NO: 412765 - DNA, 13 bp, Homo sapiens
cttcttgtaatat

SEQ ID NO: 412766 - DNA, 15 bp, Homo sapiens
cttcttgtgaaatgt

SEQ ID NO: 412767 - DNA, 17 bp, Homo sapiens
cttcttgtgattgctgc

SEQ ID NO: 412768 - DNA, 21 bp, Homo sapiens
cttcttgtgattgctgccata

SEQ ID NO: 412769 - DNA, 13 bp, Homo sapiens
cttcttgttcatg

SEQ ID NO: 412770 - DNA, 23 bp, Homo sapiens
cttcttgttcatgttttgctaat

SEQ ID NO: 412771 - DNA, 12 bp, Homo sapiens
cttgggctcctg

SEQ ID NO: 412772 - DNA, 13 bp, Homo sapiens
cttgggctcctgg

SEQ ID NO: 412773 - DNA, 22 bp, Homo sapiens
cttgggctcctggctgccaggc

SEQ ID NO: 412774 - DNA, 23 bp, Homo sapiens
cttgggctcctggctgccaggcg

SEQ ID NO: 412775 - DNA, 19 bp, Homo sapiens
cttgggcttccatttgtgt

SEQ ID NO: 412776 - DNA, 23 bp, Homo sapiens
cttgggcttccatttgtgtgtgt

SEQ ID NO: 412777 - DNA, 16 bp, Homo sapiens
cttggggaatttcctc

SEQ ID NO: 412778 - DNA, 17 bp, Homo sapiens
cttggggaatttcctct

SEQ ID NO: 412779 - DNA, 19 bp, Homo sapiens
cttggggaggggtcagctc

SEQ ID NO: 412780 - DNA, 23 bp, Homo sapiens
cttggggaggggtcagctctggc

SEQ ID NO: 412781 - DNA, 19 bp, Homo sapiens
cttggggcctggcttgctc

SEQ ID NO: 412782 - DNA, 15 bp, Homo sapiens
cttggggctatttgt

SEQ ID NO: 412783 - DNA, 12 bp, Homo sapiens
cttgggggtctg

SEQ ID NO: 412784 - DNA, 13 bp, Homo sapiens
cttgggggtctgc

SEQ ID NO: 412785 - DNA, 17 bp, Homo sapiens
cttggggtagagaggac

SEQ ID NO: 412786 - DNA, 23 bp, Homo sapiens
cttggggtcaggaacagtggctg

SEQ ID NO: 412787 - DNA, 23 bp, Homo sapiens
cttgggtcctgcaatctccaggg

SEQ ID NO: 412788 - DNA, 17 bp, Homo sapiens
cttgggttccaaccagg

SEQ ID NO: 412789 - DNA, 17 bp, Homo sapiens
cttgggtttttgttacc

SEQ ID NO: 412790 - DNA, 13 bp, Homo sapiens
cttggtagagttt

SEQ ID NO: 412791 - DNA, 15 bp, Homo sapiens
cttggtagagtttat

SEQ ID NO: 412792 - DNA, 17 bp, Homo sapiens
cttggtagagtttattt

SEQ ID NO: 412793 - DNA, 16 bp, Homo sapiens
cttggtagttctgtgc

SEQ ID NO: 412794 - DNA, 17 bp, Homo sapiens
cttggtcaagtttttct

SEQ ID NO: 412795 - DNA, 14 bp, Homo sapiens
cttggtcacctcaa

SEQ ID NO: 412796 - DNA, 16 bp, Homo sapiens
cttggtccctggtccc

SEQ ID NO: 412797 - DNA, 12 bp, Homo sapiens
cttggtctcttt

SEQ ID NO: 412798 - DNA, 19 bp, Homo sapiens
cttggtctctttctttcca

SEQ ID NO: 412799 - DNA, 22 bp, Homo sapiens
cttggtctctttctttccaaag

SEQ ID NO: 412800 - DNA, 15 bp, Homo sapiens
cttggtgaggaggag

SEQ ID NO: 412801 - DNA, 23 bp, Homo sapiens
cttggtgcaaggccatctgctta

SEQ ID NO: 412802 - DNA, 17 bp, Homo sapiens
cttggtgccttttgtgt

SEQ ID NO: 412803 - DNA, 19 bp, Homo sapiens
cttggtgccttttgtgtga

SEQ ID NO: 412804 - DNA, 14 bp, Homo sapiens
cttggtgtcctttc

SEQ ID NO: 412805 - DNA, 15 bp, Homo sapiens
cttggtgtcttggca

SEQ ID NO: 412806 - DNA, 15 bp, Homo sapiens
cttggttcctccagc

SEQ ID NO: 412807 - DNA, 22 bp, Homo sapiens
cttggttgttcctttttctttt

SEQ ID NO: 412808 - DNA, 15 bp, Homo sapiens
cttggttttgtattg

SEQ ID NO: 412809 - DNA, 18 bp, Homo sapiens
cttgtaaaaattaaaagt

SEQ ID NO: 412810 - DNA, 22 bp, Homo sapiens
cttgtaaaactgtgacattcca

SEQ ID NO: 412811 - DNA, 21 bp, Homo sapiens
cttgtaaataaccacaaggtc

SEQ ID NO: 412812 - DNA, 12 bp, Homo sapiens
cttgtaaataca

SEQ ID NO: 412813 - DNA, 13 bp, Homo sapiens
cttgtaaatacac

SEQ ID NO: 412814 - DNA, 17 bp, Homo sapiens
cttgtaacaagaaaaca

SEQ ID NO: 412815 - DNA, 23 bp, Homo sapiens
cttgtaactgggttcaaaaagaa

SEQ ID NO: 412816 - DNA, 15 bp, Homo sapiens
cttgtaattctaaat

SEQ ID NO: 412817 - DNA, 23 bp, Homo sapiens
cttgtaattctaaatgaatgttt

SEQ ID NO: 412818 - DNA, 16 bp, Homo sapiens
cttgtacagttgactg

SEQ ID NO: 412819 - DNA, 19 bp, Homo sapiens
cttgtactaagccaggagg

SEQ ID NO: 412820 - DNA, 19 bp, Homo sapiens
cttgtaggaatctgccttc

SEQ ID NO: 412821 - DNA, 17 bp, Homo sapiens
cttgtagggatgccttt

SEQ ID NO: 412822 - DNA, 18 bp, Homo sapiens
cttgtatcctctggttct

SEQ ID NO: 412823 - DNA, 14 bp, Homo sapiens
cttgtatgctgccc

SEQ ID NO: 412824 - DNA, 17 bp, Homo sapiens
cttgtattaaagacaga

SEQ ID NO: 412825 - DNA, 17 bp, Homo sapiens
cttgtattatcagtgaa

SEQ ID NO: 412826 - DNA, 19 bp, Homo sapiens
cttgtattttcttcccatt

SEQ ID NO: 412827 - DNA, 20 bp, Homo sapiens
cttgtcaatggaagaaaccc

SEQ ID NO: 412828 - DNA, 15 bp, Homo sapiens
cttgtcacaataaat

SEQ ID NO: 412829 - DNA, 16 bp, Homo sapiens
cttgtcacaataaatg

SEQ ID NO: 412830 - DNA, 17 bp, Homo sapiens
cttgtcacaataaatgt

SEQ ID NO: 412831 - DNA, 14 bp, Homo sapiens
cttgtcagagctgg

SEQ ID NO: 412832 - DNA, 22 bp, Homo sapiens
cttgtcatcttttagagtaaac

SEQ ID NO: 412833 - DNA, 15 bp, Homo sapiens
cttgtccacattcta

SEQ ID NO: 412834 - DNA, 21 bp, Homo sapiens
cttgtccctttccctaccttt

SEQ ID NO: 412835 - DNA, 19 bp, Homo sapiens
cttgtcctgccagctgcct

SEQ ID NO: 412836 - DNA, 13 bp, Homo sapiens
cttgtctctgggc

SEQ ID NO: 412837 - DNA, 15 bp, Homo sapiens
cttgtctcttcctct

SEQ ID NO: 412838 - DNA, 14 bp, Homo sapiens
cttgtctgaggcct

SEQ ID NO: 412839 - DNA, 15 bp, Homo sapiens
cttgtctgaggcctc

SEQ ID NO: 412840 - DNA, 19 bp, Homo sapiens
cttgtctgaggcctcatcc

SEQ ID NO: 412841 - DNA, 14 bp, Homo sapiens
cttgtcttttcccc

SEQ ID NO: 412842 - DNA, 17 bp, Homo sapiens
cttgtcttttcccctca

SEQ ID NO: 412843 - DNA, 14 bp, Homo sapiens
cttgtgaaatgtct

SEQ ID NO: 412844 - DNA, 14 bp, Homo sapiens
cttgtgactagtgc

SEQ ID NO: 412845 - DNA, 19 bp, Homo sapiens
cttgtgactagtgctgaag

SEQ ID NO: 412846 - DNA, 12 bp, Homo sapiens
cttgtgactgaa

SEQ ID NO: 412847 - DNA, 23 bp, Homo sapiens
cttgtgagagcccattcccacca

SEQ ID NO: 412848 - DNA, 15 bp, Homo sapiens
cttgtgatctgggaa

SEQ ID NO: 412849 - DNA, 17 bp, Homo sapiens
cttgtgattgctgccat

SEQ ID NO: 412850 - DNA, 18 bp, Homo sapiens
cttgtgattgctgccata

SEQ ID NO: 412851 - DNA, 15 bp, Homo sapiens
cttgtgatttccatt

SEQ ID NO: 412852 - DNA, 21 bp, Homo sapiens
cttgtgatttccatttctgat

SEQ ID NO: 412853 - DNA, 14 bp, Homo sapiens
cttgtgccctgccc

SEQ ID NO: 412854 - DNA, 21 bp, Homo sapiens
cttgtgccctgcccccatctc

SEQ ID NO: 412855 - DNA, 16 bp, Homo sapiens
cttgtgcctcttggga

SEQ ID NO: 412856 - DNA, 23 bp, Homo sapiens
cttgtgcttggtggggctcgtgg

SEQ ID NO: 412857 - DNA, 16 bp, Homo sapiens
cttgtgtattagatat

SEQ ID NO: 412858 - DNA, 14 bp, Homo sapiens
cttgtgtcagagct

SEQ ID NO: 412859 - DNA, 19 bp, Homo sapiens
cttgtgttaagtatgtgta

SEQ ID NO: 412860 - DNA, 15 bp, Homo sapiens
cttgtgttcaatctg

SEQ ID NO: 412861 - DNA, 19 bp, Homo sapiens
cttgtgttcaatctgtgaa

SEQ ID NO: 412862 - DNA, 13 bp, Homo sapiens
cttgtgttggctg

SEQ ID NO: 412863 - DNA, 14 bp, Homo sapiens
cttgtgttggctgt

SEQ ID NO: 412864 - DNA, 14 bp, Homo sapiens
cttgtgtttgctta

SEQ ID NO: 412865 - DNA, 22 bp, Homo sapiens
cttgtgtttgcttaaacaaagt

SEQ ID NO: 412866 - DNA, 15 bp, Homo sapiens
cttgtgtttttgtct

SEQ ID NO: 412867 - DNA, 18 bp, Homo sapiens
cttgttacggcagtcaca

SEQ ID NO: 412868 - DNA, 13 bp, Homo sapiens
cttgttatttata

SEQ ID NO: 412869 - DNA, 15 bp, Homo sapiens
cttgttatttataac

SEQ ID NO: 412870 - DNA, 20 bp, Homo sapiens
cttgttcatgttttgctaat

SEQ ID NO: 412871 - DNA, 15 bp, Homo sapiens
cttgttcatttctgt

SEQ ID NO: 412872 - DNA, 20 bp, Homo sapiens
cttgttccagccctattctg

SEQ ID NO: 412873 - DNA, 16 bp, Homo sapiens
cttgttctgttttgtt

SEQ ID NO: 412874 - DNA, 12 bp, Homo sapiens
cttgttcttcct

SEQ ID NO: 412875 - DNA, 14 bp, Homo sapiens
cttgttgcccaggc

SEQ ID NO: 412876 - DNA, 14 bp, Homo sapiens
cttgttggagcctg

SEQ ID NO: 412877 - DNA, 22 bp, Homo sapiens
cttgttgtttttaagtcctgta

SEQ ID NO: 412878 - DNA, 22 bp, Homo sapiens
cttgtttacagcactactctgt

SEQ ID NO: 412879 - DNA, 16 bp, Homo sapiens
cttgtttatgatattt

SEQ ID NO: 412880 - DNA, 13 bp, Homo sapiens
cttgtttccctgc

SEQ ID NO: 412881 - DNA, 14 bp, Homo sapiens
cttgtttccctgct

SEQ ID NO: 412882 - DNA, 15 bp, Homo sapiens
cttgtttccctgctg

SEQ ID NO: 412883 - DNA, 17 bp, Homo sapiens
cttgtttctatactgtt

SEQ ID NO: 412884 - DNA, 16 bp, Homo sapiens
cttgtttctttctgaa

SEQ ID NO: 412885 - DNA, 18 bp, Homo sapiens
cttgtttctttctgtctc

SEQ ID NO: 412886 - DNA, 19 bp, Homo sapiens
cttgtttggtagttagcca

SEQ ID NO: 412887 - DNA, 13 bp, Homo sapiens
cttgtttgtttta

SEQ ID NO: 412888 - DNA, 14 bp, Homo sapiens
cttgttttatatac

SEQ ID NO: 412889 - DNA, 14 bp, Homo sapiens
cttgttttcttgcc

SEQ ID NO: 412890 - DNA, 14 bp, Homo sapiens
cttgttttggactt

SEQ ID NO: 412891 - DNA, 19 bp, Homo sapiens
cttgttttggactttgtta

SEQ ID NO: 412892 - DNA, 13 bp, Homo sapiens
ctttaaaaaataa

SEQ ID NO: 412893 - DNA, 19 bp, Homo sapiens
ctttaaaaaataaagctgt

SEQ ID NO: 412894 - DNA, 23 bp, Homo sapiens
ctttaaaatgattcacttttatt

SEQ ID NO: 412895 - DNA, 14 bp, Homo sapiens
ctttaaactactga

SEQ ID NO: 412896 - DNA, 18 bp, Homo sapiens
ctttaaactactgaactg

SEQ ID NO: 412897 - DNA, 13 bp, Homo sapiens
ctttaaagactta

SEQ ID NO: 412898 - DNA, 16 bp, Homo sapiens
ctttaaagacttaaga

SEQ ID NO: 412899 - DNA, 18 bp, Homo sapiens
ctttaaagacttaagatt

SEQ ID NO: 412900 - DNA, 21 bp, Homo sapiens
ctttaaagacttaagattaaa

SEQ ID NO: 412901 - DNA, 21 bp, Homo sapiens
ctttaaagacttgatgaataa

SEQ ID NO: 412902 - DNA, 12 bp, Homo sapiens
ctttaaatataa

SEQ ID NO: 412903 - DNA, 15 bp, Homo sapiens
ctttaaatatcattc

SEQ ID NO: 412904 - DNA, 19 bp, Homo sapiens
ctttaaatcctaccaaagt

SEQ ID NO: 412905 - DNA, 17 bp, Homo sapiens
ctttaaatggaataatt

SEQ ID NO: 412906 - DNA, 14 bp, Homo sapiens
ctttaaattatatg

SEQ ID NO: 412907 - DNA, 13 bp, Homo sapiens
ctttaaattctcc

SEQ ID NO: 412908 - DNA, 14 bp, Homo sapiens
ctttaaattctcca

SEQ ID NO: 412909 - DNA, 16 bp, Homo sapiens
ctttaaattctccaac

SEQ ID NO: 412910 - DNA, 19 bp, Homo sapiens
ctttaaattgttcctcttt

SEQ ID NO: 412911 - DNA, 19 bp, Homo sapiens
ctttaacaaaacaagaaag

SEQ ID NO: 412912 - DNA, 19 bp, Homo sapiens
ctttaacaggttttcttct

SEQ ID NO: 412913 - DNA, 12 bp, Homo sapiens
ctttaacatgcc

SEQ ID NO: 412914 - DNA, 18 bp, Homo sapiens
ctttaaccagtctgaagt

SEQ ID NO: 412915 - DNA, 17 bp, Homo sapiens
ctttaactctgcggata

SEQ ID NO: 412916 - DNA, 15 bp, Homo sapiens
ctttaaggaagaata

SEQ ID NO: 412917 - DNA, 17 bp, Homo sapiens
ctttaagtttcaggata

SEQ ID NO: 412918 - DNA, 20 bp, Homo sapiens
ctttaatcccggtttcagaa

SEQ ID NO: 412919 - DNA, 17 bp, Homo sapiens
ctttaatcttcagtttt

SEQ ID NO: 412920 - DNA, 19 bp, Homo sapiens
ctttaatggacttatttct

SEQ ID NO: 412921 - DNA, 14 bp, Homo sapiens
ctttaattgtatct

SEQ ID NO: 412922 - DNA, 14 bp, Homo sapiens
ctttaattgtgaat

SEQ ID NO: 412923 - DNA, 18 bp, Homo sapiens
ctttaattgttgctttta

SEQ ID NO: 412924 - DNA, 16 bp, Homo sapiens
ctttacaaaatgaatg

SEQ ID NO: 412925 - DNA, 17 bp, Homo sapiens
ctttacaactaaataac

SEQ ID NO: 412926 - DNA, 17 bp, Homo sapiens
ctttacaggatcatgta

SEQ ID NO: 412927 - DNA, 16 bp, Homo sapiens
ctttacatgctgtgct

SEQ ID NO: 412928 - DNA, 20 bp, Homo sapiens
ctttacatgctgtgctcttt

SEQ ID NO: 412929 - DNA, 14 bp, Homo sapiens
ctttacattttatt

SEQ ID NO: 412930 - DNA, 22 bp, Homo sapiens
ctttacattttatttattagct

SEQ ID NO: 412931 - DNA, 16 bp, Homo sapiens
ctttacattttcagta

SEQ ID NO: 412932 - DNA, 16 bp, Homo sapiens
ctttactactgcaagt

SEQ ID NO: 412933 - DNA, 19 bp, Homo sapiens
ctttactcggcgtgctcct

SEQ ID NO: 412934 - DNA, 21 bp, Homo sapiens
ctttactcggcgtgctccttt

SEQ ID NO: 412935 - DNA, 20 bp, Homo sapiens
ctttagaaactgagtcctgt

SEQ ID NO: 412936 - DNA, 20 bp, Homo sapiens
ctttagaagtgcatttctga

SEQ ID NO: 412937 - DNA, 13 bp, Homo sapiens
ctttagagacagg

SEQ ID NO: 412938 - DNA, 15 bp, Homo sapiens
ctttagccaaaccct

SEQ ID NO: 412939 - DNA, 14 bp, Homo sapiens
ctttaggcagcctg

SEQ ID NO: 412940 - DNA, 15 bp, Homo sapiens
ctttaggcagcctgc

SEQ ID NO: 412941 - DNA, 19 bp, Homo sapiens
ctttaggcagcctgccgcc

SEQ ID NO: 412942 - DNA, 21 bp, Homo sapiens
ctttagggatctggggaagga

SEQ ID NO: 412943 - DNA, 22 bp, Homo sapiens
ctttagggatctggggaaggac

SEQ ID NO: 412944 - DNA, 18 bp, Homo sapiens
ctttagggggtgggaggg

SEQ ID NO: 412945 - DNA, 16 bp, Homo sapiens
ctttagtgattgcttt

SEQ ID NO: 412946 - DNA, 17 bp, Homo sapiens
ctttagtgattgctttt

SEQ ID NO: 412947 - DNA, 21 bp, Homo sapiens
ctttagtgtattttctgtcac

SEQ ID NO: 412948 - DNA, 18 bp, Homo sapiens
ctttataaaccataaaat

SEQ ID NO: 412949 - DNA, 16 bp, Homo sapiens
ctttatacttaaacag

SEQ ID NO: 412950 - DNA, 12 bp, Homo sapiens
ctttatatttag

SEQ ID NO: 412951 - DNA, 13 bp, Homo sapiens
ctttatatttagt

SEQ ID NO: 412952 - DNA, 16 bp, Homo sapiens
ctttatattttctata

SEQ ID NO: 412953 - DNA, 18 bp, Homo sapiens
ctttatattttctatatt

SEQ ID NO: 412954 - DNA, 21 bp, Homo sapiens
ctttatcaaaaaaagactcag

SEQ ID NO: 412955 - DNA, 22 bp, Homo sapiens
ctttatcagtgatggtctcaca

SEQ ID NO: 412956 - DNA, 14 bp, Homo sapiens
ctttatccctgctt

SEQ ID NO: 412957 - DNA, 15 bp, Homo sapiens
ctttatccctgctta

SEQ ID NO: 412958 - DNA, 16 bp, Homo sapiens
ctttatccctgcttat

SEQ ID NO: 412959 - DNA, 17 bp, Homo sapiens
ctttatctctgaggcta

SEQ ID NO: 412960 - DNA, 15 bp, Homo sapiens
ctttatgatttcatg

SEQ ID NO: 412961 - DNA, 18 bp, Homo sapiens
ctttatgcagcttccttt

SEQ ID NO: 412962 - DNA, 12 bp, Homo sapiens
ctttatgctgaa

SEQ ID NO: 412963 - DNA, 15 bp, Homo sapiens
ctttattcttgctgg

SEQ ID NO: 412964 - DNA, 16 bp, Homo sapiens
ctttattcttgctggg

SEQ ID NO: 412965 - DNA, 16 bp, Homo sapiens
ctttattgattttctt

SEQ ID NO: 412966 - DNA, 19 bp, Homo sapiens
ctttattgcccatgggata

SEQ ID NO: 412967 - DNA, 12 bp, Homo sapiens
ctttatttaatt

SEQ ID NO: 412968 - DNA, 14 bp, Homo sapiens
ctttatttaatttc

SEQ ID NO: 412969 - DNA, 15 bp, Homo sapiens
ctttatttaatttca

SEQ ID NO: 412970 - DNA, 17 bp, Homo sapiens
ctttatttaatttcata

SEQ ID NO: 412971 - DNA, 18 bp, Homo sapiens
ctttatttaatttcataa

SEQ ID NO: 412972 - DNA, 19 bp, Homo sapiens
ctttatttaatttcataaa

SEQ ID NO: 412973 - DNA, 17 bp, Homo sapiens
ctttatttctgtctcat

SEQ ID NO: 412974 - DNA, 13 bp, Homo sapiens
ctttatttgtttt

SEQ ID NO: 412975 - DNA, 16 bp, Homo sapiens
ctttatttgttttttt

SEQ ID NO: 412976 - DNA, 16 bp, Homo sapiens
ctttattttatataat

SEQ ID NO: 412977 - DNA, 20 bp, Homo sapiens
ctttattttatataataaag

SEQ ID NO: 412978 - DNA, 22 bp, Homo sapiens
ctttattttatataataaagta

SEQ ID NO: 412979 - DNA, 18 bp, Homo sapiens
ctttattttattattcag

SEQ ID NO: 412980 - DNA, 19 bp, Homo sapiens
ctttattttattattcaga

SEQ ID NO: 412981 - DNA, 11 bp, Homo sapiens
ctttattttct

SEQ ID NO: 412982 - DNA, 18 bp, Homo sapiens
ctttattttttaagtatt

SEQ ID NO: 412983 - DNA, 21 bp, Homo sapiens
ctttattttttaagtatttat

SEQ ID NO: 412984 - DNA, 14 bp, Homo sapiens
ctttcaaatttcac

SEQ ID NO: 412985 - DNA, 16 bp, Homo sapiens
ctttcaacttaaatca

SEQ ID NO: 412986 - DNA, 21 bp, Homo sapiens
ctttcaacttaaatcactgag

SEQ ID NO: 412987 - DNA, 22 bp, Homo sapiens
ctttcaacttaaatcactgagg

SEQ ID NO: 412988 - DNA, 16 bp, Homo sapiens
ctttcaatccacagta

SEQ ID NO: 412989 - DNA, 17 bp, Homo sapiens
ctttcaatccacagtat

SEQ ID NO: 412990 - DNA, 12 bp, Homo sapiens
ctttcaattgca

SEQ ID NO: 412991 - DNA, 22 bp, Homo sapiens
ctttcaattgcagatgccaaaa

SEQ ID NO: 412992 - DNA, 16 bp, Homo sapiens
ctttcacaaccttctg

SEQ ID NO: 412993 - DNA, 20 bp, Homo sapiens
ctttcacccttttctgtttg

SEQ ID NO: 412994 - DNA, 16 bp, Homo sapiens
ctttcactgaagtgaa

SEQ ID NO: 412995 - DNA, 19 bp, Homo sapiens
ctttcactgaagtgaatac

SEQ ID NO: 412996 - DNA, 18 bp, Homo sapiens
ctttcagaaaacagaaaa

SEQ ID NO: 412997 - DNA, 16 bp, Homo sapiens
ctttcagaatacaatt

SEQ ID NO: 412998 - DNA, 14 bp, Homo sapiens
ctttcagagccagt

SEQ ID NO: 412999 - DNA, 20 bp, Homo sapiens
ctttcagagccagtgaagga

SEQ ID NO: 413000 - DNA, 19 bp, Homo sapiens
ctttcagatacatggttgt

SEQ ID NO: 413001 - DNA, 23 bp, Homo sapiens
ctttcagatgtcttctgcctgtt

SEQ ID NO: 413002 - DNA, 13 bp, Homo sapiens
ctttcagatgttt

SEQ ID NO: 413003 - DNA, 16 bp, Homo sapiens
ctttcagcctgcttct

SEQ ID NO: 413004 - DNA, 22 bp, Homo sapiens
ctttcaggaagggagaggaggg

SEQ ID NO: 413005 - DNA, 13 bp, Homo sapiens
ctttcagggcctc

SEQ ID NO: 413006 - DNA, 11 bp, Homo sapiens
ctttcatacca

SEQ ID NO: 413007 - DNA, 18 bp, Homo sapiens
ctttcatagttctgttaa

SEQ ID NO: 413008 - DNA, 20 bp, Homo sapiens
ctttcatagttctgttaaat

SEQ ID NO: 413009 - DNA, 13 bp, Homo sapiens
ctttcatcctgtg

SEQ ID NO: 413010 - DNA, 15 bp, Homo sapiens
ctttcatcctgtgtc

SEQ ID NO: 413011 - DNA, 21 bp, Homo sapiens
ctttcatcctgtgtcccctga

SEQ ID NO: 413012 - DNA, 19 bp, Homo sapiens
ctttcatgaccactgggcc

SEQ ID NO: 413013 - DNA, 14 bp, Homo sapiens
ctttccaacacaca

SEQ ID NO: 413014 - DNA, 19 bp, Homo sapiens
ctttccacatttgtcacag

SEQ ID NO: 413015 - DNA, 21 bp, Homo sapiens
ctttccacatttgtcacagaa

SEQ ID NO: 413016 - DNA, 14 bp, Homo sapiens
ctttccaccccctc

SEQ ID NO: 413017 - DNA, 21 bp, Homo sapiens
ctttccaccccctccctggcc

SEQ ID NO: 413018 - DNA, 17 bp, Homo sapiens
ctttccaccctattccc

SEQ ID NO: 413019 - DNA, 15 bp, Homo sapiens
ctttccactcccact

SEQ ID NO: 413020 - DNA, 19 bp, Homo sapiens
ctttccactcccactgcca

SEQ ID NO: 413021 - DNA, 23 bp, Homo sapiens
ctttccactttgttggcccttcc

SEQ ID NO: 413022 - DNA, 21 bp, Homo sapiens
ctttccaggcttccctgactt

SEQ ID NO: 413023 - DNA, 13 bp, Homo sapiens
ctttccagggcat

SEQ ID NO: 413024 - DNA, 15 bp, Homo sapiens
ctttccatgcagtta

SEQ ID NO: 413025 - DNA, 22 bp, Homo sapiens
ctttcccaacacttcagactgc

SEQ ID NO: 413026 - DNA, 12 bp, Homo sapiens
ctttcccacagt

SEQ ID NO: 413027 - DNA, 18 bp, Homo sapiens
gaaaggattctaaacaga

SEQ ID NO: 413028 - DNA, 20 bp, Homo sapiens
gaaaggcagagattgggggg

SEQ ID NO: 413029 - DNA, 22 bp, Homo sapiens
gaaagggagcccctcctctgag

SEQ ID NO: 413030 - DNA, 22 bp, Homo sapiens
gaaagggagctatcaggaacag

SEQ ID NO: 413031 - DNA, 20 bp, Homo sapiens
gaaagggcagcccctcccca

SEQ ID NO: 413032 - DNA, 17 bp, Homo sapiens
gaaaggggggagctggg

SEQ ID NO: 413033 - DNA, 16 bp, Homo sapiens
gaaagggtgctgcttc

SEQ ID NO: 413034 - DNA, 19 bp, Homo sapiens
gaaaggtgaaacacacaca

SEQ ID NO: 413035 - DNA, 19 bp, Homo sapiens
gaaaggtgctcaaagatgt

SEQ ID NO: 413036 - DNA, 22 bp, Homo sapiens
gaaaggtgctcaaagatgtact

SEQ ID NO: 413037 - DNA, 14 bp, Homo sapiens
gaaaggtttacatt

SEQ ID NO: 413038 - DNA, 16 bp, Homo sapiens
gaaaggtttacattgt

SEQ ID NO: 413039 - DNA, 18 bp, Homo sapiens
gaaagtagtccaggctgt

SEQ ID NO: 413040 - DNA, 18 bp, Homo sapiens
gaaagtatgtgatatctg

SEQ ID NO: 413041 - DNA, 19 bp, Homo sapiens
gaaagtatgtgatatctga

SEQ ID NO: 413042 - DNA, 16 bp, Homo sapiens
gaaagtcaccaggact

SEQ ID NO: 413043 - DNA, 19 bp, Homo sapiens
gaaagtcagacctgtttct

SEQ ID NO: 413044 - DNA, 14 bp, Homo sapiens
gaaagtctatgctt

SEQ ID NO: 413045 - DNA, 19 bp, Homo sapiens
gaaagtcttgtgactagtg

SEQ ID NO: 413046 - DNA, 21 bp, Homo sapiens
gaaagtgaaaaatgtaaaaca

SEQ ID NO: 413047 - DNA, 16 bp, Homo sapiens
gaaagtgaataaaaat

SEQ ID NO: 413048 - DNA, 16 bp, Homo sapiens
gaaagtgaatttgaat

SEQ ID NO: 413049 - DNA, 21 bp, Homo sapiens
gaaagtgatatcccccagcct

SEQ ID NO: 413050 - DNA, 20 bp, Homo sapiens
gaaagtgatttgtaatatga

SEQ ID NO: 413051 - DNA, 11 bp, Homo sapiens
gaaagtgtttt

SEQ ID NO: 413052 - DNA, 15 bp, Homo sapiens
gaaagttctcagaac

SEQ ID NO: 413053 - DNA, 22 bp, Homo sapiens
gaaagtttgttctgcagagact

SEQ ID NO: 413054 - DNA, 18 bp, Homo sapiens
gaaagttttccagtattg

SEQ ID NO: 413055 - DNA, 21 bp, Homo sapiens
gaaataaaaaaaaaaggatga

SEQ ID NO: 413056 - DNA, 14 bp, Homo sapiens
gaacagggcccagg

SEQ ID NO: 413057 - DNA, 20 bp, Homo sapiens
gaacagggcccaggcctgga

SEQ ID NO: 413058 - DNA, 19 bp, Homo sapiens
gaacagtcacccttctggg

SEQ ID NO: 413059 - DNA, 15 bp, Homo sapiens
gaacagtctgaaata

SEQ ID NO: 413060 - DNA, 19 bp, Homo sapiens
gaacagtgattttttttta

SEQ ID NO: 413061 - DNA, 15 bp, Homo sapiens
gaacagtggctgggt

SEQ ID NO: 413062 - DNA, 17 bp, Homo sapiens
gaacagtgtttcccata

SEQ ID NO: 413063 - DNA, 18 bp, Homo sapiens
gaacagtgtttcccataa

SEQ ID NO: 413064 - DNA, 21 bp, Homo sapiens
gaacagtgtttcccataattt

SEQ ID NO: 413065 - DNA, 16 bp, Homo sapiens
gaacagttaagcagcc

SEQ ID NO: 413066 - DNA, 23 bp, Homo sapiens
gaacagtttatgcagtgctgctt

SEQ ID NO: 413067 - DNA, 23 bp, Homo sapiens
gaacatgcagttcattattttgt

SEQ ID NO: 413068 - DNA, 20 bp, Homo sapiens
gaacatggcatgtgaaaagt

SEQ ID NO: 413069 - DNA, 13 bp, Homo sapiens
gaaccaaagctca

SEQ ID NO: 413070 - DNA, 15 bp, Homo sapiens
gaaccaacactaaca

SEQ ID NO: 413071 - DNA, 13 bp, Homo sapiens
gaaccaaggcagc

SEQ ID NO: 413072 - DNA, 15 bp, Homo sapiens
gaaccaaggcagcct

SEQ ID NO: 413073 - DNA, 16 bp, Homo sapiens
gaaccaaggcagcctc

SEQ ID NO: 413074 - DNA, 18 bp, Homo sapiens
gaaccaaggcagcctcca

SEQ ID NO: 413075 - DNA, 23 bp, Homo sapiens
gaaccaagtggaccttgagacca

SEQ ID NO: 413076 - DNA, 17 bp, Homo sapiens
gaaccagcactcccagg

SEQ ID NO: 413077 - DNA, 15 bp, Homo sapiens
gaaccagccctccag

SEQ ID NO: 413078 - DNA, 23 bp, Homo sapiens
gaaccagctctttggtgccagct

SEQ ID NO: 413079 - DNA, 21 bp, Homo sapiens
gaaccaggccttctgatttca

SEQ ID NO: 413080 - DNA, 19 bp, Homo sapiens
gaaccagtttcaggtgttt

SEQ ID NO: 413081 - DNA, 14 bp, Homo sapiens
gaacccacactgca

SEQ ID NO: 413082 - DNA, 15 bp, Homo sapiens
gaacccaggacgctt

SEQ ID NO: 413083 - DNA, 21 bp, Homo sapiens
gaacccatttgccatgctgct

SEQ ID NO: 413084 - DNA, 14 bp, Homo sapiens
gaacccccctcccc

SEQ ID NO: 413085 - DNA, 16 bp, Homo sapiens
gaacccccctccccaa

SEQ ID NO: 413086 - DNA, 14 bp, Homo sapiens
gaaccccgcagccc

SEQ ID NO: 413087 - DNA, 16 bp, Homo sapiens
gaacccgactgtgaaa

SEQ ID NO: 413088 - DNA, 17 bp, Homo sapiens
gaacccggtcccaggcc

SEQ ID NO: 413089 - DNA, 17 bp, Homo sapiens
gaaccgagcaaagatca

SEQ ID NO: 413090 - DNA, 19 bp, Homo sapiens
gaacctagtactctctgct

SEQ ID NO: 413091 - DNA, 16 bp, Homo sapiens
gaacctccctgggcct

SEQ ID NO: 413092 - DNA, 20 bp, Homo sapiens
gaacctcgttgacatgcaca

SEQ ID NO: 413093 - DNA, 14 bp, Homo sapiens
gaacctcttcccca

SEQ ID NO: 413094 - DNA, 16 bp, Homo sapiens
gaacctgctcttcatt

SEQ ID NO: 413095 - DNA, 16 bp, Homo sapiens
gaacctggaccaaagc

SEQ ID NO: 413096 - DNA, 12 bp, Homo sapiens
gaacctggctgc

SEQ ID NO: 413097 - DNA, 13 bp, Homo sapiens
gaacctgggaagt

SEQ ID NO: 413098 - DNA, 23 bp, Homo sapiens
gaacctttccactcccactgcca

SEQ ID NO: 413099 - DNA, 13 bp, Homo sapiens
gaacctttgtcaa

SEQ ID NO: 413100 - DNA, 18 bp, Homo sapiens
gaaccttttgagtgcctt

SEQ ID NO: 413101 - DNA, 14 bp, Homo sapiens
gaacgagcactggc

SEQ ID NO: 413102 - DNA, 17 bp, Homo sapiens
gaacgagcactggccag

SEQ ID NO: 413103 - DNA, 22 bp, Homo sapiens
gaacgagcactggccagagagg

SEQ ID NO: 413104 - DNA, 18 bp, Homo sapiens
gaacgatttagaaagaag

SEQ ID NO: 413105 - DNA, 12 bp, Homo sapiens
gaacgcagcctc

SEQ ID NO: 413106 - DNA, 21 bp, Homo sapiens
gaacgccagtctcccaggccc

SEQ ID NO: 413107 - DNA, 22 bp, Homo sapiens
gaacgccagtctcccaggcccc

SEQ ID NO: 413108 - DNA, 17 bp, Homo sapiens
gaacgcgtgtgtgcctg

SEQ ID NO: 413109 - DNA, 18 bp, Homo sapiens
gaacgcgtgtgtgcctga

SEQ ID NO: 413110 - DNA, 16 bp, Homo sapiens
gaacgctcagcgctgg

SEQ ID NO: 413111 - DNA, 15 bp, Homo sapiens
gaacgggcctccccg

SEQ ID NO: 413112 - DNA, 18 bp, Homo sapiens
gaacggtgaaggtgacag

SEQ ID NO: 413113 - DNA, 23 bp, Homo sapiens
gaacgtgggagttcagctgcttc

SEQ ID NO: 413114 - DNA, 15 bp, Homo sapiens
gaactaacagaggag

SEQ ID NO: 413115 - DNA, 16 bp, Homo sapiens
gaactaacagaggaga

SEQ ID NO: 413116 - DNA, 22 bp, Homo sapiens
gaactaagttttgtgtgtatat

SEQ ID NO: 413117 - DNA, 18 bp, Homo sapiens
gaactaagttttttactt

SEQ ID NO: 413118 - DNA, 17 bp, Homo sapiens
gaactagtggtggctct

SEQ ID NO: 413119 - DNA, 17 bp, Homo sapiens
gaactcaaaaggagaac

SEQ ID NO: 413120 - DNA, 15 bp, Homo sapiens
gaactcaactttgac

SEQ ID NO: 413121 - DNA, 13 bp, Homo sapiens
gaactcaccgctc

SEQ ID NO: 413122 - DNA, 21 bp, Homo sapiens
gaactcagcagttgacatcca

SEQ ID NO: 413123 - DNA, 17 bp, Homo sapiens
gaactcagccttaagaa

SEQ ID NO: 413124 - DNA, 19 bp, Homo sapiens
gaactccatacagcctcta

SEQ ID NO: 413125 - DNA, 17 bp, Homo sapiens
gaactcctgacctcagg

SEQ ID NO: 413126 - DNA, 20 bp, Homo sapiens
gaactcctgggctcaagcag

SEQ ID NO: 413127 - DNA, 21 bp, Homo sapiens
gaactcctgtgtgtggaaggc

SEQ ID NO: 413128 - DNA, 12 bp, Homo sapiens
gaactccttggc

SEQ ID NO: 413129 - DNA, 14 bp, Homo sapiens
gaactccttggcct

SEQ ID NO: 413130 - DNA, 20 bp, Homo sapiens
gaactccttggcctagccca

SEQ ID NO: 413131 - DNA, 20 bp, Homo sapiens
gaactcgcttctctgtgact

SEQ ID NO: 413132 - DNA, 20 bp, Homo sapiens
gaactctatctgggcctggg

SEQ ID NO: 413133 - DNA, 14 bp, Homo sapiens
gaactctcctcttt

SEQ ID NO: 413134 - DNA, 18 bp, Homo sapiens
gaactctgggctgccatg

SEQ ID NO: 413135 - DNA, 13 bp, Homo sapiens
gaactctgttccc

SEQ ID NO: 413136 - DNA, 19 bp, Homo sapiens
gaactctgttcccccaccc

SEQ ID NO: 413137 - DNA, 15 bp, Homo sapiens
gaactcttcctggaa

SEQ ID NO: 413138 - DNA, 15 bp, Homo sapiens
gaactgaaaaccagt

SEQ ID NO: 413139 - DNA, 15 bp, Homo sapiens
gaactgactttctcc

SEQ ID NO: 413140 - DNA, 17 bp, Homo sapiens
gaactgagccgtgcagc

SEQ ID NO: 413141 - DNA, 15 bp, Homo sapiens
gaactgcatgctgct

SEQ ID NO: 413142 - DNA, 19 bp, Homo sapiens
gaactgcatgctgctggac

SEQ ID NO: 413143 - DNA, 22 bp, Homo sapiens
gaactgcatggacctaacattc

SEQ ID NO: 413144 - DNA, 17 bp, Homo sapiens
gaactgctgctggtcac

SEQ ID NO: 413145 - DNA, 20 bp, Homo sapiens
gaactgctgctggtcacccc

SEQ ID NO: 413146 - DNA, 14 bp, Homo sapiens
gaactgcttgcatt

SEQ ID NO: 413147 - DNA, 16 bp, Homo sapiens
gaactgcttgcccagg

SEQ ID NO: 413148 - DNA, 21 bp, Homo sapiens
gaactgctttatcccacggaa

SEQ ID NO: 413149 - DNA, 19 bp, Homo sapiens
gaactgggaaaacagtgaa

SEQ ID NO: 413150 - DNA, 16 bp, Homo sapiens
gaactgggaagatgct

SEQ ID NO: 413151 - DNA, 17 bp, Homo sapiens
gaactgggcctgttgcc

SEQ ID NO: 413152 - DNA, 16 bp, Homo sapiens
gaactggtccaggcca

SEQ ID NO: 413153 - DNA, 17 bp, Homo sapiens
gaactggtccaggccag

SEQ ID NO: 413154 - DNA, 17 bp, Homo sapiens
gaactggttcttgcctt

SEQ ID NO: 413155 - DNA, 23 bp, Homo sapiens
gaactggtttttctgttccctgc

SEQ ID NO: 413156 - DNA, 12 bp, Homo sapiens
gaactgtgacag

SEQ ID NO: 413157 - DNA, 12 bp, Homo sapiens
gaactgtgcagt

SEQ ID NO: 413158 - DNA, 14 bp, Homo sapiens
gaactgtgcctagt

SEQ ID NO: 413159 - DNA, 11 bp, Homo sapiens
gaactgtgctc

SEQ ID NO: 413160 - DNA, 14 bp, Homo sapiens
gaactgttagatgc

SEQ ID NO: 413161 - DNA, 16 bp, Homo sapiens
gaactgttctggcctc

SEQ ID NO: 413162 - DNA, 22 bp, Homo sapiens
gaactgttctggcctcagacca

SEQ ID NO: 413163 - DNA, 20 bp, Homo sapiens
gaacttaacatgctgtgtaa

SEQ ID NO: 413164 - DNA, 22 bp, Homo sapiens
gaacttaacatgctgtgtaagc

SEQ ID NO: 413165 - DNA, 19 bp, Homo sapiens
gaacttacacttggagccc

SEQ ID NO: 413166 - DNA, 21 bp, Homo sapiens
gaacttacacttggagcccgt

SEQ ID NO: 413167 - DNA, 22 bp, Homo sapiens
gaacttcaagaagtaagagcta

SEQ ID NO: 413168 - DNA, 22 bp, Homo sapiens
gaatggtgggctccagagtagg

SEQ ID NO: 413169 - DNA, 18 bp, Homo sapiens
gaatgtaagaaaacaaaa

SEQ ID NO: 413170 - DNA, 11 bp, Homo sapiens
gaatgtaatca

SEQ ID NO: 413171 - DNA, 13 bp, Homo sapiens
gaatgtaatcaat

SEQ ID NO: 413172 - DNA, 13 bp, Homo sapiens
gaatgtacaaaga

SEQ ID NO: 413173 - DNA, 15 bp, Homo sapiens
gaatgtacaaagata

SEQ ID NO: 413174 - DNA, 18 bp, Homo sapiens
gaatgtagcatctgagaa

SEQ ID NO: 413175 - DNA, 15 bp, Homo sapiens
gaatgtatcaggaaa

SEQ ID NO: 413176 - DNA, 16 bp, Homo sapiens
gaatgtatcaggaaat

SEQ ID NO: 413177 - DNA, 22 bp, Homo sapiens
gaatgtatctagtggtctgatt

SEQ ID NO: 413178 - DNA, 16 bp, Homo sapiens
gaatgtcacaaattga

SEQ ID NO: 413179 - DNA, 20 bp, Homo sapiens
gaatgtcagtgtgactgatc

SEQ ID NO: 413180 - DNA, 16 bp, Homo sapiens
gaatgtcattatttga

SEQ ID NO: 413181 - DNA, 14 bp, Homo sapiens
gaatgtcatttgct

SEQ ID NO: 413182 - DNA, 19 bp, Homo sapiens
gaatgtgatcatctttgct

SEQ ID NO: 413183 - DNA, 15 bp, Homo sapiens
gaatgtgcaggtttg

SEQ ID NO: 413184 - DNA, 19 bp, Homo sapiens
gaatgtgcagtgtcttgta

SEQ ID NO: 413185 - DNA, 19 bp, Homo sapiens
gaatgtgcccctggcccat

SEQ ID NO: 413186 - DNA, 20 bp, Homo sapiens
gaatgtggtaagtggaggaa

SEQ ID NO: 413187 - DNA, 22 bp, Homo sapiens
gaatgtggttacttcctactgt

SEQ ID NO: 413188 - DNA, 19 bp, Homo sapiens
gaatgttctgacattaaca

SEQ ID NO: 413189 - DNA, 20 bp, Homo sapiens
gaatgttctgacattaacag

SEQ ID NO: 413190 - DNA, 21 bp, Homo sapiens
gaattaaattaggaataaata

SEQ ID NO: 413191 - DNA, 20 bp, Homo sapiens
gaattaagttatctttaaaa

SEQ ID NO: 413192 - DNA, 14 bp, Homo sapiens
gaattacataacag

SEQ ID NO: 413193 - DNA, 15 bp, Homo sapiens
gaattacataacagg

SEQ ID NO: 413194 - DNA, 20 bp, Homo sapiens
gaattacctgataagggaga

SEQ ID NO: 413195 - DNA, 13 bp, Homo sapiens
gaattagaagaaa

SEQ ID NO: 413196 - DNA, 16 bp, Homo sapiens
gaattattacatcttt

SEQ ID NO: 413197 - DNA, 14 bp, Homo sapiens
gaattatttttgtg

SEQ ID NO: 413198 - DNA, 20 bp, Homo sapiens
gaattatttttgtgtttcta

SEQ ID NO: 413199 - DNA, 17 bp, Homo sapiens
gaattcactaggaggtc

SEQ ID NO: 413200 - DNA, 14 bp, Homo sapiens
gaattcagctgccc

SEQ ID NO: 413201 - DNA, 18 bp, Homo sapiens
gaattcataaaaataacc

SEQ ID NO: 413202 - DNA, 15 bp, Homo sapiens
gaattcatactctgt

SEQ ID NO: 413203 - DNA, 20 bp, Homo sapiens
gaattcatactctgttgcct

SEQ ID NO: 413204 - DNA, 20 bp, Homo sapiens
gaattcccagatagtcccag

SEQ ID NO: 413205 - DNA, 22 bp, Homo sapiens
gaattcccagatagtcccagca

SEQ ID NO: 413206 - DNA, 15 bp, Homo sapiens
cttgcccgccagcct

SEQ ID NO: 413207 - DNA, 16 bp, Homo sapiens
cttgcccgccagcctc

SEQ ID NO: 413208 - DNA, 12 bp, Homo sapiens
cttgccctgagc

SEQ ID NO: 413209 - DNA, 20 bp, Homo sapiens
cttgccctgagctttccggg

SEQ ID NO: 413210 - DNA, 15 bp, Homo sapiens
cttgccctgggccag

SEQ ID NO: 413211 - DNA, 22 bp, Homo sapiens
cttgccctgggccagcccagga

SEQ ID NO: 413212 - DNA, 19 bp, Homo sapiens
cttgccgactggctgtgag

SEQ ID NO: 413213 - DNA, 23 bp, Homo sapiens
cttgccgagagaggcgcgtctgc

SEQ ID NO: 413214 - DNA, 19 bp, Homo sapiens
cttgccgagcctaatgaaa

SEQ ID NO: 413215 - DNA, 14 bp, Homo sapiens
cttgccgctgggag

SEQ ID NO: 413216 - DNA, 21 bp, Homo sapiens
cttgccgggcctgggcctcct

SEQ ID NO: 413217 - DNA, 20 bp, Homo sapiens
cttgcctagggcctggtcca

SEQ ID NO: 413218 - DNA, 17 bp, Homo sapiens
cttgcctcaatgccagt

SEQ ID NO: 413219 - DNA, 17 bp, Homo sapiens
cttgcctccatggtgcc

SEQ ID NO: 413220 - DNA, 22 bp, Homo sapiens
cttgcctccatggtgcctctgg

SEQ ID NO: 413221 - DNA, 12 bp, Homo sapiens
cttgcctcctgt

SEQ ID NO: 413222 - DNA, 13 bp, Homo sapiens
cttgcctctctca

SEQ ID NO: 413223 - DNA, 17 bp, Homo sapiens
cttgcctctctcaggag

SEQ ID NO: 413224 - DNA, 16 bp, Homo sapiens
cttgcggaggtgaaga

SEQ ID NO: 413225 - DNA, 19 bp, Homo sapiens
cttgcggcaccgcccaccc

SEQ ID NO: 413226 - DNA, 15 bp, Homo sapiens
cttgcgtatgtctgt

SEQ ID NO: 413227 - DNA, 15 bp, Homo sapiens
cttgctaagctccag

SEQ ID NO: 413228 - DNA, 15 bp, Homo sapiens
cttgctagccctggg

SEQ ID NO: 413229 - DNA, 19 bp, Homo sapiens
cttgctagtgatacactgt

SEQ ID NO: 413230 - DNA, 19 bp, Homo sapiens
cttgctatataaataaagc

SEQ ID NO: 413231 - DNA, 15 bp, Homo sapiens
cttgctattggaatg

SEQ ID NO: 413232 - DNA, 18 bp, Homo sapiens
cttgctcaataaaggtca

SEQ ID NO: 413233 - DNA, 20 bp, Homo sapiens
cttgctcaataaaggtcata

SEQ ID NO: 413234 - DNA, 21 bp, Homo sapiens
cttgctcagacgagacaccct

SEQ ID NO: 413235 - DNA, 18 bp, Homo sapiens
cttgctcagtgcctcctg

SEQ ID NO: 413236 - DNA, 14 bp, Homo sapiens
cttgctccagggtc

SEQ ID NO: 413237 - DNA, 21 bp, Homo sapiens
cttgctccagggtcttgggct

SEQ ID NO: 413238 - DNA, 22 bp, Homo sapiens
cttgctccagggtcttgggcta

SEQ ID NO: 413239 - DNA, 12 bp, Homo sapiens
cttgctcccaac

SEQ ID NO: 413240 - DNA, 22 bp, Homo sapiens
cttgctcctaagcaaaagggaa

SEQ ID NO: 413241 - DNA, 23 bp, Homo sapiens
cttgctcctgtttaactccctag

SEQ ID NO: 413242 - DNA, 17 bp, Homo sapiens
cttgctccttgaataag

SEQ ID NO: 413243 - DNA, 19 bp, Homo sapiens
cttgctctcccctgccctg

SEQ ID NO: 413244 - DNA, 20 bp, Homo sapiens
cttgctctccctcttctcaa

SEQ ID NO: 413245 - DNA, 19 bp, Homo sapiens
cttgctctgttacccaggc

SEQ ID NO: 413246 - DNA, 19 bp, Homo sapiens
cttgctctttctactctga

SEQ ID NO: 413247 - DNA, 22 bp, Homo sapiens
cttgctctttctactctgaact

SEQ ID NO: 413248 - DNA, 18 bp, Homo sapiens
cttgctgatggcttgaca

SEQ ID NO: 413249 - DNA, 23 bp, Homo sapiens
cttgctgatggcttgacatgtgc

SEQ ID NO: 413250 - DNA, 13 bp, Homo sapiens
cttgctgcacctg

SEQ ID NO: 413251 - DNA, 16 bp, Homo sapiens
cttgctgcacctgagg

SEQ ID NO: 413252 - DNA, 21 bp, Homo sapiens
cttgctgcacctgaggcccag

SEQ ID NO: 413253 - DNA, 12 bp, Homo sapiens
cttgctgccaag

SEQ ID NO: 413254 - DNA, 21 bp, Homo sapiens
cttgctgccaagtcctgcctt

SEQ ID NO: 413255 - DNA, 18 bp, Homo sapiens
cttgctgtaactcagaca

SEQ ID NO: 413256 - DNA, 19 bp, Homo sapiens
cttgctgtaactcagacat

SEQ ID NO: 413257 - DNA, 18 bp, Homo sapiens
cttgctgtgaaacagtgt

SEQ ID NO: 413258 - DNA, 16 bp, Homo sapiens
cttgctgtggtctctt

SEQ ID NO: 413259 - DNA, 18 bp, Homo sapiens
cttgctgtggtctctttg

SEQ ID NO: 413260 - DNA, 15 bp, Homo sapiens
cttgctttgggcttt

SEQ ID NO: 413261 - DNA, 17 bp, Homo sapiens
cttgctttgggctttgc

SEQ ID NO: 413262 - DNA, 23 bp, Homo sapiens
cttgctttgggctttgcaggctc

SEQ ID NO: 413263 - DNA, 12 bp, Homo sapiens
cttggaaaatgt

SEQ ID NO: 413264 - DNA, 17 bp, Homo sapiens
cttggaaacctgccctg

SEQ ID NO: 413265 - DNA, 18 bp, Homo sapiens
cttggaaacctgccctgc

SEQ ID NO: 413266 - DNA, 23 bp, Homo sapiens
cttggaaacctgccctgcctgag

SEQ ID NO: 413267 - DNA, 17 bp, Homo sapiens
cttggaaataataaatt

SEQ ID NO: 413268 - DNA, 14 bp, Homo sapiens
cttggaaatattaa

SEQ ID NO: 413269 - DNA, 18 bp, Homo sapiens
cttggaaatattaaaaga

SEQ ID NO: 413270 - DNA, 18 bp, Homo sapiens
cttggaacatttgggaga

SEQ ID NO: 413271 - DNA, 18 bp, Homo sapiens
cttggaattggaattact

SEQ ID NO: 413272 - DNA, 20 bp, Homo sapiens
cttggaatttgtaacctcag

SEQ ID NO: 413273 - DNA, 22 bp, Homo sapiens
cttggaatttgtaacctcagct

SEQ ID NO: 413274 - DNA, 17 bp, Homo sapiens
cttggacaccatcccct

SEQ ID NO: 413275 - DNA, 21 bp, Homo sapiens
cttggacacttaattctgttc

SEQ ID NO: 413276 - DNA, 15 bp, Homo sapiens
cttggactccctccc

SEQ ID NO: 413277 - DNA, 14 bp, Homo sapiens
cttggactcttgct

SEQ ID NO: 413278 - DNA, 17 bp, Homo sapiens
cttggacttcctggggc

SEQ ID NO: 413279 - DNA, 21 bp, Homo sapiens
cttggacttcctggggccccg

SEQ ID NO: 413280 - DNA, 16 bp, Homo sapiens
cttggagagcagctgg

SEQ ID NO: 413281 - DNA, 18 bp, Homo sapiens
cttggagatctttgcttc

SEQ ID NO: 413282 - DNA, 18 bp, Homo sapiens
cttggagcaccgaggcca

SEQ ID NO: 413283 - DNA, 16 bp, Homo sapiens
cttggagcagagacgg

SEQ ID NO: 413284 - DNA, 21 bp, Homo sapiens
cttggagcagagacggcagcc

SEQ ID NO: 413285 - DNA, 22 bp, Homo sapiens
cttggagcagagacggcagccc

SEQ ID NO: 413286 - DNA, 13 bp, Homo sapiens
cttggagcaggca

SEQ ID NO: 413287 - DNA, 13 bp, Homo sapiens
cttggagctgtcc

SEQ ID NO: 413288 - DNA, 20 bp, Homo sapiens
cttggatccatacaaaacta

SEQ ID NO: 413289 - DNA, 20 bp, Homo sapiens
cttggatttgcatttttgta

SEQ ID NO: 413290 - DNA, 12 bp, Homo sapiens
cttggcaccaaa

SEQ ID NO: 413291 - DNA, 22 bp, Homo sapiens
cttggcaccaaagatgcagccg

SEQ ID NO: 413292 - DNA, 21 bp, Homo sapiens
cttggcacccccatgctgcct

SEQ ID NO: 413293 - DNA, 18 bp, Homo sapiens
cttggcagccgagctcgt

SEQ ID NO: 413294 - DNA, 23 bp, Homo sapiens
cttggccacaacctgaaagacaa

SEQ ID NO: 413295 - DNA, 21 bp, Homo sapiens
cttggccgcacctaaagcagc

SEQ ID NO: 413296 - DNA, 11 bp, Homo sapiens
cttggcctcag

SEQ ID NO: 413297 - DNA, 23 bp, Homo sapiens
cttggcctcagaattcacaaaat

SEQ ID NO: 413298 - DNA, 14 bp, Homo sapiens
cttggcctgacctg

SEQ ID NO: 413299 - DNA, 15 bp, Homo sapiens
cttggcctgtccacc

SEQ ID NO: 413300 - DNA, 22 bp, Homo sapiens
cttggcctgtctcatccccagg

SEQ ID NO: 413301 - DNA, 11 bp, Homo sapiens
cttggccttgt

SEQ ID NO: 413302 - DNA, 16 bp, Homo sapiens
cttggcgtggagcagg

SEQ ID NO: 413303 - DNA, 17 bp, Homo sapiens
cttggcgtggagccagg

SEQ ID NO: 413304 - DNA, 18 bp, Homo sapiens
cttggcgtggagccaggg

SEQ ID NO: 413305 - DNA, 19 bp, Homo sapiens
cttggcgttcctgccaggc

SEQ ID NO: 413306 - DNA, 20 bp, Homo sapiens
cttggcgttcctgccaggct

SEQ ID NO: 413307 - DNA, 24 bp, Homo sapiens
cttggctcactgcaacttctgcct

SEQ ID NO: 413308 - DNA, 16 bp, Homo sapiens
cttggctccatgctcc

SEQ ID NO: 413309 - DNA, 16 bp, Homo sapiens
cttggctcgttctctt

SEQ ID NO: 413310 - DNA, 12 bp, Homo sapiens
cttggctgcccc

SEQ ID NO: 413311 - DNA, 13 bp, Homo sapiens
cttggctgcccca

SEQ ID NO: 413312 - DNA, 14 bp, Homo sapiens
cttggctgtcccct

SEQ ID NO: 413313 - DNA, 23 bp, Homo sapiens
cttggcttcctccgtccacccag

SEQ ID NO: 413314 - DNA, 16 bp, Homo sapiens
cttgggaactccactc

SEQ ID NO: 413315 - DNA, 15 bp, Homo sapiens
cttgggacagccaga

SEQ ID NO: 413316 - DNA, 23 bp, Homo sapiens
cttgggaccgccagatggggcct

SEQ ID NO: 413317 - DNA, 20 bp, Homo sapiens
cttgggactaaatgccctgc

SEQ ID NO: 413318 - DNA, 21 bp, Homo sapiens
cttgggagagggagcaagcct

SEQ ID NO: 413319 - DNA, 18 bp, Homo sapiens
cttgggagcctgaggcag

SEQ ID NO: 413320 - DNA, 19 bp, Homo sapiens
cttgggatgggcacaggct

SEQ ID NO: 413321 - DNA, 13 bp, Homo sapiens
cttgggcagttct

SEQ ID NO: 413322 - DNA, 23 bp, Homo sapiens
cttgggcagttctcactcctagg

SEQ ID NO: 413323 - DNA, 20 bp, Homo sapiens
cttgggcatccacccagtgc

SEQ ID NO: 413324 - DNA, 16 bp, Homo sapiens
cttgggccactgccct

SEQ ID NO: 413325 - DNA, 23 bp, Homo sapiens
cttgggccactgccctctccaca

SEQ ID NO: 413326 - DNA, 21 bp, Homo sapiens
cttgggcccagctgggctctg

SEQ ID NO: 413327 - DNA, 13 bp, Homo sapiens
ctttctgtaaact

SEQ ID NO: 413328 - DNA, 20 bp, Homo sapiens
ctttctgtatcaagcccctg

SEQ ID NO: 413329 - DNA, 19 bp, Homo sapiens
ctttctgtccttttggcac

SEQ ID NO: 413330 - DNA, 15 bp, Homo sapiens
ctttctgtctctctc

SEQ ID NO: 413331 - DNA, 16 bp, Homo sapiens
ctttcttcctctgctg

SEQ ID NO: 413332 - DNA, 21 bp, Homo sapiens
ctttcttctacaaccagagcc

SEQ ID NO: 413333 - DNA, 22 bp, Homo sapiens
ctttcttctacaaccagagccc

SEQ ID NO: 413334 - DNA, 12 bp, Homo sapiens
ctttcttcttgt

SEQ ID NO: 413335 - DNA, 16 bp, Homo sapiens
ctttcttgagcaccag

SEQ ID NO: 413336 - DNA, 19 bp, Homo sapiens
ctttcttgccacacagtgg

SEQ ID NO: 413337 - DNA, 16 bp, Homo sapiens
ctttcttgctggttgt

SEQ ID NO: 413338 - DNA, 12 bp, Homo sapiens
ctttcttgcttc

SEQ ID NO: 413339 - DNA, 14 bp, Homo sapiens
ctttcttggccagt

SEQ ID NO: 413340 - DNA, 16 bp, Homo sapiens
ctttctttactccttt

SEQ ID NO: 413341 - DNA, 19 bp, Homo sapiens
ctttctttactcctttggc

SEQ ID NO: 413342 - DNA, 13 bp, Homo sapiens
ctttctttccaaa

SEQ ID NO: 413343 - DNA, 13 bp, Homo sapiens
ctttctttctcct

SEQ ID NO: 413344 - DNA, 11 bp, Homo sapiens
ctttctttgct

SEQ ID NO: 413345 - DNA, 15 bp, Homo sapiens
ctttctttgctgctg

SEQ ID NO: 413346 - DNA, 21 bp, Homo sapiens
ctttcttttcgccgtggctgc

SEQ ID NO: 413347 - DNA, 20 bp, Homo sapiens
ctttcttttgaatcaatctg

SEQ ID NO: 413348 - DNA, 20 bp, Homo sapiens
ctttctttttattttaaatc

SEQ ID NO: 413349 - DNA, 14 bp, Homo sapiens
ctttctttttcttc

SEQ ID NO: 413350 - DNA, 21 bp, Homo sapiens
ctttgaaatatgcatgtactt

SEQ ID NO: 413351 - DNA, 19 bp, Homo sapiens
ctttgaagcagttgtgtca

SEQ ID NO: 413352 - DNA, 23 bp, Homo sapiens
ctttgaatgctttttgaatgtta

SEQ ID NO: 413353 - DNA, 21 bp, Homo sapiens
ctttgacaattcctagataaa

SEQ ID NO: 413354 - DNA, 16 bp, Homo sapiens
ctttgacatgaaaaga

SEQ ID NO: 413355 - DNA, 22 bp, Homo sapiens
ctttgacctcaatggaggtttg

SEQ ID NO: 413356 - DNA, 13 bp, Homo sapiens
ctttgagaaagaa

SEQ ID NO: 413357 - DNA, 14 bp, Homo sapiens
ctttgagaaagaaa

SEQ ID NO: 413358 - DNA, 15 bp, Homo sapiens
ctttgagaatattat

SEQ ID NO: 413359 - DNA, 20 bp, Homo sapiens
ctttgagataatttaaccct

SEQ ID NO: 413360 - DNA, 13 bp, Homo sapiens
ctttgagcatttt

SEQ ID NO: 413361 - DNA, 21 bp, Homo sapiens
ctttgagcccacaaagcctta

SEQ ID NO: 413362 - DNA, 14 bp, Homo sapiens
ctttgagggactgc

SEQ ID NO: 413363 - DNA, 19 bp, Homo sapiens
ctttgagggactgcctctg

SEQ ID NO: 413364 - DNA, 16 bp, Homo sapiens
ctttgaggtctaaaca

SEQ ID NO: 413365 - DNA, 13 bp, Homo sapiens
ctttgagtaccaa

SEQ ID NO: 413366 - DNA, 20 bp, Homo sapiens
ctttgagtgtcaggctctga

SEQ ID NO: 413367 - DNA, 18 bp, Homo sapiens
ctttgagtttcctcaggc

SEQ ID NO: 413368 - DNA, 22 bp, Homo sapiens
ctttgatattatgtggctttta

SEQ ID NO: 413369 - DNA, 21 bp, Homo sapiens
ctttgatgattaattcacctt

SEQ ID NO: 413370 - DNA, 23 bp, Homo sapiens
ctttgatgtggatgaaaaaaagg

SEQ ID NO: 413371 - DNA, 15 bp, Homo sapiens
ctttgattgttcata

SEQ ID NO: 413372 - DNA, 13 bp, Homo sapiens
ctttgatttaact

SEQ ID NO: 413373 - DNA, 14 bp, Homo sapiens
ctttgcaacaataa

SEQ ID NO: 413374 - DNA, 20 bp, Homo sapiens
ctttgcaacaataataaatg

SEQ ID NO: 413375 - DNA, 16 bp, Homo sapiens
ctttgcaagaaagtca

SEQ ID NO: 413376 - DNA, 17 bp, Homo sapiens
ctttgcacaggaaagag

SEQ ID NO: 413377 - DNA, 20 bp, Homo sapiens
ctttgcactgaagttgtctg

SEQ ID NO: 413378 - DNA, 13 bp, Homo sapiens
ctttgcactgagg

SEQ ID NO: 413379 - DNA, 15 bp, Homo sapiens
ctttgcactgagggc

SEQ ID NO: 413380 - DNA, 19 bp, Homo sapiens
ctttgcagacctgggactt

SEQ ID NO: 413381 - DNA, 22 bp, Homo sapiens
ctttgcagacctgggactttag

SEQ ID NO: 413382 - DNA, 20 bp, Homo sapiens
ctttgcaggcccagcagact

SEQ ID NO: 413383 - DNA, 11 bp, Homo sapiens
ctttgcatgtt

SEQ ID NO: 413384 - DNA, 23 bp, Homo sapiens
ctttgccaaggctctcccctctc

SEQ ID NO: 413385 - DNA, 15 bp, Homo sapiens
ctttgcccaacctca

SEQ ID NO: 413386 - DNA, 22 bp, Homo sapiens
ctttgcccagggtcctgtgcct

SEQ ID NO: 413387 - DNA, 23 bp, Homo sapiens
ctttgcccagggtcctgtgcctg

SEQ ID NO: 413388 - DNA, 19 bp, Homo sapiens
ctttgcccagttcatccca

SEQ ID NO: 413389 - DNA, 14 bp, Homo sapiens
ctttgcccatggaa

SEQ ID NO: 413390 - DNA, 20 bp, Homo sapiens
ctttgcctgtagagccagcc

SEQ ID NO: 413391 - DNA, 22 bp, Homo sapiens
ctttgcctgtagagccagcctt

SEQ ID NO: 413392 - DNA, 18 bp, Homo sapiens
ctttgccttgggctgctc

SEQ ID NO: 413393 - DNA, 19 bp, Homo sapiens
ctttgcgtggatcaagctt

SEQ ID NO: 413394 - DNA, 14 bp, Homo sapiens
ctttgctacgaaga

SEQ ID NO: 413395 - DNA, 19 bp, Homo sapiens
ctttgctccaccccactca

SEQ ID NO: 413396 - DNA, 11 bp, Homo sapiens
ctttgctgcca

SEQ ID NO: 413397 - DNA, 18 bp, Homo sapiens
ctttgctgcccctgtctg

SEQ ID NO: 413398 - DNA, 22 bp, Homo sapiens
ctttgctgctatgaaaatgagc

SEQ ID NO: 413399 - DNA, 23 bp, Homo sapiens
ctttgctgctatgaaaatgagca

SEQ ID NO: 413400 - DNA, 16 bp, Homo sapiens
ctttgctgctgtggaa

SEQ ID NO: 413401 - DNA, 16 bp, Homo sapiens
ctttgctggagtcctg

SEQ ID NO: 413402 - DNA, 20 bp, Homo sapiens
ctttgctggagtcctgttct

SEQ ID NO: 413403 - DNA, 21 bp, Homo sapiens
ctttgctgtgaggctgtcctg

SEQ ID NO: 413404 - DNA, 22 bp, Homo sapiens
gacctttatttattaaacttca

SEQ ID NO: 413405 - DNA, 17 bp, Homo sapiens
gacctttcagctgtgaa

SEQ ID NO: 413406 - DNA, 20 bp, Homo sapiens
gacgaggcaggggctctgct

SEQ ID NO: 413407 - DNA, 16 bp, Homo sapiens
gacgagggagtgtctg

SEQ ID NO: 413408 - DNA, 22 bp, Homo sapiens
gacgagggagtgtctgtaagga

SEQ ID NO: 413409 - DNA, 13 bp, Homo sapiens
gacgcacacagct

SEQ ID NO: 413410 - DNA, 14 bp, Homo sapiens
gacgcagcagctgg

SEQ ID NO: 413411 - DNA, 18 bp, Homo sapiens
gacgcagggagaccctgg

SEQ ID NO: 413412 - DNA, 17 bp, Homo sapiens
gacgccaaggaggtggg

SEQ ID NO: 413413 - DNA, 14 bp, Homo sapiens
gacgccacagccca

SEQ ID NO: 413414 - DNA, 12 bp, Homo sapiens
gacgcctggctc

SEQ ID NO: 413415 - DNA, 15 bp, Homo sapiens
gacgcctggctccag

SEQ ID NO: 413416 - DNA, 14 bp, Homo sapiens
gacggaagtggcct

SEQ ID NO: 413417 - DNA, 14 bp, Homo sapiens
gacggacatccagg

SEQ ID NO: 413418 - DNA, 14 bp, Homo sapiens
gacggatggaagga

SEQ ID NO: 413419 - DNA, 12 bp, Homo sapiens
gacggcagcccc

SEQ ID NO: 413420 - DNA, 13 bp, Homo sapiens
gacggcagcccca

SEQ ID NO: 413421 - DNA, 11 bp, Homo sapiens
gacggccctgc

SEQ ID NO: 413422 - DNA, 12 bp, Homo sapiens
gacggccctgca

SEQ ID NO: 413423 - DNA, 13 bp, Homo sapiens
gacggccctgcaa

SEQ ID NO: 413424 - DNA, 15 bp, Homo sapiens
gacggcctgatgctc

SEQ ID NO: 413425 - DNA, 22 bp, Homo sapiens
gacggcctgatgctccctcccc

SEQ ID NO: 413426 - DNA, 14 bp, Homo sapiens
gacggctcctcccc

SEQ ID NO: 413427 - DNA, 12 bp, Homo sapiens
gacgggacagcg

SEQ ID NO: 413428 - DNA, 19 bp, Homo sapiens
gacgggacagcggcccggc

SEQ ID NO: 413429 - DNA, 21 bp, Homo sapiens
gacgggacagcggcccggccc

SEQ ID NO: 413430 - DNA, 15 bp, Homo sapiens
gacggggcagagctg

SEQ ID NO: 413431 - DNA, 16 bp, Homo sapiens
gacgggggctgcttct

SEQ ID NO: 413432 - DNA, 17 bp, Homo sapiens
gacgggggctgcttctc

SEQ ID NO: 413433 - DNA, 21 bp, Homo sapiens
gacggtcctttaggcagcctg

SEQ ID NO: 413434 - DNA, 21 bp, Homo sapiens
gacgtcctgccacctggggca

SEQ ID NO: 413435 - DNA, 20 bp, Homo sapiens
gacgtctggggtgtggggat

SEQ ID NO: 413436 - DNA, 22 bp, Homo sapiens
gacgtgaacgttttaataattt

SEQ ID NO: 413437 - DNA, 15 bp, Homo sapiens
gacgtgagtggggag

SEQ ID NO: 413438 - DNA, 20 bp, Homo sapiens
gacgtgcacttggtgctgcg

SEQ ID NO: 413439 - DNA, 20 bp, Homo sapiens
gacgtggtcagggcagggct

SEQ ID NO: 413440 - DNA, 21 bp, Homo sapiens
gacgtggtcagggcagggctc

SEQ ID NO: 413441 - DNA, 20 bp, Homo sapiens
gacgtgttatgactccagaa

SEQ ID NO: 413442 - DNA, 16 bp, Homo sapiens
gacgttgctttttcac

SEQ ID NO: 413443 - DNA, 17 bp, Homo sapiens
gacgttggttctgcact

SEQ ID NO: 413444 - DNA, 14 bp, Homo sapiens
gactaaagagagaa

SEQ ID NO: 413445 - DNA, 22 bp, Homo sapiens
gactaaagcatcacacagtggc

SEQ ID NO: 413446 - DNA, 20 bp, Homo sapiens
gactaacataaaatctgtga

SEQ ID NO: 413447 - DNA, 22 bp, Homo sapiens
gactaacataaaatctgtgaat

SEQ ID NO: 413448 - DNA, 13 bp, Homo sapiens
gactaacctttgt

SEQ ID NO: 413449 - DNA, 23 bp, Homo sapiens
gactaagccctgtcgagacactt

SEQ ID NO: 413450 - DNA, 18 bp, Homo sapiens
gactaatttaaaaaataa

SEQ ID NO: 413451 - DNA, 15 bp, Homo sapiens
gactacctataaatg

SEQ ID NO: 413452 - DNA, 19 bp, Homo sapiens
gactagacctccagctgtt

SEQ ID NO: 413453 - DNA, 16 bp, Homo sapiens
gactagacgttcattt

SEQ ID NO: 413454 - DNA, 11 bp, Homo sapiens
gactagcagct

SEQ ID NO: 413455 - DNA, 16 bp, Homo sapiens
gactagcaggcatgcc

SEQ ID NO: 413456 - DNA, 12 bp, Homo sapiens
gactaggagacc

SEQ ID NO: 413457 - DNA, 19 bp, Homo sapiens
gactagggaagggaggtct

SEQ ID NO: 413458 - DNA, 17 bp, Homo sapiens
gactagggattcaggct

SEQ ID NO: 413459 - DNA, 14 bp, Homo sapiens
gactagtacaaatt

SEQ ID NO: 413460 - DNA, 13 bp, Homo sapiens
gactagtgctgaa

SEQ ID NO: 413461 - DNA, 14 bp, Homo sapiens
gactagtgctgaag

SEQ ID NO: 413462 - DNA, 15 bp, Homo sapiens
gactagtgctgaagc

SEQ ID NO: 413463 - DNA, 16 bp, Homo sapiens
gactagtgctgaagct

SEQ ID NO: 413464 - DNA, 17 bp, Homo sapiens
gactagtgctgaagctt

SEQ ID NO: 413465 - DNA, 17 bp, Homo sapiens
gactagtttgttattaa

SEQ ID NO: 413466 - DNA, 15 bp, Homo sapiens
gactataaacattaa

SEQ ID NO: 413467 - DNA, 21 bp, Homo sapiens
gactatataaagtactactgt

SEQ ID NO: 413468 - DNA, 16 bp, Homo sapiens
gactatatagagatgt

SEQ ID NO: 413469 - DNA, 19 bp, Homo sapiens
gactatgtgtcatgatttc

SEQ ID NO: 413470 - DNA, 21 bp, Homo sapiens
gactatttaaacttataaatc

SEQ ID NO: 413471 - DNA, 15 bp, Homo sapiens
gactcactcataaag

SEQ ID NO: 413472 - DNA, 17 bp, Homo sapiens
gactcagacaggaaagg

SEQ ID NO: 413473 - DNA, 22 bp, Homo sapiens
gactcaggatttaaaaactgga

SEQ ID NO: 413474 - DNA, 22 bp, Homo sapiens
gactcagggccatgcctgcccc

SEQ ID NO: 413475 - DNA, 23 bp, Homo sapiens
gactcaggtggtgtccttcttcc

SEQ ID NO: 413476 - DNA, 17 bp, Homo sapiens
gactcaggttccagaac

SEQ ID NO: 413477 - DNA, 19 bp, Homo sapiens
gactccagaatctgctgtt

SEQ ID NO: 413478 - DNA, 18 bp, Homo sapiens
gactccaggatcctcctg

SEQ ID NO: 413479 - DNA, 16 bp, Homo sapiens
gactcccaaagagctg

SEQ ID NO: 413480 - DNA, 21 bp, Homo sapiens
gactccccgcccgccctcctc

SEQ ID NO: 413481 - DNA, 14 bp, Homo sapiens
gactccctccatgt

SEQ ID NO: 413482 - DNA, 13 bp, Homo sapiens
gactccctcccca

SEQ ID NO: 413483 - DNA, 16 bp, Homo sapiens
gactccctcctcacct

SEQ ID NO: 413484 - DNA, 19 bp, Homo sapiens
gactccctcctcacctctg

SEQ ID NO: 413485 - DNA, 21 bp, Homo sapiens
gactcctcgggcaagggccgt

SEQ ID NO: 413486 - DNA, 21 bp, Homo sapiens
gactcctgattgctctggaag

SEQ ID NO: 413487 - DNA, 23 bp, Homo sapiens
gactcctgattgctctggaagcc

SEQ ID NO: 413488 - DNA, 23 bp, Homo sapiens
gactccttctccccaatcacgag

SEQ ID NO: 413489 - DNA, 19 bp, Homo sapiens
gactcgagagggctgagcc

SEQ ID NO: 413490 - DNA, 20 bp, Homo sapiens
gactcgagagggctgagccc

SEQ ID NO: 413491 - DNA, 21 bp, Homo sapiens
gactcgagagggctgagcccc

SEQ ID NO: 413492 - DNA, 22 bp, Homo sapiens
gactcgggctaagtccagctct

SEQ ID NO: 413493 - DNA, 21 bp, Homo sapiens
gactcgttctcgtgacccagt

SEQ ID NO: 413494 - DNA, 20 bp, Homo sapiens
gactctaaacacacaagtag

SEQ ID NO: 413495 - DNA, 23 bp, Homo sapiens
gactctaaacacacaagtagatt

SEQ ID NO: 413496 - DNA, 12 bp, Homo sapiens
gactctaaatgc

SEQ ID NO: 413497 - DNA, 21 bp, Homo sapiens
gactctctcctctctctccct

SEQ ID NO: 413498 - DNA, 15 bp, Homo sapiens
gactctgaaaaacat

SEQ ID NO: 413499 - DNA, 13 bp, Homo sapiens
gactctgaggtgt

SEQ ID NO: 413500 - DNA, 16 bp, Homo sapiens
gactctgccccttctg

SEQ ID NO: 413501 - DNA, 17 bp, Homo sapiens
gactctgccccttctgt

SEQ ID NO: 413502 - DNA, 15 bp, Homo sapiens
gactctgccttccag

SEQ ID NO: 413503 - DNA, 15 bp, Homo sapiens
gactctgcttggctg

SEQ ID NO: 413504 - DNA, 14 bp, Homo sapiens
gactctgtgagatt

SEQ ID NO: 413505 - DNA, 18 bp, Homo sapiens
gactctgtggggccacac

SEQ ID NO: 413506 - DNA, 15 bp, Homo sapiens
gactcttgctctttc

SEQ ID NO: 413507 - DNA, 19 bp, Homo sapiens
gactctttgcaacagcact

SEQ ID NO: 413508 - DNA, 23 bp, Homo sapiens
gactttccttagacccgccaggt

SEQ ID NO: 413509 - DNA, 19 bp, Homo sapiens
gactttctacacctgttgc

SEQ ID NO: 413510 - DNA, 20 bp, Homo sapiens
gactttgattgcacattgtt

SEQ ID NO: 413511 - DNA, 12 bp, Homo sapiens
gactttgttaca

SEQ ID NO: 413512 - DNA, 21 bp, Homo sapiens
gacttttaatgtcatttgtta

SEQ ID NO: 413513 - DNA, 19 bp, Homo sapiens
gacttttacagcttttctc

SEQ ID NO: 413514 - DNA, 17 bp, Homo sapiens
gacttttccaagccctt

SEQ ID NO: 413515 - DNA, 18 bp, Homo sapiens
gacttttcgttaacattg

SEQ ID NO: 413516 - DNA, 19 bp, Homo sapiens
gactttttagccagtgact

SEQ ID NO: 413517 - DNA, 24 bp, Homo sapiens
gagaaaaaaaaagccactaaggtc

SEQ ID NO: 413518 - DNA, 15 bp, Homo sapiens
gagaaaaaaacagca

SEQ ID NO: 413519 - DNA, 14 bp, Homo sapiens
gagaaaaagagaga

SEQ ID NO: 413520 - DNA, 12 bp, Homo sapiens
gagaaaacactt

SEQ ID NO: 413521 - DNA, 14 bp, Homo sapiens
gagaaaacactttc

SEQ ID NO: 413522 - DNA, 15 bp, Homo sapiens
gagaaaacagaccta

SEQ ID NO: 413523 - DNA, 16 bp, Homo sapiens
gagaaaacttatttga

SEQ ID NO: 413524 - DNA, 18 bp, Homo sapiens
gagaaaacttatttgagt

SEQ ID NO: 413525 - DNA, 22 bp, Homo sapiens
gagaaaacttatttgagtgatt

SEQ ID NO: 413526 - DNA, 14 bp, Homo sapiens
gagaaaagattaaa

SEQ ID NO: 413527 - DNA, 21 bp, Homo sapiens
gagaaaatggacgtgttatga

SEQ ID NO: 413528 - DNA, 21 bp, Homo sapiens
gagaaacccaagtggaatcat

SEQ ID NO: 413529 - DNA, 21 bp, Homo sapiens
gagaaaccttattgtacctct

SEQ ID NO: 413530 - DNA, 17 bp, Homo sapiens
gagaaacgtccatctct

SEQ ID NO: 413531 - DNA, 23 bp, Homo sapiens
gagaaacttgtaatggtctctga

SEQ ID NO: 413532 - DNA, 12 bp, Homo sapiens
gagaaagaaata

SEQ ID NO: 413533 - DNA, 15 bp, Homo sapiens
gagaaagcccacctg

SEQ ID NO: 413534 - DNA, 16 bp, Homo sapiens
gagaaagcccacctgg

SEQ ID NO: 413535 - DNA, 21 bp, Homo sapiens
gagaaaggatggcagcctcag

SEQ ID NO: 413536 - DNA, 21 bp, Homo sapiens
gagaaagtactcagaggctga

SEQ ID NO: 413537 - DNA, 18 bp, Homo sapiens
gagaaagtgtgagcaaac

SEQ ID NO: 413538 - DNA, 23 bp, Homo sapiens
gagaaagttagagtacagatcct

SEQ ID NO: 413539 - DNA, 16 bp, Homo sapiens
gagaaatcacaggggc

SEQ ID NO: 413540 - DNA, 17 bp, Homo sapiens
gagaaatcacaggggcg

SEQ ID NO: 413541 - DNA, 15 bp, Homo sapiens
gagccaccgctgcca

SEQ ID NO: 413542 - DNA, 13 bp, Homo sapiens
gagccacctgggc

SEQ ID NO: 413543 - DNA, 18 bp, Homo sapiens
gagccacctgggctggga

SEQ ID NO: 413544 - DNA, 19 bp, Homo sapiens
gagccacctgtcccacctc

SEQ ID NO: 413545 - DNA, 17 bp, Homo sapiens
gagccactcctgtcccg

SEQ ID NO: 413546 - DNA, 21 bp, Homo sapiens
gagccactcgcagtcgcagga

SEQ ID NO: 413547 - DNA, 14 bp, Homo sapiens
gagccactgggatt

SEQ ID NO: 413548 - DNA, 15 bp, Homo sapiens
gagccagcagggcgg

SEQ ID NO: 413549 - DNA, 23 bp, Homo sapiens
gagccagcagggcgggccaggag

SEQ ID NO: 413550 - DNA, 14 bp, Homo sapiens
gagccagcagggct

SEQ ID NO: 413551 - DNA, 12 bp, Homo sapiens
gagccagccttg

SEQ ID NO: 413552 - DNA, 22 bp, Homo sapiens
gagccaggcctgggtctgtgtc

SEQ ID NO: 413553 - DNA, 16 bp, Homo sapiens
gagccagggctgtcct

SEQ ID NO: 413554 - DNA, 15 bp, Homo sapiens
gagccagggtagagc

SEQ ID NO: 413555 - DNA, 15 bp, Homo sapiens
gagccagtcccaggg

SEQ ID NO: 413556 - DNA, 14 bp, Homo sapiens
gagccatgggcctg

SEQ ID NO: 413557 - DNA, 21 bp, Homo sapiens
gagcccacgcccgactagcag

SEQ ID NO: 413558 - DNA, 23 bp, Homo sapiens
gagcccacggctaagaggctgct

SEQ ID NO: 413559 - DNA, 11 bp, Homo sapiens
gagcccactcc

SEQ ID NO: 413560 - DNA, 12 bp, Homo sapiens
gagcccactcct

SEQ ID NO: 413561 - DNA, 15 bp, Homo sapiens
gagcccagcacactg

SEQ ID NO: 413562 - DNA, 21 bp, Homo sapiens
gagcccagcacactgcttctc

SEQ ID NO: 413563 - DNA, 24 bp, Homo sapiens
gagcccaggagctgagtcacctcc

SEQ ID NO: 413564 - DNA, 12 bp, Homo sapiens
gagcccaggagt

SEQ ID NO: 413565 - DNA, 12 bp, Homo sapiens
gagcccaggccg

SEQ ID NO: 413566 - DNA, 19 bp, Homo sapiens
gagccccacgtggagctcg

SEQ ID NO: 413567 - DNA, 13 bp, Homo sapiens
gagccccagggtc

SEQ ID NO: 413568 - DNA, 19 bp, Homo sapiens
gagccccagggtcttccct

SEQ ID NO: 413569 - DNA, 21 bp, Homo sapiens
gagcccccaccagcagcacaa

SEQ ID NO: 413570 - DNA, 23 bp, Homo sapiens
gagcccccaccagcagcacaatt

SEQ ID NO: 413571 - DNA, 17 bp, Homo sapiens
gagcccccgccccgccc

SEQ ID NO: 413572 - DNA, 21 bp, Homo sapiens
gagcccccgccccgccccaca

SEQ ID NO: 413573 - DNA, 14 bp, Homo sapiens
gagccccctgcacc

SEQ ID NO: 413574 - DNA, 19 bp, Homo sapiens
gagccccctgcacccaccc

SEQ ID NO: 413575 - DNA, 21 bp, Homo sapiens
gagccccctgcacccacccct

SEQ ID NO: 413576 - DNA, 12 bp, Homo sapiens
gagccccctgga

SEQ ID NO: 413577 - DNA, 13 bp, Homo sapiens
gagccccctggat

SEQ ID NO: 413578 - DNA, 15 bp, Homo sapiens
gagccccctgtcctt

SEQ ID NO: 413579 - DNA, 22 bp, Homo sapiens
gagccccctgtccttcccacgg

SEQ ID NO: 413580 - DNA, 22 bp, Homo sapiens
gagccccctgtgcccacccagg

SEQ ID NO: 413581 - DNA, 14 bp, Homo sapiens
gagccccggagcac

SEQ ID NO: 413582 - DNA, 15 bp, Homo sapiens
gagcccctaccccac

SEQ ID NO: 413583 - DNA, 17 bp, Homo sapiens
gagcccctaccccacac

SEQ ID NO: 413584 - DNA, 22 bp, Homo sapiens
gagcccctatcctgcaccctct

SEQ ID NO: 413585 - DNA, 18 bp, Homo sapiens
gagcccctccccagccag

SEQ ID NO: 413586 - DNA, 13 bp, Homo sapiens
gagcccctcctct

SEQ ID NO: 413587 - DNA, 20 bp, Homo sapiens
gagcccctgtgtgggagggc

SEQ ID NO: 413588 - DNA, 22 bp, Homo sapiens
gagcccgatattctccctgacc

SEQ ID NO: 413589 - DNA, 20 bp, Homo sapiens
gagcccgcacccccaccctt

SEQ ID NO: 413590 - DNA, 16 bp, Homo sapiens
gagcccgcccacctgg

SEQ ID NO: 413591 - DNA, 17 bp, Homo sapiens
gagcccggatgcttctc

SEQ ID NO: 413592 - DNA, 17 bp, Homo sapiens
gagcccggcgcccctgc

SEQ ID NO: 413593 - DNA, 20 bp, Homo sapiens
gagcccggggcagagctcag

SEQ ID NO: 413594 - DNA, 20 bp, Homo sapiens
gagcccgtgcagtacaggca

SEQ ID NO: 413595 - DNA, 20 bp, Homo sapiens
gagccctccctcttcccagc

SEQ ID NO: 413596 - DNA, 20 bp, Homo sapiens
gagccctccttcttgccctg

SEQ ID NO: 413597 - DNA, 20 bp, Homo sapiens
gagaaatgaggaaaagaaaa

SEQ ID NO: 413598 - DNA, 16 bp, Homo sapiens
gagaacaaaacctctt

SEQ ID NO: 413599 - DNA, 23 bp, Homo sapiens
gagaacaagtcacagctgcagct

SEQ ID NO: 413600 - DNA, 13 bp, Homo sapiens
gagaacatggcca

SEQ ID NO: 413601 - DNA, 20 bp, Homo sapiens
gagaaccgagcaaagatcaa

SEQ ID NO: 413602 - DNA, 23 bp, Homo sapiens
gagaaccgagcaaagatcaaaat

SEQ ID NO: 413603 - DNA, 15 bp, Homo sapiens
gagaacgccagtctc

SEQ ID NO: 413604 - DNA, 20 bp, Homo sapiens
gagaactagtggtggctctg

SEQ ID NO: 413605 - DNA, 17 bp, Homo sapiens
gagaactgcttctaaga

SEQ ID NO: 413606 - DNA, 22 bp, Homo sapiens
gagaactggttcttgccttccc

SEQ ID NO: 413607 - DNA, 14 bp, Homo sapiens
gagaactgtgctct

SEQ ID NO: 413608 - DNA, 17 bp, Homo sapiens
gagaactttccattttg

SEQ ID NO: 413609 - DNA, 13 bp, Homo sapiens
gagaacttttcat

SEQ ID NO: 413610 - DNA, 11 bp, Homo sapiens
gagaagaaaga

SEQ ID NO: 413611 - DNA, 12 bp, Homo sapiens
gagaagaaagaa

SEQ ID NO: 413612 - DNA, 21 bp, Homo sapiens
gagaagaaagaagcactctgc

SEQ ID NO: 413613 - DNA, 22 bp, Homo sapiens
gagaagaaagaagcactctgct

SEQ ID NO: 413614 - DNA, 18 bp, Homo sapiens
gagaagctctcgagggaa

SEQ ID NO: 413615 - DNA, 22 bp, Homo sapiens
gagaagcttttgaataaaaact

SEQ ID NO: 413616 - DNA, 22 bp, Homo sapiens
gagaaggacccggaggggcctg

SEQ ID NO: 413617 - DNA, 23 bp, Homo sapiens
gagaaggacccggaggggcctgg

SEQ ID NO: 413618 - DNA, 18 bp, Homo sapiens
gagaaggcaagctggcag

SEQ ID NO: 413619 - DNA, 21 bp, Homo sapiens
gagaaggcctgccccccttcc

SEQ ID NO: 413620 - DNA, 19 bp, Homo sapiens
gagaaggcctggtcagcag

SEQ ID NO: 413621 - DNA, 14 bp, Homo sapiens
gagaaggcgaggag

SEQ ID NO: 413622 - DNA, 18 bp, Homo sapiens
gagaaggctaaagaagac

SEQ ID NO: 413623 - DNA, 16 bp, Homo sapiens
gagaagggcttttctt

SEQ ID NO: 413624 - DNA, 22 bp, Homo sapiens
gagaaggggaggacctctgggc

SEQ ID NO: 413625 - DNA, 18 bp, Homo sapiens
gagaagtatccaattatg

SEQ ID NO: 413626 - DNA, 19 bp, Homo sapiens
gagaagtcagttggagaaa

SEQ ID NO: 413627 - DNA, 16 bp, Homo sapiens
gagaagtgcccctgct

SEQ ID NO: 413628 - DNA, 17 bp, Homo sapiens
gagaagtgcccctgctg

SEQ ID NO: 413629 - DNA, 15 bp, Homo sapiens
gagaagttaagcagc

SEQ ID NO: 413630 - DNA, 18 bp, Homo sapiens
gagaataattgtgtacaa

SEQ ID NO: 413631 - DNA, 19 bp, Homo sapiens
gagaataattgtgtacaaa

SEQ ID NO: 413632 - DNA, 17 bp, Homo sapiens
gagaatagcagtttcac

SEQ ID NO: 413633 - DNA, 12 bp, Homo sapiens
gagaatatatac

SEQ ID NO: 413634 - DNA, 13 bp, Homo sapiens
gagaatcagacct

SEQ ID NO: 413635 - DNA, 14 bp, Homo sapiens
gagaatcctgcctc

SEQ ID NO: 413636 - DNA, 18 bp, Homo sapiens
gagaatctggctcctgtt

SEQ ID NO: 413637 - DNA, 12 bp, Homo sapiens
gagaatgccagc

SEQ ID NO: 413638 - DNA, 23 bp, Homo sapiens
gagaatggcccagtcctctccca

SEQ ID NO: 413639 - DNA, 13 bp, Homo sapiens
gagaatggctctg

SEQ ID NO: 413640 - DNA, 15 bp, Homo sapiens
gagaatgtcatttgc

SEQ ID NO: 413641 - DNA, 19 bp, Homo sapiens
gagaatgtcatttgctaat

SEQ ID NO: 413642 - DNA, 20 bp, Homo sapiens
gagaatgtcatttgctaatg

SEQ ID NO: 413643 - DNA, 18 bp, Homo sapiens
gagaattgaaaaggactc

SEQ ID NO: 413644 - DNA, 20 bp, Homo sapiens
gagacaaaaattatctattt

SEQ ID NO: 413645 - DNA, 16 bp, Homo sapiens
gagacaaaattttagt

SEQ ID NO: 413646 - DNA, 14 bp, Homo sapiens
gagacaaagcagga

SEQ ID NO: 413647 - DNA, 15 bp, Homo sapiens
gagacaaagcaggag

SEQ ID NO: 413648 - DNA, 18 bp, Homo sapiens
gagacaaatctttaagaa

SEQ ID NO: 413649 - DNA, 14 bp, Homo sapiens
gagacaagccctgg

SEQ ID NO: 413650 - DNA, 16 bp, Homo sapiens
gagacaataaaacatt

SEQ ID NO: 413651 - DNA, 16 bp, Homo sapiens
gagacaatgcagatgc

SEQ ID NO: 413652 - DNA, 23 bp, Homo sapiens
gagacaccctaactcttgctcac

SEQ ID NO: 413653 - DNA, 12 bp, Homo sapiens
gagacacctcag

SEQ ID NO: 413654 - DNA, 16 bp, Homo sapiens
gagacacctcagagcc

SEQ ID NO: 413655 - DNA, 21 bp, Homo sapiens
gagacacctcagagccccgca

SEQ ID NO: 413656 - DNA, 13 bp, Homo sapiens
gagacactggtct

SEQ ID NO: 413657 - DNA, 14 bp, Homo sapiens
gagacactggtctc

SEQ ID NO: 413658 - DNA, 20 bp, Homo sapiens
gagacactggtctcagagga

SEQ ID NO: 413659 - DNA, 22 bp, Homo sapiens
gagacactggtctcagaggagg

SEQ ID NO: 413660 - DNA, 22 bp, Homo sapiens
gagacagagaggacgtgggcgg

SEQ ID NO: 413661 - DNA, 13 bp, Homo sapiens
gagacagcaagtt

SEQ ID NO: 413662 - DNA, 16 bp, Homo sapiens
gagacagcaagtttat

SEQ ID NO: 413663 - DNA, 18 bp, Homo sapiens
gagacagccacttggttt

SEQ ID NO: 413664 - DNA, 22 bp, Homo sapiens
gagacagggtttcaccatgttg

SEQ ID NO: 413665 - DNA, 17 bp, Homo sapiens
gagacagtgatctccat

SEQ ID NO: 413666 - DNA, 17 bp, Homo sapiens
gagaccaagccggtgcc

SEQ ID NO: 413667 - DNA, 18 bp, Homo sapiens
gagaccaagccggtgccc

SEQ ID NO: 413668 - DNA, 12 bp, Homo sapiens
gagaccaagctt

SEQ ID NO: 413669 - DNA, 21 bp, Homo sapiens
gagaccaagcttgtttccctg

SEQ ID NO: 413670 - DNA, 20 bp, Homo sapiens
gagaccagaagtgaatggga

SEQ ID NO: 413671 - DNA, 15 bp, Homo sapiens
gagaccagcctttct

SEQ ID NO: 413672 - DNA, 13 bp, Homo sapiens
gagaccaggactc

SEQ ID NO: 413673 - DNA, 22 bp, Homo sapiens
gagaccagttgggagcactgga

SEQ ID NO: 413674 - DNA, 14 bp, Homo sapiens
gagacccccacacc

SEQ ID NO: 413675 - DNA, 23 bp, Homo sapiens
gagacccccacacctcagttccc

SEQ ID NO: 413676 - DNA, 12 bp, Homo sapiens
gagaccctcact

SEQ ID NO: 413677 - DNA, 21 bp, Homo sapiens
gagaccctcttctctgggccc

SEQ ID NO: 413678 - DNA, 22 bp, Homo sapiens
gagaccctggaattcagcaccc

SEQ ID NO: 413679 - DNA, 16 bp, Homo sapiens
gagaccgagtgtggag

SEQ ID NO: 413680 - DNA, 17 bp, Homo sapiens
gagaccgcttcacccct

SEQ ID NO: 413681 - DNA, 20 bp, Homo sapiens
gagacctcatcaggatgaac

SEQ ID NO: 413682 - DNA, 16 bp, Homo sapiens
gagacctggaaccaga

SEQ ID NO: 413683 - DNA, 14 bp, Homo sapiens
gagacgaggcaggg

SEQ ID NO: 413684 - DNA, 16 bp, Homo sapiens
gagacgggaccgggcc

SEQ ID NO: 413685 - DNA, 18 bp, Homo sapiens
gagacgggggcagagagg

SEQ ID NO: 413686 - DNA, 22 bp, Homo sapiens
gagacgtccacccgtttccaag

SEQ ID NO: 413687 - DNA, 22 bp, Homo sapiens
gagacgtttttggaagagtagt

SEQ ID NO: 413688 - DNA, 14 bp, Homo sapiens
gagactaagccctg

SEQ ID NO: 413689 - DNA, 16 bp, Homo sapiens
gagactaagccctgtc

SEQ ID NO: 413690 - DNA, 14 bp, Homo sapiens
gagactatgtgtca

SEQ ID NO: 413691 - DNA, 16 bp, Homo sapiens
gagactcaggcccaca

SEQ ID NO: 413692 - DNA, 17 bp, Homo sapiens
gagactccagaatctgc

SEQ ID NO: 413693 - DNA, 20 bp, Homo sapiens
gagactccagaatctgctgt

SEQ ID NO: 413694 - DNA, 14 bp, Homo sapiens
gagactccatcttg

SEQ ID NO: 413695 - DNA, 12 bp, Homo sapiens
gagactcctcgg

SEQ ID NO: 413696 - DNA, 12 bp, Homo sapiens
gagactctgagg

SEQ ID NO: 413697 - DNA, 19 bp, Homo sapiens
gagactgaaagcagcagct

SEQ ID NO: 413698 - DNA, 20 bp, Homo sapiens
gagactgaaagcagcagcta

SEQ ID NO: 413699 - DNA, 21 bp, Homo sapiens
gagactgaaagcagcagctag

SEQ ID NO: 413700 - DNA, 14 bp, Homo sapiens
gagactgcagagga

SEQ ID NO: 413701 - DNA, 16 bp, Homo sapiens
gagactgcagaggagc

SEQ ID NO: 413702 - DNA, 15 bp, Homo sapiens
gagactgcccaccct

SEQ ID NO: 413703 - DNA, 17 bp, Homo sapiens
gagactgcccaccctgg

SEQ ID NO: 413704 - DNA, 19 bp, Homo sapiens
gagactgcccaccctgggc

SEQ ID NO: 413705 - DNA, 20 bp, Homo sapiens
gagactgcccaccctgggcc

SEQ ID NO: 413706 - DNA, 22 bp, Homo sapiens
gagactgcccaccctgggcctc

SEQ ID NO: 413707 - DNA, 20 bp, Homo sapiens
gagactggccagaggcagct

SEQ ID NO: 413708 - DNA, 21 bp, Homo sapiens
gagactgggaagataggctct

SEQ ID NO: 413709 - DNA, 16 bp, Homo sapiens
gagactggtcctgtgt

SEQ ID NO: 413710 - DNA, 23 bp, Homo sapiens
gagactgtagattgcttctgtag

SEQ ID NO: 413711 - DNA, 12 bp, Homo sapiens
gagactgtccac

SEQ ID NO: 413712 - DNA, 13 bp, Homo sapiens
gagactgtcccga

SEQ ID NO: 413713 - DNA, 16 bp, Homo sapiens
gagactgtcggagagg

SEQ ID NO: 413714 - DNA, 20 bp, Homo sapiens
gagactgtcggagaggctgt

SEQ ID NO: 413715 - DNA, 23 bp, Homo sapiens
gagactgtcggagaggctgtctg

SEQ ID NO: 413716 - DNA, 22 bp, Homo sapiens
gagactgtctcaagagggcact

SEQ ID NO: 413717 - DNA, 23 bp, Homo sapiens
gagactgtgaggcggcagctggg

SEQ ID NO: 413718 - DNA, 23 bp, Homo sapiens
gagacttcaggttgttctgtata

SEQ ID NO: 413719 - DNA, 14 bp, Homo sapiens
gagacttccgtcac

SEQ ID NO: 413720 - DNA, 15 bp, Homo sapiens
gagacttcctctggt

SEQ ID NO: 413721 - DNA, 19 bp, Homo sapiens
gagacttctgcttttcaac

SEQ ID NO: 413722 - DNA, 14 bp, Homo sapiens
gagacttgctctct

SEQ ID NO: 413723 - DNA, 22 bp, Homo sapiens
gagacttttaatcagacaaagt

SEQ ID NO: 413724 - DNA, 14 bp, Homo sapiens
gagagaaaaagaga

SEQ ID NO: 413725 - DNA, 15 bp, Homo sapiens
gagagaaaaagagag

SEQ ID NO: 413726 - DNA, 18 bp, Homo sapiens
gagagaaaaagagagagc

SEQ ID NO: 413727 - DNA, 22 bp, Homo sapiens
gagagaaaacagacctaatgct

SEQ ID NO: 413728 - DNA, 23 bp, Homo sapiens
gagagaaaacagacctaatgctc

SEQ ID NO: 413729 - DNA, 13 bp, Homo sapiens
gagagaaaactta

SEQ ID NO: 413730 - DNA, 21 bp, Homo sapiens
gagctatgcacaccaaattgc

SEQ ID NO: 413731 - DNA, 23 bp, Homo sapiens
gagctatgcacaccaaattgctg

SEQ ID NO: 413732 - DNA, 13 bp, Homo sapiens
gagctatttccat

SEQ ID NO: 413733 - DNA, 17 bp, Homo sapiens
gagctcagaggagtctg

SEQ ID NO: 413734 - DNA, 22 bp, Homo sapiens
gagctcagaggagtctgggaag

SEQ ID NO: 413735 - DNA, 18 bp, Homo sapiens
gagctcagcacagcctca

SEQ ID NO: 413736 - DNA, 19 bp, Homo sapiens
gagctcagcacagcctcac

SEQ ID NO: 413737 - DNA, 16 bp, Homo sapiens
gagctcaggagaaggc

SEQ ID NO: 413738 - DNA, 13 bp, Homo sapiens
gagctcaggagag

SEQ ID NO: 413739 - DNA, 20 bp, Homo sapiens
gagctccacagaagacacgt

SEQ ID NO: 413740 - DNA, 17 bp, Homo sapiens
gagctccaccctcccct

SEQ ID NO: 413741 - DNA, 13 bp, Homo sapiens
gagctcccaggac

SEQ ID NO: 413742 - DNA, 15 bp, Homo sapiens
gagctcccaggacgc

SEQ ID NO: 413743 - DNA, 19 bp, Homo sapiens
gagctccccaatccaaccc

SEQ ID NO: 413744 - DNA, 19 bp, Homo sapiens
gagctcccctggagccagc

SEQ ID NO: 413745 - DNA, 16 bp, Homo sapiens
gagctcctctgggcag

SEQ ID NO: 413746 - DNA, 18 bp, Homo sapiens
gagctcctctgggcagga

SEQ ID NO: 413747 - DNA, 23 bp, Homo sapiens
gagctcgtgtatcctggggctcc

SEQ ID NO: 413748 - DNA, 21 bp, Homo sapiens
gagctctcctgggccagggtc

SEQ ID NO: 413749 - DNA, 13 bp, Homo sapiens
gagctctctcaga

SEQ ID NO: 413750 - DNA, 15 bp, Homo sapiens
gagctcttaatgttg

SEQ ID NO: 413751 - DNA, 17 bp, Homo sapiens
gagctcttagtttttaa

SEQ ID NO: 413752 - DNA, 22 bp, Homo sapiens
gagctcttcaggcctccctctc

SEQ ID NO: 413753 - DNA, 20 bp, Homo sapiens
gagctcttcttgtgaaatgt

SEQ ID NO: 413754 - DNA, 19 bp, Homo sapiens
gagctctttgtctcaccag

SEQ ID NO: 413755 - DNA, 23 bp, Homo sapiens
gagctgaaagggagcccctcctc

SEQ ID NO: 413756 - DNA, 19 bp, Homo sapiens
gagctgaagtactgcaccc

SEQ ID NO: 413757 - DNA, 14 bp, Homo sapiens
gagctgagtcacct

SEQ ID NO: 413758 - DNA, 20 bp, Homo sapiens
gagctgagtcacctcctcca

SEQ ID NO: 413759 - DNA, 23 bp, Homo sapiens
gagctgagtcggctgggcagggc

SEQ ID NO: 413760 - DNA, 16 bp, Homo sapiens
gagctgatccagagca

SEQ ID NO: 413761 - DNA, 18 bp, Homo sapiens
gagctgatttccaggccc

SEQ ID NO: 413762 - DNA, 21 bp, Homo sapiens
gagctgatttccaggcccctg

SEQ ID NO: 413763 - DNA, 13 bp, Homo sapiens
gagctgcagcccc

SEQ ID NO: 413764 - DNA, 20 bp, Homo sapiens
gagctgcagttgtgaaagca

SEQ ID NO: 413765 - DNA, 19 bp, Homo sapiens
gagctgcatggacgcctgg

SEQ ID NO: 413766 - DNA, 20 bp, Homo sapiens
gagctgcatggacgcctggc

SEQ ID NO: 413767 - DNA, 22 bp, Homo sapiens
gagctgcatggacgcctggctc

SEQ ID NO: 413768 - DNA, 11 bp, Homo sapiens
gagctgccagt

SEQ ID NO: 413769 - DNA, 22 bp, Homo sapiens
gagctgcctgctctgcagccca

SEQ ID NO: 413770 - DNA, 14 bp, Homo sapiens
gagctgctctgcta

SEQ ID NO: 413771 - DNA, 12 bp, Homo sapiens
gagctgctggct

SEQ ID NO: 413772 - DNA, 22 bp, Homo sapiens
gagctggatttgggagctctgc

SEQ ID NO: 413773 - DNA, 21 bp, Homo sapiens
gagctggcctattttggacgt

SEQ ID NO: 413774 - DNA, 17 bp, Homo sapiens
gagctggctggcaggtg

SEQ ID NO: 413775 - DNA, 23 bp, Homo sapiens
gagctgggaagctgtactcagag

SEQ ID NO: 413776 - DNA, 16 bp, Homo sapiens
gagctgggagccgggc

SEQ ID NO: 413777 - DNA, 16 bp, Homo sapiens
gagctgggccctgggt

SEQ ID NO: 413778 - DNA, 13 bp, Homo sapiens
gagctggggccac

SEQ ID NO: 413779 - DNA, 16 bp, Homo sapiens
gagctgggtaccaggc

SEQ ID NO: 413780 - DNA, 17 bp, Homo sapiens
gagctgggtaccaggcc

SEQ ID NO: 413781 - DNA, 15 bp, Homo sapiens
gagctgggtggcctg

SEQ ID NO: 413782 - DNA, 16 bp, Homo sapiens
gagctgggtggcctgt

SEQ ID NO: 413783 - DNA, 15 bp, Homo sapiens
gagctggtgcccgga

SEQ ID NO: 413784 - DNA, 21 bp, Homo sapiens
gagctgtgttttgtctgagcc

SEQ ID NO: 413785 - DNA, 22 bp, Homo sapiens
gagctgtgttttgtctgagcct

SEQ ID NO: 413786 - DNA, 16 bp, Homo sapiens
gagctgtttatggcct

SEQ ID NO: 413787 - DNA, 18 bp, Homo sapiens
gagcttagccttgtgccc

SEQ ID NO: 413788 - DNA, 20 bp, Homo sapiens
gagcttagccttgtgccctg

SEQ ID NO: 413789 - DNA, 22 bp, Homo sapiens
gagcttagccttgtgccctgcc

SEQ ID NO: 413790 - DNA, 19 bp, Homo sapiens
gagcttattggccactggg

SEQ ID NO: 413791 - DNA, 19 bp, Homo sapiens
gagcttcagggctgggcag

SEQ ID NO: 413792 - DNA, 16 bp, Homo sapiens
gagcttcctgtttcta

SEQ ID NO: 413793 - DNA, 15 bp, Homo sapiens
gagcttggccagaag

SEQ ID NO: 413794 - DNA, 21 bp, Homo sapiens
gagcttggtgcggtaggtgct

SEQ ID NO: 413795 - DNA, 15 bp, Homo sapiens
gagctttccggggag

SEQ ID NO: 413796 - DNA, 17 bp, Homo sapiens
gagctttccggggagga

SEQ ID NO: 413797 - DNA, 18 bp, Homo sapiens
gagctttggacgcacaca

SEQ ID NO: 413798 - DNA, 14 bp, Homo sapiens
gaggaaactcacct

SEQ ID NO: 413799 - DNA, 22 bp, Homo sapiens
gaggaaactcacctgctggccc

SEQ ID NO: 413800 - DNA, 23 bp, Homo sapiens
gaggaaactcacctgctggcccc

SEQ ID NO: 413801 - DNA, 15 bp, Homo sapiens
gaggaaattaaataa

SEQ ID NO: 413802 - DNA, 22 bp, Homo sapiens
gaggaaccagagccatggactc

SEQ ID NO: 413803 - DNA, 21 bp, Homo sapiens
gaggaacgtggttcagagact

SEQ ID NO: 413804 - DNA, 22 bp, Homo sapiens
gaggaacgtggttcagagactg

SEQ ID NO: 413805 - DNA, 23 bp, Homo sapiens
gaggaacgtggttcagagactgg

SEQ ID NO: 413806 - DNA, 15 bp, Homo sapiens
gaggaactccttggc

SEQ ID NO: 413807 - DNA, 14 bp, Homo sapiens
gaggaactgggcct

SEQ ID NO: 413808 - DNA, 15 bp, Homo sapiens
gaggaactggtccag

SEQ ID NO: 413809 - DNA, 22 bp, Homo sapiens
gaggaacttgctgctgtgcctg

SEQ ID NO: 413810 - DNA, 12 bp, Homo sapiens
gaggaagagaga

SEQ ID NO: 413811 - DNA, 18 bp, Homo sapiens
gaggaagagagagaccct

SEQ ID NO: 413812 - DNA, 22 bp, Homo sapiens
gaggaagcccagtagccatttt

SEQ ID NO: 413813 - DNA, 19 bp, Homo sapiens
gaggaagctccagtcctgc

SEQ ID NO: 413814 - DNA, 12 bp, Homo sapiens
gaggaagcttgg

SEQ ID NO: 413815 - DNA, 13 bp, Homo sapiens
gaggaagggactg

SEQ ID NO: 413816 - DNA, 14 bp, Homo sapiens
gaggaagggactgg

SEQ ID NO: 413817 - DNA, 19 bp, Homo sapiens
gaggaagggactggtccag

SEQ ID NO: 413818 - DNA, 12 bp, Homo sapiens
gaggaagggcca

SEQ ID NO: 413819 - DNA, 13 bp, Homo sapiens
gaggaagggccag

SEQ ID NO: 413820 - DNA, 13 bp, Homo sapiens
gaggaaggggggt

SEQ ID NO: 413821 - DNA, 13 bp, Homo sapiens
gaggaaggtgctg

SEQ ID NO: 413822 - DNA, 15 bp, Homo sapiens
gaggaaggtgctgag

SEQ ID NO: 413823 - DNA, 20 bp, Homo sapiens
gaggaatcgaggaaccagag

SEQ ID NO: 413824 - DNA, 18 bp, Homo sapiens
gaggaatcttttactgtg

SEQ ID NO: 413825 - DNA, 13 bp, Homo sapiens
gaggaatgctccc

SEQ ID NO: 413826 - DNA, 15 bp, Homo sapiens
gaggaatgctccccc

SEQ ID NO: 413827 - DNA, 20 bp, Homo sapiens
gaggaatgctctgtgccaga

SEQ ID NO: 413828 - DNA, 20 bp, Homo sapiens
gaggacaaagagaataaaga

SEQ ID NO: 413829 - DNA, 14 bp, Homo sapiens
gaggacaaggtaca

SEQ ID NO: 413830 - DNA, 18 bp, Homo sapiens
gaggaccacagtgggtgg

SEQ ID NO: 413831 - DNA, 22 bp, Homo sapiens
gaggaccactcctgtacactga

SEQ ID NO: 413832 - DNA, 19 bp, Homo sapiens
gaggacccacactgctaca

SEQ ID NO: 413833 - DNA, 21 bp, Homo sapiens
gaggacctccacctgggagat

SEQ ID NO: 413834 - DNA, 14 bp, Homo sapiens
gaggacctctgggc

SEQ ID NO: 413835 - DNA, 17 bp, Homo sapiens
gaggacggggcagagct

SEQ ID NO: 413836 - DNA, 22 bp, Homo sapiens
gaggacggggcagagctgagtc

SEQ ID NO: 413837 - DNA, 19 bp, Homo sapiens
gaggacgtggactggggta

SEQ ID NO: 413838 - DNA, 18 bp, Homo sapiens
gaggactccctccatgtg

SEQ ID NO: 413839 - DNA, 16 bp, Homo sapiens
gaggactccgggacca

SEQ ID NO: 413840 - DNA, 23 bp, Homo sapiens
gaggactccgggaccattgacct

SEQ ID NO: 413841 - DNA, 23 bp, Homo sapiens
gaggactgccccgtgcagactgg

SEQ ID NO: 413842 - DNA, 23 bp, Homo sapiens
gaggactgttgacatccaagctt

SEQ ID NO: 413843 - DNA, 13 bp, Homo sapiens
gaggagaaacaca

SEQ ID NO: 413844 - DNA, 14 bp, Homo sapiens
gaggagacagtcag

SEQ ID NO: 413845 - DNA, 13 bp, Homo sapiens
gaggagaccctgg

SEQ ID NO: 413846 - DNA, 16 bp, Homo sapiens
gaggagagagatgctg

SEQ ID NO: 413847 - DNA, 16 bp, Homo sapiens
gaggagagaggatcac

SEQ ID NO: 413848 - DNA, 17 bp, Homo sapiens
gaggagagtcccagagc

SEQ ID NO: 413849 - DNA, 17 bp, Homo sapiens
gaggagattgctctggg

SEQ ID NO: 413850 - DNA, 16 bp, Homo sapiens
gaggagcacccccagc

SEQ ID NO: 413851 - DNA, 19 bp, Homo sapiens
gaggagcacccccagcctc

SEQ ID NO: 413852 - DNA, 20 bp, Homo sapiens
gaggagcacccccagcctcc

SEQ ID NO: 413853 - DNA, 13 bp, Homo sapiens
gaggagcaggaag

SEQ ID NO: 413854 - DNA, 16 bp, Homo sapiens
gaggagccacctgggc

SEQ ID NO: 413855 - DNA, 22 bp, Homo sapiens
gaggagccacctgggctgggag

SEQ ID NO: 413856 - DNA, 13 bp, Homo sapiens
gaggagccaggca

SEQ ID NO: 413857 - DNA, 14 bp, Homo sapiens
gaggaggaagcaga

SEQ ID NO: 413858 - DNA, 16 bp, Homo sapiens
gaggaggagatggcca

SEQ ID NO: 413859 - DNA, 20 bp, Homo sapiens
gaggaggggtaaatatatgt

SEQ ID NO: 413860 - DNA, 16 bp, Homo sapiens
gaggagggtggaggaa

SEQ ID NO: 413861 - DNA, 19 bp, Homo sapiens
gaggaggtgtggagtggag

SEQ ID NO: 413862 - DNA, 22 bp, Homo sapiens
gaggagtccagtttgtgcaaga

SEQ ID NO: 413863 - DNA, 12 bp, Homo sapiens
gaggagttcaat

SEQ ID NO: 413864 - DNA, 15 bp, Homo sapiens
gaggagttcaatgat

SEQ ID NO: 413865 - DNA, 16 bp, Homo sapiens
gaggagttcaatgatc

SEQ ID NO: 413866 - DNA, 19 bp, Homo sapiens
gaggatcacttgagcccag

SEQ ID NO: 413867 - DNA, 23 bp, Homo sapiens
gaggatgacccggggcagctggc

SEQ ID NO: 413868 - DNA, 12 bp, Homo sapiens
gaggatgttctg

SEQ ID NO: 413869 - DNA, 17 bp, Homo sapiens
gaggattctttccccag

SEQ ID NO: 413870 - DNA, 18 bp, Homo sapiens
gaggattctttccccaga

SEQ ID NO: 413871 - DNA, 18 bp, Homo sapiens
gaggatttaactgtgaac

SEQ ID NO: 413872 - DNA, 19 bp, Homo sapiens
gaggcaacagtgttctgag

SEQ ID NO: 413873 - DNA, 21 bp, Homo sapiens
gaggcaacagtgttctgagcc

SEQ ID NO: 413874 - DNA, 21 bp, Homo sapiens
gaggcaagagaaatgaggaag

SEQ ID NO: 413875 - DNA, 13 bp, Homo sapiens
gaggcaagagaat

SEQ ID NO: 413876 - DNA, 16 bp, Homo sapiens
gaggcaatgactgtga

SEQ ID NO: 413877 - DNA, 20 bp, Homo sapiens
gaggcacacagctgcagaga

SEQ ID NO: 413878 - DNA, 14 bp, Homo sapiens
gaggcaccagctct

SEQ ID NO: 413879 - DNA, 19 bp, Homo sapiens
gaggcaccagctctgtggc

SEQ ID NO: 413880 - DNA, 23 bp, Homo sapiens
gaggcaccagctctgtggcctgt

SEQ ID NO: 413881 - DNA, 16 bp, Homo sapiens
gaggcaccggcgctgc

SEQ ID NO: 413882 - DNA, 14 bp, Homo sapiens
gaggcacctgctgg

SEQ ID NO: 413883 - DNA, 22 bp, Homo sapiens
gaggcagaacctggtggctgga

SEQ ID NO: 413884 - DNA, 11 bp, Homo sapiens
gaggcagagga

SEQ ID NO: 413885 - DNA, 14 bp, Homo sapiens
gaggcagaggacag

SEQ ID NO: 413886 - DNA, 13 bp, Homo sapiens
gaggcagcaacag

SEQ ID NO: 413887 - DNA, 13 bp, Homo sapiens
gaggcagggccct

SEQ ID NO: 413888 - DNA, 15 bp, Homo sapiens
gaggcagggccctgg

SEQ ID NO: 413889 - DNA, 15 bp, Homo sapiens
gaggcaggggctctg

SEQ ID NO: 413890 - DNA, 17 bp, Homo sapiens
gaggcaggggctctgct

SEQ ID NO: 413891 - DNA, 18 bp, Homo sapiens
gaggcaggggctgggcag

SEQ ID NO: 413892 - DNA, 14 bp, Homo sapiens
gaggcagtggcagc

SEQ ID NO: 413893 - DNA, 18 bp, Homo sapiens
gaggcagtttttgttcct

SEQ ID NO: 413894 - DNA, 13 bp, Homo sapiens
gaggcatgacagc

SEQ ID NO: 413895 - DNA, 19 bp, Homo sapiens
gaggcattcccagaggtgg

SEQ ID NO: 413896 - DNA, 21 bp, Homo sapiens
gaggcatttgtcttagagaga

SEQ ID NO: 413897 - DNA, 16 bp, Homo sapiens
gaggccaagcctgcag

SEQ ID NO: 413898 - DNA, 15 bp, Homo sapiens
gaggccaaggcaggt

SEQ ID NO: 413899 - DNA, 17 bp, Homo sapiens
gaggccacatgagtccc

SEQ ID NO: 413900 - DNA, 14 bp, Homo sapiens
gaggccaccccaaa

SEQ ID NO: 413901 - DNA, 21 bp, Homo sapiens
gaggccaccccaaaccccagc

SEQ ID NO: 413902 - DNA, 22 bp, Homo sapiens
gaggccaccccaaaccccagcc

SEQ ID NO: 413903 - DNA, 12 bp, Homo sapiens
gaggccaggccc

SEQ ID NO: 413904 - DNA, 20 bp, Homo sapiens
gaggccaggccctcctgctg

SEQ ID NO: 413905 - DNA, 23 bp, Homo sapiens
gaggccatgattcgcccaaagcc

SEQ ID NO: 413906 - DNA, 24 bp, Homo sapiens
gaggccatgggggcccctcggcat

SEQ ID NO: 413907 - DNA, 12 bp, Homo sapiens
gaggcccagcca

SEQ ID NO: 413908 - DNA, 19 bp, Homo sapiens
gaggcccatgggcagaaga

SEQ ID NO: 413909 - DNA, 14 bp, Homo sapiens
gaggccccaggccc

SEQ ID NO: 413910 - DNA, 17 bp, Homo sapiens
gaggcccccggaggcgc

SEQ ID NO: 413911 - DNA, 13 bp, Homo sapiens
gaggccctaggcg

SEQ ID NO: 413912 - DNA, 17 bp, Homo sapiens
gaggcccttttctggct

SEQ ID NO: 413913 - DNA, 19 bp, Homo sapiens
gaggcccttttctggctcc

SEQ ID NO: 413914 - DNA, 21 bp, Homo sapiens
gaggcccttttctggctcctg

SEQ ID NO: 413915 - DNA, 15 bp, Homo sapiens
gaggccgaggcaggg

SEQ ID NO: 413916 - DNA, 15 bp, Homo sapiens
gaggcctcaccctgc

SEQ ID NO: 413917 - DNA, 21 bp, Homo sapiens
gaggcctcaccctgcttgggg

SEQ ID NO: 413918 - DNA, 19 bp, Homo sapiens
gaggcctcagtttctccat

SEQ ID NO: 413919 - DNA, 23 bp, Homo sapiens
gaggcctcagtttctccatcagc

SEQ ID NO: 413920 - DNA, 15 bp, Homo sapiens
gaggcctcatccctc

SEQ ID NO: 413921 - DNA, 15 bp, Homo sapiens
gaggcctgatgctgc

SEQ ID NO: 413922 - DNA, 19 bp, Homo sapiens
gaggcctggactttcctgc

SEQ ID NO: 413923 - DNA, 13 bp, Homo sapiens
gaggcctgggagg

SEQ ID NO: 413924 - DNA, 13 bp, Homo sapiens
gaggcctgggggt

SEQ ID NO: 413925 - DNA, 19 bp, Homo sapiens
gaggcctggtctggagccc

SEQ ID NO: 413926 - DNA, 14 bp, Homo sapiens
gaggcgagccaggc

SEQ ID NO: 413927 - DNA, 16 bp, Homo sapiens
gaggcgagccaggcaa

SEQ ID NO: 413928 - DNA, 12 bp, Homo sapiens
gaggcgaggctg

SEQ ID NO: 413929 - DNA, 14 bp, Homo sapiens
gaggcgaggctgcc

SEQ ID NO: 413930 - DNA, 15 bp, Homo sapiens
gaggcgaggctgcct

SEQ ID NO: 413931 - DNA, 18 bp, Homo sapiens
gaggcgaggctgcctctg

SEQ ID NO: 413932 - DNA, 17 bp, Homo sapiens
gaggcgcccacctgccc

SEQ ID NO: 413933 - DNA, 13 bp, Homo sapiens
gaggcggcagctc

SEQ ID NO: 413934 - DNA, 14 bp, Homo sapiens
gaggcggcagctgg

SEQ ID NO: 413935 - DNA, 17 bp, Homo sapiens
gaggcgggggagcctgg

SEQ ID NO: 413936 - DNA, 20 bp, Homo sapiens
gaggcgggggagcctggagc

SEQ ID NO: 413937 - DNA, 17 bp, Homo sapiens
gaggcggtttgggagaa

SEQ ID NO: 413938 - DNA, 14 bp, Homo sapiens
gaggcgtcctggtg

SEQ ID NO: 413939 - DNA, 21 bp, Homo sapiens
gaggtgggtgagcgggtgggg

SEQ ID NO: 413940 - DNA, 18 bp, Homo sapiens
gaggtggtagctctgagc

SEQ ID NO: 413941 - DNA, 22 bp, Homo sapiens
gaggtggtagctctgagccctc

SEQ ID NO: 413942 - DNA, 19 bp, Homo sapiens
gaggtgtcaccctgcagag

SEQ ID NO: 413943 - DNA, 17 bp, Homo sapiens
gaggtgtggagtggagg

SEQ ID NO: 413944 - DNA, 18 bp, Homo sapiens
gaggtgtggagtggaggg

SEQ ID NO: 413945 - DNA, 22 bp, Homo sapiens
gccacacgctgcccaggctctg

SEQ ID NO: 413946 - DNA, 21 bp, Homo sapiens
gccacacgtctgaccctctcc

SEQ ID NO: 413947 - DNA, 14 bp, Homo sapiens
gccacactcagtcc

SEQ ID NO: 413948 - DNA, 15 bp, Homo sapiens
gccacactcagtccc

SEQ ID NO: 413949 - DNA, 17 bp, Homo sapiens
gccacactcagtccccc

SEQ ID NO: 413950 - DNA, 22 bp, Homo sapiens
gccacacttcaggctcttctcc

SEQ ID NO: 413951 - DNA, 11 bp, Homo sapiens
gccacagaaat

SEQ ID NO: 413952 - DNA, 10 bp, Homo sapiens
gccacagcag

SEQ ID NO: 413953 - DNA, 21 bp, Homo sapiens
gccacagcaggactgaggaca

SEQ ID NO: 413954 - DNA, 16 bp, Homo sapiens
gccacagccaagccca

SEQ ID NO: 413955 - DNA, 18 bp, Homo sapiens
gccacagccaagcccacc

SEQ ID NO: 413956 - DNA, 16 bp, Homo sapiens
gccacagccacctcca

SEQ ID NO: 413957 - DNA, 14 bp, Homo sapiens
gccacagctgctgg

SEQ ID NO: 413958 - DNA, 12 bp, Homo sapiens
gccacaggacac

SEQ ID NO: 413959 - DNA, 13 bp, Homo sapiens
gccacaggccact

SEQ ID NO: 413960 - DNA, 12 bp, Homo sapiens
gccacaggctgc

SEQ ID NO: 413961 - DNA, 18 bp, Homo sapiens
gccacagtggggcccatg

SEQ ID NO: 413962 - DNA, 17 bp, Homo sapiens
gccacatccccgctggc

SEQ ID NO: 413963 - DNA, 20 bp, Homo sapiens
gccacatccccgctggctgg

SEQ ID NO: 413964 - DNA, 23 bp, Homo sapiens
gccacattttgctttataatttc

SEQ ID NO: 413965 - DNA, 14 bp, Homo sapiens
gccaccaccactgt

SEQ ID NO: 413966 - DNA, 15 bp, Homo sapiens
gccaccaccactgtc

SEQ ID NO: 413967 - DNA, 14 bp, Homo sapiens
gccaccacccaccc

SEQ ID NO: 413968 - DNA, 18 bp, Homo sapiens
gccaccacccctccctct

SEQ ID NO: 413969 - DNA, 22 bp, Homo sapiens
gccaccacccctccctctgctc

SEQ ID NO: 413970 - DNA, 18 bp, Homo sapiens
gccaccaccggggcactg

SEQ ID NO: 413971 - DNA, 24 bp, Homo sapiens
gccaccaccggggcactggctgct

SEQ ID NO: 413972 - DNA, 23 bp, Homo sapiens
gcccacttagccgtccatggcac

SEQ ID NO: 413973 - DNA, 19 bp, Homo sapiens
gcccagaacgggcctcccc

SEQ ID NO: 413974 - DNA, 22 bp, Homo sapiens
gcccagaactgcccccactgtc

SEQ ID NO: 413975 - DNA, 15 bp, Homo sapiens
gcccagacaccacag

SEQ ID NO: 413976 - DNA, 16 bp, Homo sapiens
gcccagacaccacaga

SEQ ID NO: 413977 - DNA, 20 bp, Homo sapiens
gcccagacaccacagacgcc

SEQ ID NO: 413978 - DNA, 21 bp, Homo sapiens
gcccagacaccacagacgcca

SEQ ID NO: 413979 - DNA, 19 bp, Homo sapiens
gcccagacccctctggcca

SEQ ID NO: 413980 - DNA, 20 bp, Homo sapiens
gcccagacccctctggccag

SEQ ID NO: 413981 - DNA, 16 bp, Homo sapiens
gcccagagagaccctg

SEQ ID NO: 413982 - DNA, 18 bp, Homo sapiens
gcccagagagaccctgcc

SEQ ID NO: 413983 - DNA, 22 bp, Homo sapiens
gcccagagagaggcgtcctggt

SEQ ID NO: 413984 - DNA, 14 bp, Homo sapiens
gcccagagagctga

SEQ ID NO: 413985 - DNA, 21 bp, Homo sapiens
gcccagagatgggactgggag

SEQ ID NO: 413986 - DNA, 12 bp, Homo sapiens
gccccacccagg

SEQ ID NO: 413987 - DNA, 15 bp, Homo sapiens
gccccacccaggagg

SEQ ID NO: 413988 - DNA, 22 bp, Homo sapiens
gccccacccctaagtgcccaaa

SEQ ID NO: 413989 - DNA, 13 bp, Homo sapiens
gccccacccctcc

SEQ ID NO: 413990 - DNA, 21 bp, Homo sapiens
gccccaccctcgtggacacct

SEQ ID NO: 413991 - DNA, 17 bp, Homo sapiens
gccccacctacttgtga

SEQ ID NO: 413992 - DNA, 12 bp, Homo sapiens
gccccacctgcc

SEQ ID NO: 413993 - DNA, 21 bp, Homo sapiens
gccccacttcacccccaactt

SEQ ID NO: 413994 - DNA, 17 bp, Homo sapiens
gccccagaaaggggaaa

SEQ ID NO: 413995 - DNA, 22 bp, Homo sapiens
gccccagaaatgccgctgtgtc

SEQ ID NO: 413996 - DNA, 21 bp, Homo sapiens
gccccagagaagcctcagtcc

SEQ ID NO: 413997 - DNA, 24 bp, Homo sapiens
gccccagagaagcctcagtccctc

SEQ ID NO: 413998 - DNA, 11 bp, Homo sapiens
gccccagagac

SEQ ID NO: 413999 - DNA, 15 bp, Homo sapiens
gccccagagactcag

SEQ ID NO: 414000 - DNA, 18 bp, Homo sapiens
gccccagagactgcccac

SEQ ID NO: 414001 - DNA, 19 bp, Homo sapiens
gccccagagactgcccacc

SEQ ID NO: 414002 - DNA, 20 bp, Homo sapiens
gccccagagactgcccaccc

SEQ ID NO: 414003 - DNA, 13 bp, Homo sapiens
gccccagagcccc

SEQ ID NO: 414004 - DNA, 14 bp, Homo sapiens
gccccagagctccg

SEQ ID NO: 414005 - DNA, 17 bp, Homo sapiens
gccccagagctccgatg

SEQ ID NO: 414006 - DNA, 17 bp, Homo sapiens
gccccagatctgcctgg

SEQ ID NO: 414007 - DNA, 12 bp, Homo sapiens
gccccagccaag

SEQ ID NO: 414008 - DNA, 13 bp, Homo sapiens
gccccagccagcc

SEQ ID NO: 414009 - DNA, 14 bp, Homo sapiens
gccccagccagccc

SEQ ID NO: 414010 - DNA, 15 bp, Homo sapiens
gccccagccagccct

SEQ ID NO: 414011 - DNA, 22 bp, Homo sapiens
gccccagccagcccttcccagg

SEQ ID NO: 414012 - DNA, 14 bp, Homo sapiens
gccccagcccagcc

SEQ ID NO: 414013 - DNA, 16 bp, Homo sapiens
gccccagccccttctc

SEQ ID NO: 414014 - DNA, 21 bp, Homo sapiens
gccccagccccttctcccagc

SEQ ID NO: 414015 - DNA, 12 bp, Homo sapiens
gccccagcccga

SEQ ID NO: 414016 - DNA, 16 bp, Homo sapiens
gccccagcctccaggc

SEQ ID NO: 414017 - DNA, 17 bp, Homo sapiens
gccccagctggctgggt

SEQ ID NO: 414018 - DNA, 18 bp, Homo sapiens
gccccagctggctgggtc

SEQ ID NO: 414019 - DNA, 19 bp, Homo sapiens
gccccagctgtgactgagg

SEQ ID NO: 414020 - DNA, 12 bp, Homo sapiens
gccccaggcagg

SEQ ID NO: 414021 - DNA, 20 bp, Homo sapiens
gccccaggctcccctggtct

SEQ ID NO: 414022 - DNA, 24 bp, Homo sapiens
gccccaggctcccctggtctcctc

SEQ ID NO: 414023 - DNA, 15 bp, Homo sapiens
gccccagggcctggg

SEQ ID NO: 414024 - DNA, 16 bp, Homo sapiens
gccccagggctgtggg

SEQ ID NO: 414025 - DNA, 23 bp, Homo sapiens
gccccagggtcttccctacctca

SEQ ID NO: 414026 - DNA, 20 bp, Homo sapiens
gccccagggtgagcagggcc

SEQ ID NO: 414027 - DNA, 21 bp, Homo sapiens
gccccaggtgccaccaataaa

SEQ ID NO: 414028 - DNA, 13 bp, Homo sapiens
gccccagtcctgg

SEQ ID NO: 414029 - DNA, 21 bp, Homo sapiens
gccccataattttttttttcc

SEQ ID NO: 414030 - DNA, 14 bp, Homo sapiens
gccccatagaaaac

SEQ ID NO: 414031 - DNA, 16 bp, Homo sapiens
gccccatcagcagctt

SEQ ID NO: 414032 - DNA, 23 bp, Homo sapiens
gccccatccagcatgtgtgtgtc

SEQ ID NO: 414033 - DNA, 14 bp, Homo sapiens
gccccatccctgct

SEQ ID NO: 414034 - DNA, 23 bp, Homo sapiens
gccccatccctgcttgcccgctc

SEQ ID NO: 414035 - DNA, 13 bp, Homo sapiens
gccccatccttcc

SEQ ID NO: 414036 - DNA, 22 bp, Homo sapiens
gccccatccttcccgcagcacc

SEQ ID NO: 414037 - DNA, 23 bp, Homo sapiens
gccccatccttcccgcagcacca

SEQ ID NO: 414038 - DNA, 13 bp, Homo sapiens
gccccatgctctg

SEQ ID NO: 414039 - DNA, 14 bp, Homo sapiens
gccccatgctctgc

SEQ ID NO: 414040 - DNA, 21 bp, Homo sapiens
gccccatgctctgccccaagc

SEQ ID NO: 414041 - DNA, 21 bp, Homo sapiens
gccccattctccctccatggc

SEQ ID NO: 414042 - DNA, 18 bp, Homo sapiens
gcccccaaattgccttca

SEQ ID NO: 414043 - DNA, 12 bp, Homo sapiens
gcccccacccct

SEQ ID NO: 414044 - DNA, 17 bp, Homo sapiens
gcccccacccctacagc

SEQ ID NO: 414045 - DNA, 17 bp, Homo sapiens
gcccccagaaagcctcc

SEQ ID NO: 414046 - DNA, 22 bp, Homo sapiens
gcccccagaaagcctcctgccc

SEQ ID NO: 414047 - DNA, 18 bp, Homo sapiens
gcccccagatagagctgg

SEQ ID NO: 414048 - DNA, 19 bp, Homo sapiens
gcccccagatagagctggg

SEQ ID NO: 414049 - DNA, 18 bp, Homo sapiens
gcccccagctgctcctcg

SEQ ID NO: 414050 - DNA, 18 bp, Homo sapiens
gcccccatctccccaggc

SEQ ID NO: 414051 - DNA, 20 bp, Homo sapiens
gccccccaaatcccagggaa

SEQ ID NO: 414052 - DNA, 15 bp, Homo sapiens
gccccccaccccaca

SEQ ID NO: 414053 - DNA, 17 bp, Homo sapiens
gccccccaccccacaga

SEQ ID NO: 414054 - DNA, 20 bp, Homo sapiens
gccccccaccccacagatca

SEQ ID NO: 414055 - DNA, 11 bp, Homo sapiens
gccccccagag

SEQ ID NO: 414056 - DNA, 14 bp, Homo sapiens
gccccccagagcca

SEQ ID NO: 414057 - DNA, 23 bp, Homo sapiens
gccccccagagccagggctgtcc

SEQ ID NO: 414058 - DNA, 23 bp, Homo sapiens
gcccccccttcccccttttttgt

SEQ ID NO: 414059 - DNA, 13 bp, Homo sapiens
gcccccctcctcc

SEQ ID NO: 414060 - DNA, 15 bp, Homo sapiens
gcccccctcctccag

SEQ ID NO: 414061 - DNA, 15 bp, Homo sapiens
gccccccttcccacc

SEQ ID NO: 414062 - DNA, 22 bp, Homo sapiens
gcccccgagctgggggccatga

SEQ ID NO: 414063 - DNA, 13 bp, Homo sapiens
gcccccgccccgc

SEQ ID NO: 414064 - DNA, 18 bp, Homo sapiens
gcccccgccctcgctccg

SEQ ID NO: 414065 - DNA, 18 bp, Homo sapiens
gcccccgcgggttctaga

SEQ ID NO: 414066 - DNA, 22 bp, Homo sapiens
gcccccgcgggttctagacgcc

SEQ ID NO: 414067 - DNA, 15 bp, Homo sapiens
gcccccgttccagct

SEQ ID NO: 414068 - DNA, 14 bp, Homo sapiens
gccccctcccccgc

SEQ ID NO: 414069 - DNA, 17 bp, Homo sapiens
gccccctcccccgcaga

SEQ ID NO: 414070 - DNA, 18 bp, Homo sapiens
gccccctcccccgcagac

SEQ ID NO: 414071 - DNA, 20 bp, Homo sapiens
gccccctcccccgcagacag

SEQ ID NO: 414072 - DNA, 18 bp, Homo sapiens
gccccctctcctgaagca

SEQ ID NO: 414073 - DNA, 12 bp, Homo sapiens
gccccctgcacc

SEQ ID NO: 414074 - DNA, 13 bp, Homo sapiens
gccccctgcaccc

SEQ ID NO: 414075 - DNA, 20 bp, Homo sapiens
gccccctgcacccacccctg

SEQ ID NO: 414076 - DNA, 13 bp, Homo sapiens
gccccctgcatct

SEQ ID NO: 414077 - DNA, 14 bp, Homo sapiens
gccccctgccagtg

SEQ ID NO: 414078 - DNA, 12 bp, Homo sapiens
gccccctggatg

SEQ ID NO: 414079 - DNA, 21 bp, Homo sapiens
gccccctggatgtcccctgtc

SEQ ID NO: 414080 - DNA, 22 bp, Homo sapiens
gccccctggggggcacagccag

SEQ ID NO: 414081 - DNA, 14 bp, Homo sapiens
gccccctgtccttc

SEQ ID NO: 414082 - DNA, 12 bp, Homo sapiens
gccccctgtgcc

SEQ ID NO: 414083 - DNA, 14 bp, Homo sapiens
gccccctgtgccca

SEQ ID NO: 414084 - DNA, 18 bp, Homo sapiens
gcccccttctcccacact

SEQ ID NO: 414085 - DNA, 23 bp, Homo sapiens
gccccctttcagatgtcttctgc

SEQ ID NO: 414086 - DNA, 22 bp, Homo sapiens
gccccgccccacattccgacaa

SEQ ID NO: 414087 - DNA, 16 bp, Homo sapiens
gccccgccccagagct

SEQ ID NO: 414088 - DNA, 17 bp, Homo sapiens
gccccgccccagagctc

SEQ ID NO: 414089 - DNA, 16 bp, Homo sapiens
gccccgcccccacccc

SEQ ID NO: 414090 - DNA, 15 bp, Homo sapiens
gccccgccccccaga

SEQ ID NO: 414091 - DNA, 18 bp, Homo sapiens
gccccgccccccagagcc

SEQ ID NO: 414092 - DNA, 21 bp, Homo sapiens
gccccgccccccagagccagg

SEQ ID NO: 414093 - DNA, 14 bp, Homo sapiens
gccccgcgcgtgcc

SEQ ID NO: 414094 - DNA, 16 bp, Homo sapiens
gccccggagcaccacg

SEQ ID NO: 414095 - DNA, 19 bp, Homo sapiens
gccccggaggaagcttggg

SEQ ID NO: 414096 - DNA, 21 bp, Homo sapiens
gccccggccactccctgccaa

SEQ ID NO: 414097 - DNA, 22 bp, Homo sapiens
gccccggccactccctgccaac

SEQ ID NO: 414098 - DNA, 19 bp, Homo sapiens
gccccgggctctggccacc

SEQ ID NO: 414099 - DNA, 14 bp, Homo sapiens
gccccggggctggc

SEQ ID NO: 414100 - DNA, 15 bp, Homo sapiens
gccccggggctggca

SEQ ID NO: 414101 - DNA, 19 bp, Homo sapiens
gccccggggctggcaagca

SEQ ID NO: 414102 - DNA, 16 bp, Homo sapiens
gccccggtgtgcggtg

SEQ ID NO: 414103 - DNA, 20 bp, Homo sapiens
gccccgtcaccatctcaggc

SEQ ID NO: 414104 - DNA, 23 bp, Homo sapiens
gccccgtcaccatctcaggccac

SEQ ID NO: 414105 - DNA, 18 bp, Homo sapiens
gccccgtcccctgggcca

SEQ ID NO: 414106 - DNA, 21 bp, Homo sapiens
gccccgtcggactgcccccag

SEQ ID NO: 414107 - DNA, 18 bp, Homo sapiens
gccccgtgaactcaccgc

SEQ ID NO: 414108 - DNA, 13 bp, Homo sapiens
gccccgtgtcccc

SEQ ID NO: 414109 - DNA, 16 bp, Homo sapiens
gccccgtgtcccccca

SEQ ID NO: 414110 - DNA, 18 bp, Homo sapiens
gccccgtgtccccccagg

SEQ ID NO: 414111 - DNA, 16 bp, Homo sapiens
gccccgttccctgtca

SEQ ID NO: 414112 - DNA, 17 bp, Homo sapiens
gcccctagaagggaagg

SEQ ID NO: 414113 - DNA, 16 bp, Homo sapiens
gcccctatcctgcacc

SEQ ID NO: 414114 - DNA, 14 bp, Homo sapiens
gcccctcaccccaa

SEQ ID NO: 414115 - DNA, 16 bp, Homo sapiens
gcccctcaccccaagg

SEQ ID NO: 414116 - DNA, 14 bp, Homo sapiens
gcccctcacctcag

SEQ ID NO: 414117 - DNA, 16 bp, Homo sapiens
gcccctcacctcagga

SEQ ID NO: 414118 - DNA, 20 bp, Homo sapiens
gcccctcacctcaggacccc

SEQ ID NO: 414119 - DNA, 14 bp, Homo sapiens
gcccctcacctggg

SEQ ID NO: 414120 - DNA, 15 bp, Homo sapiens
gcccctcacctgggc

SEQ ID NO: 414121 - DNA, 17 bp, Homo sapiens
gcccctcacctgggcac

SEQ ID NO: 414122 - DNA, 20 bp, Homo sapiens
gcccctcacctgggcacctg

SEQ ID NO: 414123 - DNA, 20 bp, Homo sapiens
gcccctcagagccctgccct

SEQ ID NO: 414124 - DNA, 15 bp, Homo sapiens
gcccctcagcccttg

SEQ ID NO: 414125 - DNA, 14 bp, Homo sapiens
gcccctccagtgtt

SEQ ID NO: 414126 - DNA, 21 bp, Homo sapiens
gcccctcccacacacacccac

SEQ ID NO: 414127 - DNA, 20 bp, Homo sapiens
gcccctcccatggcccagca

SEQ ID NO: 414128 - DNA, 14 bp, Homo sapiens
gcccctccccagcc

SEQ ID NO: 414129 - DNA, 16 bp, Homo sapiens
gcccctccccagccag

SEQ ID NO: 414130 - DNA, 22 bp, Homo sapiens
gcccctccccagccagcccttc

SEQ ID NO: 414131 - DNA, 16 bp, Homo sapiens
gcccctccccagccct

SEQ ID NO: 414132 - DNA, 17 bp, Homo sapiens
gcccctccccagccctt

SEQ ID NO: 414133 - DNA, 13 bp, Homo sapiens
gcccctccccatg

SEQ ID NO: 414134 - DNA, 15 bp, Homo sapiens
gcccctcccccaacc

SEQ ID NO: 414135 - DNA, 22 bp, Homo sapiens
gcccctcccccaacccccaccc

SEQ ID NO: 414136 - DNA, 23 bp, Homo sapiens
gcccctcccccaacccccacccc

SEQ ID NO: 414137 - DNA, 16 bp, Homo sapiens
gcccctccctacctca

SEQ ID NO: 414138 - DNA, 15 bp, Homo sapiens
gcccctccctctgcc

SEQ ID NO: 414139 - DNA, 16 bp, Homo sapiens
gcccctccctctgccc

SEQ ID NO: 414140 - DNA, 18 bp, Homo sapiens
gcccctccctctgcccca

SEQ ID NO: 414141 - DNA, 15 bp, Homo sapiens
gcccctcccttcaac

SEQ ID NO: 414142 - DNA, 14 bp, Homo sapiens
gcccctccgtcccc

SEQ ID NO: 414143 - DNA, 17 bp, Homo sapiens
gcccctccgtccccagg

SEQ ID NO: 414144 - DNA, 19 bp, Homo sapiens
gcccctccgtccccagggt

SEQ ID NO: 414145 - DNA, 22 bp, Homo sapiens
gcccctcctcgggcgcctgcgc

SEQ ID NO: 414146 - DNA, 15 bp, Homo sapiens
gcccctcctctcctc

SEQ ID NO: 414147 - DNA, 19 bp, Homo sapiens
gcccctcctctcctcgtcc

SEQ ID NO: 414148 - DNA, 18 bp, Homo sapiens
gcccctcctctgtgctcc

SEQ ID NO: 414149 - DNA, 19 bp, Homo sapiens
gcccctcctctgtgctccc

SEQ ID NO: 414150 - DNA, 21 bp, Homo sapiens
gcccctcctctgtgctccctc

SEQ ID NO: 414151 - DNA, 13 bp, Homo sapiens
gcccctccttctc

SEQ ID NO: 414152 - DNA, 19 bp, Homo sapiens
gcccctccttctcccctcc

SEQ ID NO: 414153 - DNA, 21 bp, Homo sapiens
gcccctccttctcccctccag

SEQ ID NO: 414154 - DNA, 23 bp, Homo sapiens
gcccctccttctcccctccagac

SEQ ID NO: 414155 - DNA, 19 bp, Homo sapiens
gcccctcgtgacctacagg

SEQ ID NO: 414156 - DNA, 21 bp, Homo sapiens
gcccctctctgtttaccctcc

SEQ ID NO: 414157 - DNA, 15 bp, Homo sapiens
gcccctctgcccagc

SEQ ID NO: 414158 - DNA, 21 bp, Homo sapiens
gcccctctgcccagcttgggc

SEQ ID NO: 414159 - DNA, 22 bp, Homo sapiens
gcccctctgttctggtggcccc

SEQ ID NO: 414160 - DNA, 21 bp, Homo sapiens
gcccctcttgccccccacccc

SEQ ID NO: 414161 - DNA, 16 bp, Homo sapiens
gcccctgaggactgga

SEQ ID NO: 414162 - DNA, 18 bp, Homo sapiens
gcccctgccacctccctg

SEQ ID NO: 414163 - DNA, 12 bp, Homo sapiens
gcccctgccccg

SEQ ID NO: 414164 - DNA, 14 bp, Homo sapiens
gcccctgccccgtc

SEQ ID NO: 414165 - DNA, 16 bp, Homo sapiens
gcccctgccccgtcac

SEQ ID NO: 414166 - DNA, 16 bp, Homo sapiens
gcccctgcccctgccc

SEQ ID NO: 414167 - DNA, 20 bp, Homo sapiens
gcccctgcccctgcccgaga

SEQ ID NO: 414168 - DNA, 14 bp, Homo sapiens
gcccctgcccgaga

SEQ ID NO: 414169 - DNA, 13 bp, Homo sapiens
gcccctgctgcct

SEQ ID NO: 414170 - DNA, 19 bp, Homo sapiens
gcccctgctgcctccccaa

SEQ ID NO: 414171 - DNA, 21 bp, Homo sapiens
gcccctgctgctcctcggcca

SEQ ID NO: 414172 - DNA, 23 bp, Homo sapiens
gcccctgctgctcctcggccaga

SEQ ID NO: 414173 - DNA, 15 bp, Homo sapiens
gcccctgctggacca

SEQ ID NO: 414174 - DNA, 17 bp, Homo sapiens
gcccctgctggaccaag

SEQ ID NO: 414175 - DNA, 19 bp, Homo sapiens
gcccctggcacgtcctcca

SEQ ID NO: 414176 - DNA, 13 bp, Homo sapiens
gcccctggcccag

SEQ ID NO: 414177 - DNA, 18 bp, Homo sapiens
gcccctggcccagcggcc

SEQ ID NO: 414178 - DNA, 22 bp, Homo sapiens
gcccctggcccagcggcccctc

SEQ ID NO: 414179 - DNA, 21 bp, Homo sapiens
gcccctggcccatctcagcct

SEQ ID NO: 414180 - DNA, 12 bp, Homo sapiens
gcccctggggaa

SEQ ID NO: 414181 - DNA, 19 bp, Homo sapiens
gcccctggggaaatagcct

SEQ ID NO: 414182 - DNA, 12 bp, Homo sapiens
gcccctggggcc

SEQ ID NO: 414183 - DNA, 13 bp, Homo sapiens
gcccctggtggca

SEQ ID NO: 414184 - DNA, 17 bp, Homo sapiens
gcccctgtatggcactg

SEQ ID NO: 414185 - DNA, 18 bp, Homo sapiens
gcccctgtgtgggagggc

SEQ ID NO: 414186 - DNA, 18 bp, Homo sapiens
gcccctgtgttggggggc

SEQ ID NO: 414187 - DNA, 22 bp, Homo sapiens
gcccctgttacctaattagagc

SEQ ID NO: 414188 - DNA, 16 bp, Homo sapiens
gccccttaagggttga

SEQ ID NO: 414189 - DNA, 20 bp, Homo sapiens
gccccttaagggttgaaggc

SEQ ID NO: 414190 - DNA, 20 bp, Homo sapiens
gccccttcacttctgaccac

SEQ ID NO: 414191 - DNA, 23 bp, Homo sapiens
gccccttcacttctgaccacact

SEQ ID NO: 414192 - DNA, 12 bp, Homo sapiens
gccccttccccc

SEQ ID NO: 414193 - DNA, 20 bp, Homo sapiens
gccccttctacactctcctg

SEQ ID NO: 414194 - DNA, 20 bp, Homo sapiens
gccccttcttgggccccaga

SEQ ID NO: 414195 - DNA, 20 bp, Homo sapiens
gccccttgctctcccctgcc

SEQ ID NO: 414196 - DNA, 15 bp, Homo sapiens
gccccttgcttctca

SEQ ID NO: 414197 - DNA, 16 bp, Homo sapiens
gccccttgcttctcaa

SEQ ID NO: 414198 - DNA, 13 bp, Homo sapiens
gccccttggctgg

SEQ ID NO: 414199 - DNA, 18 bp, Homo sapiens
gccccttggctggatcag

SEQ ID NO: 414200 - DNA, 19 bp, Homo sapiens
gccccttttacttttttat

SEQ ID NO: 414201 - DNA, 18 bp, Homo sapiens
gcccctttttactcccct

SEQ ID NO: 414202 - DNA, 19 bp, Homo sapiens
gcccctttttactcccctt

SEQ ID NO: 414203 - DNA, 18 bp, Homo sapiens
gcccgaatttctcactcc

SEQ ID NO: 414204 - DNA, 12 bp, Homo sapiens
gcccgacagcct

SEQ ID NO: 414205 - DNA, 17 bp, Homo sapiens
gcccgacagcctggcac

SEQ ID NO: 414206 - DNA, 18 bp, Homo sapiens
gcccgacttgctgttttg

SEQ ID NO: 414207 - DNA, 21 bp, Homo sapiens
gccctgccaagcctggagccc

SEQ ID NO: 414208 - DNA, 22 bp, Homo sapiens
gccctgccaggctgtcagcgcc

SEQ ID NO: 414209 - DNA, 23 bp, Homo sapiens
gccctgccaggctgtcagcgcct

SEQ ID NO: 414210 - DNA, 11 bp, Homo sapiens
gccctgcccaa

SEQ ID NO: 414211 - DNA, 22 bp, Homo sapiens
gccctgcccccatctccccagg

SEQ ID NO: 414212 - DNA, 23 bp, Homo sapiens
gccctgcccccatctccccaggc

SEQ ID NO: 414213 - DNA, 10 bp, Homo sapiens
gccctgccct

SEQ ID NO: 414214 - DNA, 14 bp, Homo sapiens
gccctgccctcact

SEQ ID NO: 414215 - DNA, 19 bp, Homo sapiens
gccctgccctcccccacgg

SEQ ID NO: 414216 - DNA, 13 bp, Homo sapiens
gccctgccctgag

SEQ ID NO: 414217 - DNA, 15 bp, Homo sapiens
gccctgcccttccct

SEQ ID NO: 414218 - DNA, 12 bp, Homo sapiens
gccctgcctccc

SEQ ID NO: 414219 - DNA, 11 bp, Homo sapiens
gccctgcctga

SEQ ID NO: 414220 - DNA, 16 bp, Homo sapiens
gccctgcctgagggcc

SEQ ID NO: 414221 - DNA, 22 bp, Homo sapiens
gccctgcctgagggcccctctg

SEQ ID NO: 414222 - DNA, 15 bp, Homo sapiens
gccctgcctgcccac

SEQ ID NO: 414223 - DNA, 16 bp, Homo sapiens
gccctgcctgcccact

SEQ ID NO: 414224 - DNA, 16 bp, Homo sapiens
gccctgcgttggagcc

SEQ ID NO: 414225 - DNA, 17 bp, Homo sapiens
gccctgcgttggagcca

SEQ ID NO: 414226 - DNA, 19 bp, Homo sapiens
gccctgcgttggagccact

SEQ ID NO: 414227 - DNA, 14 bp, Homo sapiens
gccctgctcaggcc

SEQ ID NO: 414228 - DNA, 15 bp, Homo sapiens
gccctgctcaggcct

SEQ ID NO: 414229 - DNA, 22 bp, Homo sapiens
gccctgctcaggcctcacctgg

SEQ ID NO: 414230 - DNA, 22 bp, Homo sapiens
gccctgctgccgcctcccagcc

SEQ ID NO: 414231 - DNA, 17 bp, Homo sapiens
gccctgctgcttcctaa

SEQ ID NO: 414232 - DNA, 10 bp, Homo sapiens
gccctggcaa

SEQ ID NO: 414233 - DNA, 19 bp, Homo sapiens
gccctggcccagagctgga

SEQ ID NO: 414234 - DNA, 11 bp, Homo sapiens
gccctggctcc

SEQ ID NO: 414235 - DNA, 21 bp, Homo sapiens
gccctggctcccaagggaggc

SEQ ID NO: 414236 - DNA, 19 bp, Homo sapiens
gccctggctcccacaggcc

SEQ ID NO: 414237 - DNA, 16 bp, Homo sapiens
gccctgggagggggct

SEQ ID NO: 414238 - DNA, 20 bp, Homo sapiens
gccctgggccagcccaggat

SEQ ID NO: 414239 - DNA, 16 bp, Homo sapiens
gccctgggctggactg

SEQ ID NO: 414240 - DNA, 17 bp, Homo sapiens
gccctgggctggactgg

SEQ ID NO: 414241 - DNA, 20 bp, Homo sapiens
gccctgggctggactggagg

SEQ ID NO: 414242 - DNA, 19 bp, Homo sapiens
gccctggggagtgagcttg

SEQ ID NO: 414243 - DNA, 12 bp, Homo sapiens
gccctggggtct

SEQ ID NO: 414244 - DNA, 17 bp, Homo sapiens
gccctggggtctctgag

SEQ ID NO: 414245 - DNA, 22 bp, Homo sapiens
gccctggggtctctgagcagtg

SEQ ID NO: 414246 - DNA, 21 bp, Homo sapiens
gccctggggtttccacacagg

SEQ ID NO: 414247 - DNA, 23 bp, Homo sapiens
gccctggggtttccacacaggcc

SEQ ID NO: 414248 - DNA, 16 bp, Homo sapiens
gccctggtccagggaa

SEQ ID NO: 414249 - DNA, 18 bp, Homo sapiens
gccctggtccagggaagc

SEQ ID NO: 414250 - DNA, 20 bp, Homo sapiens
gccctggtccagggaagctg

SEQ ID NO: 414251 - DNA, 15 bp, Homo sapiens
gccctggtgctgcca

SEQ ID NO: 414252 - DNA, 21 bp, Homo sapiens
gccctgtatcaacccagaaac

SEQ ID NO: 414253 - DNA, 17 bp, Homo sapiens
gccctgtccctgtcccc

SEQ ID NO: 414254 - DNA, 20 bp, Homo sapiens
gccctgtccctgtccccctc

SEQ ID NO: 414255 - DNA, 17 bp, Homo sapiens
gccctgtggaagggact

SEQ ID NO: 414256 - DNA, 23 bp, Homo sapiens
gccctgtggaagggactaggagc

SEQ ID NO: 414257 - DNA, 16 bp, Homo sapiens
gccctgtgggagtcca

SEQ ID NO: 414258 - DNA, 17 bp, Homo sapiens
gccctgtgggagtccac

SEQ ID NO: 414259 - DNA, 18 bp, Homo sapiens
gccctgtgggagtccact

SEQ ID NO: 414260 - DNA, 23 bp, Homo sapiens
gccctgttgtgggggtgtcacag

SEQ ID NO: 414261 - DNA, 17 bp, Homo sapiens
gccctgttgtgtataga

SEQ ID NO: 414262 - DNA, 18 bp, Homo sapiens
gcccttcagtccctgagc

SEQ ID NO: 414263 - DNA, 14 bp, Homo sapiens
gcccttccagtggg

SEQ ID NO: 414264 - DNA, 17 bp, Homo sapiens
gcccttccagtgggatt

SEQ ID NO: 414265 - DNA, 22 bp, Homo sapiens
gcccttccatgtcgcctctgca

SEQ ID NO: 414266 - DNA, 13 bp, Homo sapiens
gcccttcccaggc

SEQ ID NO: 414267 - DNA, 12 bp, Homo sapiens
gcccttccctgc

SEQ ID NO: 414268 - DNA, 14 bp, Homo sapiens
gcccttccctgctt

SEQ ID NO: 414269 - DNA, 14 bp, Homo sapiens
gcccttcctctcca

SEQ ID NO: 414270 - DNA, 19 bp, Homo sapiens
gcccttcctctccactgcc

SEQ ID NO: 414271 - DNA, 22 bp, Homo sapiens
gcccttcctctccactgccttc

SEQ ID NO: 414272 - DNA, 22 bp, Homo sapiens
gcccttcctttccctggggtac

SEQ ID NO: 414273 - DNA, 12 bp, Homo sapiens
gcccttctgcct

SEQ ID NO: 414274 - DNA, 20 bp, Homo sapiens
gcccttcttttgaccccttc

SEQ ID NO: 414275 - DNA, 19 bp, Homo sapiens
gcccttgcagttcagcacc

SEQ ID NO: 414276 - DNA, 12 bp, Homo sapiens
gcccttgcccaa

SEQ ID NO: 414277 - DNA, 18 bp, Homo sapiens
gcccttgcccaactccca

SEQ ID NO: 414278 - DNA, 15 bp, Homo sapiens
gcccttgctgggtcc

SEQ ID NO: 414279 - DNA, 22 bp, Homo sapiens
gcccttgctgggtccagggtag

SEQ ID NO: 414280 - DNA, 14 bp, Homo sapiens
gcccttgggacagc

SEQ ID NO: 414281 - DNA, 21 bp, Homo sapiens
gcccttgggacagccagagct

SEQ ID NO: 414282 - DNA, 22 bp, Homo sapiens
gcccttgggacagccagagctg

SEQ ID NO: 414283 - DNA, 15 bp, Homo sapiens
gcccttggggcctgg

SEQ ID NO: 414284 - DNA, 17 bp, Homo sapiens
gcccttggggcctggct

SEQ ID NO: 414285 - DNA, 16 bp, Homo sapiens
gcccttgtcctgccag

SEQ ID NO: 414286 - DNA, 20 bp, Homo sapiens
gcccttgtcctgccagctgc

SEQ ID NO: 414287 - DNA, 22 bp, Homo sapiens
gcccttgtcctgccagctgcct

SEQ ID NO: 414288 - DNA, 17 bp, Homo sapiens
gccttcagattatttcc

SEQ ID NO: 414289 - DNA, 16 bp, Homo sapiens
gccttcattaaatgtt

SEQ ID NO: 414290 - DNA, 23 bp, Homo sapiens
gccttccacgctgtctccagacc

SEQ ID NO: 414291 - DNA, 21 bp, Homo sapiens
gccttccagaaagcaggagca

SEQ ID NO: 414292 - DNA, 12 bp, Homo sapiens
gccttccaggcg

SEQ ID NO: 414293 - DNA, 12 bp, Homo sapiens
gccttcccctcc

SEQ ID NO: 414294 - DNA, 22 bp, Homo sapiens
gccttccccttgaacctcatta

SEQ ID NO: 414295 - DNA, 19 bp, Homo sapiens
gccttccccttttgcctgg

SEQ ID NO: 414296 - DNA, 19 bp, Homo sapiens
gccttccctcactcttcct

SEQ ID NO: 414297 - DNA, 20 bp, Homo sapiens
gccttccctcactcttcctc

SEQ ID NO: 414298 - DNA, 21 bp, Homo sapiens
gccttccctcactcttcctca

SEQ ID NO: 414299 - DNA, 16 bp, Homo sapiens
gccttccgctcccacc

SEQ ID NO: 414300 - DNA, 21 bp, Homo sapiens
gccttccgtgggtcatcccag

SEQ ID NO: 414301 - DNA, 19 bp, Homo sapiens
gctggcttctccctggact

SEQ ID NO: 414302 - DNA, 18 bp, Homo sapiens
gctgggaaccccgcagcc

SEQ ID NO: 414303 - DNA, 19 bp, Homo sapiens
gctgggaaccccgcagccc

SEQ ID NO: 414304 - DNA, 20 bp, Homo sapiens
gctgggaaccccgcagcccg

SEQ ID NO: 414305 - DNA, 22 bp, Homo sapiens
gctgggaaccccgcagcccgtg

SEQ ID NO: 414306 - DNA, 14 bp, Homo sapiens
gctgggactgagcc

SEQ ID NO: 414307 - DNA, 18 bp, Homo sapiens
gctgggagaaaagccaga

SEQ ID NO: 414308 - DNA, 12 bp, Homo sapiens
gctgggagaagg

SEQ ID NO: 414309 - DNA, 13 bp, Homo sapiens
gctgggagaaggt

SEQ ID NO: 414310 - DNA, 14 bp, Homo sapiens
gctgggagagccaa

SEQ ID NO: 414311 - DNA, 19 bp, Homo sapiens
gctgggagcctcgcccctc

SEQ ID NO: 414312 - DNA, 21 bp, Homo sapiens
gctgggagcctcgcccctcca

SEQ ID NO: 414313 - DNA, 15 bp, Homo sapiens
gctgggagctctgca

SEQ ID NO: 414314 - DNA, 19 bp, Homo sapiens
gctgggagggatagagggg

SEQ ID NO: 414315 - DNA, 12 bp, Homo sapiens
gctgggaggggg

SEQ ID NO: 414316 - DNA, 16 bp, Homo sapiens
gctgggattacaggtg

SEQ ID NO: 414317 - DNA, 20 bp, Homo sapiens
gctgggatttcttcgctgct

SEQ ID NO: 414318 - DNA, 21 bp, Homo sapiens
gctgggatttgaactgagccg

SEQ ID NO: 414319 - DNA, 18 bp, Homo sapiens
gctgggcaaagccacaag

SEQ ID NO: 414320 - DNA, 20 bp, Homo sapiens
gctgggcagaggggagagga

SEQ ID NO: 414321 - DNA, 16 bp, Homo sapiens
gctgggcagggccgca

SEQ ID NO: 414322 - DNA, 21 bp, Homo sapiens
gctgggcagggccgcagggcg

SEQ ID NO: 414323 - DNA, 23 bp, Homo sapiens
gctgggcagggccgcagggcgct

SEQ ID NO: 414324 - DNA, 16 bp, Homo sapiens
gctgggcaggtcctgg

SEQ ID NO: 414325 - DNA, 19 bp, Homo sapiens
gctgggcaggtcctgggga

SEQ ID NO: 414326 - DNA, 13 bp, Homo sapiens
gctgggcatactt

SEQ ID NO: 414327 - DNA, 16 bp, Homo sapiens
gctgggcatactttct

SEQ ID NO: 414328 - DNA, 19 bp, Homo sapiens
gctgggcatggtaccagcc

SEQ ID NO: 414329 - DNA, 23 bp, Homo sapiens
gctgggcatggtaccagccctgg

SEQ ID NO: 414330 - DNA, 13 bp, Homo sapiens
gctgggcccagag

SEQ ID NO: 414331 - DNA, 18 bp, Homo sapiens
gctgggcccagaggcaca

SEQ ID NO: 414332 - DNA, 12 bp, Homo sapiens
gctgggcccagc

SEQ ID NO: 414333 - DNA, 13 bp, Homo sapiens
gctgggcccagcc

SEQ ID NO: 414334 - DNA, 19 bp, Homo sapiens
gctgggccccatgctctgc

SEQ ID NO: 414335 - DNA, 22 bp, Homo sapiens
gctgggccccatgctctgcccc

SEQ ID NO: 414336 - DNA, 15 bp, Homo sapiens
gctgggctctgccac

SEQ ID NO: 414337 - DNA, 14 bp, Homo sapiens
gctgggctctgtct

SEQ ID NO: 414338 - DNA, 12 bp, Homo sapiens
gctgggctgagc

SEQ ID NO: 414339 - DNA, 20 bp, Homo sapiens
gctggggaatcccctcgctt

SEQ ID NO: 414340 - DNA, 15 bp, Homo sapiens
gctggggagcagctg

SEQ ID NO: 414341 - DNA, 14 bp, Homo sapiens
gctggggcagaggg

SEQ ID NO: 414342 - DNA, 22 bp, Homo sapiens
gctggggcagaggggcagccgc

SEQ ID NO: 414343 - DNA, 24 bp, Homo sapiens
gctggggcagaggggcagccgcta

SEQ ID NO: 414344 - DNA, 18 bp, Homo sapiens
gctggggcatgtgtgcct

SEQ ID NO: 414345 - DNA, 22 bp, Homo sapiens
gctggggcttttgtgccaggag

SEQ ID NO: 414346 - DNA, 20 bp, Homo sapiens
gctgggggcaggagggccct

SEQ ID NO: 414347 - DNA, 23 bp, Homo sapiens
gctgggggcaggagggccctacc

SEQ ID NO: 414348 - DNA, 20 bp, Homo sapiens
gctgggggcatgggggaggc

SEQ ID NO: 414349 - DNA, 21 bp, Homo sapiens
gctgggggcatgggggaggct

SEQ ID NO: 414350 - DNA, 16 bp, Homo sapiens
gctggggggcagggcc

SEQ ID NO: 414351 - DNA, 22 bp, Homo sapiens
gctggggggcaggggggagagg

SEQ ID NO: 414352 - DNA, 23 bp, Homo sapiens
gctgtttatggcctcagctgcct

SEQ ID NO: 414353 - DNA, 21 bp, Homo sapiens
gctgttttagttaaatttctg

SEQ ID NO: 414354 - DNA, 21 bp, Homo sapiens
gctgttttatgtcatactctg

SEQ ID NO: 414355 - DNA, 11 bp, Homo sapiens
gctgttttctt

SEQ ID NO: 414356 - DNA, 19 bp, Homo sapiens
gctgttttggatgaatgca

SEQ ID NO: 414357 - DNA, 13 bp, Homo sapiens
gctgttttttgtt

SEQ ID NO: 414358 - DNA, 18 bp, Homo sapiens
gctgttttttgtttttta

SEQ ID NO: 414359 - DNA, 15 bp, Homo sapiens
gcttaaaaaaaggaa

SEQ ID NO: 414360 - DNA, 15 bp, Homo sapiens
gcttaaaaatcattg

SEQ ID NO: 414361 - DNA, 11 bp, Homo sapiens
gcttaaaataa

SEQ ID NO: 414362 - DNA, 11 bp, Homo sapiens
gcttaaacaaa

SEQ ID NO: 414363 - DNA, 13 bp, Homo sapiens
gcttaaacaaagt

SEQ ID NO: 414364 - DNA, 13 bp, Homo sapiens
gcttaaacatttt

SEQ ID NO: 414365 - DNA, 23 bp, Homo sapiens
gcttaacattaagtattccttgg

SEQ ID NO: 414366 - DNA, 15 bp, Homo sapiens
gcttaagcagaagca

SEQ ID NO: 414367 - DNA, 14 bp, Homo sapiens
gcttaagcctgtgt

SEQ ID NO: 414368 - DNA, 14 bp, Homo sapiens
gcttaaggagagga

SEQ ID NO: 414369 - DNA, 19 bp, Homo sapiens
gcttaatagccctccccct

SEQ ID NO: 414370 - DNA, 14 bp, Homo sapiens
gcttaatctagagc

SEQ ID NO: 414371 - DNA, 12 bp, Homo sapiens
gcttaatgttta

SEQ ID NO: 414372 - DNA, 14 bp, Homo sapiens
gcttaatgtttatt

SEQ ID NO: 414373 - DNA, 14 bp, Homo sapiens
gcttacaattccct

SEQ ID NO: 414374 - DNA, 18 bp, Homo sapiens
gcttacacatctcagacc

SEQ ID NO: 414375 - DNA, 18 bp, Homo sapiens
gcttacaggcatgagcca

SEQ ID NO: 414376 - DNA, 20 bp, Homo sapiens
gcttaccacatcacaccact

SEQ ID NO: 414377 - DNA, 16 bp, Homo sapiens
gcttagaatggggctt

SEQ ID NO: 414378 - DNA, 17 bp, Homo sapiens
gcttagattttctgtaa

SEQ ID NO: 414379 - DNA, 20 bp, Homo sapiens
gcttagccttgtgccctgcc

SEQ ID NO: 414380 - DNA, 17 bp, Homo sapiens
gcttagcgttctgtttc

SEQ ID NO: 414381 - DNA, 18 bp, Homo sapiens
gcttaggacttcaaaagg

SEQ ID NO: 414382 - DNA, 12 bp, Homo sapiens
gcttaggagaga

SEQ ID NO: 414383 - DNA, 17 bp, Homo sapiens
gcttaggtgccaggctg

SEQ ID NO: 414384 - DNA, 18 bp, Homo sapiens
gcttaggtgccaggctgt

SEQ ID NO: 414385 - DNA, 22 bp, Homo sapiens
gcttagtaatagatcacggcat

SEQ ID NO: 414386 - DNA, 14 bp, Homo sapiens
gcttataaacacat

SEQ ID NO: 414387 - DNA, 17 bp, Homo sapiens
gcttataaacacattga

SEQ ID NO: 414388 - DNA, 12 bp, Homo sapiens
gcttatacactt

SEQ ID NO: 414389 - DNA, 18 bp, Homo sapiens
gcttatctccctgcttca

SEQ ID NO: 414390 - DNA, 16 bp, Homo sapiens
gcttatgaatatttat

SEQ ID NO: 414391 - DNA, 15 bp, Homo sapiens
gcttattaatgctaa

SEQ ID NO: 414392 - DNA, 16 bp, Homo sapiens
gcttattaatgctaag

SEQ ID NO: 414393 - DNA, 20 bp, Homo sapiens
gcttattaatgctaagggca

SEQ ID NO: 414394 - DNA, 18 bp, Homo sapiens
gcttattctcaaagcagg

SEQ ID NO: 414395 - DNA, 14 bp, Homo sapiens
gcttattggccact

SEQ ID NO: 414396 - DNA, 15 bp, Homo sapiens
gcttattggccactg

SEQ ID NO: 414397 - DNA, 20 bp, Homo sapiens
gcttattgttccaagacatt

SEQ ID NO: 414398 - DNA, 22 bp, Homo sapiens
gcttattgttccaagacattgt

SEQ ID NO: 414399 - DNA, 18 bp, Homo sapiens
gcttcaaccttgagacag

SEQ ID NO: 414400 - DNA, 19 bp, Homo sapiens
gcttcaatctacgatgtta

SEQ ID NO: 414401 - DNA, 13 bp, Homo sapiens
gcttcacacccct

SEQ ID NO: 414402 - DNA, 15 bp, Homo sapiens
gcttcacacccctca

SEQ ID NO: 414403 - DNA, 17 bp, Homo sapiens
gcttcacacccctcagc

SEQ ID NO: 414404 - DNA, 19 bp, Homo sapiens
gcttcacacccctcagcgc

SEQ ID NO: 414405 - DNA, 14 bp, Homo sapiens
gcttcaccagagca

SEQ ID NO: 414406 - DNA, 23 bp, Homo sapiens
gcttcaccagtctgtctactgtg

SEQ ID NO: 414407 - DNA, 14 bp, Homo sapiens
gcttcacccctgca

SEQ ID NO: 414408 - DNA, 16 bp, Homo sapiens
gcttcagatattttgc

SEQ ID NO: 414409 - DNA, 13 bp, Homo sapiens
gcttcagcccctg

SEQ ID NO: 414410 - DNA, 15 bp, Homo sapiens
gcttcagggctgggc

SEQ ID NO: 414411 - DNA, 20 bp, Homo sapiens
gcttcagggtatcccagacc

SEQ ID NO: 414412 - DNA, 15 bp, Homo sapiens
gcttcagttgttttc

SEQ ID NO: 414413 - DNA, 19 bp, Homo sapiens
gcttcatatctctcccttc

SEQ ID NO: 414414 - DNA, 18 bp, Homo sapiens
gcttcatgaaaatcctac

SEQ ID NO: 414415 - DNA, 20 bp, Homo sapiens
gcttcatgaaaatcctacca

SEQ ID NO: 414416 - DNA, 22 bp, Homo sapiens
gcttcatttcctctgagctgtt

SEQ ID NO: 414417 - DNA, 12 bp, Homo sapiens
gcttccaagccc

SEQ ID NO: 414418 - DNA, 10 bp, Homo sapiens
gcttccagat

SEQ ID NO: 414419 - DNA, 19 bp, Homo sapiens
gcttccaggataaggagac

SEQ ID NO: 414420 - DNA, 12 bp, Homo sapiens
gcttccaggctc

SEQ ID NO: 414421 - DNA, 18 bp, Homo sapiens
gcttccaggctcttcctg

SEQ ID NO: 414422 - DNA, 17 bp, Homo sapiens
gcttccatgagaacagc

SEQ ID NO: 414423 - DNA, 14 bp, Homo sapiens
gcttccatgtttaa

SEQ ID NO: 414424 - DNA, 18 bp, Homo sapiens
gcttcccaaactcccagg

SEQ ID NO: 414425 - DNA, 15 bp, Homo sapiens
gcttcccacctccct

SEQ ID NO: 414426 - DNA, 18 bp, Homo sapiens
gcttcccacctccctgcc

SEQ ID NO: 414427 - DNA, 22 bp, Homo sapiens
gcttcccacctccctgcccagg

SEQ ID NO: 414428 - DNA, 11 bp, Homo sapiens
gcttcccagga

SEQ ID NO: 414429 - DNA, 14 bp, Homo sapiens
gcttcccaggaccc

SEQ ID NO: 414430 - DNA, 19 bp, Homo sapiens
gcttcccaggaccctgggt

SEQ ID NO: 414431 - DNA, 17 bp, Homo sapiens
gcttcccgctcagccct

SEQ ID NO: 414432 - DNA, 15 bp, Homo sapiens
gcttccctacccaca

SEQ ID NO: 414433 - DNA, 20 bp, Homo sapiens
gcttccctacccacagggcc

SEQ ID NO: 414434 - DNA, 22 bp, Homo sapiens
gcttccctacccacagggcctg

SEQ ID NO: 414435 - DNA, 19 bp, Homo sapiens
gcttccctctgcctgtccc

SEQ ID NO: 414436 - DNA, 13 bp, Homo sapiens
gcttccctctgct

SEQ ID NO: 414437 - DNA, 19 bp, Homo sapiens
gcttccctgacttgcttta

SEQ ID NO: 414438 - DNA, 15 bp, Homo sapiens
gcttcctaacttatt

SEQ ID NO: 414439 - DNA, 19 bp, Homo sapiens
gcttcctccgtccacccag

SEQ ID NO: 414440 - DNA, 15 bp, Homo sapiens
gcttcctgagggcta

SEQ ID NO: 414441 - DNA, 23 bp, Homo sapiens
gcttcctggctgtaaatcctaga

SEQ ID NO: 414442 - DNA, 17 bp, Homo sapiens
gcttcctgtttctaagt

SEQ ID NO: 414443 - DNA, 22 bp, Homo sapiens
gcttcggtttctaacttggagc

SEQ ID NO: 414444 - DNA, 14 bp, Homo sapiens
gcttcgtgctggag

SEQ ID NO: 414445 - DNA, 19 bp, Homo sapiens
gcttctaattttgtgctct

SEQ ID NO: 414446 - DNA, 14 bp, Homo sapiens
gcttctatcccagg

SEQ ID NO: 414447 - DNA, 18 bp, Homo sapiens
gcttctatcccaggaggt

SEQ ID NO: 414448 - DNA, 23 bp, Homo sapiens
gcttctccgtcactccattctca

SEQ ID NO: 414449 - DNA, 16 bp, Homo sapiens
gcttctgacctcagca

SEQ ID NO: 414450 - DNA, 13 bp, Homo sapiens
gcttctgcctgca

SEQ ID NO: 414451 - DNA, 19 bp, Homo sapiens
gcttctgcggtgaggcagg

SEQ ID NO: 414452 - DNA, 21 bp, Homo sapiens
gcttctgcggtgaggcagggg

SEQ ID NO: 414453 - DNA, 22 bp, Homo sapiens
gcttctgctcacattccctctc

SEQ ID NO: 414454 - DNA, 15 bp, Homo sapiens
gcttctgctgccctg

SEQ ID NO: 414455 - DNA, 12 bp, Homo sapiens
gcttctgggaag

SEQ ID NO: 414456 - DNA, 16 bp, Homo sapiens
gcttctggtactctcc

SEQ ID NO: 414457 - DNA, 17 bp, Homo sapiens
gcttctggtactctcct

SEQ ID NO: 414458 - DNA, 20 bp, Homo sapiens
gcttctgtagtactccttaa

SEQ ID NO: 414459 - DNA, 22 bp, Homo sapiens
gcttctgtgcatttgtgtctgc

SEQ ID NO: 414460 - DNA, 21 bp, Homo sapiens
gcttcttaatataactgcctt

SEQ ID NO: 414461 - DNA, 22 bp, Homo sapiens
gcttcttaatataactgcctta

SEQ ID NO: 414462 - DNA, 16 bp, Homo sapiens
gcttcttgtgtttgaa

SEQ ID NO: 414463 - DNA, 17 bp, Homo sapiens
gcttgaagtaaccttat

SEQ ID NO: 414464 - DNA, 13 bp, Homo sapiens
gcttgacatgtgc

SEQ ID NO: 414465 - DNA, 16 bp, Homo sapiens
gcttgagcccaggagt

SEQ ID NO: 414466 - DNA, 14 bp, Homo sapiens
gcttgatgctgttt

SEQ ID NO: 414467 - DNA, 16 bp, Homo sapiens
gcttgattagaagcca

SEQ ID NO: 414468 - DNA, 19 bp, Homo sapiens
gcttgattctaaaggggac

SEQ ID NO: 414469 - DNA, 20 bp, Homo sapiens
gcttgattctaaaggggaca

SEQ ID NO: 414470 - DNA, 19 bp, Homo sapiens
gcttgcccgctcccacagc

SEQ ID NO: 414471 - DNA, 22 bp, Homo sapiens
gcttgccgactggctgtgagac

SEQ ID NO: 414472 - DNA, 24 bp, Homo sapiens
gcttgccgggcctgggcctcctgg

SEQ ID NO: 414473 - DNA, 22 bp, Homo sapiens
gcttgcctagggcctggtccat

SEQ ID NO: 414474 - DNA, 16 bp, Homo sapiens
gcttgcgtgctgggac

SEQ ID NO: 414475 - DNA, 16 bp, Homo sapiens
gcttgctagctatgtg

SEQ ID NO: 414476 - DNA, 22 bp, Homo sapiens
gcttgctagctatgtgaccttg

SEQ ID NO: 414477 - DNA, 14 bp, Homo sapiens
gcttgctccagggt

SEQ ID NO: 414478 - DNA, 15 bp, Homo sapiens
gcttgctcctaagca

SEQ ID NO: 414479 - DNA, 17 bp, Homo sapiens
gcttgcttgccgagcct

SEQ ID NO: 414480 - DNA, 23 bp, Homo sapiens
gcttggaaaatgttctgacagca

SEQ ID NO: 414481 - DNA, 18 bp, Homo sapiens
gcttggacttcctggggc

SEQ ID NO: 414482 - DNA, 16 bp, Homo sapiens
gcttggagcagagacg

SEQ ID NO: 414483 - DNA, 16 bp, Homo sapiens
gcttggagcagaggtg

SEQ ID NO: 414484 - DNA, 18 bp, Homo sapiens
gcttggatccatacaaaa

SEQ ID NO: 414485 - DNA, 13 bp, Homo sapiens
gcttggccagaag

SEQ ID NO: 414486 - DNA, 15 bp, Homo sapiens
gcttggctccatgct

SEQ ID NO: 414487 - DNA, 21 bp, Homo sapiens
gcttggctgagccccctctcc

SEQ ID NO: 414488 - DNA, 15 bp, Homo sapiens
gcttggctgccccac

SEQ ID NO: 414489 - DNA, 16 bp, Homo sapiens
gcttgggccactgccc

SEQ ID NO: 414490 - DNA, 18 bp, Homo sapiens
gcttgggcccagtagccc

SEQ ID NO: 414491 - DNA, 15 bp, Homo sapiens
gcttgggctccattc

SEQ ID NO: 414492 - DNA, 16 bp, Homo sapiens
gcttggggcttcctaa

SEQ ID NO: 414493 - DNA, 14 bp, Homo sapiens
gcttggggtagaga

SEQ ID NO: 414494 - DNA, 18 bp, Homo sapiens
gcttgggttcctttttca

SEQ ID NO: 414495 - DNA, 23 bp, Homo sapiens
gcttggtgcggtaggtgctggcc

SEQ ID NO: 414496 - DNA, 21 bp, Homo sapiens
gcttggtggggctcgtggcct

SEQ ID NO: 414497 - DNA, 19 bp, Homo sapiens
gcttggtgtcttggcactg

SEQ ID NO: 414498 - DNA, 15 bp, Homo sapiens
gcttggttcctgccc

SEQ ID NO: 414499 - DNA, 15 bp, Homo sapiens
gcttgtaacaagaaa

SEQ ID NO: 414500 - DNA, 14 bp, Homo sapiens
gcttgtacagttga

SEQ ID NO: 414501 - DNA, 15 bp, Homo sapiens
gcttgtagggtgagg

SEQ ID NO: 414502 - DNA, 18 bp, Homo sapiens
gcttgtcagagctgggag

SEQ ID NO: 414503 - DNA, 22 bp, Homo sapiens
gcttgtcatccacacaacacca

SEQ ID NO: 414504 - DNA, 21 bp, Homo sapiens
gcttgtccaacaactccagga

SEQ ID NO: 414505 - DNA, 21 bp, Homo sapiens
gcttgtgatttccatttctga

SEQ ID NO: 414506 - DNA, 17 bp, Homo sapiens
gcttgtgcctcccttcc

SEQ ID NO: 414507 - DNA, 22 bp, Homo sapiens
gcttgtgcctcccttcccagtg

SEQ ID NO: 414508 - DNA, 15 bp, Homo sapiens
gcttgtgggctggtg

SEQ ID NO: 414509 - DNA, 22 bp, Homo sapiens
gcttgtgggctggtgccccaca

SEQ ID NO: 414510 - DNA, 20 bp, Homo sapiens
gcttgtttacagcactactc

SEQ ID NO: 414511 - DNA, 14 bp, Homo sapiens
gcttgtttccctgc

SEQ ID NO: 414512 - DNA, 16 bp, Homo sapiens
gcttgtttctatactg

SEQ ID NO: 414513 - DNA, 18 bp, Homo sapiens
gcttgtttctatactgtt

SEQ ID NO: 414514 - DNA, 15 bp, Homo sapiens
gctttaaaaaataaa

SEQ ID NO: 414515 - DNA, 16 bp, Homo sapiens
gctttaaacacccttc

SEQ ID NO: 414516 - DNA, 19 bp, Homo sapiens
gctttaacaaaacaagaaa

SEQ ID NO: 414517 - DNA, 22 bp, Homo sapiens
gctttaacaaaacaagaaagaa

SEQ ID NO: 414518 - DNA, 21 bp, Homo sapiens
gctttacaggatcatgtaaat

SEQ ID NO: 414519 - DNA, 12 bp, Homo sapiens
gctttacatgca

SEQ ID NO: 414520 - DNA, 17 bp, Homo sapiens
gctttacattttcagta

SEQ ID NO: 414521 - DNA, 23 bp, Homo sapiens
gctttacattttcagtaccaaag

SEQ ID NO: 414522 - DNA, 19 bp, Homo sapiens
gctttacctttattaatga

SEQ ID NO: 414523 - DNA, 14 bp, Homo sapiens
gctttagagacagg

SEQ ID NO: 414524 - DNA, 23 bp, Homo sapiens
gctttataccccatttgatttcg

SEQ ID NO: 414525 - DNA, 21 bp, Homo sapiens
gctttattgcccatgggatat

SEQ ID NO: 414526 - DNA, 19 bp, Homo sapiens
gctttattttttaagtatt

SEQ ID NO: 414527 - DNA, 15 bp, Homo sapiens
gctttcagagccagt

SEQ ID NO: 414528 - DNA, 17 bp, Homo sapiens
gctttcagagccagtga

SEQ ID NO: 414529 - DNA, 13 bp, Homo sapiens
gctttcatcctgt

SEQ ID NO: 414530 - DNA, 19 bp, Homo sapiens
gctttcatgaccactgggc

SEQ ID NO: 414531 - DNA, 16 bp, Homo sapiens
gctttccaacacacaa

SEQ ID NO: 414532 - DNA, 21 bp, Homo sapiens
gctttccagaaggccacaggc

SEQ ID NO: 414533 - DNA, 13 bp, Homo sapiens
gctttcccccagg

SEQ ID NO: 414534 - DNA, 22 bp, Homo sapiens
gctttcccccaggcgcctgcgc

SEQ ID NO: 414535 - DNA, 18 bp, Homo sapiens
gctttccctggctcaggg

SEQ ID NO: 414536 - DNA, 17 bp, Homo sapiens
gctttccggggaggagc

SEQ ID NO: 414537 - DNA, 18 bp, Homo sapiens
gctttcgtagcccctgct

SEQ ID NO: 414538 - DNA, 19 bp, Homo sapiens
gctttcgtgtaaattatgt

SEQ ID NO: 414539 - DNA, 19 bp, Homo sapiens
gctttctcaaaatttgatg

SEQ ID NO: 414540 - DNA, 12 bp, Homo sapiens
gctttctcaggg

SEQ ID NO: 414541 - DNA, 19 bp, Homo sapiens
gctttctccagaaccagtg

SEQ ID NO: 414542 - DNA, 15 bp, Homo sapiens
gctttctccggggtc

SEQ ID NO: 414543 - DNA, 18 bp, Homo sapiens
gctttctccggggtctgt

SEQ ID NO: 414544 - DNA, 20 bp, Homo sapiens
ggaacactaaaggtggaaat

SEQ ID NO: 414545 - DNA, 12 bp, Homo sapiens
ggaacactggcc

SEQ ID NO: 414546 - DNA, 15 bp, Homo sapiens
ggaacactggcctgg

SEQ ID NO: 414547 - DNA, 12 bp, Homo sapiens
ggaacagactcg

SEQ ID NO: 414548 - DNA, 20 bp, Homo sapiens
ggaacagatgctaataaact

SEQ ID NO: 414549 - DNA, 19 bp, Homo sapiens
ggaacagcgggagacctgt

SEQ ID NO: 414550 - DNA, 20 bp, Homo sapiens
ggaacagcgggagacctgtg

SEQ ID NO: 414551 - DNA, 23 bp, Homo sapiens
ggaacagctatgggagccccagg

SEQ ID NO: 414552 - DNA, 16 bp, Homo sapiens
ggaacatgcagctctg

SEQ ID NO: 414553 - DNA, 17 bp, Homo sapiens
ggaacatttgggagact

SEQ ID NO: 414554 - DNA, 15 bp, Homo sapiens
ggaaccagccctcca

SEQ ID NO: 414555 - DNA, 16 bp, Homo sapiens
ggaaccagggaggaga

SEQ ID NO: 414556 - DNA, 17 bp, Homo sapiens
ggaaccagggaggagag

SEQ ID NO: 414557 - DNA, 16 bp, Homo sapiens
ggaaccccgcagcccg

SEQ ID NO: 414558 - DNA, 17 bp, Homo sapiens
ggaaccccgcagcccgt

SEQ ID NO: 414559 - DNA, 16 bp, Homo sapiens
ggaacctccctgggcc

SEQ ID NO: 414560 - DNA, 18 bp, Homo sapiens
ggaacctccctgggcctg

SEQ ID NO: 414561 - DNA, 14 bp, Homo sapiens
ggaacgagcactgg

SEQ ID NO: 414562 - DNA, 19 bp, Homo sapiens
ggaacgagcactggccaga

SEQ ID NO: 414563 - DNA, 21 bp, Homo sapiens
ggaacgagcactggccagaga

SEQ ID NO: 414564 - DNA, 13 bp, Homo sapiens
ggaacgcagatga

SEQ ID NO: 414565 - DNA, 18 bp, Homo sapiens
ggaactatgggagcctca

SEQ ID NO: 414566 - DNA, 19 bp, Homo sapiens
ggaactcaaaggactgacc

SEQ ID NO: 414567 - DNA, 17 bp, Homo sapiens
ggaactccttggcctag

SEQ ID NO: 414568 - DNA, 17 bp, Homo sapiens
ggaactctgtgcaggtg

SEQ ID NO: 414569 - DNA, 15 bp, Homo sapiens
ggaactgaccccctc

SEQ ID NO: 414570 - DNA, 20 bp, Homo sapiens
ggaactgaccccctcccctg

SEQ ID NO: 414571 - DNA, 15 bp, Homo sapiens
ggaactgcatgctgc

SEQ ID NO: 414572 - DNA, 20 bp, Homo sapiens
ggaactgcttgcccagggtg

SEQ ID NO: 414573 - DNA, 16 bp, Homo sapiens
ggaactgggaagatgc

SEQ ID NO: 414574 - DNA, 15 bp, Homo sapiens
ggaacttctaatata

SEQ ID NO: 414575 - DNA, 14 bp, Homo sapiens
ggaacttgctgctg

SEQ ID NO: 414576 - DNA, 22 bp, Homo sapiens
ggaactttagggggtgggaggg

SEQ ID NO: 414577 - DNA, 12 bp, Homo sapiens
ggaagaaacaaa

SEQ ID NO: 414578 - DNA, 18 bp, Homo sapiens
ggaagaaacactcttatt

SEQ ID NO: 414579 - DNA, 23 bp, Homo sapiens
ggaagaacaaatatgattctcct

SEQ ID NO: 414580 - DNA, 19 bp, Homo sapiens
ggaagaaggcccgggagga

SEQ ID NO: 414581 - DNA, 16 bp, Homo sapiens
ggaagaattggggatt

SEQ ID NO: 414582 - DNA, 19 bp, Homo sapiens
ggaagaccccacccaagct

SEQ ID NO: 414583 - DNA, 13 bp, Homo sapiens
ggaagagaaacca

SEQ ID NO: 414584 - DNA, 13 bp, Homo sapiens
ggaagagagcctg

SEQ ID NO: 414585 - DNA, 17 bp, Homo sapiens
ggaagagaggagttcaa

SEQ ID NO: 414586 - DNA, 18 bp, Homo sapiens
ggaagagaggagttcaat

SEQ ID NO: 414587 - DNA, 15 bp, Homo sapiens
ggaagagaggcacct

SEQ ID NO: 414588 - DNA, 19 bp, Homo sapiens
ggaagagcagcctgatggc

SEQ ID NO: 414589 - DNA, 23 bp, Homo sapiens
ggaagagctgggtaccaggccac

SEQ ID NO: 414590 - DNA, 15 bp, Homo sapiens
ggaagagggacagat

SEQ ID NO: 414591 - DNA, 20 bp, Homo sapiens
ggaagagggagggtcagtgc

SEQ ID NO: 414592 - DNA, 20 bp, Homo sapiens
ggaagagggcagtacctggg

SEQ ID NO: 414593 - DNA, 19 bp, Homo sapiens
ggaagagggctgagctgag

SEQ ID NO: 414594 - DNA, 22 bp, Homo sapiens
ggaagagggctgagctgagctt

SEQ ID NO: 414595 - DNA, 19 bp, Homo sapiens
ggaagaggttctcagcaag

SEQ ID NO: 414596 - DNA, 18 bp, Homo sapiens
ggaagataggctctgcac

SEQ ID NO: 414597 - DNA, 15 bp, Homo sapiens
ggaagatcttgagag

SEQ ID NO: 414598 - DNA, 22 bp, Homo sapiens
ggaagatcttgagagctgctga

SEQ ID NO: 414599 - DNA, 18 bp, Homo sapiens
ggaagcaagacgtcctgg

SEQ ID NO: 414600 - DNA, 20 bp, Homo sapiens
ggaagcaagacgtcctggaa

SEQ ID NO: 414601 - DNA, 15 bp, Homo sapiens
ggaagcacagcaggt

SEQ ID NO: 414602 - DNA, 23 bp, Homo sapiens
ggaagcactgccattagactgaa

SEQ ID NO: 414603 - DNA, 22 bp, Homo sapiens
ggaagcattactttgtagatgt

SEQ ID NO: 414604 - DNA, 17 bp, Homo sapiens
ggaagcccaaggcagtg

SEQ ID NO: 414605 - DNA, 16 bp, Homo sapiens
ggaagcccacccgccc

SEQ ID NO: 414606 - DNA, 17 bp, Homo sapiens
ggaagcccacccgcccc

SEQ ID NO: 414607 - DNA, 20 bp, Homo sapiens
ggaagccggcggcccaagcc

SEQ ID NO: 414608 - DNA, 17 bp, Homo sapiens
ggaagccgtctgactcc

SEQ ID NO: 414609 - DNA, 20 bp, Homo sapiens
ggaagccgtctgactccaga

SEQ ID NO: 414610 - DNA, 21 bp, Homo sapiens
ggaagccgtctgactccagag

SEQ ID NO: 414611 - DNA, 13 bp, Homo sapiens
ggaagcctgctga

SEQ ID NO: 414612 - DNA, 20 bp, Homo sapiens
ggaagctctgtgtgtacctg

SEQ ID NO: 414613 - DNA, 10 bp, Homo sapiens
ggaagctgca

SEQ ID NO: 414614 - DNA, 20 bp, Homo sapiens
ggaagctgtactcagagcag

SEQ ID NO: 414615 - DNA, 21 bp, Homo sapiens
ggaagctgtactcagagcaga

SEQ ID NO: 414616 - DNA, 17 bp, Homo sapiens
ggaagcttgagcctccc

SEQ ID NO: 414617 - DNA, 20 bp, Homo sapiens
ggaagcttgagcctccccca

SEQ ID NO: 414618 - DNA, 19 bp, Homo sapiens
ggaaggacctatgtttgct

SEQ ID NO: 414619 - DNA, 11 bp, Homo sapiens
ggaaggagaga

SEQ ID NO: 414620 - DNA, 14 bp, Homo sapiens
ggaaggagagcctg

SEQ ID NO: 414621 - DNA, 15 bp, Homo sapiens
ggaaggagagcctgc

SEQ ID NO: 414622 - DNA, 13 bp, Homo sapiens
ggaaggagcctgc

SEQ ID NO: 414623 - DNA, 14 bp, Homo sapiens
ggaaggagggagct

SEQ ID NO: 414624 - DNA, 21 bp, Homo sapiens
ggaaggcacccgccctttcct

SEQ ID NO: 414625 - DNA, 13 bp, Homo sapiens
ggaaggcagctgc

SEQ ID NO: 414626 - DNA, 14 bp, Homo sapiens
ggaaggcagctgct

SEQ ID NO: 414627 - DNA, 15 bp, Homo sapiens
ggaaggcagctgctc

SEQ ID NO: 414628 - DNA, 16 bp, Homo sapiens
ggaaggcagctgctct

SEQ ID NO: 414629 - DNA, 13 bp, Homo sapiens
ggaaggcagggca

SEQ ID NO: 414630 - DNA, 13 bp, Homo sapiens
ggaaggcctgagg

SEQ ID NO: 414631 - DNA, 19 bp, Homo sapiens
ggaaggcctgagggaagcc

SEQ ID NO: 414632 - DNA, 13 bp, Homo sapiens
ggaaggcctgggt

SEQ ID NO: 414633 - DNA, 14 bp, Homo sapiens
ggaaggcctgggtg

SEQ ID NO: 414634 - DNA, 21 bp, Homo sapiens
ggaagggagagttctttgctg

SEQ ID NO: 414635 - DNA, 16 bp, Homo sapiens
ggaagggccagagcct

SEQ ID NO: 414636 - DNA, 21 bp, Homo sapiens
ggaagggccagtctgggctgc

SEQ ID NO: 414637 - DNA, 17 bp, Homo sapiens
ggaaggggcgtgtccct

SEQ ID NO: 414638 - DNA, 17 bp, Homo sapiens
ggaaggggctggactgg

SEQ ID NO: 414639 - DNA, 15 bp, Homo sapiens
ggaaggttcaggggc

SEQ ID NO: 414640 - DNA, 23 bp, Homo sapiens
gcctggcgtggggggagctctgg

SEQ ID NO: 414641 - DNA, 17 bp, Homo sapiens
gcctggctccaggctcc

SEQ ID NO: 414642 - DNA, 18 bp, Homo sapiens
gcctggctcccaggacac

SEQ ID NO: 414643 - DNA, 13 bp, Homo sapiens
gcctggctctgtc

SEQ ID NO: 414644 - DNA, 10 bp, Homo sapiens
gcctggctgt

SEQ ID NO: 414645 - DNA, 14 bp, Homo sapiens
gcctggctgtggag

SEQ ID NO: 414646 - DNA, 24 bp, Homo sapiens
gcctggctgtggaggcctgatgct

SEQ ID NO: 414647 - DNA, 15 bp, Homo sapiens
gcctggcttgctcca

SEQ ID NO: 414648 - DNA, 16 bp, Homo sapiens
gcctggcttttctggc

SEQ ID NO: 414649 - DNA, 19 bp, Homo sapiens
gcctggcttttctggctgg

SEQ ID NO: 414650 - DNA, 18 bp, Homo sapiens
gcctgggacccagctact

SEQ ID NO: 414651 - DNA, 13 bp, Homo sapiens
gcctgggagggtg

SEQ ID NO: 414652 - DNA, 14 bp, Homo sapiens
gcctgggagggtgg

SEQ ID NO: 414653 - DNA, 22 bp, Homo sapiens
gcctgggcagaaatgtgctgca

SEQ ID NO: 414654 - DNA, 20 bp, Homo sapiens
gcctgggcagccaggctgcc

SEQ ID NO: 414655 - DNA, 13 bp, Homo sapiens
gcctgggcagtgc

SEQ ID NO: 414656 - DNA, 18 bp, Homo sapiens
gcctgggccactggcatc

SEQ ID NO: 414657 - DNA, 19 bp, Homo sapiens
gcctgggccactggcatct

SEQ ID NO: 414658 - DNA, 15 bp, Homo sapiens
gcctgggcctgtgca

SEQ ID NO: 414659 - DNA, 20 bp, Homo sapiens
gcctgggcctgtgcagcagc

SEQ ID NO: 414660 - DNA, 23 bp, Homo sapiens
gcctgggcctgtgcagcagccca

SEQ ID NO: 414661 - DNA, 12 bp, Homo sapiens
gcctgggctagg

SEQ ID NO: 414662 - DNA, 22 bp, Homo sapiens
gcctggggatgtaaccaagctg

SEQ ID NO: 414663 - DNA, 23 bp, Homo sapiens
gcctggggatgtaaccaagctgt

SEQ ID NO: 414664 - DNA, 15 bp, Homo sapiens
gcctggggcctggca

SEQ ID NO: 414665 - DNA, 15 bp, Homo sapiens
gcctggggctgccgt

SEQ ID NO: 414666 - DNA, 14 bp, Homo sapiens
gcctgggggcagtg

SEQ ID NO: 414667 - DNA, 17 bp, Homo sapiens
gcctgggggcagtgact

SEQ ID NO: 414668 - DNA, 14 bp, Homo sapiens
gcctgggtctgtgt

SEQ ID NO: 414669 - DNA, 23 bp, Homo sapiens
gcctgggtctgtgtctcttttct

SEQ ID NO: 414670 - DNA, 19 bp, Homo sapiens
gcctgggtgacagagcgag

SEQ ID NO: 414671 - DNA, 20 bp, Homo sapiens
gcctgggtgacagagcgaga

SEQ ID NO: 414672 - DNA, 22 bp, Homo sapiens
gcctgggtgagaatcctgcctc

SEQ ID NO: 414673 - DNA, 15 bp, Homo sapiens
gcctgggtgctggct

SEQ ID NO: 414674 - DNA, 20 bp, Homo sapiens
gcctgggtgctggctgccca

SEQ ID NO: 414675 - DNA, 21 bp, Homo sapiens
gcctgggtgctggctgcccag

SEQ ID NO: 414676 - DNA, 19 bp, Homo sapiens
gcctgggtggatcggcctc

SEQ ID NO: 414677 - DNA, 23 bp, Homo sapiens
gcctgggtggggcagggcctggc

SEQ ID NO: 414678 - DNA, 16 bp, Homo sapiens
gcctggtcagcagagc

SEQ ID NO: 414679 - DNA, 17 bp, Homo sapiens
gcctggtctggagcccc

SEQ ID NO: 414680 - DNA, 15 bp, Homo sapiens
gcctggtgcgctgtg

SEQ ID NO: 414681 - DNA, 17 bp, Homo sapiens
gcctggtgcgctgtgct

SEQ ID NO: 414682 - DNA, 20 bp, Homo sapiens
gcctggttccctctttcctg

SEQ ID NO: 414683 - DNA, 15 bp, Homo sapiens
gcctgtaatcccagc

SEQ ID NO: 414684 - DNA, 20 bp, Homo sapiens
gcctgtaatcccagcacttt

SEQ ID NO: 414685 - DNA, 23 bp, Homo sapiens
gcctgtaatctttttctccaccc

SEQ ID NO: 414686 - DNA, 19 bp, Homo sapiens
gcctgtagagccagccttg

SEQ ID NO: 414687 - DNA, 14 bp, Homo sapiens
gcctgtagtcccag

SEQ ID NO: 414688 - DNA, 14 bp, Homo sapiens
gcctgtagttagga

SEQ ID NO: 414689 - DNA, 22 bp, Homo sapiens
gcctgtagttaggaaataaaac

SEQ ID NO: 414690 - DNA, 16 bp, Homo sapiens
gcctgtcacgctctgg

SEQ ID NO: 414691 - DNA, 19 bp, Homo sapiens
gcctgtcactactggtctg

SEQ ID NO: 414692 - DNA, 20 bp, Homo sapiens
gcctgtccacctgtgctgct

SEQ ID NO: 414693 - DNA, 12 bp, Homo sapiens
gcctgtccagcc

SEQ ID NO: 414694 - DNA, 13 bp, Homo sapiens
gcctgtccagcct

SEQ ID NO: 414695 - DNA, 14 bp, Homo sapiens
gcctgtccagcctg

SEQ ID NO: 414696 - DNA, 21 bp, Homo sapiens
gcctgtccccgccttccctca

SEQ ID NO: 414697 - DNA, 14 bp, Homo sapiens
gcctgtccctctca

SEQ ID NO: 414698 - DNA, 18 bp, Homo sapiens
gcctgtccttggtggccg

SEQ ID NO: 414699 - DNA, 21 bp, Homo sapiens
gcctgtcgtgccagtcctggg

SEQ ID NO: 414700 - DNA, 15 bp, Homo sapiens
gcctgtcgtgttctc

SEQ ID NO: 414701 - DNA, 13 bp, Homo sapiens
gcctgtctggagc

SEQ ID NO: 414702 - DNA, 16 bp, Homo sapiens
gcctgtctggagctca

SEQ ID NO: 414703 - DNA, 12 bp, Homo sapiens
gcctgtctgtct

SEQ ID NO: 414704 - DNA, 17 bp, Homo sapiens
gcctgtctgtctctcca

SEQ ID NO: 414705 - DNA, 22 bp, Homo sapiens
gcctgtcttcagatcctgctgc

SEQ ID NO: 414706 - DNA, 23 bp, Homo sapiens
gcctgtgaccggggtcctgaggc

SEQ ID NO: 414707 - DNA, 13 bp, Homo sapiens
gcctgtgagtgac

SEQ ID NO: 414708 - DNA, 17 bp, Homo sapiens
gcctgtgatcgtgtgtt

SEQ ID NO: 414709 - DNA, 17 bp, Homo sapiens
gcctgtgcagcagccca

SEQ ID NO: 414710 - DNA, 16 bp, Homo sapiens
gcctgtgcccttgctg

SEQ ID NO: 414711 - DNA, 22 bp, Homo sapiens
gcctgtgcccttgctgggtcca

SEQ ID NO: 414712 - DNA, 22 bp, Homo sapiens
gcctgtgctgggccagtggctg

SEQ ID NO: 414713 - DNA, 19 bp, Homo sapiens
gcctgtggcagaaaagagg

SEQ ID NO: 414714 - DNA, 21 bp, Homo sapiens
gcctgtggcagaaaagaggag

SEQ ID NO: 414715 - DNA, 22 bp, Homo sapiens
gcctgtggcatctttgccttgg

SEQ ID NO: 414716 - DNA, 15 bp, Homo sapiens
gcctgtgggagaagg

SEQ ID NO: 414717 - DNA, 22 bp, Homo sapiens
gcctgtgggtccccactcaccc

SEQ ID NO: 414718 - DNA, 15 bp, Homo sapiens
gcctgtggtgaagtg

SEQ ID NO: 414719 - DNA, 21 bp, Homo sapiens
gcctgtggttacagtgcagac

SEQ ID NO: 414720 - DNA, 19 bp, Homo sapiens
gcctgtgtccagcagctgc

SEQ ID NO: 414721 - DNA, 22 bp, Homo sapiens
gcctgtgtccagcagctgcggg

SEQ ID NO: 414722 - DNA, 18 bp, Homo sapiens
gcctgttctgtaggagag

SEQ ID NO: 414723 - DNA, 14 bp, Homo sapiens
gcctgttgcccttt

SEQ ID NO: 414724 - DNA, 21 bp, Homo sapiens
gcctgtttctgcagcccttgg

SEQ ID NO: 414725 - DNA, 21 bp, Homo sapiens
gcctgtttgggaggctggagt

SEQ ID NO: 414726 - DNA, 16 bp, Homo sapiens
gccttaagaaagctat

SEQ ID NO: 414727 - DNA, 15 bp, Homo sapiens
gccttaatacttttt

SEQ ID NO: 414728 - DNA, 23 bp, Homo sapiens
gccttaatacttttttattttgt

SEQ ID NO: 414729 - DNA, 20 bp, Homo sapiens
gccttaatctggaaggcccc

SEQ ID NO: 414730 - DNA, 23 bp, Homo sapiens
gccttaattcttacctcatttgc

SEQ ID NO: 414731 - DNA, 21 bp, Homo sapiens
gccttacacaatggttttctt

SEQ ID NO: 414732 - DNA, 16 bp, Homo sapiens
gccttagaacctttct

SEQ ID NO: 414733 - DNA, 18 bp, Homo sapiens
gccttagaatctgtagag

SEQ ID NO: 414734 - DNA, 13 bp, Homo sapiens
gccttagaggagc

SEQ ID NO: 414735 - DNA, 21 bp, Homo sapiens
gccttaggaagtgacttgaat

SEQ ID NO: 414736 - DNA, 22 bp, Homo sapiens
gccttataaacagataatgctt

SEQ ID NO: 414737 - DNA, 23 bp, Homo sapiens
gccttataaacagataatgcttt

SEQ ID NO: 414738 - DNA, 17 bp, Homo sapiens
gccttatcaagtgtctt

SEQ ID NO: 414739 - DNA, 22 bp, Homo sapiens
gccttatcttgcaccccaaagc

SEQ ID NO: 414740 - DNA, 18 bp, Homo sapiens
gctaagcttaaaaaaaac

SEQ ID NO: 414741 - DNA, 14 bp, Homo sapiens
gctaaggcaccagc

SEQ ID NO: 414742 - DNA, 20 bp, Homo sapiens
gctaaggcctcttgctggtg

SEQ ID NO: 414743 - DNA, 14 bp, Homo sapiens
gctaaggggcagga

SEQ ID NO: 414744 - DNA, 15 bp, Homo sapiens
gctaagtccagctct

SEQ ID NO: 414745 - DNA, 23 bp, Homo sapiens
gctaagttgtcttacacttctca

SEQ ID NO: 414746 - DNA, 11 bp, Homo sapiens
gctaataaact

SEQ ID NO: 414747 - DNA, 13 bp, Homo sapiens
gctaataaactgt

SEQ ID NO: 414748 - DNA, 14 bp, Homo sapiens
gctaataaatgacc

SEQ ID NO: 414749 - DNA, 20 bp, Homo sapiens
gctaataaatgaccagttta

SEQ ID NO: 414750 - DNA, 21 bp, Homo sapiens
gctaatcatgtgggtgagcca

SEQ ID NO: 414751 - DNA, 22 bp, Homo sapiens
gctaatcatgtgggtgagccag

SEQ ID NO: 414752 - DNA, 23 bp, Homo sapiens
gctaatcatgtgggtgagccagt

SEQ ID NO: 414753 - DNA, 20 bp, Homo sapiens
gctaatctgtagggctggac

SEQ ID NO: 414754 - DNA, 15 bp, Homo sapiens
gctaatgtaatcatt

SEQ ID NO: 414755 - DNA, 14 bp, Homo sapiens
gctaatttctgtcc

SEQ ID NO: 414756 - DNA, 16 bp, Homo sapiens
gctaatttttttgtat

SEQ ID NO: 414757 - DNA, 24 bp, Homo sapiens
gctacacttacaagtaatgaattt

SEQ ID NO: 414758 - DNA, 17 bp, Homo sapiens
gctacagtagctgtggg

SEQ ID NO: 414759 - DNA, 11 bp, Homo sapiens
gctacattcct

SEQ ID NO: 414760 - DNA, 12 bp, Homo sapiens
gctacattcctc

SEQ ID NO: 414761 - DNA, 19 bp, Homo sapiens
gctaccgccctgggctgga

SEQ ID NO: 414762 - DNA, 23 bp, Homo sapiens
gctacctgaatggcggtttttat

SEQ ID NO: 414763 - DNA, 14 bp, Homo sapiens
gctacctgtgagca

SEQ ID NO: 414764 - DNA, 18 bp, Homo sapiens
gctactaacctggagaca

SEQ ID NO: 414765 - DNA, 21 bp, Homo sapiens
gctactaacctggagacagta

SEQ ID NO: 414766 - DNA, 15 bp, Homo sapiens
gctactctgtccagg

SEQ ID NO: 414767 - DNA, 16 bp, Homo sapiens
gctcagtttggctgta

SEQ ID NO: 414768 - DNA, 22 bp, Homo sapiens
gctcatcagaaacaatttctgt

SEQ ID NO: 414769 - DNA, 16 bp, Homo sapiens
gctcatcagaactgaa

SEQ ID NO: 414770 - DNA, 23 bp, Homo sapiens
gctcatctgatattcaaacacac

SEQ ID NO: 414771 - DNA, 18 bp, Homo sapiens
gctcatggcgtaatgggc

SEQ ID NO: 414772 - DNA, 21 bp, Homo sapiens
gctcatggcgtaatgggcctg

SEQ ID NO: 414773 - DNA, 22 bp, Homo sapiens
gctcatggcgtaatgggcctgc

SEQ ID NO: 414774 - DNA, 23 bp, Homo sapiens
gctcatggcgtaatgggcctgcc

SEQ ID NO: 414775 - DNA, 20 bp, Homo sapiens
gctcatgggcccctctgact

SEQ ID NO: 414776 - DNA, 22 bp, Homo sapiens
gctcatgggcccctctgactcc

SEQ ID NO: 414777 - DNA, 16 bp, Homo sapiens
gctccacagggtggga

SEQ ID NO: 414778 - DNA, 15 bp, Homo sapiens
gctccaccccactca

SEQ ID NO: 414779 - DNA, 13 bp, Homo sapiens
gctccaccctccc

SEQ ID NO: 414780 - DNA, 15 bp, Homo sapiens
gctccaccctcccct

SEQ ID NO: 414781 - DNA, 22 bp, Homo sapiens
gctccacccttggcctgtctca

SEQ ID NO: 414782 - DNA, 18 bp, Homo sapiens
gctccacgccctggggag

SEQ ID NO: 414783 - DNA, 17 bp, Homo sapiens
gctccactcagggctgg

SEQ ID NO: 414784 - DNA, 18 bp, Homo sapiens
gctccactggcctgcccg

SEQ ID NO: 414785 - DNA, 14 bp, Homo sapiens
gctccagaccccca

SEQ ID NO: 414786 - DNA, 15 bp, Homo sapiens
gctccagacccccag

SEQ ID NO: 414787 - DNA, 17 bp, Homo sapiens
gctccagacccccagca

SEQ ID NO: 414788 - DNA, 23 bp, Homo sapiens
gctccagacccccagcaaccctc

SEQ ID NO: 414789 - DNA, 11 bp, Homo sapiens
gctccagcagt

SEQ ID NO: 414790 - DNA, 21 bp, Homo sapiens
gctccagcagtgctgggccca

SEQ ID NO: 414791 - DNA, 16 bp, Homo sapiens
gctccagcatccagcc

SEQ ID NO: 414792 - DNA, 19 bp, Homo sapiens
gctccagcatccagcctgt

SEQ ID NO: 414793 - DNA, 21 bp, Homo sapiens
gctccagcatccagcctgtgt

SEQ ID NO: 414794 - DNA, 17 bp, Homo sapiens
gctccaggctccaggct

SEQ ID NO: 414795 - DNA, 19 bp, Homo sapiens
gctccaggggcccttggga

SEQ ID NO: 414796 - DNA, 20 bp, Homo sapiens
gctccagggtcttgggctac

SEQ ID NO: 414797 - DNA, 22 bp, Homo sapiens
gctccagggtcttgggctactg

SEQ ID NO: 414798 - DNA, 24 bp, Homo sapiens
gctccagggtcttgggctactggc

SEQ ID NO: 414799 - DNA, 12 bp, Homo sapiens
gctccaggtgcc

SEQ ID NO: 414800 - DNA, 19 bp, Homo sapiens
gctccaggtgccctgtggg

SEQ ID NO: 414801 - DNA, 20 bp, Homo sapiens
gctccagtctgctgccctcc

SEQ ID NO: 414802 - DNA, 20 bp, Homo sapiens
gctccatccttgcatcactg

SEQ ID NO: 414803 - DNA, 21 bp, Homo sapiens
gctccatgactggctgtctgc

SEQ ID NO: 414804 - DNA, 19 bp, Homo sapiens
gctccatgcagatctagcc

SEQ ID NO: 414805 - DNA, 20 bp, Homo sapiens
gctccatggatgcatgccct

SEQ ID NO: 414806 - DNA, 12 bp, Homo sapiens
gctccattccca

SEQ ID NO: 414807 - DNA, 23 bp, Homo sapiens
gctcccaacacaaggtgggcagg

SEQ ID NO: 414808 - DNA, 14 bp, Homo sapiens
gctcccaagggagg

SEQ ID NO: 414809 - DNA, 17 bp, Homo sapiens
gctcccaatcagctttt

SEQ ID NO: 414810 - DNA, 15 bp, Homo sapiens
gctcccacagcttcc

SEQ ID NO: 414811 - DNA, 18 bp, Homo sapiens
gctcccacagcttcctga

SEQ ID NO: 414812 - DNA, 19 bp, Homo sapiens
gctcccagcagccctaagg

SEQ ID NO: 414813 - DNA, 23 bp, Homo sapiens
gctcccagcagccctaaggatct

SEQ ID NO: 414814 - DNA, 13 bp, Homo sapiens
gctcccagcctgc

SEQ ID NO: 414815 - DNA, 17 bp, Homo sapiens
gctcccattcctccctc

SEQ ID NO: 414816 - DNA, 17 bp, Homo sapiens
gctccccaatccaaccc

SEQ ID NO: 414817 - DNA, 22 bp, Homo sapiens
gctccccaatccaacccatgca

SEQ ID NO: 414818 - DNA, 23 bp, Homo sapiens
gctccccaatccaacccatgcat

SEQ ID NO: 414819 - DNA, 13 bp, Homo sapiens
gctccccacccct

SEQ ID NO: 414820 - DNA, 15 bp, Homo sapiens
gctccccaggagctc

SEQ ID NO: 414821 - DNA, 19 bp, Homo sapiens
gctccccaggagctcaggt

SEQ ID NO: 414822 - DNA, 15 bp, Homo sapiens
gctcccccgcagtcc

SEQ ID NO: 414823 - DNA, 14 bp, Homo sapiens
gctccccctgccag

SEQ ID NO: 414824 - DNA, 16 bp, Homo sapiens
gctcccccttcccagt

SEQ ID NO: 414825 - DNA, 18 bp, Homo sapiens
gctcccccttgcccgcca

SEQ ID NO: 414826 - DNA, 14 bp, Homo sapiens
gctccccgcctcca

SEQ ID NO: 414827 - DNA, 17 bp, Homo sapiens
gctccccgcctccactc

SEQ ID NO: 414828 - DNA, 20 bp, Homo sapiens
gctccccgcctccactctag

SEQ ID NO: 414829 - DNA, 21 bp, Homo sapiens
gctcccctctatttagcatga

SEQ ID NO: 414830 - DNA, 14 bp, Homo sapiens
gctcccctgcccgc

SEQ ID NO: 414831 - DNA, 15 bp, Homo sapiens
gctcccctggagcca

SEQ ID NO: 414832 - DNA, 20 bp, Homo sapiens
gctcccctggagccagcagg

SEQ ID NO: 414833 - DNA, 12 bp, Homo sapiens
gctcccctttcc

SEQ ID NO: 414834 - DNA, 21 bp, Homo sapiens
gctcccctttcccatcacccc

SEQ ID NO: 414835 - DNA, 17 bp, Homo sapiens
gctcccgagctactctc

SEQ ID NO: 414836 - DNA, 21 bp, Homo sapiens
gctcccgcctgattggggcct

SEQ ID NO: 414837 - DNA, 19 bp, Homo sapiens
gctcccggggcagggcagc

SEQ ID NO: 414838 - DNA, 20 bp, Homo sapiens
gctcccggggcagggcagcc

SEQ ID NO: 414839 - DNA, 16 bp, Homo sapiens
gctccctagactgcat

SEQ ID NO: 414840 - DNA, 18 bp, Homo sapiens
gctccctccccctgcccc

SEQ ID NO: 414841 - DNA, 17 bp, Homo sapiens
gctccctcccctgccct

SEQ ID NO: 414842 - DNA, 15 bp, Homo sapiens
gctccctcctcccat

SEQ ID NO: 414843 - DNA, 17 bp, Homo sapiens
gctccctcctcccatct

SEQ ID NO: 414844 - DNA, 20 bp, Homo sapiens
gctccctcctcccatctcct

SEQ ID NO: 414845 - DNA, 15 bp, Homo sapiens
gctccctcctggagc

SEQ ID NO: 414846 - DNA, 22 bp, Homo sapiens
gctccctctcctgtagccactg

SEQ ID NO: 414847 - DNA, 22 bp, Homo sapiens
gctccctggaaagcaggcaagc

SEQ ID NO: 414848 - DNA, 16 bp, Homo sapiens
gctcccttctctgtag

SEQ ID NO: 414849 - DNA, 15 bp, Homo sapiens
gctccgcctggcacc

SEQ ID NO: 414850 - DNA, 14 bp, Homo sapiens
gctccgctgtgtgg

SEQ ID NO: 414851 - DNA, 15 bp, Homo sapiens
gctccggcagaggca

SEQ ID NO: 414852 - DNA, 22 bp, Homo sapiens
gctccgtgagtgaaccatcatt

SEQ ID NO: 414853 - DNA, 22 bp, Homo sapiens
gctccgtggccccgccctcagg

SEQ ID NO: 414854 - DNA, 18 bp, Homo sapiens
gctccgtgtgtctcatgc

SEQ ID NO: 414855 - DNA, 16 bp, Homo sapiens
gctcctaaaggcagca

SEQ ID NO: 414856 - DNA, 15 bp, Homo sapiens
gctcctatctgtgtt

SEQ ID NO: 414857 - DNA, 18 bp, Homo sapiens
gctcctcaactcacctaa

SEQ ID NO: 414858 - DNA, 12 bp, Homo sapiens
gctcctcacccc

SEQ ID NO: 414859 - DNA, 13 bp, Homo sapiens
gctcctcaccccc

SEQ ID NO: 414860 - DNA, 19 bp, Homo sapiens
gctcctcacccccacccct

SEQ ID NO: 414861 - DNA, 23 bp, Homo sapiens
gctcctcacccccacccctgtac

SEQ ID NO: 414862 - DNA, 15 bp, Homo sapiens
gctcctcacctgtct

SEQ ID NO: 414863 - DNA, 23 bp, Homo sapiens
gctcctcactgcccgcacaccct

SEQ ID NO: 414864 - DNA, 19 bp, Homo sapiens
gctcctcatggtgggttca

SEQ ID NO: 414865 - DNA, 21 bp, Homo sapiens
gctcctcctcttggagctgag

SEQ ID NO: 414866 - DNA, 16 bp, Homo sapiens
gctcctcctgccctgt

SEQ ID NO: 414867 - DNA, 21 bp, Homo sapiens
gctcctcggccagagctccca

SEQ ID NO: 414868 - DNA, 13 bp, Homo sapiens
gctcctctatagg

SEQ ID NO: 414869 - DNA, 17 bp, Homo sapiens
gctcctctccttgggct

SEQ ID NO: 414870 - DNA, 22 bp, Homo sapiens
gctcctctccttgggctcctgg

SEQ ID NO: 414871 - DNA, 23 bp, Homo sapiens
gctcctctccttgggctcctggc

SEQ ID NO: 414872 - DNA, 15 bp, Homo sapiens
gctcctctgcagcct

SEQ ID NO: 414873 - DNA, 16 bp, Homo sapiens
gctcctctgcagcctg

SEQ ID NO: 414874 - DNA, 18 bp, Homo sapiens
gctcctctgcagcctgag

SEQ ID NO: 414875 - DNA, 19 bp, Homo sapiens
gctcctctgcagcctgagc

SEQ ID NO: 414876 - DNA, 11 bp, Homo sapiens
gctcctctggg

SEQ ID NO: 414877 - DNA, 13 bp, Homo sapiens
gctcctctgggca

SEQ ID NO: 414878 - DNA, 18 bp, Homo sapiens
gctcctcttaccgtagcc

SEQ ID NO: 414879 - DNA, 20 bp, Homo sapiens
gctcctcttaccgtagcctc

SEQ ID NO: 414880 - DNA, 12 bp, Homo sapiens
gctcctctttcc

SEQ ID NO: 414881 - DNA, 15 bp, Homo sapiens
gctcctctttcccct

SEQ ID NO: 414882 - DNA, 23 bp, Homo sapiens
gctcctctttcccctcctttgtc

SEQ ID NO: 414883 - DNA, 22 bp, Homo sapiens
ggacttgcttcttgtgtttgaa

SEQ ID NO: 414884 - DNA, 19 bp, Homo sapiens
ggacttgggagagggagca

SEQ ID NO: 414885 - DNA, 20 bp, Homo sapiens
ggacttgtaggaatctgcct

SEQ ID NO: 414886 - DNA, 15 bp, Homo sapiens
ggacttgtatgctgc

SEQ ID NO: 414887 - DNA, 17 bp, Homo sapiens
ggacttgtatgctgccc

SEQ ID NO: 414888 - DNA, 13 bp, Homo sapiens
ggacttgtgcctc

SEQ ID NO: 414889 - DNA, 10 bp, Homo sapiens
ggactttatt

SEQ ID NO: 414890 - DNA, 14 bp, Homo sapiens
ggactttatttaat

SEQ ID NO: 414891 - DNA, 20 bp, Homo sapiens
ggactttccaccccctccct

SEQ ID NO: 414892 - DNA, 17 bp, Homo sapiens
ggtctccatttttccca

SEQ ID NO: 414893 - DNA, 19 bp, Homo sapiens
ggtctccatttttcccagg

SEQ ID NO: 414894 - DNA, 20 bp, Homo sapiens
ggtctccatttttcccagga

SEQ ID NO: 414895 - DNA, 23 bp, Homo sapiens
ggtctccatttttcccaggacag

SEQ ID NO: 414896 - DNA, 16 bp, Homo sapiens
ggtctccctgagcctg

SEQ ID NO: 414897 - DNA, 17 bp, Homo sapiens
ggtctccctgagcctgc

SEQ ID NO: 414898 - DNA, 21 bp, Homo sapiens
ggtctcctcagggtggggggt

SEQ ID NO: 414899 - DNA, 20 bp, Homo sapiens
ggtctcgctttgttgcccag

SEQ ID NO: 414900 - DNA, 13 bp, Homo sapiens
ggtctctgagcag

SEQ ID NO: 414901 - DNA, 19 bp, Homo sapiens
ggtctctgccggctctttc

SEQ ID NO: 414902 - DNA, 17 bp, Homo sapiens
ggtctctttctttccaa

SEQ ID NO: 414903 - DNA, 23 bp, Homo sapiens
ggtctgaaggaatagccagagag

SEQ ID NO: 414904 - DNA, 21 bp, Homo sapiens
ggtctgaatgttctgacatta

SEQ ID NO: 414905 - DNA, 20 bp, Homo sapiens
ggtctgcacacataacacac

SEQ ID NO: 414906 - DNA, 21 bp, Homo sapiens
ggtctgcacacataacacaca

SEQ ID NO: 414907 - DNA, 12 bp, Homo sapiens
ggtctgcaggcc

SEQ ID NO: 414908 - DNA, 23 bp, Homo sapiens
ggtctgcctcccacgctgggaca

SEQ ID NO: 414909 - DNA, 16 bp, Homo sapiens
ggtctgctctttctct

SEQ ID NO: 414910 - DNA, 19 bp, Homo sapiens
ggtctgctctttctctgcc

SEQ ID NO: 414911 - DNA, 22 bp, Homo sapiens
ggtctgctctttctctgccagt

SEQ ID NO: 414912 - DNA, 16 bp, Homo sapiens
ggtctggagcccctat

SEQ ID NO: 414913 - DNA, 17 bp, Homo sapiens
ggtctgggacttccttg

SEQ ID NO: 414914 - DNA, 11 bp, Homo sapiens
ggtctgggagg

SEQ ID NO: 414915 - DNA, 15 bp, Homo sapiens
ggtctgggaggcagg

SEQ ID NO: 414916 - DNA, 16 bp, Homo sapiens
ggtctgggaggcaggt

SEQ ID NO: 414917 - DNA, 14 bp, Homo sapiens
ggtctgtagggatt

SEQ ID NO: 414918 - DNA, 16 bp, Homo sapiens
ggtctgtatatacatt

SEQ ID NO: 414919 - DNA, 16 bp, Homo sapiens
ggtctgtgctgtgcct

SEQ ID NO: 414920 - DNA, 16 bp, Homo sapiens
ggtctgtgggactggc

SEQ ID NO: 414921 - DNA, 19 bp, Homo sapiens
ggtctgtgtctcttttctc

SEQ ID NO: 414922 - DNA, 15 bp, Homo sapiens
ggtcttacccccacc

SEQ ID NO: 414923 - DNA, 15 bp, Homo sapiens
ggtcttagctttaca

SEQ ID NO: 414924 - DNA, 16 bp, Homo sapiens
ggtcttagctttacat

SEQ ID NO: 414925 - DNA, 20 bp, Homo sapiens
ggtcttctttaaggaagaat

SEQ ID NO: 414926 - DNA, 22 bp, Homo sapiens
ggtcttggattggtaccagagc

SEQ ID NO: 414927 - DNA, 17 bp, Homo sapiens
ggtctttttatgcattt

SEQ ID NO: 414928 - DNA, 14 bp, Homo sapiens
ggtgaaagggagct

SEQ ID NO: 414929 - DNA, 18 bp, Homo sapiens
ggtgaagggagagccagc

SEQ ID NO: 414930 - DNA, 16 bp, Homo sapiens
ggtgaagtgtggctgg

SEQ ID NO: 414931 - DNA, 13 bp, Homo sapiens
ggtgacaggcaga

SEQ ID NO: 414932 - DNA, 18 bp, Homo sapiens
ggtgacagtgccttctct

SEQ ID NO: 414933 - DNA, 13 bp, Homo sapiens
ggtgacatcccag

SEQ ID NO: 414934 - DNA, 14 bp, Homo sapiens
ggtgaccaggtcct

SEQ ID NO: 414935 - DNA, 21 bp, Homo sapiens
ggtgacggtcctttaggcagc

SEQ ID NO: 414936 - DNA, 22 bp, Homo sapiens
ggtgacggtcctttaggcagcc

SEQ ID NO: 414937 - DNA, 20 bp, Homo sapiens
ggtgactgaatttgggcctc

SEQ ID NO: 414938 - DNA, 15 bp, Homo sapiens
ggtgagacagtgggg

SEQ ID NO: 414939 - DNA, 16 bp, Homo sapiens
ggtgagacagtggggg

SEQ ID NO: 414940 - DNA, 23 bp, Homo sapiens
ggtgagacagtgggggtgcctgg

SEQ ID NO: 414941 - DNA, 15 bp, Homo sapiens
ggtgagaccacctct

SEQ ID NO: 414942 - DNA, 19 bp, Homo sapiens
ggtgagatacccagagaga

SEQ ID NO: 414943 - DNA, 21 bp, Homo sapiens
ggtgagcagggccctcagagg

SEQ ID NO: 414944 - DNA, 13 bp, Homo sapiens
ggtgagccagtgg

SEQ ID NO: 414945 - DNA, 17 bp, Homo sapiens
ggtgagcgggtggggtg

SEQ ID NO: 414946 - DNA, 16 bp, Homo sapiens
ggtgaggaggaggcag

SEQ ID NO: 414947 - DNA, 17 bp, Homo sapiens
ggtgaggcaggggagtc

SEQ ID NO: 414948 - DNA, 13 bp, Homo sapiens
ggtgagggaggcc

SEQ ID NO: 414949 - DNA, 18 bp, Homo sapiens
ggtgagggctgagagggc

SEQ ID NO: 414950 - DNA, 21 bp, Homo sapiens
ggtgaggtgggggtctggcct

SEQ ID NO: 414951 - DNA, 13 bp, Homo sapiens
ggtgagtggctga

SEQ ID NO: 414952 - DNA, 23 bp, Homo sapiens
ggtgagtggggagacacctcaga

SEQ ID NO: 414953 - DNA, 12 bp, Homo sapiens
ggtgagtttttc

SEQ ID NO: 414954 - DNA, 14 bp, Homo sapiens
ggtgagtttttctt

SEQ ID NO: 414955 - DNA, 12 bp, Homo sapiens
ggtgataagtgg

SEQ ID NO: 414956 - DNA, 15 bp, Homo sapiens
ggtgatcagcagaga

SEQ ID NO: 414957 - DNA, 12 bp, Homo sapiens
ggtgatcagtgc

SEQ ID NO: 414958 - DNA, 18 bp, Homo sapiens
ggtgatccacccacctgg

SEQ ID NO: 414959 - DNA, 16 bp, Homo sapiens
ggtgatcctctatttt

SEQ ID NO: 414960 - DNA, 23 bp, Homo sapiens
ggtgatcctctattttgtgatga

SEQ ID NO: 414961 - DNA, 16 bp, Homo sapiens
ggtgatgtttccagct

SEQ ID NO: 414962 - DNA, 18 bp, Homo sapiens
ggtgatgtttccagctgc

SEQ ID NO: 414963 - DNA, 22 bp, Homo sapiens
ggtgatgtttccagctgccaag

SEQ ID NO: 414964 - DNA, 17 bp, Homo sapiens
ggtgattaaatatttaa

SEQ ID NO: 414965 - DNA, 15 bp, Homo sapiens
ggtgattttcctgtg

SEQ ID NO: 414966 - DNA, 18 bp, Homo sapiens
ggtgcaaagttccctact

SEQ ID NO: 414967 - DNA, 19 bp, Homo sapiens
ggtgcaattaactctggac

SEQ ID NO: 414968 - DNA, 20 bp, Homo sapiens
ggtgcacagacgtccctcca

SEQ ID NO: 414969 - DNA, 22 bp, Homo sapiens
ggtgcacattttccacggaaac

SEQ ID NO: 414970 - DNA, 19 bp, Homo sapiens
ggtgcacccactcaccagg

SEQ ID NO: 414971 - DNA, 20 bp, Homo sapiens
ggtgcacttttctgtgtcat

SEQ ID NO: 414972 - DNA, 16 bp, Homo sapiens
ggtgcagatgggctgt

SEQ ID NO: 414973 - DNA, 15 bp, Homo sapiens
ggtgcagcagtgagg

SEQ ID NO: 414974 - DNA, 12 bp, Homo sapiens
ggtgcaggcgcg

SEQ ID NO: 414975 - DNA, 20 bp, Homo sapiens
ggtgcaggcgcgcaccgccc

SEQ ID NO: 414976 - DNA, 16 bp, Homo sapiens
ggtgcatgcaggtctc

SEQ ID NO: 414977 - DNA, 18 bp, Homo sapiens
ggtgcatgccgctgcatc

SEQ ID NO: 414978 - DNA, 19 bp, Homo sapiens
ggtgcatgttcttttctgg

SEQ ID NO: 414979 - DNA, 22 bp, Homo sapiens
ggtgccaaccacctctggccct

SEQ ID NO: 414980 - DNA, 23 bp, Homo sapiens
ggtgccaccaataaaaatcctac

SEQ ID NO: 414981 - DNA, 22 bp, Homo sapiens
ggtgccacttcttaaaggcctg

SEQ ID NO: 414982 - DNA, 15 bp, Homo sapiens
ggtgccagccttcct

SEQ ID NO: 414983 - DNA, 12 bp, Homo sapiens
ggtgccagctgt

SEQ ID NO: 414984 - DNA, 14 bp, Homo sapiens
ggtgccatcacgct

SEQ ID NO: 414985 - DNA, 21 bp, Homo sapiens
ggtgcccagactcaaggcctc

SEQ ID NO: 414986 - DNA, 23 bp, Homo sapiens
ggtgcctcccacacttgctgggg

SEQ ID NO: 414987 - DNA, 23 bp, Homo sapiens
ggtgcctgctctccttgccctgg

SEQ ID NO: 414988 - DNA, 12 bp, Homo sapiens
ggtgcctgtgac

SEQ ID NO: 414989 - DNA, 16 bp, Homo sapiens
ggtgcggaccggagcg

SEQ ID NO: 414990 - DNA, 19 bp, Homo sapiens
ggtgcggtaggtgctggcc

SEQ ID NO: 414991 - DNA, 13 bp, Homo sapiens
ggtgcgtggctgt

SEQ ID NO: 414992 - DNA, 17 bp, Homo sapiens
ggtgcgtggctgtggca

SEQ ID NO: 414993 - DNA, 18 bp, Homo sapiens
ggtgcgtggctgtggcac

SEQ ID NO: 414994 - DNA, 21 bp, Homo sapiens
ggtgcgtggctgtggcacaga

SEQ ID NO: 414995 - DNA, 17 bp, Homo sapiens
ggtgctagggtgcctgc

SEQ ID NO: 414996 - DNA, 17 bp, Homo sapiens
ggtgctcaaagatgtac

SEQ ID NO: 414997 - DNA, 20 bp, Homo sapiens
ggtgctcaaagatgtactga

SEQ ID NO: 414998 - DNA, 18 bp, Homo sapiens
ggtgctcacgactcttcc

SEQ ID NO: 414999 - DNA, 16 bp, Homo sapiens
ggtgctcagggctgac

SEQ ID NO: 415000 - DNA, 14 bp, Homo sapiens
ggtgctctggcggc

SEQ ID NO: 415001 - DNA, 20 bp, Homo sapiens
ggtgctctggcggcttcctg

SEQ ID NO: 415002 - DNA, 17 bp, Homo sapiens
ggtgctgaactgtgcat

SEQ ID NO: 415003 - DNA, 16 bp, Homo sapiens
ggtgctgagcttagcc

SEQ ID NO: 415004 - DNA, 15 bp, Homo sapiens
ggtgctgctttgctt

SEQ ID NO: 415005 - DNA, 16 bp, Homo sapiens
ggtgctggatattttc

SEQ ID NO: 415006 - DNA, 12 bp, Homo sapiens
ggtgctgggact

SEQ ID NO: 415007 - DNA, 14 bp, Homo sapiens
ggtgctgggactga

SEQ ID NO: 415008 - DNA, 19 bp, Homo sapiens
ggtgctgggactgagccag

SEQ ID NO: 415009 - DNA, 13 bp, Homo sapiens
ggtgcttgctgtg

SEQ ID NO: 415010 - DNA, 14 bp, Homo sapiens
ggtgcttgggcttc

SEQ ID NO: 415011 - DNA, 15 bp, Homo sapiens
ggtggaacaggagga

SEQ ID NO: 415012 - DNA, 20 bp, Homo sapiens
ggtggaacaggaggaactgg

SEQ ID NO: 415013 - DNA, 20 bp, Homo sapiens
ggtggagggtggggggcgct

SEQ ID NO: 415014 - DNA, 14 bp, Homo sapiens
ggtggagtcaggct

SEQ ID NO: 415015 - DNA, 16 bp, Homo sapiens
ggtggagtcaggcttc

SEQ ID NO: 415016 - DNA, 13 bp, Homo sapiens
ggtggatggtgac

SEQ ID NO: 415017 - DNA, 14 bp, Homo sapiens
ggtggatggtgact

SEQ ID NO: 415018 - DNA, 22 bp, Homo sapiens
ggtggatggtgacttttgaaga

SEQ ID NO: 415019 - DNA, 13 bp, Homo sapiens
ggtggcacctcct

SEQ ID NO: 415020 - DNA, 15 bp, Homo sapiens
ggtggcatttgctga

SEQ ID NO: 415021 - DNA, 18 bp, Homo sapiens
ggtggccacagcaggact

SEQ ID NO: 415022 - DNA, 20 bp, Homo sapiens
ggtggccacagcaggactga

SEQ ID NO: 415023 - DNA, 13 bp, Homo sapiens
ggtggccagggct

SEQ ID NO: 415024 - DNA, 10 bp, Homo sapiens
ggtggcccca

SEQ ID NO: 415025 - DNA, 21 bp, Homo sapiens
ggtggccccagctgtgactga

SEQ ID NO: 415026 - DNA, 15 bp, Homo sapiens
ggtggcccctcccca

SEQ ID NO: 415027 - DNA, 13 bp, Homo sapiens
ggtggccctgggg

SEQ ID NO: 415028 - DNA, 15 bp, Homo sapiens
ggtggccgtcacgct

SEQ ID NO: 415029 - DNA, 16 bp, Homo sapiens
ggtggccgtcacgctt

SEQ ID NO: 415030 - DNA, 21 bp, Homo sapiens
ggtggcgggcgcctgtaatcc

SEQ ID NO: 415031 - DNA, 22 bp, Homo sapiens
ggtggcgtctgcctaggagctg

SEQ ID NO: 415032 - DNA, 14 bp, Homo sapiens
ggtggctctggaat

SEQ ID NO: 415033 - DNA, 16 bp, Homo sapiens
ggtgggaggctcccag

SEQ ID NO: 415034 - DNA, 17 bp, Homo sapiens
ggtgggaggctcccaga

SEQ ID NO: 415035 - DNA, 18 bp, Homo sapiens
ggtgggcaccaagagcca

SEQ ID NO: 415036 - DNA, 14 bp, Homo sapiens
ggtgggcagccatg

SEQ ID NO: 415037 - DNA, 13 bp, Homo sapiens
ggtgggcagctgg

SEQ ID NO: 415038 - DNA, 18 bp, Homo sapiens
ggtgggcagctgggcccc

SEQ ID NO: 415039 - DNA, 16 bp, Homo sapiens
ggtgggccagcccctc

SEQ ID NO: 415040 - DNA, 20 bp, Homo sapiens
ggtgggccagcccctcccac

SEQ ID NO: 415041 - DNA, 14 bp, Homo sapiens
ggtgggccccagcc

SEQ ID NO: 415042 - DNA, 14 bp, Homo sapiens
ggtgggcctctggt

SEQ ID NO: 415043 - DNA, 14 bp, Homo sapiens
ggtgggcctggcct

SEQ ID NO: 415044 - DNA, 16 bp, Homo sapiens
ggtgggcctggcctga

SEQ ID NO: 415045 - DNA, 17 bp, Homo sapiens
ggtggggaagagagcct

SEQ ID NO: 415046 - DNA, 20 bp, Homo sapiens
ggtggggaagagagcctgcc

SEQ ID NO: 415047 - DNA, 19 bp, Homo sapiens
ggtggggagcccaggcctg

SEQ ID NO: 415048 - DNA, 21 bp, Homo sapiens
ggtggggagcccaggcctggc

SEQ ID NO: 415049 - DNA, 17 bp, Homo sapiens
ggtggggcgggaaagcc

SEQ ID NO: 415050 - DNA, 12 bp, Homo sapiens
ggtggggctcgt

SEQ ID NO: 415051 - DNA, 15 bp, Homo sapiens
ggtggggctgagcct

SEQ ID NO: 415052 - DNA, 20 bp, Homo sapiens
ggtggggcttagaatggggc

SEQ ID NO: 415053 - DNA, 22 bp, Homo sapiens
ggtggggcttggaagggcgctg

SEQ ID NO: 415054 - DNA, 13 bp, Homo sapiens
ggtgggggagcct

SEQ ID NO: 415055 - DNA, 14 bp, Homo sapiens
ggtgggggcctgct

SEQ ID NO: 415056 - DNA, 15 bp, Homo sapiens
ggtgggggcctgctg

SEQ ID NO: 415057 - DNA, 16 bp, Homo sapiens
ggtggggtaaggagga

SEQ ID NO: 415058 - DNA, 18 bp, Homo sapiens
ggtggggtaaggaggaga

SEQ ID NO: 415059 - DNA, 17 bp, Homo sapiens
ggtggggtgcctgagcc

SEQ ID NO: 415060 - DNA, 18 bp, Homo sapiens
ggtggggtgcctgagccc

SEQ ID NO: 415061 - DNA, 20 bp, Homo sapiens
ggtgggtccaggaaggcagc

SEQ ID NO: 415062 - DNA, 23 bp, Homo sapiens
ggtgggtccaggaaggcagctgc

SEQ ID NO: 415063 - DNA, 14 bp, Homo sapiens
ggtggtaactgcca

SEQ ID NO: 415064 - DNA, 15 bp, Homo sapiens
ggtggtaactgccag

SEQ ID NO: 415065 - DNA, 23 bp, Homo sapiens
ggtggtactttattcttgctggg

SEQ ID NO: 415066 - DNA, 15 bp, Homo sapiens
ggtggtagctctgag

SEQ ID NO: 415067 - DNA, 15 bp, Homo sapiens
ggtggtcaccaggtc

SEQ ID NO: 415068 - DNA, 19 bp, Homo sapiens
ggtggtcctgactcaacat

SEQ ID NO: 415069 - DNA, 15 bp, Homo sapiens
ggtggtctgaatgtt

SEQ ID NO: 415070 - DNA, 19 bp, Homo sapiens
ggtggtctgaatgttctga

SEQ ID NO: 415071 - DNA, 18 bp, Homo sapiens
ggtggtttcagaaagggc

SEQ ID NO: 415072 - DNA, 18 bp, Homo sapiens
ggtgtactgggttaatgg

SEQ ID NO: 415073 - DNA, 20 bp, Homo sapiens
ggtgtactgggttaatggct

SEQ ID NO: 415074 - DNA, 18 bp, Homo sapiens
ggtgtatatcatgaagcc

SEQ ID NO: 415075 - DNA, 17 bp, Homo sapiens
ggtgtcacatggggcct

SEQ ID NO: 415076 - DNA, 19 bp, Homo sapiens
ggtgtcaccctgcagagct

SEQ ID NO: 415077 - DNA, 18 bp, Homo sapiens
ggtgtcactctgcctcta

SEQ ID NO: 415078 - DNA, 20 bp, Homo sapiens
ggtgtccccaacgtcccctc

SEQ ID NO: 415079 - DNA, 17 bp, Homo sapiens
ggtgtccccagcccact

SEQ ID NO: 415080 - DNA, 17 bp, Homo sapiens
ggtgtcctttccctcca

SEQ ID NO: 415081 - DNA, 19 bp, Homo sapiens
ggtgtgaatgctgtacctt

SEQ ID NO: 415082 - DNA, 19 bp, Homo sapiens
ggtgtgaggacataaatct

SEQ ID NO: 415083 - DNA, 23 bp, Homo sapiens
ggtgtgcacatctctgcttgagt

SEQ ID NO: 415084 - DNA, 13 bp, Homo sapiens
ggtgtgccctggc

SEQ ID NO: 415085 - DNA, 16 bp, Homo sapiens
ggtgtgccctggctcc

SEQ ID NO: 415086 - DNA, 12 bp, Homo sapiens
ggtgtgctacag

SEQ ID NO: 415087 - DNA, 17 bp, Homo sapiens
ggtgtggataaggctta

SEQ ID NO: 415088 - DNA, 11 bp, Homo sapiens
ggtgtggcttg

SEQ ID NO: 415089 - DNA, 15 bp, Homo sapiens
ggtgtggggtggggt

SEQ ID NO: 415090 - DNA, 18 bp, Homo sapiens
ggtgtggtggctcatggc

SEQ ID NO: 415091 - DNA, 22 bp, Homo sapiens
ggtgtgtggccgcctggcaggt

SEQ ID NO: 415092 - DNA, 16 bp, Homo sapiens
ggtgtgtgtctctgac

SEQ ID NO: 415093 - DNA, 16 bp, Homo sapiens
ggtgtgttgcccgtgg

SEQ ID NO: 415094 - DNA, 23 bp, Homo sapiens
ggtgttccaaagagaaggcctgg

SEQ ID NO: 415095 - DNA, 17 bp, Homo sapiens
ggtgttttaaaaaatct

SEQ ID NO: 415096 - DNA, 11 bp, Homo sapiens
ggttaaaactg

SEQ ID NO: 415097 - DNA, 18 bp, Homo sapiens
ggttaaaatataaattaa

SEQ ID NO: 415098 - DNA, 18 bp, Homo sapiens
ggttaataaaactgcaca

SEQ ID NO: 415099 - DNA, 19 bp, Homo sapiens
ggttaataggaggacagaa

SEQ ID NO: 415100 - DNA, 17 bp, Homo sapiens
ggttaatctttcctgat

SEQ ID NO: 415101 - DNA, 14 bp, Homo sapiens
ggttacaaactgca

SEQ ID NO: 415102 - DNA, 21 bp, Homo sapiens
ggttaccgagtatctgtaacc

SEQ ID NO: 415103 - DNA, 15 bp, Homo sapiens
ggttacctcactttt

SEQ ID NO: 415104 - DNA, 18 bp, Homo sapiens
ggttattagcaaggctgg

SEQ ID NO: 415105 - DNA, 24 bp, Homo sapiens
ggttatttctcaacaaagcacagt

SEQ ID NO: 415106 - DNA, 14 bp, Homo sapiens
ggttcaccttgccg

SEQ ID NO: 415107 - DNA, 22 bp, Homo sapiens
ggttcaccttgccgagagaggc

SEQ ID NO: 415108 - DNA, 20 bp, Homo sapiens
ggttcacgccattctcctgc

SEQ ID NO: 415109 - DNA, 20 bp, Homo sapiens
ggttcacgtcactgccagag

SEQ ID NO: 415110 - DNA, 16 bp, Homo sapiens
ggttcagaaatgctgc

SEQ ID NO: 415111 - DNA, 17 bp, Homo sapiens
ggttcagggaactgctt

SEQ ID NO: 415112 - DNA, 19 bp, Homo sapiens
ggttcatcagtgttaaaaa

SEQ ID NO: 415113 - DNA, 17 bp, Homo sapiens
ggttcattattggaatt

SEQ ID NO: 415114 - DNA, 18 bp, Homo sapiens
ggttcattattggaatta

SEQ ID NO: 415115 - DNA, 16 bp, Homo sapiens
ggttccaaccaggcag

SEQ ID NO: 415116 - DNA, 15 bp, Homo sapiens
ggttccactggagaa

SEQ ID NO: 415117 - DNA, 22 bp, Homo sapiens
ggttccagaacagccctcggcc

SEQ ID NO: 415118 - DNA, 11 bp, Homo sapiens
ggttccagaca

SEQ ID NO: 415119 - DNA, 12 bp, Homo sapiens
ggttccagacag

SEQ ID NO: 415120 - DNA, 13 bp, Homo sapiens
ggttccagacaga

SEQ ID NO: 415121 - DNA, 14 bp, Homo sapiens
ggttccagacaggg

SEQ ID NO: 415122 - DNA, 20 bp, Homo sapiens
ggttccagcaattctcctgc

SEQ ID NO: 415123 - DNA, 22 bp, Homo sapiens
ggttccagggactgtacctgta

SEQ ID NO: 415124 - DNA, 13 bp, Homo sapiens
ggttccatgcctg

SEQ ID NO: 415125 - DNA, 15 bp, Homo sapiens
ggttccatgcctgag

SEQ ID NO: 415126 - DNA, 18 bp, Homo sapiens
ggttcccaataaaagtga

SEQ ID NO: 415127 - DNA, 13 bp, Homo sapiens
ggttcccccagcc

SEQ ID NO: 415128 - DNA, 12 bp, Homo sapiens
ggttccctcttt

SEQ ID NO: 415129 - DNA, 16 bp, Homo sapiens
ggttccctctttcctg

SEQ ID NO: 415130 - DNA, 16 bp, Homo sapiens
ggttcctaagcctgtt

SEQ ID NO: 415131 - DNA, 13 bp, Homo sapiens
ggttcgagactcc

SEQ ID NO: 415132 - DNA, 17 bp, Homo sapiens
ggttcgagactccatct

SEQ ID NO: 415133 - DNA, 10 bp, Homo sapiens
ggttctagac

SEQ ID NO: 415134 - DNA, 11 bp, Homo sapiens
ggttctagacg

SEQ ID NO: 415135 - DNA, 12 bp, Homo sapiens
ggttctatttta

SEQ ID NO: 415136 - DNA, 21 bp, Homo sapiens
ggttctcttcattcccactgc

SEQ ID NO: 415137 - DNA, 17 bp, Homo sapiens
ggttctggggccccttt

SEQ ID NO: 415138 - DNA, 22 bp, Homo sapiens
ggttctggttagctcagcccca

SEQ ID NO: 415139 - DNA, 22 bp, Homo sapiens
ggttctgtctgtgccaagggca

SEQ ID NO: 415140 - DNA, 14 bp, Homo sapiens
ggttctttcttcct

SEQ ID NO: 415141 - DNA, 23 bp, Homo sapiens
ggttctttgagggactgcctctg

SEQ ID NO: 415142 - DNA, 19 bp, Homo sapiens
ggttgaaaagattccattt

SEQ ID NO: 415143 - DNA, 16 bp, Homo sapiens
ggttgaaggcagtctg

SEQ ID NO: 415144 - DNA, 19 bp, Homo sapiens
ggttgaccctactgtggat

SEQ ID NO: 415145 - DNA, 16 bp, Homo sapiens
ggttgaggacaggaga

SEQ ID NO: 415146 - DNA, 19 bp, Homo sapiens
ggttgatatattctttcca

SEQ ID NO: 415147 - DNA, 21 bp, Homo sapiens
ggttgcgtcctgacggcgccc

SEQ ID NO: 415148 - DNA, 13 bp, Homo sapiens
ggttgctggagcc

SEQ ID NO: 415149 - DNA, 15 bp, Homo sapiens
ggttgctggagcctg

SEQ ID NO: 415150 - DNA, 15 bp, Homo sapiens
ggttgcttctgggaa

SEQ ID NO: 415151 - DNA, 19 bp, Homo sapiens
ggttgcttgggccactgcc

SEQ ID NO: 415152 - DNA, 20 bp, Homo sapiens
ggttgcttgggccactgccc

SEQ ID NO: 415153 - DNA, 21 bp, Homo sapiens
ggttgcttgggccactgccct

SEQ ID NO: 415154 - DNA, 21 bp, Homo sapiens
ggttggaggcccttttctggc

SEQ ID NO: 415155 - DNA, 22 bp, Homo sapiens
ggttggaggcctcaccctgctt

SEQ ID NO: 415156 - DNA, 17 bp, Homo sapiens
ggttggatgggagtggg

SEQ ID NO: 415157 - DNA, 15 bp, Homo sapiens
ggttggcaccccagc

SEQ ID NO: 415158 - DNA, 14 bp, Homo sapiens
ggttggcagtaagg

SEQ ID NO: 415159 - DNA, 19 bp, Homo sapiens
ggttggctgggcccagaag

SEQ ID NO: 415160 - DNA, 15 bp, Homo sapiens
ggttgggggctcctg

SEQ ID NO: 415161 - DNA, 13 bp, Homo sapiens
ggttggggtgggg

SEQ ID NO: 415162 - DNA, 14 bp, Homo sapiens
ggttgggttccaga

SEQ ID NO: 415163 - DNA, 15 bp, Homo sapiens
ggttgggttccagac

SEQ ID NO: 415164 - DNA, 21 bp, Homo sapiens
ggttgtgaaccaactgcctta

SEQ ID NO: 415165 - DNA, 21 bp, Homo sapiens
ggttgtggcccccgccccctc

SEQ ID NO: 415166 - DNA, 22 bp, Homo sapiens
ggttgttgccaactaagccctc

SEQ ID NO: 415167 - DNA, 15 bp, Homo sapiens
ggttgttgccaggtt

SEQ ID NO: 415168 - DNA, 14 bp, Homo sapiens
ggttgtttctctga

SEQ ID NO: 415169 - DNA, 22 bp, Homo sapiens
ggttgtttctctgagctttgtt

SEQ ID NO: 415170 - DNA, 19 bp, Homo sapiens
ggttgtttgctgttttttg

SEQ ID NO: 415171 - DNA, 13 bp, Homo sapiens
ggtttaactcaga

SEQ ID NO: 415172 - DNA, 18 bp, Homo sapiens
ggtttaactcagatcact

SEQ ID NO: 415173 - DNA, 18 bp, Homo sapiens
ggtttacaacaaacactg

SEQ ID NO: 415174 - DNA, 12 bp, Homo sapiens
ggtttactgctg

SEQ ID NO: 415175 - DNA, 14 bp, Homo sapiens
ggtttcagaaaggg

SEQ ID NO: 415176 - DNA, 18 bp, Homo sapiens
ggtttccacacaggccca

SEQ ID NO: 415177 - DNA, 19 bp, Homo sapiens
ggtttccacacaggcccat

SEQ ID NO: 415178 - DNA, 17 bp, Homo sapiens
ggtttctgccctgccca

SEQ ID NO: 415179 - DNA, 22 bp, Homo sapiens
ggtttgggcagtggagagggga

SEQ ID NO: 415180 - DNA, 19 bp, Homo sapiens
ggtttgggcccctcagagc

SEQ ID NO: 415181 - DNA, 23 bp, Homo sapiens
ggtttgtctgtaagctgcagtgt

SEQ ID NO: 415182 - DNA, 19 bp, Homo sapiens
ggttttattctttgagaag

SEQ ID NO: 415183 - DNA, 19 bp, Homo sapiens
ggttttattgtccttcaga

SEQ ID NO: 415184 - DNA, 13 bp, Homo sapiens
ggttttcccctcc

SEQ ID NO: 415185 - DNA, 17 bp, Homo sapiens
ggttttggagtcagtag

SEQ ID NO: 415186 - DNA, 15 bp, Homo sapiens
ggttttgtattcttt

SEQ ID NO: 415187 - DNA, 20 bp, Homo sapiens
ggtttttctgttccctgctg

SEQ ID NO: 415188 - DNA, 11 bp, Homo sapiens
gtaaaaagctt

SEQ ID NO: 415189 - DNA, 21 bp, Homo sapiens
gtaaaactacacatccctaat

SEQ ID NO: 415190 - DNA, 13 bp, Homo sapiens
gtaaaactgtgac

SEQ ID NO: 415191 - DNA, 15 bp, Homo sapiens
gtaaaactttatttt

SEQ ID NO: 415192 - DNA, 16 bp, Homo sapiens
gtaaaagagccaagtt

SEQ ID NO: 415193 - DNA, 18 bp, Homo sapiens
gtaaaagcaacatcagct

SEQ ID NO: 415194 - DNA, 19 bp, Homo sapiens
gtaaaagcaacatcagctt

SEQ ID NO: 415195 - DNA, 12 bp, Homo sapiens
gtaaaagtctac

SEQ ID NO: 415196 - DNA, 18 bp, Homo sapiens
gtaaaatcttcagctggt

SEQ ID NO: 415197 - DNA, 15 bp, Homo sapiens
gtaaaatcttgtcat

SEQ ID NO: 415198 - DNA, 19 bp, Homo sapiens
gtaaaatcttgtcatgtgt

SEQ ID NO: 415199 - DNA, 18 bp, Homo sapiens
gtaaaatgtgggattatg

SEQ ID NO: 415200 - DNA, 16 bp, Homo sapiens
gtaaaatgtttgctgt

SEQ ID NO: 415201 - DNA, 20 bp, Homo sapiens
gtaaaattattccctgaatt

SEQ ID NO: 415202 - DNA, 20 bp, Homo sapiens
gtaaacaaactgtgtaactg

SEQ ID NO: 415203 - DNA, 23 bp, Homo sapiens
gtaaacaacgtgtatagtgccta

SEQ ID NO: 415204 - DNA, 15 bp, Homo sapiens
gtaaacactcagctg

SEQ ID NO: 415205 - DNA, 21 bp, Homo sapiens
gtaaactcaaaacttaacata

SEQ ID NO: 415206 - DNA, 21 bp, Homo sapiens
gtaaactcttcaccttggttt

SEQ ID NO: 415207 - DNA, 21 bp, Homo sapiens
gtaaactgtatcaaatctgta

SEQ ID NO: 415208 - DNA, 21 bp, Homo sapiens
gtaaagataaaaggataggaa

SEQ ID NO: 415209 - DNA, 20 bp, Homo sapiens
gtaaagctaaaatgatttta

SEQ ID NO: 415210 - DNA, 22 bp, Homo sapiens
gtaaagctagacaaaggcccag

SEQ ID NO: 415211 - DNA, 16 bp, Homo sapiens
gtaaagtatgtaaaca

SEQ ID NO: 415212 - DNA, 15 bp, Homo sapiens
gtaaagttaattcat

SEQ ID NO: 415213 - DNA, 15 bp, Homo sapiens
gtaaagttgagggga

SEQ ID NO: 415214 - DNA, 21 bp, Homo sapiens
gtaaagttgaggggagaggaa

SEQ ID NO: 415215 - DNA, 12 bp, Homo sapiens
gtaaataaactc

SEQ ID NO: 415216 - DNA, 14 bp, Homo sapiens
gtaaataaactctt

SEQ ID NO: 415217 - DNA, 17 bp, Homo sapiens
gtaaataaactcttcaa

SEQ ID NO: 415218 - DNA, 16 bp, Homo sapiens
gtaaataaactttcag

SEQ ID NO: 415219 - DNA, 13 bp, Homo sapiens
gtaaatacaaaat

SEQ ID NO: 415220 - DNA, 21 bp, Homo sapiens
gtaaatacaaaataaaattat

SEQ ID NO: 415221 - DNA, 15 bp, Homo sapiens
gtaaatacatgtgtg

SEQ ID NO: 415222 - DNA, 17 bp, Homo sapiens
gtaaatacatgtgtgga

SEQ ID NO: 415223 - DNA, 18 bp, Homo sapiens
gtaaatagcaacatgctt

SEQ ID NO: 415224 - DNA, 17 bp, Homo sapiens
gtaaatagtatttgaga

SEQ ID NO: 415225 - DNA, 15 bp, Homo sapiens
gtaaatatatgtttt

SEQ ID NO: 415226 - DNA, 22 bp, Homo sapiens
gtaaatatatgttttgagaaaa

SEQ ID NO: 415227 - DNA, 19 bp, Homo sapiens
gtaaatatcccagagaaca

SEQ ID NO: 415228 - DNA, 12 bp, Homo sapiens
gtaaatattatg

SEQ ID NO: 415229 - DNA, 14 bp, Homo sapiens
gtaaatattctata

SEQ ID NO: 415230 - DNA, 12 bp, Homo sapiens
gtaaatattctt

SEQ ID NO: 415231 - DNA, 19 bp, Homo sapiens
gtaaatcctagacttgaaa

SEQ ID NO: 415232 - DNA, 20 bp, Homo sapiens
gtaaatgctacctctgatca

SEQ ID NO: 415233 - DNA, 22 bp, Homo sapiens
gtaaatgtctgtggccttgttc

SEQ ID NO: 415234 - DNA, 13 bp, Homo sapiens
gtaaatgttatga

SEQ ID NO: 415235 - DNA, 15 bp, Homo sapiens
gtaaatgttatgact

SEQ ID NO: 415236 - DNA, 17 bp, Homo sapiens
gtaaatgttatgactcc

SEQ ID NO: 415237 - DNA, 14 bp, Homo sapiens
gtaaatgtttaata

SEQ ID NO: 415238 - DNA, 14 bp, Homo sapiens
gtaaattattcagt

SEQ ID NO: 415239 - DNA, 14 bp, Homo sapiens
gtaaattattttaa

SEQ ID NO: 415240 - DNA, 15 bp, Homo sapiens
gtaaattattttaaa

SEQ ID NO: 415241 - DNA, 22 bp, Homo sapiens
gtaaattattttaaattataag

SEQ ID NO: 415242 - DNA, 12 bp, Homo sapiens
gtaaatttaact

SEQ ID NO: 415243 - DNA, 15 bp, Homo sapiens
gtaacaactaattat

SEQ ID NO: 415244 - DNA, 12 bp, Homo sapiens
gtaacaagaaaa

SEQ ID NO: 415245 - DNA, 15 bp, Homo sapiens
gtaacaagaaaacat

SEQ ID NO: 415246 - DNA, 16 bp, Homo sapiens
gtaacaagaaaacata

SEQ ID NO: 415247 - DNA, 13 bp, Homo sapiens
gtaacaatgtttg

SEQ ID NO: 415248 - DNA, 16 bp, Homo sapiens
gtaacacataaagtaa

SEQ ID NO: 415249 - DNA, 16 bp, Homo sapiens
gtaacagttggtgatt

SEQ ID NO: 415250 - DNA, 13 bp, Homo sapiens
gtaacatataaat

SEQ ID NO: 415251 - DNA, 23 bp, Homo sapiens
gtaacatatttcttgagtaattt

SEQ ID NO: 415252 - DNA, 17 bp, Homo sapiens
gtaacattctatttcaa

SEQ ID NO: 415253 - DNA, 13 bp, Homo sapiens
gtaaccaagctgt

SEQ ID NO: 415254 - DNA, 17 bp, Homo sapiens
gtaaccacctctctgtc

SEQ ID NO: 415255 - DNA, 23 bp, Homo sapiens
gtaaccacctctctgtctttttc

SEQ ID NO: 415256 - DNA, 17 bp, Homo sapiens
gtaacctcagctctggg

SEQ ID NO: 415257 - DNA, 18 bp, Homo sapiens
gtaacctcagctctggga

SEQ ID NO: 415258 - DNA, 19 bp, Homo sapiens
gtaacctgggcttaagttt

SEQ ID NO: 415259 - DNA, 20 bp, Homo sapiens
gtaacctgggcttaagtttt

SEQ ID NO: 415260 - DNA, 18 bp, Homo sapiens
gtaactcagacattccaa

SEQ ID NO: 415261 - DNA, 21 bp, Homo sapiens
gtaactgcccttttaaatggc

SEQ ID NO: 415262 - DNA, 23 bp, Homo sapiens
gtaactgcccttttaaatggcat

SEQ ID NO: 415263 - DNA, 12 bp, Homo sapiens
gtaactgctgag

SEQ ID NO: 415264 - DNA, 15 bp, Homo sapiens
gtaactgctgagcca

SEQ ID NO: 415265 - DNA, 13 bp, Homo sapiens
gtaacttaattat

SEQ ID NO: 415266 - DNA, 16 bp, Homo sapiens
gtaacttaattataag

SEQ ID NO: 415267 - DNA, 19 bp, Homo sapiens
gtaacttgctgtgaaatga

SEQ ID NO: 415268 - DNA, 19 bp, Homo sapiens
gtaacttttgtaaatacac

SEQ ID NO: 415269 - DNA, 20 bp, Homo sapiens
gtaagaaagtgaagcaaatc

SEQ ID NO: 415270 - DNA, 23 bp, Homo sapiens
gtaagacacacagcctttctgta

SEQ ID NO: 415271 - DNA, 15 bp, Homo sapiens
gtaagacggccttgg

SEQ ID NO: 415272 - DNA, 20 bp, Homo sapiens
gtaagagcaccttcctcact

SEQ ID NO: 415273 - DNA, 14 bp, Homo sapiens
gtaagagctggtgt

SEQ ID NO: 415274 - DNA, 16 bp, Homo sapiens
gtaagagctggtgtct

SEQ ID NO: 415275 - DNA, 17 bp, Homo sapiens
gtaagattttattttca

SEQ ID NO: 415276 - DNA, 13 bp, Homo sapiens
gtaagcacctggg

SEQ ID NO: 415277 - DNA, 18 bp, Homo sapiens
gtaagcagagttctttgc

SEQ ID NO: 415278 - DNA, 19 bp, Homo sapiens
gtaagcattctgagctggg

SEQ ID NO: 415279 - DNA, 19 bp, Homo sapiens
gtaatataacaatatatga

SEQ ID NO: 415280 - DNA, 23 bp, Homo sapiens
gtaatatagggtttgtttgctgc

SEQ ID NO: 415281 - DNA, 17 bp, Homo sapiens
gtaatatattgccagta

SEQ ID NO: 415282 - DNA, 13 bp, Homo sapiens
gtaatatattgct

SEQ ID NO: 415283 - DNA, 18 bp, Homo sapiens
gtaatatattgctgctgg

SEQ ID NO: 415284 - DNA, 12 bp, Homo sapiens
gtaatatcttta

SEQ ID NO: 415285 - DNA, 13 bp, Homo sapiens
gtaatatctttca

SEQ ID NO: 415286 - DNA, 12 bp, Homo sapiens
gtaatattaaat

SEQ ID NO: 415287 - DNA, 14 bp, Homo sapiens
gtaatattaaattc

SEQ ID NO: 415288 - DNA, 14 bp, Homo sapiens
gtaatatttcttca

SEQ ID NO: 415289 - DNA, 19 bp, Homo sapiens
gtaatcaatgaatattgaa

SEQ ID NO: 415290 - DNA, 17 bp, Homo sapiens
gtaatcatttatcttat

SEQ ID NO: 415291 - DNA, 15 bp, Homo sapiens
gtaatccacctgcct

SEQ ID NO: 415292 - DNA, 12 bp, Homo sapiens
gtaatcccagct

SEQ ID NO: 415293 - DNA, 22 bp, Homo sapiens
gtaatctatgaattctaagtga

SEQ ID NO: 415294 - DNA, 19 bp, Homo sapiens
gtaatctgaaacacagtca

SEQ ID NO: 415295 - DNA, 13 bp, Homo sapiens
gtaatctttcata

SEQ ID NO: 415296 - DNA, 20 bp, Homo sapiens
gtaatctttcatagccatac

SEQ ID NO: 415297 - DNA, 16 bp, Homo sapiens
gtaatgacagagagtt

SEQ ID NO: 415298 - DNA, 18 bp, Homo sapiens
gtaatgacagagagttct

SEQ ID NO: 415299 - DNA, 14 bp, Homo sapiens
gtaatgggcctgcc

SEQ ID NO: 415300 - DNA, 16 bp, Homo sapiens
gtaatgggcctgccca

SEQ ID NO: 415301 - DNA, 13 bp, Homo sapiens
gtaatgtatctta

SEQ ID NO: 415302 - DNA, 20 bp, Homo sapiens
gtaatgtgtatgtctggtaa

SEQ ID NO: 415303 - DNA, 13 bp, Homo sapiens
gtaattcaagaaa

SEQ ID NO: 415304 - DNA, 12 bp, Homo sapiens
gtaattctaaat

SEQ ID NO: 415305 - DNA, 18 bp, Homo sapiens
gtaattctaccctgaaag

SEQ ID NO: 415306 - DNA, 17 bp, Homo sapiens
gtaattgcttacatttt

SEQ ID NO: 415307 - DNA, 23 bp, Homo sapiens
gtaattgcttacatttttacaat

SEQ ID NO: 415308 - DNA, 14 bp, Homo sapiens
gtaattgtgaaaaa

SEQ ID NO: 415309 - DNA, 17 bp, Homo sapiens
gtaattgttacaatttt

SEQ ID NO: 415310 - DNA, 21 bp, Homo sapiens
gtaatttaattccccttccct

SEQ ID NO: 415311 - DNA, 20 bp, Homo sapiens
gtaatttatagtttatacag

SEQ ID NO: 415312 - DNA, 23 bp, Homo sapiens
gtaatttatagtttatacagttt

SEQ ID NO: 415313 - DNA, 23 bp, Homo sapiens
gtaattttgggtggggagaagag

SEQ ID NO: 415314 - DNA, 16 bp, Homo sapiens
gtaatttttttcttat

SEQ ID NO: 415315 - DNA, 13 bp, Homo sapiens
gtacaaagacagg

SEQ ID NO: 415316 - DNA, 14 bp, Homo sapiens
gtacaaagatactt

SEQ ID NO: 415317 - DNA, 16 bp, Homo sapiens
gtacaaagtaaaaata

SEQ ID NO: 415318 - DNA, 17 bp, Homo sapiens
gtacaaagtagagaagt

SEQ ID NO: 415319 - DNA, 21 bp, Homo sapiens
gtacaaatattcctgtttctg

SEQ ID NO: 415320 - DNA, 15 bp, Homo sapiens
gtacaatgtttcaga

SEQ ID NO: 415321 - DNA, 21 bp, Homo sapiens
gtacaattactaaattgtata

SEQ ID NO: 415322 - DNA, 21 bp, Homo sapiens
gtacaattctttgttgcttaa

SEQ ID NO: 415323 - DNA, 19 bp, Homo sapiens
gtacacaccctccagcaca

SEQ ID NO: 415324 - DNA, 21 bp, Homo sapiens
gtacacaccctccagcacaga

SEQ ID NO: 415325 - DNA, 17 bp, Homo sapiens
gtacacccaattttaaa

SEQ ID NO: 415326 - DNA, 14 bp, Homo sapiens
gtacactgaatatt

SEQ ID NO: 415327 - DNA, 17 bp, Homo sapiens
gtacagaaccagcactc

SEQ ID NO: 415328 - DNA, 20 bp, Homo sapiens
gtacagaaccagcactccca

SEQ ID NO: 415329 - DNA, 12 bp, Homo sapiens
gtacagcagggt

SEQ ID NO: 415330 - DNA, 14 bp, Homo sapiens
gtacagtatgtgtc

SEQ ID NO: 415331 - DNA, 12 bp, Homo sapiens
gtacagtcccag

SEQ ID NO: 415332 - DNA, 12 bp, Homo sapiens
gtacagtctgtc

SEQ ID NO: 415333 - DNA, 14 bp, Homo sapiens
gtacagtgaggagg

SEQ ID NO: 415334 - DNA, 21 bp, Homo sapiens
gtacagtggttctacaatcta

SEQ ID NO: 415335 - DNA, 20 bp, Homo sapiens
gtacagttatacatacctct

SEQ ID NO: 415336 - DNA, 16 bp, Homo sapiens
gtacagttcagttcct

SEQ ID NO: 415337 - DNA, 22 bp, Homo sapiens
gtacagttcttcgggaagagag

SEQ ID NO: 415338 - DNA, 23 bp, Homo sapiens
gtacagttcttcgggaagagagg

SEQ ID NO: 415339 - DNA, 22 bp, Homo sapiens
gtacataaattgcataaagcat

SEQ ID NO: 415340 - DNA, 13 bp, Homo sapiens
gtacatacattgt

SEQ ID NO: 415341 - DNA, 15 bp, Homo sapiens
gtacatatggaaatc

SEQ ID NO: 415342 - DNA, 14 bp, Homo sapiens
gtacatcgcttctt

SEQ ID NO: 415343 - DNA, 15 bp, Homo sapiens
gtacatctgcaatat

SEQ ID NO: 415344 - DNA, 13 bp, Homo sapiens
gtacatggaagaa

SEQ ID NO: 415345 - DNA, 14 bp, Homo sapiens
gtacatttatgtgt

SEQ ID NO: 415346 - DNA, 15 bp, Homo sapiens
gtacattttgcttgc

SEQ ID NO: 415347 - DNA, 16 bp, Homo sapiens
gtacattttttttcaa

SEQ ID NO: 415348 - DNA, 21 bp, Homo sapiens
gtaccaaagttttatcaagtt

SEQ ID NO: 415349 - DNA, 19 bp, Homo sapiens
gtaccaaatccacaagcca

SEQ ID NO: 415350 - DNA, 13 bp, Homo sapiens
gtaccaactgagc

SEQ ID NO: 415351 - DNA, 16 bp, Homo sapiens
gtaccaactgagccaa

SEQ ID NO: 415352 - DNA, 16 bp, Homo sapiens
gtaccaagatcacaaa

SEQ ID NO: 415353 - DNA, 19 bp, Homo sapiens
gtaccaagatcacaaatag

SEQ ID NO: 415354 - DNA, 20 bp, Homo sapiens
gtaccaagatcacaaatagt

SEQ ID NO: 415355 - DNA, 14 bp, Homo sapiens
gtaccaatcatttt

SEQ ID NO: 415356 - DNA, 21 bp, Homo sapiens
gtaccaatcattttaattatt

SEQ ID NO: 415357 - DNA, 14 bp, Homo sapiens
gtaccaatgctgtt

SEQ ID NO: 415358 - DNA, 20 bp, Homo sapiens
gtaccactgctaataaatga

SEQ ID NO: 415359 - DNA, 21 bp, Homo sapiens
gtaccagagcctatggaaagg

SEQ ID NO: 415360 - DNA, 22 bp, Homo sapiens
gtaccagagcctatggaaaggg

SEQ ID NO: 415361 - DNA, 16 bp, Homo sapiens
gtaccagccctggggc

SEQ ID NO: 415362 - DNA, 17 bp, Homo sapiens
gtaccatgttaaagagg

SEQ ID NO: 415363 - DNA, 16 bp, Homo sapiens
gtagaactgttcattt

SEQ ID NO: 415364 - DNA, 10 bp, Homo sapiens
gtagaagaaa

SEQ ID NO: 415365 - DNA, 14 bp, Homo sapiens
gtagaagaaagcaa

SEQ ID NO: 415366 - DNA, 15 bp, Homo sapiens
gtagaagaaagcaaa

SEQ ID NO: 415367 - DNA, 14 bp, Homo sapiens
gtagaagagggaga

SEQ ID NO: 415368 - DNA, 22 bp, Homo sapiens
gtagaagatggactctgaaaaa

SEQ ID NO: 415369 - DNA, 18 bp, Homo sapiens
gtagaagcccttctacct

SEQ ID NO: 415370 - DNA, 15 bp, Homo sapiens
gtagaaggtcggagg

SEQ ID NO: 415371 - DNA, 13 bp, Homo sapiens
gtagaatgctgta

SEQ ID NO: 415372 - DNA, 17 bp, Homo sapiens
gtagacaatttgcctta

SEQ ID NO: 415373 - DNA, 20 bp, Homo sapiens
gtagacctagggaggacctt

SEQ ID NO: 415374 - DNA, 10 bp, Homo sapiens
gtagactagt

SEQ ID NO: 415375 - DNA, 13 bp, Homo sapiens
gtagactagtgcc

SEQ ID NO: 415376 - DNA, 22 bp, Homo sapiens
gtagactggccatgcaagtggt

SEQ ID NO: 415377 - DNA, 15 bp, Homo sapiens
gtagagccagccttg

SEQ ID NO: 415378 - DNA, 16 bp, Homo sapiens
gtagagcggagaaagg

SEQ ID NO: 415379 - DNA, 15 bp, Homo sapiens
gtagaggaaggatgc

SEQ ID NO: 415380 - DNA, 17 bp, Homo sapiens
gtagagtcctaggacat

SEQ ID NO: 415381 - DNA, 12 bp, Homo sapiens
gtagatagaaat

SEQ ID NO: 415382 - DNA, 14 bp, Homo sapiens
gtagatagaaataa

SEQ ID NO: 415383 - DNA, 22 bp, Homo sapiens
gtagatccagatccagactgta

SEQ ID NO: 415384 - DNA, 20 bp, Homo sapiens
gtagatgatttctagcaggc

SEQ ID NO: 415385 - DNA, 13 bp, Homo sapiens
gtagatgctgcct

SEQ ID NO: 415386 - DNA, 13 bp, Homo sapiens
gtagatgtagcat

SEQ ID NO: 415387 - DNA, 18 bp, Homo sapiens
gtagatgtagcattgttc

SEQ ID NO: 415388 - DNA, 22 bp, Homo sapiens
gtagatgtattttcaataaaga

SEQ ID NO: 415389 - DNA, 13 bp, Homo sapiens
gtagattgatcta

SEQ ID NO: 415390 - DNA, 16 bp, Homo sapiens
gtagcaagatctttac

SEQ ID NO: 415391 - DNA, 18 bp, Homo sapiens
gtagcagagtcattgtta

SEQ ID NO: 415392 - DNA, 20 bp, Homo sapiens
gtagcatactgatgagacaa

SEQ ID NO: 415393 - DNA, 16 bp, Homo sapiens
gtagcatataaatgtt

SEQ ID NO: 415394 - DNA, 16 bp, Homo sapiens
gtagcatggactctgg

SEQ ID NO: 415395 - DNA, 21 bp, Homo sapiens
gtagcatgttgagccaggcct

SEQ ID NO: 415396 - DNA, 14 bp, Homo sapiens
gtagcattgttcca

SEQ ID NO: 415397 - DNA, 15 bp, Homo sapiens
gtagcattgttccac

SEQ ID NO: 415398 - DNA, 13 bp, Homo sapiens
gtagccaccaccg

SEQ ID NO: 415399 - DNA, 12 bp, Homo sapiens
gtagccactggc

SEQ ID NO: 415400 - DNA, 15 bp, Homo sapiens
gtagccatggctcag

SEQ ID NO: 415401 - DNA, 22 bp, Homo sapiens
gtagcccacaataatgaataat

SEQ ID NO: 415402 - DNA, 21 bp, Homo sapiens
gtagccccaagaaggctgggg

SEQ ID NO: 415403 - DNA, 23 bp, Homo sapiens
gtagccccaatatggtggccctg

SEQ ID NO: 415404 - DNA, 13 bp, Homo sapiens
gtagcccccgagg

SEQ ID NO: 415405 - DNA, 17 bp, Homo sapiens
gtagccctggccagagg

SEQ ID NO: 415406 - DNA, 20 bp, Homo sapiens
gtagcctccgtttatgggcc

SEQ ID NO: 415407 - DNA, 21 bp, Homo sapiens
gtagcctccgtttatgggcct

SEQ ID NO: 415408 - DNA, 13 bp, Homo sapiens
gtagcgagctgct

SEQ ID NO: 415409 - DNA, 15 bp, Homo sapiens
gtagctatttttctt

SEQ ID NO: 415410 - DNA, 17 bp, Homo sapiens
gtagctccctcctccca

SEQ ID NO: 415411 - DNA, 21 bp, Homo sapiens
gtagctccctcctcccatctc

SEQ ID NO: 415412 - DNA, 14 bp, Homo sapiens
gtagctctgagccc

SEQ ID NO: 415413 - DNA, 16 bp, Homo sapiens
gtagctctgagccctc

SEQ ID NO: 415414 - DNA, 20 bp, Homo sapiens
gtagctcttagtcctccctg

SEQ ID NO: 415415 - DNA, 22 bp, Homo sapiens
gtagctcttagtcctccctgct

SEQ ID NO: 415416 - DNA, 18 bp, Homo sapiens
gtagctgataaagaaacc

SEQ ID NO: 415417 - DNA, 17 bp, Homo sapiens
gtagctgcaaaggacag

SEQ ID NO: 415418 - DNA, 14 bp, Homo sapiens
gtagctgtggggag

SEQ ID NO: 415419 - DNA, 19 bp, Homo sapiens
gtagcttctgacctcagca

SEQ ID NO: 415420 - DNA, 22 bp, Homo sapiens
gtagcttttactttttatgaaa

SEQ ID NO: 415421 - DNA, 16 bp, Homo sapiens
gtaggaaacagaaaag

SEQ ID NO: 415422 - DNA, 18 bp, Homo sapiens
gtaggaatctgccttcca

SEQ ID NO: 415423 - DNA, 21 bp, Homo sapiens
gtaggaatctgccttccagcc

SEQ ID NO: 415424 - DNA, 16 bp, Homo sapiens
gtaggactatataaag

SEQ ID NO: 415425 - DNA, 15 bp, Homo sapiens
gtaggagctgagctt

SEQ ID NO: 415426 - DNA, 14 bp, Homo sapiens
gtaggaggtttgga

SEQ ID NO: 415427 - DNA, 15 bp, Homo sapiens
gtaggcaaggctgcc

SEQ ID NO: 415428 - DNA, 21 bp, Homo sapiens
gtaggcccttgtcctgccagc

SEQ ID NO: 415429 - DNA, 15 bp, Homo sapiens
gtaggctaaaaacat

SEQ ID NO: 415430 - DNA, 22 bp, Homo sapiens
gtaggctgtattttcttttata

SEQ ID NO: 415431 - DNA, 21 bp, Homo sapiens
gtagggagtacctgctgcccc

SEQ ID NO: 415432 - DNA, 21 bp, Homo sapiens
gtagggggcctgagttgaggg

SEQ ID NO: 415433 - DNA, 20 bp, Homo sapiens
gtaggggtcaaagaaatgct

SEQ ID NO: 415434 - DNA, 21 bp, Homo sapiens
gtagggtcaggccacggcagc

SEQ ID NO: 415435 - DNA, 16 bp, Homo sapiens
gtagggtgaggcgtgg

SEQ ID NO: 415436 - DNA, 16 bp, Homo sapiens
gtagggttataataat

SEQ ID NO: 415437 - DNA, 14 bp, Homo sapiens
gtaggtccaagggc

SEQ ID NO: 415438 - DNA, 15 bp, Homo sapiens
gtaggtccaagggcc

SEQ ID NO: 415439 - DNA, 21 bp, Homo sapiens
gtaggtgatgtttccagctgc

SEQ ID NO: 415440 - DNA, 23 bp, Homo sapiens
gtaggtgatgtttccagctgcca

SEQ ID NO: 415441 - DNA, 12 bp, Homo sapiens
gtaggtgctggc

SEQ ID NO: 415442 - DNA, 15 bp, Homo sapiens
gtaggtgctggcctc

SEQ ID NO: 415443 - DNA, 17 bp, Homo sapiens
gtagtaacacataaagt

SEQ ID NO: 415444 - DNA, 20 bp, Homo sapiens
gtagtaacacataaagtaaa

SEQ ID NO: 415445 - DNA, 22 bp, Homo sapiens
gtagtactcctgcaaaatttta

SEQ ID NO: 415446 - DNA, 17 bp, Homo sapiens
gtagtagaatctcagca

SEQ ID NO: 415447 - DNA, 20 bp, Homo sapiens
gtagtagccctttctgtgtg

SEQ ID NO: 415448 - DNA, 18 bp, Homo sapiens
gtagtagggtcaggccac

SEQ ID NO: 415449 - DNA, 22 bp, Homo sapiens
gtagtagtctcattacttttga

SEQ ID NO: 415450 - DNA, 23 bp, Homo sapiens
gtagtagttgatgaccaatctct

SEQ ID NO: 415451 - DNA, 17 bp, Homo sapiens
gtagtcaagattgtgtt

SEQ ID NO: 415452 - DNA, 14 bp, Homo sapiens
gtagtcaggtgcct

SEQ ID NO: 415453 - DNA, 11 bp, Homo sapiens
gtagtgcagtc

SEQ ID NO: 415454 - DNA, 21 bp, Homo sapiens
gtagtgcccctcccatggccc

SEQ ID NO: 415455 - DNA, 17 bp, Homo sapiens
gtagtggaagagcagcc

SEQ ID NO: 415456 - DNA, 21 bp, Homo sapiens
gtagtggaagagcagcctgat

SEQ ID NO: 415457 - DNA, 16 bp, Homo sapiens
gtagttaggaaataaa

SEQ ID NO: 415458 - DNA, 22 bp, Homo sapiens
gtagttaggaaataaaaccttt

SEQ ID NO: 415459 - DNA, 13 bp, Homo sapiens
gtagttagtagca

SEQ ID NO: 415460 - DNA, 19 bp, Homo sapiens
gtagttctttgttcctgct

SEQ ID NO: 415461 - DNA, 20 bp, Homo sapiens
gtagttctttgttcctgctt

SEQ ID NO: 415462 - DNA, 22 bp, Homo sapiens
gtagttgatgaccaatctctgt

SEQ ID NO: 415463 - DNA, 13 bp, Homo sapiens
gtagttttctttt

SEQ ID NO: 415464 - DNA, 16 bp, Homo sapiens
gtagtttttgctgaag

SEQ ID NO: 415465 - DNA, 19 bp, Homo sapiens
gtataaaaataaaaaagat

SEQ ID NO: 415466 - DNA, 19 bp, Homo sapiens
gtataaaacctaaaattaa

SEQ ID NO: 415467 - DNA, 21 bp, Homo sapiens
gtataaaactttcctcgcctg

SEQ ID NO: 415468 - DNA, 19 bp, Homo sapiens
gtataaaatgcaaaataaa

SEQ ID NO: 415469 - DNA, 12 bp, Homo sapiens
gtataaaatgta

SEQ ID NO: 415470 - DNA, 17 bp, Homo sapiens
gtataaaatgtaaaaac

SEQ ID NO: 415471 - DNA, 13 bp, Homo sapiens
gtataaactatca

SEQ ID NO: 415472 - DNA, 12 bp, Homo sapiens
gtataaagaaca

SEQ ID NO: 415473 - DNA, 19 bp, Homo sapiens
gtataaataataaagaact

SEQ ID NO: 415474 - DNA, 15 bp, Homo sapiens
gtataaatatgaaat

SEQ ID NO: 415475 - DNA, 18 bp, Homo sapiens
gtataacaaactatgtaa

SEQ ID NO: 415476 - DNA, 22 bp, Homo sapiens
gtataacaagccaaacattctt

SEQ ID NO: 415477 - DNA, 20 bp, Homo sapiens
gtataacacaatatgaatac

SEQ ID NO: 415478 - DNA, 12 bp, Homo sapiens
gtataaggaaat

SEQ ID NO: 415479 - DNA, 13 bp, Homo sapiens
gtataattatgaa

SEQ ID NO: 415480 - DNA, 11 bp, Homo sapiens
gtatacaaaca

SEQ ID NO: 415481 - DNA, 12 bp, Homo sapiens
gtatacaaacag

SEQ ID NO: 415482 - DNA, 18 bp, Homo sapiens
gtatacaaacaggtgcta

SEQ ID NO: 415483 - DNA, 21 bp, Homo sapiens
gtatacattttgttatagaat

SEQ ID NO: 415484 - DNA, 14 bp, Homo sapiens
gtataccacctgta

SEQ ID NO: 415485 - DNA, 16 bp, Homo sapiens
gtataccacctgtaca

SEQ ID NO: 415486 - DNA, 13 bp, Homo sapiens
gtatactgtgtgg

SEQ ID NO: 415487 - DNA, 16 bp, Homo sapiens
gtatacttaatactga

SEQ ID NO: 415488 - DNA, 16 bp, Homo sapiens
gtatacttttgtttca

SEQ ID NO: 415489 - DNA, 15 bp, Homo sapiens
gtatagcaacctatt

SEQ ID NO: 415490 - DNA, 17 bp, Homo sapiens
gtataggccatctgtaa

SEQ ID NO: 415491 - DNA, 15 bp, Homo sapiens
gtatagtgtaaaata

SEQ ID NO: 415492 - DNA, 19 bp, Homo sapiens
gtatagttaggatagcatt

SEQ ID NO: 415493 - DNA, 14 bp, Homo sapiens
gtatagttttacac

SEQ ID NO: 415494 - DNA, 20 bp, Homo sapiens
gtatagttttataaaactca

SEQ ID NO: 415495 - DNA, 13 bp, Homo sapiens
gtatataagcttt

SEQ ID NO: 415496 - DNA, 13 bp, Homo sapiens
gtatatacatttc

SEQ ID NO: 415497 - DNA, 14 bp, Homo sapiens
gtatatatacataa

SEQ ID NO: 415498 - DNA, 16 bp, Homo sapiens
gtatatatacataaca

SEQ ID NO: 415499 - DNA, 21 bp, Homo sapiens
gtatatatatgccatgatgga

SEQ ID NO: 415500 - DNA, 13 bp, Homo sapiens
gtatatatgtaca

SEQ ID NO: 415501 - DNA, 15 bp, Homo sapiens
gtatatatgtacagt

SEQ ID NO: 415502 - DNA, 14 bp, Homo sapiens
gtatatatgtgtgt

SEQ ID NO: 415503 - DNA, 16 bp, Homo sapiens
gtatatatgtgtgttt

SEQ ID NO: 415504 - DNA, 20 bp, Homo sapiens
gtatatatgtgtgtttaaat

SEQ ID NO: 415505 - DNA, 14 bp, Homo sapiens
gtatatatttaaaa

SEQ ID NO: 415506 - DNA, 18 bp, Homo sapiens
gtatatattttgaaagga

SEQ ID NO: 415507 - DNA, 14 bp, Homo sapiens
gtatatcagaaaag

SEQ ID NO: 415508 - DNA, 17 bp, Homo sapiens
gtatatctggacaagcc

SEQ ID NO: 415509 - DNA, 21 bp, Homo sapiens
gtatatctggacaagccaact

SEQ ID NO: 415510 - DNA, 11 bp, Homo sapiens
gtatatctttg

SEQ ID NO: 415511 - DNA, 13 bp, Homo sapiens
gtatatgtctcag

SEQ ID NO: 415512 - DNA, 15 bp, Homo sapiens
gtatatgttgtaata

SEQ ID NO: 415513 - DNA, 19 bp, Homo sapiens
gtatatgtttatatactgg

SEQ ID NO: 415514 - DNA, 13 bp, Homo sapiens
gtatattactgat

SEQ ID NO: 415515 - DNA, 21 bp, Homo sapiens
gtatattgatgtaactgtgtc

SEQ ID NO: 415516 - DNA, 17 bp, Homo sapiens
gtatatttgaaactgct

SEQ ID NO: 415517 - DNA, 19 bp, Homo sapiens
gtatcaaacagctcaggct

SEQ ID NO: 415518 - DNA, 19 bp, Homo sapiens
gtatcaaaggcagaaagga

SEQ ID NO: 415519 - DNA, 21 bp, Homo sapiens
gtatcaaaggcagaaaggaga

SEQ ID NO: 415520 - DNA, 17 bp, Homo sapiens
gtatcaacccagaaaca

SEQ ID NO: 415521 - DNA, 13 bp, Homo sapiens
gtatcaaggctgc

SEQ ID NO: 415522 - DNA, 17 bp, Homo sapiens
gtatcaaggctgcctgg

SEQ ID NO: 415523 - DNA, 16 bp, Homo sapiens
gtatcacaaagctgtg

SEQ ID NO: 415524 - DNA, 19 bp, Homo sapiens
gtatcacacactttctgac

SEQ ID NO: 415525 - DNA, 15 bp, Homo sapiens
gtatccaattatgtg

SEQ ID NO: 415526 - DNA, 17 bp, Homo sapiens
gtatccaattatgtgac

SEQ ID NO: 415527 - DNA, 18 bp, Homo sapiens
gtatccatgggggcaggg

SEQ ID NO: 415528 - DNA, 13 bp, Homo sapiens
gtatcccacctcc

SEQ ID NO: 415529 - DNA, 18 bp, Homo sapiens
gtatcccacctccagccc

SEQ ID NO: 415530 - DNA, 16 bp, Homo sapiens
gtatcctgcccagtgt

SEQ ID NO: 415531 - DNA, 13 bp, Homo sapiens
gtatcctggggct

SEQ ID NO: 415532 - DNA, 16 bp, Homo sapiens
gtatctagtgcagctg

SEQ ID NO: 415533 - DNA, 17 bp, Homo sapiens
gtatctagtggtctgat

SEQ ID NO: 415534 - DNA, 18 bp, Homo sapiens
gtatctagtggtctgatt

SEQ ID NO: 415535 - DNA, 14 bp, Homo sapiens
gtatctattttcaa

SEQ ID NO: 415536 - DNA, 18 bp, Homo sapiens
gtatctcgaagtcttcca

SEQ ID NO: 415537 - DNA, 20 bp, Homo sapiens
gtatctcggacctttcagct

SEQ ID NO: 415538 - DNA, 19 bp, Homo sapiens
gtatctctgaagcatgttt

SEQ ID NO: 415539 - DNA, 20 bp, Homo sapiens
gtatctgcatgtaaaatctt

SEQ ID NO: 415540 - DNA, 21 bp, Homo sapiens
gtatctgcatgtaaaatcttc

SEQ ID NO: 415541 - DNA, 19 bp, Homo sapiens
gtatctgctgcctctgaaa

SEQ ID NO: 415542 - DNA, 12 bp, Homo sapiens
gtatctggctgg

SEQ ID NO: 415543 - DNA, 14 bp, Homo sapiens
gtatctggctgggt

SEQ ID NO: 415544 - DNA, 14 bp, Homo sapiens
gtatctgggaactg

SEQ ID NO: 415545 - DNA, 15 bp, Homo sapiens
gtatctgtaaccctt

SEQ ID NO: 415546 - DNA, 23 bp, Homo sapiens
gtatctgtacctgcccccactca

SEQ ID NO: 415547 - DNA, 14 bp, Homo sapiens
gtatcttatttata

SEQ ID NO: 415548 - DNA, 15 bp, Homo sapiens
gtatctttccaggct

SEQ ID NO: 415549 - DNA, 16 bp, Homo sapiens
gtatcttttttaaatg

SEQ ID NO: 415550 - DNA, 23 bp, Homo sapiens
gtatgaacttgaggacacatgtc

SEQ ID NO: 415551 - DNA, 13 bp, Homo sapiens
gtatgaagtactt

SEQ ID NO: 415552 - DNA, 18 bp, Homo sapiens
gtatgaataaagacacct

SEQ ID NO: 415553 - DNA, 19 bp, Homo sapiens
gtatgaataaagacaccta

SEQ ID NO: 415554 - DNA, 13 bp, Homo sapiens
gtatgaatgatgt

SEQ ID NO: 415555 - DNA, 20 bp, Homo sapiens
gtatgactaaagagagaatg

SEQ ID NO: 415556 - DNA, 12 bp, Homo sapiens
gtatgagaaata

SEQ ID NO: 415557 - DNA, 13 bp, Homo sapiens
gtatgatgtgttg

SEQ ID NO: 415558 - DNA, 22 bp, Homo sapiens
gtatgcctttaaatctgtgatg

SEQ ID NO: 415559 - DNA, 15 bp, Homo sapiens
gtatgggacctgcta

SEQ ID NO: 415560 - DNA, 13 bp, Homo sapiens
gtatgtatctatt

SEQ ID NO: 415561 - DNA, 14 bp, Homo sapiens
gtatgtctctttaa

SEQ ID NO: 415562 - DNA, 18 bp, Homo sapiens
gtatgtgaaagtgtaaaa

SEQ ID NO: 415563 - DNA, 15 bp, Homo sapiens
gtatgtggatacagt

SEQ ID NO: 415564 - DNA, 21 bp, Homo sapiens
gtatgtggatacagtcattat

SEQ ID NO: 415565 - DNA, 16 bp, Homo sapiens
gtatgtgttgccaaag

SEQ ID NO: 415566 - DNA, 22 bp, Homo sapiens
gtatgttaaagcatcagagatg

SEQ ID NO: 415567 - DNA, 15 bp, Homo sapiens
gtatgttatgaacat

SEQ ID NO: 415568 - DNA, 21 bp, Homo sapiens
gtatgttgtgaagatgtttgc

SEQ ID NO: 415569 - DNA, 17 bp, Homo sapiens
gtattaaacttgtcaga

SEQ ID NO: 415570 - DNA, 14 bp, Homo sapiens
gtattaaagggggg

SEQ ID NO: 415571 - DNA, 15 bp, Homo sapiens
gtattaacctacctg

SEQ ID NO: 415572 - DNA, 22 bp, Homo sapiens
gtattacactgtatttgtatct

SEQ ID NO: 415573 - DNA, 15 bp, Homo sapiens
gtattacataaataa

SEQ ID NO: 415574 - DNA, 13 bp, Homo sapiens
gtattagatatca

SEQ ID NO: 415575 - DNA, 15 bp, Homo sapiens
gtattagccagtcat

SEQ ID NO: 415576 - DNA, 16 bp, Homo sapiens
gtattagtagagcaac

SEQ ID NO: 415577 - DNA, 20 bp, Homo sapiens
gtattatttctccatcccct

SEQ ID NO: 415578 - DNA, 22 bp, Homo sapiens
gtattcaaatgttagagtttaa

SEQ ID NO: 415579 - DNA, 21 bp, Homo sapiens
gtattcaagcaaacatcaaat

SEQ ID NO: 415580 - DNA, 15 bp, Homo sapiens
gtattcaccaccctg

SEQ ID NO: 415581 - DNA, 15 bp, Homo sapiens
gtattccaccttaaa

SEQ ID NO: 415582 - DNA, 17 bp, Homo sapiens
gtattcctgcctttgat

SEQ ID NO: 415583 - DNA, 13 bp, Homo sapiens
gtattctcagagc

SEQ ID NO: 415584 - DNA, 14 bp, Homo sapiens
gtattctctctatg

SEQ ID NO: 415585 - DNA, 15 bp, Homo sapiens
gtattctctgtccag

SEQ ID NO: 415586 - DNA, 19 bp, Homo sapiens
gtattctgcaacagcctgt

SEQ ID NO: 415587 - DNA, 11 bp, Homo sapiens
gtattctgtac

SEQ ID NO: 415588 - DNA, 21 bp, Homo sapiens
gtattctgtggattctatatt

SEQ ID NO: 415589 - DNA, 14 bp, Homo sapiens
gtattcttcttttc

SEQ ID NO: 415590 - DNA, 14 bp, Homo sapiens
gtattcttgtcaaa

SEQ ID NO: 415591 - DNA, 13 bp, Homo sapiens
gtattgatatcac

SEQ ID NO: 415592 - DNA, 20 bp, Homo sapiens
gtattgcagctaagctcaaa

SEQ ID NO: 415593 - DNA, 13 bp, Homo sapiens
gtattgccacctc

SEQ ID NO: 415594 - DNA, 20 bp, Homo sapiens
gtattggcatttatttatgt

SEQ ID NO: 415595 - DNA, 15 bp, Homo sapiens
gtattggcctggagg

SEQ ID NO: 415596 - DNA, 23 bp, Homo sapiens
gtattggtttctgtttgaatttt

SEQ ID NO: 415597 - DNA, 21 bp, Homo sapiens
gtattgtaagtggaaaatgca

SEQ ID NO: 415598 - DNA, 23 bp, Homo sapiens
gtattgtccatatcagacctctg

SEQ ID NO: 415599 - DNA, 19 bp, Homo sapiens
gtattgtctgacacatgct

SEQ ID NO: 415600 - DNA, 21 bp, Homo sapiens
gtattgttcttgtaaaactgt

SEQ ID NO: 415601 - DNA, 22 bp, Homo sapiens
gtattgttcttgtaaaactgtg

SEQ ID NO: 415602 - DNA, 14 bp, Homo sapiens
gtatttaaatgttc

SEQ ID NO: 415603 - DNA, 21 bp, Homo sapiens
gtatttaatgatttttgtgta

SEQ ID NO: 415604 - DNA, 23 bp, Homo sapiens
gtatttaatgatttttgtgtatc

SEQ ID NO: 415605 - DNA, 13 bp, Homo sapiens
gtatttatatatt

SEQ ID NO: 415606 - DNA, 13 bp, Homo sapiens
gtatttatattag

SEQ ID NO: 415607 - DNA, 19 bp, Homo sapiens
gtatttattgttcccacaa

SEQ ID NO: 415608 - DNA, 17 bp, Homo sapiens
gtatttattttcctccc

SEQ ID NO: 415609 - DNA, 16 bp, Homo sapiens
gtatttcagatgcttt

SEQ ID NO: 415610 - DNA, 12 bp, Homo sapiens
gtatttcattgc

SEQ ID NO: 415611 - DNA, 11 bp, Homo sapiens
gtatttctgtg

SEQ ID NO: 415612 - DNA, 21 bp, Homo sapiens
gtatttctgtggaaaacaatt

SEQ ID NO: 415613 - DNA, 19 bp, Homo sapiens
gtatttcttatttgaaagt

SEQ ID NO: 415614 - DNA, 14 bp, Homo sapiens
gtatttcttttata

SEQ ID NO: 415615 - DNA, 17 bp, Homo sapiens
gtatttcttttatatat

SEQ ID NO: 415616 - DNA, 18 bp, Homo sapiens
gtatttcttttatatata

SEQ ID NO: 415617 - DNA, 21 bp, Homo sapiens
gtatttcttttatatataaaa

SEQ ID NO: 415618 - DNA, 19 bp, Homo sapiens
gtatttgaaaattttactt

SEQ ID NO: 415619 - DNA, 19 bp, Homo sapiens
gtatttgagagttctaaat

SEQ ID NO: 415620 - DNA, 14 bp, Homo sapiens
gtatttgctgtttg

SEQ ID NO: 415621 - DNA, 15 bp, Homo sapiens
gtattttagtatatt

SEQ ID NO: 415622 - DNA, 15 bp, Homo sapiens
gtattttctgtcact

SEQ ID NO: 415623 - DNA, 23 bp, Homo sapiens
gtattttctgtcactgtaggtat

SEQ ID NO: 415624 - DNA, 16 bp, Homo sapiens
gtattttcttcccatt

SEQ ID NO: 415625 - DNA, 17 bp, Homo sapiens
gtattttgaaaacactt

SEQ ID NO: 415626 - DNA, 15 bp, Homo sapiens
gtattttgaatacca

SEQ ID NO: 415627 - DNA, 22 bp, Homo sapiens
gtatttttattttcctgtgact

SEQ ID NO: 415628 - DNA, 23 bp, Homo sapiens
gtcaaaaagtttggttctgtgtc

SEQ ID NO: 415629 - DNA, 14 bp, Homo sapiens
gtcaaaacacttgt

SEQ ID NO: 415630 - DNA, 21 bp, Homo sapiens
gtcaaacgtgccccccagttc

SEQ ID NO: 415631 - DNA, 22 bp, Homo sapiens
gtcaaacgtgccccccagttcc

SEQ ID NO: 415632 - DNA, 20 bp, Homo sapiens
gtcaaactgtagaaatgatg

SEQ ID NO: 415633 - DNA, 15 bp, Homo sapiens
gtcttcatggtctct

SEQ ID NO: 415634 - DNA, 17 bp, Homo sapiens
gtcttcatttcattgta

SEQ ID NO: 415635 - DNA, 14 bp, Homo sapiens
gtcttccaggccca

SEQ ID NO: 415636 - DNA, 15 bp, Homo sapiens
gtcttccataatgta

SEQ ID NO: 415637 - DNA, 17 bp, Homo sapiens
gtcttccataatgtata

SEQ ID NO: 415638 - DNA, 13 bp, Homo sapiens
gtcttccatcagc

SEQ ID NO: 415639 - DNA, 16 bp, Homo sapiens
gtcttccccaccttcc

SEQ ID NO: 415640 - DNA, 18 bp, Homo sapiens
gtcttccctacctcaggc

SEQ ID NO: 415641 - DNA, 21 bp, Homo sapiens
gtcttccctacctcaggcagg

SEQ ID NO: 415642 - DNA, 21 bp, Homo sapiens
gtcttccctagggctgggtgt

SEQ ID NO: 415643 - DNA, 12 bp, Homo sapiens
gtcttcctgagt

SEQ ID NO: 415644 - DNA, 18 bp, Homo sapiens
gtcttcgtacagttcttc

SEQ ID NO: 415645 - DNA, 20 bp, Homo sapiens
gtcttcgtacagttcttcgg

SEQ ID NO: 415646 - DNA, 23 bp, Homo sapiens
gtcttctaatttcaaaaatataa

SEQ ID NO: 415647 - DNA, 17 bp, Homo sapiens
gtcttctcatagcatta

SEQ ID NO: 415648 - DNA, 20 bp, Homo sapiens
gtcttctcatagcattaact

SEQ ID NO: 415649 - DNA, 15 bp, Homo sapiens
gtcttctctccactt

SEQ ID NO: 415650 - DNA, 15 bp, Homo sapiens
gtcttctgcctgtta

SEQ ID NO: 415651 - DNA, 17 bp, Homo sapiens
gtcttcttgtgtcctga

SEQ ID NO: 415652 - DNA, 23 bp, Homo sapiens
gtcttctttaaggaagaataaaa

SEQ ID NO: 415653 - DNA, 22 bp, Homo sapiens
gtcttgaagtgatcatttcaca

SEQ ID NO: 415654 - DNA, 17 bp, Homo sapiens
gtcttgacctgaactct

SEQ ID NO: 415655 - DNA, 21 bp, Homo sapiens
gtcttgacctgaactctgcaa

SEQ ID NO: 415656 - DNA, 20 bp, Homo sapiens
gtcttgagagcgctggcctc

SEQ ID NO: 415657 - DNA, 16 bp, Homo sapiens
gtcttgagtgggcccc

SEQ ID NO: 415658 - DNA, 22 bp, Homo sapiens
gtcttgagtgggccccctctct

SEQ ID NO: 415659 - DNA, 18 bp, Homo sapiens
gtcttgcaaagcctttaa

SEQ ID NO: 415660 - DNA, 20 bp, Homo sapiens
gtcttgcaaagcctttaaat

SEQ ID NO: 415661 - DNA, 14 bp, Homo sapiens
gtcttgcctaggcc

SEQ ID NO: 415662 - DNA, 15 bp, Homo sapiens
gtcttggagaggagg

SEQ ID NO: 415663 - DNA, 17 bp, Homo sapiens
gtcttgggctactggca

SEQ ID NO: 415664 - DNA, 18 bp, Homo sapiens
gtcttgggctactggcag

SEQ ID NO: 415665 - DNA, 19 bp, Homo sapiens
gtcttgggggtcagggggg

SEQ ID NO: 415666 - DNA, 18 bp, Homo sapiens
gtcttgtttaatatttgt

SEQ ID NO: 415667 - DNA, 22 bp, Homo sapiens
gtcttgttttttttttccactt

SEQ ID NO: 415668 - DNA, 14 bp, Homo sapiens
gtctttaaaatgat

SEQ ID NO: 415669 - DNA, 15 bp, Homo sapiens
gtctttatgatttca

SEQ ID NO: 415670 - DNA, 12 bp, Homo sapiens
gtctttctttgc

SEQ ID NO: 415671 - DNA, 19 bp, Homo sapiens
gtctttgaaatatgcatgt

SEQ ID NO: 415672 - DNA, 15 bp, Homo sapiens
gtctttgccttctct

SEQ ID NO: 415673 - DNA, 16 bp, Homo sapiens
gtctttgctgtttata

SEQ ID NO: 415674 - DNA, 19 bp, Homo sapiens
gtctttggcttcagaattg

SEQ ID NO: 415675 - DNA, 20 bp, Homo sapiens
gtctttgggggattcaaatg

SEQ ID NO: 415676 - DNA, 16 bp, Homo sapiens
gtctttggttcctcat

SEQ ID NO: 415677 - DNA, 23 bp, Homo sapiens
gtctttgtaagtaaactgccctg

SEQ ID NO: 415678 - DNA, 15 bp, Homo sapiens
gtctttgtacagaca

SEQ ID NO: 415679 - DNA, 14 bp, Homo sapiens
gtctttgtgtgctg

SEQ ID NO: 415680 - DNA, 24 bp, Homo sapiens
gtcttttaatgatactgtctaaga

SEQ ID NO: 415681 - DNA, 16 bp, Homo sapiens
gtcttttacatacagt

SEQ ID NO: 415682 - DNA, 16 bp, Homo sapiens
gtcttttcaaaaggat

SEQ ID NO: 415683 - DNA, 23 bp, Homo sapiens
gtcttttctgtcaccaaatttgt

SEQ ID NO: 415684 - DNA, 19 bp, Homo sapiens
gtcttttgacatgtggaaa

SEQ ID NO: 415685 - DNA, 14 bp, Homo sapiens
gtcttttgttctct

SEQ ID NO: 415686 - DNA, 16 bp, Homo sapiens
gtctttttatgcattt

SEQ ID NO: 415687 - DNA, 16 bp, Homo sapiens
gtctttttccttcctg

SEQ ID NO: 415688 - DNA, 21 bp, Homo sapiens
gtgaaaaatggtaatataaca

SEQ ID NO: 415689 - DNA, 12 bp, Homo sapiens
gtgaaacagtgt

SEQ ID NO: 415690 - DNA, 12 bp, Homo sapiens
gtgaaaccctgt

SEQ ID NO: 415691 - DNA, 16 bp, Homo sapiens
gtgaaaccctgtctct

SEQ ID NO: 415692 - DNA, 19 bp, Homo sapiens
gtgaaactaacagataagc

SEQ ID NO: 415693 - DNA, 20 bp, Homo sapiens
gtgaaagctccatgtttaga

SEQ ID NO: 415694 - DNA, 21 bp, Homo sapiens
gtgaaagggagctatcaggaa

SEQ ID NO: 415695 - DNA, 19 bp, Homo sapiens
gtgaaagtgtaaaatagaa

SEQ ID NO: 415696 - DNA, 20 bp, Homo sapiens
gtgaaagtgtaaaatagaat

SEQ ID NO: 415697 - DNA, 20 bp, Homo sapiens
gtgaaattttggtgaatgtg

SEQ ID NO: 415698 - DNA, 19 bp, Homo sapiens
gtgaacaagtgaacacatt

SEQ ID NO: 415699 - DNA, 11 bp, Homo sapiens
gtgaacagctt

SEQ ID NO: 415700 - DNA, 13 bp, Homo sapiens
gtgaacataactg

SEQ ID NO: 415701 - DNA, 18 bp, Homo sapiens
gtgaacataactgtaaca

SEQ ID NO: 415702 - DNA, 17 bp, Homo sapiens
gtgaaccaactgcctta

SEQ ID NO: 415703 - DNA, 14 bp, Homo sapiens
gtgaacgatttaga

SEQ ID NO: 415704 - DNA, 20 bp, Homo sapiens
gtgaacttggggaacaaggg

SEQ ID NO: 415705 - DNA, 21 bp, Homo sapiens
gtgaacttggtgcctaatgtt

SEQ ID NO: 415706 - DNA, 23 bp, Homo sapiens
gtgaagaatgaagtggaggaagt

SEQ ID NO: 415707 - DNA, 19 bp, Homo sapiens
gtgaagacagagcagatca

SEQ ID NO: 415708 - DNA, 19 bp, Homo sapiens
gtgaagagggagaagcatg

SEQ ID NO: 415709 - DNA, 21 bp, Homo sapiens
gtgaagagtgactagtacaaa

SEQ ID NO: 415710 - DNA, 15 bp, Homo sapiens
gtgaagataatttgc

SEQ ID NO: 415711 - DNA, 18 bp, Homo sapiens
gtgaagataatttgcata

SEQ ID NO: 415712 - DNA, 13 bp, Homo sapiens
gtgaagatgtttg

SEQ ID NO: 415713 - DNA, 15 bp, Homo sapiens
gtgaagatgtttgca

SEQ ID NO: 415714 - DNA, 18 bp, Homo sapiens
gtgaagcatgctttgctg

SEQ ID NO: 415715 - DNA, 21 bp, Homo sapiens
gtgaagcccaggaggacctgg

SEQ ID NO: 415716 - DNA, 20 bp, Homo sapiens
gtgaagtgtggctggtgtcc

SEQ ID NO: 415717 - DNA, 18 bp, Homo sapiens
gtgaagttttcttttact

SEQ ID NO: 415718 - DNA, 16 bp, Homo sapiens
gtgaataaagccacat

SEQ ID NO: 415719 - DNA, 16 bp, Homo sapiens
gtgaataacagactat

SEQ ID NO: 415720 - DNA, 14 bp, Homo sapiens
gtgaatacaattaa

SEQ ID NO: 415721 - DNA, 19 bp, Homo sapiens
gtgaatacaattaaaggtc

SEQ ID NO: 415722 - DNA, 22 bp, Homo sapiens
gtgaatcgcaaggcctgtgctg

SEQ ID NO: 415723 - DNA, 15 bp, Homo sapiens
gtgaatctaataaaa

SEQ ID NO: 415724 - DNA, 19 bp, Homo sapiens
gtgaatggccctagaactg

SEQ ID NO: 415725 - DNA, 14 bp, Homo sapiens
gtgaatgtcttcct

SEQ ID NO: 415726 - DNA, 17 bp, Homo sapiens
gtgaattgataataaac

SEQ ID NO: 415727 - DNA, 16 bp, Homo sapiens
gtgaatttaagcatga

SEQ ID NO: 415728 - DNA, 18 bp, Homo sapiens
gtgaatttgaatgaaaaa

SEQ ID NO: 415729 - DNA, 22 bp, Homo sapiens
gtgaattttggtgatgtaaaac

SEQ ID NO: 415730 - DNA, 19 bp, Homo sapiens
gtgacaaatgttgaccttt

SEQ ID NO: 415731 - DNA, 22 bp, Homo sapiens
gtgacaacctttgtgtaataaa

SEQ ID NO: 415732 - DNA, 23 bp, Homo sapiens
gtgacaagctcctggtcttgaga

SEQ ID NO: 415733 - DNA, 13 bp, Homo sapiens
gtgacaaggcccc

SEQ ID NO: 415734 - DNA, 12 bp, Homo sapiens
gtgacacagcag

SEQ ID NO: 415735 - DNA, 22 bp, Homo sapiens
gtgacagagcgagactctgtct

SEQ ID NO: 415736 - DNA, 23 bp, Homo sapiens
gtgacaggaagcccaaggcagtg

SEQ ID NO: 415737 - DNA, 15 bp, Homo sapiens
gtgacaggcccagtg

SEQ ID NO: 415738 - DNA, 19 bp, Homo sapiens
gtgacagtattttggttct

SEQ ID NO: 415739 - DNA, 18 bp, Homo sapiens
gtgacagtggattgcatt

SEQ ID NO: 415740 - DNA, 15 bp, Homo sapiens
gtgacatcagtggca

SEQ ID NO: 415741 - DNA, 18 bp, Homo sapiens
gtgacatcagtggcatgg

SEQ ID NO: 415742 - DNA, 20 bp, Homo sapiens
gtgacatgcgggctgggcag

SEQ ID NO: 415743 - DNA, 19 bp, Homo sapiens
gtgaccaagttataaatca

SEQ ID NO: 415744 - DNA, 17 bp, Homo sapiens
gtgaccaattgccctgc

SEQ ID NO: 415745 - DNA, 21 bp, Homo sapiens
gtgaccagcaccatctctcct

SEQ ID NO: 415746 - DNA, 12 bp, Homo sapiens
gtgacccagtgg

SEQ ID NO: 415747 - DNA, 14 bp, Homo sapiens
gtgacccatgcgat

SEQ ID NO: 415748 - DNA, 21 bp, Homo sapiens
gtgaccccatctctgctgctt

SEQ ID NO: 415749 - DNA, 20 bp, Homo sapiens
gtgaccccttttagtcagga

SEQ ID NO: 415750 - DNA, 18 bp, Homo sapiens
gtgacccggaggccacat

SEQ ID NO: 415751 - DNA, 16 bp, Homo sapiens
gtgacccttcagggcc

SEQ ID NO: 415752 - DNA, 15 bp, Homo sapiens
gtgaccggcccgcca

SEQ ID NO: 415753 - DNA, 21 bp, Homo sapiens
gtgaccggcccgccaccttgt

SEQ ID NO: 415754 - DNA, 21 bp, Homo sapiens
gtgactaccacttatttctaa

SEQ ID NO: 415755 - DNA, 22 bp, Homo sapiens
gtgactaccacttatttctaaa

SEQ ID NO: 415756 - DNA, 18 bp, Homo sapiens
gtgactagtgctgaagct

SEQ ID NO: 415757 - DNA, 23 bp, Homo sapiens
gtgactatgaaacgaatataagc

SEQ ID NO: 415758 - DNA, 18 bp, Homo sapiens
gtgactcatcctcttgaa

SEQ ID NO: 415759 - DNA, 14 bp, Homo sapiens
gtgactccaggaga

SEQ ID NO: 415760 - DNA, 19 bp, Homo sapiens
gtgactccaggagaggagc

SEQ ID NO: 415761 - DNA, 18 bp, Homo sapiens
gtgactgaaggggcacac

SEQ ID NO: 415762 - DNA, 19 bp, Homo sapiens
gtgactgaaggggcacacc

SEQ ID NO: 415763 - DNA, 21 bp, Homo sapiens
gtgactgaatttgggcctctt

SEQ ID NO: 415764 - DNA, 15 bp, Homo sapiens
gtgactgagggcctg

SEQ ID NO: 415765 - DNA, 17 bp, Homo sapiens
gtgactgatctctcgtg

SEQ ID NO: 415766 - DNA, 21 bp, Homo sapiens
gtgactgatgttaggctgggc

SEQ ID NO: 415767 - DNA, 14 bp, Homo sapiens
gtgactgtttggct

SEQ ID NO: 415768 - DNA, 19 bp, Homo sapiens
gtgactgtttttgttttgt

SEQ ID NO: 415769 - DNA, 23 bp, Homo sapiens
gtgacttcagactctctcctctc

SEQ ID NO: 415770 - DNA, 15 bp, Homo sapiens
gtgacttcctggtga

SEQ ID NO: 415771 - DNA, 20 bp, Homo sapiens
gtgacttgaatgtacaaaga

SEQ ID NO: 415772 - DNA, 14 bp, Homo sapiens
gtgagaaagttaga

SEQ ID NO: 415773 - DNA, 15 bp, Homo sapiens
gtgagaaattttagt

SEQ ID NO: 415774 - DNA, 14 bp, Homo sapiens
gtgagaaatttttt

SEQ ID NO: 415775 - DNA, 20 bp, Homo sapiens
gtgagaatcctgcctctccc

SEQ ID NO: 415776 - DNA, 14 bp, Homo sapiens
gtgagacagcaagt

SEQ ID NO: 415777 - DNA, 13 bp, Homo sapiens
gtgagaccacctc

SEQ ID NO: 415778 - DNA, 14 bp, Homo sapiens
gtgagacccccaca

SEQ ID NO: 415779 - DNA, 16 bp, Homo sapiens
gtgagacccccacacc

SEQ ID NO: 415780 - DNA, 15 bp, Homo sapiens
gtgagacgaggcagg

SEQ ID NO: 415781 - DNA, 11 bp, Homo sapiens
gtgagagagga

SEQ ID NO: 415782 - DNA, 20 bp, Homo sapiens
gtgagagtttggaaggtgtc

SEQ ID NO: 415783 - DNA, 23 bp, Homo sapiens
gtgagagtttggaaggtgtccaa

SEQ ID NO: 415784 - DNA, 20 bp, Homo sapiens
gtgagatacccagagagaaa

SEQ ID NO: 415785 - DNA, 22 bp, Homo sapiens
gtgagatacccagagagaaaaa

SEQ ID NO: 415786 - DNA, 20 bp, Homo sapiens
gtgagatcacagcctccagg

SEQ ID NO: 415787 - DNA, 14 bp, Homo sapiens
gtgagatgggaagg

SEQ ID NO: 415788 - DNA, 18 bp, Homo sapiens
gtgagatgggaagggctt

SEQ ID NO: 415789 - DNA, 13 bp, Homo sapiens
gtgagattctaaa

SEQ ID NO: 415790 - DNA, 16 bp, Homo sapiens
gtgagatttgtattta

SEQ ID NO: 415791 - DNA, 20 bp, Homo sapiens
gtgagcagaagtggagctgg

SEQ ID NO: 415792 - DNA, 15 bp, Homo sapiens
gtgagcagcctccac

SEQ ID NO: 415793 - DNA, 12 bp, Homo sapiens
gtgagcaggctt

SEQ ID NO: 415794 - DNA, 21 bp, Homo sapiens
gtgagcagtgtgtctcctgca

SEQ ID NO: 415795 - DNA, 20 bp, Homo sapiens
gtgagcatccttcccagcag

SEQ ID NO: 415796 - DNA, 15 bp, Homo sapiens
gtgagccaaagagaa

SEQ ID NO: 415797 - DNA, 19 bp, Homo sapiens
gtgagcccctccccagcca

SEQ ID NO: 415798 - DNA, 23 bp, Homo sapiens
gtgagcgccccgcccccacccct

SEQ ID NO: 415799 - DNA, 14 bp, Homo sapiens
gtgagcgggtgggg

SEQ ID NO: 415800 - DNA, 14 bp, Homo sapiens
gtgagctctctcag

SEQ ID NO: 415801 - DNA, 19 bp, Homo sapiens
gtgagctctctcagaccct

SEQ ID NO: 415802 - DNA, 12 bp, Homo sapiens
gtgagctgggca

SEQ ID NO: 415803 - DNA, 20 bp, Homo sapiens
gtgaggaggaggcagaacca

SEQ ID NO: 415804 - DNA, 18 bp, Homo sapiens
gtgaggcaagagaaatga

SEQ ID NO: 415805 - DNA, 22 bp, Homo sapiens
gtgaggcaagatccccgccacc

SEQ ID NO: 415806 - DNA, 15 bp, Homo sapiens
gtgaggcccagcctg

SEQ ID NO: 415807 - DNA, 15 bp, Homo sapiens
gtgaggcccccggag

SEQ ID NO: 415808 - DNA, 11 bp, Homo sapiens
gtgaggcctgg

SEQ ID NO: 415809 - DNA, 16 bp, Homo sapiens
gtgaggcggcagctgg

SEQ ID NO: 415810 - DNA, 16 bp, Homo sapiens
gtgaggctgtcctgta

SEQ ID NO: 415811 - DNA, 21 bp, Homo sapiens
gtgaggcttaacaatgtcttg

SEQ ID NO: 415812 - DNA, 13 bp, Homo sapiens
gtgaggggccagg

SEQ ID NO: 415813 - DNA, 24 bp, Homo sapiens
gtgaggtcatcccggggccatgga

SEQ ID NO: 415814 - DNA, 14 bp, Homo sapiens
gtgagtaagagctg

SEQ ID NO: 415815 - DNA, 15 bp, Homo sapiens
gtgagtaagagctgg

SEQ ID NO: 415816 - DNA, 12 bp, Homo sapiens
gtgagtatgtgt

SEQ ID NO: 415817 - DNA, 13 bp, Homo sapiens
gtgagtatgtgtg

SEQ ID NO: 415818 - DNA, 20 bp, Homo sapiens
gtgagtattctatgtaaaaa

SEQ ID NO: 415819 - DNA, 22 bp, Homo sapiens
gtgagtattctatgtaaaaata

SEQ ID NO: 415820 - DNA, 12 bp, Homo sapiens
gtgagtggcagc

SEQ ID NO: 415821 - DNA, 20 bp, Homo sapiens
gtgagtggcagccatgcctc

SEQ ID NO: 415822 - DNA, 14 bp, Homo sapiens
gtgagtggcatgtg

SEQ ID NO: 415823 - DNA, 15 bp, Homo sapiens
gtgagtggcctgcta

SEQ ID NO: 415824 - DNA, 20 bp, Homo sapiens
gtgagtgtgagggcagcact

SEQ ID NO: 415825 - DNA, 15 bp, Homo sapiens
gtgagtgtggctccc

SEQ ID NO: 415826 - DNA, 23 bp, Homo sapiens
gtgagtgtgtccaagtgtgtgtg

SEQ ID NO: 415827 - DNA, 15 bp, Homo sapiens
gtgagtgtgtgcaag

SEQ ID NO: 415828 - DNA, 16 bp, Homo sapiens
gtgataagtggaaaaa

SEQ ID NO: 415829 - DNA, 19 bp, Homo sapiens
gtgataagtggaaaaaaga

SEQ ID NO: 415830 - DNA, 20 bp, Homo sapiens
gtgatacccatagcttccat

SEQ ID NO: 415831 - DNA, 12 bp, Homo sapiens
gtgatagcattg

SEQ ID NO: 415832 - DNA, 17 bp, Homo sapiens
gtgataggcaaggatga

SEQ ID NO: 415833 - DNA, 21 bp, Homo sapiens
gtgatatggtactaaggagaa

SEQ ID NO: 415834 - DNA, 14 bp, Homo sapiens
gtgatatgtgtaat

SEQ ID NO: 415835 - DNA, 18 bp, Homo sapiens
gtgatatgtgtaatatca

SEQ ID NO: 415836 - DNA, 19 bp, Homo sapiens
gtgatatgtgtaatatcat

SEQ ID NO: 415837 - DNA, 19 bp, Homo sapiens
gtgatattgaccatgtgat

SEQ ID NO: 415838 - DNA, 15 bp, Homo sapiens
gtgatcaactgttca

SEQ ID NO: 415839 - DNA, 16 bp, Homo sapiens
gtgatcaataaaatgt

SEQ ID NO: 415840 - DNA, 17 bp, Homo sapiens
gtgatcaataaaatgtg

SEQ ID NO: 415841 - DNA, 19 bp, Homo sapiens
gtgatcaataaaatgtgat

SEQ ID NO: 415842 - DNA, 23 bp, Homo sapiens
gtgatcactttctgaaattcaca

SEQ ID NO: 415843 - DNA, 20 bp, Homo sapiens
gtgatcagaccataatgtta

SEQ ID NO: 415844 - DNA, 15 bp, Homo sapiens
gtgatcatctttgct

SEQ ID NO: 415845 - DNA, 22 bp, Homo sapiens
gtgatccacccacctgggcctc

SEQ ID NO: 415846 - DNA, 13 bp, Homo sapiens
gtgatccatccat

SEQ ID NO: 415847 - DNA, 19 bp, Homo sapiens
gtgatccatccatctccag

SEQ ID NO: 415848 - DNA, 21 bp, Homo sapiens
gtgatccatccatctccaggg

SEQ ID NO: 415849 - DNA, 17 bp, Homo sapiens
gtgatcgcacaaggaca

SEQ ID NO: 415850 - DNA, 12 bp, Homo sapiens
gtgatctgggaa

SEQ ID NO: 415851 - DNA, 19 bp, Homo sapiens
gtgatcttggctcactaca

SEQ ID NO: 415852 - DNA, 22 bp, Homo sapiens
gtgatgatcagctgtttgtcat

SEQ ID NO: 415853 - DNA, 14 bp, Homo sapiens
gtgatgatgctgtg

SEQ ID NO: 415854 - DNA, 15 bp, Homo sapiens
gtgatgccacacaga

SEQ ID NO: 415855 - DNA, 17 bp, Homo sapiens
gtgatgccacacagagt

SEQ ID NO: 415856 - DNA, 19 bp, Homo sapiens
gtgatgccacacagagtgg

SEQ ID NO: 415857 - DNA, 16 bp, Homo sapiens
gtgatgctcaggcttg

SEQ ID NO: 415858 - DNA, 20 bp, Homo sapiens
gtgatggcgcgggaggcacc

SEQ ID NO: 415859 - DNA, 22 bp, Homo sapiens
gtgatgggcgagtcccggagcc

SEQ ID NO: 415860 - DNA, 22 bp, Homo sapiens
gtgatggttcccctgttcactc

SEQ ID NO: 415861 - DNA, 11 bp, Homo sapiens
gtgatgtatgt

SEQ ID NO: 415862 - DNA, 17 bp, Homo sapiens
gtgatgtgatttatgca

SEQ ID NO: 415863 - DNA, 17 bp, Homo sapiens
gtgatgtttccagctgc

SEQ ID NO: 415864 - DNA, 18 bp, Homo sapiens
gtgatgtttccagctgcc

SEQ ID NO: 415865 - DNA, 15 bp, Homo sapiens
gtgattaaagcaaga

SEQ ID NO: 415866 - DNA, 17 bp, Homo sapiens
gtgattccccggagctg

SEQ ID NO: 415867 - DNA, 15 bp, Homo sapiens
gtgattctctcttct

SEQ ID NO: 415868 - DNA, 18 bp, Homo sapiens
gtgattctctcttctctc

SEQ ID NO: 415869 - DNA, 23 bp, Homo sapiens
gtgattctctcttctctcccctt

SEQ ID NO: 415870 - DNA, 22 bp, Homo sapiens
gtgattgaagtatctgtacctg

SEQ ID NO: 415871 - DNA, 15 bp, Homo sapiens
gtgcccctcccatgg

SEQ ID NO: 415872 - DNA, 13 bp, Homo sapiens
gtgcccctgcagg

SEQ ID NO: 415873 - DNA, 19 bp, Homo sapiens
gtgcccctgctgcctcccc

SEQ ID NO: 415874 - DNA, 12 bp, Homo sapiens
gtgcccctggcc

SEQ ID NO: 415875 - DNA, 13 bp, Homo sapiens
gtgcccgcccacc

SEQ ID NO: 415876 - DNA, 15 bp, Homo sapiens
gtgccctccactgcc

SEQ ID NO: 415877 - DNA, 22 bp, Homo sapiens
gtgccctgcccccatctcccca

SEQ ID NO: 415878 - DNA, 14 bp, Homo sapiens
gtgccctgcctcca

SEQ ID NO: 415879 - DNA, 18 bp, Homo sapiens
gtgcccttaaaataatga

SEQ ID NO: 415880 - DNA, 11 bp, Homo sapiens
gtgcctaataa

SEQ ID NO: 415881 - DNA, 12 bp, Homo sapiens
gtgcctaataaa

SEQ ID NO: 415882 - DNA, 18 bp, Homo sapiens
gtgcctaataaagtctct

SEQ ID NO: 415883 - DNA, 14 bp, Homo sapiens
gtgcctcagcgctg

SEQ ID NO: 415884 - DNA, 17 bp, Homo sapiens
gtgcctcagcgctgccc

SEQ ID NO: 415885 - DNA, 20 bp, Homo sapiens
gtgcctcagcgctgcccaca

SEQ ID NO: 415886 - DNA, 21 bp, Homo sapiens
gtgcctcagcgctgcccacac

SEQ ID NO: 415887 - DNA, 17 bp, Homo sapiens
gtgcctccccccagacc

SEQ ID NO: 415888 - DNA, 13 bp, Homo sapiens
gtgcctcccttcc

SEQ ID NO: 415889 - DNA, 22 bp, Homo sapiens
gtgcctcccttcccagtgggct

SEQ ID NO: 415890 - DNA, 23 bp, Homo sapiens
gtgcctcccttcccagtgggctg

SEQ ID NO: 415891 - DNA, 16 bp, Homo sapiens
gtgcctcccttccgct

SEQ ID NO: 415892 - DNA, 18 bp, Homo sapiens
gtgcctccttccacctcc

SEQ ID NO: 415893 - DNA, 22 bp, Homo sapiens
gtgcctcgaggcaccggcgctg

SEQ ID NO: 415894 - DNA, 15 bp, Homo sapiens
gtgcctctgcctgtc

SEQ ID NO: 415895 - DNA, 15 bp, Homo sapiens
gtgcctcttgggaga

SEQ ID NO: 415896 - DNA, 17 bp, Homo sapiens
gtgcctgaacattcttg

SEQ ID NO: 415897 - DNA, 20 bp, Homo sapiens
gtgcctgaaggctatccact

SEQ ID NO: 415898 - DNA, 12 bp, Homo sapiens
gtgcctgagccc

SEQ ID NO: 415899 - DNA, 13 bp, Homo sapiens
gtgcctgagcccg

SEQ ID NO: 415900 - DNA, 14 bp, Homo sapiens
gtgcctgcaccagg

SEQ ID NO: 415901 - DNA, 14 bp, Homo sapiens
gtgcctgctagagc

SEQ ID NO: 415902 - DNA, 17 bp, Homo sapiens
gtgcctgctagagcaac

SEQ ID NO: 415903 - DNA, 23 bp, Homo sapiens
gtgcctgctagagcaacccctgt

SEQ ID NO: 415904 - DNA, 17 bp, Homo sapiens
gtgcctggagctcctgg

SEQ ID NO: 415905 - DNA, 19 bp, Homo sapiens
gtgcctggagctcctggga

SEQ ID NO: 415906 - DNA, 16 bp, Homo sapiens
gtgcctgggaatgtat

SEQ ID NO: 415907 - DNA, 20 bp, Homo sapiens
gtgcctgggatcagtggggc

SEQ ID NO: 415908 - DNA, 19 bp, Homo sapiens
gtgcctggtgcgctgtgct

SEQ ID NO: 415909 - DNA, 23 bp, Homo sapiens
gtgcctgtaatctttttctccac

SEQ ID NO: 415910 - DNA, 21 bp, Homo sapiens
gtgccttccccgtgcggcccg

SEQ ID NO: 415911 - DNA, 23 bp, Homo sapiens
gtgccttccgtgggtcatcccag

SEQ ID NO: 415912 - DNA, 14 bp, Homo sapiens
gtgccttgagctgc

SEQ ID NO: 415913 - DNA, 22 bp, Homo sapiens
gtgccttgagctgcctgctctg

SEQ ID NO: 415914 - DNA, 23 bp, Homo sapiens
gtgccttgagctgcctgctctgc

SEQ ID NO: 415915 - DNA, 19 bp, Homo sapiens
gtgccttggggaatttcct

SEQ ID NO: 415916 - DNA, 14 bp, Homo sapiens
gtgccttttatagc

SEQ ID NO: 415917 - DNA, 18 bp, Homo sapiens
gtgccttttatagctatt

SEQ ID NO: 415918 - DNA, 18 bp, Homo sapiens
gtgccttttgtgtgatgc

SEQ ID NO: 415919 - DNA, 14 bp, Homo sapiens
gtgcctttttcctt

SEQ ID NO: 415920 - DNA, 17 bp, Homo sapiens
gtgcgaccagaggtggg

SEQ ID NO: 415921 - DNA, 14 bp, Homo sapiens
gtgcgagtgtgtgc

SEQ ID NO: 415922 - DNA, 23 bp, Homo sapiens
gtgcgagtgtgtgcatgtgtgtg

SEQ ID NO: 415923 - DNA, 23 bp, Homo sapiens
gtgcgatcatggctcactgcagc

SEQ ID NO: 415924 - DNA, 18 bp, Homo sapiens
gtggatggtgacttttga

SEQ ID NO: 415925 - DNA, 14 bp, Homo sapiens
gtggatgtaaattt

SEQ ID NO: 415926 - DNA, 19 bp, Homo sapiens
gtggattgggctgcaggct

SEQ ID NO: 415927 - DNA, 15 bp, Homo sapiens
gtggattttcctgaa

SEQ ID NO: 415928 - DNA, 15 bp, Homo sapiens
gtggattttgtggct

SEQ ID NO: 415929 - DNA, 13 bp, Homo sapiens
gtggcaaacattt

SEQ ID NO: 415930 - DNA, 17 bp, Homo sapiens
gtggcacacaactgtgg

SEQ ID NO: 415931 - DNA, 16 bp, Homo sapiens
gtggcacctcctgaga

SEQ ID NO: 415932 - DNA, 17 bp, Homo sapiens
gtggcacctcctgagaa

SEQ ID NO: 415933 - DNA, 18 bp, Homo sapiens
gtggcacctcctgagaag

SEQ ID NO: 415934 - DNA, 15 bp, Homo sapiens
gtgtggactgtgatg

SEQ ID NO: 415935 - DNA, 12 bp, Homo sapiens
gtgtggagtgga

SEQ ID NO: 415936 - DNA, 19 bp, Homo sapiens
gtgtggagtggaggggtca

SEQ ID NO: 415937 - DNA, 15 bp, Homo sapiens
gtgtggcaaacattt

SEQ ID NO: 415938 - DNA, 15 bp, Homo sapiens
gtgtggccccttcac

SEQ ID NO: 415939 - DNA, 18 bp, Homo sapiens
gtgtggccgcctggcagg

SEQ ID NO: 415940 - DNA, 17 bp, Homo sapiens
gtgtggctggtgtcccc

SEQ ID NO: 415941 - DNA, 18 bp, Homo sapiens
gtgtggctggtgtcccct

SEQ ID NO: 415942 - DNA, 18 bp, Homo sapiens
gtgtggcttaaacatttt

SEQ ID NO: 415943 - DNA, 15 bp, Homo sapiens
gtgtggcttggaaca

SEQ ID NO: 415944 - DNA, 23 bp, Homo sapiens
gtgtggcttggaacatttgggag

SEQ ID NO: 415945 - DNA, 17 bp, Homo sapiens
gtgtggggagggtgggc

SEQ ID NO: 415946 - DNA, 16 bp, Homo sapiens
gtgtggggcccaagca

SEQ ID NO: 415947 - DNA, 13 bp, Homo sapiens
gtgtggggtgggg

SEQ ID NO: 415948 - DNA, 17 bp, Homo sapiens
gtgtgggtttactctgt

SEQ ID NO: 415949 - DNA, 13 bp, Homo sapiens
gtgtggtccctcc

SEQ ID NO: 415950 - DNA, 15 bp, Homo sapiens
gtgtgtaagctgact

SEQ ID NO: 415951 - DNA, 14 bp, Homo sapiens
gtgtgtagccagga

SEQ ID NO: 415952 - DNA, 21 bp, Homo sapiens
gtgtgtatgactaaagagaga

SEQ ID NO: 415953 - DNA, 15 bp, Homo sapiens
gtgtgtccctgtggt

SEQ ID NO: 415954 - DNA, 23 bp, Homo sapiens
gtgtgtctatttggcaattcaca

SEQ ID NO: 415955 - DNA, 23 bp, Homo sapiens
gtgtgtggaaggcacccgccctt

SEQ ID NO: 415956 - DNA, 18 bp, Homo sapiens
gtgtgtggccgcctggca

SEQ ID NO: 415957 - DNA, 15 bp, Homo sapiens
gtgtgttccaactgc

SEQ ID NO: 415958 - DNA, 16 bp, Homo sapiens
gtgtgttcttttgata

SEQ ID NO: 415959 - DNA, 15 bp, Homo sapiens
gtgtgttgccacagg

SEQ ID NO: 415960 - DNA, 18 bp, Homo sapiens
gtgtgtttaaataaagta

SEQ ID NO: 415961 - DNA, 15 bp, Homo sapiens
gtgtgtttcaggaca

SEQ ID NO: 415962 - DNA, 19 bp, Homo sapiens
gtgtgtttcaggacagctg

SEQ ID NO: 415963 - DNA, 19 bp, Homo sapiens
gtgtgtttgtgagtatgtg

SEQ ID NO: 415964 - DNA, 13 bp, Homo sapiens
gtgtgttttcaat

SEQ ID NO: 415965 - DNA, 18 bp, Homo sapiens
gtgtgttttcataataaa

SEQ ID NO: 415966 - DNA, 14 bp, Homo sapiens
gtgtgttttggtat

SEQ ID NO: 415967 - DNA, 17 bp, Homo sapiens
gtgttaaagttgttttg

SEQ ID NO: 415968 - DNA, 20 bp, Homo sapiens
gtgttaaagttgttttgatt

SEQ ID NO: 415969 - DNA, 14 bp, Homo sapiens
gtgttagtgtctgt

SEQ ID NO: 415970 - DNA, 17 bp, Homo sapiens
gtgttagtgtctgtcca

SEQ ID NO: 415971 - DNA, 15 bp, Homo sapiens
gtgttcaagaaataa

SEQ ID NO: 415972 - DNA, 20 bp, Homo sapiens
gtgttcacactgtaaacatt

SEQ ID NO: 415973 - DNA, 22 bp, Homo sapiens
gtgttcagttccagcttttgta

SEQ ID NO: 415974 - DNA, 12 bp, Homo sapiens
gtgttcctcttt

SEQ ID NO: 415975 - DNA, 16 bp, Homo sapiens
gtgttcctctttgcat

SEQ ID NO: 415976 - DNA, 15 bp, Homo sapiens
gtgttcctggcaata

SEQ ID NO: 415977 - DNA, 18 bp, Homo sapiens
gtgttcctggcaatagtg

SEQ ID NO: 415978 - DNA, 23 bp, Homo sapiens
gtgttcgtggagccacaggcaga

SEQ ID NO: 415979 - DNA, 14 bp, Homo sapiens
gtgttctctcttat

SEQ ID NO: 415980 - DNA, 21 bp, Homo sapiens
gtgttctgagcccccacctgc

SEQ ID NO: 415981 - DNA, 14 bp, Homo sapiens
gtgttctgttgttt

SEQ ID NO: 415982 - DNA, 16 bp, Homo sapiens
gtgttcttttgataca

SEQ ID NO: 415983 - DNA, 20 bp, Homo sapiens
gtgttgaatcccacttcagt

SEQ ID NO: 415984 - DNA, 17 bp, Homo sapiens
gtgttgactgctgctcc

SEQ ID NO: 415985 - DNA, 19 bp, Homo sapiens
gtgttgccaaatatgtcct

SEQ ID NO: 415986 - DNA, 23 bp, Homo sapiens
gtgttgccaggcaggcacctggg

SEQ ID NO: 415987 - DNA, 21 bp, Homo sapiens
gtgttgggccccagggaacta

SEQ ID NO: 415988 - DNA, 23 bp, Homo sapiens
gtgttggtctttctaatgtagct

SEQ ID NO: 415989 - DNA, 14 bp, Homo sapiens
gtgttgtatgcctt

SEQ ID NO: 415990 - DNA, 12 bp, Homo sapiens
gtgtttaactga

SEQ ID NO: 415991 - DNA, 18 bp, Homo sapiens
gtgtttataattgttata

SEQ ID NO: 415992 - DNA, 17 bp, Homo sapiens
gtgtttcaggacagctg

SEQ ID NO: 415993 - DNA, 12 bp, Homo sapiens
gtgtttcccata

SEQ ID NO: 415994 - DNA, 15 bp, Homo sapiens
gtgtttcccataatt

SEQ ID NO: 415995 - DNA, 21 bp, Homo sapiens
gtgtttccctagactctgtaa

SEQ ID NO: 415996 - DNA, 14 bp, Homo sapiens
gtgtttgtatataa

SEQ ID NO: 415997 - DNA, 15 bp, Homo sapiens
gtgttttaattccaa

SEQ ID NO: 415998 - DNA, 15 bp, Homo sapiens
gtgttttcataataa

SEQ ID NO: 415999 - DNA, 13 bp, Homo sapiens
gtgttttgctttg

SEQ ID NO: 416000 - DNA, 11 bp, Homo sapiens
gtgtttttgta

SEQ ID NO: 416001 - DNA, 13 bp, Homo sapiens
gtgtttttgttgt

SEQ ID NO: 416002 - DNA, 19 bp, Homo sapiens
gtgttttttttaagggcat

SEQ ID NO: 416003 - DNA, 22 bp, Homo sapiens
gttaaaaaccattataaaatct

SEQ ID NO: 416004 - DNA, 21 bp, Homo sapiens
gttaaaaattaaaagaaggaa

SEQ ID NO: 416005 - DNA, 12 bp, Homo sapiens
gttaaaactgtc

SEQ ID NO: 416006 - DNA, 13 bp, Homo sapiens
gttaaaagacagt

SEQ ID NO: 416007 - DNA, 22 bp, Homo sapiens
gttaaaagcattttaatactaa

SEQ ID NO: 416008 - DNA, 22 bp, Homo sapiens
gttaaaatacagttctgtcata

SEQ ID NO: 416009 - DNA, 17 bp, Homo sapiens
gttaaaatataaattaa

SEQ ID NO: 416010 - DNA, 14 bp, Homo sapiens
gttaaacattgaag

SEQ ID NO: 416011 - DNA, 18 bp, Homo sapiens
gttaaagagacaaatagt

SEQ ID NO: 416012 - DNA, 13 bp, Homo sapiens
gttaaaggaaaaa

SEQ ID NO: 416013 - DNA, 13 bp, Homo sapiens
gtcaaacttgttt

SEQ ID NO: 416014 - DNA, 14 bp, Homo sapiens
gtcaaataaagcaa

SEQ ID NO: 416015 - DNA, 15 bp, Homo sapiens
gtcaacccgctgctt

SEQ ID NO: 416016 - DNA, 20 bp, Homo sapiens
gtcaacccgctgcttccagg

SEQ ID NO: 416017 - DNA, 21 bp, Homo sapiens
gtcaacccgctgcttccaggt

SEQ ID NO: 416018 - DNA, 16 bp, Homo sapiens
gtcaactgctgtttta

SEQ ID NO: 416019 - DNA, 12 bp, Homo sapiens
gtcaacttctgg

SEQ ID NO: 416020 - DNA, 18 bp, Homo sapiens
gtcaactttcatttgaaa

SEQ ID NO: 416021 - DNA, 14 bp, Homo sapiens
gtcaaggtgctcaa

SEQ ID NO: 416022 - DNA, 17 bp, Homo sapiens
gtcaagtctctgctggc

SEQ ID NO: 416023 - DNA, 21 bp, Homo sapiens
gtcaagtctctgctggcccag

SEQ ID NO: 416024 - DNA, 18 bp, Homo sapiens
gtcaagttaacaaggaat

SEQ ID NO: 416025 - DNA, 22 bp, Homo sapiens
gtcaagttcatagtttctgtaa

SEQ ID NO: 416026 - DNA, 18 bp, Homo sapiens
gtcaagttgtgcttgttt

SEQ ID NO: 416027 - DNA, 17 bp, Homo sapiens
gtcaagtttttctctca

SEQ ID NO: 416028 - DNA, 11 bp, Homo sapiens
gtcaatatata

SEQ ID NO: 416029 - DNA, 14 bp, Homo sapiens
gtcaatattaaata

SEQ ID NO: 416030 - DNA, 15 bp, Homo sapiens
gtcaatattaaatac

SEQ ID NO: 416031 - DNA, 18 bp, Homo sapiens
gtcaatattaaatacaga

SEQ ID NO: 416032 - DNA, 13 bp, Homo sapiens
gtcaatcaaacag

SEQ ID NO: 416033 - DNA, 15 bp, Homo sapiens
gtcaatcaaacaggg

SEQ ID NO: 416034 - DNA, 14 bp, Homo sapiens
gtcaatcatttctc

SEQ ID NO: 416035 - DNA, 15 bp, Homo sapiens
gtcaatcctgtgggt

SEQ ID NO: 416036 - DNA, 19 bp, Homo sapiens
gtcaatcctgtgggtgaag

SEQ ID NO: 416037 - DNA, 22 bp, Homo sapiens
gtcaatgaaatatttgcttatt

SEQ ID NO: 416038 - DNA, 20 bp, Homo sapiens
gtcaatgaggttatgagaaa

SEQ ID NO: 416039 - DNA, 14 bp, Homo sapiens
gtcaatgtgcagtg

SEQ ID NO: 416040 - DNA, 13 bp, Homo sapiens
gtcaattacagga

SEQ ID NO: 416041 - DNA, 13 bp, Homo sapiens
gtcacaaattgat

SEQ ID NO: 416042 - DNA, 17 bp, Homo sapiens
gtcacaagtaggagaca

SEQ ID NO: 416043 - DNA, 18 bp, Homo sapiens
gtcacaagtaggagacac

SEQ ID NO: 416044 - DNA, 11 bp, Homo sapiens
gtcacaataaa

SEQ ID NO: 416045 - DNA, 12 bp, Homo sapiens
gtcacaataaat

SEQ ID NO: 416046 - DNA, 14 bp, Homo sapiens
gtcacacattatag

SEQ ID NO: 416047 - DNA, 15 bp, Homo sapiens
gtcacactgctggga

SEQ ID NO: 416048 - DNA, 12 bp, Homo sapiens
gtcacagaggca

SEQ ID NO: 416049 - DNA, 14 bp, Homo sapiens
gtcacagaggcagt

SEQ ID NO: 416050 - DNA, 19 bp, Homo sapiens
gtcacagaggcagtggcag

SEQ ID NO: 416051 - DNA, 21 bp, Homo sapiens
gtcacagaggcagtggcagca

SEQ ID NO: 416052 - DNA, 20 bp, Homo sapiens
gtcacagcagtacttgctca

SEQ ID NO: 416053 - DNA, 12 bp, Homo sapiens
gtcacagctgca

SEQ ID NO: 416054 - DNA, 18 bp, Homo sapiens
gtcacagctgcagctggg

SEQ ID NO: 416055 - DNA, 18 bp, Homo sapiens
gtcacaggagtctttgta

SEQ ID NO: 416056 - DNA, 15 bp, Homo sapiens
gtcacatagctggga

SEQ ID NO: 416057 - DNA, 13 bp, Homo sapiens
gtcacatatcaag

SEQ ID NO: 416058 - DNA, 22 bp, Homo sapiens
gtcacatatcaagtcccgaggc

SEQ ID NO: 416059 - DNA, 23 bp, Homo sapiens
gtcacatatcaagtcccgaggca

SEQ ID NO: 416060 - DNA, 17 bp, Homo sapiens
gtcacatcagataagac

SEQ ID NO: 416061 - DNA, 16 bp, Homo sapiens
gtcaccaagaaggggc

SEQ ID NO: 416062 - DNA, 23 bp, Homo sapiens
gtcaccaagaaggggctcgagtg

SEQ ID NO: 416063 - DNA, 15 bp, Homo sapiens
gtcaccaggacttgg

SEQ ID NO: 416064 - DNA, 19 bp, Homo sapiens
gtcaccagttaaaagcatt

SEQ ID NO: 416065 - DNA, 21 bp, Homo sapiens
gtcacccagcaaggcacaggc

SEQ ID NO: 416066 - DNA, 13 bp, Homo sapiens
gtcacccctgtct

SEQ ID NO: 416067 - DNA, 16 bp, Homo sapiens
gtcaccctgcagagct

SEQ ID NO: 416068 - DNA, 19 bp, Homo sapiens
gtcacctgcaagccccagg

SEQ ID NO: 416069 - DNA, 24 bp, Homo sapiens
gtcacctgcaagccccagggcctg

SEQ ID NO: 416070 - DNA, 19 bp, Homo sapiens
gtcacctgtgctacctcta

SEQ ID NO: 416071 - DNA, 16 bp, Homo sapiens
gtcacgctctggtgca

SEQ ID NO: 416072 - DNA, 16 bp, Homo sapiens
gtcacgtgtattttca

SEQ ID NO: 416073 - DNA, 22 bp, Homo sapiens
gtcactaaagcaggccttttga

SEQ ID NO: 416074 - DNA, 14 bp, Homo sapiens
gtcactactcacag

SEQ ID NO: 416075 - DNA, 17 bp, Homo sapiens
gtcactactcacagtct

SEQ ID NO: 416076 - DNA, 22 bp, Homo sapiens
gtcactactcacagtctcttta

SEQ ID NO: 416077 - DNA, 15 bp, Homo sapiens
gtcactctgcctcta

SEQ ID NO: 416078 - DNA, 15 bp, Homo sapiens
gtcactgagctgtgt

SEQ ID NO: 416079 - DNA, 22 bp, Homo sapiens
gtcactggaacctccctgggcc

SEQ ID NO: 416080 - DNA, 14 bp, Homo sapiens
gtcactgtggtcct

SEQ ID NO: 416081 - DNA, 13 bp, Homo sapiens
gtcactgtttctc

SEQ ID NO: 416082 - DNA, 16 bp, Homo sapiens
gtcactgtttctctgc

SEQ ID NO: 416083 - DNA, 16 bp, Homo sapiens
gtcacttatttcataa

SEQ ID NO: 416084 - DNA, 18 bp, Homo sapiens
gtcagaagcctccaagcc

SEQ ID NO: 416085 - DNA, 15 bp, Homo sapiens
gtcagagaaaacact

SEQ ID NO: 416086 - DNA, 13 bp, Homo sapiens
gtcagagctggga

SEQ ID NO: 416087 - DNA, 21 bp, Homo sapiens
gtcagagcttgattagaagcc

SEQ ID NO: 416088 - DNA, 23 bp, Homo sapiens
gtcagaggagtgattgaaccagc

SEQ ID NO: 416089 - DNA, 12 bp, Homo sapiens
gtcagatgagca

SEQ ID NO: 416090 - DNA, 22 bp, Homo sapiens
gtcagatgagcaaggacattgc

SEQ ID NO: 416091 - DNA, 22 bp, Homo sapiens
gtcagatggatgtagatacaga

SEQ ID NO: 416092 - DNA, 19 bp, Homo sapiens
gtcagcagaaacccccagg

SEQ ID NO: 416093 - DNA, 21 bp, Homo sapiens
gtcagcagaaacccccaggag

SEQ ID NO: 416094 - DNA, 22 bp, Homo sapiens
gtcagcagaaacccccaggagg

SEQ ID NO: 416095 - DNA, 23 bp, Homo sapiens
gtcagcagaaacccccaggagga

SEQ ID NO: 416096 - DNA, 21 bp, Homo sapiens
gtcagccgagccgggcctggg

SEQ ID NO: 416097 - DNA, 15 bp, Homo sapiens
gtcagctcccttctc

SEQ ID NO: 416098 - DNA, 15 bp, Homo sapiens
gtcagctctggccac

SEQ ID NO: 416099 - DNA, 16 bp, Homo sapiens
gtcagctgagcttgag

SEQ ID NO: 416100 - DNA, 15 bp, Homo sapiens
gtcagctgtagaaag

SEQ ID NO: 416101 - DNA, 11 bp, Homo sapiens
gtcagctgtta

SEQ ID NO: 416102 - DNA, 18 bp, Homo sapiens
gtcagctgttactttctt

SEQ ID NO: 416103 - DNA, 15 bp, Homo sapiens
gtcagcttgaatgtc

SEQ ID NO: 416104 - DNA, 19 bp, Homo sapiens
gtcagctttcagagccagt

SEQ ID NO: 416105 - DNA, 21 bp, Homo sapiens
gtcagctttcagagccagtga

SEQ ID NO: 416106 - DNA, 17 bp, Homo sapiens
gtcagctttgccttcca

SEQ ID NO: 416107 - DNA, 20 bp, Homo sapiens
gtcaggaacagtggctgggt

SEQ ID NO: 416108 - DNA, 14 bp, Homo sapiens
gtcaggacacatcg

SEQ ID NO: 416109 - DNA, 13 bp, Homo sapiens
gtcaggagccagc

SEQ ID NO: 416110 - DNA, 17 bp, Homo sapiens
gtcaggagccagcaggg

SEQ ID NO: 416111 - DNA, 19 bp, Homo sapiens
gtcaggagttcgagaccaa

SEQ ID NO: 416112 - DNA, 22 bp, Homo sapiens
gtcaggagttgtttctgaccca

SEQ ID NO: 416113 - DNA, 12 bp, Homo sapiens
gtcaggccctgg

SEQ ID NO: 416114 - DNA, 13 bp, Homo sapiens
gtcaggccctgga

SEQ ID NO: 416115 - DNA, 17 bp, Homo sapiens
gtcagggacagcagcct

SEQ ID NO: 416116 - DNA, 21 bp, Homo sapiens
gtcagggaccaaggacccctc

SEQ ID NO: 416117 - DNA, 14 bp, Homo sapiens
gtcagggcccagag

SEQ ID NO: 416118 - DNA, 15 bp, Homo sapiens
gtcagggcccagagg

SEQ ID NO: 416119 - DNA, 18 bp, Homo sapiens
gtcagggccttggcccag

SEQ ID NO: 416120 - DNA, 14 bp, Homo sapiens
gtcagggtggctgg

SEQ ID NO: 416121 - DNA, 19 bp, Homo sapiens
gtcaggttatactcctcct

SEQ ID NO: 416122 - DNA, 13 bp, Homo sapiens
gtcaggtttgagt

SEQ ID NO: 416123 - DNA, 18 bp, Homo sapiens
gtcagtacccacctgagc

SEQ ID NO: 416124 - DNA, 22 bp, Homo sapiens
gtcagtaggagaggatgcacag

SEQ ID NO: 416125 - DNA, 19 bp, Homo sapiens
gtcagtccctacttaggaa

SEQ ID NO: 416126 - DNA, 23 bp, Homo sapiens
gtcagtgaagcccaggaggacct

SEQ ID NO: 416127 - DNA, 14 bp, Homo sapiens
gtcagtgaggccca

SEQ ID NO: 416128 - DNA, 23 bp, Homo sapiens
gtcagtgcagcccgtgtggcccc

SEQ ID NO: 416129 - DNA, 16 bp, Homo sapiens
gtcagtgtagatcaac

SEQ ID NO: 416130 - DNA, 13 bp, Homo sapiens
gtcagtgtcctca

SEQ ID NO: 416131 - DNA, 22 bp, Homo sapiens
gtcagtgtgccaccctctgcag

SEQ ID NO: 416132 - DNA, 23 bp, Homo sapiens
gtcagtgtgccaccctctgcagg

SEQ ID NO: 416133 - DNA, 14 bp, Homo sapiens
gtcagtttgtgaag

SEQ ID NO: 416134 - DNA, 22 bp, Homo sapiens
gtcataagctccagttttcgta

SEQ ID NO: 416135 - DNA, 16 bp, Homo sapiens
gtcataccaggccgcc

SEQ ID NO: 416136 - DNA, 14 bp, Homo sapiens
gtcatatgagtcct

SEQ ID NO: 416137 - DNA, 17 bp, Homo sapiens
gtcatcaaaaagagtct

SEQ ID NO: 416138 - DNA, 14 bp, Homo sapiens
gtcatcaacaaaag

SEQ ID NO: 416139 - DNA, 15 bp, Homo sapiens
gtcatcaatccagga

SEQ ID NO: 416140 - DNA, 16 bp, Homo sapiens
gtcatcactccctgga

SEQ ID NO: 416141 - DNA, 17 bp, Homo sapiens
gtcatcacttttcagtg

SEQ ID NO: 416142 - DNA, 21 bp, Homo sapiens
gtcatcataaaaggtgaccct

SEQ ID NO: 416143 - DNA, 21 bp, Homo sapiens
gtcatccacacaacaccagga

SEQ ID NO: 416144 - DNA, 19 bp, Homo sapiens
gtcatcccagcacctgcca

SEQ ID NO: 416145 - DNA, 21 bp, Homo sapiens
gtcatcccagcacctgccagg

SEQ ID NO: 416146 - DNA, 19 bp, Homo sapiens
gtcatctccatcagctgta

SEQ ID NO: 416147 - DNA, 20 bp, Homo sapiens
gttaaatagagtatatgcac

SEQ ID NO: 416148 - DNA, 21 bp, Homo sapiens
gttaaatagagtatatgcact

SEQ ID NO: 416149 - DNA, 17 bp, Homo sapiens
gttaaatttctggacct

SEQ ID NO: 416150 - DNA, 19 bp, Homo sapiens
gttaacaaggaatgcctgt

SEQ ID NO: 416151 - DNA, 22 bp, Homo sapiens
gttaacaaggaatgcctgtgcc

SEQ ID NO: 416152 - DNA, 19 bp, Homo sapiens
gttaacacagtaaaatatt

SEQ ID NO: 416153 - DNA, 17 bp, Homo sapiens
gttaacactgtaatatc

SEQ ID NO: 416154 - DNA, 23 bp, Homo sapiens
gttaacagcgtgtcaactttcat

SEQ ID NO: 416155 - DNA, 21 bp, Homo sapiens
gttaacattgaccaagaactg

SEQ ID NO: 416156 - DNA, 19 bp, Homo sapiens
gttaaccaaataaaacata

SEQ ID NO: 416157 - DNA, 19 bp, Homo sapiens
gttaacctttttgtaaata

SEQ ID NO: 416158 - DNA, 12 bp, Homo sapiens
gttaagaaaaaa

SEQ ID NO: 416159 - DNA, 18 bp, Homo sapiens
gttaagaaaaaaataatt

SEQ ID NO: 416160 - DNA, 22 bp, Homo sapiens
gttaagagtgggggagagcagg

SEQ ID NO: 416161 - DNA, 19 bp, Homo sapiens
gttaagcagccgccacatc

SEQ ID NO: 416162 - DNA, 14 bp, Homo sapiens
gttaagtatgtgta

SEQ ID NO: 416163 - DNA, 16 bp, Homo sapiens
gttaagtcgctgaaca

SEQ ID NO: 416164 - DNA, 21 bp, Homo sapiens
gttaataaaggtttcgttgca

SEQ ID NO: 416165 - DNA, 13 bp, Homo sapiens
gttaatattaatt

SEQ ID NO: 416166 - DNA, 12 bp, Homo sapiens
gttaatcttagg

SEQ ID NO: 416167 - DNA, 16 bp, Homo sapiens
gttaatcttgctttct

SEQ ID NO: 416168 - DNA, 21 bp, Homo sapiens
gttaatcttgctttctttgtt

SEQ ID NO: 416169 - DNA, 16 bp, Homo sapiens
gttaatgaaaatgtca

SEQ ID NO: 416170 - DNA, 21 bp, Homo sapiens
gttaatgaaggtgtgctacag

SEQ ID NO: 416171 - DNA, 15 bp, Homo sapiens
gttaattatgtgcat

SEQ ID NO: 416172 - DNA, 22 bp, Homo sapiens
gttaattcattaaaagttttat

SEQ ID NO: 416173 - DNA, 20 bp, Homo sapiens
gttaattctcagaagtgaaa

SEQ ID NO: 416174 - DNA, 17 bp, Homo sapiens
gttaattgatagaataa

SEQ ID NO: 416175 - DNA, 23 bp, Homo sapiens
gttaattgattaaactgtatgtc

SEQ ID NO: 416176 - DNA, 9 bp, Homo sapiens
gttacaaac

SEQ ID NO: 416177 - DNA, 14 bp, Homo sapiens
gttacaaactgcaa

SEQ ID NO: 416178 - DNA, 15 bp, Homo sapiens
gttacaaactgcaat

SEQ ID NO: 416179 - DNA, 19 bp, Homo sapiens
gttacaaactgcaatagag

SEQ ID NO: 416180 - DNA, 21 bp, Homo sapiens
gttacaaactgcaatagagac

SEQ ID NO: 416181 - DNA, 22 bp, Homo sapiens
gttacaagtatacttatatttc

SEQ ID NO: 416182 - DNA, 20 bp, Homo sapiens
gttacaatggcctttatcct

SEQ ID NO: 416183 - DNA, 21 bp, Homo sapiens
gttacacactttttaagaaat

SEQ ID NO: 416184 - DNA, 17 bp, Homo sapiens
gttacagacaaagcgtg

SEQ ID NO: 416185 - DNA, 12 bp, Homo sapiens
gttacagctgaa

SEQ ID NO: 416186 - DNA, 15 bp, Homo sapiens
gttaccatgtcactg

SEQ ID NO: 416187 - DNA, 13 bp, Homo sapiens
gttacccagagaa

SEQ ID NO: 416188 - DNA, 19 bp, Homo sapiens
gttacctaattagagcaga

SEQ ID NO: 416189 - DNA, 22 bp, Homo sapiens
gttaccttggcgtgtgtccctg

SEQ ID NO: 416190 - DNA, 16 bp, Homo sapiens
gttactaagatgaaat

SEQ ID NO: 416191 - DNA, 15 bp, Homo sapiens
gttactatcctggct

SEQ ID NO: 416192 - DNA, 19 bp, Homo sapiens
gttactgaggaccaaagat

SEQ ID NO: 416193 - DNA, 17 bp, Homo sapiens
gttactgatcatgcatt

SEQ ID NO: 416194 - DNA, 22 bp, Homo sapiens
gttactgcctaggagttaatga

SEQ ID NO: 416195 - DNA, 16 bp, Homo sapiens
gttactgtctgtagtg

SEQ ID NO: 416196 - DNA, 12 bp, Homo sapiens
gttacttaaaca

SEQ ID NO: 416197 - DNA, 15 bp, Homo sapiens
gttacttaaacatca

SEQ ID NO: 416198 - DNA, 17 bp, Homo sapiens
gttacttacctaaacag

SEQ ID NO: 416199 - DNA, 13 bp, Homo sapiens
gttacttcctact

SEQ ID NO: 416200 - DNA, 17 bp, Homo sapiens
gttacttgtctgaggcc

SEQ ID NO: 416201 - DNA, 21 bp, Homo sapiens
gttactttctttcagatgttt

SEQ ID NO: 416202 - DNA, 16 bp, Homo sapiens
gttagaatgaggagga

SEQ ID NO: 416203 - DNA, 22 bp, Homo sapiens
gttagagaggtagcgagctgct

SEQ ID NO: 416204 - DNA, 13 bp, Homo sapiens
gttagagatgcct

SEQ ID NO: 416205 - DNA, 14 bp, Homo sapiens
gttagcaatattta

SEQ ID NO: 416206 - DNA, 15 bp, Homo sapiens
gttagcaatatttat

SEQ ID NO: 416207 - DNA, 20 bp, Homo sapiens
gttagccctcagtcagttcc

SEQ ID NO: 416208 - DNA, 15 bp, Homo sapiens
gttagcctggtgaca

SEQ ID NO: 416209 - DNA, 14 bp, Homo sapiens
gttaggaaataaaa

SEQ ID NO: 416210 - DNA, 15 bp, Homo sapiens
gttaggaacccggca

SEQ ID NO: 416211 - DNA, 22 bp, Homo sapiens
gttaggaacccggcatgccgag

SEQ ID NO: 416212 - DNA, 19 bp, Homo sapiens
gttaggattaggtttagaa

SEQ ID NO: 416213 - DNA, 22 bp, Homo sapiens
gttaggattaggtttagaatca

SEQ ID NO: 416214 - DNA, 15 bp, Homo sapiens
gttaggccacgctcc

SEQ ID NO: 416215 - DNA, 23 bp, Homo sapiens
gttagggaaatccaactccaggg

SEQ ID NO: 416216 - DNA, 13 bp, Homo sapiens
gttaggggtgggg

SEQ ID NO: 416217 - DNA, 21 bp, Homo sapiens
gttaggggtgggggagaatgg

SEQ ID NO: 416218 - DNA, 12 bp, Homo sapiens
gttagtcatttg

SEQ ID NO: 416219 - DNA, 17 bp, Homo sapiens
gttagtgggaagagctg

SEQ ID NO: 416220 - DNA, 20 bp, Homo sapiens
gttagtgggaagagctgggt

SEQ ID NO: 416221 - DNA, 16 bp, Homo sapiens
gttagtgtctgtccat

SEQ ID NO: 416222 - DNA, 17 bp, Homo sapiens
gttataaatcaatgtca

SEQ ID NO: 416223 - DNA, 18 bp, Homo sapiens
gttataaatcaatgtcac

SEQ ID NO: 416224 - DNA, 17 bp, Homo sapiens
gttataacttcataaaa

SEQ ID NO: 416225 - DNA, 19 bp, Homo sapiens
gttatagtatatctggaca

SEQ ID NO: 416226 - DNA, 17 bp, Homo sapiens
gttatatattttttgta

SEQ ID NO: 416227 - DNA, 22 bp, Homo sapiens
gttatatgacttcttgttcatg

SEQ ID NO: 416228 - DNA, 21 bp, Homo sapiens
gttatcccttccttttagcct

SEQ ID NO: 416229 - DNA, 15 bp, Homo sapiens
gttatctgcctggcc

SEQ ID NO: 416230 - DNA, 18 bp, Homo sapiens
gttatctgcctggcctgg

SEQ ID NO: 416231 - DNA, 21 bp, Homo sapiens
gttatctgcctggcctggctc

SEQ ID NO: 416232 - DNA, 14 bp, Homo sapiens
gttatctgtcttta

SEQ ID NO: 416233 - DNA, 16 bp, Homo sapiens
gttatcttgtgtatgg

SEQ ID NO: 416234 - DNA, 13 bp, Homo sapiens
gttatgaatcagt

SEQ ID NO: 416235 - DNA, 14 bp, Homo sapiens
gttatgataaaagg

SEQ ID NO: 416236 - DNA, 16 bp, Homo sapiens
gttatgataaaaggaa

SEQ ID NO: 416237 - DNA, 22 bp, Homo sapiens
gttatgcaagggactgtgtgtt

SEQ ID NO: 416238 - DNA, 22 bp, Homo sapiens
gttatgtcagcagctctgagac

SEQ ID NO: 416239 - DNA, 22 bp, Homo sapiens
gttatgtgaatgatctctctga

SEQ ID NO: 416240 - DNA, 18 bp, Homo sapiens
gttattaatccacaaata

SEQ ID NO: 416241 - DNA, 14 bp, Homo sapiens
gttattagaactta

SEQ ID NO: 416242 - DNA, 19 bp, Homo sapiens
gttattattggcttgcact

SEQ ID NO: 416243 - DNA, 19 bp, Homo sapiens
gttattcactctcccagag

SEQ ID NO: 416244 - DNA, 17 bp, Homo sapiens
gttattgtacagctgtt

SEQ ID NO: 416245 - DNA, 18 bp, Homo sapiens
gttatttgttattttcag

SEQ ID NO: 416246 - DNA, 18 bp, Homo sapiens
gttattttaataccttta

SEQ ID NO: 416247 - DNA, 20 bp, Homo sapiens
gttattttaatacctttaaa

SEQ ID NO: 416248 - DNA, 21 bp, Homo sapiens
gttattttctttatcattgct

SEQ ID NO: 416249 - DNA, 14 bp, Homo sapiens
gttcaaaatgtctg

SEQ ID NO: 416250 - DNA, 18 bp, Homo sapiens
gttcaaaatgttaataaa

SEQ ID NO: 416251 - DNA, 19 bp, Homo sapiens
gttcaaaatgttaataaag

SEQ ID NO: 416252 - DNA, 15 bp, Homo sapiens
gttcaaactactgta

SEQ ID NO: 416253 - DNA, 19 bp, Homo sapiens
gttcaaagaacccccctcc

SEQ ID NO: 416254 - DNA, 13 bp, Homo sapiens
gttcaagaaataa

SEQ ID NO: 416255 - DNA, 18 bp, Homo sapiens
gttcaatctcccgctgct

SEQ ID NO: 416256 - DNA, 16 bp, Homo sapiens
gttcaatctgtgaagc

SEQ ID NO: 416257 - DNA, 12 bp, Homo sapiens
gttcaatgatct

SEQ ID NO: 416258 - DNA, 13 bp, Homo sapiens
gttcaatgatcta

SEQ ID NO: 416259 - DNA, 19 bp, Homo sapiens
gttcaatgatctaggttta

SEQ ID NO: 416260 - DNA, 21 bp, Homo sapiens
gttcaatgatctaggtttaac

SEQ ID NO: 416261 - DNA, 22 bp, Homo sapiens
gttcaatgatctaggtttaact

SEQ ID NO: 416262 - DNA, 22 bp, Homo sapiens
gttcaatgcctcacgagatttg

SEQ ID NO: 416263 - DNA, 14 bp, Homo sapiens
gttcacaccctgca

SEQ ID NO: 416264 - DNA, 15 bp, Homo sapiens
gttcacaccctgcaa

SEQ ID NO: 416265 - DNA, 14 bp, Homo sapiens
gttcacccctccac

SEQ ID NO: 416266 - DNA, 17 bp, Homo sapiens
gttcacgccattctcct

SEQ ID NO: 416267 - DNA, 16 bp, Homo sapiens
gttcacgtcactgcca

SEQ ID NO: 416268 - DNA, 18 bp, Homo sapiens
gttcagaaatgctgcctg

SEQ ID NO: 416269 - DNA, 21 bp, Homo sapiens
gttcagaaatgctgcctgcct

SEQ ID NO: 416270 - DNA, 15 bp, Homo sapiens
gttcagacccctgcc

SEQ ID NO: 416271 - DNA, 21 bp, Homo sapiens
gttcagagactggcagccagg

SEQ ID NO: 416272 - DNA, 14 bp, Homo sapiens
gttcagcactgtcc

SEQ ID NO: 416273 - DNA, 22 bp, Homo sapiens
gttcagcactgtcccttgcctc

SEQ ID NO: 416274 - DNA, 18 bp, Homo sapiens
gttcaggagagtaaaaat

SEQ ID NO: 416275 - DNA, 15 bp, Homo sapiens
gttcaggggactcag

SEQ ID NO: 416276 - DNA, 18 bp, Homo sapiens
gttcaggggactcagccc

SEQ ID NO: 416277 - DNA, 22 bp, Homo sapiens
gttcaggtcccacgtctggcca

SEQ ID NO: 416278 - DNA, 16 bp, Homo sapiens
gttcagtgtcccgggc

SEQ ID NO: 416279 - DNA, 16 bp, Homo sapiens
gttcagttccagcttt

SEQ ID NO: 416280 - DNA, 20 bp, Homo sapiens
gttcagttcctctttgcatg

SEQ ID NO: 416281 - DNA, 20 bp, Homo sapiens
gttcatagggtctcttcagg

SEQ ID NO: 416282 - DNA, 22 bp, Homo sapiens
gttcatagggtctcttcaggtt

SEQ ID NO: 416283 - DNA, 20 bp, Homo sapiens
gttcatagtcaatcaaacag

SEQ ID NO: 416284 - DNA, 19 bp, Homo sapiens
gttcatatgtaccatgtac

SEQ ID NO: 416285 - DNA, 13 bp, Homo sapiens
gttcatcagtgtt

SEQ ID NO: 416286 - DNA, 15 bp, Homo sapiens
gttcatccaatcctc

SEQ ID NO: 416287 - DNA, 21 bp, Homo sapiens
gttcatccaatcctcactggg

SEQ ID NO: 416288 - DNA, 17 bp, Homo sapiens
gttcatcgtataacaca

SEQ ID NO: 416289 - DNA, 15 bp, Homo sapiens
gttcatctctgctga

SEQ ID NO: 416290 - DNA, 10 bp, Homo sapiens
gttcattaaa

SEQ ID NO: 416291 - DNA, 12 bp, Homo sapiens
gttcattaaaca

SEQ ID NO: 416292 - DNA, 14 bp, Homo sapiens
gttcattgtaatgt

SEQ ID NO: 416293 - DNA, 22 bp, Homo sapiens
gttcattgtaatgttactgatc

SEQ ID NO: 416294 - DNA, 14 bp, Homo sapiens
gttcatttctgtct

SEQ ID NO: 416295 - DNA, 15 bp, Homo sapiens
gttcatttctgtctc

SEQ ID NO: 416296 - DNA, 18 bp, Homo sapiens
gttcatttgtgtgctcat

SEQ ID NO: 416297 - DNA, 17 bp, Homo sapiens
gttcattttagtgactg

SEQ ID NO: 416298 - DNA, 18 bp, Homo sapiens
gttcattttagtgactgt

SEQ ID NO: 416299 - DNA, 15 bp, Homo sapiens
gtgcgcagccgcgct

SEQ ID NO: 416300 - DNA, 21 bp, Homo sapiens
gtgcgctcacctgcagcccct

SEQ ID NO: 416301 - DNA, 11 bp, Homo sapiens
gtgcggcccgt

SEQ ID NO: 416302 - DNA, 15 bp, Homo sapiens
gtgcggtaggtgctg

SEQ ID NO: 416303 - DNA, 19 bp, Homo sapiens
gtgcggtaggtgctggcct

SEQ ID NO: 416304 - DNA, 23 bp, Homo sapiens
gtgcggtgcactggtccgaggag

SEQ ID NO: 416305 - DNA, 14 bp, Homo sapiens
gtgcgtggctgtgg

SEQ ID NO: 416306 - DNA, 14 bp, Homo sapiens
gtgcgttttagagt

SEQ ID NO: 416307 - DNA, 23 bp, Homo sapiens
gtgctaaaaaattaaaccaagca

SEQ ID NO: 416308 - DNA, 13 bp, Homo sapiens
gtgctaactgtat

SEQ ID NO: 416309 - DNA, 19 bp, Homo sapiens
gtgctaatttctgtccaga

SEQ ID NO: 416310 - DNA, 15 bp, Homo sapiens
gtgctagggtgcctg

SEQ ID NO: 416311 - DNA, 19 bp, Homo sapiens
gtgctagggtgcctgctct

SEQ ID NO: 416312 - DNA, 14 bp, Homo sapiens
gtgctcaaagatgt

SEQ ID NO: 416313 - DNA, 21 bp, Homo sapiens
gtgctcaaagatgtactgaga

SEQ ID NO: 416314 - DNA, 23 bp, Homo sapiens
gtgctcatgtctgttaataaaga

SEQ ID NO: 416315 - DNA, 20 bp, Homo sapiens
gtgctccagcagtgctgggc

SEQ ID NO: 416316 - DNA, 17 bp, Homo sapiens
gtgctccctcctcagtc

SEQ ID NO: 416317 - DNA, 13 bp, Homo sapiens
gtgctccttttct

SEQ ID NO: 416318 - DNA, 18 bp, Homo sapiens
gtgctccttttctctttg

SEQ ID NO: 416319 - DNA, 14 bp, Homo sapiens
gtgctctggcggct

SEQ ID NO: 416320 - DNA, 23 bp, Homo sapiens
gtgctctggcggcttcctgtcca

SEQ ID NO: 416321 - DNA, 22 bp, Homo sapiens
gtgctctggggatttctgggat

SEQ ID NO: 416322 - DNA, 18 bp, Homo sapiens
gagatcagcattcaaaat

SEQ ID NO: 416323 - DNA, 15 bp, Homo sapiens
gagatccgccctggg

SEQ ID NO: 416324 - DNA, 17 bp, Homo sapiens
gagatccgccctgggct

SEQ ID NO: 416325 - DNA, 19 bp, Homo sapiens
gagatccgccctgggctct

SEQ ID NO: 416326 - DNA, 23 bp, Homo sapiens
gagatccgccctgggctctgggt

SEQ ID NO: 416327 - DNA, 18 bp, Homo sapiens
gagatcggggccagaggc

SEQ ID NO: 416328 - DNA, 20 bp, Homo sapiens
gagatctaagcctttccata

SEQ ID NO: 416329 - DNA, 21 bp, Homo sapiens
gagatctaagcctttccataa

SEQ ID NO: 416330 - DNA, 23 bp, Homo sapiens
gagatcttccttccgctctgagg

SEQ ID NO: 416331 - DNA, 17 bp, Homo sapiens
gagatgagaaacaacag

SEQ ID NO: 416332 - DNA, 12 bp, Homo sapiens
gagatgatgtga

SEQ ID NO: 416333 - DNA, 21 bp, Homo sapiens
gagatgcgttgttacaggaag

SEQ ID NO: 416334 - DNA, 21 bp, Homo sapiens
gagatgctactgtcagtgtcc

SEQ ID NO: 416335 - DNA, 17 bp, Homo sapiens
gagatgctgctcccgcc

SEQ ID NO: 416336 - DNA, 16 bp, Homo sapiens
gagatgctgggaccct

SEQ ID NO: 416337 - DNA, 18 bp, Homo sapiens
gagatgctgggaccctcg

SEQ ID NO: 416338 - DNA, 23 bp, Homo sapiens
gagatggaacccttttggccccc

SEQ ID NO: 416339 - DNA, 12 bp, Homo sapiens
gagatggaggag

SEQ ID NO: 416340 - DNA, 17 bp, Homo sapiens
gagatgggaagggctta

SEQ ID NO: 416341 - DNA, 17 bp, Homo sapiens
gagatgggactgggagg

SEQ ID NO: 416342 - DNA, 19 bp, Homo sapiens
gagatgggactgggagggc

SEQ ID NO: 416343 - DNA, 20 bp, Homo sapiens
gagatggtaatctacagctc

SEQ ID NO: 416344 - DNA, 15 bp, Homo sapiens
gagatggtcagtgtg

SEQ ID NO: 416345 - DNA, 17 bp, Homo sapiens
gagatgtaatgacagag

SEQ ID NO: 416346 - DNA, 19 bp, Homo sapiens
gagatgtaatgacagagag

SEQ ID NO: 416347 - DNA, 23 bp, Homo sapiens
gagatgtatgaaggcttttggtc

SEQ ID NO: 416348 - DNA, 16 bp, Homo sapiens
gagatgtatgcccaaa

SEQ ID NO: 416349 - DNA, 20 bp, Homo sapiens
gagatgtgtccatgtgaaat

SEQ ID NO: 416350 - DNA, 14 bp, Homo sapiens
gagatgtttttaaa

SEQ ID NO: 416351 - DNA, 21 bp, Homo sapiens
gagatgtttttaaaagtttca

SEQ ID NO: 416352 - DNA, 13 bp, Homo sapiens
gagattaatttgt

SEQ ID NO: 416353 - DNA, 16 bp, Homo sapiens
gagattagagggaggt

SEQ ID NO: 416354 - DNA, 22 bp, Homo sapiens
gagattctgggaaaggtgctca

SEQ ID NO: 416355 - DNA, 17 bp, Homo sapiens
gagattggacggcctga

SEQ ID NO: 416356 - DNA, 18 bp, Homo sapiens
gagattggtcattaaata

SEQ ID NO: 416357 - DNA, 16 bp, Homo sapiens
gagatttatataaatg

SEQ ID NO: 416358 - DNA, 18 bp, Homo sapiens
gagatttgccagcacagg

SEQ ID NO: 416359 - DNA, 17 bp, Homo sapiens
gagcaaaaatgccaggc

SEQ ID NO: 416360 - DNA, 16 bp, Homo sapiens
gagcaaaacaaagctg

SEQ ID NO: 416361 - DNA, 14 bp, Homo sapiens
gagcaaaaggcagc

SEQ ID NO: 416362 - DNA, 17 bp, Homo sapiens
gagcaaaaggcagctca

SEQ ID NO: 416363 - DNA, 22 bp, Homo sapiens
gagcaaaaggcagctcacccct

SEQ ID NO: 416364 - DNA, 13 bp, Homo sapiens
gagcaaagatcaa

SEQ ID NO: 416365 - DNA, 14 bp, Homo sapiens
gagcaaagatcaaa

SEQ ID NO: 416366 - DNA, 14 bp, Homo sapiens
gagcaaagtctaaa

SEQ ID NO: 416367 - DNA, 20 bp, Homo sapiens
gagcaaagtgaagacactgg

SEQ ID NO: 416368 - DNA, 16 bp, Homo sapiens
gagcaacccctgtacc

SEQ ID NO: 416369 - DNA, 18 bp, Homo sapiens
gagcaacccctgtaccca

SEQ ID NO: 416370 - DNA, 21 bp, Homo sapiens
gagcaacccctgtacccagct

SEQ ID NO: 416371 - DNA, 16 bp, Homo sapiens
gttggtcggtgggttg

SEQ ID NO: 416372 - DNA, 12 bp, Homo sapiens
gttggtgactga

SEQ ID NO: 416373 - DNA, 18 bp, Homo sapiens
gttggtgcaattaactct

SEQ ID NO: 416374 - DNA, 23 bp, Homo sapiens
gttgtaaacaacgtgtatagtgc

SEQ ID NO: 416375 - DNA, 21 bp, Homo sapiens
gttgtaaggatataaaaagta

SEQ ID NO: 416376 - DNA, 15 bp, Homo sapiens
gttgtacatagtggt

SEQ ID NO: 416377 - DNA, 20 bp, Homo sapiens
gttgtaccactgctaataaa

SEQ ID NO: 416378 - DNA, 23 bp, Homo sapiens
gttgtaccactgctaataaatga

SEQ ID NO: 416379 - DNA, 19 bp, Homo sapiens
gttgtagatacaatcagct

SEQ ID NO: 416380 - DNA, 19 bp, Homo sapiens
gttgtagcaggtttcacta

SEQ ID NO: 416381 - DNA, 15 bp, Homo sapiens
gttgtagctaattag

SEQ ID NO: 416382 - DNA, 23 bp, Homo sapiens
gttgtatgcctttaaatctgtga

SEQ ID NO: 416383 - DNA, 20 bp, Homo sapiens
gttgtattcctgcctttgat

SEQ ID NO: 416384 - DNA, 23 bp, Homo sapiens
gttgtattttaactcataccttt

SEQ ID NO: 416385 - DNA, 21 bp, Homo sapiens
gttgtcaatattaaatacaga

SEQ ID NO: 416386 - DNA, 16 bp, Homo sapiens
gttgtcattgacttca

SEQ ID NO: 416387 - DNA, 15 bp, Homo sapiens
gttgtcctgtgtcat

SEQ ID NO: 416388 - DNA, 13 bp, Homo sapiens
gttgtctgccgtg

SEQ ID NO: 416389 - DNA, 12 bp, Homo sapiens
gttgtctttctt

SEQ ID NO: 416390 - DNA, 14 bp, Homo sapiens
gttgtgaatgttgt

SEQ ID NO: 416391 - DNA, 18 bp, Homo sapiens
gttgtgactgctgccatt

SEQ ID NO: 416392 - DNA, 19 bp, Homo sapiens
gttgtgactgctgccattt

SEQ ID NO: 416393 - DNA, 19 bp, Homo sapiens
gttgtgcagtgtgcctgtc

SEQ ID NO: 416394 - DNA, 17 bp, Homo sapiens
gttgtgctaatttctgt

SEQ ID NO: 416395 - DNA, 21 bp, Homo sapiens
gttgtgctaatttctgtccag

SEQ ID NO: 416396 - DNA, 17 bp, Homo sapiens
gttgtgtaagagaatgt

SEQ ID NO: 416397 - DNA, 20 bp, Homo sapiens
gttgtgtgggtttactctgt

SEQ ID NO: 416398 - DNA, 16 bp, Homo sapiens
gttgttaatgaaaatg

SEQ ID NO: 416399 - DNA, 17 bp, Homo sapiens
gttgttaatgaaaatgt

SEQ ID NO: 416400 - DNA, 18 bp, Homo sapiens
gttgttatattcattctt

SEQ ID NO: 416401 - DNA, 13 bp, Homo sapiens
gttgttatgctat

SEQ ID NO: 416402 - DNA, 21 bp, Homo sapiens
gttgttcagaagttgttagtg

SEQ ID NO: 416403 - DNA, 21 bp, Homo sapiens
gttgttgccaggttgcagctg

SEQ ID NO: 416404 - DNA, 22 bp, Homo sapiens
gttgttgccaggttgcagctgc

SEQ ID NO: 416405 - DNA, 14 bp, Homo sapiens
gttgtttctctgag

SEQ ID NO: 416406 - DNA, 14 bp, Homo sapiens
gtttcctcaggctg

SEQ ID NO: 416407 - DNA, 14 bp, Homo sapiens
gtttccttctcttt

SEQ ID NO: 416408 - DNA, 20 bp, Homo sapiens
gtttccttgttggtcagagg

SEQ ID NO: 416409 - DNA, 17 bp, Homo sapiens
gtttcggggtgaagcaa

SEQ ID NO: 416410 - DNA, 21 bp, Homo sapiens
gtttcggggtgaagcaagttc

SEQ ID NO: 416411 - DNA, 23 bp, Homo sapiens
gtttcggggtgaagcaagttcac

SEQ ID NO: 416412 - DNA, 13 bp, Homo sapiens
gtttctaaaacta

SEQ ID NO: 416413 - DNA, 15 bp, Homo sapiens
gtttctagaggcctc

SEQ ID NO: 416414 - DNA, 23 bp, Homo sapiens
gtttctagctagaaatatgattt

SEQ ID NO: 416415 - DNA, 23 bp, Homo sapiens
gtttctaggtaatttttacagaa

SEQ ID NO: 416416 - DNA, 22 bp, Homo sapiens
gtttctagttaggccacgctcc

SEQ ID NO: 416417 - DNA, 19 bp, Homo sapiens
gtttctatactgtttgtaa

SEQ ID NO: 416418 - DNA, 20 bp, Homo sapiens
gtttctatactgtttgtaat

SEQ ID NO: 416419 - DNA, 21 bp, Homo sapiens
gtttctatggattcacttcta

SEQ ID NO: 416420 - DNA, 12 bp, Homo sapiens
gtttctcagact

SEQ ID NO: 416421 - DNA, 14 bp, Homo sapiens
gtttctcagctccc

SEQ ID NO: 416422 - DNA, 14 bp, Homo sapiens
gtttctctgagctt

SEQ ID NO: 416423 - DNA, 19 bp, Homo sapiens
gtttctgaaaattccagaa

SEQ ID NO: 416424 - DNA, 13 bp, Homo sapiens
gtttctgagctaa

SEQ ID NO: 416425 - DNA, 15 bp, Homo sapiens
gtttctggtgactgc

SEQ ID NO: 416426 - DNA, 12 bp, Homo sapiens
gtttctgttctg

SEQ ID NO: 416427 - DNA, 20 bp, Homo sapiens
gtttctgtttgaattttcaa

SEQ ID NO: 416428 - DNA, 13 bp, Homo sapiens
gtttcttccaaag

SEQ ID NO: 416429 - DNA, 20 bp, Homo sapiens
gtttcttgccccagtgtggt

SEQ ID NO: 416430 - DNA, 11 bp, Homo sapiens
gtttcttgctt

SEQ ID NO: 416431 - DNA, 20 bp, Homo sapiens
gtttcttttttaatagaata

SEQ ID NO: 416432 - DNA, 13 bp, Homo sapiens
gtttgaaaatatt

SEQ ID NO: 416433 - DNA, 15 bp, Homo sapiens
gtttgacattgtatg

SEQ ID NO: 416434 - DNA, 16 bp, Homo sapiens
gtttgacgaagaaaca

SEQ ID NO: 416435 - DNA, 17 bp, Homo sapiens
gtttgagacaagccctg

SEQ ID NO: 416436 - DNA, 20 bp, Homo sapiens
gtttgagacaagccctggca

SEQ ID NO: 416437 - DNA, 16 bp, Homo sapiens
gtttgatattgtcacc

SEQ ID NO: 416438 - DNA, 18 bp, Homo sapiens
gtttgatgactaaaagtg

SEQ ID NO: 416439 - DNA, 17 bp, Homo sapiens
gtttgatgctgagtcat

SEQ ID NO: 416440 - DNA, 18 bp, Homo sapiens
gtttgccttctactttta

SEQ ID NO: 416441 - DNA, 21 bp, Homo sapiens
gtttgcctttaggcaggaagt

SEQ ID NO: 416442 - DNA, 18 bp, Homo sapiens
gtttgctaagtaaattag

SEQ ID NO: 416443 - DNA, 19 bp, Homo sapiens
gtttgctgtatacaaacag

SEQ ID NO: 416444 - DNA, 20 bp, Homo sapiens
gtttgctgtttcccctgcac

SEQ ID NO: 416445 - DNA, 14 bp, Homo sapiens
gtttgcttattgtt

SEQ ID NO: 416446 - DNA, 17 bp, Homo sapiens
gtttgcttattgttcca

SEQ ID NO: 416447 - DNA, 20 bp, Homo sapiens
gtttgctttgtatgcacttt

SEQ ID NO: 416448 - DNA, 18 bp, Homo sapiens
gtttggcgggccaaggac

SEQ ID NO: 416449 - DNA, 21 bp, Homo sapiens
gtttgggagaacacatttcta

SEQ ID NO: 416450 - DNA, 14 bp, Homo sapiens
gtttgggcagtgga

SEQ ID NO: 416451 - DNA, 22 bp, Homo sapiens
gtttgggtatcctgcccagtgt

SEQ ID NO: 416452 - DNA, 22 bp, Homo sapiens
gtttggtgggggtagagctgat

SEQ ID NO: 416453 - DNA, 15 bp, Homo sapiens
gtttgtaaataagag

SEQ ID NO: 416454 - DNA, 17 bp, Homo sapiens
gtttgtaaataagagat

SEQ ID NO: 416455 - DNA, 15 bp, Homo sapiens
gtttgtaatatacag

SEQ ID NO: 416456 - DNA, 23 bp, Homo sapiens
gtttgtaatatacagtttttgta

SEQ ID NO: 416457 - DNA, 14 bp, Homo sapiens
gtttgtaccattta

SEQ ID NO: 416458 - DNA, 16 bp, Homo sapiens
gtttgtaccatttatg

SEQ ID NO: 416459 - DNA, 14 bp, Homo sapiens
gtttgtagtaaata

SEQ ID NO: 416460 - DNA, 20 bp, Homo sapiens
gtttgtagtttttgctgaag

SEQ ID NO: 416461 - DNA, 15 bp, Homo sapiens
gtttgtataacttct

SEQ ID NO: 416462 - DNA, 17 bp, Homo sapiens
gtttgtcccccggggca

SEQ ID NO: 416463 - DNA, 18 bp, Homo sapiens
gtttgtctgtcttcatag

SEQ ID NO: 416464 - DNA, 17 bp, Homo sapiens
gtttgtgaagtgattga

SEQ ID NO: 416465 - DNA, 16 bp, Homo sapiens
gtttgtgagtatgtgt

SEQ ID NO: 416466 - DNA, 19 bp, Homo sapiens
gtttgtggaaaatgaaaat

SEQ ID NO: 416467 - DNA, 12 bp, Homo sapiens
gtttgtggcctc

SEQ ID NO: 416468 - DNA, 14 bp, Homo sapiens
gtttgtggcctcag

SEQ ID NO: 416469 - DNA, 15 bp, Homo sapiens
gtttgtgtggatacc

SEQ ID NO: 416470 - DNA, 13 bp, Homo sapiens
gtttgttaaaact

SEQ ID NO: 416471 - DNA, 17 bp, Homo sapiens
gtttgttaaaactggca

SEQ ID NO: 416472 - DNA, 14 bp, Homo sapiens
gtttgttaattgat

SEQ ID NO: 416473 - DNA, 23 bp, Homo sapiens
gtttgttaattgattaaactgta

SEQ ID NO: 416474 - DNA, 13 bp, Homo sapiens
gtttgttattaat

SEQ ID NO: 416475 - DNA, 18 bp, Homo sapiens
gtttgttgcacagtccct

SEQ ID NO: 416476 - DNA, 16 bp, Homo sapiens
gtttgtttgttttgtt

SEQ ID NO: 416477 - DNA, 17 bp, Homo sapiens
gtttgttttgtttttta

SEQ ID NO: 416478 - DNA, 13 bp, Homo sapiens
gttttaaaataag

SEQ ID NO: 416479 - DNA, 21 bp, Homo sapiens
gttttaaaataagttaaaggc

SEQ ID NO: 416480 - DNA, 22 bp, Homo sapiens
gttttaaatacgcactacatgt

SEQ ID NO: 416481 - DNA, 14 bp, Homo sapiens
gttttaaatgtgtt

SEQ ID NO: 416482 - DNA, 15 bp, Homo sapiens
gttttaaatttaaaa

SEQ ID NO: 416483 - DNA, 17 bp, Homo sapiens
gttttaacattgaaagt

SEQ ID NO: 416484 - DNA, 15 bp, Homo sapiens
gttttaacttccagt

SEQ ID NO: 416485 - DNA, 16 bp, Homo sapiens
gttttaaggaagaaaa

SEQ ID NO: 416486 - DNA, 20 bp, Homo sapiens
gttttaattccaatatgatg

SEQ ID NO: 416487 - DNA, 20 bp, Homo sapiens
gttttacattacaaatttct

SEQ ID NO: 416488 - DNA, 15 bp, Homo sapiens
gttttaccccagctc

SEQ ID NO: 416489 - DNA, 16 bp, Homo sapiens
gttttaccccagctcc

SEQ ID NO: 416490 - DNA, 12 bp, Homo sapiens
gttttactcttt

SEQ ID NO: 416491 - DNA, 13 bp, Homo sapiens
gttttagaatgat

SEQ ID NO: 416492 - DNA, 16 bp, Homo sapiens
gttttagtgccaggct

SEQ ID NO: 416493 - DNA, 11 bp, Homo sapiens
gttttatcaag

SEQ ID NO: 416494 - DNA, 19 bp, Homo sapiens
gttttatgtcatactctgt

SEQ ID NO: 416495 - DNA, 14 bp, Homo sapiens
gttttatgtttctt

SEQ ID NO: 416496 - DNA, 18 bp, Homo sapiens
gttttattctttgagaag

SEQ ID NO: 416497 - DNA, 23 bp, Homo sapiens
gttttattttggaattggtgtat

SEQ ID NO: 416498 - DNA, 14 bp, Homo sapiens
gttttcaaaatact

SEQ ID NO: 416499 - DNA, 23 bp, Homo sapiens
gttttcaaattggactttcaaaa

SEQ ID NO: 416500 - DNA, 23 bp, Homo sapiens
gttttcagattgtaaaggtaggt

SEQ ID NO: 416501 - DNA, 16 bp, Homo sapiens
gttttcagcaactcag

SEQ ID NO: 416502 - DNA, 16 bp, Homo sapiens
gttttcatcctggcct

SEQ ID NO: 416503 - DNA, 17 bp, Homo sapiens
gttttcatttacaggaa

SEQ ID NO: 416504 - DNA, 18 bp, Homo sapiens
gttttccagtattgaaaa

SEQ ID NO: 416505 - DNA, 13 bp, Homo sapiens
gttttccatgaaa

SEQ ID NO: 416506 - DNA, 17 bp, Homo sapiens
gttttcccctccctggg

SEQ ID NO: 416507 - DNA, 17 bp, Homo sapiens
gttttcgaagctcagcc

SEQ ID NO: 416508 - DNA, 23 bp, Homo sapiens
gttttcgaagctcagcccacccc

SEQ ID NO: 416509 - DNA, 22 bp, Homo sapiens
gttttcgtcacaggagtctttg

SEQ ID NO: 416510 - DNA, 17 bp, Homo sapiens
gttttctctttgtgggg

SEQ ID NO: 416511 - DNA, 18 bp, Homo sapiens
gttttctgtgcactgtag

SEQ ID NO: 416512 - DNA, 14 bp, Homo sapiens
gttttctgtttcta

SEQ ID NO: 416513 - DNA, 23 bp, Homo sapiens
gttttcttcaagggaagaaacac

SEQ ID NO: 416514 - DNA, 17 bp, Homo sapiens
gttttctttcctcccca

SEQ ID NO: 416515 - DNA, 16 bp, Homo sapiens
gttttcttttaatttt

SEQ ID NO: 416516 - DNA, 17 bp, Homo sapiens
gttttcttttgccatga

SEQ ID NO: 416517 - DNA, 21 bp, Homo sapiens
gttttctttttttagggagaa

SEQ ID NO: 416518 - DNA, 14 bp, Homo sapiens
gttttgaaagaaaa

SEQ ID NO: 416519 - DNA, 18 bp, Homo sapiens
gttttgaatggtgttgta

SEQ ID NO: 416520 - DNA, 11 bp, Homo sapiens
gttttgagaaa

SEQ ID NO: 416521 - DNA, 19 bp, Homo sapiens
gttttgatgccatttgtct

SEQ ID NO: 416522 - DNA, 23 bp, Homo sapiens
gttttgatgtttgtggcctcaga

SEQ ID NO: 416523 - DNA, 16 bp, Homo sapiens
gttttggggactcatt

SEQ ID NO: 416524 - DNA, 16 bp, Homo sapiens
gttttggttaataaaa

SEQ ID NO: 416525 - DNA, 16 bp, Homo sapiens
gttttgtacttgttct

SEQ ID NO: 416526 - DNA, 21 bp, Homo sapiens
gttttgtataaataataaaga

SEQ ID NO: 416527 - DNA, 24 bp, Homo sapiens
gttttgtcaaactgtagaaatgat

SEQ ID NO: 416528 - DNA, 21 bp, Homo sapiens
gttttgtcatcaatccaggat

SEQ ID NO: 416529 - DNA, 24 bp, Homo sapiens
gttttgtgactatatagagatgtt

SEQ ID NO: 416530 - DNA, 13 bp, Homo sapiens
gttttgtgtgtat

SEQ ID NO: 416531 - DNA, 17 bp, Homo sapiens
taaaagtttgtccttta

SEQ ID NO: 416532 - DNA, 17 bp, Homo sapiens
taaaagttttaacctca

SEQ ID NO: 416533 - DNA, 17 bp, Homo sapiens
taaaataaacagttgtg

SEQ ID NO: 416534 - DNA, 13 bp, Homo sapiens
taaaataaagtat

SEQ ID NO: 416535 - DNA, 17 bp, Homo sapiens
taaaataaagtatatat

SEQ ID NO: 416536 - DNA, 14 bp, Homo sapiens
taaaataaataatc

SEQ ID NO: 416537 - DNA, 15 bp, Homo sapiens
taaaataaataatct

SEQ ID NO: 416538 - DNA, 14 bp, Homo sapiens
taaaataaatatac

SEQ ID NO: 416539 - DNA, 18 bp, Homo sapiens
taaaataagtaacatata

SEQ ID NO: 416540 - DNA, 11 bp, Homo sapiens
taaaataagtc

SEQ ID NO: 416541 - DNA, 14 bp, Homo sapiens
taaaataagtccta

SEQ ID NO: 416542 - DNA, 20 bp, Homo sapiens
taaaataagtcctaaagtga

SEQ ID NO: 416543 - DNA, 14 bp, Homo sapiens
taaaataatgattt

SEQ ID NO: 416544 - DNA, 18 bp, Homo sapiens
taaaataatgatttaagc

SEQ ID NO: 416545 - DNA, 19 bp, Homo sapiens
taaaatactcaccaaaata

SEQ ID NO: 416546 - DNA, 18 bp, Homo sapiens
taaaatagcttgtatagt

SEQ ID NO: 416547 - DNA, 19 bp, Homo sapiens
taaaatataaattaagact

SEQ ID NO: 416548 - DNA, 15 bp, Homo sapiens
taaaatatcattcag

SEQ ID NO: 416549 - DNA, 17 bp, Homo sapiens
taaaatatgatgtttaa

SEQ ID NO: 416550 - DNA, 14 bp, Homo sapiens
taaaatatggctat

SEQ ID NO: 416551 - DNA, 13 bp, Homo sapiens
taaaatattcctg

SEQ ID NO: 416552 - DNA, 15 bp, Homo sapiens
taaaatcagactctt

SEQ ID NO: 416553 - DNA, 14 bp, Homo sapiens
taaaatcaggattt

SEQ ID NO: 416554 - DNA, 20 bp, Homo sapiens
taaaatcaggattttagtgc

SEQ ID NO: 416555 - DNA, 20 bp, Homo sapiens
taaaatcattcaatatctga

SEQ ID NO: 416556 - DNA, 21 bp, Homo sapiens
taaaatccagcatcccaagat

SEQ ID NO: 416557 - DNA, 18 bp, Homo sapiens
taaaatctgtattgctaa

SEQ ID NO: 416558 - DNA, 17 bp, Homo sapiens
taaaatcttcagctggt

SEQ ID NO: 416559 - DNA, 20 bp, Homo sapiens
taaaatcttcagctggtgga

SEQ ID NO: 416560 - DNA, 16 bp, Homo sapiens
taaaatcttgaaaatg

SEQ ID NO: 416561 - DNA, 14 bp, Homo sapiens
taaaatgaaattac

SEQ ID NO: 416562 - DNA, 13 bp, Homo sapiens
taaaatgactttt

SEQ ID NO: 416563 - DNA, 17 bp, Homo sapiens
taaaatgaggacatgtt

SEQ ID NO: 416564 - DNA, 16 bp, Homo sapiens
taaaatgattgtaaaa

SEQ ID NO: 416565 - DNA, 17 bp, Homo sapiens
taaaatgattgtaaaat

SEQ ID NO: 416566 - DNA, 18 bp, Homo sapiens
taaaatgattgtaaaata

SEQ ID NO: 416567 - DNA, 15 bp, Homo sapiens
taaaatgattttatc

SEQ ID NO: 416568 - DNA, 18 bp, Homo sapiens
taaaatgattttatctgt

SEQ ID NO: 416569 - DNA, 16 bp, Homo sapiens
taaaatgcattgaaag

SEQ ID NO: 416570 - DNA, 22 bp, Homo sapiens
taaaatgtagaagaaagcaaaa

SEQ ID NO: 416571 - DNA, 11 bp, Homo sapiens
taaaatgtgaa

SEQ ID NO: 416572 - DNA, 13 bp, Homo sapiens
taaaatgtgaagt

SEQ ID NO: 416573 - DNA, 18 bp, Homo sapiens
taaaatgtgggattatgg

SEQ ID NO: 416574 - DNA, 14 bp, Homo sapiens
taaaattagaaaaa

SEQ ID NO: 416575 - DNA, 15 bp, Homo sapiens
taaaattagaaaaaa

SEQ ID NO: 416576 - DNA, 20 bp, Homo sapiens
taaaattagtgagatttgta

SEQ ID NO: 416577 - DNA, 22 bp, Homo sapiens
taaaattattaaaaattataga

SEQ ID NO: 416578 - DNA, 19 bp, Homo sapiens
taaaattattccctgaatt

SEQ ID NO: 416579 - DNA, 23 bp, Homo sapiens
taaaattattccctgaattgttt

SEQ ID NO: 416580 - DNA, 14 bp, Homo sapiens
taaaattcaacaaa

SEQ ID NO: 416581 - DNA, 13 bp, Homo sapiens
taaaattggcacc

SEQ ID NO: 416582 - DNA, 17 bp, Homo sapiens
taaaattggcaccatgt

SEQ ID NO: 416583 - DNA, 23 bp, Homo sapiens
taaaattgggcttgtgatttcca

SEQ ID NO: 416584 - DNA, 19 bp, Homo sapiens
taaaattgtaaaattgtat

SEQ ID NO: 416585 - DNA, 16 bp, Homo sapiens
taaaattgtatagaga

SEQ ID NO: 416586 - DNA, 15 bp, Homo sapiens
taaaatttaaaaaac

SEQ ID NO: 416587 - DNA, 23 bp, Homo sapiens
taaaattttttgatgtcagcctt

SEQ ID NO: 416588 - DNA, 15 bp, Homo sapiens
taaacaaaaactttc

SEQ ID NO: 416589 - DNA, 17 bp, Homo sapiens
taaacaaaaactttcca

SEQ ID NO: 416590 - DNA, 22 bp, Homo sapiens
taaacaaaaactttccatgaca

SEQ ID NO: 416591 - DNA, 14 bp, Homo sapiens
taagacacacagcc

SEQ ID NO: 416592 - DNA, 15 bp, Homo sapiens
taagacacacagcct

SEQ ID NO: 416593 - DNA, 22 bp, Homo sapiens
taagacactagtagagcaaaga

SEQ ID NO: 416594 - DNA, 20 bp, Homo sapiens
taagacatactccttccatc

SEQ ID NO: 416595 - DNA, 19 bp, Homo sapiens
taagacattcaccaacaac

SEQ ID NO: 416596 - DNA, 23 bp, Homo sapiens
taagaccgtgtcccaaggagctg

SEQ ID NO: 416597 - DNA, 16 bp, Homo sapiens
taagacgacttatata

SEQ ID NO: 416598 - DNA, 23 bp, Homo sapiens
taagacgacttatatatttgaaa

SEQ ID NO: 416599 - DNA, 18 bp, Homo sapiens
taagacttaatctttgct

SEQ ID NO: 416600 - DNA, 19 bp, Homo sapiens
taagacttaatctttgctg

SEQ ID NO: 416601 - DNA, 12 bp, Homo sapiens
taagactttttt

SEQ ID NO: 416602 - DNA, 13 bp, Homo sapiens
taagagaaatggt

SEQ ID NO: 416603 - DNA, 14 bp, Homo sapiens
taagagaaatggta

SEQ ID NO: 416604 - DNA, 15 bp, Homo sapiens
taagagatgggacta

SEQ ID NO: 416605 - DNA, 22 bp, Homo sapiens
taagagcaccttcctcacttcc

SEQ ID NO: 416606 - DNA, 15 bp, Homo sapiens
taagagtcctgaggc

SEQ ID NO: 416607 - DNA, 19 bp, Homo sapiens
taagagtgtcactgagctg

SEQ ID NO: 416608 - DNA, 18 bp, Homo sapiens
taagataatagtttacat

SEQ ID NO: 416609 - DNA, 22 bp, Homo sapiens
taagataattaaatgaaatact

SEQ ID NO: 416610 - DNA, 12 bp, Homo sapiens
taagataattat

SEQ ID NO: 416611 - DNA, 17 bp, Homo sapiens
taagatacactcctgct

SEQ ID NO: 416612 - DNA, 18 bp, Homo sapiens
taagatactcaagcaggt

SEQ ID NO: 416613 - DNA, 18 bp, Homo sapiens
taagatatgtgagaactt

SEQ ID NO: 416614 - DNA, 13 bp, Homo sapiens
taagatattcttt

SEQ ID NO: 416615 - DNA, 14 bp, Homo sapiens
taagatattcttta

SEQ ID NO: 416616 - DNA, 12 bp, Homo sapiens
taagatctgttt

SEQ ID NO: 416617 - DNA, 16 bp, Homo sapiens
taagatgaaattgcca

SEQ ID NO: 416618 - DNA, 17 bp, Homo sapiens
taagatgagatttgcca

SEQ ID NO: 416619 - DNA, 19 bp, Homo sapiens
taagatgagatttgccagc

SEQ ID NO: 416620 - DNA, 18 bp, Homo sapiens
taagatggattctcagat

SEQ ID NO: 416621 - DNA, 21 bp, Homo sapiens
taagatggattctcagatatt

SEQ ID NO: 416622 - DNA, 20 bp, Homo sapiens
taagatgtgtcttcaatttg

SEQ ID NO: 416623 - DNA, 16 bp, Homo sapiens
taagattccattttgg

SEQ ID NO: 416624 - DNA, 12 bp, Homo sapiens
taagattgtaca

SEQ ID NO: 416625 - DNA, 18 bp, Homo sapiens
taagattgtacatatgga

SEQ ID NO: 416626 - DNA, 16 bp, Homo sapiens
taagatttattttgtt

SEQ ID NO: 416627 - DNA, 23 bp, Homo sapiens
taagatttgtgtttttctttttc

SEQ ID NO: 416628 - DNA, 16 bp, Homo sapiens
taagattttacaaaag

SEQ ID NO: 416629 - DNA, 18 bp, Homo sapiens
taagcaaccttaaagcaa

SEQ ID NO: 416630 - DNA, 20 bp, Homo sapiens
taagcaaccttaaagcaata

SEQ ID NO: 416631 - DNA, 22 bp, Homo sapiens
taagcaagtatatttatttcta

SEQ ID NO: 416632 - DNA, 22 bp, Homo sapiens
taagcactacataaactgactt

SEQ ID NO: 416633 - DNA, 13 bp, Homo sapiens
taagcactcttaa

SEQ ID NO: 416634 - DNA, 18 bp, Homo sapiens
taagcactcttaaagcaa

SEQ ID NO: 416635 - DNA, 18 bp, Homo sapiens
taagcactgtgtttatat

SEQ ID NO: 416636 - DNA, 22 bp, Homo sapiens
taagcactttgaaaatatttct

SEQ ID NO: 416637 - DNA, 17 bp, Homo sapiens
taagcagagttctttgc

SEQ ID NO: 416638 - DNA, 21 bp, Homo sapiens
taagcagagttctttgcaagc

SEQ ID NO: 416639 - DNA, 14 bp, Homo sapiens
taagcagcctttct

SEQ ID NO: 416640 - DNA, 16 bp, Homo sapiens
taagcagctaaatttt

SEQ ID NO: 416641 - DNA, 17 bp, Homo sapiens
taagcatgtgtcccagg

SEQ ID NO: 416642 - DNA, 18 bp, Homo sapiens
taagcattgggtgggtaa

SEQ ID NO: 416643 - DNA, 20 bp, Homo sapiens
taagcattgtttgcttattg

SEQ ID NO: 416644 - DNA, 20 bp, Homo sapiens
taagcattttactgtctgta

SEQ ID NO: 416645 - DNA, 10 bp, Homo sapiens
taagccaagg

SEQ ID NO: 416646 - DNA, 17 bp, Homo sapiens
taagccaataaataata

SEQ ID NO: 416647 - DNA, 18 bp, Homo sapiens
taagccctcgaaccaagg

SEQ ID NO: 416648 - DNA, 16 bp, Homo sapiens
taagccctgtcgagac

SEQ ID NO: 416649 - DNA, 14 bp, Homo sapiens
taagcctccattta

SEQ ID NO: 416650 - DNA, 16 bp, Homo sapiens
taagcctccctcctcg

SEQ ID NO: 416651 - DNA, 13 bp, Homo sapiens
taagcctgttgct

SEQ ID NO: 416652 - DNA, 16 bp, Homo sapiens
taagcctttccataag

SEQ ID NO: 416653 - DNA, 21 bp, Homo sapiens
taagcgaagtctttgccttct

SEQ ID NO: 416654 - DNA, 21 bp, Homo sapiens
taagctgggaaaaaagttttg

SEQ ID NO: 416655 - DNA, 17 bp, Homo sapiens
taagctgtgtcctagtt

SEQ ID NO: 416656 - DNA, 15 bp, Homo sapiens
taagcttaaaataag

SEQ ID NO: 416657 - DNA, 19 bp, Homo sapiens
taagcttagattttctgta

SEQ ID NO: 416658 - DNA, 14 bp, Homo sapiens
taagcttatttcta

SEQ ID NO: 416659 - DNA, 14 bp, Homo sapiens
taagctttctcctt

SEQ ID NO: 416660 - DNA, 14 bp, Homo sapiens
taaggaagaaaaat

SEQ ID NO: 416661 - DNA, 14 bp, Homo sapiens
tatttaagttatca

SEQ ID NO: 416662 - DNA, 15 bp, Homo sapiens
tatttaagttatcaa

SEQ ID NO: 416663 - DNA, 14 bp, Homo sapiens
tatttaatatgcat

SEQ ID NO: 416664 - DNA, 19 bp, Homo sapiens
tatttaatgataagtaaat

SEQ ID NO: 416665 - DNA, 20 bp, Homo sapiens
tatttaatttcataaattgg

SEQ ID NO: 416666 - DNA, 14 bp, Homo sapiens
tatttactgagctt

SEQ ID NO: 416667 - DNA, 16 bp, Homo sapiens
tatttactgagcttct

SEQ ID NO: 416668 - DNA, 19 bp, Homo sapiens
tatttactgagcttctctg

SEQ ID NO: 416669 - DNA, 21 bp, Homo sapiens
tatttactgagcttctctgtg

SEQ ID NO: 416670 - DNA, 14 bp, Homo sapiens
tatttactgtacta

SEQ ID NO: 416671 - DNA, 15 bp, Homo sapiens
tatttagttatagtt

SEQ ID NO: 416672 - DNA, 23 bp, Homo sapiens
tatttagttgattttaattactt

SEQ ID NO: 416673 - DNA, 17 bp, Homo sapiens
tatttataaatatattt

SEQ ID NO: 416674 - DNA, 19 bp, Homo sapiens
tatttataacaacctaaat

SEQ ID NO: 416675 - DNA, 14 bp, Homo sapiens
tatttataacagca

SEQ ID NO: 416676 - DNA, 17 bp, Homo sapiens
tatttataacattgtaa

SEQ ID NO: 416677 - DNA, 17 bp, Homo sapiens
tatttatataattatgt

SEQ ID NO: 416678 - DNA, 23 bp, Homo sapiens
tatttatatatgtatttataaat

SEQ ID NO: 416679 - DNA, 13 bp, Homo sapiens
tatttatatattt

SEQ ID NO: 416680 - DNA, 18 bp, Homo sapiens
tatttatattcatcaaat

SEQ ID NO: 416681 - DNA, 21 bp, Homo sapiens
tatttatatttttattttatt

SEQ ID NO: 416682 - DNA, 13 bp, Homo sapiens
tatttatcagtga

SEQ ID NO: 416683 - DNA, 14 bp, Homo sapiens
tatttatctgtctg

SEQ ID NO: 416684 - DNA, 14 bp, Homo sapiens
tatttatgtgtgag

SEQ ID NO: 416685 - DNA, 20 bp, Homo sapiens
tatttattaaacttcagcaa

SEQ ID NO: 416686 - DNA, 23 bp, Homo sapiens
tatttatttctagcaaacagatg

SEQ ID NO: 416687 - DNA, 13 bp, Homo sapiens
tatttattttcag

SEQ ID NO: 416688 - DNA, 18 bp, Homo sapiens
tatttattttcctcccca

SEQ ID NO: 416689 - DNA, 18 bp, Homo sapiens
tatttcaagggttgcttc

SEQ ID NO: 416690 - DNA, 22 bp, Homo sapiens
tatttcacttaaactttgtcac

SEQ ID NO: 416691 - DNA, 20 bp, Homo sapiens
tatttcagtgccatacatgt

SEQ ID NO: 416692 - DNA, 14 bp, Homo sapiens
tatttcattcatat

SEQ ID NO: 416693 - DNA, 20 bp, Homo sapiens
tatttccacaatagggttca

SEQ ID NO: 416694 - DNA, 12 bp, Homo sapiens
tatttcctttgc

SEQ ID NO: 416695 - DNA, 17 bp, Homo sapiens
tatttcggaaatacact

SEQ ID NO: 416696 - DNA, 20 bp, Homo sapiens
tatttcggaaatacactaca

SEQ ID NO: 416697 - DNA, 14 bp, Homo sapiens
tatttctaagctta

SEQ ID NO: 416698 - DNA, 22 bp, Homo sapiens
tatttctaagcttatttctaac

SEQ ID NO: 416699 - DNA, 14 bp, Homo sapiens
tatttctaagtatt

SEQ ID NO: 416700 - DNA, 16 bp, Homo sapiens
tatttctaagtattta

SEQ ID NO: 416701 - DNA, 23 bp, Homo sapiens
tatttctaagtatttaaatgttc

SEQ ID NO: 416702 - DNA, 13 bp, Homo sapiens
tatttctatctgc

SEQ ID NO: 416703 - DNA, 17 bp, Homo sapiens
tatttctatgtaaatta

SEQ ID NO: 416704 - DNA, 22 bp, Homo sapiens
tatttctatgtaaattattgta

SEQ ID NO: 416705 - DNA, 21 bp, Homo sapiens
tatttctcaacaaagcacagt

SEQ ID NO: 416706 - DNA, 13 bp, Homo sapiens
tatttctgatcta

SEQ ID NO: 416707 - DNA, 19 bp, Homo sapiens
tatttctgtggaaaacaat

SEQ ID NO: 416708 - DNA, 17 bp, Homo sapiens
tatttcttcaagtgagt

SEQ ID NO: 416709 - DNA, 14 bp, Homo sapiens
tatttcttgctttc

SEQ ID NO: 416710 - DNA, 13 bp, Homo sapiens
tatttcttgtttg

SEQ ID NO: 416711 - DNA, 14 bp, Homo sapiens
tatttcttgtttgt

SEQ ID NO: 416712 - DNA, 14 bp, Homo sapiens
tatttctttgttat

SEQ ID NO: 416713 - DNA, 16 bp, Homo sapiens
tatttgactaaagcat

SEQ ID NO: 416714 - DNA, 15 bp, Homo sapiens
tatttgactgcttca

SEQ ID NO: 416715 - DNA, 16 bp, Homo sapiens
tatttgagactagttt

SEQ ID NO: 416716 - DNA, 16 bp, Homo sapiens
tatttgagagttctaa

SEQ ID NO: 416717 - DNA, 19 bp, Homo sapiens
tatttgagagttctaaatt

SEQ ID NO: 416718 - DNA, 12 bp, Homo sapiens
tatttgctgttt

SEQ ID NO: 416719 - DNA, 14 bp, Homo sapiens
tatttgcttattta

SEQ ID NO: 416720 - DNA, 15 bp, Homo sapiens
tatttgcttatttat

SEQ ID NO: 416721 - DNA, 16 bp, Homo sapiens
tatttgcttatttata

SEQ ID NO: 416722 - DNA, 19 bp, Homo sapiens
tatttgtacagttcagttc

SEQ ID NO: 416723 - DNA, 23 bp, Homo sapiens
tatttgtcggggaagatgaaacc

SEQ ID NO: 416724 - DNA, 13 bp, Homo sapiens
tatttgtgtaata

SEQ ID NO: 416725 - DNA, 14 bp, Homo sapiens
tatttgtgttcagt

SEQ ID NO: 416726 - DNA, 14 bp, Homo sapiens
tatttgttattttc

SEQ ID NO: 416727 - DNA, 18 bp, Homo sapiens
tatttgttattttcagta

SEQ ID NO: 416728 - DNA, 14 bp, Homo sapiens
tatttgttttcatg

SEQ ID NO: 416729 - DNA, 14 bp, Homo sapiens
tattttaaacaaaa

SEQ ID NO: 416730 - DNA, 20 bp, Homo sapiens
tattttaaattataaggact

SEQ ID NO: 416731 - DNA, 19 bp, Homo sapiens
tattttaagcactcttaaa

SEQ ID NO: 416732 - DNA, 13 bp, Homo sapiens
tattttaatacct

SEQ ID NO: 416733 - DNA, 23 bp, Homo sapiens
tattttaatacctttaaatatca

SEQ ID NO: 416734 - DNA, 19 bp, Homo sapiens
tattttaatttatgagttt

SEQ ID NO: 416735 - DNA, 21 bp, Homo sapiens
tattttacttggaaatattaa

SEQ ID NO: 416736 - DNA, 13 bp, Homo sapiens
tattttagattac

SEQ ID NO: 416737 - DNA, 20 bp, Homo sapiens
tattttagcagttctgcaaa

SEQ ID NO: 416738 - DNA, 17 bp, Homo sapiens
tattttaggagacagtc

SEQ ID NO: 416739 - DNA, 15 bp, Homo sapiens
tattttatataataa

SEQ ID NO: 416740 - DNA, 13 bp, Homo sapiens
tattttattattc

SEQ ID NO: 416741 - DNA, 20 bp, Homo sapiens
tattttatttccatcatgtc

SEQ ID NO: 416742 - DNA, 22 bp, Homo sapiens
tattttcaaattgtatctagtg

SEQ ID NO: 416743 - DNA, 15 bp, Homo sapiens
tattttcctccccag

SEQ ID NO: 416744 - DNA, 14 bp, Homo sapiens
tattttcctttaga

SEQ ID NO: 416745 - DNA, 17 bp, Homo sapiens
tattttcgtgcatttgt

SEQ ID NO: 416746 - DNA, 19 bp, Homo sapiens
tattttcgtgcatttgtga

SEQ ID NO: 416747 - DNA, 13 bp, Homo sapiens
tattttctatatt

SEQ ID NO: 416748 - DNA, 12 bp, Homo sapiens
tattttctgaat

SEQ ID NO: 416749 - DNA, 13 bp, Homo sapiens
tattttctgaatt

SEQ ID NO: 416750 - DNA, 14 bp, Homo sapiens
tattttctgaattc

SEQ ID NO: 416751 - DNA, 22 bp, Homo sapiens
tattttctgaattcataaaaat

SEQ ID NO: 416752 - DNA, 13 bp, Homo sapiens
tattttctgtcac

SEQ ID NO: 416753 - DNA, 18 bp, Homo sapiens
tattttcttcccatttgt

SEQ ID NO: 416754 - DNA, 20 bp, Homo sapiens
tattttgaaaacacttattt

SEQ ID NO: 416755 - DNA, 16 bp, Homo sapiens
tattttgaatgtcaca

SEQ ID NO: 416756 - DNA, 18 bp, Homo sapiens
tattttgactgtgattta

SEQ ID NO: 416757 - DNA, 18 bp, Homo sapiens
tattttggaaagaagaaa

SEQ ID NO: 416758 - DNA, 12 bp, Homo sapiens
tattttggaatt

SEQ ID NO: 416759 - DNA, 16 bp, Homo sapiens
tattttggagaaatta

SEQ ID NO: 416760 - DNA, 22 bp, Homo sapiens
tattttgggaggccgaggagag

SEQ ID NO: 416761 - DNA, 19 bp, Homo sapiens
tattttggggaactgttgt

SEQ ID NO: 416762 - DNA, 19 bp, Homo sapiens
tattttgtgatgatgctgt

SEQ ID NO: 416763 - DNA, 12 bp, Homo sapiens
tatttttagaga

SEQ ID NO: 416764 - DNA, 21 bp, Homo sapiens
tatttttcagagatttatata

SEQ ID NO: 416765 - DNA, 13 bp, Homo sapiens
tatttttcatatt

SEQ ID NO: 416766 - DNA, 15 bp, Homo sapiens
tatttttcatattgt

SEQ ID NO: 416767 - DNA, 19 bp, Homo sapiens
tatttttcatattgtgcca

SEQ ID NO: 416768 - DNA, 22 bp, Homo sapiens
tatttttcttgttgcatctttt

SEQ ID NO: 416769 - DNA, 20 bp, Homo sapiens
tatttttgtaattttaaata

SEQ ID NO: 416770 - DNA, 15 bp, Homo sapiens
tatttttgtgtttct

SEQ ID NO: 416771 - DNA, 16 bp, Homo sapiens
tatttttgtgtttcta

SEQ ID NO: 416772 - DNA, 17 bp, Homo sapiens
tatttttgttaatcatc

SEQ ID NO: 416773 - DNA, 18 bp, Homo sapiens
tcatataagattcatatt

SEQ ID NO: 416774 - DNA, 15 bp, Homo sapiens
tcatataataaatgt

SEQ ID NO: 416775 - DNA, 16 bp, Homo sapiens
tcatataataaatgta

SEQ ID NO: 416776 - DNA, 15 bp, Homo sapiens
tcatatattataaga

SEQ ID NO: 416777 - DNA, 12 bp, Homo sapiens
tcatatcaactt

SEQ ID NO: 416778 - DNA, 16 bp, Homo sapiens
tcatatcaagaaattg

SEQ ID NO: 416779 - DNA, 18 bp, Homo sapiens
tcatatgaattagccaaa

SEQ ID NO: 416780 - DNA, 22 bp, Homo sapiens
tcatatgtaccatgtacatgaa

SEQ ID NO: 416781 - DNA, 22 bp, Homo sapiens
tcatatgtatctaaatgaaaag

SEQ ID NO: 416782 - DNA, 13 bp, Homo sapiens
tcatatgtgaaga

SEQ ID NO: 416783 - DNA, 13 bp, Homo sapiens
tcatatgttgctc

SEQ ID NO: 416784 - DNA, 23 bp, Homo sapiens
tcatattcctgcctttcttccat

SEQ ID NO: 416785 - DNA, 13 bp, Homo sapiens
tcatattctcaga

SEQ ID NO: 416786 - DNA, 18 bp, Homo sapiens
tcatattgatgaaaagat

SEQ ID NO: 416787 - DNA, 19 bp, Homo sapiens
tcatattgatgaaaagatt

SEQ ID NO: 416788 - DNA, 14 bp, Homo sapiens
tcatattgtgccaa

SEQ ID NO: 416789 - DNA, 15 bp, Homo sapiens
tcatattgtgccaat

SEQ ID NO: 416790 - DNA, 20 bp, Homo sapiens
tcatattgtgccaatatgta

SEQ ID NO: 416791 - DNA, 20 bp, Homo sapiens
tcatatttgcaataaaaaag

SEQ ID NO: 416792 - DNA, 14 bp, Homo sapiens
tcatatttttacaa

SEQ ID NO: 416793 - DNA, 22 bp, Homo sapiens
tcatcaaaaagagtcttaattt

SEQ ID NO: 416794 - DNA, 21 bp, Homo sapiens
tcatcaatttaaaatcattca

SEQ ID NO: 416795 - DNA, 17 bp, Homo sapiens
tcatcacttttcagtga

SEQ ID NO: 416796 - DNA, 14 bp, Homo sapiens
tcatcagaactgaa

SEQ ID NO: 416797 - DNA, 13 bp, Homo sapiens
tcatcagcccagg

SEQ ID NO: 416798 - DNA, 21 bp, Homo sapiens
tcatcagcccaggtcccagtg

SEQ ID NO: 416799 - DNA, 11 bp, Homo sapiens
tcatcaggatg

SEQ ID NO: 416800 - DNA, 13 bp, Homo sapiens
tcatcaggatgaa

SEQ ID NO: 416801 - DNA, 22 bp, Homo sapiens
tcatcaggccgggtgcagtggc

SEQ ID NO: 416802 - DNA, 15 bp, Homo sapiens
tcatcaggcttggaa

SEQ ID NO: 416803 - DNA, 18 bp, Homo sapiens
tcatcaggcttggaatga

SEQ ID NO: 416804 - DNA, 14 bp, Homo sapiens
tcatcagtaagtat

SEQ ID NO: 416805 - DNA, 17 bp, Homo sapiens
tcatcagtattgtgtaa

SEQ ID NO: 416806 - DNA, 16 bp, Homo sapiens
tcatcagtgttaaaaa

SEQ ID NO: 416807 - DNA, 19 bp, Homo sapiens
tcatcagtgttaaaaaatt

SEQ ID NO: 416808 - DNA, 14 bp, Homo sapiens
tcatcataaaaggt

SEQ ID NO: 416809 - DNA, 13 bp, Homo sapiens
tcatcataaaata

SEQ ID NO: 416810 - DNA, 14 bp, Homo sapiens
tcatcataaaataa

SEQ ID NO: 416811 - DNA, 23 bp, Homo sapiens
tcatcatagaaggagagcccagg

SEQ ID NO: 416812 - DNA, 20 bp, Homo sapiens
tcatcattgtatatatgtgt

SEQ ID NO: 416813 - DNA, 23 bp, Homo sapiens
tcatccacacaacaccaggactt

SEQ ID NO: 416814 - DNA, 16 bp, Homo sapiens
tcatccacagaggcca

SEQ ID NO: 416815 - DNA, 19 bp, Homo sapiens
tcatccatagacacagtat

SEQ ID NO: 416816 - DNA, 15 bp, Homo sapiens
tcatccatatttctt

SEQ ID NO: 416817 - DNA, 12 bp, Homo sapiens
tcatcccactcc

SEQ ID NO: 416818 - DNA, 18 bp, Homo sapiens
tcatcccagcacctgcca

SEQ ID NO: 416819 - DNA, 18 bp, Homo sapiens
tcatcccggggccatgga

SEQ ID NO: 416820 - DNA, 11 bp, Homo sapiens
tcatcctcagc

SEQ ID NO: 416821 - DNA, 12 bp, Homo sapiens
tcatcctcagca

SEQ ID NO: 416822 - DNA, 13 bp, Homo sapiens
tcatcctcagcaa

SEQ ID NO: 416823 - DNA, 14 bp, Homo sapiens
tcatcctcagcaag

SEQ ID NO: 416824 - DNA, 15 bp, Homo sapiens
tcatcctgcttctct

SEQ ID NO: 416825 - DNA, 21 bp, Homo sapiens
tcatcctgcttctcttttcct

SEQ ID NO: 416826 - DNA, 12 bp, Homo sapiens
tcatcctggcct

SEQ ID NO: 416827 - DNA, 11 bp, Homo sapiens
tcatcctgtgt

SEQ ID NO: 416828 - DNA, 13 bp, Homo sapiens
tcatctacttttt

SEQ ID NO: 416829 - DNA, 21 bp, Homo sapiens
tcatctagttaagtcgctgaa

SEQ ID NO: 416830 - DNA, 15 bp, Homo sapiens
tcatctattctagca

SEQ ID NO: 416831 - DNA, 16 bp, Homo sapiens
tcatctcattcaaacc

SEQ ID NO: 416832 - DNA, 21 bp, Homo sapiens
tcatctccaaggatcctctcc

SEQ ID NO: 416833 - DNA, 23 bp, Homo sapiens
tcatctccagggagtcccctccc

SEQ ID NO: 416834 - DNA, 20 bp, Homo sapiens
tcatctccagtatcctgctg

SEQ ID NO: 416835 - DNA, 13 bp, Homo sapiens
tcatctccatcag

SEQ ID NO: 416836 - DNA, 16 bp, Homo sapiens
tcatctccatcagctg

SEQ ID NO: 416837 - DNA, 17 bp, Homo sapiens
tcatctccatcagctgt

SEQ ID NO: 416838 - DNA, 20 bp, Homo sapiens
tcatctccatcatatgcctg

SEQ ID NO: 416839 - DNA, 15 bp, Homo sapiens
taaggaagaataaaa

SEQ ID NO: 416840 - DNA, 15 bp, Homo sapiens
taaggaagagggctg

SEQ ID NO: 416841 - DNA, 20 bp, Homo sapiens
taaggaagatcactttgctc

SEQ ID NO: 416842 - DNA, 23 bp, Homo sapiens
taaggaattgacttcagcagggg

SEQ ID NO: 416843 - DNA, 14 bp, Homo sapiens
taaggacacactaa

SEQ ID NO: 416844 - DNA, 12 bp, Homo sapiens
taaggactgcat

SEQ ID NO: 416845 - DNA, 14 bp, Homo sapiens
taaggactgcatgg

SEQ ID NO: 416846 - DNA, 21 bp, Homo sapiens
taaggactgcatggtaattta

SEQ ID NO: 416847 - DNA, 16 bp, Homo sapiens
taaggagactgaggct

SEQ ID NO: 416848 - DNA, 12 bp, Homo sapiens
taaggaggagaa

SEQ ID NO: 416849 - DNA, 17 bp, Homo sapiens
taaggatactttacatg

SEQ ID NO: 416850 - DNA, 23 bp, Homo sapiens
taaggcatgctcccagcatttgt

SEQ ID NO: 416851 - DNA, 15 bp, Homo sapiens
taaggccaaggcctc

SEQ ID NO: 416852 - DNA, 19 bp, Homo sapiens
taaggccaaggcctcagga

SEQ ID NO: 416853 - DNA, 13 bp, Homo sapiens
taaggctcctcct

SEQ ID NO: 416854 - DNA, 13 bp, Homo sapiens
taaggctgactct

SEQ ID NO: 416855 - DNA, 19 bp, Homo sapiens
taagggacttaacttgttt

SEQ ID NO: 416856 - DNA, 23 bp, Homo sapiens
taagggagtaggctgtattttct

SEQ ID NO: 416857 - DNA, 22 bp, Homo sapiens
taagggagtggcctcatttcac

SEQ ID NO: 416858 - DNA, 22 bp, Homo sapiens
taagggcatgttgggataaata

SEQ ID NO: 416859 - DNA, 22 bp, Homo sapiens
taaggggaattaacaattgcca

SEQ ID NO: 416860 - DNA, 17 bp, Homo sapiens
taagggggccttggaat

SEQ ID NO: 416861 - DNA, 20 bp, Homo sapiens
taagggttagtttacaatca

SEQ ID NO: 416862 - DNA, 21 bp, Homo sapiens
taaggtatctggtatctgcat

SEQ ID NO: 416863 - DNA, 20 bp, Homo sapiens
taaggtgggtacgggagggt

SEQ ID NO: 416864 - DNA, 16 bp, Homo sapiens
taaggtgggtccagga

SEQ ID NO: 416865 - DNA, 22 bp, Homo sapiens
taaggtgggtccaggaaggcag

SEQ ID NO: 416866 - DNA, 13 bp, Homo sapiens
taagtaaactgcc

SEQ ID NO: 416867 - DNA, 16 bp, Homo sapiens
taagtaattcaagaaa

SEQ ID NO: 416868 - DNA, 12 bp, Homo sapiens
taagtacaaaaa

SEQ ID NO: 416869 - DNA, 15 bp, Homo sapiens
taagtataacaaact

SEQ ID NO: 416870 - DNA, 18 bp, Homo sapiens
taagtataacaaactatg

SEQ ID NO: 416871 - DNA, 21 bp, Homo sapiens
taagtattccttggcccagca

SEQ ID NO: 416872 - DNA, 23 bp, Homo sapiens
taagtattccttggcccagcagc

SEQ ID NO: 416873 - DNA, 16 bp, Homo sapiens
taagtatttaaatgtt

SEQ ID NO: 416874 - DNA, 17 bp, Homo sapiens
taagtatttatatattt

SEQ ID NO: 416875 - DNA, 18 bp, Homo sapiens
taagtatttatatattta

SEQ ID NO: 416876 - DNA, 20 bp, Homo sapiens
taagtatttcagatgcttta

SEQ ID NO: 416877 - DNA, 17 bp, Homo sapiens
taagtcagtttcacata

SEQ ID NO: 416878 - DNA, 12 bp, Homo sapiens
taagtccagctc

SEQ ID NO: 416879 - DNA, 18 bp, Homo sapiens
taagtccctgccccctcc

SEQ ID NO: 416880 - DNA, 23 bp, Homo sapiens
taagtccctgccccctccccttc

SEQ ID NO: 416881 - DNA, 22 bp, Homo sapiens
taagtcgggaaattctgctgct

SEQ ID NO: 416882 - DNA, 23 bp, Homo sapiens
taagtcgggaaattctgctgctt

SEQ ID NO: 416883 - DNA, 16 bp, Homo sapiens
taagtctccaagaata

SEQ ID NO: 416884 - DNA, 22 bp, Homo sapiens
taagtctccaagaatacagaaa

SEQ ID NO: 416885 - DNA, 11 bp, Homo sapiens
taagtcttact

SEQ ID NO: 416886 - DNA, 15 bp, Homo sapiens
taagtgaaaatctta

SEQ ID NO: 416887 - DNA, 20 bp, Homo sapiens
taagtgaatctaataaaatg

SEQ ID NO: 416888 - DNA, 23 bp, Homo sapiens
taagtgacatagataagaacttt

SEQ ID NO: 416889 - DNA, 23 bp, Homo sapiens
taagtgaggatgaaaaaataaca

SEQ ID NO: 416890 - DNA, 14 bp, Homo sapiens
taagtgcccaaagt

SEQ ID NO: 416891 - DNA, 17 bp, Homo sapiens
taagtgcttttaaactg

SEQ ID NO: 416892 - DNA, 19 bp, Homo sapiens
taagtggcctgcaggggcc

SEQ ID NO: 416893 - DNA, 20 bp, Homo sapiens
taagtggctgtgattaatta

SEQ ID NO: 416894 - DNA, 24 bp, Homo sapiens
taagtggctgtgattaattattga

SEQ ID NO: 416895 - DNA, 13 bp, Homo sapiens
taagtgtaaaaaa

SEQ ID NO: 416896 - DNA, 15 bp, Homo sapiens
taagtgtactaatta

SEQ ID NO: 416897 - DNA, 15 bp, Homo sapiens
taagtgtcatttctt

SEQ ID NO: 416898 - DNA, 22 bp, Homo sapiens
taagtgtccattatttaccttg

SEQ ID NO: 416899 - DNA, 21 bp, Homo sapiens
taagtgtgagtaagagctggt

SEQ ID NO: 416900 - DNA, 22 bp, Homo sapiens
taagtgttgactttttaaaata

SEQ ID NO: 416901 - DNA, 11 bp, Homo sapiens
taagtgtttcg

SEQ ID NO: 416902 - DNA, 17 bp, Homo sapiens
taagttatttcttgttt

SEQ ID NO: 416903 - DNA, 20 bp, Homo sapiens
taagttatttcttgtttgtt

SEQ ID NO: 416904 - DNA, 13 bp, Homo sapiens
taagttcattaaa

SEQ ID NO: 416905 - DNA, 14 bp, Homo sapiens
taagttcattaaac

SEQ ID NO: 416906 - DNA, 18 bp, Homo sapiens
taagttgacctttattta

SEQ ID NO: 416907 - DNA, 23 bp, Homo sapiens
taagttgacctttatttattaaa

SEQ ID NO: 416908 - DNA, 15 bp, Homo sapiens
taagttgattctgtc

SEQ ID NO: 416909 - DNA, 21 bp, Homo sapiens
taagttgctgtaagcacctgg

SEQ ID NO: 416910 - DNA, 15 bp, Homo sapiens
taagtttagaaatta

SEQ ID NO: 416911 - DNA, 15 bp, Homo sapiens
taaccatccccaact

SEQ ID NO: 416912 - DNA, 16 bp, Homo sapiens
taaccatccccaactc

SEQ ID NO: 416913 - DNA, 19 bp, Homo sapiens
taaccattggttaatctgg

SEQ ID NO: 416914 - DNA, 15 bp, Homo sapiens
taaccccaaaatgaa

SEQ ID NO: 416915 - DNA, 13 bp, Homo sapiens
taaccccagcctg

SEQ ID NO: 416916 - DNA, 14 bp, Homo sapiens
taacccctgcctgg

SEQ ID NO: 416917 - DNA, 15 bp, Homo sapiens
taacccctgcctgga

SEQ ID NO: 416918 - DNA, 18 bp, Homo sapiens
taacccctgcctggattt

SEQ ID NO: 416919 - DNA, 17 bp, Homo sapiens
taacccttgaatttcta

SEQ ID NO: 416920 - DNA, 13 bp, Homo sapiens
taacctacctgtg

SEQ ID NO: 416921 - DNA, 15 bp, Homo sapiens
taacctacctgtgaa

SEQ ID NO: 416922 - DNA, 18 bp, Homo sapiens
taacctacgaccccagag

SEQ ID NO: 416923 - DNA, 15 bp, Homo sapiens
taacctactagacaa

SEQ ID NO: 416924 - DNA, 16 bp, Homo sapiens
taacctactagacaat

SEQ ID NO: 416925 - DNA, 19 bp, Homo sapiens
taacctggtgctggatatt

SEQ ID NO: 416926 - DNA, 16 bp, Homo sapiens
taacctttttgtaaat

SEQ ID NO: 416927 - DNA, 13 bp, Homo sapiens
taacggctccagg

SEQ ID NO: 416928 - DNA, 18 bp, Homo sapiens
taacggctccaggatttt

SEQ ID NO: 416929 - DNA, 23 bp, Homo sapiens
taactaatatgggcattgtagtt

SEQ ID NO: 416930 - DNA, 22 bp, Homo sapiens
taactacctttggcttaattcc

SEQ ID NO: 416931 - DNA, 15 bp, Homo sapiens
taactactagttttt

SEQ ID NO: 416932 - DNA, 18 bp, Homo sapiens
taactactgcaaaaagta

SEQ ID NO: 416933 - DNA, 20 bp, Homo sapiens
taactactgcaaaaagtaca

SEQ ID NO: 416934 - DNA, 17 bp, Homo sapiens
taactactgtgttcctg

SEQ ID NO: 416935 - DNA, 16 bp, Homo sapiens
taactagatggtgctg

SEQ ID NO: 416936 - DNA, 18 bp, Homo sapiens
taactagatggtgctgag

SEQ ID NO: 416937 - DNA, 18 bp, Homo sapiens
tagaatactttttaaaag

SEQ ID NO: 416938 - DNA, 12 bp, Homo sapiens
tagaatagcatg

SEQ ID NO: 416939 - DNA, 17 bp, Homo sapiens
tagaatagcatgttgta

SEQ ID NO: 416940 - DNA, 15 bp, Homo sapiens
tagaatataaacaca

SEQ ID NO: 416941 - DNA, 17 bp, Homo sapiens
tagaatatcctatactg

SEQ ID NO: 416942 - DNA, 22 bp, Homo sapiens
tagaatatcctatactggttat

SEQ ID NO: 416943 - DNA, 12 bp, Homo sapiens
tagaatatttat

SEQ ID NO: 416944 - DNA, 15 bp, Homo sapiens
tagaatatttattac

SEQ ID NO: 416945 - DNA, 15 bp, Homo sapiens
tagaatcaagtctgt

SEQ ID NO: 416946 - DNA, 21 bp, Homo sapiens
tagaatgagggaaacaaaata

SEQ ID NO: 416947 - DNA, 19 bp, Homo sapiens
tagaatgcatgtaaggtct

SEQ ID NO: 416948 - DNA, 19 bp, Homo sapiens
tagaatggaaaactgcctg

SEQ ID NO: 416949 - DNA, 23 bp, Homo sapiens
tagaattagtggcacttgctttt

SEQ ID NO: 416950 - DNA, 22 bp, Homo sapiens
tagaatttattcaattcctctg

SEQ ID NO: 416951 - DNA, 17 bp, Homo sapiens
tagaatttgaaaggaaa

SEQ ID NO: 416952 - DNA, 16 bp, Homo sapiens
tagaattttaagtgct

SEQ ID NO: 416953 - DNA, 18 bp, Homo sapiens
tagaatttttaatgtttt

SEQ ID NO: 416954 - DNA, 14 bp, Homo sapiens
tagacaaataacta

SEQ ID NO: 416955 - DNA, 15 bp, Homo sapiens
tagacaaccctgcaa

SEQ ID NO: 416956 - DNA, 18 bp, Homo sapiens
tagacaaggttgctgttg

SEQ ID NO: 416957 - DNA, 21 bp, Homo sapiens
tagacaatgtggaattacata

SEQ ID NO: 416958 - DNA, 22 bp, Homo sapiens
tagacaatgtggaattacataa

SEQ ID NO: 416959 - DNA, 23 bp, Homo sapiens
tagacaatgtggaattacataac

SEQ ID NO: 416960 - DNA, 16 bp, Homo sapiens
tagacaatttgcctta

SEQ ID NO: 416961 - DNA, 22 bp, Homo sapiens
tagacagtatgagtcaatgtgc

SEQ ID NO: 416962 - DNA, 22 bp, Homo sapiens
tagacagtattgccacctctgg

SEQ ID NO: 416963 - DNA, 14 bp, Homo sapiens
tagacattatcttt

SEQ ID NO: 416964 - DNA, 14 bp, Homo sapiens
tagacccctggctg

SEQ ID NO: 416965 - DNA, 15 bp, Homo sapiens
tagacccctggctgg

SEQ ID NO: 416966 - DNA, 15 bp, Homo sapiens
tagacccgccaggtc

SEQ ID NO: 416967 - DNA, 16 bp, Homo sapiens
tagacccgccaggtca

SEQ ID NO: 416968 - DNA, 19 bp, Homo sapiens
tagacctagggaggacctt

SEQ ID NO: 416969 - DNA, 22 bp, Homo sapiens
tagacctagggaggaccttatc

SEQ ID NO: 416970 - DNA, 17 bp, Homo sapiens
tagacctgagatgctgg

SEQ ID NO: 416971 - DNA, 20 bp, Homo sapiens
tagacgcccctcccaagcgt

SEQ ID NO: 416972 - DNA, 18 bp, Homo sapiens
tagactccttctccccaa

SEQ ID NO: 416973 - DNA, 12 bp, Homo sapiens
tagactcttcac

SEQ ID NO: 416974 - DNA, 16 bp, Homo sapiens
tagactcttcactgtt

SEQ ID NO: 416975 - DNA, 13 bp, Homo sapiens
tagactgaattta

SEQ ID NO: 416976 - DNA, 16 bp, Homo sapiens
tagactgaatttaact

SEQ ID NO: 416977 - DNA, 22 bp, Homo sapiens
tagactggagtgaggcttccag

SEQ ID NO: 416978 - DNA, 17 bp, Homo sapiens
tagacttactttcctat

SEQ ID NO: 416979 - DNA, 20 bp, Homo sapiens
tagacttatatgcaggctgt

SEQ ID NO: 416980 - DNA, 14 bp, Homo sapiens
tagacttccccatc

SEQ ID NO: 416981 - DNA, 14 bp, Homo sapiens
tagacttcgaaaac

SEQ ID NO: 416982 - DNA, 14 bp, Homo sapiens
tagacttctggttg

SEQ ID NO: 416983 - DNA, 20 bp, Homo sapiens
tagacttgaaagttttccag

SEQ ID NO: 416984 - DNA, 18 bp, Homo sapiens
tagacttggagctgtcct

SEQ ID NO: 416985 - DNA, 12 bp, Homo sapiens
tagagaacaaag

SEQ ID NO: 416986 - DNA, 13 bp, Homo sapiens
tagagacagggac

SEQ ID NO: 416987 - DNA, 18 bp, Homo sapiens
tagagacgcaccttgctg

SEQ ID NO: 416988 - DNA, 10 bp, Homo sapiens
tagagaggac

SEQ ID NO: 416989 - DNA, 23 bp, Homo sapiens
tagagaggcgttagtgggcaggt

SEQ ID NO: 416990 - DNA, 17 bp, Homo sapiens
tagagaggggactgggg

SEQ ID NO: 416991 - DNA, 19 bp, Homo sapiens
tagagaggggactggggga

SEQ ID NO: 416992 - DNA, 21 bp, Homo sapiens
tagagaggggcctctggctgc

SEQ ID NO: 416993 - DNA, 20 bp, Homo sapiens
tagagaggtagcgagctgct

SEQ ID NO: 416994 - DNA, 19 bp, Homo sapiens
tagagatatgcagaaggaa

SEQ ID NO: 416995 - DNA, 22 bp, Homo sapiens
tagagatatttaaaagacaaac

SEQ ID NO: 416996 - DNA, 13 bp, Homo sapiens
tagagatgagctt

SEQ ID NO: 416997 - DNA, 13 bp, Homo sapiens
tagagatgcctcc

SEQ ID NO: 416998 - DNA, 19 bp, Homo sapiens
tagagatgctactgtcagt

SEQ ID NO: 416999 - DNA, 19 bp, Homo sapiens
tagagatggggaaagaatt

SEQ ID NO: 417000 - DNA, 14 bp, Homo sapiens
tagagattaatttg

SEQ ID NO: 417001 - DNA, 15 bp, Homo sapiens
tagagattaatttgt

SEQ ID NO: 417002 - DNA, 20 bp, Homo sapiens
tagagattaatttgtgtaga

SEQ ID NO: 417003 - DNA, 19 bp, Homo sapiens
tagagattcccctggacca

SEQ ID NO: 417004 - DNA, 14 bp, Homo sapiens
tagagattcttagc

SEQ ID NO: 417005 - DNA, 14 bp, Homo sapiens
tagagcaaaattga

SEQ ID NO: 417006 - DNA, 22 bp, Homo sapiens
tagagcaaaattgatgtgttta

SEQ ID NO: 417007 - DNA, 20 bp, Homo sapiens
tagagcagattctagcacat

SEQ ID NO: 417008 - DNA, 17 bp, Homo sapiens
tagagcattctggggtg

SEQ ID NO: 417009 - DNA, 20 bp, Homo sapiens
tagagcattctggggtgggg

SEQ ID NO: 417010 - DNA, 14 bp, Homo sapiens
tagagccagccttg

SEQ ID NO: 417011 - DNA, 18 bp, Homo sapiens
tagagccagccttggttg

SEQ ID NO: 417012 - DNA, 22 bp, Homo sapiens
tagagccttctgatgtctctaa

SEQ ID NO: 417013 - DNA, 16 bp, Homo sapiens
tagagctagtctttca

SEQ ID NO: 417014 - DNA, 14 bp, Homo sapiens
tagagctgatccag

SEQ ID NO: 417015 - DNA, 19 bp, Homo sapiens
tagagctgatccagagcac

SEQ ID NO: 417016 - DNA, 16 bp, Homo sapiens
tagagctgggtggcct

SEQ ID NO: 417017 - DNA, 20 bp, Homo sapiens
tagaggccagccccacccag

SEQ ID NO: 417018 - DNA, 20 bp, Homo sapiens
tagagggaggtgtttaaaga

SEQ ID NO: 417019 - DNA, 18 bp, Homo sapiens
tagaggtgggcagctggg

SEQ ID NO: 417020 - DNA, 18 bp, Homo sapiens
tagagtacttaatatact

SEQ ID NO: 417021 - DNA, 21 bp, Homo sapiens
tagagtagaagatttgatgct

SEQ ID NO: 417022 - DNA, 18 bp, Homo sapiens
tagagtcacagctttccc

SEQ ID NO: 417023 - DNA, 21 bp, Homo sapiens
tagagtcatctccatcagctg

SEQ ID NO: 417024 - DNA, 23 bp, Homo sapiens
tagagtcatctccatcagctgta

SEQ ID NO: 417025 - DNA, 19 bp, Homo sapiens
tagagtccaacgtggggca

SEQ ID NO: 417026 - DNA, 17 bp, Homo sapiens
tagagtctgaacagctg

SEQ ID NO: 417027 - DNA, 13 bp, Homo sapiens
tagagtttaacac

SEQ ID NO: 417028 - DNA, 15 bp, Homo sapiens
tagataaaaagatgg

SEQ ID NO: 417029 - DNA, 16 bp, Homo sapiens
tagataactgctcttt

SEQ ID NO: 417030 - DNA, 19 bp, Homo sapiens
tagatacaatcagctgctt

SEQ ID NO: 417031 - DNA, 17 bp, Homo sapiens
tagataccattttgaaa

SEQ ID NO: 417032 - DNA, 12 bp, Homo sapiens
tagatacttttg

SEQ ID NO: 417033 - DNA, 11 bp, Homo sapiens
tagatagaaat

SEQ ID NO: 417034 - DNA, 23 bp, Homo sapiens
tagatagaaataaatagctatat

SEQ ID NO: 417035 - DNA, 21 bp, Homo sapiens
tagatattgttttctgtaaat

SEQ ID NO: 417036 - DNA, 22 bp, Homo sapiens
tagatcaactcatgttaattga

SEQ ID NO: 417037 - DNA, 14 bp, Homo sapiens
tagatcaattaatt

SEQ ID NO: 417038 - DNA, 14 bp, Homo sapiens
tagatcagtatttc

SEQ ID NO: 417039 - DNA, 15 bp, Homo sapiens
tagatcagtatttca

SEQ ID NO: 417040 - DNA, 20 bp, Homo sapiens
tagatccagatccagactgt

SEQ ID NO: 417041 - DNA, 18 bp, Homo sapiens
tagatcctgcaccccagc

SEQ ID NO: 417042 - DNA, 19 bp, Homo sapiens
tagatcctgcaccccagca

SEQ ID NO: 417043 - DNA, 23 bp, Homo sapiens
tagatctcctgtaattttgtagt

SEQ ID NO: 417044 - DNA, 14 bp, Homo sapiens
tagatctgagccct

SEQ ID NO: 417045 - DNA, 12 bp, Homo sapiens
tagatcttctga

SEQ ID NO: 417046 - DNA, 14 bp, Homo sapiens
tagatcttctgaaa

SEQ ID NO: 417047 - DNA, 22 bp, Homo sapiens
tagatgcaaaaaactaatgtga

SEQ ID NO: 417048 - DNA, 16 bp, Homo sapiens
tagatgcctgaacttg

SEQ ID NO: 417049 - DNA, 16 bp, Homo sapiens
tagatgctactaagaa

SEQ ID NO: 417050 - DNA, 18 bp, Homo sapiens
tagatgctgaatatctgt

SEQ ID NO: 417051 - DNA, 14 bp, Homo sapiens
tagatggatgaatt

SEQ ID NO: 417052 - DNA, 23 bp, Homo sapiens
tagatggatgaattatgataaag

SEQ ID NO: 417053 - DNA, 14 bp, Homo sapiens
tagatggtgctgag

SEQ ID NO: 417054 - DNA, 16 bp, Homo sapiens
tagatgtagcattgtt

SEQ ID NO: 417055 - DNA, 22 bp, Homo sapiens
tagatgtagcattgttccacac

SEQ ID NO: 417056 - DNA, 21 bp, Homo sapiens
tagatgtccctttcttggcca

SEQ ID NO: 417057 - DNA, 14 bp, Homo sapiens
tagatgtttaacaa

SEQ ID NO: 417058 - DNA, 21 bp, Homo sapiens
tagattatattgagacaaaaa

SEQ ID NO: 417059 - DNA, 22 bp, Homo sapiens
tagattatattgagacaaaaat

SEQ ID NO: 417060 - DNA, 15 bp, Homo sapiens
tagattcacctgtaa

SEQ ID NO: 417061 - DNA, 18 bp, Homo sapiens
tagattcctacttaaaca

SEQ ID NO: 417062 - DNA, 23 bp, Homo sapiens
tagattcctacttaaacaaaaac

SEQ ID NO: 417063 - DNA, 22 bp, Homo sapiens
tagattcctcttgcctctctca

SEQ ID NO: 417064 - DNA, 14 bp, Homo sapiens
tagcagcttccaga

SEQ ID NO: 417065 - DNA, 14 bp, Homo sapiens
tagcaggcccagct

SEQ ID NO: 417066 - DNA, 14 bp, Homo sapiens
tagcagttctgcaa

SEQ ID NO: 417067 - DNA, 21 bp, Homo sapiens
tagcatacatttataatgttt

SEQ ID NO: 417068 - DNA, 23 bp, Homo sapiens
tagcatactgatgagacaacaca

SEQ ID NO: 417069 - DNA, 13 bp, Homo sapiens
tagcatataaatg

SEQ ID NO: 417070 - DNA, 20 bp, Homo sapiens
tagcatataaatgtttatat

SEQ ID NO: 417071 - DNA, 22 bp, Homo sapiens
tagcatataaatgtttatattg

SEQ ID NO: 417072 - DNA, 21 bp, Homo sapiens
tagcatatattcatacctgtt

SEQ ID NO: 417073 - DNA, 20 bp, Homo sapiens
tagcatgacaagccccaggc

SEQ ID NO: 417074 - DNA, 14 bp, Homo sapiens
tagcatgcacaaag

SEQ ID NO: 417075 - DNA, 19 bp, Homo sapiens
tagcatgcacaaagtgtat

SEQ ID NO: 417076 - DNA, 16 bp, Homo sapiens
tagcattaaaaataaa

SEQ ID NO: 417077 - DNA, 14 bp, Homo sapiens
tagcattgaaataa

SEQ ID NO: 417078 - DNA, 14 bp, Homo sapiens
tagcattgttccac

SEQ ID NO: 417079 - DNA, 12 bp, Homo sapiens
tagcatttcttg

SEQ ID NO: 417080 - DNA, 16 bp, Homo sapiens
tagcatttcttgatgt

SEQ ID NO: 417081 - DNA, 19 bp, Homo sapiens
tagcattttcttgaaccaa

SEQ ID NO: 417082 - DNA, 14 bp, Homo sapiens
tagccaaagagctc

SEQ ID NO: 417083 - DNA, 22 bp, Homo sapiens
tagccaccaccggggcactggc

SEQ ID NO: 417084 - DNA, 16 bp, Homo sapiens
tagccactctctgccc

SEQ ID NO: 417085 - DNA, 19 bp, Homo sapiens
tagccactctctgcccact

SEQ ID NO: 417086 - DNA, 17 bp, Homo sapiens
tagccagagaggagcac

SEQ ID NO: 417087 - DNA, 20 bp, Homo sapiens
tagccagagaggagcacctg

SEQ ID NO: 417088 - DNA, 24 bp, Homo sapiens
tagccagagcccttcactgccatg

SEQ ID NO: 417089 - DNA, 18 bp, Homo sapiens
tagccaggagtctgtgct

SEQ ID NO: 417090 - DNA, 20 bp, Homo sapiens
tagccaggagtctgtgctct

SEQ ID NO: 417091 - DNA, 14 bp, Homo sapiens
tagccagtgacttt

SEQ ID NO: 417092 - DNA, 14 bp, Homo sapiens
tagccatggctcag

SEQ ID NO: 417093 - DNA, 16 bp, Homo sapiens
tagccatggctcaggc

SEQ ID NO: 417094 - DNA, 18 bp, Homo sapiens
tagccatggctggcagag

SEQ ID NO: 417095 - DNA, 20 bp, Homo sapiens
tagccattgtcgtttcattc

SEQ ID NO: 417096 - DNA, 16 bp, Homo sapiens
tagccatttgaagaag

SEQ ID NO: 417097 - DNA, 15 bp, Homo sapiens
tagccattttgtaac

SEQ ID NO: 417098 - DNA, 14 bp, Homo sapiens
tagcccaccctgct

SEQ ID NO: 417099 - DNA, 18 bp, Homo sapiens
tagcccaccctgctgcct

SEQ ID NO: 417100 - DNA, 19 bp, Homo sapiens
tagcccccaggctgctgga

SEQ ID NO: 417101 - DNA, 23 bp, Homo sapiens
tagcccgacagttctgaactgga

SEQ ID NO: 417102 - DNA, 23 bp, Homo sapiens
tagcccggccaaggacactgatg

SEQ ID NO: 417103 - DNA, 12 bp, Homo sapiens
tagccctcagtc

SEQ ID NO: 417104 - DNA, 23 bp, Homo sapiens
tagccctccccctcaacctcacc

SEQ ID NO: 417105 - DNA, 16 bp, Homo sapiens
tagccctctttctctc

SEQ ID NO: 417106 - DNA, 19 bp, Homo sapiens
tagccctctttctctctgt

SEQ ID NO: 417107 - DNA, 21 bp, Homo sapiens
tagccctctttctctctgtgt

SEQ ID NO: 417108 - DNA, 13 bp, Homo sapiens
tagccctttctgt

SEQ ID NO: 417109 - DNA, 14 bp, Homo sapiens
tagccctttctgtg

SEQ ID NO: 417110 - DNA, 19 bp, Homo sapiens
tagccgtccatggcaccag

SEQ ID NO: 417111 - DNA, 12 bp, Homo sapiens
tagcctccctga

SEQ ID NO: 417112 - DNA, 12 bp, Homo sapiens
tagcctctccca

SEQ ID NO: 417113 - DNA, 14 bp, Homo sapiens
tagcctctcccacc

SEQ ID NO: 417114 - DNA, 16 bp, Homo sapiens
tagcctctttgtgttt

SEQ ID NO: 417115 - DNA, 21 bp, Homo sapiens
tagcctgcgtcatggctcaag

SEQ ID NO: 417116 - DNA, 17 bp, Homo sapiens
tagcctgggccacaggg

SEQ ID NO: 417117 - DNA, 16 bp, Homo sapiens
tagcctgggccagaga

SEQ ID NO: 417118 - DNA, 17 bp, Homo sapiens
tagcctggtgacaggca

SEQ ID NO: 417119 - DNA, 18 bp, Homo sapiens
tagcctggtgacaggcag

SEQ ID NO: 417120 - DNA, 19 bp, Homo sapiens
tagcctggtgacaggcaga

SEQ ID NO: 417121 - DNA, 16 bp, Homo sapiens
tagccttgctgtagag

SEQ ID NO: 417122 - DNA, 22 bp, Homo sapiens
tagccttgtgccctgcccccat

SEQ ID NO: 417123 - DNA, 15 bp, Homo sapiens
tagcgctctcttcca

SEQ ID NO: 417124 - DNA, 18 bp, Homo sapiens
tagcggggccttgtctct

SEQ ID NO: 417125 - DNA, 14 bp, Homo sapiens
tagcgtcctgagga

SEQ ID NO: 417126 - DNA, 20 bp, Homo sapiens
tagcgtgagctaactgagag

SEQ ID NO: 417127 - DNA, 14 bp, Homo sapiens
tagcgttctggact

SEQ ID NO: 417128 - DNA, 21 bp, Homo sapiens
tagcgttggaattaaaacaat

SEQ ID NO: 417129 - DNA, 23 bp, Homo sapiens
tagcgttggaattaaaacaatgt

SEQ ID NO: 417130 - DNA, 21 bp, Homo sapiens
tagctacaatcctaccttttg

SEQ ID NO: 417131 - DNA, 22 bp, Homo sapiens
tagctacaatcctaccttttga

SEQ ID NO: 417132 - DNA, 19 bp, Homo sapiens
tagctacggttccctgcct

SEQ ID NO: 417133 - DNA, 13 bp, Homo sapiens
tagctagaatatc

SEQ ID NO: 417134 - DNA, 18 bp, Homo sapiens
tagctagctatttctatg

SEQ ID NO: 417135 - DNA, 22 bp, Homo sapiens
tagctagtttaaaattattaaa

SEQ ID NO: 417136 - DNA, 15 bp, Homo sapiens
tagctataaatagtg

SEQ ID NO: 417137 - DNA, 17 bp, Homo sapiens
tagctatatccatgtac

SEQ ID NO: 417138 - DNA, 19 bp, Homo sapiens
tagctatatccatgtactg

SEQ ID NO: 417139 - DNA, 20 bp, Homo sapiens
tagctatatccatgtactgt

SEQ ID NO: 417140 - DNA, 22 bp, Homo sapiens
tagctatatccatgtactgtag

SEQ ID NO: 417141 - DNA, 14 bp, Homo sapiens
tagctatcagaaga

SEQ ID NO: 417142 - DNA, 21 bp, Homo sapiens
tagctatcagaagaccacaaa

SEQ ID NO: 417143 - DNA, 15 bp, Homo sapiens
tagctccctcctccc

SEQ ID NO: 417144 - DNA, 20 bp, Homo sapiens
tagctccctcctcccatctc

SEQ ID NO: 417145 - DNA, 23 bp, Homo sapiens
tagctccctcctcccatctcctt

SEQ ID NO: 417146 - DNA, 17 bp, Homo sapiens
tagctccttgaagacat

SEQ ID NO: 417147 - DNA, 21 bp, Homo sapiens
tagctccttgaagacatatca

SEQ ID NO: 417148 - DNA, 14 bp, Homo sapiens
tagctccttggagc

SEQ ID NO: 417149 - DNA, 17 bp, Homo sapiens
tagctctacacaacatg

SEQ ID NO: 417150 - DNA, 18 bp, Homo sapiens
tagctctacacaacatgt

SEQ ID NO: 417151 - DNA, 21 bp, Homo sapiens
tagctctaggagggctggcaa

SEQ ID NO: 417152 - DNA, 17 bp, Homo sapiens
tagctctattttaaagt

SEQ ID NO: 417153 - DNA, 12 bp, Homo sapiens
tagctctgagcc

SEQ ID NO: 417154 - DNA, 17 bp, Homo sapiens
tagctcttagtcctccc

SEQ ID NO: 417155 - DNA, 19 bp, Homo sapiens
tagctgaaacctaaggcaa

SEQ ID NO: 417156 - DNA, 21 bp, Homo sapiens
tagctgacccagccccttgag

SEQ ID NO: 417157 - DNA, 23 bp, Homo sapiens
tagctgacccagccccttgagaa

SEQ ID NO: 417158 - DNA, 16 bp, Homo sapiens
tagctgagctggaaag

SEQ ID NO: 417159 - DNA, 14 bp, Homo sapiens
tagctgatgaaact

SEQ ID NO: 417160 - DNA, 18 bp, Homo sapiens
tagctgccaaaaagaaca

SEQ ID NO: 417161 - DNA, 11 bp, Homo sapiens
tagctggcagg

SEQ ID NO: 417162 - DNA, 13 bp, Homo sapiens
tagctggcaggac

SEQ ID NO: 417163 - DNA, 22 bp, Homo sapiens
tagctggtcttatttgtaaagc

SEQ ID NO: 417164 - DNA, 22 bp, Homo sapiens
tagctggtttcctcattcctga

SEQ ID NO: 417165 - DNA, 11 bp, Homo sapiens
tagctgtaaat

SEQ ID NO: 417166 - DNA, 20 bp, Homo sapiens
tagctgtaaatacatgtgtg

SEQ ID NO: 417167 - DNA, 13 bp, Homo sapiens
tagctgttgagct

SEQ ID NO: 417168 - DNA, 19 bp, Homo sapiens
tagcttaaaaaaaggaaaa

SEQ ID NO: 417169 - DNA, 19 bp, Homo sapiens
tagcttaactaatttgaat

SEQ ID NO: 417170 - DNA, 21 bp, Homo sapiens
tagcttacaagccagctggag

SEQ ID NO: 417171 - DNA, 17 bp, Homo sapiens
tagcttatacaattcag

SEQ ID NO: 417172 - DNA, 22 bp, Homo sapiens
tagcttatacaattcagagaat

SEQ ID NO: 417173 - DNA, 15 bp, Homo sapiens
tagtcacctctgggc

SEQ ID NO: 417174 - DNA, 15 bp, Homo sapiens
tagtcagatggatgt

SEQ ID NO: 417175 - DNA, 20 bp, Homo sapiens
tagtcaggagagtgcagatc

SEQ ID NO: 417176 - DNA, 21 bp, Homo sapiens
tagtcaggtgcctcaagagaa

SEQ ID NO: 417177 - DNA, 13 bp, Homo sapiens
tagtcatatgtga

SEQ ID NO: 417178 - DNA, 22 bp, Homo sapiens
tagtccaaattatttttacgta

SEQ ID NO: 417179 - DNA, 13 bp, Homo sapiens
tagtccaggctgt

SEQ ID NO: 417180 - DNA, 17 bp, Homo sapiens
tagtctcctttgcactg

SEQ ID NO: 417181 - DNA, 18 bp, Homo sapiens
tagtctcctttgcactga

SEQ ID NO: 417182 - DNA, 13 bp, Homo sapiens
tagtctctgattt

SEQ ID NO: 417183 - DNA, 20 bp, Homo sapiens
tagtctgaggccccttaact

SEQ ID NO: 417184 - DNA, 13 bp, Homo sapiens
tagtctggtttct

SEQ ID NO: 417185 - DNA, 17 bp, Homo sapiens
tagtctgtgtgctgtgg

SEQ ID NO: 417186 - DNA, 14 bp, Homo sapiens
tagtcttctcatag

SEQ ID NO: 417187 - DNA, 18 bp, Homo sapiens
tagtcttctcatagcatt

SEQ ID NO: 417188 - DNA, 19 bp, Homo sapiens
tagtcttctcatagcatta

SEQ ID NO: 417189 - DNA, 15 bp, Homo sapiens
tagtctttgtttaca

SEQ ID NO: 417190 - DNA, 18 bp, Homo sapiens
tagtgaaaattttattga

SEQ ID NO: 417191 - DNA, 17 bp, Homo sapiens
tagtgacccggaggcca

SEQ ID NO: 417192 - DNA, 18 bp, Homo sapiens
tagtgatacactgtatct

SEQ ID NO: 417193 - DNA, 22 bp, Homo sapiens
tagtgatacactgtatctaaaa

SEQ ID NO: 417194 - DNA, 15 bp, Homo sapiens
tagtgatgaaattat

SEQ ID NO: 417195 - DNA, 19 bp, Homo sapiens
tagtgatgtagaaagatac

SEQ ID NO: 417196 - DNA, 14 bp, Homo sapiens
tagtgcagctgatt

SEQ ID NO: 417197 - DNA, 19 bp, Homo sapiens
tagtgcagctgattttaac

SEQ ID NO: 417198 - DNA, 20 bp, Homo sapiens
tagtgcagctgattttaaca

SEQ ID NO: 417199 - DNA, 22 bp, Homo sapiens
tagtgcagtcaccctgtggcaa

SEQ ID NO: 417200 - DNA, 15 bp, Homo sapiens
tagtgcccctcccat

SEQ ID NO: 417201 - DNA, 14 bp, Homo sapiens
tagtgcccgcctag

SEQ ID NO: 417202 - DNA, 23 bp, Homo sapiens
tagtgcctaaaattgtatgaaaa

SEQ ID NO: 417203 - DNA, 13 bp, Homo sapiens
tagtgcctcagcg

SEQ ID NO: 417204 - DNA, 15 bp, Homo sapiens
taccttgaggtcttt

SEQ ID NO: 417205 - DNA, 21 bp, Homo sapiens
tacctttaaatatcattcttt

SEQ ID NO: 417206 - DNA, 18 bp, Homo sapiens
tacctttattaatgaact

SEQ ID NO: 417207 - DNA, 20 bp, Homo sapiens
tataaaatgtattcaagcaa

SEQ ID NO: 417208 - DNA, 14 bp, Homo sapiens
tataaacatcacac

SEQ ID NO: 417209 - DNA, 18 bp, Homo sapiens
tataaacatcacacacac

SEQ ID NO: 417210 - DNA, 20 bp, Homo sapiens
tataaaccataaaataaata

SEQ ID NO: 417211 - DNA, 17 bp, Homo sapiens
tataaaccgtgtgtcat

SEQ ID NO: 417212 - DNA, 15 bp, Homo sapiens
tataaactagatctc

SEQ ID NO: 417213 - DNA, 11 bp, Homo sapiens
tataaactgtg

SEQ ID NO: 417214 - DNA, 22 bp, Homo sapiens
tataaagaacaaggtagttttt

SEQ ID NO: 417215 - DNA, 15 bp, Homo sapiens
tataaagtaaagcta

SEQ ID NO: 417216 - DNA, 13 bp, Homo sapiens
tataaagttatta

SEQ ID NO: 417217 - DNA, 17 bp, Homo sapiens
tataaagttattaatag

SEQ ID NO: 417218 - DNA, 17 bp, Homo sapiens
tataaataaagcaaata

SEQ ID NO: 417219 - DNA, 16 bp, Homo sapiens
tataaatatattgtat

SEQ ID NO: 417220 - DNA, 20 bp, Homo sapiens
tataaatcaatgtcacttaa

SEQ ID NO: 417221 - DNA, 14 bp, Homo sapiens
tataaatcatattg

SEQ ID NO: 417222 - DNA, 21 bp, Homo sapiens
tataaatggtgagaattaaaa

SEQ ID NO: 417223 - DNA, 16 bp, Homo sapiens
tataaatggtgttttt

SEQ ID NO: 417224 - DNA, 20 bp, Homo sapiens
tataaatgtttatattgttt

SEQ ID NO: 417225 - DNA, 22 bp, Homo sapiens
tataaattaaatatatgtatgt

SEQ ID NO: 417226 - DNA, 23 bp, Homo sapiens
tataaattaaatatatgtatgta

SEQ ID NO: 417227 - DNA, 15 bp, Homo sapiens
tataaattaagactt

SEQ ID NO: 417228 - DNA, 14 bp, Homo sapiens
tataacaacactaa

SEQ ID NO: 417229 - DNA, 21 bp, Homo sapiens
tataacaagccaaacattctt

SEQ ID NO: 417230 - DNA, 16 bp, Homo sapiens
tataacaatatatgat

SEQ ID NO: 417231 - DNA, 21 bp, Homo sapiens
tataacaatatatgatatata

SEQ ID NO: 417232 - DNA, 14 bp, Homo sapiens
tataacaattgatt

SEQ ID NO: 417233 - DNA, 22 bp, Homo sapiens
tataacatgtctttcagcatta

SEQ ID NO: 417234 - DNA, 13 bp, Homo sapiens
tataaccccacct

SEQ ID NO: 417235 - DNA, 23 bp, Homo sapiens
tataaccccaccttgccaagctt

SEQ ID NO: 417236 - DNA, 18 bp, Homo sapiens
tataactcatcataaaat

SEQ ID NO: 417237 - DNA, 22 bp, Homo sapiens
tataacttaaaaatgtaaatat

SEQ ID NO: 417238 - DNA, 15 bp, Homo sapiens
tataacttcttaaaa

SEQ ID NO: 417239 - DNA, 16 bp, Homo sapiens
tataacttcttaaaag

SEQ ID NO: 417240 - DNA, 23 bp, Homo sapiens
tataagcaacatgaattaagaac

SEQ ID NO: 417241 - DNA, 20 bp, Homo sapiens
tataagctgtttagtttgtt

SEQ ID NO: 417242 - DNA, 16 bp, Homo sapiens
tataaggaaagcaata

SEQ ID NO: 417243 - DNA, 11 bp, Homo sapiens
tataaggaaat

SEQ ID NO: 417244 - DNA, 11 bp, Homo sapiens
tataaggactg

SEQ ID NO: 417245 - DNA, 22 bp, Homo sapiens
tataagggagtaggctgtattt

SEQ ID NO: 417246 - DNA, 14 bp, Homo sapiens
tataagtcacaaag

SEQ ID NO: 417247 - DNA, 23 bp, Homo sapiens
tataggtagatccagatccagac

SEQ ID NO: 417248 - DNA, 13 bp, Homo sapiens
tatagtatatctg

SEQ ID NO: 417249 - DNA, 11 bp, Homo sapiens
tatagtgccta

SEQ ID NO: 417250 - DNA, 19 bp, Homo sapiens
tatagtgcctaaaattgta

SEQ ID NO: 417251 - DNA, 21 bp, Homo sapiens
tatagtgtaaaataagaatga

SEQ ID NO: 417252 - DNA, 22 bp, Homo sapiens
tatagttaattgtggctttatg

SEQ ID NO: 417253 - DNA, 17 bp, Homo sapiens
tatagttaggatagcat

SEQ ID NO: 417254 - DNA, 19 bp, Homo sapiens
tatagttaggatagcattt

SEQ ID NO: 417255 - DNA, 15 bp, Homo sapiens
tatagttgaacaaga

SEQ ID NO: 417256 - DNA, 16 bp, Homo sapiens
tatagttgtctttctt

SEQ ID NO: 417257 - DNA, 22 bp, Homo sapiens
tatagtttcagatatatatcat

SEQ ID NO: 417258 - DNA, 18 bp, Homo sapiens
tatagtttgtacatgcat

SEQ ID NO: 417259 - DNA, 12 bp, Homo sapiens
tatataaaaaga

SEQ ID NO: 417260 - DNA, 18 bp, Homo sapiens
tatataaaaagaaaagat

SEQ ID NO: 417261 - DNA, 19 bp, Homo sapiens
tatataaaaagaaaagata

SEQ ID NO: 417262 - DNA, 20 bp, Homo sapiens
tatataaaaagaaaagataa

SEQ ID NO: 417263 - DNA, 17 bp, Homo sapiens
tatataaaataaatata

SEQ ID NO: 417264 - DNA, 19 bp, Homo sapiens
tatataaaataaatatact

SEQ ID NO: 417265 - DNA, 21 bp, Homo sapiens
tatataaaataaatatactaa

SEQ ID NO: 417266 - DNA, 22 bp, Homo sapiens
tatataaatgtaaaaataataa

SEQ ID NO: 417267 - DNA, 12 bp, Homo sapiens
tatataaattat

SEQ ID NO: 417268 - DNA, 22 bp, Homo sapiens
tatataaattattactttaaat

SEQ ID NO: 417269 - DNA, 13 bp, Homo sapiens
tatataagctgtt

SEQ ID NO: 417270 - DNA, 18 bp, Homo sapiens
tatataatggtttactgc

SEQ ID NO: 417271 - DNA, 17 bp, Homo sapiens
tatataattatgttatt

SEQ ID NO: 417272 - DNA, 18 bp, Homo sapiens
tatataattttattgctg

SEQ ID NO: 417273 - DNA, 13 bp, Homo sapiens
tatatacacacaa

SEQ ID NO: 417274 - DNA, 18 bp, Homo sapiens
tatatacatatacacaaa

SEQ ID NO: 417275 - DNA, 13 bp, Homo sapiens
tatatacatgtat

SEQ ID NO: 417276 - DNA, 15 bp, Homo sapiens
tatatacatgtatag

SEQ ID NO: 417277 - DNA, 19 bp, Homo sapiens
tatatacctggcttttact

SEQ ID NO: 417278 - DNA, 15 bp, Homo sapiens
tatatataaaataaa

SEQ ID NO: 417279 - DNA, 18 bp, Homo sapiens
tatatataaaataaatat

SEQ ID NO: 417280 - DNA, 19 bp, Homo sapiens
tatatataaaataaatata

SEQ ID NO: 417281 - DNA, 20 bp, Homo sapiens
tatatataaaataaatatac

SEQ ID NO: 417282 - DNA, 23 bp, Homo sapiens
tatatataaaataaatatactaa

SEQ ID NO: 417283 - DNA, 13 bp, Homo sapiens
tatatataaatat

SEQ ID NO: 417284 - DNA, 18 bp, Homo sapiens
tatatataaatatctatt

SEQ ID NO: 417285 - DNA, 11 bp, Homo sapiens
tatatatacat

SEQ ID NO: 417286 - DNA, 15 bp, Homo sapiens
tatatatacatgtat

SEQ ID NO: 417287 - DNA, 12 bp, Homo sapiens
tatatatagaat

SEQ ID NO: 417288 - DNA, 19 bp, Homo sapiens
tatatatctgcttcagtgg

SEQ ID NO: 417289 - DNA, 21 bp, Homo sapiens
tatatatctgcttcagtggag

SEQ ID NO: 417290 - DNA, 19 bp, Homo sapiens
tatatatgaataattatgt

SEQ ID NO: 417291 - DNA, 14 bp, Homo sapiens
tatatatgtacagt

SEQ ID NO: 417292 - DNA, 21 bp, Homo sapiens
tatatatgtacagttatacat

SEQ ID NO: 417293 - DNA, 14 bp, Homo sapiens
tatatatgtgtgtg

SEQ ID NO: 417294 - DNA, 18 bp, Homo sapiens
tatatatgtgtgtttaaa

SEQ ID NO: 417295 - DNA, 22 bp, Homo sapiens
tatatatgtgtgtttaaataaa

SEQ ID NO: 417296 - DNA, 15 bp, Homo sapiens
tatatattataagtt

SEQ ID NO: 417297 - DNA, 18 bp, Homo sapiens
tccaacttaaaaaggcaa

SEQ ID NO: 417298 - DNA, 19 bp, Homo sapiens
tccaagaagccctccttgc

SEQ ID NO: 417299 - DNA, 14 bp, Homo sapiens
tccaagaatgtttt

SEQ ID NO: 417300 - DNA, 19 bp, Homo sapiens
tccaagcaagtagctttcc

SEQ ID NO: 417301 - DNA, 16 bp, Homo sapiens
tccaagcatcagcaag

SEQ ID NO: 417302 - DNA, 17 bp, Homo sapiens
tccaagcctaaaattaa

SEQ ID NO: 417303 - DNA, 14 bp, Homo sapiens
tccaagcctgcctc

SEQ ID NO: 417304 - DNA, 17 bp, Homo sapiens
tccaagcctgcctccca

SEQ ID NO: 417305 - DNA, 21 bp, Homo sapiens
tccaagcctgggccactggca

SEQ ID NO: 417306 - DNA, 16 bp, Homo sapiens
tccaaggaaaagcaga

SEQ ID NO: 417307 - DNA, 17 bp, Homo sapiens
tccaaggatcctctcca

SEQ ID NO: 417308 - DNA, 13 bp, Homo sapiens
tccaaggcaaaca

SEQ ID NO: 417309 - DNA, 14 bp, Homo sapiens
tccaaggcaaacaa

SEQ ID NO: 417310 - DNA, 15 bp, Homo sapiens
tccaaggcaaacaat

SEQ ID NO: 417311 - DNA, 16 bp, Homo sapiens
tccaaggcaaatgtcc

SEQ ID NO: 417312 - DNA, 13 bp, Homo sapiens
tccaagggcccag

SEQ ID NO: 417313 - DNA, 14 bp, Homo sapiens
tccaaggtgcacat

SEQ ID NO: 417314 - DNA, 20 bp, Homo sapiens
tccaagtaccaatgctgttg

SEQ ID NO: 417315 - DNA, 14 bp, Homo sapiens
tccaagtcaacact

SEQ ID NO: 417316 - DNA, 19 bp, Homo sapiens
tccaagtctctctgtgaat

SEQ ID NO: 417317 - DNA, 20 bp, Homo sapiens
tccaagtctctctgtgaata

SEQ ID NO: 417318 - DNA, 22 bp, Homo sapiens
tccaagtcttcagcgagaccct

SEQ ID NO: 417319 - DNA, 14 bp, Homo sapiens
tccaagtgtgtgtg

SEQ ID NO: 417320 - DNA, 22 bp, Homo sapiens
tccaagttatttgatctggtgc

SEQ ID NO: 417321 - DNA, 18 bp, Homo sapiens
tccaatcccaccaaccct

SEQ ID NO: 417322 - DNA, 17 bp, Homo sapiens
tccaatgatgcttacta

SEQ ID NO: 417323 - DNA, 18 bp, Homo sapiens
tccaatggagttcagaga

SEQ ID NO: 417324 - DNA, 17 bp, Homo sapiens
tccaatgtgcccagtca

SEQ ID NO: 417325 - DNA, 19 bp, Homo sapiens
tccaattatgtgacaacct

SEQ ID NO: 417326 - DNA, 11 bp, Homo sapiens
tccaattccaa

SEQ ID NO: 417327 - DNA, 16 bp, Homo sapiens
tccaattgatgtatat

SEQ ID NO: 417328 - DNA, 19 bp, Homo sapiens
tccaattgatgtatatgtt

SEQ ID NO: 417329 - DNA, 22 bp, Homo sapiens
tccaattgatgtatatgtttat

SEQ ID NO: 417330 - DNA, 18 bp, Homo sapiens
tccacaaggaataaatga

SEQ ID NO: 417331 - DNA, 18 bp, Homo sapiens
tccacaagttaaataaat

SEQ ID NO: 417332 - DNA, 18 bp, Homo sapiens
tccacaatcatctattga

SEQ ID NO: 417333 - DNA, 16 bp, Homo sapiens
tccacacaacaccagg

SEQ ID NO: 417334 - DNA, 18 bp, Homo sapiens
tccacacaacaccaggac

SEQ ID NO: 417335 - DNA, 19 bp, Homo sapiens
tccacacaacaccaggact

SEQ ID NO: 417336 - DNA, 20 bp, Homo sapiens
tccacacaacaccaggactt

SEQ ID NO: 417337 - DNA, 21 bp, Homo sapiens
tccacacaacaccaggactta

SEQ ID NO: 417338 - DNA, 23 bp, Homo sapiens
tccacacaggcccatgccctccg

SEQ ID NO: 417339 - DNA, 18 bp, Homo sapiens
tccacacatttaaaacat

SEQ ID NO: 417340 - DNA, 16 bp, Homo sapiens
tccacacctccacccg

SEQ ID NO: 417341 - DNA, 20 bp, Homo sapiens
tccacagaaaccctgtttta

SEQ ID NO: 417342 - DNA, 17 bp, Homo sapiens
tccacagaacctttgtc

SEQ ID NO: 417343 - DNA, 21 bp, Homo sapiens
tccacagaagacacgtgtttt

SEQ ID NO: 417344 - DNA, 14 bp, Homo sapiens
tccacagagtataa

SEQ ID NO: 417345 - DNA, 18 bp, Homo sapiens
tccacagagttactgcca

SEQ ID NO: 417346 - DNA, 22 bp, Homo sapiens
tccacaggggcaggcctgggac

SEQ ID NO: 417347 - DNA, 23 bp, Homo sapiens
tccacaggggcaggcctgggacc

SEQ ID NO: 417348 - DNA, 14 bp, Homo sapiens
tccacaggggctat

SEQ ID NO: 417349 - DNA, 22 bp, Homo sapiens
tccacaggggctatcccttctc

SEQ ID NO: 417350 - DNA, 14 bp, Homo sapiens
tccacagtgctgct

SEQ ID NO: 417351 - DNA, 13 bp, Homo sapiens
tccacagttgtca

SEQ ID NO: 417352 - DNA, 18 bp, Homo sapiens
tccacatcccagcagccc

SEQ ID NO: 417353 - DNA, 17 bp, Homo sapiens
tccacatccccaccttc

SEQ ID NO: 417354 - DNA, 21 bp, Homo sapiens
tccacatgtggggacagggct

SEQ ID NO: 417355 - DNA, 14 bp, Homo sapiens
tccacattctactt

SEQ ID NO: 417356 - DNA, 15 bp, Homo sapiens
tccacattctacttc

SEQ ID NO: 417357 - DNA, 22 bp, Homo sapiens
tccacattctacttcagctttg

SEQ ID NO: 417358 - DNA, 14 bp, Homo sapiens
tccacattctgctg

SEQ ID NO: 417359 - DNA, 20 bp, Homo sapiens
tccacattctgctgccccca

SEQ ID NO: 417360 - DNA, 16 bp, Homo sapiens
tccacatttgtcacag

SEQ ID NO: 417361 - DNA, 18 bp, Homo sapiens
tccacatttgtcacagaa

SEQ ID NO: 417362 - DNA, 15 bp, Homo sapiens
tccaccaaattctga

SEQ ID NO: 417363 - DNA, 17 bp, Homo sapiens
tccaccaagaaagcagg

SEQ ID NO: 417364 - DNA, 14 bp, Homo sapiens
tccaccaagttctc

SEQ ID NO: 417365 - DNA, 21 bp, Homo sapiens
tccaccaggaacctcttcaga

SEQ ID NO: 417366 - DNA, 24 bp, Homo sapiens
tccaccatggctaaggcaccagcc

SEQ ID NO: 417367 - DNA, 19 bp, Homo sapiens
tccacccaaaccccttccc

SEQ ID NO: 417368 - DNA, 21 bp, Homo sapiens
tccacccaccagtcagggaca

SEQ ID NO: 417369 - DNA, 16 bp, Homo sapiens
tccacccacctcagcc

SEQ ID NO: 417370 - DNA, 18 bp, Homo sapiens
tccacccacctcagcctc

SEQ ID NO: 417371 - DNA, 23 bp, Homo sapiens
tccacccacctcagcctcccaaa

SEQ ID NO: 417372 - DNA, 12 bp, Homo sapiens
tccacccactgt

SEQ ID NO: 417373 - DNA, 15 bp, Homo sapiens
tccacccagcccctg

SEQ ID NO: 417374 - DNA, 13 bp, Homo sapiens
tccacccaggctg

SEQ ID NO: 417375 - DNA, 14 bp, Homo sapiens
tccacccaggctgc

SEQ ID NO: 417376 - DNA, 22 bp, Homo sapiens
tcagacctgtcttccaaggaga

SEQ ID NO: 417377 - DNA, 16 bp, Homo sapiens
tcagacgagacaccct

SEQ ID NO: 417378 - DNA, 17 bp, Homo sapiens
tcagacgagacacccta

SEQ ID NO: 417379 - DNA, 15 bp, Homo sapiens
tcagactctctcctc

SEQ ID NO: 417380 - DNA, 16 bp, Homo sapiens
tcagactggtctcgaa

SEQ ID NO: 417381 - DNA, 15 bp, Homo sapiens
tcagacttaccagga

SEQ ID NO: 417382 - DNA, 15 bp, Homo sapiens
tcagagaaaacactt

SEQ ID NO: 417383 - DNA, 17 bp, Homo sapiens
tcagagaaaacactttc

SEQ ID NO: 417384 - DNA, 19 bp, Homo sapiens
tcagagaaaacactttcct

SEQ ID NO: 417385 - DNA, 21 bp, Homo sapiens
tcagagaaggaaaagactgaa

SEQ ID NO: 417386 - DNA, 12 bp, Homo sapiens
tcagagaagtca

SEQ ID NO: 417387 - DNA, 23 bp, Homo sapiens
tcagagacaggaagtcttcaggg

SEQ ID NO: 417388 - DNA, 19 bp, Homo sapiens
tcagagactggcagccagg

SEQ ID NO: 417389 - DNA, 16 bp, Homo sapiens
tcagagagcaagaaaa

SEQ ID NO: 417390 - DNA, 16 bp, Homo sapiens
tcagagagctggtagt

SEQ ID NO: 417391 - DNA, 15 bp, Homo sapiens
tcagagcagtgattc

SEQ ID NO: 417392 - DNA, 21 bp, Homo sapiens
tcagagccagtgaaggagcca

SEQ ID NO: 417393 - DNA, 11 bp, Homo sapiens
tcagagccctg

SEQ ID NO: 417394 - DNA, 15 bp, Homo sapiens
tcagagccctggctg

SEQ ID NO: 417395 - DNA, 16 bp, Homo sapiens
tcagagccctggctgg

SEQ ID NO: 417396 - DNA, 13 bp, Homo sapiens
tcagagctaggcc

SEQ ID NO: 417397 - DNA, 23 bp, Homo sapiens
tcagagctcttcaagctgtcccc

SEQ ID NO: 417398 - DNA, 18 bp, Homo sapiens
tcagaggctaagatgaga

SEQ ID NO: 417399 - DNA, 17 bp, Homo sapiens
tcagagggactgtcagc

SEQ ID NO: 417400 - DNA, 23 bp, Homo sapiens
tcagagggactgtcagctgagct

SEQ ID NO: 417401 - DNA, 16 bp, Homo sapiens
tcagagtccaggcccc

SEQ ID NO: 417402 - DNA, 17 bp, Homo sapiens
tcagagtctggcctgcc

SEQ ID NO: 417403 - DNA, 18 bp, Homo sapiens
tcagagtctggcctgcca

SEQ ID NO: 417404 - DNA, 21 bp, Homo sapiens
tcagagtggccaatccctgtg

SEQ ID NO: 417405 - DNA, 17 bp, Homo sapiens
tcagataaagtgaccag

SEQ ID NO: 417406 - DNA, 19 bp, Homo sapiens
tcagataatcggtgcagcg

SEQ ID NO: 417407 - DNA, 13 bp, Homo sapiens
tcagatcctgctg

SEQ ID NO: 417408 - DNA, 15 bp, Homo sapiens
tcagatcctgctgcc

SEQ ID NO: 417409 - DNA, 16 bp, Homo sapiens
tcagatcctgctgccg

SEQ ID NO: 417410 - DNA, 14 bp, Homo sapiens
tcagatctgaacac

SEQ ID NO: 417411 - DNA, 15 bp, Homo sapiens
tcagatcttacaagt

SEQ ID NO: 417412 - DNA, 18 bp, Homo sapiens
tcagatgaaaataaaata

SEQ ID NO: 417413 - DNA, 18 bp, Homo sapiens
tcagatgagcaaggacat

SEQ ID NO: 417414 - DNA, 19 bp, Homo sapiens
tcagatgagcaaggacatt

SEQ ID NO: 417415 - DNA, 23 bp, Homo sapiens
tcagatgagcaaggacattgccc

SEQ ID NO: 417416 - DNA, 13 bp, Homo sapiens
tcagatggaggtt

SEQ ID NO: 417417 - DNA, 15 bp, Homo sapiens
tcagatggatgtaga

SEQ ID NO: 417418 - DNA, 20 bp, Homo sapiens
tcagatgtcttctgcctgtt

SEQ ID NO: 417419 - DNA, 18 bp, Homo sapiens
tcagattagggcggggag

SEQ ID NO: 417420 - DNA, 12 bp, Homo sapiens
tcagattgtaaa

SEQ ID NO: 417421 - DNA, 19 bp, Homo sapiens
tcagattttaaaaagtctt

SEQ ID NO: 417422 - DNA, 20 bp, Homo sapiens
tcagcaaattcttgaataaa

SEQ ID NO: 417423 - DNA, 11 bp, Homo sapiens
tcagcaaccct

SEQ ID NO: 417424 - DNA, 21 bp, Homo sapiens
tcagcaaccctacagtatata

SEQ ID NO: 417425 - DNA, 12 bp, Homo sapiens
tcagcaagtgta

SEQ ID NO: 417426 - DNA, 17 bp, Homo sapiens
tcagcaatagggtgcag

SEQ ID NO: 417427 - DNA, 15 bp, Homo sapiens
tcagcacatgcacta

SEQ ID NO: 417428 - DNA, 21 bp, Homo sapiens
tcagcacatgcactactgaaa

SEQ ID NO: 417429 - DNA, 15 bp, Homo sapiens
tcagcaccaccctag

SEQ ID NO: 417430 - DNA, 19 bp, Homo sapiens
tcagcacccccacccacct

SEQ ID NO: 417431 - DNA, 20 bp, Homo sapiens
tcagcacccccacccacctc

SEQ ID NO: 417432 - DNA, 15 bp, Homo sapiens
tcagcaccctgggtg

SEQ ID NO: 417433 - DNA, 23 bp, Homo sapiens
tcagcaccctgggtgccattccc

SEQ ID NO: 417434 - DNA, 21 bp, Homo sapiens
tcagcaccgtggtgtgaggcc

SEQ ID NO: 417435 - DNA, 17 bp, Homo sapiens
tcagcactgatttcaca

SEQ ID NO: 417436 - DNA, 12 bp, Homo sapiens
tcagcactgtcc

SEQ ID NO: 417437 - DNA, 13 bp, Homo sapiens
tcagcagacactc

SEQ ID NO: 417438 - DNA, 22 bp, Homo sapiens
tcagcagagttattgaatctta

SEQ ID NO: 417439 - DNA, 12 bp, Homo sapiens
tcagcagccccc

SEQ ID NO: 417440 - DNA, 23 bp, Homo sapiens
tcagcagtgattgaagtatctgt

SEQ ID NO: 417441 - DNA, 16 bp, Homo sapiens
tcagcatcaaacatga

SEQ ID NO: 417442 - DNA, 19 bp, Homo sapiens
tcagcatcaaacatgaaaa

SEQ ID NO: 417443 - DNA, 18 bp, Homo sapiens
tcagcattaggcttttaa

SEQ ID NO: 417444 - DNA, 18 bp, Homo sapiens
tcagcattattcctccag

SEQ ID NO: 417445 - DNA, 15 bp, Homo sapiens
tcagcattcaaaata

SEQ ID NO: 417446 - DNA, 20 bp, Homo sapiens
tcagcattcaaaatagttct

SEQ ID NO: 417447 - DNA, 21 bp, Homo sapiens
tcagcatttactttgtttctt

SEQ ID NO: 417448 - DNA, 23 bp, Homo sapiens
tcagccaacattgccttgcattt

SEQ ID NO: 417449 - DNA, 17 bp, Homo sapiens
tcagcccaggtcccagt

SEQ ID NO: 417450 - DNA, 14 bp, Homo sapiens
tcagccccagccca

SEQ ID NO: 417451 - DNA, 16 bp, Homo sapiens
tcagccccggccactc

SEQ ID NO: 417452 - DNA, 21 bp, Homo sapiens
tcagcccctcttgccccccac

SEQ ID NO: 417453 - DNA, 22 bp, Homo sapiens
tcagcccctcttgccccccacc

SEQ ID NO: 417454 - DNA, 23 bp, Homo sapiens
tcagcccctcttgccccccaccc

SEQ ID NO: 417455 - DNA, 18 bp, Homo sapiens
tcagcccctgctgctcct

SEQ ID NO: 417456 - DNA, 20 bp, Homo sapiens
tcagccctagaggcgagcca

SEQ ID NO: 417457 - DNA, 22 bp, Homo sapiens
tcagccctagaggcgagccagg

SEQ ID NO: 417458 - DNA, 14 bp, Homo sapiens
tcagccctccctgc

SEQ ID NO: 417459 - DNA, 19 bp, Homo sapiens
tcagccctccctgcccctc

SEQ ID NO: 417460 - DNA, 18 bp, Homo sapiens
tcagccctgaaaataaca

SEQ ID NO: 417461 - DNA, 23 bp, Homo sapiens
tcagccctgaggtgaaagggagc

SEQ ID NO: 417462 - DNA, 17 bp, Homo sapiens
tcagccgaattgtggtg

SEQ ID NO: 417463 - DNA, 23 bp, Homo sapiens
tcagccgaattgtggtgtcttac

SEQ ID NO: 417464 - DNA, 14 bp, Homo sapiens
tcagcctcccaaag

SEQ ID NO: 417465 - DNA, 20 bp, Homo sapiens
tcagcctccggagtagctgg

SEQ ID NO: 417466 - DNA, 13 bp, Homo sapiens
tcagcctcctgag

SEQ ID NO: 417467 - DNA, 17 bp, Homo sapiens
tcagcctcctgagcctg

SEQ ID NO: 417468 - DNA, 18 bp, Homo sapiens
tcagcctcctgagcctgt

SEQ ID NO: 417469 - DNA, 20 bp, Homo sapiens
tcagcctcctgagcctgtgg

SEQ ID NO: 417470 - DNA, 14 bp, Homo sapiens
tcagcctcctgtgt

SEQ ID NO: 417471 - DNA, 13 bp, Homo sapiens
tcagcctctggcc

SEQ ID NO: 417472 - DNA, 14 bp, Homo sapiens
tcagcctctggcca

SEQ ID NO: 417473 - DNA, 15 bp, Homo sapiens
tcagcctctggccag

SEQ ID NO: 417474 - DNA, 11 bp, Homo sapiens
tcagcctgagt

SEQ ID NO: 417475 - DNA, 20 bp, Homo sapiens
tcagcctgcttcttccccag

SEQ ID NO: 417476 - DNA, 20 bp, Homo sapiens
tcagccttccgagtagctgg

SEQ ID NO: 417477 - DNA, 14 bp, Homo sapiens
tcagcgagaccctt

SEQ ID NO: 417478 - DNA, 14 bp, Homo sapiens
tcagctactgattt

SEQ ID NO: 417479 - DNA, 20 bp, Homo sapiens
tcagctatttactgccaaag

SEQ ID NO: 417480 - DNA, 19 bp, Homo sapiens
tcagctcactgcaagctcc

SEQ ID NO: 417481 - DNA, 12 bp, Homo sapiens
tcagctccactc

SEQ ID NO: 417482 - DNA, 13 bp, Homo sapiens
tcagctccactct

SEQ ID NO: 417483 - DNA, 15 bp, Homo sapiens
tcagctccactctga

SEQ ID NO: 417484 - DNA, 16 bp, Homo sapiens
tcagctccactctgaa

SEQ ID NO: 417485 - DNA, 19 bp, Homo sapiens
tcagctctcagttgcagcc

SEQ ID NO: 417486 - DNA, 12 bp, Homo sapiens
tcagctctctgc

SEQ ID NO: 417487 - DNA, 21 bp, Homo sapiens
tcagctctctgggacctcctt

SEQ ID NO: 417488 - DNA, 22 bp, Homo sapiens
tcagctctctgggacctcctta

SEQ ID NO: 417489 - DNA, 14 bp, Homo sapiens
tcagctctggctca

SEQ ID NO: 417490 - DNA, 12 bp, Homo sapiens
tcagctctggga

SEQ ID NO: 417491 - DNA, 19 bp, Homo sapiens
tcagctgagcttgagctcc

SEQ ID NO: 417492 - DNA, 21 bp, Homo sapiens
tcagctgagcttgagctcccc

SEQ ID NO: 417493 - DNA, 17 bp, Homo sapiens
tcagctgcacattcctg

SEQ ID NO: 417494 - DNA, 20 bp, Homo sapiens
tcagctgcacattcctggcc

SEQ ID NO: 417495 - DNA, 12 bp, Homo sapiens
tcagctgcctca

SEQ ID NO: 417496 - DNA, 15 bp, Homo sapiens
tcagctgcctcactt

SEQ ID NO: 417497 - DNA, 13 bp, Homo sapiens
tcagctgcctgaa

SEQ ID NO: 417498 - DNA, 16 bp, Homo sapiens
tcagctgctttgttac

SEQ ID NO: 417499 - DNA, 22 bp, Homo sapiens
tcagctggcggaacctggctgc

SEQ ID NO: 417500 - DNA, 17 bp, Homo sapiens
tcagctggtgtcagtcc

SEQ ID NO: 417501 - DNA, 20 bp, Homo sapiens
tcagctgtaagaagagactg

SEQ ID NO: 417502 - DNA, 17 bp, Homo sapiens
tcagctgttactttctt

SEQ ID NO: 417503 - DNA, 16 bp, Homo sapiens
tcagctgtttgtcata

SEQ ID NO: 417504 - DNA, 18 bp, Homo sapiens
tcagcttaaaataaacag

SEQ ID NO: 417505 - DNA, 14 bp, Homo sapiens
tcagcttaatttaa

SEQ ID NO: 417506 - DNA, 21 bp, Homo sapiens
tcagcttcatttgtgtcaatg

SEQ ID NO: 417507 - DNA, 21 bp, Homo sapiens
tcagcttcccaacaatacttt

SEQ ID NO: 417508 - DNA, 14 bp, Homo sapiens
tcagcttgaatgtc

SEQ ID NO: 417509 - DNA, 14 bp, Homo sapiens
tcagctttcagagc

SEQ ID NO: 417510 - DNA, 14 bp, Homo sapiens
tatgcatctttgag

SEQ ID NO: 417511 - DNA, 17 bp, Homo sapiens
tatgcatctttgagaat

SEQ ID NO: 417512 - DNA, 15 bp, Homo sapiens
tatgcatgagaacta

SEQ ID NO: 417513 - DNA, 19 bp, Homo sapiens
tatgcatgagaactaaata

SEQ ID NO: 417514 - DNA, 13 bp, Homo sapiens
tatgcatgccagg

SEQ ID NO: 417515 - DNA, 14 bp, Homo sapiens
tatgcatgccaggc

SEQ ID NO: 417516 - DNA, 11 bp, Homo sapiens
tatgcatgtag

SEQ ID NO: 417517 - DNA, 13 bp, Homo sapiens
tatgcatgtagca

SEQ ID NO: 417518 - DNA, 14 bp, Homo sapiens
tatgcatgtagcat

SEQ ID NO: 417519 - DNA, 20 bp, Homo sapiens
tatgcatgtagcatataaat

SEQ ID NO: 417520 - DNA, 13 bp, Homo sapiens
tatgcatttatgc

SEQ ID NO: 417521 - DNA, 22 bp, Homo sapiens
tatgcatttatgcatgagaact

SEQ ID NO: 417522 - DNA, 14 bp, Homo sapiens
tatgccacctgcag

SEQ ID NO: 417523 - DNA, 23 bp, Homo sapiens
tatgccccttcttgggccccaga

SEQ ID NO: 417524 - DNA, 20 bp, Homo sapiens
tatgccgaatgccctcaggg

SEQ ID NO: 417525 - DNA, 17 bp, Homo sapiens
tatgccgtctcatattt

SEQ ID NO: 417526 - DNA, 16 bp, Homo sapiens
tatgcctctgtattta

SEQ ID NO: 417527 - DNA, 13 bp, Homo sapiens
tatgcctgtattt

SEQ ID NO: 417528 - DNA, 23 bp, Homo sapiens
tatgcgccctggtatgtgcctgc

SEQ ID NO: 417529 - DNA, 13 bp, Homo sapiens
tatgctaaatgtt

SEQ ID NO: 417530 - DNA, 19 bp, Homo sapiens
tatgctgaaacagaatact

SEQ ID NO: 417531 - DNA, 14 bp, Homo sapiens
tatgctgaattgaa

SEQ ID NO: 417532 - DNA, 15 bp, Homo sapiens
tatgctgatgatcaa

SEQ ID NO: 417533 - DNA, 22 bp, Homo sapiens
tatgctgccaaattttggccaa

SEQ ID NO: 417534 - DNA, 11 bp, Homo sapiens
tatgctgccca

SEQ ID NO: 417535 - DNA, 12 bp, Homo sapiens
tatgctgctgtg

SEQ ID NO: 417536 - DNA, 15 bp, Homo sapiens
tatgcttactcttgc

SEQ ID NO: 417537 - DNA, 21 bp, Homo sapiens
tatggaaactgttgccagaga

SEQ ID NO: 417538 - DNA, 16 bp, Homo sapiens
tatggaaagggtgtgg

SEQ ID NO: 417539 - DNA, 23 bp, Homo sapiens
tatggaaagggtgtggcttggaa

SEQ ID NO: 417540 - DNA, 22 bp, Homo sapiens
tatggaagggtttgtggctggg

SEQ ID NO: 417541 - DNA, 18 bp, Homo sapiens
tatggaattacatgtaaa

SEQ ID NO: 417542 - DNA, 15 bp, Homo sapiens
tatggagagaaaaca

SEQ ID NO: 417543 - DNA, 18 bp, Homo sapiens
tatggaggaacaactctc

SEQ ID NO: 417544 - DNA, 23 bp, Homo sapiens
tatggaggagagtgtttaactga

SEQ ID NO: 417545 - DNA, 14 bp, Homo sapiens
tatggaggattctt

SEQ ID NO: 417546 - DNA, 23 bp, Homo sapiens
tatggatatgtgtaaatgttatg

SEQ ID NO: 417547 - DNA, 21 bp, Homo sapiens
tatggatggggcccaggggct

SEQ ID NO: 417548 - DNA, 13 bp, Homo sapiens
tatggattcactt

SEQ ID NO: 417549 - DNA, 19 bp, Homo sapiens
tatggcctcagctgcctca

SEQ ID NO: 417550 - DNA, 14 bp, Homo sapiens
tatggcggaggcca

SEQ ID NO: 417551 - DNA, 20 bp, Homo sapiens
tatggctgtatttttagaga

SEQ ID NO: 417552 - DNA, 18 bp, Homo sapiens
tatggcttgtagggtgag

SEQ ID NO: 417553 - DNA, 14 bp, Homo sapiens
tatggctttgtgct

SEQ ID NO: 417554 - DNA, 19 bp, Homo sapiens
tatgggaacaagtgtacag

SEQ ID NO: 417555 - DNA, 18 bp, Homo sapiens
tatgggaagctctgtgtg

SEQ ID NO: 417556 - DNA, 19 bp, Homo sapiens
tatggggggccaacaccag

SEQ ID NO: 417557 - DNA, 13 bp, Homo sapiens
tattcacacacac

SEQ ID NO: 417558 - DNA, 14 bp, Homo sapiens
tattcacacacaca

SEQ ID NO: 417559 - DNA, 21 bp, Homo sapiens
tattcacgtgcagcagcaaca

SEQ ID NO: 417560 - DNA, 15 bp, Homo sapiens
tattcacttgtgttt

SEQ ID NO: 417561 - DNA, 19 bp, Homo sapiens
tattcagaatcaaaccttt

SEQ ID NO: 417562 - DNA, 21 bp, Homo sapiens
tattcagaatcaaaccttttt

SEQ ID NO: 417563 - DNA, 18 bp, Homo sapiens
tattcagaattatacaga

SEQ ID NO: 417564 - DNA, 14 bp, Homo sapiens
tattcagacaagca

SEQ ID NO: 417565 - DNA, 20 bp, Homo sapiens
tattcagagatgtaccatgt

SEQ ID NO: 417566 - DNA, 21 bp, Homo sapiens
tattcaggaccccatctgctg

SEQ ID NO: 417567 - DNA, 22 bp, Homo sapiens
tattcagtgccacaaattgaaa

SEQ ID NO: 417568 - DNA, 16 bp, Homo sapiens
tattcagttaagaaaa

SEQ ID NO: 417569 - DNA, 17 bp, Homo sapiens
tattcagttaagaaaaa

SEQ ID NO: 417570 - DNA, 21 bp, Homo sapiens
tattcagttaagaaaaaaata

SEQ ID NO: 417571 - DNA, 15 bp, Homo sapiens
tattcatacagcact

SEQ ID NO: 417572 - DNA, 17 bp, Homo sapiens
tattcatacctgttgta

SEQ ID NO: 417573 - DNA, 20 bp, Homo sapiens
tattcatagctgtatatttg

SEQ ID NO: 417574 - DNA, 14 bp, Homo sapiens
tattcatcaaactc

SEQ ID NO: 417575 - DNA, 20 bp, Homo sapiens
tattcattctgtgatcattt

SEQ ID NO: 417576 - DNA, 12 bp, Homo sapiens
tattcatttaaa

SEQ ID NO: 417577 - DNA, 14 bp, Homo sapiens
tattcatttaaaat

SEQ ID NO: 417578 - DNA, 16 bp, Homo sapiens
tattcatttaaaatga

SEQ ID NO: 417579 - DNA, 17 bp, Homo sapiens
tattcatttaaaatgat

SEQ ID NO: 417580 - DNA, 19 bp, Homo sapiens
tattcatttaaaatgatta

SEQ ID NO: 417581 - DNA, 14 bp, Homo sapiens
tattccaccttaaa

SEQ ID NO: 417582 - DNA, 18 bp, Homo sapiens
tattccaccttaaattaa

SEQ ID NO: 417583 - DNA, 22 bp, Homo sapiens
tattccatgaatgtatcaggaa

SEQ ID NO: 417584 - DNA, 23 bp, Homo sapiens
tattccatttttactaaagcagt

SEQ ID NO: 417585 - DNA, 14 bp, Homo sapiens
tattcccaggcagg

SEQ ID NO: 417586 - DNA, 23 bp, Homo sapiens
tattccctgaattgtttgatatt

SEQ ID NO: 417587 - DNA, 11 bp, Homo sapiens
tattcccttct

SEQ ID NO: 417588 - DNA, 11 bp, Homo sapiens
tattccctttg

SEQ ID NO: 417589 - DNA, 20 bp, Homo sapiens
tattccctttttaaatgagc

SEQ ID NO: 417590 - DNA, 14 bp, Homo sapiens
tattcctgaatgaa

SEQ ID NO: 417591 - DNA, 20 bp, Homo sapiens
tattcctgaatgaaatatca

SEQ ID NO: 417592 - DNA, 14 bp, Homo sapiens
tattccttctggcc

SEQ ID NO: 417593 - DNA, 15 bp, Homo sapiens
tattccttctggcct

SEQ ID NO: 417594 - DNA, 14 bp, Homo sapiens
tattccttggccca

SEQ ID NO: 417595 - DNA, 18 bp, Homo sapiens
tattccttggcccagcag

SEQ ID NO: 417596 - DNA, 21 bp, Homo sapiens
tattctaagccagttttcatt

SEQ ID NO: 417597 - DNA, 15 bp, Homo sapiens
tattctaataaatat

SEQ ID NO: 417598 - DNA, 16 bp, Homo sapiens
tattctaataaatata

SEQ ID NO: 417599 - DNA, 15 bp, Homo sapiens
tattctacatttcac

SEQ ID NO: 417600 - DNA, 19 bp, Homo sapiens
tattctagtcaactgctgt

SEQ ID NO: 417601 - DNA, 22 bp, Homo sapiens
tattctagtcaactgctgtttt

SEQ ID NO: 417602 - DNA, 15 bp, Homo sapiens
tattctataaacata

SEQ ID NO: 417603 - DNA, 15 bp, Homo sapiens
tattctatatgaatt

SEQ ID NO: 417604 - DNA, 19 bp, Homo sapiens
tattctattaactttaatt

SEQ ID NO: 417605 - DNA, 12 bp, Homo sapiens
tattctattgca

SEQ ID NO: 417606 - DNA, 22 bp, Homo sapiens
tattctattgtattatttggag

SEQ ID NO: 417607 - DNA, 18 bp, Homo sapiens
tattctattttagacttt

SEQ ID NO: 417608 - DNA, 13 bp, Homo sapiens
tattctctctatg

SEQ ID NO: 417609 - DNA, 19 bp, Homo sapiens
tattctctctatgcaaaat

SEQ ID NO: 417610 - DNA, 13 bp, Homo sapiens
tattctgagcctt

SEQ ID NO: 417611 - DNA, 22 bp, Homo sapiens
tattctgggctcctggaaccaa

SEQ ID NO: 417612 - DNA, 16 bp, Homo sapiens
tattctgtggattcta

SEQ ID NO: 417613 - DNA, 18 bp, Homo sapiens
tattctgtggattctata

SEQ ID NO: 417614 - DNA, 14 bp, Homo sapiens
tattcttaagcact

SEQ ID NO: 417615 - DNA, 18 bp, Homo sapiens
tattcttaagcactttga

SEQ ID NO: 417616 - DNA, 21 bp, Homo sapiens
tattcttaagcactttgaaaa

SEQ ID NO: 417617 - DNA, 15 bp, Homo sapiens
tattcttccttccca

SEQ ID NO: 417618 - DNA, 20 bp, Homo sapiens
tattcttcggaggaggtgga

SEQ ID NO: 417619 - DNA, 16 bp, Homo sapiens
tattcttgctgggcat

SEQ ID NO: 417620 - DNA, 19 bp, Homo sapiens
tattcttgtccacattcta

SEQ ID NO: 417621 - DNA, 19 bp, Homo sapiens
tattctttaattgttgctt

SEQ ID NO: 417622 - DNA, 18 bp, Homo sapiens
tattctttccatgcagtt

SEQ ID NO: 417623 - DNA, 23 bp, Homo sapiens
tattctttgaccaaactgtgggt

SEQ ID NO: 417624 - DNA, 13 bp, Homo sapiens
tattgaaaacttc

SEQ ID NO: 417625 - DNA, 22 bp, Homo sapiens
tattgaaaacttcaaagctgaa

SEQ ID NO: 417626 - DNA, 16 bp, Homo sapiens
tattgaattattttgt

SEQ ID NO: 417627 - DNA, 20 bp, Homo sapiens
tattgaattattttgttact

SEQ ID NO: 417628 - DNA, 15 bp, Homo sapiens
tattgaccatgtgat

SEQ ID NO: 417629 - DNA, 21 bp, Homo sapiens
tattgagatcagcattcaaaa

SEQ ID NO: 417630 - DNA, 15 bp, Homo sapiens
tattgagatgtaatt

SEQ ID NO: 417631 - DNA, 14 bp, Homo sapiens
tattgagtgtacat

SEQ ID NO: 417632 - DNA, 20 bp, Homo sapiens
tattgatatgcttatacact

SEQ ID NO: 417633 - DNA, 13 bp, Homo sapiens
tattgatgaaaag

SEQ ID NO: 417634 - DNA, 17 bp, Homo sapiens
tattgatgaaaagattt

SEQ ID NO: 417635 - DNA, 18 bp, Homo sapiens
tattgatgtgaaattaaa

SEQ ID NO: 417636 - DNA, 19 bp, Homo sapiens
tattgatgtgaaattaaat

SEQ ID NO: 417637 - DNA, 16 bp, Homo sapiens
tattgattgaaaaaag

SEQ ID NO: 417638 - DNA, 19 bp, Homo sapiens
tattgcaaataagactctt

SEQ ID NO: 417639 - DNA, 16 bp, Homo sapiens
tattgcccatgggata

SEQ ID NO: 417640 - DNA, 22 bp, Homo sapiens
tattgctgctggtaatttgtat

SEQ ID NO: 417641 - DNA, 18 bp, Homo sapiens
tattgctggaatctacta

SEQ ID NO: 417642 - DNA, 14 bp, Homo sapiens
tattgctgtaaata

SEQ ID NO: 417643 - DNA, 22 bp, Homo sapiens
tattggaaatttgttataatga

SEQ ID NO: 417644 - DNA, 19 bp, Homo sapiens
tattggaagtgttcaagaa

SEQ ID NO: 417645 - DNA, 15 bp, Homo sapiens
tattggaattaacct

SEQ ID NO: 417646 - DNA, 16 bp, Homo sapiens
tattggaattaacctg

SEQ ID NO: 417647 - DNA, 17 bp, Homo sapiens
tattggacagacacaga

SEQ ID NO: 417648 - DNA, 21 bp, Homo sapiens
tattggagggtaaatgatgtg

SEQ ID NO: 417649 - DNA, 11 bp, Homo sapiens
tattggccact

SEQ ID NO: 417650 - DNA, 19 bp, Homo sapiens
tattggccgatgagctggt

SEQ ID NO: 417651 - DNA, 17 bp, Homo sapiens
tattggtttctgtttga

SEQ ID NO: 417652 - DNA, 18 bp, Homo sapiens
tatatattataagttgac

SEQ ID NO: 417653 - DNA, 13 bp, Homo sapiens
tatatattatata

SEQ ID NO: 417654 - DNA, 17 bp, Homo sapiens
tatatattcttataaaa

SEQ ID NO: 417655 - DNA, 14 bp, Homo sapiens
tatatattgcatag

SEQ ID NO: 417656 - DNA, 13 bp, Homo sapiens
tatatatttataa

SEQ ID NO: 417657 - DNA, 14 bp, Homo sapiens
tatatattttgaaa

SEQ ID NO: 417658 - DNA, 19 bp, Homo sapiens
tatatattttgaaaggaga

SEQ ID NO: 417659 - DNA, 22 bp, Homo sapiens
tatatcaacagatagttgtgtt

SEQ ID NO: 417660 - DNA, 17 bp, Homo sapiens
tatatcaaggatgttct

SEQ ID NO: 417661 - DNA, 17 bp, Homo sapiens
tatatcatgaagccttg

SEQ ID NO: 417662 - DNA, 14 bp, Homo sapiens
tatatccatgtact

SEQ ID NO: 417663 - DNA, 15 bp, Homo sapiens
tatatccatgtactg

SEQ ID NO: 417664 - DNA, 18 bp, Homo sapiens
tatatccatgtactgtag

SEQ ID NO: 417665 - DNA, 16 bp, Homo sapiens
tatatcctttctaaca

SEQ ID NO: 417666 - DNA, 17 bp, Homo sapiens
tatatcctttctaacaa

SEQ ID NO: 417667 - DNA, 13 bp, Homo sapiens
tatatctatctat

SEQ ID NO: 417668 - DNA, 21 bp, Homo sapiens
tatatctggatttttacaaat

SEQ ID NO: 417669 - DNA, 17 bp, Homo sapiens
tatatctgttttactgc

SEQ ID NO: 417670 - DNA, 14 bp, Homo sapiens
tatatctttatact

SEQ ID NO: 417671 - DNA, 15 bp, Homo sapiens
tatatctttgcactg

SEQ ID NO: 417672 - DNA, 23 bp, Homo sapiens
tatatgaaaggcttctgggactt

SEQ ID NO: 417673 - DNA, 22 bp, Homo sapiens
tatatgaacttaacatgctgtg

SEQ ID NO: 417674 - DNA, 22 bp, Homo sapiens
tatatgaatttaaatataattc

SEQ ID NO: 417675 - DNA, 16 bp, Homo sapiens
tatatgatatgcatgt

SEQ ID NO: 417676 - DNA, 15 bp, Homo sapiens
tatatgatttatagt

SEQ ID NO: 417677 - DNA, 16 bp, Homo sapiens
tatatgatttatagtt

SEQ ID NO: 417678 - DNA, 10 bp, Homo sapiens
tatatgcacc

SEQ ID NO: 417679 - DNA, 14 bp, Homo sapiens
tatatgcataaaca

SEQ ID NO: 417680 - DNA, 18 bp, Homo sapiens
tatatgccttaagccaat

SEQ ID NO: 417681 - DNA, 14 bp, Homo sapiens
tatatgctactttt

SEQ ID NO: 417682 - DNA, 13 bp, Homo sapiens
tatatgtacagtt

SEQ ID NO: 417683 - DNA, 19 bp, Homo sapiens
tatatgtatatctttgcac

SEQ ID NO: 417684 - DNA, 12 bp, Homo sapiens
tatatgtatgta

SEQ ID NO: 417685 - DNA, 18 bp, Homo sapiens
tatatgtgcggcttttca

SEQ ID NO: 417686 - DNA, 19 bp, Homo sapiens
tatatgtgtgtgtatgttt

SEQ ID NO: 417687 - DNA, 22 bp, Homo sapiens
tatatgtgtgtgtatgtttgca

SEQ ID NO: 417688 - DNA, 15 bp, Homo sapiens
tatatgtgtgtttaa

SEQ ID NO: 417689 - DNA, 15 bp, Homo sapiens
tatatgttgtaataa

SEQ ID NO: 417690 - DNA, 14 bp, Homo sapiens
tatatgtttatata

SEQ ID NO: 417691 - DNA, 11 bp, Homo sapiens
tatatgtttta

SEQ ID NO: 417692 - DNA, 12 bp, Homo sapiens
tatatgttttga

SEQ ID NO: 417693 - DNA, 17 bp, Homo sapiens
tatatgttttgagaaaa

SEQ ID NO: 417694 - DNA, 17 bp, Homo sapiens
tatattacttttgtaaa

SEQ ID NO: 417695 - DNA, 20 bp, Homo sapiens
tatattacttttgtaaatat

SEQ ID NO: 417696 - DNA, 18 bp, Homo sapiens
tatattataagttgacct

SEQ ID NO: 417697 - DNA, 21 bp, Homo sapiens
tatattcagagatgtaccatg

SEQ ID NO: 417698 - DNA, 22 bp, Homo sapiens
tatattccgggtgccattccca

SEQ ID NO: 417699 - DNA, 20 bp, Homo sapiens
tatattgtttttatatatta

SEQ ID NO: 417700 - DNA, 15 bp, Homo sapiens
tatatttaacttcta

SEQ ID NO: 417701 - DNA, 20 bp, Homo sapiens
tatatttaagcaacatcttt

SEQ ID NO: 417702 - DNA, 17 bp, Homo sapiens
tatatttacaaataaaa

SEQ ID NO: 417703 - DNA, 16 bp, Homo sapiens
tatatttagttatagt

SEQ ID NO: 417704 - DNA, 18 bp, Homo sapiens
tatatttagttatagttt

SEQ ID NO: 417705 - DNA, 12 bp, Homo sapiens
tatatttataac

SEQ ID NO: 417706 - DNA, 15 bp, Homo sapiens
tatatttataactca

SEQ ID NO: 417707 - DNA, 21 bp, Homo sapiens
tatatttataactcatcataa

SEQ ID NO: 417708 - DNA, 22 bp, Homo sapiens
tatatttataactcatcataaa

SEQ ID NO: 417709 - DNA, 13 bp, Homo sapiens
tatatttatcata

SEQ ID NO: 417710 - DNA, 20 bp, Homo sapiens
tatatttgtttatgaaatgt

SEQ ID NO: 417711 - DNA, 14 bp, Homo sapiens
tatattttatactg

SEQ ID NO: 417712 - DNA, 21 bp, Homo sapiens
tatattttatactgcacttta

SEQ ID NO: 417713 - DNA, 14 bp, Homo sapiens
tatattttatcttg

SEQ ID NO: 417714 - DNA, 18 bp, Homo sapiens
tatatttttaataaaagt

SEQ ID NO: 417715 - DNA, 15 bp, Homo sapiens
tatatttttgtttgt

SEQ ID NO: 417716 - DNA, 22 bp, Homo sapiens
tatattttttaatttgatgaaa

SEQ ID NO: 417717 - DNA, 23 bp, Homo sapiens
tatcaaaaaggagctcttcttgt

SEQ ID NO: 417718 - DNA, 19 bp, Homo sapiens
tatcaaactcgtctgatgt

SEQ ID NO: 417719 - DNA, 16 bp, Homo sapiens
tatcaaatctgtatat

SEQ ID NO: 417720 - DNA, 22 bp, Homo sapiens
tatcaaatctgtatatgttgta

SEQ ID NO: 417721 - DNA, 23 bp, Homo sapiens
tatcaacaacaagttgtttcaaa

SEQ ID NO: 417722 - DNA, 21 bp, Homo sapiens
tatcaacatctttttcctccc

SEQ ID NO: 417723 - DNA, 19 bp, Homo sapiens
tatcaacttaattctgtta

SEQ ID NO: 417724 - DNA, 13 bp, Homo sapiens
tatcaagcccctg

SEQ ID NO: 417725 - DNA, 16 bp, Homo sapiens
tatcaagcccctgtct

SEQ ID NO: 417726 - DNA, 23 bp, Homo sapiens
tatcaagctaataaaatatcatt

SEQ ID NO: 417727 - DNA, 16 bp, Homo sapiens
tatcaaggctgcctgg

SEQ ID NO: 417728 - DNA, 19 bp, Homo sapiens
tatcaaggctgcctggaga

SEQ ID NO: 417729 - DNA, 20 bp, Homo sapiens
tatcaaggctgcctggagaa

SEQ ID NO: 417730 - DNA, 15 bp, Homo sapiens
tcacaccctgcaagg

SEQ ID NO: 417731 - DNA, 23 bp, Homo sapiens
tcacaccctgcaaggcccacagg

SEQ ID NO: 417732 - DNA, 15 bp, Homo sapiens
tcacacctctgggct

SEQ ID NO: 417733 - DNA, 16 bp, Homo sapiens
tcacactctcttctta

SEQ ID NO: 417734 - DNA, 14 bp, Homo sapiens
tcacactgctggga

SEQ ID NO: 417735 - DNA, 16 bp, Homo sapiens
tcacactgctgggaag

SEQ ID NO: 417736 - DNA, 18 bp, Homo sapiens
tcacactgtggaacacta

SEQ ID NO: 417737 - DNA, 22 bp, Homo sapiens
tcacactgtggaacactaaaga

SEQ ID NO: 417738 - DNA, 22 bp, Homo sapiens
tcacacttctgtgagaccccca

SEQ ID NO: 417739 - DNA, 23 bp, Homo sapiens
tcacacttctgtgagacccccac

SEQ ID NO: 417740 - DNA, 13 bp, Homo sapiens
tcacagaggcagt

SEQ ID NO: 417741 - DNA, 20 bp, Homo sapiens
tcacagatgggtattaaact

SEQ ID NO: 417742 - DNA, 12 bp, Homo sapiens
tcaccttttcta

SEQ ID NO: 417743 - DNA, 13 bp, Homo sapiens
tcaccttttctaa

SEQ ID NO: 417744 - DNA, 14 bp, Homo sapiens
tcacgactcttcct

SEQ ID NO: 417745 - DNA, 16 bp, Homo sapiens
tcacgagatcttcctt

SEQ ID NO: 417746 - DNA, 17 bp, Homo sapiens
tccctgggcctgtctca

SEQ ID NO: 417747 - DNA, 18 bp, Homo sapiens
tccctgggcctgtctcag

SEQ ID NO: 417748 - DNA, 23 bp, Homo sapiens
tccctgggcctgtctcagattgg

SEQ ID NO: 417749 - DNA, 17 bp, Homo sapiens
tccctggggaccaggag

SEQ ID NO: 417750 - DNA, 19 bp, Homo sapiens
tccctggggaccaggagct

SEQ ID NO: 417751 - DNA, 20 bp, Homo sapiens
tccctggggaccaggagcta

SEQ ID NO: 417752 - DNA, 21 bp, Homo sapiens
tccctggggaccaggagctag

SEQ ID NO: 417753 - DNA, 19 bp, Homo sapiens
tccctgggggtcccaggat

SEQ ID NO: 417754 - DNA, 22 bp, Homo sapiens
tccctggtccctcgtccacagg

SEQ ID NO: 417755 - DNA, 13 bp, Homo sapiens
tccctggtccctt

SEQ ID NO: 417756 - DNA, 17 bp, Homo sapiens
tccctgtaggagtaaag

SEQ ID NO: 417757 - DNA, 20 bp, Homo sapiens
tccctgtaggagtaaagata

SEQ ID NO: 417758 - DNA, 21 bp, Homo sapiens
tcctaccctcccaccagaacg

SEQ ID NO: 417759 - DNA, 22 bp, Homo sapiens
tcctacctggtcaacccgctgc

SEQ ID NO: 417760 - DNA, 20 bp, Homo sapiens
tcctaccttttgataaaatg

SEQ ID NO: 417761 - DNA, 14 bp, Homo sapiens
tcctacggagggac

SEQ ID NO: 417762 - DNA, 17 bp, Homo sapiens
tcctactcctacctggt

SEQ ID NO: 417763 - DNA, 16 bp, Homo sapiens
tcctacttaaacaaaa

SEQ ID NO: 417764 - DNA, 16 bp, Homo sapiens
tcctagacttgaaagt

SEQ ID NO: 417765 - DNA, 17 bp, Homo sapiens
tcctagagcatctgtcc

SEQ ID NO: 417766 - DNA, 20 bp, Homo sapiens
tcctagagcatctgtcccac

SEQ ID NO: 417767 - DNA, 22 bp, Homo sapiens
tcctagagcatctgtcccactg

SEQ ID NO: 417768 - DNA, 14 bp, Homo sapiens
tcctagaggacctg

SEQ ID NO: 417769 - DNA, 15 bp, Homo sapiens
tcctagaggacctga

SEQ ID NO: 417770 - DNA, 22 bp, Homo sapiens
tcctagcactttgggaggctga

SEQ ID NO: 417771 - DNA, 15 bp, Homo sapiens
tcctagctgtgtgca

SEQ ID NO: 417772 - DNA, 13 bp, Homo sapiens
tcctagcttatct

SEQ ID NO: 417773 - DNA, 20 bp, Homo sapiens
tcctagcttatctccctgct

SEQ ID NO: 417774 - DNA, 19 bp, Homo sapiens
tcctaggagagccaacctc

SEQ ID NO: 417775 - DNA, 23 bp, Homo sapiens
tcctaggagagccaacctcggct

SEQ ID NO: 417776 - DNA, 13 bp, Homo sapiens
tcctaggcctcag

SEQ ID NO: 417777 - DNA, 20 bp, Homo sapiens
tcctagggaaaagttcatag

SEQ ID NO: 417778 - DNA, 23 bp, Homo sapiens
tcctaggggtgcgctcacctgca

SEQ ID NO: 417779 - DNA, 18 bp, Homo sapiens
tcctagttccattcttgg

SEQ ID NO: 417780 - DNA, 16 bp, Homo sapiens
tcctagttcttcatcc

SEQ ID NO: 417781 - DNA, 14 bp, Homo sapiens
tcctataaatgtga

SEQ ID NO: 417782 - DNA, 17 bp, Homo sapiens
tcctatacatttctgtt

SEQ ID NO: 417783 - DNA, 20 bp, Homo sapiens
tcctatcaagccagtacgtg

SEQ ID NO: 417784 - DNA, 17 bp, Homo sapiens
tcctatcacctcccctc

SEQ ID NO: 417785 - DNA, 14 bp, Homo sapiens
tcctatcttttatt

SEQ ID NO: 417786 - DNA, 16 bp, Homo sapiens
tcctatgcccaggtac

SEQ ID NO: 417787 - DNA, 20 bp, Homo sapiens
tcctatggagcctctgcaga

SEQ ID NO: 417788 - DNA, 16 bp, Homo sapiens
tcctatgtcatttcta

SEQ ID NO: 417789 - DNA, 16 bp, Homo sapiens
tcctattaatcttcag

SEQ ID NO: 417790 - DNA, 16 bp, Homo sapiens
tcctatttgttttcat

SEQ ID NO: 417791 - DNA, 22 bp, Homo sapiens
tcctcaaaagaaagagaaatga

SEQ ID NO: 417792 - DNA, 13 bp, Homo sapiens
tcctcaaccttga

SEQ ID NO: 417793 - DNA, 13 bp, Homo sapiens
tcctcacaagcct

SEQ ID NO: 417794 - DNA, 14 bp, Homo sapiens
tcctcacagcctag

SEQ ID NO: 417795 - DNA, 14 bp, Homo sapiens
tcctcacatgcccg

SEQ ID NO: 417796 - DNA, 23 bp, Homo sapiens
tcctcacatgcccgctgtcccag

SEQ ID NO: 417797 - DNA, 15 bp, Homo sapiens
tcctcaccaataact

SEQ ID NO: 417798 - DNA, 16 bp, Homo sapiens
tcctcaccaataactt

SEQ ID NO: 417799 - DNA, 17 bp, Homo sapiens
tcctcaccaataacttc

SEQ ID NO: 417800 - DNA, 20 bp, Homo sapiens
tcctcaccaataacttcaga

SEQ ID NO: 417801 - DNA, 14 bp, Homo sapiens
tcctcaccttaatt

SEQ ID NO: 417802 - DNA, 18 bp, Homo sapiens
tcctcaccttctgtttta

SEQ ID NO: 417803 - DNA, 19 bp, Homo sapiens
tcctcactatttttttgtt

SEQ ID NO: 417804 - DNA, 14 bp, Homo sapiens
tcctcactcccagt

SEQ ID NO: 417805 - DNA, 17 bp, Homo sapiens
tcctcactcccagtcca

SEQ ID NO: 417806 - DNA, 21 bp, Homo sapiens
tcctcacttccatacagctct

SEQ ID NO: 417807 - DNA, 13 bp, Homo sapiens
tcctcagccccag

SEQ ID NO: 417808 - DNA, 14 bp, Homo sapiens
tcctcagccccagg

SEQ ID NO: 417809 - DNA, 15 bp, Homo sapiens
tcctcagccccaggg

SEQ ID NO: 417810 - DNA, 17 bp, Homo sapiens
tcctcagccccagggcc

SEQ ID NO: 417811 - DNA, 12 bp, Homo sapiens
tcctcagctgcc

SEQ ID NO: 417812 - DNA, 14 bp, Homo sapiens
tcctcagctgccaa

SEQ ID NO: 417813 - DNA, 20 bp, Homo sapiens
tcctcagctgccaagcactc

SEQ ID NO: 417814 - DNA, 19 bp, Homo sapiens
tcctcaggctgctggagga

SEQ ID NO: 417815 - DNA, 15 bp, Homo sapiens
tcctcatatggccca

SEQ ID NO: 417816 - DNA, 14 bp, Homo sapiens
tcctcatcctgctt

SEQ ID NO: 417817 - DNA, 19 bp, Homo sapiens
tcctcattgtaaacaaact

SEQ ID NO: 417818 - DNA, 18 bp, Homo sapiens
tcctcatttgttcattaa

SEQ ID NO: 417819 - DNA, 22 bp, Homo sapiens
tcctcatttgttcattaaacgt

SEQ ID NO: 417820 - DNA, 11 bp, Homo sapiens
tcctccaaaac

SEQ ID NO: 417821 - DNA, 19 bp, Homo sapiens
tcctccaaactcctgcctg

SEQ ID NO: 417822 - DNA, 14 bp, Homo sapiens
tcctccaaagcctg

SEQ ID NO: 417823 - DNA, 22 bp, Homo sapiens
tcctccaacgttaaaagacagt

SEQ ID NO: 417824 - DNA, 23 bp, Homo sapiens
tcctccaacgttaaaagacagtg

SEQ ID NO: 417825 - DNA, 17 bp, Homo sapiens
tcctccaagaagccctc

SEQ ID NO: 417826 - DNA, 22 bp, Homo sapiens
tcctccaccggtgcctcctctg

SEQ ID NO: 417827 - DNA, 18 bp, Homo sapiens
tcctccagaagcctctgg

SEQ ID NO: 417828 - DNA, 22 bp, Homo sapiens
tcctccagaagcctctggctag

SEQ ID NO: 417829 - DNA, 14 bp, Homo sapiens
tcctccagcctccc

SEQ ID NO: 417830 - DNA, 17 bp, Homo sapiens
tcctccagcctcccctc

SEQ ID NO: 417831 - DNA, 23 bp, Homo sapiens
tcctccagcctcccctcccctgg

SEQ ID NO: 417832 - DNA, 16 bp, Homo sapiens
tcctccagggggcctg

SEQ ID NO: 417833 - DNA, 23 bp, Homo sapiens
tcctccagggggcctgcaggccc

SEQ ID NO: 417834 - DNA, 15 bp, Homo sapiens
tcctccagtctgttc

SEQ ID NO: 417835 - DNA, 16 bp, Homo sapiens
tcctccattgtatctt

SEQ ID NO: 417836 - DNA, 17 bp, Homo sapiens
tcctcccaactctggcc

SEQ ID NO: 417837 - DNA, 19 bp, Homo sapiens
tcctcccaggcgccccttc

SEQ ID NO: 417838 - DNA, 21 bp, Homo sapiens
tcctcccaggcgccccttccc

SEQ ID NO: 417839 - DNA, 15 bp, Homo sapiens
tcctcccatctcctt

SEQ ID NO: 417840 - DNA, 13 bp, Homo sapiens
tcctcccatggcc

SEQ ID NO: 417841 - DNA, 23 bp, Homo sapiens
tcctccccaccagtctcacccac

SEQ ID NO: 417842 - DNA, 16 bp, Homo sapiens
tcctcccctcctcttc

SEQ ID NO: 417843 - DNA, 13 bp, Homo sapiens
tcctccccttggg

SEQ ID NO: 417844 - DNA, 14 bp, Homo sapiens
tcctcccgggccct

SEQ ID NO: 417845 - DNA, 21 bp, Homo sapiens
tcctcccgggccctcccttgg

SEQ ID NO: 417846 - DNA, 22 bp, Homo sapiens
tcctcccgggccctcccttgga

SEQ ID NO: 417847 - DNA, 19 bp, Homo sapiens
tcctcccgttgcggggtgg

SEQ ID NO: 417848 - DNA, 20 bp, Homo sapiens
tcctccctcatggctctggc

SEQ ID NO: 417849 - DNA, 20 bp, Homo sapiens
tcctcccttgggttctgata

SEQ ID NO: 417850 - DNA, 18 bp, Homo sapiens
tcctccgctcccctttcc

SEQ ID NO: 417851 - DNA, 14 bp, Homo sapiens
tcctccgtccaccc

SEQ ID NO: 417852 - DNA, 18 bp, Homo sapiens
tcctccgtccacccaggc

SEQ ID NO: 417853 - DNA, 20 bp, Homo sapiens
tcctccgtccacccaggctg

SEQ ID NO: 417854 - DNA, 16 bp, Homo sapiens
tcctccgtccagccgc

SEQ ID NO: 417855 - DNA, 20 bp, Homo sapiens
tcctcctcagtcttctcagt

SEQ ID NO: 417856 - DNA, 15 bp, Homo sapiens
tcctcctccacagtg

SEQ ID NO: 417857 - DNA, 16 bp, Homo sapiens
tcctcctccacagtgc

SEQ ID NO: 417858 - DNA, 20 bp, Homo sapiens
tcctcctccacagtgctgct

SEQ ID NO: 417859 - DNA, 16 bp, Homo sapiens
tcctcctcctgttcct

SEQ ID NO: 417860 - DNA, 13 bp, Homo sapiens
tcctcctgatggc

SEQ ID NO: 417861 - DNA, 20 bp, Homo sapiens
tcctcctgatggccaagagc

SEQ ID NO: 417862 - DNA, 12 bp, Homo sapiens
tcctcctgccct

SEQ ID NO: 417863 - DNA, 13 bp, Homo sapiens
tcctcctggaccc

SEQ ID NO: 417864 - DNA, 23 bp, Homo sapiens
tcctcctggacccagcaggggca

SEQ ID NO: 417865 - DNA, 18 bp, Homo sapiens
tcctcctgttcctgcctt

SEQ ID NO: 417866 - DNA, 19 bp, Homo sapiens
tcctccttcactccctgtc

SEQ ID NO: 417867 - DNA, 23 bp, Homo sapiens
tcctccttgcccagactacaggg

SEQ ID NO: 417868 - DNA, 13 bp, Homo sapiens
tcctcgcctgaca

SEQ ID NO: 417869 - DNA, 24 bp, Homo sapiens
tcctcgcctgacaaccactggtct

SEQ ID NO: 417870 - DNA, 12 bp, Homo sapiens
tcctcgctgtgc

SEQ ID NO: 417871 - DNA, 15 bp, Homo sapiens
tcctcgctgtgccac

SEQ ID NO: 417872 - DNA, 18 bp, Homo sapiens
tcctcgctgtgccaccac

SEQ ID NO: 417873 - DNA, 14 bp, Homo sapiens
tcctcggccagagc

SEQ ID NO: 417874 - DNA, 22 bp, Homo sapiens
tcctcgggcgcctgcgctcctc

SEQ ID NO: 417875 - DNA, 18 bp, Homo sapiens
tcctctacttaatgagat

SEQ ID NO: 417876 - DNA, 13 bp, Homo sapiens
tcctctatttctt

SEQ ID NO: 417877 - DNA, 14 bp, Homo sapiens
tcctctatttcttt

SEQ ID NO: 417878 - DNA, 16 bp, Homo sapiens
tcctctcagaactcct

SEQ ID NO: 417879 - DNA, 19 bp, Homo sapiens
tcctctcagaactcctgtg

SEQ ID NO: 417880 - DNA, 17 bp, Homo sapiens
tcctctcagttctctcc

SEQ ID NO: 417881 - DNA, 12 bp, Homo sapiens
tcctctccactg

SEQ ID NO: 417882 - DNA, 17 bp, Homo sapiens
tcctctccactgccttc

SEQ ID NO: 417883 - DNA, 18 bp, Homo sapiens
tcctctccactgccttcg

SEQ ID NO: 417884 - DNA, 13 bp, Homo sapiens
tcctctccagccc

SEQ ID NO: 417885 - DNA, 17 bp, Homo sapiens
tcctctcccaagtccac

SEQ ID NO: 417886 - DNA, 19 bp, Homo sapiens
tcctctcctgcccagctct

SEQ ID NO: 417887 - DNA, 20 bp, Homo sapiens
tcctctccttgggctcctgg

SEQ ID NO: 417888 - DNA, 18 bp, Homo sapiens
tcctctcggctggaagaa

SEQ ID NO: 417889 - DNA, 20 bp, Homo sapiens
tcctctcggctggaagaaca

SEQ ID NO: 417890 - DNA, 23 bp, Homo sapiens
tcctctcggctggaagaacatca

SEQ ID NO: 417891 - DNA, 17 bp, Homo sapiens
tcctctctatctttttt

SEQ ID NO: 417892 - DNA, 15 bp, Homo sapiens
tcaggtaaactgatg

SEQ ID NO: 417893 - DNA, 15 bp, Homo sapiens
tcaggtaggcccttg

SEQ ID NO: 417894 - DNA, 21 bp, Homo sapiens
tcaggtattgattgaaaaaag

SEQ ID NO: 417895 - DNA, 11 bp, Homo sapiens
tcaggtgccac

SEQ ID NO: 417896 - DNA, 19 bp, Homo sapiens
tcaggtggaacaggaggaa

SEQ ID NO: 417897 - DNA, 14 bp, Homo sapiens
tcaggtgttgccaa

SEQ ID NO: 417898 - DNA, 13 bp, Homo sapiens
tcaggttccaaat

SEQ ID NO: 417899 - DNA, 14 bp, Homo sapiens
tcaggttccatccc

SEQ ID NO: 417900 - DNA, 17 bp, Homo sapiens
tcaggttgttctgtata

SEQ ID NO: 417901 - DNA, 18 bp, Homo sapiens
tcaggttgttctgtataa

SEQ ID NO: 417902 - DNA, 13 bp, Homo sapiens
tcaggtttggggt

SEQ ID NO: 417903 - DNA, 19 bp, Homo sapiens
tcaggtttgtcatcagatg

SEQ ID NO: 417904 - DNA, 13 bp, Homo sapiens
tcagtaataaaac

SEQ ID NO: 417905 - DNA, 19 bp, Homo sapiens
tcagtacacccaattttaa

SEQ ID NO: 417906 - DNA, 20 bp, Homo sapiens
tcagtacacttggtgtactg

SEQ ID NO: 417907 - DNA, 18 bp, Homo sapiens
tcagtacccacctgagct

SEQ ID NO: 417908 - DNA, 22 bp, Homo sapiens
tcagtacccacctgagctttgg

SEQ ID NO: 417909 - DNA, 19 bp, Homo sapiens
tcagtagacctgattttca

SEQ ID NO: 417910 - DNA, 20 bp, Homo sapiens
tcagtaggtccaagggccat

SEQ ID NO: 417911 - DNA, 18 bp, Homo sapiens
tcagtagtgcctgtgatc

SEQ ID NO: 417912 - DNA, 14 bp, Homo sapiens
tcagtatcaaggct

SEQ ID NO: 417913 - DNA, 18 bp, Homo sapiens
tcagtatcaaggctgcct

SEQ ID NO: 417914 - DNA, 16 bp, Homo sapiens
tcagtatgaagacact

SEQ ID NO: 417915 - DNA, 19 bp, Homo sapiens
tcagtattaaactctcctt

SEQ ID NO: 417916 - DNA, 23 bp, Homo sapiens
tcagtattaaactctcctttgat

SEQ ID NO: 417917 - DNA, 18 bp, Homo sapiens
tcagtattgagacactgt

SEQ ID NO: 417918 - DNA, 20 bp, Homo sapiens
tcagtattgagacactgtca

SEQ ID NO: 417919 - DNA, 21 bp, Homo sapiens
tcagtattgagacactgtcaa

SEQ ID NO: 417920 - DNA, 19 bp, Homo sapiens
tcagtattttggagaaatt

SEQ ID NO: 417921 - DNA, 20 bp, Homo sapiens
tcagtattttggagaaatta

SEQ ID NO: 417922 - DNA, 22 bp, Homo sapiens
tcagtcagttcccggagcacag

SEQ ID NO: 417923 - DNA, 15 bp, Homo sapiens
tcagtcatcatctca

SEQ ID NO: 417924 - DNA, 23 bp, Homo sapiens
tcagtccacccccattgtgaatg

SEQ ID NO: 417925 - DNA, 14 bp, Homo sapiens
tcagtcccaaagcg

SEQ ID NO: 417926 - DNA, 22 bp, Homo sapiens
tcagtcccaaagcggccgatgg

SEQ ID NO: 417927 - DNA, 19 bp, Homo sapiens
tcagtccctccctcctggc

SEQ ID NO: 417928 - DNA, 20 bp, Homo sapiens
tcagtccctccctcctggct

SEQ ID NO: 417929 - DNA, 21 bp, Homo sapiens
tcagtccctccctcctggctc

SEQ ID NO: 417930 - DNA, 20 bp, Homo sapiens
tcagtccctgagcagtctac

SEQ ID NO: 417931 - DNA, 13 bp, Homo sapiens
tcagtctctgcag

SEQ ID NO: 417932 - DNA, 23 bp, Homo sapiens
tcagtcttcacttgcactggggg

SEQ ID NO: 417933 - DNA, 14 bp, Homo sapiens
tcagtctttgtcaa

SEQ ID NO: 417934 - DNA, 22 bp, Homo sapiens
tcagtgaactaatttggttttt

SEQ ID NO: 417935 - DNA, 19 bp, Homo sapiens
tcagtgaagcccaggagga

SEQ ID NO: 417936 - DNA, 11 bp, Homo sapiens
tcagtgacaga

SEQ ID NO: 417937 - DNA, 15 bp, Homo sapiens
tcagtgacagagttc

SEQ ID NO: 417938 - DNA, 22 bp, Homo sapiens
tcagtgagcccctccccagcca

SEQ ID NO: 417939 - DNA, 17 bp, Homo sapiens
tcagtgaggcccaggga

SEQ ID NO: 417940 - DNA, 14 bp, Homo sapiens
tcagtgatgggagt

SEQ ID NO: 417941 - DNA, 15 bp, Homo sapiens
tcagtgatgggagta

SEQ ID NO: 417942 - DNA, 23 bp, Homo sapiens
tcagtgcagcccgtgtggcccct

SEQ ID NO: 417943 - DNA, 21 bp, Homo sapiens
tcagtgccaagtctcaggagg

SEQ ID NO: 417944 - DNA, 16 bp, Homo sapiens
tcagtgccacctatgc

SEQ ID NO: 417945 - DNA, 20 bp, Homo sapiens
tcagtgccacctatgcctgt

SEQ ID NO: 417946 - DNA, 15 bp, Homo sapiens
tcagtgccacttgac

SEQ ID NO: 417947 - DNA, 21 bp, Homo sapiens
tcagtgccacttgacattcct

SEQ ID NO: 417948 - DNA, 12 bp, Homo sapiens
tcagtgcctcct

SEQ ID NO: 417949 - DNA, 22 bp, Homo sapiens
tcagtgctttctcaaaatttga

SEQ ID NO: 417950 - DNA, 22 bp, Homo sapiens
tcctggaggatgaccaggacta

SEQ ID NO: 417951 - DNA, 14 bp, Homo sapiens
tcctggagttctgg

SEQ ID NO: 417952 - DNA, 16 bp, Homo sapiens
tcctggataaaaaaga

SEQ ID NO: 417953 - DNA, 22 bp, Homo sapiens
tcctggcaatagtgtgttctga

SEQ ID NO: 417954 - DNA, 23 bp, Homo sapiens
tcctggcaatagtgtgttctgat

SEQ ID NO: 417955 - DNA, 19 bp, Homo sapiens
tcctggcagggcaggcaga

SEQ ID NO: 417956 - DNA, 20 bp, Homo sapiens
tcctggcagggcaggcagag

SEQ ID NO: 417957 - DNA, 22 bp, Homo sapiens
tcctggcagggcaggcagagct

SEQ ID NO: 417958 - DNA, 18 bp, Homo sapiens
tcctggcccctccagacc

SEQ ID NO: 417959 - DNA, 21 bp, Homo sapiens
tcctggcctcaagccatcttc

SEQ ID NO: 417960 - DNA, 22 bp, Homo sapiens
tcctggcctcaagccatcttcc

SEQ ID NO: 417961 - DNA, 18 bp, Homo sapiens
tcctggcctcactggctg

SEQ ID NO: 417962 - DNA, 23 bp, Homo sapiens
tcctggcctcactggctggggca

SEQ ID NO: 417963 - DNA, 14 bp, Homo sapiens
tcctggctacatcc

SEQ ID NO: 417964 - DNA, 18 bp, Homo sapiens
tcctggctacatcccagc

SEQ ID NO: 417965 - DNA, 19 bp, Homo sapiens
tcctggctcacagccacca

SEQ ID NO: 417966 - DNA, 16 bp, Homo sapiens
tcctggctcctgaggg

SEQ ID NO: 417967 - DNA, 13 bp, Homo sapiens
tcctggctgtgca

SEQ ID NO: 417968 - DNA, 17 bp, Homo sapiens
tcctggctttgacatga

SEQ ID NO: 417969 - DNA, 22 bp, Homo sapiens
tcctgggaaggagggagctgct

SEQ ID NO: 417970 - DNA, 16 bp, Homo sapiens
tcctgggcagcccaga

SEQ ID NO: 417971 - DNA, 18 bp, Homo sapiens
tcctgggcagcccagaga

SEQ ID NO: 417972 - DNA, 19 bp, Homo sapiens
tcctgggcagcccagagag

SEQ ID NO: 417973 - DNA, 23 bp, Homo sapiens
tcctgggccagggtctcgtcagg

SEQ ID NO: 417974 - DNA, 16 bp, Homo sapiens
tcctgggcccaggcag

SEQ ID NO: 417975 - DNA, 14 bp, Homo sapiens
tcctgggcccctcc

SEQ ID NO: 417976 - DNA, 16 bp, Homo sapiens
tcctgggcccctccct

SEQ ID NO: 417977 - DNA, 17 bp, Homo sapiens
tcctgggcccctcccta

SEQ ID NO: 417978 - DNA, 18 bp, Homo sapiens
tcctgggcccctccctac

SEQ ID NO: 417979 - DNA, 13 bp, Homo sapiens
tcctgggctcagg

SEQ ID NO: 417980 - DNA, 17 bp, Homo sapiens
tcctggggccccgctgg

SEQ ID NO: 417981 - DNA, 14 bp, Homo sapiens
tcctggggctccct

SEQ ID NO: 417982 - DNA, 23 bp, Homo sapiens
tcctggggctgggtgtgtttcag

SEQ ID NO: 417983 - DNA, 22 bp, Homo sapiens
tcctgggggttctttcttcctc

SEQ ID NO: 417984 - DNA, 23 bp, Homo sapiens
tcctggggtataaaactttcctc

SEQ ID NO: 417985 - DNA, 18 bp, Homo sapiens
tcctgggtgagtttttct

SEQ ID NO: 417986 - DNA, 19 bp, Homo sapiens
tcctgggtgagtttttctt

SEQ ID NO: 417987 - DNA, 16 bp, Homo sapiens
tcctggtagcatgacc

SEQ ID NO: 417988 - DNA, 21 bp, Homo sapiens
tcctggtgaggcccagcctgt

SEQ ID NO: 417989 - DNA, 22 bp, Homo sapiens
tcctggtgaggcccagcctgtc

SEQ ID NO: 417990 - DNA, 18 bp, Homo sapiens
tcctggtggggctgagcc

SEQ ID NO: 417991 - DNA, 21 bp, Homo sapiens
tcctgtaaacactcagctgtt

SEQ ID NO: 417992 - DNA, 22 bp, Homo sapiens
tcctgtaatcacaactcagcat

SEQ ID NO: 417993 - DNA, 12 bp, Homo sapiens
tcctgtacaagt

SEQ ID NO: 417994 - DNA, 17 bp, Homo sapiens
tcctgtacactgaatat

SEQ ID NO: 417995 - DNA, 21 bp, Homo sapiens
tcctgtacactgaatatttat

SEQ ID NO: 417996 - DNA, 20 bp, Homo sapiens
tcctgtacattgtgggatgt

SEQ ID NO: 417997 - DNA, 18 bp, Homo sapiens
tcctgtagccactggcat

SEQ ID NO: 417998 - DNA, 17 bp, Homo sapiens
tcctgtcaatgtttgct

SEQ ID NO: 417999 - DNA, 12 bp, Homo sapiens
tcctgtccactc

SEQ ID NO: 418000 - DNA, 14 bp, Homo sapiens
tcctgtcccagagg

SEQ ID NO: 418001 - DNA, 15 bp, Homo sapiens
tcctgtcccagaggt

SEQ ID NO: 418002 - DNA, 21 bp, Homo sapiens
tcctgtcccttctcttaattt

SEQ ID NO: 418003 - DNA, 17 bp, Homo sapiens
tcctgtcctgctcacgt

SEQ ID NO: 418004 - DNA, 14 bp, Homo sapiens
tcctgtctccaaga

SEQ ID NO: 418005 - DNA, 24 bp, Homo sapiens
tcctgtctccaagaatgttttgct

SEQ ID NO: 418006 - DNA, 11 bp, Homo sapiens
tcctgtctccc

SEQ ID NO: 418007 - DNA, 13 bp, Homo sapiens
tcctgtctcccct

SEQ ID NO: 418008 - DNA, 16 bp, Homo sapiens
tcctgtctcccctctg

SEQ ID NO: 418009 - DNA, 18 bp, Homo sapiens
tcctgtctcctctgtcag

SEQ ID NO: 418010 - DNA, 16 bp, Homo sapiens
tcctgtctggctcgga

SEQ ID NO: 418011 - DNA, 16 bp, Homo sapiens
tcctgtcttttcaggt

SEQ ID NO: 418012 - DNA, 18 bp, Homo sapiens
tcctgtgcatgggtgaag

SEQ ID NO: 418013 - DNA, 20 bp, Homo sapiens
tcctgtgcatgggtgaaggg

SEQ ID NO: 418014 - DNA, 17 bp, Homo sapiens
tcctgtgcccacatccc

SEQ ID NO: 418015 - DNA, 14 bp, Homo sapiens
tcctgtgctttctg

SEQ ID NO: 418016 - DNA, 18 bp, Homo sapiens
tcctgtgtaatcatttct

SEQ ID NO: 418017 - DNA, 14 bp, Homo sapiens
tcctgtgtcatctg

SEQ ID NO: 418018 - DNA, 18 bp, Homo sapiens
tcctgtgtcatctgtcag

SEQ ID NO: 418019 - DNA, 14 bp, Homo sapiens
tcctgtgtcccctg

SEQ ID NO: 418020 - DNA, 23 bp, Homo sapiens
tcctgtgtcccctgacctgtcca

SEQ ID NO: 418021 - DNA, 20 bp, Homo sapiens
tcctgttaacactgtaatat

SEQ ID NO: 418022 - DNA, 20 bp, Homo sapiens
tcctgttaaccctccacctc

SEQ ID NO: 418023 - DNA, 15 bp, Homo sapiens
tcctgttcctgcctt

SEQ ID NO: 418024 - DNA, 17 bp, Homo sapiens
tcctgttcctgccttct

SEQ ID NO: 418025 - DNA, 19 bp, Homo sapiens
tcctgttcctgccttctct

SEQ ID NO: 418026 - DNA, 16 bp, Homo sapiens
tcctgttctcagagct

SEQ ID NO: 418027 - DNA, 17 bp, Homo sapiens
tcctgttctgtgtctgc

SEQ ID NO: 418028 - DNA, 23 bp, Homo sapiens
tcctgttgccacactttcactgg

SEQ ID NO: 418029 - DNA, 18 bp, Homo sapiens
tcctgtttaactccctag

SEQ ID NO: 418030 - DNA, 14 bp, Homo sapiens
tcctgtttctaagt

SEQ ID NO: 418031 - DNA, 14 bp, Homo sapiens
tcctgtttgcaggc

SEQ ID NO: 418032 - DNA, 15 bp, Homo sapiens
tcctgtttgcaggcc

SEQ ID NO: 418033 - DNA, 23 bp, Homo sapiens
tccttaaacagggcatctccagg

SEQ ID NO: 418034 - DNA, 14 bp, Homo sapiens
tccttaaactgtgt

SEQ ID NO: 418035 - DNA, 23 bp, Homo sapiens
tccttaaactgtgtggactgtga

SEQ ID NO: 418036 - DNA, 22 bp, Homo sapiens
tccttaaaggcaccatctaata

SEQ ID NO: 418037 - DNA, 20 bp, Homo sapiens
tccttaatatgatctgtgga

SEQ ID NO: 418038 - DNA, 15 bp, Homo sapiens
tccttactctgagcc

SEQ ID NO: 418039 - DNA, 20 bp, Homo sapiens
tccttagaaaagactgacct

SEQ ID NO: 418040 - DNA, 15 bp, Homo sapiens
tccttagccctgtct

SEQ ID NO: 418041 - DNA, 18 bp, Homo sapiens
tccttagtcttctcatag

SEQ ID NO: 418042 - DNA, 14 bp, Homo sapiens
tccttagtggtaga

SEQ ID NO: 418043 - DNA, 13 bp, Homo sapiens
tccttattttgta

SEQ ID NO: 418044 - DNA, 19 bp, Homo sapiens
tccttcacaggcagtgcat

SEQ ID NO: 418045 - DNA, 13 bp, Homo sapiens
tccttcacctctg

SEQ ID NO: 418046 - DNA, 13 bp, Homo sapiens
tccttcactctga

SEQ ID NO: 418047 - DNA, 12 bp, Homo sapiens
tccttcagagct

SEQ ID NO: 418048 - DNA, 13 bp, Homo sapiens
tccttcagagctc

SEQ ID NO: 418049 - DNA, 17 bp, Homo sapiens
tccttcagtgagcccct

SEQ ID NO: 418050 - DNA, 14 bp, Homo sapiens
tccttcagtttgaa

SEQ ID NO: 418051 - DNA, 18 bp, Homo sapiens
tccttccaaaaaattaaa

SEQ ID NO: 418052 - DNA, 18 bp, Homo sapiens
tccttccaactgctgccc

SEQ ID NO: 418053 - DNA, 15 bp, Homo sapiens
tccttccatccttga

SEQ ID NO: 418054 - DNA, 20 bp, Homo sapiens
tccttccattgctcccagtg

SEQ ID NO: 418055 - DNA, 23 bp, Homo sapiens
tccttccattgctcccagtgcca

SEQ ID NO: 418056 - DNA, 14 bp, Homo sapiens
tccttcccacggcc

SEQ ID NO: 418057 - DNA, 15 bp, Homo sapiens
tccttcccactgtcc

SEQ ID NO: 418058 - DNA, 17 bp, Homo sapiens
tccttcccactgtcctt

SEQ ID NO: 418059 - DNA, 20 bp, Homo sapiens
tccttcccactgtcctttct

SEQ ID NO: 418060 - DNA, 21 bp, Homo sapiens
tccttcccactgtcctttctc

SEQ ID NO: 418061 - DNA, 22 bp, Homo sapiens
tccttcccactgtcctttctcc

SEQ ID NO: 418062 - DNA, 18 bp, Homo sapiens
tccttcccatgcctgtct

SEQ ID NO: 418063 - DNA, 14 bp, Homo sapiens
tccttcccccagcc

SEQ ID NO: 418064 - DNA, 22 bp, Homo sapiens
tccttccccctgtagactagtg

SEQ ID NO: 418065 - DNA, 16 bp, Homo sapiens
tccttcccgcagcacc

SEQ ID NO: 418066 - DNA, 23 bp, Homo sapiens
tccttcctacacccttggacttg

SEQ ID NO: 418067 - DNA, 17 bp, Homo sapiens
tccttcctatgcccagg

SEQ ID NO: 418068 - DNA, 19 bp, Homo sapiens
tccttcctgccctgtacct

SEQ ID NO: 418069 - DNA, 13 bp, Homo sapiens
tccttccttccat

SEQ ID NO: 418070 - DNA, 19 bp, Homo sapiens
tccttcgagggttccaggc

SEQ ID NO: 418071 - DNA, 16 bp, Homo sapiens
tccttcgtgtctctcc

SEQ ID NO: 418072 - DNA, 17 bp, Homo sapiens
tccttctcccctccaga

SEQ ID NO: 418073 - DNA, 21 bp, Homo sapiens
tccttctcccctccagacccc

SEQ ID NO: 418074 - DNA, 16 bp, Homo sapiens
tccttctcgtcttcct

SEQ ID NO: 418075 - DNA, 19 bp, Homo sapiens
tccttctcgtcttcctctc

SEQ ID NO: 418076 - DNA, 24 bp, Homo sapiens
tccttctcgtcttcctctctctca

SEQ ID NO: 418077 - DNA, 22 bp, Homo sapiens
tccttctctactcatgccagat

SEQ ID NO: 418078 - DNA, 20 bp, Homo sapiens
tccttctctcacctcctaaa

SEQ ID NO: 418079 - DNA, 12 bp, Homo sapiens
tccttctgcctt

SEQ ID NO: 418080 - DNA, 18 bp, Homo sapiens
tccttcttcctcaagtct

SEQ ID NO: 418081 - DNA, 13 bp, Homo sapiens
tccttcttgccct

SEQ ID NO: 418082 - DNA, 18 bp, Homo sapiens
tccttcttgccctgagct

SEQ ID NO: 418083 - DNA, 18 bp, Homo sapiens
tccttgaagacatatcat

SEQ ID NO: 418084 - DNA, 21 bp, Homo sapiens
tccttgaagacatatcatgtg

SEQ ID NO: 418085 - DNA, 22 bp, Homo sapiens
tccttgaagacatatcatgtgt

SEQ ID NO: 418086 - DNA, 17 bp, Homo sapiens
tccttgaatctgaaaga

SEQ ID NO: 418087 - DNA, 14 bp, Homo sapiens
tccttgaccttcct

SEQ ID NO: 418088 - DNA, 19 bp, Homo sapiens
tccttgaccttcctctggg

SEQ ID NO: 418089 - DNA, 23 bp, Homo sapiens
tccttgactgaagcgaacatctt

SEQ ID NO: 418090 - DNA, 16 bp, Homo sapiens
tccttgagctaagcag

SEQ ID NO: 418091 - DNA, 16 bp, Homo sapiens
tccttgaggacctcca

SEQ ID NO: 418092 - DNA, 23 bp, Homo sapiens
tccttgaggacctccacctggga

SEQ ID NO: 418093 - DNA, 15 bp, Homo sapiens
tccttgccacccccc

SEQ ID NO: 418094 - DNA, 22 bp, Homo sapiens
tccttgccaccccccgccggca

SEQ ID NO: 418095 - DNA, 17 bp, Homo sapiens
tccttgccccagtcctg

SEQ ID NO: 418096 - DNA, 12 bp, Homo sapiens
tccttgccctgg

SEQ ID NO: 418097 - DNA, 13 bp, Homo sapiens
tccttgccctggg

SEQ ID NO: 418098 - DNA, 19 bp, Homo sapiens
tccttgccctgggccagcc

SEQ ID NO: 418099 - DNA, 16 bp, Homo sapiens
tccttgcctcctgtgt

SEQ ID NO: 418100 - DNA, 15 bp, Homo sapiens
tccttggatttgcat

SEQ ID NO: 418101 - DNA, 15 bp, Homo sapiens
tccttggcaccaaag

SEQ ID NO: 418102 - DNA, 19 bp, Homo sapiens
tccttggcacccccatgct

SEQ ID NO: 418103 - DNA, 20 bp, Homo sapiens
tccttggcacccccatgctg

SEQ ID NO: 418104 - DNA, 20 bp, Homo sapiens
tccttggcccagcagcggcc

SEQ ID NO: 418105 - DNA, 22 bp, Homo sapiens
tccttggcctagcccaccctgc

SEQ ID NO: 418106 - DNA, 23 bp, Homo sapiens
tccttggcctagcccaccctgct

SEQ ID NO: 418107 - DNA, 12 bp, Homo sapiens
tccttgggctcc

SEQ ID NO: 418108 - DNA, 14 bp, Homo sapiens
tccttgggctcctg

SEQ ID NO: 418109 - DNA, 16 bp, Homo sapiens
tccttgggctcctggc

SEQ ID NO: 418110 - DNA, 14 bp, Homo sapiens
tccttgggtcctgc

SEQ ID NO: 418111 - DNA, 22 bp, Homo sapiens
tccttgtcaccagcaacatctc

SEQ ID NO: 418112 - DNA, 13 bp, Homo sapiens
tccttgtcagttg

SEQ ID NO: 418113 - DNA, 17 bp, Homo sapiens
tccttgttggtcagagg

SEQ ID NO: 418114 - DNA, 18 bp, Homo sapiens
tccttgttggtcagagga

SEQ ID NO: 418115 - DNA, 23 bp, Homo sapiens
tccttgtttgcctttaggcagga

SEQ ID NO: 418116 - DNA, 21 bp, Homo sapiens
tcctttaattttttactattt

SEQ ID NO: 418117 - DNA, 21 bp, Homo sapiens
tcctttaggcagcctgccgcc

SEQ ID NO: 418118 - DNA, 16 bp, Homo sapiens
tcctttcatcctcagc

SEQ ID NO: 418119 - DNA, 22 bp, Homo sapiens
tcctttccagtggcctggctcc

SEQ ID NO: 418120 - DNA, 13 bp, Homo sapiens
tcctttcccacag

SEQ ID NO: 418121 - DNA, 13 bp, Homo sapiens
tcctttccctcca

SEQ ID NO: 418122 - DNA, 22 bp, Homo sapiens
tcctttccttctcgtcttcctc

SEQ ID NO: 418123 - DNA, 13 bp, Homo sapiens
tcctttctgccca

SEQ ID NO: 418124 - DNA, 13 bp, Homo sapiens
tcctttctgtatt

SEQ ID NO: 418125 - DNA, 22 bp, Homo sapiens
tcctttcttgcactattccaca

SEQ ID NO: 418126 - DNA, 12 bp, Homo sapiens
tcctttcttttt

SEQ ID NO: 418127 - DNA, 14 bp, Homo sapiens
tcctttctttttct

SEQ ID NO: 418128 - DNA, 12 bp, Homo sapiens
tcctttgagaaa

SEQ ID NO: 418129 - DNA, 14 bp, Homo sapiens
tcctttgcactgag

SEQ ID NO: 418130 - DNA, 20 bp, Homo sapiens
tcctttgcactgagggccac

SEQ ID NO: 418131 - DNA, 23 bp, Homo sapiens
tcctttgtttttttttcctgtcc

SEQ ID NO: 418132 - DNA, 14 bp, Homo sapiens
tccttttataagat

SEQ ID NO: 418133 - DNA, 13 bp, Homo sapiens
tccttttctttct

SEQ ID NO: 418134 - DNA, 15 bp, Homo sapiens
tccttttgtatcctc

SEQ ID NO: 418135 - DNA, 18 bp, Homo sapiens
tccttttgtccccagggc

SEQ ID NO: 418136 - DNA, 19 bp, Homo sapiens
tccttttgtccccagggcc

SEQ ID NO: 418137 - DNA, 13 bp, Homo sapiens
tcctttttataac

SEQ ID NO: 418138 - DNA, 16 bp, Homo sapiens
tcctttttcacgttta

SEQ ID NO: 418139 - DNA, 19 bp, Homo sapiens
tccttttttattgaataac

SEQ ID NO: 418140 - DNA, 13 bp, Homo sapiens
tccttttttctct

SEQ ID NO: 418141 - DNA, 14 bp, Homo sapiens
tcgaaagtaaaaaa

SEQ ID NO: 418142 - DNA, 13 bp, Homo sapiens
tcgaaccaaggca

SEQ ID NO: 418143 - DNA, 17 bp, Homo sapiens
tcgaaccaaggcagcct

SEQ ID NO: 418144 - DNA, 18 bp, Homo sapiens
tcgaaccaaggcagcctc

SEQ ID NO: 418145 - DNA, 20 bp, Homo sapiens
tcgaaccaaggcagcctcca

SEQ ID NO: 418146 - DNA, 17 bp, Homo sapiens
tcgaacccacactgcaa

SEQ ID NO: 418147 - DNA, 14 bp, Homo sapiens
tcgaagtcttccat

SEQ ID NO: 418148 - DNA, 14 bp, Homo sapiens
tcgaatatcttaat

SEQ ID NO: 418149 - DNA, 16 bp, Homo sapiens
tcgaattaatagcttt

SEQ ID NO: 418150 - DNA, 16 bp, Homo sapiens
tcgaccctttctctga

SEQ ID NO: 418151 - DNA, 21 bp, Homo sapiens
tcgactcaggatccagtccct

SEQ ID NO: 418152 - DNA, 15 bp, Homo sapiens
tcgactctgctgctc

SEQ ID NO: 418153 - DNA, 14 bp, Homo sapiens
tcgagaccagtctg

SEQ ID NO: 418154 - DNA, 19 bp, Homo sapiens
tcgagaccatcctggcccc

SEQ ID NO: 418155 - DNA, 21 bp, Homo sapiens
tcgagaccatcctggcccctc

SEQ ID NO: 418156 - DNA, 19 bp, Homo sapiens
tcgagcatgttgttttttc

SEQ ID NO: 418157 - DNA, 14 bp, Homo sapiens
tcgagccccctgga

SEQ ID NO: 418158 - DNA, 21 bp, Homo sapiens
tcgaggcaccggcgctgcagg

SEQ ID NO: 418159 - DNA, 22 bp, Homo sapiens
tcgaggcaccggcgctgcaggt

SEQ ID NO: 418160 - DNA, 16 bp, Homo sapiens
tcgagggttccaggct

SEQ ID NO: 418161 - DNA, 10 bp, Homo sapiens
tcgaggtggc

SEQ ID NO: 418162 - DNA, 13 bp, Homo sapiens
tcggccagagctc

SEQ ID NO: 418163 - DNA, 14 bp, Homo sapiens
tcggccccacatgg

SEQ ID NO: 418164 - DNA, 16 bp, Homo sapiens
tcggccccacatggga

SEQ ID NO: 418165 - DNA, 19 bp, Homo sapiens
tcggccccacatgggaacc

SEQ ID NO: 418166 - DNA, 18 bp, Homo sapiens
tcggcctcccaaagtgct

SEQ ID NO: 418167 - DNA, 20 bp, Homo sapiens
tcggcgccttctacctgcag

SEQ ID NO: 418168 - DNA, 15 bp, Homo sapiens
tcggctggaagaaca

SEQ ID NO: 418169 - DNA, 17 bp, Homo sapiens
tcggctggaagaacatc

SEQ ID NO: 418170 - DNA, 18 bp, Homo sapiens
tcggctggaagaacatca

SEQ ID NO: 418171 - DNA, 14 bp, Homo sapiens
tcggctgggcaggg

SEQ ID NO: 418172 - DNA, 15 bp, Homo sapiens
tcggctgggcagggc

SEQ ID NO: 418173 - DNA, 14 bp, Homo sapiens
tcgggaaattctgc

SEQ ID NO: 418174 - DNA, 17 bp, Homo sapiens
tcgggaaattctgctgc

SEQ ID NO: 418175 - DNA, 14 bp, Homo sapiens
tcgggaacagtgtt

SEQ ID NO: 418176 - DNA, 16 bp, Homo sapiens
tcgggaagagaggagt

SEQ ID NO: 418177 - DNA, 23 bp, Homo sapiens
tcgggaagagaggagttcaatga

SEQ ID NO: 418178 - DNA, 13 bp, Homo sapiens
tcgggacttcaaa

SEQ ID NO: 418179 - DNA, 14 bp, Homo sapiens
tcgggagcagtgtc

SEQ ID NO: 418180 - DNA, 16 bp, Homo sapiens
tcgggagcagtgtctt

SEQ ID NO: 418181 - DNA, 14 bp, Homo sapiens
tcgggcaagggccg

SEQ ID NO: 418182 - DNA, 15 bp, Homo sapiens
tcgggccgcctcctc

SEQ ID NO: 418183 - DNA, 19 bp, Homo sapiens
tcggggagaggctgaggac

SEQ ID NO: 418184 - DNA, 23 bp, Homo sapiens
tcggggcccttggggcctggctt

SEQ ID NO: 418185 - DNA, 11 bp, Homo sapiens
tcgggggagga

SEQ ID NO: 418186 - DNA, 14 bp, Homo sapiens
tcgggggaggagca

SEQ ID NO: 418187 - DNA, 18 bp, Homo sapiens
tcgggggaggagcacccc

SEQ ID NO: 418188 - DNA, 21 bp, Homo sapiens
tcgggggaggagcacccccag

SEQ ID NO: 418189 - DNA, 16 bp, Homo sapiens
tcggtcacctgtgcta

SEQ ID NO: 418190 - DNA, 14 bp, Homo sapiens
tcggtcctgtctcc

SEQ ID NO: 418191 - DNA, 21 bp, Homo sapiens
tcggttcaagttgatgtgaca

SEQ ID NO: 418192 - DNA, 14 bp, Homo sapiens
tcggttcaggagga

SEQ ID NO: 418193 - DNA, 17 bp, Homo sapiens
tcggttcaggaggagac

SEQ ID NO: 418194 - DNA, 18 bp, Homo sapiens
tcggttctccagaatgta

SEQ ID NO: 418195 - DNA, 16 bp, Homo sapiens
tcggttgaccctactg

SEQ ID NO: 418196 - DNA, 12 bp, Homo sapiens
tcgtagctttcc

SEQ ID NO: 418197 - DNA, 22 bp, Homo sapiens
tcgtccacaggggcaggcctgg

SEQ ID NO: 418198 - DNA, 14 bp, Homo sapiens
tcgtccggcctgca

SEQ ID NO: 418199 - DNA, 16 bp, Homo sapiens
tcgtccggcctgcagc

SEQ ID NO: 418200 - DNA, 16 bp, Homo sapiens
tcgtctgactgtgtgt

SEQ ID NO: 418201 - DNA, 13 bp, Homo sapiens
tcgtctgtcccag

SEQ ID NO: 418202 - DNA, 15 bp, Homo sapiens
tcgtcttcctctctc

SEQ ID NO: 418203 - DNA, 18 bp, Homo sapiens
tcgtcttcctctctctca

SEQ ID NO: 418204 - DNA, 14 bp, Homo sapiens
tcgtgacccagtgg

SEQ ID NO: 418205 - DNA, 20 bp, Homo sapiens
tcgtgacccttcagggccag

SEQ ID NO: 418206 - DNA, 23 bp, Homo sapiens
tcgtgagtgtccgttgacgtgac

SEQ ID NO: 418207 - DNA, 16 bp, Homo sapiens
tcgtgattgataagaa

SEQ ID NO: 418208 - DNA, 20 bp, Homo sapiens
tcgtgcccccccttccccct

SEQ ID NO: 418209 - DNA, 16 bp, Homo sapiens
tcgtgcctataaatag

SEQ ID NO: 418210 - DNA, 18 bp, Homo sapiens
tcgtgcctataaatagta

SEQ ID NO: 418211 - DNA, 18 bp, Homo sapiens
tcgtgctaaattttcagt

SEQ ID NO: 418212 - DNA, 14 bp, Homo sapiens
tcgtgctttaagtg

SEQ ID NO: 418213 - DNA, 14 bp, Homo sapiens
tcgtggacacctgc

SEQ ID NO: 418214 - DNA, 15 bp, Homo sapiens
tcgtggacacctgcc

SEQ ID NO: 418215 - DNA, 16 bp, Homo sapiens
tcgtggacacctgccc

SEQ ID NO: 418216 - DNA, 19 bp, Homo sapiens
tcgtggagatgtcttcgta

SEQ ID NO: 418217 - DNA, 23 bp, Homo sapiens
tcgtggcagataatcagcctctt

SEQ ID NO: 418218 - DNA, 17 bp, Homo sapiens
tcgtggtagaagccagt

SEQ ID NO: 418219 - DNA, 19 bp, Homo sapiens
tcgtggttattagcaaggc

SEQ ID NO: 418220 - DNA, 23 bp, Homo sapiens
tcgtgtagtggaagagcagcctg

SEQ ID NO: 418221 - DNA, 13 bp, Homo sapiens
tcgtgtatcctgg

SEQ ID NO: 418222 - DNA, 15 bp, Homo sapiens
tcgtgtatcctgggg

SEQ ID NO: 418223 - DNA, 18 bp, Homo sapiens
tcgtgtatcctggggctc

SEQ ID NO: 418224 - DNA, 21 bp, Homo sapiens
tcgtgtctagtagaacaatgt

SEQ ID NO: 418225 - DNA, 21 bp, Homo sapiens
tcgtgtgcatgagaatgtcat

SEQ ID NO: 418226 - DNA, 14 bp, Homo sapiens
tcgttaactgtgta

SEQ ID NO: 418227 - DNA, 17 bp, Homo sapiens
tcgttctcgtgacccag

SEQ ID NO: 418228 - DNA, 15 bp, Homo sapiens
tcgttcttgttagta

SEQ ID NO: 418229 - DNA, 11 bp, Homo sapiens
tcgttgcatgg

SEQ ID NO: 418230 - DNA, 19 bp, Homo sapiens
tcgtttattgcttaatccc

SEQ ID NO: 418231 - DNA, 16 bp, Homo sapiens
tctaaaaaataactgt

SEQ ID NO: 418232 - DNA, 17 bp, Homo sapiens
tctaaaaataaaatgat

SEQ ID NO: 418233 - DNA, 18 bp, Homo sapiens
tctaaaacaaaatctgaa

SEQ ID NO: 418234 - DNA, 19 bp, Homo sapiens
tctaaaacattaattgagg

SEQ ID NO: 418235 - DNA, 12 bp, Homo sapiens
tctaaaattcta

SEQ ID NO: 418236 - DNA, 14 bp, Homo sapiens
tctaaaattctagt

SEQ ID NO: 418237 - DNA, 12 bp, Homo sapiens
tctaaactgttt

SEQ ID NO: 418238 - DNA, 18 bp, Homo sapiens
tctaaactgttttcatgt

SEQ ID NO: 418239 - DNA, 14 bp, Homo sapiens
tctaaaggactggt

SEQ ID NO: 418240 - DNA, 18 bp, Homo sapiens
tctaaaggtggtgaggca

SEQ ID NO: 418241 - DNA, 22 bp, Homo sapiens
tctaaaggtttcactgttcatg

SEQ ID NO: 418242 - DNA, 12 bp, Homo sapiens
tctaaagtgttg

SEQ ID NO: 418243 - DNA, 21 bp, Homo sapiens
tctaaagtgttggtctttcta

SEQ ID NO: 418244 - DNA, 15 bp, Homo sapiens
tctaaagtttacagt

SEQ ID NO: 418245 - DNA, 16 bp, Homo sapiens
tctaaatagatacttt

SEQ ID NO: 418246 - DNA, 19 bp, Homo sapiens
tctaaatgattatcttgaa

SEQ ID NO: 418247 - DNA, 23 bp, Homo sapiens
tctaaatgcatatcctgagccat

SEQ ID NO: 418248 - DNA, 17 bp, Homo sapiens
tctaaattgatcattca

SEQ ID NO: 418249 - DNA, 17 bp, Homo sapiens
tctaaatttgaatgtta

SEQ ID NO: 418250 - DNA, 22 bp, Homo sapiens
tctaaatttgaatgttaagcag

SEQ ID NO: 418251 - DNA, 13 bp, Homo sapiens
tctaacagattag

SEQ ID NO: 418252 - DNA, 15 bp, Homo sapiens
tctaacagctcagga

SEQ ID NO: 418253 - DNA, 24 bp, Homo sapiens
tctaacaggggctggtgggcacca

SEQ ID NO: 418254 - DNA, 19 bp, Homo sapiens
tctaaccccaggttttctg

SEQ ID NO: 418255 - DNA, 14 bp, Homo sapiens
tctaaccctcccat

SEQ ID NO: 418256 - DNA, 15 bp, Homo sapiens
tctaaccctcccatg

SEQ ID NO: 418257 - DNA, 21 bp, Homo sapiens
tctaaccctcccatggcacct

SEQ ID NO: 418258 - DNA, 21 bp, Homo sapiens
tctaactgtgctcaagaggtt

SEQ ID NO: 418259 - DNA, 13 bp, Homo sapiens
tctaactttagaa

SEQ ID NO: 418260 - DNA, 12 bp, Homo sapiens
tctaagagtgcc

SEQ ID NO: 418261 - DNA, 16 bp, Homo sapiens
tctaagattgtacata

SEQ ID NO: 418262 - DNA, 18 bp, Homo sapiens
tctaagcctttccataag

SEQ ID NO: 418263 - DNA, 20 bp, Homo sapiens
tctaagcttatttctaacta

SEQ ID NO: 418264 - DNA, 11 bp, Homo sapiens
tctaaggcatg

SEQ ID NO: 418265 - DNA, 19 bp, Homo sapiens
tctaaggcatgctcccagc

SEQ ID NO: 418266 - DNA, 21 bp, Homo sapiens
tctaaggccaaggcctcagga

SEQ ID NO: 418267 - DNA, 14 bp, Homo sapiens
tctaaggttctcat

SEQ ID NO: 418268 - DNA, 19 bp, Homo sapiens
tctaagtacatatgtagat

SEQ ID NO: 418269 - DNA, 12 bp, Homo sapiens
tctaagtattta

SEQ ID NO: 418270 - DNA, 19 bp, Homo sapiens
tctaagtatttaaatgttc

SEQ ID NO: 418271 - DNA, 15 bp, Homo sapiens
tctaagtcagtttca

SEQ ID NO: 418272 - DNA, 23 bp, Homo sapiens
tctaagtcagtttcacatatttg

SEQ ID NO: 418273 - DNA, 14 bp, Homo sapiens
tctaagtgtacttc

SEQ ID NO: 418274 - DNA, 17 bp, Homo sapiens
tctaataaaatggctat

SEQ ID NO: 418275 - DNA, 19 bp, Homo sapiens
tctaatagaactcagtttt

SEQ ID NO: 418276 - DNA, 14 bp, Homo sapiens
tctaatatcattca

SEQ ID NO: 418277 - DNA, 17 bp, Homo sapiens
tctaatattaaaaatat

SEQ ID NO: 418278 - DNA, 20 bp, Homo sapiens
tctaatcgaaagaaaatggg

SEQ ID NO: 418279 - DNA, 12 bp, Homo sapiens
tctaatctctta

SEQ ID NO: 418280 - DNA, 13 bp, Homo sapiens
tctaatctcttat

SEQ ID NO: 418281 - DNA, 20 bp, Homo sapiens
tctaatgtagctatttttct

SEQ ID NO: 418282 - DNA, 15 bp, Homo sapiens
tctaattcaactctg

SEQ ID NO: 418283 - DNA, 21 bp, Homo sapiens
tctaattcccattttgcaaaa

SEQ ID NO: 418284 - DNA, 14 bp, Homo sapiens
tctaattggtcatt

SEQ ID NO: 418285 - DNA, 20 bp, Homo sapiens
tctaatttcaaaaatataac

SEQ ID NO: 418286 - DNA, 21 bp, Homo sapiens
tctaattttgtgctctttcct

SEQ ID NO: 418287 - DNA, 22 bp, Homo sapiens
tctaattttgtgctctttcctg

SEQ ID NO: 418288 - DNA, 13 bp, Homo sapiens
tctacaaccagag

SEQ ID NO: 418289 - DNA, 15 bp, Homo sapiens
tctacaaccagagcc

SEQ ID NO: 418290 - DNA, 15 bp, Homo sapiens
tctacactcatctta

SEQ ID NO: 418291 - DNA, 11 bp, Homo sapiens
tctacactctc

SEQ ID NO: 418292 - DNA, 23 bp, Homo sapiens
tctacagctaatcagcattctca

SEQ ID NO: 418293 - DNA, 12 bp, Homo sapiens
tctacaggcatt

SEQ ID NO: 418294 - DNA, 20 bp, Homo sapiens
tctacaggcctttcaggaag

SEQ ID NO: 418295 - DNA, 14 bp, Homo sapiens
tctacatgtgccac

SEQ ID NO: 418296 - DNA, 15 bp, Homo sapiens
tctaccaaatgtgta

SEQ ID NO: 418297 - DNA, 15 bp, Homo sapiens
tctcagagccaagtc

SEQ ID NO: 418298 - DNA, 14 bp, Homo sapiens
tctcagatatttat

SEQ ID NO: 418299 - DNA, 23 bp, Homo sapiens
tctcagatatttatatttttatt

SEQ ID NO: 418300 - DNA, 17 bp, Homo sapiens
tctcagcaaattcttga

SEQ ID NO: 418301 - DNA, 21 bp, Homo sapiens
tctcagcaagtgtacagtatt

SEQ ID NO: 418302 - DNA, 13 bp, Homo sapiens
tctcagcactttg

SEQ ID NO: 418303 - DNA, 14 bp, Homo sapiens
tctcagcatccact

SEQ ID NO: 418304 - DNA, 12 bp, Homo sapiens
tctcagcctcct

SEQ ID NO: 418305 - DNA, 19 bp, Homo sapiens
tctcagcctcctgagcctg

SEQ ID NO: 418306 - DNA, 20 bp, Homo sapiens
tctcagcctcctgagcctgt

SEQ ID NO: 418307 - DNA, 13 bp, Homo sapiens
tctcagccttccg

SEQ ID NO: 418308 - DNA, 20 bp, Homo sapiens
tctcagctccactctgaagt

SEQ ID NO: 418309 - DNA, 15 bp, Homo sapiens
tctcagcttctaatt

SEQ ID NO: 418310 - DNA, 19 bp, Homo sapiens
tctcagcttctaattttgt

SEQ ID NO: 418311 - DNA, 22 bp, Homo sapiens
tctcagcttctaattttgtgct

SEQ ID NO: 418312 - DNA, 14 bp, Homo sapiens
tctcaggagcacag

SEQ ID NO: 418313 - DNA, 16 bp, Homo sapiens
tctcaggagcacaggc

SEQ ID NO: 418314 - DNA, 20 bp, Homo sapiens
tctcaggaggtgtctcctac

SEQ ID NO: 418315 - DNA, 18 bp, Homo sapiens
tctcaggcatgcctgtgt

SEQ ID NO: 418316 - DNA, 19 bp, Homo sapiens
tctcaggccacctgccccc

SEQ ID NO: 418317 - DNA, 21 bp, Homo sapiens
tctcaggccacctgccccctt

SEQ ID NO: 418318 - DNA, 15 bp, Homo sapiens
tctcaggtccctgca

SEQ ID NO: 418319 - DNA, 16 bp, Homo sapiens
tctcaggtgccactcc

SEQ ID NO: 418320 - DNA, 20 bp, Homo sapiens
tctcaggtgccactccctga

SEQ ID NO: 418321 - DNA, 23 bp, Homo sapiens
tctcaggtgccactccctgagct

SEQ ID NO: 418322 - DNA, 16 bp, Homo sapiens
tctcagtcaaacaagt

SEQ ID NO: 418323 - DNA, 14 bp, Homo sapiens
tctcagttgcagcc

SEQ ID NO: 418324 - DNA, 21 bp, Homo sapiens
tctcagttgcagccctgctgc

SEQ ID NO: 418325 - DNA, 15 bp, Homo sapiens
tctcataaacagagt

SEQ ID NO: 418326 - DNA, 21 bp, Homo sapiens
tctcataggaaaagtacattt

SEQ ID NO: 418327 - DNA, 14 bp, Homo sapiens
tctcataggagtta

SEQ ID NO: 418328 - DNA, 22 bp, Homo sapiens
tctcatcacatttgtaaatgtc

SEQ ID NO: 418329 - DNA, 14 bp, Homo sapiens
tctcatcagcccag

SEQ ID NO: 418330 - DNA, 15 bp, Homo sapiens
tctcatcagtgtcct

SEQ ID NO: 418331 - DNA, 20 bp, Homo sapiens
tctcatccaggtcctttcct

SEQ ID NO: 418332 - DNA, 18 bp, Homo sapiens
tctcatccccaaactgta

SEQ ID NO: 418333 - DNA, 20 bp, Homo sapiens
tctcatgcactgcaaatact

SEQ ID NO: 418334 - DNA, 17 bp, Homo sapiens
tctcatgtgctttgtag

SEQ ID NO: 418335 - DNA, 18 bp, Homo sapiens
tctcatgtgctttgtagc

SEQ ID NO: 418336 - DNA, 23 bp, Homo sapiens
tctcatgtggggatgtttgtgct

SEQ ID NO: 418337 - DNA, 13 bp, Homo sapiens
tctcattcagtat

SEQ ID NO: 418338 - DNA, 19 bp, Homo sapiens
tctcattccaacagtgagt

SEQ ID NO: 418339 - DNA, 20 bp, Homo sapiens
tctcattctgttgcccaggc

SEQ ID NO: 418340 - DNA, 18 bp, Homo sapiens
tctcatttatttttagcc

SEQ ID NO: 418341 - DNA, 16 bp, Homo sapiens
tctcattttgtatgta

SEQ ID NO: 418342 - DNA, 17 bp, Homo sapiens
tctccaaaggggctgct

SEQ ID NO: 418343 - DNA, 18 bp, Homo sapiens
tctccaaaggggctgctg

SEQ ID NO: 418344 - DNA, 20 bp, Homo sapiens
tctccaaaggggctgctggg

SEQ ID NO: 418345 - DNA, 18 bp, Homo sapiens
tctccaaatgattttcat

SEQ ID NO: 418346 - DNA, 19 bp, Homo sapiens
tctccaaatgattttcatc

SEQ ID NO: 418347 - DNA, 17 bp, Homo sapiens
tctccaaggatcctctc

SEQ ID NO: 418348 - DNA, 18 bp, Homo sapiens
tctccaaggatcctctcc

SEQ ID NO: 418349 - DNA, 16 bp, Homo sapiens
tctccaagtctctctg

SEQ ID NO: 418350 - DNA, 19 bp, Homo sapiens
tctccaagtctctctgtga

SEQ ID NO: 418351 - DNA, 20 bp, Homo sapiens
tctccaagtctctctgtgaa

SEQ ID NO: 418352 - DNA, 21 bp, Homo sapiens
tctccaagtctctctgtgaat

SEQ ID NO: 418353 - DNA, 20 bp, Homo sapiens
tctccacacccatgactgcc

SEQ ID NO: 418354 - DNA, 21 bp, Homo sapiens
tctccacacccatgactgccc

SEQ ID NO: 418355 - DNA, 22 bp, Homo sapiens
tctccacacccatgactgcccc

SEQ ID NO: 418356 - DNA, 22 bp, Homo sapiens
tctccacccaaaccccttccca

SEQ ID NO: 418357 - DNA, 12 bp, Homo sapiens
tctccacccctc

SEQ ID NO: 418358 - DNA, 13 bp, Homo sapiens
tctccacccctca

SEQ ID NO: 418359 - DNA, 14 bp, Homo sapiens
tctccacccctcaa

SEQ ID NO: 418360 - DNA, 17 bp, Homo sapiens
tctccacctgaagtgat

SEQ ID NO: 418361 - DNA, 13 bp, Homo sapiens
tctccactcactg

SEQ ID NO: 418362 - DNA, 23 bp, Homo sapiens
tctccactccatgtttgcaatgc

SEQ ID NO: 418363 - DNA, 14 bp, Homo sapiens
tctccactgccttc

SEQ ID NO: 418364 - DNA, 19 bp, Homo sapiens
tctccacttctggtcccct

SEQ ID NO: 418365 - DNA, 23 bp, Homo sapiens
tctccacttctggtcccctgtgg

SEQ ID NO: 418366 - DNA, 21 bp, Homo sapiens
tctccagaaccagtgtctgaa

SEQ ID NO: 418367 - DNA, 19 bp, Homo sapiens
tctccagaatgtaagaaaa

SEQ ID NO: 418368 - DNA, 13 bp, Homo sapiens
tctccagccagca

SEQ ID NO: 418369 - DNA, 15 bp, Homo sapiens
tctccagccagcaat

SEQ ID NO: 418370 - DNA, 13 bp, Homo sapiens
tctccagccctat

SEQ ID NO: 418371 - DNA, 15 bp, Homo sapiens
tctccagctgatttt

SEQ ID NO: 418372 - DNA, 17 bp, Homo sapiens
tctccaggcccagcctg

SEQ ID NO: 418373 - DNA, 18 bp, Homo sapiens
tctccaggcccagcctgg

SEQ ID NO: 418374 - DNA, 16 bp, Homo sapiens
tctccagggctgcccc

SEQ ID NO: 418375 - DNA, 15 bp, Homo sapiens
tctccatcataggct

SEQ ID NO: 418376 - DNA, 15 bp, Homo sapiens
tctccatcccctccc

SEQ ID NO: 418377 - DNA, 12 bp, Homo sapiens
tctccatgaaga

SEQ ID NO: 418378 - DNA, 24 bp, Homo sapiens
tctccatggccctgccatgctctc

SEQ ID NO: 418379 - DNA, 15 bp, Homo sapiens
tctcccaattttctt

SEQ ID NO: 418380 - DNA, 15 bp, Homo sapiens
tctcccacacaagca

SEQ ID NO: 418381 - DNA, 23 bp, Homo sapiens
tctccctcaacaagggagagacc

SEQ ID NO: 418382 - DNA, 11 bp, Homo sapiens
tctccctccac

SEQ ID NO: 418383 - DNA, 14 bp, Homo sapiens
tctccctccactcc

SEQ ID NO: 418384 - DNA, 19 bp, Homo sapiens
tctccctccactcctccca

SEQ ID NO: 418385 - DNA, 18 bp, Homo sapiens
tctccctcccctgccatt

SEQ ID NO: 418386 - DNA, 18 bp, Homo sapiens
tctccctccgactccaga

SEQ ID NO: 418387 - DNA, 13 bp, Homo sapiens
tctccctgacctt

SEQ ID NO: 418388 - DNA, 13 bp, Homo sapiens
tctccctgagcct

SEQ ID NO: 418389 - DNA, 23 bp, Homo sapiens
tctccctgagcctgccccagctg

SEQ ID NO: 418390 - DNA, 12 bp, Homo sapiens
tctccctgcctc

SEQ ID NO: 418391 - DNA, 13 bp, Homo sapiens
tctccctgcctca

SEQ ID NO: 418392 - DNA, 17 bp, Homo sapiens
tctccctgcctcacatc

SEQ ID NO: 418393 - DNA, 20 bp, Homo sapiens
tctccctgcctcacatctcc

SEQ ID NO: 418394 - DNA, 16 bp, Homo sapiens
tctccctggactctgt

SEQ ID NO: 418395 - DNA, 15 bp, Homo sapiens
tctcccttactattc

SEQ ID NO: 418396 - DNA, 19 bp, Homo sapiens
tctcccttactattcccac

SEQ ID NO: 418397 - DNA, 14 bp, Homo sapiens
tctcccttccacct

SEQ ID NO: 418398 - DNA, 15 bp, Homo sapiens
tctcccttccacctc

SEQ ID NO: 418399 - DNA, 16 bp, Homo sapiens
tctcccttccacctca

SEQ ID NO: 418400 - DNA, 17 bp, Homo sapiens
tctcccttccacctcac

SEQ ID NO: 418401 - DNA, 19 bp, Homo sapiens
tctcccttcctctctcctt

SEQ ID NO: 418402 - DNA, 21 bp, Homo sapiens
tctcccttctttaccttcatt

SEQ ID NO: 418403 - DNA, 15 bp, Homo sapiens
tctcccttggccacg

SEQ ID NO: 418404 - DNA, 15 bp, Homo sapiens
tctccctttcccttc

SEQ ID NO: 418405 - DNA, 21 bp, Homo sapiens
tctccggccccgcctctgccc

SEQ ID NO: 418406 - DNA, 13 bp, Homo sapiens
tctccggggtctg

SEQ ID NO: 418407 - DNA, 15 bp, Homo sapiens
tctccggggtctgtg

SEQ ID NO: 418408 - DNA, 18 bp, Homo sapiens
tctccggggtctgtgctg

SEQ ID NO: 418409 - DNA, 21 bp, Homo sapiens
tctccggggtctgtgctgtgc

SEQ ID NO: 418410 - DNA, 16 bp, Homo sapiens
tctcctaccccacctc

SEQ ID NO: 418411 - DNA, 17 bp, Homo sapiens
tctcctaccccacctca

SEQ ID NO: 418412 - DNA, 24 bp, Homo sapiens
tctcctaccccacctcatgcctgg

SEQ ID NO: 418413 - DNA, 17 bp, Homo sapiens
tctcctagactgaccct

SEQ ID NO: 418414 - DNA, 23 bp, Homo sapiens
tctcctagactgaccctgatcag

SEQ ID NO: 418415 - DNA, 17 bp, Homo sapiens
tctcctatgtggcagct

SEQ ID NO: 418416 - DNA, 18 bp, Homo sapiens
tctcctcagggtgggggg

SEQ ID NO: 418417 - DNA, 14 bp, Homo sapiens
tctcctccaaatgc

SEQ ID NO: 418418 - DNA, 18 bp, Homo sapiens
tctcctccaaatgctgtc

SEQ ID NO: 418419 - DNA, 21 bp, Homo sapiens
tctcctcccatggccttccct

SEQ ID NO: 418420 - DNA, 13 bp, Homo sapiens
tctcctccctcag

SEQ ID NO: 418421 - DNA, 13 bp, Homo sapiens
tctcctccctgtt

SEQ ID NO: 418422 - DNA, 13 bp, Homo sapiens
tctcctcctcccc

SEQ ID NO: 418423 - DNA, 13 bp, Homo sapiens
tctcctctcagct

SEQ ID NO: 418424 - DNA, 16 bp, Homo sapiens
tctcctctcagcttct

SEQ ID NO: 418425 - DNA, 14 bp, Homo sapiens
tctcctctccagcc

SEQ ID NO: 418426 - DNA, 12 bp, Homo sapiens
tctcctctccca

SEQ ID NO: 418427 - DNA, 16 bp, Homo sapiens
tctcctctctctccct

SEQ ID NO: 418428 - DNA, 19 bp, Homo sapiens
tctcctctctctccctcca

SEQ ID NO: 418429 - DNA, 16 bp, Homo sapiens
tctcctctctgggcct

SEQ ID NO: 418430 - DNA, 22 bp, Homo sapiens
tctcctctgtcagtttgtgaag

SEQ ID NO: 418431 - DNA, 17 bp, Homo sapiens
tctcctctttgttttgt

SEQ ID NO: 418432 - DNA, 16 bp, Homo sapiens
tctcctgagcctgtct

SEQ ID NO: 418433 - DNA, 18 bp, Homo sapiens
tctcctgagcctgtctct

SEQ ID NO: 418434 - DNA, 20 bp, Homo sapiens
tctcctgagcctgtctctcc

SEQ ID NO: 418435 - DNA, 15 bp, Homo sapiens
tctcctgattattta

SEQ ID NO: 418436 - DNA, 14 bp, Homo sapiens
tctcctgcatccct

SEQ ID NO: 418437 - DNA, 17 bp, Homo sapiens
tctcctgcccagctctg

SEQ ID NO: 418438 - DNA, 15 bp, Homo sapiens
tctcctgcctcagcc

SEQ ID NO: 418439 - DNA, 12 bp, Homo sapiens
tctcctgggcca

SEQ ID NO: 418440 - DNA, 13 bp, Homo sapiens
tctcctgggccag

SEQ ID NO: 418441 - DNA, 20 bp, Homo sapiens
tctcctgggccagggtctcg

SEQ ID NO: 418442 - DNA, 13 bp, Homo sapiens
tctcctgggcccc

SEQ ID NO: 418443 - DNA, 14 bp, Homo sapiens
tctcctggtagcat

SEQ ID NO: 418444 - DNA, 19 bp, Homo sapiens
tctcctgtaattttgtagt

SEQ ID NO: 418445 - DNA, 18 bp, Homo sapiens
tctcctgtagccactggc

SEQ ID NO: 418446 - DNA, 20 bp, Homo sapiens
tctcctgtataaccccacct

SEQ ID NO: 418447 - DNA, 22 bp, Homo sapiens
tctcctgtataaccccaccttg

SEQ ID NO: 418448 - DNA, 14 bp, Homo sapiens
tctcctgtatcatt

SEQ ID NO: 418449 - DNA, 23 bp, Homo sapiens
tctcctgtgcatgggtgaaggga

SEQ ID NO: 418450 - DNA, 13 bp, Homo sapiens
tctcctgtgccca

SEQ ID NO: 418451 - DNA, 21 bp, Homo sapiens
tctcctgtggtttgctccaga

SEQ ID NO: 418452 - DNA, 21 bp, Homo sapiens
tctccttactctgagcccagg

SEQ ID NO: 418453 - DNA, 22 bp, Homo sapiens
tctccttactctgagcccaggc

SEQ ID NO: 418454 - DNA, 14 bp, Homo sapiens
tctccttagtcttc

SEQ ID NO: 418455 - DNA, 17 bp, Homo sapiens
tctccttagtcttctca

SEQ ID NO: 418456 - DNA, 20 bp, Homo sapiens
tctccttatagacacttgct

SEQ ID NO: 418457 - DNA, 12 bp, Homo sapiens
tctccttcccac

SEQ ID NO: 418458 - DNA, 13 bp, Homo sapiens
tctccttcccact

SEQ ID NO: 418459 - DNA, 14 bp, Homo sapiens
tctccttcccactg

SEQ ID NO: 418460 - DNA, 16 bp, Homo sapiens
tctccttcccactgtc

SEQ ID NO: 418461 - DNA, 14 bp, Homo sapiens
tctccttcccccag

SEQ ID NO: 418462 - DNA, 20 bp, Homo sapiens
tctccttcccccagcccaat

SEQ ID NO: 418463 - DNA, 23 bp, Homo sapiens
tctccttcccccagcccaataaa

SEQ ID NO: 418464 - DNA, 18 bp, Homo sapiens
tctccttgattacataat

SEQ ID NO: 418465 - DNA, 17 bp, Homo sapiens
tctccttgccccagtcc

SEQ ID NO: 418466 - DNA, 14 bp, Homo sapiens
tctccttgccctgg

SEQ ID NO: 418467 - DNA, 16 bp, Homo sapiens
tctccttgccctgggc

SEQ ID NO: 418468 - DNA, 14 bp, Homo sapiens
tctccttgggctcc

SEQ ID NO: 418469 - DNA, 20 bp, Homo sapiens
tctcctttctttttcttctt

SEQ ID NO: 418470 - DNA, 16 bp, Homo sapiens
tctcctttgcactgag

SEQ ID NO: 418471 - DNA, 19 bp, Homo sapiens
tctcctttgcactgagggc

SEQ ID NO: 418472 - DNA, 22 bp, Homo sapiens
tctcctttgcactgagggccac

SEQ ID NO: 418473 - DNA, 22 bp, Homo sapiens
tctcctttgctgaggcctccag

SEQ ID NO: 418474 - DNA, 14 bp, Homo sapiens
tctcctttgtccat

SEQ ID NO: 418475 - DNA, 15 bp, Homo sapiens
tctcctttgtccatt

SEQ ID NO: 418476 - DNA, 23 bp, Homo sapiens
tctccttttgaggcttctccttc

SEQ ID NO: 418477 - DNA, 15 bp, Homo sapiens
tctcgagccccctgg

SEQ ID NO: 418478 - DNA, 12 bp, Homo sapiens
tctcgagtccaa

SEQ ID NO: 418479 - DNA, 17 bp, Homo sapiens
tctcggaggccaggccc

SEQ ID NO: 418480 - DNA, 18 bp, Homo sapiens
tctcggaggccaggccct

SEQ ID NO: 418481 - DNA, 17 bp, Homo sapiens
tctaggtctcctcaggg

SEQ ID NO: 418482 - DNA, 19 bp, Homo sapiens
tctaggtggagttgaaaga

SEQ ID NO: 418483 - DNA, 17 bp, Homo sapiens
tctagtagaacaatgta

SEQ ID NO: 418484 - DNA, 18 bp, Homo sapiens
tctagtcaactgctgttt

SEQ ID NO: 418485 - DNA, 16 bp, Homo sapiens
tctagtctctgatttg

SEQ ID NO: 418486 - DNA, 14 bp, Homo sapiens
tctagtgcagctga

SEQ ID NO: 418487 - DNA, 16 bp, Homo sapiens
tctagtgcagctgatt

SEQ ID NO: 418488 - DNA, 16 bp, Homo sapiens
tctagtggtctgattt

SEQ ID NO: 418489 - DNA, 17 bp, Homo sapiens
tctagttagcaggaaat

SEQ ID NO: 418490 - DNA, 21 bp, Homo sapiens
tctagttagcaggaaatagtg

SEQ ID NO: 418491 - DNA, 21 bp, Homo sapiens
tctagttccctcagtgtgaag

SEQ ID NO: 418492 - DNA, 20 bp, Homo sapiens
tctagttctcaatcactgct

SEQ ID NO: 418493 - DNA, 22 bp, Homo sapiens
tctagttctcaatcactgctcc

SEQ ID NO: 418494 - DNA, 13 bp, Homo sapiens
tctagttgtaatg

SEQ ID NO: 418495 - DNA, 15 bp, Homo sapiens
tctagtttacagaaa

SEQ ID NO: 418496 - DNA, 23 bp, Homo sapiens
tctagtttcagtaaataatgaaa

SEQ ID NO: 418497 - DNA, 14 bp, Homo sapiens
tctagtttcttgtg

SEQ ID NO: 418498 - DNA, 17 bp, Homo sapiens
tctagttttttttgtaa

SEQ ID NO: 418499 - DNA, 18 bp, Homo sapiens
tctataaacatatgcaaa

SEQ ID NO: 418500 - DNA, 21 bp, Homo sapiens
tctataacagatcctttcaaa

SEQ ID NO: 418501 - DNA, 20 bp, Homo sapiens
tctataatcccagcactttg

SEQ ID NO: 418502 - DNA, 17 bp, Homo sapiens
tctatactgtttgtaat

SEQ ID NO: 418503 - DNA, 23 bp, Homo sapiens
tctatactgtttgtaatatacag

SEQ ID NO: 418504 - DNA, 16 bp, Homo sapiens
tctatagactctagga

SEQ ID NO: 418505 - DNA, 17 bp, Homo sapiens
tctatagcagtcatcat

SEQ ID NO: 418506 - DNA, 20 bp, Homo sapiens
tctataggaacatatgaaaa

SEQ ID NO: 418507 - DNA, 22 bp, Homo sapiens
tctataggagatgagcttcatt

SEQ ID NO: 418508 - DNA, 21 bp, Homo sapiens
tctatagtatagaatgaactg

SEQ ID NO: 418509 - DNA, 17 bp, Homo sapiens
tctatataaaatgtatt

SEQ ID NO: 418510 - DNA, 21 bp, Homo sapiens
tctatataaaatgtattcaag

SEQ ID NO: 418511 - DNA, 23 bp, Homo sapiens
tctatataaaatgtattcaagca

SEQ ID NO: 418512 - DNA, 18 bp, Homo sapiens
tctatatatacatataca

SEQ ID NO: 418513 - DNA, 15 bp, Homo sapiens
tctatatatacatgt

SEQ ID NO: 418514 - DNA, 18 bp, Homo sapiens
tctatatatacatgtata

SEQ ID NO: 418515 - DNA, 12 bp, Homo sapiens
tctatatgaatt

SEQ ID NO: 418516 - DNA, 14 bp, Homo sapiens
tctatatgaattta

SEQ ID NO: 418517 - DNA, 21 bp, Homo sapiens
tctatatgaatttaaatataa

SEQ ID NO: 418518 - DNA, 18 bp, Homo sapiens
tctatatgttgctgaaac

SEQ ID NO: 418519 - DNA, 16 bp, Homo sapiens
tctatatttattttca

SEQ ID NO: 418520 - DNA, 15 bp, Homo sapiens
tctatatttcatatt

SEQ ID NO: 418521 - DNA, 16 bp, Homo sapiens
tctatccccaagctgg

SEQ ID NO: 418522 - DNA, 17 bp, Homo sapiens
tctatccccaagctggc

SEQ ID NO: 418523 - DNA, 19 bp, Homo sapiens
tctatcgagtttgcaatgt

SEQ ID NO: 418524 - DNA, 13 bp, Homo sapiens
tctatctaaatga

SEQ ID NO: 418525 - DNA, 20 bp, Homo sapiens
tctatctgcaaatagtttca

SEQ ID NO: 418526 - DNA, 15 bp, Homo sapiens
tctatctgggcctgg

SEQ ID NO: 418527 - DNA, 19 bp, Homo sapiens
tctatgactgtgtttaata

SEQ ID NO: 418528 - DNA, 23 bp, Homo sapiens
tctatgagaacaagtcacagctg

SEQ ID NO: 418529 - DNA, 21 bp, Homo sapiens
tctatggagcaaaacaaagct

SEQ ID NO: 418530 - DNA, 16 bp, Homo sapiens
tctatggattcacttc

SEQ ID NO: 418531 - DNA, 22 bp, Homo sapiens
tctatgggtatcaaacagctca

SEQ ID NO: 418532 - DNA, 22 bp, Homo sapiens
tctatggtaaagatattattca

SEQ ID NO: 418533 - DNA, 13 bp, Homo sapiens
tctatgtaaaaat

SEQ ID NO: 418534 - DNA, 15 bp, Homo sapiens
tctatgtaaattatt

SEQ ID NO: 418535 - DNA, 19 bp, Homo sapiens
tctatgtagaactgttcat

SEQ ID NO: 418536 - DNA, 12 bp, Homo sapiens
tctatgtatgtg

SEQ ID NO: 418537 - DNA, 13 bp, Homo sapiens
tctattaaaagcc

SEQ ID NO: 418538 - DNA, 18 bp, Homo sapiens
tctattagactttagaaa

SEQ ID NO: 418539 - DNA, 18 bp, Homo sapiens
tctattagcttactgatt

SEQ ID NO: 418540 - DNA, 20 bp, Homo sapiens
tctattagcttactgattaa

SEQ ID NO: 418541 - DNA, 16 bp, Homo sapiens
tctattcagacaagca

SEQ ID NO: 418542 - DNA, 22 bp, Homo sapiens
tctattccctggaattcaccct

SEQ ID NO: 418543 - DNA, 16 bp, Homo sapiens
tctattccttctggcc

SEQ ID NO: 418544 - DNA, 16 bp, Homo sapiens
tctattgatgtacagt

SEQ ID NO: 418545 - DNA, 20 bp, Homo sapiens
tctattggaggtgagatcac

SEQ ID NO: 418546 - DNA, 22 bp, Homo sapiens
tctattgggttcattattggaa

SEQ ID NO: 418547 - DNA, 14 bp, Homo sapiens
tctattgtagcatt

SEQ ID NO: 418548 - DNA, 15 bp, Homo sapiens
tctattgtagcattt

SEQ ID NO: 418549 - DNA, 16 bp, Homo sapiens
tctattgtattatttg

SEQ ID NO: 418550 - DNA, 16 bp, Homo sapiens
tctattgttactctgg

SEQ ID NO: 418551 - DNA, 13 bp, Homo sapiens
tctatttagcatg

SEQ ID NO: 418552 - DNA, 13 bp, Homo sapiens
tctatttattgga

SEQ ID NO: 418553 - DNA, 15 bp, Homo sapiens
tctatttatttactg

SEQ ID NO: 418554 - DNA, 22 bp, Homo sapiens
tctatttatttactgagcttct

SEQ ID NO: 418555 - DNA, 12 bp, Homo sapiens
tctatttcttta

SEQ ID NO: 418556 - DNA, 20 bp, Homo sapiens
tctattttactttgtacttg

SEQ ID NO: 418557 - DNA, 19 bp, Homo sapiens
tctattttctcagaatcta

SEQ ID NO: 418558 - DNA, 11 bp, Homo sapiens
tctttttctcc

SEQ ID NO: 418559 - DNA, 15 bp, Homo sapiens
tctttttctccaccc

SEQ ID NO: 418560 - DNA, 15 bp, Homo sapiens
tctttttcttcttcc

SEQ ID NO: 418561 - DNA, 14 bp, Homo sapiens
tctttttcttttct

SEQ ID NO: 418562 - DNA, 13 bp, Homo sapiens
tctttttgtgtgc

SEQ ID NO: 418563 - DNA, 15 bp, Homo sapiens
tctttttgtgtgcag

SEQ ID NO: 418564 - DNA, 13 bp, Homo sapiens
tctttttttaaaa

SEQ ID NO: 418565 - DNA, 14 bp, Homo sapiens
tctttttttgtgat

SEQ ID NO: 418566 - DNA, 16 bp, Homo sapiens
tctttttttgtgatgt

SEQ ID NO: 418567 - DNA, 23 bp, Homo sapiens
tctttttttttttttaaagacag

SEQ ID NO: 418568 - DNA, 21 bp, Homo sapiens
tctttttttttttttttgaaa

SEQ ID NO: 418569 - DNA, 23 bp, Homo sapiens
tgaaaaaaagggaaaacaaatat

SEQ ID NO: 418570 - DNA, 16 bp, Homo sapiens
tgaaaaaaagtttaca

SEQ ID NO: 418571 - DNA, 21 bp, Homo sapiens
tgaaaaaagaaattccctgga

SEQ ID NO: 418572 - DNA, 21 bp, Homo sapiens
tgaaaaaagaagtttgggcta

SEQ ID NO: 418573 - DNA, 14 bp, Homo sapiens
tgaaaaaagagaaa

SEQ ID NO: 418574 - DNA, 18 bp, Homo sapiens
tgaaaaacacggcagctg

SEQ ID NO: 418575 - DNA, 19 bp, Homo sapiens
tgaaaaacacggcagctgt

SEQ ID NO: 418576 - DNA, 13 bp, Homo sapiens
tgaaaaagcagac

SEQ ID NO: 418577 - DNA, 17 bp, Homo sapiens
tgaaaaagcctaagaaa

SEQ ID NO: 418578 - DNA, 19 bp, Homo sapiens
tgaaaaagcctaagaaaaa

SEQ ID NO: 418579 - DNA, 20 bp, Homo sapiens
tgaaaaagcctaagaaaaag

SEQ ID NO: 418580 - DNA, 13 bp, Homo sapiens
tgaaaaataaata

SEQ ID NO: 418581 - DNA, 18 bp, Homo sapiens
tgaaaacaccaagagtac

SEQ ID NO: 418582 - DNA, 11 bp, Homo sapiens
tgaaaacactt

SEQ ID NO: 418583 - DNA, 12 bp, Homo sapiens
tgaaaacactta

SEQ ID NO: 418584 - DNA, 17 bp, Homo sapiens
tgaaaacattgatgaat

SEQ ID NO: 418585 - DNA, 18 bp, Homo sapiens
tgaaaaccaacaccatca

SEQ ID NO: 418586 - DNA, 20 bp, Homo sapiens
tgaaaaccagtcttctccct

SEQ ID NO: 418587 - DNA, 18 bp, Homo sapiens
tgaaaaccatctggcctg

SEQ ID NO: 418588 - DNA, 13 bp, Homo sapiens
tgaaaacctgcat

SEQ ID NO: 418589 - DNA, 15 bp, Homo sapiens
tgaaaactgtaaata

SEQ ID NO: 418590 - DNA, 17 bp, Homo sapiens
tgaaaactgtaaataca

SEQ ID NO: 418591 - DNA, 23 bp, Homo sapiens
tgaaaactgtttatggtattttc

SEQ ID NO: 418592 - DNA, 13 bp, Homo sapiens
tgaaaacttcaaa

SEQ ID NO: 418593 - DNA, 17 bp, Homo sapiens
tgaaaagaaatgctaat

SEQ ID NO: 418594 - DNA, 22 bp, Homo sapiens
tgaaaagagtatgtagtggctt

SEQ ID NO: 418595 - DNA, 19 bp, Homo sapiens
tgaaaagctaccctgaaac

SEQ ID NO: 418596 - DNA, 19 bp, Homo sapiens
tgaaaaggactcttgagcc

SEQ ID NO: 418597 - DNA, 20 bp, Homo sapiens
tgaaaatattatctttgtaa

SEQ ID NO: 418598 - DNA, 22 bp, Homo sapiens
tgaaaatatttttttctagcta

SEQ ID NO: 418599 - DNA, 17 bp, Homo sapiens
tgaaaatctaatattaa

SEQ ID NO: 418600 - DNA, 17 bp, Homo sapiens
tgaaaatgagcctgtaa

SEQ ID NO: 418601 - DNA, 18 bp, Homo sapiens
tgaaaatggtgaagaatg

SEQ ID NO: 418602 - DNA, 12 bp, Homo sapiens
tgaaaatgtaaa

SEQ ID NO: 418603 - DNA, 12 bp, Homo sapiens
tgaaaatgtact

SEQ ID NO: 418604 - DNA, 16 bp, Homo sapiens
tgaaaatgtactgaga

SEQ ID NO: 418605 - DNA, 14 bp, Homo sapiens
tgaaaatgtcagaa

SEQ ID NO: 418606 - DNA, 11 bp, Homo sapiens
tgaaaatgtta

SEQ ID NO: 418607 - DNA, 18 bp, Homo sapiens
tgaaacaaataatcacat

SEQ ID NO: 418608 - DNA, 17 bp, Homo sapiens
tgaaacaagaagccaca

SEQ ID NO: 418609 - DNA, 16 bp, Homo sapiens
tgaaacacaccaggct

SEQ ID NO: 418610 - DNA, 23 bp, Homo sapiens
tgaaacattcacacagggctctt

SEQ ID NO: 418611 - DNA, 18 bp, Homo sapiens
tgaaacattccgaagagg

SEQ ID NO: 418612 - DNA, 19 bp, Homo sapiens
tgaaacatttgacacataa

SEQ ID NO: 418613 - DNA, 23 bp, Homo sapiens
tgaaaccctgtctctactaaaaa

SEQ ID NO: 418614 - DNA, 15 bp, Homo sapiens
tgaaaccgtccctga

SEQ ID NO: 418615 - DNA, 12 bp, Homo sapiens
tgaaaccttcct

SEQ ID NO: 418616 - DNA, 15 bp, Homo sapiens
tgaaaccttcctctt

SEQ ID NO: 418617 - DNA, 21 bp, Homo sapiens
tgaaacgaatataagcttaaa

SEQ ID NO: 418618 - DNA, 18 bp, Homo sapiens
tgaaactgctaattacac

SEQ ID NO: 418619 - DNA, 16 bp, Homo sapiens
tgaaacttcagccctg

SEQ ID NO: 418620 - DNA, 20 bp, Homo sapiens
tgaaacttcccaacttccct

SEQ ID NO: 418621 - DNA, 15 bp, Homo sapiens
tgaaacttggtgtgt

SEQ ID NO: 418622 - DNA, 13 bp, Homo sapiens
tgaaacttgtgct

SEQ ID NO: 418623 - DNA, 15 bp, Homo sapiens
tgaaacttgtgctat

SEQ ID NO: 418624 - DNA, 20 bp, Homo sapiens
tgaaagaaacagttaacttt

SEQ ID NO: 418625 - DNA, 18 bp, Homo sapiens
tgaagtgaatacatggta

SEQ ID NO: 418626 - DNA, 15 bp, Homo sapiens
tgaagtgattgacat

SEQ ID NO: 418627 - DNA, 18 bp, Homo sapiens
tgaagtgattgacatttt

SEQ ID NO: 418628 - DNA, 18 bp, Homo sapiens
tgaagtggaaaaagaaat

SEQ ID NO: 418629 - DNA, 14 bp, Homo sapiens
tgaagtgtggctgg

SEQ ID NO: 418630 - DNA, 19 bp, Homo sapiens
tgaagtgtggctggtgtcc

SEQ ID NO: 418631 - DNA, 15 bp, Homo sapiens
tgaagttaacagtct

SEQ ID NO: 418632 - DNA, 18 bp, Homo sapiens
tgaagttcatggtgatca

SEQ ID NO: 418633 - DNA, 18 bp, Homo sapiens
tgaagttctggcaagatt

SEQ ID NO: 418634 - DNA, 20 bp, Homo sapiens
tgaagtttacattgtaaata

SEQ ID NO: 418635 - DNA, 16 bp, Homo sapiens
tgaagtttatacagta

SEQ ID NO: 418636 - DNA, 19 bp, Homo sapiens
tgaagtttatacagtacag

SEQ ID NO: 418637 - DNA, 21 bp, Homo sapiens
tgaagtttcatttatgataca

SEQ ID NO: 418638 - DNA, 20 bp, Homo sapiens
tgaataaaaaacatttgtac

SEQ ID NO: 418639 - DNA, 21 bp, Homo sapiens
tgaataaaaaacatttgtaca

SEQ ID NO: 418640 - DNA, 21 bp, Homo sapiens
tgaataaaaactttgctaaat

SEQ ID NO: 418641 - DNA, 15 bp, Homo sapiens
tgaataaaaatgcac

SEQ ID NO: 418642 - DNA, 15 bp, Homo sapiens
tgaataaaaattaag

SEQ ID NO: 418643 - DNA, 15 bp, Homo sapiens
tgaataaagacacct

SEQ ID NO: 418644 - DNA, 16 bp, Homo sapiens
tgaataaataaatgta

SEQ ID NO: 418645 - DNA, 17 bp, Homo sapiens
tgaataatgtagtgcag

SEQ ID NO: 418646 - DNA, 16 bp, Homo sapiens
tgaataattatgttta

SEQ ID NO: 418647 - DNA, 14 bp, Homo sapiens
tgaataatttccca

SEQ ID NO: 418648 - DNA, 22 bp, Homo sapiens
tgaataatttcccaattaggaa

SEQ ID NO: 418649 - DNA, 17 bp, Homo sapiens
tgaatacaattaaaggt

SEQ ID NO: 418650 - DNA, 18 bp, Homo sapiens
tgaatacattaaaagaag

SEQ ID NO: 418651 - DNA, 15 bp, Homo sapiens
tgaatagaaatggga

SEQ ID NO: 418652 - DNA, 23 bp, Homo sapiens
tgaatataaatgtactacatttg

SEQ ID NO: 418653 - DNA, 23 bp, Homo sapiens
tgaatatatttaagcaacatctt

SEQ ID NO: 418654 - DNA, 13 bp, Homo sapiens
tgaatatatttta

SEQ ID NO: 418655 - DNA, 16 bp, Homo sapiens
tgaatattaagaaaca

SEQ ID NO: 418656 - DNA, 20 bp, Homo sapiens
tgaatatttatatttcacta

SEQ ID NO: 418657 - DNA, 21 bp, Homo sapiens
tgaatatttccatatggattt

SEQ ID NO: 418658 - DNA, 18 bp, Homo sapiens
tgaatcaatctggcttct

SEQ ID NO: 418659 - DNA, 19 bp, Homo sapiens
tgaatcagtatgaagacac

SEQ ID NO: 418660 - DNA, 21 bp, Homo sapiens
tgaatcgcaaggcctgtgctg

SEQ ID NO: 418661 - DNA, 15 bp, Homo sapiens
tgaatcggtgctgtc

SEQ ID NO: 418662 - DNA, 16 bp, Homo sapiens
tgaatcgtttcatgta

SEQ ID NO: 418663 - DNA, 19 bp, Homo sapiens
tgaatctcccctcctcaca

SEQ ID NO: 418664 - DNA, 21 bp, Homo sapiens
tgaatctctcaaaatgtgccg

SEQ ID NO: 418665 - DNA, 13 bp, Homo sapiens
tgaatctgcaggg

SEQ ID NO: 418666 - DNA, 13 bp, Homo sapiens
tgaatcttaattt

SEQ ID NO: 418667 - DNA, 15 bp, Homo sapiens
tgaatcttatggtgg

SEQ ID NO: 418668 - DNA, 17 bp, Homo sapiens
tgaatcttatggtggaa

SEQ ID NO: 418669 - DNA, 11 bp, Homo sapiens
tgaatgaaaaa

SEQ ID NO: 418670 - DNA, 20 bp, Homo sapiens
tgaatgaaagtcttgtgact

SEQ ID NO: 418671 - DNA, 21 bp, Homo sapiens
tgaatgaaatataaactgtga

SEQ ID NO: 418672 - DNA, 14 bp, Homo sapiens
tgaatgaaatatca

SEQ ID NO: 418673 - DNA, 18 bp, Homo sapiens
tgaatgaaccatgaatga

SEQ ID NO: 418674 - DNA, 14 bp, Homo sapiens
tgaatgatgagcct

SEQ ID NO: 418675 - DNA, 17 bp, Homo sapiens
tgaatgcagtataaaat

SEQ ID NO: 418676 - DNA, 17 bp, Homo sapiens
tgatatttcttgctttc

SEQ ID NO: 418677 - DNA, 21 bp, Homo sapiens
tgatattttcaacgcagccct

SEQ ID NO: 418678 - DNA, 15 bp, Homo sapiens
tgatcaaaacctgtg

SEQ ID NO: 418679 - DNA, 14 bp, Homo sapiens
tgatcaactgttca

SEQ ID NO: 418680 - DNA, 18 bp, Homo sapiens
tgatcaaggagtgaagta

SEQ ID NO: 418681 - DNA, 16 bp, Homo sapiens
tgatcaataaaatgtg

SEQ ID NO: 418682 - DNA, 12 bp, Homo sapiens
tgatcacagatg

SEQ ID NO: 418683 - DNA, 17 bp, Homo sapiens
tgatcaccacatctttt

SEQ ID NO: 418684 - DNA, 16 bp, Homo sapiens
tgattcccagagcaga

SEQ ID NO: 418685 - DNA, 12 bp, Homo sapiens
tgattccttcct

SEQ ID NO: 418686 - DNA, 16 bp, Homo sapiens
tgattcgcccaaagcc

SEQ ID NO: 418687 - DNA, 21 bp, Homo sapiens
tgattcgcccaaagccagaca

SEQ ID NO: 418688 - DNA, 22 bp, Homo sapiens
tgattcgcccaaagccagacag

SEQ ID NO: 418689 - DNA, 15 bp, Homo sapiens
tgattctaatgtctt

SEQ ID NO: 418690 - DNA, 19 bp, Homo sapiens
tgattctaatgtcttcatt

SEQ ID NO: 418691 - DNA, 14 bp, Homo sapiens
tgattctcatgcac

SEQ ID NO: 418692 - DNA, 15 bp, Homo sapiens
tgattctcctctccc

SEQ ID NO: 418693 - DNA, 17 bp, Homo sapiens
tgattctctcttctctc

SEQ ID NO: 418694 - DNA, 15 bp, Homo sapiens
tgattctgtgtgttt

SEQ ID NO: 418695 - DNA, 19 bp, Homo sapiens
tgattctgttctacttgat

SEQ ID NO: 418696 - DNA, 23 bp, Homo sapiens
tgattctttaatagaagttttat

SEQ ID NO: 418697 - DNA, 21 bp, Homo sapiens
tgattctttcaatccacagta

SEQ ID NO: 418698 - DNA, 14 bp, Homo sapiens
tgcaagtgtgtgca

SEQ ID NO: 418699 - DNA, 18 bp, Homo sapiens
tgcaagtgtgtgcatgtg

SEQ ID NO: 418700 - DNA, 13 bp, Homo sapiens
tgcaagtgtttct

SEQ ID NO: 418701 - DNA, 16 bp, Homo sapiens
tgcaataaaaaagtga

SEQ ID NO: 418702 - DNA, 14 bp, Homo sapiens
tgcaatagagactg

SEQ ID NO: 418703 - DNA, 19 bp, Homo sapiens
tgcaatagagactgtagat

SEQ ID NO: 418704 - DNA, 20 bp, Homo sapiens
tgcaatatcaacaacaagtt

SEQ ID NO: 418705 - DNA, 21 bp, Homo sapiens
tgcaatatcaacaacaagttg

SEQ ID NO: 418706 - DNA, 14 bp, Homo sapiens
tgcaatctccaggg

SEQ ID NO: 418707 - DNA, 16 bp, Homo sapiens
tgcaatctccagggct

SEQ ID NO: 418708 - DNA, 21 bp, Homo sapiens
tgcaatgacacagtcttggct

SEQ ID NO: 418709 - DNA, 19 bp, Homo sapiens
tgcaatgtatcccttctca

SEQ ID NO: 418710 - DNA, 21 bp, Homo sapiens
tgcaatgtcacaacctctctg

SEQ ID NO: 418711 - DNA, 22 bp, Homo sapiens
tgcaatgtcttaaataaaacta

SEQ ID NO: 418712 - DNA, 13 bp, Homo sapiens
tgcaatgtggaaa

SEQ ID NO: 418713 - DNA, 15 bp, Homo sapiens
tgcaatgttattatt

SEQ ID NO: 418714 - DNA, 19 bp, Homo sapiens
tgcaatgtttttgtgtaga

SEQ ID NO: 418715 - DNA, 18 bp, Homo sapiens
tgcaatttgttattcttt

SEQ ID NO: 418716 - DNA, 20 bp, Homo sapiens
tgcaatttgtttaaagaata

SEQ ID NO: 418717 - DNA, 23 bp, Homo sapiens
tgcaattttctaagcaatttctt

SEQ ID NO: 418718 - DNA, 18 bp, Homo sapiens
tgcattgttattgtggaa

SEQ ID NO: 418719 - DNA, 16 bp, Homo sapiens
tgcatttaaaatggac

SEQ ID NO: 418720 - DNA, 18 bp, Homo sapiens
tgcatttaccggcagtgc

SEQ ID NO: 418721 - DNA, 14 bp, Homo sapiens
tgcatttagcacaa

SEQ ID NO: 418722 - DNA, 22 bp, Homo sapiens
tgcatttagcacaaaaaaaatt

SEQ ID NO: 418723 - DNA, 16 bp, Homo sapiens
tgcatttatgcatgag

SEQ ID NO: 418724 - DNA, 19 bp, Homo sapiens
tgcatttctgaatagaaat

SEQ ID NO: 418725 - DNA, 13 bp, Homo sapiens
tgcatttctttat

SEQ ID NO: 418726 - DNA, 21 bp, Homo sapiens
tgcatttctttatttctgtct

SEQ ID NO: 418727 - DNA, 14 bp, Homo sapiens
tgcatttgtgtctg

SEQ ID NO: 418728 - DNA, 19 bp, Homo sapiens
tgcatttgttccattaaaa

SEQ ID NO: 418729 - DNA, 17 bp, Homo sapiens
tgcattttatcagacaa

SEQ ID NO: 418730 - DNA, 16 bp, Homo sapiens
tgcattttctcaggca

SEQ ID NO: 418731 - DNA, 17 bp, Homo sapiens
tgcatttttgtgaaatg

SEQ ID NO: 418732 - DNA, 17 bp, Homo sapiens
tgcattttttaaaacaa

SEQ ID NO: 418733 - DNA, 22 bp, Homo sapiens
tgccaaaaactaaaattcaaca

SEQ ID NO: 418734 - DNA, 17 bp, Homo sapiens
tgccaaacaaaaaggtt

SEQ ID NO: 418735 - DNA, 23 bp, Homo sapiens
tgccaaacaaaaaggttctcagg

SEQ ID NO: 418736 - DNA, 15 bp, Homo sapiens
tgccaaagcaggtca

SEQ ID NO: 418737 - DNA, 11 bp, Homo sapiens
tgccaaagctg

SEQ ID NO: 418738 - DNA, 13 bp, Homo sapiens
tgccaaataaatg

SEQ ID NO: 418739 - DNA, 15 bp, Homo sapiens
tgccaaataaatgct

SEQ ID NO: 418740 - DNA, 18 bp, Homo sapiens
tgccaaatatgtcctggg

SEQ ID NO: 418741 - DNA, 17 bp, Homo sapiens
tgccaaatcctgggcat

SEQ ID NO: 418742 - DNA, 16 bp, Homo sapiens
tgccaacaccttcttg

SEQ ID NO: 418743 - DNA, 19 bp, Homo sapiens
tgccaacaccttcttggct

SEQ ID NO: 418744 - DNA, 20 bp, Homo sapiens
tgccaacctgatgccccttc

SEQ ID NO: 418745 - DNA, 18 bp, Homo sapiens
tgccaactaagccctcga

SEQ ID NO: 418746 - DNA, 21 bp, Homo sapiens
tgccaactccatgaccaggcc

SEQ ID NO: 418747 - DNA, 17 bp, Homo sapiens
tgccaactcgggagcat

SEQ ID NO: 418748 - DNA, 13 bp, Homo sapiens
tgccaagaaatcg

SEQ ID NO: 418749 - DNA, 16 bp, Homo sapiens
tgccaagaactctggg

SEQ ID NO: 418750 - DNA, 14 bp, Homo sapiens
tgccaagcactcga

SEQ ID NO: 418751 - DNA, 13 bp, Homo sapiens
tgccaagcctgga

SEQ ID NO: 418752 - DNA, 20 bp, Homo sapiens
tgccaagcctggagcccctg

SEQ ID NO: 418753 - DNA, 22 bp, Homo sapiens
tgccaagcctggagcccctgtg

SEQ ID NO: 418754 - DNA, 19 bp, Homo sapiens
tgccaaggaggtcccagga

SEQ ID NO: 418755 - DNA, 21 bp, Homo sapiens
tgccaaggccagagtggcctg

SEQ ID NO: 418756 - DNA, 18 bp, Homo sapiens
tgccaaggctctcccctc

SEQ ID NO: 418757 - DNA, 16 bp, Homo sapiens
tgccaagtcctgcctt

SEQ ID NO: 418758 - DNA, 20 bp, Homo sapiens
tgccaagtggtttctatgag

SEQ ID NO: 418759 - DNA, 15 bp, Homo sapiens
tgccaatatgtattg

SEQ ID NO: 418760 - DNA, 18 bp, Homo sapiens
tgccaatcctgtaggcac

SEQ ID NO: 418761 - DNA, 15 bp, Homo sapiens
tgccaatgccacagc

SEQ ID NO: 418762 - DNA, 17 bp, Homo sapiens
tgccaatgccacagcca

SEQ ID NO: 418763 - DNA, 14 bp, Homo sapiens
tgccacaatgtgat

SEQ ID NO: 418764 - DNA, 15 bp, Homo sapiens
tgccacaatgtgata

SEQ ID NO: 418765 - DNA, 18 bp, Homo sapiens
tgccacaatgtgatatgt

SEQ ID NO: 418766 - DNA, 20 bp, Homo sapiens
tgccacacagagtggtcttt

SEQ ID NO: 418767 - DNA, 23 bp, Homo sapiens
tgccacacagagtggtctttctg

SEQ ID NO: 418768 - DNA, 15 bp, Homo sapiens
tgccacacagtgggc

SEQ ID NO: 418769 - DNA, 21 bp, Homo sapiens
tgccacactcagtcccccacc

SEQ ID NO: 418770 - DNA, 12 bp, Homo sapiens
tgccacacttca

SEQ ID NO: 418771 - DNA, 22 bp, Homo sapiens
tgccacactttcactggggatc

SEQ ID NO: 418772 - DNA, 13 bp, Homo sapiens
tgccacaggacac

SEQ ID NO: 418773 - DNA, 18 bp, Homo sapiens
tgccacaggacacagtca

SEQ ID NO: 418774 - DNA, 18 bp, Homo sapiens
tgccacattttgctttat

SEQ ID NO: 418775 - DNA, 12 bp, Homo sapiens
tgccaccaataa

SEQ ID NO: 418776 - DNA, 15 bp, Homo sapiens
tgccaccaataaaaa

SEQ ID NO: 418777 - DNA, 21 bp, Homo sapiens
tgccaccaataaaaatcctac

SEQ ID NO: 418778 - DNA, 20 bp, Homo sapiens
tgccaccaccagatgagaag

SEQ ID NO: 418779 - DNA, 22 bp, Homo sapiens
tgccaccaccagatgagaagtt

SEQ ID NO: 418780 - DNA, 16 bp, Homo sapiens
tgccaccacccacccc

SEQ ID NO: 418781 - DNA, 18 bp, Homo sapiens
tgccaccacccaccccaa

SEQ ID NO: 418782 - DNA, 13 bp, Homo sapiens
tgccaccacccct

SEQ ID NO: 418783 - DNA, 14 bp, Homo sapiens
tgccaccacccctc

SEQ ID NO: 418784 - DNA, 15 bp, Homo sapiens
tgccaccacgtctgc

SEQ ID NO: 418785 - DNA, 21 bp, Homo sapiens
tgccaccacgtctgccaggcc

SEQ ID NO: 418786 - DNA, 12 bp, Homo sapiens
tgccaccaggag

SEQ ID NO: 418787 - DNA, 13 bp, Homo sapiens
tgccaccaggaga

SEQ ID NO: 418788 - DNA, 18 bp, Homo sapiens
tgccaccatggccagcca

SEQ ID NO: 418789 - DNA, 12 bp, Homo sapiens
tgccacccacca

SEQ ID NO: 418790 - DNA, 19 bp, Homo sapiens
tgccacccactcaggattg

SEQ ID NO: 418791 - DNA, 20 bp, Homo sapiens
tgccaccctctgcagggcag

SEQ ID NO: 418792 - DNA, 16 bp, Homo sapiens
tgccacctatgcctgt

SEQ ID NO: 418793 - DNA, 15 bp, Homo sapiens
tgccacctgcagcgt

SEQ ID NO: 418794 - DNA, 12 bp, Homo sapiens
tgccacctgtct

SEQ ID NO: 418795 - DNA, 16 bp, Homo sapiens
tgccacctgtctgtct

SEQ ID NO: 418796 - DNA, 20 bp, Homo sapiens
tgccacgccccgtgtctgga

SEQ ID NO: 418797 - DNA, 23 bp, Homo sapiens
tgccacgtgccattgtctttcct

SEQ ID NO: 418798 - DNA, 18 bp, Homo sapiens
tgccactaggctgggtgc

SEQ ID NO: 418799 - DNA, 23 bp, Homo sapiens
tgccactaggctgggtgcccaca

SEQ ID NO: 418800 - DNA, 15 bp, Homo sapiens
tgccactctctggga

SEQ ID NO: 418801 - DNA, 16 bp, Homo sapiens
tgccactctctgggac

SEQ ID NO: 418802 - DNA, 19 bp, Homo sapiens
tgccactgactgcagggac

SEQ ID NO: 418803 - DNA, 13 bp, Homo sapiens
tgccactgcaaac

SEQ ID NO: 418804 - DNA, 20 bp, Homo sapiens
tgccactgcaaacaataaac

SEQ ID NO: 418805 - DNA, 12 bp, Homo sapiens
tgccactgccag

SEQ ID NO: 418806 - DNA, 14 bp, Homo sapiens
tgccactgccaggc

SEQ ID NO: 418807 - DNA, 15 bp, Homo sapiens
tgccactgccaggca

SEQ ID NO: 418808 - DNA, 17 bp, Homo sapiens
tgccactgccaggcacc

SEQ ID NO: 418809 - DNA, 18 bp, Homo sapiens
tgccactgccaggcacct

SEQ ID NO: 418810 - DNA, 20 bp, Homo sapiens
tgccactgccaggcacctgg

SEQ ID NO: 418811 - DNA, 17 bp, Homo sapiens
tgccactgcccgagctg

SEQ ID NO: 418812 - DNA, 18 bp, Homo sapiens
tgccactgcccgagctgg

SEQ ID NO: 418813 - DNA, 23 bp, Homo sapiens
tgccacttcttaaaggcctggaa

SEQ ID NO: 418814 - DNA, 16 bp, Homo sapiens
tgccacttgacattcc

SEQ ID NO: 418815 - DNA, 18 bp, Homo sapiens
tgccagaaacagtgggag

SEQ ID NO: 418816 - DNA, 23 bp, Homo sapiens
tgccagaaacagtgggagccctg

SEQ ID NO: 418817 - DNA, 18 bp, Homo sapiens
tgccagaagtgtgttttg

SEQ ID NO: 418818 - DNA, 21 bp, Homo sapiens
tgccagacggcacccacccag

SEQ ID NO: 418819 - DNA, 21 bp, Homo sapiens
tgccagagatggaggttctct

SEQ ID NO: 418820 - DNA, 22 bp, Homo sapiens
tgccagcacagagcgtccttcc

SEQ ID NO: 418821 - DNA, 14 bp, Homo sapiens
tgccagcacagggg

SEQ ID NO: 418822 - DNA, 20 bp, Homo sapiens
tgccagcacaggggccccag

SEQ ID NO: 418823 - DNA, 21 bp, Homo sapiens
tgccagccttcctctgcagct

SEQ ID NO: 418824 - DNA, 12 bp, Homo sapiens
tgccagctcagc

SEQ ID NO: 418825 - DNA, 17 bp, Homo sapiens
tgccagctgccttcctc

SEQ ID NO: 418826 - DNA, 18 bp, Homo sapiens
tgccaggactgtgactca

SEQ ID NO: 418827 - DNA, 18 bp, Homo sapiens
tgccaggagcaatgggac

SEQ ID NO: 418828 - DNA, 22 bp, Homo sapiens
tgccaggagcaatgggactgga

SEQ ID NO: 418829 - DNA, 14 bp, Homo sapiens
tgccaggagcagcc

SEQ ID NO: 418830 - DNA, 17 bp, Homo sapiens
tgccaggagcagcctcc

SEQ ID NO: 418831 - DNA, 18 bp, Homo sapiens
tgccaggagcagcctcca

SEQ ID NO: 418832 - DNA, 20 bp, Homo sapiens
tgccaggagcagcctccaag

SEQ ID NO: 418833 - DNA, 22 bp, Homo sapiens
tgccaggaggcggcagctcttc

SEQ ID NO: 418834 - DNA, 13 bp, Homo sapiens
tgccaggagtggg

SEQ ID NO: 418835 - DNA, 21 bp, Homo sapiens
tgccaggagtgggtgggacac

SEQ ID NO: 418836 - DNA, 16 bp, Homo sapiens
tgccaggattttgtat

SEQ ID NO: 418837 - DNA, 22 bp, Homo sapiens
tgccaggcacctggcctgctgg

SEQ ID NO: 418838 - DNA, 19 bp, Homo sapiens
tgccaggcgttggtgccac

SEQ ID NO: 418839 - DNA, 20 bp, Homo sapiens
tgccaggcgttggtgccact

SEQ ID NO: 418840 - DNA, 14 bp, Homo sapiens
tgccaggctctccc

SEQ ID NO: 418841 - DNA, 15 bp, Homo sapiens
tgccaggctctccct

SEQ ID NO: 418842 - DNA, 22 bp, Homo sapiens
tgccaggctgaattacagtgaa

SEQ ID NO: 418843 - DNA, 15 bp, Homo sapiens
tgccaggctgcggtg

SEQ ID NO: 418844 - DNA, 14 bp, Homo sapiens
tgccaggctgggca

SEQ ID NO: 418845 - DNA, 16 bp, Homo sapiens
tgccaggctgtaagca

SEQ ID NO: 418846 - DNA, 19 bp, Homo sapiens
tgccaggctgtcagcgcct

SEQ ID NO: 418847 - DNA, 11 bp, Homo sapiens
tgccagggagc

SEQ ID NO: 418848 - DNA, 18 bp, Homo sapiens
tgccaggggcatccaagg

SEQ ID NO: 418849 - DNA, 15 bp, Homo sapiens
tgccaggttgcagct

SEQ ID NO: 418850 - DNA, 16 bp, Homo sapiens
tgccaggttgcagctg

SEQ ID NO: 418851 - DNA, 18 bp, Homo sapiens
tgccagtatataagctgt

SEQ ID NO: 418852 - DNA, 19 bp, Homo sapiens
tggcatcccagtggcctca

SEQ ID NO: 418853 - DNA, 23 bp, Homo sapiens
tggcatcgtagaagagatgtggc

SEQ ID NO: 418854 - DNA, 23 bp, Homo sapiens
tggcatctctccccatatataaa

SEQ ID NO: 418855 - DNA, 15 bp, Homo sapiens
tggcatgacaaggtg

SEQ ID NO: 418856 - DNA, 17 bp, Homo sapiens
tggcatgacaaggtgtg

SEQ ID NO: 418857 - DNA, 17 bp, Homo sapiens
tggcatggctccagtct

SEQ ID NO: 418858 - DNA, 12 bp, Homo sapiens
tggcatgggaat

SEQ ID NO: 418859 - DNA, 22 bp, Homo sapiens
tggcatggtggcacgtgcctgt

SEQ ID NO: 418860 - DNA, 13 bp, Homo sapiens
tggcattaaaact

SEQ ID NO: 418861 - DNA, 18 bp, Homo sapiens
tggcattactctgcacta

SEQ ID NO: 418862 - DNA, 15 bp, Homo sapiens
tggcattcctttctt

SEQ ID NO: 418863 - DNA, 18 bp, Homo sapiens
tggcattcctttctttaa

SEQ ID NO: 418864 - DNA, 21 bp, Homo sapiens
tggcatttgctgaataacaac

SEQ ID NO: 418865 - DNA, 23 bp, Homo sapiens
tggccaaacatcagacctgtctt

SEQ ID NO: 418866 - DNA, 15 bp, Homo sapiens
tggccaaagtgtaca

SEQ ID NO: 418867 - DNA, 16 bp, Homo sapiens
tggccaaagtgtacaa

SEQ ID NO: 418868 - DNA, 16 bp, Homo sapiens
tggccaaattatttgt

SEQ ID NO: 418869 - DNA, 14 bp, Homo sapiens
tggccaagagcatc

SEQ ID NO: 418870 - DNA, 19 bp, Homo sapiens
tggccaaggggccagctgc

SEQ ID NO: 418871 - DNA, 22 bp, Homo sapiens
tggccaaggggccagctgcccc

SEQ ID NO: 418872 - DNA, 21 bp, Homo sapiens
tggccacaacctgaaagacaa

SEQ ID NO: 418873 - DNA, 22 bp, Homo sapiens
tggccacaccacagcaagccgg

SEQ ID NO: 418874 - DNA, 18 bp, Homo sapiens
tggccaccccgtgccacc

SEQ ID NO: 418875 - DNA, 11 bp, Homo sapiens
tggccaccctg

SEQ ID NO: 418876 - DNA, 20 bp, Homo sapiens
tggccacccttggcctgtcc

SEQ ID NO: 418877 - DNA, 14 bp, Homo sapiens
tggccacggcctgg

SEQ ID NO: 418878 - DNA, 15 bp, Homo sapiens
tggccacggcctggg

SEQ ID NO: 418879 - DNA, 17 bp, Homo sapiens
tggccacggcctgggag

SEQ ID NO: 418880 - DNA, 20 bp, Homo sapiens
tggccactatcacatatgct

SEQ ID NO: 418881 - DNA, 22 bp, Homo sapiens
tggccactgggtctcactcctg

SEQ ID NO: 418882 - DNA, 23 bp, Homo sapiens
tggccactgggtctcactcctga

SEQ ID NO: 418883 - DNA, 18 bp, Homo sapiens
tggccactttgcagacct

SEQ ID NO: 418884 - DNA, 20 bp, Homo sapiens
tggccagaagggggccatga

SEQ ID NO: 418885 - DNA, 21 bp, Homo sapiens
tggccagaccagagctctgga

SEQ ID NO: 418886 - DNA, 22 bp, Homo sapiens
tggccagaccagagctctggag

SEQ ID NO: 418887 - DNA, 21 bp, Homo sapiens
tggccagagagggcccagctg

SEQ ID NO: 418888 - DNA, 15 bp, Homo sapiens
tggccagagcacctc

SEQ ID NO: 418889 - DNA, 19 bp, Homo sapiens
tggccagagcacctcagga

SEQ ID NO: 418890 - DNA, 21 bp, Homo sapiens
tggccagagctggaaggcagg

SEQ ID NO: 418891 - DNA, 22 bp, Homo sapiens
tggccagagctggaaggcaggg

SEQ ID NO: 418892 - DNA, 23 bp, Homo sapiens
tggccagagctggaaggcagggc

SEQ ID NO: 418893 - DNA, 15 bp, Homo sapiens
tggccagaggcagct

SEQ ID NO: 418894 - DNA, 21 bp, Homo sapiens
tggccagccaacttttgcatg

SEQ ID NO: 418895 - DNA, 18 bp, Homo sapiens
tggccagcctggggcctg

SEQ ID NO: 418896 - DNA, 14 bp, Homo sapiens
tggccaggagctct

SEQ ID NO: 418897 - DNA, 16 bp, Homo sapiens
tggctggggcagaggg

SEQ ID NO: 418898 - DNA, 15 bp, Homo sapiens
tggctggggctggca

SEQ ID NO: 418899 - DNA, 16 bp, Homo sapiens
tggctgggggcaggag

SEQ ID NO: 418900 - DNA, 17 bp, Homo sapiens
tggctgggggcaggagg

SEQ ID NO: 418901 - DNA, 11 bp, Homo sapiens
tggctgggtgg

SEQ ID NO: 418902 - DNA, 17 bp, Homo sapiens
tggctgggtttgggcag

SEQ ID NO: 418903 - DNA, 14 bp, Homo sapiens
tggctggtcaactt

SEQ ID NO: 418904 - DNA, 13 bp, Homo sapiens
tggctggtgtccc

SEQ ID NO: 418905 - DNA, 16 bp, Homo sapiens
tggctggtgtcccctt

SEQ ID NO: 418906 - DNA, 15 bp, Homo sapiens
tggctggtttctgag

SEQ ID NO: 418907 - DNA, 23 bp, Homo sapiens
tggctgtaaaaacacaaatgtgt

SEQ ID NO: 418908 - DNA, 14 bp, Homo sapiens
tggctgtaatttaa

SEQ ID NO: 418909 - DNA, 15 bp, Homo sapiens
tggctgtctgcctgt

SEQ ID NO: 418910 - DNA, 12 bp, Homo sapiens
tggctgtgaaaa

SEQ ID NO: 418911 - DNA, 15 bp, Homo sapiens
tggctgtgagcagcc

SEQ ID NO: 418912 - DNA, 16 bp, Homo sapiens
tggctgtgagcagcct

SEQ ID NO: 418913 - DNA, 17 bp, Homo sapiens
tggctgtgattaattat

SEQ ID NO: 418914 - DNA, 17 bp, Homo sapiens
tggctgtggaggcctga

SEQ ID NO: 418915 - DNA, 21 bp, Homo sapiens
tggctgtggaggcctgatgct

SEQ ID NO: 418916 - DNA, 14 bp, Homo sapiens
tggctgtggcacag

SEQ ID NO: 418917 - DNA, 23 bp, Homo sapiens
tggctgtggcacagacttctgga

SEQ ID NO: 418918 - DNA, 18 bp, Homo sapiens
tggctgtggcccctcctt

SEQ ID NO: 418919 - DNA, 21 bp, Homo sapiens
tgggactgatgtcatcttgag

SEQ ID NO: 418920 - DNA, 16 bp, Homo sapiens
tgggactgggagggcc

SEQ ID NO: 418921 - DNA, 18 bp, Homo sapiens
tgggactgggagggccca

SEQ ID NO: 418922 - DNA, 17 bp, Homo sapiens
tgggactgtcttgagaa

SEQ ID NO: 418923 - DNA, 18 bp, Homo sapiens
tgggactgtcttgagaaa

SEQ ID NO: 418924 - DNA, 17 bp, Homo sapiens
tgggacttccttgctct

SEQ ID NO: 418925 - DNA, 18 bp, Homo sapiens
tgggacttgaaatcaaat

SEQ ID NO: 418926 - DNA, 16 bp, Homo sapiens
tgggagaaaagccaga

SEQ ID NO: 418927 - DNA, 17 bp, Homo sapiens
tgggagaaaagccagat

SEQ ID NO: 418928 - DNA, 19 bp, Homo sapiens
tgggagaacacatttctaa

SEQ ID NO: 418929 - DNA, 18 bp, Homo sapiens
tgggagaaggactatcaa

SEQ ID NO: 418930 - DNA, 15 bp, Homo sapiens
tgggagaagggacag

SEQ ID NO: 418931 - DNA, 16 bp, Homo sapiens
tgggagaagggacagc

SEQ ID NO: 418932 - DNA, 14 bp, Homo sapiens
tgggagaaggtgct

SEQ ID NO: 418933 - DNA, 18 bp, Homo sapiens
tgggagacctgtaatcat

SEQ ID NO: 418934 - DNA, 18 bp, Homo sapiens
tgggagagaccattgcat

SEQ ID NO: 418935 - DNA, 14 bp, Homo sapiens
tgggagagactgtg

SEQ ID NO: 418936 - DNA, 23 bp, Homo sapiens
tgggagagcccctggggcctaga

SEQ ID NO: 418937 - DNA, 23 bp, Homo sapiens
tgggagaggatttttttctgagc

SEQ ID NO: 418938 - DNA, 13 bp, Homo sapiens
tgggagaggcaga

SEQ ID NO: 418939 - DNA, 14 bp, Homo sapiens
tgggagaggcagaa

SEQ ID NO: 418940 - DNA, 13 bp, Homo sapiens
tgggagagggagc

SEQ ID NO: 418941 - DNA, 22 bp, Homo sapiens
tgggagatgaaaacctgcattt

SEQ ID NO: 418942 - DNA, 13 bp, Homo sapiens
tgggagcactgga

SEQ ID NO: 418943 - DNA, 23 bp, Homo sapiens
tgggagcactggagtgcagggag

SEQ ID NO: 418944 - DNA, 14 bp, Homo sapiens
tgggagcagaacag

SEQ ID NO: 418945 - DNA, 16 bp, Homo sapiens
tgggagcccagcacac

SEQ ID NO: 418946 - DNA, 20 bp, Homo sapiens
tgggagcctcgcccctccag

SEQ ID NO: 418947 - DNA, 11 bp, Homo sapiens
tgggagcctga

SEQ ID NO: 418948 - DNA, 13 bp, Homo sapiens
tgggagctctgct

SEQ ID NO: 418949 - DNA, 16 bp, Homo sapiens
tgggagctctgcttgc

SEQ ID NO: 418950 - DNA, 17 bp, Homo sapiens
tgggagctgtcaggcag

SEQ ID NO: 418951 - DNA, 20 bp, Homo sapiens
tgggagcttgattctcagca

SEQ ID NO: 418952 - DNA, 17 bp, Homo sapiens
tgggaggaacaaagaca

SEQ ID NO: 418953 - DNA, 16 bp, Homo sapiens
tgggaggagagggcag

SEQ ID NO: 418954 - DNA, 18 bp, Homo sapiens
tgggaggagagggcagag

SEQ ID NO: 418955 - DNA, 23 bp, Homo sapiens
tgggaggcaggtcccgagccccc

SEQ ID NO: 418956 - DNA, 11 bp, Homo sapiens
tgggaggccaa

SEQ ID NO: 418957 - DNA, 16 bp, Homo sapiens
tgggaggccaaggcag

SEQ ID NO: 418958 - DNA, 19 bp, Homo sapiens
tgggaggccaaggcaggta

SEQ ID NO: 418959 - DNA, 21 bp, Homo sapiens
tgggaggccaaggtgggcgga

SEQ ID NO: 418960 - DNA, 21 bp, Homo sapiens
tgggaggcgtgcccccctcct

SEQ ID NO: 418961 - DNA, 14 bp, Homo sapiens
tgggagggcaaggg

SEQ ID NO: 418962 - DNA, 15 bp, Homo sapiens
tgggagggggccctt

SEQ ID NO: 418963 - DNA, 13 bp, Homo sapiens
tgggcggcagaga

SEQ ID NO: 418964 - DNA, 14 bp, Homo sapiens
tgggcggctgagag

SEQ ID NO: 418965 - DNA, 15 bp, Homo sapiens
tgggcggctgagagc

SEQ ID NO: 418966 - DNA, 18 bp, Homo sapiens
tgggcggctgagagcccc

SEQ ID NO: 418967 - DNA, 13 bp, Homo sapiens
tgggctactggca

SEQ ID NO: 418968 - DNA, 15 bp, Homo sapiens
tgggctactggcagc

SEQ ID NO: 418969 - DNA, 18 bp, Homo sapiens
tgggctactggcagctcc

SEQ ID NO: 418970 - DNA, 19 bp, Homo sapiens
tgggctagtgtgagtggca

SEQ ID NO: 418971 - DNA, 22 bp, Homo sapiens
tgggctagtgtgagtggcagcc

SEQ ID NO: 418972 - DNA, 21 bp, Homo sapiens
tgggctcaagcaatcctcctg

SEQ ID NO: 418973 - DNA, 13 bp, Homo sapiens
tgggctcagggct

SEQ ID NO: 418974 - DNA, 15 bp, Homo sapiens
tgggctcagggctgg

SEQ ID NO: 418975 - DNA, 12 bp, Homo sapiens
tgggctccagag

SEQ ID NO: 418976 - DNA, 16 bp, Homo sapiens
tgggctccagagtagg

SEQ ID NO: 418977 - DNA, 15 bp, Homo sapiens
tgggctcctggctgc

SEQ ID NO: 418978 - DNA, 16 bp, Homo sapiens
tgggctcctggctgcc

SEQ ID NO: 418979 - DNA, 17 bp, Homo sapiens
tgggctcctggctgcca

SEQ ID NO: 418980 - DNA, 19 bp, Homo sapiens
tgggctcctggctgccagg

SEQ ID NO: 418981 - DNA, 20 bp, Homo sapiens
tgggctcctggctgccaggc

SEQ ID NO: 418982 - DNA, 23 bp, Homo sapiens
tgggctctgacccaagtggggcc

SEQ ID NO: 418983 - DNA, 18 bp, Homo sapiens
tgggctctgccaccctac

SEQ ID NO: 418984 - DNA, 15 bp, Homo sapiens
tgggctctggctccc

SEQ ID NO: 418985 - DNA, 14 bp, Homo sapiens
tgggctcttggccg

SEQ ID NO: 418986 - DNA, 13 bp, Homo sapiens
tgggctgacacct

SEQ ID NO: 418987 - DNA, 19 bp, Homo sapiens
tgggctgacacctaccatg

SEQ ID NO: 418988 - DNA, 22 bp, Homo sapiens
tgggctgacacctaccatgctg

SEQ ID NO: 418989 - DNA, 19 bp, Homo sapiens
tgggctgagcccctacccc

SEQ ID NO: 418990 - DNA, 13 bp, Homo sapiens
tgggctgccctgg

SEQ ID NO: 418991 - DNA, 17 bp, Homo sapiens
tgggctgccctggtgct

SEQ ID NO: 418992 - DNA, 19 bp, Homo sapiens
tgggctgccctggtgctgc

SEQ ID NO: 418993 - DNA, 20 bp, Homo sapiens
tgggctgccctggtgctgcc

SEQ ID NO: 418994 - DNA, 21 bp, Homo sapiens
tgggctgcttcacatccaccc

SEQ ID NO: 418995 - DNA, 13 bp, Homo sapiens
tgggctgggagaa

SEQ ID NO: 418996 - DNA, 16 bp, Homo sapiens
tgggctggtattctct

SEQ ID NO: 418997 - DNA, 20 bp, Homo sapiens
tgtaaatattcttgtccaca

SEQ ID NO: 418998 - DNA, 18 bp, Homo sapiens
tgtaaatcctagacttga

SEQ ID NO: 418999 - DNA, 21 bp, Homo sapiens
tgtaaatgaacacatggcaga

SEQ ID NO: 419000 - DNA, 21 bp, Homo sapiens
tgtaaatgaagggtcatttct

SEQ ID NO: 419001 - DNA, 22 bp, Homo sapiens
tgtaaatgagggcagaaacctt

SEQ ID NO: 419002 - DNA, 21 bp, Homo sapiens
tgtaaatgatatgtctttaaa

SEQ ID NO: 419003 - DNA, 19 bp, Homo sapiens
tgtaaatgtttaatatctg

SEQ ID NO: 419004 - DNA, 16 bp, Homo sapiens
tgtaaattattgtaaa

SEQ ID NO: 419005 - DNA, 22 bp, Homo sapiens
tgtaaattattgtaaacttttt

SEQ ID NO: 419006 - DNA, 18 bp, Homo sapiens
tgtaaatttaactgcata

SEQ ID NO: 419007 - DNA, 15 bp, Homo sapiens
tgtaaatttataaat

SEQ ID NO: 419008 - DNA, 18 bp, Homo sapiens
tgtaaatttgtactattt

SEQ ID NO: 419009 - DNA, 15 bp, Homo sapiens
tgtaacaagaaaaca

SEQ ID NO: 419010 - DNA, 20 bp, Homo sapiens
tgtaacacagctgagagact

SEQ ID NO: 419011 - DNA, 21 bp, Homo sapiens
tgtaacacagctgagagactt

SEQ ID NO: 419012 - DNA, 15 bp, Homo sapiens
tgtaacagctgaggt

SEQ ID NO: 419013 - DNA, 22 bp, Homo sapiens
tgtaacagttggtgattttaga

SEQ ID NO: 419014 - DNA, 13 bp, Homo sapiens
tgtaaccaagctg

SEQ ID NO: 419015 - DNA, 18 bp, Homo sapiens
tgtaaccacctctctgtc

SEQ ID NO: 419016 - DNA, 18 bp, Homo sapiens
tgtaacctcagctctggg

SEQ ID NO: 419017 - DNA, 13 bp, Homo sapiens
tgtaacctcgtgt

SEQ ID NO: 419018 - DNA, 20 bp, Homo sapiens
tgtaactaaagtatttaaag

SEQ ID NO: 419019 - DNA, 13 bp, Homo sapiens
tgtaactcagaca

SEQ ID NO: 419020 - DNA, 22 bp, Homo sapiens
tgtaactgcccttttaaatggc

SEQ ID NO: 419021 - DNA, 23 bp, Homo sapiens
tgtaactgcccttttaaatggca

SEQ ID NO: 419022 - DNA, 15 bp, Homo sapiens
tgtaacttgtgcttt

SEQ ID NO: 419023 - DNA, 13 bp, Homo sapiens
tgtaagaaaacaa

SEQ ID NO: 419024 - DNA, 17 bp, Homo sapiens
tgtaagaagagactggg

SEQ ID NO: 419025 - DNA, 21 bp, Homo sapiens
tgtaagaagagactgggaaga

SEQ ID NO: 419026 - DNA, 23 bp, Homo sapiens
tgtaagacacacagcctttctgt

SEQ ID NO: 419027 - DNA, 16 bp, Homo sapiens
tgtaagctgtgtccta

SEQ ID NO: 419028 - DNA, 14 bp, Homo sapiens
tgtaaggaatgatt

SEQ ID NO: 419029 - DNA, 22 bp, Homo sapiens
tgtaaggtcttcttgtgtcctg

SEQ ID NO: 419030 - DNA, 17 bp, Homo sapiens
tgtaagtaaactgccct

SEQ ID NO: 419031 - DNA, 18 bp, Homo sapiens
tgtaagtaaactgccctg

SEQ ID NO: 419032 - DNA, 14 bp, Homo sapiens
tgtaagtaattatc

SEQ ID NO: 419033 - DNA, 14 bp, Homo sapiens
tgtaagtgtgagta

SEQ ID NO: 419034 - DNA, 21 bp, Homo sapiens
tgtaagtgtgagtaagagctg

SEQ ID NO: 419035 - DNA, 22 bp, Homo sapiens
tgtaagttatttcttgtttgtt

SEQ ID NO: 419036 - DNA, 21 bp, Homo sapiens
tgtaataaaaatttgtttaaa

SEQ ID NO: 419037 - DNA, 14 bp, Homo sapiens
tgtaatatcatttc

SEQ ID NO: 419038 - DNA, 15 bp, Homo sapiens
tgtaatatcatttca

SEQ ID NO: 419039 - DNA, 19 bp, Homo sapiens
tgtaatatcatttcataaa

SEQ ID NO: 419040 - DNA, 14 bp, Homo sapiens
tgtaatatctttaa

SEQ ID NO: 419041 - DNA, 17 bp, Homo sapiens
tgtaatattaaattcct

SEQ ID NO: 419042 - DNA, 18 bp, Homo sapiens
tgtaatattctctgatgt

SEQ ID NO: 419043 - DNA, 21 bp, Homo sapiens
tgtaatatttcttcaagtgag

SEQ ID NO: 419044 - DNA, 19 bp, Homo sapiens
tgtaatcacactctcttct

SEQ ID NO: 419045 - DNA, 13 bp, Homo sapiens
tgtaatcatttat

SEQ ID NO: 419046 - DNA, 14 bp, Homo sapiens
tgtaatcatttatc

SEQ ID NO: 419047 - DNA, 20 bp, Homo sapiens
tgtaatccaggggtgtagat

SEQ ID NO: 419048 - DNA, 16 bp, Homo sapiens
tgtaatcccagcactt

SEQ ID NO: 419049 - DNA, 22 bp, Homo sapiens
tgtaatcccagcactttgggag

SEQ ID NO: 419050 - DNA, 17 bp, Homo sapiens
tgtaatcccagctactt

SEQ ID NO: 419051 - DNA, 22 bp, Homo sapiens
tgtaatcccagctacttgggag

SEQ ID NO: 419052 - DNA, 20 bp, Homo sapiens
tgtaatcctcagctgacaca

SEQ ID NO: 419053 - DNA, 19 bp, Homo sapiens
tgtaatctctgattaaatt

SEQ ID NO: 419054 - DNA, 12 bp, Homo sapiens
tgtaatcttaaa

SEQ ID NO: 419055 - DNA, 15 bp, Homo sapiens
tgtaatctttttctc

SEQ ID NO: 419056 - DNA, 17 bp, Homo sapiens
tgtaatggaactgaccc

SEQ ID NO: 419057 - DNA, 17 bp, Homo sapiens
tgtaatgtatcttattt

SEQ ID NO: 419058 - DNA, 16 bp, Homo sapiens
tgtaatgtgtatgtct

SEQ ID NO: 419059 - DNA, 16 bp, Homo sapiens
tgtaatgttactgatc

SEQ ID NO: 419060 - DNA, 19 bp, Homo sapiens
tgtaatgttactgatcatg

SEQ ID NO: 419061 - DNA, 23 bp, Homo sapiens
tgtaattacctgtcatctgggcc

SEQ ID NO: 419062 - DNA, 15 bp, Homo sapiens
tgtaattgaataaag

SEQ ID NO: 419063 - DNA, 18 bp, Homo sapiens
tgtaattggcttttgaat

SEQ ID NO: 419064 - DNA, 22 bp, Homo sapiens
tgtaattggcttttgaatcaaa

SEQ ID NO: 419065 - DNA, 17 bp, Homo sapiens
tgtaattttaatggctg

SEQ ID NO: 419066 - DNA, 17 bp, Homo sapiens
tgtacaaagtagagaag

SEQ ID NO: 419067 - DNA, 20 bp, Homo sapiens
tgtacaaagtagagaagtat

SEQ ID NO: 419068 - DNA, 19 bp, Homo sapiens
tgtacaattactaaattgt

SEQ ID NO: 419069 - DNA, 22 bp, Homo sapiens
tgtacaattactaaattgtata

SEQ ID NO: 419070 - DNA, 18 bp, Homo sapiens
tgtacaattttcatccca

SEQ ID NO: 419071 - DNA, 21 bp, Homo sapiens
tgtacacaacacctaaaacca

SEQ ID NO: 419072 - DNA, 12 bp, Homo sapiens
tgtacactgaat

SEQ ID NO: 419073 - DNA, 17 bp, Homo sapiens
tgtacactgaatattta

SEQ ID NO: 419074 - DNA, 20 bp, Homo sapiens
tgtacactgaatatttatat

SEQ ID NO: 419075 - DNA, 17 bp, Homo sapiens
tgtacactgacttgaga

SEQ ID NO: 419076 - DNA, 20 bp, Homo sapiens
tgtacactttctgtctcaaa

SEQ ID NO: 419077 - DNA, 21 bp, Homo sapiens
tgtacagaaccagcactccca

SEQ ID NO: 419078 - DNA, 23 bp, Homo sapiens
tgtacagaaccagcactcccagg

SEQ ID NO: 419079 - DNA, 17 bp, Homo sapiens
tgtacagaatcattgct

SEQ ID NO: 419080 - DNA, 17 bp, Homo sapiens
tgtacagagtggcccct

SEQ ID NO: 419081 - DNA, 17 bp, Homo sapiens
tgtacagatatcgagag

SEQ ID NO: 419082 - DNA, 14 bp, Homo sapiens
tgtacagtatgtgt

SEQ ID NO: 419083 - DNA, 16 bp, Homo sapiens
tgtacagtatgtgtct

SEQ ID NO: 419084 - DNA, 17 bp, Homo sapiens
tgtacagtctcaatttt

SEQ ID NO: 419085 - DNA, 14 bp, Homo sapiens
tgtacagtctgtca

SEQ ID NO: 419086 - DNA, 14 bp, Homo sapiens
tgtacagttataca

SEQ ID NO: 419087 - DNA, 18 bp, Homo sapiens
tgtacagttgactggctt

SEQ ID NO: 419088 - DNA, 23 bp, Homo sapiens
tgtacataaattgcataaagcat

SEQ ID NO: 419089 - DNA, 14 bp, Homo sapiens
tgtacatacattgt

SEQ ID NO: 419090 - DNA, 18 bp, Homo sapiens
tgtacatacattgtatag

SEQ ID NO: 419091 - DNA, 17 bp, Homo sapiens
tgtacatagtggtcatt

SEQ ID NO: 419092 - DNA, 20 bp, Homo sapiens
tgtacatagtggtcatttgg

SEQ ID NO: 419093 - DNA, 17 bp, Homo sapiens
tgtacatatggaaatcc

SEQ ID NO: 419094 - DNA, 23 bp, Homo sapiens
tgtacatattactgttgcattta

SEQ ID NO: 419095 - DNA, 15 bp, Homo sapiens
tgtacatcatgttat

SEQ ID NO: 419096 - DNA, 22 bp, Homo sapiens
tgtacatgaagaagctaaatcc

SEQ ID NO: 419097 - DNA, 14 bp, Homo sapiens
tgtacattaattac

SEQ ID NO: 419098 - DNA, 16 bp, Homo sapiens
tgtacatttatgtgtg

SEQ ID NO: 419099 - DNA, 14 bp, Homo sapiens
tgtaccaagcccct

SEQ ID NO: 419100 - DNA, 17 bp, Homo sapiens
tgtaccactgctaataa

SEQ ID NO: 419101 - DNA, 20 bp, Homo sapiens
tgtaccactgctaataaatg

SEQ ID NO: 419102 - DNA, 22 bp, Homo sapiens
tgtaccagtgtactgctttcaa

SEQ ID NO: 419103 - DNA, 12 bp, Homo sapiens
tgtaccatcaat

SEQ ID NO: 419104 - DNA, 15 bp, Homo sapiens
tgtaccatcaataaa

SEQ ID NO: 419105 - DNA, 21 bp, Homo sapiens
tgtaccatgaaacaaagctgc

SEQ ID NO: 419106 - DNA, 17 bp, Homo sapiens
tgtaccatgtacatgaa

SEQ ID NO: 419107 - DNA, 13 bp, Homo sapiens
tgtaccatgttaa

SEQ ID NO: 419108 - DNA, 16 bp, Homo sapiens
tgtaccatgttaaaga

SEQ ID NO: 419109 - DNA, 22 bp, Homo sapiens
tgtacccagccaccttcctgac

SEQ ID NO: 419110 - DNA, 13 bp, Homo sapiens
tgtacccagctcc

SEQ ID NO: 419111 - DNA, 21 bp, Homo sapiens
tgtaccgggctggcctgtgcc

SEQ ID NO: 419112 - DNA, 18 bp, Homo sapiens
tgtacctctaagtacata

SEQ ID NO: 419113 - DNA, 12 bp, Homo sapiens
tgtacctgtagg

SEQ ID NO: 419114 - DNA, 17 bp, Homo sapiens
tgtacctgtaggaaaca

SEQ ID NO: 419115 - DNA, 23 bp, Homo sapiens
tgtacctgtaggaaacagaaaag

SEQ ID NO: 419116 - DNA, 14 bp, Homo sapiens
tgtacgtgggagag

SEQ ID NO: 419117 - DNA, 16 bp, Homo sapiens
tgtacgtgggagaggc

SEQ ID NO: 419118 - DNA, 17 bp, Homo sapiens
tgtacgtgggagaggca

SEQ ID NO: 419119 - DNA, 18 bp, Homo sapiens
tgtactaagccaggaggc

SEQ ID NO: 419120 - DNA, 21 bp, Homo sapiens
tgtactaattaacatataata

SEQ ID NO: 419121 - DNA, 15 bp, Homo sapiens
tgtactacatttgca

SEQ ID NO: 419122 - DNA, 22 bp, Homo sapiens
tgtactacatttgcatgccttt

SEQ ID NO: 419123 - DNA, 19 bp, Homo sapiens
tgtactatggctgtatttt

SEQ ID NO: 419124 - DNA, 15 bp, Homo sapiens
tgtactatttaactg

SEQ ID NO: 419125 - DNA, 12 bp, Homo sapiens
tgtactcctccc

SEQ ID NO: 419126 - DNA, 19 bp, Homo sapiens
tgtactctacgccaaagtg

SEQ ID NO: 419127 - DNA, 15 bp, Homo sapiens
tgtactgacttgagg

SEQ ID NO: 419128 - DNA, 19 bp, Homo sapiens
tgtactgagccttgtaatt

SEQ ID NO: 419129 - DNA, 20 bp, Homo sapiens
tgtactgagccttgtaattc

SEQ ID NO: 419130 - DNA, 21 bp, Homo sapiens
tggttgtgaaccaactgcctt

SEQ ID NO: 419131 - DNA, 22 bp, Homo sapiens
tggttgtgaaccaactgcctta

SEQ ID NO: 419132 - DNA, 15 bp, Homo sapiens
tggttgttgccaggt

SEQ ID NO: 419133 - DNA, 16 bp, Homo sapiens
tggttgttgccaggtt

SEQ ID NO: 419134 - DNA, 15 bp, Homo sapiens
tggttgtttctctga

SEQ ID NO: 419135 - DNA, 16 bp, Homo sapiens
tggtttaaaaagtttc

SEQ ID NO: 419136 - DNA, 23 bp, Homo sapiens
tggtttaaaagacacacttgtcc

SEQ ID NO: 419137 - DNA, 18 bp, Homo sapiens
tggtttcactggcccaag

SEQ ID NO: 419138 - DNA, 17 bp, Homo sapiens
tggtttcataggagaca

SEQ ID NO: 419139 - DNA, 16 bp, Homo sapiens
tggtttcattgccttc

SEQ ID NO: 419140 - DNA, 19 bp, Homo sapiens
tggtttcctcattcctgaa

SEQ ID NO: 419141 - DNA, 15 bp, Homo sapiens
tggtttctgtttgaa

SEQ ID NO: 419142 - DNA, 23 bp, Homo sapiens
tggtttctgtttgaattttcaaa

SEQ ID NO: 419143 - DNA, 12 bp, Homo sapiens
tggttttaacaa

SEQ ID NO: 419144 - DNA, 18 bp, Homo sapiens
tggttttaccccagctcc

SEQ ID NO: 419145 - DNA, 11 bp, Homo sapiens
tggttttacta

SEQ ID NO: 419146 - DNA, 14 bp, Homo sapiens
tggttttcccctcc

SEQ ID NO: 419147 - DNA, 18 bp, Homo sapiens
tggttttcccctccctgg

SEQ ID NO: 419148 - DNA, 18 bp, Homo sapiens
tggttttcttttgccatg

SEQ ID NO: 419149 - DNA, 16 bp, Homo sapiens
tggttttggtttccac

SEQ ID NO: 419150 - DNA, 19 bp, Homo sapiens
tggtttttcttttcttgga

SEQ ID NO: 419151 - DNA, 14 bp, Homo sapiens
tggtttttgctctc

SEQ ID NO: 419152 - DNA, 12 bp, Homo sapiens
tgtaaaaaagaa

SEQ ID NO: 419153 - DNA, 14 bp, Homo sapiens
tgtaaaaaagaaaa

SEQ ID NO: 419154 - DNA, 19 bp, Homo sapiens
tgtaaaaacacaaatgtgt

SEQ ID NO: 419155 - DNA, 12 bp, Homo sapiens
tgtaaaaatatg

SEQ ID NO: 419156 - DNA, 16 bp, Homo sapiens
tgtaaaacaaaaaaca

SEQ ID NO: 419157 - DNA, 16 bp, Homo sapiens
tgtaaaacctgtcaat

SEQ ID NO: 419158 - DNA, 23 bp, Homo sapiens
tgtaaaactgtgacattccacag

SEQ ID NO: 419159 - DNA, 18 bp, Homo sapiens
tgtaaaactttattttat

SEQ ID NO: 419160 - DNA, 13 bp, Homo sapiens
tgtaaaatactat

SEQ ID NO: 419161 - DNA, 14 bp, Homo sapiens
tgtaaaatcttcag

SEQ ID NO: 419162 - DNA, 14 bp, Homo sapiens
tgtaaaattcatag

SEQ ID NO: 419163 - DNA, 17 bp, Homo sapiens
tgtaaacaacgtgtata

SEQ ID NO: 419164 - DNA, 17 bp, Homo sapiens
tgtaaacattcatattt

SEQ ID NO: 419165 - DNA, 22 bp, Homo sapiens
tgtaaacattcatatttgcaat

SEQ ID NO: 419166 - DNA, 14 bp, Homo sapiens
tgtaaactcttcac

SEQ ID NO: 419167 - DNA, 18 bp, Homo sapiens
tgtaaagtatgtaaacag

SEQ ID NO: 419168 - DNA, 15 bp, Homo sapiens
tgtaaataaaaatag

SEQ ID NO: 419169 - DNA, 15 bp, Homo sapiens
tgtaaataagagatt

SEQ ID NO: 419170 - DNA, 13 bp, Homo sapiens
tgtaaatacaaaa

SEQ ID NO: 419171 - DNA, 21 bp, Homo sapiens
tgtaaatacacatagcatgta

SEQ ID NO: 419172 - DNA, 15 bp, Homo sapiens
tgtaaatacatgtgt

SEQ ID NO: 419173 - DNA, 18 bp, Homo sapiens
tgtaaatacatgtgtgga

SEQ ID NO: 419174 - DNA, 19 bp, Homo sapiens
tgtaaatacatgtgtggat

SEQ ID NO: 419175 - DNA, 16 bp, Homo sapiens
tgtaaatagtatttga

SEQ ID NO: 419176 - DNA, 13 bp, Homo sapiens
tgtaaatattaaa

SEQ ID NO: 419177 - DNA, 15 bp, Homo sapiens
tgtaaatattctata

SEQ ID NO: 419178 - DNA, 16 bp, Homo sapiens
tgtaaatattctatat

SEQ ID NO: 419179 - DNA, 22 bp, Homo sapiens
tgtactgagccttgtaattcta

SEQ ID NO: 419180 - DNA, 19 bp, Homo sapiens
tgtactgggttaatggcta

SEQ ID NO: 419181 - DNA, 12 bp, Homo sapiens
tgtactgtgctg

SEQ ID NO: 419182 - DNA, 15 bp, Homo sapiens
tgtacttaactattc

SEQ ID NO: 419183 - DNA, 23 bp, Homo sapiens
tgtacttcataagatattcttta

SEQ ID NO: 419184 - DNA, 22 bp, Homo sapiens
tgtacttcttcatccatagaca

SEQ ID NO: 419185 - DNA, 18 bp, Homo sapiens
tgtagaaacacagcctat

SEQ ID NO: 419186 - DNA, 22 bp, Homo sapiens
tgtagaactgcaatttccattc

SEQ ID NO: 419187 - DNA, 19 bp, Homo sapiens
tgtagaactgttcatttcc

SEQ ID NO: 419188 - DNA, 23 bp, Homo sapiens
tgtagaagaaagcaaaaaataaa

SEQ ID NO: 419189 - DNA, 24 bp, Homo sapiens
tgtagaagagggagaaggagaggc

SEQ ID NO: 419190 - DNA, 14 bp, Homo sapiens
tgtagaatgctgta

SEQ ID NO: 419191 - DNA, 21 bp, Homo sapiens
tgtagacctagggaggacctt

SEQ ID NO: 419192 - DNA, 11 bp, Homo sapiens
tgtagactagt

SEQ ID NO: 419193 - DNA, 21 bp, Homo sapiens
tgtagactggccatgcaagtg

SEQ ID NO: 419194 - DNA, 21 bp, Homo sapiens
tgtagacttctggttgtattt

SEQ ID NO: 419195 - DNA, 11 bp, Homo sapiens
tgtagagactt

SEQ ID NO: 419196 - DNA, 14 bp, Homo sapiens
tgtagagccagcct

SEQ ID NO: 419197 - DNA, 21 bp, Homo sapiens
tgtagagtggtctatttctcc

SEQ ID NO: 419198 - DNA, 21 bp, Homo sapiens
tgtagatacaatcagctgctt

SEQ ID NO: 419199 - DNA, 24 bp, Homo sapiens
tgtagatattgttttctgtaaata

SEQ ID NO: 419200 - DNA, 20 bp, Homo sapiens
tgtagatcaactcatgttaa

SEQ ID NO: 419201 - DNA, 16 bp, Homo sapiens
tgtagatggagcaagt

SEQ ID NO: 419202 - DNA, 14 bp, Homo sapiens
tgtagatgtagcat

SEQ ID NO: 419203 - DNA, 20 bp, Homo sapiens
tgtagcaaaacgcatggagt

SEQ ID NO: 419204 - DNA, 14 bp, Homo sapiens
tgtagcatataaat

SEQ ID NO: 419205 - DNA, 15 bp, Homo sapiens
tgtagcatataaatg

SEQ ID NO: 419206 - DNA, 17 bp, Homo sapiens
tgtagcattgttccaca

SEQ ID NO: 419207 - DNA, 18 bp, Homo sapiens
tgtagcatttcttgatgt

SEQ ID NO: 419208 - DNA, 14 bp, Homo sapiens
tgtagccaggaagc

SEQ ID NO: 419209 - DNA, 17 bp, Homo sapiens
tgtagccatggctcagg

SEQ ID NO: 419210 - DNA, 14 bp, Homo sapiens
tgtagcccacactt

SEQ ID NO: 419211 - DNA, 21 bp, Homo sapiens
tgtagcctgcgtcatggctca

SEQ ID NO: 419212 - DNA, 23 bp, Homo sapiens
tgtagccttagtgtcacctttct

SEQ ID NO: 419213 - DNA, 16 bp, Homo sapiens
tgtagcgtcctgagga

SEQ ID NO: 419214 - DNA, 20 bp, Homo sapiens
tgtagctaattaggaagctt

SEQ ID NO: 419215 - DNA, 15 bp, Homo sapiens
tgtagctagaatatc

SEQ ID NO: 419216 - DNA, 16 bp, Homo sapiens
tgtagctagaatatcc

SEQ ID NO: 419217 - DNA, 18 bp, Homo sapiens
tgtagctccctcctccca

SEQ ID NO: 419218 - DNA, 20 bp, Homo sapiens
tgtagctccctcctcccatc

SEQ ID NO: 419219 - DNA, 21 bp, Homo sapiens
tgtagctctatggggggaggg

SEQ ID NO: 419220 - DNA, 13 bp, Homo sapiens
tgtagctgatgaa

SEQ ID NO: 419221 - DNA, 21 bp, Homo sapiens
tgtagctgatgaaactcctga

SEQ ID NO: 419222 - DNA, 16 bp, Homo sapiens
tgtaggcgcccctggg

SEQ ID NO: 419223 - DNA, 20 bp, Homo sapiens
tgtagggagatggagaaaat

SEQ ID NO: 419224 - DNA, 16 bp, Homo sapiens
tgtaggtatagaagat

SEQ ID NO: 419225 - DNA, 17 bp, Homo sapiens
tgtagtaaatattatga

SEQ ID NO: 419226 - DNA, 14 bp, Homo sapiens
tgtagtaattgtta

SEQ ID NO: 419227 - DNA, 14 bp, Homo sapiens
tgtagtagtctcat

SEQ ID NO: 419228 - DNA, 14 bp, Homo sapiens
tgtagtcccagcta

SEQ ID NO: 419229 - DNA, 16 bp, Homo sapiens
tgtagtgagaaactga

SEQ ID NO: 419230 - DNA, 13 bp, Homo sapiens
tgtagtggaagag

SEQ ID NO: 419231 - DNA, 21 bp, Homo sapiens
tgtagtggaagagcagcctga

SEQ ID NO: 419232 - DNA, 23 bp, Homo sapiens
tgtagtggctcatgcctgtaatc

SEQ ID NO: 419233 - DNA, 16 bp, Homo sapiens
tgtagtgtgtttgtga

SEQ ID NO: 419234 - DNA, 20 bp, Homo sapiens
tgtagtgtgtttgtgagtat

SEQ ID NO: 419235 - DNA, 13 bp, Homo sapiens
tgtagttaatgat

SEQ ID NO: 419236 - DNA, 13 bp, Homo sapiens
tgtagttaggaaa

SEQ ID NO: 419237 - DNA, 23 bp, Homo sapiens
tgtagttaggaaataaaaccttt

SEQ ID NO: 419238 - DNA, 17 bp, Homo sapiens
tgtagttctttgttcct

SEQ ID NO: 419239 - DNA, 18 bp, Homo sapiens
tgtagttctttgttcctg

SEQ ID NO: 419240 - DNA, 21 bp, Homo sapiens
tgtagttttcttttttaaatt

SEQ ID NO: 419241 - DNA, 18 bp, Homo sapiens
tgtagtttttgctgaagg

SEQ ID NO: 419242 - DNA, 14 bp, Homo sapiens
tgtataaaaataaa

SEQ ID NO: 419243 - DNA, 22 bp, Homo sapiens
tgtataaaaataaaaaagatcc

SEQ ID NO: 419244 - DNA, 13 bp, Homo sapiens
tgtataaagaaca

SEQ ID NO: 419245 - DNA, 23 bp, Homo sapiens
tgtataacaagccaaacattctt

SEQ ID NO: 419246 - DNA, 21 bp, Homo sapiens
tgtattacataaataaattaa

SEQ ID NO: 419247 - DNA, 19 bp, Homo sapiens
tgtattacatctaatgctt

SEQ ID NO: 419248 - DNA, 13 bp, Homo sapiens
tgtattagatatc

SEQ ID NO: 419249 - DNA, 18 bp, Homo sapiens
tgtattagatatcaatgt

SEQ ID NO: 419250 - DNA, 15 bp, Homo sapiens
tgtattatcagtgaa

SEQ ID NO: 419251 - DNA, 16 bp, Homo sapiens
tgtattattctgcagc

SEQ ID NO: 419252 - DNA, 14 bp, Homo sapiens
tgtattatttggag

SEQ ID NO: 419253 - DNA, 23 bp, Homo sapiens
tgtattcacgtgcagcagcaaca

SEQ ID NO: 419254 - DNA, 17 bp, Homo sapiens
tgtattcagtgagggtc

SEQ ID NO: 419255 - DNA, 18 bp, Homo sapiens
tgtattcccacccctgga

SEQ ID NO: 419256 - DNA, 17 bp, Homo sapiens
tgtattctttactaaag

SEQ ID NO: 419257 - DNA, 17 bp, Homo sapiens
tgtattggctctgtgaa

SEQ ID NO: 419258 - DNA, 16 bp, Homo sapiens
tgtattgtctgacaca

SEQ ID NO: 419259 - DNA, 12 bp, Homo sapiens
tgtattgttccc

SEQ ID NO: 419260 - DNA, 19 bp, Homo sapiens
tgtattgttcccagtgaca

SEQ ID NO: 419261 - DNA, 14 bp, Homo sapiens
tgtatttaatgatt

SEQ ID NO: 419262 - DNA, 16 bp, Homo sapiens
tgtatttaatgatttt

SEQ ID NO: 419263 - DNA, 13 bp, Homo sapiens
tgtatttactgta

SEQ ID NO: 419264 - DNA, 17 bp, Homo sapiens
tgtatttatgtgtgagg

SEQ ID NO: 419265 - DNA, 16 bp, Homo sapiens
tgtatttctgtagaat

SEQ ID NO: 419266 - DNA, 22 bp, Homo sapiens
tgtatttctgtagaatgctgta

SEQ ID NO: 419267 - DNA, 21 bp, Homo sapiens
tgtatttctgtggaaaacaat

SEQ ID NO: 419268 - DNA, 11 bp, Homo sapiens
tgtatttcttt

SEQ ID NO: 419269 - DNA, 13 bp, Homo sapiens
tgtatttctttta

SEQ ID NO: 419270 - DNA, 21 bp, Homo sapiens
tgtatttcttttatatataaa

SEQ ID NO: 419271 - DNA, 16 bp, Homo sapiens
tgtattttcaataaag

SEQ ID NO: 419272 - DNA, 15 bp, Homo sapiens
tgtattttcaggaag

SEQ ID NO: 419273 - DNA, 19 bp, Homo sapiens
tgtattttctgtcactgta

SEQ ID NO: 419274 - DNA, 14 bp, Homo sapiens
tgtattttctgtgt

SEQ ID NO: 419275 - DNA, 21 bp, Homo sapiens
tgtattttcttttatatctgt

SEQ ID NO: 419276 - DNA, 15 bp, Homo sapiens
tgtattttgtccaag

SEQ ID NO: 419277 - DNA, 18 bp, Homo sapiens
tgtatttttaaattctgc

SEQ ID NO: 419278 - DNA, 23 bp, Homo sapiens
tgtatttttagagattaatttgt

SEQ ID NO: 419279 - DNA, 18 bp, Homo sapiens
tgtatttttattttcctg

SEQ ID NO: 419280 - DNA, 19 bp, Homo sapiens
tgtatttttattttcctgt

SEQ ID NO: 419281 - DNA, 14 bp, Homo sapiens
tgtcaaaaaccaga

SEQ ID NO: 419282 - DNA, 19 bp, Homo sapiens
tgtcaaagtgaaagacatt

SEQ ID NO: 419283 - DNA, 14 bp, Homo sapiens
tgtcaaagtggtga

SEQ ID NO: 419284 - DNA, 16 bp, Homo sapiens
tgtcaaataaagcaaa

SEQ ID NO: 419285 - DNA, 20 bp, Homo sapiens
tgtcaacttctggctcctca

SEQ ID NO: 419286 - DNA, 15 bp, Homo sapiens
tgtcaactttcattt

SEQ ID NO: 419287 - DNA, 16 bp, Homo sapiens
tgtcaactttcatttg

SEQ ID NO: 419288 - DNA, 13 bp, Homo sapiens
tgtcaaggtgctg

SEQ ID NO: 419289 - DNA, 17 bp, Homo sapiens
tgtcaagtctctgctgg

SEQ ID NO: 419290 - DNA, 21 bp, Homo sapiens
tgtcaagttaacaaggaatgc

SEQ ID NO: 419291 - DNA, 16 bp, Homo sapiens
tgtcaagttgtgcttg

SEQ ID NO: 419292 - DNA, 17 bp, Homo sapiens
tgtcaagttgtgcttgt

SEQ ID NO: 419293 - DNA, 12 bp, Homo sapiens
tgtcaataaaca

SEQ ID NO: 419294 - DNA, 16 bp, Homo sapiens
tgtcaataaacagctt

SEQ ID NO: 419295 - DNA, 13 bp, Homo sapiens
tgtcaatattaaa

SEQ ID NO: 419296 - DNA, 17 bp, Homo sapiens
tgtcaatattaaataca

SEQ ID NO: 419297 - DNA, 14 bp, Homo sapiens
tgtcaattacagga

SEQ ID NO: 419298 - DNA, 21 bp, Homo sapiens
tgtcaattacaggaagtactg

SEQ ID NO: 419299 - DNA, 18 bp, Homo sapiens
tgtcacagaaatcagagg

SEQ ID NO: 419300 - DNA, 13 bp, Homo sapiens
tgtcacagaggca

SEQ ID NO: 419301 - DNA, 13 bp, Homo sapiens
tgtcacagctctt

SEQ ID NO: 419302 - DNA, 18 bp, Homo sapiens
tgtcacagctcttgtttg

SEQ ID NO: 419303 - DNA, 15 bp, Homo sapiens
tgtcacatcagataa

SEQ ID NO: 419304 - DNA, 18 bp, Homo sapiens
tgtcaccacatcttgtct

SEQ ID NO: 419305 - DNA, 23 bp, Homo sapiens
tgtcacccagcaaggcacaggct

SEQ ID NO: 419306 - DNA, 18 bp, Homo sapiens
tgtcaccctgcagagcta

SEQ ID NO: 419307 - DNA, 20 bp, Homo sapiens
tgtcacctagcagatatgta

SEQ ID NO: 419308 - DNA, 21 bp, Homo sapiens
tgtcacctagcagatatgtat

SEQ ID NO: 419309 - DNA, 13 bp, Homo sapiens
tgtctgtgccatg

SEQ ID NO: 419310 - DNA, 11 bp, Homo sapiens
tgtctgtggtc

SEQ ID NO: 419311 - DNA, 16 bp, Homo sapiens
tgtctgtgtgctgtaa

SEQ ID NO: 419312 - DNA, 22 bp, Homo sapiens
tgtctgtttcaatgacctgtat

SEQ ID NO: 419313 - DNA, 14 bp, Homo sapiens
tgtcttaagaaaaa

SEQ ID NO: 419314 - DNA, 16 bp, Homo sapiens
tgtcttacattggctt

SEQ ID NO: 419315 - DNA, 12 bp, Homo sapiens
tgtcttataaga

SEQ ID NO: 419316 - DNA, 21 bp, Homo sapiens
tgtcttataagaaaacatgta

SEQ ID NO: 419317 - DNA, 19 bp, Homo sapiens
tgtcttcaaccctgccctg

SEQ ID NO: 419318 - DNA, 21 bp, Homo sapiens
tgtcttcaatttgtataaaat

SEQ ID NO: 419319 - DNA, 19 bp, Homo sapiens
tgtcttcagatcctgctgc

SEQ ID NO: 419320 - DNA, 20 bp, Homo sapiens
tgtcttcagatcctgctgcc

SEQ ID NO: 419321 - DNA, 15 bp, Homo sapiens
tgtcttcatagcaga

SEQ ID NO: 419322 - DNA, 16 bp, Homo sapiens
tgtcttcatttcattg

SEQ ID NO: 419323 - DNA, 16 bp, Homo sapiens
tgtcttccaaggagac

SEQ ID NO: 419324 - DNA, 17 bp, Homo sapiens
tgtcttccataatgtat

SEQ ID NO: 419325 - DNA, 14 bp, Homo sapiens
tgtcttccttggag

SEQ ID NO: 419326 - DNA, 17 bp, Homo sapiens
tgtcttcgtacagttct

SEQ ID NO: 419327 - DNA, 15 bp, Homo sapiens
tgtcttctgcctgtt

SEQ ID NO: 419328 - DNA, 15 bp, Homo sapiens
tgtcttgtctcactt

SEQ ID NO: 419329 - DNA, 21 bp, Homo sapiens
tgtcttgtgtttttgtcttat

SEQ ID NO: 419330 - DNA, 15 bp, Homo sapiens
tgtctttcagataca

SEQ ID NO: 419331 - DNA, 21 bp, Homo sapiens
tgtctttcctcccttctttgc

SEQ ID NO: 419332 - DNA, 15 bp, Homo sapiens
tgtctttctttgctg

SEQ ID NO: 419333 - DNA, 19 bp, Homo sapiens
tgtctttctttgctgctgt

SEQ ID NO: 419334 - DNA, 14 bp, Homo sapiens
tgtcttttaatgat

SEQ ID NO: 419335 - DNA, 19 bp, Homo sapiens
tgtcttttatgcagataga

SEQ ID NO: 419336 - DNA, 17 bp, Homo sapiens
tgtcttttcccctcatt

SEQ ID NO: 419337 - DNA, 17 bp, Homo sapiens
tgtcttttgttctctct

SEQ ID NO: 419338 - DNA, 19 bp, Homo sapiens
tgtctttttccttcctgag

SEQ ID NO: 419339 - DNA, 20 bp, Homo sapiens
tgtctttttctggactgaag

SEQ ID NO: 419340 - DNA, 16 bp, Homo sapiens
tgtcttttttttcatc

SEQ ID NO: 419341 - DNA, 19 bp, Homo sapiens
tgtgaaaaagcctaagaaa

SEQ ID NO: 419342 - DNA, 17 bp, Homo sapiens
tgtgaaaacatatttgt

SEQ ID NO: 419343 - DNA, 14 bp, Homo sapiens
tgtgaaaatgggtt

SEQ ID NO: 419344 - DNA, 13 bp, Homo sapiens
tgtgaaacagtgt

SEQ ID NO: 419345 - DNA, 22 bp, Homo sapiens
tgtgaaacagtgtggatgtaaa

SEQ ID NO: 419346 - DNA, 18 bp, Homo sapiens
tgtgaaaggaaagaggct

SEQ ID NO: 419347 - DNA, 10 bp, Homo sapiens
tgtgaaattg

SEQ ID NO: 419348 - DNA, 14 bp, Homo sapiens
tgtgaacatggact

SEQ ID NO: 419349 - DNA, 16 bp, Homo sapiens
tgtgaaccaagatcta

SEQ ID NO: 419350 - DNA, 14 bp, Homo sapiens
tgtgaactatgttt

SEQ ID NO: 419351 - DNA, 12 bp, Homo sapiens
tgtgaactcatt

SEQ ID NO: 419352 - DNA, 14 bp, Homo sapiens
tgtgaagatgtttg

SEQ ID NO: 419353 - DNA, 16 bp, Homo sapiens
tgtgaagatgtttgca

SEQ ID NO: 419354 - DNA, 17 bp, Homo sapiens
tgtgaagatgtttgcaa

SEQ ID NO: 419355 - DNA, 13 bp, Homo sapiens
tgtgaagcaccta

SEQ ID NO: 419356 - DNA, 22 bp, Homo sapiens
tgtgaagctgaaccccctccag

SEQ ID NO: 419357 - DNA, 12 bp, Homo sapiens
tgtgaaggccca

SEQ ID NO: 419358 - DNA, 21 bp, Homo sapiens
tgtgaaggcccaagagcagag

SEQ ID NO: 419359 - DNA, 20 bp, Homo sapiens
tgtgaaggtaactaagaagt

SEQ ID NO: 419360 - DNA, 18 bp, Homo sapiens
tgtgaagtgaatgaaaca

SEQ ID NO: 419361 - DNA, 14 bp, Homo sapiens
tgtgaagtgattga

SEQ ID NO: 419362 - DNA, 12 bp, Homo sapiens
tgtgaatacaat

SEQ ID NO: 419363 - DNA, 20 bp, Homo sapiens
tgtgaatacaattaaaggtc

SEQ ID NO: 419364 - DNA, 19 bp, Homo sapiens
tgtgaatcgcaaggcctgt

SEQ ID NO: 419365 - DNA, 22 bp, Homo sapiens
tgtgaatcgcaaggcctgtgct

SEQ ID NO: 419366 - DNA, 16 bp, Homo sapiens
tgtgaatgctgtacct

SEQ ID NO: 419367 - DNA, 13 bp, Homo sapiens
tgtgaattcagat

SEQ ID NO: 419368 - DNA, 16 bp, Homo sapiens
tgtgaattctgtgaag

SEQ ID NO: 419369 - DNA, 18 bp, Homo sapiens
tgtgaattctgtgaagaa

SEQ ID NO: 419370 - DNA, 19 bp, Homo sapiens
tgtgaattgaagtcatcat

SEQ ID NO: 419371 - DNA, 17 bp, Homo sapiens
tgtgaattgataataaa

SEQ ID NO: 419372 - DNA, 13 bp, Homo sapiens
tgtgacaaaggat

SEQ ID NO: 419373 - DNA, 16 bp, Homo sapiens
tgtgacaacctttgtg

SEQ ID NO: 419374 - DNA, 21 bp, Homo sapiens
tgtgacaactgtctaacttta

SEQ ID NO: 419375 - DNA, 19 bp, Homo sapiens
tgtgacaattttgtacaaa

SEQ ID NO: 419376 - DNA, 19 bp, Homo sapiens
tgtgacatgcgggctgggc

SEQ ID NO: 419377 - DNA, 15 bp, Homo sapiens
tgtgacattcactca

SEQ ID NO: 419378 - DNA, 20 bp, Homo sapiens
tgtgacattcactcagagaa

SEQ ID NO: 419379 - DNA, 13 bp, Homo sapiens
tgtgaccaagtta

SEQ ID NO: 419380 - DNA, 14 bp, Homo sapiens
tgtgaccagcactg

SEQ ID NO: 419381 - DNA, 17 bp, Homo sapiens
tgtgaccagcactgtct

SEQ ID NO: 419382 - DNA, 16 bp, Homo sapiens
tgtgacccaccagtgc

SEQ ID NO: 419383 - DNA, 19 bp, Homo sapiens
tgtgacccaccagtgcctt

SEQ ID NO: 419384 - DNA, 21 bp, Homo sapiens
tgtgaccggggtcctgaggct

SEQ ID NO: 419385 - DNA, 16 bp, Homo sapiens
tgtgactagtgctgaa

SEQ ID NO: 419386 - DNA, 19 bp, Homo sapiens
tgtgactagtgctgaagct

SEQ ID NO: 419387 - DNA, 20 bp, Homo sapiens
tgtgactatatagagatgtt

SEQ ID NO: 419388 - DNA, 17 bp, Homo sapiens
tgtgactcctcccttcc

SEQ ID NO: 419389 - DNA, 22 bp, Homo sapiens
tgtgactcctcccttccccact

SEQ ID NO: 419390 - DNA, 13 bp, Homo sapiens
tgtgactcgctta

SEQ ID NO: 419391 - DNA, 13 bp, Homo sapiens
tgtgactgaaggg

SEQ ID NO: 419392 - DNA, 18 bp, Homo sapiens
tgtgacttcagctctgtt

SEQ ID NO: 419393 - DNA, 14 bp, Homo sapiens
tgtgagaataaagc

SEQ ID NO: 419394 - DNA, 14 bp, Homo sapiens
tgtgagacagcaag

SEQ ID NO: 419395 - DNA, 12 bp, Homo sapiens
tgtgagataaat

SEQ ID NO: 419396 - DNA, 14 bp, Homo sapiens
tgtgagataaatat

SEQ ID NO: 419397 - DNA, 22 bp, Homo sapiens
tgtgagataaatatcattatag

SEQ ID NO: 419398 - DNA, 22 bp, Homo sapiens
tgtgagatccttcacaggcagt

SEQ ID NO: 419399 - DNA, 21 bp, Homo sapiens
tgtgagattactttgtcccgc

SEQ ID NO: 419400 - DNA, 17 bp, Homo sapiens
tgtgagcatgaaactat

SEQ ID NO: 419401 - DNA, 16 bp, Homo sapiens
tgtgagccaaagagaa

SEQ ID NO: 419402 - DNA, 16 bp, Homo sapiens
tgtgagccaccgctgc

SEQ ID NO: 419403 - DNA, 18 bp, Homo sapiens
tgtgagccttgctgccaa

SEQ ID NO: 419404 - DNA, 18 bp, Homo sapiens
tgtgagcgtgtccacaga

SEQ ID NO: 419405 - DNA, 14 bp, Homo sapiens
tgtgaggagctgct

SEQ ID NO: 419406 - DNA, 19 bp, Homo sapiens
tgtgagggagtgcagaaca

SEQ ID NO: 419407 - DNA, 15 bp, Homo sapiens
tgtgagggcagcact

SEQ ID NO: 419408 - DNA, 21 bp, Homo sapiens
tgtgaggtgaatgtcttcctt

SEQ ID NO: 419409 - DNA, 21 bp, Homo sapiens
tgtgagtattctatgtaaaaa

SEQ ID NO: 419410 - DNA, 21 bp, Homo sapiens
tgtgagtctgtcctttcccac

SEQ ID NO: 419411 - DNA, 15 bp, Homo sapiens
tgtgagtggcagcca

SEQ ID NO: 419412 - DNA, 16 bp, Homo sapiens
tgtgagtggcagccat

SEQ ID NO: 419413 - DNA, 20 bp, Homo sapiens
tgtgatagagcctttgatct

SEQ ID NO: 419414 - DNA, 15 bp, Homo sapiens
tgtgatcagaccata

SEQ ID NO: 419415 - DNA, 17 bp, Homo sapiens
tgtgatcatctttgctg

SEQ ID NO: 419416 - DNA, 18 bp, Homo sapiens
tgtgatctattactctga

SEQ ID NO: 419417 - DNA, 13 bp, Homo sapiens
tgtgatctgggaa

SEQ ID NO: 419418 - DNA, 14 bp, Homo sapiens
tgtgatgaggggag

SEQ ID NO: 419419 - DNA, 15 bp, Homo sapiens
tgtgatgcatgagct

SEQ ID NO: 419420 - DNA, 19 bp, Homo sapiens
tgtgatgcatgagctccct

SEQ ID NO: 419421 - DNA, 17 bp, Homo sapiens
tgtgatgcgccttgctg

SEQ ID NO: 419422 - DNA, 14 bp, Homo sapiens
tgtgattatggaca

SEQ ID NO: 419423 - DNA, 17 bp, Homo sapiens
tgtgattctaatgtctt

SEQ ID NO: 419424 - DNA, 13 bp, Homo sapiens
tgtgattgaatct

SEQ ID NO: 419425 - DNA, 15 bp, Homo sapiens
tgtgattgaatctga

SEQ ID NO: 419426 - DNA, 19 bp, Homo sapiens
tgtgattgccatttcttcc

SEQ ID NO: 419427 - DNA, 13 bp, Homo sapiens
tgtgattgctgcc

SEQ ID NO: 419428 - DNA, 22 bp, Homo sapiens
tgtgattggcagcttcaaaaca

SEQ ID NO: 419429 - DNA, 18 bp, Homo sapiens
tgtgatttagaactgtat

SEQ ID NO: 419430 - DNA, 14 bp, Homo sapiens
tgtgatttatgcat

SEQ ID NO: 419431 - DNA, 15 bp, Homo sapiens
tgtgatttatgcatt

SEQ ID NO: 419432 - DNA, 14 bp, Homo sapiens
tgtgatttgtctct

SEQ ID NO: 419433 - DNA, 17 bp, Homo sapiens
tgtgatttttataatac

SEQ ID NO: 419434 - DNA, 19 bp, Homo sapiens
tgtgcaaagaaaagaactg

SEQ ID NO: 419435 - DNA, 18 bp, Homo sapiens
tgtgcaagtatgtgagtg

SEQ ID NO: 419436 - DNA, 23 bp, Homo sapiens
tgtgcaatatgaggggactgcat

SEQ ID NO: 419437 - DNA, 17 bp, Homo sapiens
tgtgcaattgtgaggga

SEQ ID NO: 419438 - DNA, 22 bp, Homo sapiens
tgtgcacacacaccacacatac

SEQ ID NO: 419439 - DNA, 21 bp, Homo sapiens
tgtgcacatatcaagaagtca

SEQ ID NO: 419440 - DNA, 13 bp, Homo sapiens
tgtgcacatctct

SEQ ID NO: 419441 - DNA, 14 bp, Homo sapiens
tgtgcacatctctg

SEQ ID NO: 419442 - DNA, 17 bp, Homo sapiens
tgtgcacattctccctt

SEQ ID NO: 419443 - DNA, 19 bp, Homo sapiens
tgtgcacattctcccttga

SEQ ID NO: 419444 - DNA, 22 bp, Homo sapiens
tgtgcactgaatcgtttcatgt

SEQ ID NO: 419445 - DNA, 12 bp, Homo sapiens
tgtgcagcagcc

SEQ ID NO: 419446 - DNA, 22 bp, Homo sapiens
tgtgcagcagcccagcttcctg

SEQ ID NO: 419447 - DNA, 16 bp, Homo sapiens
tgtgcaggtgctgcct

SEQ ID NO: 419448 - DNA, 21 bp, Homo sapiens
tgtgcaggtgctgccttgaga

SEQ ID NO: 419449 - DNA, 21 bp, Homo sapiens
tgtgcagtggccccatccagc

SEQ ID NO: 419450 - DNA, 15 bp, Homo sapiens
tgtgcataaaagtta

SEQ ID NO: 419451 - DNA, 18 bp, Homo sapiens
tgtgcatgagaatgtcat

SEQ ID NO: 419452 - DNA, 13 bp, Homo sapiens
tgtgcatgggtga

SEQ ID NO: 419453 - DNA, 19 bp, Homo sapiens
tgtgcatgggtgaagggag

SEQ ID NO: 419454 - DNA, 14 bp, Homo sapiens
tgtgcatgtgtgtg

SEQ ID NO: 419455 - DNA, 15 bp, Homo sapiens
tgtgcatgtgtgtgc

SEQ ID NO: 419456 - DNA, 20 bp, Homo sapiens
tgtgcatttcacctgtgaca

SEQ ID NO: 419457 - DNA, 15 bp, Homo sapiens
tgtgcatttgtgtct

SEQ ID NO: 419458 - DNA, 22 bp, Homo sapiens
tgtgcatttgtgtctgcctgcc

SEQ ID NO: 419459 - DNA, 18 bp, Homo sapiens
tgtgccaaagcaggtcag

SEQ ID NO: 419460 - DNA, 20 bp, Homo sapiens
tgtgccaagattctactctt

SEQ ID NO: 419461 - DNA, 16 bp, Homo sapiens
tgtgccaatatgtatt

SEQ ID NO: 419462 - DNA, 17 bp, Homo sapiens
tgtgccaccctctgcag

SEQ ID NO: 419463 - DNA, 18 bp, Homo sapiens
tgtgccaccctctgcagg

SEQ ID NO: 419464 - DNA, 20 bp, Homo sapiens
tgtgccaggaggcggcagct

SEQ ID NO: 419465 - DNA, 23 bp, Homo sapiens
tgtgccaggctgaattacagtga

SEQ ID NO: 419466 - DNA, 17 bp, Homo sapiens
tgtgcccacatcccagg

SEQ ID NO: 419467 - DNA, 13 bp, Homo sapiens
tgtgcccacccag

SEQ ID NO: 419468 - DNA, 14 bp, Homo sapiens
tgtgcccacccagg

SEQ ID NO: 419469 - DNA, 19 bp, Homo sapiens
tgtgcccacccagggcccg

SEQ ID NO: 419470 - DNA, 23 bp, Homo sapiens
tgtgcccagatcgttctgccact

SEQ ID NO: 419471 - DNA, 16 bp, Homo sapiens
tgtgcccagctcagtc

SEQ ID NO: 419472 - DNA, 19 bp, Homo sapiens
tgtgccccaagaggctagc

SEQ ID NO: 419473 - DNA, 19 bp, Homo sapiens
tgtgccccatcagcagctt

SEQ ID NO: 419474 - DNA, 15 bp, Homo sapiens
tgtgccccatgcctg

SEQ ID NO: 419475 - DNA, 22 bp, Homo sapiens
tgtgcccccagacgcacgtggg

SEQ ID NO: 419476 - DNA, 17 bp, Homo sapiens
tgtgcccctggcccatc

SEQ ID NO: 419477 - DNA, 11 bp, Homo sapiens
tgtgccctggc

SEQ ID NO: 419478 - DNA, 14 bp, Homo sapiens
tgtgcccttgctgg

SEQ ID NO: 419479 - DNA, 18 bp, Homo sapiens
tgtgcccttgctgggtcc

SEQ ID NO: 419480 - DNA, 16 bp, Homo sapiens
tgtgccgaatgtgcag

SEQ ID NO: 419481 - DNA, 13 bp, Homo sapiens
tgtgcctaataaa

SEQ ID NO: 419482 - DNA, 23 bp, Homo sapiens
tgtgcctcccaagctcagagcag

SEQ ID NO: 419483 - DNA, 17 bp, Homo sapiens
tgtgcctccccccagac

SEQ ID NO: 419484 - DNA, 18 bp, Homo sapiens
tgtgcctccccccagacc

SEQ ID NO: 419485 - DNA, 17 bp, Homo sapiens
tgtgcctcccttcccag

SEQ ID NO: 419486 - DNA, 12 bp, Homo sapiens
tgtgcctctgcc

SEQ ID NO: 419487 - DNA, 13 bp, Homo sapiens
tgtgcctctgcct

SEQ ID NO: 419488 - DNA, 16 bp, Homo sapiens
tgtgcctcttgggaga

SEQ ID NO: 419489 - DNA, 17 bp, Homo sapiens
tgtgcctcttgggagac

SEQ ID NO: 419490 - DNA, 13 bp, Homo sapiens
tgtgcctgctaga

SEQ ID NO: 419491 - DNA, 19 bp, Homo sapiens
tgtgcctgctagagcaacc

SEQ ID NO: 419492 - DNA, 17 bp, Homo sapiens
tgtgcctgctatccagc

SEQ ID NO: 419493 - DNA, 21 bp, Homo sapiens
tgtgcctgctatccagccgca

SEQ ID NO: 419494 - DNA, 22 bp, Homo sapiens
tgtgcctggcttctttctctca

SEQ ID NO: 419495 - DNA, 21 bp, Homo sapiens
tgtgcctgtaatctttttctc

SEQ ID NO: 419496 - DNA, 22 bp, Homo sapiens
tgtgcctgtcactactggtctg

SEQ ID NO: 419497 - DNA, 17 bp, Homo sapiens
tgtgcctttgggaggca

SEQ ID NO: 419498 - DNA, 14 bp, Homo sapiens
tgtgcgtgaaacac

SEQ ID NO: 419499 - DNA, 14 bp, Homo sapiens
tgtgcgttcccttc

SEQ ID NO: 419500 - DNA, 15 bp, Homo sapiens
tgtgcgttcccttca

SEQ ID NO: 419501 - DNA, 16 bp, Homo sapiens
tgtgcgttcccttcag

SEQ ID NO: 419502 - DNA, 17 bp, Homo sapiens
tgtgctaatttctgtcc

SEQ ID NO: 419503 - DNA, 20 bp, Homo sapiens
tgtgctaatttctgtccaga

SEQ ID NO: 419504 - DNA, 11 bp, Homo sapiens
tgtgctacaga

SEQ ID NO: 419505 - DNA, 17 bp, Homo sapiens
tgtgctacagagaaaat

SEQ ID NO: 419506 - DNA, 13 bp, Homo sapiens
tgtgctagatgtg

SEQ ID NO: 419507 - DNA, 16 bp, Homo sapiens
tgtgctcatcagaaac

SEQ ID NO: 419508 - DNA, 23 bp, Homo sapiens
tgtgctccagcagtgctgggccc

SEQ ID NO: 419509 - DNA, 13 bp, Homo sapiens
tgtgctcctgtgg

SEQ ID NO: 419510 - DNA, 16 bp, Homo sapiens
tgtgctcggacacagt

SEQ ID NO: 419511 - DNA, 19 bp, Homo sapiens
tgtgctctgttttgacata

SEQ ID NO: 419512 - DNA, 13 bp, Homo sapiens
tgtgctctttcct

SEQ ID NO: 419513 - DNA, 11 bp, Homo sapiens
tgtgctgctgc

SEQ ID NO: 419514 - DNA, 18 bp, Homo sapiens
tgtgctgctgtggcatca

SEQ ID NO: 419515 - DNA, 13 bp, Homo sapiens
tgtgctggcttcc

SEQ ID NO: 419516 - DNA, 15 bp, Homo sapiens
tgtgctggcttccgc

SEQ ID NO: 419517 - DNA, 14 bp, Homo sapiens
tgtgctgggtgcct

SEQ ID NO: 419518 - DNA, 17 bp, Homo sapiens
tgtgctgggtgcctccc

SEQ ID NO: 419519 - DNA, 19 bp, Homo sapiens
tgtgctgtaacctgaagtc

SEQ ID NO: 419520 - DNA, 13 bp, Homo sapiens
tgtgctgtgcctg

SEQ ID NO: 419521 - DNA, 17 bp, Homo sapiens
tgtgctgtgcctgctag

SEQ ID NO: 419522 - DNA, 18 bp, Homo sapiens
tgtgctgtgcctgctaga

SEQ ID NO: 419523 - DNA, 17 bp, Homo sapiens
tgtgctgtggttcctgg

SEQ ID NO: 419524 - DNA, 17 bp, Homo sapiens
tgtgctgttgattcttt

SEQ ID NO: 419525 - DNA, 13 bp, Homo sapiens
tgtgctttatgct

SEQ ID NO: 419526 - DNA, 13 bp, Homo sapiens
tgtgctttctgca

SEQ ID NO: 419527 - DNA, 14 bp, Homo sapiens
tgtgctttctgcat

SEQ ID NO: 419528 - DNA, 19 bp, Homo sapiens
tgtgctttctgcatgctta

SEQ ID NO: 419529 - DNA, 14 bp, Homo sapiens
tgtttgatgtgtat

SEQ ID NO: 419530 - DNA, 20 bp, Homo sapiens
tgtttgatgtgtatgtgttt

SEQ ID NO: 419531 - DNA, 18 bp, Homo sapiens
tgtttgcaatatcgatca

SEQ ID NO: 419532 - DNA, 18 bp, Homo sapiens
tgtttgcctttaggcagg

SEQ ID NO: 419533 - DNA, 19 bp, Homo sapiens
tgtttgcctttaggcagga

SEQ ID NO: 419534 - DNA, 21 bp, Homo sapiens
tgtttgcctttaggcaggaag

SEQ ID NO: 419535 - DNA, 23 bp, Homo sapiens
tgtttgctcagaacacattcttt

SEQ ID NO: 419536 - DNA, 12 bp, Homo sapiens
tgtttgcttaaa

SEQ ID NO: 419537 - DNA, 16 bp, Homo sapiens
tgtttgcttattgttc

SEQ ID NO: 419538 - DNA, 11 bp, Homo sapiens
tgtttggctgg

SEQ ID NO: 419539 - DNA, 17 bp, Homo sapiens
tgtttggcttataaaca

SEQ ID NO: 419540 - DNA, 15 bp, Homo sapiens
tgtttgggtatcctg

SEQ ID NO: 419541 - DNA, 18 bp, Homo sapiens
tgtttgggtatcctgccc

SEQ ID NO: 419542 - DNA, 22 bp, Homo sapiens
tgtttgggtggtttgtgagcct

SEQ ID NO: 419543 - DNA, 13 bp, Homo sapiens
tgtttgtaaataa

SEQ ID NO: 419544 - DNA, 18 bp, Homo sapiens
tgtttgtaaataagagat

SEQ ID NO: 419545 - DNA, 15 bp, Homo sapiens
tgtttgtctggattg

SEQ ID NO: 419546 - DNA, 15 bp, Homo sapiens
tgtttgtgagtatgt

SEQ ID NO: 419547 - DNA, 13 bp, Homo sapiens
tgtttgtggcctc

SEQ ID NO: 419548 - DNA, 14 bp, Homo sapiens
tgtttgtgtccata

SEQ ID NO: 419549 - DNA, 18 bp, Homo sapiens
tgtttgtgtccataagag

SEQ ID NO: 419550 - DNA, 17 bp, Homo sapiens
tgtttgttaaaactggc

SEQ ID NO: 419551 - DNA, 21 bp, Homo sapiens
tgtttgttaaaactggcatct

SEQ ID NO: 419552 - DNA, 14 bp, Homo sapiens
tgtttgttttcaaa

SEQ ID NO: 419553 - DNA, 12 bp, Homo sapiens
tgttttaaaaaa

SEQ ID NO: 419554 - DNA, 14 bp, Homo sapiens
tgttttaaaataag

SEQ ID NO: 419555 - DNA, 22 bp, Homo sapiens
tgttttaaatacgcactacatg

SEQ ID NO: 419556 - DNA, 18 bp, Homo sapiens
tgttttaaatttaaaaca

SEQ ID NO: 419557 - DNA, 20 bp, Homo sapiens
tgttttaaatttaaaacaat
